United States Patent 10,706,955 (BIOINFORMATIC PROCESSES FOR DETERMINATION OF PEPTIDE BINDING) - sequence listing, part 10

SEQ ID NO: 350576 - protein, 18 aa, Mycobacterium
AQAELARRFGAAKVLAHE

SEQ ID NO: 350577 - protein, 24 aa, Mycobacterium
AQAELPWPYTWDPVLGRSVPRVVT

SEQ ID NO: 350578 - protein, 18 aa, Mycobacterium
AQAGGLPPLFAGVVRRPR

SEQ ID NO: 350579 - protein, 48 aa, Mycobacterium
AQAGIYIFMIAMSLWLLRFAMSNTWLVWLATWFRPVFETIRVILADLW

SEQ ID NO: 350580 - protein, 28 aa, Mycobacterium
AQAGWALLILLRTTAPVLFFGIALNISA

SEQ ID NO: 350581 - protein, 31 aa, Mycobacterium
AQALRYAIACLLLLGWVRLTGHPLRRPRGTE

SEQ ID NO: 350582 - protein, 30 aa, Mycobacterium
AQAPLWIGPILLYVLLPILDLRFGPDGQNP

SEQ ID NO: 350583 - protein, 20 aa, Mycobacterium
AQARLVIVDFRRGLLGVVGP

SEQ ID NO: 350584 - protein, 25 aa, Mycobacterium
AQATFLPWVWYAARREELHLDESDD

SEQ ID NO: 350585 - protein, 27 aa, Mycobacterium
AQCCIAAYVPYLSWLMQASADSAATAA

SEQ ID NO: 350586 - protein, 19 aa, Mycobacterium
AQCIVLAIVIMLVHTYYGF

SEQ ID NO: 350587 - protein, 20 aa, Mycobacterium
AQEPVLYPRGTLAMANAGPG

SEQ ID NO: 350588 - protein, 24 aa, Mycobacterium
AQFGRLQFHPDVCAGVPIVALVGD

SEQ ID NO: 350589 - protein, 25 aa, Mycobacterium
AQFGWGLTCFITAIAGLMQVLLGLS

SEQ ID NO: 350590 - protein, 24 aa, Mycobacterium
AQFGYLLLWVIVVANVMAGLVQYL

SEQ ID NO: 350591 - protein, 24 aa, Mycobacterium
AQFSGSRWFLFPALAAISDDVLTR

SEQ ID NO: 350592 - protein, 25 aa, Mycobacterium
AQFTALREEFFAQPDLARGGVAPVL

SEQ ID NO: 350593 - protein, 23 aa, Mycobacterium
AQGFRLLSCLYALGFHIAITDDL

SEQ ID NO: 350594 - protein, 29 aa, Mycobacterium
AQGRTYLHTAWWLSFFPGLAIVITTVSAT

SEQ ID NO: 350595 - protein, 20 aa, Mycobacterium
AQHDALALPMPKLERLRIHV

SEQ ID NO: 350596 - protein, 26 aa, Mycobacterium
AQHPPPPRPMPPVPAPHRVAPPPQRP

SEQ ID NO: 350597 - protein, 18 aa, Mycobacterium
AQHPRLPRRDALKILPAE

SEQ ID NO: 350598 - protein, 23 aa, Mycobacterium
AQIKVTTILGSRYLAIEPNGPGR

SEQ ID NO: 350599 - protein, 24 aa, Mycobacterium
AQKQRWLPELMTLEKIAAWAITEP

SEQ ID NO: 350600 - protein, 22 aa, Mycobacterium
AQKWVLPIAMIALLISAAPEMW

SEQ ID NO: 350601 - protein, 22 aa, Mycobacterium
AQLAAPLRRLTGLSGKTGALAK

SEQ ID NO: 350602 - protein, 18 aa, Mycobacterium
AQLADLELPQLWQLTRGA

SEQ ID NO: 350603 - protein, 24 aa, Mycobacterium
AQLAITYLPAMNTMFGTAPIGFGA

SEQ ID NO: 350604 - protein, 21 aa, Mycobacterium
AQLLEWIHRAADAAEPVILNA

SEQ ID NO: 350605 - protein, 20 aa, Mycobacterium
AQLLGLMFLLTLLAANLYSV

SEQ ID NO: 350606 - protein, 22 aa, Mycobacterium
AQLLLPIALGVLLGGPAAAGTA

SEQ ID NO: 350607 - protein, 22 aa, Mycobacterium
AQLLVPVMVACGFLLGVTGQVV

SEQ ID NO: 350608 - protein, 20 aa, Mycobacterium
AQLVVFQRTPCFSIPAHNGP

SEQ ID NO: 350609 - protein, 55 aa, Mycobacterium
AQNQAYGYLFPHGTFFLLGDVLGVPGWVTQRLWWALLLTVGFWGVLRVAEALGIG

SEQ ID NO: 350610 - protein, 48 aa, Mycobacterium
AQPARRRRRLSGRFRRPKWSTLAASLAVLVIIAALAGSGYMINEHRDA

SEQ ID NO: 350611 - protein, 23 aa, Mycobacterium
AQPGALLALAAKADVLLDCFRPG

SEQ ID NO: 350612 - protein, 22 aa, Mycobacterium
AQPIAARSLAPEVLMPASPSTA

SEQ ID NO: 350613 - protein, 27 aa, Mycobacterium
AQPLVVSRWRPIYARAPFAEVLLLKTG

SEQ ID NO: 350614 - protein, 22 aa, Mycobacterium
AQPPAPQPVAPPPQYPTGDETV

SEQ ID NO: 350615 - protein, 23 aa, Mycobacterium
AQPPQQPYWQQPAPSYPGPQPYP

SEQ ID NO: 350616 - protein, 28 aa, Mycobacterium
AQPRAFLPVFLLAYFASAVALLAAGGVS

SEQ ID NO: 350617 - protein, 34 aa, Mycobacterium
AQQMRSFVDLRWWPLALLIGLTLALVTLAAALER

SEQ ID NO: 350618 - protein, 24 aa, Mycobacterium
AQRDSWLLSLLYVGSFGSFIGFAF

SEQ ID NO: 350619 - protein, 25 aa, Mycobacterium
AQRGVAVSFWLVAPLVAAESIRHLT

SEQ ID NO: 350620 - protein, 24 aa, Mycobacterium
AQRILSAPLMLTLINASIAVSMDI

SEQ ID NO: 350621 - protein, 21 aa, Mycobacterium
AQRKALLWNNPDPSALWTLAG

SEQ ID NO: 350622 - protein, 26 aa, Mycobacterium
AQRLCRPVFWYLACWVTALLAVRVTL

SEQ ID NO: 350623 - protein, 25 aa, Mycobacterium
AQRWRSPLRGPWLTSVFGSVLLVTL

SEQ ID NO: 350624 - protein, 18 aa, Mycobacterium
AQTALLFIEPEAATLAVV

SEQ ID NO: 350625 - protein, 22 aa, Mycobacterium
AQTALTVLLFTSLAIAIIVQVL

SEQ ID NO: 350626 - protein, 17 aa, Mycobacterium
AQTLLTRRHSPLVVATA

SEQ ID NO: 350627 - protein, 27 aa, Mycobacterium
AQTLRYFPDLVFVLALLAAVAFCAPNR

SEQ ID NO: 350628 - protein, 23 aa, Mycobacterium
AQTLRYFPDLVVVLALLAAVALT

SEQ ID NO: 350629 - protein, 25 aa, Mycobacterium
AQTLRYLPDLVLVLALLAAVGLCAP

SEQ ID NO: 350630 - protein, 23 aa, Mycobacterium
AQTTESLWWLTDAGARFGVEDTK

SEQ ID NO: 350631 - protein, 23 aa, Mycobacterium
AQTTESLWWLTEAGARFGVEDTK

SEQ ID NO: 350632 - protein, 26 aa, Mycobacterium
AQVAPLLWAAVGGVPAVLVYRAVNTL

SEQ ID NO: 350633 - protein, 31 aa, Mycobacterium
AQVDYADILYYSAPWMLFLGLAMSGITAYVT

SEQ ID NO: 350634 - protein, 29 aa, Mycobacterium
AQVPLWIGPILLYVLLPTLDRFFGPDGQN

SEQ ID NO: 350635 - protein, 24 aa, Mycobacterium
AQVVRILLMLFTAPLLARAVVWAS

SEQ ID NO: 350636 - protein, 18 aa, Mycobacterium
AQVWLIDPRRQLLNVLDK

SEQ ID NO: 350637 - protein, 29 aa, Mycobacterium
AQWLASIVGLFYLIWNYGYQQGTTGSSVG

SEQ ID NO: 350638 - protein, 21 aa, Mycobacterium
AQWPILLVGLTFATALALVGA

SEQ ID NO: 350639 - protein, 24 aa, Mycobacterium
AQYGFLLVWVIVVANVMAGLVQYL

SEQ ID NO: 350640 - protein, 24 aa, Mycobacterium
AQYGSWRWAFGVLVILTAAMAVLV

SEQ ID NO: 350641 - protein, 33 aa, Mycobacterium
AQYLGAVLFTLGGLAFSFLVPALAGYIAFAIAD

SEQ ID NO: 350642 - protein, 35 aa, Mycobacterium
AQYLPKLIEMQGDGPYILAGWSLGGVLAYACAIGL

SEQ ID NO: 350643 - protein, 26 aa, Mycobacterium
AQYSWFIGCGIAFGLYYVLAKRDTLV

SEQ ID NO: 350644 - protein, 35 aa, Mycobacterium
AQYVPKLIEMQGDGPYILVGWSLGGVLAYACAIGL

SEQ ID NO: 350645 - protein, 19 aa, Mycobacterium
AQYVPKLVEMQGDGPYILV

SEQ ID NO: 350646 - protein, 61 aa, Mycobacterium
ARAARPWPDWIQQINWKWVRRSVGLAAAVMILLPIVTFTMAYFIVDVPRPGDIRTNQVSTI

SEQ ID NO: 350647 - protein, 18 aa, Mycobacterium
ARAGKAAVLIAVIAVLLC

SEQ ID NO: 350648 - protein, 20 aa, Mycobacterium
ARAGLFYVPLAVVAAVCAFG

SEQ ID NO: 350649 - protein, 19 aa, Mycobacterium
ARAILTRPRILVLDDTLSA

SEQ ID NO: 350650 - protein, 36 aa, Mycobacterium
ARALAKGRRTVWIPWALGPAAAVMRLLPAFVWRRMP

SEQ ID NO: 350651 - protein, 19 aa, Mycobacterium
ARATILLGLGLLAGATGVF

SEQ ID NO: 350652 - protein, 26 aa, Mycobacterium
ARATRRALLLTALGGLLIAGLVTAIP

SEQ ID NO: 350653 - protein, 21 aa, Mycobacterium
ARAVPPPPPPRRPPPPRPPAP

SEQ ID NO: 350654 - protein, 29 aa, Mycobacterium
ARAYLLGGGLLYLGVWLYGALVDFGSDAH

SEQ ID NO: 350655 - protein, 35 aa, Mycobacterium; identical to SEQ ID NO: 20359

SEQ ID NO: 350656 - protein, 34 aa, Mycobacterium
ARDERDRLALWSRVLPITFTAVGVIALVAGGLLA

SEQ ID NO: 350657 - protein, 29 aa, Mycobacterium
ARDFLRIDIIIFGLIVYALLGIGTDAIVR

SEQ ID NO: 350658 - protein, 19 aa, Mycobacterium
ARDISIAVFTFFTRLVGRV

SEQ ID NO: 350659 - protein, 36 aa, Mycobacterium
ARDLLTVFFEVWLARIPFFWFDWDSGKVPKAWYPKP

SEQ ID NO: 350660 - protein, 36 aa, Mycobacterium
ARDQVVHGWVLAAGSFLLCAAFNVLLRGLCGRDVAA

SEQ ID NO: 350661 - protein, 35 aa, Mycobacterium; identical to SEQ ID NO: 21898

SEQ ID NO: 350662 - protein, 26 aa, Mycobacterium
ARDVFALLSPFLLVVAVMLVPALDTL

SEQ ID NO: 350663 - protein, 26 aa, Mycobacterium
ARDVVILEILVVMILFGACVVFELEG

SEQ ID NO: 350664 - protein, 27 aa, Mycobacterium
AREVRIGWLLPLSGVRLGLDPLAGFFM

SEQ ID NO: 350665 - protein, 18 aa, Mycobacterium
ARFILRSTMHYMSVLNSA

SEQ ID NO: 350666 - protein, 29 aa, Mycobacterium
ARFMTPVRVMFLMALVFLALGWSTKAACL

SEQ ID NO: 350667 - protein, 24 aa, Mycobacterium
ARFRHPIRWTPARYALLMVSSGFG

SEQ ID NO: 350668 - protein, 18 aa, Mycobacterium
ARFTAAAALFGIAVGLEL

SEQ ID NO: 350669 - protein, 24 aa, Mycobacterium
ARFVSWVAQRVTRRLDLGFAESDA

SEQ ID NO: 350670 - protein, 19 aa, Mycobacterium
ARGALIAEILIVVGAALVG

SEQ ID NO: 350671 - protein, 33 aa, Mycobacterium
ARGGRSRLAFGLLAALLCLLLGIAIVTQVRQNE

SEQ ID NO: 350672 - protein, 43 aa, Mycobacterium
ARGIVRGLKMLLVTVLLVVLGIGLALVLYFTPAMSARSIVVVG

SEQ ID NO: 350673 - protein, 23 aa, Mycobacterium
ARGKSVVALAFAGGVLFVAENPS

SEQ ID NO: 350674 - protein, 28 aa, Mycobacterium
ARGLAARKYFTYRDILGIAYAQAKFQLT

SEQ ID NO: 350675 - protein, 31 aa, Mycobacterium
ARGLRARLLGKMSGLPLGWFTGRGSGSIKQL

SEQ ID NO: 350676 - protein, 23 aa, Mycobacterium
ARGPEHPLWLGSIKSNIGHTQAA

SEQ ID NO: 350677 - protein, 36 aa, Mycobacterium
ARGPSRLGRGWLAGIASTLVLLAAAVGAGGYFALRY

SEQ ID NO: 350678 - protein, 28 aa, Mycobacterium
ARGRGKYWWLRWVVIAVAVIVLAVEIAL

SEQ ID NO: 350679 - protein, 24 aa, Mycobacterium
ARGSLWLIVVGFSAGVAVLVGLRH

SEQ ID NO: 350680 - protein, 26 aa, Mycobacterium
ARGTTMRLLLFQIPGQLIFSVVSQIA

SEQ ID NO: 350681 - protein, 20 aa, Mycobacterium
ARHAMAIALPRWGTTEVVSE

SEQ ID NO: 350682 - protein, 21 aa, Mycobacterium
ARHHRRLAVFFAVSVLSAVLA

SEQ ID NO: 350683 - protein, 24 aa, Mycobacterium
ARHMGLFVVGRLAARHGIRVGLRG

SEQ ID NO: 350684 - protein, 20 aa, Mycobacterium
ARHPWPDHRPPRAPVWVAVY

SEQ ID NO: 350685 - protein, 20 aa, Mycobacterium
ARHPWPDYRPPRAGQWVPIY

SEQ ID NO: 350686 - protein, 18 aa, Mycobacterium
ARHQIHFFVVERLAAPPE

SEQ ID NO: 350687 - protein, 31 aa, Mycobacterium
ARIALFYVGSLFLLGLLLPYTDYKAGESPFV

SEQ ID NO: 350688 - protein, 33 aa, Mycobacterium
ARIAMGWPVFLLTSTLIYLAIRTAMRTLPRGVP

SEQ ID NO: 350689 - protein, 22 aa, Mycobacterium
ARIDGRLYPALNLTSARLATGT

SEQ ID NO: 350690 - protein, 25 aa, Mycobacterium
ARIDSLHWRVFWICSGVILTTMLVG

SEQ ID NO: 350691 - protein, 24 aa, Mycobacterium
ARIDYADIFFISPALLALGVAMAG

SEQ ID NO: 350692 - protein, 26 aa, Mycobacterium
ARIFDRIWLLAAFGWIGWAGVQGGAP

SEQ ID NO: 350693 - protein, 24 aa, Mycobacterium
ARIGAFARWVARTPWPVFTLGMLQ

SEQ ID NO: 350694 - protein, 24 aa, Mycobacterium
ARIGIRITLLLSVVLMMAGVALLA

SEQ ID NO: 350695 - protein, 17 aa, Mycobacterium
ARIILLDEDGRVLLLRG

SEQ ID NO: 350696 - protein, 31 aa, Mycobacterium
ARIISHLPVLLGLIFALLVLRDYRAGRTPPN

SEQ ID NO: 350697 - protein, 20 aa, Mycobacterium
ARIIVTAALEHYCPKPAAVQ

SEQ ID NO: 350698 - protein, 29 aa, Mycobacterium
ARIKLGDKPMPLFQLLIVCMLASKPIDAA

SEQ ID NO: 350699 - protein, 23 aa, Mycobacterium
ARIKVTTILGSRYLALEPSGPAH

SEQ ID NO: 350700 - protein, 21 aa, Mycobacterium
ARILFDWRFDLIFGSAAIVFA

SEQ ID NO: 350701 - protein, 20 aa, Mycobacterium
ARIPLVTERLSMHGRTPILT

SEQ ID NO: 350702 - protein, 26 aa, Mycobacterium
ARIQLITFAGILVLLKVAAYWLDRYE

SEQ ID NO: 350703 - protein, 30 aa, Mycobacterium
ARISFIKFTLVMGLPWLAAVTAVYAVFRWF

SEQ ID NO: 350704 - protein, 18 aa, Mycobacterium
ARIVAFGRAWMRTATRQG

SEQ ID NO: 350705 - protein, 29 aa, Mycobacterium
ARIWPPWEFYFWHHTIPAAVWVALIMGLI

SEQ ID NO: 350706 - protein, 29 aa, Mycobacterium
ARIWPPWEFYFWHHTIPAVVWVALIMGGV

SEQ ID NO: 350707 - protein, 17 aa, Mycobacterium
ARKAFYGGSAAPLSIRH

SEQ ID NO: 350708 - protein, 19 aa, Mycobacterium
ARKFAFRKRVLMGLVGAMV

SEQ ID NO: 350709 - protein, 23 aa, Mycobacterium
ARKGRLWRRVGTAVVRWPAPILA

SEQ ID NO: 350710 - protein, 30 aa, Mycobacterium
ARKVLGPLRDLFAAIFFLAIGWAVDPQELV

SEQ ID NO: 350711 - protein, 17 aa, Mycobacterium
ARLDLLTQRYIELTTRI

SEQ ID NO: 350712 - protein, 21 aa, Mycobacterium
ARLEYVALTFALILSVLGVVL

SEQ ID NO: 350713 - protein, 17 aa, Mycobacterium
ARLGAISVDWWATAVAG

SEQ ID NO: 350714 - protein, 20 aa, Mycobacterium
ARLIPLFLSQTIMSANLAVT

SEQ ID NO: 350715 - protein, 18 aa, Mycobacterium
ARLLSIRVTSDKFSARSS

SEQ ID NO: 350716 - protein, 24 aa, Mycobacterium
ARLPLPSRLLAARPLVALGAMAYS

SEQ ID NO: 350717 - protein, 18 aa, Mycobacterium
ARLPLVLGLIAAITFTLL

SEQ ID NO: 350718 - protein, 18 aa, Mycobacterium
ARLRALLMPAAVVAVIGA

SEQ ID NO: 350719 - protein, 25 aa, Mycobacterium
ARLRDRSWWSGPEIYLMVDDYDLVC

SEQ ID NO: 350720 - protein, 22 aa, Mycobacterium
ARLRFIPWVRRLVDPPVRVLIR

SEQ ID NO: 350721 - protein, 17 aa, Mycobacterium
ARLRRGHTEILWTAAFV

SEQ ID NO: 350722 - protein, 19 aa, Mycobacterium
ARLTKMTAMPQLVAFFNGV

SEQ ID NO: 350723 - protein, 20 aa, Mycobacterium
ARLVLDFAPELGLLATMTTV

SEQ ID NO: 350724 - protein, 29 aa, Mycobacterium
ARLVSLRDFLLLFFFLDLGARLEFTDTAQ

SEQ ID NO: 350725 - protein, 18 aa, Mycobacterium
ARLVSMLRELAWVVVVPA

SEQ ID NO: 350726 - protein, 19 aa, Mycobacterium
ARLVVGWFDAERRGLVMGI

SEQ ID NO: 350727 - protein, 26 aa, Mycobacterium
ARLYLIVGGIIYAVLWLYGLVIDPHS

SEQ ID NO: 350728 - protein, 30 aa, Mycobacterium
ARMELDWRPKWTLDDGLPALLDWIAKSDVS

SEQ ID NO: 350729 - protein, 22 aa, Mycobacterium
ARMHKWLKRGLYVCLFGLVIEG

SEQ ID NO: 350730 - protein, 19 aa, Mycobacterium
ARMLARMRWALPGVEGAAP

SEQ ID NO: 350731 - protein, 28 aa, Mycobacterium
ARMMRSRPVIRRPGWPVFPYTTMVRTSL

SEQ ID NO: 350732 - protein, 27 aa, Mycobacterium
ARMTELVEDLLLLARLDSGRPLAQEPV

SEQ ID NO: 350733 - protein, 25 aa, Mycobacterium
ARMWRPLIVFLLAVAVVVAVWDTLA

SEQ ID NO: 350734 - protein, 32 aa, Mycobacterium
ARNFQSFTMWLIIGIIYFVVIMALTKLSDRVE

SEQ ID NO: 350735 - protein, 19 aa, Mycobacterium
ARNIAIGFLGVVAAGVLVF

SEQ ID NO: 350736 - protein, 20 aa, Mycobacterium
ARNIIDYRVTTLPAARRNAQ

SEQ ID NO: 350737 - protein, 25 aa, Mycobacterium
ARNLPGLAIIGVSLVVFVSSLVAFA

SEQ ID NO: 350738 - protein, 19 aa, Mycobacterium
ARNLWLISASLIIFALVIA

SEQ ID NO: 350739 - protein, 28 aa, Mycobacterium
ARNRFAVASLILLVLLFVGCYSLPAVLP

SEQ ID NO: 350740 - protein, 22 aa, Mycobacterium
ARNRVFLALAAIFGLLAGPQLS

SEQ ID NO: 350741 - protein, 18 aa, Mycobacterium
ARNTIRPPHLITSQPRAA

SEQ ID NO: 350742 - protein, 20 aa, Mycobacterium
ARPADRPLWLGSIKSNMGHT

SEQ ID NO: 350743 - protein, 21 aa, Mycobacterium
ARPDLIFAEPPEAAPEPARPW

SEQ ID NO: 350744 - protein, 42 aa, Mycobacterium
ARPEPLARWLARSTTVYLKLFGWLIWLFDQSSNLLLRALRIE

SEQ ID NO: 350745 - protein, 23 aa, Mycobacterium
ARPFVLLERFELNAWVDAVRTHR

SEQ ID NO: 350746 - protein, 19 aa, Mycobacterium
ARPFVLVARLFAVAATVVI

SEQ ID NO: 350747 - protein, 27 aa, Mycobacterium
ARPKRAVYYLITMALHWTIGGGSYAWT

SEQ ID NO: 350748 - protein, 20 aa, Mycobacterium
ARPLQPLLPVMAALMGLTQA

SEQ ID NO: 350749 - protein, 46 aa, Mycobacterium
ARPNRSWARYLRRGAMPLLLAGALALSAFLGWQQWQQHQVKLAGQQ

SEQ ID NO: 350750 - protein, 24 aa, Mycobacterium
ARPSTIWWRVTLPLLLPGMVSGAV

SEQ ID NO: 350751 - protein, 27 aa, Mycobacterium
ARPSTVWWRVTLPLLRPGLMSGAVLAF

SEQ ID NO: 350752 - protein, 22 aa, Mycobacterium
ARPSWLLLGPAFVAAIAYVDPG

SEQ ID NO: 350753 - protein, 17 aa, Mycobacterium
ARPTVKLGVPLVNPEVT

SEQ ID NO: 350754 - protein, 28 aa, Mycobacterium
ARPVIQFLRMISPLSWTPIAVAVFGIGN

SEQ ID NO: 350755 - protein, 26 aa, Mycobacterium
ARPVRPVGPPPRRRAHRRLVAVVSIA

SEQ ID NO: 350756 - protein, 23 aa, Mycobacterium
ARQEPYCMDLLRDNALIVGAPTR

SEQ ID NO: 350757 - protein, 22 aa, Mycobacterium
ARQLPIVALMRQSPRNLVLGIL

SEQ ID NO: 350758 - protein, 22 aa, Mycobacterium
ARQLRYWHGALAGLPERITLPT

SEQ ID NO: 350759 - protein, 19 aa, Mycobacterium
ARQLSLRMIVTGAAPISSS

SEQ ID NO: 350760 - protein, 34 aa, Mycobacterium
ARQVGLLRNYLLPLAALLLLLVQASGIPAGDIPV

SEQ ID NO: 350761 - protein, 20 aa, Mycobacterium
ARQVPATLGQLWTAASPATT

SEQ ID NO: 350762 - protein, 25 aa, Mycobacterium
ARRARARWFPWFRRARRSRRWARCW

SEQ ID NO: 350763 - protein, 20 aa, Mycobacterium
ARRAVTAREWVWAVVLTAAV

SEQ ID NO: 350764 - protein, 19 aa, Mycobacterium
ARRELMAQIWYPAESSVEA

SEQ ID NO: 350765 - protein, 21 aa, Mycobacterium
ARREMFVLAPLYKDLKKRQPD

SEQ ID NO: 350766 - protein, 24 aa, Mycobacterium
ARRESLPPSAYLPEVIDRVVQELS

SEQ ID NO: 350767 - protein, 38 aa, Mycobacterium
ARREVRLLLAHRSYFAFLAILPFVLAGLTLLIPGDAGL

SEQ ID NO: 350768 - protein, 27 aa, Mycobacterium
ARRFALSPIPVYLLAGLSLGKGGVLPV

SEQ ID NO: 350769 - protein, 25 aa, Mycobacterium
ARRFSMLALWCYVAIGLSGIINALI

SEQ ID NO: 350770 - protein, 25 aa, Mycobacterium
ARRGPLLWLALLSAAATMVLTPITV

SEQ ID NO: 350771 - protein, 24 aa, Mycobacterium
ARRIRMRIEQWDRTTLLEQERVIG

SEQ ID NO: 350772 - protein, 30 aa, Mycobacterium
ARRLPAPPSPSWWLPLVRGQLPSPAKSTKS

SEQ ID NO: 350773 - protein, 23 aa, Mycobacterium
ARRLTHFGALVRIPRSVEALGRV

SEQ ID NO: 350774 - protein, 26 aa, Mycobacterium
ARRLTLLLTPAAYSLLTAAPAWAAVG

SEQ ID NO: 350775 - protein, 22 aa, Mycobacterium
ARRLTQFGALVRIPRSVEALGR

SEQ ID NO: 350776 - protein, 25 aa, Mycobacterium
ARRNRLRAWEFRLKTVAQRFDRDAD

SEQ ID NO: 350777 - protein, 23 aa, Mycobacterium
ARRPLIGVVWAWMTGRDDTWRRT

SEQ ID NO: 350778 - protein, 18 aa, Mycobacterium
ARRPLVGYVWSWASGRGR

SEQ ID NO: 350779 - protein, 30 aa, Mycobacterium
ARRPVDPEWGPAWHLGVLPLEDGGTAISLV

SEQ ID NO: 350780 - protein, 29 aa, Mycobacterium
ARRQDALGALLWRSLYPDAAPRTQILVPP

SEQ ID NO: 350781 - protein, 28 aa, Mycobacterium
ARRQDALGSIFWHALRPDDAPRTQILVP

SEQ ID NO: 350782 - protein, 39 aa, Mycobacterium
ARRQGRLILADRGYFIFLALLPFVLAGLVLSVPGSAGFN

SEQ ID NO: 350783 - protein, 36 aa, Mycobacterium
ARRQIRLIVSDRGYFVFLALLPFIMGSLSMSVPGDV

SEQ ID NO: 350784 - protein, 40 aa, Mycobacterium
ARRQIRLVISDRGYFAFLMLLPFIMGILSLSVPGDVGFGV

SEQ ID NO: 350785 - protein, 39 aa, Mycobacterium
ARRQIRLVISDRGYTVFLALLPFLIGTLTLTVRGKTGYG

SEQ ID NO: 350786 - protein, 39 aa, Mycobacterium
ARRQIRLVVADRAYFVFLALLPFILGSLSLTVPGGNGFQ

SEQ ID NO: 350787 - protein, 37 aa, Mycobacterium
ARRQMRLIISDRGYFIFLAILPFIMGSLSMSVPGDVG

SEQ ID NO: 350788 - protein, 31 aa, Mycobacterium
ARRQQGCHTMSLDWVAWRGLGFAADAQIVSE

SEQ ID NO: 350789 - protein, 27 aa, Mycobacterium
ARRQSALGALLWRGLSPELTPRTQIVM

SEQ ID NO: 350790 - protein, 37 aa, Mycobacterium
ARRQVRLIFSDRGYFVFLAVLPFIMGSLSMSVPGNVG

SEQ ID NO: 350791 - protein, 33 aa, Mycobacterium
ARRRIRRCLTRWRPILLGLLVIATTGFAAGFFY

SEQ ID NO: 350792 - protein, 21 aa, Mycobacterium
ARRSQRLFLAQWASIGRLNAH

SEQ ID NO: 350793 - protein, 17 aa, Mycobacterium
ARRTPIIGAFPKMFIPF

SEQ ID NO: 350794 - protein, 24 aa, Mycobacterium
ARRVGPWAMFGVCAAITISAVPPY

SEQ ID NO: 350795 - protein, 32 aa, Mycobacterium
ARRVRRLPGVLSIVVLLFVACAPVASAQPAAG

SEQ ID NO: 350796 - protein, 17 aa, Mycobacterium
ARRVVTANLFIAGTFIS

SEQ ID NO: 350797 - protein, 19 aa, Mycobacterium
ARRWDLPVLRWVDGTRPGR

SEQ ID NO: 350798 - protein, 17 aa, Mycobacterium
ARSFGFTVSGLGIAIAM

SEQ ID NO: 350799 - protein, 23 aa, Mycobacterium
ARSPRLPPLIPGGDYVFEGGNGT

SEQ ID NO: 350800 - protein, 24 aa, Mycobacterium
ARSQLWLSLLSWAVVIGLYLAARA

SEQ ID NO: 350801 - protein, 30 aa, Mycobacterium
ARSRIRGIRLTEPIPLRWAKGARLHAEIVG

SEQ ID NO: 350802 - protein, 24 aa, Mycobacterium
ARSRWLPLQFAALALVWGASFLFI

SEQ ID NO: 350803 - protein, 22 aa, Mycobacterium
ARSSWLPMFILLIVLSSVAAAY

SEQ ID NO: 350804 - protein, 19 aa, Mycobacterium
ARSTLIRVELPLALRVIVA

SEQ ID NO: 350805 - protein, 18 aa, Mycobacterium
ARSYAFLVPSTVDGITSS

SEQ ID NO: 350806 - protein, 23 aa, Mycobacterium
ARTAALNLFVVVEAFYLFSCRSL

SEQ ID NO: 350807 - protein, 22 aa, Mycobacterium
ARTDTIDILRYARATYPDAAAV

SEQ ID NO: 350808 - protein, 23 aa, Mycobacterium
ARTIPVSAPWDARRARELDEVSL

SEQ ID NO: 350809 - protein, 17 aa, Mycobacterium
ARTIRLIVPGWAGHLAG

SEQ ID NO: 350810 - protein, 24 aa, Mycobacterium
ARTQLWLSLLSWSVVVAVYFVAKV

SEQ ID NO: 350811 - protein, 25 aa, Mycobacterium
ARTTHHLFQPLLYQVATGIISEGDI

SEQ ID NO: 350812 - protein, 20 aa, Mycobacterium
ARTVRNMLRAVLQPDARQIQ

SEQ ID NO: 350813 - protein, 26 aa, Mycobacterium
ARTWHLQLALFWTAAAFLAGGIFLVP

SEQ ID NO: 350814 - protein, 26 aa, Mycobacterium
ARTWHLQLSLFWTAAAFLAGGIFLVP

SEQ ID NO: 350815 - protein, 26 aa, Mycobacterium
ARTWHVQLALFWTAAAFLAGGIFLVP

SEQ ID NO: 350816 - protein, 24 aa, Mycobacterium
ARVAWIVHLLPLLPIASVVLAMHP

SEQ ID NO: 350817 - protein, 25 aa, Mycobacterium
ARVDRFPLAWLLARPDRSSLVRLLA

SEQ ID NO: 350818 - protein, 27 aa, Mycobacterium
ARVILLDAAPAVLPPFGPKLGDKARKR

SEQ ID NO: 350819 - protein, 17 aa, Mycobacterium
ARVLLLCLLVGSVVGLK

SEQ ID NO: 350820 - protein, 20 aa, Mycobacterium
ARVLPRFSQLSLGCVAVLLV

SEQ ID NO: 350821 - protein, 19 aa, Mycobacterium
ARWAAVHAAALLLPAAALY

SEQ ID NO: 350822 - protein, 17 aa, Mycobacterium
ARWIPYARADLVLGIVV

SEQ ID NO: 350823 - protein, 25 aa, Mycobacterium
ARWRGRPWYVDYGNNPGLFMPVALA

SEQ ID NO: 350824 - protein, 20 aa, Mycobacterium
ARWSSAAPAPRRGLGSYAVP

SEQ ID NO: 350825 - protein, 17 aa, Mycobacterium
ARWTWPALGLAIVIVTY

SEQ ID NO: 350826 - protein, 20 aa, Mycobacterium
ARWVAPLLGTVMYVVGGRPF

SEQ ID NO: 350827 - protein, 28 aa, Mycobacterium
ARWVVSVIGVLLIAYLAAVALQPAILDV

SEQ ID NO: 350828 - protein, 22 aa, Mycobacterium
ARWWQLLMRVVLPMSGPTMVAF

SEQ ID NO: 350829 - protein, 18 aa, Mycobacterium
ARYGYICGLVGLVLLVIP

SEQ ID NO: 350830 - protein, 25 aa, Mycobacterium
ASAADLWWLVFLGAGPSAIAFTTWA

SEQ ID NO: 350831 - protein, 25 aa, Mycobacterium
ASAAFVLCVLLLALAVEHQWPGPCR

SEQ ID NO: 350832 - protein, 32 aa, Mycobacterium
ASAAIRLFPRTPLNWRVLVGAFFVAAAFASAG

SEQ ID NO: 350833 - protein, 21 aa, Mycobacterium
ASAALWVRRWPTRGQSAAFAA

SEQ ID NO: 350834 - protein, 24 aa, Mycobacterium
ASAFAVAGFYWFDGYTLVQQRYWQ

SEQ ID NO: 350835 - protein, 19 aa, Mycobacterium
ASAFFNVRLIAPATTAVAL

SEQ ID NO: 350836 - protein, 24 aa, Mycobacterium
ASAFGYFFYTGLGTFAVALLRSRF

SEQ ID NO: 350837 - protein, 23 aa, Mycobacterium
ASAFLPYGYLGIWAAVPFAIWLF

SEQ ID NO: 350838 - protein, 43 aa, Mycobacterium
ASAGALVLRALLIAFFALVYLLPLILWLWRGETTHDRHAAARA

SEQ ID NO: 350839 - protein, 25 aa, Mycobacterium
ASAGLGLFFAFWSWVGFESTAMYGE

SEQ ID NO: 350840 - protein, 26 aa, Mycobacterium
ASAHTSLMYGWLPITVQLATATVLVL

SEQ ID NO: 350841 - protein, 21 aa, Mycobacterium
ASAIFLFFSAILGSAGPFVAG

SEQ ID NO: 350842 - protein, 17 aa, Mycobacterium
ASAIIVLVLIALTYHRL

SEQ ID NO: 350843 - protein, 26 aa, Mycobacterium
ASAILHGIWVLLFASLFSSLVQLIPK

SEQ ID NO: 350844 - protein, 41 aa, Mycobacterium
ASAISAMLIYRLISWIFISAIGWVIFFFMFRTETDLDVDRV

SEQ ID NO: 350845 - protein, 24 aa, Mycobacterium
ASALAWVIFAILLVLTVLQLRITR

SEQ ID NO: 350846 - protein, 24 aa, Mycobacterium
ASALCRHYWPIALVASVLSKRCRR

SEQ ID NO: 350847 - protein, 22 aa, Mycobacterium
ASALVILPPLLALCGRRLFWPF

SEQ ID NO: 350848 - protein, 19 aa, Mycobacterium
ASALYLFSYYLGSSVAGAV

SEQ ID NO: 350849 - protein, 19 aa, Mycobacterium
ASAMFLFFNAVFGSVGPFV

SEQ ID NO: 350850 - protein, 33 aa, Mycobacterium
ASAMGLSVLIWQHLLHMPLNWIVVPMAVIVMLA

SEQ ID NO: 350851 - protein, 30 aa, Mycobacterium
ASAMLGFLPLIWLSLAFGWGLFGIWSGLST

SEQ ID NO: 350852 - protein, 21 aa, Mycobacterium
ASAMVLWRFTGSRTLSETAER

SEQ ID NO: 350853 - protein, 20 aa, Mycobacterium
ASAMVVWRFTGSRMLSESAE

SEQ ID NO: 350854 - protein, 31 aa, Mycobacterium
ASAPPNTAFYGVPVAIWHYQPRAMDWPAPIS

SEQ ID NO: 350855 - protein, 17 aa, Mycobacterium
ASAPPTAHLPFRSGRSF

SEQ ID NO: 350856 - protein, 22 aa, Mycobacterium
ASAVLGVIAIAAVVLGTMIFTA

SEQ ID NO: 350857 - protein, 34 aa, Mycobacterium
ASAVSSSPLAWLWQILFGTSTFPTSIAALLTDLQ

SEQ ID NO: 350858 - protein, 35 aa, Mycobacterium
ASAVVAGLCWLSFSWPGRRAMAAFVVWADVALAVG

SEQ ID NO: 350859 - protein, 25 aa, Mycobacterium
ASAVVLLIVLVIRPLSVFAIFGRNK

SEQ ID NO: 350860 - protein, 25 aa, Mycobacterium
ASCERPMIFPLSNPTSRMEAMPADV

SEQ ID NO: 350861 - protein, 23 aa, Mycobacterium
ASCPDVLLVNVPGTWESAPQDDP

SEQ ID NO: 350862 - protein, 36 aa, Mycobacterium
ASDERDRIALWTRILPITFTALGLVSLVGGAVLGSF

SEQ ID NO: 350863 - protein, 30 aa, Mycobacterium
ASDIYSLACLLYESLTGRAPFEAADVRQVW

SEQ ID NO: 350864 - protein, 29 aa, Mycobacterium
ASDLELPPTWMLFFFAPTLVGLCAMRGLY

SEQ ID NO: 350865 - protein, 25 aa, Mycobacterium
ASDPDLPITYPYQGGFRDGGAMPGT

SEQ ID NO: 350866 - protein, 19 aa, Mycobacterium
ASDRLEAVLLVLAVAVSLL

SEQ ID NO: 350867 - protein, 25 aa, Mycobacterium
ASELLYPLLPIYLTAVLGAPPSVVG

SEQ ID NO: 350868 - protein, 31 aa, Mycobacterium
ASELVEGPPPRWPWVVGVTAIIAAIALVASV

SEQ ID NO: 350869 - protein, 31 aa, Mycobacterium
ASESHSDWGWLWWFGGAWAVLAVAGAAVIVL

SEQ ID NO: 350870 - protein, 20 aa, Mycobacterium
ASEVRRRYREGRLAREIAAA

SEQ ID NO: 350871 - protein, 21 aa, Mycobacterium
ASFFFVGWFLYNSMPSGFIEF

SEQ ID NO: 350872 - protein, 42 aa, Mycobacterium
ASFGLSVLLWEHILGLQLHWFVLPFTVIILLAVGSDYNLLLV

SEQ ID NO: 350873 - protein, 25 aa, Mycobacterium
ASFGNKWMWSPIVVTPPVVVAGIGG

SEQ ID NO: 350874 - protein, 23 aa, Mycobacterium
ASFGVTPLMLWQQATKHYTNISV

SEQ ID NO: 350875 - protein, 29 aa, Mycobacterium
ASFLGFAAALGYVLFEPPIYSLGAVLGSV

SEQ ID NO: 350876 - protein, 20 aa, Mycobacterium
ASFLGILRSITPLAAPHERG

SEQ ID NO: 350877 - protein, 30 aa, Mycobacterium
ASFLILVMLVALTYRYLPWRPLPEDSREKS

SEQ ID NO: 350878 - protein, 22 aa, Mycobacterium
ASFMGFYWMDHRVVGGIGFELT

SEQ ID NO: 350879 - protein, 23 aa, Mycobacterium
ASFPSLNWWWGAVVAAALLAWVL

SEQ ID NO: 350880 - protein, 24 aa, Mycobacterium
ASGAMVFAILVLLGRYINYTLDLA

SEQ ID NO: 350881 - protein, 20 aa, Mycobacterium
ASGHLIFALIATGTIVSVHL

SEQ ID NO: 350882 - protein, 23 aa, Mycobacterium
ASGHLVFALIGTGTVIGIHVLGR

SEQ ID NO: 350883 - protein, 38 aa, Mycobacterium
ASGHPRWMRWLRSHYRRWGLIAVGLFQVAIAAAQISGV

SEQ ID NO: 350884 - protein, 26 aa, Mycobacterium
ASGIGLALFGLRRGVQDRAPDGAACG

SEQ ID NO: 350885 - protein, 30 aa, Mycobacterium
ASGPAIYNYTWLILQLPFGIVGVTVLTVVM

SEQ ID NO: 350886 - protein, 32 aa, Mycobacterium
ASGPAWRLIGTTAFGLLLLTFTPTKWAVQFGA

SEQ ID NO: 350887 - protein, 23 aa, Mycobacterium
ASGPAWRLIGTTAVGLLLLTFTP

SEQ ID NO: 350888 - protein, 23 aa, Mycobacterium
ASGRVAYVLGLEGPALSVDTACS

SEQ ID NO: 350889 - protein, 19 aa, Mycobacterium
ASGRWRALLLAAVAACAAC

SEQ ID NO: 350890 - protein, 30 aa, Mycobacterium
ASGSFPPWVLYPCALSMLVLSKSFGVLRGA

SEQ ID NO: 350891 - protein, 22 aa, Mycobacterium
ASGWLLLWFATFWAVQVITIRF

SEQ ID NO: 350892 - protein, 23 aa, Mycobacterium
ASGYLVWHHRTVAHQQQRAAEFA

SEQ ID NO: 350893 - protein, 23 aa, Mycobacterium
ASHFLFVPQLLLFMLSTGIAPEK

SEQ ID NO: 350894 - protein, 26 aa, Mycobacterium
ASHGLMPIVFFLLAAGWFVLVAGGRR

SEQ ID NO: 350895 - protein, 24 aa, Mycobacterium
ASHHPWSALLVLFGIGVAGSAVGP

SEQ ID NO: 350896 - protein, 29 aa, Mycobacterium
ASHRRFLLVVVPLAPWVFGAGASAYAVLP

SEQ ID NO: 350897 - protein, 26 aa, Mycobacterium
ASHSQRFWFWLSVATLALNIVLNVTL

SEQ ID NO: 350898 - protein, 25 aa, Mycobacterium
ASIGPWLLRTVFDPAYQAGGPLLGW

SEQ ID NO: 350899 - protein, 30 aa, Mycobacterium
ASIIFTIPSLALFVALPLIIPTRILDEANV

SEQ ID NO: 350900 - protein, 22 aa, Mycobacterium
ASILGIQLFALVFNGLMRDAAT

SEQ ID NO: 350901 - protein, 31 aa, Mycobacterium
ASILQAVGFWKIGVRLPLLQGVTFATLAPVI

SEQ ID NO: 350902 - protein, 30 aa, Mycobacterium
ASITTAKWLALFSFWLVCLYSLAVHLNEPA

SEQ ID NO: 350903 - protein, 30 aa, Mycobacterium
ASIVFTIPSLALFVALPLIIKTRILDEANV

SEQ ID NO: 350904 - protein, 30 aa, Mycobacterium
ASIVFTIPSLALFVALPLIIPTRILDEANV

SEQ ID NO: 350905 - protein, 26 aa, Mycobacterium
ASIVLIFIIMVIVTRALVAAGVIVGT

SEQ ID NO: 350906 - protein, 26 aa, Mycobacterium
ASIVLIFIIMVLVTRALVAAGVIVGT

SEQ ID NO: 350907 - protein, 26 aa, Mycobacterium
ASIVTDPWAWRRPARTLRSLATLPRT

SEQ ID NO: 350908 - protein, 24 aa, Mycobacterium
ASIVVFLIALPLSVGIAIASGAPV

SEQ ID NO: 350909 - protein, 43 aa, Mycobacterium
ASKGALALRLLTIAFFALVYLLPLILWLWRGETTHDRHAAARA

SEQ ID NO: 350910 - protein, 29 aa, Mycobacterium
ASKGYFLLGIWMSLFWAVVFALSVVIRRP

SEQ ID NO: 350911 - protein, 24 aa, Mycobacterium
ASKLLSRNLSIYGLGGIVAPFIGI

SEQ ID NO: 350912 - protein, 30 aa, Mycobacterium
ASKMNLPWMFFFTGLAIPAFYAVGLLAGHD

SEQ ID NO: 350913 - protein, 30 aa, Mycobacterium
ASKSLAPGLRLGWLVLPASLLDAVVEAKRR

SEQ ID NO: 350914 - protein, 17 aa, Mycobacterium
ASLAAAPRPWQGPAAVV

SEQ ID NO: 350915 - protein, 21 aa, Mycobacterium
ASLAWMLLGTVAMAGAVLAGL

SEQ ID NO: 350916 - protein, 21 aa, Mycobacterium
ASLAYDMWGAAVSLAYQMHSG

SEQ ID NO: 350917 - protein, 24 aa, Mycobacterium
ASLCLIFVIMLVITRSIVAAFTIV

SEQ ID NO: 350918 - protein, 23 aa, Mycobacterium
ASLGIVVAVLILAGAVMLAYVKP

SEQ ID NO: 350919 - protein, 20 aa, Mycobacterium
ASLIIITMVWSRLAHFGTSG

SEQ ID NO: 350920 - protein, 19 aa, Mycobacterium
ASLLKRAVGPSLKWFDEHI

SEQ ID NO: 350921 - protein, 20 aa, Mycobacterium
ASLLKVAFLAMIIGSVIGLK

SEQ ID NO: 350922 - protein, 20 aa, Mycobacterium
ASLLMLPQGFVKSLTYALLA

SEQ ID NO: 350923 - protein, 27 aa, Mycobacterium
ASLPSRRIWALVALFVVVGVTVGAMAY

SEQ ID NO: 350924 - protein, 28 aa, Mycobacterium
ASLQIPRALFWIVIAYITFATVVAFWIG

SEQ ID NO: 350925 - protein, 23 aa, Mycobacterium
ASLSLMHDVIVYSLLHGNVDSPR

SEQ ID NO: 350926 - protein, 19 aa, Mycobacterium
ASLTKLLLIGGIVACIAGL

SEQ ID NO: 350927 - protein, 26 aa, Mycobacterium
ASLTLIFMIMLLLTRSVVAALVIVGT

SEQ ID NO: 350928 - protein, 24 aa, Mycobacterium
ASLTLLPALIGLTGPSRLSSSRPV

SEQ ID NO: 350929 - protein, 18 aa, Mycobacterium
ASLTLLVLLFVGCYALPA

SEQ ID NO: 350930 - protein, 18 aa, Mycobacterium
ASLVFLGAFVPLVGAVIA

SEQ ID NO: 350931 - protein, 20 aa, Mycobacterium
ASLVVFLVALPLSLGIAIAS

SEQ ID NO: 350932 - protein, 21 aa, Mycobacterium
ASLVVFLVALPLSLGIAIASG

SEQ ID NO: 350933 - protein, 24 aa, Mycobacterium
ASLVVFLVALPLSLGIAIASGAPL

SEQ ID NO: 350934 - protein, 28 aa, Mycobacterium
ASLVVLVCTLLLIAALTWGAGRVNAREL

SEQ ID NO: 350935 - protein, 20 aa, Mycobacterium
ASMGTWVYLADPADIKTVFA

SEQ ID NO: 350936 - protein, 25 aa, Mycobacterium
ASMHQWLDVTLLAGAALVIAGVVVA

SEQ ID NO: 350937 - protein, 25 aa, Mycobacterium
ASMIALTYFPPLWRKVMDHRVLDHY

SEQ ID NO: 350938 - protein, 26 aa, Mycobacterium
ASMILIFAIMVLITRSVVAALVIVGT

SEQ ID NO: 350939 - protein, 25 aa, Mycobacterium
ASMISFTAILWNLSGNLTLPLIGVE

SEQ ID NO: 350940 - protein, 24 aa, Mycobacterium
ASMLAIVIVGLAALGGWFYWDRVE

SEQ ID NO: 350941 - protein, 23 aa, Mycobacterium
ASMPPLWVIVSCALAMATGTYLG

SEQ ID NO: 350942 - protein, 24 aa, Mycobacterium
ASMRKFFKAFEPYGLRETAVKPSY

SEQ ID NO: 350943 - protein, 20 aa, Mycobacterium
ASMTMVWLSVLLYVKVGQPD

SEQ ID NO: 350944 - protein, 25 aa, Mycobacterium
ASMVLYIGCWWRHLTPPAPAAAPPA

SEQ ID NO: 350945 - protein, 24 aa, Mycobacterium
ASNDWVFTAIPWVVAAAGIGGIAL

SEQ ID NO: 350946 - protein, 30 aa, Mycobacterium
ASNYNVHWLFWLVPLMPLFFFAGAAANVHS

SEQ ID NO: 350947 - protein, 28 aa, Mycobacterium
ASPAPPPPSNFPPPPPRPGPQPPQQATK

SEQ ID NO: 350948 - protein, 26 aa, Mycobacterium
ASPETYVFVWLGFYGGIMGAVGGVLV

SEQ ID NO: 350949 - protein, 24 aa, Mycobacterium
ASPFWQTWDLLMLWLAQLHGGNGM

SEQ ID NO: 350950 - protein, 26 aa, Mycobacterium
ASPGLLVRVAPLAISVVMLGITAAAF

SEQ ID NO: 350951 - protein, 31 aa, Mycobacterium
ASPIGLLIVVLLLIATLFLLRSMNRQLKKVP

SEQ ID NO: 350952 - protein, 17 aa, Mycobacterium
ASPIRRLRADAPPFFVL

SEQ ID NO: 350953 - protein, 31 aa, Mycobacterium
ASPIRRLRADAPPFFVLHGCDDSLIPVGEAQ

SEQ ID NO: 350954 - protein, 38 aa, Mycobacterium
ASPLLPFGLLGIWAAIPFAIWFFLAIEGVPLAAEEAEE

SEQ ID NO: 350955 - protein, 32 aa, Mycobacterium
ASPVGLLIVVLLLISTLFLLRSMNRQLKKVPE

SEQ ID NO: 350956 - protein, 17 aa, Mycobacterium
ASPVVVWGALPFHRAAW

SEQ ID NO: 350957 - protein, 18 aa, Mycobacterium
ASPWAWYLVAAVSAGAAL

SEQ ID NO: 350958 - protein, 26 aa, Mycobacterium
ASQEFTEPEMWFLCKAHQVCPVGAVV

SEQ ID NO: 350959 - protein, 22 aa, Mycobacterium
ASQFITVFMFGQSSGLYQHYFT

SEQ ID NO: 350960 - protein, 17 aa, Mycobacterium
ASQLLRPYGPRPLVRAL

SEQ ID NO: 350961 - protein, 18 aa, Mycobacterium
ASQLLRPYGPRPLVRALL

SEQ ID NO: 350962 - protein, 27 aa, Mycobacterium
ASQLPGHWQRLAVCWRLAQTHGLALGT

SEQ ID NO: 350963 - protein, 27 aa, Mycobacterium
ASQTGFFGLAFWIALAGLTPTGLLLAA

SEQ ID NO: 350964 - protein, 24 aa, Mycobacterium
ASQWLVCFAVASTVLWVSEIRKLV

SEQ ID NO: 350965 - protein, 17 aa, Mycobacterium
ASRGWAQNPRRQSPPPY

SEQ ID NO: 350966 - protein, 21 aa, Mycobacterium
ASRHHAFLTMTPLGTEIRDAH

SEQ ID NO: 350967 - protein, 19 aa, Mycobacterium
ASRLPWVVIRSFDGLGPPK

SEQ ID NO: 350968 - protein, 23 aa, Mycobacterium
ASRLRPIRIIAAAAAASMALLAL

SEQ ID NO: 350969 - protein, 27 aa, Mycobacterium
ASRLTGRPLSLYTLPISGFGKDANGSD

SEQ ID NO: 350970 - protein, 26 aa, Mycobacterium
ASRMFAGLWTCAVGMAAVLCAGIGTG

SEQ ID NO: 350971 - protein, 19 aa, Mycobacterium
ASRRHAFLTPTPAGPEIRD

SEQ ID NO: 350972 - protein, 19 aa, Mycobacterium
ASRRHATLLQTPLGTEIRD

SEQ ID NO: 350973 - protein, 33 aa, Mycobacterium
ASRRRDRVFSWLPFYHDMGFIQVLAALLYGLRV

SEQ ID NO: 350974 - protein, 17 aa, Mycobacterium
ASRSAMMDLRRQLDLLH

SEQ ID NO: 350975 - protein, 19 aa, Mycobacterium
ASRSLIGPILRAASYSDLE

SEQ ID NO: 350976 - protein, 32 aa, Mycobacterium
ASRSPTAPSHPRWWFLWTTPGRILSIGMVLAA

SEQ ID NO: 350977 - protein, 17 aa, Mycobacterium
ASRSWAQAPRRAPTTPL

SEQ ID NO: 350978 - protein, 24 aa, Mycobacterium
ASRVEIYWLPAGIAAILVLAELYL

SEQ ID NO: 350979 - protein, 23 aa, Mycobacterium
ASSALFLLLIAFVGLYSLVNGRP

SEQ ID NO: 350980 - protein, 21 aa, Mycobacterium
ASSAPPWPAYAPHGAAAPVNH

SEQ ID NO: 350981 - protein, 28 aa, Mycobacterium
ASSATLVFGLLLIAISAWLTATPVRVVR

SEQ ID NO: 350982 - protein, 24 aa, Mycobacterium
ASSDPWYTALWHTIADAPHLPPAN

SEQ ID NO: 350983 - protein, 17 aa, Mycobacterium
ASSFSLAGPWVDIAAPG

SEQ ID NO: 350984 - protein, 24 aa, Mycobacterium
ASSLRSIFPPTPTPATRPGEPRKS

SEQ ID NO: 350985 - protein, 31 aa, Mycobacterium
ASSPVLYGALFFPVWPLGVLVPVGVAVVMGA

SEQ ID NO: 350986 - protein, 47 aa, Mycobacterium
ASSSASIPWKPVLGALAFGAVLVGAFMLFSWFRTRSRRRAEIEAAKG

SEQ ID NO: 350987 - protein, 28 aa, Mycobacterium
ASSVGPWLPLVFLLVHIVVTVPPFPRTA

SEQ ID NO: 350988 - protein, 35 aa, Mycobacterium
ASSVLVVSALFFPWNLYFGFRIPGSSRILFGVLLL

SEQ ID NO: 350989 - protein, 31 aa, Mycobacterium
ASTAALITLLMTALWVLAIVARPYQWWRVAL

SEQ ID NO: 350990 - protein, 31 aa, Mycobacterium
ASTAALITLLMTALWVLAVVARPYQWWRVAL

SEQ ID NO: 350991 - protein, 29 aa, Mycobacterium
ASTAALITLLVAALWVLAVVARPYEWWRV

SEQ ID NO: 350992 - protein, 42 aa, Mycobacterium
ASTAALITLLVTALWVLAVVARPYQWWRLGLVMASGAAYLAI

SEQ ID NO: 350993 - protein, 20 aa, Mycobacterium
ASTELPFTGLNTPLSVAVDK

SEQ ID NO: 350994 - protein, 29 aa, Mycobacterium
ASTLCPLLVLGIWWRGLTARGAMSGLAVG

SEQ ID NO: 350995 - protein, 28 aa, Mycobacterium
ASTLCPLLVLGIWWRRLTVVGAASGLVV

SEQ ID NO: 350996 - protein, 24 aa, Mycobacterium
ASTLLFRLIPWIVGAVFIAGCVLA

SEQ ID NO: 350997 - protein, 24 aa, Mycobacterium
ASTPLILVPPWTRRWSHAAWIALW

SEQ ID NO: 350998 - protein, 24 aa, Mycobacterium
ASTQIVLPFTELVFPTAVAVDKTG

SEQ ID NO: 350999 - protein, 24 aa, Mycobacterium
ASTVFGVRFPGPLGLAAGFDKDGK

SEQ ID NO: 351000 - protein, 23 aa, Mycobacterium
ASTVFKLLVPLALLFLLGMVIRD

SEQ ID NO: 351001 - protein, 38 aa, Mycobacterium
ASVGLSVLLWQYIVGLPLQWMVMSMAVIILLAVGADYN

SEQ ID NO: 351002 - protein, 26 aa, Mycobacterium
ASVGWLRLGALILALAGVAALLINRR

SEQ ID NO: 351003 - protein, 17 aa, Mycobacterium
ASVIAVIPLYIACLAVT

SEQ ID NO: 351004 - protein, 20 aa, Mycobacterium
ASVIAVIPLYVVCLAVSYLT

SEQ ID NO: 351005 - protein, 36 aa, Mycobacterium
ASVISWVSIVLIYVIVLYEIVDILPFPVGSLVGPAA

SEQ ID NO: 351006 - protein, 17 aa, Mycobacterium
ASVIWFYLVRNKSTNYL

SEQ ID NO: 351007 - protein, 30 aa, Mycobacterium; identical to SEQ ID NO: 161965

SEQ ID NO: 351008 - protein, 21 aa, Mycobacterium
ASVLILMLFDEVYGRWMLAAI

SEQ ID NO: 351009 - protein, 17 aa, Mycobacterium
ASVLIWQHLLHQDLHWS

SEQ ID NO: 351010 - protein, 24 aa, Mycobacterium
ASVNVGMAVSLYLGFRSGTKVFHD

SEQ ID NO: 351011 - protein, 32 aa, Mycobacterium
ASVNVGMVASLWFGYRAALKTLRDPLPEPETA

SEQ ID NO: 351012 - protein, 22 aa, Mycobacterium
ASVPPSVRRLPPPRIEPGPDHR

SEQ ID NO: 351013 - protein, 25 aa, Mycobacterium
ASVPVYWFGLLLIGAFAVTLGWLPT

SEQ ID NO: 351014 - protein, 25 aa, Mycobacterium
ASVSYFAPQLFSTDFTPLPPPDELD

SEQ ID NO: 351015 - protein, 31 aa, Mycobacterium
ASVVLSLYLGALLRLPRWLIDLSPVSRTTVP

SEQ ID NO: 351016 - protein, 21 aa, Mycobacterium
ASVVRWPVPILAASSAVVMIG

SEQ ID NO: 351017 - protein, 19 aa, Mycobacterium
ASVWIAWPPEVLSGALWSG

SEQ ID NO: 351018 - protein, 18 aa, Mycobacterium
ASVWMRLPATLAGIACWL

SEQ ID NO: 351019 - protein, 27 aa, Mycobacterium
ASWSTALIPLALLALAAAVAALAVRGW

SEQ ID NO: 351020 - protein, 17 aa, Mycobacterium
ASYLRFVWTVAATSMVV

SEQ ID NO: 351021 - protein, 18 aa, Mycobacterium
ASYMFNVYFQNGAPGSFV

SEQ ID NO: 351022 - protein, 29 aa, Mycobacterium
ASYSNETWRLWRFPWQAKSPGRETITVRA

SEQ ID NO: 351023 - protein, 20 aa, Mycobacterium
ASYVFPLPDRAAVTRMRVSV

SEQ ID NO: 351024 - protein, 31 aa, Mycobacterium
ATAAALLLFFWRDWLRILSGFFSSLRYRRIQ

SEQ ID NO: 351025 - protein, 24 aa, Mycobacterium
ATAAAWTVALTRPTDVREAASCNP

SEQ ID NO: 351026 - protein, 34 aa, Mycobacterium
ATAAFWVFLAFYVVCAFVTWFVFLRLQEHRAHSG

SEQ ID NO: 351027 - protein, 26 aa, Mycobacterium
ATAALLPVFFLLPISVAFQDRPALTA

SEQ ID NO: 351028 - protein, 26 aa, Mycobacterium
ATAARPLWFVCIALGLVILAVGFFST

SEQ ID NO: 351029 - protein, 26 aa, Mycobacterium
ATAASGLLLLLPLPLEARTVVALLCG

SEQ ID NO: 351030 - protein, 30 aa, Mycobacterium
ATAAWTMARFTGLPRRASTVGLVALVAAQL

SEQ ID NO: 351031 - protein, 19 aa, Mycobacterium
ATAFALQVWVNNSWVAAKC

SEQ ID NO: 351032 - protein, 17 aa, Mycobacterium
ATAFVYIGEICAYLLNQ

SEQ ID NO: 351033 - protein, 23 aa, Mycobacterium
ATAGLLQLFFGFAGIGRFYVGSN

SEQ ID NO: 351034 - protein, 24 aa, Mycobacterium
ATAKILIFSLLLGAGLPALFALGV

SEQ ID NO: 351035 - protein, 23 aa, Mycobacterium
ATALLGLLTYLASFGPKLSLDDA

SEQ ID NO: 351036 - protein, 31 aa, Mycobacterium
ATALLGLTVLVLLLAAWFHFVSPDNGPPRTR

SEQ ID NO: 351037 - protein, 22 aa, Mycobacterium
ATALLGLTVVVLLAAAWFHFVA

SEQ ID NO: 351038 - protein, 23 aa, Mycobacterium
ATALLVWAYLVWTYGRLVGRRIG

SEQ ID NO: 351039 - protein, 30 aa, Mycobacterium
ATAPTAFDGLLAPLLVFGAGVLQAVLIATL

SEQ ID NO: 351040 - protein, 21 aa, Mycobacterium
ATARTVALLLAGGAPIVIAVA

SEQ ID NO: 351041 - protein, 33 aa, Mycobacterium
ATASAALIWRRPRWGRRLQPGPVADLLTEGHAL

SEQ ID NO: 351042 - protein, 28 aa, Mycobacterium
ATASFGVAPLLLWQLATRHFTNITVETA

SEQ ID NO: 351043 - protein, 25 aa, Mycobacterium
ATATFLCCPVLSLVALILLGRSGGV

SEQ ID NO: 351044 - protein, 24 aa, Mycobacterium
ATAVATFAVWFVAGPAPTVTQALV

SEQ ID NO: 351045 - protein, 26 aa, Mycobacterium
ATAVLPRRPFSAPGGPPAPPARPGMP

SEQ ID NO: 351046 - protein, 24 aa, Mycobacterium
ATAVWVLSALWLVVLILAMLAHWL

SEQ ID NO: 351047 - protein, 37 aa, Mycobacterium
ATCVVLALTAPFDGWVRWLFTVLAAVVFVLTVVNRLV

SEQ ID NO: 351048 - protein, 29 aa, Mycobacterium
ATDIRLSQWFLLTAAFGSLFMVAGKRYAE

SEQ ID NO: 351049 - protein, 23 aa, Mycobacterium
ATDLITGWWRSDRLFCIAVGFLA

SEQ ID NO: 351050 - protein, 34 aa, Mycobacterium
ATDLKRLLPYLIPYRTRWIVIVVAATASLVATVG

SEQ ID NO: 351051 - protein, 22 aa, Mycobacterium
ATDPLIIPTIPNAGQPSPWDLG

SEQ ID NO: 351052 - protein, 25 aa, Mycobacterium
ATDYEVFLVSRIHEYWLASQAMRET

SEQ ID NO: 351053 - protein, 29 aa, Mycobacterium
ATEIPLSQWFLLSAAFASLFMVAGKRYAE

SEQ ID NO: 351054 - protein, 17 aa, Mycobacterium
ATELLLGPLARGTVVSL

SEQ ID NO: 351055 - protein, 32 aa, Mycobacterium
ATEPLVLAFVALIAFVMLLISIHSVLLALKGV

SEQ ID NO: 351056 - protein, 29 aa, Mycobacterium
ATETLMNIPLWIVLVLPVAKIVATSLSIG

SEQ ID NO: 351057 - protein, 18 aa, Mycobacterium
ATFAGWTLLAGNPVAGMT

SEQ ID NO: 351058 - protein, 26 aa, Mycobacterium
ATFCLSFTRLPYFQSLGVPLALGMLV

SEQ ID NO: 351059 - protein, 25 aa, Mycobacterium
ATFCLSFTRLPYFQTLGVPLAIGMV

SEQ ID NO: 351060 - protein, 17 aa, Mycobacterium
ATFGAGLMVGAHTHRHG

SEQ ID NO: 351061 - protein, 17 aa, Mycobacterium
ATFGFFYLGMQYVQQIM

SEQ ID NO: 351062 - protein, 21 aa, Mycobacterium
ATFILGMFWRRMTATAGWAGL

SEQ ID NO: 351063 - protein, 17 aa, Mycobacterium
ATFPAMFPTHVRYAGFA

SEQ ID NO: 351064 - protein, 37 aa, Mycobacterium
ATFRRYVATPARRARWLLWALISWPRVAKACGLSTSE

SEQ ID NO: 351065 - protein, 29 aa, Mycobacterium
ATFTVIIVMLLLVYRSIVTVLITLVMVVM

SEQ ID NO: 351066 - protein, 20 aa, Mycobacterium
ATFVDWRYLALAAGGGLIAF

SEQ ID NO: 351067 - protein, 25 aa, Mycobacterium
ATFVITAFALMRLCFAPATGMLIQR

SEQ ID NO: 351068 - protein, 21 aa, Mycobacterium
ATFVITAFAVMRLVGAPPAGF

SEQ ID NO: 351069 - protein, 25 aa, Mycobacterium
ATFVYLLVMLAIIEIPLISYLVHPG

SEQ ID NO: 351070 - protein, 21 aa, Mycobacterium
ATGAFLVVLVFAMSAGIREQS

SEQ ID NO: 351071 - protein, 24 aa, Mycobacterium
ATGFGFVVIILLLSGLNATLFQGA

SEQ ID NO: 351072 - protein, 24 aa, Mycobacterium
ATGFPILSAAFYPTAIRATGTSWA

SEQ ID NO: 351073 - protein, 17 aa, Mycobacterium
ATGFYRSAIDRVKVDVG

SEQ ID NO: 351074 - protein, 45 aa, Mycobacterium
ATGGGVSWPALLIVLGIIAVLIGILWIWSRRRRAKRRKAEFEAAK

SEQ ID NO: 351075 - protein, 24 aa, Mycobacterium
ATGGVVLLGLLAAIALVVARQIVQ

SEQ ID NO: 351076 - protein, 21 aa, Mycobacterium
ATGHFTAFIPPLLACIAYALA

SEQ ID NO: 351077 - protein, 27 aa, Mycobacterium
ATGIALWLPWLIVAGVVFILGSAAGLV

SEQ ID NO: 351078 - protein, 29 aa, Mycobacterium
ATGIPLSQWFLLSAAFASLFMVAGKRYAE

SEQ ID NO: 351079 - protein, 17 aa, Mycobacterium
ATGLSVTYRVATGALAG

SEQ ID NO: 351080 - protein, 24 aa, Mycobacterium
ATGPLPYIVMEYVDGITLRDIVKD

SEQ ID NO: 351081 - protein, 28 aa, Mycobacterium
ATGRWELSFGFLLVPLIALLAGGYHACK

SEQ ID NO: 351082 - protein, 23 aa, Mycobacterium
ATGVLLYASALAGPALAGVMLAF

SEQ ID NO: 351083 - protein, 17 aa, Mycobacterium
ATGVVVGIFWMGRRLVS

SEQ ID NO: 351084 - protein, 23 aa, Mycobacterium
ATGVWLLGGLLFLSATGITWSTY

SEQ ID NO: 351085 - protein, 24 aa, Mycobacterium
ATGWKVFTSVIFPSLMPALLSGAG

SEQ ID NO: 351086 - protein, 22 aa, Mycobacterium
ATGWVVLCGCALGFAFLTKMLQ

SEQ ID NO: 351087 - protein, 24 aa, Mycobacterium
ATHAILRRLTVLVVLVFAQAGVGT

SEQ ID NO: 351088 - protein, 25 aa, Mycobacterium
ATHPDAGLLIGNGFSYTAETCPDGK

SEQ ID NO: 351089 - protein, 20 aa, Mycobacterium
ATHPPGTPLLRLVRELRADR

SEQ ID NO: 351090 - protein, 22 aa, Mycobacterium
ATHTRMLASLWSEGARCMALED

SEQ ID NO: 351091 - protein, 27 aa, Mycobacterium
ATIFLAAWVPLFASFAALLVYPADGAG

SEQ ID NO: 351092 - protein, 26 aa, Mycobacterium
ATIGFGWTVLLLLAAFVVGLALAGSQ

SEQ ID NO: 351093 - protein, 28 aa, Mycobacterium
ATIGVLAPLILILLRLLQGFAAGGEWAG

SEQ ID NO: 351094 - protein, 36 aa, Mycobacterium
ATIIIVGVILVLLLRALLAPLYLLGTVVLNYLASLG

SEQ ID NO: 351095 - protein, 30 aa, Mycobacterium
ATIKGNLFWAFAYNVAALPLAAAGLLNPML

SEQ ID NO: 351096 - protein, 30 aa, Mycobacterium
ATIKGNLFWAFAYNVAALPLAVAGLLNPML

SEQ ID NO: 351097 - protein, 28 aa, Mycobacterium
ATILASVPWFLQDLGLYGIGIFTPTMLA

SEQ ID NO: 351098 - protein, 25 aa, Mycobacterium
ATITPVWLVLIHTVGWFPDGARLWL

SEQ ID NO: 351099 - protein, 19 aa, Mycobacterium
ATIVASFFFVGWFLYNSMP

SEQ ID NO: 351100 - protein, 22 aa, Mycobacterium
ATIVICQLRLYQWSRHGILKRG

SEQ ID NO: 351101 - protein, 20 aa, Mycobacterium
ATKAFGPWIGWIGGWGLAVS

SEQ ID NO: 351102 - protein, 28 aa, Mycobacterium
ATKAWAAVQALLNIALTANPIGLIIAAI

SEQ ID NO: 351103 - protein, 23 aa, Mycobacterium
ATKIAIAVLFFLYGTRLEPREAL

SEQ ID NO: 351104 - protein, 24 aa, Mycobacterium
ATKQTLFQWDALSHIPISDSPARC

SEQ ID NO: 351105 - protein, 19 aa, Mycobacterium
ATKTDLYPHWREIVNANIG

SEQ ID NO: 351106 - protein, 27 aa, Mycobacterium
ATKTPPPRLALMLLTALRSGMPPEQIR

SEQ ID NO: 351107 - protein, 24 aa, Mycobacterium
ATLAGCLPAMIWLACHRPNRRWWR

SEQ ID NO: 351108 - protein, 34 aa, Mycobacterium
ATLASVCIILIYLAYLMVTAPLLYRRFKGWPAQR

SEQ ID NO: 351109 - protein, 24 aa, Mycobacterium
ATLCLHFTRLPYFQTLGIPMAVGM

SEQ ID NO: 351110 - protein, 27 aa, Mycobacterium
ATLDGIFGIYALGLLPGLLIGGRASDA

SEQ ID NO: 351111 - protein, 26 aa, Mycobacterium
ATLGDWRWIFAVNVPIGLIGILFALR

SEQ ID NO: 351112 - protein, 22 aa, Mycobacterium
ATLGFPIRQPQLPGGWQANSGH

SEQ ID NO: 351113 - protein, 26 aa, Mycobacterium
ATLGLLIPVLAWPPSAPLLLIPVLLS

SEQ ID NO: 351114 - protein, 23 aa, Mycobacterium
ATLLLVTGWLVLLVAHSGYLRHP

SEQ ID NO: 351115 - protein, 19 aa, Mycobacterium
ATLLVYLLFVFTQTVRHRD

SEQ ID NO: 351116 - protein, 20 aa, Mycobacterium
ATLQACILPIYLITGGHDVE

SEQ ID NO: 351117 - protein, 24 aa, Mycobacterium
ATLSLVFAFVFAPVGAILGHAGLA

SEQ ID NO: 351118 - protein, 27 aa, Mycobacterium
ATLSRPAAAPVPYLTPAAEVPAGLHEM

SEQ ID NO: 351119 - protein, 60 aa, Mycobacterium
ATLTGCLAAVIWWACHRPNRLWWRFTAWWLLCGALAVTWWVVALLMLGRISPPFLDFIES

SEQ ID NO: 351120 - protein, 24 aa, Mycobacterium
ATLTYLWLPYMVIPVYAAFERIPD

SEQ ID NO: 351121 - protein, 23 aa, Mycobacterium
ATLVAVAAYRLAGLGPTALVATG

SEQ ID NO: 351122 - protein, 20 aa, Mycobacterium
ATLVQIIRWLRPGAVIAIAK

SEQ ID NO: 351123 - protein, 26 aa, Mycobacterium
ATLVSRLTGFARIVLLAAILGAALSS

SEQ ID NO: 351124 - protein, 29 aa, Mycobacterium
ATLVTPLWTAGILILRRYYRATYALIPVA

SEQ ID NO: 351125 - protein, 23 aa, Mycobacterium
ATMLTLAYFPPLWRKVMDHRVLD

SEQ ID NO: 351126 - protein, 17 aa, Mycobacterium
ATMLYGCYAMFGLSLLA

SEQ ID NO: 351127 - protein, 21 aa, Mycobacterium
ATMMFLFLLVVTYYQVRVMDR

SEQ ID NO: 351128 - protein, 22 aa, Mycobacterium
ATMPPLWVIVSCALAMAGGTYL

SEQ ID NO: 351129 - protein, 24 aa, Mycobacterium
ATMPPLWVIVSCAVAMAGGTYLGG

SEQ ID NO: 351130 - protein, 30 aa, Mycobacterium
ATMRNIRENLFFALIYNAIGIPLAAGVLYP

SEQ ID NO: 351131 - protein, 51 aa, Mycobacterium
ATMRNIRQNLFFALIYNAIGIPLAAGVLYPLLGLRLSPMIAAGAMALSSLS

SEQ ID NO: 351132 - protein, 18 aa, Mycobacterium
ATMVVTIPVAWLLHRFTR

SEQ ID NO: 351133 - protein, 23 aa, Mycobacterium
ATNFDAGFFGIPPSEVLAMDPQQ

SEQ ID NO: 351134 - protein, 25 aa, Mycobacterium
ATNPGLLLPIIAVAIALVAMTAAVF

SEQ ID NO: 351135 - protein, 24 aa, Mycobacterium
ATNQLYVLLSGQLHPVYNLTSARL

SEQ ID NO: 351136 - protein, 17 aa, Mycobacterium
ATNWLLGSVVFIVASWP

SEQ ID NO: 351137 - protein, 24 aa, Mycobacterium
ATPADLLLALFKAAAYGAIVAVIA

SEQ ID NO: 351138 - protein, 22 aa, Mycobacterium
ATPATQLLLGPVARGSAVSFVK

SEQ ID NO: 351139 - protein, 24 aa, Mycobacterium
ATPIAFLLFAFFGGFAVMLGAEFN

SEQ ID NO: 351140 - protein, 27 aa, Mycobacterium
ATPIIRLGHMLVFFVRALLGIPVAISH

SEQ ID NO: 351141 - protein, 23 aa, Mycobacterium
ATPIWELLVTFAIFGAGFAMVNA

SEQ ID NO: 351142 - protein, 23 aa, Mycobacterium
ATPLPPPRRPVFSRGSWAETRRV

SEQ ID NO: 351143 - protein, 31 aa, Mycobacterium
ATQPLVLAFVALIAFVMLLVSVHSMFLALKG

SEQ ID NO: 351144 - protein, 26 aa, Mycobacterium
ATQPVDLPFTGLNFPAGVTVDLSGNV

SEQ ID NO: 351145 - protein, 25 aa, Mycobacterium
ATQRRLRDTLLRFGGYPVDAMPTAH

SEQ ID NO: 351146 - protein, 18 aa, Mycobacterium
ATQYLQFVAAYRAFDTGV

SEQ ID NO: 351147 - protein, 24 aa, Mycobacterium
ATRALVQLLLVGGALTLLFAPGRS

SEQ ID NO: 351148 - protein, 25 aa, Mycobacterium
ATRAPELLPLLPDGYVAELQSCVVE

SEQ ID NO: 351149 - protein, 25 aa, Mycobacterium
ATRAQGPGWMRFPIGVYADTGETVW

SEQ ID NO: 351150 - protein, 20 aa, Mycobacterium
ATRFVAAFVYAGFWAVGAST

SEQ ID NO: 351151 - protein, 26 aa, Mycobacterium
ATRIASHMPLLLGLAFALLVARERVG

SEQ ID NO: 351152 - protein, 24 aa, Mycobacterium
ATRIGFPSLLFFLLVGVVLGEDGL

SEQ ID NO: 351153 - protein, 25 aa, Mycobacterium
ATRKSWAVLYLLIAAAAGALPGIWA

SEQ ID NO: 351154 - protein, 26 aa, Mycobacterium
ATRPSTFLWLIAVTGTLLVINHRMDP

SEQ ID NO: 351155 - protein, 24 aa, Mycobacterium
ATRQIPFWTFLRNSVIITSVLAVV

SEQ ID NO: 351156 - protein, 25 aa, Mycobacterium
ATRSPVFLAFPAMTVASLVVTAVTG

SEQ ID NO: 351157 - protein, 20 aa, Mycobacterium
ATRWYLAVPLIITLGLLNFS

SEQ ID NO: 351158 - protein, 19 aa, Mycobacterium
ATRYMLMRQIKPGSVVLFH

SEQ ID NO: 351159 - protein, 30 aa, Mycobacterium
ATSFMVVQAALLILLSRLSANSDVAVGFPI

SEQ ID NO: 351160 - protein, 20 aa, Mycobacterium
ATSFVPTWNAASRPPIRSLT

SEQ ID NO: 351161 - protein, 21 aa, Mycobacterium
ATSLFVATWVFILNTVVRDAS

SEQ ID NO: 351162 - protein, 23 aa, Mycobacterium
ATSLLTALVYVHFHMETHGALMP

SEQ ID NO: 351163 - protein, 33 aa, Mycobacterium
ATSPRDKSPKGRKLWIAALVAIVGVIVLTAAAV

SEQ ID NO: 351164 - protein, 29 aa, Mycobacterium
ATSSLSLRWRVMLLAMSMVAMVVVLMAFA

SEQ ID NO: 351165 - protein, 25 aa, Mycobacterium
ATSVGPWFPLAFLGAHILVTVFPFP

SEQ ID NO: 351166 - protein, 26 aa, Mycobacterium
ATSVGPWFPLAFLVVHIVVTVPPFPR

SEQ ID NO: 351167 - protein, 22 aa, Mycobacterium
ATSVVWWGWRERRDLFSGFGWL

SEQ ID NO: 351168 - protein, 25 aa, Mycobacterium
ATTAGLRLILFPPLIVIAYEMFAHP

SEQ ID NO: 351169 - protein, 20 aa, Mycobacterium
ATTAMLIDLARRPASQIRGS

SEQ ID NO: 351170 - protein, 21 aa, Mycobacterium
ATTFITLAIFLGVGTGGVFAW

SEQ ID NO: 351171 - protein, 27 aa, Mycobacterium
ATTGAPPWLLIIPALLTAGCAIPATYL

SEQ ID NO: 351172 - protein, 23 aa, Mycobacterium
ATTGFWLAPLLLSVPVFSRDTYS

SEQ ID NO: 351173 - protein, 26 aa, Mycobacterium
ATTGLFLIITAIISLAFALASWGMSE

SEQ ID NO: 351174 - protein, 19 aa, Mycobacterium
ATTGWAPPLAWSAADESDE

SEQ ID NO: 351175 - protein, 17 aa, Mycobacterium
ATTILFPAAVAALVYAL

SEQ ID NO: 351176 - protein, 24 aa, Mycobacterium
ATTLLVYWFETLAGSLFVAARILV

SEQ ID NO: 351177 - protein, 26 aa, Mycobacterium
ATTLTLSYNTITLPSWTAGSRQVSCN

SEQ ID NO: 351178 - protein, 18 aa, Mycobacterium
ATTPIEWMALRAIAGAVS

SEQ ID NO: 351179 - protein, 17 aa, Mycobacterium
ATTVALIALWRLDRLDG

SEQ ID NO: 351180 - protein, 26 aa, Mycobacterium
ATTVGLTFLLLSFAKMGVFRTVGVAA

SEQ ID NO: 351181 - protein, 24 aa, Mycobacterium
ATTVTIAAWPRAPLPGRPRAAPGP

SEQ ID NO: 351182 - protein, 25 aa, Mycobacterium
ATVCLIFAIMLLITRSLVAAMVIVG

SEQ ID NO: 351183 - protein, 45 aa, Mycobacterium
ATVDGLVLTIGFLLPWIPVLGVLVLAVVWVLRRKIFSRASRVGHG

SEQ ID NO: 351184 - protein, 25 aa, Mycobacterium
ATVEPIYYPRYLILTAPGAAVILAI

SEQ ID NO: 351185 - protein, 19 aa, Mycobacterium
ATVFAVLAIVFLPSTPPQH

SEQ ID NO: 351186 - protein, 23 aa, Mycobacterium
ATVFGFVVLVLLLSGLNATVFEG

SEQ ID NO: 351187 - protein, 20 aa, Mycobacterium
ATVFLPFVFGYEVGNLVIQW

SEQ ID NO: 351188 - protein, 25 aa, Mycobacterium
ATVGITFLLISFARMGVFKTVGASA

SEQ ID NO: 351189 - protein, 20 aa, Mycobacterium
ATVHVFYNLLLLASYQLGEF

SEQ ID NO: 351190 - protein, 24 aa, Mycobacterium
ATVIDLALVRPLPQLAKSLPLPDA

SEQ ID NO: 351191 - protein, 24 aa, Mycobacterium
ATVIIALLALIIVDITILTTMALA

SEQ ID NO: 351192 - protein, 22 aa, Mycobacterium
ATVIRWVLVGRLLDIPPRTLAR

SEQ ID NO: 351193 - protein, 37 aa, Mycobacterium
ATVLFFASFAVALVPLVWLLWVVIERGWYAVVQPDWW

SEQ ID NO: 351194 - protein, 17 aa, Mycobacterium
ATVLFLEAALLVLAAAG

SEQ ID NO: 351195 - protein, 19 aa, Mycobacterium
ATVLVIALIVAVAVGLFRG

SEQ ID NO: 351196 - protein, 19 aa, Mycobacterium
ATVLVLMGGVWTALYLSGP

SEQ ID NO: 351197 - protein, 26 aa, Mycobacterium
ATVPSWLQPLIQSSPPVFAAADPAAI

SEQ ID NO: 351198 - protein, 27 aa, Mycobacterium
ATVPVQFVAGWPFLKEAVQRARELTSN

SEQ ID NO: 351199 - protein, 36 aa, Mycobacterium
ATVRRRRLRRRATAALLLLSGLVMAGGLAATLTPQP

SEQ ID NO: 351200 - protein, 22 aa, Mycobacterium
ATVRVWPTPLDATVTVLCSKLT

SEQ ID NO: 351201 - protein, 18 aa, Mycobacterium
ATVRWPGPIFVASLLIAL

SEQ ID NO: 351202 - protein, 25 aa, Mycobacterium
ATVSLSAWFVLVNVVLAVVTVGLLH

SEQ ID NO: 351203 - protein, 24 aa, Mycobacterium
ATVTALLLLGWRAVAGLALRRRTG

SEQ ID NO: 351204 - protein, 30 aa, Mycobacterium
ATVTFGCLLMWILAWLTATPVRVVRAALRR

SEQ ID NO: 351205 - protein, 21 aa, Mycobacterium
ATVVFLIAVLLLMCYENYWNL

SEQ ID NO: 351206 - protein, 18 aa, Mycobacterium
ATVVIGWFAFQTGLTGAT

SEQ ID NO: 351207 - protein, 19 aa, Mycobacterium
ATVVITSVLVWLLPPRRSV

SEQ ID NO: 351208 - protein, 19 aa, Mycobacterium
ATVVLFGIAAVLATMLVGG

SEQ ID NO: 351209 - protein, 19 aa, Mycobacterium
ATVVLFVVLRRRRTRLGAG

SEQ ID NO: 351210 - protein, 27 aa, Mycobacterium
ATVVLGWRLVGFLWATVAGAVAWLIML

SEQ ID NO: 351211 - protein, 23 aa, Mycobacterium
ATVVSVLAPKWLASTIGLAPDDD

SEQ ID NO: 351212 - protein, 17 aa, Mycobacterium
ATVYMLKTQIKPGSVVL

SEQ ID NO: 351213 - protein, 17 aa, Mycobacterium
ATWAIVTGKSAGGIFNP

SEQ ID NO: 351214 - protein, 23 aa, Mycobacterium
ATWNNFHNLYWPAEYLIDANGQV

SEQ ID NO: 351215 - protein, 19 aa, Mycobacterium
ATWQAPAYTPPAEYPQYQQ

SEQ ID NO: 351216 - protein, 25 aa, Mycobacterium
ATYCLSFARLPYFSTMGAPVAIGMI

SEQ ID NO: 351217 - protein, 21 aa, Mycobacterium
ATYFHFWRVFEGIPQWALALF

SEQ ID NO: 351218 - protein, 20 aa, Mycobacterium
ATYIVLFTIYGAVLEASGAS

SEQ ID NO: 351219 - protein, 17 aa, Mycobacterium
ATYTLLGVVALGVAVVG

SEQ ID NO: 351220 - protein, 20 aa, Mycobacterium
AVAAALWVLAWVLGKTWVVV

SEQ ID NO: 351221 - protein, 29 aa, Mycobacterium
AVAAFAFVFCVILILLRSLVAAIVVIGTV

SEQ ID NO: 351222 - protein, 28 aa, Mycobacterium
AVAAFSRALVLVTVAIILGICVASMLIA

SEQ ID NO: 351223 - protein, 23 aa, Mycobacterium
AVAAIFFVWTYLRPIAVADDDQE

SEQ ID NO: 351224 - protein, 18 aa, Mycobacterium
AVAALPRLQSGKACGHAA

SEQ ID NO: 351225 - protein, 21 aa, Mycobacterium
AVAAVWTFLKIAGPIMAGIAE

SEQ ID NO: 351226 - protein, 27 aa, Mycobacterium
AVAAYPFVFVPLLVLLGVALVASARYE

SEQ ID NO: 351227 - protein, 39 aa, Mycobacterium
AVADRMRFLPWIAFTALWATLVYFPVAHWIFAVEGTTAD

SEQ ID NO: 351228 - protein, 27 aa, Mycobacterium
AVADTRAWLIHEMIIVAAVGISCLALE

SEQ ID NO: 351229 - protein, 22 aa, Mycobacterium
AVADYPAVLLNGSWLSQEQTTA

SEQ ID NO: 351230 - protein, 21 aa, Mycobacterium
AVAELLISELVLRKHLSEPVD

SEQ ID NO: 351231 - protein, 46 aa, Mycobacterium
AVAFGAGLFVAFDQLWKWNTIVALVLGVLVILGLAGGVRVVRKTED

SEQ ID NO: 351232 - protein, 22 aa, Mycobacterium
AVAFGLWVWFFHGSQYGLEFYA

SEQ ID NO: 351233 - protein, 24 aa, Mycobacterium
AVAFVLALLLREVPLRDIHNSAVD

SEQ ID NO: 351234 - protein, 19 aa, Mycobacterium
AVAFWVLGALALVGAIGVV

SEQ ID NO: 351235 - protein, 34 aa, Mycobacterium
AVAGILSGYLLARGAIRTPTPRPAPAYEWHAMSA

SEQ ID NO: 351236 - protein, 34 aa, Mycobacterium
AVAGITLAICVVSMLLAKLLVRPIRRLEAGTERI

SEQ ID NO: 351237 - protein, 25 aa, Mycobacterium
AVAGVSIFKLVRYLAREYLLIVSTS

SEQ ID NO: 351238 - protein, 20 aa, Mycobacterium
AVAIGLFVLPLSGPLHMAAV

SEQ ID NO: 351239 - protein, 24 aa, Mycobacterium
AVAIGLFVMPLSGAWLTGAWVIMA

SEQ ID NO: 351240 - protein, 24 aa, Mycobacterium
AVAILLTPVLIRLFTRQGFGHEIR

SEQ ID NO: 351241 - protein, 26 aa, Mycobacterium
AVAIVFAVLLFPADPMTVLRTARVGV

SEQ ID NO: 351242 - protein, 21 aa, Mycobacterium
AVAIVGVLWVLFGFSMVFGTS

SEQ ID NO: 351243 - protein, 20 aa, Mycobacterium
AVAKLFLFDLATLDGVARIG

SEQ ID NO: 351244 - protein, 18 aa, Mycobacterium
AVALATVMLSRRGRQGIT

SEQ ID NO: 351245 - protein, 25 aa, Mycobacterium
AVALITIRMAALYRVLVRTGTGRYL

SEQ ID NO: 351246 - protein, 20 aa, Mycobacterium
AVALLFAMRALRLVWQAWAR

SEQ ID NO: 351247 - protein, 21 aa, Mycobacterium
AVALPLTFPSLGEMAEKHPLA

SEQ ID NO: 351248 - protein, 18 aa, Mycobacterium
AVALTIPGIATPVAWAQA

SEQ ID NO: 351249 - protein, 28 aa, Mycobacterium
AVALTVSILLTPALIRLFTRQGFGHHTR

SEQ ID NO: 351250 - protein, 28 aa, Mycobacterium
AVALTVSLVPPPWYHRPAPMNVAAGSLP

SEQ ID NO: 351251 - protein, 27 aa, Mycobacterium
AVALVSVLQLFLTYLRGQQANSHSGRA

SEQ ID NO: 351252 - protein, 19 aa, Mycobacterium
AVALWQWRAHRGPVLVTAL

SEQ ID NO: 351253 - protein, 32 aa, Mycobacterium
AVAMIVLLPTAIWWFLIRPWVRERRITLDGLM

SEQ ID NO: 351254 - protein, 20 aa, Mycobacterium
AVANLMWFVFAGFGALTLET

SEQ ID NO: 351255 - protein, 27 aa, Mycobacterium
AVANMIQPFWLLPLLAIAKLNVRQVMG

SEQ ID NO: 351256 - protein, 27 aa, Mycobacterium
AVANMIQPFWPLPLLAIAKLNVRQVMG

SEQ ID NO: 351257 - protein, 32 aa, Mycobacterium
AVAQLIFEGYRWQLIPAYVLAAAIGAWEVVSI

SEQ ID NO: 351258 - protein, 38 aa, Mycobacterium
AVAQLLHPLLHLAGIPDALLHLLSFGIALSIVVMLHVL

SEQ ID NO: 351259 - protein, 26 aa, Mycobacterium
AVARTRRGLRALLSLVPDQATVLRDG

SEQ ID NO: 351260 - protein, 35 aa, Mycobacterium
AVARWPGPILVAALGLTLLAALPLAGMRVGFNEPA

SEQ ID NO: 351261 - protein, 25 aa, Mycobacterium
AVASLPVLRWSWTPALLAGALATLM

SEQ ID NO: 351262 - protein, 19 aa, Mycobacterium
AVATFAMLLGVSALPLAIV

SEQ ID NO: 351263 - protein, 18 aa, Mycobacterium
AVATILVGWWTKTIDRAK

SEQ ID NO: 351264 - protein, 23 aa, Mycobacterium
AVATLILIWRLIRRDSVQPAISG

SEQ ID NO: 351265 - protein, 24 aa, Mycobacterium
AVATLYRNRFSGGAIALLILAVLV

SEQ ID NO: 351266 - protein, 28 aa, Mycobacterium
AVATMSPWLFGWFALFCTATAIAIPVVE

SEQ ID NO: 351267 - protein, 27 aa, Mycobacterium
AVATTSRAYAFLVPSTIKSVNAGQVDS

SEQ ID NO: 351268 - protein, 22 aa, Mycobacterium
AVATVGLWLESLWIGAVYTYPW

SEQ ID NO: 351269 - protein, 24 aa, Mycobacterium
AVATVLLIVGLVLSVKSVVGTHHN

SEQ ID NO: 351270 - protein, 23 aa, Mycobacterium
AVATVTCCLLWFDNPHPPARPEP

SEQ ID NO: 351271 - protein, 17 aa, Mycobacterium
AVAVAVALVLWWRMVRF

SEQ ID NO: 351272 - protein, 24 aa, Mycobacterium
AVAVEFALLSWLFSAELRPRPVPE

SEQ ID NO: 351273 - protein, 33 aa, Mycobacterium
AVAVEIAMLVAFLYLPPLARLLGQTGPSWIGFL

SEQ ID NO: 351274 - protein, 24 aa, Mycobacterium
AVAVFFALSGFLLWRGHAAAARGG

SEQ ID NO: 351275 - protein, 24 aa, Mycobacterium
AVAVFFALSGFLLWRGHAAAARGL

SEQ ID NO: 351276 - protein, 18 aa, Mycobacterium
AVAVGALVTLGPLALLQS

SEQ ID NO: 351277 - protein, 18 aa, Mycobacterium
AVAVLYAAVRRAAGWHAA

SEQ ID NO: 351278 - protein, 18 aa, Mycobacterium
AVAVPRLAVLPRTRQTLL

SEQ ID NO: 351279 - protein, 23 aa, Mycobacterium
AVAVQFFYLFIAQVSHHLAIADL

SEQ ID NO: 351280 - protein, 30 aa, Mycobacterium
AVAVSALAALTLSWYLSHRVHRSATALSQA

SEQ ID NO: 351281 - protein, 22 aa, Mycobacterium
AVAVVLMPLLGWAKRRLGTRLE

SEQ ID NO: 351282 - protein, 18 aa, Mycobacterium
AVAVVYWLARWRGRDLLA

SEQ ID NO: 351283 - protein, 23 aa, Mycobacterium
AVAWYGIQTFLASAALDIVLVKL

SEQ ID NO: 351284 - protein, 18 aa, Mycobacterium
AVAWYGIQTYLASTAFVL

SEQ ID NO: 351285 - protein, 18 aa, Mycobacterium
AVAYFWMHQPMALWPVAD

SEQ ID NO: 351286 - protein, 24 aa, Mycobacterium
AVAYLMVLPVIILVGWDSLPERSR

SEQ ID NO: 351287 - protein, 18 aa, Mycobacterium
AVAYSLTMLMQAISYITS

SEQ ID NO: 351288 - protein, 18 aa, Mycobacterium
AVAYWYLDALGVAGEPAP

SEQ ID NO: 351289 - protein, 17 aa, Mycobacterium
AVCAAFILWNRMIRFEY

SEQ ID NO: 351290 - protein, 20 aa, Mycobacterium
AVCDLAEQPAFRAVLIRVAD

SEQ ID NO: 351291 - protein, 23 aa, Mycobacterium
AVCLFVLMLAMFPANVYAARMPD

SEQ ID NO: 351292 - protein, 22 aa, Mycobacterium
AVDALMHQLVGPWLGVLAPEHV

SEQ ID NO: 351293 - protein, 45 aa, Mycobacterium
AVDATIVRLIMVPALMAMFSQWNWWLPRWLGRILPSVDFDRPLPE

SEQ ID NO: 351294 - protein, 48 aa, Mycobacterium
AVDATIVRLVLVPALMAMFDEWNWWLPRWLDRLLPSVDFEKPLPKADI

SEQ ID NO: 351295 - protein, 47 aa, Mycobacterium
AVDATVVRLVLVPALMAMFAQWNWWLPPWLSRILPSVDFDRPLPAVD

SEQ ID NO: 351296 - protein, 43 aa, Mycobacterium
AVDATVVRLVLVPALMAMFDKRNWWLPGWLDHVLPTVDFETPC

SEQ ID NO: 351297 - protein, 43 aa, Mycobacterium
AVDATVVRLVLVPALMAMFDQWNWWLPRWLDKILPEVDFEKPL

SEQ ID NO: 351298 - protein, 20 aa, Mycobacterium
AVDDFLRPIKNYYYWEPHCA

SEQ ID NO: 351299 - protein, 17 aa, Mycobacterium
AVDLAWALWVAGTLGGL

SEQ ID NO: 351300 - protein, 30 aa, Mycobacterium
AVDRFAPIIGGIRPGLYVASNFLPGSPGYT

SEQ ID NO: 351301 - protein, 19 aa, Mycobacterium
AVDSLRWVAIAWLISAVCL

SEQ ID NO: 351302 - protein, 27 aa, Mycobacterium
AVEAGDEFWLLLSGRELPARDRRVLGA

SEQ ID NO: 351303 - protein, 25 aa, Mycobacterium
AVEEQFFIVWPVLILGITAIAVRKA

SEQ ID NO: 351304 - protein, 24 aa, Mycobacterium
AVEWYDFYLYAAMASIVFATVFFP

SEQ ID NO: 351305 - protein, 25 aa, Mycobacterium
AVEYALGVFFLAYGGVVYWLAGLDD

SEQ ID NO: 351306 - protein, 32 aa, Mycobacterium
AVEYLFIVCATVLSWLRLFAVGRVEPAGDAAW

SEQ ID NO: 351307 - protein, 21 aa, Mycobacterium
AVFAGLTWWAAFGLDSPSLVV

SEQ ID NO: 351308 - protein, 22 aa, Mycobacterium
AVFALGFLARPLGGIIFGHFGD

SEQ ID NO: 351309 - protein, 25 aa, Mycobacterium
AVFALSFFARPIGGLILGPLADRIG

SEQ ID NO: 351310 - protein, 27 aa, Mycobacterium
AVFARNPLKWIYLTIAVLAVASMAETY

SEQ ID NO: 351311 - protein, 24 aa, Mycobacterium
AVFFAVMFCFFQVVFTVAAPLQDR

SEQ ID NO: 351312 - protein, 27 aa, Mycobacterium
AVFFGRFIALLRIFAGPLAGALKMHYP

SEQ ID NO: 351313 - protein, 22 aa, Mycobacterium
AVFFGVALLLGTPPSAGFLFAV

SEQ ID NO: 351314 - protein, 22 aa, Mycobacterium
AVFFPVWMMLQIVLGRQSDAPS

SEQ ID NO: 351315 - protein, 34 aa, Mycobacterium
AVFFYAAPVFFVAILLKLFFSVKLGWLPASGRST

SEQ ID NO: 351316 - protein, 24 aa, Mycobacterium
AVFGWQVLPFLIIQGLFGASLLES

SEQ ID NO: 351317 - protein, 25 aa, Mycobacterium
AVFHGFPLGLYLIATVTALILCLAA

SEQ ID NO: 351318 - protein, 20 aa, Mycobacterium
AVFIALITKGAFTAAMILVI

SEQ ID NO: 351319 - protein, 23 aa, Mycobacterium
AVFIILGWLAITVLLTVKVPPLE

SEQ ID NO: 351320 - protein, 21 aa, Mycobacterium
AVFLGSKLWHSMSGSTSDYAG

SEQ ID NO: 351321 - protein, 20 aa, Mycobacterium
AVFMLLLDMTIVSSALADLQ

SEQ ID NO: 351322 - protein, 23 aa, Mycobacterium
AVFSGLLWWIAFGMRDRLLVVAT

SEQ ID NO: 351323 - protein, 18 aa, Mycobacterium
AVFVLIPAGILGGLYCGH

SEQ ID NO: 351324 - protein, 22 aa, Mycobacterium
AVFVLIVLPPLLALCGKRLFWP

SEQ ID NO: 351325 - protein, 19 aa, Mycobacterium
AVFVVIVLNGLFAFAQEQR

SEQ ID NO: 351326 - protein, 19 aa, Mycobacterium
AVFVVVMFFVLRRAVIRQA

SEQ ID NO: 351327 - protein, 24 aa, Mycobacterium
AVGADYNLLLALRIKQEAAAGLRT

SEQ ID NO: 351328 - protein, 27 aa, Mycobacterium
AVGAGRPILRRLAVLLALVFAQALVGI

SEQ ID NO: 351329 - protein, 24 aa, Mycobacterium
AVGALALIAVLLRAATSSAHESLI

SEQ ID NO: 351330 - protein, 26 aa, Mycobacterium
AVGALVGLLLAVWVVSTRGLLHDRAV

SEQ ID NO: 351331 - protein, 26 aa, Mycobacterium
AVGATALYCLHLEQAAYVGLAAGNIA

SEQ ID NO: 351332 - protein, 26 aa, Mycobacterium
AVGAVGMVLMAIWFHVWQDDVRDLMG

SEQ ID NO: 351333 - protein, 24 aa, Mycobacterium
AVGAVLLTIAWVVVICAMFVRGGP

SEQ ID NO: 351334 - protein, 32 aa, Mycobacterium
AVGDAVLTALWAWILFAAGVGGGLILLHRRFD

SEQ ID NO: 351335 - protein, 26 aa, Mycobacterium
AVGDFLLAIPWWEPSFVGGLAAFLVA

SEQ ID NO: 351336 - protein, 20 aa, Mycobacterium
AVGDNFVWAYQRAEALAADV

SEQ ID NO: 351337 - protein, 20 aa, Mycobacterium
AVGDNFVWAYQRAEALAAEV

SEQ ID NO: 351338 - protein, 24 aa, Mycobacterium
AVGDNFVWAYQRAKALAQEVARVF

SEQ ID NO: 351339 - protein, 19 aa, Mycobacterium
AVGFAFFPPAGVTVAAMLL

SEQ ID NO: 351340 - protein, 17 aa, Mycobacterium
AVGFLGEIVRRCVVAAV

SEQ ID NO: 351341 - protein, 22 aa, Mycobacterium
AVGFLIGSRRRRKTPAAVLADD

SEQ ID NO: 351342 - protein, 17 aa, Mycobacterium
AVGFPVGLILLTELHRA

SEQ ID NO: 351343 - protein, 35 aa, Mycobacterium
AVGFRSARWWRRGVSLLAIPLTLLAALVALNTWVG

SEQ ID NO: 351344 - protein, 29 aa, Mycobacterium
AVGGGGLGLIILLGALFLGVDPGRVMNQP

SEQ ID NO: 351345 - protein, 23 aa, Mycobacterium
AVGGLIGAALWFTRPPSKVHQHP

SEQ ID NO: 351346 - protein, 25 aa, Mycobacterium
AVGIALWLPWLIAAGVTFVLASVAG

SEQ ID NO: 351347 - protein, 20 aa, Mycobacterium
AVGILFLGYDLTQPLLAGIV

SEQ ID NO: 351348 - protein, 17 aa, Mycobacterium
AVGIPLLLILGCASGLC

SEQ ID NO: 351349 - protein, 22 aa, Mycobacterium
AVGLAAITLLAFVVVVQPSPSV

SEQ ID NO: 351350 - protein, 24 aa, Mycobacterium
AVGLFAFLPLALYSALVAGKAAKQ

SEQ ID NO: 351351 - protein, 18 aa, Mycobacterium
AVGLGCGALIGIERQWRA

SEQ ID NO: 351352 - protein, 26 aa, Mycobacterium
AVGLIFTFAVYPLTIIWPSGWSWGHG

SEQ ID NO: 351353 - protein, 21 aa, Mycobacterium
AVGLSMIGLLALPGYRTNYND

SEQ ID NO: 351354 - protein, 34 aa, Mycobacterium
AVGLSTRAYLGAKITVFCMFAITQAAITTGVVLL

SEQ ID NO: 351355 - protein, 18 aa, Mycobacterium
AVGLSTWAYLSAKVSVFC

SEQ ID NO: 351356 - protein, 25 aa, Mycobacterium
AVGMAMWLPWLIVAGVCFILTTVSG

SEQ ID NO: 351357 - protein, 21 aa, Mycobacterium
AVGQIISGLLLLFEQPFQLGD

SEQ ID NO: 351358 - protein, 28 aa, Mycobacterium
AVGRRTWRWHLIWLPAAAAVGAVLALGT

SEQ ID NO: 351359 - protein, 26 aa, Mycobacterium
AVGSLITWVLIERAITSRRLTPAALA

SEQ ID NO: 351360 - protein, 30 aa, Mycobacterium
AVGTAGAALFLWAFAFGPPPPPGPGGGGPS

SEQ ID NO: 351361 - protein, 21 aa, Mycobacterium
AVGVALRQPWIGWLAVASVVL

SEQ ID NO: 351362 - protein, 26 aa, Mycobacterium
AVGVAYAGIWWPGGVVRWVAADGLGA

SEQ ID NO: 351363 - protein, 17 aa, Mycobacterium
AVGVGCGALIGLERQWR

SEQ ID NO: 351364 - protein, 24 aa, Mycobacterium
AVGVPSVLLYRVLTCWLPVFAGWP

SEQ ID NO: 351365 - protein, 25 aa, Mycobacterium
AVGVTAIAFILWYTCVRGLGTGRAG

SEQ ID NO: 351366 - protein, 21 aa, Mycobacterium
AVGVVLMIIDAIRDRHAGALD

SEQ ID NO: 351367 - protein, 24 aa, Mycobacterium
AVGWVSVLPLLLVSGAVPLTGVAV

SEQ ID NO: 351368 - protein, 17 aa, Mycobacterium
AVGWWVIQRNYYVTEYD

SEQ ID NO: 351369 - protein, 24 aa, Mycobacterium
AVGYNVIALPIAAGVFVPSLGLVL

SEQ ID NO: 351370 - protein, 24 aa, Mycobacterium
AVGYTLVFGVLRLINFAHSEVFML

SEQ ID NO: 351371 - protein, 27 aa, Mycobacterium
AVHAWKAPGVLDPIVSLPGPGWPELRT

SEQ ID NO: 351372 - protein, 23 aa, Mycobacterium
AVHGAYYLVMHGWFALFPPTEFF

SEQ ID NO: 351373 - protein, 28 aa, Mycobacterium
AVHGLYYLLMHGWFQVFPATEFWTRAPS

SEQ ID NO: 351374 - protein, 25 aa, Mycobacterium
AVHHRFWFRSTQFVLRHALPVGLAG

SEQ ID NO: 351375 - protein, 17 aa, Mycobacterium
AVHLPATGHRHGDAGTA

SEQ ID NO: 351376 - protein, 28 aa, Mycobacterium
AVHLRRALVLYCFTLPFAMVETFGWTTI

SEQ ID NO: 351377 - protein, 19 aa, Mycobacterium
AVHNFGFFTLPRLDTDLVV

SEQ ID NO: 351378 - protein, 46 aa, Mycobacterium
AVHQEAALTWLLLVSVPILALANYWIMTHMLPLFRSMQALIDGINR

SEQ ID NO: 351379 - protein, 35 aa, Mycobacterium
AVHQNPDRWAWLWSLLVFLAVASSVVALIWFGVSR

SEQ ID NO: 351380 - protein, 27 aa, Mycobacterium
AVHTMLFAQFWLELKLLLRNGEQLLLT

SEQ ID NO: 351381 - protein, 24 aa, Mycobacterium
AVHVGWPWAALAAGPVLLAAGAVA

SEQ ID NO: 351382 - protein, 22 aa, Mycobacterium
AVIAALLLVSWRRVSGRWSKSG

SEQ ID NO: 351383 - protein, 25 aa, Mycobacterium
AVIAFMICRHLPWVPAPALPRGPAS

SEQ ID NO: 351384 - protein, 21 aa, Mycobacterium
AVIALLIFAGLFVAGAALPGP

SEQ ID NO: 351385 - protein, 32 aa, Mycobacterium
AVIALMLAITYRSLWTVLFTLLTVGIELITVR

SEQ ID NO: 351386 - protein, 21 aa, Mycobacterium
AVIALVAAVVGFVMAFQATRE

SEQ ID NO: 351387 - protein, 24 aa, Mycobacterium
AVIATSLLIFRFGPGATKGAAAVV

SEQ ID NO: 351388 - protein, 24 aa, Mycobacterium
AVIAVLFLGFFILEGFDFGVGMLM

SEQ ID NO: 351389 - protein, 25 aa, Mycobacterium
AVIAVWPGGWWLDPAVGLVIAGLAV

SEQ ID NO: 351390 - protein, 20 aa, Mycobacterium
AVIAWYDWRSAVIVAIALPL

SEQ ID NO: 351391 - protein, 23 aa, Mycobacterium
AVIDLVVVLLIMGALYLGLILVK

SEQ ID NO: 351392 - protein, 22 aa, Mycobacterium
AVIEMFLFLAALFVAVAWAWRE

SEQ ID NO: 351393 - protein, 24 aa, Mycobacterium
AVIFNAIVIVALIPLALKGVRYTP

SEQ ID NO: 351394 - protein, 25 aa, Mycobacterium
AVIFNALVIVALIPLALRGVRYTPS

SEQ ID NO: 351395 - protein, 22 aa, Mycobacterium
AVIFSYVWGVRVGGLFTALGVT

SEQ ID NO: 351396 - protein, 26 aa, Mycobacterium
AVIFTMLLLVYRSVVSVILMLVVVGI

SEQ ID NO: 351397 - protein, 32 aa, Mycobacterium
AVIGARWQLIAFAAPLLGVLCSISWQRRVPEI

SEQ ID NO: 351398 - protein, 21 aa, Mycobacterium
AVIGFLQYGLGAVASPLVGLA

SEQ ID NO: 351399 - protein, 33 aa, Mycobacterium
AVIGGRWQLIAFAAPLLGVLCSIYWQRPVPAVQ

SEQ ID NO: 351400 - protein, 17 aa, Mycobacterium
AVIGLAALVLAVVTSNE

SEQ ID NO: 351401 - protein, 17 aa, Mycobacterium
AVIGLAALVTAVVTSNE

SEQ ID NO: 351402 - protein, 24 aa, Mycobacterium
AVIGLMLVRALFLDNALSQFYQAH

SEQ ID NO: 351403 - protein, 27 aa, Mycobacterium
AVIGMGVAFLLFLPMAGTTGRAVPALV

SEQ ID NO: 351404 - protein, 23 aa, Mycobacterium
AVIGTIIVFSLIMVARSMNRRPQ

SEQ ID NO: 351405 - protein, 24 aa, Mycobacterium
AVIGVLFLGFLVLEGFDFGVGMLM

SEQ ID NO: 351406 - protein, 20 aa, Mycobacterium
AVIIVLVGLFLWGAATNDAY

SEQ ID NO: 351407 - protein, 25 aa, Mycobacterium
AVILGTPILLVSSPFLLTGSLIGLT

SEQ ID NO: 351408 - protein, 34 aa, Mycobacterium
AVILIMLLFVYRSPVTVFLLLVTVGLELTAARGA

SEQ ID NO: 351409 - protein, 23 aa, Mycobacterium
AVILSFVWGVRIGGLFTALGVTS

SEQ ID NO: 351410 - protein, 21 aa, Mycobacterium
AVILVLMFSIVPFVFEPKSTA

SEQ ID NO: 351411 - protein, 18 aa, Mycobacterium
AVILWRTFEPGLGQFYAW

SEQ ID NO: 351412 - protein, 27 aa, Mycobacterium
AVIMGALQAVFWWFSPWAAREYAAAVG

SEQ ID NO: 351413 - protein, 25 aa, Mycobacterium
AVIMIMLLITYRSVSTMLLVLVMVG

SEQ ID NO: 351414 - protein, 26 aa, Mycobacterium
AVIQPPLILFFAVPGSYFLFHGGEIN

SEQ ID NO: 351415 - protein, 27 aa, Mycobacterium
AVIQPPLILFITVPGAYWLFHSAKIGK

SEQ ID NO: 351416 - protein, 24 aa, Mycobacterium
AVIRKPVIYLFDDAFSALDVHTDA

SEQ ID NO: 351417 - protein, 27 aa, Mycobacterium
AVIRRAVLTLYPHCAPKIGVLGENPSL

SEQ ID NO: 351418 - protein, 23 aa, Mycobacterium
AVISLVMFFLAGRQPEMAPEEYL

SEQ ID NO: 351419 - protein, 29 aa, Mycobacterium
AVITGFIGKWPSELGAQPGLWIPGSSVSA

SEQ ID NO: 351420 - protein, 25 aa, Mycobacterium
AVITIPAHLFGLRRPWPPVQHHHNV

SEQ ID NO: 351421 - protein, 25 aa, Mycobacterium
AVITQLLLLPVAWYLAVGSHQPGYG

SEQ ID NO: 351422 - protein, 23 aa, Mycobacterium
AVITVMLLAVYRSVITTLIVLAM

SEQ ID NO: 351423 - protein, 22 aa, Mycobacterium
AVIVLVFPVFGPILWFAIGKSD

SEQ ID NO: 351424 - protein, 28 aa, Mycobacterium
AVIWALLTTMWFGFGWLTPVVTVFLSGL

SEQ ID NO: 351425 - protein, 22 aa, Mycobacterium
AVKDMFAWIGPVLAALQGNPVC

SEQ ID NO: 351426 - protein, 23 aa, Mycobacterium
AVKDNFYWPGLILLVVAASGLTG

SEQ ID NO: 351427 - protein, 21 aa, Mycobacterium
AVKGYAPVAYWLAGAGGAAVL

SEQ ID NO: 351428 - protein, 24 aa, Mycobacterium
AVKPILFAFVIGFLASFLALQASA

SEQ ID NO: 351429 - protein, 34 aa, Mycobacterium
AVKRARDLLSAEIWIVLVLLVVCIGLELHGPEGQ

SEQ ID NO: 351430 - protein, 19 aa, Mycobacterium
AVKRRIYWTGTVAGVVLLF

SEQ ID NO: 351431 - protein, 20 aa, Mycobacterium
AVLAALTLLPALLGLVGENI

SEQ ID NO: 351432 - protein, 19 aa, Mycobacterium
AVLAFFAFVIWTLTTKTET

SEQ ID NO: 351433 - protein, 25 aa, Mycobacterium
AVLAIMLFNGVLVRGFFAAANASFG

SEQ ID NO: 351434 - protein, 18 aa, Mycobacterium
AVLAIWFVLGVVSVRLFG

SEQ ID NO: 351435 - protein, 26 aa, Mycobacterium
AVLALLALPVLMYLTATRWRTFDIGD

SEQ ID NO: 351436 - protein, 22 aa, Mycobacterium
AVLALLYWQWRTMPTVIWDVRM

SEQ ID NO: 351437 - protein, 27 aa, Mycobacterium
AVLASAIWFLGLGLGAKRLAGLFATPM

SEQ ID NO: 351438 - protein, 20 aa, Mycobacterium
AVLAVLTRLRQLFFDVITAN

SEQ ID NO: 351439 - protein, 24 aa, Mycobacterium
AVLCPLLVFGWLGCPELGLPGSAV

SEQ ID NO: 351440 - protein, 18 aa, Mycobacterium
AVLCPLLVYGWLGFPRLE

SEQ ID NO: 351441 - protein, 23 aa, Mycobacterium
AVLEIGGAWLVWQGLREQRGWLW

SEQ ID NO: 351442 - protein, 17 aa, Mycobacterium
AVLFAGVCTVGVAVGLA

SEQ ID NO: 351443 - protein, 19 aa, Mycobacterium
AVLFIHLYPGRTGTNFALL

SEQ ID NO: 351444 - protein, 26 aa, Mycobacterium
AVLGAVAALAPWLLQKLRRADGTTQP

SEQ ID NO: 351445 - protein, 20 aa, Mycobacterium
AVLGFFAFYLSFVAELPPPP

SEQ ID NO: 351446 - protein, 22 aa, Mycobacterium
AVLGFFAFYLSFVAELPPPPPK

SEQ ID NO: 351447 - protein, 24 aa, Mycobacterium
AVLGGLLVLVTRAPLGLTPPRLWA

SEQ ID NO: 351448 - protein, 25 aa, Mycobacterium
AVLGLIGVALGWGWADAVAGIVVTG

SEQ ID NO: 351449 - protein, 18 aa, Mycobacterium
AVLGLVMGPIILGVLIAA

SEQ ID NO: 351450 - protein, 26 aa, Mycobacterium
AVLGVLTWVGGLWWVGRLPGDIRIER

SEQ ID NO: 351451 - protein, 18 aa, Mycobacterium
AVLGYRTLVAIWRGRYAE

SEQ ID NO: 351452 - protein, 19 aa, Mycobacterium
AVLIAVIAVLLCSLGFVMA

SEQ ID NO: 351453 - protein, 19 aa, Mycobacterium
AVLIILMPPGLRQLAKWTG

SEQ ID NO: 351454 - protein, 24 aa, Mycobacterium
AVLIVRPSLRWLNAGRRPTPDEIR

SEQ ID NO: 351455 - protein, 17 aa, Mycobacterium
AVLLAFVSGSLWAVFAV

SEQ ID NO: 351456 - protein, 20 aa, Mycobacterium
AVLLAGPRLIDAYVDWLWFG

SEQ ID NO: 351457 - protein, 18 aa, Mycobacterium
AVLLALVSGALWGVFAVL

SEQ ID NO: 351458 - protein, 35 aa, Mycobacterium
AVLLGIAVWLWRRRWFRGLVWTGVLCALALMISAR

SEQ ID NO: 351459 - protein, 29 aa, Mycobacterium
AVLLGLVLTLRWPGGWWLDPAIGLCIVAV

SEQ ID NO: 351460 - protein, 24 aa, Mycobacterium
AVLLHGSWHWVFAALVVVAAALLV

SEQ ID NO: 351461 - protein, 17 aa, Mycobacterium
AVLLPLVTTVAVGFVAF

SEQ ID NO: 351462 - protein, 29 aa, Mycobacterium
AVLLTAVVPLLTAPLLPIAAGAVLAPIGV

SEQ ID NO: 351463 - protein, 20 aa, Mycobacterium
AVLLVLGVVGYVVVHRSLRP

SEQ ID NO: 351464 - protein, 24 aa, Mycobacterium
AVLMAITILLIHTYFGYFASGGPA

SEQ ID NO: 351465 - protein, 20 aa, Mycobacterium
AVLMATFMLVIFPRAAVCAD

SEQ ID NO: 351466 - protein, 20 aa, Mycobacterium
AVLMGALVLITGLVGCFVFS

SEQ ID NO: 351467 - protein, 32 aa, Mycobacterium
AVLMSPVAFMMKPSRWMQLLGSNPSAFTAAPN

SEQ ID NO: 351468 - protein, 22 aa, Mycobacterium
AVLMVLPAERPGELLAVAVRPG

SEQ ID NO: 351469 - protein, 20 aa, Mycobacterium
AVLNERRYAITSLLSNISAV

SEQ ID NO: 351470 - protein, 27 aa, Mycobacterium
AVLPAKLILMAIALICAAAVFSAITLR

SEQ ID NO: 351471 - protein, 20 aa, Mycobacterium
AVLPPFRDGPPPPTRDPIDA

SEQ ID NO: 351472 - protein, 24 aa, Mycobacterium
AVLSALIVLFPLGTAVAVWSMSSW

SEQ ID NO: 351473 - protein, 25 aa, Mycobacterium
AVLSGLIMLLTWGPYLLAALRGTPA

SEQ ID NO: 351474 - protein, 25 aa, Mycobacterium
AVLSGLWVDSTHRLVLIVHHLAVDG

SEQ ID NO: 351475 - protein, 24 aa, Mycobacterium
AVLSGVLITYFLIEPRNSFAVAGA

SEQ ID NO: 351476 - protein, 22 aa, Mycobacterium
AVLTILTAAVLLAPPAGAQQPF

SEQ ID NO: 351477 - protein, 24 aa, Mycobacterium
AVLTILTAGLLLVSPAAAQPPSKL

SEQ ID NO: 351478 - protein, 24 aa, Mycobacterium
AVLTLFTLIFLLQGGRNIFAFVTK

SEQ ID NO: 351479 - protein, 30 aa, Mycobacterium
AVLTLTAFLVSLMALGWRVGDPFPTGAHLA

SEQ ID NO: 351480 - protein, 34 aa, Mycobacterium
AVLTSPVGFLQRPARWMHLLASNTRAFSAAPNFA

SEQ ID NO: 351481 - protein, 21 aa, Mycobacterium
AVLVEFLFVYVRTRELRRSLA

SEQ ID NO: 351482 - protein, 25 aa, Mycobacterium
AVLVIGLPILVGTLLVARVLADIER

SEQ ID NO: 351483 - protein, 20 aa, Mycobacterium
AVLVKWLLAIPQVLLCWSME

SEQ ID NO: 351484 - protein, 26 aa, Mycobacterium
AVLVLFTLIFFLYGGRNIWQYVAKII

SEQ ID NO: 351485 - protein, 26 aa, Mycobacterium
AVLVLFTLIFFLYGGRNIWQYVVKIV

SEQ ID NO: 351486 - protein, 21 aa, Mycobacterium
AVLVLIVFIAGVVMALQALRG

SEQ ID NO: 351487 - protein, 17 aa, Mycobacterium
AVLVPAEAPLEARIPLA

SEQ ID NO: 351488 - protein, 24 aa, Mycobacterium
AVLVVATPCPLLLAAPVAIVSGLS

SEQ ID NO: 351489 - protein, 29 aa, Mycobacterium
AVLVVAVSIGLWWYFDRRTSDNQAEAAAT

SEQ ID NO: 351490 - protein, 22 aa, Mycobacterium
AVLVVVLAGFAIYRLNGIFGSQ

SEQ ID NO: 351491 - protein, 22 aa, Mycobacterium
AVLVWTVGLVLYGLLIGSVVHG

SEQ ID NO: 351492 - protein, 17 aa, Mycobacterium
AVLVWVLGGVVAAALPI

SEQ ID NO: 351493 - protein, 40 aa, Mycobacterium
AVLVYLFVVDWRLALVMFVPVLIYLVLMTVMTIQSGPKIA

SEQ ID NO: 351494 - protein, 25 aa, Mycobacterium
AVLWAVYTTRWWLSGLLVGAAAGIK

SEQ ID NO: 351495 - protein, 24 aa, Mycobacterium
AVMAVFPMYFLKSSAYTIVATAAI

SEQ ID NO: 351496 - protein, 21 aa, Mycobacterium
AVMFALAWLLLPDLPEYRTGL

SEQ ID NO: 351497 - protein, 31 aa, Mycobacterium
AVMFSIYLTNTWLPYLFKVAGFATGSISILS

SEQ ID NO: 351498 - protein, 20 aa, Mycobacterium
AVMLLLYPLAAVWPSGWAWH

SEQ ID NO: 351499 - protein, 22 aa, Mycobacterium
AVMPIVRVAILADSRLTEMALP

SEQ ID NO: 351500 - protein, 18 aa, Mycobacterium
AVMRRPWASAIAAAILLL

SEQ ID NO: 351501 - protein, 23 aa, Mycobacterium
AVMTWPMILLAIGSVTAGAALAI

SEQ ID NO: 351502 - protein, 27 aa, Mycobacterium
AVMVPLGVFLLLYPRRSWGPTAWVVDS

SEQ ID NO: 351503 - protein, 19 aa, Mycobacterium
AVMVVVCLVLYFQFRNRNW

SEQ ID NO: 351504 - protein, 21 aa, Mycobacterium
AVNAGFLRRLAGVGGGRCVLV

SEQ ID NO: 351505 - protein, 22 aa, Mycobacterium
AVNDLILWYPGSTTAFAAIYTG

SEQ ID NO: 351506 - protein, 17 aa, Mycobacterium
AVNILVLLAIAAGTDYA

SEQ ID NO: 351507 - protein, 30 aa, Mycobacterium
AVNKTLLIVMFTGVLWQLSGPLLLWGFEIP

SEQ ID NO: 351508 - protein, 20 aa, Mycobacterium
AVNLPIMVLYPRGWSEFFRL

SEQ ID NO: 351509 - protein, 26 aa, Mycobacterium
AVNPAIMNFLFLGFMFAFAVKAPLWP

SEQ ID NO: 351510 - protein, 27 aa, Mycobacterium
AVNSHRLFMAFLAVTIFISAVAGVVAA

SEQ ID NO: 351511 - protein, 29 aa, Mycobacterium
AVNVFGAVALTLALLPALRQTRGQVIFIN

SEQ ID NO: 351512 - protein, 30 aa, Mycobacterium
AVNVLCALVFLWIPRLCPLGELLAPLTFVT

SEQ ID NO: 351513 - protein, 24 aa, Mycobacterium
AVPAAAWPAATLLAAASALAMSTL

SEQ ID NO: 351514 - protein, 27 aa, Mycobacterium
AVPAAIMLVLLLRLPESPRWLIKDGDP

SEQ ID NO: 351515 - protein, 17 aa, Mycobacterium
AVPALDMNLGLPSGASY

SEQ ID NO: 351516 - protein, 19 aa, Mycobacterium
AVPAMFDVMKRCFADRYPS

SEQ ID NO: 351517 - protein, 32 aa, Mycobacterium
AVPELIEIFCLTFLWLVVLVRIPTIRGRNERT

SEQ ID NO: 351518 - protein, 18 aa, Mycobacterium
AVPFHFWVPDVYQGAPTP

SEQ ID NO: 351519 - protein, 18 aa, Mycobacterium
AVPGLLQIPFSTGITMGA

SEQ ID NO: 351520 - protein, 28 aa, Mycobacterium
AVPGVLARLVLLWFLCSAIPIGVIAAFV

SEQ ID NO: 351521 - protein, 22 aa, Mycobacterium
AVPIVVFWVGLVAVLVMFVPSL

SEQ ID NO: 351522 - protein, 25 aa, Mycobacterium
AVPLGIGFLFPLWDRRRQTLADKLM

SEQ ID NO: 351523 - protein, 30 aa, Mycobacterium
AVPLQVISVLLGPISRLLILLGNAVTPGRG

SEQ ID NO: 351524 - protein, 27 aa, Mycobacterium
AVPLWAAMLMWLALWALYLSIVNVGQT

SEQ ID NO: 351525 - protein, 18 aa, Mycobacterium
AVPQALIRLGPQSVGDPL

SEQ ID NO: 351526 - protein, 19 aa, Mycobacterium
AVPRLWLSYGLTATSTAAL

SEQ ID NO: 351527 - protein, 26 aa, Mycobacterium
AVPSMPRWLFVVLAFGGLTAALAGGD

SEQ ID NO: 351528 - protein, 32 aa, Mycobacterium
AVPSVYARLVLLWFLCSAFPIAVIASLVVLRS

SEQ ID NO: 351529 - protein, 30 aa, Mycobacterium
AVPTIDARLMSRIGLRPNIKRVPLFGLGCV

SEQ ID NO: 351530 - protein, 19 aa, Mycobacterium
AVPVEGRVALLRKVLDSAS

SEQ ID NO: 351531 - protein, 25 aa, Mycobacterium
AVPVPWSVLALFAGGPTLSRADALL

SEQ ID NO: 351532 - protein, 27 aa, Mycobacterium
AVPVSFAALVWVFGGLLAAALPVAVGG

SEQ ID NO: 351533 - protein, 18 aa, Mycobacterium
AVQDALFWVAFIGAITVA

SEQ ID NO: 351534 - protein, 24 aa, Mycobacterium
AVQDALFWVAFIVAITVAGTLIPG

SEQ ID NO: 351535 - protein, 25 aa, Mycobacterium
AVQGNFFCRPLPASKIPRVPANSVL

SEQ ID NO: 351536 - protein, 19 aa, Mycobacterium
AVQIILFVAVVFGTLNVIG

SEQ ID NO: 351537 - protein, 18 aa, Mycobacterium
AVQLPAVWLLSAVTVCVF

SEQ ID NO: 351538 - protein, 24 aa, Mycobacterium
AVQLPWGVLLLFGGGLALSSQFSS

SEQ ID NO: 351539 - protein, 20 aa, Mycobacterium
AVQMVNFPILPGVSGHLLGG

SEQ ID NO: 351540 - protein, 19 aa, Mycobacterium
AVQNPRVMLGTPASGFGRV

SEQ ID NO: 351541 - protein, 25 aa, Mycobacterium
AVQTSVLVMPLLIDSSINPIEANEA

SEQ ID NO: 351542 - protein, 27 aa, Mycobacterium
AVQVAILAWIWRLGGPRGAFLGGVAQT

SEQ ID NO: 351543 - protein, 25 aa, Mycobacterium
AVRASALILLLSASVLLLFASGGHP

SEQ ID NO: 351544 - protein, 26 aa, Mycobacterium
AVRASMAIPFFYRPVKLTGADGSTST

SEQ ID NO: 351545 - protein, 17 aa, Mycobacterium
AVRAYPRTASVVVWYSP

SEQ ID NO: 351546 - protein, 23 aa, Mycobacterium
AVRELYGPLLDAGVPFLVTDLQT

SEQ ID NO: 351547 - protein, 23 aa, Mycobacterium
AVRELYGPLLQAGVPFLVTDLQT

SEQ ID NO: 351548 - protein, 41 aa, Mycobacterium
AVRGLKMLMWTAVIAVVVVGLGLLLYFTPIMSARSIVVVGV

SEQ ID NO: 351549 - protein, 19 aa, Mycobacterium
AVRGLLRRVPLTGAAAASM

SEQ ID NO: 351550 - protein, 18 aa, Mycobacterium
AVRGWPLRVLAGLLAVAS

SEQ ID NO: 351551 - protein, 18 aa, Mycobacterium
AVRITRTWYAPVGGLLMA

SEQ ID NO: 351552 - protein, 25 aa, Mycobacterium
AVRKAWWIRHYTFTGTALGLIFLWF

SEQ ID NO: 351553 - protein, 28 aa, Mycobacterium
AVRKSIAWWVLLIDLLGRSALNVGGFIE

SEQ ID NO: 351554 - protein, 26 aa, Mycobacterium
AVRLDLGKFFKWTGVFLIVVAAGILA

SEQ ID NO: 351555 - protein, 17 aa, Mycobacterium
AVRLLPGIWVRHLFQHR

SEQ ID NO: 351556 - protein, 19 aa, Mycobacterium
AVRLLWLRTQGATGRTPMG

SEQ ID NO: 351557 - protein, 23 aa, Mycobacterium
AVRLPALGLVLAGGLGGAAAVCC

SEQ ID NO: 351558 - protein, 24 aa, Mycobacterium
AVRPCPPVVLWSLAARQRPGDDAD

SEQ ID NO: 351559 - protein, 23 aa, Mycobacterium
AVRPDLPEVLLPQNYHAPADLAP

SEQ ID NO: 351560 - protein, 36 aa, Mycobacterium
AVRPPPRRRARGRLVAWISLAAAVVVIAALGWGVLA

SEQ ID NO: 351561 - protein, 25 aa, Mycobacterium
AVRRFTGPDWRWVLAYATVVAPSLM

SEQ ID NO: 351562 - protein, 31 aa, Mycobacterium
AVRRNKPWVWLLYALGLMLSILISINLGLLV

SEQ ID NO: 351563 - protein, 30 aa, Mycobacterium
AVRRNRPWLWLLYALVLMVSILININLGLL

SEQ ID NO: 351564 - protein, 37 aa, Mycobacterium
AVRRRRTVFVDAWRSRLWPVPALGVVFAIVAGVALPE

SEQ ID NO: 351565 - protein, 19 aa, Mycobacterium
AVRSLWHYTYAAYRFHSGL

SEQ ID NO: 351566 - protein, 22 aa, Mycobacterium
AVRVRRWLLAPAAAPIHLVALA

SEQ ID NO: 351567 - protein, 21 aa, Mycobacterium
AVRVYPDLNVTLRPSPAVLML

SEQ ID NO: 351568 - protein, 21 aa, Mycobacterium
AVRYERYMSLAALAALVFDLL

SEQ ID NO: 351569 - protein, 25 aa, Mycobacterium
AVRYSMVIVMLLVIAYFSYRSARFA

SEQ ID NO: 351570 - protein, 20 aa, Mycobacterium
AVSAIWWPLHARTGNLDMTP

SEQ ID NO: 351571 - protein, 24 aa, Mycobacterium
AVSALAALAVSFYVSRRLQRSITE

SEQ ID NO: 351572 - protein, 24 aa, Mycobacterium
AVSALAALAVSFYVSRRLQRSVTE

SEQ ID NO: 351573 - protein, 30 aa, Mycobacterium
AVSARKYAFRKKVLMVMALGLIGSATAAFK

SEQ ID NO: 351574 - protein, 29 aa, Mycobacterium
AVSARKYAFRKRMLVAMAVVLVGSAIAAF

SEQ ID NO: 351575 - protein, 23 aa, Mycobacterium
AVSASFFFFYNVPAQWIGLHSDP

SEQ ID NO: 351576 - protein, 20 aa, Mycobacterium
AVSAVAVLLAWIALYVRVSA

SEQ ID NO: 351577 - protein, 28 aa, Mycobacterium
AVSDFWLLAYWLVLGALMIYLLSYAGRV

SEQ ID NO: 351578 - protein, 22 aa, Mycobacterium
AVSFLVLTVLFPSPSVFDARVA

SEQ ID NO: 351579 - protein, 19 aa, Mycobacterium
AVSFTTLRLVYGDATARFR

SEQ ID NO: 351580 - protein, 25 aa, Mycobacterium
AVSFVGPWLFATFALLFHATRAGIA

SEQ ID NO: 351581 - protein, 20 aa, Mycobacterium
AVSGPLWRLCGSTAIGLLLL

SEQ ID NO: 351582 - protein, 20 aa, Mycobacterium
AVSIAIAFLAAVTLLPAVMV

SEQ ID NO: 351583 - protein, 23 aa, Mycobacterium
AVSILLTPALIRLFTKQGFGHHT

SEQ ID NO: 351584 - protein, 25 aa, Mycobacterium
AVSIPLTVLLIFTLNILLTEFGAAD

SEQ ID NO: 351585 - protein, 34 aa, Mycobacterium
AVSIVRRKWSLARRSLLALLVGFPVAMGVTAVGA

SEQ ID NO: 351586 - protein, 33 aa, Mycobacterium
AVSMLIVVLFVPAALPWYYSWPLAVVAPLAQSR

SEQ ID NO: 351587 - protein, 24 aa, Mycobacterium
AVSNLLWGWTLSAGIWQPLFAPFV

SEQ ID NO: 351588 - protein, 26 aa, Mycobacterium
AVSRTRRGLRALLSLVPDQATVLRAG

SEQ ID NO: 351589 - protein, 17 aa, Mycobacterium
AVSTWIALPVSAALFGG

SEQ ID NO: 351590 - protein, 21 aa, Mycobacterium
AVSVLAPKWLAKTVDVALEHQ

SEQ ID NO: 351591 - protein, 26 aa, Mycobacterium
AVSYLRQLFLVQLWFEPYFDGTSWDG

SEQ ID NO: 351592 - protein, 32 aa, Mycobacterium
AVSYTRPLAGLATIAFVGLIVAIAIGLFQGDF

SEQ ID NO: 351593 - protein, 26 aa, Mycobacterium
AVSYVRQILLVQLWFVPFFDDSSWDG

SEQ ID NO: 351594 - protein, 32 aa, Mycobacterium
AVTAGFLTLFGFIFVITQYFQFIKDYTALQTG

SEQ ID NO: 351595 - protein, 23 aa, Mycobacterium
AVTALLLLGWRVAVGLTLRRRSD

SEQ ID NO: 351596 - protein, 23 aa, Mycobacterium
AVTAVLWWIIALAGLWLGLLGIA

SEQ ID NO: 351597 - protein, 21 aa, Mycobacterium
AVTAYFWRYPDKRPHFLVWVV

SEQ ID NO: 351598 - protein, 21 aa, Mycobacterium
AVTFAGWTLIAANPVAGMTAA

SEQ ID NO: 351599 - protein, 17 aa, Mycobacterium
AVTGFGVLLWLWLLAFT

SEQ ID NO: 351600 - protein, 17 aa, Mycobacterium
AVTGFICHVGWEVSSEI

SEQ ID NO: 351601 - protein, 28 aa, Mycobacterium
AVTGLPWYAILVLPILFSAGMSLFDSLD

SEQ ID NO: 351602 - protein, 19 aa, Mycobacterium
AVTHFLVAWAGVAVFNMGV

SEQ ID NO: 351603 - protein, 24 aa, Mycobacterium
AVTIFVFILISNWLSVLPLQYTDA

SEQ ID NO: 351604 - protein, 24 aa, Mycobacterium
AVTIFVFILISNWLSVLPLQYTDK

SEQ ID NO: 351605 - protein, 26 aa, Mycobacterium
AVTKVPLPHWYWIGLTVGILVGTAFV

SEQ ID NO: 351606 - protein, 26 aa, Mycobacterium
AVTLRLITRWVGHFVLLIPTVIAVVA

SEQ ID NO: 351607 - protein, 31 aa, Mycobacterium
AVTLSYLLAMVSVLALVLFLGHLVRQIRIEM

SEQ ID NO: 351608 - protein, 23 aa, Mycobacterium
AVTLWVLIALIVAMSLFIFAYRR

SEQ ID NO: 351609 - protein, 26 aa, Mycobacterium
AVTMTIPLTIISFAIGLVIALGVALA

SEQ ID NO: 351610 - protein, 32 aa, Mycobacterium
AVTPVLWWIGPFLLYLLLPALDVFFGPDGENP

SEQ ID NO: 351611 - protein, 33 aa, Mycobacterium
AVTQRLTAMVAALPRWCDIIPGAPEVALPQPHC

SEQ ID NO: 351612 - protein, 18 aa, Mycobacterium
AVTRATVPGSHRSRPGLV

SEQ ID NO: 351613 - protein, 25 aa, Mycobacterium
AVTRINRLWFDALAGICAHVRRGGG

SEQ ID NO: 351614 - protein, 28 aa, Mycobacterium
AVTVCVLPALQFGFWLLQDSSMQSLTDP

SEQ ID NO: 351615 - protein, 20 aa, Mycobacterium
AVTVFVWASALTREAPVKEA

SEQ ID NO: 351616 - protein, 27 aa, Mycobacterium
AVTVGTLLHTAWGLALGRLTGRDDVVF

SEQ ID NO: 351617 - protein, 30 aa, Mycobacterium
AVTVISVALMAIFYLRVPTALGIGKHDVKA

SEQ ID NO: 351618 - protein, 17 aa, Mycobacterium
AVTVPVQFVAGWSILKE

SEQ ID NO: 351619 - protein, 25 aa, Mycobacterium
AVTVSHLFRRVPPVGSAPAAEPAAG

SEQ ID NO: 351620 - protein, 27 aa, Mycobacterium
AVTWTLRALPFAVLAPLRHSTTVRYLS

SEQ ID NO: 351621 - protein, 31 aa, Mycobacterium
AVVAALAVLVTAFTLLRDRPAPVMSAKLPAV

SEQ ID NO: 351622 - protein, 29 aa, Mycobacterium
AVVAFGAVLAWLVAGLAVSESVSWPGWAV

SEQ ID NO: 351623 - protein, 23 aa, Mycobacterium
AVVAFLGNGLWVVIIVLGVTNWV

SEQ ID NO: 351624 - protein, 18 aa, Mycobacterium
AVVAFTLAMGASRLARRG

SEQ ID NO: 351625 - protein, 22 aa, Mycobacterium
AVVANRVSYFYDFRGPSMAIDT

SEQ ID NO: 351626 - protein, 27 aa, Mycobacterium
AVVARPYQWWRVALVALSGLGYVAIFA

SEQ ID NO: 351627 - protein, 27 aa, Mycobacterium
AVVARPYQWWRVALVIVSGLAYVVIFS

SEQ ID NO: 351628 - protein, 20 aa, Mycobacterium
AVVAVIAALIITRSDDKPAP

SEQ ID NO: 351629 - protein, 23 aa, Mycobacterium
AVVFKVLSYLMKLAPVGAFGAMA

SEQ ID NO: 351630 - protein, 27 aa, Mycobacterium
AVVFNAIVIVLLIPLSLRGVRYTPSSA

SEQ ID NO: 351631 - protein, 24 aa, Mycobacterium
AVVFSIVALAAFRFLLPGDDHDDH

SEQ ID NO: 351632 - protein, 20 aa, Mycobacterium
AVVFVLLGSGLGIWLVTRPD

SEQ ID NO: 351633 - protein, 24 aa, Mycobacterium
AVVFWPLHLIPFTLLGLCWILGTI

SEQ ID NO: 351634 - protein, 19 aa, Mycobacterium
AVVFYLALKYTGEFLLGYL

SEQ ID NO: 351635 - protein, 20 aa, Mycobacterium
AVVFYLALKYTGEFLLGYLA

SEQ ID NO: 351636 - protein, 26 aa, Mycobacterium
AVVFYPLHLLPFGLVAFLWQIATMAA

SEQ ID NO: 351637 - protein, 30 aa, Mycobacterium
AVVFYPLHLLPFGLVAFLWQLATIAALYGA

SEQ ID NO: 351638 - protein, 27 aa, Mycobacterium
AVVGAQVLFSLLLTPAIRLTNGAANWI

SEQ ID NO: 351639 - protein, 25 aa, Mycobacterium
AVVGDKIWIVGGLRNGVALQTVESY

SEQ ID NO: 351640 - protein, 24 aa, Mycobacterium
AVVGFVLALFLREVPLRDIHDSTV

SEQ ID NO: 351641 - protein, 34 aa, Mycobacterium
AVVGGLPLPLLPLQILFLNLVTDVFPAFALATGE

SEQ ID NO: 351642 - protein, 27 aa, Mycobacterium
AVVGIGALAWIFWPDAEGGQDTSADSA

SEQ ID NO: 351643 - protein, 28 aa, Mycobacterium
AVVGVPVWAWVLWALVTVAAALLAADRS

SEQ ID NO: 351644 - protein, 19 aa, Mycobacterium
AVVGWMIAGAALVGLWLLQ

SEQ ID NO: 351645 - protein, 20 aa, Mycobacterium
AVVIAAGWWIVVVQLVPPGE

SEQ ID NO: 351646 - protein, 28 aa, Mycobacterium
AVVIVAVARWRGLLALVGIVVAFAVLVV

SEQ ID NO: 351647 - protein, 21 aa, Mycobacterium
AVVLAVLVRNAVNRPLAALAA

SEQ ID NO: 351648 - protein, 32 aa, Mycobacterium
AVVLGARFYLRTGPFALFGKHYRDLAPVGIGH

SEQ ID NO: 351649 - protein, 34 aa, Mycobacterium
AVVLIVKRVYWPVAVWLLLVIAIVHSSKPFGGFV

SEQ ID NO: 351650 - protein, 17 aa, Mycobacterium
AVVLLAIALSCCAIGYQ

SEQ ID NO: 351651 - protein, 24 aa, Mycobacterium
AVVLLALVAVWIVLALNPGIAEPE

SEQ ID NO: 351652 - protein, 18 aa, Mycobacterium
AVVLLFVNQTVTVGPDAP

SEQ ID NO: 351653 - protein, 17 aa, Mycobacterium
AVVLLLLLFARVPETRR

SEQ ID NO: 351654 - protein, 20 aa, Mycobacterium
AVVLSVICAIAALVDSRNSD

SEQ ID NO: 351655 - protein, 28 aa, Mycobacterium
AVVLVLLLLSLVVFRGLLGRLAIFTSVV

SEQ ID NO: 351656 - protein, 19 aa, Mycobacterium
AVVLVLYGGVLWGVLPGQF

SEQ ID NO: 351657 - protein, 21 aa, Mycobacterium
AVVLVSMWRGALTAVVMAVGL

SEQ ID NO: 351658 - protein, 21 aa, Mycobacterium
AVVLWPLLLISSWACGTVGCG

SEQ ID NO: 351659 - protein, 20 aa, Mycobacterium
AVVMWVLALALYLAVTALIA

SEQ ID NO: 351660 - protein, 30 aa, Mycobacterium
AVVPLGLMVLPLVGLWLWGDAPLWFVVAAF

SEQ ID NO: 351661 - protein, 23 aa, Mycobacterium
AVVPLTVVFGLLAGAVTRATVPG

SEQ ID NO: 351662 - protein, 27 aa, Mycobacterium
AVVPLYLLCLVISYITCRLLVGISSGG

SEQ ID NO: 351663 - protein, 26 aa, Mycobacterium
AVVQPPLILFASIPMAYLIMSQAPLA

SEQ ID NO: 351664 - protein, 31 aa, Mycobacterium
AVVQVIPATLLFFRYRWLRAEPLPTPRPANT

SEQ ID NO: 351665 - protein, 31 aa, Mycobacterium
AVVQVIPATLLFFRYYWLRSEPLPSQRPTTT

SEQ ID NO: 351666 - protein, 30 aa, Mycobacterium
AVVRRPVPLLIVSLVILLALSAAAATIKIS

SEQ ID NO: 351667 - protein, 34 aa, Mycobacterium
AVVRTLALALALYLIASLLIWGQARLLNVTVQRT

SEQ ID NO: 351668 - protein, 18 aa, Mycobacterium
AVVRWPAPILAVSAAIVL

SEQ ID NO: 351669 - protein, 19 aa, Mycobacterium
AVVRWPAPILAVSGAIVLV

SEQ ID NO: 351670 - protein, 21 aa, Mycobacterium
AVVRWPAPILIATIAVAVIGL

SEQ ID NO: 351671 - protein, 24 aa, Mycobacterium
AVVRWPAPILLASLAAALVGLIAL

SEQ ID NO: 351672 - protein, 20 aa, Mycobacterium
AVVRWPAPILVASLAVALVG

SEQ ID NO: 351673 - protein, 22 aa, Mycobacterium
AVVSILGVFLMISSTFNKPSAF

SEQ ID NO: 351674 - protein, 20 aa, Mycobacterium
AVVSMYFLTLLTALGGVVAF

SEQ ID NO: 351675 - protein, 26 aa, Mycobacterium
AVVSSEAGTWLLWDGKRSALNLGDVA

SEQ ID NO: 351676 - protein, 35 aa, Mycobacterium
AVVTGAHAPLWRKFIRFWTVSFPVVVYRSWRWSVA

SEQ ID NO: 351677 - protein, 25 aa, Mycobacterium
AVVTLTLLILLCGTTALVSARPSEP

SEQ ID NO: 351678 - protein, 24 aa, Mycobacterium
AVVTMLLANLFAGLVIYVGKAQFS

SEQ ID NO: 351679 - protein, 24 aa, Mycobacterium
AVVTPALWLLACAVIIVSYARRPV

SEQ ID NO: 351680 - protein, 27 aa, Mycobacterium
AVVVAAVAALIWWTSDARATISRPAAE

SEQ ID NO: 351681 - protein, 23 aa, Mycobacterium
AVVVALYYWTAVSRVALFWVAFI

SEQ ID NO: 351682 - protein, 27 aa, Mycobacterium
AVVVAVLGLWLLTRPHYGDPVRGVLRA

SEQ ID NO: 351683 - protein, 26 aa, Mycobacterium
AVVVAVTAALIWWTSDARATSSRPAA

SEQ ID NO: 351684 - protein, 23 aa, Mycobacterium
AVVVGVCCVLILAVNFGNAALFT

SEQ ID NO: 351685 - protein, 32 aa, Mycobacterium
AVVVLAREPEFVPWLRWVIAASAVLAAAIWVS

SEQ ID NO: 351686 - protein, 20 aa, Mycobacterium
AVVVLFKGKVWTGLLGMFIV

SEQ ID NO: 351687 - protein, 20 aa, Mycobacterium
AVVVTTPQPALDAAVGAALI

SEQ ID NO: 351688 - protein, 22 aa, Mycobacterium
AVVVVAVARWRGLRALIGIVVA

SEQ ID NO: 351689 - protein, 27 aa, Mycobacterium
AVVVVYALLPVLWILSLSLKPTSTVKD

SEQ ID NO: 351690 - protein, 22 aa, Mycobacterium
AVWADGWWFDPAIGLAVAVIAA

SEQ ID NO: 351691 - protein, 24 aa, Mycobacterium
AVWPITALYFGPAAVWMYWRYGRP

SEQ ID NO: 351692 - protein, 17 aa, Mycobacterium
AVWPLPEMPMDALALGL

SEQ ID NO: 351693 - protein, 24 aa, Mycobacterium
AVWVLCLGWQPLPGHIWSAGGIGS

SEQ ID NO: 351694 - protein, 22 aa, Mycobacterium
AVWVVLFHFRPILYEAAPDFTE

SEQ ID NO: 351695 - protein, 17 aa, Mycobacterium
AVYAVISAALYSDIDNQ

SEQ ID NO: 351696 - protein, 41 aa, Mycobacterium
AVYGALMTPLGWRWAALVWAYALFWFLIEDRVKLATHYWLD

SEQ ID NO: 351697 - protein, 22 aa, Mycobacterium
AVYHLVNHGLFKALLFLCAGAV

SEQ ID NO: 351698 - protein, 25 aa, Mycobacterium
AVYLAVMTVLWLTALPDWFGAVGGV

SEQ ID NO: 351699 - protein, 19 aa, Mycobacterium
AVYNGKLVCLNFRRGMTVD

SEQ ID NO: 351700 - protein, 27 aa, Mycobacterium
AVYTVDALRLGPPGALFFVLVCGGALG

SEQ ID NO: 351701 - protein, 20 aa, Mycobacterium
AVYWHMVDLLWIVIFGLLYV

SEQ ID NO: 351702 - protein, 20 aa, Mycobacterium
AVYWHMVDLLWVVIFALLYV

SEQ ID NO: 351703 - protein, 25 aa, Mycobacterium
AWAADGLLAIFFLVVGLELKREFVA

SEQ ID NO: 351704 - protein, 26 aa, Mycobacterium
AWAAGFVLLASWFPFNNGLRPEGQIA

SEQ ID NO: 351705 - protein, 24 aa, Mycobacterium
AWALIAGLLLAVVALYPAALLGQA

SEQ ID NO: 351706 - protein, 26 aa, Mycobacterium
AWAPFTMVLASALLSWILLTVFAVGC

SEQ ID NO: 351707 - protein, 23 aa, Mycobacterium
AWAPVLLLVLRVLQGFALGGEWG

SEQ ID NO: 351708 - protein, 28 aa, Mycobacterium
AWASIIPAGWSFLLALRSRGLGSVWTTM

SEQ ID NO: 351709 - protein, 34 aa, Mycobacterium
AWAVYTVLGLHVALLLLLLPRADWRWRVARAAVR

SEQ ID NO: 351710 - protein, 17 aa, Mycobacterium
AWEFYPFGHTIPQGVWV

SEQ ID NO: 351711 - protein, 19 aa, Mycobacterium
AWELYVWGHTVPAAFWVAL

SEQ ID NO: 351712 - protein, 24 aa, Mycobacterium
AWGAFLFMMSLYLQGERGFSAMQT

SEQ ID NO: 351713 - protein, 17 aa, Mycobacterium
AWGLYRFNQILAGLSAA

SEQ ID NO: 351714 - protein, 20 aa, Mycobacterium
AWGSPTIIGLFVGAAVALGV

SEQ ID NO: 351715 - protein, 18 aa, Mycobacterium
AWGWRVPMLFGAAMGFFV

SEQ ID NO: 351716 - protein, 27 aa, Mycobacterium
AWHEAHPYLPFVFTGSAAASGGGLGML

SEQ ID NO: 351717 - protein, 24 aa, Mycobacterium
AWHKVENVMLVSGFLAAAALGQAV

SEQ ID NO: 351718 - protein, 29 aa, Mycobacterium
AWHRFRRIMPAYWILVAIAYIWYHIRDQY

SEQ ID NO: 351719 - protein, 25 aa, Mycobacterium
AWIDQAIVIWVLIALATAMVVYVVA

SEQ ID NO: 351720 - protein, 17 aa, Mycobacterium
AWIDYVYDRANYAKLVA

SEQ ID NO: 351721 - protein, 18 aa, Mycobacterium
AWIFRRGVLAWNGQIAWW

SEQ ID NO: 351722 - protein, 42 aa, Mycobacterium
AWIGALIGLLFLLFAVGPLWLWVWVLLLPIAFGALWGAIFGF

SEQ ID NO: 351723 - protein, 18 aa, Mycobacterium
AWIIYFLGAWLGHTRMRT

SEQ ID NO: 351724 - protein, 20 aa, Mycobacterium
AWLIMLAASPTTRVAARLLT

SEQ ID NO: 351725 - protein, 17 aa, Mycobacterium
AWLLGPWAVAGFAALGL

SEQ ID NO: 351726 - protein, 20 aa, Mycobacterium
AWLLPTAFIALILGVIIAGK

SEQ ID NO: 351727 - protein, 19 aa, Mycobacterium
AWLRICGAALVFLAIARPG

SEQ ID NO: 351728 - protein, 25 aa, Mycobacterium
AWLVTAAGIVWYIAGSVLVVIVVTL

SEQ ID NO: 351729 - protein, 27 aa, Mycobacterium
AWMGFLRQWWTEPVPTGWLRGFLHARK

SEQ ID NO: 351730 - protein, 19 aa, Mycobacterium
AWMIGMRRPQAYPLMSHLA

SEQ ID NO: 351731 - protein, 25 aa, Mycobacterium
AWNRAQLLLEKNDLRPGWHPVPGIS

SEQ ID NO: 351732 - protein, 17 aa, Mycobacterium
AWPPQRGFEILSDRAQS

SEQ ID NO: 351733 - protein, 29 aa, Mycobacterium
AWPQAVDAWLRLCQTYGWSPGVMGASSQG

SEQ ID NO: 351734 - protein, 21 aa, Mycobacterium
AWQFVIDPLLVVDAVIEWILG

SEQ ID NO: 351735 - protein, 24 aa, Mycobacterium
AWQWDPYPFILLNLAFSTQAAYAA

SEQ ID NO: 351736 - protein, 18 aa, Mycobacterium
AWQWLVTEVPQRSLHNWQ

SEQ ID NO: 351737 - protein, 20 aa, Mycobacterium
AWREYIAQAWFVARVSLLPT

SEQ ID NO: 351738 - protein, 27 aa, Mycobacterium
AWRQRTPFLVIAAFSAAVIALGVGLLV

SEQ ID NO: 351739 - protein, 20 aa, Mycobacterium
AWRRGLIFGLFVFAAFATPG

SEQ ID NO: 351740 - protein, 19 aa, Mycobacterium
AWRWMAFIAAGVAITSRVV

SEQ ID NO: 351741 - protein, 23 aa, Mycobacterium
AWRYWRMVVGVVAAVAVLVIGSL

SEQ ID NO: 351742 - protein, 19 aa, Mycobacterium
AWRYWRTVIGVLAAVAVLV

SEQ ID NO: 351743 - protein, 24 aa, Mycobacterium
AWRYWRTVIGVVVAVAVLVIGGLT

SEQ ID NO: 351744 - protein, 25 aa, Mycobacterium
AWSAFLFTMSLYLQGQRHFSAMHTG

SEQ ID NO: 351745 - protein, 20 aa, Mycobacterium
AWSFVLALLAAALTARKRIA

SEQ ID NO: 351746 - protein, 23 aa, Mycobacterium
AWSGFALLTWALPGVVILLITAG

SEQ ID NO: 351747 - protein, 27 aa, Mycobacterium
AWSGVPVLFWINAVACALLALVAARCI

SEQ ID NO: 351748 - protein, 18 aa, Mycobacterium
AWSLLSMLTTLVGTTLLS

SEQ ID NO: 351749 - protein, 19 aa, Mycobacterium
AWSLTVLVAVAWIARGVFL

SEQ ID NO: 351750 - protein, 33 aa, Mycobacterium; identical to SEQ ID NO: 162049

SEQ ID NO: 351751 - protein, 18 aa, Mycobacterium
AWTPALLALFGCGSFVGV

SEQ ID NO: 351752 - protein, 37 aa, Mycobacterium
AWTPGAPARSTPRLPRWWPPAAIGLAAAIVVTGVVLT

SEQ ID NO: 351753 - protein, 19 aa, Mycobacterium
AWTYLMYAGSWVGGPLRME

SEQ ID NO: 351754 - protein, 21 aa, Mycobacterium
AWVFIAGFLMHIALKVPRMIT

SEQ ID NO: 351755 - protein, 18 aa, Mycobacterium
AWVKLGFVVFVVAGIYAI

SEQ ID NO: 351756 - protein, 21 aa, Mycobacterium
AWVLGVTLLLMVVAFAALVAN

SEQ ID NO: 351757 - protein, 18 aa, Mycobacterium
AWVLRSRGIGPEDTVALA

SEQ ID NO: 351758 - protein, 18 aa, Mycobacterium
AWVMFAVLLVLTVLQLRL

SEQ ID NO: 351759 - protein, 21 aa, Mycobacterium
AWVVHLLPLLPISTAVLVMLP

SEQ ID NO: 351760 - protein, 23 aa, Mycobacterium
AWWFLFLVVVAGLVALYIVVQRA

SEQ ID NO: 351761 - protein, 18 aa, Mycobacterium
AWWNKILEQIRASDVFIV

SEQ ID NO: 351762 - protein, 19 aa, Mycobacterium
AWYAAQWIRTALAMIAYGA

SEQ ID NO: 351763 - protein, 21 aa, Mycobacterium
AYACAIGLKRLGKDVRFVGLI

SEQ ID NO: 351764 - protein, 33 aa, Mycobacterium
AYAFARLEFPGRDVLFWVYLATLMVPATVTVVP

SEQ ID NO: 351765 - protein, 20 aa, Mycobacterium
AYAIGWMYFLGWSMTAIVDT

SEQ ID NO: 351766 - protein, 25 aa, Mycobacterium
AYALAALWALALAYSPSRRVIVLRR

SEQ ID NO: 351767 - protein, 20 aa, Mycobacterium
AYAMAPWIGLAVAAVLLIVV

SEQ ID NO: 351768 - protein, 18 aa, Mycobacterium
AYANKIWHRSGINIVKRP

SEQ ID NO: 351769 - protein, 20 aa, Mycobacterium
AYARGWWAGETLADALREGA

SEQ ID NO: 351770 - protein, 17 aa, Mycobacterium
AYASALIWVGPVLLRRV

SEQ ID NO: 351771 - protein, 26 aa, Mycobacterium
AYAVGLAISWLLQRLGRRSTLLHHAA

SEQ ID NO: 351772 - protein, 19 aa, Mycobacterium
AYAWRMLLSPEGPLSWATG

SEQ ID NO: 351773 - protein, 27 aa, Mycobacterium
AYCWPIRQRPRSLRPLAWVQRLTALPE

SEQ ID NO: 351774 - protein, 34 aa, Mycobacterium
AYDTDAVPFIWSSPLWFPVLVGGATVILAELRLH

SEQ ID NO: 351775 - protein, 18 aa, Mycobacterium
AYFGILVYYIADGNLERI

SEQ ID NO: 351776 - protein, 25 aa, Mycobacterium
AYFSGLGVLIVFLAGAVLSRLAVRL

SEQ ID NO: 351777 - protein, 31 aa, Mycobacterium
AYGLAIVALPFMILIGLIVAGQWKLLGAYAT

SEQ ID NO: 351778 - protein, 31 aa, Mycobacterium
AYGSLVIVFQWGWLEFLGFHKANIDSSIPPL

SEQ ID NO: 351779 - protein, 22 aa, Mycobacterium
AYGWRIPFLLGGVFGLVAIYMR

SEQ ID NO: 351780 - protein, 18 aa, Mycobacterium
AYIIPGSSTTWRCSFEFD

SEQ ID NO: 351781 - protein, 33 aa, Mycobacterium
AYKPLARNGFASLWSWIFGLVVTEFPLPTLASQ

SEQ ID NO: 351782 - protein, 23 aa, Mycobacterium
AYLALPVVAILIGLLASVAGLKR

SEQ ID NO: 351783 - protein, 39 aa, Mycobacterium
AYLFGGRMRVSTVGLVLVFFALYWVNQNYQPEPPAPAMD

SEQ ID NO: 351784 - protein, 17 aa, Mycobacterium
AYLLFLAAFLYLIGFVG

SEQ ID NO: 351785 - protein, 19 aa, Mycobacterium
AYLLIIEPPLYFPAAFGIE

SEQ ID NO: 351786 - protein, 29 aa, Mycobacterium
AYMNAQFLLAIIFQRYRLALPEGWKPKHH

SEQ ID NO: 351787 - protein, 25 aa, Mycobacterium
AYNLAIFLGYLFVSFTVASYLTLRM

SEQ ID NO: 351788 - protein, 24 aa, Mycobacterium
AYPLACLAGLWWAAHAMFDHYVVE

SEQ ID NO: 351789 - protein, 24 aa, Mycobacterium
AYPLAWGLCGLFPLAAIPLVPTRL

SEQ ID NO: 351790 - protein, 19 aa, Mycobacterium
AYPRSASVVIWYAPEDCDT

SEQ ID NO: 351791 - protein, 20 aa, Mycobacterium
AYPRSGSVVIWYLPDDCDTA

SEQ ID NO: 351792 - protein, 20 aa, Mycobacterium
AYPRTGSVVVWYSPRRCDRS

SEQ ID NO: 351793 - protein, 20 aa, Mycobacterium
AYPRTGSVVVWYSPRRCNRS

SEQ ID NO: 351794 - protein, 21 aa, Mycobacterium
AYQAALVLAIFYLTPVVKPRF

SEQ ID NO: 351795 - protein, 30 aa, Mycobacterium
AYQGYPPPGPVPPPPPMPPPYGSTYGSYDS

SEQ ID NO: 351796 - protein, 17 aa, Mycobacterium
AYRLIELALRGGGPDNV

SEQ ID NO: 351797 - protein, 18 aa, Mycobacterium
AYRLYRPASPGPNLLHPL

SEQ ID NO: 351798 - protein, 25 aa, Mycobacterium
AYRTTIFAFPVFGFGVIFGAIWAEE

SEQ ID NO: 351799 - protein, 26 aa, Mycobacterium
AYRTTIFGFPIFGFGVIFGAIWAEEA

SEQ ID NO: 351800 - protein, 20 aa, Mycobacterium
AYRYARAMARWSPTSRSEIA

SEQ ID NO: 351801 - protein, 17 aa, Mycobacterium
AYSLLTAAPAWAAVGVG

SEQ ID NO: 351802 - protein, 20 aa, Mycobacterium
AYSMAPWIALAVAAVLLVVV

SEQ ID NO: 351803 - protein, 19 aa, Mycobacterium
AYSMAPWIAMAVAAVLLVV

SEQ ID NO: 351804 - protein, 33 aa, Mycobacterium
AYSMLIVVLFVPAALPWYYSWPLAIVAPLAQSR

SEQ ID NO: 351805 - protein, 17 aa, Mycobacterium
AYSPTYLRGSTLSLTDN

SEQ ID NO: 351806 - protein, 23 aa, Mycobacterium
AYSTLVLIPLLGGASLAAGCAAG

SEQ ID NO: 351807 - protein, 25 aa, Mycobacterium
AYTGLNTPLFLKGLARMFGEGAYMN

SEQ ID NO: 351808 - protein, 28 aa, Mycobacterium
AYTLRRLVSHFWRLVISSGTRPLRFVSM

SEQ ID NO: 351809 - protein, 23 aa, Mycobacterium
AYVAAKILVFGLVAIVQTAALTA

SEQ ID NO: 351810 - protein, 20 aa, Mycobacterium
AYVAPWQLPADKWYTWVIAL

SEQ ID NO: 351811 - protein, 20 aa, Mycobacterium
AYVIVTFWQYRNACSTHPGI

SEQ ID NO: 351812 - protein, 17 aa, Mycobacterium
AYVLLVLVCRRRWRPRL

SEQ ID NO: 351813 - protein, 25 aa, Mycobacterium
AYVSFFLANRLLVAHVAWCAPMIIA

SEQ ID NO: 351814 - protein, 17 aa, Mycobacterium
CAAFLAAALAMLAPVRR

SEQ ID NO: 351815 - protein, 28 aa, Mycobacterium
CAAFVALAGFILALFLREVPLADIHDSP

SEQ ID NO: 351816 - protein, 26 aa, Mycobacterium
CAALALNLWVGYFPWVQTAWNQLTAG

SEQ ID NO: 351817 - protein, 23 aa, Mycobacterium
CAARPLTPFAALAKLIVASLISA

SEQ ID NO: 351818 - protein, 30 aa, Mycobacterium
CACTEAVLFAWLIHALAHPTPPEKGDSVVR

SEQ ID NO: 351819 - protein, 18 aa, Mycobacterium
CAFAYLRGFGRRPAWVIA

SEQ ID NO: 351820 - protein, 17 aa, Mycobacterium
CAGVPIVALVGDGPDSG

SEQ ID NO: 351821 - protein, 27 aa, Mycobacterium
CAHPPGLLNLVLVDFKGGATFLGLEAV

SEQ ID NO: 351822 - protein, 29 aa, Mycobacterium
CAILIAGMLILTAALLFSSLPALIAAAVV

SEQ ID NO: 351823 - protein, 28 aa, Mycobacterium
CAIPPLFILAPFWLLPASLYVHMEMTVP

SEQ ID NO: 351824 - protein, 25 aa, Mycobacterium
CAIVRWSIWPSKRQSVVLILALNLA

SEQ ID NO: 351825 - protein, 22 aa, Mycobacterium
CALALFAIFWWALPLTLRTHGM

SEQ ID NO: 351826 - protein, 18 aa, Mycobacterium
CALAMMVFSKSFSVLRSA

SEQ ID NO: 351827 - protein, 25 aa, Mycobacterium
CALAPNILSLIFFRVLQGVGGGMLM

SEQ ID NO: 351828 - protein, 22 aa, Mycobacterium
CALDYEYIAMLFVEADSATLAV

SEQ ID NO: 351829 - protein, 17 aa, Mycobacterium
CALIINGFTRFVSSGLS

SEQ ID NO: 351830 - protein, 17 aa, Mycobacterium
CALLGEAIYPTGPQARM

SEQ ID NO: 351831 - protein, 35 aa, Mycobacterium
CALLLQIYVVMGAGWVWYRGLQGEPLPAFGSAMVL

SEQ ID NO: 351832 - protein, 25 aa, Mycobacterium
CALTGVMPMRVILATMMVVGGLAVA

SEQ ID NO: 351833 - protein, 17 aa, Mycobacterium
CALTIISWVVFGGAATF

SEQ ID NO: 351834 - protein, 17 aa, Mycobacterium
CALWPAARQRLVWMTLA

SEQ ID NO: 351835 - protein, 17 aa, Mycobacterium
CAMFLIHDSPGYLWAGL

SEQ ID NO: 351836 - protein, 25 aa, Mycobacterium
CAPAAFRFMSQARHIGKVVLTMPSA

SEQ ID NO: 351837 - protein, 27 aa, Mycobacterium
CATIPVGLILLSWLLARADPGVPKMSL

SEQ ID NO: 351838 - protein, 18 aa, Mycobacterium
CATKWSGLYFVMFFGLMT

SEQ ID NO: 351839 - protein, 17 aa, Mycobacterium
CATVFFVVVYLLSAWTT

SEQ ID NO: 351840 - protein, 26 aa, Mycobacterium
CAVAPNILLLILFRVVQGVGGGMLLP

SEQ ID NO: 351841 - protein, 29 aa, Mycobacterium
CAVGSLGWALRWAVGPWPSLREAVAFVAF

SEQ ID NO: 351842 - protein, 18 aa, Mycobacterium
CAVLALPIVPLFAYSRGA

SEQ ID NO: 351843 - protein, 24 aa, Mycobacterium
CAVLSGLFVWKWVRETKGVSLEDM

SEQ ID NO: 351844 - protein, 23 aa, Mycobacterium
CAVVLATMPPLLSAIANASRHGV

SEQ ID NO: 351845 - protein, 22 aa, Mycobacterium
CAVVLFLLFWSLLPLLLRTRGM

SEQ ID NO: 351846 - protein, 17 aa, Mycobacterium
CCGRPLYDYGFLDIAER

SEQ ID NO: 351847 - protein, 17 aa, Mycobacterium
CCSVLLLTGIAVVELAV

SEQ ID NO: 351848 - protein, 19 aa, Mycobacterium
CDDMFKVRGATVYPAEVEQ

SEQ ID NO: 351849 - protein, 18 aa, Mycobacterium
CDGSGTLVAGLIAGAPGP

SEQ ID NO: 351850 - protein, 17 aa, Mycobacterium
CDKFPLDNLPDDALNLL

SEQ ID NO: 351851 - protein, 32 aa, Mycobacterium
CDMAVPRFCRLVFVIGLLLSVTMATTVLAAPG

SEQ ID NO: 351852 - protein, 22 aa, Mycobacterium
CDQVLLMAPGGKTAFLGPPAQI

SEQ ID NO: 351853 - protein, 25 aa, Mycobacterium
CDYRTPVLFLLRLSVPTAASVAMVL

SEQ ID NO: 351854 - protein, 37 aa, Mycobacterium
CEITATVLLVLFLYDNLGLNWALFGAAATMVVTSFVV

SEQ ID NO: 351855 - protein, 22 aa, Mycobacterium
CFVVLIKWLVARRAAAFAYYGL

SEQ ID NO: 351856 - protein, 21 aa, Mycobacterium
CFWHLVDLLWIFLFALLYLVS

SEQ ID NO: 351857 - protein, 27 aa, Mycobacterium
CGAASFLLYGLLDLWWHTVYGFDAVLA

SEQ ID NO: 351858 - protein, 29 aa, Mycobacterium
CGAVLIHGLCRWFFLNRAGAVRLTVLLDL

SEQ ID NO: 351859 - protein, 22 aa, Mycobacterium
CGCLALGWWQWTRFQSVSGSFQ

SEQ ID NO: 351860 - protein, 22 aa, Mycobacterium
CGCLALGWWQWTRFQSVSGTFQ

SEQ ID NO: 351861 - protein, 28 aa, Mycobacterium
CGCYYSDVYWITFAGMAPADDPRYVIGV

SEQ ID NO: 351862 - protein, 17 aa, Mycobacterium
CGFAMLPAYLLLVVRGQ

SEQ ID NO: 351863 - protein, 27 aa, Mycobacterium
CGGEVLTPGLFARFRKQLTTTLYHGYG

SEQ ID NO: 351864 - protein, 45 aa, Mycobacterium
CGGLVGPIFLIVYFALGVGSLLSWMLYVGLLITVADVLIALALTN

SEQ ID NO: 351865 - protein, 45 aa, Mycobacterium
CGGLVGPIFLIVYFTLGLGSLLQWMFYVGLLVTVADVLIALALAN

SEQ ID NO: 351866 - protein, 45 aa, Mycobacterium
CGGLVGPIFLIVYFTLGLGSLLSWMFYVGLLITVADVLIALALTN

SEQ ID NO: 351867 - protein, 45 aa, Mycobacterium
CGGLVGPIFLVVYFVMGLDSLLQWMFYVGLLITAADVLIALALAN

SEQ ID NO: 351868 - protein, 41 aa, Mycobacterium
CGIAFGALFFCLSLTPSLMPRTWLFQGLIGGATAAIGYGIG

SEQ ID NO: 351869 - protein, 27 aa, Mycobacterium
CGLLGLGSALIIAALLLSTYTSNRLAK

SEQ ID NO: 351870 - protein, 24 aa, Mycobacterium
CGLPPPMLVIFVLTPVVASGSTIG

SEQ ID NO: 351871 - protein, 28 aa, Mycobacterium
CGLSAVALFLTWPPNVVDAAPFLLMFTV

SEQ ID NO: 351872 - protein, 26 aa, Mycobacterium
CGPRPYLRALRPSPLPGQLLTEIGPS

SEQ ID NO: 351873 - protein, 23 aa, Mycobacterium
CGRRLFWPFIPRAEDTTALDSGF

SEQ ID NO: 351874 - protein, 23 aa, Mycobacterium
CGRTTACATLMREIRRVYAPGAD

SEQ ID NO: 351875 - protein, 30 aa, Mycobacterium
CGTDAFRSQALLYTSMLVQAYQAANVRVQV

SEQ ID NO: 351876 - protein, 30 aa, Mycobacterium
CGTDTFRTQALLYTSMLVQAYQAANIHVQV

SEQ ID NO: 351877 - protein, 25 aa, Mycobacterium
CGVAESCWFRWLASGPLDVRRRQVL

SEQ ID NO: 351878 - protein, 20 aa, Mycobacterium
CGYEFRLETSCYNPSFGADR

SEQ ID NO: 351879 - protein, 17 aa, Mycobacterium
CGYIIAYQRQRTLRRRP

SEQ ID NO: 351880 - protein, 21 aa, Mycobacterium
CGYLFRRRLGTHLRTLFLGLL

SEQ ID NO: 351881 - protein, 19 aa, Mycobacterium
CHRLDGIPLAIELAASRMQ

SEQ ID NO: 351882 - protein, 17 aa, Mycobacterium
CHRLTTSPGLGVLQCGD

SEQ ID NO: 351883 - protein, 17 aa, Mycobacterium
CHYLLFPGLAALSYDVL

SEQ ID NO: 351884 - protein, 21 aa, Mycobacterium
CIAAFGLLPLGVIAGVFGPQS

SEQ ID NO: 351885 - protein, 27 aa, Mycobacterium
CIAEILMFTGFLWPPVVSRVQAHRDVR

SEQ ID NO: 351886 - protein, 25 aa, Mycobacterium
CIGALTSWFGLLAYGGIASDRNRRS

SEQ ID NO: 351887 - protein, 43 aa, Mycobacterium
CIGLLLDTLIVRTLLMPSIATLLGRWFWWPQVVHPRGDNARPR

SEQ ID NO: 351888 - protein, 43 aa, Mycobacterium
CIGLLLDTLIVRTLLMPSIATLLGRWFWWPQVVHPRGDNARRP

SEQ ID NO: 351889 - protein, 17 aa, Mycobacterium
CILPIYLITGGHDVEIT

SEQ ID NO: 351890 - protein, 17 aa, Mycobacterium
CILVALGGVAWSQSAFR

SEQ ID NO: 351891 - protein, 17 aa, Mycobacterium
CIRPFLTTLGGITFNAE

SEQ ID NO: 351892 - protein, 25 aa, Mycobacterium
CIVFALLGLYLTYVGWAPAASGPSQ

SEQ ID NO: 351893 - protein, 18 aa, Mycobacterium
CKAWLLAQPHLVAGILLV

SEQ ID NO: 351894 - protein, 28 aa, Mycobacterium
CKGLEKVPLLGWLWSWELALPMSGIAMA

SEQ ID NO: 351895 - protein, 19 aa, Mycobacterium
CKRLLASRGLMAAVVVLAI

SEQ ID NO: 351896 - protein, 27 aa, Mycobacterium
CLAAFPILVALVWWFRNESARTYRKVR

SEQ ID NO: 351897 - protein, 25 aa, Mycobacterium
CLAAVTAVAVGLWVENNRTVDDIPQ

SEQ ID NO: 351898 - protein, 22 aa, Mycobacterium
CLASAWHYFPRHRFLFGDKYDS

SEQ ID NO: 351899 - protein, 57 aa, Mycobacterium
CLCAAVWLLCHRPNRVWWRFVAWWLPCVALAVTWWVIALLHLGRISPPFLDFIESSG

SEQ ID NO: 351900 - protein, 29 aa, Mycobacterium
CLGAAVGLTWWWWGYRRRGISYVQLTPEG

SEQ ID NO: 351901 - protein, 19 aa, Mycobacterium
CLHFTRLNYFSSMGIPSAI

SEQ ID NO: 351902 - protein, 17 aa, Mycobacterium
CLHLARLSYFKALGIPS

SEQ ID NO: 351903 - protein, 19 aa, Mycobacterium
CLHLYLRDEFTRLDGQTRR

SEQ ID NO: 351904 - protein, 30 aa, Mycobacterium
CLITIGAGLLQILFGLSRIARAALAIAPVV

SEQ ID NO: 351905 - protein, 25 aa, Mycobacterium
CLLAGYTWLLVPAVIWLLSGQVISG

SEQ ID NO: 351906 - protein, 27 aa, Mycobacterium
CLLLALGAGVLWWITDRRPRSRRWPRA

SEQ ID NO: 351907 - protein, 25 aa, Mycobacterium
CLMVATGSAALWWHAARRPKCPPQL

SEQ ID NO: 351908 - protein, 25 aa, Mycobacterium
CLPSQLPFRSLFAGPVTGRQLPEPD

SEQ ID NO: 351909 - protein, 17 aa, Mycobacterium
CLRIPYSLGIATFGGRN

SEQ ID NO: 351910 - protein, 17 aa, Mycobacterium
CLVALILILPLAALSDR

SEQ ID NO: 351911 - protein, 17 aa, Mycobacterium
CLVLLFTALNPVGAIIG

SEQ ID NO: 351912 - protein, 26 aa, Mycobacterium
CLVNEFSLTGIWLALGLGSPDRGAAL

SEQ ID NO: 351913 - protein, 18 aa, Mycobacterium
CLVTLQSVLLVLGAWRND

SEQ ID NO: 351914 - protein, 32 aa, Mycobacterium
CLYCAYELWRFDSIRSWLLVAVMNIAMIAVHL

SEQ ID NO: 351915 - protein, 18 aa, Mycobacterium
CMASAILGLLLSSIARSN

SEQ ID NO: 351916 - protein, 17 aa, Mycobacterium
CMFAPTITVLGIARGLQ

SEQ ID NO: 351917 - protein, 26 aa, Mycobacterium
CMTGRYLLTFQIYLALPIQASALAPH

SEQ ID NO: 351918 - protein, 25 aa, Mycobacterium
CMWLGVVLMLLAWLGLGRHVIAGKV

SEQ ID NO: 351919 - protein, 19 aa, Mycobacterium
CPLMKLPIISPYLGREFTE

SEQ ID NO: 351920 - protein, 28 aa, Mycobacterium
CPRSPFRDRWFVVFTIGNGVLWLHDSVL

SEQ ID NO: 351921 - protein, 18 aa, Mycobacterium
CPTWPQCFPGSFTPVAVA

SEQ ID NO: 351922 - protein, 23 aa, Mycobacterium
CPVWFYELWAFITPGLYKKERRF

SEQ ID NO: 351923 - protein, 24 aa, Mycobacterium
CRDPKGYVPLGRNPWRGPPVPYDT

SEQ ID NO: 351924 - protein, 17 aa, Mycobacterium
CRLLPMMVTVAIGLAVL

SEQ ID NO: 351925 - protein, 19 aa, Mycobacterium
CSADSSPKAPRWAWVALVV

SEQ ID NO: 351926 - protein, 23 aa, Mycobacterium
CSAGYAGWAWLQPGSFRAWVTEP

SEQ ID NO: 351927 - protein, 24 aa, Mycobacterium
CSAGYAGWAWLQPGSFRAWVTEPV

SEQ ID NO: 351928 - protein, 24 aa, Mycobacterium
CSEALRRTWRRGWPTGPATPLPLR

SEQ ID NO: 351929 - protein, 37 aa, Mycobacterium
CSGVILTTMLVGWVIGLIMVNPFRLLAQQARAINAQS

SEQ ID NO: 351930 - protein, 22 aa, Mycobacterium
CSITKFRGGLTQWLEPSMSSAV

SEQ ID NO: 351931 - protein, 25 aa, Mycobacterium
CSITLACLAYPDALAALLGCITFMT

SEQ ID NO: 351932 - protein, 18 aa, Mycobacterium
CSPWQIYWQVLLPHARPA

SEQ ID NO: 351933 - protein, 23 aa, Mycobacterium
CSPWQIYWRILLPHARPAVMVLA

SEQ ID NO: 351934 - protein, 23 aa, Mycobacterium
CSPWQIYWRILLPHARPAVMVLG

SEQ ID NO: 351935 - protein, 25 aa, Mycobacterium
CTNVLQMIISVGLDWNIRSVSWLPL

SEQ ID NO: 351936 - protein, 28 aa, Mycobacterium
CTSAGNPLLALLEYLPYATDLGLHLIVA

SEQ ID NO: 351937 - protein, 19 aa, Mycobacterium
CTVLGPGAFRLAVLVLIVL

SEQ ID NO: 351938 - protein, 26 aa, Mycobacterium
CVAALLVAQIFVRPIRRLQAGAQEIG

SEQ ID NO: 351939 - protein, 18 aa, Mycobacterium
CVALLLERSSQAIVAMLA

SEQ ID NO: 351940 - protein, 25 aa, Mycobacterium
CVASMVLAQLMLRPIRRLQAGTQKI

SEQ ID NO: 351941 - protein, 19 aa, Mycobacterium
CVDGELAGAVLLRDPLRRQ

SEQ ID NO: 351942 - protein, 35 aa, Mycobacterium
CVFWAAVTAVLAAWGWFALLLQITGAIAVVQVIPA

SEQ ID NO: 351943 - protein, 17 aa, Mycobacterium
CVGLLLDTLIVRSFIVP

SEQ ID NO: 351944 - protein, 18 aa, Mycobacterium
CVIAHWVWAPSGWLLKMG

SEQ ID NO: 351945 - protein, 17 aa, Mycobacterium
CVIFAWNEFFFAVNLTA

SEQ ID NO: 351946 - protein, 17 aa, Mycobacterium
CVLAAVLVLLLVVGKPA

SEQ ID NO: 351947 - protein, 29 aa, Mycobacterium
CVLAVLVLLRFLTPWGRQYWRITREYFVG

SEQ ID NO: 351948 - protein, 17 aa, Mycobacterium
CVLGSFLAFAFGAVVAL

SEQ ID NO: 351949 - protein, 25 aa, Mycobacterium
CVLSLLVLAVLLFTGPLAGYLSRRQ

SEQ ID NO: 351950 - protein, 18 aa, Mycobacterium
CVLTLTIAGPVRTYFSQR

SEQ ID NO: 351951 - protein, 18 aa, Mycobacterium
CVMFLRRGHEIPRRYLAL

SEQ ID NO: 351952 - protein, 17 aa, Mycobacterium
CVTPLPYAQASLDAVAE

SEQ ID NO: 351953 - protein, 19 aa, Mycobacterium
CVVFLLAAASVVATFRVNF

SEQ ID NO: 351954 - protein, 20 aa, Mycobacterium
CVVLFFVFGGVIAAALPGII

SEQ ID NO: 351955 - protein, 25 aa, Mycobacterium
CVWLAIIMVPIYWIVITSLKSQSNY

SEQ ID NO: 351956 - protein, 18 aa, Mycobacterium
CVYAFFLTFFVYRDIPLS

SEQ ID NO: 351957 - protein, 21 aa, Mycobacterium
CVYPWSPFSLVNGSVSFVGVE

SEQ ID NO: 351958 - protein, 33 aa, Mycobacterium
CWPTAPRWLGVPLYLLLGWVAIWYAPTILHQAG

SEQ ID NO: 351959 - protein, 32 aa, Mycobacterium
CWPTAPRWVGVPLYLLLGWVAVWYTATILHNA

SEQ ID NO: 351960 - protein, 24 aa, Mycobacterium
CWQAITHDLWPAPSLVVDTGASLA

SEQ ID NO: 351961 - protein, 29 aa, Mycobacterium
CWQKITRELWPAPFLVMDTGASMAPYNHF

SEQ ID NO: 351962 - protein, 22 aa, Mycobacterium
CWQQITHDFWPAPELVMDTANS

SEQ ID NO: 351963 - protein, 21 aa, Mycobacterium
CWQSITHDFWPAPELVMDTGN

SEQ ID NO: 351964 - protein, 28 aa, Mycobacterium
CWQTITRDLWPAPYLVMDVGANMAPYNH

SEQ ID NO: 351965 - protein, 30 aa, Mycobacterium
CWVVLPWPRRRVAIAFVWWADISMVVGACT

SEQ ID NO: 351966 - protein, 26 aa, Mycobacterium
CYPYREPLPAPPPGGPPPGPPAQPGQ

SEQ ID NO: 351967 - protein, 17 aa, Mycobacterium
CYVVGGWEPAWVGVRAL

SEQ ID NO: 351968 - protein, 24 aa, Mycobacterium
DAAAALAALRPTPGFPASGVVALC

SEQ ID NO: 351969 - protein, 30 aa, Mycobacterium
DAAFLLIVFVFLLIILGRLITWFARRHSES

SEQ ID NO: 351970 - protein, 23 aa, Mycobacterium
DAALQIMFIALAAQGWHLWLRGS

SEQ ID NO: 351971 - protein, 35 aa, Mycobacterium
DAALSNYFRRGNLTALRELALLWLADQVDAALAKY

SEQ ID NO: 351972 - protein, 37 aa, Mycobacterium
DAALSNYFRRGNLTALRELALLWLADQVDTALAKYRA

SEQ ID NO: 351973 - protein, 24 aa, Mycobacterium
DAAPAQAFWLSVAVAGGCVAGALR

SEQ ID NO: 351974 - protein, 36 aa, Mycobacterium
DAARNYLFPIYASQLTPWWLRILGAKIGKDTEISTA

SEQ ID NO: 351975 - protein, 35 aa, Mycobacterium
DAARNYLFPVYASLLTPWWLRLLGAKVGEGTEIST

SEQ ID NO: 351976 - protein, 28 aa, Mycobacterium
DAARQWFSAKWPGFFATNRQPQPLLDIV

SEQ ID NO: 351977 - protein, 20 aa, Mycobacterium
DAASIALALWAIRLAARPAA

SEQ ID NO: 351978 - protein, 17 aa, Mycobacterium
DACGFRRLVFATPEELE

SEQ ID NO: 351979 - protein, 37 aa, Mycobacterium
DADHPGLLGANIYWLGEQWWRPLIAVGAVALGITVIA

SEQ ID NO: 351980 - protein, 34 aa, Mycobacterium
DADIDVLLSLLLLLFPHLALAPYMRGLDPVLGLD

SEQ ID NO: 351981 - protein, 27 aa, Mycobacterium
DADRKWLTIALILIGGFMAIEVVIGII

SEQ ID NO: 351982 - protein, 29 aa, Mycobacterium
DADSKPAAWLPSGPAVLADFPTVLLSGDW

SEQ ID NO: 351983 - protein, 32 aa, Mycobacterium
DAEHARHLLIRLAVAAVLFVPLADLSVMFAVV

SEQ ID NO: 351984 - protein, 33 aa, Mycobacterium
DAEHARKLLWRLLVAAVLFVPLADLSTMCALVP

SEQ ID NO: 351985 - protein, 31 aa, Mycobacterium
DAEHARTLLRRLLVAAVLFVPLADLSTMFAL

SEQ ID NO: 351986 - protein, 35 aa, Mycobacterium
DAEHLLAVPVWDKLDRLYLLAPDPSTNLLRLRAVT

SEQ ID NO: 351987 - protein, 20 aa, Mycobacterium
DAEHWRKLLRGNAPARVRLI

SEQ ID NO: 351988 - protein, 22 aa, Mycobacterium
DAEKLLKAIMLQAQVTSKGEII

SEQ ID NO: 351989 - protein, 26 aa, Mycobacterium
DAEKYAPFPTLAWSRAYRSGDLVRLE

SEQ ID NO: 351990 - protein, 23 aa, Mycobacterium
DAELARLMAAQPPAAVPAKRTGP

SEQ ID NO: 351991 - protein, 25 aa, Mycobacterium
DAEPNPGDWLLWDGKRSPIDLADRA

SEQ ID NO: 351992 - protein, 28 aa, Mycobacterium
DAERWNLPIILIVLLAVFGSLAAAAIPL

SEQ ID NO: 351993 - protein, 22 aa, Mycobacterium
DAEWSWLKWLPHVDISGEVDGV

SEQ ID NO: 351994 - protein, 18 aa, Mycobacterium
DAFSWAWNKFSKHAVEMI

SEQ ID NO: 351995 - protein, 24 aa, Mycobacterium
DAGAALLLERAPVGSAGIALAGFT

SEQ ID NO: 351996 - protein, 25 aa, Mycobacterium
DAGFIVMLPIIYTVARRLGGSFMLY

SEQ ID NO: 351997 - protein, 23 aa, Mycobacterium
DAGFWRLIAELDAERLDRSRPMW

SEQ ID NO: 351998 - protein, 21 aa, Mycobacterium
DAGLRAWALRDLAGRDANQIR

SEQ ID NO: 351999 - protein, 31 aa, Mycobacterium
DAGQMRVGQLLAFMLYAMQILAAASMLSKIL

SEQ ID NO: 352000 - protein, 29 aa, Mycobacterium
DAGRLGWPLWVAYVGVFALTVLVGARLMV

SEQ ID NO: 352001 - protein, 26 aa, Mycobacterium
DAGSKLAGWLPQGPAAVADYPTVLLA

SEQ ID NO: 352002 - protein, 17 aa, Mycobacterium
DAGTIELLMLRAERFGV

SEQ ID NO: 352003 - protein, 24 aa, Mycobacterium
DAGTPQRFVWFPVSDPDRPKDRPA

SEQ ID NO: 352004 - protein, 21 aa, Mycobacterium
DAGTPYWLIAAVMAALGSGLG

SEQ ID NO: 352005 - protein, 44 aa, Mycobacterium
DAHRRMGWPRLLAYGVLPGLALALALLAGFLKWQCSSAPDSTGR

SEQ ID NO: 352006 - protein, 20 aa, Mycobacterium
DAHVPYLTWLATTSADYAAT

SEQ ID NO: 352007 - protein, 20 aa, Mycobacterium
DAHVPYLTWLTKTSADYAAT

SEQ ID NO: 352008 - protein, 20 aa, Mycobacterium
DAIMFEPRYAVRQPDGGWGE

SEQ ID NO: 352009 - protein, 25 aa, Mycobacterium
DAIRAGLLLWGGWVLVTGVVFSYMD

SEQ ID NO: 352010 - protein, 25 aa, Mycobacterium
DAIRYALAFFLLQAVFVFIGTALAD

SEQ ID NO: 352011 - protein, 38 aa, Mycobacterium
DAITSRLPLVLGLIAIIMFALLFLLTGSVVVPLKALVL

SEQ ID NO: 352012 - protein, 19 aa, Mycobacterium
DAIVGAGIGLFILPRTYSL

SEQ ID NO: 352013 - protein, 24 aa, Mycobacterium
DAIVLHPLWGSVIFFAVMFCFFQV

SEQ ID NO: 352014 - protein, 17 aa, Mycobacterium
DAKAPVLLQVPGGAWMI

SEQ ID NO: 352015 - protein, 26 aa, Mycobacterium
DAKKKLSSWLPPGPVAVADYPAVLLN

SEQ ID NO: 352016 - protein, 22 aa, Mycobacterium
DAKWRWRDWLRAARQYKLPGPW

SEQ ID NO: 352017 - protein, 35 aa, Mycobacterium
DALAQYRALILSRVRLFLIGVPILIGVLAGVVAQS

SEQ ID NO: 352018 - protein, 39 aa, Mycobacterium
DALETEPTPWYRKPPLLIAWLVFVAVLIGLIVYGITELL

SEQ ID NO: 352019 - protein, 21 aa, Mycobacterium
DALFAPFQRLGDTNTTTGVGL

SEQ ID NO: 352020 - protein, 20 aa, Mycobacterium
DALFWVYIATLMVPATVTVV

SEQ ID NO: 352021 - protein, 22 aa, Mycobacterium
DALGLLCTVVVIPLCAATLGVL

SEQ ID NO: 352022 - protein, 20 aa, Mycobacterium
DALHFAKPIFGPAARALAQL

SEQ ID NO: 352023 - protein, 25 aa, Mycobacterium
DALKARIPVLPPDSGVGLWTFDGVA

SEQ ID NO: 352024 - protein, 24 aa, Mycobacterium
DALRKTFLGADFRPVGLTAGSRAL

SEQ ID NO: 352025 - protein, 29 aa, Mycobacterium
DALTAVPLWIAFALGRRAATRRYTYGFGR

SEQ ID NO: 352026 - protein, 26 aa, Mycobacterium
DALTAVPLWIAFALGTRAATRRYTYG

SEQ ID NO: 352027 - protein, 18 aa, Mycobacterium
DALTSYRWDLIGSLLGIG

SEQ ID NO: 352028 - protein, 21 aa, Mycobacterium
DALYGLRGMIFGEQATRDVQV

SEQ ID NO: 352029 - protein, 17 aa, Mycobacterium
DAMILMPSIVVACGLVL

SEQ ID NO: 352030 - protein, 29 aa, Mycobacterium
DAMLTYGWRIPLLLGAPFGLFALVLRLRL

SEQ ID NO: 352031 - protein, 32 aa, Mycobacterium
DAMLTYGWRIPLLLGLPFGLVALFLRLRLEES

SEQ ID NO: 352032 - protein, 23 aa, Mycobacterium
DANGYLFYHGRSDDMFKVSGATV

SEQ ID NO: 352033 - protein, 37 aa, Mycobacterium
DANLALAPFWVAFVAFMVWLLLRFDPFRAMRPYPQVL

SEQ ID NO: 352034 - protein, 25 aa, Mycobacterium
DANYHRVFWLTTVFTAVVIVVAVAA

SEQ ID NO: 352035 - protein, 22 aa, Mycobacterium
DAPAVILVLMFSAVPFAVEPGR

SEQ ID NO: 352036 - protein, 21 aa, Mycobacterium
DAPFDWYLGVLSKLASVSTAG

SEQ ID NO: 352037 - protein, 29 aa, Mycobacterium
DAPFGYLDWLSWFGYTLVLNVVGGLALVT

SEQ ID NO: 352038 - protein, 44 aa, Mycobacterium
DAPFTDLIPPQVYWMVLQLALAVALLAWWRGRRVGPLVAEQLPV

SEQ ID NO: 352039 - protein, 21 aa, Mycobacterium
DAPLFALLRSSGDPDVVARLN

SEQ ID NO: 352040 - protein, 18 aa, Mycobacterium
DAPLYDKAAARRVRASNL

SEQ ID NO: 352041 - protein, 17 aa, Mycobacterium
DAPPGVVALWALALLIT

SEQ ID NO: 352042 - protein, 24 aa, Mycobacterium
DAPPGWLPAWLRPRKPAPHIARAH

SEQ ID NO: 352043 - protein, 34 aa, Mycobacterium
DAPPIDWRALLRQLPLLNILGVVAVLVAATLVVV

SEQ ID NO: 352044 - protein, 26 aa, Mycobacterium
DAPPPVFPEVTITPPAPTDTSAVETT

SEQ ID NO: 352045 - protein, 22 aa, Mycobacterium
DAPPVRVLLITVAEDDHYLAWS

SEQ ID NO: 352046 - protein, 67 aa, Mycobacterium
DAPRTMSPLVSALWIIGQSVIAVVFGAGLFVAFDQLWKWNNIIALVLSVLVILGLVVGVRLVRKTED

SEQ ID NO: 352047 - protein, 17 aa, Mycobacterium
DAPTLLGPPQKLQFGRR

SEQ ID NO: 352048 - protein, 19 aa, Mycobacterium
DAPTLLKKLQSNESFVYLA

SEQ ID NO: 352049 - protein, 22 aa, Mycobacterium
DAPTPRLMTAWTVLGDKIWIMG

SEQ ID NO: 352050 - protein, 28 aa, Mycobacterium
DAPYAVWIPVVLLVPLGVLLFAARRRPS

SEQ ID NO: 352051 - protein, 23 aa, Mycobacterium
DAQGATRFLPPGALIEVDGTTGE

SEQ ID NO: 352052 - protein, 22 aa, Mycobacterium
DAQGGLLPSWTPGAHIDIRLAS

SEQ ID NO: 352053 - protein, 23 aa, Mycobacterium
DAQLIIPLGIVPSWLALASTGFD

SEQ ID NO: 352054 - protein, 23 aa, Mycobacterium
DAQVAPLLWAAVAGVPGVLVYRG

SEQ ID NO: 352055 - protein, 27 aa, Mycobacterium
DARATFLRWIWYAARREKLHLDGADDD

SEQ ID NO: 352056 - protein, 26 aa, Mycobacterium
DARDARRFIWYAPPAEYDDEQMEPLD

SEQ ID NO: 352057 - protein, 29 aa, Mycobacterium
DARIRLGWPLWAAYITVFALTVLVGTRLM

SEQ ID NO: 352058 - protein, 17 aa, Mycobacterium
DARIVPIPLADAALVDL

SEQ ID NO: 352059 - protein, 22 aa, Mycobacterium
DARPTPLLRARGKFFAHADQLS

SEQ ID NO: 352060 - protein, 23 aa, Mycobacterium
DARPVWARALGLRLPPTGASDRL

SEQ ID NO: 352061 - protein, 29 aa, Mycobacterium
DARRNLLGLFMPAALGMIFIMLAVPSVEV

SEQ ID NO: 352062 - protein, 26 aa, Mycobacterium
DARTRVLYLALLATAAVLTLALMAAT

SEQ ID NO: 352063 - protein, 36 aa, Mycobacterium
DASHYPLTWVASPGRRLWMKLEYRPDVVERDRAQGL

SEQ ID NO: 352064 - protein, 34 aa, Mycobacterium
DASIWMRLPDLFAGLVCWLLLSREVLPRLGPAVA

SEQ ID NO: 352065 - protein, 34 aa, Mycobacterium
DASIWMRLPDLFAGLVCWLLLSREVLPRLGPAVT

SEQ ID NO: 352066 - protein, 17 aa, Mycobacterium
DASLIPVMAFVVGLFSL

SEQ ID NO: 352067 - protein, 17 aa, Mycobacterium
DASLPTVALWALALLIT

SEQ ID NO: 352068 - protein, 23 aa, Mycobacterium
DASLRLLVRGGRFLEMGKTDIRD

SEQ ID NO: 352069 - protein, 24 aa, Mycobacterium
DASQRTHWYGRSSVLISVTGAAAV

SEQ ID NO: 352070 - protein, 18 aa, Mycobacterium
DASRWWFVAAGAAVGFGF

SEQ ID NO: 352071 - protein, 23 aa, Mycobacterium
DASWGVRIIAFVALVFGTLNVIG

SEQ ID NO: 352072 - protein, 30 aa, Mycobacterium
DATASFGVMPPFLLQHLSGHYDNIRIETAG

SEQ ID NO: 352073 - protein, 23 aa, Mycobacterium
DATDRSVLLPLGLTPEQVTQARP

SEQ ID NO: 352074 - protein, 27 aa, Mycobacterium
DATMLRMLVMFGIVTAVALLAATTAGA

SEQ ID NO: 352075 - protein, 23 aa, Mycobacterium
DATNRSVLLPLGLTPEQVGQAKP

SEQ ID NO: 352076 - protein, 23 aa, Mycobacterium
DATNRSVLLPLGLTPEQVSQARP

SEQ ID NO: 352077 - protein, 23 aa, Mycobacterium
DATRSLIGYVLLLLVVVSVLALG

SEQ ID NO: 352078 - protein, 27 aa, Mycobacterium
DATTPFVLQSLYLFILGTGIGLCMQVL

SEQ ID NO: 352079 - protein, 20 aa, Mycobacterium
DATYALAWSQDDPSADDIVP

SEQ ID NO: 352080 - protein, 17 aa, Mycobacterium
DAVAVYRDARGCGQVTM

SEQ ID NO: 352081 - protein, 28 aa, Mycobacterium
DAVGGLLGISPLAVAKIIESLKSSGVDV

SEQ ID NO: 352082 - protein, 32 aa, Mycobacterium
DAVHGLYYLLMHAWFQAFPPTEFFSRAPSGLA

SEQ ID NO: 352083 - protein, 29 aa, Mycobacterium
DAVIRSFRLVRGGFWRVLGIRLLTALVVG

SEQ ID NO: 352084 - protein, 21 aa, Mycobacterium
DAVKFLFRRPFQTSEFLLQSW

SEQ ID NO: 352085 - protein, 27 aa, Mycobacterium
DAVLAINHPLMVATLLDRPALEARAQA

SEQ ID NO: 352086 - protein, 26 aa, Mycobacterium
DAVLLLRAVRQWRYLVGIGLDVVGFL

SEQ ID NO: 352087 - protein, 27 aa, Mycobacterium
DAVLQAYLNIIYFGRGAYGISAASKAY

SEQ ID NO: 352088 - protein, 25 aa, Mycobacterium
DAVVALFAVLRAGAAYLPLELDYPD

SEQ ID NO: 352089 - protein, 22 aa, Mycobacterium
DAVVIAVILVLNALLGYAQETR

SEQ ID NO: 352090 - protein, 22 aa, Mycobacterium
DAVWHQLMPGYTRPHVRLFSDQ

SEQ ID NO: 352091 - protein, 19 aa, Mycobacterium
DAWGHWLGCAAALASFGVG

SEQ ID NO: 352092 - protein, 24 aa, Mycobacterium
DAYALPMAGLLLTAATLGDRLGRR

SEQ ID NO: 352093 - protein, 17 aa, Mycobacterium
DAYAYEYFIRNNPLRDY

SEQ ID NO: 352094 - protein, 25 aa, Mycobacterium
DAYTLVMSGLLLSAGSLSDRFGRRG

SEQ ID NO: 352095 - protein, 25 aa, Mycobacterium
DAYTLVMSGLLLSAGSLSDRYGRRG

SEQ ID NO: 352096 - protein, 27 aa, Mycobacterium
DAYTLVMSGLLLSAGSLSDRYGRRGWL

SEQ ID NO: 352097 - protein, 21 aa, Mycobacterium
DAYVPGELWILLIGGGGVMMA

SEQ ID NO: 352098 - protein, 22 aa, Mycobacterium
DCLFGLLALLAVLNAATLRGTV

SEQ ID NO: 352099 - protein, 26 aa, Mycobacterium
DCSGLTRFAFAGVGVLLPRWSGDQYD

SEQ ID NO: 352100 - protein, 26 aa, Mycobacterium
DDAHKPAHSMFWYRSTRFVLRHAVAV

SEQ ID NO: 352101 - protein, 26 aa, Mycobacterium
DDALGPWLLLVRDLAHLLDTLPLLIG

SEQ ID NO: 352102 - protein, 24 aa, Mycobacterium
DDALNLLHMIYSLIMVAMAVEIMH

SEQ ID NO: 352103 - protein, 25 aa, Mycobacterium
DDATSWLVRRPPLHGLTPSAHDMVR

SEQ ID NO: 352104 - protein, 18 aa, Mycobacterium
DDAVRGLRARLLRAVGPE

SEQ ID NO: 352105 - protein, 23 aa, Mycobacterium
DDAWWLTIVHLRLSLVPVVIGLA

SEQ ID NO: 352106 - protein, 20 aa, Mycobacterium
DDCWWAPRWMRRVQTRIGLG

SEQ ID NO: 352107 - protein, 24 aa, Mycobacterium
DDDKFFVLAFQGVLCLFLLEMGMT

SEQ ID NO: 352108 - protein, 20 aa, Mycobacterium
DDDLVLGVTLIADGRRQPGV

SEQ ID NO: 352109 - protein, 28 aa, Mycobacterium
DDDPNSLLPRWLPATTGSHGWLAKVRAD

SEQ ID NO: 352110 - protein, 44 aa, Mycobacterium
DDDSGPGIWKWIAIGLLALGIIGALLGVWQYQKLSDTLATVRSA

SEQ ID NO: 352111 - protein, 36 aa, Mycobacterium
DDGYSDDLPPLPWYKRPPVLFGLAAAAALLAVGGLA

SEQ ID NO: 352112 - protein, 23 aa, Mycobacterium
DDKRIRLWVVYVEDFSGQSAQTW

SEQ ID NO: 352113 - protein, 27 aa, Mycobacterium
DDLAYGLGLWWGVLRERNLRALKPQIR

SEQ ID NO: 352114 - protein, 22 aa, Mycobacterium
DDLDFLRLAVLDALLVLQADTA

SEQ ID NO: 352115 - protein, 22 aa, Mycobacterium
DDLKTPFYVAVGAGDLALAAVA

SEQ ID NO: 352116 - protein, 20 aa, Mycobacterium
DDLLASLQRILLGFGLAAVV

SEQ ID NO: 352117 - protein, 22 aa, Mycobacterium
DDLLFTYTPFAALVFTPLAFIT

SEQ ID NO: 352118 - protein, 20 aa, Mycobacterium
DDLLRNILQITPVTLRGVAN

SEQ ID NO: 352119 - protein, 22 aa, Mycobacterium
DDLPAVLVVCTRGAMGLAGEAI

SEQ ID NO: 352120 - protein, 30 aa, Mycobacterium
DDLSERVGWRWRLVWYRAVSELLTGAYDAA

SEQ ID NO: 352121 - protein, 26 aa, Mycobacterium
DDLSYTPVLAPLRKPARNLVKLAAAT

SEQ ID NO: 352122 - protein, 19 aa, Mycobacterium
DDLVGWLSTVFTRADWEPE

SEQ ID NO: 352123 - protein, 23 aa, Mycobacterium
DDLWVLTLIHLRLSLIPIVLGLL

SEQ ID NO: 352124 - protein, 18 aa, Mycobacterium
DDMALLPGRVVPSRALWA

SEQ ID NO: 352125 - protein, 35 aa, Mycobacterium
DDNPRTVTPPWVIALLVFVAIGGGILFVVGERIFS

SEQ ID NO: 352126 - protein, 25 aa, Mycobacterium
DDPDDIAHFCHDGLSLVGFLGLSDT

SEQ ID NO: 352127 - protein, 25 aa, Mycobacterium
DDPPGCTVGFLPPSQWRSPADTTTI

SEQ ID NO: 352128 - protein, 23 aa, Mycobacterium
DDPPICTVGFMPPNTWRSPDDLS

SEQ ID NO: 352129 - protein, 39 aa, Mycobacterium
DDPVGLFPRLGRLIGKRPWLVIGVWVALAGTLSLTAPSL

SEQ ID NO: 352130 - protein, 19 aa, Mycobacterium
DDPWRDPAAAAALGTPALI

SEQ ID NO: 352131 - protein, 18 aa, Mycobacterium
DDPWRDPGAAAALGTPAV

SEQ ID NO: 352132 - protein, 18 aa, Mycobacterium
DDPWRDPSAAAALGTPAV

SEQ ID NO: 352133 - protein, 19 aa, Mycobacterium
DDPYQYPRHLPIIGAKGGP

SEQ ID NO: 352134 - protein, 27 aa, Mycobacterium
DDQLKSRLIGSLILAIPVVVISMAMPL

SEQ ID NO: 352135 - protein, 24 aa, Mycobacterium
DDQNSLLPRWLPDASDDRGWVAKV

SEQ ID NO: 352136 - protein, 25 aa, Mycobacterium
DDQWLQTYYLLRAAVAGVWVAAAFI

SEQ ID NO: 352137 - protein, 28 aa, Mycobacterium
DDSRFGIGLLLDGILVAASLLVVFVVLP

SEQ ID NO: 352138 - protein, 28 aa, Mycobacterium
DDSTPFVLQSLYLFILGVGIGASMQVLT

SEQ ID NO: 352139 - protein, 21 aa, Mycobacterium
DDTLSLHYLITHAIPDAVAAV

SEQ ID NO: 352140 - protein, 22 aa, Mycobacterium
DDTPVTLVLPLDQAEELFTSDA

SEQ ID NO: 352141 - protein, 27 aa, Mycobacterium
DDVAPPLLVLWLVRWLLFRVEFGAGMI

SEQ ID NO: 352142 - protein, 25 aa, Mycobacterium
DDVELAQLLAGWRDDIRETPMGHVV

SEQ ID NO: 352143 - protein, 19 aa, Mycobacterium
DDVFGFRIPQALTSAPWGE

SEQ ID NO: 352144 - protein, 27 aa, Mycobacterium
DDVLQAYLNIIYFGRGAYGISAAAKAY

SEQ ID NO: 352145 - protein, 18 aa, Mycobacterium
DDVNPRMPALRTDIAQLA

SEQ ID NO: 352146 - protein, 23 aa, Mycobacterium
DDWDAYQRLSTFGKTLVLAVAGI

SEQ ID NO: 352147 - protein, 17 aa, Mycobacterium
DDWRRWYRLARGYDYAG

SEQ ID NO: 352148 - protein, 27 aa, Mycobacterium
DDYMRNLLQILPVPLRNFTNATGSGYS

SEQ ID NO: 352149 - protein, 37 aa, Mycobacterium
DDYRDTPPMRWFQRPVLWFFAAAVFSAAVFTALFIAW

SEQ ID NO: 352150 - protein, 30 aa, Mycobacterium
DDYSFDWFRLAWTVQYPVWALGIVGIVVTR

SEQ ID NO: 352151 - protein, 19 aa, Mycobacterium
DEAAAAEPVLLWGDARIGN

SEQ ID NO: 352152 - protein, 26 aa, Mycobacterium
DEAAQFKVILTRLWESGLKPKGGPKE

SEQ ID NO: 352153 - protein, 25 aa, Mycobacterium
DEAATLWPRLYLDADIQISAGAVLA

SEQ ID NO: 352154 - protein, 18 aa, Mycobacterium
DEADLLGNLPLFAGLDAA

SEQ ID NO: 352155 - protein, 18 aa, Mycobacterium
DEAGRLFIIGRQDDMIIS

SEQ ID NO: 352156 - protein, 28 aa, Mycobacterium
DEALTIAFLIIFTVLVLVGYPVIMETAT

SEQ ID NO: 352157 - protein, 23 aa, Mycobacterium
DEAPKITLLALAALPPAAVATTA

SEQ ID NO: 352158 - protein, 29 aa, Mycobacterium
DEARIDRRWMWIAGVAGAILFVAVITVSM

SEQ ID NO: 352159 - protein, 20 aa, Mycobacterium
DEDLVLGVTLIADGRRQLGV

SEQ ID NO: 352160 - protein, 26 aa, Mycobacterium
DEDQNSLLPRWLPDGSPDRGWAARLR

SEQ ID NO: 352161 - protein, 24 aa, Mycobacterium
DEEFAPQPLSFWGVPVQPEGGADA

SEQ ID NO: 352162 - protein, 22 aa, Mycobacterium
DEFAAVIRALPRVLPHASGPVD

SEQ ID NO: 352163 - protein, 20 aa, Mycobacterium
DEFVVAVRQLTIGQDAPVEV

SEQ ID NO: 352164 - protein, 23 aa, Mycobacterium
DEGTYQLTVLPPAGVAAPRPRHL

SEQ ID NO: 352165 - protein, 26 aa, Mycobacterium
DEHPPYVDYPDDAPLYDKAAARRVRA

SEQ ID NO: 352166 - protein, 25 aa, Mycobacterium
DEIDGQLYLVMPVVDGTDVQALLNR

SEQ ID NO: 352167 - protein, 25 aa, Mycobacterium
DEIDQLILSHLLTVTPGIDSTEVSG

SEQ ID NO: 352168 - protein, 22 aa, Mycobacterium
DEIIADKIWPGTRRLAQMHLDA

SEQ ID NO: 352169 - protein, 24 aa, Mycobacterium
DELAGTELLLDALAGRADVTLDDP

SEQ ID NO: 352170 - protein, 25 aa, Mycobacterium
DELDDAWHYMTRWALLFGITEQMCP

SEQ ID NO: 352171 - protein, 26 aa, Mycobacterium
DELLDALRRCGLGRWLAGLSDGLSTV

SEQ ID NO: 352172 - protein, 17 aa, Mycobacterium
DELMPQMLPILRSTIDS

SEQ ID NO: 352173 - protein, 21 aa, Mycobacterium
DEMYKYLVAVSRQPDHAKIRA

SEQ ID NO: 352174 - protein, 18 aa, Mycobacterium
DENGLLYISGRDDEMIVS

SEQ ID NO: 352175 - protein, 23 aa, Mycobacterium
DENGYVYFAGRLGDWLRVDGENL

SEQ ID NO: 352176 - protein, 36 aa, Mycobacterium
DEPIPITALLARAAVPPRHWRWPLGEIDKPFEMRRD

SEQ ID NO: 352177 - protein, 20 aa, Mycobacterium
DEPRLGLILEVVAAAGLIAG

SEQ ID NO: 352178 - protein, 23 aa, Mycobacterium
DERLAWLIVVGTIPVGLAGLALE

SEQ ID NO: 352179 - protein, 22 aa, Mycobacterium
DERLIQLLEHRPDLAQPPPGSI

SEQ ID NO: 352180 - protein, 46 aa, Mycobacterium
DESERSRRGLLRRPKLSTLTAALAVLVILAALAGSAYMVLQHRDAT

SEQ ID NO: 352181 - protein, 22 aa, Mycobacterium
DESFTLVYDALVARGGQDAVLP

SEQ ID NO: 352182 - protein, 25 aa, Mycobacterium
DESFTLVYDALVSRAGQSVAALPTA

SEQ ID NO: 352183 - protein, 23 aa, Mycobacterium
DESGRVLTFALLSNDAGPTGRTS

SEQ ID NO: 352184 - protein, 26 aa, Mycobacterium
DESIDAFRRFHTALFSKDIQPSEVGK

SEQ ID NO: 352185 - protein, 27 aa, Mycobacterium
DESIDAFRRFHTALFTTDLQPSERGPS

SEQ ID NO: 352186 - protein, 24 aa, Mycobacterium
DESLDAFRRFHTALFTTDIQPSET

SEQ ID NO: 352187 - protein, 34 aa, Mycobacterium
DESPAVLVGRLMFLLGLPATGLTLLIIGLGRRSR

SEQ ID NO: 352188 - protein, 20 aa, Mycobacterium
DETALFLHRVADDMPNSARQ

SEQ ID NO: 352189 - protein, 30 aa, Mycobacterium
DETHPDFFTPLLWTAALLKGGDPARSLADG

SEQ ID NO: 352190 - protein, 26 aa, Mycobacterium
DETWPLLTGFVWLGGLLIVASVVLTR

SEQ ID NO: 352191 - protein, 29 aa, Mycobacterium
DEVRALFNRLRPTLPIVLANLVSVGEVAV

SEQ ID NO: 352192 - protein, 24 aa, Mycobacterium
DEVVAMLSLVPWGSNGVSLDVMRR

SEQ ID NO: 352193 - protein, 24 aa, Mycobacterium
DEYAVAMMLAAWREDVGREPMPAK

SEQ ID NO: 352194 - protein, 35 aa, Mycobacterium
DEYNEVFADPIWGPKFRKLYLRIARVGRSLHVFLK

SEQ ID NO: 352195 - protein, 26 aa, Mycobacterium
DFARLYPYQVFMDLYGLPLEDRDSVI

SEQ ID NO: 352196 - protein, 25 aa, Mycobacterium
DFATGPAPLALPYLDADNPGPNDPA

SEQ ID NO: 352197 - protein, 26 aa, Mycobacterium
DFAVTLWTAAWLLVGLAVYDAVSTIA

SEQ ID NO: 352198 - protein, 29 aa, Mycobacterium
DFAVVVWTALWLLVALAVYDAIATIADAG

SEQ ID NO: 352199 - protein, 24 aa, Mycobacterium
DFDDFIRPLRNYLYWEKHCYDIPV

SEQ ID NO: 352200 - protein, 24 aa, Mycobacterium
DFDDFLRPIRNYFYWEPHCDSIPV

SEQ ID NO: 352201 - protein, 26 aa, Mycobacterium
DFDRARFHHLAFGSGIHRCLGSHLAR

SEQ ID NO: 352202 - protein, 18 aa, Mycobacterium
DFEDFFRPLRNYFYWEKH

SEQ ID NO: 352203 - protein, 20 aa, Mycobacterium
DFEDFFRPLRSYFYWERHCY

SEQ ID NO: 352204 - protein, 20 aa, Mycobacterium
DFEDTWRPIRSYFYWEKHCA

SEQ ID NO: 352205 - protein, 17 aa, Mycobacterium
DFELSRPGALIAALPAV

SEQ ID NO: 352206 - protein, 18 aa, Mycobacterium
DFEQLIATPLDRFVGFVE

SEQ ID NO: 352207 - protein, 20 aa, Mycobacterium
DFGAPQLPIPALSGLPTLPD

SEQ ID NO: 352208 - protein, 23 aa, Mycobacterium
DFGILLVLMVLPGTALFVAIEML

SEQ ID NO: 352209 - protein, 22 aa, Mycobacterium
DFGRLVWVRLLTQFSDGLFQAG

SEQ ID NO: 352210 - protein, 18 aa, Mycobacterium
DFHAIGMTLALALSLYLI

SEQ ID NO: 352211 - protein, 21 aa, Mycobacterium
DFHFPLRRALTSPRIWALALV

SEQ ID NO: 352212 - protein, 18 aa, Mycobacterium
DFHKQPEFLAPQDKGPWG

SEQ ID NO: 352213 - protein, 34 aa, Mycobacterium
DFIYYPVSAIMWVWYKAFAFLLGPTNFFAWALSV

SEQ ID NO: 352214 - protein, 22 aa, Mycobacterium
DFKRGLKLFLSPDGKAARMIVT

SEQ ID NO: 352215 - protein, 24 aa, Mycobacterium
DFLTTVGWRIPFVASFALVAVGLW

SEQ ID NO: 352216 - protein, 17 aa, Mycobacterium
DFLVIDKIAKALARVRG

SEQ ID NO: 352217 - protein, 18 aa, Mycobacterium
DFLWGRLPLYIVAVYPTM

SEQ ID NO: 352218 - protein, 20 aa, Mycobacterium
DFMHGRVLLAPLFCVLAPVA

SEQ ID NO: 352219 - protein, 63 aa, Mycobacterium
DFMRNPVAAFFAWFPLLFFIAYEAFFIPFGFTFWGVLLSAPAWLPIVLGLALSALVPPAGIEE

SEQ ID NO: 352220 - protein, 19 aa, Mycobacterium
DFPGRDALFWVYIATLMVP

SEQ ID NO: 352221 - protein, 26 aa, Mycobacterium
DFRLPPKYMEMLNLTEAWQFGRGEGV

SEQ ID NO: 352222 - protein, 27 aa, Mycobacterium
DFTAEPLLWLLAIDAGLITLGAMAFQR

SEQ ID NO: 352223 - protein, 26 aa, Mycobacterium
DFTGAPLLWLLAIDAGLITLGVMAFR

SEQ ID NO: 352224 - protein, 26 aa, Mycobacterium
DFTGNQLDQMILRHLAVAAGDADGTA

SEQ ID NO: 352225 - protein, 32 aa, Mycobacterium
DFVAAGANLIVLFYLTLGAAALGVRRVLEELT

SEQ ID NO: 352226 - protein, 21 aa, Mycobacterium
DFVAFLDSDVAPRRGWLEALL

SEQ ID NO: 352227 - protein, 22 aa, Mycobacterium
DFVNFYACDITLKINGLQAGGP

SEQ ID NO: 352228 - protein, 23 aa, Mycobacterium
DFVNYYACDITLKFNGLQPGGPV

SEQ ID NO: 352229 - protein, 28 aa, Mycobacterium
DFVYYPVSWIMWAWYKLFAAMLGPSNFF

SEQ ID NO: 352230 - protein, 39 aa, Mycobacterium
DFWPQILPNVWWLPYAALTLPFLLLFRLTCYYYRGAYYR

SEQ ID NO: 352231 - protein, 27 aa, Mycobacterium
DFYSNPGFSFTGFLRAFKNNIFGGDLQ

SEQ ID NO: 352232 - protein, 20 aa, Mycobacterium
DFYTAPGAPPLPALTLVETD

SEQ ID NO: 352233 - protein, 27 aa, Mycobacterium
DGAGELLVWLPYPGFAAYLQVGCGQVR

SEQ ID NO: 352234 - protein, 25 aa, Mycobacterium
DGAGNPIPVTPLVGGSYLYQQSDVN

SEQ ID NO: 352235 - protein, 27 aa, Mycobacterium
DGAKILLPILLGVLLGGPAAAGTGLLL

SEQ ID NO: 352236 - protein, 24 aa, Mycobacterium
DGAKRMQVLINDLLRFSRVGRLGT

SEQ ID NO: 352237 - protein, 22 aa, Mycobacterium
DGALARWNWVLDGMVDTKALSA

SEQ ID NO: 352238 - protein, 21 aa, Mycobacterium
DGALTVAMKHIKEPPPPLPAE

SEQ ID NO: 352239 - protein, 24 aa, Mycobacterium
DGAMFVPQLPYLPVGDLRTVVSYP

SEQ ID NO: 352240 - protein, 27 aa, Mycobacterium
DGAPAQLWAFWLAPLVGAAIAGVAYPY

SEQ ID NO: 352241 - protein, 25 aa, Mycobacterium
DGAPATDWTLNWAHGLIANAPQPKH

SEQ ID NO: 352242 - protein, 25 aa, Mycobacterium
DGAQQRLAYLRLKLGMVRAAVPATD

SEQ ID NO: 352243 - protein, 20 aa, Mycobacterium
DGATLPWSLTLSTTAPSVFP

SEQ ID NO: 352244 - protein, 25 aa, Mycobacterium
DGAVFCGLLWWIAFGLHDKLLAAAT

SEQ ID NO: 352245 - protein, 23 aa, Mycobacterium
DGAVFGGLLWWVAFGMRDRLLVV

SEQ ID NO: 352246 - protein, 31 aa, Mycobacterium
DGAVFLIVSVLLLALVRPALRRKLAPAKALQ

SEQ ID NO: 352247 - protein, 25 aa, Mycobacterium
DGAVFLVVSVLLLVVVRPPLRRRLT

SEQ ID NO: 352248 - protein, 25 aa, Mycobacterium
DGAYRVFYVATLGDVVFVLHSFVKK

SEQ ID NO: 352249 - protein, 23 aa, Mycobacterium
DGDLFIGIALFGLNSMMATVDLL

SEQ ID NO: 352250 - protein, 27 aa, Mycobacterium
DGDRIQHSLPLFGPIDLPALMTNGNGN

SEQ ID NO: 352251 - protein, 22 aa, Mycobacterium
DGDRLRIAVADTGEGIAAEHVN

SEQ ID NO: 352252 - protein, 23 aa, Mycobacterium
DGDRLWIRFIPDTEKRSQVIEHI

SEQ ID NO: 352253 - protein, 23 aa, Mycobacterium
DGELILLWTLPAASVIWIAAFLL

SEQ ID NO: 352254 - protein, 18 aa, Mycobacterium
DGELYITGRIKDLIIVDG

SEQ ID NO: 352255 - protein, 26 aa, Mycobacterium
DGEPIGPWGLLLRDLAHLLDTVSVVG

SEQ ID NO: 352256 - protein, 31 aa, Mycobacterium
DGFGHLDAGLFFIAFVRNPVTQFVPMQNAIS

SEQ ID NO: 352257 - protein, 18 aa, Mycobacterium
DGFGVLVIAVCCLGAAWG

SEQ ID NO: 352258 - protein, 17 aa, Mycobacterium
DGFIKLIKMLIAPIIFC

SEQ ID NO: 352259 - protein, 21 aa, Mycobacterium
DGFWMSLTVFTILAALNVGRI

SEQ ID NO: 352260 - protein, 31 aa, Mycobacterium
DGGAAFIRRLLTLATALLLAVTIISTVGAPL

SEQ ID NO: 352261 - protein, 24 aa, Mycobacterium
DGGFTLFYLGINLGAFIGPLITGL

SEQ ID NO: 352262 - protein, 23 aa, Mycobacterium
DGGGLAPGWHPLADIPGAGSVGE

SEQ ID NO: 352263 - protein, 21 aa, Mycobacterium
DGGLQRFWLSVAQAHVAGVRV

SEQ ID NO: 352264 - protein, 24 aa, Mycobacterium
DGGNNRVLALPAGSKRQIALPFTG

SEQ ID NO: 352265 - protein, 26 aa, Mycobacterium
DGGPGPVYPGALPPPVQYPKRRRSPW

SEQ ID NO: 352266 - protein, 24 aa, Mycobacterium
DGGRIRGHRFERLPAGRGILLSDN

SEQ ID NO: 352267 - protein, 23 aa, Mycobacterium
DGGVPVWSWYLVAATALAAALRA

SEQ ID NO: 352268 - protein, 24 aa, Mycobacterium
DGHETFWRLTAFTIFLVAVITDRL

SEQ ID NO: 352269 - protein, 23 aa, Mycobacterium
DGIAYRFPGFARLAKARPKLLIA

SEQ ID NO: 352270 - protein, 23 aa, Mycobacterium
DGIFRVAAFIVVGLVLLAMGTGY

SEQ ID NO: 352271 - protein, 23 aa, Mycobacterium
DGIFRVVVFIVVGLTLLGIGAGY

SEQ ID NO: 352272 - protein, 23 aa, Mycobacterium
DGIKPTLPVLLANLTTIGQIAVT

SEQ ID NO: 352273 - protein, 19 aa, Mycobacterium
DGIVAAAIGLFILPRTWQL

SEQ ID NO: 352274 - protein, 23 aa, Mycobacterium
DGIVVVVTVLFWSVAVDGIAYRF

SEQ ID NO: 352275 - protein, 23 aa, Mycobacterium
DGKAPVLLQVPGGAWAIGMRKPQ

SEQ ID NO: 352276 - protein, 24 aa, Mycobacterium
DGKDLAAILKRYGPLTPPRAVAVV

SEQ ID NO: 352277 - protein, 25 aa, Mycobacterium
DGKLLRALTTLGPGEKWLVAPRQLD

SEQ ID NO: 352278 - protein, 38 aa, Mycobacterium
DGKSKLPLYLNIAVVVLGLVAYLLNFGPTFTISADLGP

SEQ ID NO: 352279 - protein, 22 aa, Mycobacterium
DGKVHRHWGFGGGPHRCIGSHL

SEQ ID NO: 352280 - protein, 32 aa, Mycobacterium
DGKYAWISGGYYQPLFRLDLSTGAIGQVQIDY

SEQ ID NO: 352281 - protein, 19 aa, Mycobacterium
DGLAAYRRERGLPGLSVAW

SEQ ID NO: 352282 - protein, 32 aa, Mycobacterium
DGLFTAIIQPPLILFCAVPGAYWLFHDGKVGH

SEQ ID NO: 352283 - protein, 20 aa, Mycobacterium
DGLFWVYIATLMVPATVTVV

SEQ ID NO: 352284 - protein, 25 aa, Mycobacterium
DGLGPYLSIYLLLAHHWDQASIGFV

SEQ ID NO: 352285 - protein, 21 aa, Mycobacterium
DGLGRYRVVSALSRRGDELIV

SEQ ID NO: 352286 - protein, 20 aa, Mycobacterium
DGLLRIIPAWEIYPFGHTIP

SEQ ID NO: 352287 - protein, 23 aa, Mycobacterium
DGLSATGWTLNWAQGLISGAPEP

SEQ ID NO: 352288 - protein, 25 aa, Mycobacterium
DGLTSWLTGMFDRSAWRPAAVVVVG

SEQ ID NO: 352289 - protein, 24 aa, Mycobacterium
DGMGTTLTAFLFAGKRLGMVHIGD

SEQ ID NO: 352290 - protein, 25 aa, Mycobacterium
DGMGTTLTAILFAGNRLGLVHIGDS

SEQ ID NO: 352291 - protein, 20 aa, Mycobacterium
DGNSWTLGAPIPTPRQMLAA

SEQ ID NO: 352292 - protein, 17 aa, Mycobacterium
DGPAMPMLPATWGPALA

SEQ ID NO: 352293 - protein, 19 aa, Mycobacterium
DGPEWLLLVASAVVVIIAT

SEQ ID NO: 352294 - protein, 25 aa, Mycobacterium
DGPGIDPALLPRLFERFARADNSRL

SEQ ID NO: 352295 - protein, 33 aa, Mycobacterium
DGPISDLWRLYQRIYEILWALRRGDLAPGPLPD

SEQ ID NO: 352296 - protein, 19 aa, Mycobacterium
DGPLRLGHWLLFAVISVSS

SEQ ID NO: 352297 - protein, 17 aa, Mycobacterium
DGPPRLPVSYPGLPPAP

SEQ ID NO: 352298 - protein, 35 aa, Mycobacterium
DGPSILWILVQIILILLEILYAIVAYTIILAFVLP

SEQ ID NO: 352299 - protein, 19 aa, Mycobacterium
DGQAIRLGRPGWIDPADLA

SEQ ID NO: 352300 - protein, 18 aa, Mycobacterium
DGQMYLEMRLIEGTDLDT

SEQ ID NO: 352301 - protein, 25 aa, Mycobacterium
DGQNPFALLLVSLLGPIAATVVRMA

SEQ ID NO: 352302 - protein, 20 aa, Mycobacterium
DGRALDWREAFAGLGAQRTD

SEQ ID NO: 352303 - protein, 19 aa, Mycobacterium
DGRAPRWPTFGITVLPRLT

SEQ ID NO: 352304 - protein, 17 aa, Mycobacterium
DGRFYVDMRLVDGVDLG

SEQ ID NO: 352305 - protein, 25 aa, Mycobacterium
DGRGGRFRCTFGFTFEVTEGQDRYV

SEQ ID NO: 352306 - protein, 22 aa, Mycobacterium
DGRGYGWRTAVLAAAAAAVVVG

SEQ ID NO: 352307 - protein, 23 aa, Mycobacterium
DGRHPFLVMELIDGGTLRELLRE

SEQ ID NO: 352308 - protein, 19 aa, Mycobacterium
DGRHYLVMPAVPDGSTVQD

SEQ ID NO: 352309 - protein, 23 aa, Mycobacterium
DGRLRRLMLLPPDPEPAVFRRWL

SEQ ID NO: 352310 - protein, 23 aa, Mycobacterium
DGRMPLPNRLLATKPFVSLGAMA

SEQ ID NO: 352311 - protein, 23 aa, Mycobacterium
DGRPAPLLRLRGKFFAHADQLSI

SEQ ID NO: 352312 - protein, 17 aa, Mycobacterium
DGRPLTLMVTPIGDDQK

SEQ ID NO: 352313 - protein, 29 aa, Mycobacterium
DGRPTGAVLLRDPLRRHAPRTLRRLRDAG

SEQ ID NO: 352314 - protein, 26 aa, Mycobacterium
DGRRLRSLFPANWRTFTLVDAAVIFG

SEQ ID NO: 352315 - protein, 24 aa, Mycobacterium
DGRSRLMFLIAGYVAGTAAFAVAA

SEQ ID NO: 352316 - protein, 21 aa, Mycobacterium
DGRSVLLTLIPGLLAVPQIGF

SEQ ID NO: 352317 - protein, 25 aa, Mycobacterium
DGRTIRLGRPGWLDPGPLADGVARM

SEQ ID NO: 352318 - protein, 20 aa, Mycobacterium
DGRTLLGMLSGPAAFAALYA

SEQ ID NO: 352319 - protein, 22 aa, Mycobacterium
DGRTLLLGSPGLLRSEKVRVSK

SEQ ID NO: 352320 - protein, 22 aa, Mycobacterium
DGRTRWMLLVGVFVGFGFLTKQ

SEQ ID NO: 352321 - protein, 20 aa, Mycobacterium
DGRVYGVLLVGSSQPFEFPA

SEQ ID NO: 352322 - protein, 23 aa, Mycobacterium
DGSFLWLTLVLAAVWAVGAFVSG

SEQ ID NO: 352323 - protein, 26 aa, Mycobacterium
DGSLETLLRLLARQAEFPRSAPFEAD

SEQ ID NO: 352324 - protein, 24 aa, Mycobacterium
DGSLGELWPAFDAIRRVPKAAQNG

SEQ ID NO: 352325 - protein, 31 aa, Mycobacterium
DGSLTRRIAVFILLLCLFGTLAVLLRRGVLP

SEQ ID NO: 352326 - protein, 23 aa, Mycobacterium
DGTKYLGEALAVQALSALARTVG

SEQ ID NO: 352327 - protein, 24 aa, Mycobacterium
DGTPLWPGLPPAPPPSDQPPPDPN

SEQ ID NO: 352328 - protein, 20 aa, Mycobacterium
DGTRFQFTLPVAAPATADPE

SEQ ID NO: 352329 - protein, 38 aa, Mycobacterium
DGTTKLPLYLNIAVVVLGLAVYLLNFGPTFTIGAELGP

SEQ ID NO: 352330 - protein, 22 aa, Mycobacterium
DGTTWYAMAGLAGDLGTPLAQR

SEQ ID NO: 352331 - protein, 30 aa, Mycobacterium
DGTVFLIVSVLLLVLVRPALRRRLTPAHVP

SEQ ID NO: 352332 - protein, 24 aa, Mycobacterium
DGTVFRLLTLPCAALLALATVLLA

SEQ ID NO: 352333 - protein, 30 aa, Mycobacterium
DGVAILARNHRWFLIANYGAARAGARIILL

SEQ ID NO: 352334 - protein, 17 aa, Mycobacterium
DGVHWPTAGLALGVLVL

SEQ ID NO: 352335 - protein, 19 aa, Mycobacterium
DGVIVATSLFVATWVFILN

SEQ ID NO: 352336 - protein, 23 aa, Mycobacterium
DGVKLMNYMALLGAAVALVVGAF

SEQ ID NO: 352337 - protein, 25 aa, Mycobacterium
DGVPKAVWLQRFPGIGIVGDLEQGR

SEQ ID NO: 352338 - protein, 28 aa, Mycobacterium
DGVSKLPMYLSMAVAALGLLAYLASFGP

SEQ ID NO: 352339 - protein, 22 aa, Mycobacterium
DGVSLPWTLTLSTTAPSVFPNI

SEQ ID NO: 352340 - protein, 24 aa, Mycobacterium
DGVSLRAMLTQFGPLTPARAVAIV

SEQ ID NO: 352341 - protein, 17 aa, Mycobacterium
DGVVPLLRPLYDYNWVV

SEQ ID NO: 352342 - protein, 28 aa, Mycobacterium
DGYPIKASARYGLYYTPGSDLYQDTLPE

SEQ ID NO: 352343 - protein, 26 aa, Mycobacterium
DHAAFVGIYALIRRAADKARKRGFRP

SEQ ID NO: 352344 - protein, 44 aa, Mycobacterium
DHAVAGWLVHWPWFFGVSVWLIVIFGTSFGWRVLTPVLRRLEEV

SEQ ID NO: 352345 - protein, 24 aa, Mycobacterium
DHDHPFYKWIALSNTTLGTLMATI

SEQ ID NO: 352346 - protein, 27 aa, Mycobacterium
DHFVLRRLFRAPLLRPMLVCTALATGA

SEQ ID NO: 352347 - protein, 18 aa, Mycobacterium
DHHYLWPALVLLACTAAC

SEQ ID NO: 352348 - protein, 18 aa, Mycobacterium
DHIAWLLPTAFIALILGV

SEQ ID NO: 352349 - protein, 18 aa, Mycobacterium
DHIEQSLLPLFTQAATAA

SEQ ID NO: 352350 - protein, 33 aa, Mycobacterium
DHISGPRTKLFATLFLILVLVVIGEIAGVVLGR

SEQ ID NO: 352351 - protein, 31 aa, Mycobacterium
DHKASAWLFDMAMLAVLSIAYTAIVWWKIRL

SEQ ID NO: 352352 - protein, 17 aa, Mycobacterium
DHKAWFIPVSIAGELGS

SEQ ID NO: 352353 - protein, 29 aa, Mycobacterium
DHLARLSRQLILLTLVLASVVAAAGLLNG

SEQ ID NO: 352354 - protein, 20 aa, Mycobacterium
DHLLGYPHWAQGAIGWCVLP

SEQ ID NO: 352355 - protein, 20 aa, Mycobacterium
DHLPRLRRELERRLGPEGTD

SEQ ID NO: 352356 - protein, 20 aa, Mycobacterium
DHPLLLAVPAFAPAIVVAGV

SEQ ID NO: 352357 - protein, 28 aa, Mycobacterium
DHRETYDAMFDLWFPAALGARAAVTEDD

SEQ ID NO: 352358 - protein, 20 aa, Mycobacterium
DHRFGWSPVPPWLSVLGDVL

SEQ ID NO: 352359 - protein, 31 aa, Mycobacterium
DHRGQWARILPRFSRLSFGCVAALLAGGVVG

SEQ ID NO: 352360 - protein, 25 aa, Mycobacterium
DHRIAPLLYVAIVPAVLSVALVLLV

SEQ ID NO: 352361 - protein, 18 aa, Mycobacterium
DHRMLSRYGYVCGLTGLI

SEQ ID NO: 352362 - protein, 24 aa, Mycobacterium
DHRRALPAVALLGAAFLVVCDIAA

SEQ ID NO: 352363 - protein, 24 aa, Mycobacterium
DHSGGLLFLVTDAAIMFGIRDADA

SEQ ID NO: 352364 - protein, 24 aa, Mycobacterium
DHSPKPDLLRRLLHDFRGPLIVSL

SEQ ID NO: 352365 - protein, 28 aa, Mycobacterium
DHSPPAPRWAWKVLIPIGALGMVLMAIW

SEQ ID NO: 352366 - protein, 17 aa, Mycobacterium
DHTLFYARALAGVPFAT

SEQ ID NO: 352367 - protein, 21 aa, Mycobacterium
DHTLMLWTVPLLIAPPMYSRD

SEQ ID NO: 352368 - protein, 17 aa, Mycobacterium
DHTYAKAPYLLAGEDKS

SEQ ID NO: 352369 - protein, 30 aa, Mycobacterium
DHVAFSIWTLWPVMALFMPGAVYGFSAGDK

SEQ ID NO: 352370 - protein, 19 aa, Mycobacterium
DHWVNQAVVLFPSADKAKS

SEQ ID NO: 352371 - protein, 31 aa, Mycobacterium
DHYFNTFLIPSDLLWSFLQAIVMAIAVMLVH

SEQ ID NO: 352372 - protein, 31 aa, Mycobacterium; identical to SEQ ID NO: 20441

SEQ ID NO: 352373 - protein, 20 aa, Mycobacterium
DHYFNTYLQPTDLIWSLLQV

SEQ ID NO: 352374 - protein, 24 aa, Mycobacterium
DIAALALIRFPATGDKIGSLVINP

SEQ ID NO: 352375 - protein, 23 aa, Mycobacterium
DIAGAWRWTAILAAAVTIASLPV

SEQ ID NO: 352376 - protein, 18 aa, Mycobacterium
DIAIYVVLALAVRYVLHR

SEQ ID NO: 352377 - protein, 29 aa, Mycobacterium
DIAKYFAIIPAMFVALFPGLDLINVMRLH

SEQ ID NO: 352378 - protein, 30 aa, Mycobacterium
DIAKYFAIIPAMFVALFPGLDLLNVMRLHS

SEQ ID NO: 352379 - protein, 29 aa, Mycobacterium
DIAKYFAIIPAMFVALFPGLDTINVMRLH

SEQ ID NO: 352380 - protein, 25 aa, Mycobacterium
DIANAKWSTLPPLPTPRHAEAVAAV

SEQ ID NO: 352381 - protein, 26 aa, Mycobacterium
DIANLTRRFIIGTVLTTPVLYAVMAR

SEQ ID NO: 352382 - protein, 24 aa, Mycobacterium
DIAPPPGTVFPPPAADIMLHGTGP

SEQ ID NO: 352383 - protein, 26 aa, Mycobacterium
DIDDERLRRTLWPKVAGARVLHELFP

SEQ ID NO: 352384 - protein, 27 aa, Mycobacterium
DIDIAQNLPFLLSLYAQPASVGVPPAD

SEQ ID NO: 352385 - protein, 26 aa, Mycobacterium
DIDTHGFAILDRLRAWLPQARSVLMD

SEQ ID NO: 352386 - protein, 19 aa, Mycobacterium
DIELLGMSHLLILAGLDTV

SEQ ID NO: 352387 - protein, 23 aa, Mycobacterium
DIEQLLVVFPMAISAEQAGILAN

SEQ ID NO: 352388 - protein, 32 aa, Mycobacterium
DIERLRLPAVLRRPRIRPAYRKAAPGAGVWNR

SEQ ID NO: 352389 - protein, 26 aa, Mycobacterium
DIETIYLLKREVVELRRAVSPLVTDL

SEQ ID NO: 352390 - protein, 23 aa, Mycobacterium
DIFFVLSGFLITSLLLDELGRSG

SEQ ID NO: 352391 - protein, 25 aa, Mycobacterium
DIFQQKAWRNLRFPLAWAPPEANVA

SEQ ID NO: 352392 - protein, 22 aa, Mycobacterium
DIFRGLPEVVIILLIGMGVGPL

SEQ ID NO: 352393 - protein, 20 aa, Mycobacterium
DIGFLAFGALLVLGGWLIYR

SEQ ID NO: 352394 - protein, 34 aa, Mycobacterium
DIGRIPEMMYADARLRGWFRRTPEHLGALTGYGV

SEQ ID NO: 352395 - protein, 17 aa, Mycobacterium
DIGWRLAFGIGAILGIF

SEQ ID NO: 352396 - protein, 18 aa, Mycobacterium
DIIRLIIRDEAVHGFYIG

SEQ ID NO: 352397 - protein, 38 aa, Mycobacterium
DIIRLYGEVLRFLFEPIFNFLRDPIGNTFALITDFLTN

SEQ ID NO: 352398 - protein, 19 aa, Mycobacterium
DILAIPIGSLVAPAAVIGA

SEQ ID NO: 352399 - protein, 21 aa, Mycobacterium
DILDPALLRPGRFDRQIPVSN

SEQ ID NO: 352400 - protein, 22 aa, Mycobacterium
DILDPALLRPGRFDRQIPVSNP

SEQ ID NO: 352401 - protein, 22 aa, Mycobacterium
DILDPALLRPGRFDRQIPVSSP

SEQ ID NO: 352402 - protein, 17 aa, Mycobacterium
DILIVGIAALTLIFVVM

SEQ ID NO: 352403 - protein, 18 aa, Mycobacterium
DILPFPVGSLVGPAAVLG

SEQ ID NO: 352404 - protein, 27 aa, Mycobacterium
DILVAGFSLAAMLWQIAHPPEGLEHDY

SEQ ID NO: 352405 - protein, 21 aa, Mycobacterium
DIMYGPWLYNMIPTFACIALL

SEQ ID NO: 352406 - protein, 27 aa, Mycobacterium
DIPGVPWWGAILIAVAGTLFGFALDAM

SEQ ID NO: 352407 - protein, 19 aa, Mycobacterium
DIPICWSIRSLFDSLDGFD

SEQ ID NO: 352408 - protein, 19 aa, Mycobacterium
DIPMCWSMRSLFDALDGID

SEQ ID NO: 352409 - protein, 18 aa, Mycobacterium
DIPPTRFKRKEHWLDAHF

SEQ ID NO: 352410 - protein, 17 aa, Mycobacterium
DIPVTLWDLASQVELSA

SEQ ID NO: 352411 - protein, 26 aa, Mycobacterium
DIRAAVVGFIRKPAVTASLAGVGAIV

SEQ ID NO: 352412 - protein, 22 aa, Mycobacterium
DIRAPYWIALLLFLAHRVEEKQ

SEQ ID NO: 352413 - protein, 18 aa, Mycobacterium
DIRENPSTCWWWERTRGE

SEQ ID NO: 352414 - protein, 25 aa, Mycobacterium
DIRESPWHLHLFPGVKGAPQVPGPA

SEQ ID NO: 352415 - protein, 28 aa, Mycobacterium
DIRYLERLWVPWWWALPGFGAATLLGLE

SEQ ID NO: 352416 - protein, 25 aa, Mycobacterium
DISDFSWQLETALPVPVFAQTMAQV

SEQ ID NO: 352417 - protein, 42 aa, Mycobacterium
DISFTKFTLVMTLPWLLAIAAVYVIFRWFFARDLVAEPNREH

SEQ ID NO: 352418 - protein, 35 aa, Mycobacterium
DISVPFIPLFFGGQAMIWLTWPWGTAGSVGAFAAT

SEQ ID NO: 352419 - protein, 21 aa, Mycobacterium
DITGPGCVWIAKGDRPSIVAA

SEQ ID NO: 352420 - protein, 17 aa, Mycobacterium
DITRYPVQSLSLVDVAR

SEQ ID NO: 352421 - protein, 24 aa, Mycobacterium
DIVFGTLTLLGASIFMLSIDAVTV

SEQ ID NO: 352422 - protein, 25 aa, Mycobacterium
DIVIGLVVLFFYGGVLLGALPRLGM

SEQ ID NO: 352423 - protein, 28 aa, Mycobacterium
DIVISSFALAAMLWQFAHPPKGLEHDFS

SEQ ID NO: 352424 - protein, 26 aa, Mycobacterium
DIVLFVCAIMFTLVWWHVDHSRSNWL

SEQ ID NO: 352425 - protein, 17 aa, Mycobacterium
DIWLLGAIGPRMVYSTN

SEQ ID NO: 352426 - protein, 19 aa, Mycobacterium
DIWRRPDLDLSAKAPVLFQ

SEQ ID NO: 352427 - protein, 18 aa, Mycobacterium
DIWRRPDLDPAGKAPVLF

SEQ ID NO: 352428 - protein, 18 aa, Mycobacterium
DIYSIALAAMIVPATIAM

SEQ ID NO: 352429 - protein, 25 aa, Mycobacterium
DKDEFLKVMLRWLNAFVSKPGQTIP

SEQ ID NO: 352430 - protein, 38 aa, Mycobacterium
DKDGRPFRRRNYLPALILGIALLAVTVFVWASALTREA

SEQ ID NO: 352431 - protein, 24 aa, Mycobacterium
DKGNPDVLWWALALGTDFGGNLTA

SEQ ID NO: 352432 - protein, 25 aa, Mycobacterium
DKGPWGAFDMSLGKAMYAGFTLGGL

SEQ ID NO: 352433 - protein, 24 aa, Mycobacterium
DKIAANYPGVWYRAFDLSEAGPVR

SEQ ID NO: 352434 - protein, 25 aa, Mycobacterium
DKKRYLWLMGLIAPTALFVMLPVVW

SEQ ID NO: 352435 - protein, 25 aa, Mycobacterium
DKKRYLWLMGLIAPTALFVVLPIVW

SEQ ID NO: 352436 - protein, 20 aa, Mycobacterium
DKLGAVLRAFSSRLPNQKLP

SEQ ID NO: 352437 - protein, 26 aa, Mycobacterium
DKLTKPVWLVILGVGVLLALVLGITG

SEQ ID NO: 352438 - protein, 24 aa, Mycobacterium
DKLTVKMWFFPVLSILTLAGITAV

SEQ ID NO: 352439 - protein, 25 aa, Mycobacterium
DKMDPQQRLLLEVAWEALEHAGIAP

SEQ ID NO: 352440 - protein, 25 aa, Mycobacterium
DKPTKLTLDPMLRFASLQTVFNRGR

SEQ ID NO: 352441 - protein, 28 aa, Mycobacterium
DKPVGTLALFRRLLRDRQWWTGSLVAGA

SEQ ID NO: 352442 - protein, 23 aa, Mycobacterium
DKPYMPLAMRQHTTGPYPLDPNL

SEQ ID NO: 352443 - protein, 34 aa, Mycobacterium
DKQAPVAILSIVGFLFVLGGLFGNPFAAAVGEVG

SEQ ID NO: 352444 - protein, 21 aa, Mycobacterium
DKQVSMLMVLHAAVAVLIHRL

SEQ ID NO: 352445 - protein, 35 aa, Mycobacterium
DKSDLFVAIGERLRDMLWAAIFPSINLATDSAREV

SEQ ID NO: 352446 - protein, 25 aa, Mycobacterium
DKTAGGWWNLLRKPSFLIVVAGTAF

SEQ ID NO: 352447 - protein, 28 aa, Mycobacterium
DKTAPLVISGWALTAWILMSLGTGLCRL

SEQ ID NO: 352448 - protein, 21 aa, Mycobacterium
DKTLEALGLHKPALTIPSSIL

SEQ ID NO: 352449 - protein, 17 aa, Mycobacterium
DKVRTLPSPRPRRWSRA

SEQ ID NO: 352450 - protein, 18 aa, Mycobacterium
DLACAVQMFRRGPGRTGQ

SEQ ID NO: 352451 - protein, 21 aa, Mycobacterium
DLAESLLLTAYQPLTAAAAIA

SEQ ID NO: 352452 - protein, 18 aa, Mycobacterium
DLAGLFVVAMIALSAIIA

SEQ ID NO: 352453 - protein, 34 aa, Mycobacterium
DLAHLVDTVPLVVGWLWPLWDPDRRTFADMLLRT

SEQ ID NO: 352454 - protein, 29 aa, Mycobacterium
DLALEAAYFRFTTWLNTLGADPAFPVLKM

SEQ ID NO: 352455 - protein, 18 aa, Mycobacterium
DLALYRSVMSICTGLGLL

SEQ ID NO: 352456 - protein, 19 aa, Mycobacterium
DLAMVRPLPQVPASLPVPD

SEQ ID NO: 352457 - protein, 18 aa, Mycobacterium
DLANLTLVPTPAPTTLGP

SEQ ID NO: 352458 - protein, 19 aa, Mycobacterium
DLAPIPTLFVVADEFTLML

SEQ ID NO: 352459 - protein, 23 aa, Mycobacterium
DLAPQHWIALTPPRIPQLRTLQE

SEQ ID NO: 352460 - protein, 25 aa, Mycobacterium
DLARIDADGFLWVLGRADQAIIRGG

SEQ ID NO: 352461 - protein, 26 aa, Mycobacterium
DLDGGLFSFLLLYAGLGLNSAYPDLR

SEQ ID NO: 352462 - protein, 25 aa, Mycobacterium
DLDKMDALLPQLLEIFPPSIAIAEE

SEQ ID NO: 352463 - protein, 24 aa, Mycobacterium
DLDLPALTALLRPLSAIQVVDVLE

SEQ ID NO: 352464 - protein, 25 aa, Mycobacterium
DLDQMRAWFDRPAATTLQIAAAPGV

SEQ ID NO: 352465 - protein, 28 aa, Mycobacterium
DLDRTLLLWMLPLLIAPPMYSKDVYSYL

SEQ ID NO: 352466 - protein, 17 aa, Mycobacterium
DLDSVLKRFGPLAPPRA

SEQ ID NO: 352467 - protein, 20 aa, Mycobacterium
DLEALLPTSPAQKYLQAYYT

SEQ ID NO: 352468 - protein, 25 aa, Mycobacterium
DLEDLLPVLEDALAVPVFSPAEAAL

SEQ ID NO: 352469 - protein, 25 aa, Mycobacterium
DLEGPDWSWLKWLPHTDVPGELDGV

SEQ ID NO: 352470 - protein, 28 aa, Mycobacterium
DLELGGEWFGLHLNLTLGAWAADGLLAI

SEQ ID NO: 352471 - protein, 18 aa, Mycobacterium
DLELLGMSHLLILAGLDT

SEQ ID NO: 352472 - protein, 19 aa, Mycobacterium
DLELLGMTQLLIVSGLDTV

SEQ ID NO: 352473 - protein, 25 aa, Mycobacterium
DLEPTFIDRLFMGSLVPLTSFTVNL

SEQ ID NO: 352474 - protein, 19 aa, Mycobacterium
DLEPTWSRPGWRHLKHFNG

SEQ ID NO: 352475 - protein, 28 aa, Mycobacterium
DLERLRSTWDVPTLALLGVGNGAQVALA

SEQ ID NO: 352476 - protein, 29 aa, Mycobacterium
DLERLVRIYNGLSLLYCVPLAALAAGTGL

SEQ ID NO: 352477 - protein, 25 aa, Mycobacterium
DLERLVRIYNGLSLLYCVPLTLVAA

SEQ ID NO: 352478 - protein, 40 aa, Mycobacterium
DLESPVAGWVLFGALLAWSLACAVAYLQGFGRRLSWVLAE

SEQ ID NO: 352479 - protein, 21 aa, Mycobacterium
DLFANVVLPFFAIYLAWQMFA

SEQ ID NO: 352480 - protein, 43 aa, Mycobacterium
DLGFYAFDLPFYRLVLTYLFVATFLAFVANLLGHYLFGGIRLT

SEQ ID NO: 352481 - protein, 22 aa, Mycobacterium
DLGGLYFNALVAIAITGVWLWL

SEQ ID NO: 352482 - protein, 20 aa, Mycobacterium
DLGGWLTFAAAMSSTLILSE

SEQ ID NO: 352483 - protein, 20 aa, Mycobacterium
DLGLHLLITRRAAGAERALF

SEQ ID NO: 352484 - protein, 20 aa, Mycobacterium
DLGLLLARSYHHGVDRWRAA

SEQ ID NO: 352485 - protein, 20 aa, Mycobacterium
DLGPKQWPSFIRVSGELPRT

SEQ ID NO: 352486 - protein, 19 aa, Mycobacterium
DLGYLPAGSRTLRRALRAD

SEQ ID NO: 352487 - protein, 29 aa, Mycobacterium
DLHALADRRLLGRIWRFAARHHRRLAVFV

SEQ ID NO: 352488 - protein, 21 aa, Mycobacterium
DLHLLLVALVVLTGAMVFAGL

SEQ ID NO: 352489 - protein, 19 aa, Mycobacterium
DLIAQYLRISTTGIPDMRP

SEQ ID NO: 352490 - protein, 21 aa, Mycobacterium
DLIIFALLVVLSGYMWWRAQQ

SEQ ID NO: 352491 - protein, 20 aa, Mycobacterium
DLIKLRMTVKVRPNAQWAVQ

SEQ ID NO: 352492 - protein, 37 aa, Mycobacterium
DLIPANVMWVVWQLWLVVLLAALWKGRRLGPLVAEEL

SEQ ID NO: 352493 - protein, 18 aa, Mycobacterium
DLISTGIWTGYRLAELLA

SEQ ID NO: 352494 - protein, 25 aa, Mycobacterium
DLITWLFVLPMWPFVFIVLPVTLLY

SEQ ID NO: 352495 - protein, 22 aa, Mycobacterium
DLIVEYWRPILRLAGLVVALNV

SEQ ID NO: 352496 - protein, 22 aa, Mycobacterium
DLLAARWLFTAFTALSVVGLAA

SEQ ID NO: 352497 - protein, 24 aa, Mycobacterium
DLLANRWFLRLSVITGPLAVLAVE

SEQ ID NO: 352498 - protein, 18 aa, Mycobacterium
DLLFNGVIGRRLPADITK

SEQ ID NO: 352499 - protein, 19 aa, Mycobacterium
DLLGRKRMFIYGVGLFTIA

SEQ ID NO: 352500 - protein, 25 aa, Mycobacterium
DLLGRLEVVLGDRLLEVPPGASELA

SEQ ID NO: 352501 - protein, 17 aa, Mycobacterium
DLLHRPGVFVFGSNDYF

SEQ ID NO: 352502 - protein, 26 aa, Mycobacterium
DLLHTPAEWLRFWFPDPDGGTSEHQR

SEQ ID NO: 352503 - protein, 17 aa, Mycobacterium
DLLIGGLVLLASIVGTR

SEQ ID NO: 352504 - protein, 37 aa, Mycobacterium
DLLPSNVTWIVLQLCLVVLLVAVWRGRRPGPLVAEAL

SEQ ID NO: 352505 - protein, 24 aa, Mycobacterium
DLLRSMLQTSPIFFREAANLTGDG

SEQ ID NO: 352506 - protein, 17 aa, Mycobacterium
DLLSRNGIAPDAVTSVA

SEQ ID NO: 352507 - protein, 17 aa, Mycobacterium
DLLTGGRFRLGVGLGWN

SEQ ID NO: 352508 - protein, 17 aa, Mycobacterium
DLLYVWRHFPLERAHPR

SEQ ID NO: 352509 - protein, 19 aa, Mycobacterium
DLMIAGIAALSLILLIMMI

SEQ ID NO: 352510 - protein, 29 aa, Mycobacterium
DLMIAIIASMILIFGIMLVITRSVVAALV

SEQ ID NO: 352511 - protein, 19 aa, Mycobacterium
DLMIAVLAALGLITAIMLT

SEQ ID NO: 352512 - protein, 18 aa, Mycobacterium
DLMRVLLVGVLCGNADYD

SEQ ID NO: 352513 - protein, 18 aa, Mycobacterium
DLNWWDLTVFGVSVVIGA

SEQ ID NO: 352514 - protein, 23 aa, Mycobacterium
DLPARRWEFPQFPQLPMLRWVDS

SEQ ID NO: 352515 - protein, 17 aa, Mycobacterium
DLPFALPTIVASLVMLA

SEQ ID NO: 352516 - protein, 18 aa, Mycobacterium
DLPFALPTIVASLVMLAL

SEQ ID NO: 352517 - protein, 28 aa, Mycobacterium
DLPHMWQPIILLSALWALRALAHGVQVR

SEQ ID NO: 352518 - protein, 17 aa, Mycobacterium
DLPIPYTYALIGAAWAL

SEQ ID NO: 352519 - protein, 17 aa, Mycobacterium
DLPKFPNEKIDPARSGG

SEQ ID NO: 352520 - protein, 18 aa, Mycobacterium
DLPKVFDVAYRGSNGRVP

SEQ ID NO: 352521 - protein, 19 aa, Mycobacterium
DLPLRSRDRLPLMNALLGA

SEQ ID NO: 352522 - protein, 18 aa, Mycobacterium
DLPPIQLTAVRDANLYAV

SEQ ID NO: 352523 - protein, 17 aa, Mycobacterium
DLPPLEQLALMGFDRYS

SEQ ID NO: 352524 - protein, 18 aa, Mycobacterium
DLPRLNLVIFVLSAHVVF

SEQ ID NO: 352525 - protein, 17 aa, Mycobacterium
DLPTLNLAIFSSSLVVL

SEQ ID NO: 352526 - protein, 18 aa, Mycobacterium
DLPVLRWVDGTRPGRRLV

SEQ ID NO: 352527 - protein, 24 aa, Mycobacterium
DLQDPAVLQFIYVRAFASVVDASF

SEQ ID NO: 352528 - protein, 19 aa, Mycobacterium
DLQLGHYAGAMWYADNALR

SEQ ID NO: 352529 - protein, 30 aa, Mycobacterium
DLQLLGPGPRWWGLALMVAGGVSALYGVVQ

SEQ ID NO: 352530 - protein, 22 aa, Mycobacterium
DLRALPFAVSLSRRCSRVIKQN

SEQ ID NO: 352531 - protein, 30 aa, Mycobacterium
DLRDPNPPVPPWLTPAPPVPGSADPGQILT

SEQ ID NO: 352532 - protein, 23 aa, Mycobacterium
DLRLDRPVALKIMDSRYAGDEHF

SEQ ID NO: 352533 - protein, 26 aa, Mycobacterium
DLRLRRLPNWLTVPGAVLILVGATLA

SEQ ID NO: 352534 - protein, 25 aa, Mycobacterium
DLRLVPAALTAWLVTAAGIVWYIAG

SEQ ID NO: 352535 - protein, 24 aa, Mycobacterium
DLRPDLARLDALFARALATEPAGR

SEQ ID NO: 352536 - protein, 22 aa, Mycobacterium
DLRQLMSAHMFSAPPRPSIMRR

SEQ ID NO: 352537 - protein, 30 aa, Mycobacterium
DLRSMLTHTFALPQWRDAFLAIANQGESGA

SEQ ID NO: 352538 - protein, 21 aa, Mycobacterium
DLRSPLLWALVVAALAVVIAG

SEQ ID NO: 352539 - protein, 24 aa, Mycobacterium
DLRSRLLRKLSRLPLGWFTERGSG

SEQ ID NO: 352540 - protein, 17 aa, Mycobacterium
DLRVAHPLIARAHLLLR

SEQ ID NO: 352541 - protein, 19 aa, Mycobacterium
DLSAKAPVLFQIPGGAWTT

SEQ ID NO: 352542 - protein, 18 aa, Mycobacterium
DLSCWRLAYNGAEPVSAA

SEQ ID NO: 352543 - protein, 42 aa, Mycobacterium
DLSFTRFTLLMALPWVGVVVTLYAVFRWFFAKDLRVQPRPDE

SEQ ID NO: 352544 - protein, 26 aa, Mycobacterium
DLSMLLGLIFLLWAGPGRWSLDARLV

SEQ ID NO: 352545 - protein, 23 aa, Mycobacterium
DLSNEIPLYARLFRITGDEYVLA

SEQ ID NO: 352546 - protein, 28 aa, Mycobacterium
DLSNTVGWFTTLYPVALRDAEFDWQAAV

SEQ ID NO: 352547 - protein, 25 aa, Mycobacterium
DLSRLQHEWGFRPAWESTECIDDFA

SEQ ID NO: 352548 - protein, 23 aa, Mycobacterium
DLSRLWTDFVSVALTLADGGRRS

SEQ ID NO: 352549 - protein, 22 aa, Mycobacterium
DLSSLKIVFISGSQLGAELASR

SEQ ID NO: 352550 - protein, 17 aa, Mycobacterium
DLSSLRILFVSGSQLGA

SEQ ID NO: 352551 - protein, 48 aa, Mycobacterium
DLSTMFALVPSTRFPGWGYLLTALAAPIVTWAAWPFHSVAIRNARHRT

SEQ ID NO: 352552 - protein, 26 aa, Mycobacterium
DLSTPLPLLLLAVLVTTVTLGNLFPR

SEQ ID NO: 352553 - protein, 23 aa, Mycobacterium
DLSYGLYIYAFPTQVMLAVCGLA

SEQ ID NO: 352554 - protein, 18 aa, Mycobacterium
DLSYGMYIYAYPTQQLLL

SEQ ID NO: 352555 - protein, 25 aa, Mycobacterium
DLSYGVYIFAFPIQRLLVIGGLDST

SEQ ID NO: 352556 - protein, 18 aa, Mycobacterium
DLSYGVYIYAFPTQQLLA

SEQ ID NO: 352557 - protein, 25 aa, Mycobacterium
DLTAAYLPFNAYLLTRSTLSPRVRE

SEQ ID NO: 352558 - protein, 20 aa, Mycobacterium
DLTANPLRFLARATNLWNSE

SEQ ID NO: 352559 - protein, 24 aa, Mycobacterium
DLTANPLRFLARATSLWNSELPFG

SEQ ID NO: 352560 - protein, 22 aa, Mycobacterium
DLTGAWRLLHALPAARAATDSA

SEQ ID NO: 352561 - protein, 19 aa, Mycobacterium
DLTGAWRVLHALPAARTAT

SEQ ID NO: 352562 - protein, 22 aa, Mycobacterium
DLTGELMFCRNSIDLYHKQAAD

SEQ ID NO: 352563 - protein, 23 aa, Mycobacterium
DLTGELMFCRNSIDLYHKQAADT

SEQ ID NO: 352564 - protein, 22 aa, Mycobacterium
DLTHRFWRRTGTRIVRRPRIHL

SEQ ID NO: 352565 - protein, 21 aa, Mycobacterium
DLTRPSWLFVLRKTAREFTHD

SEQ ID NO: 352566 - protein, 20 aa, Mycobacterium
DLVMMKYLAFGLMAALLLDA

SEQ ID NO: 352567 - protein, 29 aa, Mycobacterium
DLVMTRIALLALAAPRRVLAVAALIAAAA

SEQ ID NO: 352568 - protein, 29 aa, Mycobacterium
DLVRGTLRILLPIATLGALLLVAGGAIQN

SEQ ID NO: 352569 - protein, 25 aa, Mycobacterium
DLVRGTLRILLPIAVLGAVVLVMGG

SEQ ID NO: 352570 - protein, 27 aa, Mycobacterium
DLVTRPTTFLWLIATAGTLFVVSGAMQ

SEQ ID NO: 352571 - protein, 23 aa, Mycobacterium
DLVVAMLSLVPWGTSGVSLDLMR

SEQ ID NO: 352572 - protein, 23 aa, Mycobacterium
DLVWVRPNGAPPPPKPSPQDLSA

SEQ ID NO: 352573 - protein, 19 aa, Mycobacterium
DLVYQFIPVLRANGYRMVT

SEQ ID NO: 352574 - protein, 19 aa, Mycobacterium
DLWPPKLPDLPIPGLPNIP

SEQ ID NO: 352575 - protein, 26 aa, Mycobacterium
DLWSAVTFITLALFLGIGTGGVFAWV

SEQ ID NO: 352576 - protein, 26 aa, Mycobacterium
DLYSKKLVLLTVLVIVLIGSVLAATT

SEQ ID NO: 352577 - protein, 18 aa, Mycobacterium
DMAEFYWARQRAKRMVLM

SEQ ID NO: 352578 - protein, 19 aa, Mycobacterium
DMALVFRHRVRRDRLISKW

SEQ ID NO: 352579 - protein, 26 aa, Mycobacterium
DMGNLKYLFFGLALVVLMIFRPQGLF

SEQ ID NO: 352580 - protein, 24 aa, Mycobacterium
DMLEGRLVQHLWRWSRMLPEDFVP

SEQ ID NO: 352581 - protein, 25 aa, Mycobacterium
DMQAWGWRLPFLVAAPLGLIGVYLR

SEQ ID NO: 352582 - protein, 24 aa, Mycobacterium
DMRGGKWWTKPFVRAAYGNAVIAA

SEQ ID NO: 352583 - protein, 23 aa, Mycobacterium
DMRNPVDFLVLNKLARGVQAVPG

SEQ ID NO: 352584 - protein, 19 aa, Mycobacterium
DMSGWLLLGVPGAIYASGL

SEQ ID NO: 352585 - protein, 17 aa, Mycobacterium
DMTVMFIGYIMGLTLWA

SEQ ID NO: 352586 - protein, 22 aa, Mycobacterium
DNAFILIGVPLLIVWALIRRRQ

SEQ ID NO: 352587 - protein, 24 aa, Mycobacterium
DNALTILMMMVTAVAVAALVDAAA

SEQ ID NO: 352588 - protein, 23 aa, Mycobacterium
DNASGLHRLMAALRGLRVIVVDD

SEQ ID NO: 352589 - protein, 21 aa, Mycobacterium
DNDFVYLIDFGLARSAGESGM

SEQ ID NO: 352590 - protein, 20 aa, Mycobacterium
DNDWLSFDDFVPGTAIAADG

SEQ ID NO: 352591 - protein, 24 aa, Mycobacterium
DNEILGLCFMFVLAGLDTVTSAVG

SEQ ID NO: 352592 - protein, 29 aa, Mycobacterium
DNFGSFLVILLYLLVPWTSVNLVDYYFVR

SEQ ID NO: 352593 - protein, 24 aa, Mycobacterium
DNFKNFVLVLLMVFTPWSAINLTD

SEQ ID NO: 352594 - protein, 19 aa, Mycobacterium
DNGFGLRRLLRALRGMRVI

SEQ ID NO: 352595 - protein, 23 aa, Mycobacterium
DNGIRRIVMLTGDHPDIAQVVAD

SEQ ID NO: 352596 - protein, 25 aa, Mycobacterium
DNGTPLFAFLFLVALGVDYTIFLVT

SEQ ID NO: 352597 - protein, 20 aa, Mycobacterium
DNGVRRIVMLTGDHPDIAKV

SEQ ID NO: 352598 - protein, 25 aa, Mycobacterium
DNIFLLVGIPVLGAWALLRRRRGRT

SEQ ID NO: 352599 - protein, 18 aa, Mycobacterium
DNIWALIILYTAMNLPIA

SEQ ID NO: 352600 - protein, 18 aa, Mycobacterium
DNKIWIMGGVREGVGLTT

SEQ ID NO: 352601 - protein, 25 aa, Mycobacterium
DNMLVLYVFWEITTVLSFLLVGHYA

SEQ ID NO: 352602 - protein, 27 aa, Mycobacterium
DNPEDPVWAWLKWLPHLQHQTDTDAAG

SEQ ID NO: 352603 - protein, 17 aa, Mycobacterium
DNPYFQIDLKYFVSPDG

SEQ ID NO: 352604 - protein, 18 aa, Mycobacterium
DNPYRPEFPGLESFEGPV

SEQ ID NO: 352605 - protein, 23 aa, Mycobacterium
DNRDAWMVGYTPSLSTAVWVGTT

SEQ ID NO: 352606 - protein, 23 aa, Mycobacterium
DNRLAYLDQAAFLGLRAGHVSLL

SEQ ID NO: 352607 - protein, 33 aa, Mycobacterium
DNRMTLLRRPIAVWWIVWVLSAIVATWSIVSTV

SEQ ID NO: 352608 - protein, 24 aa, Mycobacterium
DNRVVAMLSLVPWGTTGVSLDLMR

SEQ ID NO: 352609 - protein, 19 aa, Mycobacterium
DNRYLWLGLGLYCAGSVFN

SEQ ID NO: 352610 - protein, 25 aa, Mycobacterium
DNSQDWSWQTQLNWIATALGRADAA

SEQ ID NO: 352611 - protein, 24 aa, Mycobacterium
DNSTPLFAFLFLAALGVDYTIFLV

SEQ ID NO: 352612 - protein, 21 aa, Mycobacterium
DNSWMGFWIFAAAMVLTAVAW

SEQ ID NO: 352613 - protein, 25 aa, Mycobacterium
DNTAPLFAFLFLVALGVDYTIFLVT

SEQ ID NO: 352614 - protein, 24 aa, Mycobacterium
DNTTPLFAFLFLAALGVDYTIFLV

SEQ ID NO: 352615 - protein, 41 aa, Mycobacterium
DNVAIPIVVILFVGFLVVVLATAVVLFVVLRRRGLGQRRRN

SEQ ID NO: 352616 - protein, 28 aa, Mycobacterium
DNVFLLVGIPMLAGWLLINRGRGEAALS

SEQ ID NO: 352617 - protein, 24 aa, Mycobacterium
DNVVTIASPAWWADYVLAVGSVNG

SEQ ID NO: 352618 - protein, 26 aa, Mycobacterium
DPAGWPRLDWSMDAALLLAALASRAG

SEQ ID NO: 352619 - protein, 30 aa, Mycobacterium
DPAKLTLKMWFFPYLPIAVIACFVLVLVAM

SEQ ID NO: 352620 - protein, 24 aa, Mycobacterium
DPAMVWAIGWPEAVFRFVLYAFLC

SEQ ID NO: 352621 - protein, 25 aa, Mycobacterium
DPANPLQFPNALLHKVTASLTQDFP

SEQ ID NO: 352622 - protein, 37 aa, Mycobacterium
DPAQKWAPRYLFQPISNLLLTLLFEWGVAIHDMDIEA

SEQ ID NO: 352623 - protein, 23 aa, Mycobacterium
DPAVRRALRLEGRTPYRVSRSLL

SEQ ID NO: 352624 - protein, 27 aa, Mycobacterium
DPDASAVRWSWVLDGMVEIGALSEQDR

SEQ ID NO: 352625 - protein, 21 aa, Mycobacterium
DPDELPATGARLKWVRAQGSS

SEQ ID NO: 352626 - protein, 31 aa, Mycobacterium
DPDERAQQLKLLRAAFIPWLATINPDNDQPM

SEQ ID NO: 352627 - protein, 17 aa, Mycobacterium
DPDFRARFIREADTAAG

SEQ ID NO: 352628 - protein, 21 aa, Mycobacterium
DPDGGLLPSWTPGAHIDVRLP

SEQ ID NO: 352629 - protein, 22 aa, Mycobacterium
DPDLVQFYCLDFGGGALAAVRD

SEQ ID NO: 352630 - protein, 27 aa, Mycobacterium
DPDQPLLTRGLVARILLVATMLVATAW

SEQ ID NO: 352631 - protein, 34 aa, Mycobacterium
DPDRRRFFAYLNLFLAAMLLLVLADNYLGLYAGW

SEQ ID NO: 352632 - protein, 39 aa, Mycobacterium
DPDRRRFFGYLNLFLAAMLLLVLADNFLGLYLGWEGVGL

SEQ ID NO: 352633 - protein, 17 aa, Mycobacterium
DPDYTWVPRTKVETPRT

SEQ ID NO: 352634 - protein, 39 aa, Mycobacterium
DPEARPRLILGTAMIALPALGLWHLWAGSPTDPVGRRGA

SEQ ID NO: 352635 - protein, 18 aa, Mycobacterium
DPEDFWRSAGLPAYRFPD

SEQ ID NO: 352636 - protein, 25 aa, Mycobacterium
DPEDPDWSWLKWLPHVQHQTDTDAA

SEQ ID NO: 352637 - protein, 24 aa, Mycobacterium
DPETVIDQLWGACYNRLLVPDQPL

SEQ ID NO: 352638 - protein, 17 aa, Mycobacterium
DPEVWHLLNWHALEELE

SEQ ID NO: 352639 - protein, 21 aa, Mycobacterium
DPFGWYYNVLALMTKVSDASI

SEQ ID NO: 352640 - protein, 19 aa, Mycobacterium
DPFRALRHRGLFGVGLTAL

SEQ ID NO: 352641 - protein, 27 aa, Mycobacterium
DPFVELRFFRSIPFASATAIAVCAFAA

SEQ ID NO: 352642 - protein, 18 aa, Mycobacterium
DPGGWLRHIILPGLTVGL

SEQ ID NO: 352643 - protein, 19 aa, Mycobacterium
DPGMPLPRLLEVNAEAVTT

SEQ ID NO: 352644 - protein, 22 aa, Mycobacterium
DPGMWSWLLHRISGATIFFFLF

SEQ ID NO: 352645 - protein, 24 aa, Mycobacterium
DPGNPLAILVPLTAAAMDVVALGA

SEQ ID NO: 352646 - protein, 25 aa, Mycobacterium
DPGNPLAVLVPLTAAALDLAALGAA

SEQ ID NO: 352647 - protein, 23 aa, Mycobacterium
DPGQTWVLVFAVTMMAGLLVSLL

SEQ ID NO: 352648 - protein, 29 aa, Mycobacterium
DPGSAVQAPWPLLRTFASGPALSREAALL

SEQ ID NO: 352649 - protein, 40 aa, Mycobacterium
DPGWAPRPNPIVPVPIPIPIPIPGWQPPYNPPYNPTTPYT

SEQ ID NO: 352650 - protein, 21 aa, Mycobacterium
DPHHWPWPTFTVNIVGAFLVG

SEQ ID NO: 352651 - protein, 21 aa, Mycobacterium
DPHMPPALTSYIFGGGADAAR

SEQ ID NO: 352652 - protein, 27 aa, Mycobacterium
DPHNPASIYPPCPFRWLTGWNCPFCGG

SEQ ID NO: 352653 - protein, 18 aa, Mycobacterium
DPHQKWRPGNLGQPLYNL

SEQ ID NO: 352654 - protein, 18 aa, Mycobacterium
DPIAWWSPDLLFSEPDWL

SEQ ID NO: 352655 - protein, 24 aa, Mycobacterium
DPIAWWTPDLLFKKPDWLREPRGY

SEQ ID NO: 352656 - protein, 17 aa, Mycobacterium
DPIIGLVITVAILAVLR

SEQ ID NO: 352657 - protein, 18 aa, Mycobacterium
DPIVWWSPDLLFTRPDWL

SEQ ID NO: 352658 - protein, 29 aa, Mycobacterium
DPKPAATPPPPLFRVAGHRGLRGWQGGHR

SEQ ID NO: 352659 - protein, 24 aa, Mycobacterium
DPKQRPPKFLEIDTLDFDSPPKPA

SEQ ID NO: 352660 - protein, 24 aa, Mycobacterium
DPKRKFNYTRWRRLATAIVRWPAP

SEQ ID NO: 352661 - protein, 24 aa, Mycobacterium
DPLEVLFSSLLWIDGRNLEPYLVL

SEQ ID NO: 352662 - protein, 18 aa, Mycobacterium
DPLFGYIDAEYRFERAWP

SEQ ID NO: 352663 - protein, 19 aa, Mycobacterium
DPLIALESLYRYLRKFHAL

SEQ ID NO: 352664 - protein, 31 aa, Mycobacterium
DPLRTGIFGVVLVICVVLIAFGYSGLPFLPQ

SEQ ID NO: 352665 - protein, 23 aa, Mycobacterium
DPMVEDLPHPWLDALGIPDRVGD

SEQ ID NO: 352666 - protein, 21 aa, Mycobacterium
DPNAVWRRPGAEGPFAPAAPA

SEQ ID NO: 352667 - protein, 24 aa, Mycobacterium
DPNGKFTIGLLWSGEKAWKQSGER

SEQ ID NO: 352668 - protein, 24 aa, Mycobacterium
DPNSKFTVSLLWPGDRAWRQSGDR

SEQ ID NO: 352669 - protein, 27 aa, Mycobacterium
DPPGALPALPALFIIVDEFTELLSQQP

SEQ ID NO: 352670 - protein, 20 aa, Mycobacterium
DPPLPLAVPPTPVGGNALAG

SEQ ID NO: 352671 - protein, 25 aa, Mycobacterium
DPQGAVLLRDPLRRQAPRTMRRLRQ

SEQ ID NO: 352672 - protein, 21 aa, Mycobacterium
DPQLISLLNDMAWFFFIAPVG

SEQ ID NO: 352673 - protein, 22 aa, Mycobacterium
DPQQRMALELTWEALEHARIPP

SEQ ID NO: 352674 - protein, 34 aa, Mycobacterium
DPRPDTAWPVYVDPPLHLTGAGGAPLGLLDSFAD

SEQ ID NO: 352675 - protein, 19 aa, Mycobacterium
DPRRSMLAGILLSIVGAGV

SEQ ID NO: 352676 - protein, 18 aa, Mycobacterium
DPRRWLGLSLGISGVVVA

SEQ ID NO: 352677 - protein, 26 aa, Mycobacterium
DPRRWPNWWWAGVTALGLILAGIGAG

SEQ ID NO: 352678 - protein, 22 aa, Mycobacterium
DPRYVIGVMLDAPHRAADGSPG

SEQ ID NO: 352679 - protein, 22 aa, Mycobacterium
DPSAQRAFGRPSGVSGSFLGAE

SEQ ID NO: 352680 - protein, 32 aa, Mycobacterium
DPSARSFTTAAIWLVIAAFVVASVVAGLAYVS

SEQ ID NO: 352681 - protein, 42 aa, Mycobacterium
DPSFSMLSWLPQFHDMGLIGMLLWPLFYGGTSRFLSPVTFIK

SEQ ID NO: 352682 - protein, 17 aa, Mycobacterium
DPSFYLRFRREAQNAAA

SEQ ID NO: 352683 - protein, 30 aa, Mycobacterium
DPTDTVLRRLGWVLLIVGGVGVAVAAAAGA

SEQ ID NO: 352684 - protein, 28 aa, Mycobacterium
DPTGISLPMFMEELFWGCAGIGLAIVMP

SEQ ID NO: 352685 - protein, 31 aa, Mycobacterium
DPTLLDPGGWPRLDWSMDAALLLAALAARAG

SEQ ID NO: 352686 - protein, 33 aa, Mycobacterium
DPTMPLPTSIPLTALWLAQSWHRRILDEELDTL

SEQ ID NO: 352687 - protein, 26 aa, Mycobacterium
DPVAALTWQLPAPQSAVPAKPVAVPP

SEQ ID NO: 352688 - protein, 21 aa, Mycobacterium
DPVALPVTVLTPPPAQPVAPN

SEQ ID NO: 352689 - protein, 26 aa, Mycobacterium
DPVLLAIPFFLLLLTLEWTAARKLEH

SEQ ID NO: 352690 - protein, 26 aa, Mycobacterium
DPVLLAIPFFLLLLTLEWTAARKLES

SEQ ID NO: 352691 - protein, 18 aa, Mycobacterium
DPVLPQTVSMLKTSRVVL

SEQ ID NO: 352692 - protein, 22 aa, Mycobacterium
DPVMLDWLVGLAFPCQRPFDHR

SEQ ID NO: 352693 - protein, 32 aa, Mycobacterium
DPVNGSLRLHPMLDKLLFESQFTKEICNMMGL

SEQ ID NO: 352694 - protein, 18 aa, Mycobacterium
DPVPFPGFKNGVGLILQL

SEQ ID NO: 352695 - protein, 26 aa, Mycobacterium
DPVSVVLVVVIVLALVFAGLLGTELY

SEQ ID NO: 352696 - protein, 24 aa, Mycobacterium
DPVVPRWFGYLNLWIAILYLPELL

SEQ ID NO: 352697 - protein, 38 aa, Mycobacterium
DPWATLKVSLVLSVVFFFVWMIAVAMLYLVLGAMGVWS

SEQ ID NO: 352698 - protein, 39 aa, Mycobacterium
DPWSTLKVSLLLSVALFFVWMISVAFLYLVLGGMGVWAK

SEQ ID NO: 352699 - protein, 21 aa, Mycobacterium
DPWVDWAPFIVTAALFVIGLV

SEQ ID NO: 352700 - protein, 20 aa, Mycobacterium
DPWYTSLWHTISDVPQGISP

SEQ ID NO: 352701 - protein, 25 aa, Mycobacterium
DQAAIWVLVFCILVLAIAASTVWTV

SEQ ID NO: 352702 - protein, 22 aa, Mycobacterium
DQAALGAAIRYAAVDKDAVIVA

SEQ ID NO: 352703 - protein, 20 aa, Mycobacterium
DQAALWQAVTIRGVTTAAAT

SEQ ID NO: 352704 - protein, 20 aa, Mycobacterium
DQADLRLVLLRPGKEEDEPE

SEQ ID NO: 352705 - protein, 34 aa, Mycobacterium
DQALPRLPIQPIDYEQWMVHWLTAQRRAALEGYW

SEQ ID NO: 352706 - protein, 20 aa, Mycobacterium
DQDLVLGVALIADGRRQAGV

SEQ ID NO: 352707 - protein, 30 aa, Mycobacterium
DQFEQPLQIIPAQPVAPWMYIELADGIADS

SEQ ID NO: 352708 - protein, 23 aa, Mycobacterium
DQFMRLGWKLLIPVSLAWIAIVA

SEQ ID NO: 352709 - protein, 26 aa, Mycobacterium
DQGALLIGVFFWFSVVGGITVVMSGG

SEQ ID NO: 352710 - protein, 21 aa, Mycobacterium
DQGRSFQAFYDFLLSETRQAE

SEQ ID NO: 352711 - protein, 26 aa, Mycobacterium
DQHGAQYWWVPIVGPFIGGLVGAALY

SEQ ID NO: 352712 - protein, 29 aa, Mycobacterium
DQLRKIDFQPYRLWQPPLNQPVAIDELVN

SEQ ID NO: 352713 - protein, 30 aa, Mycobacterium
DQLRRIDFEPYRLWKPPLDAPWSIEKLVNT

SEQ ID NO: 352714 - protein, 23 aa, Mycobacterium
DQLTSVLRVWLAGAPRGQRKPPE

SEQ ID NO: 352715 - protein, 26 aa, Mycobacterium
DQLVDYIFSGLRRPWRPRTFVRAISQ

SEQ ID NO: 352716 - protein, 21 aa, Mycobacterium
DQLVDYIFTGLRAPWRPRTFL

SEQ ID NO: 352717 - protein, 26 aa, Mycobacterium
DQMGSWGWRLPFLVAAPLGLIGVYLR

SEQ ID NO: 352718 - protein, 22 aa, Mycobacterium
DQMRSWFDRPAATTLQITAAPG

SEQ ID NO: 352719 - protein, 22 aa, Mycobacterium
DQNAPVWLFTAGSIVVLFMTLM

SEQ ID NO: 352720 - protein, 26 aa, Mycobacterium
DQPHTRFDVLFAFDIIDHSGQAVALS

SEQ ID NO: 352721 - protein, 20 aa, Mycobacterium
DQPRRFNPISQLLLCVFLTC

SEQ ID NO: 352722 - protein, 24 aa, Mycobacterium
DQQNDKLFRYLKKVAVELDEARAR

SEQ ID NO: 352723 - protein, 22 aa, Mycobacterium
DQRALWQAVGVRGATTAAAATA

SEQ ID NO: 352724 - protein, 32 aa, Mycobacterium
DQRNTFFAPFRLTRVLLILWAAGTALLTTLYG

SEQ ID NO: 352725 - protein, 24 aa, Mycobacterium
DQRRDLAELLDLAPLLADNAYNMI

SEQ ID NO: 352726 - protein, 21 aa, Mycobacterium
DQRVLAIHLPNGSSLLISKSL

SEQ ID NO: 352727 - protein, 19 aa, Mycobacterium
DQRVLAIHLPSGSSLLISK

SEQ ID NO: 352728 - protein, 35 aa, Mycobacterium
DQRWQPYFLGNPLYAFLLMVLFQYGVALHELETER

SEQ ID NO: 352729 - protein, 26 aa, Mycobacterium
DQTAYFDTDFFRELVDKFGSSGGPFA

SEQ ID NO: 352730 - protein, 22 aa, Mycobacterium
DQTWRLLGVLALADPPRADSAE

SEQ ID NO: 352731 - protein, 24 aa, Mycobacterium
DQVAACKLIMLCLWWGAAVSKLNH

SEQ ID NO: 352732 - protein, 32 aa, Mycobacterium
DQVDDLLACLYGLYALLRLHFVQEEESYFTLA

SEQ ID NO: 352733 - protein, 17 aa, Mycobacterium
DQVFARALPWLAGQVGT

SEQ ID NO: 352734 - protein, 17 aa, Mycobacterium
DQVLLMAPGGKTAFLGP

SEQ ID NO: 352735 - protein, 27 aa, Mycobacterium
DQVLQSYLNIIYFGRGAYGVAAAAKAY

SEQ ID NO: 352736 - protein, 34 aa, Mycobacterium
DQVNMAIWQLCIVVLLLAIWRGRRLGPVIAEKLP

SEQ ID NO: 352737 - protein, 18 aa, Mycobacterium
DQVWRVVNSRWVELPHLL

SEQ ID NO: 352738 - protein, 27 aa, Mycobacterium
DQYALAATAYQLLTGRTPFEHSNPAVV

SEQ ID NO: 352739 - protein, 26 aa, Mycobacterium
DQYALAATTFYLLTGAPPFQDSNRAV

SEQ ID NO: 352740 - protein, 31 aa, Mycobacterium
DRAAAARRRLRLRPRWLRRPGRTGLAAMAAA

SEQ ID NO: 352741 - protein, 30 aa, Mycobacterium
DRAGGRYSVYVWALLAMAAARLGLGPLRRV

SEQ ID NO: 352742 - protein, 35 aa, Mycobacterium
DRAGTYPFRMFGIRTVLIGLDLLLLRGADLRRAER

SEQ ID NO: 352743 - protein, 19 aa, Mycobacterium
DRALMWVVDLLLVVPSFIL

SEQ ID NO: 352744 - protein, 18 aa, Mycobacterium
DRALPIQFFDYLGGLVRG

SEQ ID NO: 352745 - protein, 23 aa, Mycobacterium
DRAQHLLLPTFTLALTAMAGYSR

SEQ ID NO: 352746 - protein, 25 aa, Mycobacterium
DRDDDPNSLLPRWLPEAGDGSGLLS

SEQ ID NO: 352747 - protein, 20 aa, Mycobacterium
DRDEFLKVMLRWLNAFVSKP

SEQ ID NO: 352748 - protein, 22 aa, Mycobacterium
DRDFYGNPGFSFSGLLRAVKNN

SEQ ID NO: 352749 - protein, 32 aa, Mycobacterium
DRDFYSNPGFSWTGFLRAIKNNLFGGGGLQGG

SEQ ID NO: 352750 - protein, 24 aa, Mycobacterium
DRDIDRLLRRIGPGDIVVMDVLDL

SEQ ID NO: 352751 - protein, 18 aa, Mycobacterium
DRDLQLVVNSLWASGAEA

SEQ ID NO: 352752 - protein, 22 aa, Mycobacterium
DRDLRFILEDAGTAMLFAPHRF

SEQ ID NO: 352753 - protein, 21 aa, Mycobacterium
DRDMQLVVNSLWTSGAEAISV

SEQ ID NO: 352754 - protein, 33 aa, Mycobacterium
DRDPLRTGIFGVVLVVCVVLIAFGYAGLPFIPQ

SEQ ID NO: 352755 - protein, 43 aa, Mycobacterium
DRDRWRKQTWLGRFISTYGWRAYAIPLLVALTVFVGYQTVTQR

SEQ ID NO: 352756 - protein, 20 aa, Mycobacterium
DREIKWLKWIEAPFARIGRL

SEQ ID NO: 352757 - protein, 24 aa, Mycobacterium
DREIPWWRRILPGKPKPKPARSAA

SEQ ID NO: 352758 - protein, 18 aa, Mycobacterium
DREIVVTRYLTVPAEDAE

SEQ ID NO: 352759 - protein, 19 aa, Mycobacterium
DREYLERIVMSKPALLQEL

SEQ ID NO: 352760 - protein, 36 aa, Mycobacterium
DRFADMSPAERWHLLARTWLDLPGRPALLGSRGPDG

SEQ ID NO: 352761 - protein, 18 aa, Mycobacterium
DRFDHVEVWWGRPVTSCV

SEQ ID NO: 352762 - protein, 26 aa, Mycobacterium
DRFGRRPLMLPAPLLAAIGSLILAVG

SEQ ID NO: 352763 - protein, 25 aa, Mycobacterium
DRFGRRYVIVWAIGSFAATTLLTAA

SEQ ID NO: 352764 - protein, 27 aa, Mycobacterium
DRFRPLPQPFWVSVTVALLLGVCLVST

SEQ ID NO: 352765 - protein, 23 aa, Mycobacterium
DRGSLWAFSIPATIFSLGCFYVL

SEQ ID NO: 352766 - protein, 18 aa, Mycobacterium
DRGVPFFLRTFTSNILST

SEQ ID NO: 352767 - protein, 19 aa, Mycobacterium
DRGYAYGPGFQGLVGVWRR

SEQ ID NO: 352768 - protein, 22 aa, Mycobacterium
DRHLRIPLREVMWGSDAALLDS

SEQ ID NO: 352769 - protein, 26 aa, Mycobacterium
DRHTLVMFALLIPAVAVGYALSRWVN

SEQ ID NO: 352770 - protein, 17 aa, Mycobacterium
DRHWLLVQGLRSPSLLT

SEQ ID NO: 352771 - protein, 26 aa, Mycobacterium
DRIAQPLVPGIMIAGALIAGTGSIFG

SEQ ID NO: 352772 - protein, 17 aa, Mycobacterium
DRIATHLALAQSAGAIQ

SEQ ID NO: 352773 - protein, 17 aa, Mycobacterium
DRIGAYERYWLYPGAEN

SEQ ID NO: 352774 - protein, 27 aa, Mycobacterium
DRIRLSIWIAMLSLLMIYTPNALELAY

SEQ ID NO: 352775 - protein, 26 aa, Mycobacterium
DRISAVFVPVVFAIAIVAGGCWLLSG

SEQ ID NO: 352776 - protein, 26 aa, Mycobacterium
DRISNFLHGTWLGHPLHPALTSIPMG

SEQ ID NO: 352777 - protein, 41 aa, Mycobacterium
DRKQTAALMLSILLVAIASGWMLLLNVLKPTGIVGDSAIIG

SEQ ID NO: 352778 - protein, 40 aa, Mycobacterium
DRKQTAALVLSILLVAIAAGWMMLLNVLKPTGAVGESSII

SEQ ID NO: 352779 - protein, 34 aa, Mycobacterium
DRKRNLLVQIGLTAVVVLFAVALVLYIVMNGEKN

SEQ ID NO: 352780 - protein, 23 aa, Mycobacterium
DRLARLALVPAARNLGIAIGLLP

SEQ ID NO: 352781 - protein, 26 aa, Mycobacterium
DRLEALMLVLAIAISLLAIPIGAAVG

SEQ ID NO: 352782 - protein, 26 aa, Mycobacterium
DRLKKYAAVALAVTAVLVLLWVLRRR

SEQ ID NO: 352783 - protein, 17 aa, Mycobacterium
DRLLGSLMPEPVARRYR

SEQ ID NO: 352784 - protein, 17 aa, Mycobacterium
DRLLLSMMPEPVVQRYR

SEQ ID NO: 352785 - protein, 18 aa, Mycobacterium
DRLLRLKVFPLAISLPWG

SEQ ID NO: 352786 - protein, 26 aa, Mycobacterium
DRLNDQILASRWTWSSAPPIWVAAVA

SEQ ID NO: 352787 - protein, 23 aa, Mycobacterium
DRLPLVCCLLAFILTFFVTRTVV

SEQ ID NO: 352788 - protein, 17 aa, Mycobacterium
DRLPPWHPGAHLDLLLP

SEQ ID NO: 352789 - protein, 26 aa, Mycobacterium
DRLPWSRFHWRVVLGLGGVWILDGLE

SEQ ID NO: 352790 - protein, 19 aa, Mycobacterium
DRLPWSRFHWRVVVGLGGV

SEQ ID NO: 352791 - protein, 19 aa, Mycobacterium
DRLQSLFQLDHLAARMRRN

SEQ ID NO: 352792 - protein, 18 aa, Mycobacterium
DRLRLVQRQLRDHFREIA

SEQ ID NO: 352793 - protein, 24 aa, Mycobacterium
DRLRRILPFVNRIGGALLVLVGLY

SEQ ID NO: 352794 - protein, 20 aa, Mycobacterium
DRLTDPLLVARYVAPVVAGV

SEQ ID NO: 352795 - protein, 23 aa, Mycobacterium
DRLTLFITGIWLVSIIGVALLIK

SEQ ID NO: 352796 - protein, 19 aa, Mycobacterium
DRLTLFVVGIWLVSIVGVA

SEQ ID NO: 352797 - protein, 20 aa, Mycobacterium
DRLTYRQLWCRASRVAGGLR

SEQ ID NO: 352798 - protein, 18 aa, Mycobacterium
DRLVVLIGLLIAAGGFVL

SEQ ID NO: 352799 - protein, 40 aa, Mycobacterium
DRMGPRKMLILGSLYMAAIGYPFFWLLSTGEGWAVLVAMI

SEQ ID NO: 352800 - protein, 38 aa, Mycobacterium
DRMKFGAWMLFAGLWAVLVYFPVAHWVFAFDGVVTENS

SEQ ID NO: 352801 - protein, 25 aa, Mycobacterium
DRNRPGWEWLKWLPHNQHPSHHDEV

SEQ ID NO: 352802 - protein, 25 aa, Mycobacterium
DRPKPLAALFLFLQTVSLGLFVSAD

SEQ ID NO: 352803 - protein, 23 aa, Mycobacterium
DRPLPIFVPLVWVGTAPTALVVY

SEQ ID NO: 352804 - protein, 20 aa, Mycobacterium
DRPLWEQYVTSLAAVSRGDL

SEQ ID NO: 352805 - protein, 25 aa, Mycobacterium
DRPPRRRVWWPPVGVRIALALLTIG

SEQ ID NO: 352806 - protein, 19 aa, Mycobacterium
DRPRQWRKQSWLGRFVSTY

SEQ ID NO: 352807 - protein, 25 aa, Mycobacterium
DRQQFRDGLGGLLGLVVVGAGAAHP

SEQ ID NO: 352808 - protein, 23 aa, Mycobacterium
DRRADLAMTWLLAGLAAGILSGA

SEQ ID NO: 352809 - protein, 24 aa, Mycobacterium
DRRADLAMTWLVAGLVAGILSGAV

SEQ ID NO: 352810 - protein, 31 aa, Mycobacterium
DRRALYRFVGLVLPLVALLTTVMAVLSWSST

SEQ ID NO: 352811 - protein, 26 aa, Mycobacterium
DRRAMMLAHWAWLSMLLAGGAGMAAG

SEQ ID NO: 352812 - protein, 24 aa, Mycobacterium
DRREDLAMTWLLAGLAAGVLSGAV

SEQ ID NO: 352813 - protein, 25 aa, Mycobacterium
DRREDLAMWWLLGGIFAGVVSGLVI

SEQ ID NO: 352814 - protein, 24 aa, Mycobacterium
DRRNRPVLTFVLDAGMPGLTQGKP

SEQ ID NO: 352815 - protein, 18 aa, Mycobacterium
DRRRANRAVALSAAGLAL

SEQ ID NO: 352816 - protein, 17 aa, Mycobacterium
DRRVAVGIVLLAALTAA

SEQ ID NO: 352817 - protein, 17 aa, Mycobacterium
DRRYLPQDLPANTGYAA

SEQ ID NO: 352818 - protein, 27 aa, Mycobacterium
DRSAAMRWYPIVTFWQVAADLANAVGV

SEQ ID NO: 352819 - protein, 25 aa, Mycobacterium
DRSANPFVFVYNYLKQVVAEMRKVI

SEQ ID NO: 352820 - protein, 18 aa, Mycobacterium
DRSPGLHRLRLLEVSYGV

SEQ ID NO: 352821 - protein, 22 aa, Mycobacterium
DRSPGMRRLKLLEISYGVGVSV

SEQ ID NO: 352822 - protein, 29 aa, Mycobacterium
DRSQLVTMTYALRFRWWVVIAGVAIASFT

SEQ ID NO: 352823 - protein, 23 aa, Mycobacterium
DRSRPMWMSYLIDGLEDGRFAFY

SEQ ID NO: 352824 - protein, 35 aa, Mycobacterium
DRSTPLPLAPMQANLWYLQQLVPTMTAYNIPAAVR

SEQ ID NO: 352825 - protein, 18 aa, Mycobacterium
DRSTVVLGMWQHLLHRYS

SEQ ID NO: 352826 - protein, 25 aa, Mycobacterium
DRTAPALDLDLLLGGLKPVIQGLNP

SEQ ID NO: 352827 - protein, 25 aa, Mycobacterium
DRTAPALDLDLLLGGLKPVITGLNP

SEQ ID NO: 352828 - protein, 25 aa, Mycobacterium
DRTASMRWYPIITFWQVAADMTNAS

SEQ ID NO: 352829 - protein, 27 aa, Mycobacterium
DRTAYFDTSFFQVLVDQFGSSGGPLAQ

SEQ ID NO: 352830 - protein, 19 aa, Mycobacterium
DRTGPGKEPLWLGSIKSNM

SEQ ID NO: 352831 - protein, 26 aa, Mycobacterium
DRTNWLPMFVIMIVVSVVAGIYAGRG

SEQ ID NO: 352832 - protein, 27 aa, Mycobacterium
DRTPEWQPWLRWVVLVGSIAVAVVFSA

SEQ ID NO: 352833 - protein, 19 aa, Mycobacterium
DRTPPKPANAPLSSPFVPP

SEQ ID NO: 352834 - protein, 23 aa, Mycobacterium
DRTRKFWAWTISGYALTVVTVPF

SEQ ID NO: 352835 - protein, 27 aa, Mycobacterium
DRTRRQQAFLVSLLAAVRQGGAMSNPA

SEQ ID NO: 352836 - protein, 21 aa, Mycobacterium
DRTRWLYFAVIGAVILGVIAG

SEQ ID NO: 352837 - protein, 25 aa, Mycobacterium
DRTTAMRWYPIVTFWQVAADMTNAS

SEQ ID NO: 352838 - protein, 17 aa, Mycobacterium
DRVAILCPQGVDYVVSF

SEQ ID NO: 352839 - protein, 25 aa, Mycobacterium
DRVLMWLVDLLLVVPSFILIAIVTP

SEQ ID NO: 352840 - protein, 30 aa, Mycobacterium
DRVRVSWFRTLLLKWMLVAVVSLFSSAVYL

SEQ ID NO: 352841 - protein, 22 aa, Mycobacterium
DRVVADLIRFTYPQPDGEPPLL

SEQ ID NO: 352842 - protein, 21 aa, Mycobacterium
DRWGHLLGCAMSLAAFAVGTV

SEQ ID NO: 352843 - protein, 18 aa, Mycobacterium
DRWIAITAGVLALVLLVW

SEQ ID NO: 352844 - protein, 17 aa, Mycobacterium
DRYARCADFARALRHRL

SEQ ID NO: 352845 - protein, 23 aa, Mycobacterium
DRYGAVKVYRWSMLAFLAASVAC

SEQ ID NO: 352846 - protein, 27 aa, Mycobacterium
DRYHDDAIFFEPRYAIRQPDGGWGEFV

SEQ ID NO: 352847 - protein, 25 aa, Mycobacterium
DRYLVIVVGLIFGVWFGAKALRGLG

SEQ ID NO: 352848 - protein, 19 aa, Mycobacterium
DRYQRCIDFARALSHRLGG

SEQ ID NO: 352849 - protein, 17 aa, Mycobacterium
DRYSLVAGLPLAHWEFY

SEQ ID NO: 352850 - protein, 18 aa, Mycobacterium
DRYSLVAGLPLAHWEFYM

SEQ ID NO: 352851 - protein, 29 aa, Mycobacterium
DSAACKAWLLTQPYLVGGTLLVLYAATGH

SEQ ID NO: 352852 - protein, 29 aa, Mycobacterium
DSAARAVFLRWLWYAARRAELHLDGETDD

SEQ ID NO: 352853 - protein, 27 aa, Mycobacterium
DSAILRKPVLTLYRQRPPEIGLPSENP

SEQ ID NO: 352854 - protein, 35 aa, Mycobacterium
DSARTYLFPVYAGLLTPWWLRLLGATVGKGTEIST

SEQ ID NO: 352855 - protein, 22 aa, Mycobacterium
DSASGLGFAIPVNEMKFVAETL

SEQ ID NO: 352856 - protein, 29 aa, Mycobacterium
DSAVCKAWLLAVPFLVSTALLVIFAVEDR

SEQ ID NO: 352857 - protein, 26 aa, Mycobacterium
DSAVKHPFWVRFWAGVSFALGPVPLR

SEQ ID NO: 352858 - protein, 26 aa, Mycobacterium
DSDETKLPFCWRGVSLHAGGAGRVRA

SEQ ID NO: 352859 - protein, 19 aa, Mycobacterium
DSDGFLFYHGRCDDMFKVR

SEQ ID NO: 352860 - protein, 24 aa, Mycobacterium
DSFDVDGFFRTGDLGRWVSTGSGD

SEQ ID NO: 352861 - protein, 25 aa, Mycobacterium
DSFFDWEMYRQAIPALFSTGLPNTL

SEQ ID NO: 352862 - protein, 24 aa, Mycobacterium
DSGAKTPTWWIAGGIVAAVIIGVS

SEQ ID NO: 352863 - protein, 23 aa, Mycobacterium
DSGAMYYLLILAVGIERVVELVV

SEQ ID NO: 352864 - protein, 25 aa, Mycobacterium
DSGEFLKVMLRWLNAFVSKPGQTIP

SEQ ID NO: 352865 - protein, 25 aa, Mycobacterium
DSGIHGFWVAIWTFCVIATLQVIQV

SEQ ID NO: 352866 - protein, 24 aa, Mycobacterium
DSGKIRGHRFARFPAGRGLLLTDT

SEQ ID NO: 352867 - protein, 23 aa, Mycobacterium
DSGLRAVLPLAVHGKWVVLHNPN

SEQ ID NO: 352868 - protein, 24 aa, Mycobacterium
DSGVLSWVLPIATLMIRPLGVLTQ

SEQ ID NO: 352869 - protein, 41 aa, Mycobacterium
DSHILLSVVLPPLLYSAALNFSFPTFLRNIKPILGLGVGLV

SEQ ID NO: 352870 - protein, 27 aa, Mycobacterium
DSHTTWVLYTVIIISALIIAGAIPVLL

SEQ ID NO: 352871 - protein, 29 aa, Mycobacterium
DSHVGIAFYFLMSVLVAALVLGIDHLMLA

SEQ ID NO: 352872 - protein, 31 aa, Mycobacterium
DSHWHHTAGAWWFDMAMLAFISLCYVSFVRW

SEQ ID NO: 352873 - protein, 31 aa, Mycobacterium
DSHWQHTPARWWFDVGMLALISAVYLGFVRW

SEQ ID NO: 352874 - protein, 39 aa, Mycobacterium
DSIRTSRAFLWTFASLIVVALGALMFITSRNIHRTVTSS

SEQ ID NO: 352875 - protein, 21 aa, Mycobacterium
DSLIRLVDGLSPWLLVGVAAA

SEQ ID NO: 352876 - protein, 26 aa, Mycobacterium
DSLPLLPFLIVVVIFLIIPTVTVVIG

SEQ ID NO: 352877 - protein, 25 aa, Mycobacterium
DSLPRSRPTFAAWSNLSVFGVAFNF

SEQ ID NO: 352878 - protein, 25 aa, Mycobacterium
DSLRSRLLISLVLTVPVIAMSMIPA

SEQ ID NO: 352879 - protein, 20 aa, Mycobacterium
DSLRWLAIAWVIGAVCLLAA

SEQ ID NO: 352880 - protein, 17 aa, Mycobacterium
DSMIGYRSERYARFGWA

SEQ ID NO: 352881 - protein, 33 aa, Mycobacterium
DSMTAGRLWFVEVLVWILVALAAVCWLPAADRL

SEQ ID NO: 352882 - protein, 23 aa, Mycobacterium
DSPAGFDVPALTLPPSVASSPDV

SEQ ID NO: 352883 - protein, 33 aa, Mycobacterium
DSPLARPAFLLRSYLIPLGALLVLLVNVARMPA

SEQ ID NO: 352884 - protein, 20 aa, Mycobacterium
DSPLFLRINYVISGVWAAAF

SEQ ID NO: 352885 - protein, 25 aa, Mycobacterium
DSPMWFILVIIFVVGMLIGLLLRRR

SEQ ID NO: 352886 - protein, 25 aa, Mycobacterium
DSPRSRIPLVYLVSGLCGVAVLLGT

SEQ ID NO: 352887 - protein, 25 aa, Mycobacterium
DSPSPLDWVLAVVALVACLYPVLPI

SEQ ID NO: 352888 - protein, 34 aa, Mycobacterium
DSPTARWIIAILALLFALWVLVAAIWGPAGSDNA

SEQ ID NO: 352889 - protein, 24 aa, Mycobacterium
DSPVRLFLIVSVALFFLGAFVGIM

SEQ ID NO: 352890 - protein, 23 aa, Mycobacterium
DSPVTGFAIKLSGGALAPAGEVF

SEQ ID NO: 352891 - protein, 22 aa, Mycobacterium
DSPYTIVSLIAAAALLIAFLFV

SEQ ID NO: 352892 - protein, 29 aa, Mycobacterium
DSQLGIHIHWIIPALLMLATNAILTYFDV

SEQ ID NO: 352893 - protein, 34 aa, Mycobacterium
DSQRELMVLAGFALLIWVPALRCPAPVAAVLGVL

SEQ ID NO: 352894 - protein, 26 aa, Mycobacterium
DSRANPFLFVYNYLKQVVAEMRKVIW

SEQ ID NO: 352895 - protein, 23 aa, Mycobacterium
DSRFRDITWLGVSTRGAAPGLDE

SEQ ID NO: 352896 - protein, 19 aa, Mycobacterium
DSRLRSVARERGWEIRDFR

SEQ ID NO: 352897 - protein, 33 aa, Mycobacterium
DSRRNVLGLFMPLALFLIFTMFAVPSVQVQMWM

SEQ ID NO: 352898 - protein, 23 aa, Mycobacterium
DSTRARVILLDAAPAVLPPFGEK

SEQ ID NO: 352899 - protein, 20 aa, Mycobacterium
DSVAIESLYHPQPGPDGRVQ

SEQ ID NO: 352900 - protein, 32 aa, Mycobacterium
DSVDLLKVVAVPMAKRFAPVLVAATVAGAVGF

SEQ ID NO: 352901 - protein, 24 aa, Mycobacterium
DSVGLSILLWVLSVLMSLFVSWLL

SEQ ID NO: 352902 - protein, 18 aa, Mycobacterium
DSVLKRFGPLAPPRAVAI

SEQ ID NO: 352903 - protein, 36 aa, Mycobacterium
DSVPPLFYPVFAVGYFILMYVATFWQAALISQANIA

SEQ ID NO: 352904 - protein, 28 aa, Mycobacterium
DSWGIAFLYLCCSGSFLGFAFAFGQVLQ

SEQ ID NO: 352905 - protein, 28 aa, Mycobacterium
DSWGIALLYLCCSGSFLGFAFAFGQVLQ

SEQ ID NO: 352906 - protein, 23 aa, Mycobacterium
DSYRLLNIVFVLVVVFTLVQGPS

SEQ ID NO: 352907 - protein, 18 aa, Mycobacterium
DTADIPVTLWDLASQVEL

SEQ ID NO: 352908 - protein, 23 aa, Mycobacterium
DTAGPRALIPFPSNAIPPCPDCR

SEQ ID NO: 352909 - protein, 18 aa, Mycobacterium
DTALAWLPESPAMPVRVS

SEQ ID NO: 352910 - protein, 17 aa, Mycobacterium
DTALTVPQLSHGDWRLR

SEQ ID NO: 352911 - protein, 17 aa, Mycobacterium
DTALVVPQLSRGDWRLR

SEQ ID NO: 352912 - protein, 24 aa, Mycobacterium
DTAMLFAALIIMSLLGIALFAVIE

SEQ ID NO: 352913 - protein, 27 aa, Mycobacterium
DTANIPALILLFLGGVSFVSCLFAFST

SEQ ID NO: 352914 - protein, 24 aa, Mycobacterium
DTARPADLLVLLDSLQQREANLNK

SEQ ID NO: 352915 - protein, 23 aa, Mycobacterium
DTARPADLLVLLDSLRQREASLN

SEQ ID NO: 352916 - protein, 22 aa, Mycobacterium
DTARVPIAIRIVADRETREATA

SEQ ID NO: 352917 - protein, 25 aa, Mycobacterium
DTASIILLPLVIDLKHAPRAAVGAV

SEQ ID NO: 352918 - protein, 24 aa, Mycobacterium
DTATVNWVLIVVGLVLGVVLGVPP

SEQ ID NO: 352919 - protein, 26 aa, Mycobacterium
DTATVVGWLWPLWDSRRRTFADMVAR

SEQ ID NO: 352920 - protein, 22 aa, Mycobacterium
DTATWAPIGRPIANVRLYIVDE

SEQ ID NO: 352921 - protein, 23 aa, Mycobacterium
DTDFFQLLVTEFGSSGGPFAQEY

SEQ ID NO: 352922 - protein, 21 aa, Mycobacterium
DTFAKIFRRPFQLKEFLDQTW

SEQ ID NO: 352923 - protein, 21 aa, Mycobacterium
DTGFFDVLKTQFGSSGGPFAE

SEQ ID NO: 352924 - protein, 18 aa, Mycobacterium
DTGGWLRITDRLKEMIKV

SEQ ID NO: 352925 - protein, 26 aa, Mycobacterium
DTGLPPGTRRRLILGFITGLEGAFVL

SEQ ID NO: 352926 - protein, 17 aa, Mycobacterium
DTGPRRIAFGGGALCVA

SEQ ID NO: 352927 - protein, 18 aa, Mycobacterium
DTGPTRQGWRGRLRNRMR

SEQ ID NO: 352928 - protein, 24 aa, Mycobacterium
DTGQTTLTFPVPSGLRPTTLNTTL

SEQ ID NO: 352929 - protein, 24 aa, Mycobacterium
DTGVARHRWLPRLVGGGDYVSNGD

SEQ ID NO: 352930 - protein, 17 aa, Mycobacterium
DTIAQTNNLHRRVILIC

SEQ ID NO: 352931 - protein, 26 aa, Mycobacterium
DTKALYPPYSVLAIGDPPTLAAAMNI

SEQ ID NO: 352932 - protein, 24 aa, Mycobacterium
DTKTQRIVALKVLPPHLAQDASFQ

SEQ ID NO: 352933 - protein, 23 aa, Mycobacterium
DTLFFKLIPYAVVGLTLGSMLLA

SEQ ID NO: 352934 - protein, 17 aa, Mycobacterium
DTLFVLYLGTLMVPLTV

SEQ ID NO: 352935 - protein, 24 aa, Mycobacterium
DTLLFAYVLGIIPALFLGGPLSDR

SEQ ID NO: 352936 - protein, 20 aa, Mycobacterium
DTLLFFVGLFIMVGALVKTG

SEQ ID NO: 352937 - protein, 23 aa, Mycobacterium
DTLTLALALLYPAADIVILAVSV

SEQ ID NO: 352938 - protein, 39 aa, Mycobacterium
DTLVAMFKWPFPWREFLLQSWFVARVSIIPTLLLAIPFT

SEQ ID NO: 352939 - protein, 25 aa, Mycobacterium
DTLYCCLPLYHNNALTVALSSVLNS

SEQ ID NO: 352940 - protein, 20 aa, Mycobacterium
DTMFLSQLPYVPLGDLRAVV

SEQ ID NO: 352941 - protein, 22 aa, Mycobacterium
DTMGYRMVIYPEYAVLDRKDPA

SEQ ID NO: 352942 - protein, 24 aa, Mycobacterium
DTNFIPKVLLGISFPGIVVSVSCH

SEQ ID NO: 352943 - protein, 25 aa, Mycobacterium
DTNRILWYLLIAHAVHFLAVPTVGR

SEQ ID NO: 352944 - protein, 27 aa, Mycobacterium
DTNSSQFFMVYRDSALPPEYTVFGTIQ

SEQ ID NO: 352945 - protein, 25 aa, Mycobacterium
DTNSSQFFMVYRDSQLPPQYTVFGT

SEQ ID NO: 352946 - protein, 25 aa, Mycobacterium
DTNVTVLLPRRTFAPLLGRLLHDRT

SEQ ID NO: 352947 - protein, 17 aa, Mycobacterium
DTPAMWRYAGMAASALV

SEQ ID NO: 352948 - protein, 20 aa, Mycobacterium
DTPCHRLTTGGLSVLQCGDP

SEQ ID NO: 352949 - protein, 27 aa, Mycobacterium
DTPQDAWPWLGWLTAATAAGWIVDTTT

SEQ ID NO: 352950 - protein, 32 aa, Mycobacterium
DTPVYTDILFKKPLRLWVAVSLYGGTALTVAL

SEQ ID NO: 352951 - protein, 35 aa, Mycobacterium
DTQLVLDNLWPMARAMITVTLPLTAISFVIGLVIA

SEQ ID NO: 352952 - protein, 26 aa, Mycobacterium
DTRFNTFLRYLSFGGLFIGLSVFQIE

SEQ ID NO: 352953 - protein, 26 aa, Mycobacterium
DTRFVKFLRYLSFGGLFIGLSVFQIE

SEQ ID NO: 352954 - protein, 27 aa, Mycobacterium
DTRLARPVAIKLLYPALAADADLRARF

SEQ ID NO: 352955 - protein, 22 aa, Mycobacterium
DTRLFAFLHTDGYALYRVDATD

SEQ ID NO: 352956 - protein, 24 aa, Mycobacterium
DTRPRWVTPALLALLASTAVLYLW

SEQ ID NO: 352957 - protein, 22 aa, Mycobacterium
DTSDILWWLLAAHAVHFLVVPQ

SEQ ID NO: 352958 - protein, 23 aa, Mycobacterium
DTSHHWLPAFVKLNNLSDKFFDE

SEQ ID NO: 352959 - protein, 25 aa, Mycobacterium
DTSIPALIGVSLFGDGAAAVVATGA

SEQ ID NO: 352960 - protein, 29 aa, Mycobacterium
DTSRPVGLTLLWPLADRPRLAPGQPGGPT

SEQ ID NO: 352961 - protein, 23 aa, Mycobacterium
DTTLWDVLVVATRGLWSAALQLA

SEQ ID NO: 352962 - protein, 29 aa, Mycobacterium
DTTRPVGLTMFWPLADRPRLAAGAPGGTT

SEQ ID NO: 352963 - protein, 32 aa, Mycobacterium
DTTTALSYLCYWLIPFTLFGLAALASRLVSGR

SEQ ID NO: 352964 - protein, 23 aa, Mycobacterium
DTTVRWLAVFALALGGFGIGTAE

SEQ ID NO: 352965 - protein, 31 aa, Mycobacterium
DTVDHGLWVAFWFFLAQLNLILGAINLLPLL

SEQ ID NO: 352966 - protein, 20 aa, Mycobacterium
DTVEFPLPQPPQDPIMLLTG

SEQ ID NO: 352967 - protein, 20 aa, Mycobacterium
DTVELWRDVLRAASGGAGDV

SEQ ID NO: 352968 - protein, 26 aa, Mycobacterium
DTVGWRGIFLINVPIGLAVLAGLRNV

SEQ ID NO: 352969 - protein, 32 aa, Mycobacterium
DTVLSRIMDVMWAFPVLLLGIALGTALALGGF

SEQ ID NO: 352970 - protein, 22 aa, Mycobacterium
DTVPRWLRIAGGVGAVAVFAVS

SEQ ID NO: 352971 - protein, 24 aa, Mycobacterium
DTVVWLIPIVVIIPVFYAFVRTPY

SEQ ID NO: 352972 - protein, 24 aa, Mycobacterium
DTWPGLIIPYITFALPLAIYTLSA

SEQ ID NO: 352973 - protein, 20 aa, Mycobacterium
DTWVLSLLYIGTFGSFIGYS

SEQ ID NO: 352974 - protein, 21 aa, Mycobacterium
DTWVMSLLYIGTFGSFIGYSA

SEQ ID NO: 352975 - protein, 19 aa, Mycobacterium
DVAALIRRLGLRSGVGAPI

SEQ ID NO: 352976 - protein, 42 aa, Mycobacterium
DVAAVFGFKLLSPGGFIPLLVMALLPRMVAVELSLRRAGVVL

SEQ ID NO: 352977 - protein, 33 aa, Mycobacterium
DVAFPRLNAFSFWLFLFGALIGIAGFITPGGAA

SEQ ID NO: 352978 - protein, 31 aa, Mycobacterium
DVAFPRLNAFSFWLFLFGATLGMAGFITPGG

SEQ ID NO: 352979 - protein, 33 aa, Mycobacterium
DVAFPRLNAFSFWLFLFGGLVAMGGFIVPGGAA

SEQ ID NO: 352980 - protein, 34 aa, Mycobacterium
DVAFPRLNAFSYWLFLFGALITLAGFITPGGAAD

SEQ ID NO: 352981 - protein, 30 aa, Mycobacterium
DVAFPRLNAFSYWLFLFGGLIAASGFIVPG

SEQ ID NO: 352982 - protein, 33 aa, Mycobacterium
DVAFPRLNALSFWLFIFGALIALSGFIVPGGPA

SEQ ID NO: 352983 - protein, 31 aa, Mycobacterium
DVAFPRLNALSFWLFLFGASIALGGFLAPGG

SEQ ID NO: 352984 - protein, 31 aa, Mycobacterium
DVAFPRLNALSFWLFVFGALIALSGFIVPGG

SEQ ID NO: 352985 - protein, 28 aa, Mycobacterium
DVAFPRLNALSFWLFVFGATIAMAGFIT

SEQ ID NO: 352986 - protein, 17 aa, Mycobacterium
DVAGRRGVLILLADDRP

SEQ ID NO: 352987 - protein, 18 aa, Mycobacterium
DVALWLASFSYLGALVWA

SEQ ID NO: 352988 - protein, 23 aa, Mycobacterium
DVALWLMPAPTSLPVRVAMMVAA

SEQ ID NO: 352989 - protein, 24 aa, Mycobacterium
DVAPRRGWLEALLGHFCDPTVALV

SEQ ID NO: 352990 - protein, 24 aa, Mycobacterium
DVAPRRGWLEALLGHFCDPTVGLV

SEQ ID NO: 352991 - protein, 21 aa, Mycobacterium
DVARLLLEQFPGGMPLDAAAP

SEQ ID NO: 352992 - protein, 20 aa, Mycobacterium
DVAVYFQDSYLARVRAMTIA

SEQ ID NO: 352993 - protein, 17 aa, Mycobacterium
DVAYWVKGMRHSVYFTH

SEQ ID NO: 352994 - protein, 18 aa, Mycobacterium
DVCWVPLLAVLAPALIST

SEQ ID NO: 352995 - protein, 22 aa, Mycobacterium
DVDAIVAAPARPGYRTALGARL

SEQ ID NO: 352996 - protein, 30 aa, Mycobacterium
DVDATMIRMLIIFGIVTIVALVAATTAGAI

SEQ ID NO: 352997 - protein, 27 aa, Mycobacterium
DVDDLPRLPWWLRPMARFHADDHFISP

SEQ ID NO: 352998 - protein, 27 aa, Mycobacterium
DVDDTLFWVAVIFGVVAVVALMAAGTA

SEQ ID NO: 352999 - protein, 23 aa, Mycobacterium
DVDEWDWVKWLPHFGDPRRQDAA

SEQ ID NO: 353000 - protein, 18 aa, Mycobacterium
DVDFVWITDFQQYQPQLD

SEQ ID NO: 353001 - protein, 17 aa, Mycobacterium
DVDIIITTALIPGRPAP

SEQ ID NO: 353002 - protein, 31 aa, Mycobacterium
DVDLSRTVGWFTSIAPVRLPAPGEDLLNTLK

SEQ ID NO: 353003 - protein, 23 aa, Mycobacterium
DVDLSRTVGWFTTKYPVALTVEN

SEQ ID NO: 353004 - protein, 30 aa, Mycobacterium
DVDRAAQVWLRPRSWLLRRATTEATVVVEI

SEQ ID NO: 353005 - protein, 20 aa, Mycobacterium
DVDVARFRRLPQPAKQHLAR

SEQ ID NO: 353006 - protein, 21 aa, Mycobacterium
DVDVPWIVFAVVMLAVNTVLT

SEQ ID NO: 353007 - protein, 24 aa, Mycobacterium
DVDWSVFPVSFMALIAVGADYSML

SEQ ID NO: 353008 - protein, 22 aa, Mycobacterium
DVEAAVFFDYLTKPKALDTYAM

SEQ ID NO: 353009 - protein, 20 aa, Mycobacterium
DVEALLPSSNPQKYLQALYT

SEQ ID NO: 353010 - protein, 19 aa, Mycobacterium
DVEPIYLLKREVVELRRCV

SEQ ID NO: 353011 - protein, 53 aa, Mycobacterium
DVEPRPRKRRIGWSRLLVFGVLPISALLIAVATGFLKWQAASNLLSRAAEIES

SEQ ID NO: 353012 - protein, 25 aa, Mycobacterium
DVFFVLSGFLITALLLDELGRTGRI

SEQ ID NO: 353013 - protein, 24 aa, Mycobacterium
DVFFVLSGFLITSLLLDELGRTGR

SEQ ID NO: 353014 - protein, 22 aa, Mycobacterium
DVFFVLSGFLITSLLLDELRHT

SEQ ID NO: 353015 - protein, 18 aa, Mycobacterium
DVFYLLVDELDALPADVA

SEQ ID NO: 353016 - protein, 27 aa, Mycobacterium
DVGFLMTALMWFVFGLTAVLALGSGVP

SEQ ID NO: 353017 - protein, 17 aa, Mycobacterium
DVGIWAAVILIVARLAQ

SEQ ID NO: 353018 - protein, 22 aa, Mycobacterium
DVGLLVLRLGLGAALLHAAFLK

SEQ ID NO: 353019 - protein, 32 aa, Mycobacterium
DVGLPPLPKVAIPNLPLPQPPSVPAPAIPAAL

SEQ ID NO: 353020 - protein, 17 aa, Mycobacterium
DVGLSWLLVVSVPVLTV

SEQ ID NO: 353021 - protein, 19 aa, Mycobacterium
DVGWLDTGGWLRITDRLKE

SEQ ID NO: 353022 - protein, 23 aa, Mycobacterium
DVHDLHVWTLVPGKDMVTAHLTS

SEQ ID NO: 353023 - protein, 28 aa, Mycobacterium
DVHLSMTLPILIPFVYFSHALNKVWRRH

SEQ ID NO: 353024 - protein, 19 aa, Mycobacterium
DVIGKSLLVGRICAGAISL

SEQ ID NO: 353025 - protein, 23 aa, Mycobacterium
DVIHAFWVPEFLFKRDVMPNPAA

SEQ ID NO: 353026 - protein, 23 aa, Mycobacterium
DVIHGFWVPEFLFKRDVLPEPKA

SEQ ID NO: 353027 - protein, 24 aa, Mycobacterium
DVIHGFWVPEFLFKRDVLPNPKEN

SEQ ID NO: 353028 - protein, 19 aa, Mycobacterium
DVIHSFRVVPFLFTRDVMP

SEQ ID NO: 353029 - protein, 33 aa, Mycobacterium
DVIIGVMVIAILLLWPKLPPKIRMVPGALVAIV

SEQ ID NO: 353030 - protein, 25 aa, Mycobacterium
DVIRRPPGLPAPRPFRTAFAAAYAV

SEQ ID NO: 353031 - protein, 17 aa, Mycobacterium
DVIVPYWMTLTSCWRLF

SEQ ID NO: 353032 - protein, 17 aa, Mycobacterium
DVKKFLRYNANKALMNL

SEQ ID NO: 353033 - protein, 17 aa, Mycobacterium
DVLASRHHALLLPTPGG

SEQ ID NO: 353034 - protein, 25 aa, Mycobacterium
DVLCDLEKVIPLMPGAQLTGHDGDD

SEQ ID NO: 353035 - protein, 20 aa, Mycobacterium
DVLGGWFAVLCWNNNPRKIL

SEQ ID NO: 353036 - protein, 46 aa, Mycobacterium
DVLPAVAAIVAVLVWGVGANLGWWKGLAGLWQWATDASHKAAATSG

SEQ ID NO: 353037 - protein, 29 aa, Mycobacterium
DVLRLRPAGPFFFIFAMGATATVPAGPVT

SEQ ID NO: 353038 - protein, 19 aa, Mycobacterium
DVLSGWMLGLAWAGTVVMV

SEQ ID NO: 353039 - protein, 28 aa, Mycobacterium
DVLVVVYALLPVLWIFSLSLKPTSTVKD

SEQ ID NO: 353040 - protein, 26 aa, Mycobacterium
DVLYEFRLLALATQLVLWAAIGVVFA

SEQ ID NO: 353041 - protein, 21 aa, Mycobacterium
DVLYVLRRPGLLARSVLAVLI

SEQ ID NO: 353042 - protein, 18 aa, Mycobacterium
DVLYWVRRTRVARLAPDR

SEQ ID NO: 353043 - protein, 25 aa, Mycobacterium
DVMGPWPVYVLTASALVLVVWALMT

SEQ ID NO: 353044 - protein, 26 aa, Mycobacterium
DVNAKLIFPGLITFSATQQGQTIPYG

SEQ ID NO: 353045 - protein, 18 aa, Mycobacterium
DVPDLPSVPLQFVDALAQ

SEQ ID NO: 353046 - protein, 25 aa, Mycobacterium
DVPDRLLQRWTGLTVTLDISGNVGR

SEQ ID NO: 353047 - protein, 19 aa, Mycobacterium
DVPGLRYVPDRYISLYGTK

SEQ ID NO: 353048 - protein, 19 aa, Mycobacterium
DVPICWSFRSLFDSLDGID

SEQ ID NO: 353049 - protein, 23 aa, Mycobacterium
DVPRAIIHQPTFGELLNLAVAQP

SEQ ID NO: 353050 - protein, 28 aa, Mycobacterium
DVPVKLLSFHLLLISLVLLAPYLDRLLD

SEQ ID NO: 353051 - protein, 31 aa, Mycobacterium
DVPVNLPPDPPPHPPPRSWRLERQLTAVLGA

SEQ ID NO: 353052 - protein, 25 aa, Mycobacterium
DVPVWPFVVVAVVIVAGGAVWAVRR

SEQ ID NO: 353053 - protein, 26 aa, Mycobacterium
DVPWQLRVLPPFLSRKHLPSRLAKLR

SEQ ID NO: 353054 - protein, 28 aa, Mycobacterium
DVQHTVRSLVWLQIGIGAGVLVVVGLAG

SEQ ID NO: 353055 - protein, 27 aa, Mycobacterium
DVRGQPLTFLDCLYFSAVSLSTTGYGD

SEQ ID NO: 353056 - protein, 27 aa, Mycobacterium
DVRNEPLTFLDCLYFSAVSLSTTGYGD

SEQ ID NO: 353057 - protein, 17 aa, Mycobacterium
DVRQVWSAHMFAAPPRP

SEQ ID NO: 353058 - protein, 22 aa, Mycobacterium
DVRRAMTMLLIACPCAVGLATP

SEQ ID NO: 353059 - protein, 23 aa, Mycobacterium
DVRRAMTMLLIACPCAVGLATPT

SEQ ID NO: 353060 - protein, 23 aa, Mycobacterium
DVRRAMTMLLIACPCAVGLSTPT

SEQ ID NO: 353061 - protein, 18 aa, Mycobacterium
DVRRFFRRVFGRPEPEPK

SEQ ID NO: 353062 - protein, 19 aa, Mycobacterium
DVRVSALLAAAWFAVFALP

SEQ ID NO: 353063 - protein, 20 aa, Mycobacterium
DVSIRWQLKQSAAPELFQQY

SEQ ID NO: 353064 - protein, 24 aa, Mycobacterium
DVSLIFFADLVILLVAALACGAVA

SEQ ID NO: 353065 - protein, 20 aa, Mycobacterium
DVSLLSIRQSSNKFRAVDDP

SEQ ID NO: 353066 - protein, 21 aa, Mycobacterium
DVSLNLVTGPVPLDHRRRPAA

SEQ ID NO: 353067 - protein, 28 aa, Mycobacterium
DVSRRNLVVFGLLGFGLVGGVVGAVITR

SEQ ID NO: 353068 - protein, 18 aa, Mycobacterium
DVTAIQAFFAEFVGTFIL

SEQ ID NO: 353069 - protein, 24 aa, Mycobacterium
DVTALCQALDLLVQRHPALRTVFP

SEQ ID NO: 353070 - protein, 25 aa, Mycobacterium
DVTAQPIMFVLLFAFVFGASITNTG

SEQ ID NO: 353071 - protein, 17 aa, Mycobacterium
DVTIGLLRPGHSPPWAA

SEQ ID NO: 353072 - protein, 18 aa, Mycobacterium
DVTIPPVSVHDFLFAGLD

SEQ ID NO: 353073 - protein, 31 aa, Mycobacterium
DVVAGWSLGYLYFLLCFTVIRPPAAALSRKP

SEQ ID NO: 353074 - protein, 23 aa, Mycobacterium
DVVELVPMMRQALGLQLDSISVV

SEQ ID NO: 353075 - protein, 23 aa, Mycobacterium
DVVHLASPALLGYGALRAARRLG

SEQ ID NO: 353076 - protein, 19 aa, Mycobacterium
DVVHTFWVPEFLFKRDVIP

SEQ ID NO: 353077 - protein, 19 aa, Mycobacterium
DVVLVTGPWLAGTSSVITA

SEQ ID NO: 353078 - protein, 18 aa, Mycobacterium
DVVVARPVLLRAGLGMRA

SEQ ID NO: 353079 - protein, 17 aa, Mycobacterium
DVWHPVPNLASARLIAG

SEQ ID NO: 353080 - protein, 17 aa, Mycobacterium
DVYAMQLSLVLDGQLDP

SEQ ID NO: 353081 - protein, 19 aa, Mycobacterium
DVYAVQFEIALGGVLDAER

SEQ ID NO: 353082 - protein, 33 aa, Mycobacterium
DVYQRTPQWYFPKPDFRLPRPLQRLLSRRRFAN

SEQ ID NO: 353083 - protein, 18 aa, Mycobacterium
DVYRASFGAQFFSGLVAP

SEQ ID NO: 353084 - protein, 28 aa, Mycobacterium
DVYSLGCVLYEILTGEPPFIGDSPVAVA

SEQ ID NO: 353085 - protein, 26 aa, Mycobacterium
DVYSLGCVLYEILTGEPPFVGDSPVA

SEQ ID NO: 353086 - protein, 26 aa, Mycobacterium
DVYSLGCVLYEMLTGEPPFVGDSPVA

SEQ ID NO: 353087 - protein, 18 aa, Mycobacterium
DVYVYTVFATYFEKQFFA

SEQ ID NO: 353088 - protein, 21 aa, Mycobacterium
DWAPGLVALAVLWSVRVVAQW

SEQ ID NO: 353089 - protein, 18 aa, Mycobacterium
DWATVVALIVLLIVFIRG

SEQ ID NO: 353090 - protein, 24 aa, Mycobacterium
DWCRYYRRHGWRHGPRRDDRAKVH

SEQ ID NO: 353091 - protein, 24 aa, Mycobacterium
DWDRHLRPMLARRYEIATGQRLAK

SEQ ID NO: 353092 - protein, 18 aa, Mycobacterium
DWGIYAIFVPFFATQFFD

SEQ ID NO: 353093 - protein, 26 aa, Mycobacterium
DWGNELWTSLWWIAQGWVYAAIATMV

SEQ ID NO: 353094 - protein, 25 aa, Mycobacterium
DWHQVKVVSAPSWFSDYVLSVGAVD

SEQ ID NO: 353095 - protein, 25 aa, Mycobacterium
DWHQVKVVSSPSWFADYVLSVGAVD

SEQ ID NO: 353096 - protein, 24 aa, Mycobacterium
DWHQVKVVSSPSWFSDYVLSVGAV

SEQ ID NO: 353097 - protein, 18 aa, Mycobacterium
DWIGFTSPFAFGAPRFDV

SEQ ID NO: 353098 - protein, 25 aa, Mycobacterium
DWKLWLGFLLVAIPVCLSPGAGAIQ

SEQ ID NO: 353099 - protein, 17 aa, Mycobacterium
DWPFADQVFARALPWLA

SEQ ID NO: 353100 - protein, 19 aa, Mycobacterium
DWPHFWSLITSPSSLTALA

SEQ ID NO: 353101 - protein, 25 aa, Mycobacterium
DWPNYRTMLRLLRRDPPAAARWRRF

SEQ ID NO: 353102 - protein, 17 aa, Mycobacterium
DWPRYGGYALAGVSSFG

SEQ ID NO: 353103 - protein, 26 aa, Mycobacterium
DWRAVFWINLPICALAILLTAIFVRE

SEQ ID NO: 353104 - protein, 32 aa, Mycobacterium
DWVFENGPPLFWLLFGIMIVTSVGWALHMEHR

SEQ ID NO: 353105 - protein, 17 aa, Mycobacterium
DWVLWTAGTLGGLFTAV

SEQ ID NO: 353106 - protein, 30 aa, Mycobacterium
DYALFILNRYRNNLLLLMPRQEAAGLAVGT

SEQ ID NO: 353107 - protein, 18 aa, Mycobacterium
DYAMAMRTYGWPRDLPRA

SEQ ID NO: 353108 - protein, 18 aa, Mycobacterium
DYAMPMRTFGWPRDLPRA

SEQ ID NO: 353109 - protein, 20 aa, Mycobacterium
DYDMVGILDVPRLKRDYSSR

SEQ ID NO: 353110 - protein, 19 aa, Mycobacterium
DYGAYPPPDQPPAPEPVPW

SEQ ID NO: 353111 - protein, 26 aa, Mycobacterium
DYGMGLLWTLVLMIPVLYVNQEMVLR

SEQ ID NO: 353112 - protein, 22 aa, Mycobacterium
DYHFRRSALPRPGRVRELLELA

SEQ ID NO: 353113 - protein, 18 aa, Mycobacterium
DYLAGPLGLAAWAVGLVM

SEQ ID NO: 353114 - protein, 33 aa, Mycobacterium
DYLGALIGGLVWPFVLLPHLGMIRGAAATGIVN

SEQ ID NO: 353115 - protein, 33 aa, Mycobacterium
DYLGALLGGLSWPFVLLPHLGMIRGAAATGIVN

SEQ ID NO: 353116 - protein, 33 aa, Mycobacterium
DYLGALLGGLVWPFLLLPQLGMIRGAAATGIVN

SEQ ID NO: 353117 - protein, 32 aa, Mycobacterium; identical to SEQ ID NO: 22038

SEQ ID NO: 353118 - protein, 25 aa, Mycobacterium
DYLKAHPLIGPWLNKLQAFDVFSSF

SEQ ID NO: 353119 - protein, 18 aa, Mycobacterium
DYLKRLTADLRRTRRRVA

SEQ ID NO: 353120 - protein, 22 aa, Mycobacterium
DYLPTLLVGLAIMGLGMGCTMM

SEQ ID NO: 353121 - protein, 18 aa, Mycobacterium
DYLQGAVWVLPTLGVILG

SEQ ID NO: 353122 - protein, 25 aa, Mycobacterium
DYLRYVLNRITWPGSIYLGVIAILP

SEQ ID NO: 353123 - protein, 22 aa, Mycobacterium
DYLRYVLSRITLPGSIYLGVIA

SEQ ID NO: 353124 - protein, 19 aa, Mycobacterium
DYLVFGKNWMDGWHGLLIS

SEQ ID NO: 353125 - protein, 33 aa, Mycobacterium; identical to SEQ ID NO: 23638

SEQ ID NO: 353126 - protein, 21 aa, Mycobacterium
DYPMVLAWHKAIGVLVLVLAV

SEQ ID NO: 353127 - protein, 25 aa, Mycobacterium
DYRALLATPQHRWTLVWSAMARLPY

SEQ ID NO: 353128 - protein, 19 aa, Mycobacterium
DYRLGWYVIIGTIPICILG

SEQ ID NO: 353129 - protein, 38 aa, Mycobacterium
DYRPNLFVTYWSFRLMIGFLVFPVAFALAVLWLTRAGR

SEQ ID NO: 353130 - protein, 26 aa, Mycobacterium
DYTKGMLPGVFPLPLTIAGHIERWPF

SEQ ID NO: 353131 - protein, 20 aa, Mycobacterium
DYVGILFVGLGASGLTLATS

SEQ ID NO: 353132 - protein, 19 aa, Mycobacterium
DYVHSLLVGWLVDKLARSP

SEQ ID NO: 353133 - protein, 24 aa, Mycobacterium
DYVILLYVALFWQTALITQTTAAL

SEQ ID NO: 353134 - protein, 51 aa, Mycobacterium
DYYERDIRFIIVVTLVIVMLVLMLLLRSLIAPLYLVGSVVVSYFAAIGIGV

SEQ ID NO: 353135 - protein, 21 aa, Mycobacterium
DYYMVGILDRPQNQNYPARAG

SEQ ID NO: 353136 - protein, 54 aa, Mycobacterium
DYYNHDIQFIVFATILIVFLILVILLRAIVAPLYLIGSVLVSFLSALGLGVIVF

SEQ ID NO: 353137 - protein, 35 aa, Mycobacterium
EAAAPRGRSWRWLRVLLAGLAKAAAVVIICGFAAL

SEQ ID NO: 353138 - protein, 28 aa, Mycobacterium
EAAAVPVWRKVLRLLADKMTLVLLVAAA

SEQ ID NO: 353139 - protein, 39 aa, Mycobacterium
EAAILISIALVLYYVTLTFIARPYLIPSESMEPTLHGCN

SEQ ID NO: 353140 - protein, 24 aa, Mycobacterium
EAAKTGTIALLSYSPESLDQDFAN

SEQ ID NO: 353141 - protein, 17 aa, Mycobacterium
EAALGVFQSLPKRVHER

SEQ ID NO: 353142 - protein, 19 aa, Mycobacterium
EAALKYFLLGAFSSAFFIY

SEQ ID NO: 353143 - protein, 25 aa, Mycobacterium
EAALKYFLLGAFSSAFFLYGVALLY

SEQ ID NO: 353144 - protein, 24 aa, Mycobacterium
EAAMFPFYTIFLVTYARSQNVDPA

SEQ ID NO: 353145 - protein, 18 aa, Mycobacterium
EAAPPRRRGFYGSFSSLG

SEQ ID NO: 353146 - protein, 27 aa, Mycobacterium
EAAQQGFYSPLFYRDLIGDPTGISLPM

SEQ ID NO: 353147 - protein, 28 aa, Mycobacterium
EAAQRGFYSPLFYRDLIGDPTGLSLPMF

SEQ ID NO: 353148 - protein, 28 aa, Mycobacterium
EAASAPIVFLTAFYGLSDLAGLRRGESV

SEQ ID NO: 353149 - protein, 26 aa, Mycobacterium
EAASTWWQSLPPIRLAHKASVGSWRL

SEQ ID NO: 353150 - protein, 28 aa, Mycobacterium
EAATRGFYSPLFYRDLIGDPTGLSLPMF

SEQ ID NO: 353151 - protein, 23 aa, Mycobacterium
EAAVTFWASAFLGAVVVPVVHFY

SEQ ID NO: 353152 - protein, 17 aa, Mycobacterium
EAAYFINLAFMALFVFA

SEQ ID NO: 353153 - protein, 22 aa, Mycobacterium
EADLRSQLHAFLRVIRGTPAGT

SEQ ID NO: 353154 - protein, 28 aa, Mycobacterium
EADNWFTSAFLFAGMLSVLAVVAAVAVW

SEQ ID NO: 353155 - protein, 17 aa, Mycobacterium
EAEAQRMNSLVSDLLLL

SEQ ID NO: 353156 - protein, 21 aa, Mycobacterium
EAELLALFAGSVLRGADLEAL

SEQ ID NO: 353157 - protein, 22 aa, Mycobacterium
EAELLALFAGSVLRGADLTALL

SEQ ID NO: 353158 - protein, 44 aa, Mycobacterium
EAESPTRKRLLRRPGWASVGVALVLVIAVLGTAALLAVSGYMRL

SEQ ID NO: 353159 - protein, 35 aa, Mycobacterium
EAFIRKLLTIVTTLLLVTTLLSVLAAPLLAGIMLG

SEQ ID NO: 353160 - protein, 19 aa, Mycobacterium
EAFLARWIVAVSNFGIFLV

SEQ ID NO: 353161 - protein, 28 aa, Mycobacterium
EAFLAYGWRIPFLLSAVLVVIGLVIRLR

SEQ ID NO: 353162 - protein, 25 aa, Mycobacterium
EAFRAQMMALYFFSLGLGTAMSGVL

SEQ ID NO: 353163 - protein, 27 aa, Mycobacterium
EAFTRLWPSVIFLISAPVSLVGLAVAM

SEQ ID NO: 353164 - protein, 29 aa, Mycobacterium
EAFVSWGWRVPFLLSVVLLAIGVYVRVSI

SEQ ID NO: 353165 - protein, 38 aa, Mycobacterium
EAFYLFSCRSLTHSAWRIGVLSNRWIILGVTAQGLAQL

SEQ ID NO: 353166 - protein, 42 aa, Mycobacterium
EAGAFIGIIALSLWVMKLTISTYWLLVFGQLAKAVTAAVITV

SEQ ID NO: 353167 - protein, 17 aa, Mycobacterium
EAGFTLSAPLRSLTKQS

SEQ ID NO: 353168 - protein, 24 aa, Mycobacterium
EAGFVIVAIPPAHRAAIEFNPPLP

SEQ ID NO: 353169 - protein, 24 aa, Mycobacterium
EAGKSVLIVEKYGFAGGAAVAGMS

SEQ ID NO: 353170 - protein, 28 aa, Mycobacterium
EAGRGWTMILLAIMMPALALTVFSDPAG

SEQ ID NO: 353171 - protein, 20 aa, Mycobacterium
EAGRQLRVLVIRALARAGIV

SEQ ID NO: 353172 - protein, 20 aa, Mycobacterium
EAGWHRAWLGGLLVGGFAAV

SEQ ID NO: 353173 - protein, 22 aa, Mycobacterium
EAGYRIPFVPLLVGGQATLWLT

SEQ ID NO: 353174 - protein, 24 aa, Mycobacterium
EAHDYMAPLWTWAVVASLVVGVIV

SEQ ID NO: 353175 - protein, 31 aa, Mycobacterium
EAHPDKTARWFGGIGLILGAVALVLAVTNKR

SEQ ID NO: 353176 - protein, 17 aa, Mycobacterium
EAHWPDEAAAAEPVLLW

SEQ ID NO: 353177 - protein, 23 aa, Mycobacterium
EAIAAILGILKTGAAYLPIDPAV

SEQ ID NO: 353178 - protein, 26 aa, Mycobacterium
EAIITLLALYPEIIVVALIAAGILVP

SEQ ID NO: 353179 - protein, 25 aa, Mycobacterium
EAIKRLIHPPQVTGALVLVTALVGV

SEQ ID NO: 353180 - protein, 23 aa, Mycobacterium
EAILLLMIVNVAISQLYIMLSPR

SEQ ID NO: 353181 - protein, 23 aa, Mycobacterium
EAILSILSVLKTGAAYLPVDPAH

SEQ ID NO: 353182 - protein, 18 aa, Mycobacterium
EAIRALLGLQARTARVLR

SEQ ID NO: 353183 - protein, 24 aa, Mycobacterium
EAIRRLIHPPQVTGTLVLITALVG

SEQ ID NO: 353184 - protein, 23 aa, Mycobacterium
EAIRRLIHPVAIEHLGWVAAAGL

SEQ ID NO: 353185 - protein, 19 aa, Mycobacterium
EALAVPIWWSYAAALVLMT

SEQ ID NO: 353186 - protein, 25 aa, Mycobacterium
EALAVPIWWVYATSLLLITAGLLFG

SEQ ID NO: 353187 - protein, 22 aa, Mycobacterium
EALELAAWVAVAPLVCWTCGVF

SEQ ID NO: 353188 - protein, 26 aa, Mycobacterium
EALESEAWSWLKWLPHVDVPGRIDGV

SEQ ID NO: 353189 - protein, 32 aa, Mycobacterium
EALGLGLTPSPAPWVVLRLLPQGPTLSRADAL

SEQ ID NO: 353190 - protein, 19 aa, Mycobacterium
EALILRCGLDRPAEFVTGA

SEQ ID NO: 353191 - protein, 23 aa, Mycobacterium
EALIQLLADRAFQWSLNAGVIIQ

SEQ ID NO: 353192 - protein, 22 aa, Mycobacterium
EALIQLLGRINARLAVYTGLIE

SEQ ID NO: 353193 - protein, 17 aa, Mycobacterium
EALLESTEFAQPALFAV

SEQ ID NO: 353194 - protein, 18 aa, Mycobacterium
EALLLTHPGIADAAVIGV

SEQ ID NO: 353195 - protein, 23 aa, Mycobacterium
EALLQLLADRAFQWSLDSEEIIE

SEQ ID NO: 353196 - protein, 28 aa, Mycobacterium
EALVFIGLALLIWLPAIRCPSALTVTAG

SEQ ID NO: 353197 - protein, 28 aa, Mycobacterium
EALVFPILFMLVLKIVLGNLIYAVTHHD

SEQ ID NO: 353198 - protein, 30 aa, Mycobacterium
EALVVIAAILFQFTLPLTPAQVLWINLVTS

SEQ ID NO: 353199 - protein, 23 aa, Mycobacterium
EAMIQLLADRAFQWSLNAGVVIQ

SEQ ID NO: 353200 - protein, 22 aa, Mycobacterium
EAMRQLLLDLLTDNPDLADMDE

SEQ ID NO: 353201 - protein, 54 aa, Mycobacterium
EAPARRRRRLRLTRSAVAAALAVIVILAGLSGSLFMLVKHRDATRHRDRVAEFA

SEQ ID NO: 353202 - protein, 24 aa, Mycobacterium
EAPDKPAWWVRHYTFFGTATGLVF

SEQ ID NO: 353203 - protein, 22 aa, Mycobacterium
EAPFDWYLGVLARLASVSTAGV

SEQ ID NO: 353204 - protein, 27 aa, Mycobacterium
EAPHRAMVWLGWLTAATALGWVIDTAT

SEQ ID NO: 353205 - protein, 21 aa, Mycobacterium
EAPKITLLALAALPPAAVATT

SEQ ID NO: 353206 - protein, 34 aa, Mycobacterium
EAPLHQSMFIADAVWIIVVFVATVALLNTLTLSV

SEQ ID NO: 353207 - protein, 17 aa, Mycobacterium
EAPPIRAPWIRGAGERA

SEQ ID NO: 353208 - protein, 25 aa, Mycobacterium
EAPSRRGWWIRRYTFTGTAVGLVFL

SEQ ID NO: 353209 - protein, 20 aa, Mycobacterium
EAPVLDFYRYITRYTRTTKA

SEQ ID NO: 353210 - protein, 32 aa, Mycobacterium
EAPVPAPVPIPVPIQIPLPQIFGPGGGGGFPG

SEQ ID NO: 353211 - protein, 21 aa, Mycobacterium
EAPVVPYGPVSYVPSAAIVVR

SEQ ID NO: 353212 - protein, 27 aa, Mycobacterium
EAPYWVCATYLVLLALVGIAAAVFMDN

SEQ ID NO: 353213 - protein, 22 aa, Mycobacterium
EAPYWVCAVYLVLIAIAGLGAA

SEQ ID NO: 353214 - protein, 26 aa, Mycobacterium
EAQRMNSLVSDLLLLARLDEGQELDT

SEQ ID NO: 353215 - protein, 17 aa, Mycobacterium
EARLEIVDFRRTLLGAV

SEQ ID NO: 353216 - protein, 41 aa, Mycobacterium
EARPVPARLRGWGPLAAAFVVSVLLGVGIGWGLYGNTRSPL

SEQ ID NO: 353217 - protein, 21 aa, Mycobacterium
EARRMASLVDELLLLSRLGEG

SEQ ID NO: 353218 - protein, 26 aa, Mycobacterium
EARSGDRWLWWNLGDVVRRASNVTVG

SEQ ID NO: 353219 - protein, 24 aa, Mycobacterium
EASALMFGALLTIAATSAAGVLAS

SEQ ID NO: 353220 - protein, 24 aa, Mycobacterium
EASFGYLDWLKWFGYTVVANVAGG

SEQ ID NO: 353221 - protein, 22 aa, Mycobacterium
EASLYIYLTHYQVYPLFGSHEL

SEQ ID NO: 353222 - protein, 18 aa, Mycobacterium
EASSLFRVSRLNCSITTS

SEQ ID NO: 353223 - protein, 17 aa, Mycobacterium
EASWWPQRKPLTHNGRP

SEQ ID NO: 353224 - protein, 26 aa, Mycobacterium
EATLSVTFVLFLTLACLLTAIGVVTD

SEQ ID NO: 353225 - protein, 25 aa, Mycobacterium
EAVKRVWNTANLLRKEGFGAAVRSS

SEQ ID NO: 353226 - protein, 32 aa, Mycobacterium
EAVLTLTAFLVSLLALGWRPAAPFPTGNELAA

SEQ ID NO: 353227 - protein, 26 aa, Mycobacterium
EAVMNKLRWVLLIVGGVGVAVAAVAG

SEQ ID NO: 353228 - protein, 23 aa, Mycobacterium
EAVMRLIHPMQIGQLGWVAAAGV

SEQ ID NO: 353229 - protein, 26 aa, Mycobacterium
EAVMTKLRWVLLIVGGVGVAVAAVAG

SEQ ID NO: 353230 - protein, 25 aa, Mycobacterium
EAVRATVGSLLLYVPVVHPEDFDVA

SEQ ID NO: 353231 - protein, 28 aa, Mycobacterium
EAVRAYPRTASVVIWYAPERCDTAAVLS

SEQ ID NO: 353232 - protein, 38 aa, Mycobacterium
EAVTALVAMSIWALLYSALPGLSGLFAAGATGVRIGYR

SEQ ID NO: 353233 - protein, 19 aa, Mycobacterium
EAYGFLFVENFSIPVIGHW

SEQ ID NO: 353234 - protein, 23 aa, Mycobacterium
EAYPSVWGLLSGAGESLLVYLGL

SEQ ID NO: 353235 - protein, 20 aa, Mycobacterium
EAYREWVLARMIDKGIMPRE

SEQ ID NO: 353236 - protein, 19 aa, Mycobacterium
ECCVAAYVPYLAWVMQESA

SEQ ID NO: 353237 - protein, 18 aa, Mycobacterium
ECLMWPDATPESAKIVNC

SEQ ID NO: 353238 - protein, 24 aa, Mycobacterium
ECRFTFAFPVTEGEDLYIVSVGRR

SEQ ID NO: 353239 - protein, 24 aa, Mycobacterium
ECVALLWFLGVYLVVLAFVPALTR

SEQ ID NO: 353240 - protein, 27 aa, Mycobacterium
ECVVDQRLLVPIPAGWSFAEAASAPIV

SEQ ID NO: 353241 - protein, 24 aa, Mycobacterium
EDALQQTALWQQLLNDGIADLTGD

SEQ ID NO: 353242 - protein, 31 aa, Mycobacterium
EDAPERLWHVVKLRRAALSGALLTGSVITAW

SEQ ID NO: 353243 - protein, 22 aa, Mycobacterium
EDAPVLLVRHNGGLYAIHNRCS

SEQ ID NO: 353244 - protein, 27 aa, Mycobacterium
EDAVAEPTSWLRFWFPDPAGSKTEFQR

SEQ ID NO: 353245 - protein, 24 aa, Mycobacterium
EDAYRVPAWWDPAKAERGRVRLNQ

SEQ ID NO: 353246 - protein, 30 aa, Mycobacterium
EDDVKASFDPLPPFLLQHMSGHYTNINIET

SEQ ID NO: 353247 - protein, 22 aa, Mycobacterium
EDDVLALWNSPRQRESYDWLAR

SEQ ID NO: 353248 - protein, 36 aa, Mycobacterium
EDDYDDYPPLPWYRRPLVWFIAAAAVAGIAFTGMMV

SEQ ID NO: 353249 - protein, 26 aa, Mycobacterium
EDEGSPLVRGLWVVAQCVIAVAFGAG

SEQ ID NO: 353250 - protein, 28 aa, Mycobacterium
EDEPSTPRWPWVVGVAAIMAAIALVASV

SEQ ID NO: 353251 - protein, 17 aa, Mycobacterium
EDFADIPPTRFKRKEHW

SEQ ID NO: 353252 - protein, 26 aa, Mycobacterium
EDFEDFWRPIRNYFYWDKHCFDIPIC

SEQ ID NO: 353253 - protein, 29 aa, Mycobacterium
EDGEATFRFPLVVAPRYIPGEPLADIAVG

SEQ ID NO: 353254 - protein, 27 aa, Mycobacterium
EDGLPRPWNPLPCMGLGAGPFGGPSTI

SEQ ID NO: 353255 - protein, 21 aa, Mycobacterium
EDGRVLLLRGFDPAAPTPAVH

SEQ ID NO: 353256 - protein, 25 aa, Mycobacterium
EDGTVRLWLNYPDAASALCAKLSTN

SEQ ID NO: 353257 - protein, 18 aa, Mycobacterium
EDIAAVAELLISELVLRK

SEQ ID NO: 353258 - protein, 26 aa, Mycobacterium
EDIASIAVFIPVALLANILVGQARLR

SEQ ID NO: 353259 - protein, 18 aa, Mycobacterium
EDIGLAIFRLIQGVGAAV

SEQ ID NO: 353260 - protein, 28 aa, Mycobacterium
EDITRFQAEFLWRDYYAPGGTIDGDEAP

SEQ ID NO: 353261 - protein, 23 aa, Mycobacterium
EDKVHRLPLRYFDSRQRGEVLSR

SEQ ID NO: 353262 - protein, 22 aa, Mycobacterium
EDLFMIGFALLTFGLVARSVYT

SEQ ID NO: 353263 - protein, 52 aa, Mycobacterium
EDLKRYFAEGLHYWPWVLLGYFTVAIMVVSLIGWWALSRLLERMRGIPDVHK

SEQ ID NO: 353264 - protein, 19 aa, Mycobacterium
EDPAGWLRHIILPALTVAV

SEQ ID NO: 353265 - protein, 26 aa, Mycobacterium
EDPEDPDWSWLKWLPHVQHQTETDGA

SEQ ID NO: 353266 - protein, 33 aa, Mycobacterium
EDRPAEVAWYRRPLVMILGAAAAVLALSAIIML

SEQ ID NO: 353267 - protein, 22 aa, Mycobacterium
EDRRTWAIWGNRTEILDGLAET

SEQ ID NO: 353268 - protein, 25 aa, Mycobacterium
EDRSKFWIGMIAVGVVAAIIASMLL

SEQ ID NO: 353269 - protein, 18 aa, Mycobacterium
EDRYAMWDAAYVLGSLSA

SEQ ID NO: 353270 - protein, 17 aa, Mycobacterium
EDSDLEWVAIRSALIIG

SEQ ID NO: 353271 - protein, 25 aa, Mycobacterium
EDSPAFLSWGWRVPFIASGLLVAVG

SEQ ID NO: 353272 - protein, 22 aa, Mycobacterium
EDTGALLGLAFALFGVGMTIVT

SEQ ID NO: 353273 - protein, 24 aa, Mycobacterium
EDVPNLFWCVGYTNASWTLRADMT

SEQ ID NO: 353274 - protein, 17 aa, Mycobacterium
EDWAATDAAYLRRFYPA

SEQ ID NO: 353275 - protein, 27 aa, Mycobacterium
EEAAAWWQQPPPLRALHDASVKSWGAV

SEQ ID NO: 353276 - protein, 29 aa, Mycobacterium
EEAARRGFYSPLFYRDLIGDPTGLSLPMF

SEQ ID NO: 353277 - protein, 34 aa, Mycobacterium
EEAGYTTVIAPPPPRMLLVGSALTFVAVSFATLA

SEQ ID NO: 353278 - protein, 24 aa, Mycobacterium
EEALRRNGIPKARLAAVATAGGGA

SEQ ID NO: 353279 - protein, 36 aa, Mycobacterium
EEDDAFLTWSLCSGFWILMFPFMGELDFYHVDRWPQ

SEQ ID NO: 353280 - protein, 22 aa, Mycobacterium
EEDLPPRPQPLDLDLYIDSSGS

SEQ ID NO: 353281 - protein, 40 aa, Mycobacterium
EEFPPERFRMLMTLMVESPFLLIRAALPHMYRQRFGRIVN

SEQ ID NO: 353282 - protein, 27 aa, Mycobacterium
EEGLPQIRELLTLLPTRLRDMENLLNE

SEQ ID NO: 353283 - protein, 17 aa, Mycobacterium
EEHKKWRRLLDPLFAPK

SEQ ID NO: 353284 - protein, 18 aa, Mycobacterium
EELIFRGYFFANVAERWS

SEQ ID NO: 353285 - protein, 18 aa, Mycobacterium
EELLIELLNLILAEYINV

SEQ ID NO: 353286 - protein, 24 aa, Mycobacterium
EELPVLLAVFGVPAAVAGIGWWGA

SEQ ID NO: 353287 - protein, 40 aa, Mycobacterium
EEMYDAGPAPLPWYKRPPILFGAAAVAALLAAGGLAVTLT

SEQ ID NO: 353288 - protein, 23 aa, Mycobacterium
EENLLDFAPIMLVAFGIGALNTS

SEQ ID NO: 353289 - protein, 42 aa, Mycobacterium
EENPKRIRGRHWALTAAAIVAIAIVALAAIIGRLYEEQRIEE

SEQ ID NO: 353290 - protein, 30 aa, Mycobacterium
EEPAEFAPPPRWPWVVGVVAIVAAVALVVS

SEQ ID NO: 353291 - protein, 28 aa, Mycobacterium
EEPKRSRRPIYLGRSIAAVVAVCSLTVT

SEQ ID NO: 353292 - protein, 36 aa, Mycobacterium
EEPLLVPHPVPPGRPWGLPLASAIGAVFMTAAITAC

SEQ ID NO: 353293 - protein, 24 aa, Mycobacterium
EEPWTPIVLIVVITIVKIAASLAS

SEQ ID NO: 353294 - protein, 22 aa, Mycobacterium
EEQFYLVWPAVIIGTAWATRRR

SEQ ID NO: 353295 - protein, 25 aa, Mycobacterium
EERAPLAPVRLALAVGLVTVAALTG

SEQ ID NO: 353296 - protein, 26 aa, Mycobacterium
EERKPFLLVGSALTSLFVVGVVALVI

SEQ ID NO: 353297 - protein, 25 aa, Mycobacterium
EERKPFLLVGSALTSVFVIGVVALV

SEQ ID NO: 353298 - protein, 25 aa, Mycobacterium
EESQNFFIAPFLMLGLSGVVAVVAA

SEQ ID NO: 353299 - protein, 26 aa, Mycobacterium
EESTLNLTFLAFLCLACLIAAVGVVT

SEQ ID NO: 353300 - protein, 28 aa, Mycobacterium
EETGFPLFTPRFDGAFTAGLYSVAPTKQ

SEQ ID NO: 353301 - protein, 25 aa, Mycobacterium
EEVEILSFVLLLFGAAIETTTAGIG

SEQ ID NO: 353302 - protein, 20 aa, Mycobacterium
EEVLFFLVIPLCALLTYNAV

SEQ ID NO: 353303 - protein, 20 aa, Mycobacterium
EEVLFFVVIPICALLTYNAV

SEQ ID NO: 353304 - protein, 29 aa, Mycobacterium
EEVLTTFVNELWMWIQEALLVAAEILETF

SEQ ID NO: 353305 - protein, 17 aa, Mycobacterium
EEWKKFVRLFVGLSFAA

SEQ ID NO: 353306 - protein, 20 aa, Mycobacterium
EFAALPDLVGALAALPSLGV

SEQ ID NO: 353307 - protein, 39 aa, Mycobacterium
EFALLAVIAVALYYVMLTFVARPYLIPSESMEPTLHGCS

SEQ ID NO: 353308 - protein, 18 aa, Mycobacterium
EFARRLPFMAAKRDFSEP

SEQ ID NO: 353309 - protein, 25 aa, Mycobacterium
EFARYLRKPEQLAELAKAGFRAEDA

SEQ ID NO: 353310 - protein, 39 aa, Mycobacterium
EFEVSPLRRILGLQTFWILGVLVLICLFFSVLAGDRFLS

SEQ ID NO: 353311 - protein, 25 aa, Mycobacterium
EFFMYYFVFTGIHLLHVLIGLLGLG

SEQ ID NO: 353312 - protein, 25 aa, Mycobacterium
EFHLTEYFGPVLGLMEARDLDEAIA

SEQ ID NO: 353313 - protein, 33 aa, Mycobacterium; identical to SEQ ID NO: 20490

SEQ ID NO: 353314 - protein, 21 aa, Mycobacterium
EFIEAIGLWLMKRWGEYFAVI

SEQ ID NO: 353315 - protein, 35 aa, Mycobacterium
EFINSYLFNFPDTSFAWSFVLALLAAALAARKRIA

SEQ ID NO: 353316 - protein, 35 aa, Mycobacterium
EFINSYLFNFPDTSFAWSFVLALLAAALTARKRIA

SEQ ID NO: 353317 - protein, 37 aa, Mycobacterium
EFLDQTWFIARVSLLPTLLVAIPFTVLVAFTLNILLR

SEQ ID NO: 353318 - protein, 18 aa, Mycobacterium
EFLRTLTLGMIATHSPDA

SEQ ID NO: 353319 - protein, 18 aa, Mycobacterium
EFLRTLVLGLITTHSPDA

SEQ ID NO: 353320 - protein, 17 aa, Mycobacterium
EFLTAFFALCAVVYAVL

SEQ ID NO: 353321 - protein, 26 aa, Mycobacterium
EFLWGRLPLYIVAIYPMMATVAFEIV

SEQ ID NO: 353322 - protein, 19 aa, Mycobacterium
EFPGRDALFWVYIATLMVP

SEQ ID NO: 353323 - protein, 25 aa, Mycobacterium
EFRSLAQLEAKPLKFGHKVVTGMRG

SEQ ID NO: 353324 - protein, 20 aa, Mycobacterium
EFRTYRFRAHSMFDPELYRD

SEQ ID NO: 353325 - protein, 17 aa, Mycobacterium
EFRVDEVLLVWDRGIRG

SEQ ID NO: 353326 - protein, 33 aa, Mycobacterium
EFSAIGWILTIIGYIALFFVVAYMHAGLLTGCL

SEQ ID NO: 353327 - protein, 18 aa, Mycobacterium
EFSWAGTVLDPLPRWLRA

SEQ ID NO: 353328 - protein, 24 aa, Mycobacterium
EFTEPELVFIQQALDLCPVAAIVN

SEQ ID NO: 353329 - protein, 19 aa, Mycobacterium
EFTPVHFFAQPVVTLIGLG

SEQ ID NO: 353330 - protein, 18 aa, Mycobacterium
EFTTTYLSGVLVGLAGLV

SEQ ID NO: 353331 - protein, 19 aa, Mycobacterium
EFVLGWHVYTGWAAGLFAA

SEQ ID NO: 353332 - protein, 18 aa, Mycobacterium
EFVVAVRQLTIGQDSPIE

SEQ ID NO: 353333 - protein, 24 aa, Mycobacterium
EFWAALIKVVALVAFLIFGIVFLA

SEQ ID NO: 353334 - protein, 22 aa, Mycobacterium
EFWASLIKVLALVTFLVVGTVF

SEQ ID NO: 353335 - protein, 18 aa, Mycobacterium
EFYDFLIYGTAAALVFPT

SEQ ID NO: 353336 - protein, 28 aa, Mycobacterium
EGAAFGFFPILWIVINAIWVYQMTVETG

SEQ ID NO: 353337 - protein, 23 aa, Mycobacterium
EGADQLLLRWRQANDRISSYISV

SEQ ID NO: 353338 - protein, 23 aa, Mycobacterium
EGADQLLLRWRQANDRITSYISV

SEQ ID NO: 353339 - protein, 24 aa, Mycobacterium
EGAFTLPLLAIWYGYPTLSFRDIC

SEQ ID NO: 353340 - protein, 25 aa, Mycobacterium
EGAHGLLVVTPYYSKPPQSGLLAHF

SEQ ID NO: 353341 - protein, 24 aa, Mycobacterium
EGALLAALIRRPSTLDPAVDPDGA

SEQ ID NO: 353342 - protein, 24 aa, Mycobacterium
EGALLAALIRRPSTLDPAVDPEGA

SEQ ID NO: 353343 - protein, 26 aa, Mycobacterium
EGALLIGVFFWFTVVGSLTVAMAGGI

SEQ ID NO: 353344 - protein, 25 aa, Mycobacterium
EGALLVGVFFWFAVVGGATLVMAGG

SEQ ID NO: 353345 - protein, 22 aa, Mycobacterium
EGAVLPWTLHFTTNLAAVMGNL

SEQ ID NO: 353346 - protein, 19 aa, Mycobacterium
EGCRFRVTLPRVSEVPAQE

SEQ ID NO: 353347 - protein, 30 aa, Mycobacterium
EGDIFRRVVLWSLGFLVLLCALTALQSSPV

SEQ ID NO: 353348 - protein, 29 aa, Mycobacterium
EGDYNWTGWPAELRWRPVTAIVGAVVAVG

SEQ ID NO: 353349 - protein, 23 aa, Mycobacterium
EGEQAFVWIGLHEPNHHQMQDVA

SEQ ID NO: 353350 - protein, 17 aa, Mycobacterium
EGEQLWRRVHSAVSVLL

SEQ ID NO: 353351 - protein, 31 aa, Mycobacterium
EGFRYMVRTTWFFATLLFAIGYVLVVVGPIE

SEQ ID NO: 353352 - protein, 21 aa, Mycobacterium
EGGDAVWLAERGWRVTAVDIS

SEQ ID NO: 353353 - protein, 49 aa, Mycobacterium
EGGKQNNFLIPNGTFFVVLAIFLIVLAVIGTFVVPPIQKVLKAREDMVT

SEQ ID NO: 353354 - protein, 25 aa, Mycobacterium
EGGNPLALLLVSFLGPIAATVVKLA

SEQ ID NO: 353355 - protein, 27 aa, Mycobacterium
EGGTGLLDLLNRLGITPLPNTAGCRSA

SEQ ID NO: 353356 - protein, 38 aa, Mycobacterium
EGGTNNFLVPNGTFFFVLAIFLVVLAVIGTFVVPPILK

SEQ ID NO: 353357 - protein, 23 aa, Mycobacterium
EGHDIAWTVLLDGDLRIGVGCQF

SEQ ID NO: 353358 - protein, 26 aa, Mycobacterium
EGHILAAILMGFWIGAITAGAILGNN

SEQ ID NO: 353359 - protein, 20 aa, Mycobacterium
EGIVGLLDFGGSGTSATLVN

SEQ ID NO: 353360 - protein, 20 aa, Mycobacterium
EGIVSALHRPVPLSGEGSDT

SEQ ID NO: 353361 - protein, 22 aa, Mycobacterium
EGKPLDTILEIVQRQGFATGNV

SEQ ID NO: 353362 - protein, 30 aa, Mycobacterium
EGLAALIFTRYLWAFELTSALLITAALGAM

SEQ ID NO: 353363 - protein, 29 aa, Mycobacterium
EGLGHVVPLPIMLWLKGIDGPIEEFNQSV

SEQ ID NO: 353364 - protein, 20 aa, Mycobacterium
EGLLSLLMPVIILGGILSGI

SEQ ID NO: 353365 - protein, 21 aa, Mycobacterium
EGLLTWLGGGHWRELGERHER

SEQ ID NO: 353366 - protein, 17 aa, Mycobacterium
EGLPIVATLALARGMLR

SEQ ID NO: 353367 - protein, 18 aa, Mycobacterium
EGLRLADEQLWPVAPLDT

SEQ ID NO: 353368 - protein, 18 aa, Mycobacterium
EGLSAQHWGLRPAGIAFA

SEQ ID NO: 353369 - protein, 24 aa, Mycobacterium
EGLTFGLLRYLNPGANLATSDPTV

SEQ ID NO: 353370 - protein, 27 aa, Mycobacterium
EGMFNALPAMGAWQLPPIPGAGTPNTL

SEQ ID NO: 353371 - protein, 24 aa, Mycobacterium
EGNPAALLLVSLLGPIAATVVRLA

SEQ ID NO: 353372 - protein, 24 aa, Mycobacterium
EGNRLPIWRIGITGGLVGILCCVG

SEQ ID NO: 353373 - protein, 22 aa, Mycobacterium
EGPAWHYALRRQPGKRLPRITL

SEQ ID NO: 353374 - protein, 17 aa, Mycobacterium
EGPLSYLGLAVAGFPNL

SEQ ID NO: 353375 - protein, 45 aa, Mycobacterium
EGPNRLPAPRRMPAWRRLLAEMVHFFALLFWVAGGLAFIAGMPQL

SEQ ID NO: 353376 - protein, 26 aa, Mycobacterium
EGPSWLLWSVILLTSGLVLGCSIVFG

SEQ ID NO: 353377 - protein, 17 aa, Mycobacterium
EGPVPWPEALHIGVKLC

SEQ ID NO: 353378 - protein, 20 aa, Mycobacterium
EGQLLSFNFAVVVCGAVLGI

SEQ ID NO: 353379 - protein, 25 aa, Mycobacterium
EGQPRILLKGFGIAAPHGAPGDATG

SEQ ID NO: 353380 - protein, 24 aa, Mycobacterium
EGQRLQGLLLQPRFAMIDDVIGGY

SEQ ID NO: 353381 - protein, 24 aa, Mycobacterium
EGRAAHWLILLFADRVDVAEHRVI

SEQ ID NO: 353382 - protein, 22 aa, Mycobacterium
EGRAPVVRRSILNLYRDRAPEV

SEQ ID NO: 353383 - protein, 22 aa, Mycobacterium
EGRHYIVLERLPGQNLADLLAR

SEQ ID NO: 353384 - protein, 23 aa, Mycobacterium
EGRLDALWRSAVVVLQSILAVAF

SEQ ID NO: 353385 - protein, 22 aa, Mycobacterium
EGRPPRVVPVIGLLGCVVLAFA

SEQ ID NO: 353386 - protein, 28 aa, Mycobacterium
EGRSLTAALWVLALWVVFQAGAAAPTAV

SEQ ID NO: 353387 - protein, 21 aa, Mycobacterium
EGRVALLRKVLDSASTKVHPI

SEQ ID NO: 353388 - protein, 31 aa, Mycobacterium
EGSRTKLFASLLLILVLVVIGEVAGVVLGRA

SEQ ID NO: 353389 - protein, 22 aa, Mycobacterium
EGSTFTCYLPVESPTEPDAPAP

SEQ ID NO: 353390 - protein, 27 aa, Mycobacterium
EGTDLDNLLKRFGPLTPPRAVAIITQV

SEQ ID NO: 353391 - protein, 26 aa, Mycobacterium
EGTDLDSILKRFGPLTPPRAVAIITQ

SEQ ID NO: 353392 - protein, 26 aa, Mycobacterium
EGTHLALLLERFGPVTPPWAVALVHQ

SEQ ID NO: 353393 - protein, 27 aa, Mycobacterium
EGTNLDSLLKRFGPLTPPRAVAIITQI

SEQ ID NO: 353394 - protein, 18 aa, Mycobacterium
EGTPLPPGAVPRGDAAGP

SEQ ID NO: 353395 - protein, 21 aa, Mycobacterium
EGTRFRFTLPVTADDTADKSL

SEQ ID NO: 353396 - protein, 23 aa, Mycobacterium
EGVLALQFPISVVNQLMTMDGKW

SEQ ID NO: 353397 - protein, 21 aa, Mycobacterium
EGVLLGSVRPRPLPPGRGTLL

SEQ ID NO: 353398 - protein, 32 aa, Mycobacterium
EGVPPPPLNAPLPPDAPPPPPAPPAPRVVEPR

SEQ ID NO: 353399 - protein, 23 aa, Mycobacterium
EHALPLFGSIRLPRELTPIDPAL

SEQ ID NO: 353400 - protein, 27 aa, Mycobacterium
EHATHMLMIGYFLLSGALFFTAVGGVE

SEQ ID NO: 353401 - protein, 24 aa, Mycobacterium
EHDGQLWIAMDYVDGTDAARLLKE

SEQ ID NO: 353402 - protein, 46 aa, Mycobacterium
EHDRALLIPAILAVILVVLYALLRSALAPLILLAATILGALAALGL

SEQ ID NO: 353403 - protein, 39 aa, Mycobacterium
EHFPPLFFAGLRFAVLALPVILFVPWPRVPVRWLLLYGL

SEQ ID NO: 353404 - protein, 46 aa, Mycobacterium
EHGGRQWGRYLRRGALPVLLVASLAVSGFLGWRQWQDHQVKLAGEQ

SEQ ID NO: 353405 - protein, 21 aa, Mycobacterium
EHGHWIALTVLVVLRPETAHT

SEQ ID NO: 353406 - protein, 24 aa, Mycobacterium
EHGPTFHLGVLPLDDGGAAVTLVA

SEQ ID NO: 353407 - protein, 17 aa, Mycobacterium
EHKLHRLPLSYFDGRQR

SEQ ID NO: 353408 - protein, 20 aa, Mycobacterium
EHLDCNLMKLDDLRPPERAQ

SEQ ID NO: 353409 - protein, 28 aa, Mycobacterium
EHLQLRQSYPNVRLLWSGDWSTFSGPDF

SEQ ID NO: 353410 - protein, 20 aa, Mycobacterium
EHLVLPYFTAFGWAVLVAES

SEQ ID NO: 353411 - protein, 26 aa, Mycobacterium
EHMDQIFVTAPPYPPSILLTGVIVNK

SEQ ID NO: 353412 - protein, 23 aa, Mycobacterium
EHNRTHFVVQPPGPAASSKVGIG

SEQ ID NO: 353413 - protein, 27 aa, Mycobacterium
EHPEPGDWLYFVTIDMQGTTLFTRDYD

SEQ ID NO: 353414 - protein, 17 aa, Mycobacterium
EHPLWSSFVWRNEVADT

SEQ ID NO: 353415 - protein, 24 aa, Mycobacterium
EHPYLVWMAPICIIAVLLAGLVAY

SEQ ID NO: 353416 - protein, 18 aa, Mycobacterium
EHRCTIAFIAPPVAVALA

SEQ ID NO: 353417 - protein, 27 aa, Mycobacterium
EHRHPLVAWAWNLLRLDFCGIAFGALF

SEQ ID NO: 353418 - protein, 36 aa, Mycobacterium
EHTGIARWIRRLAIPIILGWIALLGVLGATVPSLEE

SEQ ID NO: 353419 - protein, 30 aa, Mycobacterium
EHYFRTFLRPDDVFWSFLEAIIIAAIVMVT

SEQ ID NO: 353420 - protein, 30 aa, Mycobacterium
EHYFRTFLRPDDVFWSFLEAILITAVVMIT

SEQ ID NO: 353421 - protein, 20 aa, Mycobacterium
EIAIAVPAYWKPGTVQALRN

SEQ ID NO: 353422 - protein, 25 aa, Mycobacterium
EIALYSFIVLLITGVYLTLFFDPSM

SEQ ID NO: 353423 - protein, 31 aa, Mycobacterium
EIAVLGWPLWTAYVVVFLLTLVIGARLVVSV

SEQ ID NO: 353424 - protein, 25 aa, Mycobacterium
EIAVYSFVVLLLSGIYLALFFDPSM

SEQ ID NO: 353425 - protein, 26 aa, Mycobacterium
EIDDQFFVEMRLIDGVSLRAMLTQFG

SEQ ID NO: 353426 - protein, 25 aa, Mycobacterium
EIDGQFYVEMRLIDGVSLRTLLTQY

SEQ ID NO: 353427 - protein, 23 aa, Mycobacterium
EIDGQLFIDMRFIEGTDLGSVLK

SEQ ID NO: 353428 - protein, 17 aa, Mycobacterium
EIDGRHYLVMPAVPDGS

SEQ ID NO: 353429 - protein, 23 aa, Mycobacterium
EIDGRLYLDMRLIEGRNLGTMLQ

SEQ ID NO: 353430 - protein, 31 aa, Mycobacterium
EIDRLGWGLWLLYVTVFAITILIGVRLMVSV

SEQ ID NO: 353431 - protein, 24 aa, Mycobacterium
EIDTDLLFAQTFIDQARLMETIRD

SEQ ID NO: 353432 - protein, 21 aa, Mycobacterium
EIDVPALLMRRPKVVLVDDLA

SEQ ID NO: 353433 - protein, 29 aa, Mycobacterium
EIEEQLFRFSRILDAQPRLAILLGDYAVP

SEQ ID NO: 353434 - protein, 25 aa, Mycobacterium
EIELPPGYLPIRVPIEVNFTQRVAI

SEQ ID NO: 353435 - protein, 20 aa, Mycobacterium
EIFLLTRIRERFLQTNSTRD

SEQ ID NO: 353436 - protein, 33 aa, Mycobacterium
EIFRSRWARWVAWSLPVVGLVVLFLAARIATGS

SEQ ID NO: 353437 - protein, 26 aa, Mycobacterium
EIGGVWLFMLVLGVCFFLASSGASAA

SEQ ID NO: 353438 - protein, 18 aa, Mycobacterium
EIGPFPPAEFPGGIRIPS

SEQ ID NO: 353439 - protein, 31 aa, Mycobacterium
EIHFGLGLALLAWFGFYLYKLSHGEVEEPDL

SEQ ID NO: 353440 - protein, 40 aa, Mycobacterium
EIIGVPFFTLFVISVIILSPLWLFAFVLAELLGYSAFAAN

SEQ ID NO: 353441 - protein, 19 aa, Mycobacterium
EIIPPRYIEYRGGRFPELD

SEQ ID NO: 353442 - protein, 17 aa, Mycobacterium
EILDLSGGPLRYAGWSS

SEQ ID NO: 353443 - protein, 18 aa, Mycobacterium
EILSTVFLVGYLTARISL

SEQ ID NO: 353444 - protein, 25 aa, Mycobacterium
EIMAWGWRVPFLASSALLLVGLYVR

SEQ ID NO: 353445 - protein, 21 aa, Mycobacterium
EINGRLFVDMRLIEGRDLQSV

SEQ ID NO: 353446 - protein, 23 aa, Mycobacterium
EINRAVILIAVTVLLVGAVEVAV

SEQ ID NO: 353447 - protein, 18 aa, Mycobacterium
EIPFADLLERFGTRLQKS

SEQ ID NO: 353448 - protein, 19 aa, Mycobacterium
EIPIIRPDDPPPAPVTAPE

SEQ ID NO: 353449 - protein, 23 aa, Mycobacterium
EIPSQFLLSAYAPQPRTLIDILA

SEQ ID NO: 353450 - protein, 28 aa, Mycobacterium
EIQGDGPYILVGWSLGGALAYACAIGLK

SEQ ID NO: 353451 - protein, 18 aa, Mycobacterium
EIQKLSGLSINRFIAIDF

SEQ ID NO: 353452 - protein, 33 aa, Mycobacterium
EIRGIPYVLPLILLLLIGMTVLLRRTAYGRHIY

SEQ ID NO: 353453 - protein, 22 aa, Mycobacterium
EIRHQRRWNLDLGFRAGGPDEG

SEQ ID NO: 353454 - protein, 25 aa, Mycobacterium
EIRVRIGIHMGRSVRRGDDLFGRNV

SEQ ID NO: 353455 - protein, 34 aa, Mycobacterium
EISDIDFVVFHQANLRLIEYLVKKMGFGLDKTYA

SEQ ID NO: 353456 - protein, 30 aa, Mycobacterium
EITEDFSRYWWVYLSMPFVAAFVGWSTKIV

SEQ ID NO: 353457 - protein, 32 aa, Mycobacterium
EITTAALVLLILLIVYRNPVTMMLPLIVVGVS

SEQ ID NO: 353458 - protein, 18 aa, Mycobacterium
EIVGLLSQRPEYGPLADP

SEQ ID NO: 353459 - protein, 25 aa, Mycobacterium
EIVLALANLLWFVFAGFGALTLETE

SEQ ID NO: 353460 - protein, 25 aa, Mycobacterium
EIVQSMFIGPIFNPLLKMLGADKIA

SEQ ID NO: 353461 - protein, 29 aa, Mycobacterium
EIVVGVLLVLGLFTPLAGAGALAFLINGT

SEQ ID NO: 353462 - protein, 17 aa, Mycobacterium
EIYLVTIPGVAWFAVLV

SEQ ID NO: 353463 - protein, 26 aa, Mycobacterium
EKAPSMFVLAFIPMLLVAFAYKELSQ

SEQ ID NO: 353464 - protein, 20 aa, Mycobacterium
EKGLLRPSFVPPAPIRELRD

SEQ ID NO: 353465 - protein, 25 aa, Mycobacterium
EKHCADIPICWSLRSIFDALDGVDQ

SEQ ID NO: 353466 - protein, 25 aa, Mycobacterium
EKHCETIPICFAIRSVFQALDGTDL

SEQ ID NO: 353467 - protein, 24 aa, Mycobacterium
EKKSYPYFDPIAQKAFDANYDSQE

SEQ ID NO: 353468 - protein, 23 aa, Mycobacterium
EKKTYPFFDPIAQKAFDANYDGE

SEQ ID NO: 353469 - protein, 23 aa, Mycobacterium
EKKTYPYFDPIAQKPFDVNYDTE

SEQ ID NO: 353470 - protein, 23 aa, Mycobacterium
EKKTYPYFDPIAQKPFDVNYESQ

SEQ ID NO: 353471 - protein, 25 aa, Mycobacterium
EKLGALFGYLSFFAGRLIRIYLSRR

SEQ ID NO: 353472 - protein, 23 aa, Mycobacterium
EKNLPYLLVIDEAAQFKVILTRL

SEQ ID NO: 353473 - protein, 17 aa, Mycobacterium
EKNMPFWGTSFSAAYVS

SEQ ID NO: 353474 - protein, 18 aa, Mycobacterium
EKQKLELLRSLLTYFHYA

SEQ ID NO: 353475 - protein, 23 aa, Mycobacterium
EKTFKLLAIFMPGVKLVGNITTG

SEQ ID NO: 353476 - protein, 25 aa, Mycobacterium
EKVFAEIVPVLLVLALALVVIGPRI

SEQ ID NO: 353477 - protein, 31 aa, Mycobacterium
EKWQIPALVLGWLIAVLIRLATGSATVATIT

SEQ ID NO: 353478 - protein, 19 aa, Mycobacterium
ELAAPWFIGAAMGLQVLGT

SEQ ID NO: 353479 - protein, 36 aa, Mycobacterium
ELAASWLWVVALGGLFLWIGYRRRTGRLRRIAVPDR

SEQ ID NO: 353480 - protein, 26 aa, Mycobacterium
ELAASWLWVVASGGLYLWLVNAAGDR

SEQ ID NO: 353481 - protein, 34 aa, Mycobacterium
ELAASWMWVIALAGLALWLLQRRDKRSRLVVPDR

SEQ ID NO: 353482 - protein, 23 aa, Mycobacterium
ELAATIARRLGLTGALGTVAESV

SEQ ID NO: 353483 - protein, 24 aa, Mycobacterium
ELAETIARRLGLTGALGTVAESVD

SEQ ID NO: 353484 - protein, 25 aa, Mycobacterium
ELAGAVLLRDPLRRQAPRTVRRLRE

SEQ ID NO: 353485 - protein, 17 aa, Mycobacterium
ELAILRVAHRRQSAYEW

SEQ ID NO: 353486 - protein, 25 aa, Mycobacterium
ELAKLWPVIVDLTIVLATVAVIVLG

SEQ ID NO: 353487 - protein, 24 aa, Mycobacterium
ELALALVAVWATAASWLQTTSTVA

SEQ ID NO: 353488 - protein, 23 aa, Mycobacterium
ELAPTFLEFGEQPHMMIFGDSEC

SEQ ID NO: 353489 - protein, 20 aa, Mycobacterium
ELARLDEVFRRALAKNPDDR

SEQ ID NO: 353490 - protein, 26 aa, Mycobacterium
ELARPPIWMLVVFLVTAVGAEALKRL

SEQ ID NO: 353491 - protein, 21 aa, Mycobacterium
ELARRLAPGATVVLAARRADQ

SEQ ID NO: 353492 - protein, 35 aa, Mycobacterium
ELCAQYLAPILDSIKFNYFPFGVNFFSTAEVLPKQ

SEQ ID NO: 353493 - protein, 34 aa, Mycobacterium
ELCAQYLAPILDSIKFNYLPFGANLFSTAEVLPK

SEQ ID NO: 353494 - protein, 29 aa, Mycobacterium
ELCAQYLGPILDAIKFNYLPFGANQLQTA

SEQ ID NO: 353495 - protein, 18 aa, Mycobacterium
ELCRFPGIDPKRDLNKVP

SEQ ID NO: 353496 - protein, 24 aa, Mycobacterium
ELDIAWLIFAHLVFQEIAGLAGLP

SEQ ID NO: 353497 - protein, 20 aa, Mycobacterium
ELDKPIYPKPSLSTAFSDWL

SEQ ID NO: 353498 - protein, 24 aa, Mycobacterium
ELDPVDWWRQLSWLPQRSVLIPGT

SEQ ID NO: 353499 - protein, 18 aa, Mycobacterium
ELDRWQLRFPVRAATVGT

SEQ ID NO: 353500 - protein, 31 aa, Mycobacterium
ELDTPEFPWTGLTIFLLIGVLAAAVGTRFMQ

SEQ ID NO: 353501 - protein, 31 aa, Mycobacterium
ELEFWAALIKVIALVIFLIIGSIFLAGRYHV

SEQ ID NO: 353502 - protein, 21 aa, Mycobacterium
ELFGTFWLVFGGCGSAIFAAK

SEQ ID NO: 353503 - protein, 27 aa, Mycobacterium
ELFKRMTMILTWIWVAAFAGMTLSSLV

SEQ ID NO: 353504 - protein, 17 aa, Mycobacterium
ELGAMTAMFLGFREREL

SEQ ID NO: 353505 - protein, 26 aa, Mycobacterium
ELGAMTAMFLGFREREMILKVFEAIT

SEQ ID NO: 353506 - protein, 23 aa, Mycobacterium
ELGDLAMLLILVASLSAIGILLV

SEQ ID NO: 353507 - protein, 26 aa, Mycobacterium
ELGIDRFLLVQWLAPLASEAPEFIVA

SEQ ID NO: 353508 - protein, 18 aa, Mycobacterium
ELGKLLFYSEPMRPVGRP

SEQ ID NO: 353509 - protein, 17 aa, Mycobacterium
ELGLLIDAPRSASVRAL

SEQ ID NO: 353510 - protein, 18 aa, Mycobacterium
ELGQPMFAEYVWGRQVGE

SEQ ID NO: 353511 - protein, 30 aa, Mycobacterium
ELGRPLRRAFLYFTEPWLVAGVLLAVIAVA

SEQ ID NO: 353512 - protein, 30 aa, Mycobacterium; identical to SEQ ID NO: 304991

SEQ ID NO: 353513 - protein, 26 aa, Mycobacterium
ELGVNRFLLVQWLAPLASEAPEFIIA

SEQ ID NO: 353514 - protein, 22 aa, Mycobacterium
ELHLRVLLICASVIGGTVVVGW

SEQ ID NO: 353515 - protein, 19 aa, Mycobacterium
ELHWLVLSMSVIVLLAVGA

SEQ ID NO: 353516 - protein, 22 aa, Mycobacterium
ELHWMVLPMAVIILLAVGADYN

SEQ ID NO: 353517 - protein, 18 aa, Mycobacterium
ELIALLHSFVGLAAVLVG

SEQ ID NO: 353518 - protein, 25 aa, Mycobacterium
ELIAWAGFALLTWSLAGVAIFAITA

SEQ ID NO: 353519 - protein, 39 aa, Mycobacterium
ELIGVVHPTFLYELLWNLLVFAVLILVDRRFKIGHGRLF

SEQ ID NO: 353520 - protein, 20 aa, Mycobacterium
ELILLWTVPAVVIIWVSAFL

SEQ ID NO: 353521 - protein, 22 aa, Mycobacterium
ELIPYIVQFPRFFNGEVTLGGL

SEQ ID NO: 353522 - protein, 20 aa, Mycobacterium
ELIVQAWTLLKVTAVPAVLM

SEQ ID NO: 353523 - protein, 25 aa, Mycobacterium
ELKETLDLLPLLLDNVDRSIDPVNG

SEQ ID NO: 353524 - protein, 24 aa, Mycobacterium
ELKTVFADFPGLEVCVYAAPSQTV

SEQ ID NO: 353525 - protein, 23 aa, Mycobacterium
ELKYLIRIFGARALALGIGYLGS

SEQ ID NO: 353526 - protein, 34 aa, Mycobacterium
ELLSGLGLMLNPTSLVPLLLSQIGGLAAGVVGGA

SEQ ID NO: 353527 - protein, 18 aa, Mycobacterium
ELLTFLREQAVAVTAHRF

SEQ ID NO: 353528 - protein, 25 aa, Mycobacterium
ELLVLIAPIVGLIYAGIRAISSLNR

SEQ ID NO: 353529 - protein, 17 aa, Mycobacterium
ELMYFVAVPVAVVGALL

SEQ ID NO: 353530 - protein, 17 aa, Mycobacterium
ELNGGRYVLAPLALAQR

SEQ ID NO: 353531 - protein, 25 aa, Mycobacterium
ELNRQILAGPWTWSPQPPVWVAAVA

SEQ ID NO: 353532 - protein, 25 aa, Mycobacterium
ELNSILLLAIWIGVGWIAQGIAGTI

SEQ ID NO: 353533 - protein, 18 aa, Mycobacterium
ELPGDRLMLAPYSDTRER

SEQ ID NO: 353534 - protein, 21 aa, Mycobacterium
ELPLREILPAVQRLVIPAAEN

SEQ ID NO: 353535 - protein, 20 aa, Mycobacterium
ELPRGLFPYLAEDISFVLDE

SEQ ID NO: 353536 - protein, 19 aa, Mycobacterium
ELPRNPTGKILKRELREMD

SEQ ID NO: 353537 - protein, 38 aa, Mycobacterium
ELPRVVPPSLLRRALPYLIVILIVGMIVALVATGLRLI

SEQ ID NO: 353538 - protein, 20 aa, Mycobacterium
ELQADCYAGIWAHYASTVKQ

SEQ ID NO: 353539 - protein, 21 aa, Mycobacterium
ELQADCYAGVWAYYASTVKQQ

SEQ ID NO: 353540 - protein, 29 aa, Mycobacterium
ELQFAALAAVLLTAGWILGRSGYEGVAHA

SEQ ID NO: 353541 - protein, 18 aa, Mycobacterium
ELQKLRGMTPRAALTKHL

SEQ ID NO: 353542 - protein, 26 aa, Mycobacterium
ELQPGKLRWLATWGPWAAVGAAAITG

SEQ ID NO: 353543 - protein, 24 aa, Mycobacterium
ELQPKLLALLPPMIATMQTVKSLT

SEQ ID NO: 353544 - protein, 26 aa, Mycobacterium
ELQQQYLIADVLPLTALQQGLVFHSG

SEQ ID NO: 353545 - protein, 30 aa, Mycobacterium
ELRDRSWWSGPEIYILVDDYDLVALASGNP

SEQ ID NO: 353546 - protein, 18 aa, Mycobacterium
ELRDWLARKAFYGGSAAP

SEQ ID NO: 353547 - protein, 23 aa, Mycobacterium
ELRDWLARKAFYGGSAAPLSVRH

SEQ ID NO: 353548 - protein, 23 aa, Mycobacterium
ELRKWFARKSFYGGSAAPLTIRH

SEQ ID NO: 353549 - protein, 24 aa, Mycobacterium
ELRSVLLGILPRALTEHGLVAAAT

SEQ ID NO: 353550 - protein, 25 aa, Mycobacterium
ELRVRIGIHMGRSVRRGDDLFGRNV

SEQ ID NO: 353551 - protein, 24 aa, Mycobacterium
ELRVRNRAPLREHLEGALATESAE

SEQ ID NO: 353552 - protein, 23 aa, Mycobacterium
ELSAIGLSWPRETLQPILDSFTS

SEQ ID NO: 353553 - protein, 47 aa, Mycobacterium
ELSEVFGQRKLLKWSIPGLAHFFTMWGFFILLTVYIEAYGLLFQDNF

SEQ ID NO: 353554 - protein, 24 aa, Mycobacterium
ELSGMPALLSLIDLDDVRAIDGEQ

SEQ ID NO: 353555 - protein, 22 aa, Mycobacterium
ELSKSIYPKPSPMDLLSEWFDE

SEQ ID NO: 353556 - protein, 31 aa, Mycobacterium
ELSRQHHFTDLLPLTPLQQGLLYHSGTARGC

SEQ ID NO: 353557 - protein, 24 aa, Mycobacterium
ELSRRAWLPLVVASATWVVAEVVR

SEQ ID NO: 353558 - protein, 18 aa, Mycobacterium
ELSTVFLILGISAPVSGI

SEQ ID NO: 353559 - protein, 24 aa, Mycobacterium
ELTALIQLYIVGVFISFTLSQIGM

SEQ ID NO: 353560 - protein, 22 aa, Mycobacterium
ELTAQFWRRSGIRIVRRPVPHL

SEQ ID NO: 353561 - protein, 25 aa, Mycobacterium
ELTNRLPAYMVPAAVVTLETLPLTV

SEQ ID NO: 353562 - protein, 36 aa, Mycobacterium
ELTQRPHPYPRWLATVCWAGFSLGIAMMLGANWRTC

SEQ ID NO: 353563 - protein, 18 aa, Mycobacterium
ELTRFDRAKAYWTRQGWA

SEQ ID NO: 353564 - protein, 22 aa, Mycobacterium
ELTSAQWLFAIAVGSSVLVVDE

SEQ ID NO: 353565 - protein, 17 aa, Mycobacterium
ELTTRFWRRSGIRIVRR

SEQ ID NO: 353566 - protein, 25 aa, Mycobacterium
ELTTRFWRRSGIRIVRRPKVNLIAS

SEQ ID NO: 353567 - protein, 31 aa, Mycobacterium
ELTTSHFPWTPFTIVLVIAVILAVAGTRVLQ

SEQ ID NO: 353568 - protein, 29 aa, Mycobacterium
ELVAGVLLVLGLFTPLAAAGALAFLINGL

SEQ ID NO: 353569 - protein, 18 aa, Mycobacterium
ELVARWRGRPWYVDYGNN

SEQ ID NO: 353570 - protein, 21 aa, Mycobacterium
ELVDFVTYLQAGTQWARRPGT

SEQ ID NO: 353571 - protein, 20 aa, Mycobacterium
ELVDRLEELLSDPVLRDQLG

SEQ ID NO: 353572 - protein, 28 aa, Mycobacterium
ELVFAGLAGSLLLTGWLLAAFADTPRSA

SEQ ID NO: 353573 - protein, 27 aa, Mycobacterium
ELVFAVFLYRVWNLPVAILSGAVAGLA

SEQ ID NO: 353574 - protein, 24 aa, Mycobacterium
ELVTLPAGWAWLENGWVMTIVAAL

SEQ ID NO: 353575 - protein, 29 aa, Mycobacterium
EMDPDLVLFVILPPLLYTTALESSYVNLR

SEQ ID NO: 353576 - protein, 39 aa, Mycobacterium
EMHRPELGFLIPPAILAAAGLVFGLWPKPLDTVLSNYSD

SEQ ID NO: 353577 - protein, 20 aa, Mycobacterium
EMLAPLRRALALLGREQVAD

SEQ ID NO: 353578 - protein, 31 aa, Mycobacterium
EMLVLVIAGLVILGPERLPGAIRWTAGAVRQ

SEQ ID NO: 353579 - protein, 28 aa, Mycobacterium
EMNDGKPFILAGWSLGGALAYACAIGLK

SEQ ID NO: 353580 - protein, 18 aa, Mycobacterium
EMRQWLRNWVGKAVGRSP

SEQ ID NO: 353581 - protein, 29 aa, Mycobacterium
EMTIGTFAAFLLYLRMFFEPMHEITHFFN

SEQ ID NO: 353582 - protein, 26 aa, Mycobacterium
EMVPETPVWRLVLPFAAMGAGMAFVW

SEQ ID NO: 353583 - protein, 27 aa, Mycobacterium
EMVTETPRIMLSPPSIAPITSTTTTST

SEQ ID NO: 353584 - protein, 17 aa, Mycobacterium
EMVVLAALAWASVPLLR

SEQ ID NO: 353585 - protein, 19 aa, Mycobacterium
EMWLAWRYGACLVPAPRSL

SEQ ID NO: 353586 - protein, 24 aa, Mycobacterium
EMYRRAIPVLLTTGLPNTLILTNS

SEQ ID NO: 353587 - protein, 23 aa, Mycobacterium
ENDRLLLSLMPAPVVQRYREGVQ

SEQ ID NO: 353588 - protein, 19 aa, Mycobacterium
ENDRLLLSLMPEPVVQRYR

SEQ ID NO: 353589 - protein, 29 aa, Mycobacterium
ENGLVLAYLGLLWWMMVAWSQARRETTRT

SEQ ID NO: 353590 - protein, 30 aa, Mycobacterium
ENGLVLAYLGLLWWMMVCWSQALRAYPADG

SEQ ID NO: 353591 - protein, 23 aa, Mycobacterium
ENLRPPFGVVPFAGVLDTSAMLL

SEQ ID NO: 353592 - protein, 18 aa, Mycobacterium
ENPNLTAPGLVLRGFVER

SEQ ID NO: 353593 - protein, 33 aa, Mycobacterium
ENPTRWTNWLEIFLLLVISFSLPRTFGRMVGSK

SEQ ID NO: 353594 - protein, 25 aa, Mycobacterium
ENRPNPFALFLVSMLGPIAATVVKM

SEQ ID NO: 353595 - protein, 30 aa, Mycobacterium
ENRTGLFEALFLLGVLVGTIQILIAVFKLG

SEQ ID NO: 353596 - protein, 21 aa, Mycobacterium
ENRWEKLPPIRMVHRGTAASL

SEQ ID NO: 353597 - protein, 27 aa, Mycobacterium
ENSPAFLQWGWRVPFLVSAALIGIALY

SEQ ID NO: 353598 - protein, 24 aa, Mycobacterium
ENSRRWWTWTLLAGPGWVVFGALK

SEQ ID NO: 353599 - protein, 29 aa, Mycobacterium
ENTVNRYLGLFWAFVGVMLALGGALAFVV

SEQ ID NO: 353600 - protein, 23 aa, Mycobacterium
ENWSYALFLGLIVAVPLMIFWGR

SEQ ID NO: 353601 - protein, 29 aa, Mycobacterium
EPAGGWKRLPLTVFGIAVAAVLVAVGGVT

SEQ ID NO: 353602 - protein, 25 aa, Mycobacterium
EPAGWSFSGPLLWLKSAIVDRDRQY

SEQ ID NO: 353603 - protein, 18 aa, Mycobacterium
EPAQILVLLCVGAVFMGT

SEQ ID NO: 353604 - protein, 33 aa, Mycobacterium
EPARPWYRRGGVVFYAALFLAVVGTAGLVYSVR

SEQ ID NO: 353605 - protein, 44 aa, Mycobacterium
EPARSRRRLRMPPLSVTWKVAVILLICAFVAASGYMMWNRHEVN

SEQ ID NO: 353606 - protein, 20 aa, Mycobacterium
EPAWRNLRFPLTWAPPEANV

SEQ ID NO: 353607 - protein, 33 aa, Mycobacterium
EPDDVVLAVLPFFHIYGMTVLLNAALHARARLV

SEQ ID NO: 353608 - protein, 22 aa, Mycobacterium
EPDIGPQPDLPWRRGRRIAPEL

SEQ ID NO: 353609 - protein, 53 aa, Mycobacterium
EPDPEPARTIAWSRVLVFAVIPAVALLLAAGSAFLKWQIAWNAESDTARTESV

SEQ ID NO: 353610 - protein, 31 aa, Mycobacterium
EPEDREPRMWLWVLAALAVLVVVGLVIALVI

SEQ ID NO: 353611 - protein, 17 aa, Mycobacterium
EPELFEPRPQAFRPEPE

SEQ ID NO: 353612 - protein, 19 aa, Mycobacterium
EPEMKFIRQALEICPVAAI

SEQ ID NO: 353613 - protein, 25 aa, Mycobacterium
EPENYLVWAILVTVLCCLPFGIVSI

SEQ ID NO: 353614 - protein, 17 aa, Mycobacterium
EPEPRWPKSEPITRTKA

SEQ ID NO: 353615 - protein, 18 aa, Mycobacterium
EPEPRWPKSPPQPKRVPG

SEQ ID NO: 353616 - protein, 24 aa, Mycobacterium
EPEPVVMVPHRPAGRGVLIATAVA

SEQ ID NO: 353617 - protein, 18 aa, Mycobacterium
EPERIRRTFGELEQLLAY

SEQ ID NO: 353618 - protein, 25 aa, Mycobacterium
EPETLAPPPAAPPAPEAPVAPPAPA

SEQ ID NO: 353619 - protein, 19 aa, Mycobacterium
EPGFSKHLAGIEPQLAFTG

SEQ ID NO: 353620 - protein, 20 aa, Mycobacterium
EPGLVLRGFVERVGDPAPLV

SEQ ID NO: 353621 - protein, 25 aa, Mycobacterium
EPGSVLMLLTMAAVFMGTALTIRDL

SEQ ID NO: 353622 - protein, 44 aa, Mycobacterium
EPGVERRPSRLGRGWLVGISAVLLLAAGGIGAGGYLALRSHQES

SEQ ID NO: 353623 - protein, 24 aa, Mycobacterium
EPHCADIPMCWAMRSLFDMTDQVD

SEQ ID NO: 353624 - protein, 25 aa, Mycobacterium
EPHCFNIPICWALRSVFDSLDGINT

SEQ ID NO: 353625 - protein, 25 aa, Mycobacterium
EPHCYDIPLCWSIRSLFDGLDGINE

SEQ ID NO: 353626 - protein, 24 aa, Mycobacterium
EPHCYNIPICWSLRSIFDAMDGVD

SEQ ID NO: 353627 - protein, 24 aa, Mycobacterium
EPHCYNIPVCWALRSVFDTLDGIN

SEQ ID NO: 353628 - protein, 24 aa, Mycobacterium
EPHVLPLHDFGEIDGVPFIDMHLV

SEQ ID NO: 353629 - protein, 17 aa, Mycobacterium
EPIILRCGLERPVDFVV

SEQ ID NO: 353630 - protein, 17 aa, Mycobacterium
EPIPLSTLLATAGVAQR

SEQ ID NO: 353631 - protein, 17 aa, Mycobacterium
EPIYYPRYLIFTAPAMA

SEQ ID NO: 353632 - protein, 39 aa, Mycobacterium
EPKPRRRPILLAGRSLAALFAVLALVLTGGAWEWSSSKN

SEQ ID NO: 353633 - protein, 25 aa, Mycobacterium
EPKRRRPMLLAGRSVAALAAVLALV

SEQ ID NO: 353634 - protein, 26 aa, Mycobacterium
EPLALRQHAFGTYPLDPSLVAQGIAP

SEQ ID NO: 353635 - protein, 19 aa, Mycobacterium
EPLAMRQHVTGPYPIDPNL

SEQ ID NO: 353636 - protein, 40 aa, Mycobacterium
EPLDVPYLRASPWLLWRKRIVWLLVLFAAEAYTGTVLRAF

SEQ ID NO: 353637 - protein, 21 aa, Mycobacterium
EPLRCRPDAAYLITGGLGALG

SEQ ID NO: 353638 - protein, 26 aa, Mycobacterium
EPLRSLVWTLQAWAVTMLVFLAVAVI

SEQ ID NO: 353639 - protein, 20 aa, Mycobacterium
EPLSRWQLLALVLAFTAVAV

SEQ ID NO: 353640 - protein, 24 aa, Mycobacterium
EPMPPMRWFGFALIWVALAVFTVD

SEQ ID NO: 353641 - protein, 17 aa, Mycobacterium
EPNLTYRIALRTTSSHE

SEQ ID NO: 353642 - protein, 39 aa, Mycobacterium
EPNPEERPRLLLGFAMVALPILGLWHLFAGSPDSPEGRS

SEQ ID NO: 353643 - protein, 27 aa, Mycobacterium
EPPAFRVALIRVAAERYRFVLTNHHIV

SEQ ID NO: 353644 - protein, 29 aa, Mycobacterium
EPPPPPATPPIPPAPVAPGGINGAGRPAV

SEQ ID NO: 353645 - protein, 17 aa, Mycobacterium
EPPPRLSPGGRTTFRFL

SEQ ID NO: 353646 - protein, 30 aa, Mycobacterium
EPPQDPKSPRWLWIVAGVAVVMVIGLVIAL

SEQ ID NO: 353647 - protein, 23 aa, Mycobacterium
EPPVWLWLALAVLIGVASLTLAV

SEQ ID NO: 353648 - protein, 25 aa, Mycobacterium
EPQHPAIPLRAKPVALLAARQLRDR

SEQ ID NO: 353649 - protein, 29 aa, Mycobacterium
EPQLRAAAFGTLVGLLVAVLMGAAYAAQP

SEQ ID NO: 353650 - protein, 28 aa, Mycobacterium
EPRGQVVLPFTGLNFRFAPGGVAVDANG

SEQ ID NO: 353651 - protein, 38 aa, Mycobacterium
EPRKRRLRRILIGSVVAILLVGMLAVAIPSLREITSSP

SEQ ID NO: 353652 - protein, 22 aa, Mycobacterium
EPRLRALGWTGVLDKGGDVQNS

SEQ ID NO: 353653 - protein, 37 aa, Mycobacterium
EPRSVARWIRRLAVPIILGWLLLAVALNALVPQLEVV

SEQ ID NO: 353654 - protein, 24 aa, Mycobacterium
EPRVLQIRALVLGGAMDWLQDNEA

SEQ ID NO: 353655 - protein, 27 aa, Mycobacterium
EPSRSRRFGFLRLGRRSAPAAVTPVAE

SEQ ID NO: 353656 - protein, 17 aa, Mycobacterium
EPTILLAVFALSIPAKS

SEQ ID NO: 353657 - protein, 17 aa, Mycobacterium
EPVIMRCGLDRPADFVV

SEQ ID NO: 353658 - protein, 25 aa, Mycobacterium
EPVMITDRKLAWPADLKVGPDGLGN

SEQ ID NO: 353659 - protein, 27 aa, Mycobacterium
EPVPAALWVWVGLTAVAAAMLVVGWRG

SEQ ID NO: 353660 - protein, 24 aa, Mycobacterium
EPVPPLKFAQLVGFVFAAVGAVGF

SEQ ID NO: 353661 - protein, 20 aa, Mycobacterium
EPVPPLKFAQLVGLVFAVIG

SEQ ID NO: 353662 - protein, 22 aa, Mycobacterium
EPVPPLRFAQLVGLVFAAAGVV

SEQ ID NO: 353663 - protein, 22 aa, Mycobacterium
EPVRLVLRRWTRPAPPPTPTDA

SEQ ID NO: 353664 - protein, 22 aa, Mycobacterium
EPVSHMWVVKFLRTHGLIHDCP

SEQ ID NO: 353665 - protein, 18 aa, Mycobacterium
EPYLLGCLNARNDLSQIS

SEQ ID NO: 353666 - protein, 27 aa, Mycobacterium
EQALPQLPPQLPLPDAATALPPPVVIP

SEQ ID NO: 353667 - protein, 29 aa, Mycobacterium
EQAWDVLCDLEQVIPLMPGAQLTGHQDDD

SEQ ID NO: 353668 - protein, 24 aa, Mycobacterium
EQDMTVLPFSWQGVSLHASGAARA

SEQ ID NO: 353669 - protein, 24 aa, Mycobacterium
EQDVIVVWGFPFGKAKPGDEVTIR

SEQ ID NO: 353670 - protein, 24 aa, Mycobacterium
EQDWGYLSMLPSLLALGLAFTLAY

SEQ ID NO: 353671 - protein, 20 aa, Mycobacterium
EQFAALRDEFFAQSDLARGG

SEQ ID NO: 353672 - protein, 28 aa, Mycobacterium
EQFLAWGWRVPFLLSAPLVLVGLLIRVK

SEQ ID NO: 353673 - protein, 31 aa, Mycobacterium
EQFMLGVRTIQWFFVDLFTGNFQWQEFVRQG

SEQ ID NO: 353674 - protein, 21 aa, Mycobacterium
EQGFLFYHGRSDDMFKVSGAT

SEQ ID NO: 353675 - protein, 25 aa, Mycobacterium
EQHCFDIPICWSLRSLFDATDGVDK

SEQ ID NO: 353676 - protein, 24 aa, Mycobacterium
EQIKPTLPVLLANLTTIGQIGITY

SEQ ID NO: 353677 - protein, 23 aa, Mycobacterium
EQKRRWIPGIADGTLTMAFAITE

SEQ ID NO: 353678 - protein, 21 aa, Mycobacterium
EQLLAYRQRLFRDRGIASVSQ

SEQ ID NO: 353679 - protein, 24 aa, Mycobacterium
EQLLTFTALLLVLAAAIVFIYRPL

SEQ ID NO: 353680 - protein, 24 aa, Mycobacterium
EQLPAYMVPVAVVVLAALPMTVNG

SEQ ID NO: 353681 - protein, 19 aa, Mycobacterium
EQLTLSEGALLAALIRRPS

SEQ ID NO: 353682 - protein, 24 aa, Mycobacterium
EQLTVRYALRRLGTLRVWPSRARA

SEQ ID NO: 353683 - protein, 60 aa, Mycobacterium
EQLVDYVWGGLRRPWRPRRFLRSLAQALRLSYMALFSVPVVAPLILRVALSLAAVRRNMV

SEQ ID NO: 353684 - protein, 25 aa, Mycobacterium
EQNQTVLPFAWQGVSLHAAGASRCR

SEQ ID NO: 353685 - protein, 23 aa, Mycobacterium
EQPIRRWRPARVPLLPLAAATVA

SEQ ID NO: 353686 - protein, 25 aa, Mycobacterium
EQPWTPIVIILVITAVKIVGSVLAP

SEQ ID NO: 353687 - protein, 28 aa, Mycobacterium
EQQDPIKLIALLVCLIPTTIGALMSAIG

SEQ ID NO: 353688 - protein, 23 aa, Mycobacterium
EQQSRTVLTFRPGLPLDAEQQML

SEQ ID NO: 353689 - protein, 17 aa, Mycobacterium
EQRNLFVQVGRQGALNL

SEQ ID NO: 353690 - protein, 34 aa, Mycobacterium
EQRRNPVLVFLGYFWAPIPWMIEAALVLSLAARH

SEQ ID NO: 353691 - protein, 34 aa, Mycobacterium
EQRRSQLIQIGLTAIVVLFAVGLVGFIVLSNKKD

SEQ ID NO: 353692 - protein, 26 aa, Mycobacterium
EQSLLATICQVIIIAALFLGIAAALR

SEQ ID NO: 353693 - protein, 23 aa, Mycobacterium
EQTLLDFVPILFVVFGIGALNTS

SEQ ID NO: 353694 - protein, 24 aa, Mycobacterium
EQVGNYQHWLDRCGSYRVTNYYVD

SEQ ID NO: 353695 - protein, 25 aa, Mycobacterium
EQVRQIYLDTLASWPHDRLPEFDIY

SEQ ID NO: 353696 - protein, 22 aa, Mycobacterium
EQWGQLVGIVLPMLSGNGITIN

SEQ ID NO: 353697 - protein, 38 aa, Mycobacterium
EQWIPNYPPQAAPRPSAWPLVALAITAIVGVVLGTTAL

SEQ ID NO: 353698 - protein, 18 aa, Mycobacterium
EQWSRLWRSDVRVVGRPQ

SEQ ID NO: 353699 - protein, 25 aa, Mycobacterium
EQYLATLLAALLIGALPCAVAPPPT

SEQ ID NO: 353700 - protein, 30 aa, Mycobacterium
EQYQLTNVLKAFYAALGAKNLEVLNALSCV

SEQ ID NO: 353701 - protein, 36 aa, Mycobacterium
ERADRSDRLYWKAVVYLRIVIRWISDEHPGETYPAP

SEQ ID NO: 353702 - protein, 18 aa, Mycobacterium
ERAGRLADGWFPMTAPGP

SEQ ID NO: 353703 - protein, 42 aa, Mycobacterium
ERAGRLAPPMRWHSGRRVHLDLDPLLPFPRWHEHAAVLEEPV

SEQ ID NO: 353704 - protein, 29 aa, Mycobacterium
ERASSPAVLLNPLRWYPLASAAADTVAVD

SEQ ID NO: 353705 - protein, 22 aa, Mycobacterium
ERCYPPVIRLVTAAAALVRRAH

SEQ ID NO: 353706 - protein, 31 aa, Mycobacterium
ERDRLPIELAIGVLVLVVLLVVYRNPRTMLL

SEQ ID NO: 353707 - protein, 21 aa, Mycobacterium
ERELVFERFFRSTTARAMPGS

SEQ ID NO: 353708 - protein, 32 aa, Mycobacterium
EREPALLKRWVLLLILVGTWIPAAAVGLLLYQ

SEQ ID NO: 353709 - protein, 32 aa, Mycobacterium
ERFGGPQIPWWILTALVLAAVAWLGYRDIDLS

SEQ ID NO: 353710 - protein, 25 aa, Mycobacterium
ERFYEMLRKFGLGQRTNVGLPGESS

SEQ ID NO: 353711 - protein, 24 aa, Mycobacterium
ERGAALPPFPTLLIVVDEFTALLK

SEQ ID NO: 353712 - protein, 20 aa, Mycobacterium
ERGADLPPLPTLFVVVDEFA

SEQ ID NO: 353713 - protein, 26 aa, Mycobacterium
ERGFRAPWVPVLPIASICACVWLMVN

SEQ ID NO: 353714 - protein, 51 aa, Mycobacterium
ERGFRAPWVPVLPIASLCACLWLMLNLTALTWIRFGVWLLVGTVIYVGYGR

SEQ ID NO: 353715 - protein, 17 aa, Mycobacterium
ERGLRVLAVAKRPWEHD

SEQ ID NO: 353716 - protein, 17 aa, Mycobacterium
ERGWWLVNAPPGGEHRR

SEQ ID NO: 353717 - protein, 18 aa, Mycobacterium
ERHCFDIPICWTFRSLFE

SEQ ID NO: 353718 - protein, 25 aa, Mycobacterium
ERHCSDIPICWSLRSLFDAIDGVDK

SEQ ID NO: 353719 - protein, 19 aa, Mycobacterium
ERHRPVLAAMLAVSSTATG

SEQ ID NO: 353720 - protein, 20 aa, Mycobacterium
ERIEDFGEWLQRFEAALQGL

SEQ ID NO: 353721 - protein, 22 aa, Mycobacterium
ERILNRLLAVQDPSARRRVGPL

SEQ ID NO: 353722 - protein, 34 aa, Mycobacterium
ERIPGDEYVTWAALLWLTVFTTGMCFVLKRRSAR

SEQ ID NO: 353723 - protein, 21 aa, Mycobacterium
ERKFAIIFVTAAAVLFVAGAL

SEQ ID NO: 353724 - protein, 18 aa, Mycobacterium
ERKILGWMQLRPGPNRAG

SEQ ID NO: 353725 - protein, 22 aa, Mycobacterium
ERKTLWNTYVSQGLPGTPISSP

SEQ ID NO: 353726 - protein, 21 aa, Mycobacterium
ERLGLAIAFLLSIAAAFVVSA

SEQ ID NO: 353727 - protein, 24 aa, Mycobacterium
ERLPDYMVPSVLLRLDVLPLTVNG

SEQ ID NO: 353728 - protein, 18 aa, Mycobacterium
ERLPGYMVPAAVVGLAAL

SEQ ID NO: 353729 - protein, 24 aa, Mycobacterium
ERLQRWFAYLVFVVAGYVLIDTIF

SEQ ID NO: 353730 - protein, 36 aa, Mycobacterium
ERLTRDFATMLHYWPFLFFASGVVSITFVSLVGWWA

SEQ ID NO: 353731 - protein, 21 aa, Mycobacterium
ERLTVTALLLLTVATGLVDAI

SEQ ID NO: 353732 - protein, 20 aa, Mycobacterium
ERMIQIAAAVLFLGFGFFML

SEQ ID NO: 353733 - protein, 40 aa, Mycobacterium
ERMKFGTWLVFGGIWVTLVYFPLAHMVWGGGLLSGAEDGI

SEQ ID NO: 353734 - protein, 32 aa, Mycobacterium
ERMRRSVMAVMIPTLLLLIAVTLVYSLAHDPD

SEQ ID NO: 353735 - protein, 24 aa, Mycobacterium
ERNLTRMLLGLLLIGNAVNLLILT

SEQ ID NO: 353736 - protein, 17 aa, Mycobacterium
ERPATLCIPLLLAAFSL

SEQ ID NO: 353737 - protein, 35 aa, Mycobacterium
ERPAVMPLSYAQSRLWFIDQLHGPSPVYNLAVGLR

SEQ ID NO: 353738 - protein, 33 aa, Mycobacterium
ERPEVIPLSFAQNRLWFVDQLQGPSPVYNMPVG

SEQ ID NO: 353739 - protein, 27 aa, Mycobacterium
ERPGAVRLLRLMVDRPRYINLIVLLRM

SEQ ID NO: 353740 - protein, 33 aa, Mycobacterium
ERPGFWTVILVLLLPLVLIFFNTVFSTLEADGA

SEQ ID NO: 353741 - protein, 25 aa, Mycobacterium
ERPHPYPRWLSTAGWAGFALGIAML

SEQ ID NO: 353742 - protein, 30 aa, Mycobacterium
ERPLLVEHPVPPRQGWLVPLAATVAAVLMV

SEQ ID NO: 353743 - protein, 24 aa, Mycobacterium
ERPPVDPAAQRTFGRPAGVEGSFL

SEQ ID NO: 353744 - protein, 23 aa, Mycobacterium
ERPRALYMPRTRGALTGLLLILL

SEQ ID NO: 353745 - protein, 27 aa, Mycobacterium
ERPRYINLVVLLRIICEVTATVLLASI

SEQ ID NO: 353746 - protein, 26 aa, Mycobacterium
ERPRYVNLVVLLRTTCEILSTVFLVG

SEQ ID NO: 353747 - protein, 21 aa, Mycobacterium
ERPTFYIDFPTSVSPLTRPHR

SEQ ID NO: 353748 - protein, 33 aa, Mycobacterium
ERQQSRRAIFIWLVIVLILTSSVAAGCWSLGAN

SEQ ID NO: 353749 - protein, 25 aa, Mycobacterium
ERRALIFGPLYRILGTPVVALLGLV

SEQ ID NO: 353750 - protein, 32 aa, Mycobacterium
ERRDGLRALFSQLIFVHLYLGIAEGALAAGVA

SEQ ID NO: 353751 - protein, 30 aa, Mycobacterium
ERRFWLIPLGLVWLAFLPNAPYLVTDLVHL

SEQ ID NO: 353752 - protein, 20 aa, Mycobacterium
ERRNLDALLISTIGLADIGN

SEQ ID NO: 353753 - protein, 28 aa, Mycobacterium
ERRPPFTLAMCFLGVGLALRYDALGITM

SEQ ID NO: 353754 - protein, 24 aa, Mycobacterium
ERRTLAEFAPFDWIAAVAAGAIVG

SEQ ID NO: 353755 - protein, 23 aa, Mycobacterium
ERRWLIAALLFSAAGDWLLAIPW

SEQ ID NO: 353756 - protein, 23 aa, Mycobacterium
ERRWLVPALLFSAAGDWLLAIPW

SEQ ID NO: 353757 - protein, 27 aa, Mycobacterium
ERSTHRALLLVTFGGLFIAGVTQALPD

SEQ ID NO: 353758 - protein, 25 aa, Mycobacterium
ERTEPALNLDLLLGGLKPVIQGLNP

SEQ ID NO: 353759 - protein, 23 aa, Mycobacterium
ERTFKLLAVFMPGVKLVGNLTTG

SEQ ID NO: 353760 - protein, 21 aa, Mycobacterium
ERTFLAWIRTALALIAGGIAV

SEQ ID NO: 353761 - protein, 21 aa, Mycobacterium
ERTFLAWQRTSLGLLAAAVAV

SEQ ID NO: 353762 - protein, 23 aa, Mycobacterium
ERTFLSWIRTALGLLAGGVAVQT

SEQ ID NO: 353763 - protein, 24 aa, Mycobacterium
ERTGYFVLMILVAAIALAAALWVG

SEQ ID NO: 353764 - protein, 22 aa, Mycobacterium
ERTLLLGIVLWTSVVSLVTGFI

SEQ ID NO: 353765 - protein, 24 aa, Mycobacterium
ERTLLYVLMVVLSAALLIGAVALA

SEQ ID NO: 353766 - protein, 22 aa, Mycobacterium
ERTRLAWRRSLLALVAVLALVG

SEQ ID NO: 353767 - protein, 23 aa, Mycobacterium
ERTSIPFLLSLQSAGQVQATNFQ

SEQ ID NO: 353768 - protein, 18 aa, Mycobacterium
ERVPLVVKDFPDGPHLFD

SEQ ID NO: 353769 - protein, 18 aa, Mycobacterium
ERWLANQQKLFPNGETIT

SEQ ID NO: 353770 - protein, 22 aa, Mycobacterium
ERWMQRFSWVALVVAIVVGIIA

SEQ ID NO: 353771 - protein, 17 aa, Mycobacterium
ERYDETLFLVLKTVNYV

SEQ ID NO: 353772 - protein, 19 aa, Mycobacterium
ERYDTTLFLVLKTINYVEH

SEQ ID NO: 353773 - protein, 25 aa, Mycobacterium
ESAATYWYYAIALFGAAMTPYEVFF

SEQ ID NO: 353774 - protein, 17 aa, Mycobacterium
ESAAWPAGVPWADASLT

SEQ ID NO: 353775 - protein, 22 aa, Mycobacterium
ESAAWPAGVPWTDASLTAAAGK

SEQ ID NO: 353776 - protein, 28 aa, Mycobacterium
ESAKVLMLPTLLFIACILAVIVFGLMHS

SEQ ID NO: 353777 - protein, 23 aa, Mycobacterium
ESALFVIGVLVVALLGGVAPAAL

SEQ ID NO: 353778 - protein, 29 aa, Mycobacterium
ESALKYFLLGAFSSAFFLFGSAFVYGYAG

SEQ ID NO: 353779 - protein, 25 aa, Mycobacterium
ESALKYFLLGAFSSAFFLYGVALLY

SEQ ID NO: 353780 - protein, 25 aa, Mycobacterium
ESAPRSMWRLWRLTRRLIQQRRKNP

SEQ ID NO: 353781 - protein, 25 aa, Mycobacterium
ESCMAAYLPYLQWLAQNSTVCGESA

SEQ ID NO: 353782 - protein, 23 aa, Mycobacterium
ESDRPYIVMPYYAADSLAVRLRR

SEQ ID NO: 353783 - protein, 19 aa, Mycobacterium
ESEAPPRRRLGRGAAIAIV

SEQ ID NO: 353784 - protein, 28 aa, Mycobacterium
ESENFFVAPFLMLGLLGVVAVVAAVLIW

SEQ ID NO: 353785 - protein, 24 aa, Mycobacterium
ESENIVTLIQRPVNAPVMSGFEGA

SEQ ID NO: 353786 - protein, 32 aa, Mycobacterium
ESESRRMGLLVEDLLLLARLDAQRPLERRRVD

SEQ ID NO: 353787 - protein, 23 aa, Mycobacterium
ESFTLVYDAIVTRGGQQTALPTA

SEQ ID NO: 353788 - protein, 24 aa, Mycobacterium
ESFTLVYDALVTRAGEGVVALPSA

SEQ ID NO: 353789 - protein, 26 aa, Mycobacterium
ESGHVPLFFIVWALSNFVGPLVLGRL

SEQ ID NO: 353790 - protein, 26 aa, Mycobacterium
ESGVDPVLLLLLAALLGLSAGGVYQQ

SEQ ID NO: 353791 - protein, 31 aa, Mycobacterium
ESIRIGVMSLIWLGTLPFMTLAVLASILTDP

SEQ ID NO: 353792 - protein, 30 aa, Mycobacterium
ESKGKVALYLLITIAPFAVIAPLIGPALDR

SEQ ID NO: 353793 - protein, 29 aa, Mycobacterium
ESKGRVALYLLITIAPFAVIAPLIGPALD

SEQ ID NO: 353794 - protein, 30 aa, Mycobacterium; identical to SEQ ID NO: 20526

SEQ ID NO: 353795 - protein, 22 aa, Mycobacterium
ESKGYFLLGIWSSLIYAVVFGI

SEQ ID NO: 353796 - protein, 34 aa, Mycobacterium
ESKMNMPWLFFFSGLAIPAFYAVGLLAGSDAHYT

SEQ ID NO: 353797 - protein, 29 aa, Mycobacterium
ESKMNMPWLFFFSGLAIPTFYAVGLLASS

SEQ ID NO: 353798 - protein, 28 aa, Mycobacterium
ESKPEPPVIPWYRLPAVIIVSTVVAVLL

SEQ ID NO: 353799 - protein, 18 aa, Mycobacterium
ESKPWSWPMSLRPVLYAI

SEQ ID NO: 353800 - protein, 19 aa, Mycobacterium
ESKPWSWPMSLRPVLYAID

SEQ ID NO: 353801 - protein, 19 aa, Mycobacterium
ESKPWTWPMSLRPVLYAID

SEQ ID NO: 353802 - protein, 30 aa, Mycobacterium
ESKSKVALYLLITIAPFAVIAPLIGPALDR

SEQ ID NO: 353803 - protein, 29 aa, Mycobacterium
ESKSKVALYLLITIAPFAVVAPLIGPALD

SEQ ID NO: 353804 - protein, 29 aa, Mycobacterium
ESKSRVALYLLITIAPFAVIAPLIGPALD

SEQ ID NO: 353805 - protein, 30 aa, Mycobacterium
ESKSRVALYLLITIAPFAVIAPLIGPALDK

SEQ ID NO: 353806 - protein, 22 aa, Mycobacterium
ESLIDVLHWPGYLLVVAGVIGG

SEQ ID NO: 353807 - protein, 23 aa, Mycobacterium
ESLSARFVVLLPVVVLGTVLAGG

SEQ ID NO: 353808 - protein, 36 aa, Mycobacterium
ESMLMLTIVTIVVIIIMLLIAYRSFTRAIIPLVGVL

SEQ ID NO: 353809 - protein, 24 aa, Mycobacterium
ESNHYPLAVQVLPGSALGLRIEYD

SEQ ID NO: 353810 - protein, 29 aa, Mycobacterium
ESNPAPPTLWVWIALSGTAFGVLVAGWRG

SEQ ID NO: 353811 - protein, 26 aa, Mycobacterium
ESPAVWLNPWRWYSVPRAAAAALTVD

SEQ ID NO: 353812 - protein, 24 aa, Mycobacterium
ESQAPLVVLTALGSLGLVGVLIST

SEQ ID NO: 353813 - protein, 23 aa, Mycobacterium
ESQPFNFVAPVAGLAALLAAKGV

SEQ ID NO: 353814 - protein, 22 aa, Mycobacterium
ESRKPPVLFVHGAWHGAWCWDE

SEQ ID NO: 353815 - protein, 22 aa, Mycobacterium
ESRLSWVLAVLAGILGATAFTH

SEQ ID NO: 353816 - protein, 25 aa, Mycobacterium
ESSERFLDLLRQILDAANGSDLGLA

SEQ ID NO: 353817 - protein, 26 aa, Mycobacterium
ESSRPRALITVLAVAAVIALVAAVVG

SEQ ID NO: 353818 - protein, 24 aa, Mycobacterium
ESSTWLAIAAWAALAVVAVALIVM

SEQ ID NO: 353819 - protein, 18 aa, Mycobacterium
ESSVGLAFPPLGRGPLID

SEQ ID NO: 353820 - protein, 26 aa, Mycobacterium
ESTAWLLALGLAMIVAAVWSSAALGV

SEQ ID NO: 353821 - protein, 25 aa, Mycobacterium
ESTNRWNWVLDGMVTIGALSAQDRA

SEQ ID NO: 353822 - protein, 25 aa, Mycobacterium
ESTPALRPLVDLLAIAGGSGTMSNR

SEQ ID NO: 353823 - protein, 21 aa, Mycobacterium
ESTSPAPRPAPKLKPVRVARR

SEQ ID NO: 353824 - protein, 30 aa, Mycobacterium
ESVALPLSFLVLVWVFGGVFAAALPVAVGG

SEQ ID NO: 353825 - protein, 18 aa, Mycobacterium
ESVAVRLLWLRTQGATGR

SEQ ID NO: 353826 - protein, 17 aa, Mycobacterium
ESVNRFFNGTSGPLHAM

SEQ ID NO: 353827 - protein, 26 aa, Mycobacterium
ESVSVPSWWQPYVLSVGSVGIDGSPS

SEQ ID NO: 353828 - protein, 27 aa, Mycobacterium
ESVSWPGWAVVGVTLVFGLLIGAVTRG

SEQ ID NO: 353829 - protein, 24 aa, Mycobacterium
ESYGWRIPFLIAGPLGLVGLYIRL

SEQ ID NO: 353830 - protein, 26 aa, Mycobacterium
ESYNKAWLGAIALAVIGALVGAMLLV

SEQ ID NO: 353831 - protein, 24 aa, Mycobacterium
ESYTPWLTRLAAFIIDILPYAVVH

SEQ ID NO: 353832 - protein, 21 aa, Mycobacterium
ETALAVFLYHDLMVSPVTGGR

SEQ ID NO: 353833 - protein, 21 aa, Mycobacterium
ETALGRNVAIKVLPTFGDDES

SEQ ID NO: 353834 - protein, 17 aa, Mycobacterium
ETAQVLGFSFWQRLRVI

SEQ ID NO: 353835 - protein, 24 aa, Mycobacterium
ETARPADLLVLLDSLQQREASLNT

SEQ ID NO: 353836 - protein, 24 aa, Mycobacterium
ETARPADLLVLLDSLRQREATLNA

SEQ ID NO: 353837 - protein, 24 aa, Mycobacterium
ETARPADLLVLLDSLRQREGTLNA

SEQ ID NO: 353838 - protein, 23 aa, Mycobacterium
ETDGQLWIDMDYVDGVDAVRLLR

SEQ ID NO: 353839 - protein, 29 aa, Mycobacterium
ETERMTRLVEDLLLLARLDSGRPLERESV

SEQ ID NO: 353840 - protein, 23 aa, Mycobacterium
ETFDVVGMLLLSPGLPAFLYGMS

SEQ ID NO: 353841 - protein, 23 aa, Mycobacterium
ETFIWLTLALAGVWAAGAFASGP

SEQ ID NO: 353842 - protein, 28 aa, Mycobacterium
ETFLSWGWRIPFLLSAIVIVVGLYIRLR

SEQ ID NO: 353843 - protein, 20 aa, Mycobacterium
ETFWGFWPRSVWGALRSSWN

SEQ ID NO: 353844 - protein, 24 aa, Mycobacterium
ETGLPFWIIASCALAIGLGTYLGG

SEQ ID NO: 353845 - protein, 23 aa, Mycobacterium
ETGVRGYLITADRQFLAPYYDGQ

SEQ ID NO: 353846 - protein, 33 aa, Mycobacterium
ETIALLAHIAIMLVFLLIVLHSKHLHIGLAPIN

SEQ ID NO: 353847 - protein, 21 aa, Mycobacterium
ETLAITLFEKIQGPLSSIGDG

SEQ ID NO: 353848 - protein, 18 aa, Mycobacterium
ETLMFFAGLFIMVGALVK

SEQ ID NO: 353849 - protein, 29 aa, Mycobacterium
ETLVALAWFPLWLILLAVGWLVVRRRPGR

SEQ ID NO: 353850 - protein, 46 aa, Mycobacterium
ETNNLHRRVLLICAFAIGAAAVFAWLLAVFAVRPFKQLAEQTRSID

SEQ ID NO: 353851 - protein, 45 aa, Mycobacterium
ETNNLHRRVLLICTFAIGAATVFAWLLAVFAVRPFKQLAEQTRSI

SEQ ID NO: 353852 - protein, 23 aa, Mycobacterium
ETPAFWIFFACYIGAAILTWVRY

SEQ ID NO: 353853 - protein, 35 aa, Mycobacterium
ETPAPQARWIRPAYWAMLVGTAVLYLWGLGSKGWA

SEQ ID NO: 353854 - protein, 27 aa, Mycobacterium
ETPAYWIFLACYVAAALLAWVRYGRPR

SEQ ID NO: 353855 - protein, 23 aa, Mycobacterium
ETPILDQLRRAYGPEFLDDIFKP

SEQ ID NO: 353856 - protein, 24 aa, Mycobacterium
ETRARWDRYALFAQRTFNVEIPEI

SEQ ID NO: 353857 - protein, 23 aa, Mycobacterium
ETRQWIDIPEVLQPGSYKPPPDI

SEQ ID NO: 353858 - protein, 20 aa, Mycobacterium
ETRRRPVCSIAIVIAGGIGC

SEQ ID NO: 353859 - protein, 34 aa, Mycobacterium
ETRSAFHRFFANRWLWAAIGLSALLQVAVVQLPV

SEQ ID NO: 353860 - protein, 25 aa, Mycobacterium
ETRSLSPALEPVWRLTRGRGQVVAV

SEQ ID NO: 353861 - protein, 24 aa, Mycobacterium
ETRWFQWSVVSDHGLLFGAGRDVT

SEQ ID NO: 353862 - protein, 41 aa, Mycobacterium
ETSVMLLLKMFVPDNAFGVLYLIGVLIVATGWGAGLTTGTA

SEQ ID NO: 353863 - protein, 42 aa, Mycobacterium
ETTALLAHIAVMLAFLIIVLHSKHLHIFLAPINVTFKRLPDG

SEQ ID NO: 353864 - protein, 26 aa, Mycobacterium
ETTITPFPIWQILQILLDAVVGVLHC

SEQ ID NO: 353865 - protein, 27 aa, Mycobacterium
ETVALLLHIAVMLAFLIIVLHSKHMHI

SEQ ID NO: 353866 - protein, 34 aa, Mycobacterium
ETVALLLHIGVMLAFLIIVLHSKHLHIFLAPINV

SEQ ID NO: 353867 - protein, 31 aa, Mycobacterium
ETVDAGLWVAFWFFLAQLNFVLGAINLVPLL

SEQ ID NO: 353868 - protein, 34 aa, Mycobacterium
ETVEHDMWIMFWILLAQLNFALGAINLLPLLPFD

SEQ ID NO: 353869 - protein, 30 aa, Mycobacterium
ETVFHGFPFGLFFIALVTALILVLAANTAF

SEQ ID NO: 353870 - protein, 19 aa, Mycobacterium
ETVLLIFTLNLLLAEIGAA

SEQ ID NO: 353871 - protein, 21 aa, Mycobacterium
ETVLLSFERWAPDMPWEVSTG

SEQ ID NO: 353872 - protein, 25 aa, Mycobacterium
ETVLTSWLWPMWAGIGVIVAGTLVA

SEQ ID NO: 353873 - protein, 25 aa, Mycobacterium
ETVMGRRQFLPPLCTWFAAMLFAVV

SEQ ID NO: 353874 - protein, 19 aa, Mycobacterium
ETVPPDSVWWWVCVSLLAL

SEQ ID NO: 353875 - protein, 22 aa, Mycobacterium
ETVSPWFRSIWVLQPRGDLMVE

SEQ ID NO: 353876 - protein, 30 aa, Mycobacterium
EVAGRALMYLGFIPPVWLAAVGALSVSKIL

SEQ ID NO: 353877 - protein, 26 aa, Mycobacterium
EVAGVWPLTGWGIGVLLGGALYTAVI

SEQ ID NO: 353878 - protein, 18 aa, Mycobacterium
EVAIPLLTPAFLGSALLL

SEQ ID NO: 353879 - protein, 19 aa, Mycobacterium
EVALAALLSQLGVVPDLVL

SEQ ID NO: 353880 - protein, 24 aa, Mycobacterium
EVALYSFIVLLITGVYLTLFFDPS

SEQ ID NO: 353881 - protein, 25 aa, Mycobacterium
EVARMRALKMPFYRSLISATNWLLG

SEQ ID NO: 353882 - protein, 25 aa, Mycobacterium
EVASFAWQFVFYLGQIVVAYGVMLL

SEQ ID NO: 353883 - protein, 20 aa, Mycobacterium
EVAVFLFFGLVAVLGTQYTQ

SEQ ID NO: 353884 - protein, 21 aa, Mycobacterium
EVAVFVFFGLVAVLGTEYTQA

SEQ ID NO: 353885 - protein, 25 aa, Mycobacterium
EVAVPLLMPAFLGSALLLFANAFAA

SEQ ID NO: 353886 - protein, 26 aa, Mycobacterium
EVDHWLPGLYAVILGLYAAAAVLWLV

SEQ ID NO: 353887 - protein, 19 aa, Mycobacterium
EVDSVGRLPWLAEAEVLYW

SEQ ID NO: 353888 - protein, 27 aa, Mycobacterium
EVEDQLFRFGRLLDSQSQLSRLLADTT

SEQ ID NO: 353889 - protein, 27 aa, Mycobacterium
EVEEQLFRFGRVLDAEPRLSALLSDYT

SEQ ID NO: 353890 - protein, 20 aa, Mycobacterium
EVEEVLPLLPLQEGMYFHSM

SEQ ID NO: 353891 - protein, 25 aa, Mycobacterium
EVERIWLPFTIWLTAATALLPVRSH

SEQ ID NO: 353892 - protein, 25 aa, Mycobacterium
EVFGGLLLLLPRTTAAGALVCVVDL

SEQ ID NO: 353893 - protein, 17 aa, Mycobacterium
EVFKLVASIYLRSVLTG

SEQ ID NO: 353894 - protein, 21 aa, Mycobacterium
EVFPKWFAYVSIWQIITEVIA

SEQ ID NO: 353895 - protein, 25 aa, Mycobacterium
EVGCPLVQELTLLAPLALPQTGTVR

SEQ ID NO: 353896 - protein, 24 aa, Mycobacterium
EVGDDEFWMLMAGKKLSARDRRVL

SEQ ID NO: 353897 - protein, 24 aa, Mycobacterium
EVGEAAMLAFLFAISEGLEEYSIT

SEQ ID NO: 353898 - protein, 24 aa, Mycobacterium
EVGEAAMLAFLFSISEGLEEYALA

SEQ ID NO: 353899 - protein, 27 aa, Mycobacterium
EVGLEYEAWFLAAAVRRGWVVAVTDYP

SEQ ID NO: 353900 - protein, 24 aa, Mycobacterium
EVGPPRLPLWPVSARTRAALCAQA

SEQ ID NO: 353901 - protein, 23 aa, Mycobacterium
EVGQRVVLNPWLSCRPRGIEPPC

SEQ ID NO: 353902 - protein, 23 aa, Mycobacterium
EVGRRLRILIIAALAGAGISTQE

SEQ ID NO: 353903 - protein, 24 aa, Mycobacterium
EVGSFLFNLIIYTALISFSIWYFW

SEQ ID NO: 353904 - protein, 24 aa, Mycobacterium
EVGTTPKRWLDVQRATRARELLEN

SEQ ID NO: 353905 - protein, 23 aa, Mycobacterium
EVHDLHVWTLVPGKDMVTAHLTS

SEQ ID NO: 353906 - protein, 20 aa, Mycobacterium
EVHRVPRPVPAPAGPVERHG

SEQ ID NO: 353907 - protein, 17 aa, Mycobacterium
EVIARLRAGRYQVSMLT

SEQ ID NO: 353908 - protein, 18 aa, Mycobacterium
EVIFWHTYPVRGHLPSVR

SEQ ID NO: 353909 - protein, 25 aa, Mycobacterium
EVILGILLLIGWKPSLVGAVSCLLL

SEQ ID NO: 353910 - protein, 21 aa, Mycobacterium
EVIRLVRRLVPALVVVLAGCA

SEQ ID NO: 353911 - protein, 31 aa, Mycobacterium
EVLAAIINGLLLFGVAFYVLYEAVRRFLAPP

SEQ ID NO: 353912 - protein, 18 aa, Mycobacterium
EVLALLELGERRADDRRV

SEQ ID NO: 353913 - protein, 20 aa, Mycobacterium
EVLFSSLLWIDGRNLEPYLL

SEQ ID NO: 353914 - protein, 20 aa, Mycobacterium
EVLGDVFYRSLKLSWHADLL

SEQ ID NO: 353915 - protein, 17 aa, Mycobacterium
EVLLGVVLALLGQGRPD

SEQ ID NO: 353916 - protein, 34 aa, Mycobacterium
EVLMWVPLPLLGLPPWMVFFGFSVSLIYQFWVHT

SEQ ID NO: 353917 - protein, 18 aa, Mycobacterium
EVLPLLPTAAMVWGVART

SEQ ID NO: 353918 - protein, 39 aa, Mycobacterium
EVLRMVIGGAALALLGVRRYVFKRPPLLSPSGQLVATGA

SEQ ID NO: 353919 - protein, 18 aa, Mycobacterium
EVLSPFKVPSVWALLDDE

SEQ ID NO: 353920 - protein, 23 aa, Mycobacterium
EVLVGLGMRTWADGRTLLLGSPG

SEQ ID NO: 353921 - protein, 21 aa, Mycobacterium
EVLVYAWLMPASTVVQAVIGG

SEQ ID NO: 353922 - protein, 20 aa, Mycobacterium
EVLWHLRPLAIGCGLIVAAL

SEQ ID NO: 353923 - protein, 24 aa, Mycobacterium
EVMNALLLPIVLGLLLALEARALP

SEQ ID NO: 353924 - protein, 24 aa, Mycobacterium
EVMNALLLPIVLGLLLVLEAHTLP

SEQ ID NO: 353925 - protein, 24 aa, Mycobacterium
EVNRPDVPIVLRIYDRTLGDAVAK

SEQ ID NO: 353926 - protein, 31 aa, Mycobacterium
EVNSLLERVQPTLPILLANLVSVGQVALAYQ

SEQ ID NO: 353927 - protein, 18 aa, Mycobacterium
EVPADFTPPSLPPVAPVT

SEQ ID NO: 353928 - protein, 32 aa, Mycobacterium
EVPDSWGIALLYLCCSGSFLGFAFAFGEVLGH

SEQ ID NO: 353929 - protein, 17 aa, Mycobacterium
EVPGDRLLIAPIGRTRE

SEQ ID NO: 353930 - protein, 25 aa, Mycobacterium
EVPGMLLGTYFLVSALIGKPLTELL

SEQ ID NO: 353931 - protein, 23 aa, Mycobacterium
EVPILSGLGLTMTGARPGGFGDL

SEQ ID NO: 353932 - protein, 17 aa, Mycobacterium
EVPVLVGLVYVSLALRA

SEQ ID NO: 353933 - protein, 18 aa, Mycobacterium
EVQRLLLAGPDPSALAAA

SEQ ID NO: 353934 - protein, 17 aa, Mycobacterium
EVRLLRIASPLFHYGIL

SEQ ID NO: 353935 - protein, 36 aa, Mycobacterium
EVRPRLILGASLITLSVLGLRHLWSGSPGDPEARRR

SEQ ID NO: 353936 - protein, 31 aa, Mycobacterium
EVRQLFDRLRPTLPIMLANLVSIGQVAVTYR

SEQ ID NO: 353937 - protein, 22 aa, Mycobacterium
EVSPPLIPLAVSAFLTSRKKAA

SEQ ID NO: 353938 - protein, 17 aa, Mycobacterium
EVTLVFKSLVVVSVVLL

SEQ ID NO: 353939 - protein, 21 aa, Mycobacterium
EVVDTLLSPALWIGRQQADDP

SEQ ID NO: 353940 - protein, 24 aa, Mycobacterium
EVVGEVLYVGALLLGEFLATVLEV

SEQ ID NO: 353941 - protein, 33 aa, Mycobacterium
EVVMFFNIVAFGLALAWLVTIWASAGLSPHTRP

SEQ ID NO: 353942 - protein, 17 aa, Mycobacterium
EVVRMTVFPYGRSGMIA

SEQ ID NO: 353943 - protein, 24 aa, Mycobacterium
EVYAPLALVFLFTGADSIIGAKVV

SEQ ID NO: 353944 - protein, 27 aa, Mycobacterium
EWAPATLLIVAALTILAPGALLSAVTP

SEQ ID NO: 353945 - protein, 28 aa, Mycobacterium
EWAPATLLIVATLTILAPGALLSAVTPM

SEQ ID NO: 353946 - protein, 29 aa, Mycobacterium
EWAQRLPGPGWLIPVALVAFCAAVARTLV

SEQ ID NO: 353947 - protein, 30 aa, Mycobacterium
EWARTALALMRIGAVLVPLSTLLTPPELDA

SEQ ID NO: 353948 - protein, 18 aa, Mycobacterium
EWDWVKWLPHFGDSRRHD

SEQ ID NO: 353949 - protein, 18 aa, Mycobacterium
EWDYLYRLRAIVLTGLGK

SEQ ID NO: 353950 - protein, 21 aa, Mycobacterium
EWETLLFFAGLFIMIGALVKT

SEQ ID NO: 353951 - protein, 21 aa, Mycobacterium
EWETLLFFAGLFIMVGALVKT

SEQ ID NO: 353952 - protein, 28 aa, Mycobacterium
EWIEYLCLMPIFPLALWLMNVYAAIRYR

SEQ ID NO: 353953 - protein, 18 aa, Mycobacterium
EWLAYVLFALLVLVLLRM

SEQ ID NO: 353954 - protein, 22 aa, Mycobacterium
EWLKQIPDFELPPGYTAYIKFP

SEQ ID NO: 353955 - protein, 17 aa, Mycobacterium
EWLLVQSLIHARPEHNT

SEQ ID NO: 353956 - protein, 31 aa, Mycobacterium
EWLQSWTIFYWAWWVSWTPFVGMFIARISRG

SEQ ID NO: 353957 - protein, 26 aa, Mycobacterium
EWLRIGVMAVLYILTIPVVSIGVLLS

SEQ ID NO: 353958 - protein, 24 aa, Mycobacterium
EWMPNFIALLQRKLSRIGDPVLQK

SEQ ID NO: 353959 - protein, 29 aa, Mycobacterium
EWNVLFAYATIFLFLGFPAWQGYGVTSMS

SEQ ID NO: 353960 - protein, 26 aa, Mycobacterium
EWPIGRTISWLFGCGFLLIATSSGVG

SEQ ID NO: 353961 - protein, 25 aa, Mycobacterium
EWQRRWSDALALWSRFTRLREPQLC

SEQ ID NO: 353962 - protein, 28 aa, Mycobacterium
EWTEYLCLMPIFPLAFWLMNVYAAIRYR

SEQ ID NO: 353963 - protein, 17 aa, Mycobacterium
EWVPRYACYEDARLVPR

SEQ ID NO: 353964 - protein, 18 aa, Mycobacterium
EWVPRYACYEDARLVPRV

SEQ ID NO: 353965 - protein, 28 aa, Mycobacterium
EWWTENLRYYYLILPTTDGAISRRVAFV

SEQ ID NO: 353966 - protein, 28 aa, Mycobacterium
EWWTENLRYYYLILPTVDGAIARRVAFM

SEQ ID NO: 353967 - protein, 24 aa, Mycobacterium
EYASWRYVFVLIAALSVVVGLAVT

SEQ ID NO: 353968 - protein, 26 aa, Mycobacterium
EYDTYGDFPAYFNPLALANSIAAIQY

SEQ ID NO: 353969 - protein, 24 aa, Mycobacterium
EYFSFLINLLLVFGVSFEFPLLIV

SEQ ID NO: 353970 - protein, 27 aa, Mycobacterium
EYGDRVNFVLRYFPLPGHFNAERAARA

SEQ ID NO: 353971 - protein, 24 aa, Mycobacterium
EYLATLLAVLLLGAVPCAIAPPPT

SEQ ID NO: 353972 - protein, 25 aa, Mycobacterium
EYLCLMPIFPLALWLMNVYAAIRYR

SEQ ID NO: 353973 - protein, 24 aa, Mycobacterium
EYLNQTWFVARVSLVPALMLTVPY

SEQ ID NO: 353974 - protein, 18 aa, Mycobacterium
EYRDLELTMAVFTRLLDR

SEQ ID NO: 353975 - protein, 29 aa, Mycobacterium
EYRFERAWPLLWFVVIGLVAAAVGYLYAR

SEQ ID NO: 353976 - protein, 25 aa, Mycobacterium
EYRWKPLTWLLALLAGVAPLCSVIF

SEQ ID NO: 353977 - protein, 26 aa, Mycobacterium
EYSWFIGCGVALVVYYLLATRGRLAI

SEQ ID NO: 353978 - protein, 24 aa, Mycobacterium
EYWKKGLRHSVYFTHGIRNAVDSG

SEQ ID NO: 353979 - protein, 17 aa, Mycobacterium
EYWMAAPWQWRVDGRDH

SEQ ID NO: 353980 - protein, 22 aa, Mycobacterium
FAAAFFMRPLGGFFFGPLGDRI

SEQ ID NO: 353981 - protein, 22 aa, Mycobacterium
FAAAMIGWGGLVLILLACNQVD

SEQ ID NO: 353982 - protein, 33 aa, Mycobacterium
FAAEPMRVSAWLRLPLIGLIVLLGSDPNIQMWH

SEQ ID NO: 353983 - protein, 26 aa, Mycobacterium
FAAFALIAFVFVYRYAPETKGRQLED

SEQ ID NO: 353984 - protein, 20 aa, Mycobacterium
FAAFPHWYATVFSGLYLPLL

SEQ ID NO: 353985 - protein, 24 aa, Mycobacterium
FAAFYVLLLLEVLVGWATNRRWPR

SEQ ID NO: 353986 - protein, 25 aa, Mycobacterium
FAAGLAPTPILFAGALFLAGACDSI

SEQ ID NO: 353987 - protein, 17 aa, Mycobacterium
FAAIFLAGGLMFSLTVC

SEQ ID NO: 353988 - protein, 25 aa, Mycobacterium
FAAIPPTRFKRKPHWLDVNFTGDSS

SEQ ID NO: 353989 - protein, 18 aa, Mycobacterium
FAAIPYVVGIVGIGGVLL

SEQ ID NO: 353990 - protein, 25 aa, Mycobacterium
FAALGFLPAYLLSLGLKKAGLLRIP

SEQ ID NO: 353991 - protein, 17 aa, Mycobacterium
FAALWPMSLAFCAQLFV

SEQ ID NO: 353992 - protein, 20 aa, Mycobacterium
FAALYALYRALAIGPMGVVS

SEQ ID NO: 353993 - protein, 28 aa, Mycobacterium
FAAPILVVMVLLIIPLGQLSLGGISEKY

SEQ ID NO: 353994 - protein, 20 aa, Mycobacterium
FAATVPVCWLLMGQPLGNLP

SEQ ID NO: 353995 - protein, 26 aa, Mycobacterium
FAAWLADWRFLAICGVLALIATLALL

SEQ ID NO: 353996 - protein, 20 aa, Mycobacterium
FAAYTIVRLLGSGPTGEVYL

SEQ ID NO: 353997 - protein, 24 aa, Mycobacterium
FACDPPLVQLLQGATVEQLAALLT

SEQ ID NO: 353998 - protein, 18 aa, Mycobacterium
FACILAFHNVASRYVFAL

SEQ ID NO: 353999 - protein, 21 aa, Mycobacterium
FACYGLAYFVLTPVAGWLIDR

SEQ ID NO: 354000 - protein, 41 aa, Mycobacterium
FADAGALTLRLLTIAFCVLLYLLPLILGRWRGETTHDRRAA

SEQ ID NO: 354001 - protein, 19 aa, Mycobacterium
FADAWVRIAIAAVAAHRRG

SEQ ID NO: 354002 - protein, 19 aa, Mycobacterium
FADFPQYPLNIPADLNALL

SEQ ID NO: 354003 - protein, 17 aa, Mycobacterium
FADGRALDWREAFAGLG

SEQ ID NO: 354004 - protein, 21 aa, Mycobacterium
FADLLILPILNIYRKYYGTKM

SEQ ID NO: 354005 - protein, 21 aa, Mycobacterium
FADQAFVRALPWLAGQLDTPQ

SEQ ID NO: 354006 - protein, 18 aa, Mycobacterium
FADRLAWSLTVLVAVAWI

SEQ ID NO: 354007 - protein, 35 aa, Mycobacterium
FAEQVRISRFQTLLLKWAMMVLLGLLTSAVYVWIA

SEQ ID NO: 354008 - protein, 18 aa, Mycobacterium
FAESYWPSFALTGLLLCG

SEQ ID NO: 354009 - protein, 17 aa, Mycobacterium
FAFAVKAPLWPFHRWLP

SEQ ID NO: 354010 - protein, 18 aa, Mycobacterium
FAFKAMGIVLPIAGFFFI

SEQ ID NO: 354011 - protein, 17 aa, Mycobacterium
FAFLLGLSLAIINATFP

SEQ ID NO: 354012 - protein, 26 aa, Mycobacterium
FAFLTKMLQAFLIVPGLALAFLVAAP

SEQ ID NO: 354013 - protein, 21 aa, Mycobacterium
FAFPPTGFTLAWWADAARSPG

SEQ ID NO: 354014 - protein, 18 aa, Mycobacterium
FAFPVFGFGVIFGAIWAE

SEQ ID NO: 354015 - protein, 17 aa, Mycobacterium
FAGLKGAVPILLGELLR

SEQ ID NO: 354016 - protein, 30 aa, Mycobacterium
FAGLKRHLPRQIPIYGLQSPLFTGTPLPES

SEQ ID NO: 354017 - protein, 29 aa, Mycobacterium
FAGTAAHDWLFVTLVFALGALSFGVGSTL

SEQ ID NO: 354018 - protein, 27 aa, Mycobacterium
FAGVNLWKFFLYIKDEMFLALGTASTE

SEQ ID NO: 354019 - protein, 18 aa, Mycobacterium
FAGVTLTAILVAFLADLL

SEQ ID NO: 354020 - protein, 17 aa, Mycobacterium
FAGYTILRVLGAGAMGT

SEQ ID NO: 354021 - protein, 18 aa, Mycobacterium
FAGYTILRVLGAGAMGTV

SEQ ID NO: 354022 - protein, 20 aa, Mycobacterium
FAIALLILLGGPGWLRWAGA

SEQ ID NO: 354023 - protein, 29 aa, Mycobacterium
FAIAVMALAFMMMPFVLGYDIANAVIYWI

SEQ ID NO: 354024 - protein, 29 aa, Mycobacterium
FAIIFGVPVWGFAMLWIALATALTVRTLL

SEQ ID NO: 354025 - protein, 29 aa, Mycobacterium
FAIIFGVPVWGFAMLWIALSTALTMRTLR

SEQ ID NO: 354026 - protein, 32 aa, Mycobacterium
FAIITVLTLTVMGIFYLRLPATFGIGTYEVSA

SEQ ID NO: 354027 - protein, 27 aa, Mycobacterium
FAIKAAVFPLSTWLPDSYPTAPAPVTA

SEQ ID NO: 354028 - protein, 27 aa, Mycobacterium
FAIMHLLTHGFFKAGLFLGSGSVIHAM

SEQ ID NO: 354029 - protein, 37 aa, Mycobacterium
FAIPTYAFMIGMYLMLGWGLFQIYVLGTPLRAESASF

SEQ ID NO: 354030 - protein, 24 aa, Mycobacterium
FAIVRNPIFSAMLIFAAGITLMAP

SEQ ID NO: 354031 - protein, 17 aa, Mycobacterium
FAIWPFTRLVHAFSAPV

SEQ ID NO: 354032 - protein, 20 aa, Mycobacterium
FAIYVITILGVIFLNLLEGV

SEQ ID NO: 354033 - protein, 18 aa, Mycobacterium
FALFAARFKGAPSAIVLL

SEQ ID NO: 354034 - protein, 18 aa, Mycobacterium
FALFAITAVYAAWLHFVD

SEQ ID NO: 354035 - protein, 28 aa, Mycobacterium
FALFGTKKLLWFGLAMIIVFGVVHALFY

SEQ ID NO: 354036 - protein, 22 aa, Mycobacterium
FALFIFWLLLIARVVVEFIRSF

SEQ ID NO: 354037 - protein, 25 aa, Mycobacterium
FALGIAMLLGGSWLTCLVAALTSAA

SEQ ID NO: 354038 - protein, 27 aa, Mycobacterium
FALGNAILIIPLGLVPSWVALASTSID

SEQ ID NO: 354039 - protein, 23 aa, Mycobacterium
FALGNALPLLAFALAGRRVAERV

SEQ ID NO: 354040 - protein, 21 aa, Mycobacterium
FALLFGTTWLVNALVFACVLV

SEQ ID NO: 354041 - protein, 18 aa, Mycobacterium
FALLGYLLATFKPATLWN

SEQ ID NO: 354042 - protein, 18 aa, Mycobacterium
FALLLLLVTVNYVDRGSL

SEQ ID NO: 354043 - protein, 19 aa, Mycobacterium
FALLVGMSALIVFVGSLFG

SEQ ID NO: 354044 - protein, 17 aa, Mycobacterium
FALLVNGVLLTLKNLHG

SEQ ID NO: 354045 - protein, 24 aa, Mycobacterium
FALSGWLGLYLLARDPRKPVLVLA

SEQ ID NO: 354046 - protein, 18 aa, Mycobacterium
FALSMLQADIIGALFVLG

SEQ ID NO: 354047 - protein, 23 aa, Mycobacterium
FALSNILFLVAAFRPGRNPELVM

SEQ ID NO: 354048 - protein, 25 aa, Mycobacterium
FALSVPRFPRGWLTEPNLAVVAVVV

SEQ ID NO: 354049 - protein, 25 aa, Mycobacterium
FALSWWLGLYLLARDPRKPMLVLAA

SEQ ID NO: 354050 - protein, 30 aa, Mycobacterium
FALVFGLTLMWLLSWLIATPVRVVRSALKQ

SEQ ID NO: 354051 - protein, 29 aa, Mycobacterium
FALVKTGFWRVLGIWLLASLVASVIASAV

SEQ ID NO: 354052 - protein, 25 aa, Mycobacterium
FALVLGALAFLFLASVALVLCAEVN

SEQ ID NO: 354053 - protein, 26 aa, Mycobacterium
FALVLGLLAFLFLVSSTLVLCAEINV

SEQ ID NO: 354054 - protein, 17 aa, Mycobacterium
FALVVFVELAALAVPGR

SEQ ID NO: 354055 - protein, 18 aa, Mycobacterium
FAMFASEVAIARSLASAG

SEQ ID NO: 354056 - protein, 20 aa, Mycobacterium
FAMFNVFYQSGILLGPLVGL

SEQ ID NO: 354057 - protein, 17 aa, Mycobacterium
FAMFVFAAVFTPGSDPF

SEQ ID NO: 354058 - protein, 24 aa, Mycobacterium
FANHEKWINLIIHIGQEGRGANVF

SEQ ID NO: 354059 - protein, 25 aa, Mycobacterium
FANHEKWIQLIIHIGQEGRGANVFF

SEQ ID NO: 354060 - protein, 25 aa, Mycobacterium
FANIDRQMYFFYAATMAPFLVMAIA

SEQ ID NO: 354061 - protein, 17 aa, Mycobacterium
FANIFGPLTELARPIPA

SEQ ID NO: 354062 - protein, 25 aa, Mycobacterium
FANVFRFLDVQWLFPEYPMHWGTLG

SEQ ID NO: 354063 - protein, 36 aa, Mycobacterium
FANWKRAMDLLGQGALWLWNNAISPAWEGIKTAISA

SEQ ID NO: 354064 - protein, 20 aa, Mycobacterium
FAQLVGLIFAVLGTAGFAAG

SEQ ID NO: 354065 - protein, 25 aa, Mycobacterium
FAQQSAWLRIFAVGLMFAGVTTTAL

SEQ ID NO: 354066 - protein, 20 aa, Mycobacterium
FARDFMRIEIGIVSVVLVVC

SEQ ID NO: 354067 - protein, 24 aa, Mycobacterium
FARITSVLTWIWIAAFAGMTVSSA

SEQ ID NO: 354068 - protein, 25 aa, Mycobacterium
FARLGRFSRTLVLAVAIMIFAICVA

SEQ ID NO: 354069 - protein, 27 aa, Mycobacterium
FARLLLIWTAIATVALVLVGCIRVVDG

SEQ ID NO: 354070 - protein, 26 aa, Mycobacterium
FARPFVPWLGWPMLAVVALSTAVRWR

SEQ ID NO: 354071 - protein, 38 aa, Mycobacterium
FARPLKADPLLYPFQPIHVTIAAWFTIGIPSFILSLAP

SEQ ID NO: 354072 - protein, 18 aa, Mycobacterium
FARWVVRTPWPVFSLSML

SEQ ID NO: 354073 - protein, 29 aa, Mycobacterium
FASGTAWLVPMLYIAVALSVVLWAGMAYS

SEQ ID NO: 354074 - protein, 39 aa, Mycobacterium
FASHGSPWLLPLRWPMVEYFYLKYYLPRARSRPVAEVAE

SEQ ID NO: 354075 - protein, 38 aa, Mycobacterium
FASHGSPWLLPLRWSLVEYYYLKYYIPRARSRPVVEFA

SEQ ID NO: 354076 - protein, 27 aa, Mycobacterium
FASHRQRFWFWLSVATLGFNVALNLAL

SEQ ID NO: 354077 - protein, 27 aa, Mycobacterium
FASLFSSLVQLIPKAALAGLLIVIGIQ

SEQ ID NO: 354078 - protein, 24 aa, Mycobacterium
FASRVPAEIACRLLHAPMSDAHSV

SEQ ID NO: 354079 - protein, 19 aa, Mycobacterium
FASVPMLFATPTYYAEFSD

SEQ ID NO: 354080 - protein, 17 aa, Mycobacterium
FATALAFVLSFADRRFR

SEQ ID NO: 354081 - protein, 18 aa, Mycobacterium
FATGPPPPALPYIDVDNP

SEQ ID NO: 354082 - protein, 24 aa, Mycobacterium
FATGPPPPALPYLDVANPGPTDPA

SEQ ID NO: 354083 - protein, 24 aa, Mycobacterium
FATGPPPPALPYLDVDDPGPTDPA

SEQ ID NO: 354084 - protein, 18 aa, Mycobacterium
FATGPPPPGIPYLDTENP

SEQ ID NO: 354085 - protein, 27 aa, Mycobacterium
FATGVTVFTGYPFLRGALRSLRSGKAG

SEQ ID NO: 354086 - protein, 27 aa, Mycobacterium
FATIGMWAPIALVLLRILQGLGAGAEF

SEQ ID NO: 354087 - protein, 27 aa, Mycobacterium
FATLGLLIPVLAWPPSAPLLLLPVLVS

SEQ ID NO: 354088 - protein, 27 aa, Mycobacterium
FATLISRLTGFARVVLLAAILGAALSS

SEQ ID NO: 354089 - protein, 25 aa, Mycobacterium
FATTDDMFLALFKAVIFGAIVAVVS

SEQ ID NO: 354090 - protein, 23 aa, Mycobacterium
FATWLLLLVPSIYLALNQSSNLT

SEQ ID NO: 354091 - protein, 24 aa, Mycobacterium
FAVAAYALIVIPGPSVLFAVGRSL

SEQ ID NO: 354092 - protein, 23 aa, Mycobacterium
FAVAGVLALSLVFGGTAVAAPVW

SEQ ID NO: 354093 - protein, 17 aa, Mycobacterium
FAVERLGVALMALGIIN

SEQ ID NO: 354094 - protein, 19 aa, Mycobacterium
FAVGLLRRQDAVETFTAAV

SEQ ID NO: 354095 - protein, 18 aa, Mycobacterium
FAVIAGLVTFVLVGAITS

SEQ ID NO: 354096 - protein, 25 aa, Mycobacterium
FAVIAVMLLVVYRSLITTALVLAMV

SEQ ID NO: 354097 - protein, 28 aa, Mycobacterium
FAVIITMLLLVYRSIVTVILTLVMVVLS

SEQ ID NO: 354098 - protein, 26 aa, Mycobacterium
FAVIITMLLLVYRSIVTVLITMGMVV

SEQ ID NO: 354099 - protein, 17 aa, Mycobacterium
FAVIVTLAWFAVTFTFN

SEQ ID NO: 354100 - protein, 32 aa, Mycobacterium
FAVKVHWSVLVILWLFTWSLATTLPETAKGYG

SEQ ID NO: 354101 - protein, 17 aa, Mycobacterium
FAVLLVAFGIKAAVFPL

SEQ ID NO: 354102 - protein, 28 aa, Mycobacterium
FAVLYGVPVWGFAVLWIALATALTVRTL

SEQ ID NO: 354103 - protein, 26 aa, Mycobacterium
FAVLYGVPVWGFAVLWIGLATALTVR

SEQ ID NO: 354104 - protein, 17 aa, Mycobacterium
FAVMFAAGALLYQWRDK

SEQ ID NO: 354105 - protein, 36 aa, Mycobacterium
FAVPGIAGLLGRWFWWSPPAFLLGPLRRRTSQQPGP

SEQ ID NO: 354106 - protein, 25 aa, Mycobacterium
FAVQDSLFWVAFIVAITGAAAVIPA

SEQ ID NO: 354107 - protein, 19 aa, Mycobacterium
FAVVAVGFLAALWMMLMLA

SEQ ID NO: 354108 - protein, 17 aa, Mycobacterium
FAVVILIIAGGVSYLAS

SEQ ID NO: 354109 - protein, 46 aa, Mycobacterium
FAVVIVAVARWRGLLALVGILVAFVVLVMFLLPALRDGAPAVPVAL

SEQ ID NO: 354110 - protein, 26 aa, Mycobacterium
FAWALSVMFLVFTLRALLYKPFVRQI

SEQ ID NO: 354111 - protein, 27 aa, Mycobacterium
FAWALSVMFLVFTLRALLYKPFVRQIR

SEQ ID NO: 354112 - protein, 18 aa, Mycobacterium
FAWAWVCRLLVTMSVLLV

SEQ ID NO: 354113 - protein, 20 aa, Mycobacterium
FAWLNWITIVLACGVVSDTA

SEQ ID NO: 354114 - protein, 26 aa, Mycobacterium
FAYGAVPFIFIFSYALHPSTYVWVLD

SEQ ID NO: 354115 - protein, 23 aa, Mycobacterium
FAYGGWFWVIKVSHAATSVACPW

SEQ ID NO: 354116 - protein, 32 aa, Mycobacterium
FAYRRTDWVRLILPYAGFFGTAVLFAFHVVTG

SEQ ID NO: 354117 - protein, 20 aa, Mycobacterium
FCAACWLIALLARNYRHEDW

SEQ ID NO: 354118 - protein, 26 aa, Mycobacterium
FCALTAMFVLVVAWSPPYGNWVGAAA

SEQ ID NO: 354119 - protein, 18 aa, Mycobacterium
FCAVIIVGLLAGVAGLAT

SEQ ID NO: 354120 - protein, 27 aa, Mycobacterium
FCFVYFGLFCLVFAQILFVFTGFVGRW

SEQ ID NO: 354121 - protein, 28 aa, Mycobacterium
FCLTSTLWFFLTWFPTYLVEYRGMDYIK

SEQ ID NO: 354122 - protein, 19 aa, Mycobacterium
FCMSFTHLPYFHSLGAPCS

SEQ ID NO: 354123 - protein, 22 aa, Mycobacterium
FCTELFLPRNYAVAVTFVTPIA

SEQ ID NO: 354124 - protein, 18 aa, Mycobacterium
FCVGMAVLLVGFYAVDVL

SEQ ID NO: 354125 - protein, 18 aa, Mycobacterium
FDAAIGLALLSRGRSHAS

SEQ ID NO: 354126 - protein, 17 aa, Mycobacterium
FDADYWVDNLRNPVRFE

SEQ ID NO: 354127 - protein, 18 aa, Mycobacterium
FDAGYFWHYNELWLGGAA

SEQ ID NO: 354128 - protein, 17 aa, Mycobacterium
FDAGYFWHYNELWVGGA

SEQ ID NO: 354129 - protein, 22 aa, Mycobacterium
FDALHFAKPIFGPAARALAQLP

SEQ ID NO: 354130 - protein, 18 aa, Mycobacterium
FDANLPTGILPQGGPFTE

SEQ ID NO: 354131 - protein, 24 aa, Mycobacterium
FDAPAWVNFVIVPVYIALAVLIGA

SEQ ID NO: 354132 - protein, 28 aa, Mycobacterium
FDAQGFVTLAWWMAVFPGAAIFVTVLAF

SEQ ID NO: 354133 - protein, 23 aa, Mycobacterium
FDARTGIGWLVCGVAGTLTIAWY

SEQ ID NO: 354134 - protein, 19 aa, Mycobacterium
FDDAWRHYRFAVAYLMVLP

SEQ ID NO: 354135 - protein, 17 aa, Mycobacterium
FDDFFRPVRSYFYWERH

SEQ ID NO: 354136 - protein, 19 aa, Mycobacterium
FDDFLRPIRSYFYWEKHCY

SEQ ID NO: 354137 - protein, 28 aa, Mycobacterium
FDENNPLPPPWYPQPGPPPAPAPGVIPG

SEQ ID NO: 354138 - protein, 20 aa, Mycobacterium
FDEYLLGLSSAQRKAHRRNL

SEQ ID NO: 354139 - protein, 19 aa, Mycobacterium
FDFAFSPDRPWAWTAGRGW

SEQ ID NO: 354140 - protein, 17 aa, Mycobacterium
FDFTLITTLIWITFLTT

SEQ ID NO: 354141 - protein, 28 aa, Mycobacterium
FDGNAWTLAAPIPTPRQLLAAASDGKLV

SEQ ID NO: 354142 - protein, 22 aa, Mycobacterium
FDGRLPWLHILAALGTVVGVTV

SEQ ID NO: 354143 - protein, 24 aa, Mycobacterium
FDHGWNWRGLTAWLISAALSICFV

SEQ ID NO: 354144 - protein, 24 aa, Mycobacterium
FDHVQKMPIAFFTRTRTGALVSRL

SEQ ID NO: 354145 - protein, 20 aa, Mycobacterium
FDKLPLMGLVLIVTTTILMF

SEQ ID NO: 354146 - protein, 27 aa, Mycobacterium
FDKLVSLLDYPIFVVTAAAGGAPAGCL

SEQ ID NO: 354147 - protein, 25 aa, Mycobacterium
FDLPQGYVPEIKFPSKSFALKSLPL

SEQ ID NO: 354148 - protein, 17 aa, Mycobacterium
FDLQFRDDEWKICQSPA

SEQ ID NO: 354149 - protein, 17 aa, Mycobacterium
FDLVGYYPLILTAFLLL

SEQ ID NO: 354150 - protein, 22 aa, Mycobacterium
FDLVPYYPLVLTAFLLLTSIII

SEQ ID NO: 354151 - protein, 19 aa, Mycobacterium
FDMSALEELGIDPSLIDSP

SEQ ID NO: 354152 - protein, 24 aa, Mycobacterium
FDNMPAMLVILLTATTLLMFLAFG

SEQ ID NO: 354153 - protein, 19 aa, Mycobacterium
FDNTKCHRLTTSPGLGVLQ

SEQ ID NO: 354154 - protein, 18 aa, Mycobacterium
FDPLLARMRDMGCAGLMM

SEQ ID NO: 354155 - protein, 18 aa, Mycobacterium
FDPQSGTWTKLVGMPTPR

SEQ ID NO: 354156 - protein, 22 aa, Mycobacterium
FDPTFPFDVYWILPPTNYSAMH

SEQ ID NO: 354157 - protein, 23 aa, Mycobacterium
FDQAAILGIIRGAAQTLGIDRGE

SEQ ID NO: 354158 - protein, 18 aa, Mycobacterium
FDQELGGGDAWWNKILEQ

SEQ ID NO: 354159 - protein, 23 aa, Mycobacterium
FDQISWLIPAHWGFAAAASTVDL

SEQ ID NO: 354160 - protein, 18 aa, Mycobacterium
FDRICRVGRSLRVHLLLA

SEQ ID NO: 354161 - protein, 24 aa, Mycobacterium
FDRPIWAQYWEYLTGLLRGDLGQT

SEQ ID NO: 354162 - protein, 37 aa, Mycobacterium
FDRRIDVDAMRRAFTALLRRHPQLRAGFRTVEHAEPE

SEQ ID NO: 354163 - protein, 32 aa, Mycobacterium
FDSILPVYLLALGYPAWTPPVAYLLASALIAA

SEQ ID NO: 354164 - protein, 23 aa, Mycobacterium
FDTACMVLLGLFPLFVMFVITAI

SEQ ID NO: 354165 - protein, 24 aa, Mycobacterium
FDTALYPLLFLTVATWVLATKSLR

SEQ ID NO: 354166 - protein, 29 aa, Mycobacterium
FDTFDLVGALLWLVGVSALAWLLVDDSSP

SEQ ID NO: 354167 - protein, 30 aa, Mycobacterium
FDTFLNPIDLLWSFLQAVLMAIAILLVHTY

SEQ ID NO: 354168 - protein, 17 aa, Mycobacterium
FDTFVVRALMTPSIAVL

SEQ ID NO: 354169 - protein, 21 aa, Mycobacterium
FDTGGFLLGTILGGLGIHLDP

SEQ ID NO: 354170 - protein, 27 aa, Mycobacterium
FDTWPGLIIPYITFALPLAIYTLSAFF

SEQ ID NO: 354171 - protein, 20 aa, Mycobacterium
FDVIGVLLLSPGLAAFLLGL

SEQ ID NO: 354172 - protein, 21 aa, Mycobacterium
FDVLSGFLMFNFGLSLIIALV

SEQ ID NO: 354173 - protein, 23 aa, Mycobacterium
FDVQVIPWQIYGDAAGLSRAALN

SEQ ID NO: 354174 - protein, 26 aa, Mycobacterium
FDWTRWLTIVAFDVAIVFLLFAARRP

SEQ ID NO: 354175 - protein, 18 aa, Mycobacterium
FDWYHELLAHLAQISTAS

SEQ ID NO: 354176 - protein, 23 aa, Mycobacterium
FEAGFFLVTVAIPAIVAFLAEYP

SEQ ID NO: 354177 - protein, 23 aa, Mycobacterium
FEAGLAMMPIFVAAALAAIPAGR

SEQ ID NO: 354178 - protein, 29 aa, Mycobacterium
FEDAQAEPAAWLRFWFPDPKGSNTEYQRA

SEQ ID NO: 354179 - protein, 20 aa, Mycobacterium
FEDYVARIARTCGVPVIMTS

SEQ ID NO: 354180 - protein, 29 aa, Mycobacterium
FEELGVPLWVARARIALSGLAVSGSAVGS

SEQ ID NO: 354181 - protein, 19 aa, Mycobacterium
FEFPLLIIMLNLVGILTYE

SEQ ID NO: 354182 - protein, 23 aa, Mycobacterium
FEFPLYFLPVVVAVVLLTGIGFS

SEQ ID NO: 354183 - protein, 17 aa, Mycobacterium
FEFPYVIYQGLTMYLLL

SEQ ID NO: 354184 - protein, 18 aa, Mycobacterium
FEFTLPMPGPVEEEDSVA

SEQ ID NO: 354185 - protein, 19 aa, Mycobacterium
FEGYEYLFWVGCAGAYEDR

SEQ ID NO: 354186 - protein, 17 aa, Mycobacterium
FEHLDYAMAMRTYGWPR

SEQ ID NO: 354187 - protein, 19 aa, Mycobacterium
FEHQPFLNDAIAANGFELT

SEQ ID NO: 354188 - protein, 19 aa, Mycobacterium
FEKAAIIPFVAFTVTALYG

SEQ ID NO: 354189 - protein, 26 aa, Mycobacterium
FEKLRDLVINAPARLDLLTQRYIELT

SEQ ID NO: 354190 - protein, 22 aa, Mycobacterium
FEKYAWIFMRLSGVVLIFLALG

SEQ ID NO: 354191 - protein, 23 aa, Mycobacterium
FEKYTWLFMRFSGIVLVFLALGH

SEQ ID NO: 354192 - protein, 17 aa, Mycobacterium
FELEIKAIAVEHAVVGV

SEQ ID NO: 354193 - protein, 18 aa, Mycobacterium
FELTYYWGLTLSAQALIS

SEQ ID NO: 354194 - protein, 24 aa, Mycobacterium
FENARLGTLASWIGVRETWRVIGD

SEQ ID NO: 354195 - protein, 23 aa, Mycobacterium
FENILIRGLMEYSFWVPNGSPEY

SEQ ID NO: 354196 - protein, 17 aa, Mycobacterium
FENILNQALLRKMMHQD

SEQ ID NO: 354197 - protein, 37 aa, Mycobacterium
FENMPAMLVILLTTTTLLMFLAFGSVVLPIKAAVMSA

SEQ ID NO: 354198 - protein, 18 aa, Mycobacterium
FEPANMWRTVREFEDAGV

SEQ ID NO: 354199 - protein, 26 aa, Mycobacterium
FEPGRSLWWSWAWIAGMIGYAGDVAR

SEQ ID NO: 354200 - protein, 25 aa, Mycobacterium
FEPKRRMMVRRWRWIGTATVRWPGP

SEQ ID NO: 354201 - protein, 29 aa, Mycobacterium
FEPLAMRQHVTGPYPIDPALIAQGVPPDD

SEQ ID NO: 354202 - protein, 17 aa, Mycobacterium
FEPLLAGLRDFGCMALM

SEQ ID NO: 354203 - protein, 21 aa, Mycobacterium
FEPRPLIVALAFAVLTAPAIS

SEQ ID NO: 354204 - protein, 25 aa, Mycobacterium
FEPYLLLFTLFLAPAEHWLGQLRWL

SEQ ID NO: 354205 - protein, 17 aa, Mycobacterium
FEPYLVSFYAVPLVLFY

SEQ ID NO: 354206 - protein, 23 aa, Mycobacterium
FEQWLWQMYTTFYNNVIQPFVDW

SEQ ID NO: 354207 - protein, 26 aa, Mycobacterium
FERDTHVISLLYIATFGSWIGFSFAF

SEQ ID NO: 354208 - protein, 24 aa, Mycobacterium
FETPMLFAIGFLLTFLIGGLTGVL

SEQ ID NO: 354209 - protein, 19 aa, Mycobacterium
FETPMLFAVGFLVTFLFGG

SEQ ID NO: 354210 - protein, 23 aa, Mycobacterium
FETPMLFSFGFLVTFLAGGLTGV

SEQ ID NO: 354211 - protein, 24 aa, Mycobacterium
FETPMLFSIGFLVTFLFGGLTGVL

SEQ ID NO: 354212 - protein, 24 aa, Mycobacterium
FETPMLFSVGFLLTFLLGGLTGVM

SEQ ID NO: 354213 - protein, 23 aa, Mycobacterium
FETPMLWAFGFLVTFLLGGLSGV

SEQ ID NO: 354214 - protein, 28 aa, Mycobacterium
FETTAAALAWTWYLLSRNPDARAKLGQE

SEQ ID NO: 354215 - protein, 25 aa, Mycobacterium
FETWGWRIPFLLSGVLVAVGLFIRL

SEQ ID NO: 354216 - protein, 20 aa, Mycobacterium
FEVIGKRKLWYAVSGIIVVI

SEQ ID NO: 354217 - protein, 18 aa, Mycobacterium
FEVVGKRKLWYTVSALIV

SEQ ID NO: 354218 - protein, 29 aa, Mycobacterium
FEYPEQGGLPWYKRTALVLTVAGAGVAVL

SEQ ID NO: 354219 - protein, 26 aa, Mycobacterium
FFAADHPWRWFLIGFMVLFHLNIISN

SEQ ID NO: 354220 - protein, 25 aa, Mycobacterium
FFAGDHPWRWFLIGFMVIFHLNIIS

SEQ ID NO: 354221 - protein, 29 aa, Mycobacterium
FFALANAILIIPLGLVPSWLALASTGFDV

SEQ ID NO: 354222 - protein, 18 aa, Mycobacterium
FFALLLLTAAGMAFIFRP

SEQ ID NO: 354223 - protein, 20 aa, Mycobacterium
FFALSGFLLWRPHALAAGGG

SEQ ID NO: 354224 - protein, 30 aa, Mycobacterium
FFARMALWSMLPWYALLVPCVLIGSLARVY

SEQ ID NO: 354225 - protein, 20 aa, Mycobacterium
FFARTVRVLAVPIIVFWGLL

SEQ ID NO: 354226 - protein, 26 aa, Mycobacterium
FFAVAVLLGIITFAIIRIVREPKKHG

SEQ ID NO: 354227 - protein, 26 aa, Mycobacterium
FFAVAVLLGIIVFAIIRVVREPKKIG

SEQ ID NO: 354228 - protein, 17 aa, Mycobacterium
FFAVVKSLALFVNALHK

SEQ ID NO: 354229 - protein, 25 aa, Mycobacterium
FFAVVKSLALFVNALHRSDQQFVAL

SEQ ID NO: 354230 - protein, 27 aa, Mycobacterium
FFDLGGHSLLTIRLISRIRSELGAELT

SEQ ID NO: 354231 - protein, 20 aa, Mycobacterium
FFDTELLVLAERSGLRIHEV

SEQ ID NO: 354232 - protein, 17 aa, Mycobacterium
FFDWEMYRRAIPVLLTT

SEQ ID NO: 354233 - protein, 17 aa, Mycobacterium
FFEARAKRRAGAALRAL

SEQ ID NO: 354234 - protein, 36 aa, Mycobacterium
FFESTFIGLWIFGWTRLPRWLHLACIWIVAIAVNLS

SEQ ID NO: 354235 - protein, 24 aa, Mycobacterium
FFETAALIIAFVVLGRYFEARSTS

SEQ ID NO: 354236 - protein, 17 aa, Mycobacterium
FFFAPVLAVFSPWPAVT

SEQ ID NO: 354237 - protein, 29 aa, Mycobacterium
FFFESTFIGLWIFGWSRLPKLIHLACIWI

SEQ ID NO: 354238 - protein, 29 aa, Mycobacterium
FFFESTFIGLWIFGWSRLPRAVHLACIWI

SEQ ID NO: 354239 - protein, 30 aa, Mycobacterium
FFFESTFIGLWIFGWSRLPRLVHLACIWIV

SEQ ID NO: 354240 - protein, 30 aa, Mycobacterium
FFFESTFLGLWIFGWSRLPRLVHLACIWIV

SEQ ID NO: 354241 - protein, 17 aa, Mycobacterium
FFGALFGRTALILAVLF

SEQ ID NO: 354242 - protein, 20 aa, Mycobacterium
FFGCTPLGPVAWSGVLGSTA

SEQ ID NO: 354243 - protein, 21 aa, Mycobacterium
FFGCTPMGPVAWTGVIGATAG

SEQ ID NO: 354244 - protein, 18 aa, Mycobacterium
FFGPIYFFVKGMWRKGLV

SEQ ID NO: 354245 - protein, 19 aa, Mycobacterium
FFGQLGFSPALSSALGWAI

SEQ ID NO: 354246 - protein, 19 aa, Mycobacterium
FFGQLGLSPALSTALGWAI

SEQ ID NO: 354247 - protein, 20 aa, Mycobacterium
FFGQRLAHLSPLAAGFLGAA

SEQ ID NO: 354248 - protein, 27 aa, Mycobacterium
FFGSSVLFYLLLLGLTLPTEAFIIPLY

SEQ ID NO: 354249 - protein, 17 aa, Mycobacterium
FFGTAAVFALGSAGLYW

SEQ ID NO: 354250 - protein, 35 aa, Mycobacterium
FFGTATGLVFIWLSLTPSLLPRGPLFQGLVSGGAG

SEQ ID NO: 354251 - protein, 17 aa, Mycobacterium
FFGTLMVITQFFQNVRD

SEQ ID NO: 354252 - protein, 18 aa, Mycobacterium
FFHLNLQSLSIPFLLAIL

SEQ ID NO: 354253 - protein, 18 aa, Mycobacterium
FFIAALVVLFYSTFFFFF

SEQ ID NO: 354254 - protein, 18 aa, Mycobacterium
FFIAALVVLFYSTFFLFF

SEQ ID NO: 354255 - protein, 26 aa, Mycobacterium
FFIPTQAFQNPLFKSAMPYFFSGDGK

SEQ ID NO: 354256 - protein, 30 aa, Mycobacterium
FFLESTFLGLWIFGWTRLPKLVHLACIWMV

SEQ ID NO: 354257 - protein, 27 aa, Mycobacterium
FFLLPPERIHTMVFAVLRGATVLGFKR

SEQ ID NO: 354258 - protein, 24 aa, Mycobacterium
FFLQFGLLLLAATILGRVAIRLGM

SEQ ID NO: 354259 - protein, 17 aa, Mycobacterium
FFLQLAVILMACRLAGL

SEQ ID NO: 354260 - protein, 40 aa, Mycobacterium
FFLTGHLLGIPGWITQRLWWAVLLTVGFWGLLRVAEALGI

SEQ ID NO: 354261 - protein, 19 aa, Mycobacterium
FFLVGACLVVLLLGIEHTV

SEQ ID NO: 354262 - protein, 17 aa, Mycobacterium
FFNLLTHPHHWSMYLAG

SEQ ID NO: 354263 - protein, 20 aa, Mycobacterium
FFPGYAVPKGTYRAEPTRRP

SEQ ID NO: 354264 - protein, 19 aa, Mycobacterium
FFQAFMVAPLIFQLAHEFR

SEQ ID NO: 354265 - protein, 29 aa, Mycobacterium
FFRAVPVLIMMIFAYFFYAAYDVFPSKHL

SEQ ID NO: 354266 - protein, 21 aa, Mycobacterium
FFRMCVLTGRALFRWPFQWRE

SEQ ID NO: 354267 - protein, 18 aa, Mycobacterium
FFSPNPWGALVTGLVAGV

SEQ ID NO: 354268 - protein, 20 aa, Mycobacterium
FFSPNPWSALLTGLIAGVFF

SEQ ID NO: 354269 - protein, 28 aa, Mycobacterium
FFTDHMSWRWAFWINVPVGILVLVIAAG

SEQ ID NO: 354270 - protein, 20 aa, Mycobacterium
FFTYYFFLTGIHFVHLLIGF

SEQ ID NO: 354271 - protein, 17 aa, Mycobacterium
FFVPIIGCLAQVALAAL

SEQ ID NO: 354272 - protein, 17 aa, Mycobacterium
FFVTDSPQWLLSAGRTE

SEQ ID NO: 354273 - protein, 17 aa, Mycobacterium
FFYPHRRKGFALGFNAG

SEQ ID NO: 354274 - protein, 26 aa, Mycobacterium
FGAAALLLILLYVFATEANSRIPGDS

SEQ ID NO: 354275 - protein, 17 aa, Mycobacterium
FGAEFLSGLISPAAEFI

SEQ ID NO: 354276 - protein, 23 aa, Mycobacterium
FGAFGVPLWQMILGSLIGSAPRA

SEQ ID NO: 354277 - protein, 17 aa, Mycobacterium
FGAFLAFLDSTIVNIAF

SEQ ID NO: 354278 - protein, 18 aa, Mycobacterium
FGAFLAFLDSTIVNIAFP

SEQ ID NO: 354279 - protein, 27 aa, Mycobacterium
FGAFQLTLGGSLWWLGAVNVLCALVFL

SEQ ID NO: 354280 - protein, 39 aa, Mycobacterium
FGAGLFIAFDQLWRWNSIVALVLSVLVILGLVVAVRVVR

SEQ ID NO: 354281 - protein, 17 aa, Mycobacterium
FGAGVLALILGAAVPGR

SEQ ID NO: 354282 - protein, 28 aa, Mycobacterium
FGAILLAGLLRYWYLRILRPEVAARIGS

SEQ ID NO: 354283 - protein, 18 aa, Mycobacterium
FGALFPLIVQDLTHGTGH

SEQ ID NO: 354284 - protein, 18 aa, Mycobacterium
FGALIWIFQEGHLGGFGT

SEQ ID NO: 354285 - protein, 22 aa, Mycobacterium
FGALLRVVYVALPPLHDQWRPV

SEQ ID NO: 354286 - protein, 17 aa, Mycobacterium
FGALVWIFQDGHLGALG

SEQ ID NO: 354287 - protein, 18 aa, Mycobacterium
FGALVWIFQDGHLGALGT

SEQ ID NO: 354288 - protein, 22 aa, Mycobacterium
FGAMLRLFYVALPGLRDDWRPV

SEQ ID NO: 354289 - protein, 21 aa, Mycobacterium
FGAMVWIFQDGHLRALGTTPN

SEQ ID NO: 354290 - protein, 18 aa, Mycobacterium
FGAPHLPILGLAGMPSLP

SEQ ID NO: 354291 - protein, 31 aa, Mycobacterium
FGAPHLPIPQLAGMPALPDLSGVLANLPTLR

SEQ ID NO: 354292 - protein, 25 aa, Mycobacterium
FGAPQLPIPALTGLPTLPGPTNLTD

SEQ ID NO: 354293 - protein, 17 aa, Mycobacterium
FGAQLLSGLVSPATIFI

SEQ ID NO: 354294 - protein, 17 aa, Mycobacterium
FGARLLGIAYGLGGIRA

SEQ ID NO: 354295 - protein, 19 aa, Mycobacterium
FGARRPARLPPGRGFLLTR

SEQ ID NO: 354296 - protein, 18 aa, Mycobacterium
FGAWMVFAAFWAVLVYFP

SEQ ID NO: 354297 - protein, 25 aa, Mycobacterium
FGCGWLVLLLIGVPWLLSFAQPDIW

SEQ ID NO: 354298 - protein, 23 aa, Mycobacterium
FGDFRIGFLFITVVTALILVLAA

SEQ ID NO: 354299 - protein, 23 aa, Mycobacterium
FGDTMGYRLVIYPTYAALDRPDP

SEQ ID NO: 354300 - protein, 24 aa, Mycobacterium
FGDTMGYRLVIYPTYAVLDRKDPA

SEQ ID NO: 354301 - protein, 21 aa, Mycobacterium
FGDVRASWPWAVAVFIVVVFV

SEQ ID NO: 354302 - protein, 23 aa, Mycobacterium
FGDWGFALARRGGTAPIPAVPAD

SEQ ID NO: 354303 - protein, 25 aa, Mycobacterium
FGEFVAWIIGWDLILEFAVAAAVVA

SEQ ID NO: 354304 - protein, 26 aa, Mycobacterium
FGEFVAWIIGWDLILEFAVAAAVVAK

SEQ ID NO: 354305 - protein, 25 aa, Mycobacterium
FGEHSVGWVAVALLGAVLSPKRRGD

SEQ ID NO: 354306 - protein, 24 aa, Mycobacterium
FGEIEFWFALIKLAAIGCLIVVAV

SEQ ID NO: 354307 - protein, 27 aa, Mycobacterium
FGETIAAGPFFNAYLANLVPGQFIQPF

SEQ ID NO: 354308 - protein, 23 aa, Mycobacterium
FGEYLPMPWLFRHLSGYASRAGS

SEQ ID NO: 354309 - protein, 21 aa, Mycobacterium
FGEYLPMPWLFSHLSAYADRA

SEQ ID NO: 354310 - protein, 27 aa, Mycobacterium
FGFAALLFPVLVFLLSPAISWRAPVAA

SEQ ID NO: 354311 - protein, 17 aa, Mycobacterium
FGFLLAIPAVLASGLFS

SEQ ID NO: 354312 - protein, 21 aa, Mycobacterium
FGGFFILMFGARMADGCASGH

SEQ ID NO: 354313 - protein, 26 aa, Mycobacterium
FGGGSMFLLVGILAALWERQSSGKGQ

SEQ ID NO: 354314 - protein, 18 aa, Mycobacterium
FGGLLAAALPMALGALAV

SEQ ID NO: 354315 - protein, 17 aa, Mycobacterium
FGGLLAAALPVAVGGFA

SEQ ID NO: 354316 - protein, 19 aa, Mycobacterium
FGGLRRSPPAWASWARIVV

SEQ ID NO: 354317 - protein, 23 aa, Mycobacterium
FGGRNWTVFSALVLLIPTVMTVV

SEQ ID NO: 354318 - protein, 19 aa, Mycobacterium
FGGRRFVPIVVSLASLFVA

SEQ ID NO: 354319 - protein, 25 aa, Mycobacterium
FGGRTWAVLSSLVLLIPTVGAMVLL

SEQ ID NO: 354320 - protein, 34 aa, Mycobacterium
FGGRVSIPALAILAAVALLIGLVGGIIGRKTAEV

SEQ ID NO: 354321 - protein, 28 aa, Mycobacterium
FGGSGFKAFWYHFAIMFEALFILTTVDA

SEQ ID NO: 354322 - protein, 42 aa, Mycobacterium
FGGWIDITLVLWVLVVLVVSMLLYIMCWWRHLRPEVPAPADP

SEQ ID NO: 354323 - protein, 20 aa, Mycobacterium
FGGWLMPVVPPMVSAAAGAQ

SEQ ID NO: 354324 - protein, 17 aa, Mycobacterium
FGGYFYWDDLILVGRAG

SEQ ID NO: 354325 - protein, 24 aa, Mycobacterium
FGHDPWWLILAKSLGVFVFLLLTV

SEQ ID NO: 354326 - protein, 23 aa, Mycobacterium
FGHDPWWLMLAKAVAIFVFLLLT

SEQ ID NO: 354327 - protein, 25 aa, Mycobacterium
FGIGLVILGLWLLAGRDIIALMPKM

SEQ ID NO: 354328 - protein, 24 aa, Mycobacterium
FGIIAAIAFAWLISAGPPGPPGPP

SEQ ID NO: 354329 - protein, 17 aa, Mycobacterium
FGIIALVGAIAWAIIAF

SEQ ID NO: 354330 - protein, 21 aa, Mycobacterium
FGIIGALFLLPLVTAPVLVGV

SEQ ID NO: 354331 - protein, 19 aa, Mycobacterium
FGILALVVVLAIAGTGIGV

SEQ ID NO: 354332 - protein, 26 aa, Mycobacterium
FGINMGFYMLMPYLAGYLAGPLGLAA

SEQ ID NO: 354333 - protein, 27 aa, Mycobacterium
FGIRLNWLILAGLIYPLLYGVGRIYVR

SEQ ID NO: 354334 - protein, 27 aa, Mycobacterium
FGIRLNWLVLAVLVYPLLYGIGRFYVR

SEQ ID NO: 354335 - protein, 26 aa, Mycobacterium
FGISVLVWQHIFGLELNWIAPVFGLI

SEQ ID NO: 354336 - protein, 24 aa, Mycobacterium
FGITTVYHFIFVPLTIGLAPLIAV

SEQ ID NO: 354337 - protein, 25 aa, Mycobacterium
FGITTVYHFIFVPLTIGLAPLIAVM

SEQ ID NO: 354338 - protein, 24 aa, Mycobacterium
FGITTVYHFIFVPLTIGLAPLLAI

SEQ ID NO: 354339 - protein, 24 aa, Mycobacterium
FGITTVYHFILVPLTIGLAPLIAI

SEQ ID NO: 354340 - protein, 24 aa, Mycobacterium
FGIVTVYHFIFVPLTIGLAPLIAI

SEQ ID NO: 354341 - protein, 19 aa, Mycobacterium
FGKLFLINFALGVATGIVQ

SEQ ID NO: 354342 - protein, 24 aa, Mycobacterium
FGLAFFAVALFWPAGTFDYWQAWV

SEQ ID NO: 354343 - protein, 17 aa, Mycobacterium
FGLAIMAVLLKGAGLLV

SEQ ID NO: 354344 - protein, 19 aa, Mycobacterium
FGLALFQILLVASTALPVW

SEQ ID NO: 354345 - protein, 23 aa, Mycobacterium
FGLALLTGLYVAASPWMVGFSGT

SEQ ID NO: 354346 - protein, 19 aa, Mycobacterium
FGLAWRLDRGALLLWTIGL

SEQ ID NO: 354347 - protein, 18 aa, Mycobacterium
FGLDAWFLAAIGAPLVTG

SEQ ID NO: 354348 - protein, 18 aa, Mycobacterium
FGLGLIPFVIIQAVFGFC

SEQ ID NO: 354349 - protein, 18 aa, Mycobacterium
FGLLAALQLMLAPIVAVT

SEQ ID NO: 354350 - protein, 17 aa, Mycobacterium
FGLLDPKRELSTKSWRK

SEQ ID NO: 354351 - protein, 19 aa, Mycobacterium
FGLNTWYRAGLFGGLALLP

SEQ ID NO: 354352 - protein, 18 aa, Mycobacterium
FGLPLFLWGVRLLRRAQR

SEQ ID NO: 354353 - protein, 20 aa, Mycobacterium
FGLPVIVLPLVYFWTGRGEQ

SEQ ID NO: 354354 - protein, 19 aa, Mycobacterium
FGLRRWYVVTLLMGLIFVL

SEQ ID NO: 354355 - protein, 29 aa, Mycobacterium
FGLSFPRAMFWTVLIYVLVATIISFVIGR

SEQ ID NO: 354356 - protein, 36 aa, Mycobacterium
FGLSILVWQHILGIDLHFMVMAMAVIVLLAVGADYN

SEQ ID NO: 354357 - protein, 36 aa, Mycobacterium
FGLSVIIWQYILGIELHWLVMQMAIIVLLAVGSDYN

SEQ ID NO: 354358 - protein, 28 aa, Mycobacterium
FGLSVLIWQHIIGLELHWMVLAMAVIVL

SEQ ID NO: 354359 - protein, 35 aa, Mycobacterium
FGLSVLIWQHILHMPLHWLVLPMAIIVMLAVGSDY

SEQ ID NO: 354360 - protein, 39 aa, Mycobacterium
FGLSVLIWQHLVGLPLHWLILPLTFIILVAVGSDYNLLL

SEQ ID NO: 354361 - protein, 35 aa, Mycobacterium
FGLSVLIWQNILGIELHWLVLAMSVIILLAVGSDY

SEQ ID NO: 354362 - protein, 38 aa, Mycobacterium
FGLSVLVWQHFLGIPLSWLNLPITFIILVAVGSDYNLL

SEQ ID NO: 354363 - protein, 34 aa, Mycobacterium
FGLSVLVWQHIFGIKLHWLVLPMSVIVLLAVGSD

SEQ ID NO: 354364 - protein, 36 aa, Mycobacterium
FGLSVLVWQHIFGIQLYWIVLALAVIVLLGVGSDYN

SEQ ID NO: 354365 - protein, 38 aa, Mycobacterium
FGLSVLVWQHLIGLPLHWLVLPLAFIILVAVGSDYNLL

SEQ ID NO: 354366 - protein, 37 aa, Mycobacterium
FGLSVLVWQYLFGIQLYWVVLALAVILLLAVGSDYNL

SEQ ID NO: 354367 - protein, 28 aa, Mycobacterium
FGLSVPMLLVQAGYMLIGWQAGLAFTRA

SEQ ID NO: 354368 - protein, 25 aa, Mycobacterium
FGLSWWLGLYLLARNPRKPVLVLAA

SEQ ID NO: 354369 - protein, 19 aa, Mycobacterium
FGLSYWWYHSADQTAALFA

SEQ ID NO: 354370 - protein, 21 aa, Mycobacterium
FGLWGIFVLAPKLEPVAGFLN

SEQ ID NO: 354371 - protein, 20 aa, Mycobacterium
FGLWGIFVLAPRLEPVAAFL

SEQ ID NO: 354372 - protein, 36 aa, Mycobacterium
FGMLRLYLRRDRISLPLWVLLLSVPLATVYVGSIEK

SEQ ID NO: 354373 - protein, 18 aa, Mycobacterium
FGMLSIALVLAAIALPAA

SEQ ID NO: 354374 - protein, 17 aa, Mycobacterium
FGPLLGVFVTLGATVGT

SEQ ID NO: 354375 - protein, 18 aa, Mycobacterium
FGPPEYAALALLGVLLVA

SEQ ID NO: 354376 - protein, 26 aa, Mycobacterium
FGPVSPLPGLLAVAVLLLATRGLHID

SEQ ID NO: 354377 - protein, 22 aa, Mycobacterium
FGPYHLVRLIGRGGMGEVYEAE

SEQ ID NO: 354378 - protein, 18 aa, Mycobacterium
FGPYRLRRIVGRGAMGDV

SEQ ID NO: 354379 - protein, 24 aa, Mycobacterium
FGQALDLAWFVVLGVIAGGVGWLY

SEQ ID NO: 354380 - protein, 27 aa, Mycobacterium
FGQFSLTVLSVLYLPNIVIGAAAVAVG

SEQ ID NO: 354381 - protein, 17 aa, Mycobacterium
FGQRLAAFVVPRPNRDL

SEQ ID NO: 354382 - protein, 47 aa, Mycobacterium
FGQRRLLKWSIPGLAHFFTMWGFFILLTVYIEAYGLLFQPNFHIPII

SEQ ID NO: 354383 - protein, 41 aa, Mycobacterium
FGQTRLLRWSIPGIAHFFTMWGFFVLATVYLEAFGLLVDHD

SEQ ID NO: 354384 - protein, 40 aa, Mycobacterium
FGQTRLLRWSVPGIAHFFTMWGFFVLASVYLEAYGVLFDP

SEQ ID NO: 354385 - protein, 19 aa, Mycobacterium
FGQVAVLWPLLLLGGEVCV

SEQ ID NO: 354386 - protein, 17 aa, Mycobacterium
FGQWMLMGLPVAAVLLV

SEQ ID NO: 354387 - protein, 25 aa, Mycobacterium
FGQYLLMFIVMYLLAAASTAVAFTR

SEQ ID NO: 354388 - protein, 18 aa, Mycobacterium
FGQYRLRRLVGRGAMGDV

SEQ ID NO: 354389 - protein, 34 aa, Mycobacterium
FGRDNPLVLLPWTQWLTWGFQVVPVFFAVAGFAS

SEQ ID NO: 354390 - protein, 23 aa, Mycobacterium
FGRGWGWFSVGDLFLLNFLTIVT

SEQ ID NO: 354391 - protein, 27 aa, Mycobacterium
FGRKVVFQAAVLFFLAGSVLCGLSGSM

SEQ ID NO: 354392 - protein, 19 aa, Mycobacterium
FGRLMQIGGTALVVLFAVV

SEQ ID NO: 354393 - protein, 31 aa, Mycobacterium
FGRQQLGSILILGIWFETALAVFLYHDLMVS

SEQ ID NO: 354394 - protein, 17 aa, Mycobacterium
FGRRLSWVLAEVAVVIA

SEQ ID NO: 354395 - protein, 25 aa, Mycobacterium
FGRRRLMLVGWAAGLPWSLSVMSLI

SEQ ID NO: 354396 - protein, 23 aa, Mycobacterium
FGRWVAHFNLLIAAALVPAAFAG

SEQ ID NO: 354397 - protein, 24 aa, Mycobacterium
FGRYRLFEVLRSGGTGIVYRAYDT

SEQ ID NO: 354398 - protein, 18 aa, Mycobacterium
FGSFLSGVFLLIYLGSRF

SEQ ID NO: 354399 - protein, 36 aa, Mycobacterium
FGSGGSPLIKWMFWTGLLITALDVLIALAITAMGTR

SEQ ID NO: 354400 - protein, 25 aa, Mycobacterium
FGSLLLVQPVLVSALLFALPLSARL

SEQ ID NO: 354401 - protein, 19 aa, Mycobacterium
FGSMLWSAPVPFVSAALFA

SEQ ID NO: 354402 - protein, 18 aa, Mycobacterium
FGSPVFTVCCVLSFVVGF

SEQ ID NO: 354403 - protein, 23 aa, Mycobacterium
FGSPYAIFLLREHFRIIPNDLIN

SEQ ID NO: 354404 - protein, 23 aa, Mycobacterium
FGSPYAIFLLREHFRIIPNDLVN

SEQ ID NO: 354405 - protein, 23 aa, Mycobacterium
FGSPYAIFLLREHFRIIPNDMIN

SEQ ID NO: 354406 - protein, 26 aa, Mycobacterium
FGSSVTPPIWVQYVGKDWLVPSGEKK

SEQ ID NO: 354407 - protein, 23 aa, Mycobacterium
FGSTPLGYVDWIKAAAVGAPVFG

SEQ ID NO: 354408 - protein, 29 aa, Mycobacterium
FGTAPIGFGAWLRIFGIAVVASGVVALDK

SEQ ID NO: 354409 - protein, 24 aa, Mycobacterium
FGTAVGMAFLFRGLSRGAMSVIVP

SEQ ID NO: 354410 - protein, 40 aa, Mycobacterium
FGTGMAPFFVTLALFFGALVLWMILRPLQTRAIAAEVLPL

SEQ ID NO: 354411 - protein, 20 aa, Mycobacterium
FGTGRYLLLQTVVVFVWIAL

SEQ ID NO: 354412 - protein, 31 aa, Mycobacterium
FGTLAGVIVFLLWLWLTNLALLFGAEVDAEL

SEQ ID NO: 354413 - protein, 25 aa, Mycobacterium
FGTLLQSLGIWRVGVRLPMVIGASY

SEQ ID NO: 354414 - protein, 34 aa, Mycobacterium
FGTPVVIHLFYVVKILLYVLVAWLIVLSTSGIDG

SEQ ID NO: 354415 - protein, 33 aa, Mycobacterium
FGTPVVMHLFYVGKILLYILVGWLIVFSTKGIE

SEQ ID NO: 354416 - protein, 28 aa, Mycobacterium
FGTPYAVYLLYLLKIALYVAAPAAIIAL

SEQ ID NO: 354417 - protein, 28 aa, Mycobacterium
FGTPYAVYLLYLLKIGIYVAAPAAIISL

SEQ ID NO: 354418 - protein, 24 aa, Mycobacterium
FGVAALGLLLIAFGGGTLLLRRNN

SEQ ID NO: 354419 - protein, 22 aa, Mycobacterium
FGVAFFVRPLGGLFFGALGDRI

SEQ ID NO: 354420 - protein, 31 aa, Mycobacterium
FGVFAVVMAVLTAFLFMTFSEYRGGSYAGYS

SEQ ID NO: 354421 - protein, 32 aa, Mycobacterium
FGVFGVVMTLMTGVLFVIFGEYRSGSANTYSA

SEQ ID NO: 354422 - protein, 20 aa, Mycobacterium
FGVFVLFMAYFGLYSRHHLV

SEQ ID NO: 354423 - protein, 25 aa, Mycobacterium
FGVGIRITVVWWLVFTAVATWVLFK

SEQ ID NO: 354424 - protein, 24 aa, Mycobacterium
FGVGLAFFAIGYIGLGLTTDIVTA

SEQ ID NO: 354425 - protein, 21 aa, Mycobacterium
FGVIALLLRRGSVPGAHNGPV

SEQ ID NO: 354426 - protein, 34 aa, Mycobacterium
FGVLAFLLLPILVVIWLSLYRWDLLGPLRYVGLA

SEQ ID NO: 354427 - protein, 19 aa, Mycobacterium
FGVLFLMLGNFVLAMFHVG

SEQ ID NO: 354428 - protein, 22 aa, Mycobacterium
FGVPWREQAFLSWAGLRGAVPV

SEQ ID NO: 354429 - protein, 26 aa, Mycobacterium
FGVQMLFDLLQLVVAYVVLLAGYVLQ

SEQ ID NO: 354430 - protein, 22 aa, Mycobacterium
FGVQWPLHTAMWVLAVASLVTV

SEQ ID NO: 354431 - protein, 27 aa, Mycobacterium
FGVSRWVSIPVATVALLALALTGSYRR

SEQ ID NO: 354432 - protein, 22 aa, Mycobacterium
FGVVAFIWQIGIIAALYGVVRV

SEQ ID NO: 354433 - protein, 22 aa, Mycobacterium
FGVVALMLLNLVLALFGVGGGA

SEQ ID NO: 354434 - protein, 26 aa, Mycobacterium
FGVVWVGRFLLLDRWLFRLDQRPAGH

SEQ ID NO: 354435 - protein, 24 aa, Mycobacterium
FGWDGWLWVHQIGCVILLVVLVAI

SEQ ID NO: 354436 - protein, 17 aa, Mycobacterium
FGWESLLLETGFLMIFL

SEQ ID NO: 354437 - protein, 17 aa, Mycobacterium
FGWGITCFITAVAGLMQ

SEQ ID NO: 354438 - protein, 20 aa, Mycobacterium
FGWGLFGIWSGLSTFMVLRL

SEQ ID NO: 354439 - protein, 20 aa, Mycobacterium
FGWIWRHCRHVLFDDWFDVE

SEQ ID NO: 354440 - protein, 21 aa, Mycobacterium
FGWYYNLLAIMTKFSDISLWI

SEQ ID NO: 354441 - protein, 19 aa, Mycobacterium
FGWYYNLLALMTQVSTASI

SEQ ID NO: 354442 - protein, 28 aa, Mycobacterium
FGYGRSRFFYSFVVALVLFTLGSVFALY

SEQ ID NO: 354443 - protein, 36 aa, Mycobacterium
FGYGVLFGLAFYVPLLPWISGLVGAVPWLALAFAES

SEQ ID NO: 354444 - protein, 21 aa, Mycobacterium
FGYTGLGWRFSGALLGVVMVA

SEQ ID NO: 354445 - protein, 25 aa, Mycobacterium
FGYVMFYFGPYFPAVWLLRKLQAKY

SEQ ID NO: 354446 - protein, 24 aa, Mycobacterium
FHAGPQEILLIALGLALAEFSGTT

SEQ ID NO: 354447 - protein, 17 aa, Mycobacterium
FHDAAASRLTWGIVVGL

SEQ ID NO: 354448 - protein, 19 aa, Mycobacterium
FHGMWSLGALLGALIGAAC

SEQ ID NO: 354449 - protein, 18 aa, Mycobacterium
FHGSSISSLSWVLNAYNI

SEQ ID NO: 354450 - protein, 19 aa, Mycobacterium
FHIPFIGRWDALGFLQDFF

SEQ ID NO: 354451 - protein, 19 aa, Mycobacterium
FHLGFLMIAAVTALILVLA

SEQ ID NO: 354452 - protein, 20 aa, Mycobacterium
FHNVIARYQFALANKGVLPA

SEQ ID NO: 354453 - protein, 22 aa, Mycobacterium
FHRNLGRGLLGRRIERSPVPFA

SEQ ID NO: 354454 - protein, 29 aa, Mycobacterium
FHSAAFDFSVWELWGPLLHGGRLVVVEHD

SEQ ID NO: 354455 - protein, 24 aa, Mycobacterium
FHSKSILLLAIVFAVGMNAYVYFK

SEQ ID NO: 354456 - protein, 21 aa, Mycobacterium
FHSPLMEPMLEEFARIAAQVE

SEQ ID NO: 354457 - protein, 23 aa, Mycobacterium
FHSYSFDFSVWEIWGALLHGGRL

SEQ ID NO: 354458 - protein, 18 aa, Mycobacterium
FHVATWLLVWAGTIALLM

SEQ ID NO: 354459 - protein, 29 aa, Mycobacterium
FHVHGLSGLINLFSFGLLGKSGHEHTITA

SEQ ID NO: 354460 - protein, 26 aa, Mycobacterium
FHVVGTLLVLGLLVAPPAAATLWAHS

SEQ ID NO: 354461 - protein, 22 aa, Mycobacterium
FHWAVGIAIGVPVGLILLTELH

SEQ ID NO: 354462 - protein, 18 aa, Mycobacterium
FHYRYTVGLWFRRIWIFQ

SEQ ID NO: 354463 - protein, 18 aa, Mycobacterium
FHYRYTVGLWFRRIWILQ

SEQ ID NO: 354464 - protein, 25 aa, Mycobacterium
FHYWTAFHVIPQWALALSALLVVLS

SEQ ID NO: 354465 - protein, 18 aa, Mycobacterium
FIAAVSGWRSGALGSLLS

SEQ ID NO: 354466 - protein, 19 aa, Mycobacterium
FIAAVSGWRSGALGSLLSF

SEQ ID NO: 354467 - protein, 17 aa, Mycobacterium
FIAAVSGWRSGALGSML

SEQ ID NO: 354468 - protein, 26 aa, Mycobacterium
FIAAVTVVLLFLMTGSLLLPIKAVLL

SEQ ID NO: 354469 - protein, 19 aa, Mycobacterium
FIAHPWTALTLLVVGVYGL

SEQ ID NO: 354470 - protein, 18 aa, Mycobacterium
FIAIFLAGGVMFSLTVCI

SEQ ID NO: 354471 - protein, 17 aa, Mycobacterium
FIALFIFCGMGKGTVFK

SEQ ID NO: 354472 - protein, 18 aa, Mycobacterium
FIAMISLTIVVGVIREIF

SEQ ID NO: 354473 - protein, 17 aa, Mycobacterium
FIDSAWNLAFGVLPPYW

SEQ ID NO: 354474 - protein, 18 aa, Mycobacterium
FIDYCVNMLYITAAPYVP

SEQ ID NO: 354475 - protein, 29 aa, Mycobacterium
FIERGTPTLALLFVAAALRFVGGTLGQGL

SEQ ID NO: 354476 - protein, 25 aa, Mycobacterium
FIETGLLFPLLPGESLLFTGGLLAA

SEQ ID NO: 354477 - protein, 18 aa, Mycobacterium
FIEVSPHPLLTYGISDTL

SEQ ID NO: 354478 - protein, 24 aa, Mycobacterium
FIGDKMVELPLAAVSVPLGGEGAA

SEQ ID NO: 354479 - protein, 22 aa, Mycobacterium
FIGLAATLVVGFLLVRSGETTV

SEQ ID NO: 354480 - protein, 25 aa, Mycobacterium
FIGNEWVALYRIGVGRRIGSAALVA

SEQ ID NO: 354481 - protein, 17 aa, Mycobacterium
FIGPLLGSLARIVGGKV

SEQ ID NO: 354482 - protein, 18 aa, Mycobacterium
FIGPLLGSLSRIFGGRLG

SEQ ID NO: 354483 - protein, 19 aa, Mycobacterium
FIGSLFHSKSILLLAIVFA

SEQ ID NO: 354484 - protein, 28 aa, Mycobacterium
FIGYELPKAMFWIGIVYILFATVVAFWI

SEQ ID NO: 354485 - protein, 28 aa, Mycobacterium
FIHAADRALLVLSLLLLVAAVFVAIWSP

SEQ ID NO: 354486 - protein, 19 aa, Mycobacterium
FIHILRQIGALVVTAVTAA

SEQ ID NO: 354487 - protein, 43 aa, Mycobacterium
FIIAATLIVVLLTLMVLLRAIVAPLYLVGSVVLSYFAAIGIGV

SEQ ID NO: 354488 - protein, 26 aa, Mycobacterium
FIKHPTPWMLLAWSSALIIGRITLGS

SEQ ID NO: 354489 - protein, 30 aa, Mycobacterium
FILKTIGVFFLLLPFTWNRAGGLDGIRERA

SEQ ID NO: 354490 - protein, 25 aa, Mycobacterium
FILMTFQLLILAFFVALTIGYLVGD

SEQ ID NO: 354491 - protein, 17 aa, Mycobacterium
FILPYVVAGVLWLRDRE

SEQ ID NO: 354492 - protein, 25 aa, Mycobacterium
FINSVALLVLAFPVGNLTALSTQLG

SEQ ID NO: 354493 - protein, 25 aa, Mycobacterium
FIPPAVIMGFVLWRYQLRQGSANSV

SEQ ID NO: 354494 - protein, 17 aa, Mycobacterium
FIPVVMVLVVENIGHVK

SEQ ID NO: 354495 - protein, 19 aa, Mycobacterium
FIQRAHRRLSFQLSGAQLG

SEQ ID NO: 354496 - protein, 24 aa, Mycobacterium
FIQRIRIQLILTVFVVAANLIGIG

SEQ ID NO: 354497 - protein, 18 aa, Mycobacterium
FIRSNFDPARPIAVNVID

SEQ ID NO: 354498 - protein, 18 aa, Mycobacterium
FISGAYLPADLSLYDYDG

SEQ ID NO: 354499 - protein, 18 aa, Mycobacterium
FISLLLLAGLVQVPEDMQ

SEQ ID NO: 354500 - protein, 41 aa, Mycobacterium
FISPSRKIAMRLLYATGALFAAVLIVYLDRHGYRDINATPD

SEQ ID NO: 354501 - protein, 17 aa, Mycobacterium
FISVLRLVSYWFEPRRV

SEQ ID NO: 354502 - protein, 25 aa, Mycobacterium
FITNVIVFGMWYWEFDRGGPFARRT

SEQ ID NO: 354503 - protein, 18 aa, Mycobacterium
FIVASWPVASKSAPVVAV

SEQ ID NO: 354504 - protein, 23 aa, Mycobacterium
FIVAVVFFSGFFVAWSAGYGGGG

SEQ ID NO: 354505 - protein, 26 aa, Mycobacterium
FIVFDIEIVFLYPWAVSFDALGTFAL

SEQ ID NO: 354506 - protein, 38 aa, Mycobacterium
FIVISLLAVWLTYLGFGSIALWAFRFAWVQVGALGTLM

SEQ ID NO: 354507 - protein, 17 aa, Mycobacterium
FIVLFNTVVDLAYAYLD

SEQ ID NO: 354508 - protein, 18 aa, Mycobacterium
FIVLVITGVYLALFFDPS

SEQ ID NO: 354509 - protein, 29 aa, Mycobacterium
FIVNLAIIPFQFFLEAGWIFIVGLADICE

SEQ ID NO: 354510 - protein, 19 aa, Mycobacterium
FIVPLVLLIVAGVLRSPVA

SEQ ID NO: 354511 - protein, 17 aa, Mycobacterium
FIVVGLLWVFGVWPGDT

SEQ ID NO: 354512 - protein, 33 aa, Mycobacterium
FIYYPVSGIMWVWYKLFAYLLGPKNFFAWALSV

SEQ ID NO: 354513 - protein, 17 aa, Mycobacterium
FKAIPQWSIALIALVIV

SEQ ID NO: 354514 - protein, 27 aa, Mycobacterium
FKANPMWPWLYGAILLMGGLFIIAFHQ

SEQ ID NO: 354515 - protein, 19 aa, Mycobacterium
FKAPLSFDISVNEILLPLV

SEQ ID NO: 354516 - protein, 33 aa, Mycobacterium
FKDLLINCGYPLIERFPLMLGTAGGVLLIGLIR

SEQ ID NO: 354517 - protein, 18 aa, Mycobacterium
FKELGPLNWVIAKAGARG

SEQ ID NO: 354518 - protein, 32 aa, Mycobacterium
FKGAPSAIVLLLAAFWCLVPGALSFVNVSEVA

SEQ ID NO: 354519 - protein, 26 aa, Mycobacterium
FKHWRYDPPYKTACAGMVILVVTVLV

SEQ ID NO: 354520 - protein, 19 aa, Mycobacterium
FKIDLGDPPPCSVGFLPAT

SEQ ID NO: 354521 - protein, 18 aa, Mycobacterium
FKIHLQDPPPCATGFIPA

SEQ ID NO: 354522 - protein, 20 aa, Mycobacterium
FKLTPWIVVSVFVLGAALAT

SEQ ID NO: 354523 - protein, 20 aa, Mycobacterium
FKTSWYLLGPAFVAAIAYVD

SEQ ID NO: 354524 - protein, 18 aa, Mycobacterium
FKVFALVAALEQGIGLGY

SEQ ID NO: 354525 - protein, 17 aa, Mycobacterium
FKVGAVPFHFWVPDVYQ

SEQ ID NO: 354526 - protein, 22 aa, Mycobacterium
FLAAAVLYFLAIGQVKGFAFTL

SEQ ID NO: 354527 - protein, 22 aa, Mycobacterium
FLAAAVLYFLAVGQVKGFAFTL

SEQ ID NO: 354528 - protein, 18 aa, Mycobacterium
FLAAFGWERSDFALTGVI

SEQ ID NO: 354529 - protein, 17 aa, Mycobacterium
FLAAFINVRIAAPIVAG

SEQ ID NO: 354530 - protein, 17 aa, Mycobacterium
FLAAFINVRIAAPVVAG

SEQ ID NO: 354531 - protein, 17 aa, Mycobacterium
FLAFLQKFVVKKPVTRN

SEQ ID NO: 354532 - protein, 18 aa, Mycobacterium
FLAFVLCLGVVVDAVVLN

SEQ ID NO: 354533 - protein, 25 aa, Mycobacterium
FLAGKPPWVGALLGLVLVLTCTLGD

SEQ ID NO: 354534 - protein, 18 aa, Mycobacterium
FLAGLFLLGLVVGLGDVV

SEQ ID NO: 354535 - protein, 19 aa, Mycobacterium
FLALIAIPVNFNYWVFALL

SEQ ID NO: 354536 - protein, 18 aa, Mycobacterium
FLALLTAAGWTPAYLSVG

SEQ ID NO: 354537 - protein, 18 aa, Mycobacterium
FLALPRLTGVLATIPERT

SEQ ID NO: 354538 - protein, 18 aa, Mycobacterium
FLALRGLVLLAFPGLMRA

SEQ ID NO: 354539 - protein, 21 aa, Mycobacterium
FLAPWLFSVFVDVFGAVRAGL

SEQ ID NO: 354540 - protein, 18 aa, Mycobacterium
FLARRFRRHPWYTATGLA

SEQ ID NO: 354541 - protein, 24 aa, Mycobacterium
FLASYLFNVYFQHGAPGSFVATFA

SEQ ID NO: 354542 - protein, 24 aa, Mycobacterium
FLASYLFNVYFQNGAPGSFVATFA

SEQ ID NO: 354543 - protein, 18 aa, Mycobacterium
FLATFIAAQFFPAGNDTA

SEQ ID NO: 354544 - protein, 18 aa, Mycobacterium
FLAVLKRTLSVGNYALLV

SEQ ID NO: 354545 - protein, 19 aa, Mycobacterium
FLAVTMIDLDKFKVLNDTY

SEQ ID NO: 354546 - protein, 17 aa, Mycobacterium
FLCAAFVALAGFILALF

SEQ ID NO: 354547 - protein, 17 aa, Mycobacterium
FLCAVLAVAVGVLLKHT

SEQ ID NO: 354548 - protein, 25 aa, Mycobacterium
FLCDGELFIVGRMKDLLIVYGRNHY

SEQ ID NO: 354549 - protein, 25 aa, Mycobacterium
FLDAVICYIGFLLPLFTAKRQTIAD

SEQ ID NO: 354550 - protein, 33 aa, Mycobacterium
FLDLGVKFILLNAPWLIAPWLVLAWGYQTLKRQ

SEQ ID NO: 354551 - protein, 18 aa, Mycobacterium
FLDQTWMIARVSLVPTLL

SEQ ID NO: 354552 - protein, 18 aa, Mycobacterium
FLDYFLIGFIVTFVSTSW

SEQ ID NO: 354553 - protein, 20 aa, Mycobacterium
FLELAPNPVALMQVGLTTAA

SEQ ID NO: 354554 - protein, 20 aa, Mycobacterium
FLEPLTIAGLMYLIISYVSS

SEQ ID NO: 354555 - protein, 20 aa, Mycobacterium
FLEQTWMIARVSLVPTLLVS

SEQ ID NO: 354556 - protein, 17 aa, Mycobacterium
FLERPIAVEAAFKNLVL

SEQ ID NO: 354557 - protein, 19 aa, Mycobacterium
FLGALFAGWCPVPLPEPQG

SEQ ID NO: 354558 - protein, 18 aa, Mycobacterium
FLGALQAGQIAVPLSMPL

SEQ ID NO: 354559 - protein, 27 aa, Mycobacterium
FLGEWAVLIFRWLLLTGTFACAMAFHN

SEQ ID NO: 354560 - protein, 17 aa, Mycobacterium
FLGFALGGPLSDGLTAW

SEQ ID NO: 354561 - protein, 17 aa, Mycobacterium
FLGFAPTNSVVAYMLHR

SEQ ID NO: 354562 - protein, 17 aa, Mycobacterium
FLGFLIGATTAGAILAP

SEQ ID NO: 354563 - protein, 18 aa, Mycobacterium
FLGGLLFFEKAAIIPFVA

SEQ ID NO: 354564 - protein, 31 aa, Mycobacterium
FLGLSLLGWGGFLLMWVLQAAVFWNGMEAIR

SEQ ID NO: 354565 - protein, 28 aa, Mycobacterium
FLGNPVYAFLLMVLFQYGVALHELESER

SEQ ID NO: 354566 - protein, 24 aa, Mycobacterium
FLGVCVVLAPWQLIGHGGPVLAQF

SEQ ID NO: 354567 - protein, 29 aa, Mycobacterium
FLHAAVFSGLIWLAVLLPLPHSVRPVVEP

SEQ ID NO: 354568 - protein, 19 aa, Mycobacterium
FLHAAVFSGLIWLAVLLPM

SEQ ID NO: 354569 - protein, 34 aa, Mycobacterium
FLHELDTPEFPWAGLTIFLLIAVLAAAVGTRFMQ

SEQ ID NO: 354570 - protein, 32 aa, Mycobacterium
FLHELDTPEFPWTGLTIFLLIAVFAAAVGTRL

SEQ ID NO: 354571 - protein, 17 aa, Mycobacterium
FLIEPFSLLAVVPSWVA

SEQ ID NO: 354572 - protein, 31 aa, Mycobacterium
FLIGATVLFLACRWWQSVGAPGWVGYVGAAA

SEQ ID NO: 354573 - protein, 19 aa, Mycobacterium
FLIGAVASIVLLVAGGIFA

SEQ ID NO: 354574 - protein, 18 aa, Mycobacterium
FLINLPIVSYYQIGTALT

SEQ ID NO: 354575 - protein, 27 aa, Mycobacterium
FLISKPRPMVNLLAFWFGGMATGAAVA

SEQ ID NO: 354576 - protein, 19 aa, Mycobacterium
FLISRIREYWMASGRTRAD

SEQ ID NO: 354577 - protein, 18 aa, Mycobacterium
FLISRYHDYVRQGLASDL

SEQ ID NO: 354578 - protein, 17 aa, Mycobacterium
FLISRYHEYIKQGLASD

SEQ ID NO: 354579 - protein, 18 aa, Mycobacterium
FLITGLYVRFANRELDPR

SEQ ID NO: 354580 - protein, 18 aa, Mycobacterium
FLLALGAIPGALLPQRSL

SEQ ID NO: 354581 - protein, 17 aa, Mycobacterium
FLLALGAIPGALVPQRS

SEQ ID NO: 354582 - protein, 18 aa, Mycobacterium
FLLELMVAFFTSDLVIRV

SEQ ID NO: 354583 - protein, 22 aa, Mycobacterium
FLLFARALAFVRALLSFVRRPL

SEQ ID NO: 354584 - protein, 17 aa, Mycobacterium
FLLFLPWVRAAADNTAS

SEQ ID NO: 354585 - protein, 18 aa, Mycobacterium
FLLGAFSSAFFIYGAAML

SEQ ID NO: 354586 - protein, 27 aa, Mycobacterium
FLLGGHLGGWLLVVGLALAAGGLWWSD

SEQ ID NO: 354587 - protein, 19 aa, Mycobacterium
FLLGVVMALQFGPTLLLSV

SEQ ID NO: 354588 - protein, 17 aa, Mycobacterium
FLLWERFSRTRLIEPAG

SEQ ID NO: 354589 - protein, 24 aa, Mycobacterium
FLNDNLGWFFLFADGNVSLAGGGT

SEQ ID NO: 354590 - protein, 23 aa, Mycobacterium
FLNPILELFRNTAALALLPVFVL

SEQ ID NO: 354591 - protein, 19 aa, Mycobacterium
FLNRHLGWFFLFKQGNVSL

SEQ ID NO: 354592 - protein, 24 aa, Mycobacterium
FLNRNLGWLFLFKKGNVSLAGGGT

SEQ ID NO: 354593 - protein, 18 aa, Mycobacterium
FLNTVPLRMRLTSTDYIG

SEQ ID NO: 354594 - protein, 17 aa, Mycobacterium
FLPAYIPVEICDIAGID

SEQ ID NO: 354595 - protein, 22 aa, Mycobacterium
FLPFLLIMGGFMYFASRRQRKA

SEQ ID NO: 354596 - protein, 24 aa, Mycobacterium
FLPFLLIMGGFMYFASRRQRRAMQ

SEQ ID NO: 354597 - protein, 26 aa, Mycobacterium
FLPPVGGFLYWLRPKTIRLPAWPDKV

SEQ ID NO: 354598 - protein, 17 aa, Mycobacterium
FLPSWISFLADKKKALA

SEQ ID NO: 354599 - protein, 21 aa, Mycobacterium
FLQIVLGPNRFLAYGWRIGFL

SEQ ID NO: 354600 - protein, 19 aa, Mycobacterium
FLQRGLPLVLPRRVRARKL

SEQ ID NO: 354601 - protein, 31 aa, Mycobacterium
FLRWHHTRVGYLKSWRLALGAVWSTYRHTIS

SEQ ID NO: 354602 - protein, 17 aa, Mycobacterium
FLSIAFFGNGLASITWS

SEQ ID NO: 354603 - protein, 18 aa, Mycobacterium
FLSQLPYVPLGDLRTVVS

SEQ ID NO: 354604 - protein, 22 aa, Mycobacterium
FLTKMLQAFLVVPGLALAFLVA

SEQ ID NO: 354605 - protein, 19 aa, Mycobacterium
FLTKTVYSVLLALLVGVEC

SEQ ID NO: 354606 - protein, 18 aa, Mycobacterium
FLTKTVYSVLLALTVGLA

SEQ ID NO: 354607 - protein, 17 aa, Mycobacterium
FLTLFISFPLQLSAVTG

SEQ ID NO: 354608 - protein, 18 aa, Mycobacterium
FLTLTEFPDQLSLLARRP

SEQ ID NO: 354609 - protein, 25 aa, Mycobacterium
FLTYGWRIAFLFSIVLVVFGVVVRL

SEQ ID NO: 354610 - protein, 17 aa, Mycobacterium
FLVALRRQRWGLVAIMV

SEQ ID NO: 354611 - protein, 17 aa, Mycobacterium
FLVGACIVVLLLGIEHI

SEQ ID NO: 354612 - protein, 26 aa, Mycobacterium
FLVGATIVFLACRWVQAQGGAPLWVG

SEQ ID NO: 354613 - protein, 26 aa, Mycobacterium
FLVGATVLFLACRWAQAHANLGVWVG

SEQ ID NO: 354614 - protein, 24 aa, Mycobacterium
FLVGGRMLPFWLVGGALMGAAVDT

SEQ ID NO: 354615 - protein, 24 aa, Mycobacterium
FLVGSGIDLPLIKPTLEASTTLPV

SEQ ID NO: 354616 - protein, 37 aa, Mycobacterium
FLVGSLMVWLLSDLIGWRGILLLTGASGLLLLLARFT

SEQ ID NO: 354617 - protein, 19 aa, Mycobacterium
FLVLSGFFFGGRLLRNAIT

SEQ ID NO: 354618 - protein, 20 aa, Mycobacterium
FLVRRLECALLRGGLDPADG

SEQ ID NO: 354619 - protein, 17 aa, Mycobacterium
FLVSKLNCSITTSDGQV

SEQ ID NO: 354620 - protein, 29 aa, Mycobacterium
FLVSKPRPMVNLLAFWFGGMATGIGVALA

SEQ ID NO: 354621 - protein, 18 aa, Mycobacterium
FLVSRIREFWLQSDQSRA

SEQ ID NO: 354622 - protein, 18 aa, Mycobacterium
FLVSRIREYWLETGENGR

SEQ ID NO: 354623 - protein, 17 aa, Mycobacterium
FLVVLRLVQGFAAGAEY

SEQ ID NO: 354624 - protein, 23 aa, Mycobacterium
FLVVMIAVYFFAEGGFAVVGPYS

SEQ ID NO: 354625 - protein, 18 aa, Mycobacterium
FLVVWLLIVYLRHEVKRR

SEQ ID NO: 354626 - protein, 22 aa, Mycobacterium
FLWHFLIIFAWIAYLLVLFQIL

SEQ ID NO: 354627 - protein, 28 aa, Mycobacterium
FLWYRVNRKWRPLLVAYPLIMAFTLVYT

SEQ ID NO: 354628 - protein, 25 aa, Mycobacterium
FMALGWKLLIPVSLVWVLIAAVIRT

SEQ ID NO: 354629 - protein, 17 aa, Mycobacterium
FMANINGLGGYFFRYLF

SEQ ID NO: 354630 - protein, 24 aa, Mycobacterium
FMCVALVVYFVLLGRTALILIGSG

SEQ ID NO: 354631 - protein, 20 aa, Mycobacterium
FMDLVDKFGLGQRTGVGLPG

SEQ ID NO: 354632 - protein, 29 aa, Mycobacterium
FMDTARLREQWRFRPAWNSSECVEDFALA

SEQ ID NO: 354633 - protein, 31 aa, Mycobacterium; identical to SEQ ID NO: 20577

SEQ ID NO: 354634 - protein, 18 aa, Mycobacterium
FMFVGFCAWFVGMHLLFA

SEQ ID NO: 354635 - protein, 22 aa, Mycobacterium
FMGFQFIVVLYLQELRGWSAMT

SEQ ID NO: 354636 - protein, 28 aa, Mycobacterium
FMHVMGSWNWWAPKPLVWLHERFGISEG

SEQ ID NO: 354637 - protein, 23 aa, Mycobacterium
FMISLATIWLRTGLMPRWLAGIS

SEQ ID NO: 354638 - protein, 25 aa, Mycobacterium
FMKVALMLWQIGSPVLFPVAIWWFI

SEQ ID NO: 354639 - protein, 20 aa, Mycobacterium
FMLCAAFNVLLRGLCGRDTA

SEQ ID NO: 354640 - protein, 17 aa, Mycobacterium
FMLIRQEDDRRAAVNEA

SEQ ID NO: 354641 - protein, 23 aa, Mycobacterium
FMLRWRAWLTDQLTGDWLDGRAY

SEQ ID NO: 354642 - protein, 17 aa, Mycobacterium
FMLTVYFTLAVGAHLRA

SEQ ID NO: 354643 - protein, 25 aa, Mycobacterium
FMMRWRVWLTRRFIDDWLSDLSYYR

SEQ ID NO: 354644 - protein, 23 aa, Mycobacterium
FMNGWYYLTRREDVLAALRNTKA

SEQ ID NO: 354645 - protein, 17 aa, Mycobacterium
FMPGWLALALAVILVVL

SEQ ID NO: 354646 - protein, 17 aa, Mycobacterium
FMPVALADYPRGARQEP

SEQ ID NO: 354647 - protein, 19 aa, Mycobacterium
FMTLMVIAGLTWGAGRLGN

SEQ ID NO: 354648 - protein, 32 aa, Mycobacterium
FMTPSIAALLGRWFWWPLQVRSRPTGTTTGKP

SEQ ID NO: 354649 - protein, 33 aa, Mycobacterium
FMTPSIAALLGRWFWWPLQVRTRPTRPTAVKPR

SEQ ID NO: 354650 - protein, 25 aa, Mycobacterium
FMTQRFMLAWRTWLTDRLTGDWLDG

SEQ ID NO: 354651 - protein, 18 aa, Mycobacterium
FMVDTAVLKHRYFRRLNI

SEQ ID NO: 354652 - protein, 18 aa, Mycobacterium
FMVPLGILSALSFWYVPK

SEQ ID NO: 354653 - protein, 24 aa, Mycobacterium
FNARQMLLVNMLTDALPAAALAVS

SEQ ID NO: 354654 - protein, 39 aa, Mycobacterium
FNDFLINLAPIVIIVLAAFILLVPRLFPGAFTADPTRIG

SEQ ID NO: 354655 - protein, 21 aa, Mycobacterium
FNDLLRVLPPVPSAATGQPVA

SEQ ID NO: 354656 - protein, 17 aa, Mycobacterium
FNIAFFGRTGAGKSTLL

SEQ ID NO: 354657 - protein, 35 aa, Mycobacterium
FNILPFVFGVILLAGLAWYWYLKRTRPEIAQRIGT

SEQ ID NO: 354658 - protein, 19 aa, Mycobacterium
FNLPKTFDEYLLGLSSAQR

SEQ ID NO: 354659 - protein, 24 aa, Mycobacterium
FNLPPSFVIVTIACVFWFVVWAAN

SEQ ID NO: 354660 - protein, 19 aa, Mycobacterium
FNLVRLPRIAPFSADLYGV

SEQ ID NO: 354661 - protein, 28 aa, Mycobacterium
FNNACLILLGLFPLFVMFIITAITMQRE

SEQ ID NO: 354662 - protein, 20 aa, Mycobacterium
FNQGFYNLFLAVAIGAGTVL

SEQ ID NO: 354663 - protein, 19 aa, Mycobacterium
FNTFLRPTDVLWSSFEVVV

SEQ ID NO: 354664 - protein, 25 aa, Mycobacterium
FNTRMFKYFAKRFALKRGALMFGKL

SEQ ID NO: 354665 - protein, 21 aa, Mycobacterium
FNVVRGLLVYILASGASNRND

SEQ ID NO: 354666 - protein, 32 aa, Mycobacterium
FPADTTVVSWLPLFHDMGLILGICAPLVTGCT

SEQ ID NO: 354667 - protein, 21 aa, Mycobacterium
FPADVLYYFRLYALGTQVVIY

SEQ ID NO: 354668 - protein, 18 aa, Mycobacterium
FPAIVKFLSEHVLSRQND

SEQ ID NO: 354669 - protein, 36 aa, Mycobacterium
FPALKTAFTAIGTGAMWLWNNAIKPAWNGIKEVIGL

SEQ ID NO: 354670 - protein, 19 aa, Mycobacterium
FPASIVAIPLGFWLYAACA

SEQ ID NO: 354671 - protein, 17 aa, Mycobacterium
FPAWLRPYVRNQPVSQF

SEQ ID NO: 354672 - protein, 24 aa, Mycobacterium
FPDGARLWLPSYLAWFLGGMMLTV

SEQ ID NO: 354673 - protein, 24 aa, Mycobacterium
FPDWMIADGPWLKRYPYIPRYIDQ

SEQ ID NO: 354674 - protein, 19 aa, Mycobacterium
FPEPFMYNYCRDDHPGVLV

SEQ ID NO: 354675 - protein, 20 aa, Mycobacterium
FPEPFMYTYCRDVHPGVLVR

SEQ ID NO: 354676 - protein, 19 aa, Mycobacterium
FPGATPRSSSGNRAFWIIA

SEQ ID NO: 354677 - protein, 20 aa, Mycobacterium
FPGDIFALIVGVSLLFAHLE

SEQ ID NO: 354678 - protein, 17 aa, Mycobacterium
FPGFKNGVGLILQLPQP

SEQ ID NO: 354679 - protein, 20 aa, Mycobacterium
FPGNIYAGMFGFTAAALLEI

SEQ ID NO: 354680 - protein, 17 aa, Mycobacterium
FPGPWALVPVGAAMLLI

SEQ ID NO: 354681 - protein, 17 aa, Mycobacterium
FPGRDGLFWVYIATLMV

SEQ ID NO: 354682 - protein, 19 aa, Mycobacterium
FPGVMLYLTYWFGRDQLAR

SEQ ID NO: 354683 - protein, 20 aa, Mycobacterium
FPGWANYFPVTRGIPQPPII

SEQ ID NO: 354684 - protein, 19 aa, Mycobacterium
FPGWQVLEILPQSWSSDDA

SEQ ID NO: 354685 - protein, 17 aa, Mycobacterium
FPHTASVVVWYSPGRCD

SEQ ID NO: 354686 - protein, 18 aa, Mycobacterium
FPIVLIALGIFILVSGLA

SEQ ID NO: 354687 - protein, 21 aa, Mycobacterium
FPLGFSLYMSFQRWDVFTPPK

SEQ ID NO: 354688 - protein, 18 aa, Mycobacterium
FPLPVDIITPFLRNPEML

SEQ ID NO: 354689 - protein, 20 aa, Mycobacterium
FPLPVDIITPFLRQPELLQS

SEQ ID NO: 354690 - protein, 26 aa, Mycobacterium
FPLTVFTLMWGVPYLTKAQGLSPHLA

SEQ ID NO: 354691 - protein, 18 aa, Mycobacterium
FPNGLLAMVLITSGVVFA

SEQ ID NO: 354692 - protein, 18 aa, Mycobacterium
FPPMGSSLYWLRFGTIRL

SEQ ID NO: 354693 - protein, 22 aa, Mycobacterium
FPRKVSFLPGMRYYAGNWDTTL

SEQ ID NO: 354694 - protein, 35 aa, Mycobacterium
FPRLARLVVRRPLIVIGFWVALAAALSMALPALTQ

SEQ ID NO: 354695 - protein, 27 aa, Mycobacterium
FPSPADLFYLAFSVLAVPGLLAMAPFD

SEQ ID NO: 354696 - protein, 45 aa, Mycobacterium
FPSPPRGVWHLGPLPIRAYAFFIIIGIVMGLMIGDRRFAARGGER

SEQ ID NO: 354697 - protein, 29 aa, Mycobacterium
FPSPVPRALTPWPYNSIPMCPGCTLGGRV

SEQ ID NO: 354698 - protein, 21 aa, Mycobacterium
FPSWVLYPCALAMMVFSKSFS

SEQ ID NO: 354699 - protein, 19 aa, Mycobacterium
FPTFLRHIRPILGLGVGLV

SEQ ID NO: 354700 - protein, 17 aa, Mycobacterium
FPTLNYAVSVEEACERA

SEQ ID NO: 354701 - protein, 18 aa, Mycobacterium
FPTLNYAVSVEEACERAD

SEQ ID NO: 354702 - protein, 21 aa, Mycobacterium
FPVLAPHLLSITLIGLAILTV

SEQ ID NO: 354703 - protein, 28 aa, Mycobacterium
FPVLGWWIYDIMYITPFLAIPYLHTVNR

SEQ ID NO: 354704 - protein, 26 aa, Mycobacterium
FPVNSTLPQYLYIKSPHDLRTPRGLA

SEQ ID NO: 354705 - protein, 32 aa, Mycobacterium
FPVNVHWSVLVILWLFTWSLASTLPGSVKGYS

SEQ ID NO: 354706 - protein, 17 aa, Mycobacterium
FPVPWALLPVAGAALVI

SEQ ID NO: 354707 - protein, 53 aa, Mycobacterium
FPVQAVVFFFSTLLGQFFSWIPVISLSYAQIIIGYFVGFLAAAPVLTSGAEIA

SEQ ID NO: 354708 - protein, 20 aa, Mycobacterium
FPVVVLYVLGRRQLVSGLTA

SEQ ID NO: 354709 - protein, 25 aa, Mycobacterium
FQALTWIFQIMPLFFFAGAAACLTS

SEQ ID NO: 354710 - protein, 17 aa, Mycobacterium
FQFAFDVQTFELPQGTI

SEQ ID NO: 354711 - protein, 23 aa, Mycobacterium
FQFGEFLDQTWMIARVSLVPTLL

SEQ ID NO: 354712 - protein, 28 aa, Mycobacterium
FQHAPAAWLLDMGMLAVLSVGYGALVRW

SEQ ID NO: 354713 - protein, 28 aa, Mycobacterium
FQIGLGITLLLALIWADALAVALAGFIV

SEQ ID NO: 354714 - protein, 32 aa, Mycobacterium
FQIRRGHMMLTFVLATMLLVGVMLRYTKFLVR

SEQ ID NO: 354715 - protein, 18 aa, Mycobacterium
FQISLFVVILGYGLTAQF

SEQ ID NO: 354716 - protein, 19 aa, Mycobacterium
FQLFAFGFSFGGPAFFWTW

SEQ ID NO: 354717 - protein, 25 aa, Mycobacterium
FQQATFLFFITFGLLWSGYTVEVPS

SEQ ID NO: 354718 - protein, 17 aa, Mycobacterium
FQQWSWYRWTKSVMRHA

SEQ ID NO: 354719 - protein, 21 aa, Mycobacterium
FQRGLKLFLSPDGTAARFIIT

SEQ ID NO: 354720 - protein, 17 aa, Mycobacterium
FQRGLNLFVSPDGKAAK

SEQ ID NO: 354721 - protein, 21 aa, Mycobacterium
FQRGLTLFLSPDGTAARFIIT

SEQ ID NO: 354722 - protein, 25 aa, Mycobacterium
FQRPGLLILVFVVTILSAGFHEFGH

SEQ ID NO: 354723 - protein, 21 aa, Mycobacterium
FQSWLPALKEMVPSLGASLSD

SEQ ID NO: 354724 - protein, 18 aa, Mycobacterium
FQTPPTLTLKLPRPTEVS

SEQ ID NO: 354725 - protein, 28 aa, Mycobacterium
FQTPTFSLGLLPLFLPAVIALIAENIGH

SEQ ID NO: 354726 - protein, 18 aa, Mycobacterium
FQWAPGVWAMMAAGLVVL

SEQ ID NO: 354727 - protein, 32 aa, Mycobacterium
FQWKEFVLQSWFLIRVAFLPTLAVSIPLTVLI

SEQ ID NO: 354728 - protein, 26 aa, Mycobacterium
FQYSDMLQFVWAQAKFRLTGRENSDD

SEQ ID NO: 354729 - protein, 30 aa, Mycobacterium
FRAGVQDILLVAFGLAWTEFLNRSDTPIGV

SEQ ID NO: 354730 - protein, 19 aa, Mycobacterium
FRAHSMFDPELYRDKAEVQ

SEQ ID NO: 354731 - protein, 19 aa, Mycobacterium
FRALQNWVPLVAAAGSMII

SEQ ID NO: 354732 - protein, 31 aa, Mycobacterium
FRAVPVLIMMIFAYFLYAFYDVFPSKYLALA

SEQ ID NO: 354733 - protein, 24 aa, Mycobacterium
FRCRSWLPVVLALVGGGGIALVVL

SEQ ID NO: 354734 - protein, 20 aa, Mycobacterium
FRDWGALQRLIPFYGDAEPA

SEQ ID NO: 354735 - protein, 18 aa, Mycobacterium
FRGTAIRMVKRLAPQRFL

SEQ ID NO: 354736 - protein, 30 aa, Mycobacterium
FRGTPLLVQAFFIYFGIPATMGFQMSAVTA

SEQ ID NO: 354737 - protein, 30 aa, Mycobacterium
FRGTPLLVQAFFIYFGIPSALGFQMSALTA

SEQ ID NO: 354738 - protein, 23 aa, Mycobacterium
FRGVAMFFALTWAVGIGAYTVIA

SEQ ID NO: 354739 - protein, 17 aa, Mycobacterium
FRHGLLILVALAAVFVV

SEQ ID NO: 354740 - protein, 20 aa, Mycobacterium
FRHPIAWARATLDGVDALLL

SEQ ID NO: 354741 - protein, 22 aa, Mycobacterium
FRKVLQPFFSPHALAAMLPSLQ

SEQ ID NO: 354742 - protein, 17 aa, Mycobacterium
FRLNLGDPPPCLTGFVP

SEQ ID NO: 354743 - protein, 20 aa, Mycobacterium
FRLPFKEKWRLPDATALLVG

SEQ ID NO: 354744 - protein, 20 aa, Mycobacterium
FRMPIFTWNILVTSVIVLVA

SEQ ID NO: 354745 - protein, 21 aa, Mycobacterium
FRMPIFTWNILVTSVLVLIVF

SEQ ID NO: 354746 - protein, 23 aa, Mycobacterium
FRMSLRDARWWLGGMAAVTNYSL

SEQ ID NO: 354747 - protein, 19 aa, Mycobacterium
FRQRRRMLMPMFGRRHLAR

SEQ ID NO: 354748 - protein, 18 aa, Mycobacterium
FRQWGVWLFGIWIPIFGV

SEQ ID NO: 354749 - protein, 29 aa, Mycobacterium
FRRRNPKPAIVVVILLAVATAVVWTVALT

SEQ ID NO: 354750 - protein, 20 aa, Mycobacterium
FRRVVLPQLRLAVLGGGLLI

SEQ ID NO: 354751 - protein, 20 aa, Mycobacterium
FRRWEQMMFLLIAVNVVIIP

SEQ ID NO: 354752 - protein, 25 aa, Mycobacterium
FRRWERFLFALIAINIVMIPMAILV

SEQ ID NO: 354753 - protein, 22 aa, Mycobacterium
FRSFRPDLVLLAETSGKNAIVV

SEQ ID NO: 354754 - protein, 30 aa, Mycobacterium
FRSVHPLLYVVAMLFVIYFAKGPIEDLLAH

SEQ ID NO: 354755 - protein, 33 aa, Mycobacterium
FRTPFQWREFILQSWFLLRVAFLPTVAVSIPLT

SEQ ID NO: 354756 - protein, 25 aa, Mycobacterium
FRVPCDFWLASYWFIMCGTTAYLLV

SEQ ID NO: 354757 - protein, 19 aa, Mycobacterium
FRVPFLRNWKYSRAYLNWL

SEQ ID NO: 354758 - protein, 17 aa, Mycobacterium
FRWRASGLTRAVATCAG

SEQ ID NO: 354759 - protein, 26 aa, Mycobacterium
FSAADKPVIFWTPDHGAFVVRGAMKA

SEQ ID NO: 354760 - protein, 26 aa, Mycobacterium
FSAADKPVIFWTPDHGAFVVRGAMKV

SEQ ID NO: 354761 - protein, 24 aa, Mycobacterium
FSAFAFTIVLLVLVLIPGIGKEAN

SEQ ID NO: 354762 - protein, 25 aa, Mycobacterium
FSAGAVAVLLLWPLVAEPLLANMPG

SEQ ID NO: 354763 - protein, 24 aa, Mycobacterium
FSAGWAIFGIRGALLPLLVVEALH

SEQ ID NO: 354764 - protein, 34 aa, Mycobacterium
FSALDVLLFYIFFEAMLIPMYFLIGGFGSTHSDV

SEQ ID NO: 354765 - protein, 23 aa, Mycobacterium
FSALTFITLAIFLGAGTGGVIAW

SEQ ID NO: 354766 - protein, 26 aa, Mycobacterium
FSAPDNPVIFWTPATGARIVRGPINA

SEQ ID NO: 354767 - protein, 22 aa, Mycobacterium
FSARHYFLPHKYLVGAKYDQVM

SEQ ID NO: 354768 - protein, 25 aa, Mycobacterium
FSARKDLYIAYVPFAVAAGVAAVWA

SEQ ID NO: 354769 - protein, 25 aa, Mycobacterium
FSASGILVLFTFQLMQGKLPLHLND

SEQ ID NO: 354770 - protein, 17 aa, Mycobacterium
FSCDPLRVFPADVAGGY

SEQ ID NO: 354771 - protein, 28 aa, Mycobacterium
FSDALTAIPLWIAFALSTKAATRRYTYG

SEQ ID NO: 354772 - protein, 22 aa, Mycobacterium
FSDLVLMKYLAFGLMAALLLDA

SEQ ID NO: 354773 - protein, 29 aa, Mycobacterium
FSDLVMMKYLAFGLLIALLLDATIIRMFL

SEQ ID NO: 354774 - protein, 23 aa, Mycobacterium
FSDLVMMKYLAFGLMAALLLDAT

SEQ ID NO: 354775 - protein, 27 aa, Mycobacterium
FSEPDPPPLYYIPPSSSSATVTGSTTS

SEQ ID NO: 354776 - protein, 24 aa, Mycobacterium
FSGFAFTIVLLVLVLIPGIGKEAN

SEQ ID NO: 354777 - protein, 33 aa, Mycobacterium
FSGFDPYLLTLGNPLTYLSPLNIAFALGYPMDF

SEQ ID NO: 354778 - protein, 29 aa, Mycobacterium
FSGGISTFLFPILGVVLGVLVAFIIFGRR

SEQ ID NO: 354779 - protein, 30 aa, Mycobacterium
FSGLAAVIKAPLKLLGTFLASIPSEVFGFQ

SEQ ID NO: 354780 - protein, 30 aa, Mycobacterium
FSGLAAVIKAPLKVLGTFLAAIPSEVFGFQ

SEQ ID NO: 354781 - protein, 20 aa, Mycobacterium
FSGLIWLAVLLPMSAGLRPV

SEQ ID NO: 354782 - protein, 17 aa, Mycobacterium
FSHARRARRIMLQNVGL

SEQ ID NO: 354783 - protein, 26 aa, Mycobacterium
FSHFTLLLVHALRQQFSRVRVFAFID

SEQ ID NO: 354784 - protein, 23 aa, Mycobacterium
FSHNPLLMVLGDTGSGKTTLLRH

SEQ ID NO: 354785 - protein, 23 aa, Mycobacterium
FSINVAAVLYLLISKRLFGLRGG

SEQ ID NO: 354786 - protein, 25 aa, Mycobacterium
FSIRHKVLIIGVWVVTAAALALLFP

SEQ ID NO: 354787 - protein, 26 aa, Mycobacterium
FSITVFALMWGLPYLTVAQGLSPGVA

SEQ ID NO: 354788 - protein, 25 aa, Mycobacterium
FSIWSLWSVMVLFMPASVYGFSAGD

SEQ ID NO: 354789 - protein, 22 aa, Mycobacterium
FSIWTLWSVMVLFMPQSVYGIS

SEQ ID NO: 354790 - protein, 17 aa, Mycobacterium
FSKDPVFRERMKREARI

SEQ ID NO: 354791 - protein, 25 aa, Mycobacterium
FSKRWAKRWLPATAAIYAANGLLGE

SEQ ID NO: 354792 - protein, 39 aa, Mycobacterium
FSLGHLLGVPAWVTQRLWWALLIVAGFWGLIRVAEALGI

SEQ ID NO: 354793 - protein, 18 aa, Mycobacterium
FSLLVMVAGLIRGIKVHT

SEQ ID NO: 354794 - protein, 18 aa, Mycobacterium
FSMLAFSGRFGRARKITW

SEQ ID NO: 354795 - protein, 29 aa, Mycobacterium
FSMLALLTRRWVLSWIALAGSFVASVIGM

SEQ ID NO: 354796 - protein, 18 aa, Mycobacterium
FSPLYQRLLRRFNSGIAV

SEQ ID NO: 354797 - protein, 18 aa, Mycobacterium
FSPLYRRLGKRFGSGIAA

SEQ ID NO: 354798 - protein, 23 aa, Mycobacterium
FSPNFVALLSFLFGAGLALGCDY

SEQ ID NO: 354799 - protein, 18 aa, Mycobacterium
FSQGLINRRAVLKSTYAQ

SEQ ID NO: 354800 - protein, 18 aa, Mycobacterium
FSRNEFEQLITQPLDRFI

SEQ ID NO: 354801 - protein, 19 aa, Mycobacterium
FSRRFVPTSFIVSAITLAI

SEQ ID NO: 354802 - protein, 20 aa, Mycobacterium
FSRRFVPTSFIVSAITLLVT

SEQ ID NO: 354803 - protein, 17 aa, Mycobacterium
FSRTRLIEPAGVRFRPF

SEQ ID NO: 354804 - protein, 17 aa, Mycobacterium
FSSDPVFRERMKREARI

SEQ ID NO: 354805 - protein, 22 aa, Mycobacterium
FSSFAVLIYYAVANASAFTLGR

SEQ ID NO: 354806 - protein, 24 aa, Mycobacterium
FSSGDVFWWTLGTGLLVCVVMPLG

SEQ ID NO: 354807 - protein, 27 aa, Mycobacterium
FSSISILFLFVFQLVQGKLPLHLHDPA

SEQ ID NO: 354808 - protein, 29 aa, Mycobacterium
FSSKRAFDILGSPLPLVPLAFDPPEHTRF

SEQ ID NO: 354809 - protein, 29 aa, Mycobacterium
FSTFLQPTDIIWSLLQAVLMGLVVMLVHT

SEQ ID NO: 354810 - protein, 17 aa, Mycobacterium
FSTNKWLTLAAAALMVS

SEQ ID NO: 354811 - protein, 17 aa, Mycobacterium
FSVGFILTFLLGGLSGV

SEQ ID NO: 354812 - protein, 27 aa, Mycobacterium
FSVLALLTRRWALAWVALAGSAVASAL

SEQ ID NO: 354813 - protein, 17 aa, Mycobacterium
FSVLGLTVQIAGAGAYL

SEQ ID NO: 354814 - protein, 17 aa, Mycobacterium
FSVLLSVRLMVLLSYQG

SEQ ID NO: 354815 - protein, 19 aa, Mycobacterium
FSVPLRKWRDAGPVPYLGA

SEQ ID NO: 354816 - protein, 17 aa, Mycobacterium
FSVVQLLFFMTPIIWND

SEQ ID NO: 354817 - protein, 23 aa, Mycobacterium
FSWAAHWVWFAPAIVWLVAKACT

SEQ ID NO: 354818 - protein, 22 aa, Mycobacterium
FSWLRFGIFYYSEAVGPTLRIG

SEQ ID NO: 354819 - protein, 18 aa, Mycobacterium
FSWPAFLVQFAAAAAYAL

SEQ ID NO: 354820 - protein, 19 aa, Mycobacterium
FTAAVAVLIIACPCALGLA

SEQ ID NO: 354821 - protein, 28 aa, Mycobacterium
FTAHGIYAHYLISGLPYYLQSTKRRTGV

SEQ ID NO: 354822 - protein, 17 aa, Mycobacterium
FTAILGSVILLWLVGMV

SEQ ID NO: 354823 - protein, 29 aa, Mycobacterium
FTAKVWGFLFMYFWLRATLPRLRYDQFMA

SEQ ID NO: 354824 - protein, 20 aa, Mycobacterium
FTAVPVMLSRILDLPETVRT

SEQ ID NO: 354825 - protein, 23 aa, Mycobacterium
FTAYFSFYLFYRTQSPELFLRSQ

SEQ ID NO: 354826 - protein, 29 aa, Mycobacterium
FTDRFQRIFVPVVLVGVVLLLFAGFVVDE

SEQ ID NO: 354827 - protein, 30 aa, Mycobacterium
FTDRFQRVFVPVILVGVVLLLFAGFVVDEP

SEQ ID NO: 354828 - protein, 26 aa, Mycobacterium
FTEAPWWITFVVVPSYIVVALALGTY

SEQ ID NO: 354829 - protein, 35 aa, Mycobacterium
FTEGAWLVVVVFPILVYFLMRLNREYRSEAAILEM

SEQ ID NO: 354830 - protein, 33 aa, Mycobacterium
FTEGAWVLLIVIPLLVLLFGRTENYYRSVRSEL

SEQ ID NO: 354831 - protein, 18 aa, Mycobacterium
FTEWGRQFWRVTGDYFRG

SEQ ID NO: 354832 - protein, 27 aa, Mycobacterium
FTFGQNLRYILLPQAFRAVIIPLGSVL

SEQ ID NO: 354833 - protein, 30 aa, Mycobacterium
FTFYRPPVPGTLRLTLIATLVAAGAFALYR

SEQ ID NO: 354834 - protein, 28 aa, Mycobacterium
FTGAGSFFPLLMVGGLVAMLFGGRGGSQ

SEQ ID NO: 354835 - protein, 22 aa, Mycobacterium
FTGHVLFGMFFGIGLGLGLINA

SEQ ID NO: 354836 - protein, 19 aa, Mycobacterium
FTGLAFLLPVAPMWAVHIG

SEQ ID NO: 354837 - protein, 17 aa, Mycobacterium
FTGLWHLVGKVGGAPGG

SEQ ID NO: 354838 - protein, 24 aa, Mycobacterium
FTGNEKVWPFFEKAVPAPRGHKVP

SEQ ID NO: 354839 - protein, 19 aa, Mycobacterium
FTGPWGVVLVGFSAILIGV

SEQ ID NO: 354840 - protein, 27 aa, Mycobacterium
FTGRDSVVVWLWLAGILLLVIASVRLS

SEQ ID NO: 354841 - protein, 32 aa, Mycobacterium
FTGSAVGLIFLWFSMTPSLLPRGPLFQGLVSG

SEQ ID NO: 354842 - protein, 35 aa, Mycobacterium
FTGTTVGLVFIWLSLTPSLLPRGPLFQGLVSGLSG

SEQ ID NO: 354843 - protein, 25 aa, Mycobacterium
FTGVVIAIVYLLVALSAIVCRLRDR

SEQ ID NO: 354844 - protein, 24 aa, Mycobacterium
FTGYFGFYLFYRSRSPELFLHSQA

SEQ ID NO: 354845 - protein, 31 aa, Mycobacterium
FTHNLFKPLLLFFYFGFLIPILKVRFEFPYV

SEQ ID NO: 354846 - protein, 33 aa, Mycobacterium; identical to SEQ ID NO: 20592

SEQ ID NO: 354847 - protein, 19 aa, Mycobacterium
FTHQIAVYSLTYFLPGIIG

SEQ ID NO: 354848 - protein, 18 aa, Mycobacterium
FTIESRALTFQPKRIHKQ

SEQ ID NO: 354849 - protein, 24 aa, Mycobacterium
FTINVAAVIYLLISKRLFGLRGGR

SEQ ID NO: 354850 - protein, 18 aa, Mycobacterium
FTISLMTALLLGAATDYA

SEQ ID NO: 354851 - protein, 27 aa, Mycobacterium
FTLALIVFGLLWPVIFAGGGGDAANVD

SEQ ID NO: 354852 - protein, 20 aa, Mycobacterium
FTLEVYPRYLSLIPSNVNAD

SEQ ID NO: 354853 - protein, 26 aa, Mycobacterium
FTLGIAAIIFLQQIPAAFAAGGPPGE

SEQ ID NO: 354854 - protein, 23 aa, Mycobacterium
FTLLRVPELYVWILVAIAGTVVQ

SEQ ID NO: 354855 - protein, 26 aa, Mycobacterium
FTLRHKALVIGVWLGAAVVLALLFPQ

SEQ ID NO: 354856 - protein, 22 aa, Mycobacterium
FTLRTALLMTFVLTASAVAGSF

SEQ ID NO: 354857 - protein, 19 aa, Mycobacterium
FTLSGWLGLYLLARDPRKP

SEQ ID NO: 354858 - protein, 25 aa, Mycobacterium
FTLSLWLGLYLLARDPRKPVLVLAA

SEQ ID NO: 354859 - protein, 23 aa, Mycobacterium
FTLSWWLGLYLVARDPRKPVLVF

SEQ ID NO: 354860 - protein, 17 aa, Mycobacterium
FTLWPFTRLVHVLSAPI

SEQ ID NO: 354861 - protein, 21 aa, Mycobacterium
FTLYTFISAVLLAAGARPAFI

SEQ ID NO: 354862 - protein, 19 aa, Mycobacterium
FTMAGPWVGIAAPGENIVS

SEQ ID NO: 354863 - protein, 21 aa, Mycobacterium
FTMAGPWVGIAAPGERIVSVG

SEQ ID NO: 354864 - protein, 24 aa, Mycobacterium
FTMEFPPYRFPSPRNLLIAMWASA

SEQ ID NO: 354865 - protein, 18 aa, Mycobacterium
FTPMAWGVLVGFVALYLI

SEQ ID NO: 354866 - protein, 24 aa, Mycobacterium
FTQIGYWAPALLVTLRFIQGFAVG

SEQ ID NO: 354867 - protein, 26 aa, Mycobacterium
FTRGQIIQLVLFGALVYVAYPFISTA

SEQ ID NO: 354868 - protein, 22 aa, Mycobacterium
FTRINAILGVLLIIVLSTGSII

SEQ ID NO: 354869 - protein, 24 aa, Mycobacterium
FTRINAILGVLLLIVLATGSVING

SEQ ID NO: 354870 - protein, 18 aa, Mycobacterium
FTRTAALPVVLALAALLG

SEQ ID NO: 354871 - protein, 25 aa, Mycobacterium
FTRTQMMLVVATVVLFGIAAVLATM

SEQ ID NO: 354872 - protein, 21 aa, Mycobacterium
FTSIYPVRIDPGPLEWDTVRS

SEQ ID NO: 354873 - protein, 26 aa, Mycobacterium
FTSRPRWLSALRQLTFGAIAIGATYL

SEQ ID NO: 354874 - protein, 26 aa, Mycobacterium
FTSTFVFIGAVVYIMLAPKGREEPES

SEQ ID NO: 354875 - protein, 38 aa, Mycobacterium
FTTFLNPIDLLWSFLQAVLMALTILLIHTYFGYFASGG

SEQ ID NO: 354876 - protein, 23 aa, Mycobacterium
FTTIYSLRFLWGAFAGKGLSGPS

SEQ ID NO: 354877 - protein, 19 aa, Mycobacterium
FTTLQANGRRRLLSNTVLI

SEQ ID NO: 354878 - protein, 17 aa, Mycobacterium
FTTLRMIYEDVQAHFRA

SEQ ID NO: 354879 - protein, 28 aa, Mycobacterium
FTTLYGLIDIRFIPKYLFSVSFCGILVA

SEQ ID NO: 354880 - protein, 25 aa, Mycobacterium
FTTPTALPVIGFLASLYLVLPFSGR

SEQ ID NO: 354881 - protein, 31 aa, Mycobacterium
FTTQIITRLVIFFVVAILVGAVVFAGLALAY

SEQ ID NO: 354882 - protein, 24 aa, Mycobacterium
FTTSFRRIFGVTPQNYRAKFPPAE

SEQ ID NO: 354883 - protein, 18 aa, Mycobacterium
FTTSSGVLLLWSWLAMSL

SEQ ID NO: 354884 - protein, 17 aa, Mycobacterium
FTVAFMTAILLGAGTDY

SEQ ID NO: 354885 - protein, 25 aa, Mycobacterium
FTVAITLVLLIPTAGTIVLLANPGL

SEQ ID NO: 354886 - protein, 24 aa, Mycobacterium
FTVALMALWLAALRWRQGGAKAAL

SEQ ID NO: 354887 - protein, 20 aa, Mycobacterium
FTVASTLVLLIPTAGTIALL

SEQ ID NO: 354888 - protein, 22 aa, Mycobacterium
FTVELAAFALILLIASLTAQVG

SEQ ID NO: 354889 - protein, 17 aa, Mycobacterium
FTVFGIAMWFFGNLYEA

SEQ ID NO: 354890 - protein, 20 aa, Mycobacterium
FTVFLVRHRLPKAKSGFLPL

SEQ ID NO: 354891 - protein, 26 aa, Mycobacterium
FTVGAISLFYLQLPAAVGIGTYHVNA

SEQ ID NO: 354892 - protein, 22 aa, Mycobacterium
FTVGCYALLAMAFNTFGVQLEE

SEQ ID NO: 354893 - protein, 21 aa, Mycobacterium
FTVGYAALLLAISCAILVLGP

SEQ ID NO: 354894 - protein, 26 aa, Mycobacterium
FTVLALAGCALLGLLSPHVALDRAQI

SEQ ID NO: 354895 - protein, 18 aa, Mycobacterium
FTVNQLLHGLLMHSGNDA

SEQ ID NO: 354896 - protein, 24 aa, Mycobacterium
FTVQDALFWMSFVCAIAVAALVIA

SEQ ID NO: 354897 - protein, 26 aa, Mycobacterium
FTYVATWMGFVYVAFVIDAYSRRIVG

SEQ ID NO: 354898 - protein, 19 aa, Mycobacterium
FTYYFFLTGIHFVHLLIGF

SEQ ID NO: 354899 - protein, 20 aa, Mycobacterium
FVAAEVIKYLWPVRRMRAAE

SEQ ID NO: 354900 - protein, 17 aa, Mycobacterium
FVAAYRAFDTGVRLVPL

SEQ ID NO: 354901 - protein, 25 aa, Mycobacterium
FVADGHPWRWFLIGFMVIFHLNILS

SEQ ID NO: 354902 - protein, 24 aa, Mycobacterium
FVAFQLMFAIITVALISGAVSDRL

SEQ ID NO: 354903 - protein, 17 aa, Mycobacterium
FVAILLARDGLLAATLP

SEQ ID NO: 354904 - protein, 17 aa, Mycobacterium
FVAIPLAIISYFIASTP

SEQ ID NO: 354905 - protein, 17 aa, Mycobacterium
FVALASVVQCYYGFCAE

SEQ ID NO: 354906 - protein, 21 aa, Mycobacterium
FVAPVWTLMALMGFVIPNAPA

SEQ ID NO: 354907 - protein, 24 aa, Mycobacterium
FVARRAVFHAMMRSLDGFVGTLRQ

SEQ ID NO: 354908 - protein, 17 aa, Mycobacterium
FVARVSIIPTLLLTIPF

SEQ ID NO: 354909 - protein, 52 aa, Mycobacterium
FVASLTKPLSKTNFVLVFLAALLLGPGIPLALLYAGKWYAAKIPGEPMLAER

SEQ ID NO: 354910 - protein, 17 aa, Mycobacterium
FVASVSLAVGLQLTPDR

SEQ ID NO: 354911 - protein, 26 aa, Mycobacterium
FVAVGFLMILLFRHNLTVAAIIASFV

SEQ ID NO: 354912 - protein, 20 aa, Mycobacterium
FVAVYLVPFAKYPPNPPAVG

SEQ ID NO: 354913 - protein, 19 aa, Mycobacterium
FVAVYNFLGFRLSAAPFNL

SEQ ID NO: 354914 - protein, 17 aa, Mycobacterium
FVCAGVLLYVDIGRRRS

SEQ ID NO: 354915 - protein, 17 aa, Mycobacterium
FVCALVAGALFGIVIVA

SEQ ID NO: 354916 - protein, 23 aa, Mycobacterium
FVDALKHLVLPVLALGLLTAGVF

SEQ ID NO: 354917 - protein, 34 aa, Mycobacterium
FVDDYIFNFPDTSFAWAFVLALLAAALAARKRIA

SEQ ID NO: 354918 - protein, 34 aa, Mycobacterium
FVDEYLFGWPDGSLSWAFVLSLLAAALAVRKSIA

SEQ ID NO: 354919 - protein, 26 aa, Mycobacterium
FVDGHFSKWLNFTPTPLTAPVIVLII

SEQ ID NO: 354920 - protein, 27 aa, Mycobacterium
FVDGNVLQIIFLAVLFGVALNAVGQVG

SEQ ID NO: 354921 - protein, 23 aa, Mycobacterium
FVDHKLWIRFGVSGALLSAVLAL

SEQ ID NO: 354922 - protein, 25 aa, Mycobacterium
FVDRALGWALRLFAAVAVYNAVSMI

SEQ ID NO: 354923 - protein, 23 aa, Mycobacterium
FVEARWLSVGLLSVGLAGFCLHA

SEQ ID NO: 354924 - protein, 23 aa, Mycobacterium
FVEDRWLSVGLLSVGLAGFCLHA

SEQ ID NO: 354925 - protein, 21 aa, Mycobacterium
FVEERWLSVALLCAGLAGFCV

SEQ ID NO: 354926 - protein, 29 aa, Mycobacterium
FVEFSAYMAIPWLAAVAVEFALLSWLFSA

SEQ ID NO: 354927 - protein, 19 aa, Mycobacterium
FVEIPWDAIFAGLDAERFD

SEQ ID NO: 354928 - protein, 17 aa, Mycobacterium
FVEQAPAPAPAAPAPAP

SEQ ID NO: 354929 - protein, 25 aa, Mycobacterium
FVETGLLFPLLPGESLLFTGGLLAA

SEQ ID NO: 354930 - protein, 17 aa, Mycobacterium
FVEVTLGAFYQIAKAVE

SEQ ID NO: 354931 - protein, 21 aa, Mycobacterium
FVEWGWRIPFLASAVLVAVGL

SEQ ID NO: 354932 - protein, 18 aa, Mycobacterium
FVFHAWYRTDHPLIDLRL

SEQ ID NO: 354933 - protein, 19 aa, Mycobacterium
FVFNVLVAALIVYVGDQLG

SEQ ID NO: 354934 - protein, 41 aa, Mycobacterium
FVFRHRTGNLAILAVLVIAAVQLFMLQVPRAAGLRAEAASQ

SEQ ID NO: 354935 - protein, 17 aa, Mycobacterium
FVFTRLLAEGVRLFASA

SEQ ID NO: 354936 - protein, 26 aa, Mycobacterium
FVFTVGCYALLAMAFNTFGVQPEHAT

SEQ ID NO: 354937 - protein, 32 aa, Mycobacterium
FVGFLGTAAFVPLTIFIVCFHAARVLALSWTV

SEQ ID NO: 354938 - protein, 23 aa, Mycobacterium
FVGGLLLWLVWPSGGGWADIRAP

SEQ ID NO: 354939 - protein, 35 aa, Mycobacterium
FVGHVIRIFSLPIVLLWVLLVVALGAIFPSLDDVA

SEQ ID NO: 354940 - protein, 32 aa, Mycobacterium
FVGLFDTWPGLILPYITFALPLAIYTLSAFFR

SEQ ID NO: 354941 - protein, 33 aa, Mycobacterium
FVGLFDTWPGLILPYITFALPLAIYTLSAFFRE

SEQ ID NO: 354942 - protein, 19 aa, Mycobacterium
FVGPRLPVAWRVTLQAGAA

SEQ ID NO: 354943 - protein, 19 aa, Mycobacterium
FVGTFWLVLGGCGSAVFAA

SEQ ID NO: 354944 - protein, 20 aa, Mycobacterium
FVHAFLAIPIALRRYRREFL

SEQ ID NO: 354945 - protein, 17 aa, Mycobacterium
FVHMLPAGYQTRISGDG

SEQ ID NO: 354946 - protein, 26 aa, Mycobacterium
FVIDEGPLYFWLPCLACLLALAELHL

SEQ ID NO: 354947 - protein, 17 aa, Mycobacterium
FVIFMIYRAMNPDEFLR

SEQ ID NO: 354948 - protein, 17 aa, Mycobacterium
FVIGVVALVVSLAIAIR

SEQ ID NO: 354949 - protein, 19 aa, Mycobacterium
FVIIPLACLGAAVGLTWWW

SEQ ID NO: 354950 - protein, 20 aa, Mycobacterium
FVILTLPLGLVFGWLGKRLA

SEQ ID NO: 354951 - protein, 20 aa, Mycobacterium
FVIQEFVHWVLPKIAKGYGG

SEQ ID NO: 354952 - protein, 17 aa, Mycobacterium
FVISLWAGSSAISAFVD

SEQ ID NO: 354953 - protein, 18 aa, Mycobacterium
FVIVYLPNRLLGVEFLGI

SEQ ID NO: 354954 - protein, 25 aa, Mycobacterium
FVKGKWKGHWMPKGRGFLLNTAESG

SEQ ID NO: 354955 - protein, 20 aa, Mycobacterium
FVKRDWRYAVLLVGYNAGFL

SEQ ID NO: 354956 - protein, 24 aa, Mycobacterium
FVLGFLAQFLFGVKLGLAPVTVGG

SEQ ID NO: 354957 - protein, 22 aa, Mycobacterium
FVLGFLAQYLFGVRLGLAPVTV

SEQ ID NO: 354958 - protein, 18 aa, Mycobacterium
FVLGRPRLQRAYCRAVLR

SEQ ID NO: 354959 - protein, 19 aa, Mycobacterium
FVLHHFYMDGALWKSKKNP

SEQ ID NO: 354960 - protein, 29 aa, Mycobacterium
FVLNFLIGGLAYLLLNWLTSLRRIDRATV

SEQ ID NO: 354961 - protein, 17 aa, Mycobacterium
FVLPRGLITVRLTPDFD

SEQ ID NO: 354962 - protein, 17 aa, Mycobacterium
FVLSFADRRFRLTPRRL

SEQ ID NO: 354963 - protein, 20 aa, Mycobacterium
FVLSGFLLFLPWVRAAADNT

SEQ ID NO: 354964 - protein, 19 aa, Mycobacterium
FVLTFHHIVIDGWSLPILL

SEQ ID NO: 354965 - protein, 22 aa, Mycobacterium
FVLVAIPMLAAWLVVRRARGAS

SEQ ID NO: 354966 - protein, 18 aa, Mycobacterium
FVLVFITVSLLYLRDHPD

SEQ ID NO: 354967 - protein, 25 aa, Mycobacterium
FVMAITGFGWAGYNTAVGQIITSHV

SEQ ID NO: 354968 - protein, 17 aa, Mycobacterium
FVMIVFHLNILLAFPMG

SEQ ID NO: 354969 - protein, 30 aa, Mycobacterium
FVMSYITMPYYSMPIIGWWLRPKASARQPR

SEQ ID NO: 354970 - protein, 18 aa, Mycobacterium
FVNFGQIMDGYYGKYGKV

SEQ ID NO: 354971 - protein, 17 aa, Mycobacterium
FVNFLRARMGPAMASSG

SEQ ID NO: 354972 - protein, 17 aa, Mycobacterium
FVNFYSCDISLKINGLQ

SEQ ID NO: 354973 - protein, 24 aa, Mycobacterium
FVNSVALLVWAFPVGHLTALTTKA

SEQ ID NO: 354974 - protein, 19 aa, Mycobacterium
FVNWVAQQVTRRVSLGFAA

SEQ ID NO: 354975 - protein, 23 aa, Mycobacterium
FVPALLFPQFFLGVAAYRPEERS

SEQ ID NO: 354976 - protein, 28 aa, Mycobacterium
FVPITRRITRFSDTFFREVWDPELATAK

SEQ ID NO: 354977 - protein, 17 aa, Mycobacterium
FVPKLRHWLATAVRPRL

SEQ ID NO: 354978 - protein, 17 aa, Mycobacterium
FVPLVLLPTAASAGQLA

SEQ ID NO: 354979 - protein, 25 aa, Mycobacterium
FVPSATILYLIAGLALGLVGAFLAV

SEQ ID NO: 354980 - protein, 22 aa, Mycobacterium
FVQALDKLPWPAPTVFLMRRGA

SEQ ID NO: 354981 - protein, 21 aa, Mycobacterium
FVQSLFLVILGAGIGMCMQTL

SEQ ID NO: 354982 - protein, 22 aa, Mycobacterium
FVRRTWLVLRMNPQRNIAAVAV

SEQ ID NO: 354983 - protein, 20 aa, Mycobacterium
FVRSRVVAWALWDCGSTGLN

SEQ ID NO: 354984 - protein, 19 aa, Mycobacterium
FVRTLRPRPEGSSKVPVFV

SEQ ID NO: 354985 - protein, 18 aa, Mycobacterium
FVRWLKKKKRIDDDRIVL

SEQ ID NO: 354986 - protein, 17 aa, Mycobacterium
FVSKPPVAISLAGVGVL

SEQ ID NO: 354987 - protein, 18 aa, Mycobacterium
FVSLPFLVISLEGAARTA

SEQ ID NO: 354988 - protein, 19 aa, Mycobacterium
FVSLPFLVISLEGAARTAG

SEQ ID NO: 354989 - protein, 17 aa, Mycobacterium
FVSSGNSVILWDTQTRK

SEQ ID NO: 354990 - protein, 27 aa, Mycobacterium
FVTGVILLFVLYYQLSLAGVKFFPSGG

SEQ ID NO: 354991 - protein, 24 aa, Mycobacterium
FVTGWMYWYFFVVVVAVETVAGGR

SEQ ID NO: 354992 - protein, 28 aa, Mycobacterium
FVTLGLLIPVMLWPPSAPLLLIPVVLSA

SEQ ID NO: 354993 - protein, 17 aa, Mycobacterium
FVTLPFVVRAVQPVLLE

SEQ ID NO: 354994 - protein, 25 aa, Mycobacterium
FVTRMDYLSPFFNETAYCLGVEQLL

SEQ ID NO: 354995 - protein, 26 aa, Mycobacterium
FVTRTRHPFWSRPAPARILLAAVIGT

SEQ ID NO: 354996 - protein, 17 aa, Mycobacterium
FVTSLLDHPQCRPEHVR

SEQ ID NO: 354997 - protein, 21 aa, Mycobacterium
FVTTLIWAVVLLAVFLPLAVR

SEQ ID NO: 354998 - protein, 24 aa, Mycobacterium
FVTYTALGWFYKTAVEVIMLPVTY

SEQ ID NO: 354999 - protein, 17 aa, Mycobacterium
FVVANLLILGALRVNWA

SEQ ID NO: 355000 - protein, 21 aa, Mycobacterium
FVVANLLILGALRVNWALGLQ

SEQ ID NO: 355001 - protein, 21 aa, Mycobacterium
FVVAVRQLKIGQEATITVLRQ

SEQ ID NO: 355002 - protein, 25 aa, Mycobacterium
FVVDLVAMIFGMPRILFPQIAHEGF

SEQ ID NO: 355003 - protein, 32 aa, Mycobacterium
FVVDWRVALVLFLPVLVYLVLTSSLTIQSGPR

SEQ ID NO: 355004 - protein, 55 aa, Mycobacterium
FVVDYLIRLALAPDRRQWFVQHIFDLLIVALPMMRPLRLLRLVVLVGALQKAVGN

SEQ ID NO: 355005 - protein, 32 aa, Mycobacterium
FVVGFAAIAWFLKFLVSHSMYWFVGYRVVLGV

SEQ ID NO: 355006 - protein, 28 aa, Mycobacterium
FVVGPDHRRLLPTVALLGAVFMVWVDTL

SEQ ID NO: 355007 - protein, 27 aa, Mycobacterium
FVVGSGIDIPLIKPALEAATTLPLTAA

SEQ ID NO: 355008 - protein, 18 aa, Mycobacterium
FVVLRSYGWLIQETASLD

SEQ ID NO: 355009 - protein, 17 aa, Mycobacterium
FVVNLLVALAIAAGTDY

SEQ ID NO: 355010 - protein, 24 aa, Mycobacterium
FVVNRVAGRWPFALRAAICMAVPV

SEQ ID NO: 355011 - protein, 20 aa, Mycobacterium
FVVPTIALAVPWLTELRRLF

SEQ ID NO: 355012 - protein, 17 aa, Mycobacterium
FVVRFRKPLLVGGSAAL

SEQ ID NO: 355013 - protein, 27 aa, Mycobacterium
FVVRGAMKAAWDKLRGPAGKLGAPVGD

SEQ ID NO: 355014 - protein, 30 aa, Mycobacterium
FVVRTLVIPALFTLIGDRIWWPSDPKTTAH

SEQ ID NO: 355015 - protein, 23 aa, Mycobacterium
FVVSFVFNVLVAALIVFVGDQLG

SEQ ID NO: 355016 - protein, 23 aa, Mycobacterium
FVVSFVFNVLVAALIVYLGDQLG

SEQ ID NO: 355017 - protein, 18 aa, Mycobacterium
FVVSFVFNVLVAALIVYV

SEQ ID NO: 355018 - protein, 24 aa, Mycobacterium
FVVTWAVALLVWRYGRIEEKWGPT

SEQ ID NO: 355019 - protein, 24 aa, Mycobacterium
FVVTWAVALLVWRYGRLEQKWDPQ

SEQ ID NO: 355020 - protein, 20 aa, Mycobacterium
FVVVGLLFLGTVALTLAGID

SEQ ID NO: 355021 - protein, 17 aa, Mycobacterium
FVWATVIVWILGGFGTW

SEQ ID NO: 355022 - protein, 17 aa, Mycobacterium
FVWLRRRRKPPDVPSEP

SEQ ID NO: 355023 - protein, 19 aa, Mycobacterium
FVWMANWRFVAQKTDYFTQ

SEQ ID NO: 355024 - protein, 21 aa, Mycobacterium
FVWNLLVDYWFRMEIDGWDNI

SEQ ID NO: 355025 - protein, 17 aa, Mycobacterium
FWAKVRKGALVKAAAVL

SEQ ID NO: 355026 - protein, 18 aa, Mycobacterium
FWAKVRRAALFKAAAVLL

SEQ ID NO: 355027 - protein, 27 aa, Mycobacterium
FWFVVVAVLFLGFLVLEGFDFGVGMLM

SEQ ID NO: 355028 - protein, 43 aa, Mycobacterium
FWGKLVNWVMKRPLAFAIPIAVGMILLVIPLGNLSFGGMSEKY

SEQ ID NO: 355029 - protein, 17 aa, Mycobacterium
FWLATTVALAVAVPAAW

SEQ ID NO: 355030 - protein, 18 aa, Mycobacterium
FWRNAGLPAFRFPDPNGE

SEQ ID NO: 355031 - protein, 17 aa, Mycobacterium
FWSRPAPARILLLAVIG

SEQ ID NO: 355032 - protein, 18 aa, Mycobacterium
FWSVPVFFSLFGLVFIPL

SEQ ID NO: 355033 - protein, 28 aa, Mycobacterium
FWTFGIIAMVTLLAKIDLARGYLAVALP

SEQ ID NO: 355034 - protein, 19 aa, Mycobacterium
FWTGWVLQLGSIFFAVAFT

SEQ ID NO: 355035 - protein, 20 aa, Mycobacterium
FWTRWTGAVMRRPWASAIAA

SEQ ID NO: 355036 - protein, 18 aa, Mycobacterium
FYCPVDKTAYFDTDFFDV

SEQ ID NO: 355037 - protein, 20 aa, Mycobacterium
FYCPVDQTAYFDTDFFRELV

SEQ ID NO: 355038 - protein, 17 aa, Mycobacterium
FYDAYWSVVPPLLALYW

SEQ ID NO: 355039 - protein, 25 aa, Mycobacterium
FYDGELFIIGRIKDLLIVYGRNHSP

SEQ ID NO: 355040 - protein, 40 aa, Mycobacterium
FYEEPLDRRWIWVAGVAGAILLVAVICTVVILGGGDSGSV

SEQ ID NO: 355041 - protein, 23 aa, Mycobacterium
FYEMVRKFGLGQRTGVGLPGESA

SEQ ID NO: 355042 - protein, 19 aa, Mycobacterium
FYEWFRIMPTAVDVLDSIG

SEQ ID NO: 355043 - protein, 20 aa, Mycobacterium
FYEWFRIMPTAVDVLDSIGR

SEQ ID NO: 355044 - protein, 26 aa, Mycobacterium
FYFDGELFIIGRIKDLLIVYGRNHSP

SEQ ID NO: 355045 - protein, 18 aa, Mycobacterium
FYGLLLAVVFFLTSHWHY

SEQ ID NO: 355046 - protein, 19 aa, Mycobacterium
FYISVIRGTPLLVQLFIVF

SEQ ID NO: 355047 - protein, 22 aa, Mycobacterium
FYLALPILALLARRLPVGARVS

SEQ ID NO: 355048 - protein, 17 aa, Mycobacterium
FYLLAYSFSTVGAFAIV

SEQ ID NO: 355049 - protein, 18 aa, Mycobacterium
FYMPQRALTDPRYTAVLG

SEQ ID NO: 355050 - protein, 28 aa, Mycobacterium
FYPTYSHLFYLWWLAKAGVVGMAAFAVF

SEQ ID NO: 355051 - protein, 19 aa, Mycobacterium
FYRNFYLNHLTSVAACLIL

SEQ ID NO: 355052 - protein, 26 aa, Mycobacterium
FYRRSGALLCLLYAFNGTDFHFENLI

SEQ ID NO: 355053 - protein, 19 aa, Mycobacterium
FYVALPFLAWLLVKKLCGG

SEQ ID NO: 355054 - protein, 20 aa, Mycobacterium
FYVGLQYIQLMLGYGPLKSS

SEQ ID NO: 355055 - protein, 19 aa, Mycobacterium
FYVRQLLIRAAAAGERIAI

SEQ ID NO: 355056 - protein, 17 aa, Mycobacterium
FYVSALGLMIHISPPDA

SEQ ID NO: 355057 - protein, 22 aa, Mycobacterium
FYWAIGIAVGFPVGLILLTELH

SEQ ID NO: 355058 - protein, 20 aa, Mycobacterium
FYWAVGIAAALPVLVVILTE

SEQ ID NO: 355059 - protein, 21 aa, Mycobacterium
FYWAVGIAIGLPVGMILLTEL

SEQ ID NO: 355060 - protein, 20 aa, Mycobacterium
FYWAVSVALGLPVLIVILTE

SEQ ID NO: 355061 - protein, 18 aa, Mycobacterium
FYYFPDQLSIDRYFDRNN

SEQ ID NO: 355062 - protein, 18 aa, Mycobacterium
FYYFPDQLSIDRYVDRNG

SEQ ID NO: 355063 - protein, 18 aa, Mycobacterium
FYYVLTGVHLVHVLLGLI

SEQ ID NO: 355064 - protein, 23 aa, Mycobacterium
GAAAAYLGVSLWAVRDVGPRAAE

SEQ ID NO: 355065 - protein, 26 aa, Mycobacterium
GAAAIWVFALILLLCGIYLTQSRGTF

SEQ ID NO: 355066 - protein, 25 aa, Mycobacterium
GAAAKLYPLLFLGPLVVLGIRTGRL

SEQ ID NO: 355067 - protein, 25 aa, Mycobacterium
GAAAKLYPLLFLGPMLLLGIRTGRL

SEQ ID NO: 355068 - protein, 24 aa, Mycobacterium
GAAAKLYPLLFLGPMVVLAIRTGR

SEQ ID NO: 355069 - protein, 21 aa, Mycobacterium
GAAALVLLSGYVVPRVSGWLT

SEQ ID NO: 355070 - protein, 28 aa, Mycobacterium
GAAAWLGSAVWWKALLALAVAVALTVGV

SEQ ID NO: 355071 - protein, 29 aa, Mycobacterium
GAAAWLHAAVWWKALLALVVAIALTVGVN

SEQ ID NO: 355072 - protein, 26 aa, Mycobacterium
GAAAWLHAAVWWKALLALVVAVALTV

SEQ ID NO: 355073 - protein, 23 aa, Mycobacterium
GAAAYLMWALHIVGPGAVVFVFG

SEQ ID NO: 355074 - protein, 33 aa, Mycobacterium
GAAELMPARLRRTWPGALLARLARPAGLSAAAV

SEQ ID NO: 355075 - protein, 26 aa, Mycobacterium
GAAFAVIWPLLGFSVLIRTLFRKKNL

SEQ ID NO: 355076 - protein, 38 aa, Mycobacterium
GAAFGLSVLIWQSILGIPLNWVVLAMSVIILLAVGSDY

SEQ ID NO: 355077 - protein, 37 aa, Mycobacterium
GAAFGLSVLLWQHILHMPLHWLVLPMAVIVMLAVGSD

SEQ ID NO: 355078 - protein, 20 aa, Mycobacterium
GAAFVRRLVTLATTLLVVAT

SEQ ID NO: 355079 - protein, 20 aa, Mycobacterium
GAAFVRRLVTLTTALLVFAT

SEQ ID NO: 355080 - protein, 24 aa, Mycobacterium
GAAFVRRLVTLTTTLLIVATTLSV

SEQ ID NO: 355081 - protein, 32 aa, Mycobacterium
GAAFVRRLVTLVTTLLLVTTLVSVAAAPALVR

SEQ ID NO: 355082 - protein, 26 aa, Mycobacterium
GAAGIAMMTFVGAALGYRQAKAGHTV

SEQ ID NO: 355083 - protein, 29 aa, Mycobacterium
GAAGLMNIFLLFWLLAVLFNAMNRIDPFG

SEQ ID NO: 355084 - protein, 24 aa, Mycobacterium
GAAGLWSVLRGHAATWWAQLTGTD

SEQ ID NO: 355085 - protein, 27 aa, Mycobacterium
GAAGWVILLCLAFSALGKGIGLLRRAL

SEQ ID NO: 355086 - protein, 20 aa, Mycobacterium
GAAIFLIVLAFNLFGDGLRD

SEQ ID NO: 355087 - protein, 21 aa, Mycobacterium
GAAILLFRRRASIPGSARGVV

SEQ ID NO: 355088 - protein, 34 aa, Mycobacterium
GAAIPWSMLVFGQLVWLLFDRRMLWLHGLAAVAT

SEQ ID NO: 355089 - protein, 33 aa, Mycobacterium
GAAKVIWFLVNLGALFIIIWRCWRVLGFSANAP

SEQ ID NO: 355090 - protein, 20 aa, Mycobacterium
GAALALIGLILVGTGLSVAH

SEQ ID NO: 355091 - protein, 30 aa, Mycobacterium
GAALHHCVIAFAALGWYASVHRLPNPAEPE

SEQ ID NO: 355092 - protein, 25 aa, Mycobacterium
GAALLIAFIVAVAMFPALFTTVDPT

SEQ ID NO: 355093 - protein, 19 aa, Mycobacterium
GAALPILPTQILWVNMTTA

SEQ ID NO: 355094 - protein, 24 aa, Mycobacterium
GAALPWLRIAILGTPAILISLAGN

SEQ ID NO: 355095 - protein, 17 aa, Mycobacterium
GAALQIWEGGLGIWGAV

SEQ ID NO: 355096 - protein, 18 aa, Mycobacterium
GAALRYAALEKDAVIVAA

SEQ ID NO: 355097 - protein, 23 aa, Mycobacterium
GAALTFLGLRMQRPGHPAPEAQP

SEQ ID NO: 355098 - protein, 23 aa, Mycobacterium
GAALTLWLHVVDARFARGLRARL

SEQ ID NO: 355099 - protein, 29 aa, Mycobacterium
GAALVAFGAWLWWRRAHGTGRPGWDGGVG

SEQ ID NO: 355100 - protein, 24 aa, Mycobacterium
GAALWGWGLAWMAVVVWFAVLASR

SEQ ID NO: 355101 - protein, 24 aa, Mycobacterium
GAALYALLVNRWPLPEAGADSGFA

SEQ ID NO: 355102 - protein, 24 aa, Mycobacterium
GAALYALLVNRWPLRESGVRSGLA

SEQ ID NO: 355103 - protein, 21 aa, Mycobacterium
GAALYALLVNRWPLTESSVRS

SEQ ID NO: 355104 - protein, 23 aa, Mycobacterium
GAAPFRAPLQTSFRDFVALERQA

SEQ ID NO: 355105 - protein, 28 aa, Mycobacterium
GAAPGQLWLFWVAPLIGGLIGGLLYPFL

SEQ ID NO: 355106 - protein, 25 aa, Mycobacterium
GAAPKLVMWFPPRVVVLASSGLILI

SEQ ID NO: 355107 - protein, 29 aa, Mycobacterium
GAARLSAFSVLLEMLGRPPLKSATREEQL

SEQ ID NO: 355108 - protein, 33 aa, Mycobacterium
GAASFRRRWLVLGTWLAVLLGVGLAFVGFRGEP

SEQ ID NO: 355109 - protein, 28 aa, Mycobacterium
GAASGAWFGLFIGLLLAIFTVGPVWIVT

SEQ ID NO: 355110 - protein, 23 aa, Mycobacterium
GAATVLGWVLAAFAVRPLKRLAE

SEQ ID NO: 355111 - protein, 27 aa, Mycobacterium
GAAVAVVFGYLLWPGARRLPGSARFSS

SEQ ID NO: 355112 - protein, 17 aa, Mycobacterium
GAAVFAIIGSRRSEANP

SEQ ID NO: 355113 - protein, 25 aa, Mycobacterium
GAAVKFLLYNLFGGLIMLAAVIGLY

SEQ ID NO: 355114 - protein, 27 aa, Mycobacterium
GAAVPDWLFSLIALIAVANGALLTMIM

SEQ ID NO: 355115 - protein, 18 aa, Mycobacterium
GAAVWGLVRSAQAEHPGR

SEQ ID NO: 355116 - protein, 19 aa, Mycobacterium
GAAVWMATFILAKTLRGES

SEQ ID NO: 355117 - protein, 26 aa, Mycobacterium
GACGWAFLIWGLYGYLWAFVQYAVQM

SEQ ID NO: 355118 - protein, 33 aa, Mycobacterium
GACGWAFLIWGMYAYLWAFVLYVVQMTLVVRRM

SEQ ID NO: 355119 - protein, 30 aa, Mycobacterium
GACGWAFLIWGMYAYLWAFVLYVVQMTMVV

SEQ ID NO: 355120 - protein, 25 aa, Mycobacterium
GADALPLPLLASYLDRYGIRADKIR

SEQ ID NO: 355121 - protein, 19 aa, Mycobacterium
GADALWYPVGFTAGYLGLL

SEQ ID NO: 355122 - protein, 34 aa, Mycobacterium
GADHVAQFRKLFWINLIIAVPVIAFSTMFAMLLG

SEQ ID NO: 355123 - protein, 36 aa, Mycobacterium
GADHVAVFRKLFWINLIIAIPVIAFSTMFAMLLGYE

SEQ ID NO: 355124 - protein, 24 aa, Mycobacterium
GADLQSALLRAMTFMIVASPCALV

SEQ ID NO: 355125 - protein, 56 aa, Mycobacterium
GADPAAERRTWLRRVWLAWPFGLLSAGLTMMAAPWAGWLALAVTVPVQFVAGWSIL

SEQ ID NO: 355126 - protein, 23 aa, Mycobacterium
GADPLFIMYTSGTTGLPKGAVHT

SEQ ID NO: 355127 - protein, 24 aa, Mycobacterium
GADSIKVWVWLAALLLSVITGVRL

SEQ ID NO: 355128 - protein, 24 aa, Mycobacterium
GADWSAALVPLAVALIAAAIATLA

SEQ ID NO: 355129 - protein, 28 aa, Mycobacterium
GAEGAAWLRLAWAGILMLVIVRPRPSAF

SEQ ID NO: 355130 - protein, 17 aa, Mycobacterium
GAELLWELPMRSVGCGL

SEQ ID NO: 355131 - protein, 25 aa, Mycobacterium
GAELSFPMLQFTLIGALCMLGTVWL

SEQ ID NO: 355132 - protein, 25 aa, Mycobacterium
GAELTFPMLQFSLLGALCLLGTLWL

SEQ ID NO: 355133 - protein, 26 aa, Mycobacterium
GAELTFPMLQFSLLGALCMLGTLWLV

SEQ ID NO: 355134 - protein, 19 aa, Mycobacterium
GAEPFVPWFAQSVGNATQV

SEQ ID NO: 355135 - protein, 24 aa, Mycobacterium
GAEPLAFLLSGGAGGWLLLVGTVF

SEQ ID NO: 355136 - protein, 34 aa, Mycobacterium
GAEVALIATTLWYLVMRDFRIALAGIGFALATVS

SEQ ID NO: 355137 - protein, 23 aa, Mycobacterium
GAEVPLLMTLLQRGRLAEAADTG

SEQ ID NO: 355138 - protein, 31 aa, Mycobacterium
GAEVTSRIRLWLPYLPLVLAAAIGLGHLMDQ

SEQ ID NO: 355139 - protein, 23 aa, Mycobacterium
GAEYLFGLVHLPGALYVIVAVSV

SEQ ID NO: 355140 - protein, 18 aa, Mycobacterium
GAFDAVLLVPGDGPREAT

SEQ ID NO: 355141 - protein, 29 aa, Mycobacterium
GAFDPGLRRKAPIYVLEDAPWSAFRDRDN

SEQ ID NO: 355142 - protein, 26 aa, Mycobacterium
GAFFSDFMAWILRPLGATANMWIETV

SEQ ID NO: 355143 - protein, 30 aa, Mycobacterium
GAFGLAVFAFPFWMLVQTGQFWLITVAMVV

SEQ ID NO: 355144 - protein, 40 aa, Mycobacterium
GAFGLSVLIWQHLIGLPLHWLVLPLTFIILVAVGSDYNLL

SEQ ID NO: 355145 - protein, 22 aa, Mycobacterium
GAFLFMMSLYLQSERGYSAMFT

SEQ ID NO: 355146 - protein, 29 aa, Mycobacterium
GAFLPPDVIPFFGLIPLALGLKAAWQAWR

SEQ ID NO: 355147 - protein, 31 aa, Mycobacterium
GAFLPPQIIPYFGLIPLALGLWAAWKAWRGN

SEQ ID NO: 355148 - protein, 21 aa, Mycobacterium
GAFLSQLFGAILRPLGHTGNE

SEQ ID NO: 355149 - protein, 19 aa, Mycobacterium
GAFRIAMAAGIPVVPIVIR

SEQ ID NO: 355150 - protein, 21 aa, Mycobacterium
GAFYLTLIPAFPAPWVYYHYR

SEQ ID NO: 355151 - protein, 42 aa, Mycobacterium
GAGAAWLFLQSFNSDLFNMQLALGWSTLALAAVAVLAAAAIS

SEQ ID NO: 355152 - protein, 24 aa, Mycobacterium
GAGAVAFSVLRRSGQPEPSPLAPS

SEQ ID NO: 355153 - protein, 18 aa, Mycobacterium
GAGAVLASAIWFLGLGLG

SEQ ID NO: 355154 - protein, 17 aa, Mycobacterium
GAGAYIWWGLCPGFFLL

SEQ ID NO: 355155 - protein, 28 aa, Mycobacterium
GAGELLRRNLLIYGLGGVIVPFVGIWLI

SEQ ID NO: 355156 - protein, 21 aa, Mycobacterium
GAGFFLYLIAMPETAPRELRA

SEQ ID NO: 355157 - protein, 26 aa, Mycobacterium
GAGGIAWLAGARRIADGCWIAGTVVA

SEQ ID NO: 355158 - protein, 35 aa, Mycobacterium
GAGIGAASFVWPPPRDPDRAPYRGWEPLDEADAAV

SEQ ID NO: 355159 - protein, 20 aa, Mycobacterium
GAGLALGGLIVFWQSRRHRR

SEQ ID NO: 355160 - protein, 38 aa, Mycobacterium
GAGLFVAFDELWRWNSIVALVLSVLVILGLVVGVRVVR

SEQ ID NO: 355161 - protein, 20 aa, Mycobacterium
GAGLFYFDFVRLRSIPALRE

SEQ ID NO: 355162 - protein, 26 aa, Mycobacterium
GAGLKAFWYHFAIMFEALFILTAVDA

SEQ ID NO: 355163 - protein, 23 aa, Mycobacterium
GAGMLRLGYLANMLSKPVLVGYM

SEQ ID NO: 355164 - protein, 25 aa, Mycobacterium
GAGPLLPPWLWVLVKTVALLTVLVW

SEQ ID NO: 355165 - protein, 35 aa, Mycobacterium
GAGPVARLWRALLVFFSKWWQLESLYRSNMKYQPE

SEQ ID NO: 355166 - protein, 35 aa, Mycobacterium
GAGPVARLWRGFLLFFSRWWQLETLYRSNMKYQPE

SEQ ID NO: 355167 - protein, 34 aa, Mycobacterium
GAGPVARLWRWLLIFFSRWWQIETLYRSNQKYQP

SEQ ID NO: 355168 - protein, 25 aa, Mycobacterium
GAGVLALIAFSATAFGLATFSSYLP

SEQ ID NO: 355169 - protein, 27 aa, Mycobacterium
GAGVLLVLGLLTPLAGAAALAFTVNVL

SEQ ID NO: 355170 - protein, 25 aa, Mycobacterium
GAGVLYFFFVLPRWPELMGDTAHSL

SEQ ID NO: 355171 - protein, 41 aa, Mycobacterium
GAGVRLLAMQIPGQLLFSLASQLALILLAGMATWLTVRGEL

SEQ ID NO: 355172 - protein, 25 aa, Mycobacterium
GAHFGYLLYLPSGGFLALRWPRTLA

SEQ ID NO: 355173 - protein, 24 aa, Mycobacterium
GAHGFALLGLILPIATLVSVLLPP

SEQ ID NO: 355174 - protein, 19 aa, Mycobacterium
GAHILVTVFPFPRTAFTLA

SEQ ID NO: 355175 - protein, 18 aa, Mycobacterium
GAHIVWLWVLIFGLQFTS

SEQ ID NO: 355176 - protein, 35 aa, Mycobacterium
GAHRPGLVLGLLVIAILVAWRWAPARVAGIPGPLV

SEQ ID NO: 355177 - protein, 25 aa, Mycobacterium
GAIAIMLLLVYRSIVTTLIQLFMTF

SEQ ID NO: 355178 - protein, 25 aa, Mycobacterium
GAIAIMLLLVYRSIVTTLVQLFMTG

SEQ ID NO: 355179 - protein, 24 aa, Mycobacterium
GAIAVMLLLVYRSIVTTVIQLFMT

SEQ ID NO: 355180 - protein, 25 aa, Mycobacterium
GAIAYTLLITPQYQASTRLFVSTSS

SEQ ID NO: 355181 - protein, 20 aa, Mycobacterium
GAICYLIFVAAFLYAIGFVG

SEQ ID NO: 355182 - protein, 26 aa, Mycobacterium
GAIEPQFFAALLAGLGLSAAEVPSQL

SEQ ID NO: 355183 - protein, 24 aa, Mycobacterium
GAIEPQFFAALLDGLGLSPEDVPG

SEQ ID NO: 355184 - protein, 26 aa, Mycobacterium
GAIEPQFFAALLTGLGLSAGEVPGQL

SEQ ID NO: 355185 - protein, 26 aa, Mycobacterium
GAIGAYPWVFIPLIAAAALAYVADRE

SEQ ID NO: 355186 - protein, 23 aa, Mycobacterium
GAIGFALGWRPAPPALALGAAVI

SEQ ID NO: 355187 - protein, 24 aa, Mycobacterium
GAIGILISWGLVELFPGSLAAPDR

SEQ ID NO: 355188 - protein, 33 aa, Mycobacterium
GAIGLAAVLLYSLLYYRVLGLLVALSLVAAGAV

SEQ ID NO: 355189 - protein, 32 aa, Mycobacterium
GAIGLAIVLLYSLIYYRVLGLLTALSLVASGA

SEQ ID NO: 355190 - protein, 35 aa, Mycobacterium
GAIGLALVLLYSLLYYRVLGLLTALSLIASGAMVF

SEQ ID NO: 355191 - protein, 23 aa, Mycobacterium
GAIIRRFIYLALLMTAFNWMSHG

SEQ ID NO: 355192 - protein, 24 aa, Mycobacterium
GAILCLHFTRLPYFQTMGIPCAIG

SEQ ID NO: 355193 - protein, 30 aa, Mycobacterium
GAILFPVGFCLLYLLGFDLLTGVFTLVPLA

SEQ ID NO: 355194 - protein, 19 aa, Mycobacterium
GAILLFDVYVPRDIGFPKV

SEQ ID NO: 355195 - protein, 19 aa, Mycobacterium
GAILSGALVDAPLFCDLLG

SEQ ID NO: 355196 - protein, 38 aa, Mycobacterium
GAILVTIAVVLYYVMLTFIARPYLIPSESMEPTLHGCN

SEQ ID NO: 355197 - protein, 28 aa, Mycobacterium
GAISYGIYLWHWPIFLALNGERTGWTGF

SEQ ID NO: 355198 - protein, 26 aa, Mycobacterium
GAIVRRFFYLVLLMTAFNWMSHGTQD

SEQ ID NO: 355199 - protein, 18 aa, Mycobacterium
GAIYARIDGRLYPALNLT

SEQ ID NO: 355200 - protein, 23 aa, Mycobacterium
GAKAGLFPFHTWLADAHSQAPAP

SEQ ID NO: 355201 - protein, 24 aa, Mycobacterium
GAKRLCLDTNYYATFNLPHVRLVN

SEQ ID NO: 355202 - protein, 22 aa, Mycobacterium
GAKRMQVLINDLLTFSRVGRLN

SEQ ID NO: 355203 - protein, 27 aa, Mycobacterium
GAKRMQVLINDLLTFSRVGRLYSTTTE

SEQ ID NO: 355204 - protein, 25 aa, Mycobacterium
GAKSVEFLPPQYPSPTSLRPDAHVT

SEQ ID NO: 355205 - protein, 39 aa, Mycobacterium
GAKVSGSRFYFLTGFGALLQLGLFQLAVRTATENGFTLM

SEQ ID NO: 355206 - protein, 18 aa, Mycobacterium
GAKYDLMIAGIAALSLIL

SEQ ID NO: 355207 - protein, 23 aa, Mycobacterium
GAKYDLMIVAFAALSLILLIMMI

SEQ ID NO: 355208 - protein, 18 aa, Mycobacterium
GALAAFIVFGRRAQKSIY

SEQ ID NO: 355209 - protein, 19 aa, Mycobacterium
GALAAVIAVAFLATGLSVT

SEQ ID NO: 355210 - protein, 21 aa, Mycobacterium
GALAFLINGLLATVSARPHTH

SEQ ID NO: 355211 - protein, 19 aa, Mycobacterium
GALAPILLVVLRIAQGFGA

SEQ ID NO: 355212 - protein, 25 aa, Mycobacterium
GALARPVLGPWGSQLLFLGILASTL

SEQ ID NO: 355213 - protein, 18 aa, Mycobacterium
GALARRAVVARAVAVEAY

SEQ ID NO: 355214 - protein, 21 aa, Mycobacterium
GALFMLSCFFVFGSLYHLHGA

SEQ ID NO: 355215 - protein, 21 aa, Mycobacterium
GALFPFLFITIACGALSGFHA

SEQ ID NO: 355216 - protein, 23 aa, Mycobacterium
GALFRAPEFYVWIAAALGGMIFQ

SEQ ID NO: 355217 - protein, 24 aa, Mycobacterium
GALGAILDIPYFRDRAYDGVYDEK

SEQ ID NO: 355218 - protein, 21 aa, Mycobacterium
GALGGALAWLGNGLPDVGDAL

SEQ ID NO: 355219 - protein, 25 aa, Mycobacterium
GALGWKSIFFVNVPIGVVGLALAAR

SEQ ID NO: 355220 - protein, 18 aa, Mycobacterium
GALILAPTLQWFVPGHPP

SEQ ID NO: 355221 - protein, 21 aa, Mycobacterium
GALILLMVLATRGGPHRRAEV

SEQ ID NO: 355222 - protein, 28 aa, Mycobacterium
GALISVLWLVPFFLLLESLSPALLVLGF

SEQ ID NO: 355223 - protein, 26 aa, Mycobacterium
GALITGLAFVAILLASINIFGGFAVT

SEQ ID NO: 355224 - protein, 22 aa, Mycobacterium
GALITLLPFLLGLLTSFTSAHQ

SEQ ID NO: 355225 - protein, 17 aa, Mycobacterium
GALLAGVSLLPKQKNHA

SEQ ID NO: 355226 - protein, 23 aa, Mycobacterium
GALLLIVVTLCGAVLIHGLCRWF

SEQ ID NO: 355227 - protein, 33 aa, Mycobacterium
GALLMSLYSLGMAAPLFVLAFAWGKLGLSQRRW

SEQ ID NO: 355228 - protein, 17 aa, Mycobacterium
GALLPVTLALAADLWSA

SEQ ID NO: 355229 - protein, 17 aa, Mycobacterium
GALLPWTRPMFMNDNYA

SEQ ID NO: 355230 - protein, 24 aa, Mycobacterium
GALLVFFTLIFLLHGGRNIFSFVT

SEQ ID NO: 355231 - protein, 17 aa, Mycobacterium
GALLVLQLYVWIRWITG

SEQ ID NO: 355232 - protein, 17 aa, Mycobacterium
GALLVPGPLLAAGSGFL

SEQ ID NO: 355233 - protein, 17 aa, Mycobacterium
GALMVAALALSLDGLLA

SEQ ID NO: 355234 - protein, 19 aa, Mycobacterium
GALMVAALALVLDGLLALL

SEQ ID NO: 355235 - protein, 25 aa, Mycobacterium
GALPSPRRWIWIVLAVGGITAALGA

SEQ ID NO: 355236 - protein, 23 aa, Mycobacterium
GALPWAIGLLVLIGLGLLWRVRI

SEQ ID NO: 355237 - protein, 27 aa, Mycobacterium
GALRVVLASFWPALLVVVCQVFVMYVV

SEQ ID NO: 355238 - protein, 24 aa, Mycobacterium
GALRVVLASYWPGLLIAVCQVVVM

SEQ ID NO: 355239 - protein, 22 aa, Mycobacterium
GALSLAPTLRWFVPGDEPTPQQ

SEQ ID NO: 355240 - protein, 23 aa, Mycobacterium
GALSPYPIMRKLFSQFGLDVLAA

SEQ ID NO: 355241 - protein, 42 aa, Mycobacterium
GALSWFSPLGWSLLVRPYAGERWWVLLLPLATTAALTVLAYR

SEQ ID NO: 355242 - protein, 23 aa, Mycobacterium
GALSWLSPLGWSLQVRPYAGDHW

SEQ ID NO: 355243 - protein, 24 aa, Mycobacterium
GALSWLSPLGWSLQVRPYAGDRWW

SEQ ID NO: 355244 - protein, 17 aa, Mycobacterium
GALTFLPTYMQYVNGVS

SEQ ID NO: 355245 - protein, 19 aa, Mycobacterium
GALTVAVLLLATRGLHIDG

SEQ ID NO: 355246 - protein, 18 aa, Mycobacterium
GALVAFIIFGRRAQKSVY

SEQ ID NO: 355247 - protein, 36 aa, Mycobacterium
GALVEALNWRWVFLVNLPLGIVAVLAARRALVESRA

SEQ ID NO: 355248 - protein, 25 aa, Mycobacterium
GALVHHVRWPMWLRTVVSVVALAAI

SEQ ID NO: 355249 - protein, 20 aa, Mycobacterium
GALVLWLVVGGIQGGLLMAI

SEQ ID NO: 355250 - protein, 23 aa, Mycobacterium
GALVSLLASMYFLVGDLGRPERF

SEQ ID NO: 355251 - protein, 24 aa, Mycobacterium
GALVTGLGLLRRQGLRQAVASGIA

SEQ ID NO: 355252 - protein, 17 aa, Mycobacterium
GALWADTRLGVGYLAAL

SEQ ID NO: 355253 - protein, 22 aa, Mycobacterium
GALWAGFVLFRLRPPSHGTSAR

SEQ ID NO: 355254 - protein, 33 aa, Mycobacterium
GAMAYSLYLWHWPVLIFWLVHTGAPRVGILDGL

SEQ ID NO: 355255 - protein, 24 aa, Mycobacterium
GAMILVRFINWGAQKITRRLDRSF

SEQ ID NO: 355256 - protein, 22 aa, Mycobacterium
GAMIVVCMFWRLFMQDNRPHDG

SEQ ID NO: 355257 - protein, 29 aa, Mycobacterium
GAMLCLSFTRLPYLQTLGVPLAVGMTVGV

SEQ ID NO: 355258 - protein, 25 aa, Mycobacterium
GAMLGGIIIGDLLSGGMRGGFGGWS

SEQ ID NO: 355259 - protein, 21 aa, Mycobacterium
GAMMAGRLLIPVTGAIGVYDP

SEQ ID NO: 355260 - protein, 22 aa, Mycobacterium
GAMPLIAAVAWVFAPETLGRLA

SEQ ID NO: 355261 - protein, 24 aa, Mycobacterium
GAMTLRRIALPAAGLYPLATFGLG

SEQ ID NO: 355262 - protein, 24 aa, Mycobacterium
GAMTLYLWHIPAIAVAAFVLHAVG

SEQ ID NO: 355263 - protein, 25 aa, Mycobacterium
GAMTLYLWHIVAIAIAAFGLHAVGL

SEQ ID NO: 355264 - protein, 26 aa, Mycobacterium
GAMTLYLWHMPLLLGMHLVFDYAGFD

SEQ ID NO: 355265 - protein, 21 aa, Mycobacterium
GAMYCLSFARLPYFNTLGPPC

SEQ ID NO: 355266 - protein, 39 aa, Mycobacterium
GAMYCLSFTRLPYFQTLALPCSIGLFVVVLASLTFAPAV

SEQ ID NO: 355267 - protein, 22 aa, Mycobacterium
GAMYCLSFTRLPYFQTLGAPCA

SEQ ID NO: 355268 - protein, 40 aa, Mycobacterium
GANDFVLGLVFLFAAFWIGLFIWYVGVSTLLVGAKATYYC

SEQ ID NO: 355269 - protein, 25 aa, Mycobacterium
GANIPAIIRGLIAVAWYGIQTFLAS

SEQ ID NO: 355270 - protein, 25 aa, Mycobacterium
GANIPAIIRGLIAVAWYGIQTYLAS

SEQ ID NO: 355271 - protein, 40 aa, Mycobacterium
GANTGWWPLLWFTAKVWGFLFIYFWLRATLPRLRYDQFMA

SEQ ID NO: 355272 - protein, 27 aa, Mycobacterium
GAPAPTPRPFIIKPPTPEPAADPAATS

SEQ ID NO: 355273 - protein, 17 aa, Mycobacterium
GAPARLDDARFLLPVLG

SEQ ID NO: 355274 - protein, 19 aa, Mycobacterium
GAPCAVGMLVAVLAALTLG

SEQ ID NO: 355275 - protein, 25 aa, Mycobacterium
GAPDLPVPRLAGMPSRPPLPAADEF

SEQ ID NO: 355276 - protein, 28 aa, Mycobacterium
GAPFTALQILWVNIIMDGPPALALGVDP

SEQ ID NO: 355277 - protein, 20 aa, Mycobacterium
GAPGYVFFVSGTTAAHLGNV

SEQ ID NO: 355278 - protein, 26 aa, Mycobacterium
GAPHLPIPRLTGMPTLPDALPTMLST

SEQ ID NO: 355279 - protein, 20 aa, Mycobacterium
GAPLGLLDSFADSVSSLANT

SEQ ID NO: 355280 - protein, 25 aa, Mycobacterium
GAPLMALISGRWPRRRALVLFLSVF

SEQ ID NO: 355281 - protein, 28 aa, Mycobacterium
GAPPTITLILPGFWLLVPGSMGLIGVTE

SEQ ID NO: 355282 - protein, 18 aa, Mycobacterium
GAPQLPITALTGLPALPT

SEQ ID NO: 355283 - protein, 19 aa, Mycobacterium
GAPSPLLQGGLAFIDTPGV

SEQ ID NO: 355284 - protein, 20 aa, Mycobacterium
GAPTVPWVLSARSAPALANQ

SEQ ID NO: 355285 - protein, 19 aa, Mycobacterium
GAPWRLSVANFGLLICVLP

SEQ ID NO: 355286 - protein, 25 aa, Mycobacterium
GAQEWLKSIVPFGGFPWGSVAFGQV

SEQ ID NO: 355287 - protein, 25 aa, Mycobacterium
GAQFGFLLVWVIVAANLMACLVQYL

SEQ ID NO: 355288 - protein, 25 aa, Mycobacterium
GAQFGYLLLWVIVVANALAGLVQYL

SEQ ID NO: 355289 - protein, 21 aa, Mycobacterium
GAQLFPGPWALVPVGATVLVI

SEQ ID NO: 355290 - protein, 29 aa, Mycobacterium
GAQLGDLRWFYIYSGVIWCCVFMRTGARR

SEQ ID NO: 355291 - protein, 19 aa, Mycobacterium
GAQLGIFIKGYQALETIHG

SEQ ID NO: 355292 - protein, 20 aa, Mycobacterium
GAQLGIFIKGYRALETIHGI

SEQ ID NO: 355293 - protein, 30 aa, Mycobacterium
GAQQRANRSFFWWVLALAAMASVGSNALHA

SEQ ID NO: 355294 - protein, 35 aa, Mycobacterium
GAQTALICVYAFAALWALALAFRRSRPMVSLDRFA

SEQ ID NO: 355295 - protein, 21 aa, Mycobacterium
GAQVALAYAGAHPTKVSRLVL

SEQ ID NO: 355296 - protein, 27 aa, Mycobacterium
GARGLKPFIRYLMVGIMAILGAATLLM

SEQ ID NO: 355297 - protein, 22 aa, Mycobacterium
GARIWIARIMATWGLLSAAMAF

SEQ ID NO: 355298 - protein, 22 aa, Mycobacterium
GARLLLPIVLGVLLGGSAAAGT

SEQ ID NO: 355299 - protein, 24 aa, Mycobacterium
GARLRVEVPLRRPAATSGPATVPH

SEQ ID NO: 355300 - protein, 24 aa, Mycobacterium
GARPLGFLLDGHAGGWLLVTGSTL

SEQ ID NO: 355301 - protein, 17 aa, Mycobacterium
GARPRLIWYAPHRVEGE

SEQ ID NO: 355302 - protein, 33 aa, Mycobacterium
GARRGRSRLLFGALAILLCLVLGVAIVTQVRQT

SEQ ID NO: 355303 - protein, 34 aa, Mycobacterium
GARRRWRLLYLASMGCWLIAQLFRVTGSIGVGNT

SEQ ID NO: 355304 - protein, 24 aa, Mycobacterium
GARYLAGVFERPGTWRMLDAGIAV

SEQ ID NO: 355305 - protein, 26 aa, Mycobacterium
GASAILWTINIVEVLETLMGFGPPAE

SEQ ID NO: 355306 - protein, 39 aa, Mycobacterium
GASFGLSVLIWQYIFGIELYWMVLPMSVIVLLAVGSDYN

SEQ ID NO: 355307 - protein, 39 aa, Mycobacterium
GASFGLSVLLWQYILGIELHWMTMAFSVIVLLAVGSDYN

SEQ ID NO: 355308 - protein, 32 aa, Mycobacterium
GASFGLSVLLWQYILGIHLHWMVLAMSVIILL

SEQ ID NO: 355309 - protein, 31 aa, Mycobacterium
GASFGLSVLLWQYILGVNLHWMVLAMSVIIL

SEQ ID NO: 355310 - protein, 22 aa, Mycobacterium
GASFTAFLRLTSPLVTPTQHAG

SEQ ID NO: 355311 - protein, 26 aa, Mycobacterium
GASGLIFGWLAFLLVFGIFVRRFVDI

SEQ ID NO: 355312 - protein, 26 aa, Mycobacterium
GASGLIFGWLAFLLVFGIFVRRVSNI

SEQ ID NO: 355313 - protein, 21 aa, Mycobacterium
GASGLTPIALGSSANLVVGQS

SEQ ID NO: 355314 - protein, 17 aa, Mycobacterium
GASIALALWAIRLSARP

SEQ ID NO: 355315 - protein, 24 aa, Mycobacterium
GASIGFYMLMPYLSSYLAGTLGLA

SEQ ID NO: 355316 - protein, 23 aa, Mycobacterium
GASLYALLINRWPLPETGEPSGL

SEQ ID NO: 355317 - protein, 38 aa, Mycobacterium
GASPPAVKRAWLRTWQAAVLIAVIVVALVVGGLAGAEL

SEQ ID NO: 355318 - protein, 28 aa, Mycobacterium
GASVPYIRWPMWLRTVTATAALAAILSC

SEQ ID NO: 355319 - protein, 24 aa, Mycobacterium
GASVSVLALMRRATLRQAVADGVA

SEQ ID NO: 355320 - protein, 40 aa, Mycobacterium
GASVTGWLAAVALPPAICALLLAVPPLGVGTQTALFVAGV

SEQ ID NO: 355321 - protein, 30 aa, Mycobacterium
GASVVIFIVLIPVALALWLSVRFGPHVLGP

SEQ ID NO: 355322 - protein, 18 aa, Mycobacterium
GASWFSLSPVTLSWLLII

SEQ ID NO: 355323 - protein, 18 aa, Mycobacterium
GASWTWIALGTAALSLVA

SEQ ID NO: 355324 - protein, 24 aa, Mycobacterium
GASYRSSLLYPEPPRRHEPRYVRT

SEQ ID NO: 355325 - protein, 24 aa, Mycobacterium
GATAAWAIGRWTPGTERRTATMGL

SEQ ID NO: 355326 - protein, 31 aa, Mycobacterium
GATACGVLMSVWWWRRKWPSRNQSWLVVGIG

SEQ ID NO: 355327 - protein, 26 aa, Mycobacterium
GATFCLHFTRLPYFKTTGIPLSIGMA

SEQ ID NO: 355328 - protein, 23 aa, Mycobacterium
GATGVFLACRWAQAHAGAGVWVG

SEQ ID NO: 355329 - protein, 26 aa, Mycobacterium
GATLCLHFTRLPYFQTMGVPLAIGML

SEQ ID NO: 355330 - protein, 29 aa, Mycobacterium
GATLGFLLGGAWFVGIAGRAPWAGDGRLT

SEQ ID NO: 355331 - protein, 30 aa, Mycobacterium
GATLINTFAWVFYLFGLILLLAAGGVLRPD

SEQ ID NO: 355332 - protein, 17 aa, Mycobacterium
GATLLAMPILGRTKKRL

SEQ ID NO: 355333 - protein, 18 aa, Mycobacterium
GATLLLFPVVQPWYVLWA

SEQ ID NO: 355334 - protein, 18 aa, Mycobacterium
GATLLPPAALPYFGLLPI

SEQ ID NO: 355335 - protein, 29 aa, Mycobacterium
GATPTSWWYPVAWLAYPAAYLVLALLVLN

SEQ ID NO: 355336 - protein, 26 aa, Mycobacterium
GATRALFEPLLAALRDFGCMALMMSG

SEQ ID NO: 355337 - protein, 22 aa, Mycobacterium
GATTALFQWGWGQPLLGMDSTT

SEQ ID NO: 355338 - protein, 32 aa, Mycobacterium
GATTHLYLPLLGLRLTAFLGLLVTAVGLWCMC

SEQ ID NO: 355339 - protein, 23 aa, Mycobacterium
GATVGYYLLRRALRPGGGQLIGA

SEQ ID NO: 355340 - protein, 19 aa, Mycobacterium
GATVLTLRLVMRAGEPRLS

SEQ ID NO: 355341 - protein, 18 aa, Mycobacterium
GATWRAVWIPAVVVLIGV

SEQ ID NO: 355342 - protein, 25 aa, Mycobacterium
GATYCLSFTRLPWFNTMGAPVAIGM

SEQ ID NO: 355343 - protein, 26 aa, Mycobacterium
GATYCLSFTRLPWFNTMGAPVAIGMI

SEQ ID NO: 355344 - protein, 25 aa, Mycobacterium
GATYYVYLTMYVVGAPLSVFMGLIV

SEQ ID NO: 355345 - protein, 29 aa, Mycobacterium
GAVAFAVFAYPLFLLLNTGSLAAAIAAHA

SEQ ID NO: 355346 - protein, 27 aa, Mycobacterium
GAVARLLAWRPLVWLGAISYGIYLWHW

SEQ ID NO: 355347 - protein, 19 aa, Mycobacterium
GAVARWNWVLDGMVETKAL

SEQ ID NO: 355348 - protein, 26 aa, Mycobacterium
GAVAVLLLWPTVLELMLGWLTDAGKA

SEQ ID NO: 355349 - protein, 26 aa, Mycobacterium
GAVAVVGLLWVLFGFSMVFGTSYGGF

SEQ ID NO: 355350 - protein, 23 aa, Mycobacterium
GAVAWLIMLVASPSARAAARLLT

SEQ ID NO: 355351 - protein, 24 aa, Mycobacterium
GAVFCGLLWWITFGMHDALLAVAT

SEQ ID NO: 355352 - protein, 28 aa, Mycobacterium
GAVFGDPMLWLERALVVLVAASPCALAI

SEQ ID NO: 355353 - protein, 31 aa, Mycobacterium
GAVFIAAVIFFSATFLGWYSGGHYSWHRGGA

SEQ ID NO: 355354 - protein, 25 aa, Mycobacterium
GAVFRDIMQILLVTSLFACVLSFHN

SEQ ID NO: 355355 - protein, 25 aa, Mycobacterium
GAVFSRRQLLVRGGAALALVAVLTA

SEQ ID NO: 355356 - protein, 23 aa, Mycobacterium
GAVFVHWLIFQSLYRIGALCPYC

SEQ ID NO: 355357 - protein, 18 aa, Mycobacterium
GAVGWTFAIVTGGVLLAV

SEQ ID NO: 355358 - protein, 31 aa, Mycobacterium
GAVIFGIVVIAIAVSTFFRSGDGLTPEGRVG

SEQ ID NO: 355359 - protein, 34 aa, Mycobacterium
GAVIVGALGMWWTFRGGYAGWWQQLSGESQWSLS

SEQ ID NO: 355360 - protein, 26 aa, Mycobacterium
GAVKPAIPIAVGVLAVVVGVVLWRRR

SEQ ID NO: 355361 - protein, 19 aa, Mycobacterium
GAVLFFRWLLKGGRNAELL

SEQ ID NO: 355362 - protein, 28 aa, Mycobacterium
GAVLGDPMLWLERALVVLVAASPCALAI

SEQ ID NO: 355363 - protein, 24 aa, Mycobacterium
GAVLGVILLVIFAAGGISAARFSL

SEQ ID NO: 355364 - protein, 20 aa, Mycobacterium
GAVLIIFTVLALVGYPAIFE

SEQ ID NO: 355365 - protein, 22 aa, Mycobacterium
GAVLLFVYLLIAFSQIVLRGRT

SEQ ID NO: 355366 - protein, 25 aa, Mycobacterium
GAVLLSIHLPLGLMVLIGVPVVVFG

SEQ ID NO: 355367 - protein, 21 aa, Mycobacterium
GAVLRAPFGAAAAPGPAPGQL

SEQ ID NO: 355368 - protein, 25 aa, Mycobacterium
GAVLTFPMLQFTLLGAVCLLGALWL

SEQ ID NO: 355369 - protein, 29 aa, Mycobacterium
GAVLVGVYVLAALLLFVLGQRHLFAELNR

SEQ ID NO: 355370 - protein, 28 aa, Mycobacterium
GAVLVLAAILFGWFMISAGASVFTVSVK

SEQ ID NO: 355371 - protein, 28 aa, Mycobacterium
GAVMLWVIAAGLVALGLWYVAEAVLGSK

SEQ ID NO: 355372 - protein, 17 aa, Mycobacterium
GAVPFFSALVPVGPAMY

SEQ ID NO: 355373 - protein, 24 aa, Mycobacterium
GAVPMGLLGYRYRIRVLLAAAVAG

SEQ ID NO: 355374 - protein, 17 aa, Mycobacterium
GAVPWLALAFAESLFCG

SEQ ID NO: 355375 - protein, 18 aa, Mycobacterium
GAVPWWLVLTLLGRDAVL

SEQ ID NO: 355376 - protein, 20 aa, Mycobacterium
GAVRALMVLTLVAGLASTVF

SEQ ID NO: 355377 - protein, 24 aa, Mycobacterium
GAVRRYMLLTAIPPLLVLAPFWLL

SEQ ID NO: 355378 - protein, 25 aa, Mycobacterium
GAVSGLLLVILGAWGALIPFVGPHF

SEQ ID NO: 355379 - protein, 23 aa, Mycobacterium
GAVSWLIALVYTGLYTGGLINEV

SEQ ID NO: 355380 - protein, 28 aa, Mycobacterium
GAVTVGWFLPLLGLTLAAFALTDLILGS

SEQ ID NO: 355381 - protein, 23 aa, Mycobacterium
GAVTWLIAVFYNGVYAGGLISEL

SEQ ID NO: 355382 - protein, 29 aa, Mycobacterium
GAVVALLWNYPLATLLLVLGSSALVPLGL

SEQ ID NO: 355383 - protein, 23 aa, Mycobacterium
GAVVLLVLAAVGIWLVTKSDDPG

SEQ ID NO: 355384 - protein, 22 aa, Mycobacterium
GAVVPALMWTPAAALVSVVVYA

SEQ ID NO: 355385 - protein, 25 aa, Mycobacterium
GAVVTGLGLLRRQGLRQAVASGIAV

SEQ ID NO: 355386 - protein, 22 aa, Mycobacterium
GAVVWFGITSAWKERLDRRLDE

SEQ ID NO: 355387 - protein, 19 aa, Mycobacterium
GAVYTYPWPTSMWGEALAM

SEQ ID NO: 355388 - protein, 25 aa, Mycobacterium
GAWGALVPFFGPNIDWAYAGGPAWT

SEQ ID NO: 355389 - protein, 22 aa, Mycobacterium
GAWHVLLGLELCIVSAPLGACV

SEQ ID NO: 355390 - protein, 17 aa, Mycobacterium
GAWLVFAGLWATFVYFP

SEQ ID NO: 355391 - protein, 20 aa, Mycobacterium
GAWMIGMRRPQSYPLMSHLA

SEQ ID NO: 355392 - protein, 24 aa, Mycobacterium
GAWQGFWIAFVGIPSFIVTLGGML

SEQ ID NO: 355393 - protein, 28 aa, Mycobacterium
GAYGQLLAWTRVLGAVLRAPFGAAAAPG

SEQ ID NO: 355394 - protein, 25 aa, Mycobacterium
GAYGSFFNIFYCSTRLKINGPAGSD

SEQ ID NO: 355395 - protein, 30 aa, Mycobacterium
GAYIWWGLCPGFFLLLLPAGPLEVVAHRIV

SEQ ID NO: 355396 - protein, 17 aa, Mycobacterium
GAYLVWPSRTGQKVTAY

SEQ ID NO: 355397 - protein, 18 aa, Mycobacterium
GAYTFVPSTLKRLAKGKI

SEQ ID NO: 355398 - protein, 23 aa, Mycobacterium
GAYTWALLYFVGAGVIMTAAVLI

SEQ ID NO: 355399 - protein, 21 aa, Mycobacterium
GAYVLITFWQYRNACVTAPGL

SEQ ID NO: 355400 - protein, 22 aa, Mycobacterium
GAYWLFHGSKIGKFKDLLINCG

SEQ ID NO: 355401 - protein, 22 aa, Mycobacterium
GAYWLFHSAKIGKFKDLLINCG

SEQ ID NO: 355402 - protein, 28 aa, Mycobacterium
GCAVGAPVTLLRLLFCRGAPARHSNGRY

SEQ ID NO: 355403 - protein, 18 aa, Mycobacterium
GCAVLVVFLRSITGSVMA

SEQ ID NO: 355404 - protein, 24 aa, Mycobacterium
GCELAFTRLLHLPGALFVVIAVTA

SEQ ID NO: 355405 - protein, 25 aa, Mycobacterium
GCFGADVWFLAALAAPLFTAVCGVV

SEQ ID NO: 355406 - protein, 23 aa, Mycobacterium
GCFVVLIRWLIARRAAAFGHHGL

SEQ ID NO: 355407 - protein, 17 aa, Mycobacterium
GCLALSNPYSGLMGCTL

SEQ ID NO: 355408 - protein, 20 aa, Mycobacterium
GCMALGITGPVLRATGLAHD

SEQ ID NO: 355409 - protein, 24 aa, Mycobacterium
GCRRRGIPLPAFLDAVAPGVVMGQ

SEQ ID NO: 355410 - protein, 22 aa, Mycobacterium
GCSLLVLYLLTMATGQPLTVAL

SEQ ID NO: 355411 - protein, 25 aa, Mycobacterium
GCSRAWMLAFSWIAMAGIGVLQYGY

SEQ ID NO: 355412 - protein, 35 aa, Mycobacterium
GCVFWAAVTMLLAAWGWFALLLEITGAVSVVMAIP

SEQ ID NO: 355413 - protein, 19 aa, Mycobacterium
GCVVLAFTLPPVSVLAGAA

SEQ ID NO: 355414 - protein, 30 aa, Mycobacterium
GCWQPITRDLWPAPFLVLDTGASVAPYNHM

SEQ ID NO: 355415 - protein, 29 aa, Mycobacterium
GCWQTITRELWPAPFLVMDTGASMAPYNH

SEQ ID NO: 355416 - protein, 18 aa, Mycobacterium
GCYALLAMAFNTFGVELE

SEQ ID NO: 355417 - protein, 26 aa, Mycobacterium
GDACVWWGLWLITITGWVPLLTVVSP

SEQ ID NO: 355418 - protein, 24 aa, Mycobacterium
GDACVWWGLWLVTITGWVPLITVG

SEQ ID NO: 355419 - protein, 23 aa, Mycobacterium
GDADGTAPLAPLSRRLAQCRSAK

SEQ ID NO: 355420 - protein, 23 aa, Mycobacterium
GDALWISLGLAIGGALFGVVVYL

SEQ ID NO: 355421 - protein, 38 aa, Mycobacterium
GDATAFRLLAVAGVIMLLLIAIGTILRARRRAAAHLHR

SEQ ID NO: 355422 - protein, 20 aa, Mycobacterium
GDAVWLIRDGRRSLINQGAR

SEQ ID NO: 355423 - protein, 23 aa, Mycobacterium
GDDCWWAPRWMRRLQTRIGLGEI

SEQ ID NO: 355424 - protein, 18 aa, Mycobacterium
GDDFAYLVDFGIAHVGGE

SEQ ID NO: 355425 - protein, 26 aa, Mycobacterium
GDDPAWYSPPLLARLRPGLPAPQVPA

SEQ ID NO: 355426 - protein, 24 aa, Mycobacterium
GDDTLIDYVLPAGVALIAVIEDLI

SEQ ID NO: 355427 - protein, 26 aa, Mycobacterium
GDEIDQLVLGHLLRVAPDVDGTEVSG

SEQ ID NO: 355428 - protein, 25 aa, Mycobacterium
GDERLRIPLVVRIDDPWQAAAWRAQ

SEQ ID NO: 355429 - protein, 26 aa, Mycobacterium
GDFMHGRVLLAPLFCLLAPVAVIPVA

SEQ ID NO: 355430 - protein, 26 aa, Mycobacterium
GDFMHGRVLLAPLFCLLAPVAVIPVL

SEQ ID NO: 355431 - protein, 33 aa, Mycobacterium
GDGAMELYRPVATLWLFAIGWAAARATRDRERV

SEQ ID NO: 355432 - protein, 24 aa, Mycobacterium
GDGKRLLVYQVLKSGAKLITDPDN

SEQ ID NO: 355433 - protein, 23 aa, Mycobacterium
GDGMPFLSLTGISAALVGAGTGG

SEQ ID NO: 355434 - protein, 19 aa, Mycobacterium
GDGWFPMTAPGPDLDHALA

SEQ ID NO: 355435 - protein, 17 aa, Mycobacterium
GDGWLLAGDLPLDEAER

SEQ ID NO: 355436 - protein, 31 aa, Mycobacterium
GDHAAQFRKLFWLNLILAVPVVAFSGMFAML

SEQ ID NO: 355437 - protein, 35 aa, Mycobacterium
GDHGWRAMMLLAGLPALLVWFIRRYVPEPPEISDH

SEQ ID NO: 355438 - protein, 18 aa, Mycobacterium
GDHTLFYGKAIAGAPFAA

SEQ ID NO: 355439 - protein, 20 aa, Mycobacterium
GDHTLFYLRAIAGTPHAALH

SEQ ID NO: 355440 - protein, 31 aa, Mycobacterium
GDHVAVRWRRECLIAVIELKPRPFTPTVIVD

SEQ ID NO: 355441 - protein, 18 aa, Mycobacterium
GDHVVGGVTLFPGAGFVE

SEQ ID NO: 355442 - protein, 31 aa, Mycobacterium
GDIPFYEPGLRTLLTKNLAAGRLRFTTDYDM

SEQ ID NO: 355443 - protein, 18 aa, Mycobacterium
GDKAFYRYDLDGLRGIAI

SEQ ID NO: 355444 - protein, 24 aa, Mycobacterium
GDLGIPRTLVWRLAADPVPDDHDA

SEQ ID NO: 355445 - protein, 31 aa, Mycobacterium
GDLHALANRRLLARIWRFAARHHRRLAVFFA

SEQ ID NO: 355446 - protein, 20 aa, Mycobacterium
GDLPGLQAWLASNGYALRPA

SEQ ID NO: 355447 - protein, 24 aa, Mycobacterium
GDLPLLLGALFANGLARFVASGLS

SEQ ID NO: 355448 - protein, 18 aa, Mycobacterium
GDLSWWVTAVILVREIGI

SEQ ID NO: 355449 - protein, 17 aa, Mycobacterium
GDLVEKIRYFVIALLGG

SEQ ID NO: 355450 - protein, 23 aa, Mycobacterium
GDLVHLLAELLDNGLRYSPPHTQ

SEQ ID NO: 355451 - protein, 32 aa, Mycobacterium
GDMAERMRIYFARLLKLFGVGFIVGAAPPLRW

SEQ ID NO: 355452 - protein, 27 aa, Mycobacterium
GDNAGRPWWRPSFKALVRVYDPHEPTC

SEQ ID NO: 355453 - protein, 22 aa, Mycobacterium
GDPPACTVGFLPPSEWRSPADL

SEQ ID NO: 355454 - protein, 22 aa, Mycobacterium
GDPPPCLTGFVPPPLMRTPADE

SEQ ID NO: 355455 - protein, 20 aa, Mycobacterium
GDPPPCSVGFLPATEIRSPA

SEQ ID NO: 355456 - protein, 23 aa, Mycobacterium
GDPRVWIERALVVLVAASPCALA

SEQ ID NO: 355457 - protein, 17 aa, Mycobacterium
GDPRYPYREPPPAPAPG

SEQ ID NO: 355458 - protein, 26 aa, Mycobacterium
GDPSSCTVGFLPPSAWRSPADESDMD

SEQ ID NO: 355459 - protein, 29 aa, Mycobacterium
GDPTGLSLPMFMEELFWGCAGIGLAVVMP

SEQ ID NO: 355460 - protein, 27 aa, Mycobacterium
GDPTRRWLLLTLVAIWGLRLSWHIHRK

SEQ ID NO: 355461 - protein, 23 aa, Mycobacterium
GDPVAMLSLVPWGTNGVSLELMR

SEQ ID NO: 355462 - protein, 29 aa, Mycobacterium
GDQITMKALFALVVFLALVGVYITVRYER

SEQ ID NO: 355463 - protein, 17 aa, Mycobacterium
GDRDHVINLPGFPALGG

SEQ ID NO: 355464 - protein, 22 aa, Mycobacterium
GDRGWYTRFLASRPMVFLGEIS

SEQ ID NO: 355465 - protein, 19 aa, Mycobacterium
GDRLKHLVLPSLTLALGAA

SEQ ID NO: 355466 - protein, 20 aa, Mycobacterium
GDRLWIRFIQDTEHRSQVIE

SEQ ID NO: 355467 - protein, 32 aa, Mycobacterium
GDRSQLITMTYALRYRWWVVLTGVAIASVTVH

SEQ ID NO: 355468 - protein, 23 aa, Mycobacterium
GDRWWVLLLHLVTASALTMVAYW

SEQ ID NO: 355469 - protein, 23 aa, Mycobacterium
GDSDTDALPPYRDYRPGDHDAHD

SEQ ID NO: 355470 - protein, 24 aa, Mycobacterium
GDSLPGDGLLLAARGAMVAVNAAG

SEQ ID NO: 355471 - protein, 21 aa, Mycobacterium
GDSLSAMRLLAGINAALNTGV

SEQ ID NO: 355472 - protein, 28 aa, Mycobacterium
GDSLVAWWVRLIVPALAVVLVVKPVVDA

SEQ ID NO: 355473 - protein, 25 aa, Mycobacterium
GDSMQAVIIFIILAASIGLGFVNEY

SEQ ID NO: 355474 - protein, 25 aa, Mycobacterium
GDSVAWTLMRYLPATPGLAFSNYTT

SEQ ID NO: 355475 - protein, 23 aa, Mycobacterium
GDTVGYRLVIYPTYAVLDRPDPS

SEQ ID NO: 355476 - protein, 26 aa, Mycobacterium
GDVGLLNFPVTITVAYRPSTGVPAVA

SEQ ID NO: 355477 - protein, 22 aa, Mycobacterium
GDVIVFKGPPPWNLGYKSIRSN

SEQ ID NO: 355478 - protein, 22 aa, Mycobacterium
GDVLTGAWWTLAVPAAALIATA

SEQ ID NO: 355479 - protein, 23 aa, Mycobacterium
GDVVYAFWVPNAQSPSIADPEYL

SEQ ID NO: 355480 - protein, 34 aa, Mycobacterium
GDWCYRQRWVVIAAWLVLISAVATILVVAPPALS

SEQ ID NO: 355481 - protein, 21 aa, Mycobacterium
GDWGFALARRGGGAPTPTVPA

SEQ ID NO: 355482 - protein, 17 aa, Mycobacterium
GDWGFVLARRGSSAPAP

SEQ ID NO: 355483 - protein, 22 aa, Mycobacterium
GDWSWLKWLPHVDVPNEADGVG

SEQ ID NO: 355484 - protein, 28 aa, Mycobacterium
GDYGTYFKGHLYIAGRIKDLVIIDGRNH

SEQ ID NO: 355485 - protein, 25 aa, Mycobacterium
GEAGMILTLLTMAAAFMGTALTIRD

SEQ ID NO: 355486 - protein, 25 aa, Mycobacterium
GEAGTILTLLTMAAAFMGTALTIRD

SEQ ID NO: 355487 - protein, 23 aa, Mycobacterium
GEAIRALLGLQARTARVIRNGTQ

SEQ ID NO: 355488 - protein, 18 aa, Mycobacterium
GEALKRLPAYATALGEVV

SEQ ID NO: 355489 - protein, 20 aa, Mycobacterium
GEALLALYRRRGAFIDAGVG

SEQ ID NO: 355490 - protein, 18 aa, Mycobacterium
GEALRRLPPYATALGEVV

SEQ ID NO: 355491 - protein, 26 aa, Mycobacterium
GEAPRTNWWAIVSLIFGVIGGVLIAL

SEQ ID NO: 355492 - protein, 24 aa, Mycobacterium
GEATVLPFSWQHLSLHGSGASRLR

SEQ ID NO: 355493 - protein, 23 aa, Mycobacterium
GEAVTFWILGALALIGALAVVLA

SEQ ID NO: 355494 - protein, 22 aa, Mycobacterium
GEAVTFWILGALALVGALGVVM

SEQ ID NO: 355495 - protein, 25 aa, Mycobacterium
GEDRLFSRAIPQLRTAWVSYRRGAP

SEQ ID NO: 355496 - protein, 17 aa, Mycobacterium
GEELGFIGALGLLGLFG

SEQ ID NO: 355497 - protein, 22 aa, Mycobacterium
GEELPPPLAPLWMQELKASMHV

SEQ ID NO: 355498 - protein, 25 aa, Mycobacterium
GEFEGRLWIAMDYIDGISAAQLMRE

SEQ ID NO: 355499 - protein, 24 aa, Mycobacterium
GEFIAALDKLPWPAPTVFLMRRGT

SEQ ID NO: 355500 - protein, 19 aa, Mycobacterium
GEFLTYWWHRLEHGSRFVF

SEQ ID NO: 355501 - protein, 18 aa, Mycobacterium
GEFWGYLAGWSFAVGKTA

SEQ ID NO: 355502 - protein, 23 aa, Mycobacterium
GEGLGWFSLFVAIAALGYSWHAF

SEQ ID NO: 355503 - protein, 20 aa, Mycobacterium
GEGLVILVAIAFGAALPILP

SEQ ID NO: 355504 - protein, 29 aa, Mycobacterium
GEHDPTNIRWLLYALGTIAIIVAIQRVFS

SEQ ID NO: 355505 - protein, 23 aa, Mycobacterium
GEHPYLMWDAAYVLGSLSAADRR

SEQ ID NO: 355506 - protein, 24 aa, Mycobacterium
GEHSIGWLAASALGAVLSPRRRRD

SEQ ID NO: 355507 - protein, 24 aa, Mycobacterium
GEHSLGWLALAGIGALVSPRQRSD

SEQ ID NO: 355508 - protein, 27 aa, Mycobacterium
GEHSVGWLLVSALGALLFPSRRREWVV

SEQ ID NO: 355509 - protein, 27 aa, Mycobacterium
GEHYWLKLFVFFFPFTDQIAAFKLIML

SEQ ID NO: 355510 - protein, 27 aa, Mycobacterium
GEHYWLKLFVFFFPFTDQVAACKLIML

SEQ ID NO: 355511 - protein, 27 aa, Mycobacterium
GEHYWLKLLVFFFPFTDQIAAFKIIML

SEQ ID NO: 355512 - protein, 27 aa, Mycobacterium
GEHYWLKLLVFFFPFTDQIAAYKLIML

SEQ ID NO: 355513 - protein, 26 aa, Mycobacterium
GEIALYSFIVLLLSGVYLTLFFDPSM

SEQ ID NO: 355514 - protein, 22 aa, Mycobacterium
GEIAVFVFFGLVAVLGTEYAQT

SEQ ID NO: 355515 - protein, 25 aa, Mycobacterium
GEIDGRLYLDMRLIEGRNLGTMLTR

SEQ ID NO: 355516 - protein, 23 aa, Mycobacterium
GEILMWIPLPLLGVPPWMVFVAF

SEQ ID NO: 355517 - protein, 22 aa, Mycobacterium
GEILMWVPLPLLGIPPWMVFFS

SEQ ID NO: 355518 - protein, 22 aa, Mycobacterium
GEILMWVPLPLLGVPPWMVFFA

SEQ ID NO: 355519 - protein, 24 aa, Mycobacterium
GEKLDITALLPTSPAQKYLQAYYT

SEQ ID NO: 355520 - protein, 25 aa, Mycobacterium
GELDGRLWIAMDYIEGIDVGQLMRD

SEQ ID NO: 355521 - protein, 34 aa, Mycobacterium
GELEFWAALIKVFALIAFLVVGIIFLAGRYRIDG

SEQ ID NO: 355522 - protein, 22 aa, Mycobacterium
GELGWMTTYAYPAEAISSRALP

SEQ ID NO: 355523 - protein, 19 aa, Mycobacterium
GELLLWLVRPDFAAYLHVG

SEQ ID NO: 355524 - protein, 17 aa, Mycobacterium
GELPALTPITWLVQVMP

SEQ ID NO: 355525 - protein, 25 aa, Mycobacterium
GELPGGWFTILVTTLVVIAAAVLLV

SEQ ID NO: 355526 - protein, 24 aa, Mycobacterium
GELRDAMLLMPISDPAAPTRIALH

SEQ ID NO: 355527 - protein, 21 aa, Mycobacterium
GELTARRRKWFALQDDTRDIV

SEQ ID NO: 355528 - protein, 19 aa, Mycobacterium
GELVPKYLAVARPLRTARA

SEQ ID NO: 355529 - protein, 29 aa, Mycobacterium
GELVSPARWYWAVIAAFVIFAGTNSWGET

SEQ ID NO: 355530 - protein, 28 aa, Mycobacterium
GEMEQILTPLQWVSTARPLAAKVRSDVG

SEQ ID NO: 355531 - protein, 25 aa, Mycobacterium
GENPFALLLVSLLGPIAATVVRLAV

SEQ ID NO: 355532 - protein, 26 aa, Mycobacterium
GENSKYFLVFWGVVFFVTVNTIAGVA

SEQ ID NO: 355533 - protein, 25 aa, Mycobacterium
GEPDPMPRIWRMRITLERVDDGFKA

SEQ ID NO: 355534 - protein, 24 aa, Mycobacterium
GEPQPFNFIAPADSLAALLAGKGV

SEQ ID NO: 355535 - protein, 18 aa, Mycobacterium
GEPSFGPSGAFLATGPRG

SEQ ID NO: 355536 - protein, 18 aa, Mycobacterium
GEQALAVAIPYTETLTSI

SEQ ID NO: 355537 - protein, 22 aa, Mycobacterium
GEQRFHQVTLPFTGLRDPQGLS

SEQ ID NO: 355538 - protein, 23 aa, Mycobacterium
GERLAWLIVGATIPVGLAGLALE

SEQ ID NO: 355539 - protein, 30 aa, Mycobacterium
GERPAEQGPLPWYKRTALVLSVAGAAAAVL

SEQ ID NO: 355540 - protein, 25 aa, Mycobacterium
GESKGYFLLGIWMSLLWAVVVAVSV

SEQ ID NO: 355541 - protein, 30 aa, Mycobacterium
GESKMNMPWLFFFSGLAIPAFYTVGLLASS

SEQ ID NO: 355542 - protein, 29 aa, Mycobacterium
GETARRTLVFPAGMYWRTTEMFSGAPQMV

SEQ ID NO: 355543 - protein, 23 aa, Mycobacterium
GETAWPFLVALIAVATMTLGNLA

SEQ ID NO: 355544 - protein, 27 aa, Mycobacterium
GEVAEGALLLFLFSVGHALEGYAMGRA

SEQ ID NO: 355545 - protein, 28 aa, Mycobacterium
GEVDPTNLRWFLYALGTIAVIVAIQRIF

SEQ ID NO: 355546 - protein, 26 aa, Mycobacterium
GEVGIGWGLITLAVVSGLQAAVSVYS

SEQ ID NO: 355547 - protein, 30 aa, Mycobacterium
GEVLMRILDVLFAFPLVLLAIALSAVLGAG

SEQ ID NO: 355548 - protein, 24 aa, Mycobacterium
GEVPLLAVVIAFSLAFGMGLPITV

SEQ ID NO: 355549 - protein, 23 aa, Mycobacterium
GEWAITLFNILLVTGSFACGMAF

SEQ ID NO: 355550 - protein, 27 aa, Mycobacterium
GEWIITRGLRVVMLLIAAVLAARFVSW

SEQ ID NO: 355551 - protein, 19 aa, Mycobacterium
GEWLKRIPDFGLAPGYTPE

SEQ ID NO: 355552 - protein, 26 aa, Mycobacterium
GEYDGRLYLVMPIVDGVDLNKVLKTD

SEQ ID NO: 355553 - protein, 22 aa, Mycobacterium
GEYHSHLWISMEYVAGTDAGRL

SEQ ID NO: 355554 - protein, 17 aa, Mycobacterium
GFAFSIVLLVLVLIPGI

SEQ ID NO: 355555 - protein, 24 aa, Mycobacterium
GFAIAAMLWLWRYAGARRAGRSAG

SEQ ID NO: 355556 - protein, 18 aa, Mycobacterium
GFAIPINEAADVAQTLIR

SEQ ID NO: 355557 - protein, 28 aa, Mycobacterium
GFALGIAILLGGNWLVCLLAAATSAVID

SEQ ID NO: 355558 - protein, 19 aa, Mycobacterium
GFALLTMNFRIVVLGAAGV

SEQ ID NO: 355559 - protein, 27 aa, Mycobacterium
GFAMEALACLVLWTAKVLPPAEFYPNQ

SEQ ID NO: 355560 - protein, 17 aa, Mycobacterium
GFAPPMPTPSTPAAQPA

SEQ ID NO: 355561 - protein, 18 aa, Mycobacterium
GFARKVVVAAICHGVLLA

SEQ ID NO: 355562 - protein, 23 aa, Mycobacterium
GFASAFFNVRLIAPGTTAVALSA

SEQ ID NO: 355563 - protein, 26 aa, Mycobacterium
GFAVHIVAIVLLVLAYREFWAKVRKG

SEQ ID NO: 355564 - protein, 22 aa, Mycobacterium
GFAVLILLRIPIALALALAAVF

SEQ ID NO: 355565 - protein, 30 aa, Mycobacterium
GFCTDYLHWRWAFWINLPISIVVLAVTATA

SEQ ID NO: 355566 - protein, 25 aa, Mycobacterium
GFDLRPYYPLILTAFLLLTSIIIVG

SEQ ID NO: 355567 - protein, 27 aa, Mycobacterium
GFDPRAWPAWIWGALTGLGLVVAGIGA

SEQ ID NO: 355568 - protein, 25 aa, Mycobacterium
GFDSAFTLALIALSGGVYSPVVAVL

SEQ ID NO: 355569 - protein, 25 aa, Mycobacterium
GFEHSIVNMFLFPSGLMLGGDFSIA

SEQ ID NO: 355570 - protein, 24 aa, Mycobacterium
GFEHSVVNMFLFPSGLMLGGDFSI

SEQ ID NO: 355571 - protein, 18 aa, Mycobacterium
GFELSVRTLTFPVPVIIA

SEQ ID NO: 355572 - protein, 17 aa, Mycobacterium
GFFAAIEAGAIAVPLFA

SEQ ID NO: 355573 - protein, 27 aa, Mycobacterium
GFFAPGRFWWWSLAAVVGILAVPYVIA

SEQ ID NO: 355574 - protein, 20 aa, Mycobacterium
GFFGFFLLAFLDHCPPATCS

SEQ ID NO: 355575 - protein, 23 aa, Mycobacterium
GFFMGWSYWFAWIVTGIADLVAI

SEQ ID NO: 355576 - protein, 20 aa, Mycobacterium
GFFSPNPWAALVTGLVAGVF

SEQ ID NO: 355577 - protein, 21 aa, Mycobacterium
GFFTNDRWLSISAALLLASFV

SEQ ID NO: 355578 - protein, 30 aa, Mycobacterium
GFGAAFGPLILLSLFWRRLTSAGAIAGMIA

SEQ ID NO: 355579 - protein, 31 aa, Mycobacterium
GFGEQWPGDLGERPALWIPASSVSEARLEAS

SEQ ID NO: 355580 - protein, 20 aa, Mycobacterium
GFGFFMLLENIWHAPALLLV

SEQ ID NO: 355581 - protein, 33 aa, Mycobacterium
GFGPAWVVTALWWFPFAVIFPVGDPLDFGALAT

SEQ ID NO: 355582 - protein, 18 aa, Mycobacterium
GFGQLRYCNPRTSAVLAR

SEQ ID NO: 355583 - protein, 18 aa, Mycobacterium
GFGWALLFNGFFGPRLGV

SEQ ID NO: 355584 - protein, 21 aa, Mycobacterium
GFHGKWPWQMTHQMDGAVQID

SEQ ID NO: 355585 - protein, 23 aa, Mycobacterium
GFHNGFFVFAILLTALSVIPLGG

SEQ ID NO: 355586 - protein, 29 aa, Mycobacterium
GFHPSPLALAFTLGALAISLLGSVPPARR

SEQ ID NO: 355587 - protein, 17 aa, Mycobacterium
GFIALFIVCGAGKGAVY

SEQ ID NO: 355588 - protein, 25 aa, Mycobacterium
GFIGKWPAELSGQPALWIPGSSVSA

SEQ ID NO: 355589 - protein, 21 aa, Mycobacterium
GFIGVVFLVVWLLIVYLRHEV

SEQ ID NO: 355590 - protein, 19 aa, Mycobacterium
GFILYLLAMPETASARLAG

SEQ ID NO: 355591 - protein, 26 aa, Mycobacterium
GFINSVALLVLAFPVGNLTALSTQLG

SEQ ID NO: 355592 - protein, 24 aa, Mycobacterium
GFISWVVLALARGRFRSVHPLLYV

SEQ ID NO: 355593 - protein, 24 aa, Mycobacterium
GFITTLVLNAFFLDKYNAYGEVPI

SEQ ID NO: 355594 - protein, 23 aa, Mycobacterium
GFIVTLVLNAFFLDKYDAYGEVA

SEQ ID NO: 355595 - protein, 21 aa, Mycobacterium
GFLAFWSIHLLVVWAAIYLTW

SEQ ID NO: 355596 - protein, 18 aa, Mycobacterium
GFLAIYRMLDHHSGPESA

SEQ ID NO: 355597 - protein, 28 aa, Mycobacterium
GFLALGLLIPVMLWPPSAPLLIIPVVLS

SEQ ID NO: 355598 - protein, 17 aa, Mycobacterium
GFLALLLGRSELFTEGF

SEQ ID NO: 355599 - protein, 20 aa, Mycobacterium
GFLGALERGWQSLIATVDGL

SEQ ID NO: 355600 - protein, 25 aa, Mycobacterium
GFLGAYLFNVYWQGGAPGSFVSTFA

SEQ ID NO: 355601 - protein, 25 aa, Mycobacterium
GFLGAYLFNVYWQNGAPGSFVTTFS

SEQ ID NO: 355602 - protein, 26 aa, Mycobacterium
GFLGLPLLLNLFHPTAPRGAIGWGFG

SEQ ID NO: 355603 - protein, 18 aa, Mycobacterium
GFLLFGPVTDRFGRRRVL

SEQ ID NO: 355604 - protein, 18 aa, Mycobacterium
GFLMLAHHWGTMAAAPAF

SEQ ID NO: 355605 - protein, 25 aa, Mycobacterium
GFLNGVLITFCRVPAFIATLATLTA

SEQ ID NO: 355606 - protein, 17 aa, Mycobacterium
GFLPLIATALLAVGDGA

SEQ ID NO: 355607 - protein, 29 aa, Mycobacterium
GFLQYLGAILFTLGGLAFSFLVPALAGYI

SEQ ID NO: 355608 - protein, 22 aa, Mycobacterium
GFLRSPLAGIAPWALLAILSGP

SEQ ID NO: 355609 - protein, 40 aa, Mycobacterium
GFLTGWALMLDYLLLPLVNYLLIGIYLNAQFPAVPAPVFC

SEQ ID NO: 355610 - protein, 19 aa, Mycobacterium
GFLVLIVLLIFIAQNTAST

SEQ ID NO: 355611 - protein, 26 aa, Mycobacterium
GFMCVALIVYFVMLGRAAFVFITSGE

SEQ ID NO: 355612 - protein, 18 aa, Mycobacterium
GFMILTCGLGLSAAAVFH

SEQ ID NO: 355613 - protein, 19 aa, Mycobacterium
GFMSRIWIVVAGGALPVLY

SEQ ID NO: 355614 - protein, 18 aa, Mycobacterium
GFPGWANYFPVTRGTPEP

SEQ ID NO: 355615 - protein, 20 aa, Mycobacterium
GFPTDGIVVLCDFGASGSSV

SEQ ID NO: 355616 - protein, 27 aa, Mycobacterium
GFPVTEFNVALPWTKMVVLNPGVQTES

SEQ ID NO: 355617 - protein, 19 aa, Mycobacterium
GFPWAAFVVGLSSAGPPPV

SEQ ID NO: 355618 - protein, 19 aa, Mycobacterium
GFQGLVGVWRRDSELFAEV

SEQ ID NO: 355619 - protein, 32 aa, Mycobacterium
GFQLLSAHGLYPLLIMTLLPVLAGVDISSRRA

SEQ ID NO: 355620 - protein, 26 aa, Mycobacterium
GFRHRKEIVYLPPAWFDSTRTELPTI

SEQ ID NO: 355621 - protein, 19 aa, Mycobacterium
GFRRYVVVYSDLFEIGGQA

SEQ ID NO: 355622 - protein, 27 aa, Mycobacterium
GFSELAVGFPVLFLTAAAIAEYVVVTR

SEQ ID NO: 355623 - protein, 22 aa, Mycobacterium
GFSGLYMLHRLRELGLRARVLE

SEQ ID NO: 355624 - protein, 17 aa, Mycobacterium
GFSGSYRLFAVTSPPVS

SEQ ID NO: 355625 - protein, 39 aa, Mycobacterium
GFSPYPIDEVPARPPHRPWGGRVPLVLTGAAIALVIAGF

SEQ ID NO: 355626 - protein, 27 aa, Mycobacterium
GFSVGWLYWYFWVIVVGFEAVAGAKVL

SEQ ID NO: 355627 - protein, 27 aa, Mycobacterium
GFSVGWLYWYFWVIVVGFEAVAGGKLI

SEQ ID NO: 355628 - protein, 19 aa, Mycobacterium
GFSVWMLWSIVVVQMMAVG

SEQ ID NO: 355629 - protein, 18 aa, Mycobacterium
GFTARRAAVLAAVVCVLT

SEQ ID NO: 355630 - protein, 30 aa, Mycobacterium
GFTFFIDMLVYGIVVPVLPRLAKPAGLEFL

SEQ ID NO: 355631 - protein, 23 aa, Mycobacterium
GFTRPWVLLLAAGLALAPILIFI

SEQ ID NO: 355632 - protein, 23 aa, Mycobacterium
GFTRRMMGLINLVLAIVPALMVL

SEQ ID NO: 355633 - protein, 23 aa, Mycobacterium
GFTTYMLIPLGIVLGALVAFIIF

SEQ ID NO: 355634 - protein, 27 aa, Mycobacterium
GFVACVTLVLLFALTGSVLLPVKAVLL

SEQ ID NO: 355635 - protein, 26 aa, Mycobacterium
GFVALSAVGGWLYWKGVELDGEQQAR

SEQ ID NO: 355636 - protein, 19 aa, Mycobacterium
GFVHSLTYAIFAAVGLAAL

SEQ ID NO: 355637 - protein, 23 aa, Mycobacterium
GFVKSLTYALLAAVGLAALLSIT

SEQ ID NO: 355638 - protein, 26 aa, Mycobacterium
GFVLMTLGFFVLDWTTPGPLRQMVRA

SEQ ID NO: 355639 - protein, 54 aa, Mycobacterium
GFVNALAILIFLSQLPHLLGVPPVVYPFVIVGLLLMVFLPKLTTVVPAPLVAIV

SEQ ID NO: 355640 - protein, 21 aa, Mycobacterium
GFVPLDYLWDLVSIGTLVAFI

SEQ ID NO: 355641 - protein, 25 aa, Mycobacterium
GFVSEWLLVQSLIHTAREHSAVLAL

SEQ ID NO: 355642 - protein, 28 aa, Mycobacterium
GFVTMAWWMAVFPGAAIFLIVLAFNLFG

SEQ ID NO: 355643 - protein, 22 aa, Mycobacterium
GFVVALILNALFFDKFDAYGEV

SEQ ID NO: 355644 - protein, 18 aa, Mycobacterium
GFVVWYRGMGFIGVARAS

SEQ ID NO: 355645 - protein, 24 aa, Mycobacterium
GFWAGVLVYFLPRRSWLRAAAEDT

SEQ ID NO: 355646 - protein, 19 aa, Mycobacterium
GFWFAFVMLRIVRGRGPLR

SEQ ID NO: 355647 - protein, 17 aa, Mycobacterium
GFWKSILIFGLLVAADI

SEQ ID NO: 355648 - protein, 34 aa, Mycobacterium
GFYCYVLTHVLYLNYVWHYSLLKAGFAIAPAALI

SEQ ID NO: 355649 - protein, 23 aa, Mycobacterium
GFYDYLYGWWGLAIAVVLGLAGG

SEQ ID NO: 355650 - protein, 23 aa, Mycobacterium
GGAAIPYVTQRLSERLRAPVVTS

SEQ ID NO: 355651 - protein, 24 aa, Mycobacterium
GGAALGYFWGWRAALWAVVLVSVP

SEQ ID NO: 355652 - protein, 18 aa, Mycobacterium
GGAALVVAALGIALALIR

SEQ ID NO: 355653 - protein, 25 aa, Mycobacterium
GGAAVTGLALLRRASLRQAVADGVA

SEQ ID NO: 355654 - protein, 24 aa, Mycobacterium
GGAAWLPFLVAFAIATITAFSYLE

SEQ ID NO: 355655 - protein, 24 aa, Mycobacterium
GGAAWLPFLVAFLVATVTAFSYLE

SEQ ID NO: 355656 - protein, 26 aa, Mycobacterium
GGAGAIFPIFMVGGMMMMMFGGRFGG

SEQ ID NO: 355657 - protein, 22 aa, Mycobacterium
GGAGFPAAAWEFARAAAAELTG

SEQ ID NO: 355658 - protein, 25 aa, Mycobacterium
GGAGGMYFFALSGLTSRPGPEPDLG

SEQ ID NO: 355659 - protein, 25 aa, Mycobacterium
GGAGGRGPLIVLRAGRTGDGGDGGD

SEQ ID NO: 355660 - protein, 27 aa, Mycobacterium
GGAGLKAFWYHFAIMFEALFILTTVDA

SEQ ID NO: 355661 - protein, 32 aa, Mycobacterium
GGAGSLLRLLVLGLIMVPILAAVMLGAQVPEA

SEQ ID NO: 355662 - protein, 29 aa, Mycobacterium
GGAGSLVRLFVLGLIMLPITATVMLRAQV

SEQ ID NO: 355663 - protein, 18 aa, Mycobacterium
GGAIAAVVVLVAIIALVV

SEQ ID NO: 355664 - protein, 17 aa, Mycobacterium
GGAIALHLLFGLPLLLG

SEQ ID NO: 355665 - protein, 27 aa, Mycobacterium
GGAIALLVLAMLIAVIAALWVSRADAA

SEQ ID NO: 355666 - protein, 25 aa, Mycobacterium
GGAIAWLILLVASPATRAAARLLTP

SEQ ID NO: 355667 - protein, 29 aa, Mycobacterium
GGAIFDRVALWAYLGWLRYKVKDPEVRQQ

SEQ ID NO: 355668 - protein, 22 aa, Mycobacterium
GGALFGVVVYLLSGARPQAPDI

SEQ ID NO: 355669 - protein, 17 aa, Mycobacterium
GGALGMFLWELRSGTSV

SEQ ID NO: 355670 - protein, 18 aa, Mycobacterium
GGALHKLTGGLLGGGGGG

SEQ ID NO: 355671 - protein, 24 aa, Mycobacterium
GGALWRFAALMFLSSMVASIGLLQ

SEQ ID NO: 355672 - protein, 24 aa, Mycobacterium
GGAMLGMIAIMFAGGRQLSPYMLM

SEQ ID NO: 355673 - protein, 25 aa, Mycobacterium
GGAMTLYLWHIPVIAAAALGLHALG

SEQ ID NO: 355674 - protein, 22 aa, Mycobacterium
GGAPFYGVYECQDGRFFAVGAI

SEQ ID NO: 355675 - protein, 17 aa, Mycobacterium
GGAQYRAFDLLEAGPDR

SEQ ID NO: 355676 - protein, 18 aa, Mycobacterium
GGARFKMPGIERVDIMSL

SEQ ID NO: 355677 - protein, 23 aa, Mycobacterium
GGASIPLLTARLAERFQVPVHTA

SEQ ID NO: 355678 - protein, 17 aa, Mycobacterium
GGASLWVAIYGTFVLNF

SEQ ID NO: 355679 - protein, 19 aa, Mycobacterium
GGASWWQFIRNSRNPELPV

SEQ ID NO: 355680 - protein, 23 aa, Mycobacterium
GGATALIGLLPTAAQIGAWAPVL

SEQ ID NO: 355681 - protein, 26 aa, Mycobacterium
GGATAVIALLPPLPVILVCCTVIGLV

SEQ ID NO: 355682 - protein, 22 aa, Mycobacterium
GGAVAFTVVRRSSQPEPSPRPP

SEQ ID NO: 355683 - protein, 23 aa, Mycobacterium
GGAVALRILFDVPLPVGGIITGV

SEQ ID NO: 355684 - protein, 29 aa, Mycobacterium
GGAVTLTLVWFVALFVMFFRGSPQIPRKY

SEQ ID NO: 355685 - protein, 31 aa, Mycobacterium
GGDANYGAWWFWLGLILIVGILLLVGNLERS

SEQ ID NO: 355686 - protein, 17 aa, Mycobacterium
GGELYAAGFLLGRGYVN

SEQ ID NO: 355687 - protein, 25 aa, Mycobacterium
GGENLSFADLLPWIDAHGDARPELI

SEQ ID NO: 355688 - protein, 24 aa, Mycobacterium
GGEPEYPAPTLTLAAGPVAAHGHR

SEQ ID NO: 355689 - protein, 20 aa, Mycobacterium
GGEPGPITPLPVYTSEEVGQ

SEQ ID NO: 355690 - protein, 28 aa, Mycobacterium
GGEPGVIYDIALWAVPFGLAGGRIYHVI

SEQ ID NO: 355691 - protein, 32 aa, Mycobacterium
GGEPGVIYDIALWAVPFGLIGGRLYHVITDWP

SEQ ID NO: 355692 - protein, 33 aa, Mycobacterium
GGERRMLRLIRRYGPIMTMPILTLGDVAIVSDP

SEQ ID NO: 355693 - protein, 28 aa, Mycobacterium
GGESALFFVGVLLVGLFGGVAPAALSAM

SEQ ID NO: 355694 - protein, 17 aa, Mycobacterium
GGEWRITRMSTITSFDL

SEQ ID NO: 355695 - protein, 27 aa, Mycobacterium
GGEYAWTSPMIIGLFIGSITALVLFVR

SEQ ID NO: 355696 - protein, 20 aa, Mycobacterium
GGFAAMLFGSVSAAVVLLTH

SEQ ID NO: 355697 - protein, 18 aa, Mycobacterium
GGFLIDLAVRTSRNATEL

SEQ ID NO: 355698 - protein, 19 aa, Mycobacterium
GGFPWVAFVAGLSSAGPPP

SEQ ID NO: 355699 - protein, 17 aa, Mycobacterium
GGFTLFYLGVNLGAFVG

SEQ ID NO: 355700 - protein, 24 aa, Mycobacterium
GGFTQVFTFGLTGLRLRADGIVVD

SEQ ID NO: 355701 - protein, 26 aa, Mycobacterium
GGFVLALLIVTFLHLVIGEMAPKSWA

SEQ ID NO: 355702 - protein, 18 aa, Mycobacterium
GGFYLFTVALQIGSVNGA

SEQ ID NO: 355703 - protein, 29 aa, Mycobacterium
GGGAGSLLRLFILAVIMAPIMAAVMLRAG

SEQ ID NO: 355704 - protein, 35 aa, Mycobacterium
GGGAPVAIATPAYWGPAALGALRGALRNKPAFAPD

SEQ ID NO: 355705 - protein, 24 aa, Mycobacterium
GGGASIPLITARLSQRFGVPVRSA

SEQ ID NO: 355706 - protein, 25 aa, Mycobacterium
GGGGAPWLWVGVAVAVVVAVAAGLG

SEQ ID NO: 355707 - protein, 27 aa, Mycobacterium
GGGIGSLLRLLILGVIMAPIVIAVLLA

SEQ ID NO: 355708 - protein, 30 aa, Mycobacterium
GGGILLFWAMLYGWAFMHRGVAYFPNLVLP

SEQ ID NO: 355709 - protein, 27 aa, Mycobacterium
GGGILLFWAMLYGWGFMHRGVPYFPNL

SEQ ID NO: 355710 - protein, 24 aa, Mycobacterium
GGGKQFYVLLPDGVQKITSFVADL

SEQ ID NO: 355711 - protein, 25 aa, Mycobacterium
GGGLALVVMTAWLTPKVGPTIVGAN

SEQ ID NO: 355712 - protein, 27 aa, Mycobacterium
GGGLGGLLIVVVALFLGVDPSSVVPQQ

SEQ ID NO: 355713 - protein, 37 aa, Mycobacterium
GGGLGLVLLTAGITPRLYVWITGPDVLPAVAAIVAVL

SEQ ID NO: 355714 - protein, 29 aa, Mycobacterium
GGGMMRSPMFMLFPIMMMVSMVSMVSNSG

SEQ ID NO: 355715 - protein, 37 aa, Mycobacterium
GGGSYAWTIFRKRFWRFWLGAPIADMLFMLGAAGQRK

SEQ ID NO: 355716 - protein, 25 aa, Mycobacterium
GGGTLGWLAGVWRDVLAAPIDGPEA

SEQ ID NO: 355717 - protein, 21 aa, Mycobacterium
GGGVKFIGLVGAIVALMDAGY

SEQ ID NO: 355718 - protein, 28 aa, Mycobacterium
GGHIFIENPLLLFGYSATVGPLVGAVLG

SEQ ID NO: 355719 - protein, 26 aa, Mycobacterium
GGHLNYGVWWYWLGLCLIAAVLVLMG

SEQ ID NO: 355720 - protein, 19 aa, Mycobacterium
GGHVLFIKDGRLHYVYNFL

SEQ ID NO: 355721 - protein, 26 aa, Mycobacterium
GGIAITLFMGIILLAERTGAKIAEDP

SEQ ID NO: 355722 - protein, 34 aa, Mycobacterium
GGIAKLIRTLAVPIILVWVALIAVLNTIVPQLEE

SEQ ID NO: 355723 - protein, 34 aa, Mycobacterium
GGIAKWIRVLAVPIILVWVAIIAVLNTVVPQLDV

SEQ ID NO: 355724 - protein, 35 aa, Mycobacterium
GGIALLLVVVVLVLGFWQPGFFVTTKLDVSKAQAG

SEQ ID NO: 355725 - protein, 34 aa, Mycobacterium
GGIDGRLWQAVITLLFILLGGLLITSLSARRNQL

SEQ ID NO: 355726 - protein, 33 aa, Mycobacterium
GGIGLVLVLLYSLLYYRVLGLLTALSLIASGAM

SEQ ID NO: 355727 - protein, 24 aa, Mycobacterium
GGILSWVLILLLPAGTLHYWQAWV

SEQ ID NO: 355728 - protein, 20 aa, Mycobacterium
GGIRHALFIALAVTAVVILS

SEQ ID NO: 355729 - protein, 24 aa, Mycobacterium
GGITVLTGLLWWTVAIHLIASMVM

SEQ ID NO: 355730 - protein, 26 aa, Mycobacterium
GGITVLTGLLWWTVAIHLLVSMAMVW

SEQ ID NO: 355731 - protein, 24 aa, Mycobacterium
GGIVFRVQQELGVPVKLVGLGEGP

SEQ ID NO: 355732 - protein, 27 aa, Mycobacterium
GGIVVKALLVLGLWFAGWGAARLVSVV

SEQ ID NO: 355733 - protein, 33 aa, Mycobacterium
GGKLIQDWLPHAPLWLIALLLMLAMTATNLFSV

SEQ ID NO: 355734 - protein, 38 aa, Mycobacterium
GGKNQNFLVPNGTFFFVLAIFLVVLGVIGTFVVPPILK

SEQ ID NO: 355735 - protein, 34 aa, Mycobacterium
GGKPPLRQRNWGWVLAIVVIVLAVAAIAILGTVL

SEQ ID NO: 355736 - protein, 23 aa, Mycobacterium
GGKPRWLCATAALTAALVGALPW

SEQ ID NO: 355737 - protein, 25 aa, Mycobacterium
GGLAFFFGPVVVFWVLATMAAMSVV

SEQ ID NO: 355738 - protein, 29 aa, Mycobacterium
GGLAFTVFCLIGFPFLIAAVLWGIVDAIM

SEQ ID NO: 355739 - protein, 25 aa, Mycobacterium
GGLALAVAVLWWLSVQRDRRQADAH

SEQ ID NO: 355740 - protein, 23 aa, Mycobacterium
GGLALLPILACLALLPARGRTTL

SEQ ID NO: 355741 - protein, 27 aa, Mycobacterium
GGLALVFAVLLFPPDPVQILCDARADV

SEQ ID NO: 355742 - protein, 39 aa, Mycobacterium
GGLALWLSFPPIGWWFTAFPGLALLGWVLTRTATTKAGG

SEQ ID NO: 355743 - protein, 22 aa, Mycobacterium
GGLDLPFTYPPLAAIAFAPFAW

SEQ ID NO: 355744 - protein, 21 aa, Mycobacterium
GGLELPFTYPPLAAVAFSPFA

SEQ ID NO: 355745 - protein, 20 aa, Mycobacterium
GGLGAFLPGLVELLRARMPA

SEQ ID NO: 355746 - protein, 26 aa, Mycobacterium
GGLGGLLIVVLALFLGVDPGQVLPQQ

SEQ ID NO: 355747 - protein, 25 aa, Mycobacterium
GGLGIWGAVTLGTVGAWIGCRRRGI

SEQ ID NO: 355748 - protein, 22 aa, Mycobacterium
GGLGMLYVVYLLWEHKDTAAGT

SEQ ID NO: 355749 - protein, 18 aa, Mycobacterium
GGLHRTPPAWASWLRVVL

SEQ ID NO: 355750 - protein, 20 aa, Mycobacterium
GGLIAFVLLLLRTRMSKFTP

SEQ ID NO: 355751 - protein, 30 aa, Mycobacterium
GGLIAILIFAPYLWLALLSAAVAMATYEVS

SEQ ID NO: 355752 - protein, 26 aa, Mycobacterium
GGLIELAVWLAIPYLCIGFAWTVFHP

SEQ ID NO: 355753 - protein, 24 aa, Mycobacterium
GGLIFTFFTALLGSLILLWIVGMV

SEQ ID NO: 355754 - protein, 18 aa, Mycobacterium
GGLISTIVLIVFSPAVSG

SEQ ID NO: 355755 - protein, 20 aa, Mycobacterium
GGLIVYSLGFWRGMLAIALG

SEQ ID NO: 355756 - protein, 17 aa, Mycobacterium
GGLLAAALPMALGALAV

SEQ ID NO: 355757 - protein, 25 aa, Mycobacterium
GGLNYLLCWGLLYQLGICWQAGLLS

SEQ ID NO: 355758 - protein, 26 aa, Mycobacterium
GGLSQAVVLAVWPPQRWRAQRDAVVA

SEQ ID NO: 355759 - protein, 19 aa, Mycobacterium
GGLTFPRYLAATRPGTHNV

SEQ ID NO: 355760 - protein, 24 aa, Mycobacterium
GGLVFGLIPGFVATAPPPFNIVIS

SEQ ID NO: 355761 - protein, 18 aa, Mycobacterium
GGLVPLVGTWGFDQIAWF

SEQ ID NO: 355762 - protein, 26 aa, Mycobacterium
GGMDSMLLTIWLIIGAVTFGALLEKF

SEQ ID NO: 355763 - protein, 24 aa, Mycobacterium
GGMFGWVRNPIFTAMLVFGAGVAL

SEQ ID NO: 355764 - protein, 26 aa, Mycobacterium
GGMLSGAWLGLFIGLVLGMFSTNLAG

SEQ ID NO: 355765 - protein, 24 aa, Mycobacterium
GGMTGVFINVLFGSGLRAPAAPGS

SEQ ID NO: 355766 - protein, 31 aa, Mycobacterium
GGMTLPRALFWIVVVYVLVATIIVFAIGRPL

SEQ ID NO: 355767 - protein, 30 aa, Mycobacterium
GGMVVVLLVAAWWLFEALWHPVRGRLADLA

SEQ ID NO: 355768 - protein, 28 aa, Mycobacterium
GGNGGSVGLFAIFATAGAGGAGGAGGNG

SEQ ID NO: 355769 - protein, 35 aa, Mycobacterium
GGNNFLVPNGTFFFVLAIFLIVLAVIGTFVVPPVM

SEQ ID NO: 355770 - protein, 25 aa, Mycobacterium
GGPALALRFLALTAGVFGVSAAVAA

SEQ ID NO: 355771 - protein, 26 aa, Mycobacterium
GGPALPLALIASAAILFVVIYLAHGV

SEQ ID NO: 355772 - protein, 24 aa, Mycobacterium
GGPARMRVIVLLALVVGLEGASNG

SEQ ID NO: 355773 - protein, 21 aa, Mycobacterium
GGPFPGPPPQRPSGNRMWWIM

SEQ ID NO: 355774 - protein, 27 aa, Mycobacterium
GGPGSKLPWLIIGGLVILAVVALVATL

SEQ ID NO: 355775 - protein, 18 aa, Mycobacterium
GGPKCLVKVIQKLSGLHV

SEQ ID NO: 355776 - protein, 24 aa, Mycobacterium
GGPKCLVKVIQKLSGLSINRFIAI

SEQ ID NO: 355777 - protein, 25 aa, Mycobacterium
GGPKCLVKVIQKLSGLSINRFIAID

SEQ ID NO: 355778 - protein, 28 aa, Mycobacterium
GGPLAFVFRFLVLAPLSWLIPAIRPIVL

SEQ ID NO: 355779 - protein, 27 aa, Mycobacterium
GGPLAIGFSLLCIGLAAFSFLIDFDAA

SEQ ID NO: 355780 - protein, 32 aa, Mycobacterium
GGPLALWIAAAALFAMGLWRLVETALGRSCDR

SEQ ID NO: 355781 - protein, 19 aa, Mycobacterium
GGPLFDSLYVLQNFLDDDT

SEQ ID NO: 355782 - protein, 17 aa, Mycobacterium
GGPLLIAALLLAVIHDA

SEQ ID NO: 355783 - protein, 26 aa, Mycobacterium
GGPLMIIVLALLFRLFVRSRLIDAAR

SEQ ID NO: 355784 - protein, 23 aa, Mycobacterium
GGPLMIVVLAALFRLFVRSRLVD

SEQ ID NO: 355785 - protein, 17 aa, Mycobacterium
GGPLVIVARFLPGGRTA

SEQ ID NO: 355786 - protein, 18 aa, Mycobacterium
GGPLVLAALTAVGAMWCY

SEQ ID NO: 355787 - protein, 17 aa, Mycobacterium
GGPMIGWICTHANPRVA

SEQ ID NO: 355788 - protein, 24 aa, Mycobacterium
GGQAQFIPPVRTALGAGGLGPTLS

SEQ ID NO: 355789 - protein, 26 aa, Mycobacterium
GGQATAWLGYLLLYASYIVGATVGGV

SEQ ID NO: 355790 - protein, 17 aa, Mycobacterium
GGQNPFTLLAVTAARWP

SEQ ID NO: 355791 - protein, 17 aa, Mycobacterium
GGQPLSWSVPGMAFIVL

SEQ ID NO: 355792 - protein, 36 aa, Mycobacterium
GGQSRFWNRWIGWVMRRPWMSALAASLVLLVMAAPA

SEQ ID NO: 355793 - protein, 27 aa, Mycobacterium
GGQVVFQRGFQLPALPPGTATVEVNGV

SEQ ID NO: 355794 - protein, 18 aa, Mycobacterium
GGQYPYPPTGPYTNPQGG

SEQ ID NO: 355795 - protein, 30 aa, Mycobacterium
GGRALLFAGILPPAWLAGTAMLGLSKILDN

SEQ ID NO: 355796 - protein, 29 aa, Mycobacterium
GGRALLFGGIFPPFWLAGTTMLGLSKIID

SEQ ID NO: 355797 - protein, 25 aa, Mycobacterium
GGRGPLWLVLLPAAALIPVAITFLI

SEQ ID NO: 355798 - protein, 24 aa, Mycobacterium
GGRNWAMFSSAILLIPTAGTIVLL

SEQ ID NO: 355799 - protein, 23 aa, Mycobacterium
GGRPLQIAVDLVDRLLADAGSGA

SEQ ID NO: 355800 - protein, 25 aa, Mycobacterium
GGRRAWAIPLAVLGVIAIGATLLTG

SEQ ID NO: 355801 - protein, 19 aa, Mycobacterium
GGRWIRWDDARAAEAYARG

SEQ ID NO: 355802 - protein, 22 aa, Mycobacterium
GGRYRRLWAGGRRIDRVGAATT

SEQ ID NO: 355803 - protein, 26 aa, Mycobacterium
GGSALKAFWYHFAIMFEALFILTTVD

SEQ ID NO: 355804 - protein, 23 aa, Mycobacterium
GGSFAQRWVLPLSAAGFLGVALV

SEQ ID NO: 355805 - protein, 33 aa, Mycobacterium
GGSFVFRHRAGNVVILVLMLVAAAQLFVLQVTK

SEQ ID NO: 355806 - protein, 19 aa, Mycobacterium
GGSLALLIMQMRRGRQAQP

SEQ ID NO: 355807 - protein, 30 aa, Mycobacterium
GGSMIRLVVLGLIMLPIIAGVLIAAKVPEA

SEQ ID NO: 355808 - protein, 23 aa, Mycobacterium
GGSMLVLLGIMAALYERERSGQG

SEQ ID NO: 355809 - protein, 23 aa, Mycobacterium
GGSMLVLLGIVAALYERERSGAG

SEQ ID NO: 355810 - protein, 25 aa, Mycobacterium
GGSMLVLLGIVAALYERERSGKGQV

SEQ ID NO: 355811 - protein, 37 aa, Mycobacterium
GGSNFLIPNGTFFAVLIIFLIVLGVISKWVVPPISKV

SEQ ID NO: 355812 - protein, 25 aa, Mycobacterium
GGSNRLVFALFLAVALSVSAIAVIV

SEQ ID NO: 355813 - protein, 20 aa, Mycobacterium
GGSRFRALWAAGAGLVLGWA

SEQ ID NO: 355814 - protein, 24 aa, Mycobacterium
GGSRWDVLLRVVLPGSLPGVFGGL

SEQ ID NO: 355815 - protein, 29 aa, Mycobacterium
GGSTVVYEPLLNRLPPDTPMYGFERVEGS

SEQ ID NO: 355816 - protein, 23 aa, Mycobacterium
GGTLLNWRSPIAWLSRYRPGTHL

SEQ ID NO: 355817 - protein, 22 aa, Mycobacterium
GGTLREPLLVRLFGGARLDAVM

SEQ ID NO: 355818 - protein, 17 aa, Mycobacterium
GGTLYAWGSPTIIGLFV

SEQ ID NO: 355819 - protein, 27 aa, Mycobacterium
GGTMLWEHLFWFFGHPEVYIIALPFFG

SEQ ID NO: 355820 - protein, 23 aa, Mycobacterium
GGTMVLNLYRWPDDLSPAVDMGW

SEQ ID NO: 355821 - protein, 31 aa, Mycobacterium
GGTNRMRVFAMWFTTFGFFTLAACASLASLL

SEQ ID NO: 355822 - protein, 22 aa, Mycobacterium
GGTRFCFTLPVMPTNKPGVLTD

SEQ ID NO: 355823 - protein, 38 aa, Mycobacterium
GGTSNFLLPNGTFFAVLLIFLIVLGVIAKWVVPPISKV

SEQ ID NO: 355824 - protein, 25 aa, Mycobacterium
GGVAIFTGYPFLRGALRSLRSGKAG

SEQ ID NO: 355825 - protein, 30 aa, Mycobacterium
GGVASIAVPFLLFSNPLGWAAAAAGFGIGA

SEQ ID NO: 355826 - protein, 24 aa, Mycobacterium
GGVERFWMSLSQAWLAGVGVDWSA

SEQ ID NO: 355827 - protein, 23 aa, Mycobacterium
GGVFILLIIYPFLEKRFSGDYAH

SEQ ID NO: 355828 - protein, 35 aa, Mycobacterium
GGVFPLAHRVGLNQISWLVPSRWGFAASASTMDLA

SEQ ID NO: 355829 - protein, 28 aa, Mycobacterium
GGVFSRRWAKLWLPITAGIYTANGLMGE

SEQ ID NO: 355830 - protein, 24 aa, Mycobacterium
GGVGLGYKWGLSGMWLVVAIAVGL

SEQ ID NO: 355831 - protein, 26 aa, Mycobacterium
GGVGVLALAILWLLTTISVVIFFRRR

SEQ ID NO: 355832 - protein, 31 aa, Mycobacterium; identical to SEQ ID NO: 20645

SEQ ID NO: 355833 - protein, 25 aa, Mycobacterium
GGVILWQHLFWYFGHPEVYVIALPF

SEQ ID NO: 355834 - protein, 22 aa, Mycobacterium
GGVLGFLTTAWVVRARALLHDR

SEQ ID NO: 355835 - protein, 20 aa, Mycobacterium
GGVLLLAGWIAFAGTAAHDW

SEQ ID NO: 355836 - protein, 27 aa, Mycobacterium
GGVLLWQHLFWFFGHPEVYILALPFFG

SEQ ID NO: 355837 - protein, 27 aa, Mycobacterium
GGVLLWQHLFWFFGHPEVYIVALPFFG

SEQ ID NO: 355838 - protein, 26 aa, Mycobacterium
GGVLLWQHLFWFFGHPEVYVLALPFF

SEQ ID NO: 355839 - protein, 37 aa, Mycobacterium
GGVLSGAWLGLFIGLVLGFFSPNPWAALATGLVAGVF

SEQ ID NO: 355840 - protein, 32 aa, Mycobacterium
GGVLSGAWLGLFIGLVLGFFSPNPWAALVTGL

SEQ ID NO: 355841 - protein, 38 aa, Mycobacterium
GGVLSGAWLGLFIGLVLGFFSPNPWGALITGLVAGVFF

SEQ ID NO: 355842 - protein, 27 aa, Mycobacterium
GGVLVKMLLALGLWLAGWGAARLAAQL

SEQ ID NO: 355843 - protein, 21 aa, Mycobacterium
GGVLWAPMTVALGLALLTAGS

SEQ ID NO: 355844 - protein, 26 aa, Mycobacterium
GGVMLFQHLFWFFGHPEVYVIALPFF

SEQ ID NO: 355845 - protein, 27 aa, Mycobacterium
GGVMLWQHLFWFFGHPEVYIIALPFFG

SEQ ID NO: 355846 - protein, 18 aa, Mycobacterium
GGVPLWPGVPPAPTEPAP

SEQ ID NO: 355847 - protein, 23 aa, Mycobacterium
GGVRPAMYLALGPPALIITLLSF

SEQ ID NO: 355848 - protein, 25 aa, Mycobacterium
GGVSLGEFWATEGPLSYLGLAVAGF

SEQ ID NO: 355849 - protein, 26 aa, Mycobacterium
GGVTASLDWVAWRGLGFGSDAQVVID

SEQ ID NO: 355850 - protein, 32 aa, Mycobacterium
GGVTRWRWAGLTTAAFLLLVAALRPTFGDDGQ

SEQ ID NO: 355851 - protein, 33 aa, Mycobacterium
GGVTVLVVALWRFRWIRLAMISALLATLGSGLA

SEQ ID NO: 355852 - protein, 23 aa, Mycobacterium
GGVWTFIIVLAAAFFLASAGASA

SEQ ID NO: 355853 - protein, 27 aa, Mycobacterium
GGVYPWARRLWGRKWAWMTGWVYMFCL

SEQ ID NO: 355854 - protein, 27 aa, Mycobacterium
GGVYPWARRLWGRKYAWMTGWVYLVAL

SEQ ID NO: 355855 - protein, 26 aa, Mycobacterium
GGWILMTVLMVLFWAAVITAVVLAIR

SEQ ID NO: 355856 - protein, 21 aa, Mycobacterium
GGWLAPTIFGVTALVVAGAAV

SEQ ID NO: 355857 - protein, 19 aa, Mycobacterium
GGWLGYRYLSDHPTALTSL

SEQ ID NO: 355858 - protein, 31 aa, Mycobacterium
GGWLIDAFGWQWIFLINLPIGALTLILAGLV

SEQ ID NO: 355859 - protein, 32 aa, Mycobacterium
GGWLISSFGWHWIFLVNLPIGLAAFALAAITF

SEQ ID NO: 355860 - protein, 21 aa, Mycobacterium
GGWLLLVGTVFVCAGLLWSDR

SEQ ID NO: 355861 - protein, 19 aa, Mycobacterium
GGWLMPVVPPMVAAATGSL

SEQ ID NO: 355862 - protein, 26 aa, Mycobacterium
GGWLTATVLVILLGVALAVAVHVARR

SEQ ID NO: 355863 - protein, 21 aa, Mycobacterium
GGWPAVLIGYPAALSVPLAFA

SEQ ID NO: 355864 - protein, 23 aa, Mycobacterium
GGWRWHARLFLGTGFCGAFTTYS

SEQ ID NO: 355865 - protein, 21 aa, Mycobacterium
GGWWFTLFTAILGSVILLWLV

SEQ ID NO: 355866 - protein, 18 aa, Mycobacterium
GGYALLLPAAACAVFAAT

SEQ ID NO: 355867 - protein, 24 aa, Mycobacterium
GGYFFTFFTALLGSLLLLWIVGMV

SEQ ID NO: 355868 - protein, 22 aa, Mycobacterium
GGYLSWVPVILNAASSPAVVLQ

SEQ ID NO: 355869 - protein, 17 aa, Mycobacterium
GGYLWATVAGAGAWLIL

SEQ ID NO: 355870 - protein, 17 aa, Mycobacterium
GGYPSLYSWMVGLIVTE

SEQ ID NO: 355871 - protein, 18 aa, Mycobacterium
GHALWAAVLVPACILIFA

SEQ ID NO: 355872 - protein, 23 aa, Mycobacterium
GHARLIFSRFGRFWGAFSVGDLF

SEQ ID NO: 355873 - protein, 18 aa, Mycobacterium
GHDARIGRRFLNAGLGFG

SEQ ID NO: 355874 - protein, 24 aa, Mycobacterium
GHDRPEIMMFHRGGPPPMMPGMGP

SEQ ID NO: 355875 - protein, 21 aa, Mycobacterium
GHDTWWLVLGKALAIFVFLML

SEQ ID NO: 355876 - protein, 32 aa, Mycobacterium; identical to SEQ ID NO: 308906

SEQ ID NO: 355877 - protein, 22 aa, Mycobacterium
GHFYTPWSWLPRIVTQFTAGAL

SEQ ID NO: 355878 - protein, 26 aa, Mycobacterium
GHGDGMPFLSLTSLSAALTGAGAGGF

SEQ ID NO: 355879 - protein, 21 aa, Mycobacterium
GHGMSEHFGFSAAGAAMLCGW

SEQ ID NO: 355880 - protein, 30 aa, Mycobacterium
GHGPRAHQVWLPPLDRAPALASLLSDGAAE

SEQ ID NO: 355881 - protein, 21 aa, Mycobacterium
GHGRLFASYVALYCVGRFCVE

SEQ ID NO: 355882 - protein, 29 aa, Mycobacterium
GHHHTAITALAFVAILLASINVFGGFAVT

SEQ ID NO: 355883 - protein, 19 aa, Mycobacterium
GHHPSLIRPAPTTFGHTYG

SEQ ID NO: 355884 - protein, 23 aa, Mycobacterium
GHHQGVIGLLPPPETMPGVAPAD

SEQ ID NO: 355885 - protein, 27 aa, Mycobacterium
GHKVTTSPLPMKPIPQPAAQPNALEHT

SEQ ID NO: 355886 - protein, 23 aa, Mycobacterium
GHLALFGMLLRDTRWWMGGLGDI

SEQ ID NO: 355887 - protein, 28 aa, Mycobacterium
GHLELFLKLLRDGRWWLGSGVAAMGFAC

SEQ ID NO: 355888 - protein, 37 aa, Mycobacterium
GHLGDILPIPPPEPPWWLEILAWLQKFATLLEEVLTT

SEQ ID NO: 355889 - protein, 21 aa, Mycobacterium
GHLKWAWIPGVPLLWDLIVTL

SEQ ID NO: 355890 - protein, 23 aa, Mycobacterium
GHLLLMSFVLLAPQVRRLVDLFV

SEQ ID NO: 355891 - protein, 30 aa, Mycobacterium
GHLMDQVRRWPFLFAALGILVAAALARQLV

SEQ ID NO: 355892 - protein, 29 aa, Mycobacterium
GHLPLLCCLVAFILTFFVTRTFVRLIRHR

SEQ ID NO: 355893 - protein, 24 aa, Mycobacterium
GHNPWNWPPAFFSWFAAGMVLAEL

SEQ ID NO: 355894 - protein, 19 aa, Mycobacterium
GHPCYADYLPVTRAVPQPP

SEQ ID NO: 355895 - protein, 27 aa, Mycobacterium
GHPEPFLNWPYWWAGVFELVLGSLLTV

SEQ ID NO: 355896 - protein, 18 aa, Mycobacterium
GHPQPFFAPIAAAVSLST

SEQ ID NO: 355897 - protein, 22 aa, Mycobacterium
GHQGPVIALAFSPDGRRIISGS

SEQ ID NO: 355898 - protein, 24 aa, Mycobacterium
GHQLRLGKPTWVPPGPLAAEVERL

SEQ ID NO: 355899 - protein, 30 aa, Mycobacterium
GHQSSYGWLVWVFVAMFGVGLIDLVLSVVW

SEQ ID NO: 355900 - protein, 23 aa, Mycobacterium
GHRGLVWLTLLVAVALVTVRRET

SEQ ID NO: 355901 - protein, 39 aa, Mycobacterium
GHRPYLPHAIRIFAIPIILGWLVITVLVNVLVPSLEVVG

SEQ ID NO: 355902 - protein, 21 aa, Mycobacterium
GHRRDGIALALLGLAVIVAAS

SEQ ID NO: 355903 - protein, 26 aa, Mycobacterium
GHRRDGIALLLLGFSVVVAASSWFHA

SEQ ID NO: 355904 - protein, 21 aa, Mycobacterium
GHRRRVLLTDFGIARRIDDVS

SEQ ID NO: 355905 - protein, 29 aa, Mycobacterium
GHSNWLSATRWLGCLLACALAGAVLVMPL

SEQ ID NO: 355906 - protein, 23 aa, Mycobacterium
GHSPWYLAWTRLRRNKVALFNGG

SEQ ID NO: 355907 - protein, 18 aa, Mycobacterium
GHTLLPKRIALPVFASDA

SEQ ID NO: 355908 - protein, 20 aa, Mycobacterium
GHTMRLLAVLLGAAGVLLAV

SEQ ID NO: 355909 - protein, 26 aa, Mycobacterium
GHTPGVQFLALLSVAFLAASAVRLVN

SEQ ID NO: 355910 - protein, 21 aa, Mycobacterium
GHTPVWVAWDGAVRGVIVVAD

SEQ ID NO: 355911 - protein, 29 aa, Mycobacterium
GHTVPAAFWVALLMGMLFALLTTYPLIEK

SEQ ID NO: 355912 - protein, 25 aa, Mycobacterium
GHVAGWLALVWVIVETVNVLWPRTG

SEQ ID NO: 355913 - protein, 25 aa, Mycobacterium
GHVALSFPFFLWPVDGAMSAAGVRQ

SEQ ID NO: 355914 - protein, 32 aa, Mycobacterium
GHVEKLGRALILHGLWPQPPTEQFCDVPKADE

SEQ ID NO: 355915 - protein, 25 aa, Mycobacterium
GHVLGAIFLGFLMGAAIAGAILAPT

SEQ ID NO: 355916 - protein, 18 aa, Mycobacterium
GHVTLQVFFLASGLLFIL

SEQ ID NO: 355917 - protein, 25 aa, Mycobacterium
GHVTLQVFFLTSGMLFILPILSTGP

SEQ ID NO: 355918 - protein, 17 aa, Mycobacterium
GHVTLQVFFLVSGLLFI

SEQ ID NO: 355919 - protein, 18 aa, Mycobacterium
GHVVDFFSVGWWPVFNVA

SEQ ID NO: 355920 - protein, 19 aa, Mycobacterium
GHVVDFFSVGWWPVFNVAD

SEQ ID NO: 355921 - protein, 18 aa, Mycobacterium
GIAADQFALFRLSVKLPD

SEQ ID NO: 355922 - protein, 38 aa, Mycobacterium
GIAAFATLPTYRYGWWPATAITVVALILLAVTVHRRNA

SEQ ID NO: 355923 - protein, 17 aa, Mycobacterium
GIAAGIAVWVFLNGVNP

SEQ ID NO: 355924 - protein, 29 aa, Mycobacterium
GIAAIGLIFIIMLILTRAVIAAAVIVGTV

SEQ ID NO: 355925 - protein, 24 aa, Mycobacterium
GIAALPDWLPFATLFAVAAGTLLW

SEQ ID NO: 355926 - protein, 24 aa, Mycobacterium
GIAALVFFFLGWLWMHVERRRVRR

SEQ ID NO: 355927 - protein, 28 aa, Mycobacterium
GIAAMCLIFIIMLIVTRSFIAALVIVGT

SEQ ID NO: 355928 - protein, 18 aa, Mycobacterium
GIAATYLELVRDARFVIL

SEQ ID NO: 355929 - protein, 31 aa, Mycobacterium
GIAAVVVVVLVVAGFLWLRGSGEKKLTVAAT

SEQ ID NO: 355930 - protein, 27 aa, Mycobacterium
GIAAWLITRAWQMPPVLDLSVAAVAVR

SEQ ID NO: 355931 - protein, 19 aa, Mycobacterium
GIAIIWIASLSFLGLGAQP

SEQ ID NO: 355932 - protein, 18 aa, Mycobacterium
GIAILFAFAGFMGFEATA

SEQ ID NO: 355933 - protein, 28 aa, Mycobacterium
GIAITALLLLLGSPFHRARWGFADDRIL

SEQ ID NO: 355934 - protein, 24 aa, Mycobacterium
GIALAVSILLTPALIRLFTKQGLG

SEQ ID NO: 355935 - protein, 30 aa, Mycobacterium
GIALMIASTLWWTLLMRPETQMWQLMLPAA

SEQ ID NO: 355936 - protein, 23 aa, Mycobacterium
GIALPFLVWVWARDLRDRRGYRS

SEQ ID NO: 355937 - protein, 18 aa, Mycobacterium
GIALTALALLLMPVLGRA

SEQ ID NO: 355938 - protein, 17 aa, Mycobacterium
GIALVLVLAFFFAGMDP

SEQ ID NO: 355939 - protein, 19 aa, Mycobacterium
GIAMFGFFGLVIGPVLMII

SEQ ID NO: 355940 - protein, 18 aa, Mycobacterium
GIAMWFFGNLYEAIVIGP

SEQ ID NO: 355941 - protein, 20 aa, Mycobacterium
GIANGLLMLALSRLAFGAGE

SEQ ID NO: 355942 - protein, 23 aa, Mycobacterium
GIAPPPPAITGPPPPPGPGPQLA

SEQ ID NO: 355943 - protein, 27 aa, Mycobacterium
GIAPVVIAPAKLFSVPGLTGLLAQMRA

SEQ ID NO: 355944 - protein, 29 aa, Mycobacterium
GIASLCLIFIIMLILTRALIAATVIVGTV

SEQ ID NO: 355945 - protein, 17 aa, Mycobacterium
GIATFAVIRLMRSPKEI

SEQ ID NO: 355946 - protein, 18 aa, Mycobacterium
GIATPMASFLTLAGLIPT

SEQ ID NO: 355947 - protein, 24 aa, Mycobacterium
GIAVMVLQYIRVPTLLGIGRIEVT

SEQ ID NO: 355948 - protein, 34 aa, Mycobacterium
GIAVRMSLWYPDRAWWVLGIYTVAAAVALIVVGA

SEQ ID NO: 355949 - protein, 28 aa, Mycobacterium
GIAVVVVLAVLTGWLGYRAYQSYGVEQQ

SEQ ID NO: 355950 - protein, 24 aa, Mycobacterium
GIAVYLVPFVKYPPNPPAVGQADT

SEQ ID NO: 355951 - protein, 20 aa, Mycobacterium
GIAYGLYALTFFLPSIISGF

SEQ ID NO: 355952 - protein, 23 aa, Mycobacterium
GICGLILAAWFIPAVPTQARQFD

SEQ ID NO: 355953 - protein, 23 aa, Mycobacterium
GIDEELLPRLFERFVRADKSRSD

SEQ ID NO: 355954 - protein, 22 aa, Mycobacterium
GIDETIGLFLNTVPVRVDMSPT

SEQ ID NO: 355955 - protein, 25 aa, Mycobacterium
GIDGKPFRMLKFRTMVDGADAQIDH

SEQ ID NO: 355956 - protein, 25 aa, Mycobacterium
GIDGRLWQAITVLVAMTAVALAISS

SEQ ID NO: 355957 - protein, 31 aa, Mycobacterium
GIELGLRVLIYTPKPLFRAGGAIFDRVALWA

SEQ ID NO: 355958 - protein, 19 aa, Mycobacterium
GIEQMWFGDAVAAPRASLI

SEQ ID NO: 355959 - protein, 23 aa, Mycobacterium
GIEYIYLLKREVVEMRRAVAPLT

SEQ ID NO: 355960 - protein, 20 aa, Mycobacterium
GIFALVIFATGLPLAYYAAR

SEQ ID NO: 355961 - protein, 23 aa, Mycobacterium
GIFATYPFFIKLGRRLGSRLATR

SEQ ID NO: 355962 - protein, 20 aa, Mycobacterium
GIFAVVFLAVAVLLVMKMVG

SEQ ID NO: 355963 - protein, 17 aa, Mycobacterium
GIFGALFPLIVQDLTHG

SEQ ID NO: 355964 - protein, 38 aa, Mycobacterium
GIFGIAVVSMLVLVAFGYTGLPFWPQGKQYTGYFADSG

SEQ ID NO: 355965 - protein, 22 aa, Mycobacterium
GIFRTIVFLPLAISSVVMAVVW

SEQ ID NO: 355966 - protein, 17 aa, Mycobacterium
GIFVLAPKLEPIAEFLN

SEQ ID NO: 355967 - protein, 24 aa, Mycobacterium
GIGAAFGRILSAVGPALVGGLSNA

SEQ ID NO: 355968 - protein, 30 aa, Mycobacterium
GIGDPLLVVTINFLGLRHLTEALIPMMAAG

SEQ ID NO: 355969 - protein, 24 aa, Mycobacterium
GIGGLLIVVVALFLGVDPGGIMSQ

SEQ ID NO: 355970 - protein, 24 aa, Mycobacterium
GIGGLLIVVVAMFLGVDPGGVLSQ

SEQ ID NO: 355971 - protein, 25 aa, Mycobacterium
GIGGVLLALFLKFKDPNRYAELGRT

SEQ ID NO: 355972 - protein, 32 aa, Mycobacterium
GIGIQLELAIVRRVLSLLPQLPDDVFVSINIS

SEQ ID NO: 355973 - protein, 29 aa, Mycobacterium
GIGISEAVLWFIRRWLVARATMGVEADIR

SEQ ID NO: 355974 - protein, 31 aa, Mycobacterium
GIGLAILLPVIPFALEMLALRRLDAGAFGTL

SEQ ID NO: 355975 - protein, 31 aa, Mycobacterium
GIGLALVLVYSLLYYRVLGLLTALSLVASGA

SEQ ID NO: 355976 - protein, 18 aa, Mycobacterium
GIGLLFDTFVVRSLITPS

SEQ ID NO: 355977 - protein, 23 aa, Mycobacterium
GIGLVFFLGFGILALGVVLMLVQ

SEQ ID NO: 355978 - protein, 25 aa, Mycobacterium
GIGLVFYLGFGILAFGALLMGIMRW

SEQ ID NO: 355979 - protein, 18 aa, Mycobacterium
GIGPLVQLFVQWTPDRVL

SEQ ID NO: 355980 - protein, 24 aa, Mycobacterium
GIGSWIGQLLRDILSFLADPYKYF

SEQ ID NO: 355981 - protein, 25 aa, Mycobacterium
GIGVAFLILLITFGAVVAAGLPILT

SEQ ID NO: 355982 - protein, 22 aa, Mycobacterium
GIGVALVIWGSAVVAGFESVTK

SEQ ID NO: 355983 - protein, 28 aa, Mycobacterium
GIGVLVFQVLLGQQLDWAVPAMTFVLIV

SEQ ID NO: 355984 - protein, 34 aa, Mycobacterium
GIGVLVFQYLLGQQLHWSVPPLAFVVLVAVGADY

SEQ ID NO: 355985 - protein, 22 aa, Mycobacterium
GIGVWMITQPPKPSPPPKPIAE

SEQ ID NO: 355986 - protein, 18 aa, Mycobacterium
GIHLLHVLIGLLGLGAAA

SEQ ID NO: 355987 - protein, 23 aa, Mycobacterium
GIHPAILSKGGLGPALRTLARRS

SEQ ID NO: 355988 - protein, 26 aa, Mycobacterium
GIIALLVLLGVPFTGIKWGFPDDRVL

SEQ ID NO: 355989 - protein, 29 aa, Mycobacterium
GIIASNALMWTIVLALSGPAPLWVLVVLV

SEQ ID NO: 355990 - protein, 25 aa, Mycobacterium
GIIDEPIFLGRKWGVGFMWTEAVAY

SEQ ID NO: 355991 - protein, 24 aa, Mycobacterium
GIIGMLFLGFFILEGFDFGVGMLM

SEQ ID NO: 355992 - protein, 22 aa, Mycobacterium
GIIGVIFSLVAWGSFFGGVVKM

SEQ ID NO: 355993 - protein, 31 aa, Mycobacterium
GIIGVVAMVLFYIQAPTLLGIGRMTVTLELP

SEQ ID NO: 355994 - protein, 17 aa, Mycobacterium
GIIIGDLLSGGMRGGFG

SEQ ID NO: 355995 - protein, 18 aa, Mycobacterium
GIIIGPVLMILIVTTIDV

SEQ ID NO: 355996 - protein, 19 aa, Mycobacterium
GIIIGPVLMILIVTTIDVY

SEQ ID NO: 355997 - protein, 19 aa, Mycobacterium
GIILALIFRGIFIALGAVA

SEQ ID NO: 355998 - protein, 20 aa, Mycobacterium
GIILALIFRGIFIALGAVAI

SEQ ID NO: 355999 - protein, 20 aa, Mycobacterium
GIILALIMRAIFIAVGATLL

SEQ ID NO: 356000 - protein, 29 aa, Mycobacterium
GIILGAVIPVLWILVLIVIAAGSSSTSGS

SEQ ID NO: 356001 - protein, 21 aa, Mycobacterium
GIIPIPLSLFVSGLELSRSVG

SEQ ID NO: 356002 - protein, 38 aa, Mycobacterium
GIIVTLALLAWTAPLLGWVWWVYTVAAVLVVGAVLANR

SEQ ID NO: 356003 - protein, 28 aa, Mycobacterium
GIKTAISAAWRFVSPILDKFSEGWDALK

SEQ ID NO: 356004 - protein, 20 aa, Mycobacterium
GILAPILLVLCRLIQGIGIG

SEQ ID NO: 356005 - protein, 20 aa, Mycobacterium
GILCALACVGRWLPAAGLAV

SEQ ID NO: 356006 - protein, 23 aa, Mycobacterium
GILEGLRFVWNNKVLRTLAFVDL

SEQ ID NO: 356007 - protein, 27 aa, Mycobacterium
GILGMILAVFGFFGIGPIVSAFTRGAG

SEQ ID NO: 356008 - protein, 28 aa, Mycobacterium
GILIAVFGMRLVFPLAIVWVTAGLDPVH

SEQ ID NO: 356009 - protein, 24 aa, Mycobacterium
GILLSLLTGLALAAPWPAGIELNY

SEQ ID NO: 356010 - protein, 22 aa, Mycobacterium
GILPGAGLWLLVAALPGLVTVI

SEQ ID NO: 356011 - protein, 25 aa, Mycobacterium
GILVAIGTYVLLRFSLRTPLTFGAR

SEQ ID NO: 356012 - protein, 19 aa, Mycobacterium
GILVASLSYFPFVYVPAAA

SEQ ID NO: 356013 - protein, 24 aa, Mycobacterium
GILVVLLAALLIKWTYGPASDAQT

SEQ ID NO: 356014 - protein, 17 aa, Mycobacterium
GILYLALAQAMRQGYRW

SEQ ID NO: 356015 - protein, 25 aa, Mycobacterium
GIMGRTILIWLLGSGVPVVGIALLA

SEQ ID NO: 356016 - protein, 23 aa, Mycobacterium
GIMLTFYPGWVPIGFTAVLVLVV

SEQ ID NO: 356017 - protein, 32 aa, Mycobacterium
GINAATLLLLFYFLRHWMPFKRPAGDWVFENG

SEQ ID NO: 356018 - protein, 25 aa, Mycobacterium
GINLGFYMLMPYLAGYLAGPLGLAA

SEQ ID NO: 356019 - protein, 22 aa, Mycobacterium
GINTLFPLFGIANQLLAAIALT

SEQ ID NO: 356020 - protein, 20 aa, Mycobacterium
GINTLFPLFGIANQLLAAIS

SEQ ID NO: 356021 - protein, 22 aa, Mycobacterium
GINTLFPLFGIANQLLAAVALT

SEQ ID NO: 356022 - protein, 26 aa, Mycobacterium
GINVGFYMLMPYLAGYLAGPLGLAAW

SEQ ID NO: 356023 - protein, 24 aa, Mycobacterium
GINYVFYMAWDEKPWRVPVAFVIA

SEQ ID NO: 356024 - protein, 19 aa, Mycobacterium
GIPAALVPDSMAALAALKA

SEQ ID NO: 356025 - protein, 19 aa, Mycobacterium
GIPADLVRTLLGVLRQRLG

SEQ ID NO: 356026 - protein, 24 aa, Mycobacterium
GIPDWALVRAGEPAPWPQIEGDIV

SEQ ID NO: 356027 - protein, 21 aa, Mycobacterium
GIPHLITPIITSPKKAASALA

SEQ ID NO: 356028 - protein, 32 aa, Mycobacterium
GIPLAAGVLYPTLGLRLSPMIAAAAMALSSLS

SEQ ID NO: 356029 - protein, 19 aa, Mycobacterium
GIPVLLLPLILFWKGRGEQ

SEQ ID NO: 356030 - protein, 24 aa, Mycobacterium
GIQLITPVIFLVLVSVFVGIQVKA

SEQ ID NO: 356031 - protein, 23 aa, Mycobacterium
GIRDGWYSFLLPGLVLASLSMAY

SEQ ID NO: 356032 - protein, 24 aa, Mycobacterium
GIREEWLPLFDQYQVDLVLCGHEH

SEQ ID NO: 356033 - protein, 25 aa, Mycobacterium
GIRNGWWVYLTIYALFIGIHLSGVG

SEQ ID NO: 356034 - protein, 19 aa, Mycobacterium
GIRPSFPALAANLANLGRV

SEQ ID NO: 356035 - protein, 18 aa, Mycobacterium
GIRRRPRRPKPRPAPPVE

SEQ ID NO: 356036 - protein, 24 aa, Mycobacterium
GIRVRIGIHMGRSVRRGDDLFGRN

SEQ ID NO: 356037 - protein, 28 aa, Mycobacterium
GISALCLIFIIMLIITRSVVAAAVIVGT

SEQ ID NO: 356038 - protein, 20 aa, Mycobacterium
GISIPLLINAFGERWEFAAE

SEQ ID NO: 356039 - protein, 26 aa, Mycobacterium
GISKSRWLRWPARVYTDIFRGLPEVV

SEQ ID NO: 356040 - protein, 25 aa, Mycobacterium
GISLILQAFIISTLLRVAQGSATVA

SEQ ID NO: 356041 - protein, 21 aa, Mycobacterium
GISLLMLPQGFVKSLTYALIA

SEQ ID NO: 356042 - protein, 31 aa, Mycobacterium
GISMPVFWLAAILLYFLSFKLQLFPSSSYVP

SEQ ID NO: 356043 - protein, 27 aa, Mycobacterium
GISPCILPVLPVVFFSGAHGGATVATT

SEQ ID NO: 356044 - protein, 17 aa, Mycobacterium
GISPLGCWPGSSALPTV

SEQ ID NO: 356045 - protein, 22 aa, Mycobacterium
GISRADLKETWLRISPSEDPAT

SEQ ID NO: 356046 - protein, 27 aa, Mycobacterium
GISRAVWLRWPARIYTDIFRGLPEVVI

SEQ ID NO: 356047 - protein, 24 aa, Mycobacterium
GISTFIWHDLLGKDLHWAVQSMAF

SEQ ID NO: 356048 - protein, 31 aa, Mycobacterium
GITAATIGLILLLLLMVYRSPVAAAIPLISV

SEQ ID NO: 356049 - protein, 18 aa, Mycobacterium
GITAVMVAPWLTAGAAPG

SEQ ID NO: 356050 - protein, 30 aa, Mycobacterium
GITETRHWWHLPLLGHHLLVAGATGAGKGS

SEQ ID NO: 356051 - protein, 32 aa, Mycobacterium
GITFIVITIMLLFIYRSITTVLLILFMVFVEL

SEQ ID NO: 356052 - protein, 17 aa, Mycobacterium
GITVIGVPVQLIVNTQD

SEQ ID NO: 356053 - protein, 32 aa, Mycobacterium
GITVSTIFFVLFALAVLYAAWLHFAPRGSGEG

SEQ ID NO: 356054 - protein, 21 aa, Mycobacterium
GIVALLFALIYIWDRWVKGTV

SEQ ID NO: 356055 - protein, 24 aa, Mycobacterium
GIVDFGLYLLLFKAAHVQVDVAKS

SEQ ID NO: 356056 - protein, 24 aa, Mycobacterium
GIVFILSSVFFVGAFIWKHHYHCH

SEQ ID NO: 356057 - protein, 18 aa, Mycobacterium
GIVFRVQQELGVPVKLVG

SEQ ID NO: 356058 - protein, 25 aa, Mycobacterium
GIVFSLFCFLGFPVLLGGIIWAIVD

SEQ ID NO: 356059 - protein, 17 aa, Mycobacterium
GIVGALAFWLSHGVERL

SEQ ID NO: 356060 - protein, 22 aa, Mycobacterium
GIVGLIVVMYASGARQLAGGFG

SEQ ID NO: 356061 - protein, 25 aa, Mycobacterium
GIVGVVLAVLLIAGGLAWLARTHRK

SEQ ID NO: 356062 - protein, 25 aa, Mycobacterium
GIVHGWVYFIYLMFTANLAVKIRWP

SEQ ID NO: 356063 - protein, 27 aa, Mycobacterium
GIVLIVLALAFFLLRAVGTSGLVGVGA

SEQ ID NO: 356064 - protein, 21 aa, Mycobacterium
GIVLLIGLTRWYFGMSHQTTS

SEQ ID NO: 356065 - protein, 24 aa, Mycobacterium
GIVLMAIWFHFWQDDVRDLMGVVH

SEQ ID NO: 356066 - protein, 17 aa, Mycobacterium
GIVLPIAGFFFIGNGDF

SEQ ID NO: 356067 - protein, 19 aa, Mycobacterium
GIVMLLSGLTLVGAMQDAI

SEQ ID NO: 356068 - protein, 18 aa, Mycobacterium
GIVPWWFIAALLARDAAL

SEQ ID NO: 356069 - protein, 25 aa, Mycobacterium
GIVVLCYLWLDRWEPEPSRLLVLAF

SEQ ID NO: 356070 - protein, 26 aa, Mycobacterium
GIVVMAAVVFLLSGLVPLRKFRTHRR

SEQ ID NO: 356071 - protein, 18 aa, Mycobacterium
GIWLVTRPDPEPPPPAPL

SEQ ID NO: 356072 - protein, 18 aa, Mycobacterium
GIWSGLSTFMVLRLVFVG

SEQ ID NO: 356073 - protein, 18 aa, Mycobacterium
GIWTGYRLADLLAAAGVH

SEQ ID NO: 356074 - protein, 39 aa, Mycobacterium
GIYFSKRQLLARGGIALVVVLLVTSWLLAKSMGYLDRGV

SEQ ID NO: 356075 - protein, 27 aa, Mycobacterium
GIYGDFFSFYLCDVVLKLNGRGGQPVY

SEQ ID NO: 356076 - protein, 18 aa, Mycobacterium
GIYVTSPVYEAMRDVRQF

SEQ ID NO: 356077 - protein, 31 aa, Mycobacterium
GIYYGLPMWLILLLRVVFLLLAVGSLWLLYR

SEQ ID NO: 356078 - protein, 30 aa, Mycobacterium
GKAALALAALGALALLVILGKSWVFDQRKD

SEQ ID NO: 356079 - protein, 20 aa, Mycobacterium
GKALFRRPFQWREFILQCWF

SEQ ID NO: 356080 - protein, 20 aa, Mycobacterium
GKALFRRPFQWRELILQCWF

SEQ ID NO: 356081 - protein, 22 aa, Mycobacterium
GKARFIVWPPSRWGVVRSVNPQ

SEQ ID NO: 356082 - protein, 29 aa, Mycobacterium
GKASPVGLLVIVLLVVATLFLVRSMNRQL

SEQ ID NO: 356083 - protein, 23 aa, Mycobacterium
GKDLAAMLKRYGPLPPPRAVAIT

SEQ ID NO: 356084 - protein, 18 aa, Mycobacterium
GKFHFWLTFIGFHATFLV

SEQ ID NO: 356085 - protein, 33 aa, Mycobacterium
GKFVARHATKIVIGVLAVCLAAVTAVAVGLWVE

SEQ ID NO: 356086 - protein, 24 aa, Mycobacterium
GKGGLLLGLLAPHGLLELTAVFLS

SEQ ID NO: 356087 - protein, 22 aa, Mycobacterium
GKGLMRTWYLIGRKATEEPTDL

SEQ ID NO: 356088 - protein, 23 aa, Mycobacterium
GKGLTYAAIAAATLFVAAGAFAG

SEQ ID NO: 356089 - protein, 27 aa, Mycobacterium
GKHDDLLRSLYPIAPVLIRGIANSTGT

SEQ ID NO: 356090 - protein, 39 aa, Mycobacterium
GKITLFTLVAIAVMLLIVYRSIVTTLIQLVLTGVGLLAS

SEQ ID NO: 356091 - protein, 37 aa, Mycobacterium
GKIVPAVLALLVVASLALLGGLYWFSYRPDRATDAAA

SEQ ID NO: 356092 - protein, 17 aa, Mycobacterium
GKKAFVWIGLHEPDEFQ

SEQ ID NO: 356093 - protein, 21 aa, Mycobacterium
GKLISTGIWTGYRLADLLAAA

SEQ ID NO: 356094 - protein, 25 aa, Mycobacterium
GKLRPALFVVPTDSPGFTYTPIEME

SEQ ID NO: 356095 - protein, 21 aa, Mycobacterium
GKNIGQFQLIQLKLAKMEVAR

SEQ ID NO: 356096 - protein, 32 aa, Mycobacterium
GKPAAKFVLNVYPRYLPLIPENVDAQIKATTV

SEQ ID NO: 356097 - protein, 27 aa, Mycobacterium
GKPDVVLMTWFFPAWYAVFGVIICLMA

SEQ ID NO: 356098 - protein, 21 aa, Mycobacterium
GKPLISFLVGFSMLAAGVTSA

SEQ ID NO: 356099 - protein, 25 aa, Mycobacterium
GKPPSRRPPLLRYLRERAPAAASSS

SEQ ID NO: 356100 - protein, 25 aa, Mycobacterium
GKRKWYDLKPLIKGMWRKASKQVLK

SEQ ID NO: 356101 - protein, 22 aa, Mycobacterium
GKSQLLNSLLNIPVARVGDDES

SEQ ID NO: 356102 - protein, 32 aa, Mycobacterium
GKSSLLWISIVATPIVLFALRGLTYGKQRANG

SEQ ID NO: 356103 - protein, 23 aa, Mycobacterium
GKSTLAWIMAGLAVPTVGSCLLD

SEQ ID NO: 356104 - protein, 25 aa, Mycobacterium
GKSTLAWIMAGLTVPTYGACLLDGA

SEQ ID NO: 356105 - protein, 18 aa, Mycobacterium
GKTSPFTVVGIDPGTDIA

SEQ ID NO: 356106 - protein, 26 aa, Mycobacterium
GKTTLLMTLAGLLPPLHGRVLLDEID

SEQ ID NO: 356107 - protein, 23 aa, Mycobacterium
GKTTLLMTLAGLLSPLQGQVLLN

SEQ ID NO: 356108 - protein, 20 aa, Mycobacterium
GKTTLMLILAGREPTSGTVE

SEQ ID NO: 356109 - protein, 20 aa, Mycobacterium
GKTTLMLMLAGREPTSGTID

SEQ ID NO: 356110 - protein, 19 aa, Mycobacterium
GKTTLMLVLSGREPTGGTV

SEQ ID NO: 356111 - protein, 23 aa, Mycobacterium
GKTTLTLILAGRPPTSGTVQRPG

SEQ ID NO: 356112 - protein, 26 aa, Mycobacterium
GKVEDWLGYFLLYASFSLGAVAGGVI

SEQ ID NO: 356113 - protein, 29 aa, Mycobacterium
GKVGGALWAPLLAALMLALLTAGSYAELV

SEQ ID NO: 356114 - protein, 27 aa, Mycobacterium
GKVIAMWMPIMLFFYMGFEHSIVNMFL

SEQ ID NO: 356115 - protein, 24 aa, Mycobacterium
GKVLTYWLHAPLWALSLGLMVLMT

SEQ ID NO: 356116 - protein, 23 aa, Mycobacterium
GKVYAQVLLPWDLSQRLFALPDA

SEQ ID NO: 356117 - protein, 21 aa, Mycobacterium
GKWTKLVGMPTPRGSYGATFI

SEQ ID NO: 356118 - protein, 21 aa, Mycobacterium
GKYGPLYDAKTKTWGPKMVYT

SEQ ID NO: 356119 - protein, 35 aa, Mycobacterium
GLAAFIWETLIGIELHWLTLPIAFIVLVGVGCDYN

SEQ ID NO: 356120 - protein, 29 aa, Mycobacterium
GLAALIFTKYLWAFELTGALLITAALGAM

SEQ ID NO: 356121 - protein, 25 aa, Mycobacterium
GLAAVLYPALLWLSPEPRDAFGPDG

SEQ ID NO: 356122 - protein, 25 aa, Mycobacterium
GLADRHAVLPLRPEGLRRLDTVDAL

SEQ ID NO: 356123 - protein, 25 aa, Mycobacterium
GLAERHSVLPLRPESLRRLNKVDTI

SEQ ID NO: 356124 - protein, 28 aa, Mycobacterium
GLAERIFIDYLWAFELTGALLITATIGA

SEQ ID NO: 356125 - protein, 17 aa, Mycobacterium
GLAFSIGFLALLLGHSE

SEQ ID NO: 356126 - protein, 21 aa, Mycobacterium
GLAFVLNGALLPYLRKQQANS

SEQ ID NO: 356127 - protein, 26 aa, Mycobacterium
GLAGAALIEVLWWVQGRVLGEERRVW

SEQ ID NO: 356128 - protein, 32 aa, Mycobacterium
GLAGFPLFPLPWLLHVAMWLLAVTSLITVGQR

SEQ ID NO: 356129 - protein, 31 aa, Mycobacterium
GLAGLSAWLITRAWQMPPVLDLSVAVVAVRA

SEQ ID NO: 356130 - protein, 20 aa, Mycobacterium
GLAIERLISRPLPRELGGSN

SEQ ID NO: 356131 - protein, 19 aa, Mycobacterium
GLAIFRLIQGVGAAVASPT

SEQ ID NO: 356132 - protein, 20 aa, Mycobacterium
GLAIILFSGRRWVTTLGAFI

SEQ ID NO: 356133 - protein, 19 aa, Mycobacterium
GLAILLLVALVTTGVIFLT

SEQ ID NO: 356134 - protein, 23 aa, Mycobacterium
GLALAITTAWWLVAVGAVCVAGA

SEQ ID NO: 356135 - protein, 24 aa, Mycobacterium
GLALARYVPLARGPIVWWVEWLAE

SEQ ID NO: 356136 - protein, 21 aa, Mycobacterium
GLALAVLVALLLVAALVYPEK

SEQ ID NO: 356137 - protein, 17 aa, Mycobacterium
GLALAWLATVWASAGLA

SEQ ID NO: 356138 - protein, 19 aa, Mycobacterium
GLALAYWLVPVLPTQSHRF

SEQ ID NO: 356139 - protein, 32 aa, Mycobacterium
GLALCASFPPWGFWWAAFPALSVLGLVLWSPR

SEQ ID NO: 356140 - protein, 18 aa, Mycobacterium
GLALGVLVLVLTMERVAP

SEQ ID NO: 356141 - protein, 18 aa, Mycobacterium
GLALLTLDFRMTVLGASA

SEQ ID NO: 356142 - protein, 24 aa, Mycobacterium
GLALPFLLVGGFGGLIMVAIASFG

SEQ ID NO: 356143 - protein, 24 aa, Mycobacterium
GLALSAYPLWCSFATVLATHVWRL

SEQ ID NO: 356144 - protein, 31 aa, Mycobacterium
GLALSVLLGLWLLPGLPWAVLLAVACIVVPI

SEQ ID NO: 356145 - protein, 26 aa, Mycobacterium
GLALVALNFLLCIGYLFLTLTQQASS

SEQ ID NO: 356146 - protein, 18 aa, Mycobacterium
GLALVCSLVLGSAALMRR

SEQ ID NO: 356147 - protein, 24 aa, Mycobacterium
GLALVVAMLLFPADPVRILRDART

SEQ ID NO: 356148 - protein, 18 aa, Mycobacterium
GLALVWVVVVGVVGICLF

SEQ ID NO: 356149 - protein, 27 aa, Mycobacterium
GLAMVFGRLLPIILVLALAGSLASQGV

SEQ ID NO: 356150 - protein, 17 aa, Mycobacterium
GLAPRFTPMAWGVLVGF

SEQ ID NO: 356151 - protein, 27 aa, Mycobacterium
GLAPTLWGWRRKPVLRWFVLGAGIGVA

SEQ ID NO: 356152 - protein, 31 aa, Mycobacterium
GLAPTLWGWRRTPVLRWFVLGAGVGVAVAWL

SEQ ID NO: 356153 - protein, 28 aa, Mycobacterium
GLAPTLWGWRRTPVLRWFVLGAGVGVTG

SEQ ID NO: 356154 - protein, 21 aa, Mycobacterium
GLARFVWATAIIWILGGIGTW

SEQ ID NO: 356155 - protein, 27 aa, Mycobacterium
GLARSGPWLFAALAVWGMFQGGLDVAM

SEQ ID NO: 356156 - protein, 17 aa, Mycobacterium
GLASWLVLILLSARNML

SEQ ID NO: 356157 - protein, 23 aa, Mycobacterium
GLASYLLIGFWSHKPSAATAAKK

SEQ ID NO: 356158 - protein, 22 aa, Mycobacterium
GLATFSSYLPQTAAVASADPCG

SEQ ID NO: 356159 - protein, 31 aa, Mycobacterium
GLATRNYFTYRDVIGFIYAQAKFQVLGKENS

SEQ ID NO: 356160 - protein, 25 aa, Mycobacterium
GLAVGLALLAALLAGVSLVPKAKSY

SEQ ID NO: 356161 - protein, 25 aa, Mycobacterium
GLAVGMVFAYFRRLLRRWRHDVLTA

SEQ ID NO: 356162 - protein, 25 aa, Mycobacterium
GLAVLVVIVLTVAATLFVTGRQSEE

SEQ ID NO: 356163 - protein, 19 aa, Mycobacterium
GLAVPRPLSALISEAAAHT

SEQ ID NO: 356164 - protein, 23 aa, Mycobacterium
GLAYVRPWLAGALVVALLGLVGT

SEQ ID NO: 356165 - protein, 25 aa, Mycobacterium
GLAYVVIFSIPLARKAFLLDPSDVA

SEQ ID NO: 356166 - protein, 18 aa, Mycobacterium
GLCDDGMHMMIALPNVAE

SEQ ID NO: 356167 - protein, 26 aa, Mycobacterium
GLCEAGMLFIRRWLTAHATMGVEADI

SEQ ID NO: 356168 - protein, 19 aa, Mycobacterium
GLCFLWYERPRQQQRRVCR

SEQ ID NO: 356169 - protein, 20 aa, Mycobacterium
GLCGIVKRKGRGTPTVAFLS

SEQ ID NO: 356170 - protein, 19 aa, Mycobacterium
GLCIPIFLSGRRVSRMEGG

SEQ ID NO: 356171 - protein, 38 aa, Mycobacterium
GLCVDLLGWRWVFVLSAIPMAAGYALTFWLCPVSGRVA

SEQ ID NO: 356172 - protein, 25 aa, Mycobacterium
GLDADYWHRSIRQTVQFERAIRTAF

SEQ ID NO: 356173 - protein, 27 aa, Mycobacterium
GLDDLRPYFAGYLPALLSAAIVTPAAA

SEQ ID NO: 356174 - protein, 25 aa, Mycobacterium
GLDFDIRVFDDYSLGNRWLAEGDID

SEQ ID NO: 356175 - protein, 21 aa, Mycobacterium
GLDGFIWRQQSYGYGGSLTSG

SEQ ID NO: 356176 - protein, 32 aa, Mycobacterium
GLDGLRPYFTGYLPALLLAAILTPATVAVIAV

SEQ ID NO: 356177 - protein, 33 aa, Mycobacterium
GLDGLRPYFTGYLPALLLAVILTPATVAVIAAY

SEQ ID NO: 356178 - protein, 32 aa, Mycobacterium
GLDGLRPYFTGYLPTLFLAAILTPATVVMIAV

SEQ ID NO: 356179 - protein, 31 aa, Mycobacterium
GLDGLRPYLTGYLPTLLLAAILTPATVAVIA

SEQ ID NO: 356180 - protein, 18 aa, Mycobacterium
GLDGSFLRTNRALRAMLG

SEQ ID NO: 356181 - protein, 24 aa, Mycobacterium
GLDIWSALPILGSVSLIGRMLRAN

SEQ ID NO: 356182 - protein, 18 aa, Mycobacterium
GLDLLNIMRLHSPQSAIL

SEQ ID NO: 356183 - protein, 26 aa, Mycobacterium
GLDLPRNKIWIFDTTRPGELLVNATR

SEQ ID NO: 356184 - protein, 24 aa, Mycobacterium
GLDPRLLHTLSFVVALAIVVTLHV

SEQ ID NO: 356185 - protein, 26 aa, Mycobacterium
GLDQDLIRTLIFLKLSVSGHLTVFVT

SEQ ID NO: 356186 - protein, 21 aa, Mycobacterium
GLDRRGVAVLLDFGGSGTSIT

SEQ ID NO: 356187 - protein, 18 aa, Mycobacterium
GLDVMWFGDAVRTAQQTW

SEQ ID NO: 356188 - protein, 39 aa, Mycobacterium
GLDWNIRSVSWLPLFHDMGLLMIMFPALCGGHITLMSPV

SEQ ID NO: 356189 - protein, 28 aa, Mycobacterium
GLEARVEYLLPGYALPVALATTMLTSVA

SEQ ID NO: 356190 - protein, 23 aa, Mycobacterium
GLEDLFLLLVLAVLEVSLSFDNA

SEQ ID NO: 356191 - protein, 19 aa, Mycobacterium
GLENLCPRTLHLADGVLAT

SEQ ID NO: 356192 - protein, 18 aa, Mycobacterium
GLEPGRLRPLATWGPWVS

SEQ ID NO: 356193 - protein, 18 aa, Mycobacterium
GLERAAHILVVRPTFGLA

SEQ ID NO: 356194 - protein, 26 aa, Mycobacterium
GLFAQFGLWRWAFAAMAVMSGLMAVL

SEQ ID NO: 356195 - protein, 26 aa, Mycobacterium
GLFAQFGLWRWAFGAMAVLTTLMAML

SEQ ID NO: 356196 - protein, 26 aa, Mycobacterium
GLFAQFGLWRWAFGVMATMAGLMTLL

SEQ ID NO: 356197 - protein, 27 aa, Mycobacterium
GLFAQLGIWRWAFVTMAVLTVLMALLV

SEQ ID NO: 356198 - protein, 18 aa, Mycobacterium
GLFDDHLPPYRPEDSPAT

SEQ ID NO: 356199 - protein, 30 aa, Mycobacterium
GLFDTWPGLILPYITFALPLAIYTLSAFFR

SEQ ID NO: 356200 - protein, 37 aa, Mycobacterium
GLFGVGLTALLYNFGFFTLLAFTPFPLDMTAHQIGLI

SEQ ID NO: 356201 - protein, 28 aa, Mycobacterium
GLFLVGSDVDIPFIKPALEAATSLSVTT

SEQ ID NO: 356202 - protein, 20 aa, Mycobacterium
GLFNALPDEGPWRLPDIPGA

SEQ ID NO: 356203 - protein, 23 aa, Mycobacterium
GLFPGLFSGLLAFSYFVAFEVSQ

SEQ ID NO: 356204 - protein, 18 aa, Mycobacterium
GLFPLFVMFIITAITMQR

SEQ ID NO: 356205 - protein, 17 aa, Mycobacterium
GLFTLRAYLVVAVVLVV

SEQ ID NO: 356206 - protein, 17 aa, Mycobacterium
GLFVAGLPMFMLMGTGM

SEQ ID NO: 356207 - protein, 24 aa, Mycobacterium
GLFVMPLYAWSPVWTTVAWAIMWA

SEQ ID NO: 356208 - protein, 20 aa, Mycobacterium
GLGAAYRLLQRNPGLSYTIL

SEQ ID NO: 356209 - protein, 22 aa, Mycobacterium
GLGAPTLLYLAAAGVGMIGIVD

SEQ ID NO: 356210 - protein, 23 aa, Mycobacterium
GLGAVFAGGLLLVSAASPGALTQ

SEQ ID NO: 356211 - protein, 28 aa, Mycobacterium
GLGFFFAPALIVVSPWPGLTAALWVVIA

SEQ ID NO: 356212 - protein, 26 aa, Mycobacterium
GLGGDWWDAMPLPKNRTYLAVGDVVG

SEQ ID NO: 356213 - protein, 22 aa, Mycobacterium
GLGGFIAMCQCVYIGGLTGVVR

SEQ ID NO: 356214 - protein, 29 aa, Mycobacterium
GLGGGGWYFWPVWPIMGWGIGVASHAIPI

SEQ ID NO: 356215 - protein, 26 aa, Mycobacterium
GLGGLFFRHLFSHPIQYRRAGLDGRA

SEQ ID NO: 356216 - protein, 31 aa, Mycobacterium
GLGGPRTPMFLAFPIMLLASSMATSLSGRAR

SEQ ID NO: 356217 - protein, 25 aa, Mycobacterium
GLGGYFFNYLFSNPIPYARAGLDPK

SEQ ID NO: 356218 - protein, 25 aa, Mycobacterium
GLGGYFFNYLFSNPIPYARTGLDPK

SEQ ID NO: 356219 - protein, 25 aa, Mycobacterium
GLGGYFFNYLFSNPVPYARTGLDPQ

SEQ ID NO: 356220 - protein, 19 aa, Mycobacterium
GLGILFLFGTVFTLIEGPV

SEQ ID NO: 356221 - protein, 17 aa, Mycobacterium
GLGIMRYGLRSEPMHSM

SEQ ID NO: 356222 - protein, 18 aa, Mycobacterium
GLGITLWLSTSAAERSYQ

SEQ ID NO: 356223 - protein, 18 aa, Mycobacterium
GLGIWGAIALGAVGAWIA

SEQ ID NO: 356224 - protein, 23 aa, Mycobacterium
GLGIWGAVAFGAVGAWIACRLRG

SEQ ID NO: 356225 - protein, 22 aa, Mycobacterium
GLGIWLVVRPKPAPPPDPIPAE

SEQ ID NO: 356226 - protein, 18 aa, Mycobacterium
GLGLIFPPVQHLIERPFA

SEQ ID NO: 356227 - protein, 24 aa, Mycobacterium
GLGLKFVQYLAFAGVLIGASVYQI

SEQ ID NO: 356228 - protein, 19 aa, Mycobacterium
GLGLLFDTFVVRSLMTPSL

SEQ ID NO: 356229 - protein, 18 aa, Mycobacterium
GLGLLFDTLVVRAFMTPS

SEQ ID NO: 356230 - protein, 23 aa, Mycobacterium
GLGLLTAVLCALAWGLSTLLDPA

SEQ ID NO: 356231 - protein, 23 aa, Mycobacterium
GLGLSAPFLIYGAALLVAAAVVF

SEQ ID NO: 356232 - protein, 23 aa, Mycobacterium
GLGNKYFSRLPQRALERVTPKPG

SEQ ID NO: 356233 - protein, 17 aa, Mycobacterium
GLGPLRRVRPDVVVDTQ

SEQ ID NO: 356234 - protein, 17 aa, Mycobacterium
GLGPVSIGLPLSGWDLA

SEQ ID NO: 356235 - protein, 24 aa, Mycobacterium
GLGRAVLNLLDNAAKWSPPGGGVW

SEQ ID NO: 356236 - protein, 23 aa, Mycobacterium
GLGRAVLNLLDNAAKWSPPGGRV

SEQ ID NO: 356237 - protein, 27 aa, Mycobacterium
GLGSGGWYFWPVWPILGAGIGVLVHAL

SEQ ID NO: 356238 - protein, 26 aa, Mycobacterium
GLGSKIFHYGAVPFPFQPIHVTIAAW

SEQ ID NO: 356239 - protein, 26 aa, Mycobacterium
GLGSTMGILTWIFVDGHFSKWLNFTP

SEQ ID NO: 356240 - protein, 23 aa, Mycobacterium
GLGTRWVAMNALTFASKGALALR

SEQ ID NO: 356241 - protein, 25 aa, Mycobacterium
GLGVARLMRFVPRSVMVGFVNALAI

SEQ ID NO: 356242 - protein, 39 aa, Mycobacterium
GLGVIVFQLILGKELHWSLPGLSFILLVAVGADYNMLLI

SEQ ID NO: 356243 - protein, 18 aa, Mycobacterium
GLGVQGYLLALRYLANAA

SEQ ID NO: 356244 - protein, 32 aa, Mycobacterium
GLGYGLLFGLAFYVALLPWTSSFVGVGPWLAL

SEQ ID NO: 356245 - protein, 34 aa, Mycobacterium
GLHDMTYIGLPPFYPAGWFWLGGRIAAATGTPAW

SEQ ID NO: 356246 - protein, 23 aa, Mycobacterium
GLHGWQWMFLIEGLVTMLVGVLV

SEQ ID NO: 356247 - protein, 34 aa, Mycobacterium
GLHIPLWLGYAFSTLLIFPLVIYGMKVLSQLQLW

SEQ ID NO: 356248 - protein, 18 aa, Mycobacterium
GLHLFHVCLGLGALIFVL

SEQ ID NO: 356249 - protein, 26 aa, Mycobacterium
GLHLLGWLTLVFLVAPAQYSLGGKAF

SEQ ID NO: 356250 - protein, 29 aa, Mycobacterium
GLHPAILSKGLAPALRTLARRSLIPVRTE

SEQ ID NO: 356251 - protein, 26 aa, Mycobacterium
GLIFGWLTFLIVFGFFTRTVWEIVVG

SEQ ID NO: 356252 - protein, 24 aa, Mycobacterium
GLIFGWLTFLLVFGLFVRKVWDIV

SEQ ID NO: 356253 - protein, 25 aa, Mycobacterium
GLIFGWLTFLLVFGWFTRNAWQIVV

SEQ ID NO: 356254 - protein, 29 aa, Mycobacterium
GLIGGILWNLLTWLFGIPSSSSHALFGGL

SEQ ID NO: 356255 - protein, 30 aa, Mycobacterium
GLIGGLALLPLLLVLAFVPVRAGAAAGAAA

SEQ ID NO: 356256 - protein, 21 aa, Mycobacterium
GLIGMFFIGVMIGAIASRVSG

SEQ ID NO: 356257 - protein, 24 aa, Mycobacterium
GLIIGAIMYIPLLNRIRNEIVGMG

SEQ ID NO: 356258 - protein, 20 aa, Mycobacterium
GLIIGMIMFIRRYLQRVTYD

SEQ ID NO: 356259 - protein, 24 aa, Mycobacterium
GLILAGAVLLFTRPRLRIGAAGIS

SEQ ID NO: 356260 - protein, 26 aa, Mycobacterium
GLILKTFGWGVFGGLALLVGVAALGA

SEQ ID NO: 356261 - protein, 21 aa, Mycobacterium
GLILMPLGMYTFPGAIQALSI

SEQ ID NO: 356262 - protein, 26 aa, Mycobacterium
GLILTAVLLVWRRDLRSIVRLLAAQG

SEQ ID NO: 356263 - protein, 17 aa, Mycobacterium
GLIMPNGTRWVQIAVAL

SEQ ID NO: 356264 - protein, 19 aa, Mycobacterium
GLIRAFAGNLPVYDPARMP

SEQ ID NO: 356265 - protein, 20 aa, Mycobacterium
GLISFLIAGFGGLVSALTCA

SEQ ID NO: 356266 - protein, 17 aa, Mycobacterium
GLISTIVLIVFSPAVSG

SEQ ID NO: 356267 - protein, 20 aa, Mycobacterium
GLITAIMLTLTRSLVAALVI

SEQ ID NO: 356268 - protein, 22 aa, Mycobacterium
GLITAWIVVLALIYQWARVVWS

SEQ ID NO: 356269 - protein, 21 aa, Mycobacterium
GLIVDTLIVRAFMTPSIAAAL

SEQ ID NO: 356270 - protein, 24 aa, Mycobacterium
GLIVVPFLLWSIFDPKSQWQVLSS

SEQ ID NO: 356271 - protein, 26 aa, Mycobacterium
GLKGFGLVCWVVVLAGLILARVLANR

SEQ ID NO: 356272 - protein, 23 aa, Mycobacterium
GLKGFWIRRARRLLPALVVMVLA

SEQ ID NO: 356273 - protein, 30 aa, Mycobacterium
GLKKHSPSPAPWLALRLLAAGPALSRSDAL

SEQ ID NO: 356274 - protein, 17 aa, Mycobacterium
GLKLLRPIDPERDHVRG

SEQ ID NO: 356275 - protein, 25 aa, Mycobacterium
GLKMPAIFVFGFIPMFLTAFAYREL

SEQ ID NO: 356276 - protein, 21 aa, Mycobacterium
GLLAFNWNVLLPTLARDTFGG

SEQ ID NO: 356277 - protein, 18 aa, Mycobacterium
GLLALLGLGFPDQGDGLH

SEQ ID NO: 356278 - protein, 18 aa, Mycobacterium
GLLALLVGLVSWLEPVRL

SEQ ID NO: 356279 - protein, 26 aa, Mycobacterium
GLLARFPGLFVQPMGLTFSGATPSNL

SEQ ID NO: 356280 - protein, 24 aa, Mycobacterium
GLLAWARRKPWLSGVLIGLGAAAK

SEQ ID NO: 356281 - protein, 17 aa, Mycobacterium
GLLAWLGHEFPDQGDRL

SEQ ID NO: 356282 - protein, 17 aa, Mycobacterium
GLLAYLASFGPMFTVSS

SEQ ID NO: 356283 - protein, 17 aa, Mycobacterium
GLLAYRYRPRALMAATV

SEQ ID NO: 356284 - protein, 23 aa, Mycobacterium
GLLDRLKARWPWFDHVMRAQERY

SEQ ID NO: 356285 - protein, 19 aa, Mycobacterium
GLLEGLVWPIPSAWAAHTS

SEQ ID NO: 356286 - protein, 25 aa, Mycobacterium
GLLERVLANLIDNALRYAPDCVVRV

SEQ ID NO: 356287 - protein, 25 aa, Mycobacterium
GLLERVLANLIDNALRYAPNCVVRV

SEQ ID NO: 356288 - protein, 23 aa, Mycobacterium
GLLGIFAFYLAFVAELPPPPPKP

SEQ ID NO: 356289 - protein, 24 aa, Mycobacterium
GLLGMFIVVLLIVGAIRLSRPHAP

SEQ ID NO: 356290 - protein, 20 aa, Mycobacterium
GLLGMFIVVLLVIGAIRLSR

SEQ ID NO: 356291 - protein, 30 aa, Mycobacterium
GLLGVLIAVCAPTLLLAPVASADPPFRIPG

SEQ ID NO: 356292 - protein, 23 aa, Mycobacterium
GLLIGVALFILWEAIQRLRETPS

SEQ ID NO: 356293 - protein, 18 aa, Mycobacterium
GLLIVIGIELLKPAHIET

SEQ ID NO: 356294 - protein, 19 aa, Mycobacterium
GLLIVIGIELLKPAHIETA

SEQ ID NO: 356295 - protein, 17 aa, Mycobacterium
GLLIWAALVLRRRELLK

SEQ ID NO: 356296 - protein, 29 aa, Mycobacterium
GLLLAGSFVLFSFWAFDYAGPSANKLILV

SEQ ID NO: 356297 - protein, 23 aa, Mycobacterium
GLLLDTFLLRTVTVPAIAVLVGR

SEQ ID NO: 356298 - protein, 27 aa, Mycobacterium
GLLLGRHLRVLLIVLLSALTTASFVYA

SEQ ID NO: 356299 - protein, 26 aa, Mycobacterium
GLLLGWGVFLSYGLMLMGLPALAVLV

SEQ ID NO: 356300 - protein, 33 aa, Mycobacterium
GLLLGWRLPMWRAPTLILAAIWNGLHGYFHIVD

SEQ ID NO: 356301 - protein, 18 aa, Mycobacterium
GLLLLFEQPFQLGDWLDT

SEQ ID NO: 356302 - protein, 21 aa, Mycobacterium
GLLLLSGLLPNYRVLGAIPLA

SEQ ID NO: 356303 - protein, 17 aa, Mycobacterium
GLLLSPISWTHHWVWLV

SEQ ID NO: 356304 - protein, 19 aa, Mycobacterium
GLLMLLKAVAYWFDRYELL

SEQ ID NO: 356305 - protein, 29 aa, Mycobacterium
GLLMMGLHPLMFFLPIWHDANSWALRAVV

SEQ ID NO: 356306 - protein, 27 aa, Mycobacterium
GLLPAWKVVLILLLLAVLGLRDKVIFL

SEQ ID NO: 356307 - protein, 25 aa, Mycobacterium
GLLPMWEIVMILLLLAMVGLRDKVI

SEQ ID NO: 356308 - protein, 19 aa, Mycobacterium
GLLRINRYQQFFGAARITD

SEQ ID NO: 356309 - protein, 20 aa, Mycobacterium
GLLSILAVGLVTAMIFWMSR

SEQ ID NO: 356310 - protein, 19 aa, Mycobacterium
GLLSQRPEYGPLADPVRRA

SEQ ID NO: 356311 - protein, 26 aa, Mycobacterium
GLLVAPALLLAYLVSAKWPWKTTLLH

SEQ ID NO: 356312 - protein, 39 aa, Mycobacterium
GLLVDHDFHIPLIGRWDALGFLQDFFAVAVLLGIITFAI

SEQ ID NO: 356313 - protein, 22 aa, Mycobacterium
GLLVGLPLAAPLAVLSAAALLA

SEQ ID NO: 356314 - protein, 19 aa, Mycobacterium
GLLWGAVDRRRGPWAALAV

SEQ ID NO: 356315 - protein, 17 aa, Mycobacterium
GLLWRVRIFARRSPARR

SEQ ID NO: 356316 - protein, 23 aa, Mycobacterium
GLMFDRVFGALFWGKMFAVVAVW

SEQ ID NO: 356317 - protein, 20 aa, Mycobacterium
GLMLIAWLGLGRRVLAGELT

SEQ ID NO: 356318 - protein, 22 aa, Mycobacterium
GLMLYLLTFVVNAAARAALAGA

SEQ ID NO: 356319 - protein, 19 aa, Mycobacterium
GLMMLPVPAGFGMASLLAG

SEQ ID NO: 356320 - protein, 21 aa, Mycobacterium
GLMMRRFGLPVLPLIIGVILG

SEQ ID NO: 356321 - protein, 22 aa, Mycobacterium
GLMRAILCELVFFHGPDHLRLV

SEQ ID NO: 356322 - protein, 18 aa, Mycobacterium
GLMRTLVFGLIGIAAQTI

SEQ ID NO: 356323 - protein, 24 aa, Mycobacterium
GLMSRREALRRLGLLGLSTAAATA

SEQ ID NO: 356324 - protein, 26 aa, Mycobacterium
GLMVAFAVITYLSYTAAFASIDNVTV

SEQ ID NO: 356325 - protein, 19 aa, Mycobacterium
GLMVFAYITAYLVLFCTAW

SEQ ID NO: 356326 - protein, 17 aa, Mycobacterium
GLMVITVAITPLYGILR

SEQ ID NO: 356327 - protein, 38 aa, Mycobacterium
GLMVRRRKELWLRVANLFAFIAALAGFCLWFGISATMV

SEQ ID NO: 356328 - protein, 20 aa, Mycobacterium
GLNAYIPLLALGLLSRFTDL

SEQ ID NO: 356329 - protein, 21 aa, Mycobacterium
GLNCHVMVAPVLPYLTDSAEH

SEQ ID NO: 356330 - protein, 26 aa, Mycobacterium
GLNLPGWGSLRLALPMKGNGDAAFLA

SEQ ID NO: 356331 - protein, 21 aa, Mycobacterium
GLNPFAFFAFSALGTLPLAAL

SEQ ID NO: 356332 - protein, 22 aa, Mycobacterium
GLNVTFLALALPILLTGLVCTR

SEQ ID NO: 356333 - protein, 18 aa, Mycobacterium
GLPAFRFPDPNGVGFENG

SEQ ID NO: 356334 - protein, 20 aa, Mycobacterium
GLPAIMSVVLALGMRRMAGQ

SEQ ID NO: 356335 - protein, 17 aa, Mycobacterium
GLPARGIVALCDFGATG

SEQ ID NO: 356336 - protein, 24 aa, Mycobacterium
GLPCLPWFVHSYWNIAFGVLPPYW

SEQ ID NO: 356337 - protein, 18 aa, Mycobacterium
GLPEFSLPTAPSPGFPDF

SEQ ID NO: 356338 - protein, 27 aa, Mycobacterium
GLPGESSGLLPPIDQWSGSSFSNLPIG

SEQ ID NO: 356339 - protein, 26 aa, Mycobacterium
GLPGWPVWFALVWAAQEWLKSLVPFG

SEQ ID NO: 356340 - protein, 17 aa, Mycobacterium
GLPHRWARRRVVMAAVA

SEQ ID NO: 356341 - protein, 21 aa, Mycobacterium
GLPLGWTLRKIVLKSAIPGIV

SEQ ID NO: 356342 - protein, 23 aa, Mycobacterium
GLPNRFMLVGPYSWTGTSFHYIL

SEQ ID NO: 356343 - protein, 27 aa, Mycobacterium
GLPPALWTLILLGTITGLVVLTVAAFN

SEQ ID NO: 356344 - protein, 18 aa, Mycobacterium
GLPSDFVHKGGHTAYFVV

SEQ ID NO: 356345 - protein, 27 aa, Mycobacterium
GLPTAIAGLLFLLYLAGTMSSAVAGRL

SEQ ID NO: 356346 - protein, 19 aa, Mycobacterium
GLPVCWLGYALMSGPIWQY

SEQ ID NO: 356347 - protein, 17 aa, Mycobacterium
GLPVILAGFLIAIAFRV

SEQ ID NO: 356348 - protein, 21 aa, Mycobacterium
GLPVVLMAVILYISGALRSIG

SEQ ID NO: 356349 - protein, 30 aa, Mycobacterium
GLQDPPVLIPWSVLSLFAPGPTLSRADALM

SEQ ID NO: 356350 - protein, 24 aa, Mycobacterium
GLQIFADMVLAFPKGVPPPTVQKM

SEQ ID NO: 356351 - protein, 22 aa, Mycobacterium
GLQLLAYFTTVFIAAPAALITG

SEQ ID NO: 356352 - protein, 29 aa, Mycobacterium
GLQTPPLTIPWSVLSLFAAGPTLSRADAL

SEQ ID NO: 356353 - protein, 17 aa, Mycobacterium
GLRARLLRAVGPEARRV

SEQ ID NO: 356354 - protein, 36 aa, Mycobacterium
GLRARPKFVIAGLLILFIAAVALFPALFTAADPAYA

SEQ ID NO: 356355 - protein, 28 aa, Mycobacterium
GLRATMLAHWVWLCLLLAGAAGMAGCWV

SEQ ID NO: 356356 - protein, 35 aa, Mycobacterium
GLRDMTYIGLPPFYPAGWFWLGGRLAALTGTPAWE

SEQ ID NO: 356357 - protein, 25 aa, Mycobacterium
GLREFLRLVFSGTMVTWLAAALAIT

SEQ ID NO: 356358 - protein, 21 aa, Mycobacterium
GLRGPLWMTPPPAPNTAWLVS

SEQ ID NO: 356359 - protein, 31 aa, Mycobacterium
GLRGPRARLRWRWVLLGLAVLMCWLSVAVLI

SEQ ID NO: 356360 - protein, 18 aa, Mycobacterium
GLRIFILVLVLPGVGMLF

SEQ ID NO: 356361 - protein, 19 aa, Mycobacterium
GLRIPLEALLDFLTLHFAA

SEQ ID NO: 356362 - protein, 21 aa, Mycobacterium
GLRKVFGWWGGTGLSGFEATL

SEQ ID NO: 356363 - protein, 20 aa, Mycobacterium
GLRLLVVNSLVVLAGIATTS

SEQ ID NO: 356364 - protein, 28 aa, Mycobacterium
GLRNDALAAFLWMANWRFVAQKTDYFTQ

SEQ ID NO: 356365 - protein, 25 aa, Mycobacterium
GLRNTFWALVLPFMFGSPYAIFLLR

SEQ ID NO: 356366 - protein, 25 aa, Mycobacterium
GLRNTFWALVLPFVFGSPYAIFLLR

SEQ ID NO: 356367 - protein, 19 aa, Mycobacterium
GLRQLPSWVPYPILFAIVA

SEQ ID NO: 356368 - protein, 23 aa, Mycobacterium
GLRQWWKVGVAAILAVAALFGGL

SEQ ID NO: 356369 - protein, 19 aa, Mycobacterium
GLRRILPYVGRIAGALLLL

SEQ ID NO: 356370 - protein, 24 aa, Mycobacterium
GLRSATFYKLLVAAGLFAFTTLGI

SEQ ID NO: 356371 - protein, 26 aa, Mycobacterium
GLRTRRWFRRWVPVAVGIGVALAGWA

SEQ ID NO: 356372 - protein, 17 aa, Mycobacterium
GLRVLAVAQRPWEHGTG

SEQ ID NO: 356373 - protein, 19 aa, Mycobacterium
GLSAFSTLRRVELPLSLPV

SEQ ID NO: 356374 - protein, 31 aa, Mycobacterium
GLSALLCPLLVYGWLGLPRLGLAGSAVANLA

SEQ ID NO: 356375 - protein, 31 aa, Mycobacterium
GLSDDPAPAALWLWIMLTGTAAAVLVLGWRG

SEQ ID NO: 356376 - protein, 28 aa, Mycobacterium
GLSDLPFFPLPWTLHVAMWVLAVASVVT

SEQ ID NO: 356377 - protein, 19 aa, Mycobacterium
GLSEPAVPVPWSVLALFAG

SEQ ID NO: 356378 - protein, 18 aa, Mycobacterium
GLSFLERGARKPHKSTVQ

SEQ ID NO: 356379 - protein, 37 aa, Mycobacterium
GLSILVWQHLIGLHLHWLVLPLTFIILVAVGSDYNLL

SEQ ID NO: 356380 - protein, 24 aa, Mycobacterium
GLSKFFTWTGWASPAAWLNTAHQW

SEQ ID NO: 356381 - protein, 18 aa, Mycobacterium
GLSLAIINATFPPAQRGK

SEQ ID NO: 356382 - protein, 22 aa, Mycobacterium
GLSLFMAIAIAVTWMVYATLRR

SEQ ID NO: 356383 - protein, 31 aa, Mycobacterium
GLSLFMIVAITLTWLVYVTLRRDVAGEKVPY

SEQ ID NO: 356384 - protein, 32 aa, Mycobacterium
GLSLFMVVALTLTWMVYVTLRRDVAGRTVPYT

SEQ ID NO: 356385 - protein, 31 aa, Mycobacterium
GLSLFMVVAVALTWMVYVSLRREVAGKTVAY

SEQ ID NO: 356386 - protein, 19 aa, Mycobacterium
GLSLGLLLGGLAFAVTSLV

SEQ ID NO: 356387 - protein, 17 aa, Mycobacterium
GLSLIISTFFRFVARRL

SEQ ID NO: 356388 - protein, 29 aa, Mycobacterium
GLSLLGWGSFLLLWVLQACVFWRGMESIR

SEQ ID NO: 356389 - protein, 30 aa, Mycobacterium
GLSLQGATGVPWLLISGPLGPSNASDTALL

SEQ ID NO: 356390 - protein, 28 aa, Mycobacterium
GLSLRGATGVPWLLISGPLGSAAESSIT

SEQ ID NO: 356391 - protein, 24 aa, Mycobacterium
GLSLSAPFIIYAAALVIVVMLVYF

SEQ ID NO: 356392 - protein, 27 aa, Mycobacterium
GLSMLGELPWWVTVVILVREFGVTVLR

SEQ ID NO: 356393 - protein, 28 aa, Mycobacterium
GLSQLFGCTPLDPLGWGQGLLAATAASS

SEQ ID NO: 356394 - protein, 23 aa, Mycobacterium
GLSRAVLNLLDNAAKWSPSGTAV

SEQ ID NO: 356395 - protein, 22 aa, Mycobacterium
GLSRFVWATAIVWILGGFGTWL

SEQ ID NO: 356396 - protein, 25 aa, Mycobacterium
GLSVIIWQYILGKELHWMVMQMAII

SEQ ID NO: 356397 - protein, 26 aa, Mycobacterium
GLSVLIWQHLIGIELHWMVLAMSVII

SEQ ID NO: 356398 - protein, 35 aa, Mycobacterium
GLSVLVWEDILGIELYWLVLAMSVILLLAVGSDYN

SEQ ID NO: 356399 - protein, 35 aa, Mycobacterium
GLSVLVWEYLFGIKLYWVVLALAVILLLAVGSDYN

SEQ ID NO: 356400 - protein, 24 aa, Mycobacterium
GLSVLVWQHIFGLELNWIAPVFGL

SEQ ID NO: 356401 - protein, 24 aa, Mycobacterium
GLSVLVWQHILGLDLNWIAPVFGV

SEQ ID NO: 356402 - protein, 24 aa, Mycobacterium
GLSVLVWQHLLGLDLNWIAPVFGL

SEQ ID NO: 356403 - protein, 20 aa, Mycobacterium
GLSVPEFPNFLMMYGPNTNV

SEQ ID NO: 356404 - protein, 23 aa, Mycobacterium
GLTAAMFLIRDSPGYLWPGLALL

SEQ ID NO: 356405 - protein, 39 aa, Mycobacterium
GLTAEDRLFCNSPFFWIGGFAFGLLATLVAGSTLICSTA

SEQ ID NO: 356406 - protein, 18 aa, Mycobacterium
GLTAGIRELLRQLQSRHL

SEQ ID NO: 356407 - protein, 23 aa, Mycobacterium
GLTAGLALVLRYLAGGRYELGET

SEQ ID NO: 356408 - protein, 27 aa, Mycobacterium
GLTAIHPALLHTLSLALALVIVVTLHV

SEQ ID NO: 356409 - protein, 40 aa, Mycobacterium
GLTFNDFLVHLAPIVVIVLAVLMVLLPRLFPGAFSVDPDR

SEQ ID NO: 356410 - protein, 18 aa, Mycobacterium
GLTFPRYLAATRPGTRNV

SEQ ID NO: 356411 - protein, 33 aa, Mycobacterium
GLTGADWRGVRWWRRSLTVLAIPLCVICAGLSI

SEQ ID NO: 356412 - protein, 26 aa, Mycobacterium
GLTGRLDGHDVRLGRPGWLDPADLAE

SEQ ID NO: 356413 - protein, 30 aa, Mycobacterium; identical to SEQ ID NO: 23901

SEQ ID NO: 356414 - protein, 18 aa, Mycobacterium
GLTLFCLWPFTRLVHAFS

SEQ ID NO: 356415 - protein, 28 aa, Mycobacterium
GLTLGSMLLALYWRKARPDLYDRIGSTI

SEQ ID NO: 356416 - protein, 17 aa, Mycobacterium
GLTLPLAEWVNEGLMTV

SEQ ID NO: 356417 - protein, 23 aa, Mycobacterium
GLTLSVLFGLFASGVLAATAGVA

SEQ ID NO: 356418 - protein, 19 aa, Mycobacterium
GLTLTLIHLISIPISNTSV

SEQ ID NO: 356419 - protein, 25 aa, Mycobacterium
GLTLVLLLVFPLPRRGRHRKARRLP

SEQ ID NO: 356420 - protein, 24 aa, Mycobacterium
GLTMAAEHFLFASPALDGQPNPVA

SEQ ID NO: 356421 - protein, 30 aa, Mycobacterium
GLTMILFSGRRWVTALGAFILAAAPGWFGV

SEQ ID NO: 356422 - protein, 18 aa, Mycobacterium
GLTRILFAMGRDGLLPAR

SEQ ID NO: 356423 - protein, 28 aa, Mycobacterium
GLTRPQWFLLPWLLLVGVRLGLGYRRGY

SEQ ID NO: 356424 - protein, 17 aa, Mycobacterium
GLTRWYFGMSHQTTSAP

SEQ ID NO: 356425 - protein, 27 aa, Mycobacterium
GLTVVTPPWNFPVAIPAGSTLAALAAG

SEQ ID NO: 356426 - protein, 23 aa, Mycobacterium
GLTYAVFGLLIFGVGAGGPIVVS

SEQ ID NO: 356427 - protein, 23 aa, Mycobacterium
GLTYGLLRYLNPDVDLPESDPAI

SEQ ID NO: 356428 - protein, 21 aa, Mycobacterium
GLVAAIVMYDATRSALMVGLV

SEQ ID NO: 356429 - protein, 27 aa, Mycobacterium
GLVAGAVIAVWLVAVRGLLHDRTVLDR

SEQ ID NO: 356430 - protein, 25 aa, Mycobacterium
GLVALVTCWLLIGVPFGIAAVITGD

SEQ ID NO: 356431 - protein, 23 aa, Mycobacterium
GLVFGMLLAVPFGLLAAGTLPLA

SEQ ID NO: 356432 - protein, 20 aa, Mycobacterium
GLVFLVVSVLLLVGVRPALR

SEQ ID NO: 356433 - protein, 17 aa, Mycobacterium
GLVFMGFFPALQRDARF

SEQ ID NO: 356434 - protein, 18 aa, Mycobacterium
GLVFMGFFPALQRDARFT

SEQ ID NO: 356435 - protein, 17 aa, Mycobacterium
GLVFVGFIPALQRQARF

SEQ ID NO: 356436 - protein, 28 aa, Mycobacterium
GLVFVLALGLLLFLPVRVPPRHGATVSA

SEQ ID NO: 356437 - protein, 22 aa, Mycobacterium
GLVFYIGFGILLLGAVLMLVMR

SEQ ID NO: 356438 - protein, 22 aa, Mycobacterium
GLVFYLGFGILSLGAVLMVVMR

SEQ ID NO: 356439 - protein, 29 aa, Mycobacterium
GLVGGIVWNLLTWLLGIPSSSSHALIGGI

SEQ ID NO: 356440 - protein, 29 aa, Mycobacterium
GLVGGVVWNLLTWLLGIPSSSSHALIGGI

SEQ ID NO: 356441 - protein, 25 aa, Mycobacterium
GLVGLITCWMMLGVPFGIAAVVTGD

SEQ ID NO: 356442 - protein, 21 aa, Mycobacterium
GLVIGLAFAWGRRLLRRLPHD

SEQ ID NO: 356443 - protein, 25 aa, Mycobacterium
GLVITVAILAILRTAARDIFRRLMD

SEQ ID NO: 356444 - protein, 20 aa, Mycobacterium
GLVLFILTFVVNSLARAAVG

SEQ ID NO: 356445 - protein, 19 aa, Mycobacterium
GLVLFVLTFLVNSAARAVV

SEQ ID NO: 356446 - protein, 17 aa, Mycobacterium
GLVLLLVARPLSVVVSL

SEQ ID NO: 356447 - protein, 21 aa, Mycobacterium
GLVLLVLGLWLVPDTAAAPHP

SEQ ID NO: 356448 - protein, 19 aa, Mycobacterium
GLVLLVTLPIVVITGLLSY

SEQ ID NO: 356449 - protein, 31 aa, Mycobacterium
GLVLTLVVAAAYLLVGALRLTPFASSYRVTV

SEQ ID NO: 356450 - protein, 31 aa, Mycobacterium
GLVLTVGSFFWLWWTTNLLSGLLALATIAFY

SEQ ID NO: 356451 - protein, 21 aa, Mycobacterium
GLVNTPFLWAVTAGLLVVAVV

SEQ ID NO: 356452 - protein, 18 aa, Mycobacterium
GLVPSWLALASTGFDVAL

SEQ ID NO: 356453 - protein, 27 aa, Mycobacterium
GLVTGYLMCAVLLAGAIWVASTSRSPS

SEQ ID NO: 356454 - protein, 25 aa, Mycobacterium
GLVTILFSGRRWVTALGAFVLSVAP

SEQ ID NO: 356455 - protein, 29 aa, Mycobacterium
GLVTTVFGLLLLAPPIRAAARPGLTAIAV

SEQ ID NO: 356456 - protein, 23 aa, Mycobacterium
GLVVFGFVLFYPAGTFNYWQAWV

SEQ ID NO: 356457 - protein, 28 aa, Mycobacterium
GLVVHGAFILLLLLARKEFYAKVRRGAT

SEQ ID NO: 356458 - protein, 19 aa, Mycobacterium
GLVVPVVIFLSFTQGLPSS

SEQ ID NO: 356459 - protein, 18 aa, Mycobacterium
GLVVSLLVRRRRVWVRLT

SEQ ID NO: 356460 - protein, 17 aa, Mycobacterium
GLVVVLIVAIVIVVLRR

SEQ ID NO: 356461 - protein, 17 aa, Mycobacterium
GLWFRRIWILQPHGEVM

SEQ ID NO: 356462 - protein, 17 aa, Mycobacterium
GLWNVQHLLGHICWIFA

SEQ ID NO: 356463 - protein, 24 aa, Mycobacterium
GLWWSYVIVLVVYLGMTIGAVVVL

SEQ ID NO: 356464 - protein, 26 aa, Mycobacterium
GLYGDFFSFYLCDIVLKLNGKGGQPV

SEQ ID NO: 356465 - protein, 28 aa, Mycobacterium
GLYGDFFSFYLCEMLFKLNGKGGQPVYV

SEQ ID NO: 356466 - protein, 27 aa, Mycobacterium
GLYGDFFSFYMCDLLLKLNGKGGQPIY

SEQ ID NO: 356467 - protein, 17 aa, Mycobacterium
GLYGLMALLGTTAILIV

SEQ ID NO: 356468 - protein, 22 aa, Mycobacterium
GLYGMLILAIITVFVAGLMVGR

SEQ ID NO: 356469 - protein, 17 aa, Mycobacterium
GLYLPLLLILVSMIVRI

SEQ ID NO: 356470 - protein, 17 aa, Mycobacterium
GLYVAYYGYYEIRLYFT

SEQ ID NO: 356471 - protein, 24 aa, Mycobacterium
GMAVFRAVFYFAVEKDFAAGMTQA

SEQ ID NO: 356472 - protein, 21 aa, Mycobacterium
GMAVLWLSGWPTRRQSIFYIM

SEQ ID NO: 356473 - protein, 24 aa, Mycobacterium
GMDLAAFVMFSSLAGIAGAPGQGN

SEQ ID NO: 356474 - protein, 26 aa, Mycobacterium
GMDLKAFWYHFAIMFEALFILTTLDA

SEQ ID NO: 356475 - protein, 25 aa, Mycobacterium
GMDYLPPNIPGLGELWGRSVFHCPF

SEQ ID NO: 356476 - protein, 33 aa, Mycobacterium
GMFGSGILLSFWDWKSIFWALGAAGALVFVLTC

SEQ ID NO: 356477 - protein, 19 aa, Mycobacterium
GMFLVYAVCGFFVFLILRA

SEQ ID NO: 356478 - protein, 22 aa, Mycobacterium
GMFRVAAFIVVGLVLLGMGAGY

SEQ ID NO: 356479 - protein, 38 aa, Mycobacterium
GMGAASFPWPPPSQPDRPPYLGWEPFQPVDAGVFFGRD

SEQ ID NO: 356480 - protein, 24 aa, Mycobacterium
GMGFPHYLILLFGALGLATTMPIK

SEQ ID NO: 356481 - protein, 23 aa, Mycobacterium
GMGLIFDTLVIRSFMTPSIAALL

SEQ ID NO: 356482 - protein, 42 aa, Mycobacterium
GMGLPPLPDLPAAPLLPEIWSNAPPIPGWPASVPSAIAVPPQ

SEQ ID NO: 356483 - protein, 23 aa, Mycobacterium
GMGMYLPMSLILVIAIGAVIGYV

SEQ ID NO: 356484 - protein, 50 aa, Mycobacterium
GMGRHWHFFSVIGWILVGLSYYILLFATGQWHRYWPASWSIFGEAWNDIV

SEQ ID NO: 356485 - protein, 49 aa, Mycobacterium
GMGRHWHFFSVIGWILVGLSYYILLFTTGQWHRYWPYSWSIFHEAYNDI

SEQ ID NO: 356486 - protein, 18 aa, Mycobacterium
GMGTTLTAILFAGDRIGL

SEQ ID NO: 356487 - protein, 23 aa, Mycobacterium
GMGTTLTAILFAGDRIGLVHIGD

SEQ ID NO: 356488 - protein, 22 aa, Mycobacterium
GMIAAPLFIVLGVTAVFLVTRD

SEQ ID NO: 356489 - protein, 17 aa, Mycobacterium
GMIWVTDRILLDQLSWA

SEQ ID NO: 356490 - protein, 23 aa, Mycobacterium
GMLAAFGILAALFERERSGRGQY

SEQ ID NO: 356491 - protein, 19 aa, Mycobacterium
GMLGIVYAIKEGFTGLVHG

SEQ ID NO: 356492 - protein, 18 aa, Mycobacterium
GMLILAVITVFIAGLMVG

SEQ ID NO: 356493 - protein, 17 aa, Mycobacterium
GMLPALNARRHPDRAAC

SEQ ID NO: 356494 - protein, 22 aa, Mycobacterium
GMLTMMVFLPFAGRLSDRVGRK

SEQ ID NO: 356495 - protein, 30 aa, Mycobacterium
GMLVDWASWRWVFLVNIPLGVVAVLATSRA

SEQ ID NO: 356496 - protein, 17 aa, Mycobacterium
GMMSSPTGELFFDNVRL

SEQ ID NO: 356497 - protein, 17 aa, Mycobacterium
GMNAYVYFKSDTLALRA

SEQ ID NO: 356498 - protein, 39 aa, Mycobacterium
GMNFDHMPELNWTFGYPLALLVMATVCVVLYRNFRRNNW

SEQ ID NO: 356499 - protein, 32 aa, Mycobacterium
GMNFDNMPELHWAWGYPAVLCVMAVVCFVLYR

SEQ ID NO: 356500 - protein, 26 aa, Mycobacterium
GMNGKFNGVMALPLPISKINKIMTAD

SEQ ID NO: 356501 - protein, 18 aa, Mycobacterium
GMPFLLLAFGSARAVRGM

SEQ ID NO: 356502 - protein, 31 aa, Mycobacterium
GMPKASVMTHYRWLRALAGFGGLGMRLNSND

SEQ ID NO: 356503 - protein, 18 aa, Mycobacterium
GMPLLTVIGVICSAIIAA

SEQ ID NO: 356504 - protein, 33 aa, Mycobacterium
GMPRRLRWVSPFIPLVAGPLPVAFFIGVLAGEE

SEQ ID NO: 356505 - protein, 38 aa, Mycobacterium
GMRRQLKWLSPLIPLVASPLPIPFWFGILAGEEPIDHT

SEQ ID NO: 356506 - protein, 40 aa, Mycobacterium
GMRVTLAIGLLLLGGPALLHLFAETLWAVLVLAALRGLGF

SEQ ID NO: 356507 - protein, 19 aa, Mycobacterium
GMSLLPPIAVLLVLAACLG

SEQ ID NO: 356508 - protein, 35 aa, Mycobacterium
GMSTIPLLCISLSIPAFLWGIRYARARAVTYGESV

SEQ ID NO: 356509 - protein, 21 aa, Mycobacterium
GMSVMLIWGFVQIYVLGTPLR

SEQ ID NO: 356510 - protein, 23 aa, Mycobacterium
GMSWGPVVWVLLGEIFPNRIRAA

SEQ ID NO: 356511 - protein, 23 aa, Mycobacterium
GMSYSTTLWRIVIPQASRVAVPP

SEQ ID NO: 356512 - protein, 18 aa, Mycobacterium
GMSYVWWALAVIVAAGVT

SEQ ID NO: 356513 - protein, 25 aa, Mycobacterium
GMSYVWWALAVLLAAGLTVTARTAS

SEQ ID NO: 356514 - protein, 24 aa, Mycobacterium
GMTAAIAVLIIACPCALGLATPTA

SEQ ID NO: 356515 - protein, 22 aa, Mycobacterium
GMTAAVAVLIIACPCALGLATP

SEQ ID NO: 356516 - protein, 28 aa, Mycobacterium
GMTETRHWWHLPLLGHHVLVAGATGAGK

SEQ ID NO: 356517 - protein, 31 aa, Mycobacterium
GMTLALALSLYLIAGMLAWVQARLLNVTVQR

SEQ ID NO: 356518 - protein, 26 aa, Mycobacterium
GMTLSPTLIFDYPTPAALAEHLAQQL

SEQ ID NO: 356519 - protein, 25 aa, Mycobacterium
GMVGGVWLAFIGWFIFAASREEETR

SEQ ID NO: 356520 - protein, 36 aa, Mycobacterium
GMVGMHYFWIGAVPAILFLGIVMMPFFYGSQVRSVP

SEQ ID NO: 356521 - protein, 18 aa, Mycobacterium
GMVHAYYTVLLAPAVGAL

SEQ ID NO: 356522 - protein, 24 aa, Mycobacterium
GMVILPPFVYFISYRWSIGLQRSD

SEQ ID NO: 356523 - protein, 19 aa, Mycobacterium
GMVLAILGFVGFSSADALA

SEQ ID NO: 356524 - protein, 25 aa, Mycobacterium
GMVLQDTWLFAGTIYDNIAYGRPDA

SEQ ID NO: 356525 - protein, 22 aa, Mycobacterium
GMVRVNRPWRLLPSLSSAIAAG

SEQ ID NO: 356526 - protein, 17 aa, Mycobacterium
GMVTPGGWHLWCAAALS

SEQ ID NO: 356527 - protein, 26 aa, Mycobacterium
GMVVLPPFVYFLSYRWSIGLQRSDRS

SEQ ID NO: 356528 - protein, 19 aa, Mycobacterium
GMVVNPILPSLRDRDLRFI

SEQ ID NO: 356529 - protein, 23 aa, Mycobacterium
GNAAGVLALPLPIAKVNRIMTAD

SEQ ID NO: 356530 - protein, 18 aa, Mycobacterium
GNAKTFGFLILFALLMSP

SEQ ID NO: 356531 - protein, 24 aa, Mycobacterium
GNALLVWLVEVALFVVGALACGVG

SEQ ID NO: 356532 - protein, 24 aa, Mycobacterium
GNDPYVFPDNLPLVAARGGPGGAP

SEQ ID NO: 356533 - protein, 19 aa, Mycobacterium
GNEFLFQQLAMQNIELLNS

SEQ ID NO: 356534 - protein, 29 aa, Mycobacterium
GNFLGLPLNFLLFSLLVVVTASLTVPVFG

SEQ ID NO: 356535 - protein, 19 aa, Mycobacterium
GNHLPALTALDLLSTARLD

SEQ ID NO: 356536 - protein, 26 aa, Mycobacterium
GNIGDWLGYFLLLASFMVGAAVGGFI

SEQ ID NO: 356537 - protein, 31 aa, Mycobacterium
GNLAFSTIIFGWLPIVMGLTFWQAVSSSVTG

SEQ ID NO: 356538 - protein, 21 aa, Mycobacterium
GNLAWWVFVVAALVNRGLCPR

SEQ ID NO: 356539 - protein, 21 aa, Mycobacterium
GNLIAVLRDGVVIGSAVFSED

SEQ ID NO: 356540 - protein, 21 aa, Mycobacterium
GNLIAVLRNGVVIGSAVFSEG

SEQ ID NO: 356541 - protein, 20 aa, Mycobacterium
GNLIVVLRDGAVIGSAVFSE

SEQ ID NO: 356542 - protein, 32 aa, Mycobacterium
GNLNMVRLWWDKPWPMRIIALARLPLQVPMIT

SEQ ID NO: 356543 - protein, 20 aa, Mycobacterium
GNLPVQWDKVPAAVPNGGKL

SEQ ID NO: 356544 - protein, 31 aa, Mycobacterium
GNLSPLVAAGLFYLALTIPLTHLVNYIDVRL

SEQ ID NO: 356545 - protein, 19 aa, Mycobacterium
GNMFGLWLCPLGTDVDDPV

SEQ ID NO: 356546 - protein, 33 aa, Mycobacterium; identical to SEQ ID NO: 20692

SEQ ID NO: 356547 - protein, 17 aa, Mycobacterium
GNPLLLLELSRIIDDRR

SEQ ID NO: 356548 - protein, 37 aa, Mycobacterium
GNQFVMPDLVGQFWSDAYPRLTALGWTGVLDKGPDVR

SEQ ID NO: 356549 - protein, 19 aa, Mycobacterium
GNQRWRWGALMLVVSIVLQ

SEQ ID NO: 356550 - protein, 22 aa, Mycobacterium
GNRFLPIFVRQGTSYLLLADVR

SEQ ID NO: 356551 - protein, 28 aa, Mycobacterium
GNRTIFLRVILPALLPALLSGAGLAFSR

SEQ ID NO: 356552 - protein, 28 aa, Mycobacterium
GNSLDAVWTQLMPDRYTRPHLRLFSGQV

SEQ ID NO: 356553 - protein, 25 aa, Mycobacterium
GNVETIWPLSPLQEGVYLQARYATA

SEQ ID NO: 356554 - protein, 24 aa, Mycobacterium
GNVSIGGLLLAGFIIGSLGVLNDV

SEQ ID NO: 356555 - protein, 23 aa, Mycobacterium
GNYLPALIVIAVLMISVNFALSA

SEQ ID NO: 356556 - protein, 34 aa, Mycobacterium
GPAAALRIWDGGLGIWGAVALGAVGAWIACRRRG

SEQ ID NO: 356557 - protein, 19 aa, Mycobacterium
GPAATIAILLPITYTIDPV

SEQ ID NO: 356558 - protein, 28 aa, Mycobacterium
GPAATIILFLGLIMLFVVGGAISAAYMA

SEQ ID NO: 356559 - protein, 28 aa, Mycobacterium
GPAAVADYPTVLLAGSWLEQEQVTAASE

SEQ ID NO: 356560 - protein, 25 aa, Mycobacterium
GPADYAIIPPTRFKRKEHWLDAKFS

SEQ ID NO: 356561 - protein, 24 aa, Mycobacterium
GPAGQLWSFKIALAACGAALAVAA

SEQ ID NO: 356562 - protein, 22 aa, Mycobacterium
GPAGWSMRLNVIDPPRERRPWR

SEQ ID NO: 356563 - protein, 17 aa, Mycobacterium
GPALMFALAWLLVPDLP

SEQ ID NO: 356564 - protein, 28 aa, Mycobacterium
GPAMNFLIGIVVFYGVVLFWGLPDNNAP

SEQ ID NO: 356565 - protein, 32 aa, Mycobacterium
GPAMWLYGLFNVAAWLFVYFRMPDLTGRSLEE

SEQ ID NO: 356566 - protein, 17 aa, Mycobacterium
GPAPLWVLVVLVAVISV

SEQ ID NO: 356567 - protein, 25 aa, Mycobacterium
GPAPSAPPLPAFKPSAEVGANCQYP

SEQ ID NO: 356568 - protein, 24 aa, Mycobacterium
GPAPTWLLVVLIVIISVGGPGSMV

SEQ ID NO: 356569 - protein, 21 aa, Mycobacterium
GPASLPWIAIVAAAGIITLTG

SEQ ID NO: 356570 - protein, 24 aa, Mycobacterium
GPAVLFMLATLWFATMAVIAARTP

SEQ ID NO: 356571 - protein, 17 aa, Mycobacterium
GPAWLDSLTRLVGQLRG

SEQ ID NO: 356572 - protein, 37 aa, Mycobacterium
GPAWRLMGVIFATIFFLMFTPTKWIHHFGLFAAVGGA

SEQ ID NO: 356573 - protein, 35 aa, Mycobacterium
GPAWRLMGVIFATMFFLMFTPTKWVHHFGLFAAVG

SEQ ID NO: 356574 - protein, 26 aa, Mycobacterium
GPAWVVYQWRWSIAALWFTAVFLLCM

SEQ ID NO: 356575 - protein, 20 aa, Mycobacterium
GPAYLIFPIVSISPAITVLM

SEQ ID NO: 356576 - protein, 25 aa, Mycobacterium
GPDGRPTIHLPLDDPYQAPDGYPIK

SEQ ID NO: 356577 - protein, 18 aa, Mycobacterium
GPDIVPPPAPPAFGTTRG

SEQ ID NO: 356578 - protein, 25 aa, Mycobacterium
GPDKLVWTRVAGDVLDMALLIAGVA

SEQ ID NO: 356579 - protein, 19 aa, Mycobacterium
GPDLWWSARADHIVTRVRI

SEQ ID NO: 356580 - protein, 26 aa, Mycobacterium
GPDQLARRLVHLVVPAQVARVVVGDV

SEQ ID NO: 356581 - protein, 24 aa, Mycobacterium
GPDQQALWRAVGVRGTTTAAAATA

SEQ ID NO: 356582 - protein, 23 aa, Mycobacterium
GPEIPWPVYSFATLAIVAVLGYR

SEQ ID NO: 356583 - protein, 24 aa, Mycobacterium
GPELIPVLRDTGLAMVAWAIAVAA

SEQ ID NO: 356584 - protein, 25 aa, Mycobacterium
GPEPHPVLPATPWHHTRHWVAHKKV

SEQ ID NO: 356585 - protein, 40 aa, Mycobacterium
GPERTAMLLVPAYLPYVRAARPIIFLYNKCANAILRIFGV

SEQ ID NO: 356586 - protein, 26 aa, Mycobacterium
GPERTAMLLVPPYLAYVRAARPFIVF

SEQ ID NO: 356587 - protein, 27 aa, Mycobacterium
GPERTAMLLVPPYLAYVRAARPFIVFY

SEQ ID NO: 356588 - protein, 40 aa, Mycobacterium
GPESAAMLLIPPYLVYIRLARPLIAFYNWCANTALRLVKV

SEQ ID NO: 356589 - protein, 39 aa, Mycobacterium
GPETAAMLLIPPYLLYIRAARPFIAFYNWCANATLRAFG

SEQ ID NO: 356590 - protein, 24 aa, Mycobacterium
GPETRQDFRWLMASDVCKHCTHAG

SEQ ID NO: 356591 - protein, 24 aa, Mycobacterium
GPEVLNLLLIDFKGGATFLDLAQA

SEQ ID NO: 356592 - protein, 18 aa, Mycobacterium
GPEWLRIGVMGVLYVLAI

SEQ ID NO: 356593 - protein, 17 aa, Mycobacterium
GPFFGVSALMALALVVT

SEQ ID NO: 356594 - protein, 17 aa, Mycobacterium
GPFFIEFRTYRFRAHSM

SEQ ID NO: 356595 - protein, 24 aa, Mycobacterium
GPFLPIAIILYWVSNNIWTFGQQH

SEQ ID NO: 356596 - protein, 26 aa, Mycobacterium
GPFLPLAIILYWFSNNIWTFAQQHYV

SEQ ID NO: 356597 - protein, 25 aa, Mycobacterium
GPFLPLAIILYWFSNNIWTFGQQHY

SEQ ID NO: 356598 - protein, 21 aa, Mycobacterium
GPFLPLAVIMYWLANNIWTYG

SEQ ID NO: 356599 - protein, 26 aa, Mycobacterium
GPFLSYGIQWIAFGIIAPIGLGYFMY

SEQ ID NO: 356600 - protein, 27 aa, Mycobacterium
GPFLSYGIQWIAFGILAPIGLGYFAYA

SEQ ID NO: 356601 - protein, 27 aa, Mycobacterium
GPFLSYGIQWIAFGILAPIGLGYFAYS

SEQ ID NO: 356602 - protein, 24 aa, Mycobacterium
GPGGLLLDLDGLGLDLLPALLQAG

SEQ ID NO: 356603 - protein, 26 aa, Mycobacterium
GPGILPPITLPVLPGAAPAPAPTPTP

SEQ ID NO: 356604 - protein, 17 aa, Mycobacterium
GPGLILTYLVAGLAIFV

SEQ ID NO: 356605 - protein, 31 aa, Mycobacterium
GPGLSRGLIIGAVVLVLVVVGAFLGMKLYKQ

SEQ ID NO: 356606 - protein, 26 aa, Mycobacterium
GPGMNFVICLVLIYAIAVMWGLPNLH

SEQ ID NO: 356607 - protein, 22 aa, Mycobacterium
GPGPLKWIYLTMSVQMVAAMVT

SEQ ID NO: 356608 - protein, 24 aa, Mycobacterium
GPGPLKWIYMSLGVLMAATMVDMY

SEQ ID NO: 356609 - protein, 25 aa, Mycobacterium
GPGRLPGFGLVAAPLRAALAGTRRT

SEQ ID NO: 356610 - protein, 26 aa, Mycobacterium
GPGRQFRINWKWVRRGSAIAVAVMVL

SEQ ID NO: 356611 - protein, 26 aa, Mycobacterium
GPHDGPPIPPLNTLADFAGGGMLAAF

SEQ ID NO: 356612 - protein, 25 aa, Mycobacterium
GPHGPPPPPPPPPGGPPPGPPPDAT

SEQ ID NO: 356613 - protein, 21 aa, Mycobacterium
GPHVLRIWNYPLVIGVLEGTQ

SEQ ID NO: 356614 - protein, 17 aa, Mycobacterium
GPIAEFLPYAQDLGLHL

SEQ ID NO: 356615 - protein, 24 aa, Mycobacterium
GPIAIIFSLVCIGLAAFSFLIDFD

SEQ ID NO: 356616 - protein, 24 aa, Mycobacterium
GPIAQPVLFSVLWAAGIAAVCAVP

SEQ ID NO: 356617 - protein, 26 aa, Mycobacterium
GPIIAFLRMISPLSWTPIALAVFGIG

SEQ ID NO: 356618 - protein, 40 aa, Mycobacterium
GPILGGWLIGAFSWPWIFLVNLPIGLIAFTLAAIVFPKDR

SEQ ID NO: 356619 - protein, 31 aa, Mycobacterium
GPISGGWLLEHFWWGSIFMVNIPIAVITIAG

SEQ ID NO: 356620 - protein, 32 aa, Mycobacterium
GPISGGWLLEHFWWGSVFMVNIPIAALAIAGG

SEQ ID NO: 356621 - protein, 34 aa, Mycobacterium
GPIYGISLVWLFHHWQSVFWVNVPLALVAMVMIH

SEQ ID NO: 356622 - protein, 34 aa, Mycobacterium
GPLAGRYFPPMGSVLYWLRPGTIRLPPWPDRVPL

SEQ ID NO: 356623 - protein, 17 aa, Mycobacterium
GPLAWWAYHRWGRPATP

SEQ ID NO: 356624 - protein, 17 aa, Mycobacterium
GPLFEIMKVLKANGIGS

SEQ ID NO: 356625 - protein, 21 aa, Mycobacterium
GPLFLAAFALPIAMVAGWRCG

SEQ ID NO: 356626 - protein, 30 aa, Mycobacterium
GPLGLCFLPAFVCLGIVPVLAGLAAKVLDS

SEQ ID NO: 356627 - protein, 21 aa, Mycobacterium
GPLGTIFLACIVIAVTVCCLA

SEQ ID NO: 356628 - protein, 20 aa, Mycobacterium
GPLISTGIWAGYRVADLLAA

SEQ ID NO: 356629 - protein, 21 aa, Mycobacterium
GPLKWIYLTMSVQMVAAMVTT

SEQ ID NO: 356630 - protein, 33 aa, Mycobacterium
GPLLGGYFTDCLSWRWAFWINLPVSAVVICVAT

SEQ ID NO: 356631 - protein, 41 aa, Mycobacterium
GPLNNRFFPPLGSILYWLRPNTIRLPPWPRIPLTKGSARTA

SEQ ID NO: 356632 - protein, 25 aa, Mycobacterium
GPLPAQIYWRRRALAIGIAVVVVGV

SEQ ID NO: 356633 - protein, 24 aa, Mycobacterium
GPLRKLQSPSWRPGAWLATILVVA

SEQ ID NO: 356634 - protein, 19 aa, Mycobacterium
GPLTPARAVAIVRQIAAAL

SEQ ID NO: 356635 - protein, 36 aa, Mycobacterium; identical to SEQ ID NO: 20698

SEQ ID NO: 356636 - protein, 36 aa, Mycobacterium
GPLYGIFIVYLFHDWRYVFWINVPLTLIAMAMIQFS

SEQ ID NO: 356637 - protein, 33 aa, Mycobacterium
GPNEPLWLGMDAWRWMFLAMAVPAVVYGGLAFT

SEQ ID NO: 356638 - protein, 25 aa, Mycobacterium
GPNIDGCWGFPFGPVKVPEGKLWMM

SEQ ID NO: 356639 - protein, 25 aa, Mycobacterium
GPNLALLLLFVYRPLVDNIRLSFFD

SEQ ID NO: 356640 - protein, 31 aa, Mycobacterium
GPNSGKETLAPRSWRIVMTLQRDGGQLKVAK

SEQ ID NO: 356641 - protein, 26 aa, Mycobacterium
GPPAHQVWLPPLREAPPLGALLADDA

SEQ ID NO: 356642 - protein, 20 aa, Mycobacterium
GPPAPAPPPLAVPQPDNLPR

SEQ ID NO: 356643 - protein, 20 aa, Mycobacterium
GPPAPWPGYAEDFPAPPRQH

SEQ ID NO: 356644 - protein, 19 aa, Mycobacterium
GPPFWHIGGLTIGFHGVLA

SEQ ID NO: 356645 - protein, 17 aa, Mycobacterium
GPPIVALMLLGMPPLLA

SEQ ID NO: 356646 - protein, 32 aa, Mycobacterium
GPPLALSWTISLIPLFALIGVLIVAWRRTHDQ

SEQ ID NO: 356647 - protein, 20 aa, Mycobacterium
GPPPPALPYIDVDNPGPTDP

SEQ ID NO: 356648 - protein, 40 aa, Mycobacterium
GPPPPFTSWMPPDYPPQPPLLPYPKTLPPPPPPVGTGPEP

SEQ ID NO: 356649 - protein, 25 aa, Mycobacterium
GPPPQPPTVPLSALPGLMLDVATIN

SEQ ID NO: 356650 - protein, 18 aa, Mycobacterium
GPPRSKTPLYAGIAAVVV

SEQ ID NO: 356651 - protein, 27 aa, Mycobacterium
GPPSGQWQPTYPPQLLGRPLVGRPRTW

SEQ ID NO: 356652 - protein, 17 aa, Mycobacterium
GPPYFVTSLLDHPQCRP

SEQ ID NO: 356653 - protein, 20 aa, Mycobacterium
GPPYPMAPPPYGGPPPYGAH

SEQ ID NO: 356654 - protein, 25 aa, Mycobacterium
GPQCYDLPLVPFDKAPPFVVADVGA

SEQ ID NO: 356655 - protein, 28 aa, Mycobacterium
GPQGLLWMALVAVIFFLPYGLLTAELGS

SEQ ID NO: 356656 - protein, 23 aa, Mycobacterium
GPQLWPAFWTTLRLTFFSAVGAL

SEQ ID NO: 356657 - protein, 26 aa, Mycobacterium
GPQPAPWPYFSPPDHVVPPYGRPPLA

SEQ ID NO: 356658 - protein, 28 aa, Mycobacterium
GPQPLNFWGLPLWWVCVNPLMPLTAGTL

SEQ ID NO: 356659 - protein, 23 aa, Mycobacterium
GPQVWWVLHVARWAADVPGATVA

SEQ ID NO: 356660 - protein, 18 aa, Mycobacterium
GPRALLRRPLLWVGAAVA

SEQ ID NO: 356661 - protein, 24 aa, Mycobacterium
GPRAPQLWLPPLDEPIPVSAMLAR

SEQ ID NO: 356662 - protein, 26 aa, Mycobacterium
GPRDLEPFRCFYLSAPFVVPKKKEVA

SEQ ID NO: 356663 - protein, 26 aa, Mycobacterium
GPRDLEPFRCFYLSAPFVVPKTKEVA

SEQ ID NO: 356664 - protein, 26 aa, Mycobacterium
GPRDLEPFRCFYLSAPFVVPKVKEVA

SEQ ID NO: 356665 - protein, 27 aa, Mycobacterium
GPRFIDTYVDWLWFGELGYRSVFTTQI

SEQ ID NO: 356666 - protein, 30 aa, Mycobacterium
GPRLGPPPTMPPALAWWAASLQLSGLSVGQ

SEQ ID NO: 356667 - protein, 22 aa, Mycobacterium
GPRLGVRWWRFGAGVLLGLACA

SEQ ID NO: 356668 - protein, 22 aa, Mycobacterium
GPRLGVRWWRFGAGVLLGLACG

SEQ ID NO: 356669 - protein, 23 aa, Mycobacterium
GPRLGVRWWRFGAGVLLGLAFAT

SEQ ID NO: 356670 - protein, 26 aa, Mycobacterium
GPRLGVRWWRFLAGILLGLACGTKWS

SEQ ID NO: 356671 - protein, 27 aa, Mycobacterium
GPRLIDAYVDWLWFGELGYRSVFTTVL

SEQ ID NO: 356672 - protein, 24 aa, Mycobacterium
GPRPYLRGLRRSVLPTQLVSEIGP

SEQ ID NO: 356673 - protein, 17 aa, Mycobacterium
GPRRIAFGGGALCVAVA

SEQ ID NO: 356674 - protein, 28 aa, Mycobacterium
GPRRLEAFALFNVFYQAGILAGPLVGLA

SEQ ID NO: 356675 - protein, 21 aa, Mycobacterium
GPRRWGPWLRKRIASARRWLS

SEQ ID NO: 356676 - protein, 27 aa, Mycobacterium
GPRSVTVLALVPFFSTVIGTVGIDLDQ

SEQ ID NO: 356677 - protein, 22 aa, Mycobacterium
GPRTDPLPRQPLRPIDDSNGGS

SEQ ID NO: 356678 - protein, 27 aa, Mycobacterium
GPRVDVTWFSWVTMLISIAAAVVWAHA

SEQ ID NO: 356679 - protein, 22 aa, Mycobacterium
GPRVLAVSSLPYWLGDSLRAAS

SEQ ID NO: 356680 - protein, 22 aa, Mycobacterium
GPSDRQLLVCGVAVLAIVSIVT

SEQ ID NO: 356681 - protein, 28 aa, Mycobacterium
GPSEPLRPAPVVLPFTGLDGPTPVAVGP

SEQ ID NO: 356682 - protein, 19 aa, Mycobacterium
GPSFWWGFGLVFAGQFLVA

SEQ ID NO: 356683 - protein, 20 aa, Mycobacterium
GPSFWWGFGLVFAGQFLVAL

SEQ ID NO: 356684 - protein, 23 aa, Mycobacterium
GPSLVALMLLGVPALLAGTYAGI

SEQ ID NO: 356685 - protein, 32 aa, Mycobacterium
GPSMWLYALFNVAAWIFVFFRMPDLTGKSLEE

SEQ ID NO: 356686 - protein, 25 aa, Mycobacterium
GPTAPAALLPPPPSSARIPLPGGGA

SEQ ID NO: 356687 - protein, 18 aa, Mycobacterium
GPTFLRWHHTRVGYLKSW

SEQ ID NO: 356688 - protein, 59 aa, Mycobacterium
GPTGDVHWTQQINWLWVRRAAYLSAAVLVLLPIVTFAMAYFIVDIPKPGDLRTNQVSTI

SEQ ID NO: 356689 - protein, 22 aa, Mycobacterium
GPTGVLAPQVPPGNSLTPLVPE

SEQ ID NO: 356690 - protein, 24 aa, Mycobacterium
GPTIAWYQEFLRYYFLTVESNVDG

SEQ ID NO: 356691 - protein, 29 aa, Mycobacterium
GPTLLVSLVSWGLVWRALHPGVPADDELD

SEQ ID NO: 356692 - protein, 28 aa, Mycobacterium
GPTPRNVDIPGLGWYRVVSHPGDGDESL

SEQ ID NO: 356693 - protein, 28 aa, Mycobacterium
GPTSVKAWLGLGVLLLLVLFSVRLNVLF

SEQ ID NO: 356694 - protein, 22 aa, Mycobacterium
GPTWTLLYALMAIAAWLVWRTG

SEQ ID NO: 356695 - protein, 25 aa, Mycobacterium
GPTYSHLFYQWWLAKAGAVGMAAFA

SEQ ID NO: 356696 - protein, 24 aa, Mycobacterium
GPVAPPTVPTPKAPAVAIATPPAP

SEQ ID NO: 356697 - protein, 24 aa, Mycobacterium
GPVARLLSVWPLVGLGAISYGVYL

SEQ ID NO: 356698 - protein, 41 aa, Mycobacterium
GPVAVLVYLFVIEWRMALILLIPILVYLLTMMAMMYQSGPK

SEQ ID NO: 356699 - protein, 18 aa, Mycobacterium
GPVDPAGMVPACTTPPLV

SEQ ID NO: 356700 - protein, 20 aa, Mycobacterium
GPVFLILFATLMACAGDGIS

SEQ ID NO: 356701 - protein, 25 aa, Mycobacterium
GPVFYYDMPFPALGLVFERMVRRTL

SEQ ID NO: 356702 - protein, 26 aa, Mycobacterium
GPVGIWTWPIAVIGQLAVAFVLGALA

SEQ ID NO: 356703 - protein, 23 aa, Mycobacterium
GPVGTDWLIPFGGPPDPSKGRCA

SEQ ID NO: 356704 - protein, 25 aa, Mycobacterium
GPVLKDGDLIPLDRTRTPVGFDRVL

SEQ ID NO: 356705 - protein, 20 aa, Mycobacterium
GPVLLITALHRDFASTDTLA

SEQ ID NO: 356706 - protein, 21 aa, Mycobacterium
GPVLLITALHRDFASTDTLAA

SEQ ID NO: 356707 - protein, 18 aa, Mycobacterium
GPVLLTQDAARAGLPAPL

SEQ ID NO: 356708 - protein, 43 aa, Mycobacterium
GPVQPPPPPFPPPPPPPYPPAPYAFPPPPPPRPPRPGPPPDAT

SEQ ID NO: 356709 - protein, 25 aa, Mycobacterium
GPVVLFFGVWAKYKGIEVLLEAFDR

SEQ ID NO: 356710 - protein, 20 aa, Mycobacterium
GPVVVFWVLAVMAATSVLAT

SEQ ID NO: 356711 - protein, 30 aa, Mycobacterium
GPVWRLIGSTAIGLLLLTFTPTKWAIQFGI

SEQ ID NO: 356712 - protein, 20 aa, Mycobacterium
GPVWVAWRESALTRAYELET

SEQ ID NO: 356713 - protein, 33 aa, Mycobacterium
GPWLPARWRHWWWTLLWAFVPIHLVISAVVPAR

SEQ ID NO: 356714 - protein, 32 aa, Mycobacterium; identical to SEQ ID NO: 23931

SEQ ID NO: 356715 - protein, 22 aa, Mycobacterium
GPWTIILARFAPFVRTFVPVVA

SEQ ID NO: 356716 - protein, 22 aa, Mycobacterium
GPWVKWYPGVPGYLDPAWVAQA

SEQ ID NO: 356717 - protein, 19 aa, Mycobacterium
GPYPTPPPYPGYPPRPAAG

SEQ ID NO: 356718 - protein, 27 aa, Mycobacterium
GQAADWLGYFMLLASFILGATVGGTIS

SEQ ID NO: 356719 - protein, 23 aa, Mycobacterium
GQAIMTAVALLLLAAATSLTRPD

SEQ ID NO: 356720 - protein, 21 aa, Mycobacterium
GQAVGRFLPVLGRFPRSVGGE

SEQ ID NO: 356721 - protein, 21 aa, Mycobacterium
GQAVGRFLPVLGRFPRTVGGE

SEQ ID NO: 356722 - protein, 29 aa, Mycobacterium
GQELGYDPFPLWSLLWGLVETMLIEIIGV

SEQ ID NO: 356723 - protein, 24 aa, Mycobacterium
GQEVSFYIASFVAAIVLLIAGVVM

SEQ ID NO: 356724 - protein, 23 aa, Mycobacterium
GQFGSLPPGIFPGEQQPGGYRDG

SEQ ID NO: 356725 - protein, 59 aa, Mycobacterium
GQFLPALVLALIAVGAIFLLPIALVLDILTAFPILVQILAWLIALSIALAVLLSPLIAV

SEQ ID NO: 356726 - protein, 19 aa, Mycobacterium
GQFWISMDFVDGTDAATLR

SEQ ID NO: 356727 - protein, 17 aa, Mycobacterium
GQFYAWISTPAAISALN

SEQ ID NO: 356728 - protein, 23 aa, Mycobacterium
GQFYLAFLFLVAACAYVFRRPLG

SEQ ID NO: 356729 - protein, 20 aa, Mycobacterium
GQFYLAMLAVTLGLAAVLRR

SEQ ID NO: 356730 - protein, 23 aa, Mycobacterium
GQFYTPWSWLPRIVTQFIAGALA

SEQ ID NO: 356731 - protein, 31 aa, Mycobacterium
GQFYVGFLALVYLLAVLLRKPLGRHIRTVLI

SEQ ID NO: 356732 - protein, 20 aa, Mycobacterium
GQGLFIKALDRELTRRRLTV

SEQ ID NO: 356733 - protein, 25 aa, Mycobacterium
GQGLLFILVVGFLPAGLAGLGVFLK

SEQ ID NO: 356734 - protein, 23 aa, Mycobacterium
GQHSLVGQVPILAPSGEPLAIVS

SEQ ID NO: 356735 - protein, 26 aa, Mycobacterium
GQIELPPGYLPLRIPIEVNFTQRVAV

SEQ ID NO: 356736 - protein, 20 aa, Mycobacterium
GQIFLEMRLVEGTDLGSVLK

SEQ ID NO: 356737 - protein, 18 aa, Mycobacterium
GQILSFHIAIPICTMAVF

SEQ ID NO: 356738 - protein, 31 aa, Mycobacterium
GQITQKALIALVVFLILAAIYITVRYEWSMA

SEQ ID NO: 356739 - protein, 24 aa, Mycobacterium
GQKVGFTLSAPLRALTKPSLGAEK

SEQ ID NO: 356740 - protein, 38 aa, Mycobacterium
GQKYDLLMAALASLGLILLIMMFLTRSLVAALVIVGTV

SEQ ID NO: 356741 - protein, 22 aa, Mycobacterium
GQLDSYRLALLVPLALGVIGVA

SEQ ID NO: 356742 - protein, 18 aa, Mycobacterium
GQLLASIDVIPPLIVEHE

SEQ ID NO: 356743 - protein, 22 aa, Mycobacterium
GQLTVWLTWPFHAAGALAGFGV

SEQ ID NO: 356744 - protein, 24 aa, Mycobacterium
GQLVAFWLGGIFTSVALATGVLFG

SEQ ID NO: 356745 - protein, 17 aa, Mycobacterium
GQLWISMDYVEGTDAAR

SEQ ID NO: 356746 - protein, 17 aa, Mycobacterium
GQLYLDMRLIEGTHLAL

SEQ ID NO: 356747 - protein, 17 aa, Mycobacterium
GQMGAVIGGILIGNVLS

SEQ ID NO: 356748 - protein, 35 aa, Mycobacterium
GQMLAELMTLFAAGKLHRLPVKTWDVRCAPQAYQF

SEQ ID NO: 356749 - protein, 33 aa, Mycobacterium
GQMQVGSLIAFLAYFMQILMAVLMATFMLVIFP

SEQ ID NO: 356750 - protein, 23 aa, Mycobacterium
GQPGTPALPVPYPRTGQGGEPRL

SEQ ID NO: 356751 - protein, 22 aa, Mycobacterium
GQPIHALYATPQFWNADGQTAT

SEQ ID NO: 356752 - protein, 25 aa, Mycobacterium
GQPIWNTRGYILDAALRPVPDGAVG

SEQ ID NO: 356753 - protein, 29 aa, Mycobacterium
GQPPGTSFYVLLPGRPLPPATYSATEPEA

SEQ ID NO: 356754 - protein, 32 aa, Mycobacterium
GQPPPRPRRNVWLIVAAVAVVFVLLGSGLGIW

SEQ ID NO: 356755 - protein, 20 aa, Mycobacterium
GQQVWLITATPYELAATIAR

SEQ ID NO: 356756 - protein, 25 aa, Mycobacterium
GQRATLLTFVLPACTPPGPVAERLL

SEQ ID NO: 356757 - protein, 31 aa, Mycobacterium
GQRLFERVITGLLMIIAVGFTASFFVATPPS

SEQ ID NO: 356758 - protein, 24 aa, Mycobacterium
GQRLTDMLALLPKSLDAIPAPADM

SEQ ID NO: 356759 - protein, 30 aa, Mycobacterium
GQRPSLLAWLGIVVAVPALWLVAGRQSRNA

SEQ ID NO: 356760 - protein, 23 aa, Mycobacterium
GQSFTSIPMMFASPSYYGQFTDT

SEQ ID NO: 356761 - protein, 24 aa, Mycobacterium
GQSFTSVPMLFAKPSYYGQFTDSG

SEQ ID NO: 356762 - protein, 34 aa, Mycobacterium
GQSKGYFLLGIWMSLLWAVIFALSVVIRRPAVGV

SEQ ID NO: 356763 - protein, 30 aa, Mycobacterium
GQSKGYFLLGIWMSLLWAVVFALSIVVRRP

SEQ ID NO: 356764 - protein, 23 aa, Mycobacterium
GQSPAWPALYPHARQVELPTYPF

SEQ ID NO: 356765 - protein, 24 aa, Mycobacterium
GQTMQIPLYGPILWSLVLSSSGAL

SEQ ID NO: 356766 - protein, 22 aa, Mycobacterium
GQTVQLTPLLYAILREIDGERS

SEQ ID NO: 356767 - protein, 29 aa, Mycobacterium
GQTVSLSIILLALLWYAGLPLKVFLSSVV

SEQ ID NO: 356768 - protein, 21 aa, Mycobacterium
GQTWVLVFAITMMAGLVVSLL

SEQ ID NO: 356769 - protein, 21 aa, Mycobacterium
GQTWVLVFAITMMGGLVVSLL

SEQ ID NO: 356770 - protein, 27 aa, Mycobacterium
GQVFDGALLIVIFATSGALEAVATKRT

SEQ ID NO: 356771 - protein, 22 aa, Mycobacterium
GQVFPIDLGPQPAWRNLRFPLT

SEQ ID NO: 356772 - protein, 19 aa, Mycobacterium
GQVGLTYRAGLEQLLVLLP

SEQ ID NO: 356773 - protein, 19 aa, Mycobacterium
GQVGRLWKLTAALTTDDRT

SEQ ID NO: 356774 - protein, 25 aa, Mycobacterium
GQVLRSVAVFDLMTRTWAGLPDMET

SEQ ID NO: 356775 - protein, 22 aa, Mycobacterium
GQVPPPSPPGPAPPPIAAVQYD

SEQ ID NO: 356776 - protein, 18 aa, Mycobacterium
GQVVLPFTGLDNPQRVAV

SEQ ID NO: 356777 - protein, 27 aa, Mycobacterium
GQWNPPLWGWMVALSSMPILLAVDALD

SEQ ID NO: 356778 - protein, 31 aa, Mycobacterium
GQWVPIYGLTSILLGGLPLLALAAGLAVVAY

SEQ ID NO: 356779 - protein, 30 aa, Mycobacterium
GQYTFTTFGWFRFYLAAVPLVVIVAMVCWA

SEQ ID NO: 356780 - protein, 32 aa, Mycobacterium
GRAAAARWVVPLTLLLTLAAALFPALRCSPAL

SEQ ID NO: 356781 - protein, 19 aa, Mycobacterium
GRAALPRPNSTGAWLMVQF

SEQ ID NO: 356782 - protein, 30 aa, Mycobacterium
GRADVYALGCTLFRMLTGQPPFGSGNSLPA

SEQ ID NO: 356783 - protein, 20 aa, Mycobacterium
GRAGLWTWITDTGVIGGLLI

SEQ ID NO: 356784 - protein, 25 aa, Mycobacterium
GRAGRLRLALNTPYLLLVLAFVVYD

SEQ ID NO: 356785 - protein, 23 aa, Mycobacterium
GRANWWRPSGWESAIRWPLRRRR

SEQ ID NO: 356786 - protein, 25 aa, Mycobacterium
GRAQQPINLLLLAGAVAAAVVVGIH

SEQ ID NO: 356787 - protein, 24 aa, Mycobacterium
GRAQQPVNLLLLVAAVAAAVVVGV

SEQ ID NO: 356788 - protein, 25 aa, Mycobacterium
GRATRLPRLPVTIAAGITFFDYQPW

SEQ ID NO: 356789 - protein, 19 aa, Mycobacterium
GRAVPWRPKLLPVEDRRSI

SEQ ID NO: 356790 - protein, 30 aa, Mycobacterium
GRAVSFLAPWLFFMFIDIFGTDRAGMGGLC

SEQ ID NO: 356791 - protein, 24 aa, Mycobacterium
GRAVTFIPWPVIEGFTLGIAAIIF

SEQ ID NO: 356792 - protein, 26 aa, Mycobacterium
GRAVTFIPWPVIEGFTLGIAAIIFLQ

SEQ ID NO: 356793 - protein, 20 aa, Mycobacterium
GRDDRVDRLLRLPLPEPYVP

SEQ ID NO: 356794 - protein, 24 aa, Mycobacterium
GRDPISGAVLWTYARDADLCGVTS

SEQ ID NO: 356795 - protein, 26 aa, Mycobacterium
GRDRWLNLMWLIPIGFALLVLAVAVG

SEQ ID NO: 356796 - protein, 20 aa, Mycobacterium
GRDVVNVLLLTSLFACVLSF

SEQ ID NO: 356797 - protein, 21 aa, Mycobacterium
GREALLRVLSGLTKRHRTALV

SEQ ID NO: 356798 - protein, 27 aa, Mycobacterium
GREHISLRPLWGIDQRLKRFGAMAAAM

SEQ ID NO: 356799 - protein, 24 aa, Mycobacterium
GRFEPWHFAILVGVIVVALAITPW

SEQ ID NO: 356800 - protein, 17 aa, Mycobacterium
GRFGWSVALLGAVALIA

SEQ ID NO: 356801 - protein, 18 aa, Mycobacterium
GRFNLFATTGFLAPEFRA

SEQ ID NO: 356802 - protein, 21 aa, Mycobacterium
GRFRLGVGLGWNAVEYEALGE

SEQ ID NO: 356803 - protein, 34 aa, Mycobacterium
GRFSKQWLMVHRTIFRLAFPGGKPRRKPGPYRSP

SEQ ID NO: 356804 - protein, 30 aa, Mycobacterium
GRFVQTLGSRKLWIWLRGQGHDVARCTVER

SEQ ID NO: 356805 - protein, 27 aa, Mycobacterium
GRGAPAHRVWLPPLTSAPRLADLLHGT

SEQ ID NO: 356806 - protein, 22 aa, Mycobacterium
GRGAQLGIFLKGYQSLEATRSV

SEQ ID NO: 356807 - protein, 23 aa, Mycobacterium
GRGFIFASFAIRAGLAVLARKPM

SEQ ID NO: 356808 - protein, 31 aa, Mycobacterium
GRGGLQFMLIIWLQGIWLPLHGYSFESTPLW

SEQ ID NO: 356809 - protein, 33 aa, Mycobacterium
GRGGLQFMLIIWLQGIWLPLRGYSYESTPLWAG

SEQ ID NO: 356810 - protein, 26 aa, Mycobacterium
GRGGNSGAFALFAQAGNGGAGANGGN

SEQ ID NO: 356811 - protein, 26 aa, Mycobacterium
GRGHRRSRKALAAAGALVIICASLSA

SEQ ID NO: 356812 - protein, 25 aa, Mycobacterium
GRGNWLPMFVLLIVLTVVTAAYAFR

SEQ ID NO: 356813 - protein, 24 aa, Mycobacterium
GRGPAVMFFPAMMAMSVLATLAYS

SEQ ID NO: 356814 - protein, 21 aa, Mycobacterium
GRGRAADAPLLIGAIKSNLGH

SEQ ID NO: 356815 - protein, 42 aa, Mycobacterium
GRGRPSWRVLLVGLAVIVAWLLIVMLLSRLLAPHGIGPAPSP

SEQ ID NO: 356816 - protein, 20 aa, Mycobacterium
GRGRWLAFGVSISVAAAMFY

SEQ ID NO: 356817 - protein, 27 aa, Mycobacterium
GRGTPTLALLFVAVALRFVTTTLGEGL

SEQ ID NO: 356818 - protein, 36 aa, Mycobacterium
GRGTPTVAFLSLIAGVLWGAGWVAVLAVLTRLRQLF

SEQ ID NO: 356819 - protein, 18 aa, Mycobacterium
GRGTPTVFAAAIVAGALF

SEQ ID NO: 356820 - protein, 23 aa, Mycobacterium
GRGWAWLSAFTLFASAIGALLTE

SEQ ID NO: 356821 - protein, 31 aa, Mycobacterium
GRHDWPFADRVFAAALPWLAGALGTPGISRT

SEQ ID NO: 356822 - protein, 25 aa, Mycobacterium
GRHEGRYFVGGQPTDLIRDGGVEAL

SEQ ID NO: 356823 - protein, 23 aa, Mycobacterium
GRHLRTVFIVLLAALTIASFVYA

SEQ ID NO: 356824 - protein, 26 aa, Mycobacterium
GRHRVHVHVPYWLPSQIGPADTLVDV

SEQ ID NO: 356825 - protein, 38 aa, Mycobacterium
GRHWHFFSVIGWILVGLTYYILLFATGQWHRYWPYSWS

SEQ ID NO: 356826 - protein, 27 aa, Mycobacterium
GRIAASHILPWIGLSYDSLLAKRYRRL

SEQ ID NO: 356827 - protein, 23 aa, Mycobacterium
GRIARPVPRPPRIAKPGPRIAGP

SEQ ID NO: 356828 - protein, 19 aa, Mycobacterium
GRIFGVLMYVPFGVLWVLT

SEQ ID NO: 356829 - protein, 35 aa, Mycobacterium
GRIIGVEALLRWPHPRLGLLYPGAFMSLVRQHGLM

SEQ ID NO: 356830 - protein, 29 aa, Mycobacterium
GRIINISSVLGFLPAPYAALYAASKHAVE

SEQ ID NO: 356831 - protein, 30 aa, Mycobacterium
GRIKRQQLFLSSLLRSLISEDTLFNLNKLN

SEQ ID NO: 356832 - protein, 27 aa, Mycobacterium
GRIKRQQLFLSSLLRSLISEDTLMNLN

SEQ ID NO: 356833 - protein, 19 aa, Mycobacterium
GRILLGLQQRRLQPVAVDF

SEQ ID NO: 356834 - protein, 19 aa, Mycobacterium
GRINGFARWVVRTPWPVFS

SEQ ID NO: 356835 - protein, 26 aa, Mycobacterium
GRIPDKRWFGWFALLTIPTPFLANIS

SEQ ID NO: 356836 - protein, 24 aa, Mycobacterium
GRISAFVRWVARTPWPVFTLGMLQ

SEQ ID NO: 356837 - protein, 30 aa, Mycobacterium
GRISAFVRWVVRTPWPLFSLSMLQADIIGA

SEQ ID NO: 356838 - protein, 18 aa, Mycobacterium
GRITAIEHPLWSSFVWRN

SEQ ID NO: 356839 - protein, 31 aa, Mycobacterium
GRKKFLPPFVSWFAAMLFAVVPLRNILPGNP

SEQ ID NO: 356840 - protein, 25 aa, Mycobacterium
GRKKSVVLLLVAYAAFALLGALAVS

SEQ ID NO: 356841 - protein, 22 aa, Mycobacterium
GRKLFWPFIPAVGDQPLTDSGV

SEQ ID NO: 356842 - protein, 24 aa, Mycobacterium
GRKPLLLWTFAVMSAAFIAMAVVP

SEQ ID NO: 356843 - protein, 22 aa, Mycobacterium
GRKPMIALAYLGSAAVAVILTV

SEQ ID NO: 356844 - protein, 23 aa, Mycobacterium
GRKRRKWLAGKRMAVTVAVAAAL

SEQ ID NO: 356845 - protein, 17 aa, Mycobacterium
GRKTVIDTLVLATGFDL

SEQ ID NO: 356846 - protein, 19 aa, Mycobacterium
GRLAWLFVGPVVAFPSFGY

SEQ ID NO: 356847 - protein, 23 aa, Mycobacterium
GRLFGTTAMWLAVLFAVGMNVYV

SEQ ID NO: 356848 - protein, 17 aa, Mycobacterium
GRLFTRFCTVVAAGMLT

SEQ ID NO: 356849 - protein, 21 aa, Mycobacterium
GRLLLVVHHLAVDGVSWRILL

SEQ ID NO: 356850 - protein, 25 aa, Mycobacterium
GRLMFDWRFDLIFGTAAIVFAIAYV

SEQ ID NO: 356851 - protein, 21 aa, Mycobacterium
GRLMVLAAILLFALCLRSAVT

SEQ ID NO: 356852 - protein, 18 aa, Mycobacterium
GRLNWWAPGPLARWHQRW

SEQ ID NO: 356853 - protein, 24 aa, Mycobacterium
GRLPLPNRLLATRPLVELGAMAYS

SEQ ID NO: 356854 - protein, 21 aa, Mycobacterium
GRLRLGVGLGWNAVEYEALGE

SEQ ID NO: 356855 - protein, 24 aa, Mycobacterium
GRLRYPARLGYWPAAAGLFAFVWL

SEQ ID NO: 356856 - protein, 18 aa, Mycobacterium
GRLTLYLFSTVVGSVICT

SEQ ID NO: 356857 - protein, 21 aa, Mycobacterium
GRLVVFTRWDLGTDPLDVLDA

SEQ ID NO: 356858 - protein, 19 aa, Mycobacterium
GRLWPLIIAHTLIDAVAFV

SEQ ID NO: 356859 - protein, 25 aa, Mycobacterium
GRMAVAWLVTLPAAGIVGALAFWLS

SEQ ID NO: 356860 - protein, 25 aa, Mycobacterium
GRMAVAWLVTLPLAGVVGAVTYWIV

SEQ ID NO: 356861 - protein, 26 aa, Mycobacterium
GRMGVAWLVTLPLAGLVGAFTYEIVH

SEQ ID NO: 356862 - protein, 18 aa, Mycobacterium
GRMLVVLILTLVFGFALA

SEQ ID NO: 356863 - protein, 25 aa, Mycobacterium
GRNRTARHIAPHMVLAYGAARADLD

SEQ ID NO: 356864 - protein, 20 aa, Mycobacterium
GRPAPLLRVRNKFFAHADQL

SEQ ID NO: 356865 - protein, 25 aa, Mycobacterium
GRPCASWMMPYTISAMRAAISTPHP

SEQ ID NO: 356866 - protein, 19 aa, Mycobacterium
GRPLEHATIPYLFTMQGST

SEQ ID NO: 356867 - protein, 26 aa, Mycobacterium
GRPTTWLQVSAYRFLVRRLECALLRG

SEQ ID NO: 356868 - protein, 25 aa, Mycobacterium
GRPVVYAFGLVFFAVGYLGLGITTD

SEQ ID NO: 356869 - protein, 22 aa, Mycobacterium
GRQFLNAGLGFGGGCLPKDIRA

SEQ ID NO: 356870 - protein, 23 aa, Mycobacterium
GRQFLNAGLGFGGGCLPKDIRAF

SEQ ID NO: 356871 - protein, 31 aa, Mycobacterium
GRQLSPYMLMMPLMMIVMMVGSLAGGSGGGG

SEQ ID NO: 356872 - protein, 25 aa, Mycobacterium
GRQRPTVLALVPYFSTVIGTVGMSL

SEQ ID NO: 356873 - protein, 19 aa, Mycobacterium
GRQRVLAIVILLMSAATLG

SEQ ID NO: 356874 - protein, 24 aa, Mycobacterium
GRQSLILVGAWAASGAVLMLLNHA

SEQ ID NO: 356875 - protein, 19 aa, Mycobacterium
GRRAFFVPIIGCLAQVALA

SEQ ID NO: 356876 - protein, 17 aa, Mycobacterium
GRRAIMLPAGALVYIAV

SEQ ID NO: 356877 - protein, 19 aa, Mycobacterium
GRRAVMLPAGALVYISLPP

SEQ ID NO: 356878 - protein, 25 aa, Mycobacterium
GRRDRWIRRAHQRLSFQLSGAQLGI

SEQ ID NO: 356879 - protein, 17 aa, Mycobacterium
GRRFGMPLFDRLGRRFP

SEQ ID NO: 356880 - protein, 25 aa, Mycobacterium
GRRFGPWFFIVPAFGVTALVMVGFL

SEQ ID NO: 356881 - protein, 29 aa, Mycobacterium
GRRGLRTVTIIALVAVLVGGIYVLASVGG

SEQ ID NO: 356882 - protein, 28 aa, Mycobacterium
GRRHKRFLPPRWWSVSPLDGLVAAVLVW

SEQ ID NO: 356883 - protein, 17 aa, Mycobacterium
GRRIGTSLRLLIIGSVV

SEQ ID NO: 356884 - protein, 19 aa, Mycobacterium
GRRIGTSLRLLLIGSVVGT

SEQ ID NO: 356885 - protein, 31 aa, Mycobacterium
GRRLIGELTHFFALLLWAAAVLAFFADLPEL

SEQ ID NO: 356886 - protein, 18 aa, Mycobacterium
GRRLPLMVDVMFYSVVGF

SEQ ID NO: 356887 - protein, 19 aa, Mycobacterium
GRRLPLMVDVMFYSVVGFL

SEQ ID NO: 356888 - protein, 19 aa, Mycobacterium
GRRPPRPNAAPSIGRAAPA

SEQ ID NO: 356889 - protein, 17 aa, Mycobacterium
GRRRQLRRMLGERVVRV

SEQ ID NO: 356890 - protein, 32 aa, Mycobacterium
GRRRVPEGLWHPGLVAALVGGGLALVVMTAWL

SEQ ID NO: 356891 - protein, 24 aa, Mycobacterium
GRRRWYLMGIALFTLGSIACGLAP

SEQ ID NO: 356892 - protein, 23 aa, Mycobacterium
GRRSLRVWLVLGAMLLSVIIGVR

SEQ ID NO: 356893 - protein, 21 aa, Mycobacterium
GRRSRFLKLFGLRVDLDQLEH

SEQ ID NO: 356894 - protein, 29 aa, Mycobacterium
GRRVDLPTYGFVRQHFWLPGGSTGSSDAA

SEQ ID NO: 356895 - protein, 26 aa, Mycobacterium
GRSALKFFLYTFLGSLALLVGFIGLY

SEQ ID NO: 356896 - protein, 28 aa, Mycobacterium
GRSDSLRSWLRFLVLASAAPLAGAPLGV

SEQ ID NO: 356897 - protein, 23 aa, Mycobacterium
GRSGLVYDMWGGAVSLAYQMHSG

SEQ ID NO: 356898 - protein, 31 aa, Mycobacterium
GRSLAAQFLVFQLFVVAVVLVAVAAVSVAQS

SEQ ID NO: 356899 - protein, 30 aa, Mycobacterium
GRSPEFQPWLRWAILILALLALIGLAMSRC

SEQ ID NO: 356900 - protein, 24 aa, Mycobacterium
GRSRAWMVWLPWISMMAISSSEYA

SEQ ID NO: 356901 - protein, 44 aa, Mycobacterium
GRSRLTRVAIVVLMLLPLVYGALYLWAFWDPFGHTNKMPVALVN

SEQ ID NO: 356902 - protein, 32 aa, Mycobacterium
GRSRRLFFAYLNLFVAAMLLLVLADNYLGLYM

SEQ ID NO: 356903 - protein, 26 aa, Mycobacterium
GRSVLRALVLLPLVLPPVVGGIALLY

SEQ ID NO: 356904 - protein, 18 aa, Mycobacterium
GRSWKPWLRGTAFGFPFG

SEQ ID NO: 356905 - protein, 25 aa, Mycobacterium
GRTDTLHFVGGYWQGAPQQDRVDCA

SEQ ID NO: 356906 - protein, 25 aa, Mycobacterium
GRTGYIWSMFAAFGLFTVGAVVSIW

SEQ ID NO: 356907 - protein, 20 aa, Mycobacterium
GRTLLLGSPGLLRAENVRVS

SEQ ID NO: 356908 - protein, 20 aa, Mycobacterium
GRTLLLGSPSLLRSEKVRVS

SEQ ID NO: 356909 - protein, 35 aa, Mycobacterium
GRTRHIIRLALFAAFLLGLFYLVAVARVVEIGDIR

SEQ ID NO: 356910 - protein, 29 aa, Mycobacterium
GRTVSPVEFWQYPTINALARFLTGGEVEA

SEQ ID NO: 356911 - protein, 21 aa, Mycobacterium
GRVLYLPLRRLGTPRARTTAQ

SEQ ID NO: 356912 - protein, 26 aa, Mycobacterium
GRVRLWLNVPYALLVLAFVGFDAFET

SEQ ID NO: 356913 - protein, 31 aa, Mycobacterium
GRVRRLPGVIAIVVLLFLACAPVASAQPAAG

SEQ ID NO: 356914 - protein, 25 aa, Mycobacterium
GRVVALIVLLILVAAALRGYLPDDD

SEQ ID NO: 356915 - protein, 26 aa, Mycobacterium
GRVVGLILLLILVAAALRGYLPVADG

SEQ ID NO: 356916 - protein, 22 aa, Mycobacterium
GRVVSLPWRMATIGDLPSVDAP

SEQ ID NO: 356917 - protein, 25 aa, Mycobacterium
GRWDALGFLQDFFATAVFLGIATFA

SEQ ID NO: 356918 - protein, 24 aa, Mycobacterium
GRWPWPTFTVNIVGAFLLGVFVTR

SEQ ID NO: 356919 - protein, 26 aa, Mycobacterium
GRWSYGLFIWHLAALAMVFPVVGTFP

SEQ ID NO: 356920 - protein, 26 aa, Mycobacterium
GRWSYGLFVWHLAALAMVFPVLGTFA

SEQ ID NO: 356921 - protein, 19 aa, Mycobacterium
GRWVSWFALLTIPTPFLAN

SEQ ID NO: 356922 - protein, 20 aa, Mycobacterium
GRYDIRVSPPRLGDDFDALA

SEQ ID NO: 356923 - protein, 25 aa, Mycobacterium
GRYRLLIFHGGTPHLRFWQALDTAL

SEQ ID NO: 356924 - protein, 24 aa, Mycobacterium
GRYRLLVFHGGPPHLQFWQALDTA

SEQ ID NO: 356925 - protein, 21 aa, Mycobacterium
GRYVLAPLALAQRVTGRQGRL

SEQ ID NO: 356926 - protein, 19 aa, Mycobacterium
GRYWVAVTTMVTVSAAGLG

SEQ ID NO: 356927 - protein, 27 aa, Mycobacterium
GSAAFLQWGWRVPFLLSAVLVGLALYV

SEQ ID NO: 356928 - protein, 26 aa, Mycobacterium
GSAARRAAILAAVICVLTLTIAGPVR

SEQ ID NO: 356929 - protein, 17 aa, Mycobacterium
GSAIAVLLILRSQNWLL

SEQ ID NO: 356930 - protein, 35 aa, Mycobacterium
GSAIRLARRLLPQRALTLAVILLGVGGIAIGVIGP

SEQ ID NO: 356931 - protein, 24 aa, Mycobacterium
GSAKGFFLMGIWTSLIAAVVFAMS

SEQ ID NO: 356932 - protein, 19 aa, Mycobacterium
GSALLLQRLSRKQEPPKAA

SEQ ID NO: 356933 - protein, 18 aa, Mycobacterium
GSALLTALHLPQDAIRWA

SEQ ID NO: 356934 - protein, 19 aa, Mycobacterium
GSAQRWKAIRGELGWMTTY

SEQ ID NO: 356935 - protein, 23 aa, Mycobacterium
GSATFSYPLALPPDTFALQGPWS

SEQ ID NO: 356936 - protein, 26 aa, Mycobacterium
GSATTFPWVFLFPAGVLVLIILCSNL

SEQ ID NO: 356937 - protein, 23 aa, Mycobacterium
GSAVFWVFVIALAAGAFALLNQE

SEQ ID NO: 356938 - protein, 22 aa, Mycobacterium
GSCLLFPAYFQQVLGKTPLQSG

SEQ ID NO: 356939 - protein, 22 aa, Mycobacterium
GSCLLFPAYFQQVLGKTPMQSG

SEQ ID NO: 356940 - protein, 19 aa, Mycobacterium
GSCWMLFVVMIAFGTMQLA

SEQ ID NO: 356941 - protein, 25 aa, Mycobacterium
GSDGKLVAPIKYPSLYAGDEDGKIT

SEQ ID NO: 356942 - protein, 31 aa, Mycobacterium
GSDHLPWLGLGFFVVIPVVGGLLYGPLISRF

SEQ ID NO: 356943 - protein, 20 aa, Mycobacterium
GSDKPRTVRWNLRLDVADVD

SEQ ID NO: 356944 - protein, 22 aa, Mycobacterium
GSENLLLVVLTNDKGLGPADEA

SEQ ID NO: 356945 - protein, 28 aa, Mycobacterium
GSEPESALRWLPDSLTAGGTRGWLESVR

SEQ ID NO: 356946 - protein, 32 aa, Mycobacterium
GSETERITSLVEDLLLLARLDSGRPLEREPVD

SEQ ID NO: 356947 - protein, 28 aa, Mycobacterium
GSEWVLHAEGLLRPGAVTPAADLSVWPP

SEQ ID NO: 356948 - protein, 17 aa, Mycobacterium
GSFGFFCSMNMINGTLV

SEQ ID NO: 356949 - protein, 24 aa, Mycobacterium
GSFILRTALALLLILNYDGATGSY

SEQ ID NO: 356950 - protein, 17 aa, Mycobacterium
GSFKITVQLPDVATLPQ

SEQ ID NO: 356951 - protein, 21 aa, Mycobacterium
GSFLGVSLQEPYLLGCLNNRN

SEQ ID NO: 356952 - protein, 24 aa, Mycobacterium
GSFLPRRRQWWTRGVAAAALCGAI

SEQ ID NO: 356953 - protein, 20 aa, Mycobacterium
GSFLRTNRALRAMLGYSRRA

SEQ ID NO: 356954 - protein, 22 aa, Mycobacterium
GSFMLMPYLVGYLTGPLGLPTW

SEQ ID NO: 356955 - protein, 23 aa, Mycobacterium
GSFPILSVFGFIVMFGGVVFAIT

SEQ ID NO: 356956 - protein, 24 aa, Mycobacterium
GSFPSWVLYPCALAMMVLSKSFSV

SEQ ID NO: 356957 - protein, 23 aa, Mycobacterium
GSFPSWVLYPCALGMMVLSKSFS

SEQ ID NO: 356958 - protein, 24 aa, Mycobacterium
GSFRRWEAMMFLLIAVNVVIIPMA

SEQ ID NO: 356959 - protein, 29 aa, Mycobacterium
GSFRRWERLMFLLIAVNVLIIPMVLLAHP

SEQ ID NO: 356960 - protein, 28 aa, Mycobacterium
GSFRSMRPYFDLFFMGAAFLLLETKNIA

SEQ ID NO: 356961 - protein, 26 aa, Mycobacterium
GSGDRTVRLWSAEPGPLVGQSLTPPG

SEQ ID NO: 356962 - protein, 27 aa, Mycobacterium
GSGGASLWWMIGLLAAAGVLGLMVVLP

SEQ ID NO: 356963 - protein, 20 aa, Mycobacterium
GSGIPFTATWTCTAFVVNPD

SEQ ID NO: 356964 - protein, 27 aa, Mycobacterium
GSGKSTLLINLLLGLVARHTPEQLNLI

SEQ ID NO: 356965 - protein, 19 aa, Mycobacterium
GSGLGIWLVTRPDPEPPPP

SEQ ID NO: 356966 - protein, 33 aa, Mycobacterium
GSGMLREVGVLLLIALVLYCITQNFIARPYLIP

SEQ ID NO: 356967 - protein, 26 aa, Mycobacterium
GSGPLLRRVFVIASLITAVLSLDTAV

SEQ ID NO: 356968 - protein, 26 aa, Mycobacterium
GSGSLFGLAFWIALAGLTPTGLLLAA

SEQ ID NO: 356969 - protein, 24 aa, Mycobacterium
GSGTLITFPTLVALGFPPVTATMS

SEQ ID NO: 356970 - protein, 41 aa, Mycobacterium
GSGVVSWLPFYHDMGFFVGIIIPILAGIPVVLTSPAGFLQR

SEQ ID NO: 356971 - protein, 33 aa, Mycobacterium
GSHLARQISLLRNYLLPLGALLLLIVNSEGVPA

SEQ ID NO: 356972 - protein, 24 aa, Mycobacterium
GSHMLMIGYFLVSGSLFFAAVSGV

SEQ ID NO: 356973 - protein, 22 aa, Mycobacterium
GSHPDYGAPAGWRAPGWPPPSE

SEQ ID NO: 356974 - protein, 33 aa, Mycobacterium
GSHRWARILYQWRWSLVVFWFVALVLAILERFW

SEQ ID NO: 356975 - protein, 35 aa, Mycobacterium
GSHYDLLIVGLAALTLIFVVMVIITRALVASLVIV

SEQ ID NO: 356976 - protein, 24 aa, Mycobacterium
GSIALFDDFLRPIRNYFYWEKHCF

SEQ ID NO: 356977 - protein, 35 aa, Mycobacterium
GSIGQLLVYHYSNGVWTYILGSPTQREYISRGVGG

SEQ ID NO: 356978 - protein, 23 aa, Mycobacterium
GSIHAMVVILWFSAAMAIVGSFH

SEQ ID NO: 356979 - protein, 24 aa, Mycobacterium
GSIPAFLLIRFGGIYPVIFVGVLL

SEQ ID NO: 356980 - protein, 41 aa, Mycobacterium
GSIRNKIVFILPAILLLSQFVPVLLTPILMVGATYLCYEGA

SEQ ID NO: 356981 - protein, 18 aa, Mycobacterium
GSIVALLFYLLRSRRNAR

SEQ ID NO: 356982 - protein, 30 aa, Mycobacterium
GSIVSLALLLTRMYAPLTALANARVEIASA

SEQ ID NO: 356983 - protein, 22 aa, Mycobacterium
GSKAEWFFGAVVFVAVAVTMWQ

SEQ ID NO: 356984 - protein, 27 aa, Mycobacterium
GSKAGLLPLHAWLPRAHPESPSPVSAL

SEQ ID NO: 356985 - protein, 44 aa, Mycobacterium
GSKKSLLLFGGLGAAALVLIVLAVLFFWVPGWAVTTELDIDKAQ

SEQ ID NO: 356986 - protein, 23 aa, Mycobacterium
GSKYDLMIVGIAALTLIFVVMVI

SEQ ID NO: 356987 - protein, 35 aa, Mycobacterium
GSLALCVLWTRTLPAWAFFSLPTRAWELAIGGLVA

SEQ ID NO: 356988 - protein, 17 aa, Mycobacterium
GSLANIAWYLQHAGKRS

SEQ ID NO: 356989 - protein, 21 aa, Mycobacterium
GSLFPFLFITIACGALSGFHS

SEQ ID NO: 356990 - protein, 22 aa, Mycobacterium
GSLGILRLVSLFGPVHFFAQPV

SEQ ID NO: 356991 - protein, 25 aa, Mycobacterium
GSLLAAGVVALLAWISRDRSPRLTA

SEQ ID NO: 356992 - protein, 21 aa, Mycobacterium
GSLLAGLWHLGDLQLLVIASV

SEQ ID NO: 356993 - protein, 27 aa, Mycobacterium
GSLLGDPAVWIERALVVLVAASPCALA

SEQ ID NO: 356994 - protein, 19 aa, Mycobacterium
GSLLSFVGVLLGAIAGVLL

SEQ ID NO: 356995 - protein, 25 aa, Mycobacterium
GSLMRLFAMQVPGQLLFSIASQLAL

SEQ ID NO: 356996 - protein, 31 aa, Mycobacterium
GSLMRPHTSTLLLLLLLAVLENAARLSVPLL

SEQ ID NO: 356997 - protein, 19 aa, Mycobacterium
GSLMSFVGVILGAVAGIML

SEQ ID NO: 356998 - protein, 31 aa, Mycobacterium
GSLPMTVFVAFQLMFAIITVALISGAVADRL

SEQ ID NO: 356999 - protein, 37 aa, Mycobacterium
GSLTRRFAVLVLLLCLFGLIMVLLRRGRVPGAVSGPL

SEQ ID NO: 357000 - protein, 21 aa, Mycobacterium
GSLVQLLFFMTPIIWNENMLN

SEQ ID NO: 357001 - protein, 19 aa, Mycobacterium
GSLVQLLFFMTPIIWNEST

SEQ ID NO: 357002 - protein, 19 aa, Mycobacterium
GSLWWLAEAWTISGAGLLA

SEQ ID NO: 357003 - protein, 17 aa, Mycobacterium
GSMFWHALRRDDAPRTQ

SEQ ID NO: 357004 - protein, 24 aa, Mycobacterium
GSMGPYLHYFTLLASGTDIAYSVG

SEQ ID NO: 357005 - protein, 18 aa, Mycobacterium
GSMKPLIHVLGQAEGNVI

SEQ ID NO: 357006 - protein, 22 aa, Mycobacterium
GSMLVVFGIAVALYERERSGKG

SEQ ID NO: 357007 - protein, 36 aa, Mycobacterium
GSMSRRFAVLVLLLCLFGMLVTLLRRGRIPGVASGP

SEQ ID NO: 357008 - protein, 23 aa, Mycobacterium
GSMTWEILWALIVGFTLSAVVQA

SEQ ID NO: 357009 - protein, 18 aa, Mycobacterium
GSMWADVLVALTRCDALR

SEQ ID NO: 357010 - protein, 25 aa, Mycobacterium
GSNENWKWVASIAGAVFAIAVIATA

SEQ ID NO: 357011 - protein, 24 aa, Mycobacterium
GSNGSQFFLVYQDSPLPPTYTVFG

SEQ ID NO: 357012 - protein, 24 aa, Mycobacterium
GSNRIYKPYPYILAIVDELADLMM

SEQ ID NO: 357013 - protein, 26 aa, Mycobacterium
GSNRLLMGLGWPVVVLLALAVARKTS

SEQ ID NO: 357014 - protein, 31 aa, Mycobacterium
GSPGHSDLGWLWWFGAGWVAVAVVGAGVIVW

SEQ ID NO: 357015 - protein, 19 aa, Mycobacterium
GSPLLMTYFLVDVSGARLT

SEQ ID NO: 357016 - protein, 26 aa, Mycobacterium
GSPLTAALSLMWGWRLAVVCVTVAAA

SEQ ID NO: 357017 - protein, 31 aa, Mycobacterium
GSPPDIYLMWTDGLLRLVPNWELYVFGHTVP

SEQ ID NO: 357018 - protein, 17 aa, Mycobacterium
GSPTRIMILLVLVMAFG

SEQ ID NO: 357019 - protein, 22 aa, Mycobacterium
GSPTRLLRLAPAARTLLSGGRL

SEQ ID NO: 357020 - protein, 20 aa, Mycobacterium
GSPTRLLRLAPTAQNMLSGG

SEQ ID NO: 357021 - protein, 20 aa, Mycobacterium
GSPYSFLPQLSPGDTIAGQY

SEQ ID NO: 357022 - protein, 26 aa, Mycobacterium
GSQPDFYMMWTDGLLRIIPAWEIYPF

SEQ ID NO: 357023 - protein, 19 aa, Mycobacterium
GSQPLWLAGMWVAAAMAVG

SEQ ID NO: 357024 - protein, 20 aa, Mycobacterium
GSQQIILDRDLQLVVNSLWA

SEQ ID NO: 357025 - protein, 24 aa, Mycobacterium
GSQTPLFSIFGAVSLLITADFPGN

SEQ ID NO: 357026 - protein, 17 aa, Mycobacterium
GSQTRLLAACRRAKEQL

SEQ ID NO: 357027 - protein, 24 aa, Mycobacterium
GSQYGYLLLWVIVAANVLAGLVQY

SEQ ID NO: 357028 - protein, 22 aa, Mycobacterium
GSRAIFNDLTFSEVPQLAGMNK

SEQ ID NO: 357029 - protein, 17 aa, Mycobacterium
GSRFLTIVAYQSGGTTA

SEQ ID NO: 357030 - protein, 18 aa, Mycobacterium
GSRLPLPAGGAPVTLAQA

SEQ ID NO: 357031 - protein, 20 aa, Mycobacterium
GSRLYAWVTTLYLVGSVVAA

SEQ ID NO: 357032 - protein, 25 aa, Mycobacterium
GSRRMWSIPLAVVGLIAIGGALLTG

SEQ ID NO: 357033 - protein, 24 aa, Mycobacterium
GSSALFDWPIWADGLVFLVVSVLL

SEQ ID NO: 357034 - protein, 38 aa, Mycobacterium
GSSFGLSVLIWQYILGINLYWMVLPMSVIVLLAVGSDY

SEQ ID NO: 357035 - protein, 22 aa, Mycobacterium
GSSGWLRLGVLAALIATALALL

SEQ ID NO: 357036 - protein, 27 aa, Mycobacterium
GSSIYNILLILGITCLIPAGGLALPDS

SEQ ID NO: 357037 - protein, 24 aa, Mycobacterium
GSSKPPVFVFHPAGGSTVVYEPLL

SEQ ID NO: 357038 - protein, 21 aa, Mycobacterium
GSSPLLVAWLRSLTSDYTLPI

SEQ ID NO: 357039 - protein, 35 aa, Mycobacterium
GSSRDELWLGLPAWRWMFLAMALPALVYGTLAFTI

SEQ ID NO: 357040 - protein, 25 aa, Mycobacterium
GSSRLETTWWEFPRDIEARLSEVAR

SEQ ID NO: 357041 - protein, 27 aa, Mycobacterium
GSSVLVQMMWAMRATGMWTDVRGTNML

SEQ ID NO: 357042 - protein, 17 aa, Mycobacterium
GSSVLWRIHAVGALLMV

SEQ ID NO: 357043 - protein, 27 aa, Mycobacterium
GSSVVVLLLLLGVPFLGVHWGFPDERV

SEQ ID NO: 357044 - protein, 17 aa, Mycobacterium
GSSWGIYIVIGVSLAVI

SEQ ID NO: 357045 - protein, 25 aa, Mycobacterium
GSTAIGLLLLILTPTKWAIQFGAFA

SEQ ID NO: 357046 - protein, 26 aa, Mycobacterium
GSTGTLFLFGIVIGAVAMLGLSVLLA

SEQ ID NO: 357047 - protein, 28 aa, Mycobacterium
GSTIGLGLLFDTLIVRSLMTPSLAGLLG

SEQ ID NO: 357048 - protein, 24 aa, Mycobacterium
GSTKPPVFVFHPAGGSTVVYEPLL

SEQ ID NO: 357049 - protein, 20 aa, Mycobacterium
GSTLFLLFGAAPAAAGLAAG

SEQ ID NO: 357050 - protein, 24 aa, Mycobacterium
GSTMGILTWMFVDGHGSGLMNYTP

SEQ ID NO: 357051 - protein, 35 aa, Mycobacterium
GSTVILRFSYQPRPKMTWLDALYFSTETIATVGYG

SEQ ID NO: 357052 - protein, 23 aa, Mycobacterium
GSTVLLALLLPYTAYREHVSPFV

SEQ ID NO: 357053 - protein, 26 aa, Mycobacterium
GSTVPGGWFTISVLAILVVVAVLVAV

SEQ ID NO: 357054 - protein, 25 aa, Mycobacterium
GSVAFWICGLLLCMFIGPSQSSSRA

SEQ ID NO: 357055 - protein, 19 aa, Mycobacterium
GSVAIWEYLTRSGAADRVA

SEQ ID NO: 357056 - protein, 23 aa, Mycobacterium
GSVARRFAVLTLLLALAVSIAMT

SEQ ID NO: 357057 - protein, 24 aa, Mycobacterium
GSVDPIVMSLLTQTVRLLRGESAE

SEQ ID NO: 357058 - protein, 34 aa, Mycobacterium
GSVELFANLLRSQRWWWGTVLLAASIGLQAAALA

SEQ ID NO: 357059 - protein, 35 aa, Mycobacterium
GSVGLMIAFYYGLTGFACAWFYRKRLTTSFRDLMM

SEQ ID NO: 357060 - protein, 26 aa, Mycobacterium
GSVIFFAVMFCFFQVVFTVAAPLQDR

SEQ ID NO: 357061 - protein, 22 aa, Mycobacterium
GSVLLLLLVYVGFMAGAGDVRG

SEQ ID NO: 357062 - protein, 27 aa, Mycobacterium
GSVLLVQALLMFSVLFALPINARFSHR

SEQ ID NO: 357063 - protein, 29 aa, Mycobacterium
GSVLLVQPLLMFSLLFALPINARLSHRTV

SEQ ID NO: 357064 - protein, 25 aa, Mycobacterium
GSVLYWMRFGTIRLPPWPDRVPLTR

SEQ ID NO: 357065 - protein, 21 aa, Mycobacterium
GSVVLPLKALVLNVLSLSAAF

SEQ ID NO: 357066 - protein, 26 aa, Mycobacterium
GSVVTLRRWLWPAVTAPVCCLALIFA

SEQ ID NO: 357067 - protein, 25 aa, Mycobacterium
GSVWALFFGTLLMTIPLASLLHRFT

SEQ ID NO: 357068 - protein, 18 aa, Mycobacterium
GSWFHAARPVGVWVDVVL

SEQ ID NO: 357069 - protein, 23 aa, Mycobacterium
GSYAVVAVVWLLAVSRGPVPRWA

SEQ ID NO: 357070 - protein, 34 aa, Mycobacterium
GSYLARPVSLLRNYILPLAALLILLVKGSEISAE

SEQ ID NO: 357071 - protein, 17 aa, Mycobacterium
GSYWGLVIVPPSVLVLA

SEQ ID NO: 357072 - protein, 18 aa, Mycobacterium
GTAAILVFTSSAAVLVVE

SEQ ID NO: 357073 - protein, 25 aa, Mycobacterium
GTAALAFIALFKPPPDVFSALTFIT

SEQ ID NO: 357074 - protein, 39 aa, Mycobacterium
GTACGLSVLLWQDILGLGVQWIVIPLSMVILLAVGSDYN

SEQ ID NO: 357075 - protein, 30 aa, Mycobacterium
GTACGLSVLLWQDILGLGVQWVVLPLSIVI

SEQ ID NO: 357076 - protein, 25 aa, Mycobacterium
GTACGLSVLLWQDVLGLGVQWIVIP

SEQ ID NO: 357077 - protein, 28 aa, Mycobacterium
GTADKLLLTVLIIAIIATLAAVTAPLET

SEQ ID NO: 357078 - protein, 24 aa, Mycobacterium
GTADLFANLLRGGGLVGGVASIAV

SEQ ID NO: 357079 - protein, 28 aa, Mycobacterium
GTAGLWLESLWIGAVYRYPWPVSMWPEA

SEQ ID NO: 357080 - protein, 21 aa, Mycobacterium
GTAICMLLPGRPMPDSAYPAA

SEQ ID NO: 357081 - protein, 24 aa, Mycobacterium
GTAINIVLVLVFLAAVTAWAVADG

SEQ ID NO: 357082 - protein, 26 aa, Mycobacterium
GTAIVRWPAPILITTLAVALIGLITL

SEQ ID NO: 357083 - protein, 22 aa, Mycobacterium
GTAIVRWPAPILVASLAVALIG

SEQ ID NO: 357084 - protein, 21 aa, Mycobacterium
GTAIVRWPGPILAVSIAIALI

SEQ ID NO: 357085 - protein, 28 aa, Mycobacterium
GTAIVRWPGPILAVTMIIALLGLGILPS

SEQ ID NO: 357086 - protein, 30 aa, Mycobacterium
GTALLRLCMLPGLALLIWAAPRLARHLGTD

SEQ ID NO: 357087 - protein, 25 aa, Mycobacterium
GTALVVLFLAGWMVNLKLLMPVFRW

SEQ ID NO: 357088 - protein, 19 aa, Mycobacterium
GTARRWAMLAIALGSTAGA

SEQ ID NO: 357089 - protein, 34 aa, Mycobacterium
GTAVPLQVISWLLMPISRLLVLLGNALTPGRGFR

SEQ ID NO: 357090 - protein, 34 aa, Mycobacterium
GTAVSGLPVLFLLLCALWCAGVAMLWAHGPNTGL

SEQ ID NO: 357091 - protein, 20 aa, Mycobacterium
GTAVVPIYGPALDGTLPGNE

SEQ ID NO: 357092 - protein, 27 aa, Mycobacterium
GTAVVRWPAPILALSGAIVLVGMVALP

SEQ ID NO: 357093 - protein, 33 aa, Mycobacterium
GTAVYIGLHPGLPVWWIVAVLVFAGVMGLFVVF

SEQ ID NO: 357094 - protein, 20 aa, Mycobacterium
GTAWGYRWGGLGAGIIGAVL

SEQ ID NO: 357095 - protein, 21 aa, Mycobacterium
GTDLPAPRPIAPGLFNAIPEA

SEQ ID NO: 357096 - protein, 49 aa, Mycobacterium
GTDLSRYFHGRLPRIALATIIVMPLLYGAMYLWAFWNPFAEVNKVPVAL

SEQ ID NO: 357097 - protein, 28 aa, Mycobacterium
GTDTLAFWAFLAFYLSAAVVTWARYVRR

SEQ ID NO: 357098 - protein, 22 aa, Mycobacterium
GTDYAIFLFSRYHECVRSGLSS

SEQ ID NO: 357099 - protein, 22 aa, Mycobacterium
GTEAPQTVRWTLRLDVTDVDGE

SEQ ID NO: 357100 - protein, 36 aa, Mycobacterium
GTETPAFWVFLLCYIGATTLTWWRYVRPHGGSGPAP

SEQ ID NO: 357101 - protein, 26 aa, Mycobacterium
GTEVAWLLPVALIGLVVLLWLTRHTV

SEQ ID NO: 357102 - protein, 30 aa, Mycobacterium
GTFGPGVFFWFLVIGLLTVFMLGGATRLPA

SEQ ID NO: 357103 - protein, 26 aa, Mycobacterium
GTFHYWQAWVFLAIFVVCSGVSSIYL

SEQ ID NO: 357104 - protein, 23 aa, Mycobacterium
GTGAIVLIAVLFLGSHLSLTKVL

SEQ ID NO: 357105 - protein, 26 aa, Mycobacterium
GTGDYFYFPAQMLSDPRFKPYLKMMF

SEQ ID NO: 357106 - protein, 29 aa, Mycobacterium
GTGLTMLTWLMRIGFLGAPLIVGVVADAV

SEQ ID NO: 357107 - protein, 30 aa, Mycobacterium
GTGRYLLLQTLLVLIWIAVNLFAAHWRWDP

SEQ ID NO: 357108 - protein, 18 aa, Mycobacterium
GTGRYLLVQTLIVVIWIS

SEQ ID NO: 357109 - protein, 22 aa, Mycobacterium
GTGWRVSGLLRIDEVASATGFR

SEQ ID NO: 357110 - protein, 20 aa, Mycobacterium
GTGWTWIVLAAAVIAQLVAV

SEQ ID NO: 357111 - protein, 20 aa, Mycobacterium
GTHLANWRRVGLATWIADAG

SEQ ID NO: 357112 - protein, 21 aa, Mycobacterium
GTIAMLAIGILIARPVAQLPA

SEQ ID NO: 357113 - protein, 20 aa, Mycobacterium
GTIEAFIQYVRQFNQPVTDV

SEQ ID NO: 357114 - protein, 27 aa, Mycobacterium
GTIELLMLRAERFGVRLTVVPSARWAR

SEQ ID NO: 357115 - protein, 28 aa, Mycobacterium
GTIGLGSALLIAALLLSTYTSSKITKIP

SEQ ID NO: 357116 - protein, 36 aa, Mycobacterium
GTIKANLFWAFAYNTAAIPLAALGLLNPMIAGAAMA

SEQ ID NO: 357117 - protein, 28 aa, Mycobacterium
GTIMALGFILLTLPVGLFFGWLGKRLAV

SEQ ID NO: 357118 - protein, 22 aa, Mycobacterium
GTIRLWNLTDPAHPRRLGQPLQ

SEQ ID NO: 357119 - protein, 28 aa, Mycobacterium
GTISYGVYLWHWPIFLALNGERTGWSGL

SEQ ID NO: 357120 - protein, 30 aa, Mycobacterium
GTISYGVYLWHWPIFLVLNGERTGWTGLPL

SEQ ID NO: 357121 - protein, 40 aa, Mycobacterium
GTITIVTLLFLYIARTRWGTPLWLVLIGGGALLLVDLMFL

SEQ ID NO: 357122 - protein, 28 aa, Mycobacterium
GTIVTGGVVLLVLLAAAALLVARQVVLP

SEQ ID NO: 357123 - protein, 19 aa, Mycobacterium
GTIWIFGGIGSNHAVVANH

SEQ ID NO: 357124 - protein, 17 aa, Mycobacterium
GTIWIIIGAVLAGCVQD

SEQ ID NO: 357125 - protein, 26 aa, Mycobacterium
GTKGVFFGRMLPFFRSFISVPAGTER

SEQ ID NO: 357126 - protein, 17 aa, Mycobacterium
GTKLLVVFAISVLLTFY

SEQ ID NO: 357127 - protein, 17 aa, Mycobacterium
GTKLLVVFGISVLLTFY

SEQ ID NO: 357128 - protein, 18 aa, Mycobacterium
GTKRLFVGAVFLFTLGSL

SEQ ID NO: 357129 - protein, 17 aa, Mycobacterium
GTKWSGLYFVVFFGVMS

SEQ ID NO: 357130 - protein, 25 aa, Mycobacterium
GTLAFVLTIAIITAATLLAARLRPD

SEQ ID NO: 357131 - protein, 26 aa, Mycobacterium
GTLGILTALFIFNFLGLPSTGATIPL

SEQ ID NO: 357132 - protein, 27 aa, Mycobacterium
GTLIVLKAFAYWLDRYELLSNDRSAKP

SEQ ID NO: 357133 - protein, 25 aa, Mycobacterium
GTLLIVILALLLDAALVLLGRLTTS

SEQ ID NO: 357134 - protein, 17 aa, Mycobacterium
GTLLWCDIYDPDHATLK

SEQ ID NO: 357135 - protein, 21 aa, Mycobacterium
GTLPWWAGIIEFVGGAAIALG

SEQ ID NO: 357136 - protein, 28 aa, Mycobacterium
GTLRISNWPLYMADGFVAAFQTASGITV

SEQ ID NO: 357137 - protein, 39 aa, Mycobacterium
GTLTIWVGFIAAFFIVYLMNSWLPILMTDVGFALSTAAT

SEQ ID NO: 357138 - protein, 29 aa, Mycobacterium
GTMLGWRATFWAIALLCLPAVVGIATALP

SEQ ID NO: 357139 - protein, 20 aa, Mycobacterium
GTMLIIFTLSFMTNTYFPGF

SEQ ID NO: 357140 - protein, 29 aa, Mycobacterium
GTMLLRLCMLPGLALLIWATPRLAHHLGA

SEQ ID NO: 357141 - protein, 28 aa, Mycobacterium
GTMLLRLCMLPGLALLIWATPRVARHLG

SEQ ID NO: 357142 - protein, 25 aa, Mycobacterium
GTMLLRLCMLPGLALLVWATPRVAQ

SEQ ID NO: 357143 - protein, 24 aa, Mycobacterium
GTNFWTGWILQLAAIFFAAAITDF

SEQ ID NO: 357144 - protein, 26 aa, Mycobacterium
GTNRTLFEVLLYGALLALLVVALVSD

SEQ ID NO: 357145 - protein, 31 aa, Mycobacterium
GTPAMWFIAVPVLGWALWRTVVRRDWRYGAV

SEQ ID NO: 357146 - protein, 25 aa, Mycobacterium
GTPESPFGWYYDLLTIWAHVSTASV

SEQ ID NO: 357147 - protein, 22 aa, Mycobacterium
GTPGIVPYLISPAGQKVELPNR

SEQ ID NO: 357148 - protein, 25 aa, Mycobacterium
GTPITIAVPAYWSDAQFTALREEFF

SEQ ID NO: 357149 - protein, 31 aa, Mycobacterium
GTPLLVQLFIVFFALPEFGVKIDPFPAAVIA

SEQ ID NO: 357150 - protein, 20 aa, Mycobacterium
GTPLYPGLPPAPPPGRPRDP

SEQ ID NO: 357151 - protein, 17 aa, Mycobacterium
GTPQLRPFLTSQDKTTW

SEQ ID NO: 357152 - protein, 19 aa, Mycobacterium
GTPTLPPPSPPAPEVPPAG

SEQ ID NO: 357153 - protein, 35 aa, Mycobacterium
GTPVALHLFYVAKILLYILGAWLFASATAGLGGFT

SEQ ID NO: 357154 - protein, 33 aa, Mycobacterium
GTPVALHLFYVLKIALYILGGWLFAMVTTEGID

SEQ ID NO: 357155 - protein, 23 aa, Mycobacterium
GTPVRQPLQCRPDAAYLITGGMG

SEQ ID NO: 357156 - protein, 20 aa, Mycobacterium
GTPWVLYTVIGVSAAVIVAS

SEQ ID NO: 357157 - protein, 26 aa, Mycobacterium
GTPYAAYLLYLFKIGVYIAAPAAIIS

SEQ ID NO: 357158 - protein, 25 aa, Mycobacterium
GTQFGYLLLWVIVAANVMAGVVQYL

SEQ ID NO: 357159 - protein, 26 aa, Mycobacterium
GTQNFGLLILRVGLGAVLIAHGLQKL

SEQ ID NO: 357160 - protein, 18 aa, Mycobacterium
GTRESGVRALFLPAHDPF

SEQ ID NO: 357161 - protein, 17 aa, Mycobacterium
GTRFPAADYLSHSEAEP

SEQ ID NO: 357162 - protein, 26 aa, Mycobacterium
GTRHRRFLPARWWSIGALDALVIAVL

SEQ ID NO: 357163 - protein, 26 aa, Mycobacterium
GTRHRRFLPSRWWSLSGLDALVVAVL

SEQ ID NO: 357164 - protein, 26 aa, Mycobacterium
GTRHRRILPPRWWSIGALDGLVTAVL

SEQ ID NO: 357165 - protein, 26 aa, Mycobacterium
GTRHRRILPQRWWSIGGLDALVIAVL

SEQ ID NO: 357166 - protein, 17 aa, Mycobacterium
GTRLYCAGGWYTGDTLD

SEQ ID NO: 357167 - protein, 20 aa, Mycobacterium
GTRPLLAGLIALAGHQPPVH

SEQ ID NO: 357168 - protein, 20 aa, Mycobacterium
GTRPVRLWSPLGTGRRWLLR

SEQ ID NO: 357169 - protein, 17 aa, Mycobacterium
GTRRLWPAAVAIVIAMF

SEQ ID NO: 357170 - protein, 32 aa, Mycobacterium
GTRVGLIMPNGVRWVQIAIALTRIGAVLVPLS

SEQ ID NO: 357171 - protein, 28 aa, Mycobacterium
GTSFRSALMYPEPKRPGWRHEHSYFPRP

SEQ ID NO: 357172 - protein, 27 aa, Mycobacterium
GTSISVLLPGRPMPGATYPATPADTGA

SEQ ID NO: 357173 - protein, 27 aa, Mycobacterium
GTSLLLYASFLVVLYLATQRFSWVIIG

SEQ ID NO: 357174 - protein, 23 aa, Mycobacterium
GTSLLLYTSFLVVVYLATQRFSW

SEQ ID NO: 357175 - protein, 29 aa, Mycobacterium
GTSLVIQLLWIFFVLPQLGLRFEPMAAAT

SEQ ID NO: 357176 - protein, 17 aa, Mycobacterium
GTSVVLWVLLNLPARAA

SEQ ID NO: 357177 - protein, 18 aa, Mycobacterium
GTTAVIEMFLFLAALFVA

SEQ ID NO: 357178 - protein, 20 aa, Mycobacterium
GTTEAPFDWYHELLAHLAQI

SEQ ID NO: 357179 - protein, 24 aa, Mycobacterium
GTTGPYWTLFLTGLAVFGAPLTLT

SEQ ID NO: 357180 - protein, 50 aa, Mycobacterium
GTTIGLGLLFDTFIVRAFMMPSIATLLGRWFWWPLVVRSRPLRPRPQQQA

SEQ ID NO: 357181 - protein, 28 aa, Mycobacterium
GTTIGLGLLFDTLIVRAFMTPAIAALLG

SEQ ID NO: 357182 - protein, 17 aa, Mycobacterium
GTTIGLGLLFDTLIVRS

SEQ ID NO: 357183 - protein, 33 aa, Mycobacterium
GTTIGLGLLFDTLIVRSFMMPSVAALLGRWFWW

SEQ ID NO: 357184 - protein, 27 aa, Mycobacterium
GTTIGLGLLFDTLIVRSFMTPSIAALL

SEQ ID NO: 357185 - protein, 28 aa, Mycobacterium
GTTIGLGLLFDTLIVRSFMTPSIAALLG

SEQ ID NO: 357186 - protein, 28 aa, Mycobacterium
GTTIGLGLLFDTLIVRSFMTPSIAALMG

SEQ ID NO: 357187 - protein, 27 aa, Mycobacterium
GTTIGLGLLFDTLIVRSLMTPSIAALL

SEQ ID NO: 357188 - protein, 21 aa, Mycobacterium
GTTLAVYWFETVVASLLVALR

SEQ ID NO: 357189 - protein, 20 aa, Mycobacterium
GTTLYGLHAMFFDQPRVNEK

SEQ ID NO: 357190 - protein, 24 aa, Mycobacterium
GTTMPFWYALSLLLLVALAIKERG

SEQ ID NO: 357191 - protein, 29 aa, Mycobacterium
GTTVGWGVYLVIAFTLLQAAVAVVCLLFD

SEQ ID NO: 357192 - protein, 18 aa, Mycobacterium
GTTYPWSSPVIIGLFASS

SEQ ID NO: 357193 - protein, 24 aa, Mycobacterium
GTVEFYAIIFISLGASVGAAAFGY

SEQ ID NO: 357194 - protein, 25 aa, Mycobacterium
GTVGLLFAIILLDASLIGANAIGLA

SEQ ID NO: 357195 - protein, 24 aa, Mycobacterium
GTVIAIGALLPWTRPMFLNNNYAT

SEQ ID NO: 357196 - protein, 32 aa, Mycobacterium
GTVIGRRYRVGPPVLLILMGVLLGLVPHFGHV

SEQ ID NO: 357197 - protein, 20 aa, Mycobacterium
GTVIPLLEVALDGALLKFLL

SEQ ID NO: 357198 - protein, 33 aa, Mycobacterium
GTVIVGWVISLIVVSPFRLLAQQARLINAQSNP

SEQ ID NO: 357199 - protein, 24 aa, Mycobacterium
GTVLTLVLAFAAAALLWLVVEELL

SEQ ID NO: 357200 - protein, 25 aa, Mycobacterium
GTVMILIVVLLFKTGGNLGPVVSQP

SEQ ID NO: 357201 - protein, 20 aa, Mycobacterium
GTVMLLFYATPIVFGFANLV

SEQ ID NO: 357202 - protein, 23 aa, Mycobacterium
GTVPAIVWVAFQLTFAVITVALI

SEQ ID NO: 357203 - protein, 23 aa, Mycobacterium
GTVPAIVWVGFQLTFAVITVALI

SEQ ID NO: 357204 - protein, 24 aa, Mycobacterium
GTVPMGLLAYRHRMRVLLAATVAG

SEQ ID NO: 357205 - protein, 24 aa, Mycobacterium
GTVTFLVLLVLIRAVGQRESGGLG

SEQ ID NO: 357206 - protein, 38 aa, Mycobacterium
GTVVALLLIATYRSPVLWLLPLLVIGFADRLAAAAGTA

SEQ ID NO: 357207 - protein, 26 aa, Mycobacterium
GTVVVRWPLPVLAATCAVALVGLLAL

SEQ ID NO: 357208 - protein, 23 aa, Mycobacterium
GTVVWFGITDAWNERLDRRLDEA

SEQ ID NO: 357209 - protein, 18 aa, Mycobacterium
GTWAAIVIALAVVAWGPV

SEQ ID NO: 357210 - protein, 26 aa, Mycobacterium
GTWARLYTDWVPRALPPGWKPGSKAA

SEQ ID NO: 357211 - protein, 19 aa, Mycobacterium
GTWLFTRAQRLCRPVFAYL

SEQ ID NO: 357212 - protein, 18 aa, Mycobacterium
GTWPLVAPMLAAGTVILP

SEQ ID NO: 357213 - protein, 27 aa, Mycobacterium
GTWSRLYSDWVPRALPPGWKPGSKTAP

SEQ ID NO: 357214 - protein, 19 aa, Mycobacterium
GTYLLIFHRHHGFDAIFHG

SEQ ID NO: 357215 - protein, 25 aa, Mycobacterium
GVAAAIVALLAFGAGLAWLAMDRRR

SEQ ID NO: 357216 - protein, 26 aa, Mycobacterium
GVAAKLYPLLLLIPLVLLAVRTGRMR

SEQ ID NO: 357217 - protein, 26 aa, Mycobacterium
GVAAKLYPLLLLIPLVLLAVRTGRVR

SEQ ID NO: 357218 - protein, 28 aa, Mycobacterium
GVAAKLYPVLLLLPLLLVSLRSGKVHEF

SEQ ID NO: 357219 - protein, 26 aa, Mycobacterium
GVAALRLLTRFWPGPEKPGEPDVSRR

SEQ ID NO: 357220 - protein, 30 aa, Mycobacterium
GVAALTALFVTWYFSRRLQHSIAEVASAAT

SEQ ID NO: 357221 - protein, 25 aa, Mycobacterium
GVAARALLAWPSGVAPIVVMAAVAA

SEQ ID NO: 357222 - protein, 17 aa, Mycobacterium
GVAETFLLFALADNTFQ

SEQ ID NO: 357223 - protein, 28 aa, Mycobacterium
GVAFAAAAVLFALIALSPAALQVHLVVF

SEQ ID NO: 357224 - protein, 24 aa, Mycobacterium
GVAFWSWMFIRQSGSYVKAFLTLG

SEQ ID NO: 357225 - protein, 26 aa, Mycobacterium
GVAHPWRLLGLVMLPLIAKAARPVVT

SEQ ID NO: 357226 - protein, 29 aa, Mycobacterium
GVAIICYAWPFYWLVDMRAMAWLVVAMMV

SEQ ID NO: 357227 - protein, 20 aa, Mycobacterium
GVAIPFVWAPLAAIGSRDLP

SEQ ID NO: 357228 - protein, 18 aa, Mycobacterium
GVALAAYCWPIRQRPRSL

SEQ ID NO: 357229 - protein, 38 aa, Mycobacterium
GVALGITVLLFPVVQPWYLLWAIIPLAAWATRPAFRGT

SEQ ID NO: 357230 - protein, 36 aa, Mycobacterium
GVALGLTVLLFPVVQPWYLLWAIIPMAAWATRTGFR

SEQ ID NO: 357231 - protein, 29 aa, Mycobacterium
GVALLARNHRWFLIANYGAARVGARIILL

SEQ ID NO: 357232 - protein, 17 aa, Mycobacterium
GVALLVPTAFSAAYGAS

SEQ ID NO: 357233 - protein, 21 aa, Mycobacterium
GVAMFLLYLCGGTSALIAASL

SEQ ID NO: 357234 - protein, 32 aa, Mycobacterium
GVAMLLEFLSPILVIAWTWMITRHRPHTRVLA

SEQ ID NO: 357235 - protein, 23 aa, Mycobacterium
GVAMLLLLVHLALVAVTALKGKY

SEQ ID NO: 357236 - protein, 19 aa, Mycobacterium
GVANAALWRYESDGTATLV

SEQ ID NO: 357237 - protein, 30 aa, Mycobacterium
GVANYGTWWFWLGLALIVGILLLVGNLERS

SEQ ID NO: 357238 - protein, 17 aa, Mycobacterium
GVARLLARALARKQTRA

SEQ ID NO: 357239 - protein, 26 aa, Mycobacterium
GVASTLAYAVLFLALHGLAGDQAANF

SEQ ID NO: 357240 - protein, 25 aa, Mycobacterium
GVASVLALVAFLQSVYLVILAGSDS

SEQ ID NO: 357241 - protein, 28 aa, Mycobacterium
GVAVAILVMILVAIVIWAATHDDNPQPT

SEQ ID NO: 357242 - protein, 22 aa, Mycobacterium
GVAVLFLLRPVLDSAQFTLPRV

SEQ ID NO: 357243 - protein, 26 aa, Mycobacterium
GVAVMAVWYIQAPTLLGIGKMTVTLE

SEQ ID NO: 357244 - protein, 22 aa, Mycobacterium
GVAVPVFAFFAAGVTLGGFAGL

SEQ ID NO: 357245 - protein, 20 aa, Mycobacterium
GVAVSFWLTAPYIAADSVAH

SEQ ID NO: 357246 - protein, 21 aa, Mycobacterium
GVAVSFWLTAPYIAAESLHHL

SEQ ID NO: 357247 - protein, 18 aa, Mycobacterium
GVAWLLGVPALMRKRFES

SEQ ID NO: 357248 - protein, 30 aa, Mycobacterium
GVAWVLYQWRWSITALWFTAVFLMIMARFW

SEQ ID NO: 357249 - protein, 24 aa, Mycobacterium
GVCLVSTWHYFPRHRFLFGDKYDS

SEQ ID NO: 357250 - protein, 26 aa, Mycobacterium
GVDARNLWFVIITALALALAIYGYHW

SEQ ID NO: 357251 - protein, 24 aa, Mycobacterium
GVDLGTLLRRDGPLAAPRAIAIIS

SEQ ID NO: 357252 - protein, 24 aa, Mycobacterium
GVDLLVHLQMVQAGLAVAILPALL

SEQ ID NO: 357253 - protein, 22 aa, Mycobacterium
GVDLLYYAYHRIAHRVRLIWAT

SEQ ID NO: 357254 - protein, 26 aa, Mycobacterium
GVDSRLWIAIVVLTGLLAVSLAGSAW

SEQ ID NO: 357255 - protein, 24 aa, Mycobacterium
GVEAFALYSVFYQSGALLGPLVGF

SEQ ID NO: 357256 - protein, 18 aa, Mycobacterium
GVECLFARPLKADPLLYP

SEQ ID NO: 357257 - protein, 28 aa, Mycobacterium
GVEEQYYFVWPLLLVAVTLALAARARRR

SEQ ID NO: 357258 - protein, 29 aa, Mycobacterium
GVEEQYYIAWPLLLIAVTLLLAVRAKRYF

SEQ ID NO: 357259 - protein, 29 aa, Mycobacterium
GVEEQYYIVWPLLLIAVTLLLAARARRYF

SEQ ID NO: 357260 - protein, 34 aa, Mycobacterium
GVEEQYYLVWPLLVLFAVLLLRRRGARAVRIAVV

SEQ ID NO: 357261 - protein, 28 aa, Mycobacterium
GVEGVAWLRLAWAGILFLIIVRPRRTAF

SEQ ID NO: 357262 - protein, 27 aa, Mycobacterium
GVEHLKWYDYPLAAAVSLIALFTLVEI

SEQ ID NO: 357263 - protein, 36 aa, Mycobacterium
GVEIFLAALPQYWLGIVLLVVFAIQLRLLPVIGGDD

SEQ ID NO: 357264 - protein, 47 aa, Mycobacterium
GVELPRAMFFIGILYVVVATVIAFWIGRPIIWLAFDNEKFNAAFRYA

SEQ ID NO: 357265 - protein, 22 aa, Mycobacterium
GVEQFRLVLQPMMIAAAAALAA

SEQ ID NO: 357266 - protein, 24 aa, Mycobacterium
GVEQLFRAVSWLPADGRGRLLTVP

SEQ ID NO: 357267 - protein, 24 aa, Mycobacterium
GVEVVPMSVLLRTLAAAAAESGAS

SEQ ID NO: 357268 - protein, 21 aa, Mycobacterium
GVEYVIGFFAAIEAGAIAVPL

SEQ ID NO: 357269 - protein, 24 aa, Mycobacterium
GVFAPILLIVLRLLQGFGAGGEYA

SEQ ID NO: 357270 - protein, 18 aa, Mycobacterium
GVFAQWLSTVLPGGVTPE

SEQ ID NO: 357271 - protein, 21 aa, Mycobacterium
GVFEYVAIWAAKRARGKPLRI

SEQ ID NO: 357272 - protein, 30 aa, Mycobacterium
GVFGLALLGVFLFWPWEYKPFGDPGNALYN

SEQ ID NO: 357273 - protein, 17 aa, Mycobacterium
GVFGVWLVRFMRSKDTS

SEQ ID NO: 357274 - protein, 23 aa, Mycobacterium
GVFILIVLFCLAAPLWSEHVAHT

SEQ ID NO: 357275 - protein, 24 aa, Mycobacterium
GVFLGFAALFYTLLTAFGALAITV

SEQ ID NO: 357276 - protein, 21 aa, Mycobacterium
GVFSRLYVPQLLITGTADAAV

SEQ ID NO: 357277 - protein, 29 aa, Mycobacterium
GVFTTVLLTRLALFLIVGTLVAAVVFAGF

SEQ ID NO: 357278 - protein, 19 aa, Mycobacterium
GVFVFLILRALGELVLYRP

SEQ ID NO: 357279 - protein, 18 aa, Mycobacterium
GVFVTRLLERLPVSSYRR

SEQ ID NO: 357280 - protein, 24 aa, Mycobacterium
GVFYVLLWVGVVALSLAIGPVWRV

SEQ ID NO: 357281 - protein, 28 aa, Mycobacterium
GVGALCLIFIIMLIITRGFVASLVIVGT

SEQ ID NO: 357282 - protein, 28 aa, Mycobacterium
GVGALCLIFIIMLIITRSFIAALVIVGT

SEQ ID NO: 357283 - protein, 24 aa, Mycobacterium
GVGALLRLPYTFAIPVFGGRNWTT

SEQ ID NO: 357284 - protein, 37 aa, Mycobacterium
GVGAPLWNADLLLPDLQAAWRVLHALPAAAAATQRGI

SEQ ID NO: 357285 - protein, 18 aa, Mycobacterium
GVGASFLGILRSITPLAA

SEQ ID NO: 357286 - protein, 19 aa, Mycobacterium
GVGFLARPLGALVFGQLGD

SEQ ID NO: 357287 - protein, 26 aa, Mycobacterium
GVGGDGAFFLLLDQPEVYGLPPDPVV

SEQ ID NO: 357288 - protein, 26 aa, Mycobacterium
GVGGNGAFFLLLDEPEVYGLPPDPVV

SEQ ID NO: 357289 - protein, 22 aa, Mycobacterium
GVGGTWHWNTYPGIAVDIPSFS

SEQ ID NO: 357290 - protein, 23 aa, Mycobacterium
GVGIAVLLVLVISGIFVGTTNQV

SEQ ID NO: 357291 - protein, 23 aa, Mycobacterium
GVGIAVLLVLVISGIFVGTTNRV

SEQ ID NO: 357292 - protein, 23 aa, Mycobacterium
GVGLGPLWYLVGPAPAAGPAIRV

SEQ ID NO: 357293 - protein, 20 aa, Mycobacterium
GVGLGYWRRTGLTSTRFVAC

SEQ ID NO: 357294 - protein, 17 aa, Mycobacterium
GVGLLGAYCFYLEQFEG

SEQ ID NO: 357295 - protein, 33 aa, Mycobacterium
GVGLLLISPLFLTLMLLVRLSSPGPIFFGQPRI

SEQ ID NO: 357296 - protein, 28 aa, Mycobacterium
GVGMAAIQLARLWGARVFVTASRGKWDT

SEQ ID NO: 357297 - protein, 24 aa, Mycobacterium
GVGMVLFWGLIIVGIVALIRYTTG

SEQ ID NO: 357298 - protein, 25 aa, Mycobacterium
GVGPVAATPIMRWLRDVEGTGAPTD

SEQ ID NO: 357299 - protein, 36 aa, Mycobacterium
GVGSAFLGVLSVAAVVLGVLIWIGHRDEISERVYLT

SEQ ID NO: 357300 - protein, 28 aa, Mycobacterium
GVGSIFPIFMMVGIMMMMFRSVGAGGQQ

SEQ ID NO: 357301 - protein, 28 aa, Mycobacterium
GVGSRAHRRYFWAVLAISAIISIGGNAL

SEQ ID NO: 357302 - protein, 17 aa, Mycobacterium
GVGTLKDLALVQLIGIM

SEQ ID NO: 357303 - protein, 22 aa, Mycobacterium
GVGVFYVFISWMAIAGTGPQQS

SEQ ID NO: 357304 - protein, 20 aa, Mycobacterium
GVGVWIGLALLIIAQVWDIW

SEQ ID NO: 357305 - protein, 24 aa, Mycobacterium
GVGWAAYILFSLAALAFAVWNWGL

SEQ ID NO: 357306 - protein, 25 aa, Mycobacterium
GVGYATAFLLISLLLCLAVALGADA

SEQ ID NO: 357307 - protein, 25 aa, Mycobacterium
GVHLAYLAYVPAGGFLALRWPRTIV

SEQ ID NO: 357308 - protein, 18 aa, Mycobacterium
GVHLMVSAGGWIHGQRQS

SEQ ID NO: 357309 - protein, 18 aa, Mycobacterium
GVHLVLGVSWQAALLLGA

SEQ ID NO: 357310 - protein, 34 aa, Mycobacterium
GVIAAIWLVLVGWLAVWPFLNWWTTHFVITDRRV

SEQ ID NO: 357311 - protein, 19 aa, Mycobacterium
GVIAFLGYYEIIGLSTFAT

SEQ ID NO: 357312 - protein, 19 aa, Mycobacterium
GVIAFLIAGMGGFMGVVHS

SEQ ID NO: 357313 - protein, 17 aa, Mycobacterium
GVIAFLLLPILVVIWLS

SEQ ID NO: 357314 - protein, 25 aa, Mycobacterium
GVIAILLFAPLVWVGVVAAAMAVAT

SEQ ID NO: 357315 - protein, 26 aa, Mycobacterium
GVIAVMLFFVYRSVLTTLLVLLTVLI

SEQ ID NO: 357316 - protein, 26 aa, Mycobacterium
GVIAVMLLIVFRSVATMVLILFMVFA

SEQ ID NO: 357317 - protein, 25 aa, Mycobacterium
GVIGLLFLGFFILEGFDFGVGMLME

SEQ ID NO: 357318 - protein, 21 aa, Mycobacterium
GVIIFLYVFLALLTNGDKVLD

SEQ ID NO: 357319 - protein, 24 aa, Mycobacterium
GVIIVMLLIVYRSVVTMLVSMVII

SEQ ID NO: 357320 - protein, 23 aa, Mycobacterium
GVILPHRVFAILLVVFGAGFSMV

SEQ ID NO: 357321 - protein, 19 aa, Mycobacterium
GVIPWWVVGLLLGRDAVLA

SEQ ID NO: 357322 - protein, 19 aa, Mycobacterium
GVIREIFWELPVYDPHHLA

SEQ ID NO: 357323 - protein, 19 aa, Mycobacterium
GVITLVVFGGLFAAIDAAL

SEQ ID NO: 357324 - protein, 24 aa, Mycobacterium
GVIVFQFLLGEEMHWSVPGLTFVI

SEQ ID NO: 357325 - protein, 25 aa, Mycobacterium
GVIVRQILTWALSTGVPILAIVLTV

SEQ ID NO: 357326 - protein, 30 aa, Mycobacterium
GVIWGIWLVIVGWLTLWPFGSWLTTHFVVT

SEQ ID NO: 357327 - protein, 34 aa, Mycobacterium
GVIWGIWLVIVGWLTLWPFLSWLTTHFVVTNRRV

SEQ ID NO: 357328 - protein, 35 aa, Mycobacterium
GVIWGVWLVIVGWLTLWPFLSWLTTHFVVTNRRVM

SEQ ID NO: 357329 - protein, 20 aa, Mycobacterium
GVIWKGLVSHVLIPAVVAAI

SEQ ID NO: 357330 - protein, 28 aa, Mycobacterium
GVIYDIALWMVPFGLIGGRLYHLATDWR

SEQ ID NO: 357331 - protein, 24 aa, Mycobacterium
GVIYTYILITYLPQTHSAIMSFLL

SEQ ID NO: 357332 - protein, 24 aa, Mycobacterium
GVKALIYFEAITTFALLFGLVVGN

SEQ ID NO: 357333 - protein, 20 aa, Mycobacterium
GVKVVIVMALLLIVMLIFAY

SEQ ID NO: 357334 - protein, 17 aa, Mycobacterium
GVLAFRSGAWRAAAVNL

SEQ ID NO: 357335 - protein, 24 aa, Mycobacterium
GVLAISVLAAMPWLVASGLGAAVP

SEQ ID NO: 357336 - protein, 19 aa, Mycobacterium
GVLAPIGIVLPMSVGAILM

SEQ ID NO: 357337 - protein, 18 aa, Mycobacterium
GVLASLCFMIGWGGVMLV

SEQ ID NO: 357338 - protein, 18 aa, Mycobacterium
GVLAYACAIGLKRLGKDV

SEQ ID NO: 357339 - protein, 28 aa, Mycobacterium
GVLAYACAIGLKRLGKDVAFVGLIDAVR

SEQ ID NO: 357340 - protein, 24 aa, Mycobacterium
GVLAYACAIGLKRLGKDVQWVGLI

SEQ ID NO: 357341 - protein, 22 aa, Mycobacterium
GVLCNMIAAWLTATSVRDLHSA

SEQ ID NO: 357342 - protein, 26 aa, Mycobacterium
GVLEGLRFFWNIKILRTIALVDMAIT

SEQ ID NO: 357343 - protein, 25 aa, Mycobacterium
GVLFALLLFGRWSDAIGRRPMLLAG

SEQ ID NO: 357344 - protein, 18 aa, Mycobacterium
GVLFCDIERFKSVNDRHG

SEQ ID NO: 357345 - protein, 22 aa, Mycobacterium
GVLGFFAFYLSFVAELPPPPPK

SEQ ID NO: 357346 - protein, 37 aa, Mycobacterium
GVLHHELEFWWELALLIVIMLLGHWFEMRSLAQTTSA

SEQ ID NO: 357347 - protein, 20 aa, Mycobacterium
GVLIGFVALYLLGSLAGFPQ

SEQ ID NO: 357348 - protein, 20 aa, Mycobacterium
GVLIIMVMVSWLLLAVFRGR

SEQ ID NO: 357349 - protein, 17 aa, Mycobacterium
GVLILLADDRPATLTGL

SEQ ID NO: 357350 - protein, 18 aa, Mycobacterium
GVLILMLFDRVQGPWLLG

SEQ ID NO: 357351 - protein, 29 aa, Mycobacterium
GVLILSLIVFGLIFADLPALYYPLSVATA

SEQ ID NO: 357352 - protein, 19 aa, Mycobacterium
GVLLCLLLGVAIVTQVRQN

SEQ ID NO: 357353 - protein, 21 aa, Mycobacterium
GVLLGLAITAAWPGGWWIDPG

SEQ ID NO: 357354 - protein, 23 aa, Mycobacterium
GVLLLLEVLFFRWLLDGNRNHEW

SEQ ID NO: 357355 - protein, 17 aa, Mycobacterium
GVLLSILADPRGWRPIK

SEQ ID NO: 357356 - protein, 32 aa, Mycobacterium
GVLMAAFYITCVIFIFGVLGALLWAVARVSIF

SEQ ID NO: 357357 - protein, 21 aa, Mycobacterium
GVLMLYTIVIIRGFRTALAVR

SEQ ID NO: 357358 - protein, 21 aa, Mycobacterium
GVLMTIPWAVISGFLFNVLLT

SEQ ID NO: 357359 - protein, 25 aa, Mycobacterium
GVLPLLPVLLMIWATARSTARATSP

SEQ ID NO: 357360 - protein, 23 aa, Mycobacterium
GVLQIIFGLSRMARAALAIAPVV

SEQ ID NO: 357361 - protein, 26 aa, Mycobacterium
GVLRHGILPWIALTVSMIPWLLLTTR

SEQ ID NO: 357362 - protein, 17 aa, Mycobacterium
GVLRVLLHKEPIATASD

SEQ ID NO: 357363 - protein, 31 aa, Mycobacterium
GVLSGAWLGLFIGLILGFFSPNPWSALLTGL

SEQ ID NO: 357364 - protein, 31 aa, Mycobacterium
GVLSGAWLGLFIGLVLGFFSPNPWGALVTGL

SEQ ID NO: 357365 - protein, 28 aa, Mycobacterium
GVLTAFGWRWVFFAPVVLASVVLLLAVP

SEQ ID NO: 357366 - protein, 20 aa, Mycobacterium
GVLTFQFALGQQLHWSVPPL

SEQ ID NO: 357367 - protein, 28 aa, Mycobacterium
GVLTGAWLGLFIGLILGFFSPNPWSALI

SEQ ID NO: 357368 - protein, 23 aa, Mycobacterium
GVLTIAAILALRFTGRRLSIYTA

SEQ ID NO: 357369 - protein, 24 aa, Mycobacterium
GVLTIIMGLVFVGLIPALQRQARF

SEQ ID NO: 357370 - protein, 24 aa, Mycobacterium
GVLTIVMGLVFVGLIPALQRQARF

SEQ ID NO: 357371 - protein, 34 aa, Mycobacterium
GVLTRVLQKAWIPLLLVVVLALSALVVSRLHKLF

SEQ ID NO: 357372 - protein, 19 aa, Mycobacterium
GVLVGFVALYLLGSLSGFP

SEQ ID NO: 357373 - protein, 25 aa, Mycobacterium
GVLVQFLDWRLVFASIAGLAALAAL

SEQ ID NO: 357374 - protein, 18 aa, Mycobacterium
GVLWIASRLGWVVIRSFD

SEQ ID NO: 357375 - protein, 21 aa, Mycobacterium
GVLYIDMRLVEGASLKDILRT

SEQ ID NO: 357376 - protein, 22 aa, Mycobacterium
GVLYIDMRLVEGASLKEVLRSD

SEQ ID NO: 357377 - protein, 26 aa, Mycobacterium
GVMGFGVYLVWPAFYTDVTDSYRLGR

SEQ ID NO: 357378 - protein, 25 aa, Mycobacterium
GVMPLLPVLLMIYGTARTTAAATTS

SEQ ID NO: 357379 - protein, 25 aa, Mycobacterium
GVMPLLPVLLMVWATARSTARATSP

SEQ ID NO: 357380 - protein, 20 aa, Mycobacterium
GVMSLMAMPFADWGNRTLPG

SEQ ID NO: 357381 - protein, 18 aa, Mycobacterium
GVMYSIPLRRALVTGSDL

SEQ ID NO: 357382 - protein, 24 aa, Mycobacterium
GVNFRDVLVALGMYPGGGELGVEG

SEQ ID NO: 357383 - protein, 27 aa, Mycobacterium
GVNFRDVLVALGMYPGGGQLGAEGAGV

SEQ ID NO: 357384 - protein, 24 aa, Mycobacterium
GVNFRDVLVVLGLYPGNKPTLGGE

SEQ ID NO: 357385 - protein, 22 aa, Mycobacterium
GVNHALAWSGIAAAAVFIVAVV

SEQ ID NO: 357386 - protein, 19 aa, Mycobacterium
GVNLPLILSALVLLAGVAV

SEQ ID NO: 357387 - protein, 27 aa, Mycobacterium
GVNPLNWPPAFFSWFAAGMLLAEWVHS

SEQ ID NO: 357388 - protein, 18 aa, Mycobacterium
GVPAPPPPPPSAAPPSET

SEQ ID NO: 357389 - protein, 24 aa, Mycobacterium
GVPAWPFVAAVTVIVAAGALWAVR

SEQ ID NO: 357390 - protein, 22 aa, Mycobacterium
GVPDDHLVAYLLGVGYPADRPL

SEQ ID NO: 357391 - protein, 24 aa, Mycobacterium
GVPFGRILLIKNLALLAIVGLPTL

SEQ ID NO: 357392 - protein, 28 aa, Mycobacterium
GVPIFFVLSGFLLFRPWVKAAATGAPAP

SEQ ID NO: 357393 - protein, 23 aa, Mycobacterium
GVPIFFVLSGYLLFRPWVKSGAT

SEQ ID NO: 357394 - protein, 18 aa, Mycobacterium
GVPKFERPGDATGAEART

SEQ ID NO: 357395 - protein, 18 aa, Mycobacterium
GVPKWKTIVSIVFPIAMP

SEQ ID NO: 357396 - protein, 17 aa, Mycobacterium
GVPMCWSLRSIFDALDG

SEQ ID NO: 357397 - protein, 25 aa, Mycobacterium
GVPPPPLNAPLPEPAPPAPPAPRVV

SEQ ID NO: 357398 - protein, 38 aa, Mycobacterium
GVPPVPPQLPYPKWLPPPAPPLGINPPPPGPGPEKPWG

SEQ ID NO: 357399 - protein, 26 aa, Mycobacterium
GVPPYVHMILLGLFTGGFWAASDDWL

SEQ ID NO: 357400 - protein, 34 aa, Mycobacterium
GVPQFAVFDWLFWLFSILIATLVSWLLFTWMIAR

SEQ ID NO: 357401 - protein, 20 aa, Mycobacterium
GVPRLKFWDHPLTAVLSIVV

SEQ ID NO: 357402 - protein, 23 aa, Mycobacterium
GVPRRDVPLVLRVYDRELGAAVA

SEQ ID NO: 357403 - protein, 25 aa, Mycobacterium
GVPSLLWVSLVVVGLVCAAALFALR

SEQ ID NO: 357404 - protein, 21 aa, Mycobacterium
GVPSVLLYRVLTCWLPVFLGW

SEQ ID NO: 357405 - protein, 18 aa, Mycobacterium
GVPVVLYIRQNRANITVT

SEQ ID NO: 357406 - protein, 17 aa, Mycobacterium
GVQATWLALGLGALVVI

SEQ ID NO: 357407 - protein, 30 aa, Mycobacterium
GVQIDHFVEVTLAAFFQIAKTVQPIAVCLN

SEQ ID NO: 357408 - protein, 27 aa, Mycobacterium
GVQLVVVLTAAWLLATPLTQSKDQPEL

SEQ ID NO: 357409 - protein, 29 aa, Mycobacterium
GVQPYKFLNFPYWWGFINGASFVTVGAIL

SEQ ID NO: 357410 - protein, 30 aa, Mycobacterium
GVRALRNRTLDVDLLMIVAAIGAATIGQVF

SEQ ID NO: 357411 - protein, 29 aa, Mycobacterium
GVRASALWLMRGWLPALVAVIAVCAVLTV

SEQ ID NO: 357412 - protein, 36 aa, Mycobacterium
GVRDVLFGGKVSFVALMVLGLIALVIGVAGGWVGRT

SEQ ID NO: 357413 - protein, 23 aa, Mycobacterium
GVRIVWVYGCTYLGRLFTKNHEP

SEQ ID NO: 357414 - protein, 20 aa, Mycobacterium
GVRLPPAASYRSFVTWLSER

SEQ ID NO: 357415 - protein, 18 aa, Mycobacterium
GVRPALRRRLTAGPVLHT

SEQ ID NO: 357416 - protein, 26 aa, Mycobacterium
GVRPVQLCRTVIAQAALIAGLGYILG

SEQ ID NO: 357417 - protein, 40 aa, Mycobacterium
GVRRGWSGMPVALRLLLPIAMVLTLVGIGFAFWVKSPRDD

SEQ ID NO: 357418 - protein, 23 aa, Mycobacterium
GVRRWEPLVFTAVDIVALTGFQL

SEQ ID NO: 357419 - protein, 30 aa, Mycobacterium
GVRSLSTGFFPLMGIGAFSMLAFSGRFGRA

SEQ ID NO: 357420 - protein, 26 aa, Mycobacterium
GVRTVQYFFFDLLTGRFQWQEFVRQG

SEQ ID NO: 357421 - protein, 24 aa, Mycobacterium
GVRVAWVVGTLVAAAYALLAVGCS

SEQ ID NO: 357422 - protein, 28 aa, Mycobacterium
GVSAWLITRAWQMPPVLDLSVAVVAVRT

SEQ ID NO: 357423 - protein, 28 aa, Mycobacterium
GVSDFPFIAWPPALPVAMWLLAVTSVIT

SEQ ID NO: 357424 - protein, 24 aa, Mycobacterium
GVSDFPFIAWPPALPVAMWVLAVA

SEQ ID NO: 357425 - protein, 25 aa, Mycobacterium
GVSFPRAMFWTVLGYVLVATVISFV

SEQ ID NO: 357426 - protein, 19 aa, Mycobacterium
GVSFTVIALLITMSAVLGL

SEQ ID NO: 357427 - protein, 22 aa, Mycobacterium
GVSIFRLVRYLAREYLLIFATS

SEQ ID NO: 357428 - protein, 26 aa, Mycobacterium
GVSKVTIYKWWPSKGALALDGYFAKV

SEQ ID NO: 357429 - protein, 24 aa, Mycobacterium
GVSLAVIVGAVPLLLRARKSAAQR

SEQ ID NO: 357430 - protein, 17 aa, Mycobacterium
GVSLLPKVKSYGAVVAV

SEQ ID NO: 357431 - protein, 22 aa, Mycobacterium
GVSLPMIAIFVLGTCTIKVMSV

SEQ ID NO: 357432 - protein, 26 aa, Mycobacterium
GVSLQQVFLLLLIPITIGALCMAIKA

SEQ ID NO: 357433 - protein, 26 aa, Mycobacterium
GVSLRTLLTQYGPLAPARAVAIVRQV

SEQ ID NO: 357434 - protein, 19 aa, Mycobacterium
GVSRKRWARLRTLMVISGP

SEQ ID NO: 357435 - protein, 23 aa, Mycobacterium
GVSSVVAALRQRAPRHEFVEPSA

SEQ ID NO: 357436 - protein, 18 aa, Mycobacterium
GVSSYARPLAGLATVLVI

SEQ ID NO: 357437 - protein, 25 aa, Mycobacterium
GVSTFIWHDLLGKDLHWAVQSMALI

SEQ ID NO: 357438 - protein, 24 aa, Mycobacterium
GVSVALVLAFVLRLRQLGYVLGSV

SEQ ID NO: 357439 - protein, 25 aa, Mycobacterium
GVSVRIWGFLTAVVIFTVAQSLLSP

SEQ ID NO: 357440 - protein, 25 aa, Mycobacterium
GVTALLYNFGFFTLLAFTPFPLDMG

SEQ ID NO: 357441 - protein, 26 aa, Mycobacterium
GVTESRRWWTLPVLGQHILVAGATGA

SEQ ID NO: 357442 - protein, 21 aa, Mycobacterium
GVTLLVLAGWLAYEAIRRLVH

SEQ ID NO: 357443 - protein, 24 aa, Mycobacterium
GVTLTVLWRSRWVRRAVAGAAVVM

SEQ ID NO: 357444 - protein, 25 aa, Mycobacterium
GVTPAYMLVALFFGTAWITSRTVRS

SEQ ID NO: 357445 - protein, 23 aa, Mycobacterium
GVTPNPRFPALFAGGDYVQGLPN

SEQ ID NO: 357446 - protein, 23 aa, Mycobacterium
GVTVILVALTFLPALALGPLAEG

SEQ ID NO: 357447 - protein, 28 aa, Mycobacterium
GVTVSAVFFVLFGIAALAAFWLHLRNKQ

SEQ ID NO: 357448 - protein, 27 aa, Mycobacterium
GVTVVLIAVLLFVVYRSVITAAIPLMT

SEQ ID NO: 357449 - protein, 19 aa, Mycobacterium
GVVAFLAYHKLIGISVFAS

SEQ ID NO: 357450 - protein, 17 aa, Mycobacterium
GVVAFRFALPANQPLAL

SEQ ID NO: 357451 - protein, 20 aa, Mycobacterium
GVVALDKWLRRRTASVVHVP

SEQ ID NO: 357452 - protein, 23 aa, Mycobacterium
GVVANAVWPIYYAAASDAAPEGA

SEQ ID NO: 357453 - protein, 24 aa, Mycobacterium
GVVAPLLLLLLRCLQGFSAGGEYG

SEQ ID NO: 357454 - protein, 31 aa, Mycobacterium
GVVAQRFWELPPRFWLYCGFTAITMSGFATF

SEQ ID NO: 357455 - protein, 25 aa, Mycobacterium
GVVEGLQFVWRTPVLRTLAIVDLVA

SEQ ID NO: 357456 - protein, 28 aa, Mycobacterium
GVVFFVVYYLMFRFAITKWNMRTPGREP

SEQ ID NO: 357457 - protein, 32 aa, Mycobacterium
GVVFPVIGWWLYDIFYITPFLAIPYLHTVNRE

SEQ ID NO: 357458 - protein, 18 aa, Mycobacterium
GVVFSLFLLAFAGIPLTS

SEQ ID NO: 357459 - protein, 27 aa, Mycobacterium
GVVIATLALIAIPLMLGTPVQVVLLRA

SEQ ID NO: 357460 - protein, 34 aa, Mycobacterium
GVVIGIIWMGRRLVSPWWALGLGLILGGATGNLV

SEQ ID NO: 357461 - protein, 21 aa, Mycobacterium
GVVILLYVLVAFVAVGNLSVV

SEQ ID NO: 357462 - protein, 17 aa, Mycobacterium
GVVLFFITQLINKQLGI

SEQ ID NO: 357463 - protein, 17 aa, Mycobacterium
GVVLIVLGAWLLSGREL

SEQ ID NO: 357464 - protein, 25 aa, Mycobacterium
GVVLLMLLLVYRSVITTIVALLIVG

SEQ ID NO: 357465 - protein, 24 aa, Mycobacterium
GVVLSILLFVPRAAKLKAAELVVT

SEQ ID NO: 357466 - protein, 23 aa, Mycobacterium
GVVLVALSIWLLCGRELTLVLPR

SEQ ID NO: 357467 - protein, 20 aa, Mycobacterium
GVVRLLLCVAYLVVVIGFVA

SEQ ID NO: 357468 - protein, 20 aa, Mycobacterium
GVVSRLNPALAVVAAVVCVA

SEQ ID NO: 357469 - protein, 28 aa, Mycobacterium
GVVSTLAYLLLFSLMRAGLGAQAANLIA

SEQ ID NO: 357470 - protein, 19 aa, Mycobacterium
GVVSVRLFGFTPGQLALGL

SEQ ID NO: 357471 - protein, 29 aa, Mycobacterium
GVVTFALTYLLVLIAVAAVLFVLGSMLFG

SEQ ID NO: 357472 - protein, 18 aa, Mycobacterium
GVVTFLLLPMLVVVWLSL

SEQ ID NO: 357473 - protein, 20 aa, Mycobacterium
GVVTLILALILKYTIGLRLG

SEQ ID NO: 357474 - protein, 20 aa, Mycobacterium
GVVTLILALILKYTIGLRLN

SEQ ID NO: 357475 - protein, 20 aa, Mycobacterium
GVVVFFIYGGILLGVLPGTF

SEQ ID NO: 357476 - protein, 26 aa, Mycobacterium
GVVVKALLMLGLWLAGWGAARLVAEV

SEQ ID NO: 357477 - protein, 26 aa, Mycobacterium
GVVVKALLVLGLWLAGWGAARLVATA

SEQ ID NO: 357478 - protein, 23 aa, Mycobacterium
GVVVLIICLLAQALSFGVLASRQ

SEQ ID NO: 357479 - protein, 27 aa, Mycobacterium
GVVVTYMYFILPLYVLLVLPAMSVLRA

SEQ ID NO: 357480 - protein, 18 aa, Mycobacterium
GVVWWVFGAGWAALLLVA

SEQ ID NO: 357481 - protein, 23 aa, Mycobacterium
GVWAFIGVLIVAFFLASAGASAA

SEQ ID NO: 357482 - protein, 24 aa, Mycobacterium
GVWAPILLVVLRFVQGFAVGGEWG

SEQ ID NO: 357483 - protein, 19 aa, Mycobacterium
GVWATFFLALLNTGETWAI

SEQ ID NO: 357484 - protein, 19 aa, Mycobacterium
GVWGLYVLAPVLKPVAVWL

SEQ ID NO: 357485 - protein, 29 aa, Mycobacterium
GVWILGRGVPIALLLIGGLLAARFINWSA

SEQ ID NO: 357486 - protein, 19 aa, Mycobacterium
GVWLQFAHMWVAAFMLVGL

SEQ ID NO: 357487 - protein, 20 aa, Mycobacterium
GVWLRRLASRSPLVRSTDRV

SEQ ID NO: 357488 - protein, 22 aa, Mycobacterium
GVWTFIIVLAVAFFLASAGASA

SEQ ID NO: 357489 - protein, 29 aa, Mycobacterium
GVWVALAMGLIFMLLGAYPFIEKKLTGDN

SEQ ID NO: 357490 - protein, 31 aa, Mycobacterium
GVYALVVAVLMLFSKLWLSRWERGPLEMLWQ

SEQ ID NO: 357491 - protein, 22 aa, Mycobacterium
GVYGFLAVYVGAAFFASEDPLV

SEQ ID NO: 357492 - protein, 36 aa, Mycobacterium
GVYIQRWWPGIPQWVTALVVLLILFGANLISVKIFG

SEQ ID NO: 357493 - protein, 26 aa, Mycobacterium
GVYLSQWFLLIMAFGSLMMTAGKRYA

SEQ ID NO: 357494 - protein, 25 aa, Mycobacterium
GVYPWARRLWGRKWAWMTGWVYMFT

SEQ ID NO: 357495 - protein, 18 aa, Mycobacterium
GVYTLVALTFVELPLASQ

SEQ ID NO: 357496 - protein, 19 aa, Mycobacterium
GVYVWTLPAARLRRIPVIR

SEQ ID NO: 357497 - protein, 18 aa, Mycobacterium
GWAELLGFARRFARQAYP

SEQ ID NO: 357498 - protein, 26 aa, Mycobacterium
GWAFLIWGLGMYLWTFVLYVAQIVMI

SEQ ID NO: 357499 - protein, 18 aa, Mycobacterium
GWAGWLRAPTTTDPTVKR

SEQ ID NO: 357500 - protein, 19 aa, Mycobacterium
GWALACSVPVVLAGAVIIH

SEQ ID NO: 357501 - protein, 20 aa, Mycobacterium
GWALRAIIAALLEWQRKSEL

SEQ ID NO: 357502 - protein, 17 aa, Mycobacterium
GWARRPFIGSFAAVVLG

SEQ ID NO: 357503 - protein, 20 aa, Mycobacterium
GWASFGLRIALVPLFVVEVL

SEQ ID NO: 357504 - protein, 24 aa, Mycobacterium
GWATDGLLAIFFFVVGVELKREFV

SEQ ID NO: 357505 - protein, 21 aa, Mycobacterium
GWDMRLSVATSLLTALVYVHF

SEQ ID NO: 357506 - protein, 26 aa, Mycobacterium
GWDPDWFKFFLGAMLLFAVIANNAFR

SEQ ID NO: 357507 - protein, 24 aa, Mycobacterium
GWEQLLILGIIGAAAGIGNFAGNM

SEQ ID NO: 357508 - protein, 25 aa, Mycobacterium
GWEVDPFAIPLLQIAHRTGGRVVLR

SEQ ID NO: 357509 - protein, 25 aa, Mycobacterium
GWEVDPYAIPLLQTAHRTGARVVLR

SEQ ID NO: 357510 - protein, 25 aa, Mycobacterium
GWFAGWAYMWTLLVTLTAVSYGGAL

SEQ ID NO: 357511 - protein, 18 aa, Mycobacterium
GWFALFPPTEFFSRLPSA

SEQ ID NO: 357512 - protein, 26 aa, Mycobacterium
GWFFDTELLILAERSGLRIHEVPVDW

SEQ ID NO: 357513 - protein, 18 aa, Mycobacterium
GWFFLFKQGNVSLAGGGT

SEQ ID NO: 357514 - protein, 18 aa, Mycobacterium
GWFLDWLMHRTKSLAAPL

SEQ ID NO: 357515 - protein, 59 aa, Mycobacterium
GWFTNRLLVPAVLIELAFSLIVMWVPPVARLLGQWNPPLWGWAVALASMPILLAVDALD

SEQ ID NO: 357516 - protein, 19 aa, Mycobacterium
GWFVSRRVDILFVFGLGAL

SEQ ID NO: 357517 - protein, 17 aa, Mycobacterium
GWGITWLGYAADYSRFV

SEQ ID NO: 357518 - protein, 21 aa, Mycobacterium
GWGLLGLFFSILTLIVVIVIP

SEQ ID NO: 357519 - protein, 19 aa, Mycobacterium
GWGLTAPFIVYGVALLGVA

SEQ ID NO: 357520 - protein, 20 aa, Mycobacterium
GWGRRRTLLLLIAGAILLAA

SEQ ID NO: 357521 - protein, 19 aa, Mycobacterium
GWHVYTGWAAGLFAATLAA

SEQ ID NO: 357522 - protein, 23 aa, Mycobacterium
GWKNYLWADLLMPFAGLARLGSI

SEQ ID NO: 357523 - protein, 20 aa, Mycobacterium
GWLAILSLRLIPAVPFAALN

SEQ ID NO: 357524 - protein, 20 aa, Mycobacterium
GWLAILSLRLIPAVPFSAIN

SEQ ID NO: 357525 - protein, 17 aa, Mycobacterium
GWLEALLGHFCDPTVAL

SEQ ID NO: 357526 - protein, 26 aa, Mycobacterium
GWLGFNGVFYGLLTWGPLFLSESKGF

SEQ ID NO: 357527 - protein, 20 aa, Mycobacterium
GWLGLYLLARDPRKPVLILA

SEQ ID NO: 357528 - protein, 21 aa, Mycobacterium
GWLGVAMPIWVLALGSYGLMT

SEQ ID NO: 357529 - protein, 33 aa, Mycobacterium
GWLIDRFGWEWIFWINLPIGLITVGLAAVVFPK

SEQ ID NO: 357530 - protein, 31 aa, Mycobacterium
GWLIDSFGWQWIFLINLPIGVLTLVLAVVTL

SEQ ID NO: 357531 - protein, 30 aa, Mycobacterium
GWLIDSYGWQWIFLINVPAGLLAFGLAAIL

SEQ ID NO: 357532 - protein, 30 aa, Mycobacterium
GWLIDSYSWQWIFWINLPVGVVAIGLAAIV

SEQ ID NO: 357533 - protein, 30 aa, Mycobacterium
GWLIDSYSWQWIFWVNLPVGVVAVGLAAVV

SEQ ID NO: 357534 - protein, 21 aa, Mycobacterium
GWLKLPTFDWPTNPSWLYRLT

SEQ ID NO: 357535 - protein, 34 aa, Mycobacterium
GWLLRRCTRLYRPVFYYLAFWTATLVVLRAILPV

SEQ ID NO: 357536 - protein, 24 aa, Mycobacterium
GWLLVIGVVLACAGLLWSDRITAE

SEQ ID NO: 357537 - protein, 22 aa, Mycobacterium
GWLMQRENVPLSPDPGPPLTLQ

SEQ ID NO: 357538 - protein, 17 aa, Mycobacterium
GWLPDWLRPVGSRRASA

SEQ ID NO: 357539 - protein, 22 aa, Mycobacterium
GWLRLPVFAWPTHPSWLYRLTQ

SEQ ID NO: 357540 - protein, 21 aa, Mycobacterium
GWLRVDPHPISPLRALGGVLM

SEQ ID NO: 357541 - protein, 17 aa, Mycobacterium
GWLTRPWEDLLAEAGKQ

SEQ ID NO: 357542 - protein, 32 aa, Mycobacterium
GWNLSMNHIIIPLPWLLQAPRLFAGQIQLGAV

SEQ ID NO: 357543 - protein, 26 aa, Mycobacterium
GWNPDWFKFFLGAMLLFAVVANNVVR

SEQ ID NO: 357544 - protein, 17 aa, Mycobacterium
GWPLRALAGLLALASLA

SEQ ID NO: 357545 - protein, 20 aa, Mycobacterium
GWPVLTFSRPVSLGDRIPVP

SEQ ID NO: 357546 - protein, 19 aa, Mycobacterium
GWQAAFIVAIIPAVVLFLA

SEQ ID NO: 357547 - protein, 21 aa, Mycobacterium
GWQGWQWMFVIEGIPAVLLAA

SEQ ID NO: 357548 - protein, 19 aa, Mycobacterium
GWRAVWYWMRYSSVVKKHT

SEQ ID NO: 357549 - protein, 33 aa, Mycobacterium
GWRGFVDHLLVITLIATITWTIASLVRVAERQA

SEQ ID NO: 357550 - protein, 24 aa, Mycobacterium
GWRHLKHFNGFVTSFWVTPSDISS

SEQ ID NO: 357551 - protein, 19 aa, Mycobacterium
GWRHLKHFNGYATSFWVTP

SEQ ID NO: 357552 - protein, 18 aa, Mycobacterium
GWRRWTATLTVLSAVAVL

SEQ ID NO: 357553 - protein, 18 aa, Mycobacterium
GWRSSTSLRWCSARWHWR

SEQ ID NO: 357554 - protein, 20 aa, Mycobacterium
GWRSTSPRWGLTDPTAHLAS

SEQ ID NO: 357555 - protein, 27 aa, Mycobacterium
GWSAFGLRIALVPLFIAEVFHRGPGIA

SEQ ID NO: 357556 - protein, 31 aa, Mycobacterium
GWSGVPVLFWINAVACALLALLAACCIPARE

SEQ ID NO: 357557 - protein, 17 aa, Mycobacterium
GWSLFNWIADVACLAFA

SEQ ID NO: 357558 - protein, 27 aa, Mycobacterium
GWSLGYLYFLVCLWVFRPPAPTVRAKA

SEQ ID NO: 357559 - protein, 20 aa, Mycobacterium
GWSLQTAASVPVVFLTAFYG

SEQ ID NO: 357560 - protein, 27 aa, Mycobacterium
GWSMSETFWLLAIWALFQAGIAFPAGK

SEQ ID NO: 357561 - protein, 20 aa, Mycobacterium
GWSWLFFRYHKLGAAAVGAA

SEQ ID NO: 357562 - protein, 30 aa, Mycobacterium
GWTQRVFYRLIHILDPLIALESLYRYVRKW

SEQ ID NO: 357563 - protein, 29 aa, Mycobacterium
GWTSFTLAVPRWPLLARLRGRHALVRAVD

SEQ ID NO: 357564 - protein, 34 aa, Mycobacterium
GWTSPLILTLLMTAAVGCALFLWLEGRSADPMMD

SEQ ID NO: 357565 - protein, 19 aa, Mycobacterium
GWVAILPTVIGAVCGIAAL

SEQ ID NO: 357566 - protein, 37 aa, Mycobacterium
GWVDHTLVLLLIAAITWLVASLVLVAERRAINQFGGG

SEQ ID NO: 357567 - protein, 26 aa, Mycobacterium
GWVHQHGIWPWAVALTLLVAGAFSVS

SEQ ID NO: 357568 - protein, 17 aa, Mycobacterium
GWVKPPHEVTARFWRRS

SEQ ID NO: 357569 - protein, 18 aa, Mycobacterium
GWVLLTVLTNVAVPSLEK

SEQ ID NO: 357570 - protein, 18 aa, Mycobacterium
GWVLLTVLVNVVVPSLEV

SEQ ID NO: 357571 - protein, 22 aa, Mycobacterium
GWVQLAMLGLIGAAAAIGNFAG

SEQ ID NO: 357572 - protein, 20 aa, Mycobacterium
GWVQLGMLGLIGAAAAIGNF

SEQ ID NO: 357573 - protein, 29 aa, Mycobacterium
GWVSAVNWFWLLAFAIAAIIWAVMSVRAR

SEQ ID NO: 357574 - protein, 34 aa, Mycobacterium
GWWTLILVAVFAVAIFVTYALFTGSLKSTVPVTL

SEQ ID NO: 357575 - protein, 25 aa, Mycobacterium
GWWTSPLFLCIWITGTSILMVSKIP

SEQ ID NO: 357576 - protein, 26 aa, Mycobacterium
GYAAAFLLISLLLCLAIALGADALGS

SEQ ID NO: 357577 - protein, 33 aa, Mycobacterium
GYAFLFGLAFYLPLLPWVGLLVGSVPWVALSAV

SEQ ID NO: 357578 - protein, 29 aa, Mycobacterium
GYALQWPMFAWFCIYAYRKFVRYEEVPPE

SEQ ID NO: 357579 - protein, 20 aa, Mycobacterium
GYARPAALLLPRGRSRGNGP

SEQ ID NO: 357580 - protein, 17 aa, Mycobacterium
GYAVVLLVAGRLGDRFG

SEQ ID NO: 357581 - protein, 21 aa, Mycobacterium
GYCAGWLPWFANIDRQMYFFY

SEQ ID NO: 357582 - protein, 27 aa, Mycobacterium
GYDETARWVPRLWRRDIKAGHFSPMSH

SEQ ID NO: 357583 - protein, 22 aa, Mycobacterium
GYDITFYPRWLLPAASGHELHH

SEQ ID NO: 357584 - protein, 22 aa, Mycobacterium
GYDRLVGPLPAVAIRTVWVVLR

SEQ ID NO: 357585 - protein, 26 aa, Mycobacterium
GYDVLPQTRWIPVVTFLQVTADMAVA

SEQ ID NO: 357586 - protein, 24 aa, Mycobacterium
GYETVVAALAWTLALLPQNPQAQR

SEQ ID NO: 357587 - protein, 29 aa, Mycobacterium
GYEWDPYPFILLNLAFSTQAAYAAPLILL

SEQ ID NO: 357588 - protein, 28 aa, Mycobacterium
GYFGHRLPAAAPYRNFVNWLATQDATAA

SEQ ID NO: 357589 - protein, 17 aa, Mycobacterium
GYFLLRLFNYTLSSVAA

SEQ ID NO: 357590 - protein, 22 aa, Mycobacterium
GYFMGWSYWFAWIVAGIADLVA

SEQ ID NO: 357591 - protein, 25 aa, Mycobacterium
GYFTTRLLERLPTSSYRRPLLGTGL

SEQ ID NO: 357592 - protein, 18 aa, Mycobacterium
GYFTTRLLERLPVSSYRR

SEQ ID NO: 357593 - protein, 36 aa, Mycobacterium
GYGDFSFLHQPTWLRLFSIMLMFAGVTTTALLVAFI

SEQ ID NO: 357594 - protein, 19 aa, Mycobacterium
GYGFPARLWRTLDAHPPPG

SEQ ID NO: 357595 - protein, 33 aa, Mycobacterium
GYGLLFGLAFYVPLLPWISGLVGAVPWLALSVV

SEQ ID NO: 357596 - protein, 18 aa, Mycobacterium
GYGLTLGAGYLGGTLVFA

SEQ ID NO: 357597 - protein, 22 aa, Mycobacterium
GYGTPISIAVPAYWSDEQFAAL

SEQ ID NO: 357598 - protein, 23 aa, Mycobacterium
GYGYGPAFRGLRAAWRRGREIYA

SEQ ID NO: 357599 - protein, 19 aa, Mycobacterium
GYIAYFVLPAVIGAALGRR

SEQ ID NO: 357600 - protein, 42 aa, Mycobacterium
GYILASLHWYTWVAFSGWVVLALVFYFVWGRHHSALNDETVG

SEQ ID NO: 357601 - protein, 37 aa, Mycobacterium
GYINPRLAFGYPSRHWWLVWMFAGVFAASLAALAASA

SEQ ID NO: 357602 - protein, 19 aa, Mycobacterium
GYLAGPLGLAAWAIGLVLG

SEQ ID NO: 357603 - protein, 18 aa, Mycobacterium
GYLAIIGVPPFAGFFSKD

SEQ ID NO: 357604 - protein, 17 aa, Mycobacterium
GYLAIIGVPPFAGYFSK

SEQ ID NO: 357605 - protein, 17 aa, Mycobacterium
GYLIGVAALLVLLGGVQ

SEQ ID NO: 357606 - protein, 19 aa, Mycobacterium
GYLMWWRRRPTKSGRWPVP

SEQ ID NO: 357607 - protein, 23 aa, Mycobacterium
GYLPTMRKVILPQAIRTMIPSYI

SEQ ID NO: 357608 - protein, 19 aa, Mycobacterium
GYLQGRLARYEIPTRITIV

SEQ ID NO: 357609 - protein, 21 aa, Mycobacterium
GYLSWVPVILNAASSPAVVLQ

SEQ ID NO: 357610 - protein, 36 aa, Mycobacterium
GYNLPLELVLTVVPFLIIAVLFYFTVVVQNKVMHKD

SEQ ID NO: 357611 - protein, 25 aa, Mycobacterium
GYPARLVVPGLYGYVSATKWVVDLE

SEQ ID NO: 357612 - protein, 26 aa, Mycobacterium
GYPARLVVPGLYGYVSATKWVVDMEL

SEQ ID NO: 357613 - protein, 24 aa, Mycobacterium
GYPDEMIYCIWALTMIIPAVFALR

SEQ ID NO: 357614 - protein, 32 aa, Mycobacterium
GYPGPVMTLFSFLFAALWLSCLAIFNTRSQHV

SEQ ID NO: 357615 - protein, 21 aa, Mycobacterium
GYPLAFALCGLFPLAAAPLVP

SEQ ID NO: 357616 - protein, 25 aa, Mycobacterium
GYRDGYGEVFLLIDNLYAFSRDNTD

SEQ ID NO: 357617 - protein, 25 aa, Mycobacterium
GYRGPVRPRFWLTVPVDAGTAGRTP

SEQ ID NO: 357618 - protein, 21 aa, Mycobacterium
GYRLRPIRTIALAAAVTMAAL

SEQ ID NO: 357619 - protein, 19 aa, Mycobacterium
GYRQFTAEFLQAAALRPGN

SEQ ID NO: 357620 - protein, 20 aa, Mycobacterium
GYRSRFLPLFIRLIERIQNR

SEQ ID NO: 357621 - protein, 24 aa, Mycobacterium
GYSGWWWLVAGVCAGAVIGYYAGV

SEQ ID NO: 357622 - protein, 22 aa, Mycobacterium
GYSKFWWPDVPTWAPALVTIAV

SEQ ID NO: 357623 - protein, 22 aa, Mycobacterium
GYSLQRFMPFLNGIYATGQDIV

SEQ ID NO: 357624 - protein, 27 aa, Mycobacterium
GYSSVRTLVWQRWPTTGLAPPATSAAE

SEQ ID NO: 357625 - protein, 26 aa, Mycobacterium
GYSVERLLVRWIELGLGLVLVLILVA

SEQ ID NO: 357626 - protein, 25 aa, Mycobacterium
GYSVGVWVFFLLSLALFVGFFVRMI

SEQ ID NO: 357627 - protein, 25 aa, Mycobacterium
GYTASYLRFVWTLAATAVVVCYGLW

SEQ ID NO: 357628 - protein, 26 aa, Mycobacterium
GYTEFLIAMPILGFGLFGALSGTFIY

SEQ ID NO: 357629 - protein, 27 aa, Mycobacterium
GYTGHSWWIQLLALISVASVALAAVRL

SEQ ID NO: 357630 - protein, 24 aa, Mycobacterium
GYTNFLILTMVLMGLSSMALASLK

SEQ ID NO: 357631 - protein, 19 aa, Mycobacterium
GYTVPTLWSGSLSDSTLIT

SEQ ID NO: 357632 - protein, 19 aa, Mycobacterium
GYVHSLLVAWLVDKLARSP

SEQ ID NO: 357633 - protein, 17 aa, Mycobacterium
GYVIGYGGFMLLGGRTA

SEQ ID NO: 357634 - protein, 18 aa, Mycobacterium
GYVIVALFIVTWAAAALG

SEQ ID NO: 357635 - protein, 20 aa, Mycobacterium
GYVNLPAVILIGLCALLLIR

SEQ ID NO: 357636 - protein, 28 aa, Mycobacterium
GYVNSVALLVWVFPVGNLTALTTRVGMH

SEQ ID NO: 357637 - protein, 38 aa, Mycobacterium
GYVSEDFLLLAAVALALVFLIVLVMLRSPVAAAVVIGT

SEQ ID NO: 357638 - protein, 26 aa, Mycobacterium
GYVVIASVGLWWFIRRQISRQRRGIE

SEQ ID NO: 357639 - protein, 22 aa, Mycobacterium
GYWTPETLGELLARGLDSAPGA

SEQ ID NO: 357640 - protein, 19 aa, Mycobacterium
GYYAGVYVWTLPAARLRRI

SEQ ID NO: 357641 - protein, 20 aa, Mycobacterium
GYYPLILTAFLLLTSIIIVG

SEQ ID NO: 357642 - protein, 23 aa, Mycobacterium
GYYSTMLFPFLMTVVLPNSVLRN

SEQ ID NO: 357643 - protein, 24 aa, Mycobacterium
HAAAIIGLLMLVAGGLMALAPNLE

SEQ ID NO: 357644 - protein, 24 aa, Mycobacterium
HAAFVGIYALIRKAAEKARRHGFS

SEQ ID NO: 357645 - protein, 26 aa, Mycobacterium
HAAGWMPWIWVMIVAGVGFLAVFVYW

SEQ ID NO: 357646 - protein, 33 aa, Mycobacterium
HAAILPPSVFSPGPLKWIYLTMGVLMGAAMVNT

SEQ ID NO: 357647 - protein, 22 aa, Mycobacterium
HAALPWLRVAILAAPAILVSMA

SEQ ID NO: 357648 - protein, 24 aa, Mycobacterium
HAAPHWDWLKWLPHSQHPSAFDGV

SEQ ID NO: 357649 - protein, 30 aa, Mycobacterium
HAASLAGRFLVFQLLVVAVVLGAVAAISVA

SEQ ID NO: 357650 - protein, 20 aa, Mycobacterium
HACKLWPLVFARLAATVVIF

SEQ ID NO: 357651 - protein, 26 aa, Mycobacterium
HADDCGVVLGWPDGLRLAVDNLVRNA

SEQ ID NO: 357652 - protein, 26 aa, Mycobacterium
HADDDVGLVLGWPGGLRIAVDNLVRN

SEQ ID NO: 357653 - protein, 18 aa, Mycobacterium
HADLRVAHPLIDRAHLLL

SEQ ID NO: 357654 - protein, 34 aa, Mycobacterium
HADVRITHPLVSRIHLIIRFVDGKWIAEDQRSLN

SEQ ID NO: 357655 - protein, 19 aa, Mycobacterium
HAELNSVALLLYTASLRAR

SEQ ID NO: 357656 - protein, 23 aa, Mycobacterium
HAELWMAALIFPAFTAGAAIGNM

SEQ ID NO: 357657 - protein, 21 aa, Mycobacterium
HAEPLLKRTWGPEGLRIAQAV

SEQ ID NO: 357658 - protein, 28 aa, Mycobacterium
HAFDNWLVSILVWISPWAAIMLVDYVVL

SEQ ID NO: 357659 - protein, 18 aa, Mycobacterium
HAFLLVAVMLGLSATLVP

SEQ ID NO: 357660 - protein, 17 aa, Mycobacterium
HAFRKPHVRLETTSIAR

SEQ ID NO: 357661 - protein, 29 aa, Mycobacterium
HAGESFIDTLWLPGLFLIVLGVIGLAGIV

SEQ ID NO: 357662 - protein, 23 aa, Mycobacterium
HAGLAVPRPLPALIADAAAHTEP

SEQ ID NO: 357663 - protein, 25 aa, Mycobacterium
HAGSTSCLLALLPQVRHLLQPGTAA

SEQ ID NO: 357664 - protein, 27 aa, Mycobacterium
HAGVHEILLIAFALAWAQHLGTGAAPI

SEQ ID NO: 357665 - protein, 24 aa, Mycobacterium
HAHSSLLIAYLALVVGLGFGLLAV

SEQ ID NO: 357666 - protein, 17 aa, Mycobacterium
HALGYLHATIAMFLGST

SEQ ID NO: 357667 - protein, 22 aa, Mycobacterium
HALLLHFVVVLVPLTAVLEVVC

SEQ ID NO: 357668 - protein, 18 aa, Mycobacterium
HALLYYPSVFHALAAVFC

SEQ ID NO: 357669 - protein, 23 aa, Mycobacterium
HALSALNFMLPAGELFFVEVFGR

SEQ ID NO: 357670 - protein, 25 aa, Mycobacterium
HAMSPADFLQRPSAWLRLISQVRAT

SEQ ID NO: 357671 - protein, 20 aa, Mycobacterium
HANPGALWWSLALGTDFGGN

SEQ ID NO: 357672 - protein, 19 aa, Mycobacterium
HANRELWIGSVIAAFVVGG

SEQ ID NO: 357673 - protein, 18 aa, Mycobacterium
HAPDGPISDLWRLYQRIY

SEQ ID NO: 357674 - protein, 23 aa, Mycobacterium
HAPGRQRKPWRGVLLTLAAVTVI

SEQ ID NO: 357675 - protein, 42 aa, Mycobacterium
HAPLWRHFIHFWTVSFPVVAYRSWRWWLGATLGSMAVAVAVG

SEQ ID NO: 357676 - protein, 23 aa, Mycobacterium
HAPWPLNLWHGANAGWWPVLWFT

SEQ ID NO: 357677 - protein, 25 aa, Mycobacterium
HAQRYRLCMIVGVQPLRAAPIFDDA

SEQ ID NO: 357678 - protein, 27 aa, Mycobacterium
HAQVWQVNWIYPVSWHYAFDIILRQYF

SEQ ID NO: 357679 - protein, 22 aa, Mycobacterium
HARARLVIMPSFDLGDFLGNIA

SEQ ID NO: 357680 - protein, 32 aa, Mycobacterium
HARSLHFVVLVYFLFFILVHVTMVLTTNALRN

SEQ ID NO: 357681 - protein, 29 aa, Mycobacterium
HASARKLLSAFKVPTVWLLLHSGDDVPRG

SEQ ID NO: 357682 - protein, 20 aa, Mycobacterium
HASGRMLFGAELWEWVNPNN

SEQ ID NO: 357683 - protein, 26 aa, Mycobacterium
HASHMLMIGYFLLSGALFFTAVGGVE

SEQ ID NO: 357684 - protein, 18 aa, Mycobacterium
HASREAELLALFAGSVLR

SEQ ID NO: 357685 - protein, 29 aa, Mycobacterium
HATPDKLFNPILLLALAALAIGSASTLLV

SEQ ID NO: 357686 - protein, 29 aa, Mycobacterium
HATPEKLFTPILLLALAALGIGFVSTLLV

SEQ ID NO: 357687 - protein, 25 aa, Mycobacterium
HATRGLGLSMFVLCSSIAGVVGAPG

SEQ ID NO: 357688 - protein, 29 aa, Mycobacterium
HATRRRRRRWPQALLAAGAITFVASASAA

SEQ ID NO: 357689 - protein, 18 aa, Mycobacterium
HATTYLRPQPGVGRVVLR

SEQ ID NO: 357690 - protein, 43 aa, Mycobacterium
HATYRTMLMHLMRLAGSLGFLPIGGWALRAIVAALLEWQRKSE

SEQ ID NO: 357691 - protein, 19 aa, Mycobacterium
HAVLTVPAPYLLVALAVAA

SEQ ID NO: 357692 - protein, 32 aa, Mycobacterium
HAVVAPGLAWLPLFVVFGVLTGLLGAAYNVVV

SEQ ID NO: 357693 - protein, 21 aa, Mycobacterium
HAYPRTGSVVVWYSPRRCDRS

SEQ ID NO: 357694 - protein, 29 aa, Mycobacterium
HCGYRTPVMFLLWVLIPTAASVAVTLLFW

SEQ ID NO: 357695 - protein, 19 aa, Mycobacterium
HCWRGNGRAWIEVRGLADA

SEQ ID NO: 357696 - protein, 23 aa, Mycobacterium
HCYDIPICLSLRSIFDALDGVDK

SEQ ID NO: 357697 - protein, 18 aa, Mycobacterium
HCYDIPICWSIRSLFDSL

SEQ ID NO: 357698 - protein, 21 aa, Mycobacterium
HCYDIPICWSLRSIFDTLDGI

SEQ ID NO: 357699 - protein, 24 aa, Mycobacterium
HDAPLRALLKWLGIPQFGVLDWFF

SEQ ID NO: 357700 - protein, 17 aa, Mycobacterium
HDAVRVYPDLNVTLRPS

SEQ ID NO: 357701 - protein, 24 aa, Mycobacterium
HDCPKLLQLRTFPTIAIGGARPGA

SEQ ID NO: 357702 - protein, 24 aa, Mycobacterium
HDCPKLLQLRTFPTIAVGGDTDGA

SEQ ID NO: 357703 - protein, 26 aa, Mycobacterium
HDDLLHSMLQISPIFFREAANLTGEG

SEQ ID NO: 357704 - protein, 24 aa, Mycobacterium
HDDWAWLKVTLVISGIALAMGALL

SEQ ID NO: 357705 - protein, 25 aa, Mycobacterium
HDFRGPLIVSLLLVALETGAGLLPP

SEQ ID NO: 357706 - protein, 19 aa, Mycobacterium
HDFWRGHIGEWIITRGLRV

SEQ ID NO: 357707 - protein, 35 aa, Mycobacterium
HDGGQRWRQWWASHPGLGLTLLAGGGALVFLSGYV

SEQ ID NO: 357708 - protein, 25 aa, Mycobacterium
HDGTIRLWNLNTVLPVRGHTGPVRS

SEQ ID NO: 357709 - protein, 24 aa, Mycobacterium
HDGTWRPFLLSFAISYGVGLTVNL

SEQ ID NO: 357710 - protein, 25 aa, Mycobacterium
HDHKLLHRDVKPANILIAAPASQAK

SEQ ID NO: 357711 - protein, 20 aa, Mycobacterium
HDLPPIPTLFVVADEFTLML

SEQ ID NO: 357712 - protein, 32 aa, Mycobacterium
HDMTYPDMPPFYPAGWFWIGGRLAALTGTSGW

SEQ ID NO: 357713 - protein, 25 aa, Mycobacterium
HDPDLVWRLILAGLAQIPALLVVCG

SEQ ID NO: 357714 - protein, 17 aa, Mycobacterium
HDPFIDLRFFRSVPFAS

SEQ ID NO: 357715 - protein, 17 aa, Mycobacterium
HDPRFLLGLAVYLCGFT

SEQ ID NO: 357716 - protein, 24 aa, Mycobacterium
HDPSNFWTGWILQLAAIFFAVAVT

SEQ ID NO: 357717 - protein, 27 aa, Mycobacterium
HDQTGLLYFWVPIVGPLIGALVGAAAY

SEQ ID NO: 357718 - protein, 22 aa, Mycobacterium
HDRAEALVVRLAEQGLRVLAVA

SEQ ID NO: 357719 - protein, 34 aa, Mycobacterium
HDRRVLIPAILMVILLVLYALLRAALAPPTLLAA

SEQ ID NO: 357720 - protein, 30 aa, Mycobacterium
HDRVLLIPAILAVILVVLYALLRSALAPPT

SEQ ID NO: 357721 - protein, 38 aa, Mycobacterium
HDSKGSNLHWLLDDYYEVPYLSLVPVAGENIIVAGRCL

SEQ ID NO: 357722 - protein, 30 aa, Mycobacterium
HDTATQAPLLLLFGPMLASLVLIAAGAILD

SEQ ID NO: 357723 - protein, 20 aa, Mycobacterium
HDTWWLVLGKALAIFVFLML

SEQ ID NO: 357724 - protein, 27 aa, Mycobacterium
HDVDYWKKGLRHSVYFTHGIRNAVDSG

SEQ ID NO: 357725 - protein, 25 aa, Mycobacterium
HDVDYWKKGLRHSVYFTHGVRNAVD

SEQ ID NO: 357726 - protein, 27 aa, Mycobacterium
HDVEYWKKGLRHSVYFTHGIRNAVDNG

SEQ ID NO: 357727 - protein, 32 aa, Mycobacterium
HDWPFAAQAFATALPWLAFTLGTPAAEPVQLP

SEQ ID NO: 357728 - protein, 17 aa, Mycobacterium
HDYGEIDGLLFVDMRMI

SEQ ID NO: 357729 - protein, 25 aa, Mycobacterium
HEAPYWVCAIYLVLLAIGGIGAALF

SEQ ID NO: 357730 - protein, 26 aa, Mycobacterium
HEEPAQPPQPWWPSALGYGALGVVVG

SEQ ID NO: 357731 - protein, 17 aa, Mycobacterium
HEGLTYRFPFDTEKKTY

SEQ ID NO: 357732 - protein, 21 aa, Mycobacterium
HEGRIWGLVYSPDGRHIASAS

SEQ ID NO: 357733 - protein, 30 aa, Mycobacterium
HEILGIDGWRWLLILGGLAAVFVLAVRSML

SEQ ID NO: 357734 - protein, 36 aa, Mycobacterium
HEMPKTRRPPTRSQITFGVLGVALCALLGLAITTQV

SEQ ID NO: 357735 - protein, 21 aa, Mycobacterium
HEMPQLIAAYTWLDTHRNSNR

SEQ ID NO: 357736 - protein, 30 aa, Mycobacterium
HERRPFALLASIMGSIFIIGVGALAVSLAV

SEQ ID NO: 357737 - protein, 24 aa, Mycobacterium
HERTHSFWLPLTTAVIVRPEYASV

SEQ ID NO: 357738 - protein, 30 aa, Mycobacterium
HESKVKMVFWIIVLLLIGGPFIDPDRDPWG

SEQ ID NO: 357739 - protein, 24 aa, Mycobacterium
HETMFISQLPYLPLGNLRDALSYP

SEQ ID NO: 357740 - protein, 25 aa, Mycobacterium
HEVPALSALGLTMTGPRPGGFGALD

SEQ ID NO: 357741 - protein, 22 aa, Mycobacterium
HEVWTRLIAMIAFSAVAGVTIA

SEQ ID NO: 357742 - protein, 27 aa, Mycobacterium
HFESILIRGLMNYTFWMPNGSPEYRYC

SEQ ID NO: 357743 - protein, 28 aa, Mycobacterium
HFESILVRGLMNYTFWMPNGSPEYRYCL

SEQ ID NO: 357744 - protein, 20 aa, Mycobacterium
HFESVLIRGLMGYAFWVPNG

SEQ ID NO: 357745 - protein, 19 aa, Mycobacterium
HFFVAPALMLGLLTVLAVV

SEQ ID NO: 357746 - protein, 19 aa, Mycobacterium
HFGLIPLSSFAVNVVVALT

SEQ ID NO: 357747 - protein, 31 aa, Mycobacterium
HFGRRSISLGWLLLVLPACTLSYFGQGALVL

SEQ ID NO: 357748 - protein, 31 aa, Mycobacterium
HFIQHPQPWFFWPTRPVWLYRLTQGLHVISG

SEQ ID NO: 357749 - protein, 19 aa, Mycobacterium
HFLAGLNWPTAFLVGAILS

SEQ ID NO: 357750 - protein, 18 aa, Mycobacterium
HFLLSGYLFYWVVIGVDP

SEQ ID NO: 357751 - protein, 27 aa, Mycobacterium
HFPLSQSIPEYILIQSPRDLRTPQALA

SEQ ID NO: 357752 - protein, 26 aa, Mycobacterium
HFSWPTTLHMTLVVIALIITIHNVST

SEQ ID NO: 357753 - protein, 17 aa, Mycobacterium
HFTPILLLAFSIGALNT

SEQ ID NO: 357754 - protein, 29 aa, Mycobacterium
HFVDAIICFIGFLFPLWDAKRQTLADKIM

SEQ ID NO: 357755 - protein, 29 aa, Mycobacterium
HFVDAIICFIGFLFPLWDSKRQTLADKIM

SEQ ID NO: 357756 - protein, 30 aa, Mycobacterium
HFVDAIICYVGFLFPLWDAKRQTLADKIMT

SEQ ID NO: 357757 - protein, 22 aa, Mycobacterium
HFVSYTFIVELIRNVLGVRGPN

SEQ ID NO: 357758 - protein, 27 aa, Mycobacterium
HGAAIPLLLVVLMYLGFAATGSVLAGQ

SEQ ID NO: 357759 - protein, 23 aa, Mycobacterium
HGAFITFLRYLSFGGMFIGLSVY

SEQ ID NO: 357760 - protein, 22 aa, Mycobacterium
HGAGWFLLALSLFCLAFPGAAL

SEQ ID NO: 357761 - protein, 26 aa, Mycobacterium
HGAWCWDEHFLDFFADRGHLAVALSL

SEQ ID NO: 357762 - protein, 22 aa, Mycobacterium
HGAWPWVAALAMLTLGGLAGAW

SEQ ID NO: 357763 - protein, 24 aa, Mycobacterium
HGDPRLIVCYYLALSVLTFGAACV

SEQ ID NO: 357764 - protein, 22 aa, Mycobacterium
HGDVVVSLPPPGPYFVDASGTE

SEQ ID NO: 357765 - protein, 24 aa, Mycobacterium
HGEPLPNYGPWQPDAQPPAQAPVQ

SEQ ID NO: 357766 - protein, 28 aa, Mycobacterium
HGEPLPWQDLRAAFTERGWLDLTHNRRE

SEQ ID NO: 357767 - protein, 26 aa, Mycobacterium
HGGELVCLPHQGGARFRLTLPLAVAG

SEQ ID NO: 357768 - protein, 25 aa, Mycobacterium
HGGHGGLFLGTGGDGGAGAAGVAGV

SEQ ID NO: 357769 - protein, 23 aa, Mycobacterium
HGGIPIPRILALGLLMGVLSNVI

SEQ ID NO: 357770 - protein, 22 aa, Mycobacterium
HGGMGWIYLALDRNVNDRPVVL

SEQ ID NO: 357771 - protein, 20 aa, Mycobacterium
HGHTVFRVRLPMMDRPGTDI

SEQ ID NO: 357772 - protein, 32 aa, Mycobacterium
HGHVNDALVAALYLALRRWLHTRGVGADTLLV

SEQ ID NO: 357773 - protein, 27 aa, Mycobacterium
HGIGSLHQWLNLTLAVGGGLVVLGVVV

SEQ ID NO: 357774 - protein, 20 aa, Mycobacterium
HGIVSALHRPVPLSGDGSDT

SEQ ID NO: 357775 - protein, 23 aa, Mycobacterium
HGLDYLIATVILAGLLQLVLGGL

SEQ ID NO: 357776 - protein, 25 aa, Mycobacterium
HGLHVADFLFVPPQALPKTTSGKIS

SEQ ID NO: 357777 - protein, 22 aa, Mycobacterium
HGLLAALAPFGAAASLLFVVVF

SEQ ID NO: 357778 - protein, 28 aa, Mycobacterium
HGLLGVVNFALLMWLIPDELGDEAWVPR

SEQ ID NO: 357779 - protein, 17 aa, Mycobacterium
HGLLISVVLGLAGAIGQ

SEQ ID NO: 357780 - protein, 20 aa, Mycobacterium
HGLMMLAMAWMYVSMNIHLV

SEQ ID NO: 357781 - protein, 34 aa, Mycobacterium
HGLPLRAMVMVLLFLGVIFLLVGFNALGSDKSAS

SEQ ID NO: 357782 - protein, 28 aa, Mycobacterium
HGPGAAVPPLLLGLAAGVFFVWWEQHTD

SEQ ID NO: 357783 - protein, 36 aa, Mycobacterium
HGPHRSFIPRMIRLFAVPIILGWIALIVVVNVTVPQ

SEQ ID NO: 357784 - protein, 25 aa, Mycobacterium
HGPLPRQIYWRRRALAAGIAALVIA

SEQ ID NO: 357785 - protein, 22 aa, Mycobacterium
HGPMRLVALGCAVACAGLGPVW

SEQ ID NO: 357786 - protein, 17 aa, Mycobacterium
HGPTQPDYGAPAGWHAP

SEQ ID NO: 357787 - protein, 17 aa, Mycobacterium
HGPTQPDYGAPAGWRAP

SEQ ID NO: 357788 - protein, 25 aa, Mycobacterium
HGQVWQVGWIYPVSWHYAFDIILRQ

SEQ ID NO: 357789 - protein, 18 aa, Mycobacterium
HGRLMNRTVLRRAFGLLG

SEQ ID NO: 357790 - protein, 36 aa, Mycobacterium
HGRPFRRRNPRPAIIVVILLVVLTGVVWTVALTRPP

SEQ ID NO: 357791 - protein, 25 aa, Mycobacterium
HGRPTLADLYLFAALLVCAAGYAEG

SEQ ID NO: 357792 - protein, 24 aa, Mycobacterium
HGRQPLLAGLLTLAGATAPAQGLA

SEQ ID NO: 357793 - protein, 25 aa, Mycobacterium
HGSAQVLLVFTWATAAAALTGWLAR

SEQ ID NO: 357794 - protein, 24 aa, Mycobacterium
HGSHIFWLLGAWVLFQAAVAFPAG

SEQ ID NO: 357795 - protein, 20 aa, Mycobacterium
HGVDRWRAAILTATVSAFIA

SEQ ID NO: 357796 - protein, 17 aa, Mycobacterium
HGVLIGLALAIALTGWR

SEQ ID NO: 357797 - protein, 25 aa, Mycobacterium
HGVSRTWRLLAVGAVAGLLVGELVW

SEQ ID NO: 357798 - protein, 17 aa, Mycobacterium
HGWRWASLIVAAAALAV

SEQ ID NO: 357799 - protein, 28 aa, Mycobacterium
HGYALQEFWPTWLFAVTVSVGGPLSYAP

SEQ ID NO: 357800 - protein, 30 aa, Mycobacterium
HGYLPPDTALWPWLAACIAAVAPLSLLATV

SEQ ID NO: 357801 - protein, 26 aa, Mycobacterium
HGYPARLVVPGLYGYVSATKWVVDLE

SEQ ID NO: 357802 - protein, 21 aa, Mycobacterium
HGYTYGLLWVAGAAVIVGGAA

SEQ ID NO: 357803 - protein, 21 aa, Mycobacterium
HGYTYGLLWVAGVAVIVGGAA

SEQ ID NO: 357804 - protein, 17 aa, Mycobacterium
HGYYIGYKFQRGLERVD

SEQ ID NO: 357805 - protein, 19 aa, Mycobacterium
HHEALLFFAFSGVGVLLSM

SEQ ID NO: 357806 - protein, 22 aa, Mycobacterium
HHEALLFFAFSGVGVLLSMAPL

SEQ ID NO: 357807 - protein, 33 aa, Mycobacterium
HHIVIDGWSLPILLQEIFAGYFGHRLPAAAPYR

SEQ ID NO: 357808 - protein, 31 aa, Mycobacterium
HHIVLDGWSLPILLQEIFAAYRGQRLPAATP

SEQ ID NO: 357809 - protein, 32 aa, Mycobacterium
HHIVRLVVFAGFLLGLWYLVAVARVVDVEVMR

SEQ ID NO: 357810 - protein, 24 aa, Mycobacterium
HHIYRAMVALALLASLIAAAFGML

SEQ ID NO: 357811 - protein, 24 aa, Mycobacterium
HHIYRGAIGLALLAALIAAAFGML

SEQ ID NO: 357812 - protein, 23 aa, Mycobacterium
HHLIGLIWGITIGLAAAHFFAFK

SEQ ID NO: 357813 - protein, 17 aa, Mycobacterium
HHNLLSRLYTGTGAFEV

SEQ ID NO: 357814 - protein, 28 aa, Mycobacterium
HHNTAITALAFVAILLASINVFGGFAVT

SEQ ID NO: 357815 - protein, 25 aa, Mycobacterium
HHRGGRLLPLHLIAAGLAAAAIAAG

SEQ ID NO: 357816 - protein, 28 aa, Mycobacterium
HHRITRWEWMWAVALAAALAVVIIVGDP

SEQ ID NO: 357817 - protein, 18 aa, Mycobacterium
HHRWFLAIPRRRKARLGN

SEQ ID NO: 357818 - protein, 26 aa, Mycobacterium
HHTTGAWLLDMAMLGLLSTVYAGFVL

SEQ ID NO: 357819 - protein, 24 aa, Mycobacterium
HHVLQSSWVQLLPSRKEGWGLAVV

SEQ ID NO: 357820 - protein, 20 aa, Mycobacterium
HHVRPRPIPQRWPSPTPSQP

SEQ ID NO: 357821 - protein, 23 aa, Mycobacterium
HHVRPRPIPQRWPSPTPSQPTTN

SEQ ID NO: 357822 - protein, 20 aa, Mycobacterium
HHWSVRVPDDPVWVRADHAR

SEQ ID NO: 357823 - protein, 30 aa, Mycobacterium
HIAAPRAKLFTALFLILGLVVVGEVAGVVL

SEQ ID NO: 357824 - protein, 21 aa, Mycobacterium
HIAIPICTMAVFTAATALGVL

SEQ ID NO: 357825 - protein, 18 aa, Mycobacterium
HIALVGALMVAALALSLD

SEQ ID NO: 357826 - protein, 17 aa, Mycobacterium
HIAVYVLAGIAVAEAVG

SEQ ID NO: 357827 - protein, 19 aa, Mycobacterium
HIAVYVLAGVAALEAAALI

SEQ ID NO: 357828 - protein, 25 aa, Mycobacterium
HIDAVHGFYYLLMHGWYAIFPPTEF

SEQ ID NO: 357829 - protein, 33 aa, Mycobacterium
HIDAVHGLYYLLMHGWFAIFPPTEFWSRVPSSL

SEQ ID NO: 357830 - protein, 32 aa, Mycobacterium
HIDAVHGLYYLLMHGWFALFPPTEFWSRAPSA

SEQ ID NO: 357831 - protein, 24 aa, Mycobacterium
HIGKVVLTLPQGPAAQSVLSGGTV

SEQ ID NO: 357832 - protein, 26 aa, Mycobacterium
HIGSTLGLVVTLLDRTRLRTGARSSV

SEQ ID NO: 357833 - protein, 24 aa, Mycobacterium
HIITDIFPVLVDAAKVAWRSGQAV

SEQ ID NO: 357834 - protein, 18 aa, Mycobacterium
HILSVEPQVAFFGDNIPL

SEQ ID NO: 357835 - protein, 31 aa, Mycobacterium
HINGEIVLLLFLPAILYWEGLNTSFREIRAN

SEQ ID NO: 357836 - protein, 20 aa, Mycobacterium
HINPDTLWWALALGADFGGN

SEQ ID NO: 357837 - protein, 28 aa, Mycobacterium
HINSYSMDLFLRIAPELYLKRLCVGGVE

SEQ ID NO: 357838 - protein, 31 aa, Mycobacterium
HIPFIGRWPVLGFLQDFFAVAVLLGIIVFAI

SEQ ID NO: 357839 - protein, 34 aa, Mycobacterium
HIRRKSLWALIPRPLRRLMGPALILLAWTVGSGT

SEQ ID NO: 357840 - protein, 21 aa, Mycobacterium
HISEALKRLPGYGTALGEVVS

SEQ ID NO: 357841 - protein, 17 aa, Mycobacterium
HITPNWFASVMGTGIVA

SEQ ID NO: 357842 - protein, 29 aa, Mycobacterium
HIVDAIICYIGFLFPLWDAKRQTLADKIM

SEQ ID NO: 357843 - protein, 28 aa, Mycobacterium
HIWMTDRAIDPYRLAIRIELAGVEAATG

SEQ ID NO: 357844 - protein, 24 aa, Mycobacterium
HKAAPLWTVYAFNGFIVVVVGALV

SEQ ID NO: 357845 - protein, 31 aa, Mycobacterium
HKASAWLFDMAMLGVVSIAYTAIVWWRIRLR

SEQ ID NO: 357846 - protein, 20 aa, Mycobacterium
HKGLEQVLVFLPQGASIAQT

SEQ ID NO: 357847 - protein, 38 aa, Mycobacterium
HKHPAAARWLRVLAIPVVLFWVIAAAVLNIFVPSLEET

SEQ ID NO: 357848 - protein, 22 aa, Mycobacterium
HKKWRRLLDPLFAPKQMARLEA

SEQ ID NO: 357849 - protein, 29 aa, Mycobacterium
HKRSNTALWLIPVVVVVVLAAGIIGIVAY

SEQ ID NO: 357850 - protein, 18 aa, Mycobacterium
HKVTTSPLPLKPASEQRP

SEQ ID NO: 357851 - protein, 22 aa, Mycobacterium
HKWPFAQTAFTSALPWMAGRIG

SEQ ID NO: 357852 - protein, 20 aa, Mycobacterium
HLAAYLVMTVVVLTVWAAVA

SEQ ID NO: 357853 - protein, 19 aa, Mycobacterium
HLAEILWDVIPFDWINDAD

SEQ ID NO: 357854 - protein, 19 aa, Mycobacterium
HLALVGALMVAALALVLDG

SEQ ID NO: 357855 - protein, 36 aa, Mycobacterium
HLAMNLHFLLSGYLFYWVVIGIDPSPRRLPPVAKLG

SEQ ID NO: 357856 - protein, 27 aa, Mycobacterium
HLAVDGVSWRILLEDLNIAWAQHCTGQ

SEQ ID NO: 357857 - protein, 22 aa, Mycobacterium
HLCLAFLHYQAWAIPVAFVIAQ

SEQ ID NO: 357858 - protein, 23 aa, Mycobacterium
HLCLALLHYRGWAIPVAFVIAQG

SEQ ID NO: 357859 - protein, 26 aa, Mycobacterium
HLDEGLQYLEELLGSGPLASAVPGID

SEQ ID NO: 357860 - protein, 19 aa, Mycobacterium
HLDYIIMGILLIAVGLAVP

SEQ ID NO: 357861 - protein, 25 aa, Mycobacterium
HLEMPLRRTLRYAALLRLPAGTPAA

SEQ ID NO: 357862 - protein, 18 aa, Mycobacterium
HLFGRPLGRLIDHDNTVE

SEQ ID NO: 357863 - protein, 25 aa, Mycobacterium
HLFGWPLASYLQPVGTLPWWAGIIE

SEQ ID NO: 357864 - protein, 18 aa, Mycobacterium
HLFYNRRLRAATTRFSVR

SEQ ID NO: 357865 - protein, 17 aa, Mycobacterium
HLGFLLIATVTALILVL

SEQ ID NO: 357866 - protein, 29 aa, Mycobacterium
HLGHDRLLGLVLLAPAAPAPGLGLAAVRR

SEQ ID NO: 357867 - protein, 22 aa, Mycobacterium
HLGLAYGFYALCAVLSFLFVSK

SEQ ID NO: 357868 - protein, 32 aa, Mycobacterium
HLGSDPFVAILGFPFIPQAMRHRYFELEIKAI

SEQ ID NO: 357869 - protein, 35 aa, Mycobacterium
HLGVDVLWLLNGAVFYVLLFTTGQWRHIVPTSWDV

SEQ ID NO: 357870 - protein, 31 aa, Mycobacterium
HLGVRPEHVLLTPDHFAYLVGFGIPDASGVY

SEQ ID NO: 357871 - protein, 37 aa, Mycobacterium
HLGVWFGHFPWWIPLGSLVLPFLLGFRLTCYYYRKAY

SEQ ID NO: 357872 - protein, 20 aa, Mycobacterium
HLIALVMLILLGTLGFRAAL

SEQ ID NO: 357873 - protein, 17 aa, Mycobacterium
HLIGFAVAAYALIVIPG

SEQ ID NO: 357874 - protein, 17 aa, Mycobacterium
HLILGSTLFLLFGAAPA

SEQ ID NO: 357875 - protein, 20 aa, Mycobacterium
HLITGYGARRLLLTSRRGAS

SEQ ID NO: 357876 - protein, 17 aa, Mycobacterium
HLIVAIALALTAVLCVV

SEQ ID NO: 357877 - protein, 18 aa, Mycobacterium
HLKSSWYELPPPSPDRPL

SEQ ID NO: 357878 - protein, 25 aa, Mycobacterium
HLLALAVAWLALPTAAILLYSALVH

SEQ ID NO: 357879 - protein, 17 aa, Mycobacterium
HLMGYLRDQLETPLTLV

SEQ ID NO: 357880 - protein, 18 aa, Mycobacterium
HLMPVWQGQGYNSGIRDA

SEQ ID NO: 357881 - protein, 18 aa, Mycobacterium
HLPIPTLVGLPRQPDVFR

SEQ ID NO: 357882 - protein, 33 aa, Mycobacterium
HLPQDAIRWAALVVLTLIGLGLIFPPVQHLIER

SEQ ID NO: 357883 - protein, 24 aa, Mycobacterium
HLPQDAIRWVALVALVAIGLGLMF

SEQ ID NO: 357884 - protein, 28 aa, Mycobacterium
HLQRARVPMPIIPVSSLLRSHAVTLNDK

SEQ ID NO: 357885 - protein, 29 aa, Mycobacterium
HLQRARVPMPVLPVSSLLRSHAITLNDKE

SEQ ID NO: 357886 - protein, 18 aa, Mycobacterium
HLRGIRRSPLPAELVTEI

SEQ ID NO: 357887 - protein, 19 aa, Mycobacterium
HLRGVASLAFLPWPVRVLA

SEQ ID NO: 357888 - protein, 19 aa, Mycobacterium
HLRTVIGMLTYVDTLVFGI

SEQ ID NO: 357889 - protein, 18 aa, Mycobacterium
HLSATLGLLPDADAILMV

SEQ ID NO: 357890 - protein, 21 aa, Mycobacterium
HLSATLGLLPDADALLMVSDA

SEQ ID NO: 357891 - protein, 18 aa, Mycobacterium
HLSFGLLLAGSFVLFSFW

SEQ ID NO: 357892 - protein, 29 aa, Mycobacterium
HLSHIFFTIIGWIMRLAPVGALGAMAYIV

SEQ ID NO: 357893 - protein, 28 aa, Mycobacterium
HLSHIFFTVIGWIMRLAPLGAFGAMAYI

SEQ ID NO: 357894 - protein, 29 aa, Mycobacterium
HLSNRRLLVIYLLVFCFMGAIISIFNALP

SEQ ID NO: 357895 - protein, 21 aa, Mycobacterium
HLSRVVFVPEIPRLPSGKVLR

SEQ ID NO: 357896 - protein, 20 aa, Mycobacterium
HLSWGYFDQPPLVPFIAGVA

SEQ ID NO: 357897 - protein, 18 aa, Mycobacterium
HLTEALIPMMAAGASIVS

SEQ ID NO: 357898 - protein, 20 aa, Mycobacterium
HLTGDFLSYYTDFTTKVVAP

SEQ ID NO: 357899 - protein, 26 aa, Mycobacterium
HLVDVPWLVYALTAVGIAVMFLLPKV

SEQ ID NO: 357900 - protein, 31 aa, Mycobacterium
HLVPWTVSVNWWLIVVAFVAFVTPLGRMGIA

SEQ ID NO: 357901 - protein, 20 aa, Mycobacterium
HLVVRIFGQPLPLGALAAAQ

SEQ ID NO: 357902 - protein, 18 aa, Mycobacterium
HLVWWMVAVVGFNSLLGA

SEQ ID NO: 357903 - protein, 31 aa, Mycobacterium
HLWDERRLVLPCTYFTTTPFQNWTRNATELL

SEQ ID NO: 357904 - protein, 21 aa, Mycobacterium
HMAVRRWAPYADPLLLPCVAL

SEQ ID NO: 357905 - protein, 31 aa, Mycobacterium
HMIRWALPPILILAPLWLLPASLYVHSEMTV

SEQ ID NO: 357906 - protein, 32 aa, Mycobacterium
HMIRWGIPPLFVLAPFWLLPASLYVHTEMTAP

SEQ ID NO: 357907 - protein, 18 aa, Mycobacterium
HMISTLFLTLTEFPDQLS

SEQ ID NO: 357908 - protein, 29 aa, Mycobacterium
HNGQPTQVILPPGPIPLQQADLRDLPEDD

SEQ ID NO: 357909 - protein, 24 aa, Mycobacterium
HNGRRLFAVLLHGTRQPIAPWEQA

SEQ ID NO: 357910 - protein, 23 aa, Mycobacterium
HNGRRLMAVLLHGTRQPIAPWEQ

SEQ ID NO: 357911 - protein, 20 aa, Mycobacterium
HNGYLWAVLYVIAVIGPAVM

SEQ ID NO: 357912 - protein, 19 aa, Mycobacterium
HNIKAIRTVRFWAAPLIIT

SEQ ID NO: 357913 - protein, 24 aa, Mycobacterium
HNIVFKFLFPLIGGLVLAAVFGFS

SEQ ID NO: 357914 - protein, 17 aa, Mycobacterium
HNVASRYVFALSQRDVL

SEQ ID NO: 357915 - protein, 23 aa, Mycobacterium
HNVIRTLIYLKLSVSGHLTVFVT

SEQ ID NO: 357916 - protein, 26 aa, Mycobacterium
HNVSTQVVLIFRLGGAWPPQRGFEIL

SEQ ID NO: 357917 - protein, 24 aa, Mycobacterium
HPAAMLGFMVLISGAFVAATQAIN

SEQ ID NO: 357918 - protein, 27 aa, Mycobacterium
HPAATEFVLLLWPVGAMTSLVLLSQLS

SEQ ID NO: 357919 - protein, 33 aa, Mycobacterium; identical to SEQ ID NO: 24050

SEQ ID NO: 357920 - protein, 34 aa, Mycobacterium
HPARYLSVFLVLLIGVYLLVFLTGDKKAAPKLGI

SEQ ID NO: 357921 - protein, 34 aa, Mycobacterium
HPARYLSVFLVLLIGVYLLVFLTGDKRAAPKLGI

SEQ ID NO: 357922 - protein, 36 aa, Mycobacterium
HPARYLTLFLVLLVGVYLLVFLTGDKKPEPKLGIDL

SEQ ID NO: 357923 - protein, 27 aa, Mycobacterium
HPAWHTLILVLLFVAAMWVTYALFMGS

SEQ ID NO: 357924 - protein, 28 aa, Mycobacterium
HPDIPGVPWYAALLFAVTATAIGYGIDA

SEQ ID NO: 357925 - protein, 17 aa, Mycobacterium
HPDTWVMSLLYIGTFGS

SEQ ID NO: 357926 - protein, 23 aa, Mycobacterium
HPESWPWPTFTVNIVGAFLVGYF

SEQ ID NO: 357927 - protein, 25 aa, Mycobacterium
HPETAHWFKTFLAPLLGGTGMLYVI

SEQ ID NO: 357928 - protein, 25 aa, Mycobacterium
HPETAHWFRTLVAPLLGGLGMVYVV

SEQ ID NO: 357929 - protein, 17 aa, Mycobacterium
HPFGYGRSRFFYSFVVA

SEQ ID NO: 357930 - protein, 17 aa, Mycobacterium
HPGAHLDLLLPSGRMRQ

SEQ ID NO: 357931 - protein, 29 aa, Mycobacterium
HPGDALYGLRTSLFGAPPAVRTDPVVLSA

SEQ ID NO: 357932 - protein, 26 aa, Mycobacterium
HPGDASFYWLTLALAGVWVAGGFASG

SEQ ID NO: 357933 - protein, 22 aa, Mycobacterium
HPHYKWVALSNTTLGVLLATIN

SEQ ID NO: 357934 - protein, 24 aa, Mycobacterium
HPITAFILFVASPYIVYFTPLFDI

SEQ ID NO: 357935 - protein, 25 aa, Mycobacterium
HPKPPPVRRPVKLTLLTSGTTGLAK

SEQ ID NO: 357936 - protein, 38 aa, Mycobacterium
HPLARLFMIAIISAVAIGVFWWLKRELGDHTRQDFTHT

SEQ ID NO: 357937 - protein, 27 aa, Mycobacterium
HPLIARAHLLLRFDRGRWLAVDNNTLN

SEQ ID NO: 357938 - protein, 21 aa, Mycobacterium
HPMLSLGLPVLIIALGGIGFP

SEQ ID NO: 357939 - protein, 36 aa, Mycobacterium
HPMRYLAAFLVLLIGAYLLVFLTGDKQPKPKLGIDL

SEQ ID NO: 357940 - protein, 25 aa, Mycobacterium
HPMYSWALVMILASPLALGSFWALL

SEQ ID NO: 357941 - protein, 30 aa, Mycobacterium
HPNLQDPNPPLPWWQPNPSPRVPGSADPDD

SEQ ID NO: 357942 - protein, 28 aa, Mycobacterium
HPNVAGIPWWGAILSAVVASLIGFAFDA

SEQ ID NO: 357943 - protein, 24 aa, Mycobacterium
HPNYFGEFGFWFALALFGVSASPS

SEQ ID NO: 357944 - protein, 24 aa, Mycobacterium
HPPGMTWLDALYFSTETIATVGYG

SEQ ID NO: 357945 - protein, 32 aa, Mycobacterium
HPPHGLAAWRVPLAILLTLWTIRTLAHWLQAR

SEQ ID NO: 357946 - protein, 19 aa, Mycobacterium
HPPMLLTGDNRRAAGRLAE

SEQ ID NO: 357947 - protein, 29 aa, Mycobacterium
HPQDWYGTLDAIVARRLDPLPSVGRIIGL

SEQ ID NO: 357948 - protein, 21 aa, Mycobacterium
HPQLVVLSLWRKYGDRYDFPA

SEQ ID NO: 357949 - protein, 22 aa, Mycobacterium
HPRFGVLEPAQFLPLVREHGLM

SEQ ID NO: 357950 - protein, 17 aa, Mycobacterium
HPRLRRVIGAMTGVYVL

SEQ ID NO: 357951 - protein, 23 aa, Mycobacterium
HPRRHPWEIGLLVLVIVSSVLLY

SEQ ID NO: 357952 - protein, 32 aa, Mycobacterium
HPRRLTPWVAILFTTLIAFGLIFYVSAFANSS

SEQ ID NO: 357953 - protein, 23 aa, Mycobacterium
HPRRPRIPLHAKPVAQLAARQLR

SEQ ID NO: 357954 - protein, 23 aa, Mycobacterium
HPSLAVQIILFVAVVFGTLNVIG

SEQ ID NO: 357955 - protein, 24 aa, Mycobacterium
HPSSAHWFKTFLAPLTGGIGMLYV

SEQ ID NO: 357956 - protein, 26 aa, Mycobacterium
HPVAMLGFMVLISFAFVAATQAINAL

SEQ ID NO: 357957 - protein, 31 aa, Mycobacterium
HPVRQRFFALFLYVVGLLFIVISAPVAVMGP

SEQ ID NO: 357958 - protein, 28 aa, Mycobacterium
HPVRQRLFALFLYVVMLVFVVCAAPVLV

SEQ ID NO: 357959 - protein, 18 aa, Mycobacterium
HPVYNLTSARLVLGNPAA

SEQ ID NO: 357960 - protein, 18 aa, Mycobacterium
HPWQMGLHLLITVAYFAL

SEQ ID NO: 357961 - protein, 18 aa, Mycobacterium
HPYVFVIGDLMAVPGVPG

SEQ ID NO: 357962 - protein, 33 aa, Mycobacterium
HQDGILLERIGAQPLWIPWQSITALRAERGIAG

SEQ ID NO: 357963 - protein, 23 aa, Mycobacterium
HQGLTWVAGLLFPAFSIGAILGN

SEQ ID NO: 357964 - protein, 22 aa, Mycobacterium
HQHVPAPSCKGTWRPRAERRNK

SEQ ID NO: 357965 - protein, 18 aa, Mycobacterium
HQICPVGVLLATKTDLYP

SEQ ID NO: 357966 - protein, 23 aa, Mycobacterium
HQLADRKGIWQALLGSDAIYFEV

SEQ ID NO: 357967 - protein, 19 aa, Mycobacterium
HQLRLLMIGAGVATLVVAA

SEQ ID NO: 357968 - protein, 27 aa, Mycobacterium
HQRAPLQTWIIVALVMAPLLVGCVVAA

SEQ ID NO: 357969 - protein, 40 aa, Mycobacterium
HQSSYGYLVWVFVAVFVVGLLDLALSVMWLSRSRPRVVSP

SEQ ID NO: 357970 - protein, 26 aa, Mycobacterium
HQVEYVYSLLLNWIADKLARSPGFEG

SEQ ID NO: 357971 - protein, 24 aa, Mycobacterium
HQVTGWRFVMRRIASGIALHDTRM

SEQ ID NO: 357972 - protein, 18 aa, Mycobacterium
HRCDVVLVTGPWMAGVSA

SEQ ID NO: 357973 - protein, 32 aa, Mycobacterium
HRCTRLYRPVFYYLGFWAVALLILRQILPLHV

SEQ ID NO: 357974 - protein, 30 aa, Mycobacterium
HREHEVVNYVKWFMGQFTSVDPYHANEYVE

SEQ ID NO: 357975 - protein, 17 aa, Mycobacterium
HRERVTLFRGWPDQAEA

SEQ ID NO: 357976 - protein, 22 aa, Mycobacterium
HRFDPATLWRGQARRDRLRVPI

SEQ ID NO: 357977 - protein, 18 aa, Mycobacterium
HRFGWSQAPTWLVIVGEV

SEQ ID NO: 357978 - protein, 29 aa, Mycobacterium
HRGELVYLPPEWFATSPPPPLPTVMMIGG

SEQ ID NO: 357979 - protein, 27 aa, Mycobacterium
HRGELVYLPPEWFTSSPPPALPTVMMI

SEQ ID NO: 357980 - protein, 23 aa, Mycobacterium
HRGWFRTQLLRPADIKIIRITEF

SEQ ID NO: 357981 - protein, 27 aa, Mycobacterium
HRHPHWKRLIWPVLVLIVVTGLAAFGS

SEQ ID NO: 357982 - protein, 29 aa, Mycobacterium
HRHPHWKRLIWPVVVLILVTGLAALGSGF

SEQ ID NO: 357983 - protein, 26 aa, Mycobacterium
HRLIVTLGALVWAGSLFWYLQRVGTE

SEQ ID NO: 357984 - protein, 20 aa, Mycobacterium
HRLLPLFAIGVFIGFTISQT

SEQ ID NO: 357985 - protein, 18 aa, Mycobacterium
HRLPAEVLDLAAAELRVV

SEQ ID NO: 357986 - protein, 18 aa, Mycobacterium
HRLPLSYFDGRQRGELLS

SEQ ID NO: 357987 - protein, 19 aa, Mycobacterium
HRLPLSYFDSRQRGEILSR

SEQ ID NO: 357988 - protein, 18 aa, Mycobacterium
HRLRAFVVKKDGADLDED

SEQ ID NO: 357989 - protein, 24 aa, Mycobacterium
HRLTIVALLLLTFATGLADAISVL

SEQ ID NO: 357990 - protein, 23 aa, Mycobacterium
HRLTLREWFARKAFYGKSAAPLS

SEQ ID NO: 357991 - protein, 21 aa, Mycobacterium
HRLVLIVHHLAVDGVSWRILL

SEQ ID NO: 357992 - protein, 34 aa, Mycobacterium
HRPDAPTRIPVPSLLRSLLTDHLDPGYAAAAQDG

SEQ ID NO: 357993 - protein, 35 aa, Mycobacterium
HRPFLGHLIRVLSLPIILFWVALAVILGTVTPSLT

SEQ ID NO: 357994 - protein, 36 aa, Mycobacterium
HRPFVGRMVRIFSLPIIVFWVLVAVGLGILTPSLDA

SEQ ID NO: 357995 - protein, 22 aa, Mycobacterium
HRPGFLFPPCPFKMLTGWDCPG

SEQ ID NO: 357996 - protein, 34 aa, Mycobacterium
HRPYLPHAIRIFAVPIILIWVAVTVLVNVVVPTL

SEQ ID NO: 357997 - protein, 24 aa, Mycobacterium
HRQEFVYVPPAWFASDPPPALPVV

SEQ ID NO: 357998 - protein, 25 aa, Mycobacterium
HRQEYVYLPPAWFAANPPPKLPTVM

SEQ ID NO: 357999 - protein, 19 aa, Mycobacterium
HRQLVLLVLFAVVGIWQVL

SEQ ID NO: 358000 - protein, 25 aa, Mycobacterium
HRQPYWVSGLYMVLLTATGIGAFMF

SEQ ID NO: 358001 - protein, 36 aa, Mycobacterium
HRQRAWLSGLALVLTLVVGLAYLAIGALRINPLDST

SEQ ID NO: 358002 - protein, 18 aa, Mycobacterium
HRRDGIALALLGIAVVVA

SEQ ID NO: 358003 - protein, 28 aa, Mycobacterium
HRRGVAWLLLIPIVLLAFVAPPAIRPDA

SEQ ID NO: 358004 - protein, 25 aa, Mycobacterium
HRRIEGLIAAGRWDFDPMAEPEQIL

SEQ ID NO: 358005 - protein, 23 aa, Mycobacterium
HRRLLLRITRWDVVLAMAVAGTV

SEQ ID NO: 358006 - protein, 18 aa, Mycobacterium
HRRWGLLVPAVLAAGVVL

SEQ ID NO: 358007 - protein, 19 aa, Mycobacterium
HRRWGLMVPAVLAVALVAV

SEQ ID NO: 358008 - protein, 31 aa, Mycobacterium
HRSIVPNIPGVPWWAAVLIAVTATAVGYAFD

SEQ ID NO: 358009 - protein, 40 aa, Mycobacterium
HRSRPQRLFYLLIHLLDPFISLESLYRYLCKFHALDERRY

SEQ ID NO: 358010 - protein, 59 aa, Mycobacterium
HRSTTQRDWLRRINWKWVRRSAYLAAAVVILLPIVTFTMAYFIVDVPRPGDIRTNQVST

SEQ ID NO: 358011 - protein, 19 aa, Mycobacterium
HRTRKITWLARLGDWSGRR

SEQ ID NO: 358012 - protein, 22 aa, Mycobacterium
HRVAALPLWTWLATVAVLSFGG

SEQ ID NO: 358013 - protein, 17 aa, Mycobacterium
HRVFTSFVLVFGLMASA

SEQ ID NO: 358014 - protein, 25 aa, Mycobacterium
HRVQNWLTWLFLATFGVFTVVALVT

SEQ ID NO: 358015 - protein, 21 aa, Mycobacterium
HRVRLLFGLLAALQLMLAPIV

SEQ ID NO: 358016 - protein, 22 aa, Mycobacterium
HSAAPLFHNIAGWLMQRENVPL

SEQ ID NO: 358017 - protein, 17 aa, Mycobacterium
HSDTWVMSLLYIGTFGS

SEQ ID NO: 358018 - protein, 23 aa, Mycobacterium
HSDVQWRAMTVRGLRGELTTVAI

SEQ ID NO: 358019 - protein, 22 aa, Mycobacterium
HSFTLIHLVMALALLAGLVALH

SEQ ID NO: 358020 - protein, 22 aa, Mycobacterium
HSGPITFCFFVFAFMGTVVLDP

SEQ ID NO: 358021 - protein, 29 aa, Mycobacterium
HSGSDIYFTVDWLQAWWAHYGRQRNFVGL

SEQ ID NO: 358022 - protein, 22 aa, Mycobacterium
HSHLYIVGYQYIPSIGPAFLVQ

SEQ ID NO: 358023 - protein, 30 aa, Mycobacterium
HSHRRAVLLIYLWVGIIAFGAASTIFFDPG

SEQ ID NO: 358024 - protein, 28 aa, Mycobacterium
HSHRRVVLLIYLWVGIVAFGAASTIFFD

SEQ ID NO: 358025 - protein, 28 aa, Mycobacterium
HSHRRVVLLIYLWVGIVAFGAASTIFFN

SEQ ID NO: 358026 - protein, 28 aa, Mycobacterium
HSHRRVVLLIYLWVGIVAFGAASTIFFR

SEQ ID NO: 358027 - protein, 28 aa, Mycobacterium
HSHRRVVLLIYLWVGIVAFGAASTIFVD

SEQ ID NO: 358028 - protein, 26 aa, Mycobacterium
HSHRRVVLLIYLWVGIVAIGAASTIF

SEQ ID NO: 358029 - protein, 17 aa, Mycobacterium
HSIDYVRPQLFTNSFTP

SEQ ID NO: 358030 - protein, 29 aa, Mycobacterium
HSKHIFVFDMAMLTLLSIAYTGIVRWHIR

SEQ ID NO: 358031 - protein, 24 aa, Mycobacterium
HSLAFDFSVWEIFGALLHGGRLVI

SEQ ID NO: 358032 - protein, 23 aa, Mycobacterium
HSLGLHAVVSCPIGLATRVLAQS

SEQ ID NO: 358033 - protein, 17 aa, Mycobacterium
HSPEVLNIVFTDFKLRS

SEQ ID NO: 358034 - protein, 29 aa, Mycobacterium
HSRRNLTLYITALLFVLAWATSGINGWFY

SEQ ID NO: 358035 - protein, 27 aa, Mycobacterium
HSRSNWLPTFILLIVLSVVAAAYTVRG

SEQ ID NO: 358036 - protein, 26 aa, Mycobacterium
HSRSNWLVMFVVMIVLTVIVGIYAAR

SEQ ID NO: 358037 - protein, 19 aa, Mycobacterium
HSSIFYLVLTYMSSFLTAN

SEQ ID NO: 358038 - protein, 18 aa, Mycobacterium
HSSLLVAYLALLVGLGFG

SEQ ID NO: 358039 - protein, 39 aa, Mycobacterium
HSSRPQRLFYLLIHLLDPLISLESLYRYLCKFHALDQRR

SEQ ID NO: 358040 - protein, 24 aa, Mycobacterium
HSSWVLYAVIVVSALIIVGAVPML

SEQ ID NO: 358041 - protein, 23 aa, Mycobacterium
HSTLTPPEWWRLGAMFAFIAALH

SEQ ID NO: 358042 - protein, 26 aa, Mycobacterium
HSTSWVLYAVIIVSALIIAGAIPMLL

SEQ ID NO: 358043 - protein, 28 aa, Mycobacterium
HSVRVWLMLGVLLFSVLLSVRLMVLLSY

SEQ ID NO: 358044 - protein, 18 aa, Mycobacterium
HSWRWILGLAAVPATLLL

SEQ ID NO: 358045 - protein, 17 aa, Mycobacterium
HSWRWMLGLACVPALLL

SEQ ID NO: 358046 - protein, 26 aa, Mycobacterium
HSYAFDFSVWEIWAALLGGARVVVVP

SEQ ID NO: 358047 - protein, 22 aa, Mycobacterium
HSYLLLPLLTATGIPVPEEVVT

SEQ ID NO: 358048 - protein, 23 aa, Mycobacterium
HSYLWAGLVLLALAGACGELASV

SEQ ID NO: 358049 - protein, 31 aa, Mycobacterium
HTAGAVTVLLLWPLLIEPLLGNLPGRSVEIG

SEQ ID NO: 358050 - protein, 21 aa, Mycobacterium
HTAITLPIYVWAILMTHALNK

SEQ ID NO: 358051 - protein, 29 aa, Mycobacterium
HTAPEKLFDPILLLALAALGIGFVSTLLV

SEQ ID NO: 358052 - protein, 31 aa, Mycobacterium
HTEILWTAAFVVALLQYLRPIAFVPDSGHQT

SEQ ID NO: 358053 - protein, 25 aa, Mycobacterium
HTFLNAIFGLFGALALMAAAIVLFQ

SEQ ID NO: 358054 - protein, 27 aa, Mycobacterium
HTFRAQWPILLVGLIFTVAFVLVGANF

SEQ ID NO: 358055 - protein, 26 aa, Mycobacterium
HTGPQDILLIAFGLALAEFAATDTPI

SEQ ID NO: 358056 - protein, 27 aa, Mycobacterium
HTGQRWLPVLLAGFSAGFLLLRGRSYV

SEQ ID NO: 358057 - protein, 24 aa, Mycobacterium
HTGVEQVLVFLPQGASIAQTVAAP

SEQ ID NO: 358058 - protein, 24 aa, Mycobacterium
HTHNSIHALIRQIGEHWLVEPGDT

SEQ ID NO: 358059 - protein, 17 aa, Mycobacterium
HTLAAWAMPDIERVYKV

SEQ ID NO: 358060 - protein, 22 aa, Mycobacterium
HTLGLIFVCCYIALVATNFAWL

SEQ ID NO: 358061 - protein, 19 aa, Mycobacterium
HTLRLGRPGWIDPGSLAPD

SEQ ID NO: 358062 - protein, 30 aa, Mycobacterium
HTPIGLNLPFTYPPLAAIVFCPFAWLQMPA

SEQ ID NO: 358063 - protein, 19 aa, Mycobacterium
HTPLSLFIGNLLQLMSPLN

SEQ ID NO: 358064 - protein, 17 aa, Mycobacterium
HTRKVLDLVIRLAEVML

SEQ ID NO: 358065 - protein, 17 aa, Mycobacterium
HTRLRKLAAAAFSPRAV

SEQ ID NO: 358066 - protein, 27 aa, Mycobacterium
HTRSNWLVMFLVMLALTLIAGFYAVRT

SEQ ID NO: 358067 - protein, 28 aa, Mycobacterium
HTSRIRPAVLIPVVLAVLLVAAVAVAAF

SEQ ID NO: 358068 - protein, 28 aa, Mycobacterium
HTTAELVPLLWLIACAVIIISYARRPAA

SEQ ID NO: 358069 - protein, 25 aa, Mycobacterium
HTVLRRAFGLLGPLEAVLTLTAFLV

SEQ ID NO: 358070 - protein, 18 aa, Mycobacterium
HTVPNQILRFFDAKRRIL

SEQ ID NO: 358071 - protein, 23 aa, Mycobacterium
HTWLLVALPLAGAAILLFGGRRT

SEQ ID NO: 358072 - protein, 28 aa, Mycobacterium
HVAFGVWTLWPVLVLFMPYDVYGFSAAD

SEQ ID NO: 358073 - protein, 30 aa, Mycobacterium
HVAFIALTLGFLQPIIFATAAAMALVPLRG

SEQ ID NO: 358074 - protein, 27 aa, Mycobacterium
HVAPTTLAILVLLPLAAFEASTALPAA

SEQ ID NO: 358075 - protein, 31 aa, Mycobacterium
HVARLAVFVVFLLVLFYLVAVARVIDVDEVR

SEQ ID NO: 358076 - protein, 19 aa, Mycobacterium
HVATVLLSIEKWLPAGLLV

SEQ ID NO: 358077 - protein, 31 aa, Mycobacterium
HVDGARTKLFVTLFLILALVVVGEIAGVVLG

SEQ ID NO: 358078 - protein, 21 aa, Mycobacterium
HVDPHTIVCAPPRSIPKTTSG

SEQ ID NO: 358079 - protein, 18 aa, Mycobacterium
HVEDWFLIGFAALVLVVL

SEQ ID NO: 358080 - protein, 23 aa, Mycobacterium
HVEDWFLIGFAVLTLAVLVRDVW

SEQ ID NO: 358081 - protein, 27 aa, Mycobacterium
HVFVMEWLAILRDLVLGLLIAGAVAAW

SEQ ID NO: 358082 - protein, 37 aa, Mycobacterium
HVGGVFRVLLCIAEARPFVLLPKFELQRWAAAVREHR

SEQ ID NO: 358083 - protein, 18 aa, Mycobacterium
HVGLLLVLSILVFPGMFG

SEQ ID NO: 358084 - protein, 32 aa, Mycobacterium
HVGPLPIRAYALFIIAGIVAALLIGDRRWEAR

SEQ ID NO: 358085 - protein, 25 aa, Mycobacterium
HVHANTVAILWWLLAAHATHFAVIP

SEQ ID NO: 358086 - protein, 18 aa, Mycobacterium
HVHPLWAILLNIVAVGGL

SEQ ID NO: 358087 - protein, 33 aa, Mycobacterium
HVHYLDWLNYLLGWGALYQLGIAWRGGLLTGRR

SEQ ID NO: 358088 - protein, 17 aa, Mycobacterium
HVIAFYAGAVLVPLLIA

SEQ ID NO: 358089 - protein, 31 aa, Mycobacterium
HVLALGYIGMVLGAYRWLRPHGRRTAKEIAV

SEQ ID NO: 358090 - protein, 32 aa, Mycobacterium
HVLDTLAVFVGWLWPLWDARNRTFADLLTRTE

SEQ ID NO: 358091 - protein, 21 aa, Mycobacterium
HVLGAIFLGFLIGATTAGAIL

SEQ ID NO: 358092 - protein, 18 aa, Mycobacterium
HVLGRPLGRLIDRDNSAD

SEQ ID NO: 358093 - protein, 17 aa, Mycobacterium
HVLGRPLGRLIDRDNTG

SEQ ID NO: 358094 - protein, 17 aa, Mycobacterium
HVLGVERIGLDDSFFDL

SEQ ID NO: 358095 - protein, 19 aa, Mycobacterium
HVMAPPPPIGERRPELARL

SEQ ID NO: 358096 - protein, 25 aa, Mycobacterium
HVMMNVHFLLSGYLFYWVVIGIDPT

SEQ ID NO: 358097 - protein, 28 aa, Mycobacterium
HVNELQALLLDWGFAPMTVGSRPPAAAP

SEQ ID NO: 358098 - protein, 18 aa, Mycobacterium
HVQFIMNMWGKPITAAGS

SEQ ID NO: 358099 - protein, 36 aa, Mycobacterium
HVRIAAAVLALIVLAAVVFTYLSYTAAFTPTDKVTV

SEQ ID NO: 358100 - protein, 17 aa, Mycobacterium
HVRIKVTMVKLNGRWMA

SEQ ID NO: 358101 - protein, 20 aa, Mycobacterium
HVRKVLDLTIRLAEVMLSSG

SEQ ID NO: 358102 - protein, 17 aa, Mycobacterium
HVRVWMMQVAEPAVYQV

SEQ ID NO: 358103 - protein, 31 aa, Mycobacterium
HVSGHEQLFDTLFLYESYPIDTSAFMGVQEL

SEQ ID NO: 358104 - protein, 34 aa, Mycobacterium
HVSTASIWMRLPTLVMALTCWWVISREVMPRLGH

SEQ ID NO: 358105 - protein, 33 aa, Mycobacterium
HVSTASVWMRFPTLLMGLACWWVISREVIPRLG

SEQ ID NO: 358106 - protein, 34 aa, Mycobacterium
HVSTASVWMRLPTLLMALACWWVISREVIPRLGT

SEQ ID NO: 358107 - protein, 34 aa, Mycobacterium
HVSTTSIWMRLPTLVMALTCWWVISREVMPRLGH

SEQ ID NO: 358108 - protein, 18 aa, Mycobacterium
HVTALRRSYADGTTLVAA

SEQ ID NO: 358109 - protein, 20 aa, Mycobacterium
HVVPVVLFGVFYIGSCLTRR

SEQ ID NO: 358110 - protein, 32 aa, Mycobacterium
HVVRYILLIVNRTVLLPPWLAAAATWGGVAVS

SEQ ID NO: 358111 - protein, 18 aa, Mycobacterium
HVWTLAPGKDMATAHLTS

SEQ ID NO: 358112 - protein, 17 aa, Mycobacterium
HWAFQITAQFLGPSWDA

SEQ ID NO: 358113 - protein, 29 aa, Mycobacterium
HWDALGFLQDFFATAVFLGIATFAIIRIK

SEQ ID NO: 358114 - protein, 30 aa, Mycobacterium
HWDVAFIRRFMLIFGPISSLFDFLTFGLML

SEQ ID NO: 358115 - protein, 22 aa, Mycobacterium
HWFIEVPIRITAYIVIVLIARY

SEQ ID NO: 358116 - protein, 17 aa, Mycobacterium
HWIYLAGIVVILLTMAV

SEQ ID NO: 358117 - protein, 19 aa, Mycobacterium
HWMVLAMSVILLLAVGSDY

SEQ ID NO: 358118 - protein, 34 aa, Mycobacterium
HWQEWMPAGLFFVAVALFQLIWARAVLARTTIPV

SEQ ID NO: 358119 - protein, 18 aa, Mycobacterium
HWQPAAPAPPRPFAPSPP

SEQ ID NO: 358120 - protein, 23 aa, Mycobacterium
HWSLLLGYGCLPWVAATMLGLRA

SEQ ID NO: 358121 - protein, 18 aa, Mycobacterium
HWVNQAVVLFPSADKAKD

SEQ ID NO: 358122 - protein, 17 aa, Mycobacterium
HYALGLAIAYVLAVLDA

SEQ ID NO: 358123 - protein, 23 aa, Mycobacterium
HYCHYWKALQFVPQWTLALVALV

SEQ ID NO: 358124 - protein, 20 aa, Mycobacterium
HYDWFADYLSARGLVGLARV

SEQ ID NO: 358125 - protein, 20 aa, Mycobacterium
HYFARDPLKPELTLADYKVT

SEQ ID NO: 358126 - protein, 18 aa, Mycobacterium
HYFGAWVFIAGFLMHIAL

SEQ ID NO: 358127 - protein, 23 aa, Mycobacterium
HYFNTFLIPSDLLWSFLQAIVMA

SEQ ID NO: 358128 - protein, 23 aa, Mycobacterium
HYFNTFLIPSDLLWSFLQAIVMS

SEQ ID NO: 358129 - protein, 38 aa, Mycobacterium
HYFTTFLNPRDLLWSFLQAILMAMAVLLVHTYFGYFAG

SEQ ID NO: 358130 - protein, 19 aa, Mycobacterium
HYLPVLLVALAVTGLGMGC

SEQ ID NO: 358131 - protein, 30 aa, Mycobacterium
HYPTGWAVAFSTPFQMFKRYSQFSGGTCDP

SEQ ID NO: 358132 - protein, 29 aa, Mycobacterium
HYTVAEFWRFWVVHLWVEDFLELFTTVMV

SEQ ID NO: 358133 - protein, 18 aa, Mycobacterium
HYVLAPLALAQNATGRTG

SEQ ID NO: 358134 - protein, 17 aa, Mycobacterium
HYWKEFLRHLSDIAWGN

SEQ ID NO: 358135 - protein, 25 aa, Mycobacterium
IAAAAAIEVLWWVQGHVLGERRRLW

SEQ ID NO: 358136 - protein, 18 aa, Mycobacterium
IAAAFFFPAYSAILPRIL

SEQ ID NO: 358137 - protein, 30 aa, Mycobacterium
IAAAKYPPAWLLCALFPLAAVPLVPTRLLP

SEQ ID NO: 358138 - protein, 24 aa, Mycobacterium
IAAALLLALIILVGGHWLRHPTVA

SEQ ID NO: 358139 - protein, 25 aa, Mycobacterium
IAAALMPMLIVPQQFLRSLTYAGIA

SEQ ID NO: 358140 - protein, 27 aa, Mycobacterium
IAAALTLAPALLTLGSLLALFDPKRPT

SEQ ID NO: 358141 - protein, 17 aa, Mycobacterium
IAAARRPGRGQGALVAG

SEQ ID NO: 358142 - protein, 26 aa, Mycobacterium
IAAAVILCIFIYWGWDACLAVGEETK

SEQ ID NO: 358143 - protein, 19 aa, Mycobacterium
IAAAVLPLLVALAARHIDS

SEQ ID NO: 358144 - protein, 26 aa, Mycobacterium
IAACLIMGWGHRLLRGLALVAVSAMV

SEQ ID NO: 358145 - protein, 25 aa, Mycobacterium
IAAFKIIMLCLWWGAATSKLNHHFP

SEQ ID NO: 358146 - protein, 25 aa, Mycobacterium
IAAFKLIMLALWWGAATSKLNHHFP

SEQ ID NO: 358147 - protein, 24 aa, Mycobacterium
IAAFLLFPGFLPPMSPTMPAERVA

SEQ ID NO: 358148 - protein, 35 aa, Mycobacterium
IAAGAFTFLIAPFFARLIRFFPPVVTGSVITIIGV

SEQ ID NO: 358149 - protein, 27 aa, Mycobacterium
IAAGAVALLLFLIIKVKLHAFVALVLV

SEQ ID NO: 358150 - protein, 26 aa, Mycobacterium
IAAGFLYFFFVLPRWPELMGDTAHSL

SEQ ID NO: 358151 - protein, 22 aa, Mycobacterium
IAAGLLLFILPAGTKLGVRLLD

SEQ ID NO: 358152 - protein, 18 aa, Mycobacterium
IAAGLLVGLPLAAPLAVL

SEQ ID NO: 358153 - protein, 27 aa, Mycobacterium
IAAGLLYFYFVLPRWFELMGETSHALG

SEQ ID NO: 358154 - protein, 27 aa, Mycobacterium
IAAGVLLVLGLFTPIAAAGALAYGING

SEQ ID NO: 358155 - protein, 27 aa, Mycobacterium
IAAGVLLVLGLFTPIAAAGALGYLVTA

SEQ ID NO: 358156 - protein, 26 aa, Mycobacterium
IAAGVNLLLSPAVFRGFDQVGALSPT

SEQ ID NO: 358157 - protein, 27 aa, Mycobacterium
IAAGYFLRRRGLEPLSRRQPADAPGHR

SEQ ID NO: 358158 - protein, 18 aa, Mycobacterium
IAAHLVWIALLAAGGVAV

SEQ ID NO: 358159 - protein, 28 aa, Mycobacterium
IAAIAAFTLIFLIMMVITRSLVAPFVII

SEQ ID NO: 358160 - protein, 29 aa, Mycobacterium
IAAIAALSLIFLIMLNITRSAIAALVIVG

SEQ ID NO: 358161 - protein, 27 aa, Mycobacterium
IAAICLVFIIMLITTRSFIAALVIVGT

SEQ ID NO: 358162 - protein, 19 aa, Mycobacterium
IAAIMLPPLTFPGLWTIPQ

SEQ ID NO: 358163 - protein, 24 aa, Mycobacterium
IAAITFVLLFVLTGSVVLPLKALV

SEQ ID NO: 358164 - protein, 27 aa, Mycobacterium
IAALALFKFFTPWGRQFWRITSEYFIG

SEQ ID NO: 358165 - protein, 24 aa, Mycobacterium
IAALGVMVLVVTLGTWVWLGVEED

SEQ ID NO: 358166 - protein, 17 aa, Mycobacterium
IAALKHEGVPMPSQEYA

SEQ ID NO: 358167 - protein, 18 aa, Mycobacterium
IAALLLTVAFPKPSVIFD

SEQ ID NO: 358168 - protein, 17 aa, Mycobacterium
IAALLLVNGLVAFTEEH

SEQ ID NO: 358169 - protein, 20 aa, Mycobacterium
IAALPAVLGFIPENSLVLVS

SEQ ID NO: 358170 - protein, 25 aa, Mycobacterium
IAALTLIFVVMVIITRALVASLVIV

SEQ ID NO: 358171 - protein, 17 aa, Mycobacterium
IAALVISLLIVALAAWY

SEQ ID NO: 358172 - protein, 20 aa, Mycobacterium
IAAMFAWGISFLGRTRGQMA

SEQ ID NO: 358173 - protein, 22 aa, Mycobacterium
IAAMLVVHLAGAGYRRYTAEFL

SEQ ID NO: 358174 - protein, 17 aa, Mycobacterium
IAAMWRGAPLAIIASIA

SEQ ID NO: 358175 - protein, 31 aa, Mycobacterium
IAAPAPPVEVPPPALPPPPPTPVTITQTVPP

SEQ ID NO: 358176 - protein, 25 aa, Mycobacterium
IAAPIVLTFLLILRGLSVAGEAPGA

SEQ ID NO: 358177 - protein, 17 aa, Mycobacterium
IAAPRRIIAIGVLVFVA

SEQ ID NO: 358178 - protein, 23 aa, Mycobacterium
IAAPTFEFFALYGTAAVYYWVIC

SEQ ID NO: 358179 - protein, 26 aa, Mycobacterium
IAAPVLPLTLAGWVAVGLGLAGGVPQ

SEQ ID NO: 358180 - protein, 25 aa, Mycobacterium
IAAQALRWWCITTLGPQWNTRVVVV

SEQ ID NO: 358181 - protein, 18 aa, Mycobacterium
IAAQVAFMRMFGLGLTLA

SEQ ID NO: 358182 - protein, 24 aa, Mycobacterium
IAARRLLDLAPPDRLAEAAATPAG

SEQ ID NO: 358183 - protein, 41 aa, Mycobacterium
IAASFGISVLLWQDLFGVEVHWLVMLMSVIILLAVGSDYNL

SEQ ID NO: 358184 - protein, 38 aa, Mycobacterium
IAASFGLSVLIWQDLFGFKIHWIVAALSVIILLAVGSD

SEQ ID NO: 358185 - protein, 38 aa, Mycobacterium
IAASFGLSVLIWQDLFGIKIHWIVAALSVIILLAVGSD

SEQ ID NO: 358186 - protein, 41 aa, Mycobacterium
IAASFGLSVLIWQDLFGINIHWIVMALAVIILLAVGSDYNL

SEQ ID NO: 358187 - protein, 25 aa, Mycobacterium
IAATALAPLAPLAPGGADAPASAVQ

SEQ ID NO: 358188 - protein, 27 aa, Mycobacterium
IAATKTDLYPHWRRVVEANAAHLRRAG

SEQ ID NO: 358189 - protein, 26 aa, Mycobacterium
IAATTLIFVIMLVITRSLVAAFVIVG

SEQ ID NO: 358190 - protein, 26 aa, Mycobacterium
IAAVAAAGLIGYLAGRRRSKSQAGLR

SEQ ID NO: 358191 - protein, 26 aa, Mycobacterium
IAAVAVLALLLLAWADYMNSRWQAGL

SEQ ID NO: 358192 - protein, 28 aa, Mycobacterium
IAAVGWRTRRWRRVWVPWAASIGGGLAF

SEQ ID NO: 358193 - protein, 19 aa, Mycobacterium
IAAVLFFISAFGTGFAPET

SEQ ID NO: 358194 - protein, 28 aa, Mycobacterium
IAAVVVLVAIIALVVLLLVPSQSSDQKA

SEQ ID NO: 358195 - protein, 26 aa, Mycobacterium
IAAVVYFLVVLPYNTIKERLAKSGEE

SEQ ID NO: 358196 - protein, 23 aa, Mycobacterium
IAAVYWLCNLVARPSQQTGVPYP

SEQ ID NO: 358197 - protein, 24 aa, Mycobacterium
IAAWATRWYLGTLANEPVPAALWV

SEQ ID NO: 358198 - protein, 17 aa, Mycobacterium
IAAYAVLMLAGAWLCGQ

SEQ ID NO: 358199 - protein, 17 aa, Mycobacterium
IAAYLFSGGLSAGSALL

SEQ ID NO: 358200 - protein, 18 aa, Mycobacterium
IAAYTWLDTHRNSNRYLR

SEQ ID NO: 358201 - protein, 27 aa, Mycobacterium
IACLSFTRLPYFQPLGIPGAVGIGVAV

SEQ ID NO: 358202 - protein, 26 aa, Mycobacterium
IACMLVWGLFRIFVLDDPLRAESAGF

SEQ ID NO: 358203 - protein, 20 aa, Mycobacterium
IACRLRGIPLPAFGDAIAPG

SEQ ID NO: 358204 - protein, 24 aa, Mycobacterium
IACRRRGIPLPAFGDAIAPGIVLA

SEQ ID NO: 358205 - protein, 18 aa, Mycobacterium
IACTYVICLNCELFMGPQ

SEQ ID NO: 358206 - protein, 18 aa, Mycobacterium
IACVFWFVVWAANRARRS

SEQ ID NO: 358207 - protein, 27 aa, Mycobacterium
IACWLLISRFVLRRLGPGKNGLAANRV

SEQ ID NO: 358208 - protein, 22 aa, Mycobacterium
IADAKWSTLPPMPTARHAEVVA

SEQ ID NO: 358209 - protein, 22 aa, Mycobacterium
IADFCHDGLALVGFLGLSDTPR

SEQ ID NO: 358210 - protein, 29 aa, Mycobacterium
IADFDDFWRPIRSYFYWDKHCNGVPMCWS

SEQ ID NO: 358211 - protein, 26 aa, Mycobacterium
IADFDDFWRPIRSYFYWEKHCYDVPI

SEQ ID NO: 358212 - protein, 30 aa, Mycobacterium
IADFDDFWRPIRSYFYWERHCYDIPICWSL

SEQ ID NO: 358213 - protein, 42 aa, Mycobacterium
IADFDDFWRPIRSYFYWERHCYDIPICWSLRSLFDALDGFDQ

SEQ ID NO: 358214 - protein, 17 aa, Mycobacterium
IADFLKPGPRHVLVAED

SEQ ID NO: 358215 - protein, 21 aa, Mycobacterium
IADGWSYPVLFGDIVDHYNAA

SEQ ID NO: 358216 - protein, 18 aa, Mycobacterium
IADKIWPGTRALTQMHLD

SEQ ID NO: 358217 - protein, 27 aa, Mycobacterium
IADLEATFTPFFKMLLDNEATLFRPGD

SEQ ID NO: 358218 - protein, 26 aa, Mycobacterium
IADNQSWPTTLWATNATISVALHFGP

SEQ ID NO: 358219 - protein, 21 aa, Mycobacterium
IAEAFRKLRTNLQFLAVDNPP

SEQ ID NO: 358220 - protein, 25 aa, Mycobacterium
IAEAISCVLVWQAARWRPTLQFSKS

SEQ ID NO: 358221 - protein, 27 aa, Mycobacterium
IAEFDDLWRPIRSYFYWERHCSDIPIC

SEQ ID NO: 358222 - protein, 23 aa, Mycobacterium
IAEIELLRRYGLLSFATAREFGG

SEQ ID NO: 358223 - protein, 24 aa, Mycobacterium
IAETPAAPWYLSVAIMAALVVVGA

SEQ ID NO: 358224 - protein, 17 aa, Mycobacterium
IAFALGYPMDFATYVTL

SEQ ID NO: 358225 - protein, 20 aa, Mycobacterium
IAFALLAFAFIGPAASMAIR

SEQ ID NO: 358226 - protein, 17 aa, Mycobacterium
IAFAVITVWMLVENSIG

SEQ ID NO: 358227 - protein, 18 aa, Mycobacterium
IAFDENGIRPLYLDGLSS

SEQ ID NO: 358228 - protein, 24 aa, Mycobacterium
IAFGIYFLRDYLILIVVAGVAAYL

SEQ ID NO: 358229 - protein, 19 aa, Mycobacterium
IAFGVWTLFPVMALFMPQD

SEQ ID NO: 358230 - protein, 29 aa, Mycobacterium
IAFGYAALPFWPQGKIYDAYFSDAGGINP

SEQ ID NO: 358231 - protein, 24 aa, Mycobacterium
IAFGYAGLPFIPQGKTYDAYFTDA

SEQ ID NO: 358232 - protein, 25 aa, Mycobacterium
IAFGYSGLPFLPQGKTYNAYFSDAG

SEQ ID NO: 358233 - protein, 29 aa, Mycobacterium
IAFGYSGLPFWPQGKIYDAYFSDAGGINP

SEQ ID NO: 358234 - protein, 17 aa, Mycobacterium
IAFIFLLIRTGMSKFTP

SEQ ID NO: 358235 - protein, 34 aa, Mycobacterium
IAFLGFSGIWTYIGFAFLGALFAMLMVYLIGMTG

SEQ ID NO: 358236 - protein, 18 aa, Mycobacterium
IAFLLAGLGGFIAMCQCV

SEQ ID NO: 358237 - protein, 22 aa, Mycobacterium
IAFLLFAVWAWREGAAGDDKPA

SEQ ID NO: 358238 - protein, 32 aa, Mycobacterium
IAFLLLPILVVIWLSLYRWDLLGPLRYVGLAN

SEQ ID NO: 358239 - protein, 24 aa, Mycobacterium
IAFLPPLPVILTLCAVTGLVYGPI

SEQ ID NO: 358240 - protein, 18 aa, Mycobacterium
IAFLSAIVCLAYPAVLAG

SEQ ID NO: 358241 - protein, 21 aa, Mycobacterium
IAFNYLGRVSGLTGAGWQLCP

SEQ ID NO: 358242 - protein, 25 aa, Mycobacterium
IAFSTMFAMLLGYAVPDFPGARWIA

SEQ ID NO: 358243 - protein, 20 aa, Mycobacterium
IAFVGPLLGSLARIYGGRLA

SEQ ID NO: 358244 - protein, 24 aa, Mycobacterium
IAGAFAVLFLPYSAIGPFAGALLD

SEQ ID NO: 358245 - protein, 26 aa, Mycobacterium
IAGALGILRLVAVFGPVHFFAQPVVS

SEQ ID NO: 358246 - protein, 25 aa, Mycobacterium
IAGALGIMRLVTLFAPVHFFAQPVV

SEQ ID NO: 358247 - protein, 37 aa, Mycobacterium
IAGDRSMRLILLVTFAVIVVMLLVIYGSVTTALAVLV

SEQ ID NO: 358248 - protein, 19 aa, Mycobacterium
IAGFFFVVALLYGVLTALF

SEQ ID NO: 358249 - protein, 24 aa, Mycobacterium
IAGFVFSWLRRRSGSLLAPIALHW

SEQ ID NO: 358250 - protein, 33 aa, Mycobacterium
IAGGYLLVLAMLYGWLFMHRGVAYFPNLVVPIV

SEQ ID NO: 358251 - protein, 28 aa, Mycobacterium
IAGHRQPYWVCGLYLVLLTVVAVGATHY

SEQ ID NO: 358252 - protein, 31 aa, Mycobacterium
IAGIAALGLIFIIMLILTRAVVAAAVIVGTV

SEQ ID NO: 358253 - protein, 29 aa, Mycobacterium
IAGIGAFVFAWLAMVGLIGGGYAALHVVL

SEQ ID NO: 358254 - protein, 28 aa, Mycobacterium
IAGIGYGTLWLRRWPTRRQSLMMGMVGG

SEQ ID NO: 358255 - protein, 26 aa, Mycobacterium
IAGIVLGFIWMIVLAVVVAVGAGNSA

SEQ ID NO: 358256 - protein, 21 aa, Mycobacterium
IAGIYLVAVYRLSRRGAPWST

SEQ ID NO: 358257 - protein, 22 aa, Mycobacterium
IAGLAHRGVLVVALVAAVVGTL

SEQ ID NO: 358258 - protein, 21 aa, Mycobacterium
IAGLLCLLIAFPVAYYVARLS

SEQ ID NO: 358259 - protein, 21 aa, Mycobacterium
IAGPIARLALVGAAAEGSAVI

SEQ ID NO: 358260 - protein, 25 aa, Mycobacterium
IAGSAPLWSGRMFVEARWLSVGLLS

SEQ ID NO: 358261 - protein, 32 aa, Mycobacterium
IAGTFISVLVLWDLLGHLPLPLGVAGHEGSTV

SEQ ID NO: 358262 - protein, 30 aa, Mycobacterium
IAGVAAICLIFIIMLIMTRSFIAALVIVGT

SEQ ID NO: 358263 - protein, 30 aa, Mycobacterium
IAGVAALCLIFIIMLLMTRSLVAALVIVGT

SEQ ID NO: 358264 - protein, 19 aa, Mycobacterium
IAGVFWPKKFVATSVINSV

SEQ ID NO: 358265 - protein, 40 aa, Mycobacterium
IAGVLLKMFWPSAPRWLGVPLYILLGWVAAWFIGPIMDGA

SEQ ID NO: 358266 - protein, 29 aa, Mycobacterium
IAGVSALCLIFIIMLIMTRSFIAAMVIVG

SEQ ID NO: 358267 - protein, 25 aa, Mycobacterium
IAGVSYMRYPLFLGFDIVGGIAWGG

SEQ ID NO: 358268 - protein, 21 aa, Mycobacterium
IAGVVIIRRALAPLRRVAQTA

SEQ ID NO: 358269 - protein, 23 aa, Mycobacterium
IAGWGREYPALTGVIHAAGVLDD

SEQ ID NO: 358270 - protein, 33 aa, Mycobacterium
IAGWGWLALTLIGVPWLLSFAQPTIWQIGRPWY

SEQ ID NO: 358271 - protein, 17 aa, Mycobacterium
IAGYRIEGVLGSGGMGT

SEQ ID NO: 358272 - protein, 17 aa, Mycobacterium
IAHAAWLALLVAGGAGA

SEQ ID NO: 358273 - protein, 19 aa, Mycobacterium
IAHGLGMPIDLGWQLWAYG

SEQ ID NO: 358274 - protein, 22 aa, Mycobacterium
IAHMMLSMLAPILLVLGAPVTL

SEQ ID NO: 358275 - protein, 25 aa, Mycobacterium
IAHYRDLLWLGALALIASSVAALLV

SEQ ID NO: 358276 - protein, 19 aa, Mycobacterium
IAIELILGVALLVLALRRD

SEQ ID NO: 358277 - protein, 25 aa, Mycobacterium
IAIGALVITLLFPTELFMARHYALA

SEQ ID NO: 358278 - protein, 20 aa, Mycobacterium
IAIGEWLFGYDPFGWRFAAA

SEQ ID NO: 358279 - protein, 18 aa, Mycobacterium
IAIGEWLFGYNGLGWRFS

SEQ ID NO: 358280 - protein, 21 aa, Mycobacterium
IAIGVLGLIGAFVLMAVVFAG

SEQ ID NO: 358281 - protein, 19 aa, Mycobacterium
IAIIAVVVPFAAGLSLVGT

SEQ ID NO: 358282 - protein, 20 aa, Mycobacterium
IAIIMIYLAYLMVTGPLLKK

SEQ ID NO: 358283 - protein, 25 aa, Mycobacterium
IAILALKPLLTALFLRAGGAGGMLT

SEQ ID NO: 358284 - protein, 17 aa, Mycobacterium
IAILAVAMLAAVSGWRS

SEQ ID NO: 358285 - protein, 25 aa, Mycobacterium
IAILIAWYLLLRLFNYTLSSVAAPA

SEQ ID NO: 358286 - protein, 19 aa, Mycobacterium
IAILLPITYTIDPVSAIIM

SEQ ID NO: 358287 - protein, 26 aa, Mycobacterium
IAILLVWSRLPAMVRMVPGPLVAIAG

SEQ ID NO: 358288 - protein, 33 aa, Mycobacterium
IAINPDLRRPALGWVLFTVLIGWSAACAVAYLR

SEQ ID NO: 358289 - protein, 28 aa, Mycobacterium
IAIPLSFLVLVWVFGGLLAAALPMALGA

SEQ ID NO: 358290 - protein, 20 aa, Mycobacterium
IAIRPIPYLVTTRLIASVVA

SEQ ID NO: 358291 - protein, 20 aa, Mycobacterium
IAIRPIPYLVTTRLMAAIVV

SEQ ID NO: 358292 - protein, 18 aa, Mycobacterium
IAIVAMGALFMLMKLIRR

SEQ ID NO: 358293 - protein, 31 aa, Mycobacterium
IAIVIYYVMLTFVARPYLIPSESMEPTLHGC

SEQ ID NO: 358294 - protein, 18 aa, Mycobacterium
IAIWIGRPIIRLTFRNEL

SEQ ID NO: 358295 - protein, 32 aa, Mycobacterium
IAKLRLFRVPELLAGSFLLALLAVTSANFFTA

SEQ ID NO: 358296 - protein, 17 aa, Mycobacterium
IAKPLVPGVMIVAALIA

SEQ ID NO: 358297 - protein, 31 aa, Mycobacterium
IALAAAGLVFLWQPPAKLTGWPLQVTDALGL

SEQ ID NO: 358298 - protein, 37 aa, Mycobacterium
IALAAIGGFILLIKKIWWPLAVWVLLVVMNVNAGTPL

SEQ ID NO: 358299 - protein, 18 aa, Mycobacterium
IALAIALPAGIYAALREG

SEQ ID NO: 358300 - protein, 26 aa, Mycobacterium
IALASIWLSGPLLLGLGALQLVLLVL

SEQ ID NO: 358301 - protein, 17 aa, Mycobacterium
IALFIVCGAGKGAVYKL

SEQ ID NO: 358302 - protein, 17 aa, Mycobacterium
IALGFLFGGYEIADSGN

SEQ ID NO: 358303 - protein, 17 aa, Mycobacterium
IALGLAALAMRLGWLPE

SEQ ID NO: 358304 - protein, 21 aa, Mycobacterium
IALGLLFDTLIVRSFMTPAIA

SEQ ID NO: 358305 - protein, 24 aa, Mycobacterium
IALGLRFSYGWIAALAFVLVPVAI

SEQ ID NO: 358306 - protein, 24 aa, Mycobacterium
IALIVGFMFHALYRADKPLIDLRL

SEQ ID NO: 358307 - protein, 23 aa, Mycobacterium
IALLGFFAFYLSFVAELPPPPPK

SEQ ID NO: 358308 - protein, 18 aa, Mycobacterium
IALLGPRLDALDARPILH

SEQ ID NO: 358309 - protein, 18 aa, Mycobacterium
IALLISVLLAMVLLYIRP

SEQ ID NO: 358310 - protein, 27 aa, Mycobacterium
IALLPPLPVILVLCALIGVVYGPIQPI

SEQ ID NO: 358311 - protein, 20 aa, Mycobacterium
IALLVVLVSGALMGLLGGGD

SEQ ID NO: 358312 - protein, 24 aa, Mycobacterium
IALNAALDLVFIYGLLGIPRLGLA

SEQ ID NO: 358313 - protein, 23 aa, Mycobacterium
IALRWLLLLAVTIAVTVPLTLIG

SEQ ID NO: 358314 - protein, 23 aa, Mycobacterium
IALSAPLLAWIVALKDVYADNLG

SEQ ID NO: 358315 - protein, 24 aa, Mycobacterium
IALSATCYFFAELMLRPAATIALG

SEQ ID NO: 358316 - protein, 20 aa, Mycobacterium
IALTAITLGSWWLAPAHFTT

SEQ ID NO: 358317 - protein, 17 aa, Mycobacterium
IALTCALAPGAGRPRWW

SEQ ID NO: 358318 - protein, 19 aa, Mycobacterium
IALVAIWTDLPAAQAIPPP

SEQ ID NO: 358319 - protein, 18 aa, Mycobacterium
IALVIAIPAGIWSALREG

SEQ ID NO: 358320 - protein, 18 aa, Mycobacterium
IALWAPTLLVMTLGIDPA

SEQ ID NO: 358321 - protein, 21 aa, Mycobacterium
IAMAAVFYPPAFAALTRWYGP

SEQ ID NO: 358322 - protein, 26 aa, Mycobacterium
IAMAITLLTLAPLLGIPLPGRVRWQR

SEQ ID NO: 358323 - protein, 19 aa, Mycobacterium
IAMGLALGVLLGVAIAVVR

SEQ ID NO: 358324 - protein, 34 aa, Mycobacterium
IAMLLTIAAALTLGPALLHLGSLFGLFDPKRRVK

SEQ ID NO: 358325 - protein, 20 aa, Mycobacterium
IAMPILPQAWRAWAWVIIVV

SEQ ID NO: 358326 - protein, 24 aa, Mycobacterium
IAMPLGIWVFAPLRRRATAALATA

SEQ ID NO: 358327 - protein, 26 aa, Mycobacterium
IAMPLGMWIFTPLRRQATAALAVAGE

SEQ ID NO: 358328 - protein, 17 aa, Mycobacterium
IAMVLMFYELFAMVREY

SEQ ID NO: 358329 - protein, 23 aa, Mycobacterium
IAMVSLLLKLDIARGYLAVALPV

SEQ ID NO: 358330 - protein, 22 aa, Mycobacterium
IAMVTLLAKIDLARGYLAVALP

SEQ ID NO: 358331 - protein, 27 aa, Mycobacterium
IANFDDFWRPIRSYFYWEKHCYDIPIC

SEQ ID NO: 358332 - protein, 20 aa, Mycobacterium
IANFYNIYDPAQGTLNGLLS

SEQ ID NO: 358333 - protein, 23 aa, Mycobacterium
IANYLLVALLAAIAGLIGILFKN

SEQ ID NO: 358334 - protein, 23 aa, Mycobacterium
IANYLVVIAFIVGVGFFAPGRFW

SEQ ID NO: 358335 - protein, 20 aa, Mycobacterium
IAPAYYLIAAAIVSLLTVLT

SEQ ID NO: 358336 - protein, 24 aa, Mycobacterium
IAPDAVLLSIRQTAQTFGLVDPGV

SEQ ID NO: 358337 - protein, 19 aa, Mycobacterium
IAPLRAPDLSGLPPAIVVS

SEQ ID NO: 358338 - protein, 24 aa, Mycobacterium
IAPLWSRRLVARGLPKPLADALAV

SEQ ID NO: 358339 - protein, 23 aa, Mycobacterium
IAPPVLTDRGLPSALAALAIRCT

SEQ ID NO: 358340 - protein, 18 aa, Mycobacterium
IAPWEQAAHLLDYGFSTA

SEQ ID NO: 358341 - protein, 18 aa, Mycobacterium
IAPWEQAAHLLDYGFSTP

SEQ ID NO: 358342 - protein, 22 aa, Mycobacterium
IAQAWFVARVSLLPTLMLTIPY

SEQ ID NO: 358343 - protein, 21 aa, Mycobacterium
IAQLLVGWLTCGLGALVWGVI

SEQ ID NO: 358344 - protein, 22 aa, Mycobacterium
IAQLLVGWLTCGVGAVIWGVID

SEQ ID NO: 358345 - protein, 23 aa, Mycobacterium
IAQLTARLAFLAAAGPAVSMGVI

SEQ ID NO: 358346 - protein, 25 aa, Mycobacterium
IAQNLPLLLGFYAQPATLPIPPADA

SEQ ID NO: 358347 - protein, 24 aa, Mycobacterium
IAQRRPVISLLRAIGGRRVTIVGD

SEQ ID NO: 358348 - protein, 27 aa, Mycobacterium
IAQTNNLHRRVILICALSIGAAAVFAW

SEQ ID NO: 358349 - protein, 32 aa, Mycobacterium
IAQYAGIPYGYWIPLTALLVLRPETAHTYTRC

SEQ ID NO: 358350 - protein, 17 aa, Mycobacterium
IARFNARTGYHLALRAG

SEQ ID NO: 358351 - protein, 30 aa, Mycobacterium
IARKIHAFAVPIVLGWLAICVALTVFVPSL

SEQ ID NO: 358352 - protein, 19 aa, Mycobacterium
IARLAGGLLLVGYGAKAGL

SEQ ID NO: 358353 - protein, 19 aa, Mycobacterium
IARNLPLLPSLYAQPATVA

SEQ ID NO: 358354 - protein, 24 aa, Mycobacterium
IARPLVPTIMVLAAAVAAIGALVG

SEQ ID NO: 358355 - protein, 35 aa, Mycobacterium
IARREPWFRRYATTYLLFAPISLGTTFFSLRAAQS

SEQ ID NO: 358356 - protein, 24 aa, Mycobacterium
IARRNLLWIIACDHIAFGVWTLFP

SEQ ID NO: 358357 - protein, 39 aa, Mycobacterium
IARRQFRLVVADRAYFVFLALLPFIMGSLSLTVPGSNGF

SEQ ID NO: 358358 - protein, 25 aa, Mycobacterium
IARSLLRVVILLGVLYIFATYPQIL

SEQ ID NO: 358359 - protein, 24 aa, Mycobacterium
IARSRPFISLIIAFALASCASYAV

SEQ ID NO: 358360 - protein, 25 aa, Mycobacterium
IARWTATVFGLLGFVLSVSIPLLPV

SEQ ID NO: 358361 - protein, 30 aa, Mycobacterium
IASAVAFLLAWATFRIGDRVRPLPTPAGRV

SEQ ID NO: 358362 - protein, 18 aa, Mycobacterium
IASFFLFPGFNPPMSPAM

SEQ ID NO: 358363 - protein, 25 aa, Mycobacterium
IASGAMVFAILVLLGRYINYTLDLA

SEQ ID NO: 358364 - protein, 28 aa, Mycobacterium
IASGAMVFAILVLLGRYINYTLDLAGIA

SEQ ID NO: 358365 - protein, 28 aa, Mycobacterium
IASGPLLLWFAIFFTFQAIAIRFWEEPH

SEQ ID NO: 358366 - protein, 25 aa, Mycobacterium
IASGVLLIRWLIARRAAAFAHHGLP

SEQ ID NO: 358367 - protein, 28 aa, Mycobacterium
IASIAACVWLMLNLTALTWVRFGVWLVV

SEQ ID NO: 358368 - protein, 23 aa, Mycobacterium
IASIPLIVLLPELGIPALLVAFR

SEQ ID NO: 358369 - protein, 29 aa, Mycobacterium
IASLAVGLIMFFLIGRPLALINTGLTNWL

SEQ ID NO: 358370 - protein, 28 aa, Mycobacterium
IASLCLIFVIMLILTRALVAAGVIVGTV

SEQ ID NO: 358371 - protein, 27 aa, Mycobacterium
IASLIGAMLLIKALGLGYTSYTAEFVQ

SEQ ID NO: 358372 - protein, 31 aa, Mycobacterium
IASLTAITHDPWLIPPLAASAALVVGGAHFP

SEQ ID NO: 358373 - protein, 24 aa, Mycobacterium
IASPAYFFALTGLVSIAALAVLRP

SEQ ID NO: 358374 - protein, 36 aa, Mycobacterium
IASSATLVFGLLLIAISAWLTATPVRLVRAALKQVE

SEQ ID NO: 358375 - protein, 22 aa, Mycobacterium
IASSIQLPAWLSRTGADVLKAH

SEQ ID NO: 358376 - protein, 22 aa, Mycobacterium
IASWHWVLIVGGVLPVVYAVVV

SEQ ID NO: 358377 - protein, 58 aa, Mycobacterium
IATLAGCLPAVIWLACHRPNRLWWRYTAWWLVALVLATLWWVVALSQLRGVSPPFLDF

SEQ ID NO: 358378 - protein, 18 aa, Mycobacterium
IATLGALDKLFLAVVVLV

SEQ ID NO: 358379 - protein, 18 aa, Mycobacterium
IATMVITIPLAWVLHRFT

SEQ ID NO: 358380 - protein, 19 aa, Mycobacterium
IATPTLWARTAGICLVFGA

SEQ ID NO: 358381 - protein, 19 aa, Mycobacterium
IATTGFAAGFFYFGYRPDQ

SEQ ID NO: 358382 - protein, 19 aa, Mycobacterium
IATVACCSVLLLTGIAVVE

SEQ ID NO: 358383 - protein, 40 aa, Mycobacterium
IATVLIVLMILIIVYRNLVAMLLPLLMIGMALVVAEQSVA

SEQ ID NO: 358384 - protein, 29 aa, Mycobacterium
IATVLSWALFTWMIARLPRERLPFSSSVR

SEQ ID NO: 358385 - protein, 43 aa, Mycobacterium
IATVPPTPAWRKLLAQFHSPLIYLLLAALIASLAVWVVEGAGG

SEQ ID NO: 358386 - protein, 24 aa, Mycobacterium
IATWLLDKFGTWVPIALYLAGAAV

SEQ ID NO: 358387 - protein, 17 aa, Mycobacterium
IATWLLVTMEVASLTLG

SEQ ID NO: 358388 - protein, 36 aa, Mycobacterium
IAVAAPPILAFAGPWIFLRIRFFRRKLIAVQLAATP

SEQ ID NO: 358389 - protein, 31 aa, Mycobacterium
IAVALLVVAVFLPWNLYFGVGIPGSRPALFT

SEQ ID NO: 358390 - protein, 30 aa, Mycobacterium
IAVAVAVALVLWWRMIRFEYALLVTIATTA

SEQ ID NO: 358391 - protein, 19 aa, Mycobacterium
IAVAVGALITLGPLALSLQ

SEQ ID NO: 358392 - protein, 20 aa, Mycobacterium
IAVAVGALITLGPLALSLQS

SEQ ID NO: 358393 - protein, 48 aa, Mycobacterium
IAVDATIVRLILVPALMAMFSQWNWWLPRWLARMLPSVDFDRPLPEVD

SEQ ID NO: 358394 - protein, 22 aa, Mycobacterium
IAVGLALVGLIAFVIVVQPSAS

SEQ ID NO: 358395 - protein, 33 aa, Mycobacterium
IAVIAALLVIVALVVGLLRYRRRRISLAARPEV

SEQ ID NO: 358396 - protein, 19 aa, Mycobacterium
IAVIAALWGPPGSATSAVA

SEQ ID NO: 358397 - protein, 18 aa, Mycobacterium
IAVIATVAAVAAAIVGAC

SEQ ID NO: 358398 - protein, 35 aa, Mycobacterium
IAVIAVLLVVALVVGLVRYRRRQIKLSAPDTATPV

SEQ ID NO: 358399 - protein, 25 aa, Mycobacterium
IAVIIIMLVLVYRSIACVVLILLTV

SEQ ID NO: 358400 - protein, 24 aa, Mycobacterium
IAVIVLWLLFAVLRGRLHPVGGLG

SEQ ID NO: 358401 - protein, 24 aa, Mycobacterium
IAVIVMLGVLLFIASYDSFRNLTA

SEQ ID NO: 358402 - protein, 17 aa, Mycobacterium
IAVLSMAALWQVERRSA

SEQ ID NO: 358403 - protein, 18 aa, Mycobacterium
IAVLSTGLIFGMTLVLTG

SEQ ID NO: 358404 - protein, 36 aa, Mycobacterium
IAVLVLAVLLLVYRSALTMMLPLVTIGSSLVIAQSV

SEQ ID NO: 358405 - protein, 27 aa, Mycobacterium
IAVLVSMWWYWGLYVRAMRLNPDFESY

SEQ ID NO: 358406 - protein, 19 aa, Mycobacterium
IAVLWRWILAPTDGALSTV

SEQ ID NO: 358407 - protein, 18 aa, Mycobacterium
IAVPAIAVSSALRSHALQ

SEQ ID NO: 358408 - protein, 22 aa, Mycobacterium
IAVPLLGWALLIADVVLMAASV

SEQ ID NO: 358409 - protein, 20 aa, Mycobacterium
IAVQLGIAIIWIASLSFLGL

SEQ ID NO: 358410 - protein, 26 aa, Mycobacterium
IAVRPDLPEVLLPQNYQPPANLAPPP

SEQ ID NO: 358411 - protein, 22 aa, Mycobacterium
IAVTTIYDWVPAPAGLVLAAVI

SEQ ID NO: 358412 - protein, 24 aa, Mycobacterium
IAVTWMVYATLRRDVAGPTTPYAA

SEQ ID NO: 358413 - protein, 21 aa, Mycobacterium
IAVVALSWPDPLTGLLGCITF

SEQ ID NO: 358414 - protein, 38 aa, Mycobacterium
IAVVAVLLLVAALVLGLVRYRRRRISFTAKPEPGAIDR

SEQ ID NO: 358415 - protein, 18 aa, Mycobacterium
IAVVFVGAVLLLMCIVLR

SEQ ID NO: 358416 - protein, 32 aa, Mycobacterium
IAVVLYYVMLTFVARPYLIPSESMEPTLHGCS

SEQ ID NO: 358417 - protein, 25 aa, Mycobacterium
IAVVTFVLIFLMTGSVILPIKALVM

SEQ ID NO: 358418 - protein, 30 aa, Mycobacterium
IAVVVFLGLGLLWTMGLWPSATPGLGKLVD

SEQ ID NO: 358419 - protein, 18 aa, Mycobacterium
IAVWLLKTFDSSVPIAIY

SEQ ID NO: 358420 - protein, 42 aa, Mycobacterium
IAVYGVLMTPLGWGWATVVWAYALFWFLVEDRVKLSTYQWLD

SEQ ID NO: 358421 - protein, 24 aa, Mycobacterium
IAWCALFPILWALSGSLKKSGEVS

SEQ ID NO: 358422 - protein, 23 aa, Mycobacterium
IAWRVFQLLTLAGVLWVGWRLLG

SEQ ID NO: 358423 - protein, 30 aa, Mycobacterium
IAWTRSGHGWWWAVALGVLGLGLLGGSMAA

SEQ ID NO: 358424 - protein, 28 aa, Mycobacterium
IAWWHDPLINWFQPALFYNASLLNFGNW

SEQ ID NO: 358425 - protein, 21 aa, Mycobacterium
IAYAGLLFTWLLVAARTARGS

SEQ ID NO: 358426 - protein, 21 aa, Mycobacterium
IAYIGLLCTWLLVAVRTLRVG

SEQ ID NO: 358427 - protein, 20 aa, Mycobacterium
IAYLLIIEPPLYFPGAFGIS

SEQ ID NO: 358428 - protein, 24 aa, Mycobacterium
ICAALAFPPLTFPGAWTIPQLAAR

SEQ ID NO: 358429 - protein, 25 aa, Mycobacterium
ICAFVHSYWQLLVFRSVGGVGSTMF

SEQ ID NO: 358430 - protein, 39 aa, Mycobacterium; identical to SEQ ID NO: 22276

SEQ ID NO: 358431 - protein, 25 aa, Mycobacterium
ICANLIRVLLVALVGFELAFSADDV

SEQ ID NO: 358432 - protein, 43 aa, Mycobacterium
ICAVAVFSAIFLRDLRIPAIGVVLLLLSSLVVGAGWPLVVEQI

SEQ ID NO: 358433 - protein, 18 aa, Mycobacterium
ICAVAVFSALVLRDLRIP

SEQ ID NO: 358434 - protein, 17 aa, Mycobacterium
ICERVEDVLYWVRRTRV

SEQ ID NO: 358435 - protein, 18 aa, Mycobacterium
ICFVLTWSEATLGFCVGC

SEQ ID NO: 358436 - protein, 25 aa, Mycobacterium
ICGNGLRPAIWDDFTKRFGIDRVCE

SEQ ID NO: 358437 - protein, 30 aa, Mycobacterium
ICGTALFVAAVALTFLAVTTSRNASAVQAA

SEQ ID NO: 358438 - protein, 46 aa, Mycobacterium
ICIGLVFDMMIVRLFLVMPLARLLGPWFWWPQKLPRRQPVQLRGTP

SEQ ID NO: 358439 - protein, 19 aa, Mycobacterium
ICLGCQLYPLVARLRRARA

SEQ ID NO: 358440 - protein, 21 aa, Mycobacterium
ICNLMGLRQLGCSTGTLQDYG

SEQ ID NO: 358441 - protein, 17 aa, Mycobacterium
ICNMMGLRQLGCSTGTM

SEQ ID NO: 358442 - protein, 17 aa, Mycobacterium
ICPQPWIALALAAVVGI

SEQ ID NO: 358443 - protein, 27 aa, Mycobacterium
ICSADPWVYGYTFPATPLNYGPMAFHP

SEQ ID NO: 358444 - protein, 32 aa, Mycobacterium
ICSALVEFFRAIPVLILMVFSYYLYGQQAVFP

SEQ ID NO: 358445 - protein, 17 aa, Mycobacterium
ICSHWWPELPGNGKSIL

SEQ ID NO: 358446 - protein, 19 aa, Mycobacterium
ICVGAYAPYVAWLMQASAD

SEQ ID NO: 358447 - protein, 18 aa, Mycobacterium
ICYAIWLSVQKYSFASPQ

SEQ ID NO: 358448 - protein, 26 aa, Mycobacterium
IDAALYAALLVLLAIALVSDGSGPIP

SEQ ID NO: 358449 - protein, 24 aa, Mycobacterium
IDAANRSVLLPLGLTPEQVSMAKP

SEQ ID NO: 358450 - protein, 25 aa, Mycobacterium
IDADGFLWIVGRADQAIIRGGFKVM

SEQ ID NO: 358451 - protein, 18 aa, Mycobacterium
IDAGWFLINCDPDTYRRV

SEQ ID NO: 358452 - protein, 29 aa, Mycobacterium
IDARLWQAIIVLAAITAVALAISCLSARR

SEQ ID NO: 358453 - protein, 23 aa, Mycobacterium
IDAWLVGIVGWLSPWAAVMLVHY

SEQ ID NO: 358454 - protein, 18 aa, Mycobacterium
IDEISLGAAINYAVNVKN

SEQ ID NO: 358455 - protein, 17 aa, Mycobacterium
IDELGLPPFRVPAPRNS

SEQ ID NO: 358456 - protein, 25 aa, Mycobacterium
IDFTAIAHTLLVAAALFCVSAFLVS

SEQ ID NO: 358457 - protein, 20 aa, Mycobacterium
IDGFLLGLFAAMGIGLVLPA

SEQ ID NO: 358458 - protein, 32 aa, Mycobacterium
IDGGILVKALLVLGLWLAGWGAAVLVARALPA

SEQ ID NO: 358459 - protein, 17 aa, Mycobacterium
IDGIKERQFHIALVGAV

SEQ ID NO: 358460 - protein, 19 aa, Mycobacterium
IDGLLFVDMRMIDGVDLRR

SEQ ID NO: 358461 - protein, 22 aa, Mycobacterium
IDGQMFLEMRLIEGTDLDSILK

SEQ ID NO: 358462 - protein, 22 aa, Mycobacterium
IDGQMFLEMRLIEGTDLDSVLK

SEQ ID NO: 358463 - protein, 24 aa, Mycobacterium
IDGQMFLEMRLIEGTNLDSLLKRF

SEQ ID NO: 358464 - protein, 18 aa, Mycobacterium
IDGRIESLLPAILEGRQL

SEQ ID NO: 358465 - protein, 20 aa, Mycobacterium
IDGRLFVDMRLIEGHDLQSV

SEQ ID NO: 358466 - protein, 17 aa, Mycobacterium
IDGRLYPALNFTSARLA

SEQ ID NO: 358467 - protein, 18 aa, Mycobacterium
IDHFLVQADLTVVVPGPL

SEQ ID NO: 358468 - protein, 18 aa, Mycobacterium
IDHLPRLRRELEKRLGPE

SEQ ID NO: 358469 - protein, 22 aa, Mycobacterium
IDIAGAWRWTALFAALVTVVSI

SEQ ID NO: 358470 - protein, 22 aa, Mycobacterium
IDIPVMVVATLLLIPVFFSGRR

SEQ ID NO: 358471 - protein, 25 aa, Mycobacterium
IDIWQWTPFMVLLILAGLESMPKQP

SEQ ID NO: 358472 - protein, 29 aa, Mycobacterium
IDKIVYWSQYQAQVLFTMQVTPATGGPPK

SEQ ID NO: 358473 - protein, 17 aa, Mycobacterium
IDLLIAGVAALCLIFII

SEQ ID NO: 358474 - protein, 21 aa, Mycobacterium
IDLPFALPTIVASLVMLALYG

SEQ ID NO: 358475 - protein, 25 aa, Mycobacterium
IDLQDPALLQFTYVRAFASVVDASF

SEQ ID NO: 358476 - protein, 20 aa, Mycobacterium
IDLQLFTHPVYRSALVVYFV

SEQ ID NO: 358477 - protein, 22 aa, Mycobacterium
IDLSRTVGWFTAKYPVSLSGRG

SEQ ID NO: 358478 - protein, 25 aa, Mycobacterium
IDLSRTVGWFTTKYPVALAVSGKPG

SEQ ID NO: 358479 - protein, 17 aa, Mycobacterium
IDMKSQVIGINTAGKSL

SEQ ID NO: 358480 - protein, 17 aa, Mycobacterium
IDMLAIFATLFGSAASL

SEQ ID NO: 358481 - protein, 25 aa, Mycobacterium
IDNFNWTFYAFGLGLLVMAGNLAKP

SEQ ID NO: 358482 - protein, 27 aa, Mycobacterium
IDNIETSLWMTISPLLTAVLTVVAVLS

SEQ ID NO: 358483 - protein, 24 aa, Mycobacterium
IDNTQALRWRTTVGAAAISLAQRI

SEQ ID NO: 358484 - protein, 24 aa, Mycobacterium
IDPAAWAYVLYTSGSTGRPKGVAV

SEQ ID NO: 358485 - protein, 20 aa, Mycobacterium
IDPEEFWRNAGLPAFRFPDP

SEQ ID NO: 358486 - protein, 25 aa, Mycobacterium
IDPLFASTYLALALLVATRYVVAMR

SEQ ID NO: 358487 - protein, 27 aa, Mycobacterium
IDPPKEPPWRRLRFSQLLIGFSAVVAM

SEQ ID NO: 358488 - protein, 21 aa, Mycobacterium
IDQSVLGAALRYAALEKDAVI

SEQ ID NO: 358489 - protein, 22 aa, Mycobacterium
IDRAHLLLRFEQGSWVAIDNNS

SEQ ID NO: 358490 - protein, 30 aa, Mycobacterium
IDRAWDVLCDLEQVIPLMPGAQLTGHEGDD

SEQ ID NO: 358491 - protein, 29 aa, Mycobacterium
IDRRRPLPTFAPMTLQQWFARRPVVNAGG

SEQ ID NO: 358492 - protein, 23 aa, Mycobacterium
IDRYHMRILAICGGVLIGTVIVG

SEQ ID NO: 358493 - protein, 23 aa, Mycobacterium
IDSAIFFTLKLTILEPKPVTAKI

SEQ ID NO: 358494 - protein, 19 aa, Mycobacterium
IDSAIFYTLKLTILEPKPV

SEQ ID NO: 358495 - protein, 34 aa, Mycobacterium
IDSKRKQWIIVGAIALVALVAFIVAVAGYLSTRS

SEQ ID NO: 358496 - protein, 24 aa, Mycobacterium
IDSTRARVILLDAAPAVLPPFGDK

SEQ ID NO: 358497 - protein, 17 aa, Mycobacterium
IDVNACGYHIASEGRQL

SEQ ID NO: 358498 - protein, 18 aa, Mycobacterium
IDVPPPPLRALSVTADPA

SEQ ID NO: 358499 - protein, 27 aa, Mycobacterium
IDVRDYHTELLWSAIGLVPQRGYLFSG

SEQ ID NO: 358500 - protein, 23 aa, Mycobacterium
IDVTAFQWNWKFGYQRVDFHDHT

SEQ ID NO: 358501 - protein, 22 aa, Mycobacterium
IDVTAFQWNWKFGYQRVDFKDG

SEQ ID NO: 358502 - protein, 26 aa, Mycobacterium
IDVWQWTPFMVLLLLAGLESIPKEPL

SEQ ID NO: 358503 - protein, 20 aa, Mycobacterium
IDVYTLVLASLLLLAGATGD

SEQ ID NO: 358504 - protein, 19 aa, Mycobacterium
IDWGALLIVSVLTVLLAVG

SEQ ID NO: 358505 - protein, 24 aa, Mycobacterium
IDWIIWGVIIAAATLGAAIGVPVV

SEQ ID NO: 358506 - protein, 18 aa, Mycobacterium
IDYSFGRHKYWCNINADK

SEQ ID NO: 358507 - protein, 23 aa, Mycobacterium
IDYSLFILMRFREELRAGRDQQD

SEQ ID NO: 358508 - protein, 23 aa, Mycobacterium
IDYSLFILMRFREELRAGREPED

SEQ ID NO: 358509 - protein, 18 aa, Mycobacterium
IEAFAMFNVFYQSGILLG

SEQ ID NO: 358510 - protein, 30 aa, Mycobacterium
IEALQKLVFRILIGVLWLAPIGAFGAIAEV

SEQ ID NO: 358511 - protein, 22 aa, Mycobacterium
IEAPHYPLTLMISVRDTITVTV

SEQ ID NO: 358512 - protein, 42 aa, Mycobacterium
IEAVTFLVIITMLLLVYRSIVTVLITLFLVVICLQSARGVVA

SEQ ID NO: 358513 - protein, 17 aa, Mycobacterium
IEAYLNFVADRLDLRRD

SEQ ID NO: 358514 - protein, 27 aa, Mycobacterium
IEDFQDFWRPIRNYLYWEPHCYDIPLC

SEQ ID NO: 358515 - protein, 20 aa, Mycobacterium
IEFALEIELIVNRFANQSQH

SEQ ID NO: 358516 - protein, 18 aa, Mycobacterium
IEGFTLGIAAIIFLQQIP

SEQ ID NO: 358517 - protein, 27 aa, Mycobacterium
IEGRQLVSRLIPFLRAEVPGFENARLG

SEQ ID NO: 358518 - protein, 23 aa, Mycobacterium
IEGSPLFHIISGNLGYQVEHHLF

SEQ ID NO: 358519 - protein, 22 aa, Mycobacterium
IEGSPLFHVISGNLGYQVEHHL

SEQ ID NO: 358520 - protein, 28 aa, Mycobacterium
IEGTDLDTLLKRFGPLTPPRAVAIISQV

SEQ ID NO: 358521 - protein, 28 aa, Mycobacterium
IEGTHLALLLERFGPVTPPWAVALVHQV

SEQ ID NO: 358522 - protein, 20 aa, Mycobacterium
IEHDPIRALGPWPGAEPQPV

SEQ ID NO: 358523 - protein, 20 aa, Mycobacterium
IEIAPGITIPVGPPTTVPVG

SEQ ID NO: 358524 - protein, 28 aa, Mycobacterium
IEIEKKRRWPWIAGAATAVAAIVGGVVY

SEQ ID NO: 358525 - protein, 19 aa, Mycobacterium
IEIPLLCYLVSPDRTRAVL

SEQ ID NO: 358526 - protein, 22 aa, Mycobacterium
IEKLWTVIGLVPQRGYLFSGTI

SEQ ID NO: 358527 - protein, 28 aa, Mycobacterium
IELAFSFVVLFVPPVARLLGQWNPPLWG

SEQ ID NO: 358528 - protein, 27 aa, Mycobacterium
IELLARLGIAILLFLVGLRLDLHMVRG

SEQ ID NO: 358529 - protein, 25 aa, Mycobacterium
IELPPGYLPLRVPIEVHFTQRVAVD

SEQ ID NO: 358530 - protein, 22 aa, Mycobacterium
IELYDFLIFGLAAGLVFPKLFF

SEQ ID NO: 358531 - protein, 31 aa, Mycobacterium
IEMAPTTPIWRLLLPQLLMGIGMAFIWSPLA

SEQ ID NO: 358532 - protein, 18 aa, Mycobacterium
IEMLLFMLTVFVAYAYVW

SEQ ID NO: 358533 - protein, 31 aa, Mycobacterium
IEMLLNRRKFLPPFITWYAAMLFAVVPLRNI

SEQ ID NO: 358534 - protein, 17 aa, Mycobacterium
IEMLTTLPKFPGLPLPS

SEQ ID NO: 358535 - protein, 19 aa, Mycobacterium
IEMLVPLPLFFCHGGWPVT

SEQ ID NO: 358536 - protein, 19 aa, Mycobacterium
IEMLVPLPLFFCHSGWPIT

SEQ ID NO: 358537 - protein, 29 aa, Mycobacterium
IEMSLSTPIWRLVLPITALGVAIPFVWAP

SEQ ID NO: 358538 - protein, 30 aa, Mycobacterium
IEMVTFTVIIVMLLLVYRSIITAAIMLTMV

SEQ ID NO: 358539 - protein, 25 aa, Mycobacterium
IENIIPIMIALLAAAIAPVPLALAV

SEQ ID NO: 358540 - protein, 31 aa, Mycobacterium
IEPALRFYVIFFVGLLVVTWYRYLRRTAGTS

SEQ ID NO: 358541 - protein, 24 aa, Mycobacterium
IEPKFYAQFLSALGIEDIALAAQL

SEQ ID NO: 358542 - protein, 25 aa, Mycobacterium
IEPLKEPAWRRFRVSQVLIGLSAVV

SEQ ID NO: 358543 - protein, 23 aa, Mycobacterium
IEQTLLQTKRLLIRWARDYVTVI

SEQ ID NO: 358544 - protein, 25 aa, Mycobacterium
IERDTWWSMIGWLPQRPVLIPGTVR

SEQ ID NO: 358545 - protein, 31 aa, Mycobacterium
IERFAPIIGGIRPGLFVSSNFLPGSPAYTYP

SEQ ID NO: 358546 - protein, 21 aa, Mycobacterium
IERQWRARMAGLRTNALVATG

SEQ ID NO: 358547 - protein, 25 aa, Mycobacterium
IERSPVPFARDHWVLAPAPAEIDFV

SEQ ID NO: 358548 - protein, 33 aa, Mycobacterium
IESEASRMGLLVDDLLLLARLDVQRPLEHNRVD

SEQ ID NO: 358549 - protein, 41 aa, Mycobacterium
IETATIVMVLLILLVVYRNPVTMFLPLLTIGLSLVTAQQVV

SEQ ID NO: 358550 - protein, 24 aa, Mycobacterium
IETNLSRVYRKLGIRSRAQLGRML

SEQ ID NO: 358551 - protein, 20 aa, Mycobacterium
IEVAPGITIPVGPPTTITNA

SEQ ID NO: 358552 - protein, 23 aa, Mycobacterium
IEVPILVALVYVSLALRPRLFGA

SEQ ID NO: 358553 - protein, 17 aa, Mycobacterium
IEVRGWRRVGTVVVRWP

SEQ ID NO: 358554 - protein, 19 aa, Mycobacterium
IEVTIYLIVSLLKTTHSHA

SEQ ID NO: 358555 - protein, 25 aa, Mycobacterium
IEVVHGWVYFIYVLTAFNLAIKVRW

SEQ ID NO: 358556 - protein, 18 aa, Mycobacterium
IEWLRLPGDFVFILGGVL

SEQ ID NO: 358557 - protein, 21 aa, Mycobacterium
IEWYDFYLYATAAALVFKPLF

SEQ ID NO: 358558 - protein, 17 aa, Mycobacterium
IEWYDFYLYATAAALVL

SEQ ID NO: 358559 - protein, 18 aa, Mycobacterium
IFAASMAGLLFSSIGLVV

SEQ ID NO: 358560 - protein, 18 aa, Mycobacterium
IFAGYTILRLLGSGGMGE

SEQ ID NO: 358561 - protein, 22 aa, Mycobacterium
IFAIISFTLIWVAAFGAFMFTR

SEQ ID NO: 358562 - protein, 19 aa, Mycobacterium
IFANLLPRYPEIKTDLQLS

SEQ ID NO: 358563 - protein, 25 aa, Mycobacterium
IFATGLGLFMIFLDAFIVNVALPDI

SEQ ID NO: 358564 - protein, 19 aa, Mycobacterium
IFDDLLRPIRNYFYWEPHC

SEQ ID NO: 358565 - protein, 18 aa, Mycobacterium
IFEKVLILPLMIAPVIAG

SEQ ID NO: 358566 - protein, 19 aa, Mycobacterium
IFFFLFVHVLDTALVRVSP

SEQ ID NO: 358567 - protein, 51 aa, Mycobacterium
IFFIAALVVLFYSTFFFFFFAAEVLKIWLPAWAAYLIIFAAMVFVAVLAVL

SEQ ID NO: 358568 - protein, 27 aa, Mycobacterium
IFFVLSGFLLFLPWVKAAAAGDAPPSV

SEQ ID NO: 358569 - protein, 19 aa, Mycobacterium
IFGEIFFPALGASAGTVAS

SEQ ID NO: 358570 - protein, 18 aa, Mycobacterium
IFGFVWYSHPIFGLESLG

SEQ ID NO: 358571 - protein, 25 aa, Mycobacterium
IFGGTIVYGLGFWKGVLAIVVGNAV

SEQ ID NO: 358572 - protein, 27 aa, Mycobacterium
IFGIVAFAAVILWLYKRTQTLSSREVG

SEQ ID NO: 358573 - protein, 24 aa, Mycobacterium
IFGLPLFLYGLALLRRSLKSGLSV

SEQ ID NO: 358574 - protein, 32 aa, Mycobacterium
IFGLWGILVLANWLEPVAAFLNSTLGWLFLFD

SEQ ID NO: 358575 - protein, 25 aa, Mycobacterium
IFGTVLVVCVVLIAFGYAALPFWPQ

SEQ ID NO: 358576 - protein, 19 aa, Mycobacterium
IFIFGVLGTLLWAVSRVSI

SEQ ID NO: 358577 - protein, 18 aa, Mycobacterium
IFIGSIAIVFIFIGRFAF

SEQ ID NO: 358578 - protein, 25 aa, Mycobacterium
IFLGWTATWYTLLFGFSAFAIELMA

SEQ ID NO: 358579 - protein, 17 aa, Mycobacterium
IFLVCVTAAVALAATVL

SEQ ID NO: 358580 - protein, 17 aa, Mycobacterium
IFLYVFISLLVNSEKVT

SEQ ID NO: 358581 - protein, 17 aa, Mycobacterium
IFPSLMPALLSGAGLAF

SEQ ID NO: 358582 - protein, 18 aa, Mycobacterium
IFRMGYYALLVPGTALAK

SEQ ID NO: 358583 - protein, 20 aa, Mycobacterium
IFRTIVFLPLAISSVVMAVV

SEQ ID NO: 358584 - protein, 18 aa, Mycobacterium
IFSLFSLGYVLAAGVALV

SEQ ID NO: 358585 - protein, 25 aa, Mycobacterium
IFSVQLGLFSLFPDGSLASLLVPAT

SEQ ID NO: 358586 - protein, 23 aa, Mycobacterium
IFTQKAWRNLRFPLSTAPPEANV

SEQ ID NO: 358587 - protein, 19 aa, Mycobacterium
IFTRFGLAALYRPPRRDTG

SEQ ID NO: 358588 - protein, 19 aa, Mycobacterium
IFTVVPTFWMGQPPEVHSG

SEQ ID NO: 358589 - protein, 25 aa, Mycobacterium
IFVGMGLYFAFLGLTQFVQMPPETA

SEQ ID NO: 358590 - protein, 23 aa, Mycobacterium
IFVGMGLYFAFLGLTVFVQVDRS

SEQ ID NO: 358591 - protein, 19 aa, Mycobacterium
IFVLLVVPVSLILWRTFRP

SEQ ID NO: 358592 - protein, 32 aa, Mycobacterium
IFVLPGLVMIGWWTGFPYWITVAVCAVGGILG

SEQ ID NO: 358593 - protein, 17 aa, Mycobacterium
IFVTAYLVGVTAAGIAV

SEQ ID NO: 358594 - protein, 31 aa, Mycobacterium
IFVWELARPPLWLFALFLLTATAAHALKVLA

SEQ ID NO: 358595 - protein, 24 aa, Mycobacterium
IGAALYALLVNRWPLPESGEPSGL

SEQ ID NO: 358596 - protein, 17 aa, Mycobacterium
IGAAVAALLWKFAGNDK

SEQ ID NO: 358597 - protein, 25 aa, Mycobacterium
IGAEFCVALWYLARVRHLSGRERGA

SEQ ID NO: 358598 - protein, 23 aa, Mycobacterium
IGAFGSYFVYKGAWRKFYGDLTV

SEQ ID NO: 358599 - protein, 23 aa, Mycobacterium
IGAFIVTGLLLLGGGTLYAREYA

SEQ ID NO: 358600 - protein, 17 aa, Mycobacterium
IGAGPVLRLWRSVLMFA

SEQ ID NO: 358601 - protein, 41 aa, Mycobacterium
IGAIGRISYSWYLWHWPVLLLAPPLLGHPLGLVGRLATVAI

SEQ ID NO: 358602 - protein, 18 aa, Mycobacterium
IGAILYAAKWPNPWPLHF

SEQ ID NO: 358603 - protein, 24 aa, Mycobacterium
IGAITIAALLRYLPGLTDMRITNP

SEQ ID NO: 358604 - protein, 25 aa, Mycobacterium
IGALGMVLMAIWFHVWQDNVRDLMG

SEQ ID NO: 358605 - protein, 18 aa, Mycobacterium
IGALIGLWRARVVEMTGM

SEQ ID NO: 358606 - protein, 29 aa, Mycobacterium
IGALVGEPMLWLERALVVLVAASPCALAI

SEQ ID NO: 358607 - protein, 19 aa, Mycobacterium
IGALWAWVAPPIHAVVALT

SEQ ID NO: 358608 - protein, 17 aa, Mycobacterium
IGAMLLVRVADIGYTQY

SEQ ID NO: 358609 - protein, 29 aa, Mycobacterium
IGAPLGLCFLPSFICLGIVPVVMGLARDV

SEQ ID NO: 358610 - protein, 19 aa, Mycobacterium
IGAPQQLGWMLMAISVGGL

SEQ ID NO: 358611 - protein, 23 aa, Mycobacterium
IGAPVWLRIFGVATVVSLVVAAD

SEQ ID NO: 358612 - protein, 24 aa, Mycobacterium
IGARGLRVLLLGSSDRPVDAPDAP

SEQ ID NO: 358613 - protein, 18 aa, Mycobacterium
IGAVALARRWVATLGAFN

SEQ ID NO: 358614 - protein, 17 aa, Mycobacterium
IGAVVAAVLFFVWERMA

SEQ ID NO: 358615 - protein, 20 aa, Mycobacterium
IGCLVLVVTLPWESVAAGLG

SEQ ID NO: 358616 - protein, 24 aa, Mycobacterium
IGCWLIIGHWMLRRLGPGRDGLAA

SEQ ID NO: 358617 - protein, 25 aa, Mycobacterium
IGDKQRLPLIVRIDDPWLAEAWRAQ

SEQ ID NO: 358618 - protein, 17 aa, Mycobacterium
IGDLIPVLYPPKNPDRW

SEQ ID NO: 358619 - protein, 18 aa, Mycobacterium
IGDRPGVDALLKDMREFT

SEQ ID NO: 358620 - protein, 38 aa, Mycobacterium
IGDRYQAALWALAALAVLVLVWIVAALNPKIASPDTYS

SEQ ID NO: 358621 - protein, 24 aa, Mycobacterium
IGELLFVVPALLLFVVYVAVGEAN

SEQ ID NO: 358622 - protein, 18 aa, Mycobacterium
IGERLGLIVSAAMGYEPE

SEQ ID NO: 358623 - protein, 26 aa, Mycobacterium
IGERLRDMLWTSIFPSINLATDSARE

SEQ ID NO: 358624 - protein, 18 aa, Mycobacterium
IGEWGWRGALFGLGGLWG

SEQ ID NO: 358625 - protein, 28 aa, Mycobacterium
IGFAAIVFLVVRYVVPPVRRLMTARQET

SEQ ID NO: 358626 - protein, 23 aa, Mycobacterium
IGFALGWRPALLALALGAGVIAL

SEQ ID NO: 358627 - protein, 23 aa, Mycobacterium
IGFALIGAMFYLDHAAPAMLVEA

SEQ ID NO: 358628 - protein, 29 aa, Mycobacterium
IGFAVIAFIIVKWVVPPVRTLMRNQQEAV

SEQ ID NO: 358629 - protein, 27 aa, Mycobacterium
IGFAVIVFIIMKWVAPLVKSMMQKQQE

SEQ ID NO: 358630 - protein, 27 aa, Mycobacterium
IGFAVIVFLVVKYVVPPVRTLMAKQQD

SEQ ID NO: 358631 - protein, 18 aa, Mycobacterium
IGFLGVVAAGVLVFAIAA

SEQ ID NO: 358632 - protein, 21 aa, Mycobacterium
IGFMIVGLLYCRADGVILSLL

SEQ ID NO: 358633 - protein, 17 aa, Mycobacterium
IGFNYLGRLGSPAAYAS

SEQ ID NO: 358634 - protein, 24 aa, Mycobacterium
IGFSSFGVLLYYAVANASAWTLTA

SEQ ID NO: 358635 - protein, 24 aa, Mycobacterium
IGFVYAFFVGFMVSALWSQINNED

SEQ ID NO: 358636 - protein, 35 aa, Mycobacterium
IGGAALALLGMRRYVFARPPLLGPSGRLFATGVTV

SEQ ID NO: 358637 - protein, 18 aa, Mycobacterium
IGGAFLGFAGIVLFIFGY

SEQ ID NO: 358638 - protein, 27 aa, Mycobacterium
IGGGGLGLLILVGALLLGVDPGRVLNQ

SEQ ID NO: 358639 - protein, 17 aa, Mycobacterium
IGGILRGMLSGGAGHHS

SEQ ID NO: 358640 - protein, 23 aa, Mycobacterium
IGGLLGFPSVAYALARVGVLLDD

SEQ ID NO: 358641 - protein, 19 aa, Mycobacterium
IGGLLLAGFIIGSLGVLND

SEQ ID NO: 358642 - protein, 24 aa, Mycobacterium
IGGQLTVWLSWPYGVRGVLAGFGA

SEQ ID NO: 358643 - protein, 17 aa, Mycobacterium
IGGRPLGWSVPGMAFIV

SEQ ID NO: 358644 - protein, 28 aa, Mycobacterium
IGGVFSRRWAKLWLPITAGVYTANGLMG

SEQ ID NO: 358645 - protein, 33 aa, Mycobacterium
IGGVLIVTLIFAPLFWVPIVALAILVATHEVVR

SEQ ID NO: 358646 - protein, 31 aa, Mycobacterium
IGHEPMPLGRWIGFALIWTALAVMTIGTLRN

SEQ ID NO: 358647 - protein, 37 aa, Mycobacterium
IGHGRLFALYVAGYCAGRFWIELMRSDTATLLAGIRV

SEQ ID NO: 358648 - protein, 25 aa, Mycobacterium
IGHGRLFALYVASYCVGRFWVELMR

SEQ ID NO: 358649 - protein, 24 aa, Mycobacterium
IGHGRLFGLYVALYCVGRFGVELM

SEQ ID NO: 358650 - protein, 23 aa, Mycobacterium
IGHHILCPANLTDQARMLARMRW

SEQ ID NO: 358651 - protein, 24 aa, Mycobacterium
IGHPCWADYLPVTRAVPQPPSVRP

SEQ ID NO: 358652 - protein, 22 aa, Mycobacterium
IGHTTVLPFGAPYTRFNGRLGP

SEQ ID NO: 358653 - protein, 25 aa, Mycobacterium
IGIAFHVAAIVFLVVARKEFWAKVR

SEQ ID NO: 358654 - protein, 23 aa, Mycobacterium
IGIDTYIDWLIEAGYPIERIEDF

SEQ ID NO: 358655 - protein, 20 aa, Mycobacterium
IGIFSLFVVVTMIVVIRASK

SEQ ID NO: 358656 - protein, 25 aa, Mycobacterium
IGIFTPLLIIGWYLQRDRVMRLAQE

SEQ ID NO: 358657 - protein, 23 aa, Mycobacterium
IGIGLLFDTLVVRAFMTPAIAAL

SEQ ID NO: 358658 - protein, 24 aa, Mycobacterium
IGIGLLFDTLVVRAFMTPAVAALL

SEQ ID NO: 358659 - protein, 35 aa, Mycobacterium
IGIGVLVFQLLLGQQLHWSVPPLAFVVLVAVGADY

SEQ ID NO: 358660 - protein, 17 aa, Mycobacterium
IGILAIRWRLPSGVEID

SEQ ID NO: 358661 - protein, 17 aa, Mycobacterium
IGILIIAMSLPLLWWRF

SEQ ID NO: 358662 - protein, 31 aa, Mycobacterium
IGIRADSILLSANRIPLYAAVGVVTVLVAAG

SEQ ID NO: 358663 - protein, 17 aa, Mycobacterium
IGITTFVVNLLVALAIA

SEQ ID NO: 358664 - protein, 24 aa, Mycobacterium
IGKARFIAWPPSRWGGISDVNPQT

SEQ ID NO: 358665 - protein, 23 aa, Mycobacterium
IGKARFIVWPPSRWGVVRSVNPQ

SEQ ID NO: 358666 - protein, 18 aa, Mycobacterium
IGKLIHPGLDAIGIPANF

SEQ ID NO: 358667 - protein, 30 aa, Mycobacterium
IGKVSFAFFIPIYFAIVGLKLDLIRGVSVW

SEQ ID NO: 358668 - protein, 17 aa, Mycobacterium
IGKVVLTMPSALADGLA

SEQ ID NO: 358669 - protein, 18 aa, Mycobacterium
IGLAAAHFFAFKISARLI

SEQ ID NO: 358670 - protein, 23 aa, Mycobacterium
IGLALAYWLIPVLPTQSHRFDLI

SEQ ID NO: 358671 - protein, 19 aa, Mycobacterium
IGLARWWHLGVDVLWLLNG

SEQ ID NO: 358672 - protein, 18 aa, Mycobacterium
IGLARWYFGNAQGTKATS

SEQ ID NO: 358673 - protein, 21 aa, Mycobacterium
IGLDALWVGLVLLVVSTVSTW

SEQ ID NO: 358674 - protein, 20 aa, Mycobacterium
IGLDLPFTYPPLSAVVFSPF

SEQ ID NO: 358675 - protein, 24 aa, Mycobacterium
IGLFASVLGWLPTSGYRPLFDDPG

SEQ ID NO: 358676 - protein, 31 aa, Mycobacterium
IGLFDTWPGLILPYITFALPLAIYTLSAFFR

SEQ ID NO: 358677 - protein, 17 aa, Mycobacterium
IGLFILPRTYSLMKQAV

SEQ ID NO: 358678 - protein, 24 aa, Mycobacterium
IGLGLALLLMPAIGLWAMIATLRA

SEQ ID NO: 358679 - protein, 22 aa, Mycobacterium
IGLGLLFDTLVVRAFMTPAIAA

SEQ ID NO: 358680 - protein, 20 aa, Mycobacterium
IGLGLLFDTLVVRAFMTPSI

SEQ ID NO: 358681 - protein, 23 aa, Mycobacterium
IGLGLLFDTLVVRAFMTPSVAAL

SEQ ID NO: 358682 - protein, 20 aa, Mycobacterium
IGLGLLFDTLVVRSFMTPAI

SEQ ID NO: 358683 - protein, 20 aa, Mycobacterium
IGLGLLFDTLVVRSFMTPSI

SEQ ID NO: 358684 - protein, 19 aa, Mycobacterium
IGLGLLFDTLVVRSLMTPS

SEQ ID NO: 358685 - protein, 32 aa, Mycobacterium
IGLGSYNPWPVALIVGIPLVTVGLAVVLRVSR

SEQ ID NO: 358686 - protein, 17 aa, Mycobacterium
IGLIFFGWGVALAFTSV

SEQ ID NO: 358687 - protein, 29 aa, Mycobacterium
IGLILVCLGIWLLAGRRLGVLMPNSLADN

SEQ ID NO: 358688 - protein, 17 aa, Mycobacterium
IGLKLQFGDGWWTSPLF

SEQ ID NO: 358689 - protein, 18 aa, Mycobacterium
IGLLALIRYRGHSWAELG

SEQ ID NO: 358690 - protein, 27 aa, Mycobacterium
IGLLGAALIEAMWWLRARALGLRPRVW

SEQ ID NO: 358691 - protein, 18 aa, Mycobacterium
IGLLLGGIFVLGALVVRK

SEQ ID NO: 358692 - protein, 22 aa, Mycobacterium
IGLLVLLFLLTAQTGFWIGVLP

SEQ ID NO: 358693 - protein, 29 aa, Mycobacterium
IGLSMLNDLPWWVTVLILSRELGVTMLRL

SEQ ID NO: 358694 - protein, 18 aa, Mycobacterium
IGLVITVAILAVLRTAVR

SEQ ID NO: 358695 - protein, 24 aa, Mycobacterium
IGLVLGRQWKLLGAYAAAALLAAL

SEQ ID NO: 358696 - protein, 17 aa, Mycobacterium
IGLVNLSGLLLMGLETL

SEQ ID NO: 358697 - protein, 17 aa, Mycobacterium
IGLVQMVAWALFKNPWI

SEQ ID NO: 358698 - protein, 31 aa, Mycobacterium
IGLWVMVAVALPLTFPPLTEMAQKHPLAILP

SEQ ID NO: 358699 - protein, 17 aa, Mycobacterium
IGLYAAALAIGAYTFVP

SEQ ID NO: 358700 - protein, 28 aa, Mycobacterium
IGMAASLWFGFRSAAKVFRDPLPEPETV

SEQ ID NO: 358701 - protein, 21 aa, Mycobacterium
IGMAFGMWAFFAALGSGPISV

SEQ ID NO: 358702 - protein, 24 aa, Mycobacterium
IGMGLLFDTLIVRSFMTPSIAALL

SEQ ID NO: 358703 - protein, 24 aa, Mycobacterium
IGMGLLFDTLVIRSFMTPSIAALL

SEQ ID NO: 358704 - protein, 27 aa, Mycobacterium
IGMGLLLDTFLVRTITIPALVVLCGQA

SEQ ID NO: 358705 - protein, 27 aa, Mycobacterium
IGMGVGVLILPFIGLWAMIATLRAGFA

SEQ ID NO: 358706 - protein, 19 aa, Mycobacterium
IGMLYVVYLLWEHKESAAG

SEQ ID NO: 358707 - protein, 25 aa, Mycobacterium
IGMVVLPPIIYYITYRWCIGLQRGD

SEQ ID NO: 358708 - protein, 21 aa, Mycobacterium
IGPKLLVHITADGGAPRLAIA

SEQ ID NO: 358709 - protein, 23 aa, Mycobacterium
IGPKLLVRITADGGAPRLAIAAW

SEQ ID NO: 358710 - protein, 24 aa, Mycobacterium
IGPQPAWRNLRFPLAWAPPEANVA

SEQ ID NO: 358711 - protein, 38 aa, Mycobacterium
IGPTPYSAVWLWVAIALTVALIGWYTAVFAFTSPGRQV

SEQ ID NO: 358712 - protein, 22 aa, Mycobacterium
IGPVAKIAWPNATTYLGPHSGV

SEQ ID NO: 358713 - protein, 18 aa, Mycobacterium
IGPVWRLISPVRTLIRLI

SEQ ID NO: 358714 - protein, 21 aa, Mycobacterium
IGQAITMPLFFASNALYPVDV

SEQ ID NO: 358715 - protein, 18 aa, Mycobacterium
IGQPAWSPGAHPAAPAHS

SEQ ID NO: 358716 - protein, 29 aa, Mycobacterium
IGQSLLVLLLAFTVIFWGVSILPTDPVSI

SEQ ID NO: 358717 - protein, 24 aa, Mycobacterium
IGRAPWRLLRVYENPIDTTVSVYR

SEQ ID NO: 358718 - protein, 30 aa, Mycobacterium
IGRDFTAVPLLWLLAIDITLILLGALALRR

SEQ ID NO: 358719 - protein, 29 aa, Mycobacterium
IGRDRWFNLLWLIPIGFALLIAGVAVGKG

SEQ ID NO: 358720 - protein, 20 aa, Mycobacterium
IGRFVYTPILPLMTAQAGVS

SEQ ID NO: 358721 - protein, 23 aa, Mycobacterium
IGRHLLTDQWPSPRSLNGLGRLA

SEQ ID NO: 358722 - protein, 28 aa, Mycobacterium
IGRIIRVLAVPIVLGWVLLTVLTNVAVP

SEQ ID NO: 358723 - protein, 31 aa, Mycobacterium
IGRKRSVVLILFAYAAFALLAAFSVSLTMLL

SEQ ID NO: 358724 - protein, 21 aa, Mycobacterium
IGRQCLTAGLGFGGGCLPKDI

SEQ ID NO: 358725 - protein, 24 aa, Mycobacterium
IGRRFLNAGLGFGGGCLPKDIRAF

SEQ ID NO: 358726 - protein, 26 aa, Mycobacterium
IGRRKVLFLTLLLIGTATALIGMLPT

SEQ ID NO: 358727 - protein, 39 aa, Mycobacterium
IGRSRGVWILLALALLYVAFFFFFVGISAGVVILVVVAA

SEQ ID NO: 358728 - protein, 26 aa, Mycobacterium
IGSEPVLQPWLGMLGHLVVAGPIPRM

SEQ ID NO: 358729 - protein, 24 aa, Mycobacterium
IGSFPILSVFGFVVMFGGVVFAIS

SEQ ID NO: 358730 - protein, 24 aa, Mycobacterium
IGSFPILSVFGFVVMFGGVVYAIT

SEQ ID NO: 358731 - protein, 18 aa, Mycobacterium
IGSGYPVAAAFTAAVAVL

SEQ ID NO: 358732 - protein, 35 aa, Mycobacterium
IGSIEPVWIIVLSPVFAWLWTRLGDRAPTTPRKFS

SEQ ID NO: 358733 - protein, 20 aa, Mycobacterium
IGSLGVGLALTLWLSTDAAE

SEQ ID NO: 358734 - protein, 28 aa, Mycobacterium
IGSLVFQAILLPLGFSGAFAWFAGLSLL

SEQ ID NO: 358735 - protein, 17 aa, Mycobacterium
IGSRFRRWRRLPAAVAV

SEQ ID NO: 358736 - protein, 26 aa, Mycobacterium
IGSRTLWYLVMVLASVVLALAAVWLG

SEQ ID NO: 358737 - protein, 23 aa, Mycobacterium
IGTAFVPLALLPTAASAGQLAAI

SEQ ID NO: 358738 - protein, 23 aa, Mycobacterium
IGTAIVRWPVPILAATIAVAVVG

SEQ ID NO: 358739 - protein, 17 aa, Mycobacterium
IGTASFWTFGIIAMVTL

SEQ ID NO: 358740 - protein, 20 aa, Mycobacterium
IGTFLFVPTLRRWLSTEVRP

SEQ ID NO: 358741 - protein, 17 aa, Mycobacterium
IGTFVVPPVMRVLRERD

SEQ ID NO: 358742 - protein, 21 aa, Mycobacterium
IGTMAIICLILYRSFRHRNWL

SEQ ID NO: 358743 - protein, 22 aa, Mycobacterium
IGTPYFFQRVTGAAVATLVAVA

SEQ ID NO: 358744 - protein, 36 aa, Mycobacterium
IGTVGLYLESLWIGAVYAFPWPTSIWPEGLAMAVPV

SEQ ID NO: 358745 - protein, 20 aa, Mycobacterium
IGTYRRPIFACILGLFGVLM

SEQ ID NO: 358746 - protein, 25 aa, Mycobacterium
IGVAQPLILLGLLPAVIGALLFVQP

SEQ ID NO: 358747 - protein, 36 aa, Mycobacterium
IGVFLERMLRRFVLPNRLWWPLSPRLRKALKTVTVA

SEQ ID NO: 358748 - protein, 24 aa, Mycobacterium
IGVGVMVVLILLGGGARAVGSFFG

SEQ ID NO: 358749 - protein, 30 aa, Mycobacterium
IGVILENTPGFARLLTAAALAGLVLVGLNS

SEQ ID NO: 358750 - protein, 18 aa, Mycobacterium
IGVILGAGLVWYFVKGRN

SEQ ID NO: 358751 - protein, 26 aa, Mycobacterium
IGVLAPILLLVLRIVQGFALGGEWAG

SEQ ID NO: 358752 - protein, 20 aa, Mycobacterium
IGVLAVRKGGKLPPPVLGET

SEQ ID NO: 358753 - protein, 23 aa, Mycobacterium
IGVLIIMVMVGWLLIAVFRGRLH

SEQ ID NO: 358754 - protein, 33 aa, Mycobacterium
IGVLTFQYLLGEQLHWTVPPLAFVVLVAVGADY

SEQ ID NO: 358755 - protein, 29 aa, Mycobacterium
IGVPIFFVLSGFLLFRPWVHSAVTGAPPP

SEQ ID NO: 358756 - protein, 29 aa, Mycobacterium
IGVPIFFVLSGYLLFRPWVRSAATDGPPP

SEQ ID NO: 358757 - protein, 22 aa, Mycobacterium
IGVPSVLLYRVLTCWLPVFLGW

SEQ ID NO: 358758 - protein, 26 aa, Mycobacterium
IGVVCTWMFMYGMTPLLQGPAALALG

SEQ ID NO: 358759 - protein, 25 aa, Mycobacterium
IGVVGQVLMAIWFHVWQDDVRDLMG

SEQ ID NO: 358760 - protein, 33 aa, Mycobacterium
IGVVWLVLVGWLSLWPFLNWLTTHFVITDRRVM

SEQ ID NO: 358761 - protein, 28 aa, Mycobacterium
IGVWLAMAVALPLSFPSLGEMAEKHPLQ

SEQ ID NO: 358762 - protein, 23 aa, Mycobacterium
IGWTMMHYLPATPGFRFIDHTVI

SEQ ID NO: 358763 - protein, 31 aa, Mycobacterium
IGYAMGFFAIWWAWMNFTWFASAFDTDDWLY

SEQ ID NO: 358764 - protein, 24 aa, Mycobacterium
IGYIFGFITLFICCGIGKGSVFKL

SEQ ID NO: 358765 - protein, 24 aa, Mycobacterium
IGYLPTMRKVILPQAIRTMIPSYI

SEQ ID NO: 358766 - protein, 23 aa, Mycobacterium
IGYPLIERFPLMISTALGVLIIG

SEQ ID NO: 358767 - protein, 31 aa, Mycobacterium
IGYTHFVHLLPVYLLIVAVIAALALAKSYMT

SEQ ID NO: 358768 - protein, 21 aa, Mycobacterium
IGYVNFVVWLLPAVLGVGYRR

SEQ ID NO: 358769 - protein, 21 aa, Mycobacterium
IHDVILGRDPAFSGIILVIDA

SEQ ID NO: 358770 - protein, 25 aa, Mycobacterium
IHFAVLPAHWQEWPASGVFFGLVAV

SEQ ID NO: 358771 - protein, 17 aa, Mycobacterium
IHFLNRIGTWVLGIAIV

SEQ ID NO: 358772 - protein, 19 aa, Mycobacterium
IHGIVVLGALIVLGDLPAD

SEQ ID NO: 358773 - protein, 19 aa, Mycobacterium
IHGIVVLGALIVLGNLPAD

SEQ ID NO: 358774 - protein, 19 aa, Mycobacterium
IHGWRWMLGLATVPAMLLL

SEQ ID NO: 358775 - protein, 27 aa, Mycobacterium
IHHLAWGPEIVFTYGPLAFLQNTAYYS

SEQ ID NO: 358776 - protein, 30 aa, Mycobacterium
IHKLALPIVLVWLGIVFVTNTVAPQLEVVA

SEQ ID NO: 358777 - protein, 23 aa, Mycobacterium
IHLLVVWAAIYLCWGRGMRPTWR

SEQ ID NO: 358778 - protein, 24 aa, Mycobacterium
IHNFWVSLGIFILLAAIFIARVIL

SEQ ID NO: 358779 - protein, 18 aa, Mycobacterium
IHQAAMANTPLLLEEVLE

SEQ ID NO: 358780 - protein, 43 aa, Mycobacterium
IHQDAGLSWLLLVAVPVLALANYWIVSHLLPIFRRVQGQIDSI

SEQ ID NO: 358781 - protein, 39 aa, Mycobacterium
IHQNLGWAFGYNTAAIPLAAFGLLNPVVAGAAMGLSSVS

SEQ ID NO: 358782 - protein, 28 aa, Mycobacterium
IHQNLGWAFGYNTAAIPLAALGLLNPVV

SEQ ID NO: 358783 - protein, 34 aa, Mycobacterium
IIAGLITVGFVAVLMWILRRVPAPALRAVVGQRK

SEQ ID NO: 358784 - protein, 25 aa, Mycobacterium
IIAGYLIAWALSSTGSWRLMLGLAA

SEQ ID NO: 358785 - protein, 35 aa, Mycobacterium
IIAIAALVLFVALPLIYVRNYVKVPPNEVAVFTGR

SEQ ID NO: 358786 - protein, 24 aa, Mycobacterium
IIAIMLMFVYRSIGTVLLTMVILF

SEQ ID NO: 358787 - protein, 29 aa, Mycobacterium
IIAIQWRARPWLKRVLPVALIAAAAVTAL

SEQ ID NO: 358788 - protein, 18 aa, Mycobacterium
IIALALKPMGWRVTDEDE

SEQ ID NO: 358789 - protein, 19 aa, Mycobacterium
IIALPFFGIVTEIIPVFSR

SEQ ID NO: 358790 - protein, 18 aa, Mycobacterium
IIANFWQLVYRSMGFTGW

SEQ ID NO: 358791 - protein, 20 aa, Mycobacterium
IIANRVSYFYDFRGPSVAVD

SEQ ID NO: 358792 - protein, 21 aa, Mycobacterium
IIANRVSYFYDLRGPSVTIDT

SEQ ID NO: 358793 - protein, 18 aa, Mycobacterium
IIAPFLGIKLIDLVVQLL

SEQ ID NO: 358794 - protein, 25 aa, Mycobacterium
IIDNAQALRWRTSVGAAAISVAQRI

SEQ ID NO: 358795 - protein, 38 aa, Mycobacterium
IIDPIFSLCKALGYLLWWAVLFPAVSIPIIASAATAIT

SEQ ID NO: 358796 - protein, 24 aa, Mycobacterium
IIDQRLHYGIGRPGRWLVYAGCIG

SEQ ID NO: 358797 - protein, 19 aa, Mycobacterium
IIEIILAILINLIAITFFL

SEQ ID NO: 358798 - protein, 21 aa, Mycobacterium
IIFAHMVFQELAGLAGLPGLP

SEQ ID NO: 358799 - protein, 27 aa, Mycobacterium
IIFVIRTRMVPFFRSRPSALLAVTSLT

SEQ ID NO: 358800 - protein, 24 aa, Mycobacterium
IIGAAWGWHGAGWMLTKLGFHDVG

SEQ ID NO: 358801 - protein, 22 aa, Mycobacterium
IIGIWVMLQIADVLQFSVGGLV

SEQ ID NO: 358802 - protein, 25 aa, Mycobacterium
IIGLCWLAIGFVWLAGVTRGFQRPT

SEQ ID NO: 358803 - protein, 23 aa, Mycobacterium
IIGLVITVAILAVLRTAVRDVFH

SEQ ID NO: 358804 - protein, 42 aa, Mycobacterium
IIGMIGIFLSMGIRRMSPMMLMFPLMFLMAAGGMMAGHGNSG

SEQ ID NO: 358805 - protein, 26 aa, Mycobacterium
IIGNLLQMAFRFWAFRRWVFPDEFAR

SEQ ID NO: 358806 - protein, 27 aa, Mycobacterium
IIGVGAMLCWGLFRIYVLGNPLRAESA

SEQ ID NO: 358807 - protein, 17 aa, Mycobacterium
IIGVPPFAGFFSKDAII

SEQ ID NO: 358808 - protein, 20 aa, Mycobacterium
IIGVVRWYWGIFSGRPARDK

SEQ ID NO: 358809 - protein, 19 aa, Mycobacterium
IIGWALACSVPVVLVGAAV

SEQ ID NO: 358810 - protein, 29 aa, Mycobacterium
IIHCHSSHFFTWFDGLPTLLRRAVRAALR

SEQ ID NO: 358811 - protein, 17 aa, Mycobacterium
IIIACAICITIIMSLTY

SEQ ID NO: 358812 - protein, 24 aa, Mycobacterium
IIIGLAVLFFYGGILLGALPRLGV

SEQ ID NO: 358813 - protein, 19 aa, Mycobacterium
IIKVLVAMAAINELNLNKS

SEQ ID NO: 358814 - protein, 27 aa, Mycobacterium
IILAFQIYVWIRWITGPYFTRVDPGPT

SEQ ID NO: 358815 - protein, 22 aa, Mycobacterium
IILFWLAVVVLLSVFVPSLEVV

SEQ ID NO: 358816 - protein, 21 aa, Mycobacterium
IILGLIVGWIARLIVPGKENF

SEQ ID NO: 358817 - protein, 32 aa, Mycobacterium
IILIVVMLLLVYRTPSTLLVPLLGVLIEMLVA

SEQ ID NO: 358818 - protein, 21 aa, Mycobacterium
IILLAAKWFGLSGKLGSLLAI

SEQ ID NO: 358819 - protein, 17 aa, Mycobacterium
IILMLATLAFGYASSPV

SEQ ID NO: 358820 - protein, 20 aa, Mycobacterium
IIMLVLFAVFAYVAKFTAYG

SEQ ID NO: 358821 - protein, 20 aa, Mycobacterium
IIRRFVYLVLLMTAFNWMSH

SEQ ID NO: 358822 - protein, 28 aa, Mycobacterium
IISFVIGRPLIWLSFRNEKLNAAFRYAL

SEQ ID NO: 358823 - protein, 26 aa, Mycobacterium
IISVVAFTPILWNLAGPLTILGVTVP

SEQ ID NO: 358824 - protein, 18 aa, Mycobacterium
IITTPSWLEVPLAMRDGL

SEQ ID NO: 358825 - protein, 27 aa, Mycobacterium
IIVAAVLALTWIAWPSPRKAVTLYCGT

SEQ ID NO: 358826 - protein, 29 aa, Mycobacterium
IIVASSVPLLLFPQGFLKSITYAIIASVM

SEQ ID NO: 358827 - protein, 17 aa, Mycobacterium
IIVATVVAVLLVGAAVA

SEQ ID NO: 358828 - protein, 18 aa, Mycobacterium
IIVFVLVFQRRIVAGLTS

SEQ ID NO: 358829 - protein, 27 aa, Mycobacterium
IIVGAIVMLIVLFLPDGLVSLGRRARR

SEQ ID NO: 358830 - protein, 17 aa, Mycobacterium
IIVLLGVFLLARLTGDP

SEQ ID NO: 358831 - protein, 25 aa, Mycobacterium
IIVPRAALPEWLQWVSNALPASYAL

SEQ ID NO: 358832 - protein, 19 aa, Mycobacterium
IIVTGIMRALLFLAILGVT

SEQ ID NO: 358833 - protein, 19 aa, Mycobacterium
IIVTPPLLAALLPVALVSS

SEQ ID NO: 358834 - protein, 18 aa, Mycobacterium
IIYCAAATLIHCYYGYFA

SEQ ID NO: 358835 - protein, 17 aa, Mycobacterium
IIYMLYFLQHVLEVDQT

SEQ ID NO: 358836 - protein, 33 aa, Mycobacterium
IIYYPVSAIMWVWYKAFSFLLGPTNFFAWALSV

SEQ ID NO: 358837 - protein, 25 aa, Mycobacterium
IKAPLWPFHRWLPDAAVESTPATAV

SEQ ID NO: 358838 - protein, 25 aa, Mycobacterium
IKDGRLHYVYNFLGIKPEQEFISAP

SEQ ID NO: 358839 - protein, 19 aa, Mycobacterium
IKDMFAWVAPVLAALQGNP

SEQ ID NO: 358840 - protein, 19 aa, Mycobacterium
IKEFAPLIGVRKAGLFTSS

SEQ ID NO: 358841 - protein, 29 aa, Mycobacterium
IKEREFYLALVGALLVAALALALDGLLAV

SEQ ID NO: 358842 - protein, 18 aa, Mycobacterium
IKFGAFAAVMIVLTVFLF

SEQ ID NO: 358843 - protein, 36 aa, Mycobacterium
IKFGIFAVIMTVLTVFLFFIFGQYRTGSTNGYSAVF

SEQ ID NO: 358844 - protein, 34 aa, Mycobacterium
IKFTVFGLVMAVLTAFLFLVFSDTRTGAANEYSA

SEQ ID NO: 358845 - protein, 17 aa, Mycobacterium
IKGMWRKASKQVLKDYV

SEQ ID NO: 358846 - protein, 32 aa, Mycobacterium
IKIATFTVIIVLMLFFFRSVPTVLVLLGVVGI

SEQ ID NO: 358847 - protein, 44 aa, Mycobacterium
IKIEIAIVALLLTILVIVYRKPATILLPVLMIGVSLGVAQAVVA

SEQ ID NO: 358848 - protein, 17 aa, Mycobacterium
IKIIPTPDAVFSVAFSP

SEQ ID NO: 358849 - protein, 19 aa, Mycobacterium
IKINLGKFFKYTGAFLVIV

SEQ ID NO: 358850 - protein, 24 aa, Mycobacterium
IKLIKMLIAPIIFCTVVLGIAHVG

SEQ ID NO: 358851 - protein, 19 aa, Mycobacterium
IKLSIFAAVSGIAAAVTVF

SEQ ID NO: 358852 - protein, 24 aa, Mycobacterium
IKLTPLIFLPYLLCTRQWRAATHA

SEQ ID NO: 358853 - protein, 26 aa, Mycobacterium
IKLTPMIFIVFLFVVGRIRAAVVATV

SEQ ID NO: 358854 - protein, 17 aa, Mycobacterium
IKQNLWASLGIVAVLIP

SEQ ID NO: 358855 - protein, 28 aa, Mycobacterium
IKTNLVWAFGYNLAAIPLAALGMLNPML

SEQ ID NO: 358856 - protein, 35 aa, Mycobacterium
IKTRGWRRIGTAVVRWPAPILTATCAVSLVGLIAL

SEQ ID NO: 358857 - protein, 18 aa, Mycobacterium
IKTTTLLGSRYIELRPRG

SEQ ID NO: 358858 - protein, 22 aa, Mycobacterium
IKTWLLIYALAMGLGAWAFGAR

SEQ ID NO: 358859 - protein, 18 aa, Mycobacterium
IKVELPLSIPVLVAGLRV

SEQ ID NO: 358860 - protein, 21 aa, Mycobacterium
IKVLTAMQALRDLPLMKTVPG

SEQ ID NO: 358861 - protein, 18 aa, Mycobacterium
IKVRGWRRIGTATVRWPG

SEQ ID NO: 358862 - protein, 23 aa, Mycobacterium
IKVRGWRRIGTATVRWPGPVFVA

SEQ ID NO: 358863 - protein, 26 aa, Mycobacterium
IKVSVFGVVMLVVAAALVVVFGDFRF

SEQ ID NO: 358864 - protein, 19 aa, Mycobacterium
IKYIWWILGGLAMVAAFFI

SEQ ID NO: 358865 - protein, 19 aa, Mycobacterium
ILAAALLGLLAGLIGPFVV

SEQ ID NO: 358866 - protein, 21 aa, Mycobacterium
ILAFGALLMGIMRWYQPAFFR

SEQ ID NO: 358867 - protein, 25 aa, Mycobacterium
ILAGAGLLAYFKPAGKLGGSNLLTD

SEQ ID NO: 358868 - protein, 19 aa, Mycobacterium
ILAGAVMLAYVKPQGQLGD

SEQ ID NO: 358869 - protein, 37 aa, Mycobacterium
ILAIGDNTWFSWLVVFWLWLTVIFANLAEAVAEGRGK

SEQ ID NO: 358870 - protein, 47 aa, Mycobacterium
ILAILINLIAITFFLVFAIIAYTIIFAILLIPILIALAFSVVVFAFY

SEQ ID NO: 358871 - protein, 25 aa, Mycobacterium
ILAIPHYIVLVFLYLGAFVATVIAF

SEQ ID NO: 358872 - protein, 17 aa, Mycobacterium
ILAIPYPGPGWAIVFLG

SEQ ID NO: 358873 - protein, 17 aa, Mycobacterium
ILAIRQSSNRFADDAGG

SEQ ID NO: 358874 - protein, 17 aa, Mycobacterium
ILAIVFTMVYVQFRGGI

SEQ ID NO: 358875 - protein, 20 aa, Mycobacterium
ILALLAFRHFGQGYAILLLA

SEQ ID NO: 358876 - protein, 20 aa, Mycobacterium
ILAMMVWLMSYNRLWERPRD

SEQ ID NO: 358877 - protein, 30 aa, Mycobacterium
ILAPQGLEYIVAFLGALQAGFIGVPLSTPQ

SEQ ID NO: 358878 - protein, 27 aa, Mycobacterium
ILAPQGLEYVLAFLGALQAGQIAVPLS

SEQ ID NO: 358879 - protein, 29 aa, Mycobacterium
ILAPQSLEYIIGFLGAVAAGFIAVPLSMP

SEQ ID NO: 358880 - protein, 24 aa, Mycobacterium
ILAPQTLDYIAGFLGALEAGLTAV

SEQ ID NO: 358881 - protein, 22 aa, Mycobacterium
ILARFPGLYIQSVGLTFNGATP

SEQ ID NO: 358882 - protein, 34 aa, Mycobacterium
ILARSIYKFAVPIALFWLAVCAIIAAFVPSLESV

SEQ ID NO: 358883 - protein, 33 aa, Mycobacterium
ILASGVLGWWRWHHNTWLTTIFASVIAVLVLMV

SEQ ID NO: 358884 - protein, 25 aa, Mycobacterium
ILAVGFGGGLLVAPAAGAQAPFRLA

SEQ ID NO: 358885 - protein, 20 aa, Mycobacterium
ILAVTGYLIFKPSGQAPVKR

SEQ ID NO: 358886 - protein, 21 aa, Mycobacterium
ILAYLWLDRFEPEPPRLLLFA

SEQ ID NO: 358887 - protein, 18 aa, Mycobacterium
ILCPQGVDYVVSFFAAIQ

SEQ ID NO: 358888 - protein, 30 aa, Mycobacterium
ILCVHVVLYLTLRFSTVLIRVLRDGGIMLL

SEQ ID NO: 358889 - protein, 29 aa, Mycobacterium
ILDATVVRMLLIPAVMKLLGDDCWWAPAW

SEQ ID NO: 358890 - protein, 19 aa, Mycobacterium
ILDCFPRRTPWPRGLLLGL

SEQ ID NO: 358891 - protein, 23 aa, Mycobacterium
ILDLVGFAWAGFGAAFGPLILLS

SEQ ID NO: 358892 - protein, 27 aa, Mycobacterium
ILDLVVVFLVTWPLVYLASKSPTLAKP

SEQ ID NO: 358893 - protein, 24 aa, Mycobacterium
ILDQHLYFALNAPAAQTGGTAASA

SEQ ID NO: 358894 - protein, 21 aa, Mycobacterium
ILDQHLYFTLNAPPAQTGGTA

SEQ ID NO: 358895 - protein, 24 aa, Mycobacterium
ILDQHLYFVLNAPAAKTGGTAASA

SEQ ID NO: 358896 - protein, 18 aa, Mycobacterium
ILDRYRARFPWFDHIMRM

SEQ ID NO: 358897 - protein, 21 aa, Mycobacterium
ILDVYGFLLAGLLITMGNLGD

SEQ ID NO: 358898 - protein, 32 aa, Mycobacterium
ILEEVWEFLTHPFEFLKDLLNKLVSWASSLLS

SEQ ID NO: 358899 - protein, 18 aa, Mycobacterium
ILEGRELWQRVQAAVSVL

SEQ ID NO: 358900 - protein, 24 aa, Mycobacterium
ILELRLLPSLIPIGLLAGLSAVVT

SEQ ID NO: 358901 - protein, 20 aa, Mycobacterium
ILFAVLVLQFRNPAGLTPGS

SEQ ID NO: 358902 - protein, 19 aa, Mycobacterium
ILFIPLVITLAIGVGSLPR

SEQ ID NO: 358903 - protein, 20 aa, Mycobacterium
ILFTIGIVVLYRVGATLPSP

SEQ ID NO: 358904 - protein, 23 aa, Mycobacterium
ILGAHWKLALTALLACTVGAAFV

SEQ ID NO: 358905 - protein, 24 aa, Mycobacterium
ILGAINLLPLLPFDGGHIAVAVFE

SEQ ID NO: 358906 - protein, 18 aa, Mycobacterium
ILGFVLGVGRLSTHTPIR

SEQ ID NO: 358907 - protein, 24 aa, Mycobacterium
ILGGIIIGNLLSGGLRGGFGGWSP

SEQ ID NO: 358908 - protein, 18 aa, Mycobacterium
ILGGVLPFVWIAWTAIRN

SEQ ID NO: 358909 - protein, 17 aa, Mycobacterium
ILGLAAVPATLLLPLLM

SEQ ID NO: 358910 - protein, 29 aa, Mycobacterium
ILGLLVIAIMVAWRWAPAKAAAVPGPLVA

SEQ ID NO: 358911 - protein, 28 aa, Mycobacterium
ILGLQIPVLLMIIGIIALAIIMKRTTYG

SEQ ID NO: 358912 - protein, 18 aa, Mycobacterium
ILGLSRIARAVLAISPVV

SEQ ID NO: 358913 - protein, 21 aa, Mycobacterium
ILGVPGPGPYLVHADSRASTK

SEQ ID NO: 358914 - protein, 18 aa, Mycobacterium
ILGVVYLKDLVRQTFFSP

SEQ ID NO: 358915 - protein, 23 aa, Mycobacterium
ILGWGWLALTLLGVPWLLSFAQP

SEQ ID NO: 358916 - protein, 18 aa, Mycobacterium
ILGYYLYYSVAEGGLGLP

SEQ ID NO: 358917 - protein, 17 aa, Mycobacterium
ILHESPPPLAALRPDVP

SEQ ID NO: 358918 - protein, 25 aa, Mycobacterium
ILHRRYKQFGALPLLAPLLAAATVT

SEQ ID NO: 358919 - protein, 30 aa, Mycobacterium
ILHRRYKQFGALPLLAPLLAAATVTAILIF

SEQ ID NO: 358920 - protein, 25 aa, Mycobacterium
ILIAAPLLHPILVGYGFDGIWIGVL

SEQ ID NO: 358921 - protein, 18 aa, Mycobacterium
ILIAAVTGLLYALIPQID

SEQ ID NO: 358922 - protein, 22 aa, Mycobacterium
ILIAFGVLWPVVFDGGSGDPTD

SEQ ID NO: 358923 - protein, 18 aa, Mycobacterium
ILIHRRVVERFGEEFRIG

SEQ ID NO: 358924 - protein, 18 aa, Mycobacterium
ILILPFFMVIVVQMKRMR

SEQ ID NO: 358925 - protein, 21 aa, Mycobacterium
ILIPLQLIILARAAGPARLGR

SEQ ID NO: 358926 - protein, 20 aa, Mycobacterium
ILIRGLMNYTFWVPNGSPEY

SEQ ID NO: 358927 - protein, 23 aa, Mycobacterium
ILITTIFGFVWYSHSIFGLESLG

SEQ ID NO: 358928 - protein, 17 aa, Mycobacterium
ILIVLASVAPMFLEWMR

SEQ ID NO: 358929 - protein, 17 aa, Mycobacterium
ILIWRLVRRETAQPAIS

SEQ ID NO: 358930 - protein, 17 aa, Mycobacterium
ILLAVDALDKHLRARHR

SEQ ID NO: 358931 - protein, 24 aa, Mycobacterium
ILLAVLFLGFFLLEGFDFGVGMLM

SEQ ID NO: 358932 - protein, 22 aa, Mycobacterium
ILLDTFLVRTITVPAIAALVGR

SEQ ID NO: 358933 - protein, 25 aa, Mycobacterium
ILLDTFLVRTITVPALATLVGRASW

SEQ ID NO: 358934 - protein, 28 aa, Mycobacterium
ILLGPLVGLALLALDFRMTVLGAAAVFA

SEQ ID NO: 358935 - protein, 21 aa, Mycobacterium
ILLGVAGYNFGRFCLTPLPRP

SEQ ID NO: 358936 - protein, 26 aa, Mycobacterium
ILLIFVVPWAIWLLNLLWVVRNAVHG

SEQ ID NO: 358937 - protein, 18 aa, Mycobacterium
ILLNLAFSTQAAYAAPLI

SEQ ID NO: 358938 - protein, 18 aa, Mycobacterium
ILLSAARVPFYIGVGVVT

SEQ ID NO: 358939 - protein, 24 aa, Mycobacterium
ILLTFYPGWASVGLMLVLLITAAR

SEQ ID NO: 358940 - protein, 25 aa, Mycobacterium
ILLTGMLLVVLALHTSSLPWYLASA

SEQ ID NO: 358941 - protein, 31 aa, Mycobacterium
ILMGRITGWPLPALLIPPMALSRMLLGVHYP

SEQ ID NO: 358942 - protein, 30 aa, Mycobacterium
ILMVTVPVGLALWLSMRFPPRLLGPDDSKR

SEQ ID NO: 358943 - protein, 20 aa, Mycobacterium
ILNDLFAFIATAVAGAVIVF

SEQ ID NO: 358944 - protein, 17 aa, Mycobacterium
ILNIYRKYYGTKMMLTL

SEQ ID NO: 358945 - protein, 25 aa, Mycobacterium
ILPIGFTVVLWVAWVRRDLLGGYRY

SEQ ID NO: 358946 - protein, 17 aa, Mycobacterium
ILPLSSVLLMLLVLAVH

SEQ ID NO: 358947 - protein, 18 aa, Mycobacterium
ILPMSFHGRWQSGQLLSR

SEQ ID NO: 358948 - protein, 21 aa, Mycobacterium
ILPQLVQVSAFLKNISVDFAD

SEQ ID NO: 358949 - protein, 24 aa, Mycobacterium
ILPTQILWVNMTTAVALGLMLAFE

SEQ ID NO: 358950 - protein, 21 aa, Mycobacterium
ILPYVGRIAGALLLLTGLYVT

SEQ ID NO: 358951 - protein, 30 aa, Mycobacterium
ILQSVPHHWWTPWIVLPLGGVIIGYIVNYL

SEQ ID NO: 358952 - protein, 19 aa, Mycobacterium
ILRIFVKRHRLVGTLPLLS

SEQ ID NO: 358953 - protein, 18 aa, Mycobacterium
ILRIRDYGGVLFAQLRDW

SEQ ID NO: 358954 - protein, 17 aa, Mycobacterium
ILRRLFDRRRGAPRYSW

SEQ ID NO: 358955 - protein, 19 aa, Mycobacterium
ILRTTFELAAYSQPLQIVH

SEQ ID NO: 358956 - protein, 26 aa, Mycobacterium
ILSAAGLVFGLWPKGLDAVLEDYADT

SEQ ID NO: 358957 - protein, 29 aa, Mycobacterium
ILSFLADPYKYFLEFFQRMGFSPAVAVIL

SEQ ID NO: 358958 - protein, 22 aa, Mycobacterium
ILSIGVIGFIGASSGRTALRQV

SEQ ID NO: 358959 - protein, 24 aa, Mycobacterium
ILSLRGGEFFAPELAALASDPVRE

SEQ ID NO: 358960 - protein, 17 aa, Mycobacterium
ILSLVAMTHPDQVNLLL

SEQ ID NO: 358961 - protein, 19 aa, Mycobacterium
ILSMIAFAEQLGKPWTMVY

SEQ ID NO: 358962 - protein, 19 aa, Mycobacterium
ILSVLAIYATVYSASFHAG

SEQ ID NO: 358963 - protein, 29 aa, Mycobacterium
ILTAISTIAIVGFALRPLRRVAATAAEVA

SEQ ID NO: 358964 - protein, 19 aa, Mycobacterium
ILTDRYWWSALAVTLGITV

SEQ ID NO: 358965 - protein, 25 aa, Mycobacterium
ILTGTFQLFYFGFGTAGPAYLWSWP

SEQ ID NO: 358966 - protein, 17 aa, Mycobacterium
ILTLIMLGRLLEARAKA

SEQ ID NO: 358967 - protein, 27 aa, Mycobacterium
ILTQRDTWVLALLYLGTFGSWIGFSFA

SEQ ID NO: 358968 - protein, 17 aa, Mycobacterium
ILTTPWAWLACVPLAMA

SEQ ID NO: 358969 - protein, 28 aa, Mycobacterium
ILTTVFGFLVLVLLLSALNATVFASAPQ

SEQ ID NO: 358970 - protein, 27 aa, Mycobacterium
ILTTVFGFLVLVLLLSGLNATVFAAAP

SEQ ID NO: 358971 - protein, 27 aa, Mycobacterium
ILTTVFGLLVVVLLLSGLNATVFERAP

SEQ ID NO: 358972 - protein, 43 aa, Mycobacterium
ILTVVAVLSMMVWISPLLALITLLTVPLSLLVTRAITRRSQRL

SEQ ID NO: 358973 - protein, 19 aa, Mycobacterium
ILVAANDFAYLVDFGIARA

SEQ ID NO: 358974 - protein, 25 aa, Mycobacterium
ILVAFIADLLLSRRFTRSAGRRRVR

SEQ ID NO: 358975 - protein, 24 aa, Mycobacterium
ILVAFLADLLLSRRFTRSAGRMRV

SEQ ID NO: 358976 - protein, 19 aa, Mycobacterium
ILVALLFRTLDAFRIFDNI

SEQ ID NO: 358977 - protein, 29 aa, Mycobacterium
ILVASSVPLLLFPQGFLKSITYAIIASVM

SEQ ID NO: 358978 - protein, 17 aa, Mycobacterium
ILVAVVVVLLVARALVR

SEQ ID NO: 358979 - protein, 23 aa, Mycobacterium
ILVDLWIFTPFVAILVLAGIRSL

SEQ ID NO: 358980 - protein, 20 aa, Mycobacterium
ILVESLGWRWALVVAPAAAL

SEQ ID NO: 358981 - protein, 17 aa, Mycobacterium
ILVFVLLGSFILPHTGN

SEQ ID NO: 358982 - protein, 18 aa, Mycobacterium
ILVGWRYAAGTALLALVA

SEQ ID NO: 358983 - protein, 18 aa, Mycobacterium
ILVLIAFPPLTAALFALA

SEQ ID NO: 358984 - protein, 18 aa, Mycobacterium
ILVLLAFPILTAALFGLA

SEQ ID NO: 358985 - protein, 17 aa, Mycobacterium
ILVLLPAAGLTSAAVVP

SEQ ID NO: 358986 - protein, 23 aa, Mycobacterium
ILVLLVYGGILWGAVPVLNGCGG

SEQ ID NO: 358987 - protein, 17 aa, Mycobacterium
ILVLSGFVGFAVISKVP

SEQ ID NO: 358988 - protein, 19 aa, Mycobacterium
ILVMGFPVLLKLTSDELGA

SEQ ID NO: 358989 - protein, 19 aa, Mycobacterium
ILVMGFPVLLKLTSNELGA

SEQ ID NO: 358990 - protein, 19 aa, Mycobacterium
ILVMGFPVLLKLTSNELGP

SEQ ID NO: 358991 - protein, 20 aa, Mycobacterium
ILVMLLVAIFFVSGADAASI

SEQ ID NO: 358992 - protein, 27 aa, Mycobacterium
ILVSVPFTVLLIFTLNVLLAQFGAADL

SEQ ID NO: 358993 - protein, 18 aa, Mycobacterium
ILVTAWALSGGTFILLNL

SEQ ID NO: 358994 - protein, 17 aa, Mycobacterium
ILVVALAALVLGLPTMI

SEQ ID NO: 358995 - protein, 23 aa, Mycobacterium
ILVYGKLAILLLFCVAGLAFVHG

SEQ ID NO: 358996 - protein, 20 aa, Mycobacterium
ILWLVPLAGSVLVILLPPGL

SEQ ID NO: 358997 - protein, 27 aa, Mycobacterium
ILYSLLKTIIFVWIASTVQCYYGFYAS

SEQ ID NO: 358998 - protein, 24 aa, Mycobacterium
IMAAKLIFMVIWIGAATSKLNRHF

SEQ ID NO: 358999 - protein, 18 aa, Mycobacterium
IMAGGSMAALYLLRHIRA

SEQ ID NO: 359000 - protein, 19 aa, Mycobacterium
IMAPILLVALRLIQGFGAG

SEQ ID NO: 359001 - protein, 17 aa, Mycobacterium
IMAVFVPQYFRVVRNAT

SEQ ID NO: 359002 - protein, 18 aa, Mycobacterium
IMCIWPNLIAYWAGKPPI

SEQ ID NO: 359003 - protein, 18 aa, Mycobacterium
IMDRSIRALPHADHPSVL

SEQ ID NO: 359004 - protein, 25 aa, Mycobacterium
IMGLHPLMFFLPIWEGADSWPLRAA

SEQ ID NO: 359005 - protein, 17 aa, Mycobacterium
IMGLSFLERGARKPHKS

SEQ ID NO: 359006 - protein, 35 aa, Mycobacterium
IMGRTMVVWFLGSGLPVLGIAFLAGFQALMRNLTE

SEQ ID NO: 359007 - protein, 31 aa, Mycobacterium
IMHSVWILVFTLFFAGLIQQIPTAALAGLLV

SEQ ID NO: 359008 - protein, 17 aa, Mycobacterium
IMLARYQARRTVWEQEI

SEQ ID NO: 359009 - protein, 18 aa, Mycobacterium
IMLGWVGLGPVPWLVEPH

SEQ ID NO: 359010 - protein, 28 aa, Mycobacterium
IMMSFISIPLVTVAWLLVGYSLAFSDGG

SEQ ID NO: 359011 - protein, 19 aa, Mycobacterium
IMRALLFLAILGVTAGGVS

SEQ ID NO: 359012 - protein, 28 aa, Mycobacterium
IMRGIQGSLLGMPLHEPYLLGCLNARND

SEQ ID NO: 359013 - protein, 18 aa, Mycobacterium
IMSGALIGFAGSVGALGG

SEQ ID NO: 359014 - protein, 25 aa, Mycobacterium
IMVIIKLAVLALFVAVAFTAFTTDH

SEQ ID NO: 359015 - protein, 30 aa, Mycobacterium
IMVISAWILTRWLIRGWAGRVTVWAVTIGA

SEQ ID NO: 359016 - protein, 18 aa, Mycobacterium
IMVLYPRGWSEFFRLNTR

SEQ ID NO: 359017 - protein, 33 aa, Mycobacterium
IMVMALLTPLHAYLWLLLPTVVVGVVLGVIYPA

SEQ ID NO: 359018 - protein, 18 aa, Mycobacterium
IMVNLAVIALWSVSRTAG

SEQ ID NO: 359019 - protein, 35 aa, Mycobacterium
IMVQNIAFSLAIIAVLIPLAAFGVLGLATVVLIHE

SEQ ID NO: 359020 - protein, 27 aa, Mycobacterium
IMVSIPLTVLLIFTLNVLLAQFGAADI

SEQ ID NO: 359021 - protein, 19 aa, Mycobacterium
IMYMVACFIFFFIGGLMAL

SEQ ID NO: 359022 - protein, 20 aa, Mycobacterium
IMYMVACFVFFFIGGLMALL

SEQ ID NO: 359023 - protein, 17 aa, Mycobacterium
IMYVVTCFIFFLIGGLL

SEQ ID NO: 359024 - protein, 31 aa, Mycobacterium
INALALAKVMAVPMAKRFAPAIAAVAAAGLI

SEQ ID NO: 359025 - protein, 26 aa, Mycobacterium
INALGWHAFWRGEIGQWIITRGLRIA

SEQ ID NO: 359026 - protein, 24 aa, Mycobacterium
INATQLVIGTSRRTRWARLFEEGI

SEQ ID NO: 359027 - protein, 25 aa, Mycobacterium
INATQLVLGTSRRSRWARMFDEGIG

SEQ ID NO: 359028 - protein, 29 aa, Mycobacterium
INAVLPAKLILLAIAVICAVAVFSALVLK

SEQ ID NO: 359029 - protein, 40 aa, Mycobacterium
INCGYPLIERFPLMLFTSAAVLLIGLGRWYVGLTSRDTGD

SEQ ID NO: 359030 - protein, 26 aa, Mycobacterium
INCGYPLIERFPLMLGTAGTVLLIGL

SEQ ID NO: 359031 - protein, 32 aa, Mycobacterium
INDKSWLLFGPFAGWSPKFLKQGKVTDLPFSV

SEQ ID NO: 359032 - protein, 18 aa, Mycobacterium
INEPVFLGRTWGVGYMWT

SEQ ID NO: 359033 - protein, 47 aa, Mycobacterium
INFIVLATIVIVFLILVMLLRAIIAPLYLIGSVLVSFFAALGLGVIV

SEQ ID NO: 359034 - protein, 19 aa, Mycobacterium
INIRPTVALLPKPSENHLV

SEQ ID NO: 359035 - protein, 17 aa, Mycobacterium
INLFTSTFVFIGAVVYV

SEQ ID NO: 359036 - protein, 20 aa, Mycobacterium
INLGTLLREPLVGPLVALVI

SEQ ID NO: 359037 - protein, 19 aa, Mycobacterium
INLVLAIVPALMVLSPSGP

SEQ ID NO: 359038 - protein, 17 aa, Mycobacterium
INMAWRAAGGPNGPLGA

SEQ ID NO: 359039 - protein, 17 aa, Mycobacterium
INMDAEVIGINTAGKSL

SEQ ID NO: 359040 - protein, 33 aa, Mycobacterium
INMLNPGLVVLGGFLRVFPAFAAAVLREELARR

SEQ ID NO: 359041 - protein, 25 aa, Mycobacterium
INMTPACLTGFLPASQWRSFVDETP

SEQ ID NO: 359042 - protein, 29 aa, Mycobacterium
INMVLAFVLALFIFLVGPTVFMLNMIPTS

SEQ ID NO: 359043 - protein, 17 aa, Mycobacterium
INPGLIVGALGILVMVV

SEQ ID NO: 359044 - protein, 21 aa, Mycobacterium
INPLPFIVQAPRLFAGSIKLG

SEQ ID NO: 359045 - protein, 19 aa, Mycobacterium
INPVLFLPLAFRGRGLKPL

SEQ ID NO: 359046 - protein, 44 aa, Mycobacterium
INPVVNLLRKVPPRKLGYRLAWLYNVLFIVAVYGVARKAPRISR

SEQ ID NO: 359047 - protein, 19 aa, Mycobacterium
INQPPPCLTGFIPASEWRS

SEQ ID NO: 359048 - protein, 26 aa, Mycobacterium
INQPPPCMTGFLPASEWRSPADTSQA

SEQ ID NO: 359049 - protein, 17 aa, Mycobacterium
INSFTSTFVFIGAVVYI

SEQ ID NO: 359050 - protein, 26 aa, Mycobacterium
INSGRLLIFSAYVTHRIPEVWPNPTQ

SEQ ID NO: 359051 - protein, 28 aa, Mycobacterium
INSQRLLPYRWIAVGVLVILAIVFTMVY

SEQ ID NO: 359052 - protein, 22 aa, Mycobacterium
INVGFYMLMPYLAGYLAGPLGL

SEQ ID NO: 359053 - protein, 21 aa, Mycobacterium
IPAGLLLPPVGIFLGHRARKQ

SEQ ID NO: 359054 - protein, 18 aa, Mycobacterium
IPAHVSFMRMLGLGLTLA

SEQ ID NO: 359055 - protein, 21 aa, Mycobacterium
IPAILFIVYFAISPVILIPLV

SEQ ID NO: 359056 - protein, 29 aa, Mycobacterium
IPAILVVVLIVLYVLLRSALAPLVLVGVT

SEQ ID NO: 359057 - protein, 19 aa, Mycobacterium
IPALAAAVLLLFAVAPQLA

SEQ ID NO: 359058 - protein, 19 aa, Mycobacterium
IPALMFPPLMEAAAGKNNS

SEQ ID NO: 359059 - protein, 35 aa, Mycobacterium
IPANVSWIVWQLWLAVILVALWKGRRMGPLVAEEM

SEQ ID NO: 359060 - protein, 18 aa, Mycobacterium
IPANWRTFTLADVTVIFG

SEQ ID NO: 359061 - protein, 18 aa, Mycobacterium
IPAPGPMWVAVGATYDAT

SEQ ID NO: 359062 - protein, 30 aa, Mycobacterium; identical to SEQ ID NO: 22309

SEQ ID NO: 359063 - protein, 18 aa, Mycobacterium
IPATVVFAIFYLTGPQRF

SEQ ID NO: 359064 - protein, 23 aa, Mycobacterium
IPDPIRPILSWTGLTLIGAAFVL

SEQ ID NO: 359065 - protein, 24 aa, Mycobacterium
IPDQRWFSWFALLTIPTPFLANSA

SEQ ID NO: 359066 - protein, 19 aa, Mycobacterium
IPDSTAALASLRVSPGLPG

SEQ ID NO: 359067 - protein, 25 aa, Mycobacterium
IPDVLASRHHATLIPLPGGTEIRDE

SEQ ID NO: 359068 - protein, 27 aa, Mycobacterium
IPERWRTLRWVLLGLAAIVAVAALSTW

SEQ ID NO: 359069 - protein, 23 aa, Mycobacterium
IPETPLEQRRLLIDVITTAARAD

SEQ ID NO: 359070 - protein, 19 aa, Mycobacterium
IPEYIFIQSPHDLRNPRAL

SEQ ID NO: 359071 - protein, 18 aa, Mycobacterium
IPEYILVQSPHDLRTPRA

SEQ ID NO: 359072 - protein, 18 aa, Mycobacterium
IPFFLFLLTVEWAAARKL

SEQ ID NO: 359073 - protein, 17 aa, Mycobacterium
IPFVHSTSERMRRAAAQ

SEQ ID NO: 359074 - protein, 23 aa, Mycobacterium
IPGAPNQFYPKSPPASSWLVCDT

SEQ ID NO: 359075 - protein, 30 aa, Mycobacterium
IPGFFRSPRWVPVLGWLLVLGSVAGVLFGV

SEQ ID NO: 359076 - protein, 18 aa, Mycobacterium
IPHLITPIITQPKKAAAA

SEQ ID NO: 359077 - protein, 21 aa, Mycobacterium
IPHLITPIITQPKKAAAALAW

SEQ ID NO: 359078 - protein, 18 aa, Mycobacterium
IPKWKTIVRIVVPTALPG

SEQ ID NO: 359079 - protein, 24 aa, Mycobacterium
IPLAALGMLNPMLAGAAMAFSSVF

SEQ ID NO: 359080 - protein, 21 aa, Mycobacterium
IPLCYVAFLGLESYFCYFVIR

SEQ ID NO: 359081 - protein, 26 aa, Mycobacterium
IPLGLVGIFIARHVLRRVWGSEARTS

SEQ ID NO: 359082 - protein, 19 aa, Mycobacterium
IPLKIFRDRNFALCSVGVA

SEQ ID NO: 359083 - protein, 19 aa, Mycobacterium
IPLLIGVVVLVGAFTVMRV

SEQ ID NO: 359084 - protein, 22 aa, Mycobacterium
IPLLVALCAVLALSVLPLCRRR

SEQ ID NO: 359085 - protein, 30 aa, Mycobacterium
IPLRVSLVAATLVLVLCGLLASGVAVTSIL

SEQ ID NO: 359086 - protein, 26 aa, Mycobacterium
IPLSQWFLLVMAFGSLFMAAGKRYAE

SEQ ID NO: 359087 - protein, 26 aa, Mycobacterium
IPLSQWFLLVMTFGSLFMVAGKRYAE

SEQ ID NO: 359088 - protein, 18 aa, Mycobacterium
IPMALLVHPTFSGTVGGL

SEQ ID NO: 359089 - protein, 18 aa, Mycobacterium
IPMALLVHPTFTGTVDGL

SEQ ID NO: 359090 - protein, 20 aa, Mycobacterium
IPMSVLCAALALNLWVGYFP

SEQ ID NO: 359091 - protein, 19 aa, Mycobacterium
IPMVLLAHPAPKATAAGLI

SEQ ID NO: 359092 - protein, 21 aa, Mycobacterium
IPPAPILQVFFSAGVDGFFAI

SEQ ID NO: 359093 - protein, 19 aa, Mycobacterium
IPPIPSFTIPPIPVNPPTQ

SEQ ID NO: 359094 - protein, 23 aa, Mycobacterium
IPPLLVLAPFWLLPASLYVHLEM

SEQ ID NO: 359095 - protein, 18 aa, Mycobacterium
IPPLNLVADFGGGSMLVV

SEQ ID NO: 359096 - protein, 22 aa, Mycobacterium
IPQFILMRVLGWVDTPWAMIVP

SEQ ID NO: 359097 - protein, 23 aa, Mycobacterium
IPQRWRAAWVGWWVSAGLASAII

SEQ ID NO: 359098 - protein, 18 aa, Mycobacterium
IPQYIYIHSPHDLRNPQA

SEQ ID NO: 359099 - protein, 38 aa, Mycobacterium
IPRIADPVLAMLLRVAQPAFVPFTLEPLAREISRLFIG

SEQ ID NO: 359100 - protein, 24 aa, Mycobacterium
IPRMKVPVWSLLIIGVAALAVSGA

SEQ ID NO: 359101 - protein, 17 aa, Mycobacterium
IPRMPGQLPFPRDFDME

SEQ ID NO: 359102 - protein, 24 aa, Mycobacterium
IPRMYSLHILLLPGIILALIGMHM

SEQ ID NO: 359103 - protein, 17 aa, Mycobacterium
IPRPEQLAYFGGLAALA

SEQ ID NO: 359104 - protein, 24 aa, Mycobacterium
IPRPWRPVWIGWWLGVAASVAATA

SEQ ID NO: 359105 - protein, 33 aa, Mycobacterium
IPSLPEATRAAARWIRPLVPPFVARVIDTTTQP

SEQ ID NO: 359106 - protein, 33 aa, Mycobacterium
IPSLPILAAAPRPPLGPVWVALLIIGASSGVAV

SEQ ID NO: 359107 - protein, 39 aa, Mycobacterium
IPSPPQGVWYLGPFPLRAYALCIIVGIVAALVIGDRRWV

SEQ ID NO: 359108 - protein, 41 aa, Mycobacterium
IPSPPRGVWHLGPLPIRAYALFIITGIIVALLIGDRRFVAR

SEQ ID NO: 359109 - protein, 21 aa, Mycobacterium
IPTDRLWGAALTLILVIAAIN

SEQ ID NO: 359110 - protein, 18 aa, Mycobacterium
IPTIALASIWLSGPLLLG

SEQ ID NO: 359111 - protein, 24 aa, Mycobacterium
IPVDPVPDWPAPVAPPLTPNLLDL

SEQ ID NO: 359112 - protein, 26 aa, Mycobacterium
IPVFFDIGIFILAPLVYVAAKRGGRS

SEQ ID NO: 359113 - protein, 35 aa, Mycobacterium
IPVGLAIITLLIALGIPFLGIKWGYPDDRVLPSSA

SEQ ID NO: 359114 - protein, 23 aa, Mycobacterium
IPVLVPVFRFPDPGGPYAIGTVS

SEQ ID NO: 359115 - protein, 17 aa, Mycobacterium
IPVMSFVLARRVGRIAA

SEQ ID NO: 359116 - protein, 28 aa, Mycobacterium
IPVSFVALVWVFGGLLAAALPVAVGGFA

SEQ ID NO: 359117 - protein, 27 aa, Mycobacterium
IPVVLTSPAGFLQRPARWMQLMASSGR

SEQ ID NO: 359118 - protein, 18 aa, Mycobacterium
IPWLRRTVGQPAAPHLAE

SEQ ID NO: 359119 - protein, 20 aa, Mycobacterium
IPWNGWTALAALVVMCLVMI

SEQ ID NO: 359120 - protein, 22 aa, Mycobacterium
IPWRGVCRLYDTPGINGWGGRK

SEQ ID NO: 359121 - protein, 19 aa, Mycobacterium
IPYAQHAFDFYYGSPRAHY

SEQ ID NO: 359122 - protein, 24 aa, Mycobacterium
IPYPGPGWAIVFLGLAILATEFRF

SEQ ID NO: 359123 - protein, 26 aa, Mycobacterium
IQAAGLLALPLAGLSLPLCVLCVAAV

SEQ ID NO: 359124 - protein, 18 aa, Mycobacterium
IQAFIQYVRQFNQPLTQI

SEQ ID NO: 359125 - protein, 18 aa, Mycobacterium
IQAFIQYVRQFNSPLSQL

SEQ ID NO: 359126 - protein, 31 aa, Mycobacterium
IQAGAALTVLLFDSGILTPPPPKPAYEQQPQ

SEQ ID NO: 359127 - protein, 24 aa, Mycobacterium
IQAKLLVTLLVCSILSVAVVGVIG

SEQ ID NO: 359128 - protein, 25 aa, Mycobacterium
IQDYKGDYLVFNLNLNLPPPCTTGF

SEQ ID NO: 359129 - protein, 26 aa, Mycobacterium
IQGAVLLIAALFLLINLLVDVLYAVV

SEQ ID NO: 359130 - protein, 23 aa, Mycobacterium
IQGSFLGMSLHEPYLMGCLNARN

SEQ ID NO: 359131 - protein, 18 aa, Mycobacterium
IQKQWYRIFDAKAGLIEE

SEQ ID NO: 359132 - protein, 31 aa, Mycobacterium
IQLGLIGTQLALTALWRSYGVQPDAVIGHSM

SEQ ID NO: 359133 - protein, 22 aa, Mycobacterium
IQLIAIHSFVEAALRPARVAII

SEQ ID NO: 359134 - protein, 43 aa, Mycobacterium
IQLTIFAVIALSVLAITFLHFAKLPAMLFGVGRYTVTMELTKS

SEQ ID NO: 359135 - protein, 20 aa, Mycobacterium
IQLVALLSMFTIGLPRAAAS

SEQ ID NO: 359136 - protein, 19 aa, Mycobacterium
IQMAIFAIVATTALLIMVF

SEQ ID NO: 359137 - protein, 17 aa, Mycobacterium
IQPLPTGTYCKIPMETP

SEQ ID NO: 359138 - protein, 25 aa, Mycobacterium
IQQLDRFMMAPAFMAAFTAPDDVDE

SEQ ID NO: 359139 - protein, 17 aa, Mycobacterium
IQRRSAPLVRGLKALSR

SEQ ID NO: 359140 - protein, 24 aa, Mycobacterium
IQRYLPFVTVVFGIGLVILGLWLL

SEQ ID NO: 359141 - protein, 18 aa, Mycobacterium
IQSWFILTVTVVPAILVS

SEQ ID NO: 359142 - protein, 22 aa, Mycobacterium
IQSWPWRAWPQMAVLAVLVAWN

SEQ ID NO: 359143 - protein, 35 aa, Mycobacterium
IQTARSLHFLVLVYFLFFILVHVTLVFTTEALRNL

SEQ ID NO: 359144 - protein, 30 aa, Mycobacterium
IQTPVVSHFFGCTPLGPVAWTGVFSATAGA

SEQ ID NO: 359145 - protein, 19 aa, Mycobacterium
IQWIRAMSKYRATVGVAPN

SEQ ID NO: 359146 - protein, 29 aa, Mycobacterium
IQWPALVMFLIIFFWTPPHTWALAMRYKE

SEQ ID NO: 359147 - protein, 19 aa, Mycobacterium
IQYDYIFGFSFYTGHYFGA

SEQ ID NO: 359148 - protein, 24 aa, Mycobacterium
IRAKPAWPFAVGTLALCVLSLAIG

SEQ ID NO: 359149 - protein, 25 aa, Mycobacterium
IRAMVCQLAVLHPPDQLLIAAVASD

SEQ ID NO: 359150 - protein, 19 aa, Mycobacterium
IRARFPALTARQVMQRIES

SEQ ID NO: 359151 - protein, 17 aa, Mycobacterium
IRDTLLQHGPPVALTDY

SEQ ID NO: 359152 - protein, 21 aa, Mycobacterium
IREADVAAALWHPNIVRVHDR

SEQ ID NO: 359153 - protein, 22 aa, Mycobacterium
IRELPSYWTPFASPAVTLIAIV

SEQ ID NO: 359154 - protein, 17 aa, Mycobacterium
IRFPWLAKLTLLMLTVY

SEQ ID NO: 359155 - protein, 20 aa, Mycobacterium
IRFSVWMAIGVVLYFVYGRR

SEQ ID NO: 359156 - protein, 23 aa, Mycobacterium
IRGGPFVLIFVDIDDFKEVNDRF

SEQ ID NO: 359157 - protein, 22 aa, Mycobacterium
IRGWLRTQLLRRLDIKIIRISQ

SEQ ID NO: 359158 - protein, 23 aa, Mycobacterium
IRGWRKIGALVVRWPGPILVVTI

SEQ ID NO: 359159 - protein, 26 aa, Mycobacterium
IRHSGPATGWWAFRSVCTTNGCAATG

SEQ ID NO: 359160 - protein, 27 aa, Mycobacterium
IRITAYIVIVLIARYVLHRLIDRATTG

SEQ ID NO: 359161 - protein, 18 aa, Mycobacterium
IRITLIVGFLVAVAASLT

SEQ ID NO: 359162 - protein, 27 aa, Mycobacterium
IRIVRRPIPHLVASVLVLALLGSCALL

SEQ ID NO: 359163 - protein, 23 aa, Mycobacterium
IRKLVLRRWAADRRGRRSRPQES

SEQ ID NO: 359164 - protein, 19 aa, Mycobacterium
IRKRWDRYAKFAEKTFNVT

SEQ ID NO: 359165 - protein, 21 aa, Mycobacterium
IRLAFIPLFLYLLLVRHADGW

SEQ ID NO: 359166 - protein, 32 aa, Mycobacterium
IRLISPQTLFFPFVLLLAATALYRGGGDKVRT

SEQ ID NO: 359167 - protein, 25 aa, Mycobacterium
IRLRPWKWVPFTKGDRRTLLDVALY

SEQ ID NO: 359168 - protein, 19 aa, Mycobacterium
IRLSRRTLNTIKTNLFWAF

SEQ ID NO: 359169 - protein, 20 aa, Mycobacterium
IRMVKRLAPQRFLTATVITL

SEQ ID NO: 359170 - protein, 24 aa, Mycobacterium
IRNGFWRVLGIRTLTFLVASIVAN

SEQ ID NO: 359171 - protein, 17 aa, Mycobacterium
IRPIPYLVTTRLMAAVV

SEQ ID NO: 359172 - protein, 30 aa, Mycobacterium
IRPVAPEAYALYGISRVLPPALRSTARMRV

SEQ ID NO: 359173 - protein, 18 aa, Mycobacterium
IRPVAPEAYALYGLSRVA

SEQ ID NO: 359174 - protein, 27 aa, Mycobacterium
IRQPRFWRLAIAFLTLALAVGGMLQHL

SEQ ID NO: 359175 - protein, 21 aa, Mycobacterium
IRQVLMVQLWFQPFFDDSSWD

SEQ ID NO: 359176 - protein, 23 aa, Mycobacterium
IRRPLMRFGHMVAFFFRALSGIP

SEQ ID NO: 359177 - protein, 25 aa, Mycobacterium
IRRRDVVLVTGPWLAGVSSVVAALR

SEQ ID NO: 359178 - protein, 19 aa, Mycobacterium
IRRVLPALVNQFIGLLKAS

SEQ ID NO: 359179 - protein, 22 aa, Mycobacterium
IRRWARWESVSFWLLLLGGICV

SEQ ID NO: 359180 - protein, 17 aa, Mycobacterium
IRSNVLHNIAFPGVFLA

SEQ ID NO: 359181 - protein, 26 aa, Mycobacterium
IRSRKPAMMLLIGLAITVAFVASWGA

SEQ ID NO: 359182 - protein, 29 aa, Mycobacterium
IRSRKPGMMLLIGLAITVAFFASWGASLG

SEQ ID NO: 359183 - protein, 30 aa, Mycobacterium
IRSRKPGMMLLIGLAITVAFLASWGASLGL

SEQ ID NO: 359184 - protein, 26 aa, Mycobacterium
IRSRLRSLLLLLVLGSAAIAATVLAA

SEQ ID NO: 359185 - protein, 19 aa, Mycobacterium
IRSYFYWEKHCYDIPACWA

SEQ ID NO: 359186 - protein, 17 aa, Mycobacterium
IRTLLELAPPVAVVLRD

SEQ ID NO: 359187 - protein, 31 aa, Mycobacterium
IRTLSPLIILGWLVLILYTTLASVNWDWTKA

SEQ ID NO: 359188 - protein, 27 aa, Mycobacterium
IRVATLRKLAFPGFAVTIVLLVLVLIP

SEQ ID NO: 359189 - protein, 21 aa, Mycobacterium
IRVSRVLLFAFTFAGLCAGVA

SEQ ID NO: 359190 - protein, 17 aa, Mycobacterium
IRWIFPPIKAASAVGLI

SEQ ID NO: 359191 - protein, 19 aa, Mycobacterium
IRYSMILFNWFGVCLIPIL

SEQ ID NO: 359192 - protein, 17 aa, Mycobacterium
ISAFPVVLLDEPTENLD

SEQ ID NO: 359193 - protein, 21 aa, Mycobacterium
ISAGPWLAGLALTAGLGYPSV

SEQ ID NO: 359194 - protein, 30 aa, Mycobacterium
ISAIPVLSLIVVAIWLLGVGTLKDLALVQL

SEQ ID NO: 359195 - protein, 20 aa, Mycobacterium
ISALAYVVIFSIPAARELFI

SEQ ID NO: 359196 - protein, 28 aa, Mycobacterium
ISALVGFLPLIWLSLVFGWGLAGIWTGL

SEQ ID NO: 359197 - protein, 18 aa, Mycobacterium
ISASLIIFALVIAAAEYY

SEQ ID NO: 359198 - protein, 21 aa, Mycobacterium
ISATFPAMFPTQVRYAGFAIA

SEQ ID NO: 359199 - protein, 25 aa, Mycobacterium
ISAVPPYVVLPPLVGRVASLNTFVA

SEQ ID NO: 359200 - protein, 18 aa, Mycobacterium
ISCVLFPVGLIWVAIDRQ

SEQ ID NO: 359201 - protein, 29 aa, Mycobacterium
ISDFDDFFRPIRNYLYWEPHCYNIPMCYS

SEQ ID NO: 359202 - protein, 24 aa, Mycobacterium
ISDGAVFCGLLWWAAFGLQSAELV

SEQ ID NO: 359203 - protein, 28 aa, Mycobacterium
ISDNLLVLYIFWELTTVLSFLLVGHYAE

SEQ ID NO: 359204 - protein, 18 aa, Mycobacterium
ISDPAVAALLIAKTSLAA

SEQ ID NO: 359205 - protein, 17 aa, Mycobacterium
ISEGLFNALPDEGPWRL

SEQ ID NO: 359206 - protein, 28 aa, Mycobacterium
ISEQLRRFLDDQIWLENRRVLNLVRAVE

SEQ ID NO: 359207 - protein, 40 aa, Mycobacterium
ISFTKFTLVMALPWLGAVATLYVVFRWFFAKDLRVQPNPE

SEQ ID NO: 359208 - protein, 24 aa, Mycobacterium
ISGATIFFFLFVHVLDAAMLRISP

SEQ ID NO: 359209 - protein, 25 aa, Mycobacterium
ISGGPSILVWIYPNELFPTEFRATA

SEQ ID NO: 359210 - protein, 25 aa, Mycobacterium
ISGIALLAAPRWFSELTGLPVAVEY

SEQ ID NO: 359211 - protein, 33 aa, Mycobacterium
ISGPRYLVSMWPWRALLWTVFGGVLGTVLIVGL

SEQ ID NO: 359212 - protein, 39 aa, Mycobacterium
ISGVFVPIVLAIAVITLGAWLGAGFPVAAAFTAAVAVLV

SEQ ID NO: 359213 - protein, 25 aa, Mycobacterium
ISHKRWLRWPARVYTDIFRGLPEVV

SEQ ID NO: 359214 - protein, 25 aa, Mycobacterium
ISHQRWLRWPARVYTDIFRGLPEVV

SEQ ID NO: 359215 - protein, 17 aa, Mycobacterium
ISIGVVILLYVLVAFVA

SEQ ID NO: 359216 - protein, 18 aa, Mycobacterium
ISISTIFFALFAITAVYA

SEQ ID NO: 359217 - protein, 17 aa, Mycobacterium
ISLAFFCFTTIVAYYYM

SEQ ID NO: 359218 - protein, 22 aa, Mycobacterium
ISLAIIVVSIPLPWMAVLIAND

SEQ ID NO: 359219 - protein, 23 aa, Mycobacterium
ISLALLALYIIAVVVWGLIDGNA

SEQ ID NO: 359220 - protein, 28 aa, Mycobacterium
ISLAPFRVPWREQVFLSWAGLRGAVPIV

SEQ ID NO: 359221 - protein, 26 aa, Mycobacterium
ISLAVGIVFTWLFMYGMVPMMQGPIA

SEQ ID NO: 359222 - protein, 18 aa, Mycobacterium
ISLLIVALAAWYYKLNVN

SEQ ID NO: 359223 - protein, 19 aa, Mycobacterium
ISLLIVALVAWYYKLNVNP

SEQ ID NO: 359224 - protein, 18 aa, Mycobacterium
ISLPAIFRGIGLNPLAPG

SEQ ID NO: 359225 - protein, 27 aa, Mycobacterium
ISLPDAARLLRAGNRVSYFLVRPRDGY

SEQ ID NO: 359226 - protein, 25 aa, Mycobacterium
ISLPSFTIILWNLSGPLNIFGYEMP

SEQ ID NO: 359227 - protein, 29 aa, Mycobacterium
ISLVAMTAGGAWLWNEARRLRKLEDDYNA

SEQ ID NO: 359228 - protein, 21 aa, Mycobacterium
ISLVFPFDLTRITLTGSPLDA

SEQ ID NO: 359229 - protein, 22 aa, Mycobacterium
ISMIGRPLRTMIGIAALVGVAL

SEQ ID NO: 359230 - protein, 26 aa, Mycobacterium
ISNFDDWFRPIRNYLYWEKHCFDIPM

SEQ ID NO: 359231 - protein, 44 aa, Mycobacterium
ISNGFYYTAFVPNFLVMEIFQPFFDYFFGFRAYGAPGQPPDTAG

SEQ ID NO: 359232 - protein, 25 aa, Mycobacterium
ISNRRWLRWPARVYTDIFRGLPEVV

SEQ ID NO: 359233 - protein, 22 aa, Mycobacterium
ISPRIVFVPVIIGALRAADDFS

SEQ ID NO: 359234 - protein, 19 aa, Mycobacterium
ISQLRPVSILPSEAPVLVA

SEQ ID NO: 359235 - protein, 24 aa, Mycobacterium
ISQSRWLRWPARVYTDVFRGLPEV

SEQ ID NO: 359236 - protein, 25 aa, Mycobacterium
ISRRWRPAWIGWWASLAVAAAIAGG

SEQ ID NO: 359237 - protein, 23 aa, Mycobacterium
ISSAYVIFVAVQLAWHGFRHIDR

SEQ ID NO: 359238 - protein, 23 aa, Mycobacterium
ISSELRLPPFRVPAPRDSKQHVA

SEQ ID NO: 359239 - protein, 32 aa, Mycobacterium
ISSETLPMMLAPWVLLPLILTFQGRMSPRRAA

SEQ ID NO: 359240 - protein, 20 aa, Mycobacterium
ISSRFLISAIGAYINPRTAP

SEQ ID NO: 359241 - protein, 23 aa, Mycobacterium
ISTALWQYLAGREIPAAVPLVSF

SEQ ID NO: 359242 - protein, 35 aa, Mycobacterium
ISTAPTFFFQLRTANWWFALLGLAVSALTYVGAAA

SEQ ID NO: 359243 - protein, 18 aa, Mycobacterium
ISTIIAVLALWRIDQTDG

SEQ ID NO: 359244 - protein, 26 aa, Mycobacterium
ISTNWPSPTFLYRLRARRPKRRAYVL

SEQ ID NO: 359245 - protein, 17 aa, Mycobacterium
ISTPIIMRVLMGAIMTP

SEQ ID NO: 359246 - protein, 17 aa, Mycobacterium
ISVDWWATAVAGAIVAL

SEQ ID NO: 359247 - protein, 26 aa, Mycobacterium
ISVHRGRLQLMLLDAVRKRIGPQAVR

SEQ ID NO: 359248 - protein, 31 aa, Mycobacterium
ISVLIFVCVGLIALLFIKVFGAAAPGGDVDG

SEQ ID NO: 359249 - protein, 18 aa, Mycobacterium
ISVLLTFFPTWTAIGAVA

SEQ ID NO: 359250 - protein, 25 aa, Mycobacterium
ISVLLTFYPGWVTIGLMAALVLTAA

SEQ ID NO: 359251 - protein, 31 aa, Mycobacterium
ISVLPVLSLMVVAVWLLGVGTLKDLALVQLI

SEQ ID NO: 359252 - protein, 31 aa, Mycobacterium
ISVLPVVALMVVAVWLLGVGTLKDLALVQLI

SEQ ID NO: 359253 - protein, 21 aa, Mycobacterium
ISVMTLVVLLGTWVWVGVTND

SEQ ID NO: 359254 - protein, 26 aa, Mycobacterium
ISVSTIFFALFALAVGYAAWLHFSPR

SEQ ID NO: 359255 - protein, 26 aa, Mycobacterium
ISVSTIFFALFVLAVLYAIWLHFASR

SEQ ID NO: 359256 - protein, 31 aa, Mycobacterium
ISWTHHWVWLIPLMMWLLHGPLSALRGARIL

SEQ ID NO: 359257 - protein, 23 aa, Mycobacterium
ISWTHHWVWLVPLMIWAIHGAGR

SEQ ID NO: 359258 - protein, 26 aa, Mycobacterium
ISWTHHWVWLVPLMIWAIHGPLRQRP

SEQ ID NO: 359259 - protein, 28 aa, Mycobacterium
ISYGVYLWHWPLFLILNGERTGLTGWSL

SEQ ID NO: 359260 - protein, 26 aa, Mycobacterium
ISYVRQILLVQLWFQPFFDGSSWDGP

SEQ ID NO: 359261 - protein, 20 aa, Mycobacterium
ITAALLWIGYLHRQRRITWL

SEQ ID NO: 359262 - protein, 26 aa, Mycobacterium
ITAAWPGGWWIDPGIGLVIAGIAVWQ

SEQ ID NO: 359263 - protein, 26 aa, Mycobacterium
ITAFACVWYFRRTLFSSARNLFFRGV

SEQ ID NO: 359264 - protein, 23 aa, Mycobacterium
ITAGVGWWYILVATAFVVFALYC

SEQ ID NO: 359265 - protein, 24 aa, Mycobacterium
ITAHLMAPIPRPSQLRPGIPAAFD

SEQ ID NO: 359266 - protein, 24 aa, Mycobacterium
ITAHLMAPIPRPSQLRPGIPATFD

SEQ ID NO: 359267 - protein, 30 aa, Mycobacterium; identical to SEQ ID NO: 20842

SEQ ID NO: 359268 - protein, 22 aa, Mycobacterium
ITALAFVPVLMLASPAGPAGAL

SEQ ID NO: 359269 - protein, 26 aa, Mycobacterium
ITALCLFTAVFIMLRRKRVPGVARGP

SEQ ID NO: 359270 - protein, 21 aa, Mycobacterium
ITALLFSAVLLAAASAVMFPF

SEQ ID NO: 359271 - protein, 33 aa, Mycobacterium
ITAPLGLRSFNYFGWFFLVPGVLAAAVALDSKG

SEQ ID NO: 359272 - protein, 23 aa, Mycobacterium
ITATFERIAVVLVIVSVVTIPAA

SEQ ID NO: 359273 - protein, 27 aa, Mycobacterium
ITAVSALPFFWLIESRSLPQIWAAFLL

SEQ ID NO: 359274 - protein, 23 aa, Mycobacterium
ITAYLINRRWTFQAPPSTARFVA

SEQ ID NO: 359275 - protein, 25 aa, Mycobacterium
ITAYMLSFGGLMLLGGRLGDTFGRK

SEQ ID NO: 359276 - protein, 25 aa, Mycobacterium
ITAYMLTFGGLMLLGGRLGDTIGRK

SEQ ID NO: 359277 - protein, 21 aa, Mycobacterium
ITDDEFVYLIDFGIARGEAAP

SEQ ID NO: 359278 - protein, 22 aa, Mycobacterium
ITDGAFVLFPLSYVIGDVLSEV

SEQ ID NO: 359279 - protein, 25 aa, Mycobacterium
ITDGGFLVFPLTYVIGDVLTEVYGF

SEQ ID NO: 359280 - protein, 23 aa, Mycobacterium
ITDIFFGLPLLLAAIVLMQVMHH

SEQ ID NO: 359281 - protein, 31 aa, Mycobacterium
ITDVRTTVRDLLWLQVAIGIAVLTVLGVAGY

SEQ ID NO: 359282 - protein, 17 aa, Mycobacterium
ITDYPQVTLGIYNSPRQ

SEQ ID NO: 359283 - protein, 17 aa, Mycobacterium
ITEIAVVVVLMLSTKMV

SEQ ID NO: 359284 - protein, 20 aa, Mycobacterium
ITELPGVFAQWLSTVLPGGV

SEQ ID NO: 359285 - protein, 29 aa, Mycobacterium
ITETRHWWHLPLLGHHLLVAGATGAGKGS

SEQ ID NO: 359286 - protein, 23 aa, Mycobacterium
ITFGVALCAGLWFIGRRVIATVG

SEQ ID NO: 359287 - protein, 17 aa, Mycobacterium
ITFITVEVLLGIVGGLS

SEQ ID NO: 359288 - protein, 17 aa, Mycobacterium
ITFPTLVALGYPPVTST

SEQ ID NO: 359289 - protein, 18 aa, Mycobacterium
ITFPTLVTLGFPPVTATM

SEQ ID NO: 359290 - protein, 23 aa, Mycobacterium
ITGAAIFFFLFVHVLDTALVRVS

SEQ ID NO: 359291 - protein, 26 aa, Mycobacterium
ITGGWLLEHFSWGSIFLVNVPIAVAA

SEQ ID NO: 359292 - protein, 28 aa, Mycobacterium
ITGISPCILPVLPVILLSGAGGTRADSR

SEQ ID NO: 359293 - protein, 18 aa, Mycobacterium
ITGLLLAGFIIGSLGVLN

SEQ ID NO: 359294 - protein, 23 aa, Mycobacterium
ITGPAIWISFLIAAGTCALAALC

SEQ ID NO: 359295 - protein, 25 aa, Mycobacterium
ITGVWTWQIISLNALAAMIFAAVPW

SEQ ID NO: 359296 - protein, 18 aa, Mycobacterium
ITGWVPLLTVVSPLLMTY

SEQ ID NO: 359297 - protein, 24 aa, Mycobacterium
ITGYGMHPALLDAALHPIAAALGA

SEQ ID NO: 359298 - protein, 18 aa, Mycobacterium
ITHITLLILFSAAAGASA

SEQ ID NO: 359299 - protein, 23 aa, Mycobacterium
ITHPDDPLPFLLTDTRLASPTFR

SEQ ID NO: 359300 - protein, 29 aa, Mycobacterium
ITHVGSGTWIAWAAWAAIVLAVVTLVFTS

SEQ ID NO: 359301 - protein, 30 aa, Mycobacterium
ITIAVAVALVLWWRLIRFEYALLVTIATAA

SEQ ID NO: 359302 - protein, 27 aa, Mycobacterium
ITIGIVVLAFVLTLLFTKNEEARKLLE

SEQ ID NO: 359303 - protein, 22 aa, Mycobacterium
ITILMGLVFIGLVPVLQRDTRF

SEQ ID NO: 359304 - protein, 23 aa, Mycobacterium
ITIPIIIFVLIFQRRIVAGLTSG

SEQ ID NO: 359305 - protein, 24 aa, Mycobacterium
ITIQLRITDWFASRWRPGRSLVVG

SEQ ID NO: 359306 - protein, 25 aa, Mycobacterium
ITIVALSVLGLTLALALGGLSARAL

SEQ ID NO: 359307 - protein, 22 aa, Mycobacterium
ITIVTTLPPGAGPPPAPAGPPM

SEQ ID NO: 359308 - protein, 24 aa, Mycobacterium
ITLGNIQAFIQYVRQFNAPLSQVA

SEQ ID NO: 359309 - protein, 17 aa, Mycobacterium
ITLGSWWLAPAHFTTTV

SEQ ID NO: 359310 - protein, 17 aa, Mycobacterium
ITLKRAKGPLVFDLGIC

SEQ ID NO: 359311 - protein, 23 aa, Mycobacterium
ITLMSPLAFVRRPRRWIKQLATE

SEQ ID NO: 359312 - protein, 17 aa, Mycobacterium
ITLQGLAFPALGAAGVV

SEQ ID NO: 359313 - protein, 27 aa, Mycobacterium
ITLTVMAIFYLRLPATFGIGTYGVSAD

SEQ ID NO: 359314 - protein, 26 aa, Mycobacterium
ITLVQLAPFVLLVELARLLLSGASSD

SEQ ID NO: 359315 - protein, 27 aa, Mycobacterium
ITLVVMAVFYLRLPATFGLGTYGVSAD

SEQ ID NO: 359316 - protein, 20 aa, Mycobacterium
ITMLIMLVMVFIELAAARGV

SEQ ID NO: 359317 - protein, 22 aa, Mycobacterium
ITNFAWMYPILTGLPISQTTWN

SEQ ID NO: 359318 - protein, 35 aa, Mycobacterium
ITPEARLINVLVITPLRVAFLIVLIGTTVETLTTQ

SEQ ID NO: 359319 - protein, 36 aa, Mycobacterium
ITQRLPTVLVLIALVTFALLFLLTGSAVLPLQALVC

SEQ ID NO: 359320 - protein, 25 aa, Mycobacterium
ITRDRRHMLIGLPRVDSISSNQDLG

SEQ ID NO: 359321 - protein, 26 aa, Mycobacterium
ITRFGALPLVLPLLAAVTVTGILIFR

SEQ ID NO: 359322 - protein, 29 aa, Mycobacterium
ITRHYDVWNILLIEHLFAPEGPELGPDAW

SEQ ID NO: 359323 - protein, 17 aa, Mycobacterium
ITRISLNFAMFRSAFEQ

SEQ ID NO: 359324 - protein, 27 aa, Mycobacterium
ITRLAPFSWVWPALSLVVLQLLVSLAL

SEQ ID NO: 359325 - protein, 17 aa, Mycobacterium
ITRTLCLFVIAFGLYMV

SEQ ID NO: 359326 - protein, 36 aa, Mycobacterium
ITRTLLDLYLMQYFIIRWRVWLTDRLTGDWLDDRAY

SEQ ID NO: 359327 - protein, 18 aa, Mycobacterium
ITSALYDLMTHDELRFVV

SEQ ID NO: 359328 - protein, 36 aa, Mycobacterium
ITSRLPMVFGFIAIVTLVLLFLLTGSVLLPIKAVVL

SEQ ID NO: 359329 - protein, 22 aa, Mycobacterium
ITSRVVLRWSWTPLLVLGSVAT

SEQ ID NO: 359330 - protein, 24 aa, Mycobacterium
ITSWGVLYYAFPVLAPRITADTGW

SEQ ID NO: 359331 - protein, 30 aa, Mycobacterium
ITTMSSLLFMFVWAMIILSYLAYRRRHPQR

SEQ ID NO: 359332 - protein, 17 aa, Mycobacterium
ITTPNWLEVPLAMRDGL

SEQ ID NO: 359333 - protein, 27 aa, Mycobacterium
ITTTKPPPPPPPPPPPPSTEIPTATET

SEQ ID NO: 359334 - protein, 30 aa, Mycobacterium
ITVAAPAYWSEGQFAALRGALRSQPALAPD

SEQ ID NO: 359335 - protein, 27 aa, Mycobacterium
ITVALCVFLLAWLLALNTVYETYRDDT

SEQ ID NO: 359336 - protein, 17 aa, Mycobacterium
ITVIIWLVSIMIVLTGV

SEQ ID NO: 359337 - protein, 25 aa, Mycobacterium
ITVLAQQVLLPRLPPKGLSQEELRA

SEQ ID NO: 359338 - protein, 17 aa, Mycobacterium
ITVLLYEAEPINAIIPS

SEQ ID NO: 359339 - protein, 25 aa, Mycobacterium
ITVPAHIIGLRRPWPSLPATHLAES

SEQ ID NO: 359340 - protein, 24 aa, Mycobacterium
ITVPIIIFVLIFQRRIVAGLTSGA

SEQ ID NO: 359341 - protein, 24 aa, Mycobacterium
ITVSTIFFALFAIAAVYAAWLHFA

SEQ ID NO: 359342 - protein, 17 aa, Mycobacterium
ITVTSQFLSHGPAAMCF

SEQ ID NO: 359343 - protein, 31 aa, Mycobacterium
ITVVTAILLAMYWPLGVVVLVSIVPIAATVL

SEQ ID NO: 359344 - protein, 30 aa, Mycobacterium
ITVVTVCLLVMYWPLGLVVLGSIVPIVATV

SEQ ID NO: 359345 - protein, 17 aa, Mycobacterium
ITYAMFAWLPVIVTSAG

SEQ ID NO: 359346 - protein, 25 aa, Mycobacterium
ITYHPSIEQLLVLLPSGVAIEQAAT

SEQ ID NO: 359347 - protein, 29 aa, Mycobacterium
ITYTSVVLVFLAFMVALVGGADLGLGRLV

SEQ ID NO: 359348 - protein, 34 aa, Mycobacterium
IVAAAVVLIVLLVTAFLAPGWAVTTTLDVNKAQD

SEQ ID NO: 359349 - protein, 24 aa, Mycobacterium
IVAAFFLTMLHWLGGAAVFALFGA

SEQ ID NO: 359350 - protein, 18 aa, Mycobacterium
IVAAFRRHWRQILLVAGA

SEQ ID NO: 359351 - protein, 23 aa, Mycobacterium
IVAAKLVFLVIWMGAATSKLNRH

SEQ ID NO: 359352 - protein, 26 aa, Mycobacterium
IVAALAVLVTVFTLVRDRPAPVMSAK

SEQ ID NO: 359353 - protein, 26 aa, Mycobacterium
IVAATGWLGYLLGPPLIGHLSGWVGL

SEQ ID NO: 359354 - protein, 23 aa, Mycobacterium
IVAAVLFHRLVVLIGVALIVWAT

SEQ ID NO: 359355 - protein, 18 aa, Mycobacterium
IVAFLRTGLVIAIVSLVT

SEQ ID NO: 359356 - protein, 20 aa, Mycobacterium
IVAFNIIKWIGVAYLIYLAV

SEQ ID NO: 359357 - protein, 31 aa, Mycobacterium
IVAGALFGAMIVVALLVLSRLRNLMFDTLTA

SEQ ID NO: 359358 - protein, 17 aa, Mycobacterium
IVAGCLLRIGAFGLLAI

SEQ ID NO: 359359 - protein, 26 aa, Mycobacterium
IVAGIVFIVAVIFFTGFRLGMQSGHG

SEQ ID NO: 359360 - protein, 27 aa, Mycobacterium
IVAGIVFIVSVIFFTGFRLGMHSGHGG

SEQ ID NO: 359361 - protein, 28 aa, Mycobacterium
IVAGVLLVLGLFTPLAAAGALAFLINGL

SEQ ID NO: 359362 - protein, 30 aa, Mycobacterium
IVAGVVFIVAVIFFSGFFVGKQYGGGYRDG

SEQ ID NO: 359363 - protein, 27 aa, Mycobacterium
IVAIALPLIPIFMILIGMATADRSEAA

SEQ ID NO: 359364 - protein, 26 aa, Mycobacterium
IVAIAMGPLLLLGLLGARIWSDRPVA

SEQ ID NO: 359365 - protein, 37 aa, Mycobacterium
IVAILLPVLVLVALVLMAWGAFRLWRWRRRRAKSTHP

SEQ ID NO: 359366 - protein, 30 aa, Mycobacterium
IVAITLPLIPVFMILIGLLTRDRAATALAA

SEQ ID NO: 359367 - protein, 24 aa, Mycobacterium
IVALIGTIVMLYVSGVRSLSTGFF

SEQ ID NO: 359368 - protein, 21 aa, Mycobacterium
IVALMLLGMPPLLAGTYAGIA

SEQ ID NO: 359369 - protein, 25 aa, Mycobacterium
IVALSLLTAVLLAGAGILGGALWLD

SEQ ID NO: 359370 - protein, 18 aa, Mycobacterium
IVAPFIGIKLIDLIIQFL

SEQ ID NO: 359371 - protein, 22 aa, Mycobacterium
IVAPVLAILLVRLLELRPQIAI

SEQ ID NO: 359372 - protein, 18 aa, Mycobacterium
IVASLPTMAQLSTALRQL

SEQ ID NO: 359373 - protein, 27 aa, Mycobacterium
IVATKTDLYPHWRQIVDANIAHLQRAG

SEQ ID NO: 359374 - protein, 24 aa, Mycobacterium
IVAVALLVCLIPTTIGALLSAIGI

SEQ ID NO: 359375 - protein, 20 aa, Mycobacterium
IVAVIWGIGMALNLAWPRAA

SEQ ID NO: 359376 - protein, 22 aa, Mycobacterium
IVAVNALMLKRLKLPVPASAEA

SEQ ID NO: 359377 - protein, 32 aa, Mycobacterium
IVAVVTFEEFFFPLPGLWKWVAAAVFVWGSAC

SEQ ID NO: 359378 - protein, 27 aa, Mycobacterium
IVAVVVALIVVGVLVALARKSRNRRRA

SEQ ID NO: 359379 - protein, 30 aa, Mycobacterium
IVCEITATAFLVVFFRHNLNLNGGLFVAAA

SEQ ID NO: 359380 - protein, 23 aa, Mycobacterium
IVDFGLYLLLYQAVGVQVDLAKA

SEQ ID NO: 359381 - protein, 22 aa, Mycobacterium
IVDFGLYVLFLHVGLQVNVAKS

SEQ ID NO: 359382 - protein, 17 aa, Mycobacterium
IVDFRRGLLGVVGPEYL

SEQ ID NO: 359383 - protein, 28 aa, Mycobacterium
IVDGLICYVGYLFPLWDAKRQTLADKIM

SEQ ID NO: 359384 - protein, 17 aa, Mycobacterium
IVDLGFWCFMAGAVIMI

SEQ ID NO: 359385 - protein, 17 aa, Mycobacterium
IVDPLVFAEAADLIADH

SEQ ID NO: 359386 - protein, 20 aa, Mycobacterium
IVDRLFMGSLVPLTAYTVAL

SEQ ID NO: 359387 - protein, 21 aa, Mycobacterium
IVDTLIVRAFMTPSIAAALGR

SEQ ID NO: 359388 - protein, 43 aa, Mycobacterium
IVDTLVVRIFAVPAIMGLLGRWFWWSPPPFLRASLAGPRRWGP

SEQ ID NO: 359389 - protein, 28 aa, Mycobacterium
IVDVLYIAAFALFIYGLSGLTGPKTAVR

SEQ ID NO: 359390 - protein, 27 aa, Mycobacterium
IVERVITIALVLVLFDGGMHIGPARFR

SEQ ID NO: 359391 - protein, 20 aa, Mycobacterium
IVEWLSPLLALLFGLYLIYQ

SEQ ID NO: 359392 - protein, 26 aa, Mycobacterium
IVFALPSIFLLPWLADVFGLSDAVAG

SEQ ID NO: 359393 - protein, 23 aa, Mycobacterium
IVFCPFAWMHMPAASVAITALTL

SEQ ID NO: 359394 - protein, 23 aa, Mycobacterium
IVFGALLTPEWLSGLSWRAWVFA

SEQ ID NO: 359395 - protein, 22 aa, Mycobacterium
IVFLYVFVALLLNRDKLRTLIG

SEQ ID NO: 359396 - protein, 17 aa, Mycobacterium
IVFPLTPPQATPIPQIE

SEQ ID NO: 359397 - protein, 22 aa, Mycobacterium
IVFVFAFAYLRPPGQRPSARGV

SEQ ID NO: 359398 - protein, 18 aa, Mycobacterium
IVFVLIFQRRIVAGLTSG

SEQ ID NO: 359399 - protein, 27 aa, Mycobacterium
IVGAAGIWWVMRGHASGWWAQITGGDS

SEQ ID NO: 359400 - protein, 25 aa, Mycobacterium
IVGAAPPLRWVVDKLAAHGPDELSS

SEQ ID NO: 359401 - protein, 27 aa, Mycobacterium
IVGALGILVMVVWVGTALTISTAASRS

SEQ ID NO: 359402 - protein, 22 aa, Mycobacterium
IVGALLVMSLLITPAAAAARIT

SEQ ID NO: 359403 - protein, 22 aa, Mycobacterium
IVGALLVMSLLITPAAAAARVV

SEQ ID NO: 359404 - protein, 23 aa, Mycobacterium
IVGALLVMSLLITPAAAAARVVT

SEQ ID NO: 359405 - protein, 24 aa, Mycobacterium
IVGAPLPLLLWLAGPGDSLVSAAA

SEQ ID NO: 359406 - protein, 28 aa, Mycobacterium
IVGCVALGLVLTLWVVHTRALLSDRAVL

SEQ ID NO: 359407 - protein, 18 aa, Mycobacterium
IVGFAMLGALTFLPTFMQ

SEQ ID NO: 359408 - protein, 17 aa, Mycobacterium
IVGFPLALGSYWGLACV

SEQ ID NO: 359409 - protein, 18 aa, Mycobacterium
IVGGLGIWLVVRPKPAPP

SEQ ID NO: 359410 - protein, 27 aa, Mycobacterium
IVGGTVIAILLLWSKLPAKARIVPGAL

SEQ ID NO: 359411 - protein, 24 aa, Mycobacterium
IVGGVLPFVWIAWIALRNFRSGST

SEQ ID NO: 359412 - protein, 20 aa, Mycobacterium
IVGGVLPFVWIAWTALRHFR

SEQ ID NO: 359413 - protein, 17 aa, Mycobacterium
IVGIHDRGKHRNRLWIS

SEQ ID NO: 359414 - protein, 31 aa, Mycobacterium
IVGISAMCLIFIIVLILTRALIAAAVIVGTV

SEQ ID NO: 359415 - protein, 19 aa, Mycobacterium
IVGLGLYYSYAPLHALLTA

SEQ ID NO: 359416 - protein, 18 aa, Mycobacterium
IVGLLINTIPVPMSWEPH

SEQ ID NO: 359417 - protein, 40 aa, Mycobacterium
IVGLVRFGYRKRSWLSALGLVMTLVVATAYLFFGALQVNP

SEQ ID NO: 359418 - protein, 20 aa, Mycobacterium
IVGPPMFRRLMDQQVSPGAG

SEQ ID NO: 359419 - protein, 25 aa, Mycobacterium
IVGVAVMIFSYMQVPTLLGIGRLAV

SEQ ID NO: 359420 - protein, 24 aa, Mycobacterium
IVGVLLFLSGILMATTLFPDLDVV

SEQ ID NO: 359421 - protein, 25 aa, Mycobacterium
IVGVMFSMFLLAFAGIPLTSGFVSK

SEQ ID NO: 359422 - protein, 26 aa, Mycobacterium
IVGVMFSMFLLAFAGIPLTSGFVSKL

SEQ ID NO: 359423 - protein, 27 aa, Mycobacterium
IVGVMLSMFLLAFAGIPLTSGFISKFA

SEQ ID NO: 359424 - protein, 27 aa, Mycobacterium
IVGVMLSMFLLAFAGIPLTSGFISKFS

SEQ ID NO: 359425 - protein, 33 aa, Mycobacterium
IVGVTIIVVLLTLIALLRAVVAPLYLVASVVIS

SEQ ID NO: 359426 - protein, 30 aa, Mycobacterium
IVGVVVMVLMYIQAPTLLGIGRITVTLEVP

SEQ ID NO: 359427 - protein, 19 aa, Mycobacterium
IVHAFPVLPIASAVLALHP

SEQ ID NO: 359428 - protein, 24 aa, Mycobacterium
IVHGWIYFVYLIFTTDLAVKVRWP

SEQ ID NO: 359429 - protein, 23 aa, Mycobacterium
IVHGWVYFVYVLAAFNLAVKVRW

SEQ ID NO: 359430 - protein, 28 aa, Mycobacterium
IVHQWRWSLVALWFTALVLLILVRFWEY

SEQ ID NO: 359431 - protein, 25 aa, Mycobacterium
IVHSLVLLAVVYLATGPVSAIPLSA

SEQ ID NO: 359432 - protein, 21 aa, Mycobacterium
IVHVILLIFFSTMAGARADLS

SEQ ID NO: 359433 - protein, 35 aa, Mycobacterium
IVIAVVAGAFGWTYLRDRSHRLTITAQFESVSGLY

SEQ ID NO: 359434 - protein, 22 aa, Mycobacterium
IVICLVARWRGLRALVGILVAF

SEQ ID NO: 359435 - protein, 25 aa, Mycobacterium
IVIDTLIMWLGKLLTPWTRAQPRST

SEQ ID NO: 359436 - protein, 17 aa, Mycobacterium
IVILLLLPEAKADLTVW

SEQ ID NO: 359437 - protein, 25 aa, Mycobacterium
IVLALANLLWFIFAGLGALTLEDGR

SEQ ID NO: 359438 - protein, 18 aa, Mycobacterium
IVLCIVLISFVSCALSLQ

SEQ ID NO: 359439 - protein, 25 aa, Mycobacterium
IVLCRDFFGTRSPVVFGWVFASHQV

SEQ ID NO: 359440 - protein, 17 aa, Mycobacterium
IVLDGFSWAWNTFTRNA

SEQ ID NO: 359441 - protein, 17 aa, Mycobacterium
IVLFVFTVSFLFSTPGV

SEQ ID NO: 359442 - protein, 25 aa, Mycobacterium
IVLFVVIVPLWRYRVHRWDISVDTA

SEQ ID NO: 359443 - protein, 21 aa, Mycobacterium
IVLGLLAFLYLVSTAFMICAE

SEQ ID NO: 359444 - protein, 24 aa, Mycobacterium
IVLGYPLFLLITSGSPVAAITGHC

SEQ ID NO: 359445 - protein, 18 aa, Mycobacterium
IVLITGLYVAYYGYYEIR

SEQ ID NO: 359446 - protein, 28 aa, Mycobacterium
IVLLAHPGLPLWPYLVCAALTGLGGGNY

SEQ ID NO: 359447 - protein, 17 aa, Mycobacterium
IVLLFVNQTIIVSQDAP

SEQ ID NO: 359448 - protein, 20 aa, Mycobacterium
IVLLIAGVVMYDLAEKTWLS

SEQ ID NO: 359449 - protein, 21 aa, Mycobacterium
IVLLLVFTAFVANSALHVKPS

SEQ ID NO: 359450 - protein, 17 aa, Mycobacterium
IVLMSVGLPLGAWGLHD

SEQ ID NO: 359451 - protein, 17 aa, Mycobacterium
IVLPGAYIGVVLLATAA

SEQ ID NO: 359452 - protein, 37 aa, Mycobacterium
IVLPTPLSIPPPEGKPWWLIVVGVVVVGLLGGMVAMV

SEQ ID NO: 359453 - protein, 38 aa, Mycobacterium
IVLPTPLSIPPPEGKPWWLVVVGVLVVGLLIGMVGMTF

SEQ ID NO: 359454 - protein, 39 aa, Mycobacterium
IVLPTPLSIPPPEGKPWWLVVVGVLVVGLLIGMVGMTFA

SEQ ID NO: 359455 - protein, 24 aa, Mycobacterium
IVLSLFRIVFGLLFTIHGTAILFR

SEQ ID NO: 359456 - protein, 18 aa, Mycobacterium
IVLSSFWGWRGPYGTHPI

SEQ ID NO: 359457 - protein, 26 aa, Mycobacterium
IVLVFAAKRVLWLTKLIRSGQKTLDE

SEQ ID NO: 359458 - protein, 28 aa, Mycobacterium
IVLVLMALTYHRLPWRALPVESPPPAEV

SEQ ID NO: 359459 - protein, 19 aa, Mycobacterium
IVLWASLVSSVLPLVLRKL

SEQ ID NO: 359460 - protein, 18 aa, Mycobacterium
IVLYVLVAFVAVGNLDVA

SEQ ID NO: 359461 - protein, 19 aa, Mycobacterium
IVMFIGYLAVFAVVLFMHA

SEQ ID NO: 359462 - protein, 20 aa, Mycobacterium
IVMLNHCYFGYFASGGAVGV

SEQ ID NO: 359463 - protein, 32 aa, Mycobacterium
IVMRRRRLVGTWPLIAPLLAAGTVILAVVFAD

SEQ ID NO: 359464 - protein, 31 aa, Mycobacterium
IVNDQSLLLAWPWALLIAASSWVAATTLGPF

SEQ ID NO: 359465 - protein, 19 aa, Mycobacterium
IVNKRLVWIIDGYTTLDNY

SEQ ID NO: 359466 - protein, 18 aa, Mycobacterium
IVNKRMVWILDGYTTLDN

SEQ ID NO: 359467 - protein, 26 aa, Mycobacterium
IVNRLFLAVELVFVVLFIIIAVRAIN

SEQ ID NO: 359468 - protein, 18 aa, Mycobacterium
IVNSPLVHIGGVFRVLQC

SEQ ID NO: 359469 - protein, 19 aa, Mycobacterium
IVPATLGPDTLMIGAAELA

SEQ ID NO: 359470 - protein, 17 aa, Mycobacterium
IVPFFAIYLAWQMFSED

SEQ ID NO: 359471 - protein, 18 aa, Mycobacterium
IVPGLALAFLVAAPVASV

SEQ ID NO: 359472 - protein, 17 aa, Mycobacterium
IVPWWFVAILLARDGLL

SEQ ID NO: 359473 - protein, 24 aa, Mycobacterium
IVQAFGVWWFYAALGSGPISVVSP

SEQ ID NO: 359474 - protein, 29 aa, Mycobacterium
IVQHLLAEDIGLPTPPWPTEGLSPAEYWE

SEQ ID NO: 359475 - protein, 27 aa, Mycobacterium
IVQPFGEYLPWRSFFAHFSEYADRAGY

SEQ ID NO: 359476 - protein, 18 aa, Mycobacterium
IVRAFIRVLLIALLIPPL

SEQ ID NO: 359477 - protein, 23 aa, Mycobacterium
IVRLGHMLVFFVRAVAAIPIVLR

SEQ ID NO: 359478 - protein, 29 aa, Mycobacterium
IVRRAPVIVIGLWIGLAAVLALTAPSLQK

SEQ ID NO: 359479 - protein, 21 aa, Mycobacterium
IVRRPRIHLVASLVVLAILAG

SEQ ID NO: 359480 - protein, 21 aa, Mycobacterium
IVRRRRVWVRLTPGPAGTVNV

SEQ ID NO: 359481 - protein, 36 aa, Mycobacterium
IVRSLVIPSIATLLGRWFWWPMRVPCRAFRETDPAV

SEQ ID NO: 359482 - protein, 38 aa, Mycobacterium
IVRSLVVPCLLRLLGPWFWWPTFIRQRPLRQAVRQRER

SEQ ID NO: 359483 - protein, 17 aa, Mycobacterium
IVRVAILADSRLTEVAL

SEQ ID NO: 359484 - protein, 17 aa, Mycobacterium
IVSFWLLGFDTAGSPLW

SEQ ID NO: 359485 - protein, 17 aa, Mycobacterium
IVSFWLLGFDTAGSPVW

SEQ ID NO: 359486 - protein, 19 aa, Mycobacterium
IVSLPGPGWPELRTHEDKI

SEQ ID NO: 359487 - protein, 20 aa, Mycobacterium
IVSMLFKLEIARGFLVIALP

SEQ ID NO: 359488 - protein, 19 aa, Mycobacterium
IVSPVFIFALVLAADSEHA

SEQ ID NO: 359489 - protein, 25 aa, Mycobacterium
IVSQLLGCTPLDPVGWAQALGAAAA

SEQ ID NO: 359490 - protein, 23 aa, Mycobacterium
IVSTVIALLALWRLDRLDGRRMH

SEQ ID NO: 359491 - protein, 20 aa, Mycobacterium
IVSWIAVILLTFHWARVVWQ

SEQ ID NO: 359492 - protein, 19 aa, Mycobacterium
IVTAFYLVVALAALGAQPW

SEQ ID NO: 359493 - protein, 21 aa, Mycobacterium
IVTCYLGIILGIVGVILGVVA

SEQ ID NO: 359494 - protein, 19 aa, Mycobacterium
IVTDVLTWIGLRPSVDDSP

SEQ ID NO: 359495 - protein, 33 aa, Mycobacterium
IVTGGVLLAVYLVIALALFLLTQRDLFAEMNLR

SEQ ID NO: 359496 - protein, 35 aa, Mycobacterium
IVTICLIVVMLLLVYRAPSTLLVPLLGVLIEMLVA

SEQ ID NO: 359497 - protein, 19 aa, Mycobacterium
IVTILLAVALVFNLPAVLQ

SEQ ID NO: 359498 - protein, 24 aa, Mycobacterium
IVTLRGVLLLAFPKAFVSAANSMI

SEQ ID NO: 359499 - protein, 22 aa, Mycobacterium
IVTRFDYRDALLLDLHGNVVYT

SEQ ID NO: 359500 - protein, 23 aa, Mycobacterium
IVTRFQYRDALLLDLQGNVVYSV

SEQ ID NO: 359501 - protein, 17 aa, Mycobacterium
IVTTSLALALWVTSYPD

SEQ ID NO: 359502 - protein, 32 aa, Mycobacterium
IVTTTILMFLAFGSIVLPIKAALMSALTLGST

SEQ ID NO: 359503 - protein, 23 aa, Mycobacterium
IVTYVLMALLLVAPLVLRLMHRS

SEQ ID NO: 359504 - protein, 19 aa, Mycobacterium
IVVAALVTGLMLLKSTGRL

SEQ ID NO: 359505 - protein, 26 aa, Mycobacterium
IVVAILLIAVFLLLRALPSLRVNHAN

SEQ ID NO: 359506 - protein, 25 aa, Mycobacterium
IVVALPLGIWLFSPLRRRANASIAV

SEQ ID NO: 359507 - protein, 30 aa, Mycobacterium
IVVGAIVGTLWFGGWLVPLLAIWAYWQVFH

SEQ ID NO: 359508 - protein, 31 aa, Mycobacterium
IVVHFSYTKPRLSWLDAMYFTAETITTVGYG

SEQ ID NO: 359509 - protein, 33 aa, Mycobacterium
IVVIAIMMFIVYRSLSTVLILLALMGIGVGAAR

SEQ ID NO: 359510 - protein, 30 aa, Mycobacterium
IVVIALPLIPIFMVLIGLLTAERSAAALTA

SEQ ID NO: 359511 - protein, 17 aa, Mycobacterium
IVVIAPVWARRLEARGW

SEQ ID NO: 359512 - protein, 26 aa, Mycobacterium
IVVIVIAAILLIAAIVWVARNKRNEH

SEQ ID NO: 359513 - protein, 22 aa, Mycobacterium
IVVKALLVVGLWLAGWGAARLV

SEQ ID NO: 359514 - protein, 26 aa, Mycobacterium
IVVKQGLYKWAWIPALPLGWDLIVTM

SEQ ID NO: 359515 - protein, 18 aa, Mycobacterium
IVVLAVLFRLFVRSRLID

SEQ ID NO: 359516 - protein, 18 aa, Mycobacterium
IVVLYKRNETFRNIVQAT

SEQ ID NO: 359517 - protein, 20 aa, Mycobacterium
IVVMLLVIYGSVTTALVVLV

SEQ ID NO: 359518 - protein, 18 aa, Mycobacterium
IVVRWPGPVLVATLLISL

SEQ ID NO: 359519 - protein, 27 aa, Mycobacterium
IVVSSDLAEWEWVKWLPHFGDSRRYDA

SEQ ID NO: 359520 - protein, 17 aa, Mycobacterium
IVVSYYWHFVDIVWIAL

SEQ ID NO: 359521 - protein, 18 aa, Mycobacterium
IVVSYYWHFVDIVWIALF

SEQ ID NO: 359522 - protein, 25 aa, Mycobacterium
IVVVGTVILWSFFGDALSNRSHRAA

SEQ ID NO: 359523 - protein, 27 aa, Mycobacterium
IVVVIALVTLLIWWTSDARATVSRPAA

SEQ ID NO: 359524 - protein, 29 aa, Mycobacterium
IVVVTIAIVIFAIAFALPATRAKPVDVPI

SEQ ID NO: 359525 - protein, 28 aa, Mycobacterium
IVVVVAVVAALIWWTSDARATISRPAAT

SEQ ID NO: 359526 - protein, 17 aa, Mycobacterium
IVWVAIALLITDHYHVT

SEQ ID NO: 359527 - protein, 17 aa, Mycobacterium
IVYFAISPVILIPLVRK

SEQ ID NO: 359528 - protein, 20 aa, Mycobacterium
IVYWVLVGNVPFEIAVAVSL

SEQ ID NO: 359529 - protein, 19 aa, Mycobacterium
IWAAIFVWELARPPIWMLV

SEQ ID NO: 359530 - protein, 17 aa, Mycobacterium
IWALALVYFGIAYGLYA

SEQ ID NO: 359531 - protein, 18 aa, Mycobacterium
IWAQVLLVIIRIGQGLST

SEQ ID NO: 359532 - protein, 22 aa, Mycobacterium
IWDIRNRGVIPPGALPRVRAFT

SEQ ID NO: 359533 - protein, 33 aa, Mycobacterium
IWGIWLVIVGWGTLWPFLSWLTTHFVVTNRRVM

SEQ ID NO: 359534 - protein, 19 aa, Mycobacterium
IWGWIFNDPIDVAGPARSA

SEQ ID NO: 359535 - protein, 17 aa, Mycobacterium
IWISFVIAAITCALAAL

SEQ ID NO: 359536 - protein, 24 aa, Mycobacterium
IWLNGWFIPLLLPGALKRPRMALF

SEQ ID NO: 359537 - protein, 22 aa, Mycobacterium
IWLVFGGLWLALGYLLAALICF

SEQ ID NO: 359538 - protein, 19 aa, Mycobacterium
IWPNRKEMIAYTTTVLFFL

SEQ ID NO: 359539 - protein, 46 aa, Mycobacterium
IWPPWEFYFWHHTIPAPVWVALIMGLIFMLLIVYPFLEKRFTGDYA

SEQ ID NO: 359540 - protein, 29 aa, Mycobacterium
IWPPWEFYFWHHTVPAPVWVALLMGLIFV

SEQ ID NO: 359541 - protein, 25 aa, Mycobacterium
IWQIGRPWYLAWAGLVYVVATLATL

SEQ ID NO: 359542 - protein, 18 aa, Mycobacterium
IWRHRALALCLKELGLAG

SEQ ID NO: 359543 - protein, 22 aa, Mycobacterium
IWRLAAFMVVCTLGLAAMLAIF

SEQ ID NO: 359544 - protein, 23 aa, Mycobacterium
IWRLAIFMVVCTLGLIAMLAIFA

SEQ ID NO: 359545 - protein, 18 aa, Mycobacterium
IWSIGDPRIDVGWFLINC

SEQ ID NO: 359546 - protein, 24 aa, Mycobacterium
IWSRHFADALLRRSPDPPYPGQVI

SEQ ID NO: 359547 - protein, 19 aa, Mycobacterium
IWSVIYLGLFAYTVYLGLA

SEQ ID NO: 359548 - protein, 17 aa, Mycobacterium
IWTLFFVLLCDVMVSVL

SEQ ID NO: 359549 - protein, 28 aa, Mycobacterium
IWTRTSPPWAFFSLPTRAWELAVGGLVA

SEQ ID NO: 359550 - protein, 17 aa, Mycobacterium
IWVFGPLRRRATAALAI

SEQ ID NO: 359551 - protein, 26 aa, Mycobacterium
IWVGDQVIDPFRLAIRVELAGVDAAT

SEQ ID NO: 359552 - protein, 18 aa, Mycobacterium
IWVIKHTAVPAGWVPVFM

SEQ ID NO: 359553 - protein, 32 aa, Mycobacterium
IWVTDRILLDQLSWATPARWGYAASASTIDTH

SEQ ID NO: 359554 - protein, 37 aa, Mycobacterium
IYANIIKFVKFQLTTAWGFVLIFLVCGSLGLAGGAPF

SEQ ID NO: 359555 - protein, 25 aa, Mycobacterium
IYAYLAPWQLSPTQWYTWVIAIVGV

SEQ ID NO: 359556 - protein, 17 aa, Mycobacterium
IYCCYETALGRSVAVKV

SEQ ID NO: 359557 - protein, 27 aa, Mycobacterium
IYDTWLGLIIPYLTFALPLSIWTMSAF

SEQ ID NO: 359558 - protein, 25 aa, Mycobacterium
IYGDFFNFYACDVTLKLNGLQPGGP

SEQ ID NO: 359559 - protein, 22 aa, Mycobacterium
IYGLMTWLTLWRVVNERQDRDG

SEQ ID NO: 359560 - protein, 22 aa, Mycobacterium
IYGTFVLGSYYLVPSILAVRGT

SEQ ID NO: 359561 - protein, 17 aa, Mycobacterium
IYHGMRLLGFRPGRERP

SEQ ID NO: 359562 - protein, 20 aa, Mycobacterium
IYIDGGKFLVLQSPDPRYAE

SEQ ID NO: 359563 - protein, 19 aa, Mycobacterium
IYLAYLMVTTPLLLRRLGI

SEQ ID NO: 359564 - protein, 19 aa, Mycobacterium
IYMLPMTIGFLVSGPLAGS

SEQ ID NO: 359565 - protein, 20 aa, Mycobacterium
IYRNAIALALLAALTFAAFG

SEQ ID NO: 359566 - protein, 17 aa, Mycobacterium
IYRTRSCPLSMPGSGLK

SEQ ID NO: 359567 - protein, 25 aa, Mycobacterium
IYTDIFRGLPEVVIILLIGLGVGPI

SEQ ID NO: 359568 - protein, 26 aa, Mycobacterium
IYVAAHVPYLMWLIQASANSAAMAGQ

SEQ ID NO: 359569 - protein, 22 aa, Mycobacterium
IYVDALWVFLVLSLSVNQGLTF

SEQ ID NO: 359570 - protein, 26 aa, Mycobacterium
KAAARWIRPLMPPFVARVIDNTTQPL

SEQ ID NO: 359571 - protein, 25 aa, Mycobacterium
KAAAVVIICGFAALSGIMVWQHHQT

SEQ ID NO: 359572 - protein, 25 aa, Mycobacterium
KAAIAAVLVVLGIAIGWGLYGNSSS

SEQ ID NO: 359573 - protein, 17 aa, Mycobacterium
KAAIRVTTILGSRYLDL

SEQ ID NO: 359574 - protein, 25 aa, Mycobacterium
KAAVLALTLVLFLVGGAAGLLIGTW

SEQ ID NO: 359575 - protein, 24 aa, Mycobacterium
KADAYWTIRGWSARGPIKTGCRID

SEQ ID NO: 359576 - protein, 27 aa, Mycobacterium
KADGDPYQFLLLPLARVSGIEDQALQE

SEQ ID NO: 359577 - protein, 24 aa, Mycobacterium
KAEAYWTRQGWAPRAPIKTESRID

SEQ ID NO: 359578 - protein, 27 aa, Mycobacterium
KAEKWNIPVILIVLIAAFGSLAAASLP

SEQ ID NO: 359579 - protein, 28 aa, Mycobacterium
KAEVERIWLPFTVWLTAAPALLPVRSHR

SEQ ID NO: 359580 - protein, 18 aa, Mycobacterium
KAGGALRALAALGAKDVT

SEQ ID NO: 359581 - protein, 22 aa, Mycobacterium
KAGLTLFLYLEVLDAAFSFDGV

SEQ ID NO: 359582 - protein, 25 aa, Mycobacterium
KAGLVPLHAWLPRAHPEAPSPVSAL

SEQ ID NO: 359583 - protein, 21 aa, Mycobacterium
KAGQPFWTALLLAVVCTWFLQ

SEQ ID NO: 359584 - protein, 19 aa, Mycobacterium
KAGSALRALAALGAKDVTV

SEQ ID NO: 359585 - protein, 21 aa, Mycobacterium
KAGYRPLIVVGDPLLMSNDVL

SEQ ID NO: 359586 - protein, 19 aa, Mycobacterium
KAIGGLRRLLGARPDSDAP

SEQ ID NO: 359587 - protein, 25 aa, Mycobacterium
KAILPVFVLFAAWRLILADYSSYVG

SEQ ID NO: 359588 - protein, 18 aa, Mycobacterium
KAIPTWYARLRKPPYQPP

SEQ ID NO: 359589 - protein, 23 aa, Mycobacterium
KAKRMPILSRELFQEVFLNPGLV

SEQ ID NO: 359590 - protein, 19 aa, Mycobacterium
KALEPSFVPPPASAARAPS

SEQ ID NO: 359591 - protein, 29 aa, Mycobacterium
KALQLVLESFAFLLIGLQLPAVVGELAGI

SEQ ID NO: 359592 - protein, 27 aa, Mycobacterium
KALSRAVGFTWRRSLQVRVVVSNLALS

SEQ ID NO: 359593 - protein, 18 aa, Mycobacterium
KAMRRTIYIGGAAATFVC

SEQ ID NO: 359594 - protein, 25 aa, Mycobacterium
KAMSWHAVIGVWVLAVLLALSVTGI

SEQ ID NO: 359595 - protein, 24 aa, Mycobacterium
KANRRDIPLVLRVYDRELGGAVAQ

SEQ ID NO: 359596 - protein, 26 aa, Mycobacterium
KAPAIVLISFIPMYLIAVAYQELNKA

SEQ ID NO: 359597 - protein, 22 aa, Mycobacterium
KAPAIVLLSFIPMYMIAVAYQE

SEQ ID NO: 359598 - protein, 23 aa, Mycobacterium
KAPAKKAPAKAAPPPAKAAEPKP

SEQ ID NO: 359599 - protein, 21 aa, Mycobacterium
KAPAPVPVPVAQAPVPVPQAP

SEQ ID NO: 359600 - protein, 23 aa, Mycobacterium
KAPLWPLHRWLPDSAVEATPASA

SEQ ID NO: 359601 - protein, 26 aa, Mycobacterium
KAPPRWSSWLRVVLGAGLIAFGVYRW

SEQ ID NO: 359602 - protein, 24 aa, Mycobacterium
KAPPSPSQLRPGAFPPALDQVIAK

SEQ ID NO: 359603 - protein, 23 aa, Mycobacterium
KAPPVAWRILVVLGLIGTVLMIV

SEQ ID NO: 359604 - protein, 17 aa, Mycobacterium
KAPRWAWVALVVVGIVG

SEQ ID NO: 359605 - protein, 20 aa, Mycobacterium
KAPVLLQVPGGAWMIGMRRP

SEQ ID NO: 359606 - protein, 23 aa, Mycobacterium
KAQQPVNLLLLAGAVAAAVVIGL

SEQ ID NO: 359607 - protein, 19 aa, Mycobacterium
KAREFLPSRHYLYAVIAIA

SEQ ID NO: 359608 - protein, 22 aa, Mycobacterium
KARVIGFVQKPVVLASLAGVGA

SEQ ID NO: 359609 - protein, 23 aa, Mycobacterium
KARVLYNIAFPGAYLCLSATSLA

SEQ ID NO: 359610 - protein, 20 aa, Mycobacterium
KAVAFAFLALGAAAGLALAI

SEQ ID NO: 359611 - protein, 17 aa, Mycobacterium
KAVAWALLYIVHRRNRT

SEQ ID NO: 359612 - protein, 21 aa, Mycobacterium
KAVEFGRYRLFEKLGQGNMGA

SEQ ID NO: 359613 - protein, 28 aa, Mycobacterium
KAVLFACLTVIIALLAALAGLVEGERRY

SEQ ID NO: 359614 - protein, 17 aa, Mycobacterium
KAVLLNMLSLTAGFGAL

SEQ ID NO: 359615 - protein, 17 aa, Mycobacterium
KAVLYTMLFEVVGLGCC

SEQ ID NO: 359616 - protein, 25 aa, Mycobacterium
KAWMSIYQANWWWLVAAMGAAAASM

SEQ ID NO: 359617 - protein, 26 aa, Mycobacterium
KAWMSLYEANWWWLLASVVAAAASMH

SEQ ID NO: 359618 - protein, 26 aa, Mycobacterium
KDAEVWDRLTGNFWLPEKVPVSNDIQ

SEQ ID NO: 359619 - protein, 23 aa, Mycobacterium
KDAPRNWRLSVDLRRDGDQIKMA

SEQ ID NO: 359620 - protein, 26 aa, Mycobacterium
KDAQVWDRLTGNFWLPEKVPLSNDSA

SEQ ID NO: 359621 - protein, 23 aa, Mycobacterium
KDGKFFPWPITLDNYRGIFSGNV

SEQ ID NO: 359622 - protein, 20 aa, Mycobacterium
KDHLKHLVAVPIHAPDDAEL

SEQ ID NO: 359623 - protein, 24 aa, Mycobacterium
KDHQAWMLPIGLPGDLGSPQSKHA

SEQ ID NO: 359624 - protein, 37 aa, Mycobacterium
KDKWRHGPSTYLGLMTEGFPNLFLIAGPHSPSVLSNM

SEQ ID NO: 359625 - protein, 38 aa, Mycobacterium
KDLGFYAFELPFYRLLLSYLFVAIFLAFVANVVSHYLF

SEQ ID NO: 359626 - protein, 43 aa, Mycobacterium
KDLGFYAFELPFYRLVLSYLFVAVFLAFVANLLAHYIFGGIRL

SEQ ID NO: 359627 - protein, 19 aa, Mycobacterium
KDLTWLDLVVFGVAVVIGA

SEQ ID NO: 359628 - protein, 19 aa, Mycobacterium
KDLTWWDLTVFGVSVVIGA

SEQ ID NO: 359629 - protein, 30 aa, Mycobacterium
KDQIEAAFLLLWFLAALPVGALLGGWLATR

SEQ ID NO: 359630 - protein, 30 aa, Mycobacterium
KDQRNAFLAPWRLALVPVVSWTIGSALFAV

SEQ ID NO: 359631 - protein, 28 aa, Mycobacterium
KDQVMEAYLNIIYFGRGAYGISAASKAY

SEQ ID NO: 359632 - protein, 33 aa, Mycobacterium
KDRQSVRWSVAWRMLLAWCFTLPASGIVGGIAA

SEQ ID NO: 359633 - protein, 25 aa, Mycobacterium
KEACASRDVARLRTWLLECRTAANR

SEQ ID NO: 359634 - protein, 27 aa, Mycobacterium
KEALPKIAWPSVFLIVGIVTYVGLLQE

SEQ ID NO: 359635 - protein, 21 aa, Mycobacterium
KEAQLWPLVFGRAAAVVVVLI

SEQ ID NO: 359636 - protein, 25 aa, Mycobacterium
KEDKRLLPYMIGAFVLIVGISVAVG

SEQ ID NO: 359637 - protein, 24 aa, Mycobacterium
KEDKRLLPYMIGAFVLIVGLSVVG

SEQ ID NO: 359638 - protein, 25 aa, Mycobacterium
KEDKRLLPYMIGAFVLIVGVSVGVG

SEQ ID NO: 359639 - protein, 34 aa, Mycobacterium
KEEKRSWGWVIALALVVAALAAVIVLAAVIISRT

SEQ ID NO: 359640 - protein, 23 aa, Mycobacterium
KELHWMVMQMAIIVLLAVGSDYN

SEQ ID NO: 359641 - protein, 20 aa, Mycobacterium
KELQPIMDRSIRALPHADHP

SEQ ID NO: 359642 - protein, 25 aa, Mycobacterium
KENGLPFWIIASCALAIGLGTYLGG

SEQ ID NO: 359643 - protein, 24 aa, Mycobacterium
KERDSWLLSLLYVGTFGSFIGFSF

SEQ ID NO: 359644 - protein, 26 aa, Mycobacterium
KESLLIVIPCWLLPLLASVPVFSRDA

SEQ ID NO: 359645 - protein, 18 aa, Mycobacterium
KESLLPPGFSDPTQWGLV

SEQ ID NO: 359646 - protein, 20 aa, Mycobacterium
KETPPPLPADLPPNVRELIE

SEQ ID NO: 359647 - protein, 17 aa, Mycobacterium
KEWGARLRAFVVKAAGS

SEQ ID NO: 359648 - protein, 24 aa, Mycobacterium
KFAAWMVFVPIWAVAVYCVIAHWV

SEQ ID NO: 359649 - protein, 24 aa, Mycobacterium
KFAAWMVFVPVWSIAVYSVVAHWV

SEQ ID NO: 359650 - protein, 25 aa, Mycobacterium
KFAAWMVFVPVWTIAVYSIVAHWVW

SEQ ID NO: 359651 - protein, 17 aa, Mycobacterium
KFAQLVGLVFAVCGVAG

SEQ ID NO: 359652 - protein, 22 aa, Mycobacterium
KFARTRLLDPKGVRFRPFLAAL

SEQ ID NO: 359653 - protein, 36 aa, Mycobacterium
KFATFAVVMAVLTAFLFFIFGQYRTGATTGYSAVFN

SEQ ID NO: 359654 - protein, 35 aa, Mycobacterium
KFDPWGVVAWIVGLGFFFPVFWMVLTAFKQEVDAY

SEQ ID NO: 359655 - protein, 25 aa, Mycobacterium
KFDVARWRDALHDVWLAAASRRRKG

SEQ ID NO: 359656 - protein, 35 aa, Mycobacterium
KFEVIAKFILGIPLLVLAWLFGPKVMRLPFSRRLA

SEQ ID NO: 359657 - protein, 40 aa, Mycobacterium
KFEVIAKFILGIPLLVLAWMFRQRVLRLPFSRPLATYAIS

SEQ ID NO: 359658 - protein, 37 aa, Mycobacterium
KFGRLIQIGGTAFVVFFAVALVFYIVTSHQKKGGGAA

SEQ ID NO: 359659 - protein, 17 aa, Mycobacterium
KFHALDERRYALVSLTQ

SEQ ID NO: 359660 - protein, 18 aa, Mycobacterium
KFLVLQSPDPRYAESMYY

SEQ ID NO: 359661 - protein, 27 aa, Mycobacterium
KFNHFLPQALGIKPIIAFLVEHPDLLK

SEQ ID NO: 359662 - protein, 21 aa, Mycobacterium
KFNPRTLWRNPVMFIVEIGAT

SEQ ID NO: 359663 - protein, 24 aa, Mycobacterium
KFRTPPLPVVWWTIVASLAMAYVI

SEQ ID NO: 359664 - protein, 35 aa, Mycobacterium
KFSAWLVFAGLWATLVYFPIAHWVFAFDGSVAEHG

SEQ ID NO: 359665 - protein, 18 aa, Mycobacterium
KFSTFYISGPYVPPAGVD

SEQ ID NO: 359666 - protein, 24 aa, Mycobacterium
KFTDAFAPYGFPPSAIKPSYGMAE

SEQ ID NO: 359667 - protein, 35 aa, Mycobacterium
KFTEGAWLVVVVFPLLVFMLMRLNREYRAEAAILE

SEQ ID NO: 359668 - protein, 35 aa, Mycobacterium; identical to SEQ ID NO: 20861

SEQ ID NO: 359669 - protein, 17 aa, Mycobacterium
KFVILLGVASFLTFALT

SEQ ID NO: 359670 - protein, 19 aa, Mycobacterium
KFVLFMLPTNGGEALVVIA

SEQ ID NO: 359671 - protein, 18 aa, Mycobacterium
KFVRLFVGLSFAALAIYA

SEQ ID NO: 359672 - protein, 19 aa, Mycobacterium
KFVVAAALILLILVVAAFP

SEQ ID NO: 359673 - protein, 20 aa, Mycobacterium
KFWDHPLTAVLSIVVLYVLV

SEQ ID NO: 359674 - protein, 23 aa, Mycobacterium
KGARKLWLLLAAPSGMMFNYFGV

SEQ ID NO: 359675 - protein, 17 aa, Mycobacterium
KGCPLFLVVLGSVLALM

SEQ ID NO: 359676 - protein, 26 aa, Mycobacterium
KGDPTLLTMVWQNLIGNAVKFRREDT

SEQ ID NO: 359677 - protein, 23 aa, Mycobacterium
KGEPSLPVVPWVISARSAEALTA

SEQ ID NO: 359678 - protein, 31 aa, Mycobacterium
KGFEMFRTIRKIWMPLLIAAVVAIGGFAVFR

SEQ ID NO: 359679 - protein, 19 aa, Mycobacterium
KGFWIRRARRLLPALLVMT

SEQ ID NO: 359680 - protein, 22 aa, Mycobacterium
KGGVLLGLLIPHGLLELTAVFL

SEQ ID NO: 359681 - protein, 29 aa, Mycobacterium
KGHLKWAWIPGVPLLWDLAVTLTASWQKV

SEQ ID NO: 359682 - protein, 23 aa, Mycobacterium
KGIGLTVLYLGIAMLFAMLVSGS

SEQ ID NO: 359683 - protein, 23 aa, Mycobacterium
KGISPLGCWPGSSALPTVSVPPG

SEQ ID NO: 359684 - protein, 17 aa, Mycobacterium
KGKVWTGLLGMFIVVLL

SEQ ID NO: 359685 - protein, 19 aa, Mycobacterium
KGKVWTGLLGMFIVVLLVI

SEQ ID NO: 359686 - protein, 27 aa, Mycobacterium
KGLEKVPILGWLWSWELALPMSGIAMA

SEQ ID NO: 359687 - protein, 19 aa, Mycobacterium
KGLRRIIAAELRLPETDLD

SEQ ID NO: 359688 - protein, 18 aa, Mycobacterium
KGLRRLEYGLWHGQSAST

SEQ ID NO: 359689 - protein, 21 aa, Mycobacterium
KGMLPGVFPVPLTIAGDIESW

SEQ ID NO: 359690 - protein, 21 aa, Mycobacterium
KGMVYALITLGLLIAVNQLEA

SEQ ID NO: 359691 - protein, 24 aa, Mycobacterium
KGPDWGWSSLPAIGSLVAAALAMI

SEQ ID NO: 359692 - protein, 27 aa, Mycobacterium
KGPGSKAPWLIIAGVAVLGVLALVVVL

SEQ ID NO: 359693 - protein, 25 aa, Mycobacterium
KGPLVFDLGICLVLITLPTLALFVA

SEQ ID NO: 359694 - protein, 26 aa, Mycobacterium
KGRDYKSLVLIAVIVVAVALAAVLGI

SEQ ID NO: 359695 - protein, 18 aa, Mycobacterium
KGRLLFMPGVMVTSVPWQ

SEQ ID NO: 359696 - protein, 32 aa, Mycobacterium
KGRRTVWIPWALRPMFFVLRLLPQFVWRKMPR

SEQ ID NO: 359697 - protein, 24 aa, Mycobacterium
KGVALQVMSARELPLLRADEQRLS

SEQ ID NO: 359698 - protein, 30 aa, Mycobacterium
KGVALRVRLQTTLPPLWADEQRLSQVLGNL

SEQ ID NO: 359699 - protein, 20 aa, Mycobacterium
KGVMRTWYLIGRKPIDEPTA

SEQ ID NO: 359700 - protein, 24 aa, Mycobacterium
KGVMRTWYLLGRKPAEQPADTLAE

SEQ ID NO: 359701 - protein, 19 aa, Mycobacterium
KGWAFLAALVGGPAGLVLL

SEQ ID NO: 359702 - protein, 23 aa, Mycobacterium
KGWQRLLGTLLGVPAGVLVATLL

SEQ ID NO: 359703 - protein, 22 aa, Mycobacterium
KGYFLIGIWANFFWGTVFLVSV

SEQ ID NO: 359704 - protein, 20 aa, Mycobacterium
KHANWSWALLGLAVSALTYV

SEQ ID NO: 359705 - protein, 24 aa, Mycobacterium
KHCFDIPICWAFRSLWDTIDHIDH

SEQ ID NO: 359706 - protein, 25 aa, Mycobacterium
KHCFDIPMCWALRSVFDALDGISLM

SEQ ID NO: 359707 - protein, 19 aa, Mycobacterium
KHCFDIPMCWSMRSLFDAL

SEQ ID NO: 359708 - protein, 19 aa, Mycobacterium
KHCFDVPICWSFRSLFDSL

SEQ ID NO: 359709 - protein, 19 aa, Mycobacterium
KHCNGVPMCWSLRSIFDAL

SEQ ID NO: 359710 - protein, 24 aa, Mycobacterium
KHCYDIPICFSLRSVFDTLDGIDA

SEQ ID NO: 359711 - protein, 24 aa, Mycobacterium
KHCYDIPICWSFRSIFDALDGLDQ

SEQ ID NO: 359712 - protein, 24 aa, Mycobacterium
KHCYDIPICWSFRSVFDALDGVDE

SEQ ID NO: 359713 - protein, 25 aa, Mycobacterium
KHCYDIPICWSLRSLFDALDGFDLL

SEQ ID NO: 359714 - protein, 23 aa, Mycobacterium
KHCYDVPICWSLRSIFDALDGVD

SEQ ID NO: 359715 - protein, 26 aa, Mycobacterium
KHDWPFADRAFAAALPWLAGRLGTPG

SEQ ID NO: 359716 - protein, 18 aa, Mycobacterium
KHEGLSYRFPFDTEKKTY

SEQ ID NO: 359717 - protein, 18 aa, Mycobacterium
KHFNGYATSFWVTPADIN

SEQ ID NO: 359718 - protein, 36 aa, Mycobacterium
KHGRFAHATRILAIPILIGWLLITAALNVIAPQLDV

SEQ ID NO: 359719 - protein, 25 aa, Mycobacterium
KHGRPFRRRNFLPGAVMFACLAVAA

SEQ ID NO: 359720 - protein, 26 aa, Mycobacterium
KHHVLQSAWVQLLPSRKEGWGLAVVE

SEQ ID NO: 359721 - protein, 28 aa, Mycobacterium
KHIFVFDMAMLIFLSAAYTGFVRWYIRL

SEQ ID NO: 359722 - protein, 18 aa, Mycobacterium
KHPWPDHRPPRAPVWVAM

SEQ ID NO: 359723 - protein, 23 aa, Mycobacterium
KHQFQGLVIFGIGLALTSGSLVA

SEQ ID NO: 359724 - protein, 25 aa, Mycobacterium
KHRGELVYLPPAWFASDPPPRLPVV

SEQ ID NO: 359725 - protein, 29 aa, Mycobacterium
KHRGELVYLPPAWFASYPPPRLPAVMMIG

SEQ ID NO: 359726 - protein, 17 aa, Mycobacterium
KHRIVALKLISTQYSEN

SEQ ID NO: 359727 - protein, 18 aa, Mycobacterium
KHRNWLLAARIIGYASMF

SEQ ID NO: 359728 - protein, 34 aa, Mycobacterium
KHSGNILTFVYWLGLLLLMFLSGAEMQQLFTRGE

SEQ ID NO: 359729 - protein, 22 aa, Mycobacterium
KHSWLDALSSAGALLGLCGVAA

SEQ ID NO: 359730 - protein, 23 aa, Mycobacterium
KHSWLDALSSAGALLGLCGVAKG

SEQ ID NO: 359731 - protein, 23 aa, Mycobacterium
KHTSIPFMIAMQGSFMQLNQHYQ

SEQ ID NO: 359732 - protein, 19 aa, Mycobacterium
KHWIGLLAMIFVVGAAQAY

SEQ ID NO: 359733 - protein, 26 aa, Mycobacterium
KHYPGRLIFVLFNLLIALVLMEANMF

SEQ ID NO: 359734 - protein, 24 aa, Mycobacterium
KHYQSSATILISFPGATDLTELYN

SEQ ID NO: 359735 - protein, 27 aa, Mycobacterium
KIAIAPLFIVWLGFGPSPKILVAVLMA

SEQ ID NO: 359736 - protein, 20 aa, Mycobacterium
KIDGRLYPALNLTSARLATG

SEQ ID NO: 359737 - protein, 63 aa, Mycobacterium
KIDIIDLIMWLIMNILYYSIILGVYLYVIVYLSMIILLVFWHTFLMVYLYEIALAVGVLAAPA

SEQ ID NO: 359738 - protein, 27 aa, Mycobacterium
KIDLNDPPPCNVGFIPPPLIRSPADEG

SEQ ID NO: 359739 - protein, 20 aa, Mycobacterium
KIDVHRAWRDVLAANRGTLA

SEQ ID NO: 359740 - protein, 25 aa, Mycobacterium
KIEAFAMFNIFYQAGILLGPLVGLA

SEQ ID NO: 359741 - protein, 49 aa, Mycobacterium
KIGPVEFSGLFAWFAWLVLHLVYLVGFKTKISTLLSWTVTFLSTRRGQL

SEQ ID NO: 359742 - protein, 48 aa, Mycobacterium
KIGPWAPWLGVLVYAIGVLLFLAPPLSFLPWLVVICYTAFAAQYLGGT

SEQ ID NO: 359743 - protein, 27 aa, Mycobacterium
KIKTQVLTLRRIAVAIIVMLGAAAALM

SEQ ID NO: 359744 - protein, 33 aa, Mycobacterium
KILAFSLLCGIVGPIFIVMYYVIDEPATSWMLY

SEQ ID NO: 359745 - protein, 18 aa, Mycobacterium
KILAGLIAAAAPGAALAV

SEQ ID NO: 359746 - protein, 21 aa, Mycobacterium
KILFTLGIVVLYRLGAALPSP

SEQ ID NO: 359747 - protein, 22 aa, Mycobacterium
KILFTLGIVVLYRLGAALPSPG

SEQ ID NO: 359748 - protein, 17 aa, Mycobacterium
KILGYFAIFGFSAELIG

SEQ ID NO: 359749 - protein, 22 aa, Mycobacterium
KILGYFAIFGFSAELIGALVVG

SEQ ID NO: 359750 - protein, 23 aa, Mycobacterium
KILLPILLGVVLGGPAAAGTGML

SEQ ID NO: 359751 - protein, 18 aa, Mycobacterium
KILNCMTALTAIAALLIA

SEQ ID NO: 359752 - protein, 20 aa, Mycobacterium
KIPKGVLLYGPPGTGKTLLA

SEQ ID NO: 359753 - protein, 17 aa, Mycobacterium
KIPTRFATLPPSEIPLL

SEQ ID NO: 359754 - protein, 34 aa, Mycobacterium
KIPVSPVPLRNMAIGFIAGLLLAIAVALTREAGD

SEQ ID NO: 359755 - protein, 21 aa, Mycobacterium
KIQAFVLLCGIVGPIFLVIYF

SEQ ID NO: 359756 - protein, 39 aa, Mycobacterium
KIQLAIFTVISLSAASLMFFDYMQIPTVFFGVDRYTVTV

SEQ ID NO: 359757 - protein, 17 aa, Mycobacterium
KIRSDDTFAYLARSVDP

SEQ ID NO: 359758 - protein, 26 aa, Mycobacterium
KIRSRIWMIFIVGFVLVRAVACVASG

SEQ ID NO: 359759 - protein, 25 aa, Mycobacterium
KISAIFVPIVIALSVATLGSWIVVG

SEQ ID NO: 359760 - protein, 22 aa, Mycobacterium
KISAWVGIAAFPTMLAGIYGMN

SEQ ID NO: 359761 - protein, 29 aa, Mycobacterium
KISRFQTLLLKWAIMVLLGLFTSGAYVAI

SEQ ID NO: 359762 - protein, 17 aa, Mycobacterium
KITRVRWEFSDGSSVKQ

SEQ ID NO: 359763 - protein, 17 aa, Mycobacterium
KITVQLPDVATLPQNSP

SEQ ID NO: 359764 - protein, 19 aa, Mycobacterium
KITWLARLGDWSGRRFKRP

SEQ ID NO: 359765 - protein, 18 aa, Mycobacterium
KIVAIPRNPAIDTPLRDI

SEQ ID NO: 359766 - protein, 23 aa, Mycobacterium
KIVGAQAPRPAAFHEWHAMSAEQ

SEQ ID NO: 359767 - protein, 21 aa, Mycobacterium
KIVILLVINLLLLALGAVMDM

SEQ ID NO: 359768 - protein, 18 aa, Mycobacterium
KIVLYVLGAWLFALSTSG

SEQ ID NO: 359769 - protein, 17 aa, Mycobacterium
KKALVFTLLLTGFGTFL

SEQ ID NO: 359770 - protein, 24 aa, Mycobacterium
KKDWVPAILTWNRIGAAYGSFKDY

SEQ ID NO: 359771 - protein, 22 aa, Mycobacterium
KKGIINMISLDFRKAKEDVQRV

SEQ ID NO: 359772 - protein, 19 aa, Mycobacterium
KKISFLPAMRYYAGNWASS

SEQ ID NO: 359773 - protein, 33 aa, Mycobacterium
KKKRRFLRDPLSILLVCIIVVCLVIAGLVGAEL

SEQ ID NO: 359774 - protein, 18 aa, Mycobacterium
KKLLQFAILLVGVVTFLM

SEQ ID NO: 359775 - protein, 21 aa, Mycobacterium
KKLLQFSLLLVGAATFLMGCL

SEQ ID NO: 359776 - protein, 21 aa, Mycobacterium
KKMLTFFCAKYREAFKDIAGS

SEQ ID NO: 359777 - protein, 25 aa, Mycobacterium
KKNKTGLWVLLALLAVIVVVAGGVV

SEQ ID NO: 359778 - protein, 25 aa, Mycobacterium
KKPPASSLISLAPKERNVAVEAPAV

SEQ ID NO: 359779 - protein, 23 aa, Mycobacterium
KKRYLWLMGLIAPTALFVVLPLV

SEQ ID NO: 359780 - protein, 24 aa, Mycobacterium
KKSKPWLLIASVAGAVVVVLALVL

SEQ ID NO: 359781 - protein, 19 aa, Mycobacterium
KKSLRYLLSSNMGEIFTVF

SEQ ID NO: 359782 - protein, 28 aa, Mycobacterium
KKVKNLRYWILGWLLLAGILNYMDRSSV

SEQ ID NO: 359783 - protein, 19 aa, Mycobacterium
KLAHMKLAWRTGDLAVYAI

SEQ ID NO: 359784 - protein, 26 aa, Mycobacterium
KLAITAGIGLFILFIGVVDAGFIGST

SEQ ID NO: 359785 - protein, 18 aa, Mycobacterium
KLDLNDPPPCAVGFLPPP

SEQ ID NO: 359786 - protein, 20 aa, Mycobacterium
KLDPRTLWRNPVMFIVEIGA

SEQ ID NO: 359787 - protein, 21 aa, Mycobacterium
KLDPRTLWRNPVMFIVEIGAG

SEQ ID NO: 359788 - protein, 25 aa, Mycobacterium
KLDVEPIYLLKREVLELRRCVNPLS

SEQ ID NO: 359789 - protein, 20 aa, Mycobacterium
KLEPNLTYRIALRTTSSHES

SEQ ID NO: 359790 - protein, 24 aa, Mycobacterium
KLESRIIIDSMHLGRHLGISDLMV

SEQ ID NO: 359791 - protein, 20 aa, Mycobacterium
KLFIGTLVVWFFVLFDMLDG

SEQ ID NO: 359792 - protein, 17 aa, Mycobacterium
KLFLINFAIGVATGIVQ

SEQ ID NO: 359793 - protein, 19 aa, Mycobacterium
KLGAAIARWPGPILITASV

SEQ ID NO: 359794 - protein, 26 aa, Mycobacterium
KLGAFALVLLMFTAIIIVVFGQMRFD

SEQ ID NO: 359795 - protein, 37 aa, Mycobacterium
KLGEIFWINPVNLVPLLFLVVLWCGRFPRHWRCWPRH

SEQ ID NO: 359796 - protein, 17 aa, Mycobacterium
KLGFIVSSLLHLAAMAL

SEQ ID NO: 359797 - protein, 23 aa, Mycobacterium
KLGTDYNPWRPAVKFAYPEDHGD

SEQ ID NO: 359798 - protein, 17 aa, Mycobacterium
KLHFWLTFIGFHTTFLV

SEQ ID NO: 359799 - protein, 17 aa, Mycobacterium
KLHFWLTLIGFHTTFLV

SEQ ID NO: 359800 - protein, 21 aa, Mycobacterium
KLHRAVAIKLLYPGVADRPDS

SEQ ID NO: 359801 - protein, 35 aa, Mycobacterium
KLIMIGCLTVIFTVVLLLLRGLVASLIVIGSVLVS

SEQ ID NO: 359802 - protein, 18 aa, Mycobacterium
KLIVEHDLLLPDRLADAA

SEQ ID NO: 359803 - protein, 21 aa, Mycobacterium
KLLEPIFILIVLASVAPMFLE

SEQ ID NO: 359804 - protein, 21 aa, Mycobacterium
KLLEPIFILIVVASVAPMFIE

SEQ ID NO: 359805 - protein, 27 aa, Mycobacterium
KLLGDDCWWAPAWMKRIQVKLGLGEVT

SEQ ID NO: 359806 - protein, 25 aa, Mycobacterium
KLLISSLLLNWVAGPALMFALAWLL

SEQ ID NO: 359807 - protein, 17 aa, Mycobacterium
KLLNLRLQSRNPNATLP

SEQ ID NO: 359808 - protein, 21 aa, Mycobacterium
KLLSRNLYRYGVGGLIAPFIG

SEQ ID NO: 359809 - protein, 21 aa, Mycobacterium
KLLSRNLYVYGLGGIVAPFAG

SEQ ID NO: 359810 - protein, 24 aa, Mycobacterium
KLNLAWAFGYNIAAIPIAAAGVLN

SEQ ID NO: 359811 - protein, 30 aa, Mycobacterium
KLNRLGASGSWIPYYLCELSMRVSDLQYRT

SEQ ID NO: 359812 - protein, 31 aa, Mycobacterium
KLQFGEGWWTSVYFLAFWITGTSLLMVSAIP

SEQ ID NO: 359813 - protein, 19 aa, Mycobacterium
KLQSNESFVYLARAVDPVI

SEQ ID NO: 359814 - protein, 23 aa, Mycobacterium
KLQTRGWRRIGTAVVRWPAPILA

SEQ ID NO: 359815 - protein, 25 aa, Mycobacterium
KLQTRGWRRMGTAVVRWPAPVLAVT

SEQ ID NO: 359816 - protein, 22 aa, Mycobacterium
KLSLDHLLFSGSQFYDYLHGWW

SEQ ID NO: 359817 - protein, 22 aa, Mycobacterium
KLSPSLMMLGWAVIAAAGVVNV

SEQ ID NO: 359818 - protein, 28 aa, Mycobacterium
KLTKRQRFWISLYLPLTMRSLANAILVP

SEQ ID NO: 359819 - protein, 18 aa, Mycobacterium
KLTLLAAGLIFLLALVLG

SEQ ID NO: 359820 - protein, 26 aa, Mycobacterium
KLTPAVFLLYFLLRRDTRALLVTAAS

SEQ ID NO: 359821 - protein, 18 aa, Mycobacterium
KLTPLVSGLYFLGARRWT

SEQ ID NO: 359822 - protein, 21 aa, Mycobacterium
KLTPLYFVLYFLTLRQRRVAV

SEQ ID NO: 359823 - protein, 23 aa, Mycobacterium
KLTQAWLVLELTDSPLLLGVTVA

SEQ ID NO: 359824 - protein, 32 aa, Mycobacterium
KLTRLGSYGAWFPYYLCGLALRVSDLQYRTVE

SEQ ID NO: 359825 - protein, 29 aa, Mycobacterium
KLVGSLVFYLVIVFALLPFERRWVTARIA

SEQ ID NO: 359826 - protein, 24 aa, Mycobacterium
KLVHGAWLPLLIGLAVFTVMTTWQ

SEQ ID NO: 359827 - protein, 20 aa, Mycobacterium
KLVIMDLRDHWMAKAPYILG

SEQ ID NO: 359828 - protein, 20 aa, Mycobacterium
KLVIMDLRDHWMAKAPYLLG

SEQ ID NO: 359829 - protein, 20 aa, Mycobacterium
KLVLGVIVLGSFIASIDLTI

SEQ ID NO: 359830 - protein, 27 aa, Mycobacterium
KLWSVIPKLFVWPPARSIAQLLERVSL

SEQ ID NO: 359831 - protein, 26 aa, Mycobacterium
KLYTDRHIRLWVVYVDDFSGQSPTGW

SEQ ID NO: 359832 - protein, 19 aa, Mycobacterium
KMLLGTVVLVVVGVGLALI

SEQ ID NO: 359833 - protein, 24 aa, Mycobacterium
KMMRFFPPVVIGTTILLIGIQLIP

SEQ ID NO: 359834 - protein, 17 aa, Mycobacterium
KMPGIERVDIMSLEPFN

SEQ ID NO: 359835 - protein, 31 aa, Mycobacterium
KMQFGEGWWTSVWFLAFWITGTSMLMVSGIP

SEQ ID NO: 359836 - protein, 37 aa, Mycobacterium
KMRTRGWRRIGTAIVRWPGPILTVACAVALIGLLALP

SEQ ID NO: 359837 - protein, 21 aa, Mycobacterium
KMRTRGWRRVGTAIVRWPGPI

SEQ ID NO: 359838 - protein, 28 aa, Mycobacterium
KMSLNTSYYRLMLKLKGGPEAVADAAHQ

SEQ ID NO: 359839 - protein, 22 aa, Mycobacterium
KNDDFFFLPPDSFKTKDFQSGL

SEQ ID NO: 359840 - protein, 18 aa, Mycobacterium
KNDWFRDWGALQRLIPFY

SEQ ID NO: 359841 - protein, 19 aa, Mycobacterium
KNFPLRYLVTNTGWGRGLD

SEQ ID NO: 359842 - protein, 23 aa, Mycobacterium
KNNPFSLLFTLGGFVALLLAQAV

SEQ ID NO: 359843 - protein, 26 aa, Mycobacterium
KNNPFSLLFTLGGFVALLLLAQAVAS

SEQ ID NO: 359844 - protein, 26 aa, Mycobacterium
KNSRRWWAWMLLAGPGWVIFGAAKQI

SEQ ID NO: 359845 - protein, 25 aa, Mycobacterium
KNSTNMMFLVLLLAGFGWMISSRMV

SEQ ID NO: 359846 - protein, 22 aa, Mycobacterium
KNVFAWIGPVLAALQGNPRCDA

SEQ ID NO: 359847 - protein, 19 aa, Mycobacterium
KNVFTMMMGLPRLYRIPVH

SEQ ID NO: 359848 - protein, 24 aa, Mycobacterium
KNVFTMMMQLPRLYRVPVHTVHKF

SEQ ID NO: 359849 - protein, 30 aa, Mycobacterium
KNVPSLKYLSYRLFLKRAGSHWLVTRMTTI

SEQ ID NO: 359850 - protein, 17 aa, Mycobacterium
KNVPSLKYLSYRLFMKR

SEQ ID NO: 359851 - protein, 21 aa, Mycobacterium
KPAAKVVLAITPRYVKTIPAN

SEQ ID NO: 359852 - protein, 38 aa, Mycobacterium
KPAATVALVMTIFVTGFVALALALLFGRDPGTDKPPEV

SEQ ID NO: 359853 - protein, 25 aa, Mycobacterium
KPAESLLRLPPPGENWRLVTGGGGT

SEQ ID NO: 359854 - protein, 17 aa, Mycobacterium
KPAILVALLFRTLDAFR

SEQ ID NO: 359855 - protein, 20 aa, Mycobacterium
KPANAPLSSPFVPPSAAPET

SEQ ID NO: 359856 - protein, 20 aa, Mycobacterium
KPANILIARPDSNTRRIMLA

SEQ ID NO: 359857 - protein, 22 aa, Mycobacterium
KPANILLSAGDRRIMLGDFGLT

SEQ ID NO: 359858 - protein, 25 aa, Mycobacterium
KPAPPPDPIPAERLNALLLGASDIN

SEQ ID NO: 359859 - protein, 45 aa, Mycobacterium
KPAPSKVRLAIVVGLAAVVAMAALASWFGFHAYQSHQADQQRKLY

SEQ ID NO: 359860 - protein, 20 aa, Mycobacterium
KPARLTLDPGLRFSSLQTVF

SEQ ID NO: 359861 - protein, 22 aa, Mycobacterium
KPATLTLDPALRFASLQTVFQH

SEQ ID NO: 359862 - protein, 27 aa, Mycobacterium
KPATPGRGRWIAIALTALVIVAGVAIA

SEQ ID NO: 359863 - protein, 18 aa, Mycobacterium
KPAVLVALLFRTLDAFRI

SEQ ID NO: 359864 - protein, 17 aa, Mycobacterium
KPAVPQSIPPRLGGKLR

SEQ ID NO: 359865 - protein, 25 aa, Mycobacterium
KPAYHALTFGWLMSGLARGVTGKGM

SEQ ID NO: 359866 - protein, 26 aa, Mycobacterium
KPDFEFPLAVRGLFARLPVAQRALRW

SEQ ID NO: 359867 - protein, 17 aa, Mycobacterium
KPESAVVLLFINQTTTS

SEQ ID NO: 359868 - protein, 19 aa, Mycobacterium
KPFIKEYQPVLFGVGSGAD

SEQ ID NO: 359869 - protein, 26 aa, Mycobacterium
KPGLVRLRPAPSLGLPPPLTELAVRS

SEQ ID NO: 359870 - protein, 28 aa, Mycobacterium
KPIIRLGHMLVFFFRALAGVPIAVRQYR

SEQ ID NO: 359871 - protein, 30 aa, Mycobacterium
KPLESYNRLWLGVVAVAVVSVLIGAMLLVR

SEQ ID NO: 359872 - protein, 35 aa, Mycobacterium
KPLGADPLLYPFQPIHVTIAAWFTIGIPSFILSLA

SEQ ID NO: 359873 - protein, 21 aa, Mycobacterium
KPLSMAISVAGGLLAGKVFSE

SEQ ID NO: 359874 - protein, 18 aa, Mycobacterium
KPLVWLHERFGISEGAAV

SEQ ID NO: 359875 - protein, 20 aa, Mycobacterium
KPPNILITRDDFAYLVDFGI

SEQ ID NO: 359876 - protein, 32 aa, Mycobacterium
KPPVWGMRWTLWRTITVLVVSVGWVAATVGRL

SEQ ID NO: 359877 - protein, 27 aa, Mycobacterium
KPQYRSLWVFVLVPVLILLTVSGKWLY

SEQ ID NO: 359878 - protein, 20 aa, Mycobacterium
KPQYSATFYAAMSGLALVPF

SEQ ID NO: 359879 - protein, 33 aa, Mycobacterium
KPRLARTIRVLALPIVVFWVLLAVGVNVFVPQL

SEQ ID NO: 359880 - protein, 19 aa, Mycobacterium
KPRLYNWQFQPLDAADATA

SEQ ID NO: 359881 - protein, 30 aa, Mycobacterium
KPRRVRRWFRIALACLLLIAVAGVAVGAWI

SEQ ID NO: 359882 - protein, 29 aa, Mycobacterium
KPRSRLAEWGWQAIAAIAIAVVFAAAVAQ

SEQ ID NO: 359883 - protein, 27 aa, Mycobacterium
KPRSRRRMIIAAVLVVLVVVAGLAIGR

SEQ ID NO: 359884 - protein, 29 aa, Mycobacterium
KPSAFSTGWALWIVLVCIVFQAVAAVGAL

SEQ ID NO: 359885 - protein, 22 aa, Mycobacterium
KPTKLTLDPTLRFASLQTVFNR

SEQ ID NO: 359886 - protein, 18 aa, Mycobacterium
KPTNLRPEPGPDAGVAEI

SEQ ID NO: 359887 - protein, 27 aa, Mycobacterium
KPTSPIELALLILALVAVVLGLRSMIL

SEQ ID NO: 359888 - protein, 23 aa, Mycobacterium
KPVDVALYALLLIMLVTALFTDG

SEQ ID NO: 359889 - protein, 22 aa, Mycobacterium
KPVEQLFWYRSSKFVMRRWAPV

SEQ ID NO: 359890 - protein, 29 aa, Mycobacterium
KPVRPRLFHRMIINMLPLAFQRGSMLWVA

SEQ ID NO: 359891 - protein, 22 aa, Mycobacterium
KPVTIFMGATPIGDAGSAATIG

SEQ ID NO: 359892 - protein, 22 aa, Mycobacterium
KPWAIWVNLGVQLLLLAGFAVY

SEQ ID NO: 359893 - protein, 22 aa, Mycobacterium
KPWMERHPVLPRLVNMYGITET

SEQ ID NO: 359894 - protein, 19 aa, Mycobacterium
KQAKTRRIVLIAAGAIVAV

SEQ ID NO: 359895 - protein, 36 aa, Mycobacterium
KQARTALWAAIGFVSVYLLICLGIELQGPEGQLLSF

SEQ ID NO: 359896 - protein, 26 aa, Mycobacterium
KQAYRGYYLDFNLNLNLPPLCTTGFL

SEQ ID NO: 359897 - protein, 25 aa, Mycobacterium
KQFGIFILLFVLLAPVLNQWLFGLV

SEQ ID NO: 359898 - protein, 26 aa, Mycobacterium
KQGRSKRPWVIAGAVTVVVVAGGAVA

SEQ ID NO: 359899 - protein, 19 aa, Mycobacterium
KQILIYTWLTVLSTLALAL

SEQ ID NO: 359900 - protein, 21 aa, Mycobacterium
KQLANLHHFSGRRFDVGLGVG

SEQ ID NO: 359901 - protein, 25 aa, Mycobacterium
KQLITIARAFLARPQLLIFDEATSS

SEQ ID NO: 359902 - protein, 22 aa, Mycobacterium
KQNPIFDPLQPDDPRDWNAVTT

SEQ ID NO: 359903 - protein, 35 aa, Mycobacterium
KQRKKFSISALARRFWIPLLIGAVVFVGAFTVMRV

SEQ ID NO: 359904 - protein, 17 aa, Mycobacterium
KQRLGLVWVTLLGYLVA

SEQ ID NO: 359905 - protein, 30 aa, Mycobacterium
KQRSTSVARWLIAVAVLAVLTVVVTVAINM

SEQ ID NO: 359906 - protein, 38 aa, Mycobacterium
KQTWLGRFVSTYGWRAYALPILMVLTAVVVYQTVTGTT

SEQ ID NO: 359907 - protein, 19 aa, Mycobacterium
KQVIPFILAQVGGAFVAAL

SEQ ID NO: 359908 - protein, 24 aa, Mycobacterium
KQVLWTVIGLFAFYVALRTPVAVM

SEQ ID NO: 359909 - protein, 27 aa, Mycobacterium
KQWGFFILLFLLLPASHWFFGMMLWLF

SEQ ID NO: 359910 - protein, 35 aa, Mycobacterium
KRAARLFRPVFYYLSFWAVALVIFYPLLPQHVYEP

SEQ ID NO: 359911 - protein, 43 aa, Mycobacterium
KRAERGVALWLLLGGFFGLALLLVFLFWPWEYKPSGDKGNLLY

SEQ ID NO: 359912 - protein, 29 aa, Mycobacterium
KRAERLVALWFALGGVFGLALLGVFLFWP

SEQ ID NO: 359913 - protein, 46 aa, Mycobacterium
KRAERTVAYWFLLAGFSGLALLLIFLFWPWEYKPYGSGGEFLYSLT

SEQ ID NO: 359914 - protein, 24 aa, Mycobacterium
KRALLEVTYFTGLGALIVFLGGAA

SEQ ID NO: 359915 - protein, 21 aa, Mycobacterium
KRCDAVAYIIPGSSTTWRCSF

SEQ ID NO: 359916 - protein, 34 aa, Mycobacterium
KRCSRLFRPVFYYLGFWVIALISLYPILPQHVYQ

SEQ ID NO: 359917 - protein, 31 aa, Mycobacterium
KRCTRLFRPVFYYLAFWAVALTVLYRALPQH

SEQ ID NO: 359918 - protein, 18 aa, Mycobacterium
KRDDSICRSPWPIELHDG

SEQ ID NO: 359919 - protein, 28 aa, Mycobacterium
KRDVRLVTWFFPAWYAVFGVIICILARV

SEQ ID NO: 359920 - protein, 35 aa, Mycobacterium
KRELWLAWWTLVVFYNLFVLVFFVLTRTQPPPDPS

SEQ ID NO: 359921 - protein, 17 aa, Mycobacterium
KRFALKRGALMFGKLLP

SEQ ID NO: 359922 - protein, 21 aa, Mycobacterium
KRFMPEGWWKPRPLDALVGAV

SEQ ID NO: 359923 - protein, 36 aa, Mycobacterium
KRGAFAMLSVALVGGLLYWVWPSRGTYKIVGHFASA

SEQ ID NO: 359924 - protein, 36 aa, Mycobacterium
KRGGLLLRILRQFHHPLIYVLLVAGAITAGLQEYID

SEQ ID NO: 359925 - protein, 22 aa, Mycobacterium
KRGVLLFGKLLPAGIGAIIGAI

SEQ ID NO: 359926 - protein, 19 aa, Mycobacterium
KRHLWLMGLIAPTALFVML

SEQ ID NO: 359927 - protein, 21 aa, Mycobacterium
KRHLWLMGLIAPTALFVVLPL

SEQ ID NO: 359928 - protein, 20 aa, Mycobacterium
KRHVPPYALLAAVIVPASLI

SEQ ID NO: 359929 - protein, 19 aa, Mycobacterium
KRIRIAIVVGTVLTILVAV

SEQ ID NO: 359930 - protein, 27 aa, Mycobacterium
KRITMNYPPLLFHPINSITAYKGQIIY

SEQ ID NO: 359931 - protein, 18 aa, Mycobacterium
KRIVMCSMLYLAVVTPLY

SEQ ID NO: 359932 - protein, 23 aa, Mycobacterium
KRKPIDVALYALFLLVTFAALFA

SEQ ID NO: 359933 - protein, 26 aa, Mycobacterium
KRKVPGWLAPAAVVAALLILALVLGF

SEQ ID NO: 359934 - protein, 21 aa, Mycobacterium
KRLRVVWFNLVQTATAAGLSW

SEQ ID NO: 359935 - protein, 25 aa, Mycobacterium
KRLVRRLLPALILVLAACAVLTVLV

SEQ ID NO: 359936 - protein, 20 aa, Mycobacterium
KRMFIYGVGLFTIASVLCAA

SEQ ID NO: 359937 - protein, 25 aa, Mycobacterium
KRMLYVIRDWLPFALVLVAYDLSRG

SEQ ID NO: 359938 - protein, 25 aa, Mycobacterium
KRMSPFWRQMFLTVGIVIAVFGMRL

SEQ ID NO: 359939 - protein, 34 aa, Mycobacterium
KRRALVRLALVVAVLAVLFYLTAIARVIDVEAVR

SEQ ID NO: 359940 - protein, 30 aa, Mycobacterium
KRRLARALSLALLIVVAVGAVFLGSKLWHS

SEQ ID NO: 359941 - protein, 27 aa, Mycobacterium
KRRLDDYLRFLNDWQRPFIGRKTFMDL

SEQ ID NO: 359942 - protein, 19 aa, Mycobacterium
KRRLWLMGLIAPTALFVML

SEQ ID NO: 359943 - protein, 21 aa, Mycobacterium
KRRRIWLLAVASIDVLMVISS

SEQ ID NO: 359944 - protein, 24 aa, Mycobacterium
KRRRRPLLIAAVAVTVLGGGAAAF

SEQ ID NO: 359945 - protein, 20 aa, Mycobacterium
KRRWVIPAIFVLTLCATAYF

SEQ ID NO: 359946 - protein, 44 aa, Mycobacterium
KRTERLVAYWLMLGGLSGLALLLVFLFWPWEYQPFGSEGEFLYS

SEQ ID NO: 359947 - protein, 34 aa, Mycobacterium
KRTREARRASQEAELLILFAGSVLRGADPETLLE

SEQ ID NO: 359948 - protein, 24 aa, Mycobacterium
KRTRRMINPGMLAGGLALLLMVVW

SEQ ID NO: 359949 - protein, 23 aa, Mycobacterium
KRVQGGLLDPRMLWRSTPDALRK

SEQ ID NO: 359950 - protein, 25 aa, Mycobacterium
KRWYQGIFFTMFYTIILVLQMPYAM

SEQ ID NO: 359951 - protein, 38 aa, Mycobacterium
KRYARVAVVAAVYLGAFGLAGGLGWKLWDEHTVTQAGQ

SEQ ID NO: 359952 - protein, 25 aa, Mycobacterium
KRYIEIAHRLFPRAMLHFEDFGPTN

SEQ ID NO: 359953 - protein, 17 aa, Mycobacterium
KRYPYIPRYIDQDWVAE

SEQ ID NO: 359954 - protein, 24 aa, Mycobacterium
KSAGGIFNPLPKLDKDKAAKMAQR

SEQ ID NO: 359955 - protein, 24 aa, Mycobacterium
KSAHPWAFLIRSLVGGAMVGFGAL

SEQ ID NO: 359956 - protein, 27 aa, Mycobacterium
KSAPRGSLIWLVLAIGVAMLGQRLGSL

SEQ ID NO: 359957 - protein, 26 aa, Mycobacterium
KSAVSFLVLVWVILQSLAILGVNVAP

SEQ ID NO: 359958 - protein, 17 aa, Mycobacterium
KSDLFVAIGERLRDMLW

SEQ ID NO: 359959 - protein, 22 aa, Mycobacterium
KSEFFLSLVYGIALTHSPEAFN

SEQ ID NO: 359960 - protein, 20 aa, Mycobacterium
KSEFLRTLILSLAATHHPDQ

SEQ ID NO: 359961 - protein, 22 aa, Mycobacterium
KSERRDALRWVWLGVSCAIAVT

SEQ ID NO: 359962 - protein, 32 aa, Mycobacterium
KSESRRMGLLVEDLLLLARLDAQRPLEHRRVD

SEQ ID NO: 359963 - protein, 21 aa, Mycobacterium
KSGRVLFSVYLVTGVIAAIAA

SEQ ID NO: 359964 - protein, 22 aa, Mycobacterium
KSGYFGPVPRMVSGAALAGGLV

SEQ ID NO: 359965 - protein, 35 aa, Mycobacterium
KSHLARQVGLLRNYLLPLGALLLLLVKASQIPAGD

SEQ ID NO: 359966 - protein, 26 aa, Mycobacterium
KSIEQLLVVFPALFAAITTAAGGVPQ

SEQ ID NO: 359967 - protein, 25 aa, Mycobacterium
KSIEQLLVVLPALFAAITTAAGGGP

SEQ ID NO: 359968 - protein, 26 aa, Mycobacterium
KSIEQLLVVLPALFAALTTAAGGVPQ

SEQ ID NO: 359969 - protein, 19 aa, Mycobacterium
KSIFYVVIATLLVAPAALG

SEQ ID NO: 359970 - protein, 24 aa, Mycobacterium
KSIRVWLMLGVLLLSVVLAVRLNV

SEQ ID NO: 359971 - protein, 24 aa, Mycobacterium
KSKNTLKPTLRLPKLPVAQPGTAP

SEQ ID NO: 359972 - protein, 31 aa, Mycobacterium
KSLAPTVQVLRRLGTVLLIVGGIGVAVAAIA

SEQ ID NO: 359973 - protein, 21 aa, Mycobacterium
KSLAPVPPPMTTTLVPVRPPL

SEQ ID NO: 359974 - protein, 32 aa, Mycobacterium
KSLARASVIVPAVLAILLVVAIAVALREFERA

SEQ ID NO: 359975 - protein, 26 aa, Mycobacterium
KSLEQALVIFPALMAALNTVAGGVPS

SEQ ID NO: 359976 - protein, 27 aa, Mycobacterium
KSLSQALRLGWMALPAELVDQVVETAG

SEQ ID NO: 359977 - protein, 17 aa, Mycobacterium
KSPLLPQYVAIGATFVL

SEQ ID NO: 359978 - protein, 45 aa, Mycobacterium
KSPRPSGGIPLLVVLSVLAVAVAIFWIVMRYRASRRRTNALAAAR

SEQ ID NO: 359979 - protein, 32 aa, Mycobacterium
KSPRRLLLDGLIVATSLFVIAWVFVVEAQLQE

SEQ ID NO: 359980 - protein, 32 aa, Mycobacterium
KSQLMAMTFALRYRWWVVLGGITLATTAVHLI

SEQ ID NO: 359981 - protein, 17 aa, Mycobacterium
KSQTLMSILLALLTTHS

SEQ ID NO: 359982 - protein, 22 aa, Mycobacterium
KSQTLMSILLSLLATHSADRLI

SEQ ID NO: 359983 - protein, 17 aa, Mycobacterium
KSQTLMSILLSLLTTHP

SEQ ID NO: 359984 - protein, 22 aa, Mycobacterium
KSRGDQVIINRSGPVKPLSECV

SEQ ID NO: 359985 - protein, 28 aa, Mycobacterium
KSRKGRAFAIVAALLAIAAIAVAAVLTH

SEQ ID NO: 359986 - protein, 25 aa, Mycobacterium
KSRVYSILLLIVLGSFLVGTTLLTG

SEQ ID NO: 359987 - protein, 17 aa, Mycobacterium
KSSTLAFSKPFFAQGLL

SEQ ID NO: 359988 - protein, 30 aa, Mycobacterium
KSSTLAFSKPFFNQGLLNRRAVLKSSYAQF

SEQ ID NO: 359989 - protein, 31 aa, Mycobacterium
KSTFPILMIGLRMTLILTVVSIAIALVLGVI

SEQ ID NO: 359990 - protein, 41 aa, Mycobacterium
KSVKPPPRRQPNRALVAWISFAAALLAIGALAGCLAVLVVQ

SEQ ID NO: 359991 - protein, 20 aa, Mycobacterium
KSVLIFLGLPLLAGYLSRHL

SEQ ID NO: 359992 - protein, 35 aa, Mycobacterium
KSWTALLTMAILLLVYLLFRPVRFYYDGENHRFTL

SEQ ID NO: 359993 - protein, 29 aa, Mycobacterium
KTAAWSWRLLVILAALVALLLVIKKLEII

SEQ ID NO: 359994 - protein, 17 aa, Mycobacterium
KTAPLLRRLAGNAAATP

SEQ ID NO: 359995 - protein, 34 aa, Mycobacterium
KTAPRLPDGTPFPTLYYLTHPALTAAASRLESSG

SEQ ID NO: 359996 - protein, 27 aa, Mycobacterium
KTARRLLLQYAFDLALAYFIAVVDASA

SEQ ID NO: 359997 - protein, 19 aa, Mycobacterium
KTAYWSEPEPRWPKSPPQP

SEQ ID NO: 359998 - protein, 23 aa, Mycobacterium
KTELFGRMVAVLSWVWVATAAAM

SEQ ID NO: 359999 - protein, 29 aa, Mycobacterium
KTEPLVLAIVALIAFVMLLVSVHSVFLAL

SEQ ID NO: 360000 - protein, 38 aa, Mycobacterium
KTFARALTQALRLSYMALFSVPVLAPLVLRATLSRASV

SEQ ID NO: 360001 - protein, 22 aa, Mycobacterium
KTFGFLILFALLMSPPVNRAFF

SEQ ID NO: 360002 - protein, 26 aa, Mycobacterium
KTFVTVVPVLLILALVLVVVGPKIQA

SEQ ID NO: 360003 - protein, 23 aa, Mycobacterium
KTGIGLLCFVIVFLQGVTQFYPL

SEQ ID NO: 360004 - protein, 26 aa, Mycobacterium
KTGILPLMWFVLLCTAGINIFGIAMQ

SEQ ID NO: 360005 - protein, 17 aa, Mycobacterium
KTIVSIVFPIAMPGIVS

SEQ ID NO: 360006 - protein, 30 aa, Mycobacterium
KTKLTPATRWGPMLQWILVAAAGAAIVAGI

SEQ ID NO: 360007 - protein, 22 aa, Mycobacterium
KTLPQPFWTSVTAALLAGICLA

SEQ ID NO: 360008 - protein, 21 aa, Mycobacterium
KTLRLWDAATGAPIGAPLTGH

SEQ ID NO: 360009 - protein, 20 aa, Mycobacterium
KTLSLGWPAPVALVTVLAVG

SEQ ID NO: 360010 - protein, 17 aa, Mycobacterium
KTLVLAVAGITLAICVV

SEQ ID NO: 360011 - protein, 21 aa, Mycobacterium
KTMGIIFLALISYGSVSKTAS

SEQ ID NO: 360012 - protein, 19 aa, Mycobacterium
KTMGIIFLALMSYGSISRN

SEQ ID NO: 360013 - protein, 19 aa, Mycobacterium
KTMGVIFLALMSYGAVSKT

SEQ ID NO: 360014 - protein, 19 aa, Mycobacterium
KTMGVIFLALMSYGAVSTS

SEQ ID NO: 360015 - protein, 24 aa, Mycobacterium
KTNSSSWWAFRSFCSSTGCVASGT

SEQ ID NO: 360016 - protein, 19 aa, Mycobacterium
KTRLLFMPGVMVTSVPWQL

SEQ ID NO: 360017 - protein, 17 aa, Mycobacterium
KTTALTWAMERLAWRLT

SEQ ID NO: 360018 - protein, 26 aa, Mycobacterium
KTTIAWLMMFYGFAASVLPVWLLLAP

SEQ ID NO: 360019 - protein, 21 aa, Mycobacterium
KTVWQTANLVRKEGFGAAVRS

SEQ ID NO: 360020 - protein, 23 aa, Mycobacterium
KTWTKLPDLPQPRSDLGVAIADR

SEQ ID NO: 360021 - protein, 19 aa, Mycobacterium
KTYAFAVPPQVPGLTPAEL

SEQ ID NO: 360022 - protein, 27 aa, Mycobacterium
KTYLQGGWIAAQYLLAAAAGAGLFFGF

SEQ ID NO: 360023 - protein, 17 aa, Mycobacterium
KVAANVVDFRPLGKGDA

SEQ ID NO: 360024 - protein, 29 aa, Mycobacterium
KVALLLERTHLIPIAVLAIVKTGAAYVPI

SEQ ID NO: 360025 - protein, 30 aa, Mycobacterium
KVAPMVISRWTLLVWILAAVGSGMGYLAAV

SEQ ID NO: 360026 - protein, 28 aa, Mycobacterium
KVDLNDPPPCNVGFLPPPLIRSPADETL

SEQ ID NO: 360027 - protein, 30 aa, Mycobacterium
KVDYADILYISPWLFLLGVSMAALTAYATL

SEQ ID NO: 360028 - protein, 29 aa, Mycobacterium
KVDYADILYISPWLFLLGVSMAGLTAYAT

SEQ ID NO: 360029 - protein, 25 aa, Mycobacterium
KVEAFAMFNVFYQAGILLGPLVGSA

SEQ ID NO: 360030 - protein, 23 aa, Mycobacterium
KVFAEVVPVLLVLALALVVTGPR

SEQ ID NO: 360031 - protein, 27 aa, Mycobacterium
KVFAGQWPILVVGLIFIAAFALVVAGY

SEQ ID NO: 360032 - protein, 25 aa, Mycobacterium
KVGGLAFLYFLVMSTAALGIGLFVG

SEQ ID NO: 360033 - protein, 38 aa, Mycobacterium
KVGKVEFAGFIAWLAWLFLHLLYLVGHRNRVAAAFSWG

SEQ ID NO: 360034 - protein, 17 aa, Mycobacterium
KVGLPQDIWWLLPVVKT

SEQ ID NO: 360035 - protein, 24 aa, Mycobacterium
KVGLPQWYWIGLTAGLVLGAAFVH

SEQ ID NO: 360036 - protein, 28 aa, Mycobacterium
KVGPRAPQLWLPPLDTAIPLASVLDETG

SEQ ID NO: 360037 - protein, 49 aa, Mycobacterium
KVGPVEFAGFFAWLCWLVLHLVYLVGFKTKIVTLLSWGVTFLSTKRGQL

SEQ ID NO: 360038 - protein, 49 aa, Mycobacterium
KVGPVEFSGLIAWFAWLVLHLVYLVGFKTKVSTLLSWTVTFLSTRRGQL

SEQ ID NO: 360039 - protein, 27 aa, Mycobacterium
KVGRKPLLLWFGFGGVIYTYILITYLP

SEQ ID NO: 360040 - protein, 18 aa, Mycobacterium
KVHRHWGFGGGPHRCLGS

SEQ ID NO: 360041 - protein, 25 aa, Mycobacterium
KVIGMWMPVMLFFYMGFEHSVVNMF

SEQ ID NO: 360042 - protein, 19 aa, Mycobacterium
KVILVIVLLSFLSCAMSLQ

SEQ ID NO: 360043 - protein, 17 aa, Mycobacterium
KVLIPVSLLWIMVVAIT

SEQ ID NO: 360044 - protein, 17 aa, Mycobacterium
KVLLEPTSPRGPMGHWL

SEQ ID NO: 360045 - protein, 25 aa, Mycobacterium
KVLMYWIHAPLWLLSLCLMIMMTAT

SEQ ID NO: 360046 - protein, 17 aa, Mycobacterium
KVMIAHRLSAIRNADHV

SEQ ID NO: 360047 - protein, 35 aa, Mycobacterium
KVNEPPYKIAGIALFLVGLLILSLVYLQFRGDFDR

SEQ ID NO: 360048 - protein, 23 aa, Mycobacterium
KVPNASALPFRYTVNGYRGCSHA

SEQ ID NO: 360049 - protein, 27 aa, Mycobacterium
KVRSTLWALVAIVSVLLVVCIGLELQG

SEQ ID NO: 360050 - protein, 34 aa, Mycobacterium
KVTIITFVVIIVMLLWVYRSIITVFSTLFMVVIE

SEQ ID NO: 360051 - protein, 23 aa, Mycobacterium
KVTKLILVYTWLTVLSTLALALA

SEQ ID NO: 360052 - protein, 33 aa, Mycobacterium
KVTLVTFLVIILMLLFVYRSAITMLIMLVMVFI

SEQ ID NO: 360053 - protein, 25 aa, Mycobacterium
KVTSMLLVVVLIPAVIQFGIAVVRW

SEQ ID NO: 360054 - protein, 36 aa, Mycobacterium
KVVAALVALLVAASLALLAGLYFFSYRPDREVDAQA

SEQ ID NO: 360055 - protein, 25 aa, Mycobacterium
KVVALPGNPWIDTPLRDIATEIGKD

SEQ ID NO: 360056 - protein, 20 aa, Mycobacterium
KVVFMVIWLGAATSKLNRHF

SEQ ID NO: 360057 - protein, 19 aa, Mycobacterium
KVVKKGWFSWDKAAVSAHA

SEQ ID NO: 360058 - protein, 19 aa, Mycobacterium
KVVLALQHDKLPPSINFAG

SEQ ID NO: 360059 - protein, 19 aa, Mycobacterium
KVVLRWSLLTLVIVSVFAA

SEQ ID NO: 360060 - protein, 20 aa, Mycobacterium
KVVTLLSIAFGALAKLTLVW

SEQ ID NO: 360061 - protein, 20 aa, Mycobacterium
KVWATVLGVTVLCLALLTCS

SEQ ID NO: 360062 - protein, 24 aa, Mycobacterium
KVWSPQFSLWLVPLAVLALPHRRI

SEQ ID NO: 360063 - protein, 19 aa, Mycobacterium
KVYTDFYAALFASDFQPQE

SEQ ID NO: 360064 - protein, 20 aa, Mycobacterium
KVYVRRPVGYLPALQPAAVE

SEQ ID NO: 360065 - protein, 29 aa, Mycobacterium
KWAWMTGWVYMFCLLALIADAAFGAGPYV

SEQ ID NO: 360066 - protein, 31 aa, Mycobacterium
KWFSLSPVTLSWLLIGYGFAASVLPVWLLLA

SEQ ID NO: 360067 - protein, 18 aa, Mycobacterium
KWGEFGMLPSLNARRHPD

SEQ ID NO: 360068 - protein, 25 aa, Mycobacterium
KWKTIMRIVFPIAMPGIVSGVLLSV

SEQ ID NO: 360069 - protein, 17 aa, Mycobacterium
KWRDAGPVPYLGAAWGL

SEQ ID NO: 360070 - protein, 25 aa, Mycobacterium
KWSGLYFVMFFGLMTVAYTVAARKQ

SEQ ID NO: 360071 - protein, 23 aa, Mycobacterium
KWSGLYFVVFFGVMSLAFDVAAR

SEQ ID NO: 360072 - protein, 17 aa, Mycobacterium
KWSPFLRLNTWTTYILP

SEQ ID NO: 360073 - protein, 25 aa, Mycobacterium
KYAWMTGWVYLVALLVTIASVTYGS

SEQ ID NO: 360074 - protein, 27 aa, Mycobacterium
KYGSYPLLLVFGFFLGIAGTVFAVGIP

SEQ ID NO: 360075 - protein, 30 aa, Mycobacterium
KYKVGPTIAWYQDWLRYYFLTVESNPDGSM

SEQ ID NO: 360076 - protein, 25 aa, Mycobacterium
KYNLRFVWLYIVGSFFIAVSVMFPL

SEQ ID NO: 360077 - protein, 17 aa, Mycobacterium
KYPTAMLGIFLAPIAWV

SEQ ID NO: 360078 - protein, 45 aa, Mycobacterium
KYRFRARTIAVMSVLMLASAVAALTWSSTMWYSTAAVAAVTLLYL

SEQ ID NO: 360079 - protein, 30 aa, Mycobacterium
KYRWLVFTGWLLALVPAVYLALTQSGNLTG

SEQ ID NO: 360080 - protein, 28 aa, Mycobacterium
KYSWVSLGVCWLIWVLNAYDREIILRLG

SEQ ID NO: 360081 - protein, 28 aa, Mycobacterium
KYVVGPTIPWYQEFLRYYWLTVEESVDG

SEQ ID NO: 360082 - protein, 18 aa, Mycobacterium
KYYGTKMMLTLLGTFYAA

SEQ ID NO: 360083 - protein, 25 aa, Mycobacterium
KYYRYCTYIYIPFQYLSVVLGAYLF

SEQ ID NO: 360084 - protein, 21 aa, Mycobacterium
KYYRYCTYIYVPFQYLSVVLG

SEQ ID NO: 360085 - protein, 27 aa, Mycobacterium
LAAAAIYLGFFAPDVSLPPLVHRSVDA

SEQ ID NO: 360086 - protein, 24 aa, Mycobacterium
LAAAFAAVLWTCPSALAIEAPKVD

SEQ ID NO: 360087 - protein, 18 aa, Mycobacterium
LAAAFRLDLLGAALWTVC

SEQ ID NO: 360088 - protein, 20 aa, Mycobacterium
LAAAIPRRRTDRRYYSSWPV

SEQ ID NO: 360089 - protein, 20 aa, Mycobacterium
LAAALAMLAPVRRLRQSREH

SEQ ID NO: 360090 - protein, 23 aa, Mycobacterium
LAAALAPLGLLGSRLIFIHLFVV

SEQ ID NO: 360091 - protein, 27 aa, Mycobacterium
LAAALGLLAIIRRPPWPDLTSPGWSPA

SEQ ID NO: 360092 - protein, 29 aa, Mycobacterium
LAAALLVPALRFRPLIRLAVEWLEVLAMI

SEQ ID NO: 360093 - protein, 18 aa, Mycobacterium
LAAARFLLGLTVGVSVVV

SEQ ID NO: 360094 - protein, 18 aa, Mycobacterium
LAAAVRILSALPVARSAS

SEQ ID NO: 360095 - protein, 18 aa, Mycobacterium
LAAAYYLWTLASPRADAR

SEQ ID NO: 360096 - protein, 17 aa, Mycobacterium
LAAFLVAHLCFLAALLP

SEQ ID NO: 360097 - protein, 24 aa, Mycobacterium
LAAFPILIPILIGLMALAAAFGAL

SEQ ID NO: 360098 - protein, 18 aa, Mycobacterium
LAAGFFFSLGHSTVVFAL

SEQ ID NO: 360099 - protein, 33 aa, Mycobacterium
LAAGLALAPILIFIIAGRKLNTFWTVACGLSAV

SEQ ID NO: 360100 - protein, 28 aa, Mycobacterium
LAAGLIFLWALVLGIWKYRQMATSADHL

SEQ ID NO: 360101 - protein, 23 aa, Mycobacterium
LAAGLLAFAFLAPAAAVATGHSD

SEQ ID NO: 360102 - protein, 19 aa, Mycobacterium
LAAGLLFGPALGVPIAVAA

SEQ ID NO: 360103 - protein, 35 aa, Mycobacterium
LAAGMLPILGLRNEFRWILLVAGFTLFAAADTLYL

SEQ ID NO: 360104 - protein, 19 aa, Mycobacterium
LAAGRALTLGKRWGRGLAV

SEQ ID NO: 360105 - protein, 26 aa, Mycobacterium
LAAGWWSFLSILLMNWIAIFGNMGQI

SEQ ID NO: 360106 - protein, 40 aa, Mycobacterium
LAAIAAILILVVVPLIYVKNYIKVPPNEVAVFTGRGAPKV

SEQ ID NO: 360107 - protein, 19 aa, Mycobacterium
LAAIAILGTVLLTRGKHTG

SEQ ID NO: 360108 - protein, 18 aa, Mycobacterium
LAAILAICYLIPTAKPRS

SEQ ID NO: 360109 - protein, 23 aa, Mycobacterium
LAAILMLYTIVIIRGLRTAIATR

SEQ ID NO: 360110 - protein, 39 aa, Mycobacterium
LAAITAILALALLANTWWWRALSGWWAWAHTPNGPGGPT

SEQ ID NO: 360111 - protein, 25 aa, Mycobacterium
LAAIWMLHYANRGWFFPLAIRQVPG

SEQ ID NO: 360112 - protein, 25 aa, Mycobacterium
LAALAALVFDLLVTAGVYSLVGFEV

SEQ ID NO: 360113 - protein, 19 aa, Mycobacterium
LAALAMRLGWLPEGALATA

SEQ ID NO: 360114 - protein, 27 aa, Mycobacterium
LAALCYSIFLFLLRRGGPDRPLVQSYV

SEQ ID NO: 360115 - protein, 17 aa, Mycobacterium
LAALFWAGYIVVGKRVA

SEQ ID NO: 360116 - protein, 25 aa, Mycobacterium
LAALGALLALLLGVSRTTLAMARDR

SEQ ID NO: 360117 - protein, 26 aa, Mycobacterium
LAALGISVVLWQHLLDRELQAAVPLV

SEQ ID NO: 360118 - protein, 26 aa, Mycobacterium
LAALGWSVYALFWGTAGMPGMRHAFE

SEQ ID NO: 360119 - protein, 22 aa, Mycobacterium
LAALIGLPGLALYVGARWMGMS

SEQ ID NO: 360120 - protein, 19 aa, Mycobacterium
LAALLKRLEPDWSITVVER

SEQ ID NO: 360121 - protein, 17 aa, Mycobacterium
LAALLLPGGLIAAAMLI

SEQ ID NO: 360122 - protein, 21 aa, Mycobacterium
LAALNLLFIAFVGVQISVLFG

SEQ ID NO: 360123 - protein, 20 aa, Mycobacterium
LAALPTLFIIVDEFAELLSQ

SEQ ID NO: 360124 - protein, 23 aa, Mycobacterium
LAALRRESWYRRYLAVQLLFGSV

SEQ ID NO: 360125 - protein, 27 aa, Mycobacterium
LAALTFAAFGVLSIALVLAAIALPTVV

SEQ ID NO: 360126 - protein, 26 aa, Mycobacterium
LAALTLFPIGQLWWGAVAVSFFVLAD

SEQ ID NO: 360127 - protein, 19 aa, Mycobacterium
LAALYAKPGFPTDGIVVLC

SEQ ID NO: 360128 - protein, 18 aa, Mycobacterium
LAALYLPAVDARIIDRGI

SEQ ID NO: 360129 - protein, 20 aa, Mycobacterium
LAAMFAWGISFLGRTRGQMA

SEQ ID NO: 360130 - protein, 19 aa, Mycobacterium
LAAMVIGVALCGVVCFVGF

SEQ ID NO: 360131 - protein, 20 aa, Mycobacterium
LAAPLPRPAVIVAGDYSAGK

SEQ ID NO: 360132 - protein, 19 aa, Mycobacterium
LAAPLVLHPGMGVQVQVIV

SEQ ID NO: 360133 - protein, 23 aa, Mycobacterium
LAAPMADGWIDRGRLVCPWHGSR

SEQ ID NO: 360134 - protein, 31 aa, Mycobacterium
LAAPPSGPMPWAPPPWTSPARRTRTPWLLAV

SEQ ID NO: 360135 - protein, 18 aa, Mycobacterium
LAAPVVVWGALPFHRAAW

SEQ ID NO: 360136 - protein, 29 aa, Mycobacterium
LAAPWPALWLVLVVIALWSTAFGGVPSIY

SEQ ID NO: 360137 - protein, 18 aa, Mycobacterium
LAAREYFTYQDLARFAYA

SEQ ID NO: 360138 - protein, 28 aa, Mycobacterium
LAARKRIAWWILTGYMVAAAVWNVTGLL

SEQ ID NO: 360139 - protein, 28 aa, Mycobacterium
LAARLRNPWMLLGAAALVALIVFAAQGI

SEQ ID NO: 360140 - protein, 18 aa, Mycobacterium
LAARNYFTYRDVIGFIYA

SEQ ID NO: 360141 - protein, 25 aa, Mycobacterium
LAARPHALGPYPFDPSLVAQGVPPD

SEQ ID NO: 360142 - protein, 17 aa, Mycobacterium
LAARWIPVLPTHTHRFD

SEQ ID NO: 360143 - protein, 40 aa, Mycobacterium
LAASFGLSVLFWQHILGQPLHWMVLAMAVIILLAVGADYN

SEQ ID NO: 360144 - protein, 24 aa, Mycobacterium
LAASFLDWDLYKQAIPDLFKTGLP

SEQ ID NO: 360145 - protein, 28 aa, Mycobacterium
LAASVIMTILYWRVARVRPRFAFDGPVC

SEQ ID NO: 360146 - protein, 25 aa, Mycobacterium
LAASVLFFLLGCFTIVGTRQIAIVT

SEQ ID NO: 360147 - protein, 26 aa, Mycobacterium
LAASVLPVWFLLAPRDYLSTFMKVGT

SEQ ID NO: 360148 - protein, 19 aa, Mycobacterium
LAATAFHLLTGAPPFRHSN

SEQ ID NO: 360149 - protein, 26 aa, Mycobacterium
LAATAFPLQVPWLPLAAPLAVLAIYV

SEQ ID NO: 360150 - protein, 32 aa, Mycobacterium
LAATAPLLLTILAAVAVLWRRRWRAETSNTHT

SEQ ID NO: 360151 - protein, 19 aa, Mycobacterium
LAATIYHLLTGTTLFPHTN

SEQ ID NO: 360152 - protein, 23 aa, Mycobacterium
LAATLLWVLATPIVHLIFGSEFL

SEQ ID NO: 360153 - protein, 26 aa, Mycobacterium
LAATQGFIAVIMLVSLLIGQEAAGRI

SEQ ID NO: 360154 - protein, 18 aa, Mycobacterium
LAATVLIAVPFADGLFSR

SEQ ID NO: 360155 - protein, 24 aa, Mycobacterium
LAATVPMMLIIVAGTLVMSRRRWR

SEQ ID NO: 360156 - protein, 25 aa, Mycobacterium
LAATYVLFPLLGLAMRLLVPSVLTD

SEQ ID NO: 360157 - protein, 23 aa, Mycobacterium
LAAVAVFMLFPLGFSLYMSFQRW

SEQ ID NO: 360158 - protein, 22 aa, Mycobacterium
LAAVFIVLLLLPDAAGARGIVW

SEQ ID NO: 360159 - protein, 27 aa, Mycobacterium
LAAVGAAITALLFVGSAAFAGAAVQPY

SEQ ID NO: 360160 - protein, 20 aa, Mycobacterium
LAAVLISFLLAVLTLRLIEN

SEQ ID NO: 360161 - protein, 18 aa, Mycobacterium
LAAVLLVWRRASDGWAFT

SEQ ID NO: 360162 - protein, 18 aa, Mycobacterium
LAAVLRRFVGSRLKAVFV

SEQ ID NO: 360163 - protein, 24 aa, Mycobacterium
LAAVLVVAALFIGRAIIRNNYYVA

SEQ ID NO: 360164 - protein, 17 aa, Mycobacterium
LAAVLWQALQWFGATYV

SEQ ID NO: 360165 - protein, 24 aa, Mycobacterium
LAAVLYLLTAYPLRWPPQVNALRY

SEQ ID NO: 360166 - protein, 27 aa, Mycobacterium
LAAVPRPPLGPVWVALLIIGASSGVAV

SEQ ID NO: 360167 - protein, 26 aa, Mycobacterium
LAAVSAVLLIVLRLLGRLPAVGWDVY

SEQ ID NO: 360168 - protein, 28 aa, Mycobacterium
LAAVSWFLRFLLRHSMYWFVGYRVVVGV

SEQ ID NO: 360169 - protein, 24 aa, Mycobacterium
LAAVTLLPAILVLAGRRGWVKPRR

SEQ ID NO: 360170 - protein, 25 aa, Mycobacterium
LAAVVEIWMLLGSPAVICSMLSPKA

SEQ ID NO: 360171 - protein, 24 aa, Mycobacterium
LAAVVLLVWAYLAWTYGHVVGRRV

SEQ ID NO: 360172 - protein, 24 aa, Mycobacterium
LAAVVLLVWAYLAWTYGRITGRRI

SEQ ID NO: 360173 - protein, 24 aa, Mycobacterium
LAAVVLLVWAYLAWTYGRLVGRRI

SEQ ID NO: 360174 - protein, 25 aa, Mycobacterium
LAAYGFLTMDRWLLWQLPSTGRAFE

SEQ ID NO: 360175 - protein, 25 aa, Mycobacterium
LAAYVIILTLITLYATLRTPETRAR

SEQ ID NO: 360176 - protein, 20 aa, Mycobacterium
LAAYWLGSMIVSLAGLLVPL

SEQ ID NO: 360177 - protein, 20 aa, Mycobacterium
LACLLIAVNAYFVGAEFSLI

SEQ ID NO: 360178 - protein, 24 aa, Mycobacterium
LACPIWFYELWAFITPGLYQKERR

SEQ ID NO: 360179 - protein, 24 aa, Mycobacterium
LACPVWFYQLWAFITPGLYQKERR

SEQ ID NO: 360180 - protein, 33 aa, Mycobacterium
LADARLTWVLAAAMLFVAVAFAALARNAGRILL

SEQ ID NO: 360181 - protein, 25 aa, Mycobacterium
LADEVLYFFLVESAIVFVAAYVLGV

SEQ ID NO: 360182 - protein, 27 aa, Mycobacterium
LADEVLYFFLVESAVIFVTAYLVGVTA

SEQ ID NO: 360183 - protein, 29 aa, Mycobacterium
LADFDDFFRPIRNYLYWEPHCYDIPMCWS

SEQ ID NO: 360184 - protein, 29 aa, Mycobacterium
LADFDDFFRPLRSYFYWEQHCFNIPICWA

SEQ ID NO: 360185 - protein, 26 aa, Mycobacterium
LADFDDFWRPIRSYLYWEKHCYDIPN

SEQ ID NO: 360186 - protein, 30 aa, Mycobacterium
LADGQLYLGTSWWIAVFPGLALMLTALSIN

SEQ ID NO: 360187 - protein, 20 aa, Mycobacterium
LADGWFPMTAPGPGLEHARE

SEQ ID NO: 360188 - protein, 27 aa, Mycobacterium
LADICELVIAWFLGNLGFVGGPGLVTQ

SEQ ID NO: 360189 - protein, 27 aa, Mycobacterium
LADLLGRKRLFVYGVVLFTIASGLCAA

SEQ ID NO: 360190 - protein, 22 aa, Mycobacterium
LADNRGRWFFRHLFDLAIVVLP

SEQ ID NO: 360191 - protein, 17 aa, Mycobacterium
LADPLTPILAVGAAASA

SEQ ID NO: 360192 - protein, 28 aa, Mycobacterium
LADPNPPLPPWMPPSPPVPLTANPALVP

SEQ ID NO: 360193 - protein, 24 aa, Mycobacterium
LADRHRVLPLRPEGLRRLSKVDAI

SEQ ID NO: 360194 - protein, 17 aa, Mycobacterium
LADRIFRWLAQGAGVLV

SEQ ID NO: 360195 - protein, 24 aa, Mycobacterium
LADSFLDWDLYKQAIPDLLKTGLP

SEQ ID NO: 360196 - protein, 21 aa, Mycobacterium
LADVAVIFGFVLWHVIGANSS

SEQ ID NO: 360197 - protein, 26 aa, Mycobacterium
LAEFDDFWRPMRSYFYWEKHCFDVPI

SEQ ID NO: 360198 - protein, 25 aa, Mycobacterium
LAEGGPVFSPLWQAGLWAGVLIAVF

SEQ ID NO: 360199 - protein, 32 aa, Mycobacterium
LAEIQKPDFPWMTLTIVLVLGVAAAAALTRVL

SEQ ID NO: 360200 - protein, 24 aa, Mycobacterium
LAENNGRTWLLWDGRRSAIDLADR

SEQ ID NO: 360201 - protein, 31 aa, Mycobacterium
LAERDPRWLLWIVVTLTLVLLPASVLAFVVE

SEQ ID NO: 360202 - protein, 36 aa, Mycobacterium
LAERVKFGTWLVFSGLWVTLVYFPLAHMVWGGGLLS

SEQ ID NO: 360203 - protein, 19 aa, Mycobacterium
LAESVIFVLPSYSEGLPMA

SEQ ID NO: 360204 - protein, 23 aa, Mycobacterium
LAETIARRLGLTGALGTVAESID

SEQ ID NO: 360205 - protein, 25 aa, Mycobacterium
LAETVVLLLLFVFTATNIAVLVLRR

SEQ ID NO: 360206 - protein, 27 aa, Mycobacterium
LAFAAGAALPLLFFALAGQRVAERVSA

SEQ ID NO: 360207 - protein, 19 aa, Mycobacterium
LAFDLDWFNPFTNLAFGAF

SEQ ID NO: 360208 - protein, 20 aa, Mycobacterium
LAFFHNTKAVLFNFAVAATV

SEQ ID NO: 360209 - protein, 19 aa, Mycobacterium
LAFGLIRIARAVLAISPVV

SEQ ID NO: 360210 - protein, 26 aa, Mycobacterium
LAFGWRAMFLIIGLAGLVLALAFWAY

SEQ ID NO: 360211 - protein, 18 aa, Mycobacterium
LAFIAGMPQLGVAVFVVI

SEQ ID NO: 360212 - protein, 17 aa, Mycobacterium
LAFLAGVLILMLFDRVQ

SEQ ID NO: 360213 - protein, 29 aa, Mycobacterium
LAFNFLSAGLILILSYYATVVRGYSLTVL

SEQ ID NO: 360214 - protein, 32 aa, Mycobacterium
LAFPAPSWWWLAWFALVPLLLLVRAAATSGDG

SEQ ID NO: 360215 - protein, 17 aa, Mycobacterium
LAFPVIGVWVLIATLRA

SEQ ID NO: 360216 - protein, 28 aa, Mycobacterium
LAFSVVVFAFYIAIAIIIVTPPLLAALL

SEQ ID NO: 360217 - protein, 17 aa, Mycobacterium
LAFTVAALALALDPFSS

SEQ ID NO: 360218 - protein, 17 aa, Mycobacterium
LAFVWSWIFIEPLINRA

SEQ ID NO: 360219 - protein, 25 aa, Mycobacterium
LAGAIVGYYLLRRALRPGGGQLVGT

SEQ ID NO: 360220 - protein, 34 aa, Mycobacterium
LAGALAIPAYIAGLHWYLPRSAPMYADERIAIAN

SEQ ID NO: 360221 - protein, 25 aa, Mycobacterium
LAGALPLVMWLRRRPPRLPDTVHAW

SEQ ID NO: 360222 - protein, 28 aa, Mycobacterium
LAGALVGYLLLRRALLPAGGHLIGVAEV

SEQ ID NO: 360223 - protein, 17 aa, Mycobacterium
LAGALVHHVRWPMWLRT

SEQ ID NO: 360224 - protein, 30 aa, Mycobacterium
LAGALVQHVRWPMWLRTLVSVLALAAILSC

SEQ ID NO: 360225 - protein, 33 aa, Mycobacterium
LAGASLMIYLTQPLTFFLLEWGRSLLVDQPDAR

SEQ ID NO: 360226 - protein, 23 aa, Mycobacterium
LAGAVIIHLARSWSLAVSMVALV

SEQ ID NO: 360227 - protein, 30 aa, Mycobacterium
LAGAWIAILAMGLLFVLMKMIHKHYNTVAR

SEQ ID NO: 360228 - protein, 28 aa, Mycobacterium
LAGDFWAWALQFVVTLWVSTFLVVASHE

SEQ ID NO: 360229 - protein, 24 aa, Mycobacterium
LAGEVIFWHTFPIRGHLPSARAVL

SEQ ID NO: 360230 - protein, 23 aa, Mycobacterium
LAGFVVVLLITALTGYFVAQEFA

SEQ ID NO: 360231 - protein, 25 aa, Mycobacterium
LAGGISVLIAWWMWEKRATRPLVST

SEQ ID NO: 360232 - protein, 28 aa, Mycobacterium
LAGGMLIALWIVPALKYPPSPPALSLDE

SEQ ID NO: 360233 - protein, 17 aa, Mycobacterium
LAGGPWHWDRWAPASPW

SEQ ID NO: 360234 - protein, 17 aa, Mycobacterium
LAGGPWQWQRWAPASPW

SEQ ID NO: 360235 - protein, 20 aa, Mycobacterium
LAGGVLLAPPSAAQPPFRLP

SEQ ID NO: 360236 - protein, 20 aa, Mycobacterium
LAGIAFSIGFLALLLGRSEL

SEQ ID NO: 360237 - protein, 29 aa, Mycobacterium
LAGIASLCLIFIIMLLVTGSVVAALVIVG

SEQ ID NO: 360238 - protein, 31 aa, Mycobacterium
LAGIELSATMLWNYPTIGALAAYLAEKVAPQ

SEQ ID NO: 360239 - protein, 52 aa, Mycobacterium
LAGIFVCLFCAFYFMTVTYSLMTFWITTMLALLYGLLGQFSFGVLMLRIEET

SEQ ID NO: 360240 - protein, 24 aa, Mycobacterium
LAGIGVALVIWASAAVAGTESVGK

SEQ ID NO: 360241 - protein, 24 aa, Mycobacterium
LAGIGVALVIWASAAVAGVESVDK

SEQ ID NO: 360242 - protein, 28 aa, Mycobacterium
LAGIWCGLTLFLVLRLVLVGWRALSGGW

SEQ ID NO: 360243 - protein, 25 aa, Mycobacterium
LAGLFAAGLLWRRGRRTLARLGALA

SEQ ID NO: 360244 - protein, 20 aa, Mycobacterium
LAGLIWLRVYPVSMIGVPGQ

SEQ ID NO: 360245 - protein, 33 aa, Mycobacterium
LAGLKMTIILTVVSIFFALILGVIFGLARVSRS

SEQ ID NO: 360246 - protein, 20 aa, Mycobacterium
LAGLLIVIGIQLLQPAHIET

SEQ ID NO: 360247 - protein, 19 aa, Mycobacterium
LAGLLVNSLFAWSWADPIA

SEQ ID NO: 360248 - protein, 25 aa, Mycobacterium
LAGLSRFIFATAIIWFAGGLGTWLI

SEQ ID NO: 360249 - protein, 24 aa, Mycobacterium
LAGLTVIIPLYAMAMIMAFLSPQI

SEQ ID NO: 360250 - protein, 26 aa, Mycobacterium
LAGLVLAWFSAPWLIAVGAVCIAGAW

SEQ ID NO: 360251 - protein, 20 aa, Mycobacterium
LAGLVMNPVLALGGGIHSVF

SEQ ID NO: 360252 - protein, 26 aa, Mycobacterium
LAGMNGFFFAAIARIPLGVAVTIEFA

SEQ ID NO: 360253 - protein, 21 aa, Mycobacterium
LAGPYAFLGLNFFNTMEYQMR

SEQ ID NO: 360254 - protein, 22 aa, Mycobacterium
LAGRDLPPVPVLLVIVDEYLEL

SEQ ID NO: 360255 - protein, 23 aa, Mycobacterium
LAGRDLPPVPVLLVIVDEYLELF

SEQ ID NO: 360256 - protein, 31 aa, Mycobacterium
LAGRYFPPMGSILYWLRPGTIRLPPWPDRVP

SEQ ID NO: 360257 - protein, 18 aa, Mycobacterium
LAGTLILTVARRSYPRDV

SEQ ID NO: 360258 - protein, 19 aa, Mycobacterium
LAGVAALGLILFAGGSWRA

SEQ ID NO: 360259 - protein, 40 aa, Mycobacterium
LAGVALKMLWPSSPRWLGVPLYILLGWVAVWFIGPIMHGA

SEQ ID NO: 360260 - protein, 26 aa, Mycobacterium
LAGVLMLYTILIIRGLRTAIAVRDSF

SEQ ID NO: 360261 - protein, 35 aa, Mycobacterium
LAGVMLAFVGVGWALTLPAALFVVGALTALRITVA

SEQ ID NO: 360262 - protein, 25 aa, Mycobacterium
LAGVTLLPAILVLAGPRGWIKPRRE

SEQ ID NO: 360263 - protein, 25 aa, Mycobacterium
LAGVTLLPAILVLAGPRGWVKPRRE

SEQ ID NO: 360264 - protein, 27 aa, Mycobacterium
LAGVWSHFPTWLNLLGIFVPSIGAVVI

SEQ ID NO: 360265 - protein, 23 aa, Mycobacterium
LAGWLVRHWLIKLAVYVGVHFGG

SEQ ID NO: 360266 - protein, 37 aa, Mycobacterium
LAGWSLLLDYLFLPMINYLVIGLYLSAAIPAIPAWVF

SEQ ID NO: 360267 - protein, 26 aa, Mycobacterium
LAHEPPWVGALLGVLFVLTTTLGDLV

SEQ ID NO: 360268 - protein, 19 aa, Mycobacterium
LAHGLMWSVIAPIGVRLVP

SEQ ID NO: 360269 - protein, 23 aa, Mycobacterium
LAHPSRRRLVMYGLLGLGVVSGV

SEQ ID NO: 360270 - protein, 29 aa, Mycobacterium
LAHSYVPLRLITLTGFLLSAVAAIAVFVL

SEQ ID NO: 360271 - protein, 26 aa, Mycobacterium
LAIAAPRRIIGAALLVFLAAAVFGIP

SEQ ID NO: 360272 - protein, 18 aa, Mycobacterium
LAIAFVPLAMVPNAQRFG

SEQ ID NO: 360273 - protein, 18 aa, Mycobacterium
LAIGPQWVRQHTVLTVAV

SEQ ID NO: 360274 - protein, 22 aa, Mycobacterium
LAIGWGFLVWGMAMYVWSGILY

SEQ ID NO: 360275 - protein, 20 aa, Mycobacterium
LAIIAVSIPLPWMAVLIAND

SEQ ID NO: 360276 - protein, 19 aa, Mycobacterium
LAIIFSLVCIGIAAFSFLI

SEQ ID NO: 360277 - protein, 19 aa, Mycobacterium
LAIIIAVLIVINSRADSQQ

SEQ ID NO: 360278 - protein, 17 aa, Mycobacterium
LAILVLAGFVGFAVISK

SEQ ID NO: 360279 - protein, 17 aa, Mycobacterium
LAILVLSGFVGFAVISK

SEQ ID NO: 360280 - protein, 42 aa, Mycobacterium
LAIMAVLLKGAGLLVGTWLLMRYILPWLLPQIARSQELLVLF

SEQ ID NO: 360281 - protein, 18 aa, Mycobacterium
LAIPAVLASGLFSLPDAF

SEQ ID NO: 360282 - protein, 28 aa, Mycobacterium
LAIPLSFLVLVWVFGGLVAAALPVAIGG

SEQ ID NO: 360283 - protein, 17 aa, Mycobacterium
LAIPQVLLCWSMEAPLQ

SEQ ID NO: 360284 - protein, 20 aa, Mycobacterium
LAIPRPLPVLIAEAGTTARE

SEQ ID NO: 360285 - protein, 17 aa, Mycobacterium
LAISFVVLLILRIVGGH

SEQ ID NO: 360286 - protein, 33 aa, Mycobacterium
LAISILLVVLALWYYRLYVYPPVTAGYGLYVGG

SEQ ID NO: 360287 - protein, 24 aa, Mycobacterium
LAISLAFFVFVVGPTVFILNLLPT

SEQ ID NO: 360288 - protein, 20 aa, Mycobacterium
LAITGLVATAAWTIGSNLSG

SEQ ID NO: 360289 - protein, 18 aa, Mycobacterium
LAITPRYVKTIPANVAAA

SEQ ID NO: 360290 - protein, 25 aa, Mycobacterium
LAITYLPAMNAVFATAPIGAPVWLR

SEQ ID NO: 360291 - protein, 23 aa, Mycobacterium
LAITYLPAMNTVFGTAPIGAPAW

SEQ ID NO: 360292 - protein, 21 aa, Mycobacterium
LAIVARPYQWWRVALVVGSGL

SEQ ID NO: 360293 - protein, 17 aa, Mycobacterium
LAIVAVSIPLPWMAVLI

SEQ ID NO: 360294 - protein, 20 aa, Mycobacterium
LAIWNPYVAERLLQGHWSLL

SEQ ID NO: 360295 - protein, 19 aa, Mycobacterium
LAKDPKDRYQRCIDFARAL

SEQ ID NO: 360296 - protein, 18 aa, Mycobacterium
LAKDPNQRYPTCTAFALA

SEQ ID NO: 360297 - protein, 23 aa, Mycobacterium
LAKFHFWLTFLGFHATFLVQHWL

SEQ ID NO: 360298 - protein, 25 aa, Mycobacterium
LAKGLALLVLYGLATVLLAPYGTRG

SEQ ID NO: 360299 - protein, 21 aa, Mycobacterium
LAKINRFRWIRDKELRARFTP

SEQ ID NO: 360300 - protein, 32 aa, Mycobacterium
LAKLEPVIRLPLALGLVHLLGRIPLPGSAPRA

SEQ ID NO: 360301 - protein, 18 aa, Mycobacterium
LAKLFFPGGSSLAGLLAT

SEQ ID NO: 360302 - protein, 18 aa, Mycobacterium
LAKLKVLRRKGIDAYPVG

SEQ ID NO: 360303 - protein, 19 aa, Mycobacterium
LAKLTLVWALADLTMAVMA

SEQ ID NO: 360304 - protein, 26 aa, Mycobacterium
LAKLWSVIPRLFVVPPARSVAQLLER

SEQ ID NO: 360305 - protein, 24 aa, Mycobacterium
LAKMTIITIIIIAIMLMFVYRSIG

SEQ ID NO: 360306 - protein, 17 aa, Mycobacterium
LAKNPADRYARCIDFAH

SEQ ID NO: 360307 - protein, 18 aa, Mycobacterium
LAKNPAERYPTCSDFAAA

SEQ ID NO: 360308 - protein, 23 aa, Mycobacterium
LAKVALALHYNKIPASINYTGPN

SEQ ID NO: 360309 - protein, 29 aa, Mycobacterium
LALAFVSLGALIYFLHHLMHSIQIDTIME

SEQ ID NO: 360310 - protein, 17 aa, Mycobacterium
LALAIVLAVRPAIFGSD

SEQ ID NO: 360311 - protein, 17 aa, Mycobacterium
LALAIVLGRRRGWPTTL

SEQ ID NO: 360312 - protein, 30 aa, Mycobacterium
LALALVVCTVLWPPVRWLRNKGVPPAAAVL

SEQ ID NO: 360313 - protein, 22 aa, Mycobacterium
LALANLLWFVFAGLGALVLERG

SEQ ID NO: 360314 - protein, 19 aa, Mycobacterium
LALATFLRVLAIALPSVIL

SEQ ID NO: 360315 - protein, 37 aa, Mycobacterium
LALAVGMLPILGWRSEFRWGFLVVGLVGFAVADTAYL

SEQ ID NO: 360316 - protein, 24 aa, Mycobacterium
LALCGRRLFWPFIPRPEDADGVDS

SEQ ID NO: 360317 - protein, 20 aa, Mycobacterium
LALFALRAVVLPWLLARALG

SEQ ID NO: 360318 - protein, 21 aa, Mycobacterium
LALFIDWLARVVEIIAAPRGL

SEQ ID NO: 360319 - protein, 22 aa, Mycobacterium
LALFLVYPMGYLVALALTKSSL

SEQ ID NO: 360320 - protein, 22 aa, Mycobacterium
LALFSVVGLVFFLAHLVAEIRV

SEQ ID NO: 360321 - protein, 20 aa, Mycobacterium
LALGGLLRLDALSVTMLIVI

SEQ ID NO: 360322 - protein, 19 aa, Mycobacterium
LALGWWQWTRFQSVSGTFQ

SEQ ID NO: 360323 - protein, 23 aa, Mycobacterium
LALHSALILLTTLSFIALTGAHN

SEQ ID NO: 360324 - protein, 19 aa, Mycobacterium
LALHTWLLSLASILISLYP

SEQ ID NO: 360325 - protein, 17 aa, Mycobacterium
LALIDQYPRARFEVISF

SEQ ID NO: 360326 - protein, 42 aa, Mycobacterium
LALIDSHWLTGLFALNFFALISVYLVFFDGPKALALHSALIL

SEQ ID NO: 360327 - protein, 25 aa, Mycobacterium
LALLASTAVLYLWGLGSSGWANQYY

SEQ ID NO: 360328 - protein, 29 aa, Mycobacterium
LALLFSPVSWPERLLLGWLGPRGTTSIVF

SEQ ID NO: 360329 - protein, 17 aa, Mycobacterium
LALLIGVVAGLRAMTAP

SEQ ID NO: 360330 - protein, 18 aa, Mycobacterium
LALLIGVVAGLRSLTAPA

SEQ ID NO: 360331 - protein, 17 aa, Mycobacterium
LALLIWIGPYPVSMIGV

SEQ ID NO: 360332 - protein, 17 aa, Mycobacterium
LALLLSGPVPAMLARAA

SEQ ID NO: 360333 - protein, 18 aa, Mycobacterium
LALLLTGPVPALLARARW

SEQ ID NO: 360334 - protein, 19 aa, Mycobacterium
LALLLVALGVTIDVSLGVL

SEQ ID NO: 360335 - protein, 17 aa, Mycobacterium
LALLLVLGIYPKPALDV

SEQ ID NO: 360336 - protein, 51 aa, Mycobacterium
LALLRALYVILGWRPVLLVPLTFALFTPLALPSFAWWAAGLNALPMLAAMA

SEQ ID NO: 360337 - protein, 25 aa, Mycobacterium
LALLRRQLLVLTAFTTGVLLICDAW

SEQ ID NO: 360338 - protein, 24 aa, Mycobacterium
LALLVRFTTWGRQYWRITSGYFTG

SEQ ID NO: 360339 - protein, 24 aa, Mycobacterium
LALMTRRWALAWVALAGSALAGAA

SEQ ID NO: 360340 - protein, 24 aa, Mycobacterium
LALNAGWSWVFFNRRQLGPAAALA

SEQ ID NO: 360341 - protein, 23 aa, Mycobacterium
LALPFMVWVWARQLRDRRGFSPA

SEQ ID NO: 360342 - protein, 20 aa, Mycobacterium
LALPFMVWVWMRQLRDRHDM

SEQ ID NO: 360343 - protein, 19 aa, Mycobacterium
LALPLLALLARRLPVRARI

SEQ ID NO: 360344 - protein, 18 aa, Mycobacterium
LALPMPKLERLRIHVDIA

SEQ ID NO: 360345 - protein, 23 aa, Mycobacterium
LALPPTLAFDYPTPAALAAHLGQ

SEQ ID NO: 360346 - protein, 17 aa, Mycobacterium
LALPVLAIITGLAGGLS

SEQ ID NO: 360347 - protein, 19 aa, Mycobacterium
LALRLLIPVIRWQRRETVL

SEQ ID NO: 360348 - protein, 32 aa, Mycobacterium
LALRRDRFRICMWVGWLTLLMTYTPLAFESMY

SEQ ID NO: 360349 - protein, 25 aa, Mycobacterium
LALSVASFFWLWWTTNMLSAHLAGA

SEQ ID NO: 360350 - protein, 33 aa, Mycobacterium
LALSWARLTTVFVIDLLILIVASHCPDSWQGEN

SEQ ID NO: 360351 - protein, 17 aa, Mycobacterium
LALTLWLSTDAAERSYQ

SEQ ID NO: 360352 - protein, 26 aa, Mycobacterium
LALTVISFFWLWLSANLLSGLLALAT

SEQ ID NO: 360353 - protein, 17 aa, Mycobacterium
LALYLLFVFTQTVRHRD

SEQ ID NO: 360354 - protein, 25 aa, Mycobacterium
LAMAFGRFLPIVLVLALAGSLARQG

SEQ ID NO: 360355 - protein, 21 aa, Mycobacterium
LAMALTCWWVISREVIPRLGH

SEQ ID NO: 360356 - protein, 21 aa, Mycobacterium
LAMCGLSSWLRAMMLGIMRSY

SEQ ID NO: 360357 - protein, 20 aa, Mycobacterium
LAMGALLWIVVRRNHKHRKP

SEQ ID NO: 360358 - protein, 27 aa, Mycobacterium
LAMLATPWLLYLTPWYTASLTNGALGA

SEQ ID NO: 360359 - protein, 22 aa, Mycobacterium
LAMLPILLIFIVLQRQMIKGLT

SEQ ID NO: 360360 - protein, 19 aa, Mycobacterium
LAMPLTLIGALGGLGLVLV

SEQ ID NO: 360361 - protein, 19 aa, Mycobacterium
LAMPLTLVGALGGLALVLV

SEQ ID NO: 360362 - protein, 21 aa, Mycobacterium
LAMPMFPGLYSISVLQALTGI

SEQ ID NO: 360363 - protein, 20 aa, Mycobacterium
LAMQLGGWDPALQKLNTLAA

SEQ ID NO: 360364 - protein, 24 aa, Mycobacterium
LAMRQHVFGTYPLDPNLLAQGIPP

SEQ ID NO: 360365 - protein, 24 aa, Mycobacterium
LAMVFGRFLPIVLVLALAGSLARQ

SEQ ID NO: 360366 - protein, 26 aa, Mycobacterium
LAMVFGRFLPIVLVLALAGSLVRQGT

SEQ ID NO: 360367 - protein, 20 aa, Mycobacterium
LAMYTLFLTQPVIGWALVSA

SEQ ID NO: 360368 - protein, 27 aa, Mycobacterium
LANDPAPAALWIWAGLTGVAATVLVLD

SEQ ID NO: 360369 - protein, 27 aa, Mycobacterium
LANFDDFFRPIRNYLYWEPHCFDIPMC

SEQ ID NO: 360370 - protein, 22 aa, Mycobacterium
LANPAHYFILIGLFGIFVAGCT

SEQ ID NO: 360371 - protein, 17 aa, Mycobacterium
LANPGIVSIPLAFILGI

SEQ ID NO: 360372 - protein, 25 aa, Mycobacterium
LANPGLPLWPYLVCAALSGLGGGNY

SEQ ID NO: 360373 - protein, 25 aa, Mycobacterium
LANPGLPLWPYLVCAALTGLGGGNF

SEQ ID NO: 360374 - protein, 25 aa, Mycobacterium
LANPGLPLWPYLVCAVLTGLGGGNF

SEQ ID NO: 360375 - protein, 25 aa, Mycobacterium
LANPGLPLWPYVVCAALTGLGGGNY

SEQ ID NO: 360376 - protein, 25 aa, Mycobacterium
LANRDTYLLSLLYLGTFGSFIGFSF

SEQ ID NO: 360377 - protein, 33 aa, Mycobacterium
LANTLTLLRLVLVPVFLLALFAGDGQEPGFRVV

SEQ ID NO: 360378 - protein, 28 aa, Mycobacterium
LAPARQWGFFILLILLIAPPLNQWFFAA

SEQ ID NO: 360379 - protein, 23 aa, Mycobacterium
LAPELAGFWTGAFVQGPFNTRIV

SEQ ID NO: 360380 - protein, 22 aa, Mycobacterium
LAPFMSYGKFTGDAPLGTCAFW

SEQ ID NO: 360381 - protein, 46 aa, Mycobacterium
LAPHRGRWFIRHIIDLLIVALPMMRPLRLLRLLVLVGALQKAVGNA

SEQ ID NO: 360382 - protein, 19 aa, Mycobacterium
LAPIALHWSLNGMGALAAA

SEQ ID NO: 360383 - protein, 18 aa, Mycobacterium
LAPLAFPVLVLGGTLHLY

SEQ ID NO: 360384 - protein, 21 aa, Mycobacterium
LAPMLAAPLVPLAAGAVLVPL

SEQ ID NO: 360385 - protein, 19 aa, Mycobacterium
LAPNWSFHFGLLLAGWGIF

SEQ ID NO: 360386 - protein, 34 aa, Mycobacterium
LAPPCIMMFLHMRYWWVGIALVALGVIVATVTFS

SEQ ID NO: 360387 - protein, 25 aa, Mycobacterium
LAPQGLDYVIGFFAAIQAGNIAVPL

SEQ ID NO: 360388 - protein, 22 aa, Mycobacterium
LAPQHWIALTPPRIPRLRTLQD

SEQ ID NO: 360389 - protein, 18 aa, Mycobacterium
LAPRPVERPPVDPAAQRT

SEQ ID NO: 360390 - protein, 24 aa, Mycobacterium
LAPSPTCIIVGLPAGLRLAVDNAI

SEQ ID NO: 360391 - protein, 25 aa, Mycobacterium
LAPSPTVIIVGLPTGLRLSVDNAIA

SEQ ID NO: 360392 - protein, 19 aa, Mycobacterium
LAPTLQWFVPGHPPTKAQR

SEQ ID NO: 360393 - protein, 27 aa, Mycobacterium
LAPTLTPVLVRWFGLWRVIAAGMAFAA

SEQ ID NO: 360394 - protein, 29 aa, Mycobacterium
LAPTLWTQQLPFGIAITGLLAVAASYAAE

SEQ ID NO: 360395 - protein, 25 aa, Mycobacterium
LAPTTSWYVIRWVIASALAGPLLMT

SEQ ID NO: 360396 - protein, 30 aa, Mycobacterium
LAPTVWGWRRVPVWRWFVLGAGVGVAGSWI

SEQ ID NO: 360397 - protein, 24 aa, Mycobacterium
LAPVAVIPVLLPDGKDFSKETGYW

SEQ ID NO: 360398 - protein, 23 aa, Mycobacterium
LAPWAAVMLVHWFGVARRQVDPA

SEQ ID NO: 360399 - protein, 26 aa, Mycobacterium
LAPYILIWVIIIAYVCHIPFAVRSKR

SEQ ID NO: 360400 - protein, 17 aa, Mycobacterium
LAQFLGWPWGKFRRPAQ

SEQ ID NO: 360401 - protein, 28 aa, Mycobacterium
LAQHDDLLSNLLQISPIFFREATNITGD

SEQ ID NO: 360402 - protein, 25 aa, Mycobacterium
LAQIGLFVLLGLLVSPSQLGSELIP

SEQ ID NO: 360403 - protein, 20 aa, Mycobacterium
LAQLLFLVVAVFLLTNKVWS

SEQ ID NO: 360404 - protein, 31 aa, Mycobacterium
LAQLTVRGWLALVLWIMGATVLLGAVVGGVL

SEQ ID NO: 360405 - protein, 18 aa, Mycobacterium
LAQTLLTRRHSPLVLGTA

SEQ ID NO: 360406 - protein, 19 aa, Mycobacterium
LAREALTESGLLIERDRAA

SEQ ID NO: 360407 - protein, 24 aa, Mycobacterium
LARFGHMIAFYLHTVLAIPVALRR

SEQ ID NO: 360408 - protein, 17 aa, Mycobacterium
LARGYLAIALPVGTMGL

SEQ ID NO: 360409 - protein, 17 aa, Mycobacterium
LARGYLAIALPVGTVGL

SEQ ID NO: 360410 - protein, 17 aa, Mycobacterium
LARGYLAVALPVGTIGL

SEQ ID NO: 360411 - protein, 17 aa, Mycobacterium
LARGYLAVALPVGTLGL

SEQ ID NO: 360412 - protein, 33 aa, Mycobacterium
LARIVRRFAIPIILFWVAITALLNLAVPQLEVV

SEQ ID NO: 360413 - protein, 28 aa, Mycobacterium
LARKITGPLLFLFILGDVLGAGVYALMG

SEQ ID NO: 360414 - protein, 20 aa, Mycobacterium
LARLMPTPPPPPSPPTTPPW

SEQ ID NO: 360415 - protein, 26 aa, Mycobacterium
LARLNPFLFFLLAATATLPIAALSWF

SEQ ID NO: 360416 - protein, 19 aa, Mycobacterium
LARLTTAMLTLYFMLAVAA

SEQ ID NO: 360417 - protein, 25 aa, Mycobacterium
LARLTTAMLTVYFVLALGAHVRARD

SEQ ID NO: 360418 - protein, 17 aa, Mycobacterium
LARMFTLARLSEALLLA

SEQ ID NO: 360419 - protein, 29 aa, Mycobacterium
LARMGRRLGALTIDWLIALGLAALAMRLG

SEQ ID NO: 360420 - protein, 31 aa, Mycobacterium
LARRGASLIWRFGVPLVCALAGFLLAATHTV

SEQ ID NO: 360421 - protein, 21 aa, Mycobacterium
LARRLLNYVVLLALASFLTFC

SEQ ID NO: 360422 - protein, 18 aa, Mycobacterium
LARRTAIALTRWRVRMEV

SEQ ID NO: 360423 - protein, 18 aa, Mycobacterium
LARSWPRSLAGQAIALQV

SEQ ID NO: 360424 - protein, 32 aa, Mycobacterium
LARTAPGFLPWHLRLLIRLGAAVSVVLPGVVI

SEQ ID NO: 360425 - protein, 17 aa, Mycobacterium
LARTRRGLRALLSLAPE

SEQ ID NO: 360426 - protein, 17 aa, Mycobacterium
LARVHPLLAAGLNLIAV

SEQ ID NO: 360427 - protein, 23 aa, Mycobacterium
LARVTTAMLTLYFVVAVGAHVRV

SEQ ID NO: 360428 - protein, 25 aa, Mycobacterium
LARVTTAMLTVYFVLALGAHIRVRD

SEQ ID NO: 360429 - protein, 24 aa, Mycobacterium
LARWQPAWLRYSPLSFTGLAMILA

SEQ ID NO: 360430 - protein, 31 aa, Mycobacterium
LARYGPQAPRLWLPPLDEPIPLSTLLATAGV

SEQ ID NO: 360431 - protein, 29 aa, Mycobacterium
LARYGPRAPQLWLPPLDEPIPITALLARA

SEQ ID NO: 360432 - protein, 29 aa, Mycobacterium
LARYGPRAPQLWLPPLDEPIPLTAVLARA

SEQ ID NO: 360433 - protein, 18 aa, Mycobacterium
LASAWYLLPTPDDGHPLV

SEQ ID NO: 360434 - protein, 30 aa, Mycobacterium
LASDPAPFRLWLWIGVFATSVAVAAVGFRS

SEQ ID NO: 360435 - protein, 36 aa, Mycobacterium
LASGPYFKVMLANLAPYWILQPFVDAAFKKRGINPE

SEQ ID NO: 360436 - protein, 28 aa, Mycobacterium
LASGPYFKVMLVNLIPPTILQPFVDAAF

SEQ ID NO: 360437 - protein, 27 aa, Mycobacterium
LASLADTLWSLRRLGYRSRPLWRPFTR

SEQ ID NO: 360438 - protein, 30 aa, Mycobacterium
LASLAIFVTVWWILSMTLFNPALVPPPQQV

SEQ ID NO: 360439 - protein, 28 aa, Mycobacterium
LASLAVLRWSWTPLLFAGSVLTLIPLAL

SEQ ID NO: 360440 - protein, 19 aa, Mycobacterium
LASLVFLGAFIPIIGAAIS

SEQ ID NO: 360441 - protein, 18 aa, Mycobacterium
LASLVFLGAFIPLIGALI

SEQ ID NO: 360442 - protein, 19 aa, Mycobacterium
LASPWLIASLVLTGAAAAV

SEQ ID NO: 360443 - protein, 22 aa, Mycobacterium
LASRHHAFLIQTPLGTEIRDAH

SEQ ID NO: 360444 - protein, 26 aa, Mycobacterium
LASRHPLPTLWPLLLVGYGVVAILPS

SEQ ID NO: 360445 - protein, 20 aa, Mycobacterium
LASRRHATLVPTPLGTEIRD

SEQ ID NO: 360446 - protein, 18 aa, Mycobacterium
LASSLPRLPLFAAAAKVV

SEQ ID NO: 360447 - protein, 17 aa, Mycobacterium
LASTIVVHFSYTKPRLS

SEQ ID NO: 360448 - protein, 24 aa, Mycobacterium
LASVISWVSVVIIGIWVMMQIADV

SEQ ID NO: 360449 - protein, 22 aa, Mycobacterium
LASVVTWFCYVRRPAAMPVTGT

SEQ ID NO: 360450 - protein, 22 aa, Mycobacterium
LASYLLIGFWSHKPSAATAAKK

SEQ ID NO: 360451 - protein, 26 aa, Mycobacterium
LATALGFLFALLSTTSRNASGLHLLT

SEQ ID NO: 360452 - protein, 35 aa, Mycobacterium
LATALPIFLVVVVGLAFILLTIAFRAALVPLTSIA

SEQ ID NO: 360453 - protein, 29 aa, Mycobacterium
LATAVIAVLLLLWARRSLVAAAVVLLTAG

SEQ ID NO: 360454 - protein, 35 aa, Mycobacterium
LATAVPLQVISWLLMPISRLLVLLGNALTPGRGFR

SEQ ID NO: 360455 - protein, 32 aa, Mycobacterium
LATAVPLRVLSWLLMPLSRLLVVLGNALTPGR

SEQ ID NO: 360456 - protein, 20 aa, Mycobacterium
LATFLVLTVLTFVLSQDAME

SEQ ID NO: 360457 - protein, 17 aa, Mycobacterium
LATFTWFVGAGIGFAVY

SEQ ID NO: 360458 - protein, 25 aa, Mycobacterium
LATFVLGLVLWAPMGGWQLGRHLMQ

SEQ ID NO: 360459 - protein, 25 aa, Mycobacterium
LATGVAGWLFGWLADRSGSLAAPML

SEQ ID NO: 360460 - protein, 17 aa, Mycobacterium
LATLRRGSEARLITAMI

SEQ ID NO: 360461 - protein, 17 aa, Mycobacterium
LATLYQIGVIAALFLGV

SEQ ID NO: 360462 - protein, 23 aa, Mycobacterium
LATRLHPVLFFLASVTATLPLAA

SEQ ID NO: 360463 - protein, 24 aa, Mycobacterium
LATRLTMITLIPTVAFMTVGGPAM

SEQ ID NO: 360464 - protein, 24 aa, Mycobacterium
LATRLTMITLIPTVAFMTVGGSAM

SEQ ID NO: 360465 - protein, 25 aa, Mycobacterium
LATRMAFRRLAFADWTLYMVGAALL

SEQ ID NO: 360466 - protein, 26 aa, Mycobacterium
LATRVGFPSMLLFLLVGVAVGEDGLG

SEQ ID NO: 360467 - protein, 23 aa, Mycobacterium
LATRVGFPSMLLFLLVGVIVGED

SEQ ID NO: 360468 - protein, 23 aa, Mycobacterium
LATSVLGFLWYSNGFLGLPSLGD

SEQ ID NO: 360469 - protein, 21 aa, Mycobacterium
LATVLIAALLLTVTTDLKRML

SEQ ID NO: 360470 - protein, 17 aa, Mycobacterium
LATWVLVTLRTAKGSLR

SEQ ID NO: 360471 - protein, 19 aa, Mycobacterium
LATYILMYLVLRSESDLTG

SEQ ID NO: 360472 - protein, 20 aa, Mycobacterium
LAVAIMIFAICVASMVLAQL

SEQ ID NO: 360473 - protein, 18 aa, Mycobacterium
LAVALLCTAALAAAVATG

SEQ ID NO: 360474 - protein, 46 aa, Mycobacterium
LAVALRTPWIAWLAVAFVIVALYLGALLRLPRWLLDLSPVGRTTAP

SEQ ID NO: 360475 - protein, 22 aa, Mycobacterium
LAVANLLWFVFAGLGALTVESG

SEQ ID NO: 360476 - protein, 22 aa, Mycobacterium
LAVANLMWFVFAGFGALTVETD

SEQ ID NO: 360477 - protein, 24 aa, Mycobacterium
LAVANLMWFVFAGLGALTVETDII

SEQ ID NO: 360478 - protein, 28 aa, Mycobacterium
LAVANYWIMTHLLPLFRGMQSLIDGINR

SEQ ID NO: 360479 - protein, 21 aa, Mycobacterium
LAVARIAMGWPLTVVAALVTY

SEQ ID NO: 360480 - protein, 26 aa, Mycobacterium
LAVDGVSWRILLEDINLGWAQHRDGQ

SEQ ID NO: 360481 - protein, 26 aa, Mycobacterium
LAVDGVSWRILLEDLNIAWTQQQDGR

SEQ ID NO: 360482 - protein, 24 aa, Mycobacterium
LAVDGVSWRILLEDLTIASTQLRG

SEQ ID NO: 360483 - protein, 29 aa, Mycobacterium
LAVEEQYYVLWPLLIAAVIAGLTALAYRR

SEQ ID NO: 360484 - protein, 39 aa, Mycobacterium
LAVEPGVAPWRQLLDDLSYNPLLAPLRGPAGQVGRLLSA

SEQ ID NO: 360485 - protein, 25 aa, Mycobacterium
LAVERLFRAMVLGLAAWAVWEFRGA

SEQ ID NO: 360486 - protein, 19 aa, Mycobacterium
LAVERLFRAVAIALAAYAV

SEQ ID NO: 360487 - protein, 33 aa, Mycobacterium
LAVFALVFGFILMWILSWLTATPIRVVRAALNR

SEQ ID NO: 360488 - protein, 24 aa, Mycobacterium
LAVFRGFPWKQVIPFILAQVGGAF

SEQ ID NO: 360489 - protein, 18 aa, Mycobacterium
LAVFVVVGLVANSLARTA

SEQ ID NO: 360490 - protein, 32 aa, Mycobacterium
LAVGIAVVFVRWWGQPAWSWAVLGLRGRRPVS

SEQ ID NO: 360491 - protein, 22 aa, Mycobacterium
LAVGIFFLLSYLGAGWISGLIH

SEQ ID NO: 360492 - protein, 26 aa, Mycobacterium
LAVGMALLAGLLAGVSLLPKVKSYGA

SEQ ID NO: 360493 - protein, 17 aa, Mycobacterium
LAVGWRSRRWRAVRMPV

SEQ ID NO: 360494 - protein, 18 aa, Mycobacterium
LAVGWRSRRWRTVWLPAA

SEQ ID NO: 360495 - protein, 26 aa, Mycobacterium
LAVIARFIQFIIVPVALVALARDTAG

SEQ ID NO: 360496 - protein, 35 aa, Mycobacterium
LAVIGTLVAILWFGGWLIPLLAIWAYWQVFHVLKQ

SEQ ID NO: 360497 - protein, 20 aa, Mycobacterium
LAVIVLLKGKVWTGLVGMFI

SEQ ID NO: 360498 - protein, 34 aa, Mycobacterium
LAVKLSLWYPHYAWLLLTIYLAAALVTLISVGAM

SEQ ID NO: 360499 - protein, 35 aa, Mycobacterium
LAVLHPSIFAWAITAWLWFTVVFANLAEAVAEGRG

SEQ ID NO: 360500 - protein, 19 aa, Mycobacterium
LAVLIGAVGVAFMVSRMIS

SEQ ID NO: 360501 - protein, 17 aa, Mycobacterium
LAVLILRRRRSTAIEQR

SEQ ID NO: 360502 - protein, 17 aa, Mycobacterium
LAVLLAGPTPALLARAT

SEQ ID NO: 360503 - protein, 19 aa, Mycobacterium
LAVLLILMGGVQRKPWAIW

SEQ ID NO: 360504 - protein, 17 aa, Mycobacterium
LAVLLLGFVLLLALAVL

SEQ ID NO: 360505 - protein, 20 aa, Mycobacterium
LAVLQRRLLEMPSVELHFER

SEQ ID NO: 360506 - protein, 17 aa, Mycobacterium
LAVLSFGFNLYWRVRYA

SEQ ID NO: 360507 - protein, 18 aa, Mycobacterium
LAVLSRMLVRSRAEIDEL

SEQ ID NO: 360508 - protein, 18 aa, Mycobacterium
LAVLTIVVTIAINTFGGN

SEQ ID NO: 360509 - protein, 17 aa, Mycobacterium
LAVLVCVDFVALQLITG

SEQ ID NO: 360510 - protein, 22 aa, Mycobacterium
LAVLVMPVIGLWAMVATLRAGF

SEQ ID NO: 360511 - protein, 26 aa, Mycobacterium
LAVLWAALTARWWLSGLLVGAAAGIK

SEQ ID NO: 360512 - protein, 17 aa, Mycobacterium
LAVMDSFYLPLLVRRRI

SEQ ID NO: 360513 - protein, 26 aa, Mycobacterium
LAVMGIRPIAYLASTRLLAGVIVVVP

SEQ ID NO: 360514 - protein, 17 aa, Mycobacterium
LAVMVILVGLSPDRFVA

SEQ ID NO: 360515 - protein, 18 aa, Mycobacterium
LAVNLFGIVLAGVLVLWV

SEQ ID NO: 360516 - protein, 25 aa, Mycobacterium
LAVNLPIMVLFPRGWSEFFRLNTRR

SEQ ID NO: 360517 - protein, 17 aa, Mycobacterium
LAVPAFAPAIVVAGVVA

SEQ ID NO: 360518 - protein, 29 aa, Mycobacterium
LAVPERPFQIPYRALLPRNVDGLITTGRC

SEQ ID NO: 360519 - protein, 24 aa, Mycobacterium
LAVRALPVVLLTALVFFNTYVWLM

SEQ ID NO: 360520 - protein, 29 aa, Mycobacterium
LAVRALPVVLLTTLVFFNGNVWLMAATIG

SEQ ID NO: 360521 - protein, 29 aa, Mycobacterium
LAVRALPVVLLTTLVFFNSNIWLMASTIS

SEQ ID NO: 360522 - protein, 33 aa, Mycobacterium
LAVRGRVSLGRRVVSLPWRLANIQDLPAVDAPA

SEQ ID NO: 360523 - protein, 20 aa, Mycobacterium
LAVRGWPLRILAVLVAAASA

SEQ ID NO: 360524 - protein, 26 aa, Mycobacterium
LAVSIPLTVLIIFTLNILLAEFGAAD

SEQ ID NO: 360525 - protein, 27 aa, Mycobacterium
LAVSLTLLPILLGFAAPRGLSVPQTGG

SEQ ID NO: 360526 - protein, 18 aa, Mycobacterium
LAVSPLPNWLGDSLRAAA

SEQ ID NO: 360527 - protein, 33 aa, Mycobacterium
LAVTAGFLTLFGFIFVITQYFQFIKEYRAFETG

SEQ ID NO: 360528 - protein, 32 aa, Mycobacterium
LAVTAGFLTLFGFIFVITQYFQFVKDYTAFQS

SEQ ID NO: 360529 - protein, 40 aa, Mycobacterium
LAVTAIVVALLLIVTYRSPILWLVPLLVIAFADRVGSVVG

SEQ ID NO: 360530 - protein, 33 aa, Mycobacterium
LAVTLLSLIAIAVPYVGPWRLSGTRFAPTATNR

SEQ ID NO: 360531 - protein, 25 aa, Mycobacterium
LAVTVIALVYAWRQYLKAKERRAEL

SEQ ID NO: 360532 - protein, 30 aa, Mycobacterium
LAVTVLVVHIRSLLRDRALLDRWAGEVTSS

SEQ ID NO: 360533 - protein, 17 aa, Mycobacterium
LAVVAIAFVAAISGWRS

SEQ ID NO: 360534 - protein, 28 aa, Mycobacterium
LAVVARPYEWWRVALVSISALAYVVIFS

SEQ ID NO: 360535 - protein, 18 aa, Mycobacterium
LAVVFLCTAALVAAVLTG

SEQ ID NO: 360536 - protein, 20 aa, Mycobacterium
LAVVLLTFGTAVFVAAEFSL

SEQ ID NO: 360537 - protein, 28 aa, Mycobacterium
LAVVNLGWPWWAAVLVAIACGAVIGLII

SEQ ID NO: 360538 - protein, 21 aa, Mycobacterium
LAVVRRWIGLATVVVSCASLA

SEQ ID NO: 360539 - protein, 38 aa, Mycobacterium
LAVVVHPTFLYELLWNVLVFAMLIYLDRRFTIGHGRLF

SEQ ID NO: 360540 - protein, 19 aa, Mycobacterium
LAVVVVGVGWFMPLLGISL

SEQ ID NO: 360541 - protein, 31 aa, Mycobacterium
LAWGILVVFYNLFFPMFFIVAQVQPPPQPTW

SEQ ID NO: 360542 - protein, 24 aa, Mycobacterium
LAWGPQIVFTYGPLAFLQDSSYYS

SEQ ID NO: 360543 - protein, 20 aa, Mycobacterium
LAWIALYVRVSAPINRQLTA

SEQ ID NO: 360544 - protein, 19 aa, Mycobacterium
LAWIMAGLTVPTSGACLID

SEQ ID NO: 360545 - protein, 27 aa, Mycobacterium
LAWKAHGLTFYYPLIGLAAGAAAVVGI

SEQ ID NO: 360546 - protein, 23 aa, Mycobacterium
LAWKAYELVLRHLARLRRDQLHT

SEQ ID NO: 360547 - protein, 19 aa, Mycobacterium
LAWLMLGRFALGSRRMSRG

SEQ ID NO: 360548 - protein, 17 aa, Mycobacterium
LAWTGRLVPRGGFDAIP

SEQ ID NO: 360549 - protein, 19 aa, Mycobacterium
LAWTPIAIAWFATHVPTVA

SEQ ID NO: 360550 - protein, 27 aa, Mycobacterium
LAYAGFLLPAILAALARFFSYPAMLTV

SEQ ID NO: 360551 - protein, 22 aa, Mycobacterium
LAYGLGLWYGVVRERNIGALKP

SEQ ID NO: 360552 - protein, 26 aa, Mycobacterium
LAYGLGWRPRLLVAMLVATALALVGT

SEQ ID NO: 360553 - protein, 23 aa, Mycobacterium
LAYGRPWTWIALAAAVVALLAAV

SEQ ID NO: 360554 - protein, 20 aa, Mycobacterium
LAYLAIIGVPPFAGFFSKDA

SEQ ID NO: 360555 - protein, 25 aa, Mycobacterium
LAYLGIFFVVPFYSLARTSLSETAG

SEQ ID NO: 360556 - protein, 17 aa, Mycobacterium
LAYNLHLNLWVGALLAL

SEQ ID NO: 360557 - protein, 25 aa, Mycobacterium
LAYVAIFSLPLAQRKFFLDPSNLAT

SEQ ID NO: 360558 - protein, 20 aa, Mycobacterium
LAYVLLVLVSRRRWQPRLMV

SEQ ID NO: 360559 - protein, 25 aa, Mycobacterium
LAYVVIFSLPLARKQFLLDPSNVTV

SEQ ID NO: 360560 - protein, 26 aa, Mycobacterium
LCAAMLVYFVLLGRIAVALIGSGRAA

SEQ ID NO: 360561 - protein, 33 aa, Mycobacterium
LCAQYLAPVLDAIKFNYFPFGLNAFNTAEVLPK

SEQ ID NO: 360562 - protein, 28 aa, Mycobacterium
LCAVVALALFLWWEGRTPAPMLSLRLVT

SEQ ID NO: 360563 - protein, 26 aa, Mycobacterium
LCCLGVFCAFILYFALYSRHQLVANS

SEQ ID NO: 360564 - protein, 21 aa, Mycobacterium
LCEEILYRGLLWGALERRWGQ

SEQ ID NO: 360565 - protein, 17 aa, Mycobacterium
LCFQAARLQLLRGHAGA

SEQ ID NO: 360566 - protein, 25 aa, Mycobacterium
LCGFLPSVWLALVFGWGLAGIWCGL

SEQ ID NO: 360567 - protein, 24 aa, Mycobacterium
LCGGPFFLWLLRRDARRADTGAAW

SEQ ID NO: 360568 - protein, 18 aa, Mycobacterium
LCGIGIFALVIFATGLPL

SEQ ID NO: 360569 - protein, 45 aa, Mycobacterium
LCGIVGPIFLVIYFATGADPLLAWMFWTGLLITAADVLIALAITG

SEQ ID NO: 360570 - protein, 25 aa, Mycobacterium
LCGLFPLAAAPLVPVGLRPPDAEDR

SEQ ID NO: 360571 - protein, 20 aa, Mycobacterium
LCGLLIAFFADPLSSLTGLT

SEQ ID NO: 360572 - protein, 22 aa, Mycobacterium
LCGVSWVYHYAVAVYRDDRGCG

SEQ ID NO: 360573 - protein, 23 aa, Mycobacterium
LCGYLLLRRSLGRAAGPLIGPDV

SEQ ID NO: 360574 - protein, 17 aa, Mycobacterium
LCIGFVWTVFHAEEAAR

SEQ ID NO: 360575 - protein, 19 aa, Mycobacterium
LCIPLLLAAFWLGNGAAIY

SEQ ID NO: 360576 - protein, 19 aa, Mycobacterium
LCLGGQMLFYGFAKLIPTQ

SEQ ID NO: 360577 - protein, 21 aa, Mycobacterium
LCLIFGIMLIMTRSFVAALVI

SEQ ID NO: 360578 - protein, 19 aa, Mycobacterium
LCLPALWAIRHRTIETRSG

SEQ ID NO: 360579 - protein, 25 aa, Mycobacterium
LCPQNLDYLISFFGALYSGRIAVPL

SEQ ID NO: 360580 - protein, 24 aa, Mycobacterium
LCRDPRGYVPLGSNPWRGPPVPVG

SEQ ID NO: 360581 - protein, 23 aa, Mycobacterium
LCRLVRLLLWLSVIPVIECSLGG

SEQ ID NO: 360582 - protein, 20 aa, Mycobacterium
LCRPVFAYLAAWVVALVAVH

SEQ ID NO: 360583 - protein, 17 aa, Mycobacterium
LCTGIPLLLAMWAFLIR

SEQ ID NO: 360584 - protein, 18 aa, Mycobacterium
LCVAYLVVVIGFVAFHLV

SEQ ID NO: 360585 - protein, 27 aa, Mycobacterium
LCVVTVGLMRLLLPKGRPSLSARLVFA

SEQ ID NO: 360586 - protein, 22 aa, Mycobacterium
LCVYVLILRFTAAQLVKAAFEM

SEQ ID NO: 360587 - protein, 17 aa, Mycobacterium
LCWAALVVSVPYGNLYI

SEQ ID NO: 360588 - protein, 19 aa, Mycobacterium
LDAAFKEILRMYAPAGTLF

SEQ ID NO: 360589 - protein, 18 aa, Mycobacterium
LDAAFKESLRMYAPAGTL

SEQ ID NO: 360590 - protein, 21 aa, Mycobacterium
LDAAPAVLPPMGPKLGLKAQK

SEQ ID NO: 360591 - protein, 21 aa, Mycobacterium
LDAAPAVLPPMGPKLGLKAQR

SEQ ID NO: 360592 - protein, 32 aa, Mycobacterium
LDAAPLVTLYRQYVARFGLGYTVTRGHHLEVA

SEQ ID NO: 360593 - protein, 18 aa, Mycobacterium
LDACWPASSLLIAMASWS

SEQ ID NO: 360594 - protein, 17 aa, Mycobacterium
LDALRRARRGHFAGRRG

SEQ ID NO: 360595 - protein, 22 aa, Mycobacterium
LDAMIFLIVLPFMLMWPFWLAA

SEQ ID NO: 360596 - protein, 26 aa, Mycobacterium
LDANIPYFPNLVLPITIGGLGIGMIV

SEQ ID NO: 360597 - protein, 22 aa, Mycobacterium
LDAPINWFPLYLGAAVVVELVA

SEQ ID NO: 360598 - protein, 23 aa, Mycobacterium
LDARHPFLVMELIEGGTLRELLA

SEQ ID NO: 360599 - protein, 24 aa, Mycobacterium
LDARHPFLVMELIEGGTLRELLSE

SEQ ID NO: 360600 - protein, 17 aa, Mycobacterium
LDASPKRAAVTAGLAVL

SEQ ID NO: 360601 - protein, 23 aa, Mycobacterium
LDATVVRMFLVPSVMKLLGDDCW

SEQ ID NO: 360602 - protein, 24 aa, Mycobacterium
LDATVVRMFLVPSVMKLLGDDCWW

SEQ ID NO: 360603 - protein, 21 aa, Mycobacterium
LDAVWLAKLTEKGLLRPSFVP

SEQ ID NO: 360604 - protein, 25 aa, Mycobacterium
LDDDDFAYLIDFGIARAPGELGLTA

SEQ ID NO: 360605 - protein, 24 aa, Mycobacterium
LDDGYGETFLIVDNLYAFSRDNTD

SEQ ID NO: 360606 - protein, 26 aa, Mycobacterium
LDDPAVTTTLRWFAGRIPAFGTERIG

SEQ ID NO: 360607 - protein, 23 aa, Mycobacterium
LDDPFLVQYLRYLGGLLHGDLGR

SEQ ID NO: 360608 - protein, 20 aa, Mycobacterium
LDDPWRDPGAAAALGTPAVA

SEQ ID NO: 360609 - protein, 25 aa, Mycobacterium
LDEGEQLWRRVQSAVSMLLGGNLGE

SEQ ID NO: 360610 - protein, 18 aa, Mycobacterium
LDEGLLSVLPQLTAKHRV

SEQ ID NO: 360611 - protein, 17 aa, Mycobacterium
LDELLREMQQHRKHMAL

SEQ ID NO: 360612 - protein, 18 aa, Mycobacterium
LDELLRWLNSDNKRWQRL

SEQ ID NO: 360613 - protein, 19 aa, Mycobacterium
LDERRYALVSLTQIVPLLL

SEQ ID NO: 360614 - protein, 20 aa, Mycobacterium
LDEWDWVKWIPHFGDPRRQD

SEQ ID NO: 360615 - protein, 23 aa, Mycobacterium
LDEYIGFLVAWQKPFTGKKSMMD

SEQ ID NO: 360616 - protein, 24 aa, Mycobacterium
LDEYIKFLVTWQRPLVGKKTMMDL

SEQ ID NO: 360617 - protein, 24 aa, Mycobacterium
LDFFVSLAFMPLSFAIVGPLSKVV

SEQ ID NO: 360618 - protein, 17 aa, Mycobacterium
LDFNVLVTATINFVLIA

SEQ ID NO: 360619 - protein, 18 aa, Mycobacterium
LDFRTLFTKAEDPETDFA

SEQ ID NO: 360620 - protein, 25 aa, Mycobacterium
LDFVLIAMFLVLTIDTYRSRPDRRG

SEQ ID NO: 360621 - protein, 23 aa, Mycobacterium
LDGGELFVVGRRKEMLIVRGRNF

SEQ ID NO: 360622 - protein, 26 aa, Mycobacterium
LDGLGLRGWGSLRLAMPLGDDSDASF

SEQ ID NO: 360623 - protein, 25 aa, Mycobacterium
LDGLRPYFTGYLPAVVLAGILTPAA

SEQ ID NO: 360624 - protein, 30 aa, Mycobacterium
LDGLRVYFTAYLPSLLLAVLLTPTTAAVIA

SEQ ID NO: 360625 - protein, 25 aa, Mycobacterium
LDGRHPFLVMELIEGGTLRELLRER

SEQ ID NO: 360626 - protein, 24 aa, Mycobacterium
LDGRPFEMIKFRTMVDGADGMLGK

SEQ ID NO: 360627 - protein, 24 aa, Mycobacterium
LDGVGLPGWGSLRLALPSSGNADA

SEQ ID NO: 360628 - protein, 23 aa, Mycobacterium
LDGVWAQLMPDYTRPRVEIFTNG

SEQ ID NO: 360629 - protein, 26 aa, Mycobacterium
LDGWSMPILIQEIFASLRGQRLRPAA

SEQ ID NO: 360630 - protein, 22 aa, Mycobacterium
LDHGYTYGMLWIAGTAVLVGVA

SEQ ID NO: 360631 - protein, 17 aa, Mycobacterium
LDHLAARLRRNSANLLV

SEQ ID NO: 360632 - protein, 23 aa, Mycobacterium
LDIFALLAIPFFILGGEIMAAGG

SEQ ID NO: 360633 - protein, 22 aa, Mycobacterium
LDIGLFKVMPFTSSILANFLSI

SEQ ID NO: 360634 - protein, 25 aa, Mycobacterium
LDIGRLRWQFDRIARTIPVSAPWDA

SEQ ID NO: 360635 - protein, 30 aa, Mycobacterium
LDIGSFISAIIYFVVFMTAVYFMIVVPYKH

SEQ ID NO: 360636 - protein, 19 aa, Mycobacterium
LDIGVIAVAFIAAVSGWRS

SEQ ID NO: 360637 - protein, 19 aa, Mycobacterium
LDIIILVIAILSTLPAAAT

SEQ ID NO: 360638 - protein, 25 aa, Mycobacterium
LDIVGDGWWRQRLVDHVRRLGIPDA

SEQ ID NO: 360639 - protein, 18 aa, Mycobacterium
LDIWRRPDLDPTGKAPVL

SEQ ID NO: 360640 - protein, 37 aa, Mycobacterium
LDKPPVWASWLRIVLGTALIIFGVYRWLNRSKAAHTP

SEQ ID NO: 360641 - protein, 18 aa, Mycobacterium
LDKYSPSFFCMMRNYHDV

SEQ ID NO: 360642 - protein, 21 aa, Mycobacterium
LDLALLLVFGLLGLMMRRFGL

SEQ ID NO: 360643 - protein, 17 aa, Mycobacterium
LDLIAGIPTLRALGRAS

SEQ ID NO: 360644 - protein, 24 aa, Mycobacterium
LDLRQWWTRVAWLAQRPVLIPGTV

SEQ ID NO: 360645 - protein, 27 aa, Mycobacterium
LDLTANPLRFLARAFNLWNSDLPFGQA

SEQ ID NO: 360646 - protein, 19 aa, Mycobacterium
LDLTGCMALGITGPVLRAT

SEQ ID NO: 360647 - protein, 17 aa, Mycobacterium
LDLTIRLAEVMLSSGSG

SEQ ID NO: 360648 - protein, 18 aa, Mycobacterium
LDLVVFGVAVVIGAGIFT

SEQ ID NO: 360649 - protein, 29 aa, Mycobacterium
LDMPWTQWLTWIFQAVPVFFFVAGYAGAV

SEQ ID NO: 360650 - protein, 17 aa, Mycobacterium
LDMRLIEGTHLALLLER

SEQ ID NO: 360651 - protein, 17 aa, Mycobacterium
LDNARFLLPVVGVPPDK

SEQ ID NO: 360652 - protein, 30 aa, Mycobacterium
LDPAAAVQAPWPLLRTFAAGPALSREAALV

SEQ ID NO: 360653 - protein, 20 aa, Mycobacterium
LDPFDLAARWGGDEFLVITR

SEQ ID NO: 360654 - protein, 25 aa, Mycobacterium
LDPLIRLESLYRYLRKFHALSERRY

SEQ ID NO: 360655 - protein, 19 aa, Mycobacterium
LDPLPRWVRPDVLSSGDLV

SEQ ID NO: 360656 - protein, 17 aa, Mycobacterium
LDPPPLRQRLGIAAAGF

SEQ ID NO: 360657 - protein, 17 aa, Mycobacterium
LDPWAIAVFAAVVSGAW

SEQ ID NO: 360658 - protein, 17 aa, Mycobacterium
LDQLSGLPTLAELPGRR

SEQ ID NO: 360659 - protein, 26 aa, Mycobacterium
LDQVQLVLMYLYITLRGAIAMVTLVA

SEQ ID NO: 360660 - protein, 23 aa, Mycobacterium
LDRDRLVAELPRLAAIPFSSERQ

SEQ ID NO: 360661 - protein, 19 aa, Mycobacterium
LDREIVVTRYLTVPAEDAT

SEQ ID NO: 360662 - protein, 25 aa, Mycobacterium
LDRGYTYGLLWLAGVVVLLGAVALL

SEQ ID NO: 360663 - protein, 20 aa, Mycobacterium
LDRLFDRFYRADAARDRQHG

SEQ ID NO: 360664 - protein, 22 aa, Mycobacterium
LDRLHVRYDLSWQALDGALARR

SEQ ID NO: 360665 - protein, 30 aa, Mycobacterium
LDRLRGQGPPAHPVWLPPLGAAPELSALLR

SEQ ID NO: 360666 - protein, 33 aa, Mycobacterium
LDRLRGQGPPAHRVWLPPLGPAPQLHTLLHSAE

SEQ ID NO: 360667 - protein, 20 aa, Mycobacterium
LDRLTLFITGIWLVCIIGMA

SEQ ID NO: 360668 - protein, 24 aa, Mycobacterium
LDRSAWWGRLAWMPHRPVLVPGTV

SEQ ID NO: 360669 - protein, 26 aa, Mycobacterium
LDRTLVLWMLPLLIAPPMYSKDVYSY

SEQ ID NO: 360670 - protein, 20 aa, Mycobacterium
LDRYLPLWIGLAMAAGLLLG

SEQ ID NO: 360671 - protein, 24 aa, Mycobacterium
LDSAGSWLFGIYGAAAALALLGAF

SEQ ID NO: 360672 - protein, 24 aa, Mycobacterium
LDSDGFLFYHGRSDDMFKVSGATV

SEQ ID NO: 360673 - protein, 26 aa, Mycobacterium
LDSELAWRLPFLLSSVLIVAGMIIRL

SEQ ID NO: 360674 - protein, 37 aa, Mycobacterium
LDSHILLSVVLPPLLYSAALNFSFPTFLRHIRPILGL

SEQ ID NO: 360675 - protein, 27 aa, Mycobacterium
LDSLDVRPLLRRILWGVPRQPASFQQW

SEQ ID NO: 360676 - protein, 25 aa, Mycobacterium
LDSMVGYRSPRYLRFGWAAARLDDV

SEQ ID NO: 360677 - protein, 19 aa, Mycobacterium
LDSPTLRRWLRSYRTALNS

SEQ ID NO: 360678 - protein, 26 aa, Mycobacterium
LDTARIAFGWIRRPAAPGRLVVIADH

SEQ ID NO: 360679 - protein, 26 aa, Mycobacterium
LDTARPADLLVLLDSLRQREGTLRSE

SEQ ID NO: 360680 - protein, 17 aa, Mycobacterium
LDTFVVRTLVIPALFTL

SEQ ID NO: 360681 - protein, 22 aa, Mycobacterium
LDTLMPQMLLQFPPMIAMLENS

SEQ ID NO: 360682 - protein, 30 aa, Mycobacterium
LDTQTPLSFIFYWVVPFALLGVAALLTRIL

SEQ ID NO: 360683 - protein, 23 aa, Mycobacterium
LDTSAMLLFAYAAGHGSLAVAAV

SEQ ID NO: 360684 - protein, 28 aa, Mycobacterium
LDTVSVVGWLWPLWDSGRRTFADVLLRT

SEQ ID NO: 360685 - protein, 19 aa, Mycobacterium
LDVITFPFDPETLKIVLDE

SEQ ID NO: 360686 - protein, 35 aa, Mycobacterium
LDVKLGLMCLVAFPVLVLLVWWFQRESSKTYREVR

SEQ ID NO: 360687 - protein, 17 aa, Mycobacterium
LDVLLFYVFFEAMLIPM

SEQ ID NO: 360688 - protein, 30 aa, Mycobacterium
LDVLLFYVFFEAMLIPMYFLIGGFGGGAGR

SEQ ID NO: 360689 - protein, 30 aa, Mycobacterium
LDVLLFYVFFEAMLIPMYFLIGGFGQGPGR

SEQ ID NO: 360690 - protein, 25 aa, Mycobacterium
LDVVHAVVRFPVSLVTFSVVVSWWA

SEQ ID NO: 360691 - protein, 17 aa, Mycobacterium
LDWMIFGKNWFDGWGGL

SEQ ID NO: 360692 - protein, 19 aa, Mycobacterium
LDWRLGLMCLAAFPILVAL

SEQ ID NO: 360693 - protein, 18 aa, Mycobacterium
LEALLPPEQRARPGARAT

SEQ ID NO: 360694 - protein, 20 aa, Mycobacterium
LEALTYLELAWLTVGIETFA

SEQ ID NO: 360695 - protein, 19 aa, Mycobacterium
LEARPLRMAFLLGAAMLID

SEQ ID NO: 360696 - protein, 23 aa, Mycobacterium
LEATPPFFQWLAEFEPMHQVFLG

SEQ ID NO: 360697 - protein, 27 aa, Mycobacterium
LEAYAVVSLILFVNWIRVLVAHRYESE

SEQ ID NO: 360698 - protein, 27 aa, Mycobacterium
LEDIIRFQAEFLWRDYFQPGITVDGEE

SEQ ID NO: 360699 - protein, 31 aa, Mycobacterium
LEDIVRFQAEFLWRDYFPRGLTDDGDEAPAL

SEQ ID NO: 360700 - protein, 31 aa, Mycobacterium
LEDIVRFQAEFLWRDYFPRGLTDDGEEAPAL

SEQ ID NO: 360701 - protein, 21 aa, Mycobacterium
LEDPNPPLPWWPWQIGPTPRV

SEQ ID NO: 360702 - protein, 22 aa, Mycobacterium
LEDQFWYRSTRYVLRHAIPIGL

SEQ ID NO: 360703 - protein, 22 aa, Mycobacterium
LEDWRDNLRWPPASALVSAEEA

SEQ ID NO: 360704 - protein, 17 aa, Mycobacterium
LEELLSDPVLRDQLGAK

SEQ ID NO: 360705 - protein, 19 aa, Mycobacterium
LEETPLAHVLPDDPAPYAG

SEQ ID NO: 360706 - protein, 17 aa, Mycobacterium
LEFQINLALPLHASRLA

SEQ ID NO: 360707 - protein, 20 aa, Mycobacterium
LEFWAALVKVLALVVFLVVG

SEQ ID NO: 360708 - protein, 24 aa, Mycobacterium
LEFWGLTNNVPLTLPVLHGLTPTA

SEQ ID NO: 360709 - protein, 18 aa, Mycobacterium
LEGFRPGVADRLGVGYRA

SEQ ID NO: 360710 - protein, 25 aa, Mycobacterium
LEGSDWSWLKWLPHVDIPGQADGVG

SEQ ID NO: 360711 - protein, 24 aa, Mycobacterium
LEGSPPPKPPPPPPPGRGGGGPSG

SEQ ID NO: 360712 - protein, 17 aa, Mycobacterium
LEHCYAYSDSITDIPML

SEQ ID NO: 360713 - protein, 17 aa, Mycobacterium
LEHCYAYSDSITDLPML

SEQ ID NO: 360714 - protein, 34 aa, Mycobacterium
LEHFHWGAVFLVAVPILLPLLVLGPRLVPESRDP

SEQ ID NO: 360715 - protein, 37 aa, Mycobacterium
LEHFYWARQRARRALLFWVIAVITLAGLAAAGAWTLG

SEQ ID NO: 360716 - protein, 17 aa, Mycobacterium
LEHVARLALLARAERDG

SEQ ID NO: 360717 - protein, 39 aa, Mycobacterium
LEIARGFLVIALPVGVVVLVVLRWLARKVVVTVRRKYGR

SEQ ID NO: 360718 - protein, 17 aa, Mycobacterium
LEIGGAWLVWQGFREHR

SEQ ID NO: 360719 - protein, 20 aa, Mycobacterium
LEILLAYTVPLLIMIVVAAA

SEQ ID NO: 360720 - protein, 21 aa, Mycobacterium
LEKWLGLTRFGVLYALSGLGG

SEQ ID NO: 360721 - protein, 29 aa, Mycobacterium
LELALTVTPFLIISVLFYFTVVVQEKMLH

SEQ ID NO: 360722 - protein, 17 aa, Mycobacterium
LELILDDAIDYSDETTE

SEQ ID NO: 360723 - protein, 17 aa, Mycobacterium
LEMPLSMRDGLGLRLEL

SEQ ID NO: 360724 - protein, 25 aa, Mycobacterium
LENFDDWFRPIKNYFYWEKHCFDIP

SEQ ID NO: 360725 - protein, 20 aa, Mycobacterium
LEPARWWAQLSWLPQRPVLV

SEQ ID NO: 360726 - protein, 30 aa, Mycobacterium
LEPGDRTLLLYPPGLPFVAAFLGCLAAGVV

SEQ ID NO: 360727 - protein, 17 aa, Mycobacterium
LEPLFPTPPLPMKPLAQ

SEQ ID NO: 360728 - protein, 31 aa, Mycobacterium
LEPLHTLVVVALFPMLVLAVWRAPTQAHWPP

SEQ ID NO: 360729 - protein, 27 aa, Mycobacterium
LEPLTTTFLLPLFFVYSGLNTEIGLVN

SEQ ID NO: 360730 - protein, 18 aa, Mycobacterium
LEPNLTYRIALRTTSSAE

SEQ ID NO: 360731 - protein, 24 aa, Mycobacterium
LEPYLLLFTLFLAPAEHWLGQLRW

SEQ ID NO: 360732 - protein, 17 aa, Mycobacterium
LEQALVDLRPGVLCAIA

SEQ ID NO: 360733 - protein, 17 aa, Mycobacterium
LEQFPGGMPLDAAAPII

SEQ ID NO: 360734 - protein, 24 aa, Mycobacterium
LEQKLWLTEISVAGFPIPGLDGLF

SEQ ID NO: 360735 - protein, 26 aa, Mycobacterium
LEQLHYRHELLYYKVLENHLPELMPV

SEQ ID NO: 360736 - protein, 29 aa, Mycobacterium
LEQLHYRHELLYYKVLIDHLPELMPVVYT

SEQ ID NO: 360737 - protein, 24 aa, Mycobacterium
LERDFYTPPGVPPLPALTLVERDA

SEQ ID NO: 360738 - protein, 17 aa, Mycobacterium
LERHFPISQSIPQYILI

SEQ ID NO: 360739 - protein, 21 aa, Mycobacterium
LERQWRARMAGLRTNALVATG

SEQ ID NO: 360740 - protein, 20 aa, Mycobacterium
LERYDDTLFLILKTVNYVEH

SEQ ID NO: 360741 - protein, 19 aa, Mycobacterium
LERYDGTLFLVLKTVTYVE

SEQ ID NO: 360742 - protein, 20 aa, Mycobacterium
LESALLLVLVILNPIKFTRS

SEQ ID NO: 360743 - protein, 25 aa, Mycobacterium
LESGQWSWLKWLPHVDIPGQADGVG

SEQ ID NO: 360744 - protein, 24 aa, Mycobacterium
LESIAIRPIPYLVTTRLIASVVAI

SEQ ID NO: 360745 - protein, 23 aa, Mycobacterium
LESLAIRPIPFLVTTRLMASVIA

SEQ ID NO: 360746 - protein, 22 aa, Mycobacterium
LESRSFLLGEDWFDQDESSEIH

SEQ ID NO: 360747 - protein, 27 aa, Mycobacterium
LESYHKAWLGTVAVVVVAVLVGALLLI

SEQ ID NO: 360748 - protein, 26 aa, Mycobacterium
LETAVVIGVVWTWFRGQGGDAVSGVT

SEQ ID NO: 360749 - protein, 24 aa, Mycobacterium
LETRRRPFGSVVIAAAGVLGCIAV

SEQ ID NO: 360750 - protein, 27 aa, Mycobacterium
LEVDVILWCTGFRHALDHLAPLHLRNG

SEQ ID NO: 360751 - protein, 30 aa, Mycobacterium
LEVGGRALLFLPPAWLLGTAMLGLSKILDN

SEQ ID NO: 360752 - protein, 24 aa, Mycobacterium
LEVGQVFAGYTILRVLGAGGMGHV

SEQ ID NO: 360753 - protein, 25 aa, Mycobacterium
LEVLKRCFAGRYRSWLPTLEEMVPS

SEQ ID NO: 360754 - protein, 25 aa, Mycobacterium
LEVNTLFQSLMDLLHKIDPVELNGT

SEQ ID NO: 360755 - protein, 20 aa, Mycobacterium
LEVYLGFFAGFLMYLASADI

SEQ ID NO: 360756 - protein, 17 aa, Mycobacterium
LEWAMQLGGDSVSRRIR

SEQ ID NO: 360757 - protein, 26 aa, Mycobacterium
LEWDPYPFILLNLAFSTQAAYAAPLI

SEQ ID NO: 360758 - protein, 21 aa, Mycobacterium
LEWIGQWGIFDALRSGTEVVR

SEQ ID NO: 360759 - protein, 27 aa, Mycobacterium
LEYTAPLLVVGWLWATTRHRPSGMTLA

SEQ ID NO: 360760 - protein, 19 aa, Mycobacterium
LEYYDFFVYVALTGTLTEL

SEQ ID NO: 360761 - protein, 17 aa, Mycobacterium
LEYYDMFIYASAATLVF

SEQ ID NO: 360762 - protein, 26 aa, Mycobacterium
LFADQIVWIFLIIAAGYMVITLTIGL

SEQ ID NO: 360763 - protein, 20 aa, Mycobacterium
LFAEQFGWRGPFWTWIGGLD

SEQ ID NO: 360764 - protein, 18 aa, Mycobacterium
LFAIAVGSSVLVVDEIGK

SEQ ID NO: 360765 - protein, 19 aa, Mycobacterium
LFAPVHFFAQPVVTLIGLG

SEQ ID NO: 360766 - protein, 18 aa, Mycobacterium
LFATVGILAALRARDRSG

SEQ ID NO: 360767 - protein, 18 aa, Mycobacterium
LFATVIVPFFAIYLAWQM

SEQ ID NO: 360768 - protein, 31 aa, Mycobacterium
LFAVEVALFAALQRWGLQPDFVMGHSVGELS

SEQ ID NO: 360769 - protein, 28 aa, Mycobacterium
LFAVHVTSNTFWLLQSLMGQSTRGALKT

SEQ ID NO: 360770 - protein, 27 aa, Mycobacterium
LFAVKLRWDPYPFILLNLAFSTQASYA

SEQ ID NO: 360771 - protein, 19 aa, Mycobacterium
LFAVLAIAGLPILAGGRTG

SEQ ID NO: 360772 - protein, 17 aa, Mycobacterium
LFCLLAPVAVIPVAIPD

SEQ ID NO: 360773 - protein, 33 aa, Mycobacterium
LFCNSPFCWIGGFAFGLLATLLAGSTLVCSNAD

SEQ ID NO: 360774 - protein, 19 aa, Mycobacterium
LFCTLVLIAVLSWGAGRIN

SEQ ID NO: 360775 - protein, 18 aa, Mycobacterium
LFCVAILVGLGAGLGAVA

SEQ ID NO: 360776 - protein, 18 aa, Mycobacterium
LFCVHPASGLSWQFAGLK

SEQ ID NO: 360777 - protein, 19 aa, Mycobacterium
LFCWGFLLLVFTGGGSLSI

SEQ ID NO: 360778 - protein, 17 aa, Mycobacterium
LFDACGFRRLVFATPEE

SEQ ID NO: 360779 - protein, 18 aa, Mycobacterium
LFDDLKPMPATQFKEVIV

SEQ ID NO: 360780 - protein, 46 aa, Mycobacterium
LFDKEPLLIWTLIASLFIGNFLLLALNLPLAPLWAKLLRTPRPYLY

SEQ ID NO: 360781 - protein, 34 aa, Mycobacterium
LFDLAIVVLPMLRPLRLLRLVTLIAVLQRVAGNA

SEQ ID NO: 360782 - protein, 27 aa, Mycobacterium
LFDLSFAFAVLLITSPLLLITAIAIKA

SEQ ID NO: 360783 - protein, 31 aa, Mycobacterium
LFDRDTWVISLLYVCTFGSWIGFSFAFGQVL

SEQ ID NO: 360784 - protein, 18 aa, Mycobacterium
LFDRVQGPWLLGALLLGI

SEQ ID NO: 360785 - protein, 21 aa, Mycobacterium
LFDTAVLHRLPVTTWDVRCAP

SEQ ID NO: 360786 - protein, 26 aa, Mycobacterium
LFEKEPLLIWTLIASLFIGNFLLLVL

SEQ ID NO: 360787 - protein, 21 aa, Mycobacterium
LFFDTSALIIAFVVLGRYFEA

SEQ ID NO: 360788 - protein, 18 aa, Mycobacterium
LFFSVLAGDRFLSAGNFS

SEQ ID NO: 360789 - protein, 18 aa, Mycobacterium
LFFTAPTPALVAFLVVWG

SEQ ID NO: 360790 - protein, 30 aa, Mycobacterium
LFGAAAYLMWGLFPAFFPLLEPAGALEILA

SEQ ID NO: 360791 - protein, 18 aa, Mycobacterium
LFGAELWEWVNPNNVVRS

SEQ ID NO: 360792 - protein, 27 aa, Mycobacterium
LFGASWAGWLAFAATVPVQFVAGWPFL

SEQ ID NO: 360793 - protein, 17 aa, Mycobacterium
LFGCWRGMYFTTLLRRR

SEQ ID NO: 360794 - protein, 17 aa, Mycobacterium
LFGDADHPGLLGANIYW

SEQ ID NO: 360795 - protein, 17 aa, Mycobacterium
LFGERLWQWVDPNNVAS

SEQ ID NO: 360796 - protein, 20 aa, Mycobacterium
LFGFSPWSMLVPQAVIGVAA

SEQ ID NO: 360797 - protein, 18 aa, Mycobacterium
LFGFSWADHVVALIIAGA

SEQ ID NO: 360798 - protein, 39 aa, Mycobacterium
LFGGAWAGWLAFAATVPVQFVAGWPFLVGAVQQARAGSA

SEQ ID NO: 360799 - protein, 18 aa, Mycobacterium
LFGGFMFAFAIKAPLWPL

SEQ ID NO: 360800 - protein, 18 aa, Mycobacterium
LFGGLIGAVWIGSGANAV

SEQ ID NO: 360801 - protein, 26 aa, Mycobacterium
LFGITDGWWVYLAAYALFIGIHLAGV

SEQ ID NO: 360802 - protein, 26 aa, Mycobacterium
LFGITNGWWVYLAAYAFFIGIHLSGV

SEQ ID NO: 360803 - protein, 20 aa, Mycobacterium
LFGLLIAWVLVRDDFVGKRL

SEQ ID NO: 360804 - protein, 19 aa, Mycobacterium
LFGMSPWSVLAPQAVMGVA

SEQ ID NO: 360805 - protein, 17 aa, Mycobacterium
LFGPMARFFYDAGIIKG

SEQ ID NO: 360806 - protein, 20 aa, Mycobacterium
LFGPNLLATRRPVSNFMLLV

SEQ ID NO: 360807 - protein, 28 aa, Mycobacterium
LFGRKMIFGVAILFFLAGSVLCGIASTM

SEQ ID NO: 360808 - protein, 24 aa, Mycobacterium
LFGRNVMFLAVLFAVGMNAYVYFN

SEQ ID NO: 360809 - protein, 21 aa, Mycobacterium
LFGRTAMFLAVLFAVGMNIYT

SEQ ID NO: 360810 - protein, 17 aa, Mycobacterium
LFGTSRPGPLPAGRGVL

SEQ ID NO: 360811 - protein, 17 aa, Mycobacterium
LFGVELWDWVNPNNVIR

SEQ ID NO: 360812 - protein, 36 aa, Mycobacterium; identical to SEQ ID NO: 20914

SEQ ID NO: 360813 - protein, 37 aa, Mycobacterium
LFGVLAFLLLPILVVVWLSLYRWDLLGPLRFVGLANW

SEQ ID NO: 360814 - protein, 24 aa, Mycobacterium
LFIGLMLFGLIWLLVFQLAATNPI

SEQ ID NO: 360815 - protein, 17 aa, Mycobacterium
LFILTLAIYLVATVATA

SEQ ID NO: 360816 - protein, 23 aa, Mycobacterium
LFINFVYIWYVGGLAYLAYRIFN

SEQ ID NO: 360817 - protein, 25 aa, Mycobacterium
LFISSIICALFGFIWDVSLHIGNGR

SEQ ID NO: 360818 - protein, 19 aa, Mycobacterium
LFITFFVLHVLVVWSAIYL

SEQ ID NO: 360819 - protein, 17 aa, Mycobacterium
LFKIILPLSLPALSTLA

SEQ ID NO: 360820 - protein, 19 aa, Mycobacterium
LFLAALAFPVSVAAGCRCR

SEQ ID NO: 360821 - protein, 20 aa, Mycobacterium
LFLAKTVYSALLALLVGIEC

SEQ ID NO: 360822 - protein, 18 aa, Mycobacterium
LFLGFMFAFAVKAPLWPL

SEQ ID NO: 360823 - protein, 17 aa, Mycobacterium
LFLLTLAVYLVATVATA

SEQ ID NO: 360824 - protein, 20 aa, Mycobacterium
LFLTKTVYSALLALLVGIEC

SEQ ID NO: 360825 - protein, 20 aa, Mycobacterium
LFLTKTVYSVLLALLVGIEC

SEQ ID NO: 360826 - protein, 19 aa, Mycobacterium
LFLTLLGVSGIGPSIALGA

SEQ ID NO: 360827 - protein, 24 aa, Mycobacterium
LFLVATLVFAPRGWVAICAFAMVV

SEQ ID NO: 360828 - protein, 24 aa, Mycobacterium
LFLVLALFTLFSGTPVALADSASA

SEQ ID NO: 360829 - protein, 19 aa, Mycobacterium
LFMGPQGQLWSFRIATIVC

SEQ ID NO: 360830 - protein, 21 aa, Mycobacterium
LFNGTFRSFVPLTLTSDRSGL

SEQ ID NO: 360831 - protein, 20 aa, Mycobacterium
LFPTLNYAVSVAEACERADA

SEQ ID NO: 360832 - protein, 17 aa, Mycobacterium
LFQGALINAWQTQAGLI

SEQ ID NO: 360833 - protein, 24 aa, Mycobacterium
LFRMSLKDTRWWLGGMAAVTNYSL

SEQ ID NO: 360834 - protein, 17 aa, Mycobacterium
LFRRCRRVVLVAAIVDG

SEQ ID NO: 360835 - protein, 25 aa, Mycobacterium
LFRYIAKRLLLAIPVLIGTSLLIYS

SEQ ID NO: 360836 - protein, 27 aa, Mycobacterium
LFSAIPTFWLGLVVLQIFSVQLGLFSL

SEQ ID NO: 360837 - protein, 18 aa, Mycobacterium
LFSAPPAWAIDPPVIDAG

SEQ ID NO: 360838 - protein, 30 aa, Mycobacterium
LFSGRRWVTTLGAFILALAPGWFGVLAAIQ

SEQ ID NO: 360839 - protein, 25 aa, Mycobacterium
LFSGRRWVTVLGAFILALAPGWLGV

SEQ ID NO: 360840 - protein, 18 aa, Mycobacterium
LFSLGRFGIVVNVLAVLY

SEQ ID NO: 360841 - protein, 18 aa, Mycobacterium
LFSVVQLLFFMTPIIWND

SEQ ID NO: 360842 - protein, 19 aa, Mycobacterium
LFSVVQLLFFMTPIIWNDD

SEQ ID NO: 360843 - protein, 22 aa, Mycobacterium
LFTADPLFLIAIRNTVIFTLGT

SEQ ID NO: 360844 - protein, 31 aa, Mycobacterium
LFTAVIQPPLILFFTVPGAYWLFHGSKIGKF

SEQ ID NO: 360845 - protein, 31 aa, Mycobacterium
LFTDHLGWRWAFYINLPISVVVIMVAAGAIP

SEQ ID NO: 360846 - protein, 18 aa, Mycobacterium
LFTGGRYVTGLAREALTE

SEQ ID NO: 360847 - protein, 18 aa, Mycobacterium
LFTLGIVVLYRVGAALPS

SEQ ID NO: 360848 - protein, 18 aa, Mycobacterium
LFTLGIVVLYRVGASLPS

SEQ ID NO: 360849 - protein, 31 aa, Mycobacterium
LFTLLYGLYDPMYIPKIFFAVGFSGAVVCAA

SEQ ID NO: 360850 - protein, 20 aa, Mycobacterium
LFTLVWDHLLRTFSFDPARR

SEQ ID NO: 360851 - protein, 19 aa, Mycobacterium
LFTRVVLPLVALAAGALLG

SEQ ID NO: 360852 - protein, 26 aa, Mycobacterium
LFTSTFVFIGAVVYVILAPKGREDPA

SEQ ID NO: 360853 - protein, 25 aa, Mycobacterium
LFTSTIICALFGFIWDVSLHIGQGR

SEQ ID NO: 360854 - protein, 20 aa, Mycobacterium
LFTVDPLFLIAVRNTAIFTV

SEQ ID NO: 360855 - protein, 26 aa, Mycobacterium
LFVAFLMSYFYPIFDAGLTALGRFIG

SEQ ID NO: 360856 - protein, 18 aa, Mycobacterium
LFVFTVGMVLIVAASAFF

SEQ ID NO: 360857 - protein, 24 aa, Mycobacterium
LFVMLPVVWALNNAGWHAAAQVPF

SEQ ID NO: 360858 - protein, 17 aa, Mycobacterium
LFVTYWSFRAMIGLLLV

SEQ ID NO: 360859 - protein, 25 aa, Mycobacterium
LFVVLPLVWALNALGWHAAAQVPLW

SEQ ID NO: 360860 - protein, 19 aa, Mycobacterium
LFYGKALAGAPFAATHYRR

SEQ ID NO: 360861 - protein, 21 aa, Mycobacterium
LFYHGRCDDMFKVRGATVYPA

SEQ ID NO: 360862 - protein, 24 aa, Mycobacterium
LFYVVKICLYVLGAWLVVLSTRGI

SEQ ID NO: 360863 - protein, 18 aa, Mycobacterium
LGAAIRYAAVDKDAVIVA

SEQ ID NO: 360864 - protein, 20 aa, Mycobacterium
LGAALTLWLHVVDARFARDL

SEQ ID NO: 360865 - protein, 27 aa, Mycobacterium
LGAAVMHRFIPRYSPWPRHARAESNEN

SEQ ID NO: 360866 - protein, 32 aa, Mycobacterium
LGADPLLYPFQPIHVTIAAWFTIGIPSFILSL

SEQ ID NO: 360867 - protein, 25 aa, Mycobacterium
LGAFYVLLWVGLVALSLAVGPVWRV

SEQ ID NO: 360868 - protein, 21 aa, Mycobacterium
LGAGLFFLAYSLCEVPSNLIM

SEQ ID NO: 360869 - protein, 36 aa, Mycobacterium
LGAGPVARLWRGLLLFFSRWWQLETLYRSNMKYQPE

SEQ ID NO: 360870 - protein, 35 aa, Mycobacterium
LGAGPVARLWRWLLVFFSRWWQIETLYRSNQKYQP

SEQ ID NO: 360871 - protein, 36 aa, Mycobacterium
LGAGPVARLWRWLLVFFSRWWQLETLYRSNMKYQPE

SEQ ID NO: 360872 - protein, 26 aa, Mycobacterium
LGAIAIMLLLVYRSIVTTLVQLFMTL

SEQ ID NO: 360873 - protein, 24 aa, Mycobacterium
LGAIKIWLVVYLAVTLAGALWCGP

SEQ ID NO: 360874 - protein, 24 aa, Mycobacterium
LGAINLLPLLPFDGGHIAVATYEK

SEQ ID NO: 360875 - protein, 22 aa, Mycobacterium
LGAINLLPLLPFDGGHIAVAVF

SEQ ID NO: 360876 - protein, 17 aa, Mycobacterium
LGAISVDWWATAVAGAI

SEQ ID NO: 360877 - protein, 17 aa, Mycobacterium
LGALAVIVAFMIGEVTV

SEQ ID NO: 360878 - protein, 32 aa, Mycobacterium
LGALAYSLYLWHWPLLVYWLVYTGEARVTVAE

SEQ ID NO: 360879 - protein, 25 aa, Mycobacterium
LGALFGLTVLLFAPVLIVLERLDVF

SEQ ID NO: 360880 - protein, 30 aa, Mycobacterium
LGALGFAMFTMFWTALTFLLSGAPYDFTAW

SEQ ID NO: 360881 - protein, 22 aa, Mycobacterium
LGALHLDLRLVNGKSWLVFGPY

SEQ ID NO: 360882 - protein, 18 aa, Mycobacterium
LGALITLAPFTLGLMTAF

SEQ ID NO: 360883 - protein, 23 aa, Mycobacterium
LGALLLMALPEKALAFALAAVVL

SEQ ID NO: 360884 - protein, 19 aa, Mycobacterium
LGALLRRLEPDWSMTVIER

SEQ ID NO: 360885 - protein, 18 aa, Mycobacterium
LGALLRRLQPEWSLTFVE

SEQ ID NO: 360886 - protein, 25 aa, Mycobacterium
LGALRRVQVWFTLLIGIVGFGGMFA

SEQ ID NO: 360887 - protein, 34 aa, Mycobacterium
LGALVGALVPAIRWPMWLRTLLATVALAAILSCG

SEQ ID NO: 360888 - protein, 33 aa, Mycobacterium
LGAMAYSLYLWHWPLLIFWLAYSGHAQANLAEG

SEQ ID NO: 360889 - protein, 33 aa, Mycobacterium
LGAMAYSLYLWHWPLLIFWLAYSGHTQANLAEG

SEQ ID NO: 360890 - protein, 34 aa, Mycobacterium
LGAMAYSLYLWHWPLLIFWLSFTGHRHAGFVEGS

SEQ ID NO: 360891 - protein, 34 aa, Mycobacterium
LGAMAYSLYLWHWPLLIFWLSYTGHRHANFIEGA

SEQ ID NO: 360892 - protein, 34 aa, Mycobacterium
LGAMAYSLYLWHWPLLIFWLSYTGHRQANFLEGA

SEQ ID NO: 360893 - protein, 34 aa, Mycobacterium
LGAMAYSLYLWHWPLLIFYLAYTGGTRVNFVEGA

SEQ ID NO: 360894 - protein, 20 aa, Mycobacterium
LGARSRAFWLLAASFAICGM

SEQ ID NO: 360895 - protein, 39 aa, Mycobacterium
LGASFGLSVLFWQDILGIALHWLVLPMSVIVLLAVGSDY

SEQ ID NO: 360896 - protein, 44 aa, Mycobacterium
LGASFGLSVLLWQHIIGLALHWMVLPMAVILLLAVGSDYNLLLV

SEQ ID NO: 360897 - protein, 39 aa, Mycobacterium
LGASFGLSVLLWQHIIGMPLHWLVIAMSVIVLLAVGSDY

SEQ ID NO: 360898 - protein, 40 aa, Mycobacterium
LGASFGLSVLLWQHIIGTPLHWMVLPMAVIILLAVGADYN

SEQ ID NO: 360899 - protein, 31 aa, Mycobacterium
LGASFGLSVLLWQHILGVPLHYMVLTMSVIA

SEQ ID NO: 360900 - protein, 40 aa, Mycobacterium
LGASFGLSVLLWQYILGINLHWMVLAMAIILLLAVGSDYN

SEQ ID NO: 360901 - protein, 40 aa, Mycobacterium; identical to SEQ ID NO: 22400

SEQ ID NO: 360902 - protein, 37 aa, Mycobacterium
LGAVAAIMVGALVFSGIFGWKVWQQHQIDAAGEQALA

SEQ ID NO: 360903 - protein, 21 aa, Mycobacterium
LGAVFMVWVDTLARTVFAPQE

SEQ ID NO: 360904 - protein, 26 aa, Mycobacterium
LGAVFTLMLVSLNYDKLPFFHSDRTY

SEQ ID NO: 360905 - protein, 24 aa, Mycobacterium
LGAVFVHWLIFQSLYRIGALCPYC

SEQ ID NO: 360906 - protein, 31 aa, Mycobacterium
LGAVLFPVGFCLLYLLGFDLLTGVFTLVPLA

SEQ ID NO: 360907 - protein, 17 aa, Mycobacterium
LGAVVVFGLILVARSMN

SEQ ID NO: 360908 - protein, 32 aa, Mycobacterium; identical to SEQ ID NO: 24342

SEQ ID NO: 360909 - protein, 22 aa, Mycobacterium
LGAWLAGLPHGLSTVLIGGAQA

SEQ ID NO: 360910 - protein, 26 aa, Mycobacterium
LGAYGSFFNIYYCSIRIKVNGPVGTD

SEQ ID NO: 360911 - protein, 17 aa, Mycobacterium
LGCQLYPLVARLRGGAR

SEQ ID NO: 360912 - protein, 31 aa, Mycobacterium
LGDAFTFISVLRLVPHWFAPRQIPVVTQLTG

SEQ ID NO: 360913 - protein, 29 aa, Mycobacterium
LGDAVTFISVLRLVPHWFKPSQVPLLTQL

SEQ ID NO: 360914 - protein, 19 aa, Mycobacterium
LGDFWGYLAGWGFVVGKTA

SEQ ID NO: 360915 - protein, 38 aa, Mycobacterium
LGDGFTHWAELLGLFVFAAMIALLYRYVRAAASYRPTT

SEQ ID NO: 360916 - protein, 29 aa, Mycobacterium
LGDISFALYLVHWPVIVLLAAVMDRSVFY

SEQ ID NO: 360917 - protein, 36 aa, Mycobacterium
LGDNGMSWLLPLLYVLLALTLVAWAGLRYSNRSRRG

SEQ ID NO: 360918 - protein, 22 aa, Mycobacterium
LGDPIGFLIAGVIGFFGGFAYG

SEQ ID NO: 360919 - protein, 26 aa, Mycobacterium
LGDPPACSVGFLPPSSWRSPADLTDV

SEQ ID NO: 360920 - protein, 27 aa, Mycobacterium
LGDPTRLPYLLLPKIANRYGDIVRLFT

SEQ ID NO: 360921 - protein, 25 aa, Mycobacterium
LGDQGWYWRLLATRPMVWLGEISYE

SEQ ID NO: 360922 - protein, 28 aa, Mycobacterium
LGEAMPRRRILLADFGIARQLGEISGLT

SEQ ID NO: 360923 - protein, 24 aa, Mycobacterium
LGEAPFGKFLLVAAALGIAAFGLY

SEQ ID NO: 360924 - protein, 19 aa, Mycobacterium
LGEDYLRLAALGSYGAFFN

SEQ ID NO: 360925 - protein, 19 aa, Mycobacterium
LGEFWGYLAGWGFVVGKTA

SEQ ID NO: 360926 - protein, 26 aa, Mycobacterium
LGELWGRSVFHCPFCHGWEVRDAPLA

SEQ ID NO: 360927 - protein, 31 aa, Mycobacterium
LGENLGFALHIVAIVLLVLAYREFWAKVRRG

SEQ ID NO: 360928 - protein, 28 aa, Mycobacterium
LGEQLRTLITVPLFHVTGCNSQLLTAAR

SEQ ID NO: 360929 - protein, 26 aa, Mycobacterium
LGERDTWIISLLYIGTFGSFIGFAFA

SEQ ID NO: 360930 - protein, 23 aa, Mycobacterium
LGERRFELALAHSPIGMAVVGLD

SEQ ID NO: 360931 - protein, 20 aa, Mycobacterium
LGEVLFLTAGIVVGILAGLQ

SEQ ID NO: 360932 - protein, 20 aa, Mycobacterium
LGFAFGYNTAAIPLAALGML

SEQ ID NO: 360933 - protein, 20 aa, Mycobacterium
LGFALIFLVARAFSSGSAAL

SEQ ID NO: 360934 - protein, 19 aa, Mycobacterium
LGFALVFLVARAFSSGCAA

SEQ ID NO: 360935 - protein, 19 aa, Mycobacterium
LGFATAYPMVWWLLAKEAT

SEQ ID NO: 360936 - protein, 19 aa, Mycobacterium
LGFEPVIGAFFAGILVIAA

SEQ ID NO: 360937 - protein, 20 aa, Mycobacterium
LGFGGMSEVHLARDVRLHRD

SEQ ID NO: 360938 - protein, 18 aa, Mycobacterium
LGFGSSPLLVAWLRSLTS

SEQ ID NO: 360939 - protein, 21 aa, Mycobacterium
LGFGVLIFGIAMGALFAVLFC

SEQ ID NO: 360940 - protein, 19 aa, Mycobacterium
LGFGVLIFGVAMGALFGVL

SEQ ID NO: 360941 - protein, 19 aa, Mycobacterium
LGFHLAAIASLLLARREFW

SEQ ID NO: 360942 - protein, 23 aa, Mycobacterium
LGFHPLMFVLAMWSDTHSVMLHA

SEQ ID NO: 360943 - protein, 20 aa, Mycobacterium
LGFLALVVLLLFFTEDGRTA

SEQ ID NO: 360944 - protein, 17 aa, Mycobacterium
LGFWLGTGGSVAAAFTA

SEQ ID NO: 360945 - protein, 17 aa, Mycobacterium
LGGALVEWNWRAAFLIN

SEQ ID NO: 360946 - protein, 25 aa, Mycobacterium
LGGHSLLLVRLAAALRREFSVDVPV

SEQ ID NO: 360947 - protein, 24 aa, Mycobacterium
LGGILAFVILQFIDGLPGLTEQVT

SEQ ID NO: 360948 - protein, 38 aa, Mycobacterium
LGGKLRTSRQFNWGWVLALVLVVLALAAIAILGTVLLT

SEQ ID NO: 360949 - protein, 18 aa, Mycobacterium
LGGLGGATWRAVWIPAVV

SEQ ID NO: 360950 - protein, 26 aa, Mycobacterium
LGGLLIGAGVGWWLARRRRDATNLPD

SEQ ID NO: 360951 - protein, 24 aa, Mycobacterium
LGGLLYGLRVGIMTPLAFLRDPLS

SEQ ID NO: 360952 - protein, 24 aa, Mycobacterium
LGGQALAPRPIAAGLFNAVPAAPA

SEQ ID NO: 360953 - protein, 26 aa, Mycobacterium
LGGQWPILVVALFLVAAFALVAAGYW

SEQ ID NO: 360954 - protein, 18 aa, Mycobacterium
LGGTKWIVIVAHTALVLA

SEQ ID NO: 360955 - protein, 23 aa, Mycobacterium
LGGTLLVGEYLAGALIAVMLAGG

SEQ ID NO: 360956 - protein, 26 aa, Mycobacterium
LGGTMGWLAGLWRDILAAPVDGPEAD

SEQ ID NO: 360957 - protein, 32 aa, Mycobacterium
LGGVIFAYKKIWWPLAVWLLLVAVEVDAGTPL

SEQ ID NO: 360958 - protein, 21 aa, Mycobacterium
LGGVWLTSFLVVAANAAIAVA

SEQ ID NO: 360959 - protein, 17 aa, Mycobacterium
LGGWLIEHFSVGSIFWV

SEQ ID NO: 360960 - protein, 22 aa, Mycobacterium
LGGWPPVEYYGPPAGLPSGLPS

SEQ ID NO: 360961 - protein, 26 aa, Mycobacterium
LGGWPSLIVSIWMLGGLTIFCLGLIG

SEQ ID NO: 360962 - protein, 37 aa, Mycobacterium
LGGYDPSWSLLYGYNVLDWFNWGLSGFNRYGYDFMGF

SEQ ID NO: 360963 - protein, 24 aa, Mycobacterium
LGGYFFSIFVQDVNPGAFAAGITL

SEQ ID NO: 360964 - protein, 17 aa, Mycobacterium
LGGYLAIRRQRTGSFPI

SEQ ID NO: 360965 - protein, 34 aa, Mycobacterium
LGGYLWATVAGAFSWLLMLLVSPATRAAARVQTT

SEQ ID NO: 360966 - protein, 30 aa, Mycobacterium
LGHGTPAHRVWLSPLPRAIPLSDVLMADPE

SEQ ID NO: 360967 - protein, 33 aa, Mycobacterium
LGHWAGFSVGWLYWYFWVIVVGFEAIAGAKIVQ

SEQ ID NO: 360968 - protein, 30 aa, Mycobacterium
LGIAALADWLPYAILFTVAAAALLWLGRVE

SEQ ID NO: 360969 - protein, 27 aa, Mycobacterium
LGIASAVPWWAGLFTSATMAAIGILII

SEQ ID NO: 360970 - protein, 22 aa, Mycobacterium
LGIFFVVPFFTLARTSLSSSGG

SEQ ID NO: 360971 - protein, 23 aa, Mycobacterium
LGIFSLYMMFFVLCGWMMGHILQ

SEQ ID NO: 360972 - protein, 24 aa, Mycobacterium
LGIFTSFVVNWLLQWAAGGPNEVL

SEQ ID NO: 360973 - protein, 27 aa, Mycobacterium
LGIGVVFFQFILGKEIVWTVPGMAFLV

SEQ ID NO: 360974 - protein, 18 aa, Mycobacterium
LGILGAAIWIGGPTGGWV

SEQ ID NO: 360975 - protein, 20 aa, Mycobacterium
LGILGFVGLALLIGAALAII

SEQ ID NO: 360976 - protein, 21 aa, Mycobacterium
LGILLAFTVFGKGVARASAPG

SEQ ID NO: 360977 - protein, 26 aa, Mycobacterium
LGINMGFFMLMPYLADYLSGPLGLAT

SEQ ID NO: 360978 - protein, 23 aa, Mycobacterium
LGIPLVLVVLAALVYLYTVVLFA

SEQ ID NO: 360979 - protein, 35 aa, Mycobacterium
LGIPQFGVLDWFFWLLSIVISTAVSWLLFAWMIAR

SEQ ID NO: 360980 - protein, 17 aa, Mycobacterium
LGIPRLGLAGIGLATTL

SEQ ID NO: 360981 - protein, 25 aa, Mycobacterium
LGIPSFVVTLAFFLGLQGVTLKLIG

SEQ ID NO: 360982 - protein, 26 aa, Mycobacterium
LGIRQEWLPLFDQYEVDLVLCGHEHH

SEQ ID NO: 360983 - protein, 26 aa, Mycobacterium
LGISLILQAFLISTLLRVAQGSATVA

SEQ ID NO: 360984 - protein, 26 aa, Mycobacterium
LGITAGIGLFILFIGLVDAGFIGSTG

SEQ ID NO: 360985 - protein, 18 aa, Mycobacterium
LGITLMLLSGSVAFWICG

SEQ ID NO: 360986 - protein, 34 aa, Mycobacterium
LGITVAFLFWEFFIPLLLSLLQGLLGLIGGLLSA

SEQ ID NO: 360987 - protein, 20 aa, Mycobacterium
LGIWLFGPLRRRATASLAIA

SEQ ID NO: 360988 - protein, 20 aa, Mycobacterium
LGKDWIWLHAARIAAAVLPL

SEQ ID NO: 360989 - protein, 25 aa, Mycobacterium
LGKSRPMSLLLVPVKFESEVVGVIE

SEQ ID NO: 360990 - protein, 30 aa, Mycobacterium
LGKTRVLVKWWLLGLPQILLCWAMEPLLQA

SEQ ID NO: 360991 - protein, 22 aa, Mycobacterium
LGLAFATILPAYDLSLFLNQLL

SEQ ID NO: 360992 - protein, 44 aa, Mycobacterium
LGLAIAVVLCWLLYRRAVRLNLRVFFTRTAIVLIVIAAGILAYG

SEQ ID NO: 360993 - protein, 20 aa, Mycobacterium
LGLAIVNFAIALSAARFATG

SEQ ID NO: 360994 - protein, 19 aa, Mycobacterium
LGLALAWLATVWATAGLAG

SEQ ID NO: 360995 - protein, 23 aa, Mycobacterium
LGLALLFAAMAIGAAIGLWRAKI

SEQ ID NO: 360996 - protein, 27 aa, Mycobacterium
LGLASVLLFVFLVPDIPPVSGGRFDPF

SEQ ID NO: 360997 - protein, 22 aa, Mycobacterium
LGLAVAFYYGITAFACVWYFRR

SEQ ID NO: 360998 - protein, 36 aa, Mycobacterium
LGLAVFIWETLLGIELHWLTLPIAFIVLVGVGCDYN

SEQ ID NO: 360999 - protein, 27 aa, Mycobacterium
LGLAVLIMPLIGLWAMVATLRFGFAHQ

SEQ ID NO: 361000 - protein, 21 aa, Mycobacterium
LGLCALAILRALYPDVAVAVV

SEQ ID NO: 361001 - protein, 25 aa, Mycobacterium
LGLCFLPAFVCLGIVPVVAGLAGNV

SEQ ID NO: 361002 - protein, 23 aa, Mycobacterium
LGLDKPIPLRYLHWASGAVRGDF

SEQ ID NO: 361003 - protein, 25 aa, Mycobacterium
LGLDTYFVVYVVWMVPIFALTIVLA

SEQ ID NO: 361004 - protein, 21 aa, Mycobacterium
LGLFFAFWCWMGFESTALYGE

SEQ ID NO: 361005 - protein, 19 aa, Mycobacterium
LGLFSWWYGSIDKTPALFA

SEQ ID NO: 361006 - protein, 26 aa, Mycobacterium
LGLGPPLVALMLLGVPALLAGTYAGI

SEQ ID NO: 361007 - protein, 17 aa, Mycobacterium
LGLGQLFADGRALDWRE

SEQ ID NO: 361008 - protein, 41 aa, Mycobacterium
LGLGVIVFQLILGKDLHWSLPGLSFILLVAVGADYNMLLIS

SEQ ID NO: 361009 - protein, 26 aa, Mycobacterium
LGLHPDPVIALLIFGAAVVSASFLLA

SEQ ID NO: 361010 - protein, 24 aa, Mycobacterium
LGLIFAGAVLLLTRPRLRVGAAGL

SEQ ID NO: 361011 - protein, 30 aa, Mycobacterium
LGLKTKPSLAPWVALRLLPQGPTLSRADAL

SEQ ID NO: 361012 - protein, 21 aa, Mycobacterium
LGLLAAGILWRRGRQTVARIG

SEQ ID NO: 361013 - protein, 19 aa, Mycobacterium
LGLLLERRLWHRHVARERV

SEQ ID NO: 361014 - protein, 18 aa, Mycobacterium
LGLLLLALVAVVGLAKVE

SEQ ID NO: 361015 - protein, 18 aa, Mycobacterium
LGLLMADWLADRGARRLV

SEQ ID NO: 361016 - protein, 20 aa, Mycobacterium
LGLLMAFWSWVGFESTAIYG

SEQ ID NO: 361017 - protein, 24 aa, Mycobacterium
LGLLVPVYAALLPLLAPAQSRKAP

SEQ ID NO: 361018 - protein, 17 aa, Mycobacterium
LGLMLWAATLTEFDTAL

SEQ ID NO: 361019 - protein, 20 aa, Mycobacterium
LGLMVLIGVPVVVFGLQLTA

SEQ ID NO: 361020 - protein, 30 aa, Mycobacterium
LGLPALGWASYLILWVLQACVFWRGMEAIR

SEQ ID NO: 361021 - protein, 24 aa, Mycobacterium
LGLPLFFEVGVVLLIPIVLLVARR

SEQ ID NO: 361022 - protein, 18 aa, Mycobacterium
LGLPPFAMFASELAIVRS

SEQ ID NO: 361023 - protein, 17 aa, Mycobacterium
LGLPPFAMFASEVSIAR

SEQ ID NO: 361024 - protein, 17 aa, Mycobacterium
LGLRFRYAVTDPARTRR

SEQ ID NO: 361025 - protein, 28 aa, Mycobacterium
LGLRNTFWALVLPFLFGSPYAIFLLREH

SEQ ID NO: 361026 - protein, 32 aa, Mycobacterium
LGLRQLYFLIDNLLDRLIYLSYGLAAILGFIG

SEQ ID NO: 361027 - protein, 35 aa, Mycobacterium
LGLRQLYFLIDNLLYRLIYLPYGLATILGFIGIKL

SEQ ID NO: 361028 - protein, 30 aa, Mycobacterium
LGLSLAPSMAPWVALRLLPQGPTLSRADAL

SEQ ID NO: 361029 - protein, 30 aa, Mycobacterium
LGLSTSPLPVPWSVLSQFAAGPALSRGDAL

SEQ ID NO: 361030 - protein, 20 aa, Mycobacterium
LGLVFLCAAPVALLGFVVSL

SEQ ID NO: 361031 - protein, 18 aa, Mycobacterium
LGLVFLCAAPVAVIGFVV

SEQ ID NO: 361032 - protein, 27 aa, Mycobacterium
LGLVIAGIVLLFARPRLRVGPSGVSVR

SEQ ID NO: 361033 - protein, 20 aa, Mycobacterium
LGLVIIAMTLAVDSPLRLGV

SEQ ID NO: 361034 - protein, 22 aa, Mycobacterium
LGLVILLLFKDFHALLLGAAVI

SEQ ID NO: 361035 - protein, 17 aa, Mycobacterium
LGLVLVATRSRPWWLHR

SEQ ID NO: 361036 - protein, 20 aa, Mycobacterium
LGLYAVTLNVIPLLTELGFG

SEQ ID NO: 361037 - protein, 18 aa, Mycobacterium
LGMAFLFGLVFVLIEGPG

SEQ ID NO: 361038 - protein, 20 aa, Mycobacterium
LGMALRWDVFGIGLGRAAWF

SEQ ID NO: 361039 - protein, 17 aa, Mycobacterium
LGMLPTLLGPVAAATAL

SEQ ID NO: 361040 - protein, 27 aa, Mycobacterium
LGMPAPQLLAVWLFGAFIVATVGVMSS

SEQ ID NO: 361041 - protein, 28 aa, Mycobacterium
LGMPIDLSWQLWAFGVFAIAAVGITSSS

SEQ ID NO: 361042 - protein, 31 aa, Mycobacterium
LGMTAIVGAFALRRVWWLYKLIMSGQPASDR

SEQ ID NO: 361043 - protein, 19 aa, Mycobacterium
LGMYFGVCAAIFLASQLPA

SEQ ID NO: 361044 - protein, 19 aa, Mycobacterium
LGMYVPTVWLAAVGACLAS

SEQ ID NO: 361045 - protein, 25 aa, Mycobacterium
LGNKQRLPLIVRIDDPWLAESWRAK

SEQ ID NO: 361046 - protein, 26 aa, Mycobacterium
LGNLKYLFFGLALVVLMLFRPQGLFP

SEQ ID NO: 361047 - protein, 18 aa, Mycobacterium
LGNLPLFAGLDAAALAEL

SEQ ID NO: 361048 - protein, 27 aa, Mycobacterium
LGNPVYAFLLMVLFQYGVALHELETER

SEQ ID NO: 361049 - protein, 25 aa, Mycobacterium
LGNSWWAYPLILASCTFDAILPLLP

SEQ ID NO: 361050 - protein, 25 aa, Mycobacterium
LGNVVRLGVLLAGQLLADPALGGVL

SEQ ID NO: 361051 - protein, 32 aa, Mycobacterium
LGPACAIAVLFGFLATVTLLPPVLSLAAKRGI

SEQ ID NO: 361052 - protein, 26 aa, Mycobacterium
LGPANIFLVVWLTINALQLFDEVYAT

SEQ ID NO: 361053 - protein, 43 aa, Mycobacterium
LGPDAWDPVWNYWFIEVLFLALVFCAVLLAIPAARRVERTWPF

SEQ ID NO: 361054 - protein, 25 aa, Mycobacterium
LGPGRLYIGLLVLRGLGYCCYAGVS

SEQ ID NO: 361055 - protein, 18 aa, Mycobacterium
LGPLILGYTFVLIGIVDM

SEQ ID NO: 361056 - protein, 18 aa, Mycobacterium
LGPLLLLPLLNRQWRALI

SEQ ID NO: 361057 - protein, 26 aa, Mycobacterium
LGPLYGIFIVWLFHDWRDVFWINVPL

SEQ ID NO: 361058 - protein, 27 aa, Mycobacterium
LGPLYGIFIVWLFHDWRDVFWINVPLT

SEQ ID NO: 361059 - protein, 33 aa, Mycobacterium
LGPMYGIALVWLFNHWQAVFWVNVPLAVIAMVM

SEQ ID NO: 361060 - protein, 28 aa, Mycobacterium
LGPRLLALSRLPAWIPDALRGAAAGVIA

SEQ ID NO: 361061 - protein, 25 aa, Mycobacterium
LGPRLRTLFVVLLSALTIASFGYAV

SEQ ID NO: 361062 - protein, 17 aa, Mycobacterium
LGPRWLFGAGDSGASIT

SEQ ID NO: 361063 - protein, 31 aa, Mycobacterium
LGPTGWPHTAFLFSLYAFLCATALVVVRIEE

SEQ ID NO: 361064 - protein, 17 aa, Mycobacterium
LGPVPIKLRESPGVMIL

SEQ ID NO: 361065 - protein, 28 aa, Mycobacterium
LGPWAGFFTGWTYWFCWIVTGVAEVVAI

SEQ ID NO: 361066 - protein, 17 aa, Mycobacterium
LGQMEIPRPEQLAYFGG

SEQ ID NO: 361067 - protein, 18 aa, Mycobacterium
LGQPLFTEYVWGRQVGEH

SEQ ID NO: 361068 - protein, 32 aa, Mycobacterium
LGQRPGLLIGALVSILLLIAGGVFAVVKLTQS

SEQ ID NO: 361069 - protein, 25 aa, Mycobacterium
LGQTGPSWIGFLAALLAIPAVLGAD

SEQ ID NO: 361070 - protein, 24 aa, Mycobacterium
LGRDLTTLFWFVSVFACALAFHNI

SEQ ID NO: 361071 - protein, 20 aa, Mycobacterium
LGRDVAIKLLQPELAAEPGY

SEQ ID NO: 361072 - protein, 17 aa, Mycobacterium
LGRECVALLWFLGVYLV

SEQ ID NO: 361073 - protein, 29 aa, Mycobacterium
LGREHFSWTALTIVLVVLVAAACAGIALV

SEQ ID NO: 361074 - protein, 20 aa, Mycobacterium
LGRFIPGTALLIAFAVVMVA

SEQ ID NO: 361075 - protein, 17 aa, Mycobacterium
LGRITVTLQLPATGGLY

SEQ ID NO: 361076 - protein, 20 aa, Mycobacterium
LGRKWVLMLTIALMGGSSTL

SEQ ID NO: 361077 - protein, 22 aa, Mycobacterium
LGRLLLVVLVGVLLALGAGDLE

SEQ ID NO: 361078 - protein, 25 aa, Mycobacterium
LGRPEFLWVLLTVIGMLSAAALYRL

SEQ ID NO: 361079 - protein, 25 aa, Mycobacterium
LGRRKLLIFGLMLAAVSTALVGFTT

SEQ ID NO: 361080 - protein, 25 aa, Mycobacterium
LGRRRLYLLGMALFTTASLVCALSG

SEQ ID NO: 361081 - protein, 19 aa, Mycobacterium
LGSFWALLAATAGLPVLVF

SEQ ID NO: 361082 - protein, 32 aa, Mycobacterium
LGSGVLLRFWDWHAIFWSLGAAGLVILALACT

SEQ ID NO: 361083 - protein, 26 aa, Mycobacterium
LGSGWWQTFWRITLPSIRWGLTYGIV

SEQ ID NO: 361084 - protein, 29 aa, Mycobacterium
LGSILRLAILGIVMLAVTFALMVAVKLPE

SEQ ID NO: 361085 - protein, 33 aa, Mycobacterium
LGSMAYSLYLWHWPLLIFWLSYSGHTAANFVEG

SEQ ID NO: 361086 - protein, 24 aa, Mycobacterium
LGSQAIWFKLLLVAVVVGVAVYLP

SEQ ID NO: 361087 - protein, 19 aa, Mycobacterium
LGSTLVLRRRFKPATVLED

SEQ ID NO: 361088 - protein, 24 aa, Mycobacterium
LGSTMGILTWIFVDGHGSGLLNFT

SEQ ID NO: 361089 - protein, 24 aa, Mycobacterium
LGSTMGILTWIFVDGHGSGVLNFT

SEQ ID NO: 361090 - protein, 24 aa, Mycobacterium
LGSTMGILTWIFVDGHLSGVLNFT

SEQ ID NO: 361091 - protein, 18 aa, Mycobacterium
LGSVLKRFGPLTPPRAVA

SEQ ID NO: 361092 - protein, 25 aa, Mycobacterium
LGSVLLVQALLVTSLLFALPINARL

SEQ ID NO: 361093 - protein, 29 aa, Mycobacterium
LGSVLLVQALLVTSLLFALPLSARLSHRR

SEQ ID NO: 361094 - protein, 19 aa, Mycobacterium
LGSVWLRKVAMLVVVVICV

SEQ ID NO: 361095 - protein, 27 aa, Mycobacterium
LGSYGAFFNIYFCTVTIKINGPAGSDI

SEQ ID NO: 361096 - protein, 20 aa, Mycobacterium
LGSYWGLLFVIPGGVMLALR

SEQ ID NO: 361097 - protein, 40 aa, Mycobacterium
LGTACGLSVLLWQDILGLGVQWIVIPLSMVILLAVGSDYN

SEQ ID NO: 361098 - protein, 17 aa, Mycobacterium
LGTAFGLALFGALASAV

SEQ ID NO: 361099 - protein, 18 aa, Mycobacterium
LGTALFPVAVRAIGALLI

SEQ ID NO: 361100 - protein, 18 aa, Mycobacterium
LGTARLYAPLLAGRAAVM

SEQ ID NO: 361101 - protein, 30 aa, Mycobacterium
LGTGVLLHFFSWQSIFYMFAAGALLMFIAT

SEQ ID NO: 361102 - protein, 29 aa, Mycobacterium
LGTISYGIYLWHWPIFLALNGERTGWTGM

SEQ ID NO: 361103 - protein, 27 aa, Mycobacterium
LGTLGVFPFFVLATLLTLPLAAMSWFI

SEQ ID NO: 361104 - protein, 26 aa, Mycobacterium
LGTLIQFHPLGPHGLWPRLIHGVLVA

SEQ ID NO: 361105 - protein, 18 aa, Mycobacterium
LGTLLMLLVGFISSLPFA

SEQ ID NO: 361106 - protein, 27 aa, Mycobacterium
LGTLMLGFYVTCAIFIFGVLGTLLWAV

SEQ ID NO: 361107 - protein, 18 aa, Mycobacterium
LGTLRRDLLPTGYALALI

SEQ ID NO: 361108 - protein, 25 aa, Mycobacterium
LGTQPLATRLVAAPLPPPHRSDPVT

SEQ ID NO: 361109 - protein, 24 aa, Mycobacterium
LGTSPHWVWIAGFAATLVSGCLLR

SEQ ID NO: 361110 - protein, 24 aa, Mycobacterium
LGTSVVLWVLLNLPARQAETAHMS

SEQ ID NO: 361111 - protein, 24 aa, Mycobacterium
LGTVFVHWLIFQSLYRIGALCPYC

SEQ ID NO: 361112 - protein, 31 aa, Mycobacterium
LGTVGVGLFFVLCAWLKDFRGFFGIGFAVLA

SEQ ID NO: 361113 - protein, 18 aa, Mycobacterium
LGTVLLYFAAQHAGADGA

SEQ ID NO: 361114 - protein, 17 aa, Mycobacterium
LGTVPTGLLAYRYRLRV

SEQ ID NO: 361115 - protein, 24 aa, Mycobacterium
LGTVRTAPLGRKPLRFTSFGDQGT

SEQ ID NO: 361116 - protein, 20 aa, Mycobacterium
LGTWLLLFHRENSLSVLFSG

SEQ ID NO: 361117 - protein, 22 aa, Mycobacterium
LGTYWITRRTVLALRWAIEERQ

SEQ ID NO: 361118 - protein, 30 aa, Mycobacterium
LGVAALFYTLLLVYAAFTLTIMALCVAVAR

SEQ ID NO: 361119 - protein, 28 aa, Mycobacterium
LGVAALLFGFPIFFDAGLVVFLPIIMTV

SEQ ID NO: 361120 - protein, 35 aa, Mycobacterium
LGVAGIVEWPILLAVGGSALLLRRMSQRPEASAPA

SEQ ID NO: 361121 - protein, 28 aa, Mycobacterium
LGVAGLFYTLLFAYAAFTIAIMAVLLAA

SEQ ID NO: 361122 - protein, 25 aa, Mycobacterium
LGVALTLSRLLAGLAPGLDLGLTLA

SEQ ID NO: 361123 - protein, 25 aa, Mycobacterium
LGVASIVVFIPMLSAAIGATTMRFL

SEQ ID NO: 361124 - protein, 25 aa, Mycobacterium
LGVASLAIAWWLTPSLAVVMAVYLA

SEQ ID NO: 361125 - protein, 23 aa, Mycobacterium
LGVASLALAWWLTPDLAVVMAVY

SEQ ID NO: 361126 - protein, 23 aa, Mycobacterium
LGVDLLYYAYHRIAHRVRLIWAT

SEQ ID NO: 361127 - protein, 31 aa, Mycobacterium
LGVDSAYVLLGFPLATVSFTVIVAMLAAGIA

SEQ ID NO: 361128 - protein, 34 aa, Mycobacterium
LGVDVLWLLNGVVFYVLLFATGQWRHIVPTSWDV

SEQ ID NO: 361129 - protein, 34 aa, Mycobacterium
LGVDVLWLVNGAVFYVLLFATGQWRHIVPTSWDV

SEQ ID NO: 361130 - protein, 29 aa, Mycobacterium
LGVEEQFYILWPALIIGTAWLIRRARRRA

SEQ ID NO: 361131 - protein, 32 aa, Mycobacterium
LGVEEQFYLVWPALIIATAWLLRRIGKNNRGA

SEQ ID NO: 361132 - protein, 33 aa, Mycobacterium
LGVEEQFYLVWPALILGVAWWLRRRSAGGGRGT

SEQ ID NO: 361133 - protein, 22 aa, Mycobacterium
LGVFPLIVMFLITSITMQRERV

SEQ ID NO: 361134 - protein, 26 aa, Mycobacterium
LGVGATQLTLLRYLLGQLRLSEPDRL

SEQ ID NO: 361135 - protein, 22 aa, Mycobacterium
LGVGLAITLWLSTDAAERSYQL

SEQ ID NO: 361136 - protein, 28 aa, Mycobacterium
LGVGLTEMGLLKYLIGQLLLSEAARVEN

SEQ ID NO: 361137 - protein, 28 aa, Mycobacterium
LGVGLTQLTLLRYLLGQLRLSAPDRIRA

SEQ ID NO: 361138 - protein, 26 aa, Mycobacterium
LGVGMLADLRFLVALTAILASGAAVA

SEQ ID NO: 361139 - protein, 18 aa, Mycobacterium
LGVIFLDIILYSAGGVIG

SEQ ID NO: 361140 - protein, 20 aa, Mycobacterium
LGVIGTVEYVAARNALLPAA

SEQ ID NO: 361141 - protein, 24 aa, Mycobacterium
LGVLLLAARRRPSFLRPALSPDYG

SEQ ID NO: 361142 - protein, 23 aa, Mycobacterium
LGVLLLGVLVFGLGIGPPIAALM

SEQ ID NO: 361143 - protein, 24 aa, Mycobacterium
LGVLLLPFVLISFNTVIDTLMTAG

SEQ ID NO: 361144 - protein, 20 aa, Mycobacterium
LGVLLVAGIFRLTASVWRLP

SEQ ID NO: 361145 - protein, 33 aa, Mycobacterium
LGVLMFQVVLGQQLHWSVPPLAFVVLVAVGADY

SEQ ID NO: 361146 - protein, 27 aa, Mycobacterium
LGVLVIGIMVAWRWAPAKVAAVPGPLV

SEQ ID NO: 361147 - protein, 29 aa, Mycobacterium
LGVLVTWMLVERAIALRRLAPAAVAIIVA

SEQ ID NO: 361148 - protein, 18 aa, Mycobacterium
LGVLVTWVLVERSIAQRH

SEQ ID NO: 361149 - protein, 19 aa, Mycobacterium
LGVLWSFSTILLALSWLNP

SEQ ID NO: 361150 - protein, 31 aa, Mycobacterium
LGVNLVLNAAWSWLFFRFHKLGASAAGAAVL

SEQ ID NO: 361151 - protein, 31 aa, Mycobacterium
LGVNLVLNGAWSWLFFRFHKLGASALGAAVL

SEQ ID NO: 361152 - protein, 23 aa, Mycobacterium
LGVPLQRPYLVGCLNARNELALV

SEQ ID NO: 361153 - protein, 23 aa, Mycobacterium
LGVQVAIFQWGWGADLLGVTPGE

SEQ ID NO: 361154 - protein, 18 aa, Mycobacterium
LGVSFGLSVLLWQHLLRI

SEQ ID NO: 361155 - protein, 37 aa, Mycobacterium
LGVSIAAVIVLLAWWKGMFLTTRIGRALAMVRRNRAE

SEQ ID NO: 361156 - protein, 19 aa, Mycobacterium
LGVSLWRLSIGLAVATVIG

SEQ ID NO: 361157 - protein, 36 aa, Mycobacterium
LGVTGIVEWPILLAVGGGALLLRRMNKKPGDSGPPV

SEQ ID NO: 361158 - protein, 26 aa, Mycobacterium
LGVTGLLGRVWLLPAATALAVLWSAV

SEQ ID NO: 361159 - protein, 24 aa, Mycobacterium
LGVTTLLKIPFLANWQFSRRIIDW

SEQ ID NO: 361160 - protein, 35 aa, Mycobacterium
LGVTVLLFPVVQPWYLLWAIIPLAAWATRSGFRAA

SEQ ID NO: 361161 - protein, 30 aa, Mycobacterium
LGVTVPKALFWIALLWVAVTTVIAIWIGRP

SEQ ID NO: 361162 - protein, 36 aa, Mycobacterium
LGVVFGTIFFLMFAPTKWVHHFGLFAALGAAVAALA

SEQ ID NO: 361163 - protein, 24 aa, Mycobacterium
LGVVLLIVDALRERQQREAASKDQ

SEQ ID NO: 361164 - protein, 17 aa, Mycobacterium
LGVVYLKDLVRQTFCAP

SEQ ID NO: 361165 - protein, 28 aa, Mycobacterium
LGVVYRTLFMAFLWTIALTFEAGFFLVT

SEQ ID NO: 361166 - protein, 18 aa, Mycobacterium
LGVYGLPAALAAAAVCFA

SEQ ID NO: 361167 - protein, 17 aa, Mycobacterium
LGVYYQSTLADAGPTYI

SEQ ID NO: 361168 - protein, 20 aa, Mycobacterium
LGWAFGYNTAAIPLAALGLL

SEQ ID NO: 361169 - protein, 21 aa, Mycobacterium
LGWGVLALVGQHRDADAEQAR

SEQ ID NO: 361170 - protein, 22 aa, Mycobacterium
LGWLVALVMAAIAHPYIALSNW

SEQ ID NO: 361171 - protein, 27 aa, Mycobacterium
LGWLVTLRGLLLLAFPKAFVSVADAMI

SEQ ID NO: 361172 - protein, 19 aa, Mycobacterium
LGWRMLPVATAVLATVFAV

SEQ ID NO: 361173 - protein, 19 aa, Mycobacterium
LGWRPPLAGLALGAVIIAL

SEQ ID NO: 361174 - protein, 19 aa, Mycobacterium
LGWRWALVVAPAVALLTIP

SEQ ID NO: 361175 - protein, 26 aa, Mycobacterium
LGWTATWYTLLFAFGAFTVALMALWL

SEQ ID NO: 361176 - protein, 24 aa, Mycobacterium
LGYAISFLLRPLGGMVWGPLGDRL

SEQ ID NO: 361177 - protein, 22 aa, Mycobacterium
LGYAYFIVCLLALPPWTVTAAD

SEQ ID NO: 361178 - protein, 20 aa, Mycobacterium
LGYFAIFGFSAELIGAIVVG

SEQ ID NO: 361179 - protein, 36 aa, Mycobacterium
LGYGFLFGLAFYLPLLPWISLLVGAVPWVVLATTCA

SEQ ID NO: 361180 - protein, 35 aa, Mycobacterium
LGYGFLFGLAFYVPLLPWIGSLVGPMPWLVLATVS

SEQ ID NO: 361181 - protein, 55 aa, Mycobacterium
LGYGLLFGLAFFIPLLPWTGQLVGAVPWLALSLLCALWVALFGLLAVAVRNLPGW

SEQ ID NO: 361182 - protein, 24 aa, Mycobacterium
LGYITLWIRRRLAHPALETVQGLM

SEQ ID NO: 361183 - protein, 20 aa, Mycobacterium
LGYLAIIGVPPFAGFFSKDA

SEQ ID NO: 361184 - protein, 25 aa, Mycobacterium
LGYLASFVFLALVLRRGMGLGVAYG

SEQ ID NO: 361185 - protein, 23 aa, Mycobacterium
LGYLRRQLLLLTAFTTGVLLICD

SEQ ID NO: 361186 - protein, 20 aa, Mycobacterium
LGYRIMAWTTGLWLIALCYE

SEQ ID NO: 361187 - protein, 21 aa, Mycobacterium
LGYRLLPRLLRSLAVLIGMIA

SEQ ID NO: 361188 - protein, 27 aa, Mycobacterium
LGYSVWTLWPVLVLFMPENVYGFSAGD

SEQ ID NO: 361189 - protein, 28 aa, Mycobacterium
LGYSVWTLWPVLVLFMPQSVYGFSAGDK

SEQ ID NO: 361190 - protein, 20 aa, Mycobacterium
LGYWFHAPLWLLSLCLMLLM

SEQ ID NO: 361191 - protein, 21 aa, Mycobacterium
LHAAHPAPAVLWTLAGTPRMW

SEQ ID NO: 361192 - protein, 18 aa, Mycobacterium
LHAAIFSGLIWLAVLLPM

SEQ ID NO: 361193 - protein, 24 aa, Mycobacterium
LHAPATVFVVLTTALLFGAIATVT

SEQ ID NO: 361194 - protein, 22 aa, Mycobacterium
LHAPRLGFWGYQLLLTGAVFTP

SEQ ID NO: 361195 - protein, 18 aa, Mycobacterium
LHCWTLPILLITHGDEVV

SEQ ID NO: 361196 - protein, 26 aa, Mycobacterium
LHDELFDACGWRRLIFATPEELEATL

SEQ ID NO: 361197 - protein, 27 aa, Mycobacterium
LHDGEKPKLHWLLDDYYDVPYGALVPQ

SEQ ID NO: 361198 - protein, 29 aa, Mycobacterium
LHDQACFTVLAFWFFAAGWAAAKATQTWQ

SEQ ID NO: 361199 - protein, 17 aa, Mycobacterium
LHFAKPIFGPAARALAQ

SEQ ID NO: 361200 - protein, 37 aa, Mycobacterium
LHFSGWEILVAALTTPILLWGGYPFHRAALVNARHGA

SEQ ID NO: 361201 - protein, 17 aa, Mycobacterium
LHGLATVLLMMAAFAIS

SEQ ID NO: 361202 - protein, 23 aa, Mycobacterium
LHGSGVHLLLVRPGFVIGRMTEG

SEQ ID NO: 361203 - protein, 26 aa, Mycobacterium
LHGVISRPFLDLLQLAIAGLIPIVGA

SEQ ID NO: 361204 - protein, 18 aa, Mycobacterium
LHGYLQENFALPTRITIA

SEQ ID NO: 361205 - protein, 19 aa, Mycobacterium
LHHRQPFFAPISAVVCMSA

SEQ ID NO: 361206 - protein, 19 aa, Mycobacterium
LHKYLGLVGPVGFSTVLSG

SEQ ID NO: 361207 - protein, 19 aa, Mycobacterium
LHLIVGYLAIRVACGDGGT

SEQ ID NO: 361208 - protein, 18 aa, Mycobacterium
LHLNLWVGAALALVLSLA

SEQ ID NO: 361209 - protein, 29 aa, Mycobacterium
LHLPGLADGWWIYLAVYAVFIGIHLSGAG

SEQ ID NO: 361210 - protein, 19 aa, Mycobacterium
LHLRQDTIRWVALAALVAI

SEQ ID NO: 361211 - protein, 18 aa, Mycobacterium
LHNRILALFAGSTTPVVL

SEQ ID NO: 361212 - protein, 25 aa, Mycobacterium
LHPAWWTLILVVATLGTIVLTSAFF

SEQ ID NO: 361213 - protein, 24 aa, Mycobacterium
LHPSDSIVVLLKETLHRASMPGAP

SEQ ID NO: 361214 - protein, 19 aa, Mycobacterium
LHPVLNLTSARLIVGKPVN

SEQ ID NO: 361215 - protein, 42 aa, Mycobacterium
LHQDAGLSWLLLVSVPVLGLANYWIIRHLMPVFTRMQSLIDG

SEQ ID NO: 361216 - protein, 22 aa, Mycobacterium
LHRGIPYFPNLVLPITIGGIGI

SEQ ID NO: 361217 - protein, 29 aa, Mycobacterium
LHRLDAIALYLGFIAVGWLLGYVMRAQRL

SEQ ID NO: 361218 - protein, 23 aa, Mycobacterium
LHSGLAIPRPLPTLIGEARAGAQ

SEQ ID NO: 361219 - protein, 23 aa, Mycobacterium
LHSRRVLVLSWIASGLTVGFLAI

SEQ ID NO: 361220 - protein, 18 aa, Mycobacterium
LHTAWVTLVTFQPVQPKP

SEQ ID NO: 361221 - protein, 18 aa, Mycobacterium
LHTWLLSLASILISLYPA

SEQ ID NO: 361222 - protein, 20 aa, Mycobacterium
LHVHLLLASQRLDEGRLRGL

SEQ ID NO: 361223 - protein, 18 aa, Mycobacterium
LHVPLWLGYAISTLMIFP

SEQ ID NO: 361224 - protein, 17 aa, Mycobacterium
LHWLVLSMSVIVLLAVG

SEQ ID NO: 361225 - protein, 20 aa, Mycobacterium
LHWMVLAMSVILLLAVGSDY

SEQ ID NO: 361226 - protein, 22 aa, Mycobacterium
LHWSGVRMWRGASDVGPFLTGK

SEQ ID NO: 361227 - protein, 20 aa, Mycobacterium
LHWSVPVAVFAILISVGADY

SEQ ID NO: 361228 - protein, 19 aa, Mycobacterium
LHYIAMWFAVFYTEEHAWL

SEQ ID NO: 361229 - protein, 23 aa, Mycobacterium
LHYIAMWFAVFYTGTGAWLTATG

SEQ ID NO: 361230 - protein, 17 aa, Mycobacterium
LHYWPLAVEEQFFIVWP

SEQ ID NO: 361231 - protein, 26 aa, Mycobacterium
LIAAGLFFFFVIPRWPELMGETSPTL

SEQ ID NO: 361232 - protein, 20 aa, Mycobacterium
LIAAHLMEPPPRPSQLRPGR

SEQ ID NO: 361233 - protein, 23 aa, Mycobacterium
LIAATFCLVVYWVKREGLAGVTL

SEQ ID NO: 361234 - protein, 26 aa, Mycobacterium
LIAAYGYWLIHYWRQDVLSQKHDIFG

SEQ ID NO: 361235 - protein, 25 aa, Mycobacterium
LIAAYGYWLIHYWRQDVMSQKHNIL

SEQ ID NO: 361236 - protein, 25 aa, Mycobacterium
LIAGCTFLFRRLLGTHLRTMFVVLL

SEQ ID NO: 361237 - protein, 23 aa, Mycobacterium
LIAGFLMVDVLTPGNLRRLVFID

SEQ ID NO: 361238 - protein, 18 aa, Mycobacterium
LIAGLIAIIPLYSLSVLA

SEQ ID NO: 361239 - protein, 18 aa, Mycobacterium
LIAGLIAIVPLYALSVLA

SEQ ID NO: 361240 - protein, 30 aa, Mycobacterium
LIAGLLRNKRWWAGALLLAASIALQAAALG

SEQ ID NO: 361241 - protein, 20 aa, Mycobacterium
LIAGLLYIGVTFIGIRALTV

SEQ ID NO: 361242 - protein, 17 aa, Mycobacterium
LIAGLVAIIPLYSLAVL

SEQ ID NO: 361243 - protein, 17 aa, Mycobacterium
LIAGRRKGNRREAETIS

SEQ ID NO: 361244 - protein, 21 aa, Mycobacterium
LIAGVPWPRHKLFAVIAGFAA

SEQ ID NO: 361245 - protein, 20 aa, Mycobacterium
LIAGVPWPRHKLFAVIAGLV

SEQ ID NO: 361246 - protein, 17 aa, Mycobacterium
LIAIAVLVPVLTAGWYL

SEQ ID NO: 361247 - protein, 20 aa, Mycobacterium
LIAILMFFSIGFVPLDQYPE

SEQ ID NO: 361248 - protein, 23 aa, Mycobacterium
LIAISMIFVFGTLPLFWSIAMAR

SEQ ID NO: 361249 - protein, 27 aa, Mycobacterium
LIALFSTVLGWLPTSGYRPLFEDPAGW

SEQ ID NO: 361250 - protein, 19 aa, Mycobacterium
LIALFVVFIAYIAYRESRR

SEQ ID NO: 361251 - protein, 17 aa, Mycobacterium
LIALPRLDGTADERGLA

SEQ ID NO: 361252 - protein, 25 aa, Mycobacterium
LIALTPLIKRPILFGALAGLGVGTA

SEQ ID NO: 361253 - protein, 17 aa, Mycobacterium
LIALWRLDRLDGRRLRS

SEQ ID NO: 361254 - protein, 25 aa, Mycobacterium
LIAMFPAWIMWAPNAIWKSFDLFVG

SEQ ID NO: 361255 - protein, 20 aa, Mycobacterium
LIAMWASAKLFLRKAGTIIL

SEQ ID NO: 361256 - protein, 21 aa, Mycobacterium
LIAPIALHWSLNGLGALAAAF

SEQ ID NO: 361257 - protein, 21 aa, Mycobacterium
LIAPIALHWSLNGLGALAAAL

SEQ ID NO: 361258 - protein, 22 aa, Mycobacterium
LIAPIALHWSLNGLGALAAALV

SEQ ID NO: 361259 - protein, 22 aa, Mycobacterium
LIAPIALHWSLNGLGALAAAVV

SEQ ID NO: 361260 - protein, 26 aa, Mycobacterium
LIAPPLNQWFFAAVYWLFELSGVDVY

SEQ ID NO: 361261 - protein, 30 aa, Mycobacterium
LIARQRWIYPVLVVLWAAAGTYITTAPKVA

SEQ ID NO: 361262 - protein, 20 aa, Mycobacterium
LIASAIWLLAGKDIAVMTPK

SEQ ID NO: 361263 - protein, 24 aa, Mycobacterium
LIASGLYIPILLASAFGLGMAGQV

SEQ ID NO: 361264 - protein, 37 aa, Mycobacterium
LIASLFIGNFLLLVLNLPLAPLWARLLRTPRPYLYAG

SEQ ID NO: 361265 - protein, 23 aa, Mycobacterium
LIASQMVILLVTLALYGQTGTFN

SEQ ID NO: 361266 - protein, 18 aa, Mycobacterium
LIATLVAAGAFALYRRDP

SEQ ID NO: 361267 - protein, 19 aa, Mycobacterium
LIAVFLLIRAIPSLRANHA

SEQ ID NO: 361268 - protein, 17 aa, Mycobacterium
LIAVGVVLLMLLLVYRS

SEQ ID NO: 361269 - protein, 18 aa, Mycobacterium
LIAVPLAAGVLAPIGFVL

SEQ ID NO: 361270 - protein, 17 aa, Mycobacterium
LIAVPLAAGVLAPIGIV

SEQ ID NO: 361271 - protein, 19 aa, Mycobacterium
LIAVVAGAVVLLVLAAVGI

SEQ ID NO: 361272 - protein, 24 aa, Mycobacterium
LICAACLTALVLNGVRADKRTVTA

SEQ ID NO: 361273 - protein, 18 aa, Mycobacterium
LIDAFLVVVIGGLGQIKG

SEQ ID NO: 361274 - protein, 31 aa, Mycobacterium
LIDIRALHRPILLTLLALLLAAGSFRSMLQL

SEQ ID NO: 361275 - protein, 23 aa, Mycobacterium
LIDTFIVRTVTVPALAALIGQAN

SEQ ID NO: 361276 - protein, 30 aa, Mycobacterium
LIDVMSWPGYLFMLVGVIAVFRCLVALGTG

SEQ ID NO: 361277 - protein, 17 aa, Mycobacterium
LIEGLLDRLVYLSYGLG

SEQ ID NO: 361278 - protein, 33 aa, Mycobacterium
LIELVGVQPVVLWILLPIVAFGSAYVPEVASFI

SEQ ID NO: 361279 - protein, 19 aa, Mycobacterium
LIEMLLFMVVVFVAYAYVW

SEQ ID NO: 361280 - protein, 26 aa, Mycobacterium
LIEVPIRIVVYIAVALVIRYLVHRMI

SEQ ID NO: 361281 - protein, 20 aa, Mycobacterium
LIEVPVLVGLVYVSLALRPR

SEQ ID NO: 361282 - protein, 17 aa, Mycobacterium
LIFERFGKFWGAFSVGD

SEQ ID NO: 361283 - protein, 17 aa, Mycobacterium
LIFFGWGVALAFTSVVV

SEQ ID NO: 361284 - protein, 23 aa, Mycobacterium
LIFGIPVILLPFVILWNAPGEKR

SEQ ID NO: 361285 - protein, 18 aa, Mycobacterium
LIFGSLFIAGAKLHPLVY

SEQ ID NO: 361286 - protein, 17 aa, Mycobacterium
LIFLGIPLLAGYLSRRL

SEQ ID NO: 361287 - protein, 28 aa, Mycobacterium
LIFMVLVGLSFYMWWRAQQQKVDHNNVN

SEQ ID NO: 361288 - protein, 24 aa, Mycobacterium
LIFSRYVWAFELTSALLITAAIGA

SEQ ID NO: 361289 - protein, 20 aa, Mycobacterium
LIFVAVLLGMLLAALDGTIV

SEQ ID NO: 361290 - protein, 25 aa, Mycobacterium
LIGACAAVWLVLLGVSVAAAVALAD

SEQ ID NO: 361291 - protein, 23 aa, Mycobacterium
LIGAFYLFTLVLGYGAAALVGPD

SEQ ID NO: 361292 - protein, 21 aa, Mycobacterium
LIGAMIIGALIGLWRARVVEM

SEQ ID NO: 361293 - protein, 24 aa, Mycobacterium
LIGAWLGCMYFGVPLVVMSPQAFL

SEQ ID NO: 361294 - protein, 17 aa, Mycobacterium
LIGDRIWWPTAPQHAKA

SEQ ID NO: 361295 - protein, 17 aa, Mycobacterium
LIGFAAVALFVLIRDLW

SEQ ID NO: 361296 - protein, 17 aa, Mycobacterium
LIGFAAVIVALVGRNWW

SEQ ID NO: 361297 - protein, 24 aa, Mycobacterium
LIGFPVWMIFACHAIVLFYQFPIH

SEQ ID NO: 361298 - protein, 19 aa, Mycobacterium
LIGGLGIVALLVGIVGLIA

SEQ ID NO: 361299 - protein, 26 aa, Mycobacterium
LIGGQAMVWLTLPFGPAGALGGFGAT

SEQ ID NO: 361300 - protein, 27 aa, Mycobacterium
LIGGRLYHVITDWPTYFGDGGAGPAAA

SEQ ID NO: 361301 - protein, 17 aa, Mycobacterium
LIGIPLLLVVVLAVLIW

SEQ ID NO: 361302 - protein, 28 aa, Mycobacterium
LIGLAVIAAYLLLTLLLSRLFTPDEVAP

SEQ ID NO: 361303 - protein, 33 aa, Mycobacterium
LIGLTLSYAFILFAAVALVVWLVMGGGRGPSPG

SEQ ID NO: 361304 - protein, 18 aa, Mycobacterium
LIGLVFLALGWSTKAACL

SEQ ID NO: 361305 - protein, 20 aa, Mycobacterium
LIGNVLSGVLRGGLGGGGFG

SEQ ID NO: 361306 - protein, 30 aa, Mycobacterium
LIGRARFMTPLRAILLIAVVFLALGYSTKA

SEQ ID NO: 361307 - protein, 26 aa, Mycobacterium
LIGTGWVFLLNFVSFIAVGIALWRMR

SEQ ID NO: 361308 - protein, 25 aa, Mycobacterium
LIGVFAAFLLGWRVLAVHCVFATVA

SEQ ID NO: 361309 - protein, 18 aa, Mycobacterium
LIGYVGLADTARASARPL

SEQ ID NO: 361310 - protein, 29 aa, Mycobacterium
LIIAGLVVRYIWWVVGAAALAGVVYLCVV

SEQ ID NO: 361311 - protein, 22 aa, Mycobacterium
LIILSFLLGLVLTCALMVRSTK

SEQ ID NO: 361312 - protein, 31 aa, Mycobacterium
LIIVAASALILIFIIMMVLTRAVVAAAVIVG

SEQ ID NO: 361313 - protein, 19 aa, Mycobacterium
LIIYTQLFTTDSGWRESVL

SEQ ID NO: 361314 - protein, 25 aa, Mycobacterium
LIKADFWRVFGIWLLAAIVAQFIAG

SEQ ID NO: 361315 - protein, 27 aa, Mycobacterium
LIKPFVDWLANIPFLQALFSGFDPYLL

SEQ ID NO: 361316 - protein, 18 aa, Mycobacterium
LILAALGLVLIINISVPF

SEQ ID NO: 361317 - protein, 19 aa, Mycobacterium
LILAIALAIAVIFASALAG

SEQ ID NO: 361318 - protein, 22 aa, Mycobacterium
LILALLAFRHFGQGYAILLLAI

SEQ ID NO: 361319 - protein, 18 aa, Mycobacterium
LILDALLAFAVWASVPGT

SEQ ID NO: 361320 - protein, 24 aa, Mycobacterium
LILIPVLMLVFPGMAPATALGTNK

SEQ ID NO: 361321 - protein, 26 aa, Mycobacterium
LILLGAGLLAFFKPQGKLGASSLLTD

SEQ ID NO: 361322 - protein, 19 aa, Mycobacterium
LILLILVVAAFPGLFTGAD

SEQ ID NO: 361323 - protein, 19 aa, Mycobacterium
LILPAVVFLAFNPSGENAH

SEQ ID NO: 361324 - protein, 32 aa, Mycobacterium; identical to SEQ ID NO: 162958

SEQ ID NO: 361325 - protein, 33 aa, Mycobacterium
LILRENVVALTVLWLLNIGEYLQDLTLRRTRRA

SEQ ID NO: 361326 - protein, 39 aa, Mycobacterium
LILRIVALFYVIALLIVPLGAILWQTFAPGLGAFWASIT

SEQ ID NO: 361327 - protein, 18 aa, Mycobacterium
LILRLVLGLTLAAHGLNK

SEQ ID NO: 361328 - protein, 18 aa, Mycobacterium
LILRLVLGVTLAAHGYNK

SEQ ID NO: 361329 - protein, 17 aa, Mycobacterium
LILVKAAASVSGAAATV

SEQ ID NO: 361330 - protein, 19 aa, Mycobacterium
LILVRALFLEKALDQFYQA

SEQ ID NO: 361331 - protein, 22 aa, Mycobacterium
LIMLQALLDRHSMLRLRAADDG

SEQ ID NO: 361332 - protein, 19 aa, Mycobacterium
LIMVQPAVYRDAGLPPLRS

SEQ ID NO: 361333 - protein, 17 aa, Mycobacterium
LINCDPDTYRRVASAAG

SEQ ID NO: 361334 - protein, 29 aa, Mycobacterium
LINCGYPLIERFPLMLGTAGIVLLIGLTR

SEQ ID NO: 361335 - protein, 33 aa, Mycobacterium
LINCGYPLIQRFPLMFFTSAAVLLIGLARWYFA

SEQ ID NO: 361336 - protein, 30 aa, Mycobacterium
LINRLKAFGLALVYLALAFTAAQFALGVGR

SEQ ID NO: 361337 - protein, 19 aa, Mycobacterium
LIPANWRTFTLADVAVIFG

SEQ ID NO: 361338 - protein, 23 aa, Mycobacterium
LIPAQVSFMRMLGLGLTLAVLAD

SEQ ID NO: 361339 - protein, 21 aa, Mycobacterium
LIPFIGPRFDFAYTPGQAWTA

SEQ ID NO: 361340 - protein, 17 aa, Mycobacterium
LIPFVIIQAVFGFSLLE

SEQ ID NO: 361341 - protein, 17 aa, Mycobacterium
LIPGDHVLVVRPSIWYR

SEQ ID NO: 361342 - protein, 25 aa, Mycobacterium
LIPIGLVWLAFLPNAPYLVTDLVHL

SEQ ID NO: 361343 - protein, 17 aa, Mycobacterium
LIPLVGAAAILVLPAHQ

SEQ ID NO: 361344 - protein, 19 aa, Mycobacterium
LIPMLPAAFVLAVVTAGTK

SEQ ID NO: 361345 - protein, 27 aa, Mycobacterium
LIPNAPPLTVWFGSVRYVFAPGRDVLA

SEQ ID NO: 361346 - protein, 27 aa, Mycobacterium
LIPRLYALHILLIPGIILALIGAHLAL

SEQ ID NO: 361347 - protein, 26 aa, Mycobacterium
LIPRLYALHILLIPGIILALIGVHLA

SEQ ID NO: 361348 - protein, 27 aa, Mycobacterium
LIPRLYALHILLLPGIILALIGLHLAL

SEQ ID NO: 361349 - protein, 26 aa, Mycobacterium
LIPRLYAMHILLIPAIILALIGIHLA

SEQ ID NO: 361350 - protein, 17 aa, Mycobacterium
LIPRMVRVLAVPIVVFW

SEQ ID NO: 361351 - protein, 17 aa, Mycobacterium
LIPVLPTQSHRFDLIGV

SEQ ID NO: 361352 - protein, 27 aa, Mycobacterium
LIPVRPDLPEVLLPQNYHPPKDLAPPP

SEQ ID NO: 361353 - protein, 23 aa, Mycobacterium
LIQALVNLNFWGALEAVIMLVLT

SEQ ID NO: 361354 - protein, 19 aa, Mycobacterium
LIQLFMTFVALACARGVVA

SEQ ID NO: 361355 - protein, 17 aa, Mycobacterium
LIQLYIVGVFVSFTLSQ

SEQ ID NO: 361356 - protein, 21 aa, Mycobacterium
LIRAGFIGAVLVVLVIAVGLN

SEQ ID NO: 361357 - protein, 35 aa, Mycobacterium
LIRAGFIGVILIILVIAVGLQPERLLSWATAIRYQ

SEQ ID NO: 361358 - protein, 19 aa, Mycobacterium
LIRGAAAWRGSNRNPAWLL

SEQ ID NO: 361359 - protein, 29 aa, Mycobacterium
LIRVDRCARAVWPLCLAASAAIPFVTAGA

SEQ ID NO: 361360 - protein, 19 aa, Mycobacterium
LIRWKDAIIALGLLASLDD

SEQ ID NO: 361361 - protein, 19 aa, Mycobacterium
LISILISVLVAWLMFTWMI

SEQ ID NO: 361362 - protein, 21 aa, Mycobacterium
LISIWRRIMSSPLLTLNGWVA

SEQ ID NO: 361363 - protein, 31 aa, Mycobacterium
LISMGTLAAFGWSLYALFWGTAGVPGMTHPF

SEQ ID NO: 361364 - protein, 18 aa, Mycobacterium
LISMVIIGLELFAAQSVT

SEQ ID NO: 361365 - protein, 17 aa, Mycobacterium
LISMWGWRRGERWVWWS

SEQ ID NO: 361366 - protein, 18 aa, Mycobacterium
LISNAVVAFAVIGFASLA

SEQ ID NO: 361367 - protein, 22 aa, Mycobacterium
LISTIGLILGFVIAVSSFLAAV

SEQ ID NO: 361368 - protein, 21 aa, Mycobacterium
LISVLLAMVLLYIRPRRRRNE

SEQ ID NO: 361369 - protein, 32 aa, Mycobacterium
LISVLPIVALMVVAVWLLGVGTLMDLALVQLV

SEQ ID NO: 361370 - protein, 32 aa, Mycobacterium
LISVTTILMFLAFGSLVLPIKAAVMSALGLGS

SEQ ID NO: 361371 - protein, 19 aa, Mycobacterium
LITASWLRHPHLRDYSAAR

SEQ ID NO: 361372 - protein, 25 aa, Mycobacterium
LITDKDFVYLIDFGLVRTAGEQGLT

SEQ ID NO: 361373 - protein, 29 aa, Mycobacterium
LITEYAGWRWLFLINVPICAFALRATRTI

SEQ ID NO: 361374 - protein, 17 aa, Mycobacterium
LITIARAFLAGPQFLIL

SEQ ID NO: 361375 - protein, 17 aa, Mycobacterium
LITIARAILARPQVLVL

SEQ ID NO: 361376 - protein, 21 aa, Mycobacterium
LITIVIWVWAVRLTANWVRGF

SEQ ID NO: 361377 - protein, 18 aa, Mycobacterium
LITLALMSALAALYLGGI

SEQ ID NO: 361378 - protein, 23 aa, Mycobacterium
LITLTYFPPLWRKVMDHRVIEHY

SEQ ID NO: 361379 - protein, 18 aa, Mycobacterium
LITLVGLLMLLKAVAYWF

SEQ ID NO: 361380 - protein, 19 aa, Mycobacterium
LITSLRDHTYAKAPYLLAG

SEQ ID NO: 361381 - protein, 21 aa, Mycobacterium
LITTLDGVLPETVTLLKSSKV

SEQ ID NO: 361382 - protein, 25 aa, Mycobacterium
LITTLIWITFLTTDPLRFTLFYWIP

SEQ ID NO: 361383 - protein, 17 aa, Mycobacterium
LITYVLAGALIGLITPL

SEQ ID NO: 361384 - protein, 36 aa, Mycobacterium
LIVAGQFLIAFLQLIWTLAIFVLLLVEIIKEFAFFL

SEQ ID NO: 361385 - protein, 23 aa, Mycobacterium
LIVAGYIAALGLGALLVKPLLGH

SEQ ID NO: 361386 - protein, 32 aa, Mycobacterium
LIVAIAAFVLIFLIMMFLTRSLMAPFVIIGTV

SEQ ID NO: 361387 - protein, 26 aa, Mycobacterium
LIVALIGTIVMLYVSGVRSLSTGFFP

SEQ ID NO: 361388 - protein, 26 aa, Mycobacterium
LIVALIGTIVMLYVSGVRSLTTGFFP

SEQ ID NO: 361389 - protein, 28 aa, Mycobacterium
LIVAPAFALTYLLLAPTTWRRRAVHLLA

SEQ ID NO: 361390 - protein, 20 aa, Mycobacterium
LIVAVLLLLVYLLRSRSTAQ

SEQ ID NO: 361391 - protein, 23 aa, Mycobacterium
LIVDLLTIPLFTGIIGYITNWTG

SEQ ID NO: 361392 - protein, 24 aa, Mycobacterium
LIVGFCWALFFNGFLGAKLGVFYY

SEQ ID NO: 361393 - protein, 20 aa, Mycobacterium
LIVGLWIPAIGIAAAAGLVI

SEQ ID NO: 361394 - protein, 20 aa, Mycobacterium
LIVIAAVRFVPLPTALQMRD

SEQ ID NO: 361395 - protein, 17 aa, Mycobacterium
LIVLIAVLFLGSTITVA

SEQ ID NO: 361396 - protein, 21 aa, Mycobacterium
LIVLLAVTGLRRLVFDAVPME

SEQ ID NO: 361397 - protein, 20 aa, Mycobacterium
LIVPEYLFVQSPRDLRTAKT

SEQ ID NO: 361398 - protein, 25 aa, Mycobacterium
LIVPLGLILWRAFAPGLVQFWEYIS

SEQ ID NO: 361399 - protein, 17 aa, Mycobacterium
LIVRAFMTPSIAAALGR

SEQ ID NO: 361400 - protein, 31 aa, Mycobacterium
LIVSDRGYFVFLALLPFIMGSLSMSVPGDVG

SEQ ID NO: 361401 - protein, 28 aa, Mycobacterium
LIVSWIIVMLLTFYWARVVWQRTIVQLA

SEQ ID NO: 361402 - protein, 17 aa, Mycobacterium
LIVTCTAPWMVVMMIGW

SEQ ID NO: 361403 - protein, 34 aa, Mycobacterium
LIVTTTVLMFLAFGSVVLPIKAALMSALTLGSTM

SEQ ID NO: 361404 - protein, 18 aa, Mycobacterium
LIVVGAVIALLIFAGLFV

SEQ ID NO: 361405 - protein, 20 aa, Mycobacterium
LIVVVTITLFISLAVYGASG

SEQ ID NO: 361406 - protein, 17 aa, Mycobacterium
LIVVVVITLFISLAVYG

SEQ ID NO: 361407 - protein, 20 aa, Mycobacterium
LIWAALVLRRRELLKVLIGA

SEQ ID NO: 361408 - protein, 17 aa, Mycobacterium
LIWVAKGWAISAAVLIV

SEQ ID NO: 361409 - protein, 20 aa, Mycobacterium
LIYFATVVVITLVAALAVVQ

SEQ ID NO: 361410 - protein, 25 aa, Mycobacterium
LIYGALGAVFLLLVLQLQTVSGFSP

SEQ ID NO: 361411 - protein, 24 aa, Mycobacterium
LIYTDLWIGFTTVSALLILGLAQT

SEQ ID NO: 361412 - protein, 24 aa, Mycobacterium
LIYVASLFGYWWVSSSYPALPAFD

SEQ ID NO: 361413 - protein, 28 aa, Mycobacterium
LKACGWAFLIWGLYAYLWAFVLYIVQMT

SEQ ID NO: 361414 - protein, 20 aa, Mycobacterium
LKAHPVIGPWLDRLQAFDVF

SEQ ID NO: 361415 - protein, 20 aa, Mycobacterium
LKAHPVIGPWLDRLQAFNVF

SEQ ID NO: 361416 - protein, 30 aa, Mycobacterium
LKAIRAKTVPIMLGIALVASAALATFVYLT

SEQ ID NO: 361417 - protein, 34 aa, Mycobacterium
LKDLLINCGYPLIERFPLMLGTAGAVLAIGLARW

SEQ ID NO: 361418 - protein, 25 aa, Mycobacterium
LKDYVAFPLLAGPFAPFVFAGNLSA

SEQ ID NO: 361419 - protein, 22 aa, Mycobacterium
LKDYVAFPLLAGPFAPFVFTGN

SEQ ID NO: 361420 - protein, 18 aa, Mycobacterium
LKFAQLVGLVFAVIGAVG

SEQ ID NO: 361421 - protein, 29 aa, Mycobacterium
LKGDLSLMLFPLLSTLFAFLAVVAIWAPT

SEQ ID NO: 361422 - protein, 21 aa, Mycobacterium
LKGNWYLLGPAFVAAIAYVDP

SEQ ID NO: 361423 - protein, 19 aa, Mycobacterium
LKGRLLFMPNVMVTSVPWQ

SEQ ID NO: 361424 - protein, 22 aa, Mycobacterium
LKGWYMSFWPVLALTLIMVSSV

SEQ ID NO: 361425 - protein, 35 aa, Mycobacterium
LKMALVRLIPQTLRGFPVAALLWAGAGLAVVTLIV

SEQ ID NO: 361426 - protein, 19 aa, Mycobacterium
LKMLLATVVVVVVGVGLGL

SEQ ID NO: 361427 - protein, 21 aa, Mycobacterium
LKMMGPVLARISPLLSRHPWA

SEQ ID NO: 361428 - protein, 29 aa, Mycobacterium
LKMSLNTSYYRLMLKLKGGPQAVADAAHQ

SEQ ID NO: 361429 - protein, 40 aa, Mycobacterium
LKNITILTIILIVAMLLLVYRSVPSLLVPLPAVLIELLAA

SEQ ID NO: 361430 - protein, 18 aa, Mycobacterium
LKPVGPGLLSRFLIALEV

SEQ ID NO: 361431 - protein, 29 aa, Mycobacterium
LKQSLNTSYYRLMLKLKGGPQAVADAAHQ

SEQ ID NO: 361432 - protein, 24 aa, Mycobacterium
LKRHSLRLYHSKGGPLYAVRGALL

SEQ ID NO: 361433 - protein, 24 aa, Mycobacterium
LKRHWVIPILLISALFCSAHFSYT

SEQ ID NO: 361434 - protein, 28 aa, Mycobacterium
LKRSLNTSFYRLMLKLKNGPEDVAAAAH

SEQ ID NO: 361435 - protein, 20 aa, Mycobacterium
LKRWWTLVVAAAVVAVVAFG

SEQ ID NO: 361436 - protein, 22 aa, Mycobacterium
LKSIKPPPRRQPHRALVVWISF

SEQ ID NO: 361437 - protein, 18 aa, Mycobacterium
LKSLKPFIKEYQPALIGV

SEQ ID NO: 361438 - protein, 29 aa, Mycobacterium
LKSRRQETWLMIVLGVGFGLGVALTLSRL

SEQ ID NO: 361439 - protein, 20 aa, Mycobacterium
LKSSWYLLGPAFVAAIAYVD

SEQ ID NO: 361440 - protein, 34 aa, Mycobacterium
LKSWVRKYTVRRGALLFGKLLPVGIGVVVGAVGN

SEQ ID NO: 361441 - protein, 27 aa, Mycobacterium
LKTLLGAPVWIGPLLVGAIVITNVVAG

SEQ ID NO: 361442 - protein, 32 aa, Mycobacterium
LKTMFATLLHHWPVLMLLMGISSITMVTMVGW

SEQ ID NO: 361443 - protein, 21 aa, Mycobacterium
LKTSWYLLGPAFVAAIAYVDP

SEQ ID NO: 361444 - protein, 19 aa, Mycobacterium
LKVMLRWLNAFVSKPGQTI

SEQ ID NO: 361445 - protein, 24 aa, Mycobacterium
LKVTFLALAVPILLIGLIAVRLPS

SEQ ID NO: 361446 - protein, 29 aa, Mycobacterium
LLAAALGVSILLGVAIGWGLYGNTRSPLD

SEQ ID NO: 361447 - protein, 28 aa, Mycobacterium
LLAAAVLLRPRLPRVLAAITLGVLSLGS

SEQ ID NO: 361448 - protein, 26 aa, Mycobacterium
LLAAGARPAFIGPLLLMCGVCSLAGL

SEQ ID NO: 361449 - protein, 30 aa, Mycobacterium
LLAAIVPAPPLWPHSWPFIAQVLAAILVAD

SEQ ID NO: 361450 - protein, 17 aa, Mycobacterium
LLAALIQRPSVLDPAVD

SEQ ID NO: 361451 - protein, 20 aa, Mycobacterium
LLAALLAGLSLLPKAKSYVG

SEQ ID NO: 361452 - protein, 18 aa, Mycobacterium
LLAALLPVALVSSLIGIP

SEQ ID NO: 361453 - protein, 18 aa, Mycobacterium
LLAALTRGRPAGPVVVTH

SEQ ID NO: 361454 - protein, 24 aa, Mycobacterium
LLAARFINWSARRITRRIDAQYLE

SEQ ID NO: 361455 - protein, 34 aa, Mycobacterium
LLAAVLIVWRRDLLAIIRLLAWQGAALAAIPVLR

SEQ ID NO: 361456 - protein, 21 aa, Mycobacterium
LLAAVVLYILAIGQVKGFAFT

SEQ ID NO: 361457 - protein, 27 aa, Mycobacterium
LLAAWPLLRPRLPRVALSVLLGALSLG

SEQ ID NO: 361458 - protein, 22 aa, Mycobacterium
LLAGFFIITEKQYGFGDLVRLT

SEQ ID NO: 361459 - protein, 25 aa, Mycobacterium
LLAGLRLFHSILDSLLIFGALITGE

SEQ ID NO: 361460 - protein, 19 aa, Mycobacterium
LLAGPLMHFVWDAPLPDDY

SEQ ID NO: 361461 - protein, 18 aa, Mycobacterium
LLAGVIVVVPLYCVALLM

SEQ ID NO: 361462 - protein, 26 aa, Mycobacterium
LLAHPGLPLWPYLVCAAFTGLGGGNY

SEQ ID NO: 361463 - protein, 17 aa, Mycobacterium
LLAISLSAGWQLTFGPY

SEQ ID NO: 361464 - protein, 21 aa, Mycobacterium
LLAIWIGIGFIFRGVATAVSA

SEQ ID NO: 361465 - protein, 19 aa, Mycobacterium
LLAIWIGVGFVFRGVATAV

SEQ ID NO: 361466 - protein, 25 aa, Mycobacterium
LLAKGLVYALITLGLIIAVQQLEGH

SEQ ID NO: 361467 - protein, 24 aa, Mycobacterium
LLAKGLVYALITLGLLIAVNQLEA

SEQ ID NO: 361468 - protein, 25 aa, Mycobacterium
LLAKGLVYALLTLALLITVNQLEAH

SEQ ID NO: 361469 - protein, 19 aa, Mycobacterium
LLAKTAVFCGFAILQSTVI

SEQ ID NO: 361470 - protein, 17 aa, Mycobacterium
LLALAVAVALVIYLLTN

SEQ ID NO: 361471 - protein, 25 aa, Mycobacterium
LLALFGVAKLMRFIPRSVMVGFVNA

SEQ ID NO: 361472 - protein, 20 aa, Mycobacterium
LLALGLAMVAAGVWPITAIG

SEQ ID NO: 361473 - protein, 17 aa, Mycobacterium
LLALILSALLVPVVDWL

SEQ ID NO: 361474 - protein, 19 aa, Mycobacterium
LLALIRLFFDPTHVVLWAA

SEQ ID NO: 361475 - protein, 19 aa, Mycobacterium
LLALLCAVPVLSSPSPAVV

SEQ ID NO: 361476 - protein, 19 aa, Mycobacterium
LLALLFGLYLIYQGISFAA

SEQ ID NO: 361477 - protein, 17 aa, Mycobacterium
LLALLIAPFWISYMMRM

SEQ ID NO: 361478 - protein, 20 aa, Mycobacterium
LLALLVGIAAVYWLCNLVAR

SEQ ID NO: 361479 - protein, 27 aa, Mycobacterium
LLALMFGFYVTCFVFVFGVLGVLMRAV

SEQ ID NO: 361480 - protein, 28 aa, Mycobacterium
LLALPMRGFMFLTRPMLRALNRAANWCL

SEQ ID NO: 361481 - protein, 27 aa, Mycobacterium
LLALSGRRLFWPFIPEPDAGATLESGL

SEQ ID NO: 361482 - protein, 19 aa, Mycobacterium
LLALSLLECNFGGLLSFVI

SEQ ID NO: 361483 - protein, 30 aa, Mycobacterium
LLALSPVFGFAQFALLIAGLTAGVSLLSGK

SEQ ID NO: 361484 - protein, 26 aa, Mycobacterium
LLALTKVVLPQWYWLGLTAGVLAGAV

SEQ ID NO: 361485 - protein, 26 aa, Mycobacterium
LLAMAMAALGWLPPAAGALLQEGIDV

SEQ ID NO: 361486 - protein, 24 aa, Mycobacterium
LLAMLPILVIFIGLQRRMIKGLTS

SEQ ID NO: 361487 - protein, 20 aa, Mycobacterium
LLANLIVVLLLRSHSKESLA

SEQ ID NO: 361488 - protein, 19 aa, Mycobacterium
LLAPGGKTAFFGPPSQIGP

SEQ ID NO: 361489 - protein, 18 aa, Mycobacterium
LLAPLALPQTGTVRMQLV

SEQ ID NO: 361490 - protein, 24 aa, Mycobacterium
LLAPLLLLPLLNRQWRALVAAFVV

SEQ ID NO: 361491 - protein, 24 aa, Mycobacterium
LLAPLLLLPLLNRQWRVFAAAFGI

SEQ ID NO: 361492 - protein, 20 aa, Mycobacterium
LLAQTWRPWQGPVVVAVALI

SEQ ID NO: 361493 - protein, 26 aa, Mycobacterium
LLARFIPGTVLLIGFALMMIATAVAM

SEQ ID NO: 361494 - protein, 28 aa, Mycobacterium
LLARTETPALWIFLGCYVALAALTWAVY

SEQ ID NO: 361495 - protein, 17 aa, Mycobacterium
LLASFAMFFVVAVWKEL

SEQ ID NO: 361496 - protein, 25 aa, Mycobacterium
LLASLPLKRAVVLRGLLSWPEDSAA

SEQ ID NO: 361497 - protein, 19 aa, Mycobacterium
LLASTLMVMGLVLAGPASA

SEQ ID NO: 361498 - protein, 20 aa, Mycobacterium
LLATFSWPALRRTATLFLVG

SEQ ID NO: 361499 - protein, 30 aa, Mycobacterium
LLATRRPVSNFMLLVRQFASPVVALLATAM

SEQ ID NO: 361500 - protein, 29 aa, Mycobacterium
LLAVATVARSYVFLVPSTVPDVSAGQVEE

SEQ ID NO: 361501 - protein, 17 aa, Mycobacterium
LLAVFEKDEIRSEARPT

SEQ ID NO: 361502 - protein, 19 aa, Mycobacterium
LLCDRAFEWALGASDTIDR

SEQ ID NO: 361503 - protein, 23 aa, Mycobacterium
LLCGLPILLVVALAVKLSSKGPV

SEQ ID NO: 361504 - protein, 24 aa, Mycobacterium
LLCVAMLGYFVLLGRMALAMIASG

SEQ ID NO: 361505 - protein, 17 aa, Mycobacterium
LLCWAMEPLLQALCVVS

SEQ ID NO: 361506 - protein, 26 aa, Mycobacterium
LLDASHSWALAPRRQSPPPYEGPDPG

SEQ ID NO: 361507 - protein, 25 aa, Mycobacterium
LLDATVVRMFLVPSVMKLLGDDCWW

SEQ ID NO: 361508 - protein, 26 aa, Mycobacterium
LLDGRIESLLPSILEGRELWQRVQAA

SEQ ID NO: 361509 - protein, 32 aa, Mycobacterium
LLDIARLRWQFERLARSIPISAPWAANRAADL

SEQ ID NO: 361510 - protein, 20 aa, Mycobacterium
LLDITIVRTVLVPAAMSIIG

SEQ ID NO: 361511 - protein, 20 aa, Mycobacterium
LLDPTMLWKSLPAAVRKLDP

SEQ ID NO: 361512 - protein, 24 aa, Mycobacterium
LLDQGFPRVHRWARGVDLIRFAPS

SEQ ID NO: 361513 - protein, 17 aa, Mycobacterium
LLDRHAMLRLRVENWML

SEQ ID NO: 361514 - protein, 18 aa, Mycobacterium
LLDRLRARYGWFDHVLRA

SEQ ID NO: 361515 - protein, 19 aa, Mycobacterium
LLDTFLVRTITVPAAAVLI

SEQ ID NO: 361516 - protein, 21 aa, Mycobacterium
LLDTFLVRTITVPSLAVLVGN

SEQ ID NO: 361517 - protein, 42 aa, Mycobacterium
LLDTLIVRSFIVPSLVRLFGTWFWWPTRVFARPLRRQNVGAH

SEQ ID NO: 361518 - protein, 19 aa, Mycobacterium
LLDVRLFADPGFATGVGAI

SEQ ID NO: 361519 - protein, 33 aa, Mycobacterium
LLEADARLRRQLALRYVIFGGEALDVRRLAPWY

SEQ ID NO: 361520 - protein, 23 aa, Mycobacterium
LLEAFVFAYIGLHLRFVLEDLRD

SEQ ID NO: 361521 - protein, 23 aa, Mycobacterium
LLEAFVFAYIGLHLRFVLEHLNE

SEQ ID NO: 361522 - protein, 19 aa, Mycobacterium
LLEALAHFQLDRTGEKIVL

SEQ ID NO: 361523 - protein, 17 aa, Mycobacterium
LLEGTWASFLASLVVAI

SEQ ID NO: 361524 - protein, 17 aa, Mycobacterium
LLEIFPPSIAIAEEARD

SEQ ID NO: 361525 - protein, 20 aa, Mycobacterium
LLEKPFDLVGIPDALLHTVS

SEQ ID NO: 361526 - protein, 19 aa, Mycobacterium
LLELAIPYALHAMSDEERV

SEQ ID NO: 361527 - protein, 17 aa, Mycobacterium
LLELATPYALHAVSDEE

SEQ ID NO: 361528 - protein, 21 aa, Mycobacterium
LLEPYGPRPLVRALLEGPSGA

SEQ ID NO: 361529 - protein, 29 aa, Mycobacterium
LLEQLHYRHELLYYKVLTEHLVELMPVVY

SEQ ID NO: 361530 - protein, 20 aa, Mycobacterium
LLERLPVSSYRRPLLGTGFC

SEQ ID NO: 361531 - protein, 24 aa, Mycobacterium
LLERVLANLIDNALRYAPDGLIRV

SEQ ID NO: 361532 - protein, 23 aa, Mycobacterium
LLERVLANLIDNALRYAPHCLVR

SEQ ID NO: 361533 - protein, 18 aa, Mycobacterium
LLEVTVFISLFALMLAMP

SEQ ID NO: 361534 - protein, 19 aa, Mycobacterium
LLFAVMPFHAFFGIALMTT

SEQ ID NO: 361535 - protein, 20 aa, Mycobacterium
LLFGAYFLRDYFVLIVVAAV

SEQ ID NO: 361536 - protein, 20 aa, Mycobacterium
LLFLFILGDVLGAGIYALMG

SEQ ID NO: 361537 - protein, 27 aa, Mycobacterium
LLFNYFLGMPHWLGVVLIAAIAVAYTG

SEQ ID NO: 361538 - protein, 28 aa, Mycobacterium
LLFPVVQPWYVLWAIIPLAAWATRPRFR

SEQ ID NO: 361539 - protein, 17 aa, Mycobacterium
LLFTAIELQVRRVEEPY

SEQ ID NO: 361540 - protein, 17 aa, Mycobacterium
LLFVFTQTVRHRDFFLP

SEQ ID NO: 361541 - protein, 20 aa, Mycobacterium
LLFYSSFLIVLYVATARISW

SEQ ID NO: 361542 - protein, 26 aa, Mycobacterium
LLFYVFFEAMLIPMYFLIGGFGQGRA

SEQ ID NO: 361543 - protein, 25 aa, Mycobacterium
LLGACAAIYLVLLGVSVAAAVALTD

SEQ ID NO: 361544 - protein, 18 aa, Mycobacterium
LLGALLIGGGVFGTAMLM

SEQ ID NO: 361545 - protein, 25 aa, Mycobacterium
LLGALLPSVIYVIVGAVLVPLIMYI

SEQ ID NO: 361546 - protein, 29 aa, Mycobacterium
LLGASVIVAWVTPLGPVVLGMKALALAVG

SEQ ID NO: 361547 - protein, 25 aa, Mycobacterium
LLGATVVFLACRWAQADGAAPLWVG

SEQ ID NO: 361548 - protein, 28 aa, Mycobacterium
LLGEIALYSFIILLLTGVWLTLFFDPSM

SEQ ID NO: 361549 - protein, 17 aa, Mycobacterium
LLGFAAFLTTIALLLVE

SEQ ID NO: 361550 - protein, 19 aa, Mycobacterium
LLGFAVVLLVAGRLGDRFG

SEQ ID NO: 361551 - protein, 20 aa, Mycobacterium
LLGFPVWMIFVLNTAGLLFQ

SEQ ID NO: 361552 - protein, 27 aa, Mycobacterium
LLGGILFLPIDMWQRMFLAMSALFVVT

SEQ ID NO: 361553 - protein, 24 aa, Mycobacterium
LLGGTGMLYVIYLLAKNASFAAGD

SEQ ID NO: 361554 - protein, 36 aa, Mycobacterium
LLGGYFTDHFTWRWAFWINVPISVVVFFVAAAAIPS

SEQ ID NO: 361555 - protein, 33 aa, Mycobacterium
LLGGYFTDHLTWRWAFWINVPIGIVVLIVALAT

SEQ ID NO: 361556 - protein, 33 aa, Mycobacterium
LLGGYFTDYLTWRWAFWVNVPISVVVIFVAAAA

SEQ ID NO: 361557 - protein, 18 aa, Mycobacterium
LLGIMERGQLLPAGELLE

SEQ ID NO: 361558 - protein, 20 aa, Mycobacterium
LLGITRPTEVTIAIPANPSA

SEQ ID NO: 361559 - protein, 18 aa, Mycobacterium
LLGLAIAVAGLVDQTARH

SEQ ID NO: 361560 - protein, 19 aa, Mycobacterium
LLGLALGFLGVCVVLAPWQ

SEQ ID NO: 361561 - protein, 19 aa, Mycobacterium
LLGLILVVISRPRPVQNLL

SEQ ID NO: 361562 - protein, 27 aa, Mycobacterium
LLGLVLAGVVLLFARPRLRIGAAGISV

SEQ ID NO: 361563 - protein, 18 aa, Mycobacterium
LLGPLVGLALLTLDFRMT

SEQ ID NO: 361564 - protein, 17 aa, Mycobacterium
LLGQWNPPLWGWMVALS

SEQ ID NO: 361565 - protein, 25 aa, Mycobacterium
LLGSRLIFIHLFVVAGVVWWVRQGL

SEQ ID NO: 361566 - protein, 26 aa, Mycobacterium
LLGTLPTHWYLHSVADLEQHARSKQR

SEQ ID NO: 361567 - protein, 25 aa, Mycobacterium
LLGTVPMGLLTYRYRLRVLVAATFA

SEQ ID NO: 361568 - protein, 23 aa, Mycobacterium
LLGTVPTGLLAYRFRLRVLIAAT

SEQ ID NO: 361569 - protein, 20 aa, Mycobacterium
LLGVAGYNFGRFCLTPLPRA

SEQ ID NO: 361570 - protein, 26 aa, Mycobacterium
LLGVFSRWYVPQLLITGTADAAVLLA

SEQ ID NO: 361571 - protein, 27 aa, Mycobacterium
LLGVGWVLFVWSVLGQLFGLVLLVGGV

SEQ ID NO: 361572 - protein, 18 aa, Mycobacterium
LLGVMERGRMLPPEELHE

SEQ ID NO: 361573 - protein, 24 aa, Mycobacterium
LLGVPPWMVFVAFSISLIYQFWIH

SEQ ID NO: 361574 - protein, 20 aa, Mycobacterium
LLGVPWLLSFAQPTIWEIGR

SEQ ID NO: 361575 - protein, 17 aa, Mycobacterium
LLGWLTAGAVMIALLTL

SEQ ID NO: 361576 - protein, 25 aa, Mycobacterium
LLGYALQMMKILNLLIADLIVLALD

SEQ ID NO: 361577 - protein, 21 aa, Mycobacterium
LLHLLVDLRRRKRLTVVVISH

SEQ ID NO: 361578 - protein, 28 aa, Mycobacterium
LLIAACLFIAMFILLRRKRVPGVARGPA

SEQ ID NO: 361579 - protein, 20 aa, Mycobacterium
LLIAAKWLVEPLGPSLQFQV

SEQ ID NO: 361580 - protein, 32 aa, Mycobacterium
LLIAGVAALCLIFIIMLIMTRSFIAALVIVGT

SEQ ID NO: 361581 - protein, 21 aa, Mycobacterium
LLIAVLFLGFLVLEGFDFGVG

SEQ ID NO: 361582 - protein, 18 aa, Mycobacterium
LLIFVVVVVILVTVLVQG

SEQ ID NO: 361583 - protein, 25 aa, Mycobacterium
LLIGARRFGWFEPKSTVRSTRLWRR

SEQ ID NO: 361584 - protein, 28 aa, Mycobacterium
LLIGGFTKFTLIPLGVVLGALVAFIIFG

SEQ ID NO: 361585 - protein, 29 aa, Mycobacterium
LLIGVAAFILYEAVRRLSEAPAVPGVPMI

SEQ ID NO: 361586 - protein, 22 aa, Mycobacterium
LLIIMGAFMYFASRRQKKAMQA

SEQ ID NO: 361587 - protein, 19 aa, Mycobacterium
LLIKCGIVLLLVFTAFVAN

SEQ ID NO: 361588 - protein, 19 aa, Mycobacterium
LLILLGVSVAMIAATGTFT

SEQ ID NO: 361589 - protein, 30 aa, Mycobacterium
LLIRFTGPEVWWLLTVARWAARMPAATVPV

SEQ ID NO: 361590 - protein, 17 aa, Mycobacterium
LLISIHSVLLALKGVLM

SEQ ID NO: 361591 - protein, 20 aa, Mycobacterium
LLITAALTLAAFAAARPLVN

SEQ ID NO: 361592 - protein, 17 aa, Mycobacterium
LLITLVTVGVIFLMLLL

SEQ ID NO: 361593 - protein, 33 aa, Mycobacterium
LLIVAIAAFVLIFLIMLYLTRSLVAALVIPGTV

SEQ ID NO: 361594 - protein, 32 aa, Mycobacterium
LLIVAIAAFVLIFLIMLYLTRSLVAAMVIPGT

SEQ ID NO: 361595 - protein, 25 aa, Mycobacterium
LLIVEGVVVNFWLLRRDSVSVGTDD

SEQ ID NO: 361596 - protein, 20 aa, Mycobacterium
LLIVSVLTVLLAVGTKLSSR

SEQ ID NO: 361597 - protein, 18 aa, Mycobacterium
LLIWTAVFVTMSAIYFSL

SEQ ID NO: 361598 - protein, 19 aa, Mycobacterium
LLIYAMVFLLPGDPLAAMA

SEQ ID NO: 361599 - protein, 19 aa, Mycobacterium
LLKDIPLLGLSFWTLSDAL

SEQ ID NO: 361600 - protein, 28 aa, Mycobacterium
LLKKSYPLLLRRLVTLVPALLVLAIGVD

SEQ ID NO: 361601 - protein, 17 aa, Mycobacterium
LLKRRWPAPVVFALFLV

SEQ ID NO: 361602 - protein, 21 aa, Mycobacterium
LLKSWVKRYTLRRGALMFGKV

SEQ ID NO: 361603 - protein, 20 aa, Mycobacterium
LLLAAMVGVLYWFGAHPISG

SEQ ID NO: 361604 - protein, 24 aa, Mycobacterium
LLLAGGLFLMRFLDADATFLDIMW

SEQ ID NO: 361605 - protein, 24 aa, Mycobacterium
LLLAGTVMLLLRKMTGRWIVIAGC

SEQ ID NO: 361606 - protein, 24 aa, Mycobacterium
LLLAILTTGLLVAPAAAAEPPLRL

SEQ ID NO: 361607 - protein, 32 aa, Mycobacterium
LLLALAYFLFYLYLIPVFSLVPSVLILEQQSV

SEQ ID NO: 361608 - protein, 19 aa, Mycobacterium
LLLALRFQRGAACTLLALF

SEQ ID NO: 361609 - protein, 23 aa, Mycobacterium
LLLAPLVIRMPDTARWYVLKGRV

SEQ ID NO: 361610 - protein, 25 aa, Mycobacterium
LLLARREFWARVRPGALVKAAVTLV

SEQ ID NO: 361611 - protein, 20 aa, Mycobacterium
LLLAVVVLYVFSPSAANIIL

SEQ ID NO: 361612 - protein, 42 aa, Mycobacterium
LLLDTLIVRSFIVPAIARILGPWFWWPRVVRWRPAHASGAVL

SEQ ID NO: 361613 - protein, 23 aa, Mycobacterium
LLLGLALPWYFTQQATGSPPAGF

SEQ ID NO: 361614 - protein, 17 aa, Mycobacterium
LLLGLMSGSLWGLFAVL

SEQ ID NO: 361615 - protein, 20 aa, Mycobacterium
LLLGVIAVRLFGFTPGQLLL

SEQ ID NO: 361616 - protein, 22 aa, Mycobacterium
LLLGWGIFLNYGLALAALIALA

SEQ ID NO: 361617 - protein, 17 aa, Mycobacterium
LLLGWRAAAGLMLRRRS

SEQ ID NO: 361618 - protein, 20 aa, Mycobacterium
LLLHGLTLPWVIRVLGVQSD

SEQ ID NO: 361619 - protein, 20 aa, Mycobacterium
LLLILAVVALPETLPPSARR

SEQ ID NO: 361620 - protein, 19 aa, Mycobacterium
LLLILFAALMAGAGNGISI

SEQ ID NO: 361621 - protein, 19 aa, Mycobacterium
LLLIPTVLAYYYMKNPASY

SEQ ID NO: 361622 - protein, 19 aa, Mycobacterium
LLLLLPLGLEERTVIALLG

SEQ ID NO: 361623 - protein, 17 aa, Mycobacterium
LLLLVRPVRSAVGPGLA

SEQ ID NO: 361624 - protein, 19 aa, Mycobacterium
LLLMLPLDLEVRAVVALLC

SEQ ID NO: 361625 - protein, 20 aa, Mycobacterium
LLLMVVNVAISQLYIMLFPR

SEQ ID NO: 361626 - protein, 35 aa, Mycobacterium
LLLNMWALYVVGPPLEIWLGRLRFGALYALSGLGG

SEQ ID NO: 361627 - protein, 28 aa, Mycobacterium
LLLNSDALKQLLYGPLDGPPRNSMQIGQ

SEQ ID NO: 361628 - protein, 18 aa, Mycobacterium
LLLPHTDPDARDLMLSCG

SEQ ID NO: 361629 - protein, 18 aa, Mycobacterium
LLLPLLNRQWRALIPAFV

SEQ ID NO: 361630 - protein, 22 aa, Mycobacterium
LLLQGSTLPWLIRKLHISRFND

SEQ ID NO: 361631 - protein, 21 aa, Mycobacterium
LLLQGWTLPLLIRRLKVSAEA

SEQ ID NO: 361632 - protein, 26 aa, Mycobacterium
LLLRALPVMLLTVLVFFNGPVWTMAA

SEQ ID NO: 361633 - protein, 24 aa, Mycobacterium
LLLSALMLMRPLRILTLGGRRQDD

SEQ ID NO: 361634 - protein, 18 aa, Mycobacterium
LLLSLRTAAASTALCVLL

SEQ ID NO: 361635 - protein, 20 aa, Mycobacterium
LLLTFTVVAILWANSPWAHT

SEQ ID NO: 361636 - protein, 19 aa, Mycobacterium
LLLTGRWPRYVGAATCLVL

SEQ ID NO: 361637 - protein, 25 aa, Mycobacterium
LLLTIPVLLTHQWQLVFVAAALLGA

SEQ ID NO: 361638 - protein, 20 aa, Mycobacterium
LLLTVGGWVTFMVRKSRRQR

SEQ ID NO: 361639 - protein, 26 aa, Mycobacterium
LLLVGFIIVAPMLLILAATLADVLLD

SEQ ID NO: 361640 - protein, 17 aa, Mycobacterium
LLLVLIVVYLTHIPFAW

SEQ ID NO: 361641 - protein, 18 aa, Mycobacterium
LLLVPATRRIGALSAIAL

SEQ ID NO: 361642 - protein, 18 aa, Mycobacterium
LLLVTELVVFTLAGDFWA

SEQ ID NO: 361643 - protein, 18 aa, Mycobacterium
LLLVVLTNEKGLGPADEA

SEQ ID NO: 361644 - protein, 17 aa, Mycobacterium
LLLYLVFVFTQTVRHRD

SEQ ID NO: 361645 - protein, 22 aa, Mycobacterium
LLMACYAMFGLSLLVGFVTVTM

SEQ ID NO: 361646 - protein, 17 aa, Mycobacterium
LLMCAAIVLWLSGSAWL

SEQ ID NO: 361647 - protein, 20 aa, Mycobacterium
LLMFNVIAFALVEIPFLAHA

SEQ ID NO: 361648 - protein, 19 aa, Mycobacterium
LLMISFAVLFVLRYFGARA

SEQ ID NO: 361649 - protein, 19 aa, Mycobacterium
LLMKYQPGLTCMLVGAKTA

SEQ ID NO: 361650 - protein, 19 aa, Mycobacterium
LLMPNGVEWARTALALMRI

SEQ ID NO: 361651 - protein, 23 aa, Mycobacterium
LLMSEVFYKFPKLKVALSEGGIG

SEQ ID NO: 361652 - protein, 17 aa, Mycobacterium
LLMTPALAFFYGGMVRA

SEQ ID NO: 361653 - protein, 17 aa, Mycobacterium
LLMVTLLALLVVGRLRG

SEQ ID NO: 361654 - protein, 17 aa, Mycobacterium
LLMYVVYRVFPPITVWT

SEQ ID NO: 361655 - protein, 18 aa, Mycobacterium
LLNENLAAGRLRFTTDYD

SEQ ID NO: 361656 - protein, 25 aa, Mycobacterium
LLNGFEPLFTLLNPKDADDLTKGVL

SEQ ID NO: 361657 - protein, 26 aa, Mycobacterium
LLNGMFLVLLGLLWPHIHLPHAWGIA

SEQ ID NO: 361658 - protein, 20 aa, Mycobacterium
LLNVHLFTRAPFTIAVLAVL

SEQ ID NO: 361659 - protein, 24 aa, Mycobacterium
LLNYLVLLALASFLTYCLTSLAFS

SEQ ID NO: 361660 - protein, 17 aa, Mycobacterium
LLNYVILLALASVLTFT

SEQ ID NO: 361661 - protein, 20 aa, Mycobacterium
LLNYVVLLALASFLTFCLTS

SEQ ID NO: 361662 - protein, 19 aa, Mycobacterium
LLNYVVLLALASFLTYCLT

SEQ ID NO: 361663 - protein, 19 aa, Mycobacterium
LLPAFIALFGVVAALFLLG

SEQ ID NO: 361664 - protein, 19 aa, Mycobacterium
LLPAFVALFGIVAALFLVG

SEQ ID NO: 361665 - protein, 21 aa, Mycobacterium
LLPAGLLPLVLVTSGVIFAYA

SEQ ID NO: 361666 - protein, 19 aa, Mycobacterium
LLPALLVMTLAVVAARELF

SEQ ID NO: 361667 - protein, 18 aa, Mycobacterium
LLPAPIYMRLEMTAPIYI

SEQ ID NO: 361668 - protein, 23 aa, Mycobacterium
LLPAVFVVFGIVGWIIAPLIYRV

SEQ ID NO: 361669 - protein, 21 aa, Mycobacterium
LLPFFSFMTFMIAVPTGIKFV

SEQ ID NO: 361670 - protein, 17 aa, Mycobacterium
LLPGVRAVQWYAGDDVQ

SEQ ID NO: 361671 - protein, 17 aa, Mycobacterium
LLPITYNVSPSAAFIMF

SEQ ID NO: 361672 - protein, 20 aa, Mycobacterium
LLPLQLIILARAAGPARLGR

SEQ ID NO: 361673 - protein, 22 aa, Mycobacterium
LLPMTRPMFLNHRYATVSGALI

SEQ ID NO: 361674 - protein, 24 aa, Mycobacterium
LLPNGLRRFPFNALMLDLDWRIRT

SEQ ID NO: 361675 - protein, 17 aa, Mycobacterium
LLPQMRAQIPPMINTMT

SEQ ID NO: 361676 - protein, 18 aa, Mycobacterium
LLPSGNYIQWDLVPQARP

SEQ ID NO: 361677 - protein, 25 aa, Mycobacterium
LLPTFFLSRRALVAHCAFATSLLGA

SEQ ID NO: 361678 - protein, 19 aa, Mycobacterium
LLPVTLALAADLWAARNRA

SEQ ID NO: 361679 - protein, 19 aa, Mycobacterium
LLPVTLALAADLWSARSRA

SEQ ID NO: 361680 - protein, 18 aa, Mycobacterium
LLPYMIGAIVVIVAAFAV

SEQ ID NO: 361681 - protein, 38 aa, Mycobacterium
LLQDGRDMFWSVAPLVLACVVLAGVLGMCSFAPTGPGA

SEQ ID NO: 361682 - protein, 24 aa, Mycobacterium
LLQINPIWVLGPYKPSQISAGSQP

SEQ ID NO: 361683 - protein, 24 aa, Mycobacterium
LLQMAFRFWAFRRWVFPDQFARTP

SEQ ID NO: 361684 - protein, 17 aa, Mycobacterium
LLQPVASAGLRAAQRGQ

SEQ ID NO: 361685 - protein, 26 aa, Mycobacterium
LLQRPRFRMPWAPYSGYLTLAFLAGV

SEQ ID NO: 361686 - protein, 18 aa, Mycobacterium
LLRAGEKFTWLGRGMEVA

SEQ ID NO: 361687 - protein, 18 aa, Mycobacterium
LLRAGNRVSYFLVQPRDG

SEQ ID NO: 361688 - protein, 50 aa, Mycobacterium
LLRALRVMLGWRPVLLIPLTFALFTPLAVPGFAWWAAALNSLPMLAALAW

SEQ ID NO: 361689 - protein, 25 aa, Mycobacterium
LLRLGRLMTLVWAVLMAVFACGFSA

SEQ ID NO: 361690 - protein, 19 aa, Mycobacterium
LLRLRKDPDRNLRVDRVDR

SEQ ID NO: 361691 - protein, 24 aa, Mycobacterium
LLRPQWLALFVVVAAFAYLCFTVL

SEQ ID NO: 361692 - protein, 17 aa, Mycobacterium
LLRQAQIIAAPTFEFFA

SEQ ID NO: 361693 - protein, 17 aa, Mycobacterium
LLRQVALRASVTGRPLV

SEQ ID NO: 361694 - protein, 19 aa, Mycobacterium
LLRSMGYRDALIGALLAGA

SEQ ID NO: 361695 - protein, 32 aa, Mycobacterium
LLRSRWMTVCVTMVFAVMGAIAYTLLITPQYQ

SEQ ID NO: 361696 - protein, 17 aa, Mycobacterium
LLRSSLAPLNRLAESMQ

SEQ ID NO: 361697 - protein, 20 aa, Mycobacterium
LLRSWPAFLAYLVSFVFIGS

SEQ ID NO: 361698 - protein, 19 aa, Mycobacterium
LLRVQGKYGVALPSDLLAS

SEQ ID NO: 361699 - protein, 36 aa, Mycobacterium
LLSAAINFVLIAAVVYFFVVLPYNTLRKRGEVEQAD

SEQ ID NO: 361700 - protein, 19 aa, Mycobacterium
LLSAHGLLLAPFALAVGLT

SEQ ID NO: 361701 - protein, 24 aa, Mycobacterium
LLSATINFILVAGVVYFLVVVPYN

SEQ ID NO: 361702 - protein, 25 aa, Mycobacterium
LLSDPLSVVLVVVIVLALVVAGVLG

SEQ ID NO: 361703 - protein, 21 aa, Mycobacterium
LLSFRLQPTLTVLLAAAGVFG

SEQ ID NO: 361704 - protein, 23 aa, Mycobacterium
LLSFRLVPTLTVLLAAAGVFAFL

SEQ ID NO: 361705 - protein, 31 aa, Mycobacterium
LLSGWLVARWLIMSWTGRVIVWTLAMGWSAL

SEQ ID NO: 361706 - protein, 32 aa, Mycobacterium
LLSLQIASLMFLFVITSLLSVLGFFAIATYRN

SEQ ID NO: 361707 - protein, 17 aa, Mycobacterium
LLSLYIAGGMLLSLYVV

SEQ ID NO: 361708 - protein, 20 aa, Mycobacterium
LLSLYVIPNLKYPANPPALS

SEQ ID NO: 361709 - protein, 20 aa, Mycobacterium
LLSLYVVPNLKYPASPPALS

SEQ ID NO: 361710 - protein, 39 aa, Mycobacterium
LLSPTRIRRTLTVSRLLAPILAPVIYRAAIAVRGLIDQR

SEQ ID NO: 361711 - protein, 20 aa, Mycobacterium
LLSRLWVVPVHRAAGLLARL

SEQ ID NO: 361712 - protein, 19 aa, Mycobacterium
LLSRLWVVPVHRASGLIAR

SEQ ID NO: 361713 - protein, 20 aa, Mycobacterium
LLSRNLYVYGLGGIVAPFVG

SEQ ID NO: 361714 - protein, 25 aa, Mycobacterium
LLSSAVLLLLYWQWRTMPAVIWDVR

SEQ ID NO: 361715 - protein, 19 aa, Mycobacterium
LLSVAGILAFPRSLLDRDS

SEQ ID NO: 361716 - protein, 29 aa, Mycobacterium
LLSYLLIHALYRWFPPITVWTGLSLLGVA

SEQ ID NO: 361717 - protein, 22 aa, Mycobacterium
LLTAALLLANAFFVGAEFALIS

SEQ ID NO: 361718 - protein, 26 aa, Mycobacterium
LLTATTLLMFLAFGSVVLPIKAAVMS

SEQ ID NO: 361719 - protein, 17 aa, Mycobacterium
LLTFFPTWTAIGAVAAL

SEQ ID NO: 361720 - protein, 32 aa, Mycobacterium
LLTGATGFLGRYLLLEWLRQLRRVDDKVICLV

SEQ ID NO: 361721 - protein, 19 aa, Mycobacterium
LLTGLALAAPWPAGIELNY

SEQ ID NO: 361722 - protein, 19 aa, Mycobacterium
LLTGLAVALAQWRADRGHS

SEQ ID NO: 361723 - protein, 21 aa, Mycobacterium
LLTGLIIIAVPIFVLGFLAQY

SEQ ID NO: 361724 - protein, 27 aa, Mycobacterium
LLTGVFLVLVMFLWSAAYSSLFYLVAL

SEQ ID NO: 361725 - protein, 23 aa, Mycobacterium
LLTGVSYMIPFVAAGGLLIALGF

SEQ ID NO: 361726 - protein, 24 aa, Mycobacterium
LLTGVSYMIPFVAAGGLLIALGFL

SEQ ID NO: 361727 - protein, 21 aa, Mycobacterium
LLTIYTQLFTTDAGWREAVLR

SEQ ID NO: 361728 - protein, 20 aa, Mycobacterium
LLTLAVVTLVAIVALTGAML

SEQ ID NO: 361729 - protein, 20 aa, Mycobacterium
LLTLGLIKGPDWGWSSLPAI

SEQ ID NO: 361730 - protein, 17 aa, Mycobacterium
LLTLSLLTLIGVTGHFV

SEQ ID NO: 361731 - protein, 17 aa, Mycobacterium
LLTNLMVDLLYAALDPR

SEQ ID NO: 361732 - protein, 19 aa, Mycobacterium
LLTPAFLGSALLLFANAFA

SEQ ID NO: 361733 - protein, 19 aa, Mycobacterium
LLTRWFSMEYDQWFGMTLP

SEQ ID NO: 361734 - protein, 26 aa, Mycobacterium
LLTVSLVFFWDALAAWLIVVAAGLLL

SEQ ID NO: 361735 - protein, 24 aa, Mycobacterium
LLTVTAVLYLWHLSINGYGNDFYA

SEQ ID NO: 361736 - protein, 17 aa, Mycobacterium
LLTVVSPLLMTYFLVDV

SEQ ID NO: 361737 - protein, 24 aa, Mycobacterium
LLTVYTQLFTTKAGWRESVLRTVG

SEQ ID NO: 361738 - protein, 21 aa, Mycobacterium
LLVAALTFFPALALGPIAEAV

SEQ ID NO: 361739 - protein, 18 aa, Mycobacterium
LLVAIGREHISLRPLWGI

SEQ ID NO: 361740 - protein, 20 aa, Mycobacterium
LLVAIPFTVLVSFTLNILLR

SEQ ID NO: 361741 - protein, 20 aa, Mycobacterium
LLVAIPFTVLVSFTLNILLS

SEQ ID NO: 361742 - protein, 19 aa, Mycobacterium
LLVASLVLLTIAMAGPTND

SEQ ID NO: 361743 - protein, 19 aa, Mycobacterium
LLVASYPEVPKRQWGLPLA

SEQ ID NO: 361744 - protein, 17 aa, Mycobacterium
LLVDDLLMLARLDVQRP

SEQ ID NO: 361745 - protein, 28 aa, Mycobacterium
LLVDGWGWQWIFYVNVPVGVLGIILGAI

SEQ ID NO: 361746 - protein, 18 aa, Mycobacterium
LLVDSWMCAISGRAKQFG

SEQ ID NO: 361747 - protein, 27 aa, Mycobacterium
LLVGAALVLIFLIVTAMLRSPVAGLVV

SEQ ID NO: 361748 - protein, 45 aa, Mycobacterium
LLVGELVWWERAGLLPLVGVIPYLLFLILGLASMLVLVGAGRGIS

SEQ ID NO: 361749 - protein, 19 aa, Mycobacterium
LLVGFYVVDVLTPGKLRHL

SEQ ID NO: 361750 - protein, 17 aa, Mycobacterium
LLVGIVACLVASLLCAV

SEQ ID NO: 361751 - protein, 17 aa, Mycobacterium
LLVHLRPTSVHSLGDSD

SEQ ID NO: 361752 - protein, 17 aa, Mycobacterium
LLVIAGLCFLWYERPRQ

SEQ ID NO: 361753 - protein, 17 aa, Mycobacterium
LLVIGLSIVVLTVAVLQ

SEQ ID NO: 361754 - protein, 17 aa, Mycobacterium
LLVILCAMILRIVAIEW

SEQ ID NO: 361755 - protein, 33 aa, Mycobacterium
LLVITAVSIVLITLVLLAVYRSLVTAMVPLITI

SEQ ID NO: 361756 - protein, 18 aa, Mycobacterium
LLVIWHLVAKRGAFSPSQ

SEQ ID NO: 361757 - protein, 18 aa, Mycobacterium
LLVLAAWLAYEAIKRLIH

SEQ ID NO: 361758 - protein, 17 aa, Mycobacterium
LLVLALRRDGVARSLGW

SEQ ID NO: 361759 - protein, 18 aa, Mycobacterium
LLVLFRVIGGVGVGVASL

SEQ ID NO: 361760 - protein, 18 aa, Mycobacterium
LLVLGFLMVRRTGKVRRI

SEQ ID NO: 361761 - protein, 18 aa, Mycobacterium
LLVLLAWAAIWVARRGRL

SEQ ID NO: 361762 - protein, 18 aa, Mycobacterium
LLVLLPAAGMTAAAVVPN

SEQ ID NO: 361763 - protein, 27 aa, Mycobacterium
LLVLQLYVWIRWITGPYFERVPSGPSE

SEQ ID NO: 361764 - protein, 18 aa, Mycobacterium
LLVLVILNPIKFTRSTTL

SEQ ID NO: 361765 - protein, 17 aa, Mycobacterium
LLVLVVCALPVAGLRLG

SEQ ID NO: 361766 - protein, 25 aa, Mycobacterium
LLVNLPVLVFFPRGWSEFFRLNTRR

SEQ ID NO: 361767 - protein, 19 aa, Mycobacterium
LLVNQWPLPESGTRSGFPP

SEQ ID NO: 361768 - protein, 20 aa, Mycobacterium
LLVPSYFQQLLRETPLQVGI

SEQ ID NO: 361769 - protein, 32 aa, Mycobacterium
LLVRILRQFHHPLIYVLLAAGLITAGLREYVD

SEQ ID NO: 361770 - protein, 22 aa, Mycobacterium
LLVRRRRVWVRITPATDTPGTV

SEQ ID NO: 361771 - protein, 18 aa, Mycobacterium
LLVTEMVVFVLAGDFWAW

SEQ ID NO: 361772 - protein, 26 aa, Mycobacterium
LLVTPAWFVVLGIAWAFLRRRLGHKA

SEQ ID NO: 361773 - protein, 24 aa, Mycobacterium
LLVTSIFLLLLFIAGRRAGRFGVF

SEQ ID NO: 361774 - protein, 25 aa, Mycobacterium
LLVVAGLLVYVYLAVAVTARVAAGS

SEQ ID NO: 361775 - protein, 19 aa, Mycobacterium
LLVVELFGLLLSPISWTHH

SEQ ID NO: 361776 - protein, 29 aa, Mycobacterium
LLVVHAGLAWWWAPVFAAVIYAGSLEFLM

SEQ ID NO: 361777 - protein, 21 aa, Mycobacterium
LLVVLSLFGFDFDTVGRRQPD

SEQ ID NO: 361778 - protein, 26 aa, Mycobacterium
LLVVVATPIWLYRIKALTPARLSVSA

SEQ ID NO: 361779 - protein, 26 aa, Mycobacterium
LLWAAAISVLFPIVWIALASVKTPEQ

SEQ ID NO: 361780 - protein, 18 aa, Mycobacterium
LLWARGVDTLIGCAVALL

SEQ ID NO: 361781 - protein, 19 aa, Mycobacterium
LLWIGDIYSFVLAALLVTM

SEQ ID NO: 361782 - protein, 27 aa, Mycobacterium
LLWIGPILVYVLLPILDLRFGPDGQNP

SEQ ID NO: 361783 - protein, 20 aa, Mycobacterium
LLWVALCFAVLALTVWAARR

SEQ ID NO: 361784 - protein, 19 aa, Mycobacterium
LLYASFLVLLYVATERISW

SEQ ID NO: 361785 - protein, 19 aa, Mycobacterium
LLYGGALAWLAPPVLRRMT

SEQ ID NO: 361786 - protein, 19 aa, Mycobacterium
LLYGLHAMLFNEPRVSEDQ

SEQ ID NO: 361787 - protein, 18 aa, Mycobacterium
LLYIAIAVGFVLATAVLR

SEQ ID NO: 361788 - protein, 26 aa, Mycobacterium
LLYQWRDKIPARWWLVAVSAVVVALG

SEQ ID NO: 361789 - protein, 29 aa, Mycobacterium
LMAAILLVIGMYVLLRFSLRTPPVFRSGA

SEQ ID NO: 361790 - protein, 26 aa, Mycobacterium
LMAAITFALLFLLTGSVLLPAKALAC

SEQ ID NO: 361791 - protein, 25 aa, Mycobacterium
LMADDLRALPFAISLSRRSSRVIKQ

SEQ ID NO: 361792 - protein, 19 aa, Mycobacterium
LMADDLRALPFAVSLSRRC

SEQ ID NO: 361793 - protein, 25 aa, Mycobacterium
LMADDLRALPFAVSLSRRSSRVIKQ

SEQ ID NO: 361794 - protein, 22 aa, Mycobacterium
LMAGLALVLRYLAGGRYELGET

SEQ ID NO: 361795 - protein, 41 aa, Mycobacterium
LMALIGVLPIALSPWPPRAFGMLLLALAVAVAIDVALAASP

SEQ ID NO: 361796 - protein, 26 aa, Mycobacterium
LMANPGLPLWPYLVCAALAGFGGGNF

SEQ ID NO: 361797 - protein, 23 aa, Mycobacterium
LMAWLNIIGILILQRPAYKALWD

SEQ ID NO: 361798 - protein, 18 aa, Mycobacterium
LMDAAIRTGFSRFPIIKG

SEQ ID NO: 361799 - protein, 37 aa, Mycobacterium
LMDAARNYLFPLYASLLTPIWLRILGAKVGRGTEIST

SEQ ID NO: 361800 - protein, 20 aa, Mycobacterium
LMDAEVLERLGPLIAAELRG

SEQ ID NO: 361801 - protein, 20 aa, Mycobacterium
LMDIMMPVMDGYEAMRRIRA

SEQ ID NO: 361802 - protein, 22 aa, Mycobacterium
LMFAVLGWFYLSVLPGWLGLEQ

SEQ ID NO: 361803 - protein, 17 aa, Mycobacterium
LMFVIGTVAFVVWALAT

SEQ ID NO: 361804 - protein, 20 aa, Mycobacterium
LMGAVFSWTYALCQLPAGYL

SEQ ID NO: 361805 - protein, 26 aa, Mycobacterium
LMGCTLFAVIGGFLAYFHSVGQVAAN

SEQ ID NO: 361806 - protein, 18 aa, Mycobacterium
LMGGFGVFAITTPAADAK

SEQ ID NO: 361807 - protein, 29 aa, Mycobacterium
LMGHIGVMLVFLLIVLHSKHLHIGLAPIN

SEQ ID NO: 361808 - protein, 18 aa, Mycobacterium
LMGLFFVCGQGYEYFHLA

SEQ ID NO: 361809 - protein, 18 aa, Mycobacterium
LMGLFFVCGQGYEYYHLA

SEQ ID NO: 361810 - protein, 21 aa, Mycobacterium
LMGPWPWYVVVATVLVLAVWA

SEQ ID NO: 361811 - protein, 21 aa, Mycobacterium
LMHGVTLVVALLTSSPQLAQL

SEQ ID NO: 361812 - protein, 33 aa, Mycobacterium
LMIAIIAAMILIFAIMLLITRSVVAALVIVCTV

SEQ ID NO: 361813 - protein, 17 aa, Mycobacterium
LMIALNFSLSWFATWLE

SEQ ID NO: 361814 - protein, 22 aa, Mycobacterium
LMIDTLIVRTFVVPAIAGALGK

SEQ ID NO: 361815 - protein, 17 aa, Mycobacterium
LMIGMAQLLLVIAAGAL

SEQ ID NO: 361816 - protein, 19 aa, Mycobacterium
LMIRRAWAIPAAAIGGITL

SEQ ID NO: 361817 - protein, 19 aa, Mycobacterium
LMKDIALLGLSLWLLADAV

SEQ ID NO: 361818 - protein, 27 aa, Mycobacterium
LMKYNPEYTCMLLGATWYVDNGGRDAL

SEQ ID NO: 361819 - protein, 20 aa, Mycobacterium
LMLAILLNLNLVLLVPVYAV

SEQ ID NO: 361820 - protein, 26 aa, Mycobacterium
LMLDDLAGAWRVLHALPAARAASRQG

SEQ ID NO: 361821 - protein, 19 aa, Mycobacterium
LMLGTIAVTLLMAMVLLAV

SEQ ID NO: 361822 - protein, 18 aa, Mycobacterium
LMLGVIAVSMFMGMIVLS

SEQ ID NO: 361823 - protein, 17 aa, Mycobacterium
LMLGVSLLLLMRATTLQ

SEQ ID NO: 361824 - protein, 17 aa, Mycobacterium
LMLIAWLGLGRRVLAGD

SEQ ID NO: 361825 - protein, 25 aa, Mycobacterium
LMLKGAPETILPRCRFADPDADLAH

SEQ ID NO: 361826 - protein, 25 aa, Mycobacterium
LMLKGAPETILPRCRFADPDADLEH

SEQ ID NO: 361827 - protein, 19 aa, Mycobacterium
LMLSLLGAALLMLGTGRLY

SEQ ID NO: 361828 - protein, 21 aa, Mycobacterium
LMLTIPYTVLLTFIENILLTE

SEQ ID NO: 361829 - protein, 19 aa, Mycobacterium
LMLTIPYTVLLTFTFNILL

SEQ ID NO: 361830 - protein, 17 aa, Mycobacterium
LMMLAMTWMYVVMNGHL

SEQ ID NO: 361831 - protein, 18 aa, Mycobacterium
LMNMLSLTAAFGALVWVF

SEQ ID NO: 361832 - protein, 21 aa, Mycobacterium
LMNVPFYWQQIVTGAVVVVAV

SEQ ID NO: 361833 - protein, 17 aa, Mycobacterium
LMPLGFTILTRVAGPKR

SEQ ID NO: 361834 - protein, 18 aa, Mycobacterium
LMPVLGRANHRLGARLGS

SEQ ID NO: 361835 - protein, 30 aa, Mycobacterium
LMQEFIIRWRVWLTHRLMGDWLGDRAYYRG

SEQ ID NO: 361836 - protein, 17 aa, Mycobacterium
LMRSMFKVRLRPAEIDH

SEQ ID NO: 361837 - protein, 18 aa, Mycobacterium
LMRVVDVMFAFPVLLLAL

SEQ ID NO: 361838 - protein, 18 aa, Mycobacterium
LMSWLYDFLSVTAVAYCL

SEQ ID NO: 361839 - protein, 22 aa, Mycobacterium
LMTAVSAPMWLLMQSDSDTRGW

SEQ ID NO: 361840 - protein, 25 aa, Mycobacterium
LMTGWWMAMLVYILPRRAHLAAAAA

SEQ ID NO: 361841 - protein, 18 aa, Mycobacterium
LMTNPLLRRFNDLQATTL

SEQ ID NO: 361842 - protein, 31 aa, Mycobacterium
LMTPLTAKLAWFSKVLTIAILGLAAVTFAVG

SEQ ID NO: 361843 - protein, 32 aa, Mycobacterium
LMTPSIAALLGRWFWWPIRVRPRPASEMLRPF

SEQ ID NO: 361844 - protein, 34 aa, Mycobacterium
LMTPSIAALLGRWFWWPLNIRSRPPRLTRQRPLP

SEQ ID NO: 361845 - protein, 18 aa, Mycobacterium
LMTWPMILLAVGSVFSGG

SEQ ID NO: 361846 - protein, 18 aa, Mycobacterium
LMVDRLGPRRVGIIGAGL

SEQ ID NO: 361847 - protein, 19 aa, Mycobacterium
LMVFAYITARLVLFATAWA

SEQ ID NO: 361848 - protein, 21 aa, Mycobacterium
LMVFPALLVYSVWRMLNWLNI

SEQ ID NO: 361849 - protein, 17 aa, Mycobacterium
LMVFTPWSAINLTDYYV

SEQ ID NO: 361850 - protein, 25 aa, Mycobacterium
LMVGSAVLTYLSYTAAFTSTDTVIV

SEQ ID NO: 361851 - protein, 19 aa, Mycobacterium
LMVIAIGFLTSLFAASPPV

SEQ ID NO: 361852 - protein, 19 aa, Mycobacterium
LMVLAWVWLGRHVIDRTAT

SEQ ID NO: 361853 - protein, 18 aa, Mycobacterium
LMVLFTSAVGLIAVLANR

SEQ ID NO: 361854 - protein, 24 aa, Mycobacterium
LMVNLPVMVLYPRGWSEFFRLNTR

SEQ ID NO: 361855 - protein, 25 aa, Mycobacterium
LMVPQTVVLTFMLVWLIHSHGWSIA

SEQ ID NO: 361856 - protein, 25 aa, Mycobacterium
LMVTTPLLLRRLGIGGSTWDANLGQ

SEQ ID NO: 361857 - protein, 17 aa, Mycobacterium
LMWGVPYLTVAQGLSTA

SEQ ID NO: 361858 - protein, 22 aa, Mycobacterium
LNALATLLLLAALVAIVVGFLV

SEQ ID NO: 361859 - protein, 24 aa, Mycobacterium
LNARQMLLVNMLTDALPAAALAVS

SEQ ID NO: 361860 - protein, 22 aa, Mycobacterium
LNAWAMSVLLWGVLIAVFGLGL

SEQ ID NO: 361861 - protein, 22 aa, Mycobacterium
LNAWLMSVVLWGALIAVFGPAL

SEQ ID NO: 361862 - protein, 26 aa, Mycobacterium
LNAYTPEAARLLTLPDILNSVVQATE

SEQ ID NO: 361863 - protein, 24 aa, Mycobacterium
LNDFAWITFTILVPFLIGQSVILA

SEQ ID NO: 361864 - protein, 22 aa, Mycobacterium
LNDPPPCAVGFLPPPLMRTPAD

SEQ ID NO: 361865 - protein, 21 aa, Mycobacterium
LNDVFWLWFIGIVGTIIVQNL

SEQ ID NO: 361866 - protein, 23 aa, Mycobacterium
LNEAMRVYPPILGLARTAKADDV

SEQ ID NO: 361867 - protein, 18 aa, Mycobacterium
LNEKIVDMGYPLVRIMNF

SEQ ID NO: 361868 - protein, 20 aa, Mycobacterium
LNELWFQALTGICAHVRSGG

SEQ ID NO: 361869 - protein, 29 aa, Mycobacterium
LNGAAEPVWWTLYLACYLAGGWGSAWAGA

SEQ ID NO: 361870 - protein, 29 aa, Mycobacterium
LNGAPQPVWWTLYLGCYLAGGWGSAWAGA

SEQ ID NO: 361871 - protein, 31 aa, Mycobacterium
LNGFLLITLGTLVAPYPWPAVAAMFVIGVAV

SEQ ID NO: 361872 - protein, 25 aa, Mycobacterium
LNGKRPKLRRILSDPDARVIVVEHR

SEQ ID NO: 361873 - protein, 22 aa, Mycobacterium
LNGYEPLFSLLDPQAADDLTQG

SEQ ID NO: 361874 - protein, 24 aa, Mycobacterium
LNGYNIVFAAFLVAAGRLADLLGR

SEQ ID NO: 361875 - protein, 17 aa, Mycobacterium
LNHPAYLIYTSGSTGRP

SEQ ID NO: 361876 - protein, 21 aa, Mycobacterium
LNISTLGLPFYGATADNPYPT

SEQ ID NO: 361877 - protein, 20 aa, Mycobacterium
LNKAAAWVGIAAGAVFIVAV

SEQ ID NO: 361878 - protein, 20 aa, Mycobacterium
LNLGGIPPFSGFIGKIALME

SEQ ID NO: 361879 - protein, 19 aa, Mycobacterium
LNLPPLCTTGFLPAQQHRV

SEQ ID NO: 361880 - protein, 18 aa, Mycobacterium
LNLSAFVLFSSMAGIIGT

SEQ ID NO: 361881 - protein, 18 aa, Mycobacterium
LNLVIFVLSAHVVFFAGV

SEQ ID NO: 361882 - protein, 21 aa, Mycobacterium
LNLWRLVLAVEVIFWHSFPVT

SEQ ID NO: 361883 - protein, 19 aa, Mycobacterium
LNLWVGYFPTVQSAWSQLT

SEQ ID NO: 361884 - protein, 19 aa, Mycobacterium
LNNNLYVTGRIKDLVIIDG

SEQ ID NO: 361885 - protein, 37 aa, Mycobacterium
LNNRFFPPMGSILYWLRPKTIRLPPWPDRVPLTKGDT

SEQ ID NO: 361886 - protein, 22 aa, Mycobacterium
LNNRFFPPMGSVLYWMRFGTIR

SEQ ID NO: 361887 - protein, 18 aa, Mycobacterium
LNNWPAVFPLGMYSAASF

SEQ ID NO: 361888 - protein, 25 aa, Mycobacterium
LNPKLGWWLMEIPATVVFLVCYLTG

SEQ ID NO: 361889 - protein, 36 aa, Mycobacterium
LNPRELVARVPFVVLVIAALGLGLGITLWLSTSAAE

SEQ ID NO: 361890 - protein, 19 aa, Mycobacterium
LNPRTLWRNPVMFIVEVGA

SEQ ID NO: 361891 - protein, 24 aa, Mycobacterium
LNQAMTFRYFYNGAYQQLYLPRGA

SEQ ID NO: 361892 - protein, 25 aa, Mycobacterium
LNQAWFVYPPFATLVLAPLAWASFE

SEQ ID NO: 361893 - protein, 18 aa, Mycobacterium
LNQHLYFAINAPTAATGG

SEQ ID NO: 361894 - protein, 20 aa, Mycobacterium
LNQLLVPVDIPAVGFNIVFS

SEQ ID NO: 361895 - protein, 17 aa, Mycobacterium
LNRELWIGAVIASLVVG

SEQ ID NO: 361896 - protein, 25 aa, Mycobacterium
LNRGHWDWLKWLPHNQHQRCVDALG

SEQ ID NO: 361897 - protein, 23 aa, Mycobacterium
LNRMMLYFGWNVSVSQTINPLPW

SEQ ID NO: 361898 - protein, 24 aa, Mycobacterium
LNRNLGWLFLFKKGNVSLAGGGTI

SEQ ID NO: 361899 - protein, 23 aa, Mycobacterium
LNRPRPMLQLLAFLSGGFVMGMA

SEQ ID NO: 361900 - protein, 20 aa, Mycobacterium
LNSIFGWSWADPIAGLVIAA

SEQ ID NO: 361901 - protein, 17 aa, Mycobacterium
LNSLIQAALARVGMQQN

SEQ ID NO: 361902 - protein, 25 aa, Mycobacterium
LNSRLVRYFVKRYTLKRGAMAFGKL

SEQ ID NO: 361903 - protein, 23 aa, Mycobacterium
LNTHVLIYLLIGGGIYFTVRTRF

SEQ ID NO: 361904 - protein, 31 aa, Mycobacterium
LNVEPVPAPWPIVGLLPPGPRLSKEDALVVH

SEQ ID NO: 361905 - protein, 18 aa, Mycobacterium
LNVVWTPITFERDSVQRD

SEQ ID NO: 361906 - protein, 27 aa, Mycobacterium
LNWQHPEPEWLFTLVGGPRMWERRQAD

SEQ ID NO: 361907 - protein, 27 aa, Mycobacterium
LNYLLCWGLLYQLGIAWRGGLLAGRRP

SEQ ID NO: 361908 - protein, 17 aa, Mycobacterium
LPAALIGLVAALWITRR

SEQ ID NO: 361909 - protein, 23 aa, Mycobacterium
LPAALVPRLILLDELPTRTSGKV

SEQ ID NO: 361910 - protein, 26 aa, Mycobacterium
LPAATPFRNFVSWLAARDTAAAQAAW

SEQ ID NO: 361911 - protein, 18 aa, Mycobacterium
LPADGVVVLCDFGGSGTS

SEQ ID NO: 361912 - protein, 19 aa, Mycobacterium
LPAEIPYLAPNQEWRIVWD

SEQ ID NO: 361913 - protein, 20 aa, Mycobacterium
LPAGADFQTVLPLGGLNHPE

SEQ ID NO: 361914 - protein, 17 aa, Mycobacterium
LPAGALVYIAIPPARDF

SEQ ID NO: 361915 - protein, 27 aa, Mycobacterium
LPAGFAIGWAMWPLVAAIVLQAIAAVV

SEQ ID NO: 361916 - protein, 25 aa, Mycobacterium
LPAKLIMLAIAVICAVAVFSALVLR

SEQ ID NO: 361917 - protein, 21 aa, Mycobacterium
LPAPKPRRWKSWGATLETSVA

SEQ ID NO: 361918 - protein, 20 aa, Mycobacterium
LPARRIQPASQWRTLPDAPT

SEQ ID NO: 361919 - protein, 34 aa, Mycobacterium
LPATGRGRALRWVWQALAALLIATVFAAAVAQAR

SEQ ID NO: 361920 - protein, 18 aa, Mycobacterium
LPAVLWGVAFAILVRGLP

SEQ ID NO: 361921 - protein, 18 aa, Mycobacterium
LPAVLWGVAFAVLVRGLP

SEQ ID NO: 361922 - protein, 29 aa, Mycobacterium
LPAVMLGAGLLWFGWFGFNAGSALAADGT

SEQ ID NO: 361923 - protein, 21 aa, Mycobacterium
LPAVMRGLVACGWFGIQTWFG

SEQ ID NO: 361924 - protein, 20 aa, Mycobacterium
LPCVPWFIDSAWNLAFGVLP

SEQ ID NO: 361925 - protein, 20 aa, Mycobacterium
LPDAARLLRAGNRVSYFLVQ

SEQ ID NO: 361926 - protein, 30 aa, Mycobacterium
LPDAQFLAWGWRLPFLFSAALIVIGLVIRL

SEQ ID NO: 361927 - protein, 26 aa, Mycobacterium
LPDTTEGQRPAWLNVIRADPGRVGVL

SEQ ID NO: 361928 - protein, 23 aa, Mycobacterium
LPDVRSFLNPIPHVSFVTGADNV

SEQ ID NO: 361929 - protein, 18 aa, Mycobacterium
LPDYRIVAALPLAYAVIV

SEQ ID NO: 361930 - protein, 47 aa, Mycobacterium
LPEAKLTTRTNAPVWKWIAAGVTVVIILGLLTVSGLMMYHHKQMQDD

SEQ ID NO: 361931 - protein, 29 aa, Mycobacterium
LPEAQRMHTLIEDLLLLARADERSLLRRQ

SEQ ID NO: 361932 - protein, 38 aa, Mycobacterium
LPEIVGDPTLLTMLWQNLIGNAIKFRHKDRPPRVVIEC

SEQ ID NO: 361933 - protein, 19 aa, Mycobacterium
LPEIYRKLARVGSYGAWFP

SEQ ID NO: 361934 - protein, 30 aa, Mycobacterium
LPEKVFVTVVPILLILALVLVLVGPRIQAW

SEQ ID NO: 361935 - protein, 18 aa, Mycobacterium
LPEMPMDALALGLALGTA

SEQ ID NO: 361936 - protein, 33 aa, Mycobacterium
LPEQLLHLLASLLFLLFGLWMLFEGALGWRSVA

SEQ ID NO: 361937 - protein, 24 aa, Mycobacterium
LPESQAVAALMRAAGRPGAALVMD

SEQ ID NO: 361938 - protein, 21 aa, Mycobacterium
LPEVIDRVMLDLSSRFDRIVV

SEQ ID NO: 361939 - protein, 17 aa, Mycobacterium
LPFALPTIVASLVMLAL

SEQ ID NO: 361940 - protein, 22 aa, Mycobacterium
LPFMLMWPFWLAAKWCGVSWTV

SEQ ID NO: 361941 - protein, 26 aa, Mycobacterium
LPFVICSYITHLTWELGWLILHKPIA

SEQ ID NO: 361942 - protein, 17 aa, Mycobacterium
LPFYHDMGLMQGVIAPI

SEQ ID NO: 361943 - protein, 37 aa, Mycobacterium
LPGAVMFACLAVAALLVWMIALSRPPEVVQAAICNPP

SEQ ID NO: 361944 - protein, 22 aa, Mycobacterium
LPGAVVFAWLGAVPMGVLCYRH

SEQ ID NO: 361945 - protein, 18 aa, Mycobacterium
LPGELLPDGTRVPMPGTT

SEQ ID NO: 361946 - protein, 24 aa, Mycobacterium
LPGFGLVTAPLRAGALLAATAGST

SEQ ID NO: 361947 - protein, 25 aa, Mycobacterium
LPGGATLLLLFWLRRRVPHPERYEH

SEQ ID NO: 361948 - protein, 23 aa, Mycobacterium
LPGHPHIVFLTFVVVVGTLLLHG

SEQ ID NO: 361949 - protein, 34 aa, Mycobacterium
LPGILLIVFIETGLLFPLLPGESLLFTGGLLAAS

SEQ ID NO: 361950 - protein, 24 aa, Mycobacterium
LPGPVYALPLLPAAAIALAALPGT

SEQ ID NO: 361951 - protein, 24 aa, Mycobacterium
LPGQPLPQWYATAAAALVGLGGHF

SEQ ID NO: 361952 - protein, 25 aa, Mycobacterium
LPGRTPLWLLVTLIVVVSVGGPASM

SEQ ID NO: 361953 - protein, 17 aa, Mycobacterium
LPGVCVCLVLFAMAISW

SEQ ID NO: 361954 - protein, 21 aa, Mycobacterium
LPGYWTPFASPVFTLLAILVI

SEQ ID NO: 361955 - protein, 24 aa, Mycobacterium
LPHDRIPVLYCKTGVRSAAALATV

SEQ ID NO: 361956 - protein, 30 aa, Mycobacterium
LPHIDGDPTLLIMVWQNLLGNAVKFRRDGV

SEQ ID NO: 361957 - protein, 20 aa, Mycobacterium
LPHVFERFYRADVARDRSHG

SEQ ID NO: 361958 - protein, 37 aa, Mycobacterium
LPIEHGYPARLVVPGLYGYVSATKWVTALELTRFDRA

SEQ ID NO: 361959 - protein, 44 aa, Mycobacterium
LPIEIAIAVLVLGVLLLVYRNPVTMLLPLLTIGASVLIAQGVVA

SEQ ID NO: 361960 - protein, 31 aa, Mycobacterium
LPINARLFRRRVTGTEWRWAGVLTAAVVVVV

SEQ ID NO: 361961 - protein, 20 aa, Mycobacterium
LPISVAQPCPFGWPAPGPDE

SEQ ID NO: 361962 - protein, 18 aa, Mycobacterium
LPIVPLFAYSRGAAMLCL

SEQ ID NO: 361963 - protein, 19 aa, Mycobacterium
LPKLIHLACIWIVAFGVNA

SEQ ID NO: 361964 - protein, 20 aa, Mycobacterium
LPKRLWPVLPVVKGASALGL

SEQ ID NO: 361965 - protein, 27 aa, Mycobacterium
LPKVGPWALYGLLFTIVILFALQGDQI

SEQ ID NO: 361966 - protein, 18 aa, Mycobacterium
LPLAKRGGLLLRILRQFH

SEQ ID NO: 361967 - protein, 28 aa, Mycobacterium
LPLAMPSYLLAYLWVSAFPTAAGFWGAA

SEQ ID NO: 361968 - protein, 27 aa, Mycobacterium
LPLAMPSYLLAYLWVSAYPQVAGFWGA

SEQ ID NO: 361969 - protein, 20 aa, Mycobacterium
LPLARIEFMVADTAPILAVT

SEQ ID NO: 361970 - protein, 31 aa, Mycobacterium
LPLARRPPPVAYPRRWGYWPAAAGLYLFVWL

SEQ ID NO: 361971 - protein, 27 aa, Mycobacterium
LPLDAWQRLFLGITFLFLVSSAFTLAK

SEQ ID NO: 361972 - protein, 17 aa, Mycobacterium
LPLFIRLIERIQNRRLP

SEQ ID NO: 361973 - protein, 24 aa, Mycobacterium
LPLFLGIKTWLYPASIALSLIVLV

SEQ ID NO: 361974 - protein, 30 aa, Mycobacterium
LPLGTVVVVLLLVLGAPFLGVKWGFPDERV

SEQ ID NO: 361975 - protein, 21 aa, Mycobacterium
LPLHYPVASTILWSLALTAVF

SEQ ID NO: 361976 - protein, 19 aa, Mycobacterium
LPLLAYFAIMWAGGYALGV

SEQ ID NO: 361977 - protein, 17 aa, Mycobacterium
LPLLAYFAIMWGGGYLL

SEQ ID NO: 361978 - protein, 28 aa, Mycobacterium
LPLLCCLLAFILTFFVTRTFVRFIRHRA

SEQ ID NO: 361979 - protein, 20 aa, Mycobacterium
LPLLLTVVAAVIIFLSLNGN

SEQ ID NO: 361980 - protein, 21 aa, Mycobacterium
LPLLLTVVAAVIIFLSLNGNA

SEQ ID NO: 361981 - protein, 21 aa, Mycobacterium
LPLLSVVVFGVVWQLAAASGI

SEQ ID NO: 361982 - protein, 18 aa, Mycobacterium
LPLLVYFAIMWGGGYLLG

SEQ ID NO: 361983 - protein, 18 aa, Mycobacterium
LPLLVYFAVMWGGGYLLG

SEQ ID NO: 361984 - protein, 17 aa, Mycobacterium
LPLLWWRFRRDDRAALT

SEQ ID NO: 361985 - protein, 20 aa, Mycobacterium
LPLMLALPTRTGAALVMAYW

SEQ ID NO: 361986 - protein, 20 aa, Mycobacterium
LPLPLIAGYLDRYGIRADKI

SEQ ID NO: 361987 - protein, 26 aa, Mycobacterium
LPLTMKLLCRAIVVPPKAFWQEFDIP

SEQ ID NO: 361988 - protein, 19 aa, Mycobacterium
LPLTPLQHGLLFQANTSRG

SEQ ID NO: 361989 - protein, 21 aa, Mycobacterium
LPLVPATIVGWGGLALLLLTC

SEQ ID NO: 361990 - protein, 29 aa, Mycobacterium
LPLVYGALYLWAFWDPFGHTNKMPVALVN

SEQ ID NO: 361991 - protein, 31 aa, Mycobacterium
LPLYGFQRPAMLLFGLVPLALLAVYVVVQAR

SEQ ID NO: 361992 - protein, 37 aa, Mycobacterium
LPLYGFQRPGMLLFGLLPLALLAVYILVQGRRRRRLR

SEQ ID NO: 361993 - protein, 17 aa, Mycobacterium
LPMAFEAGLAKLSFIAR

SEQ ID NO: 361994 - protein, 17 aa, Mycobacterium
LPMLWWRFRRDDRAALT

SEQ ID NO: 361995 - protein, 47 aa, Mycobacterium
LPNVIRHLLTLLLCLAVMAWLSLPLALLVVLLVPLIGLVAHRSRRLL

SEQ ID NO: 361996 - protein, 18 aa, Mycobacterium
LPPCPPPRATSPPESPPG

SEQ ID NO: 361997 - protein, 18 aa, Mycobacterium
LPPGWKPGSKTAPTPVLP

SEQ ID NO: 361998 - protein, 17 aa, Mycobacterium
LPPIVTQFADGLPLTQW

SEQ ID NO: 361999 - protein, 26 aa, Mycobacterium
LPPKPTLVHWTIVGAAIVATIVAAVV

SEQ ID NO: 362000 - protein, 17 aa, Mycobacterium
LPPLFAGVVRRPRRRQI

SEQ ID NO: 362001 - protein, 28 aa, Mycobacterium
LPPPVQYPKRRRSPWIIVAVALAAVVAV

SEQ ID NO: 362002 - protein, 32 aa, Mycobacterium
LPPSQLTLTIGFGPSFFLKDGVDRFGIADKKP

SEQ ID NO: 362003 - protein, 26 aa, Mycobacterium
LPPSWGWFWFSLTVLGALLGSAGLVR

SEQ ID NO: 362004 - protein, 18 aa, Mycobacterium
LPPTLYGTLPVSPTIALG

SEQ ID NO: 362005 - protein, 21 aa, Mycobacterium
LPPVLVLTWSGLRAADRERHA

SEQ ID NO: 362006 - protein, 26 aa, Mycobacterium
LPQENPPYLRLPALTRREAIIAAATV

SEQ ID NO: 362007 - protein, 30 aa, Mycobacterium
LPQHHDMGLISAYLFIMLLGGTTHAMSPAD

SEQ ID NO: 362008 - protein, 26 aa, Mycobacterium
LPQLGWLNYLFCWGMLYQLGIAWQTG

SEQ ID NO: 362009 - protein, 32 aa, Mycobacterium
LPQPLLGLIADRWRLLWMAPAGLAAAGIGAGL

SEQ ID NO: 362010 - protein, 22 aa, Mycobacterium
LPQRRMMIAYAVLLVIGSAVAA

SEQ ID NO: 362011 - protein, 24 aa, Mycobacterium
LPQRVRARNPVPCLRVVISSGDRL

SEQ ID NO: 362012 - protein, 18 aa, Mycobacterium
LPQYVAIGATFVLVDIVV

SEQ ID NO: 362013 - protein, 19 aa, Mycobacterium
LPRFEAEAALNLLHRTRRI

SEQ ID NO: 362014 - protein, 27 aa, Mycobacterium
LPRGFRTPLVPVLPVAAILACVWLMLN

SEQ ID NO: 362015 - protein, 17 aa, Mycobacterium
LPRHDALKVLRANISAD

SEQ ID NO: 362016 - protein, 27 aa, Mycobacterium
LPRIGPWALYGLLFTIVILFALQGDQI

SEQ ID NO: 362017 - protein, 27 aa, Mycobacterium
LPRIGPWALYGLLFTIVILFALQGHQI

SEQ ID NO: 362018 - protein, 19 aa, Mycobacterium
LPRLVHLACIWIVAIAVNV

SEQ ID NO: 362019 - protein, 20 aa, Mycobacterium
LPRLVHLACIWIVAISVNVS

SEQ ID NO: 362020 - protein, 23 aa, Mycobacterium
LPRPWNPLPCAGVDAGAFGGSFP

SEQ ID NO: 362021 - protein, 27 aa, Mycobacterium
LPRRKRFWLSLYVPVIMRVACSAIVVP

SEQ ID NO: 362022 - protein, 17 aa, Mycobacterium
LPRTATFKVIKRQLSAE

SEQ ID NO: 362023 - protein, 39 aa, Mycobacterium; identical to SEQ ID NO: 24449

SEQ ID NO: 362024 - protein, 38 aa, Mycobacterium
LPRVIPPSFLRRAMPYVLVILIVGMVVALFATGMRLIS

SEQ ID NO: 362025 - protein, 20 aa, Mycobacterium
LPSFITPTPKFYRIDTALTV

SEQ ID NO: 362026 - protein, 17 aa, Mycobacterium
LPSKENGFALLKVGPRD

SEQ ID NO: 362027 - protein, 20 aa, Mycobacterium
LPSLKRYVLEMRFKPMPRYE

SEQ ID NO: 362028 - protein, 25 aa, Mycobacterium
LPSLLSAVRWRRRRTRVVTWVASAA

SEQ ID NO: 362029 - protein, 20 aa, Mycobacterium
LPSMAVLIRSGIAGAFAAMI

SEQ ID NO: 362030 - protein, 19 aa, Mycobacterium
LPSQILLNNLLYDSSQLAI

SEQ ID NO: 362031 - protein, 19 aa, Mycobacterium
LPTEIYWRRRGLAVGVAVV

SEQ ID NO: 362032 - protein, 19 aa, Mycobacterium
LPTHRLLTGSLLAAGVFLV

SEQ ID NO: 362033 - protein, 19 aa, Mycobacterium
LPTIGLAGLPWVAAALIAI

SEQ ID NO: 362034 - protein, 27 aa, Mycobacterium
LPTKAPTWQQGYSRRLIVLDLVGVVLA

SEQ ID NO: 362035 - protein, 28 aa, Mycobacterium
LPTLGVLLLGVLLFGLGLGPPIVALMLL

SEQ ID NO: 362036 - protein, 18 aa, Mycobacterium
LPTLLVGLAIMGLGIGCT

SEQ ID NO: 362037 - protein, 25 aa, Mycobacterium
LPTLPAAIVGWAGLALILVACNHLD

SEQ ID NO: 362038 - protein, 35 aa, Mycobacterium
LPTPLSIPPPEGKPWWLIVVGVVVIGLLGGMVAMT

SEQ ID NO: 362039 - protein, 18 aa, Mycobacterium
LPTVILVRWLLTAGARWD

SEQ ID NO: 362040 - protein, 22 aa, Mycobacterium
LPTVLAWVFAPRYAAGAAVLAA

SEQ ID NO: 362041 - protein, 18 aa, Mycobacterium
LPTVLFQTTTNKLRQVLA

SEQ ID NO: 362042 - protein, 19 aa, Mycobacterium
LPTVLFQTTVNKLRQILTA

SEQ ID NO: 362043 - protein, 24 aa, Mycobacterium
LPVFVVLVYLVLCAVASLLLSMVQ

SEQ ID NO: 362044 - protein, 36 aa, Mycobacterium
LPVGLAIIALLVALGAPFFGIRWGYPDDRVLPASSS

SEQ ID NO: 362045 - protein, 17 aa, Mycobacterium
LPVLAAVPRPPLGPVWV

SEQ ID NO: 362046 - protein, 19 aa, Mycobacterium
LPVLAAVPTPPLGPVWVAL

SEQ ID NO: 362047 - protein, 29 aa, Mycobacterium
LPVLGWWAFNIFYVTPFLAIPYLHTVNRE

SEQ ID NO: 362048 - protein, 20 aa, Mycobacterium
LPVLIPTLAAAATLIAGRRP

SEQ ID NO: 362049 - protein, 18 aa, Mycobacterium
LPVLPQLSAKHQVVVAAV

SEQ ID NO: 362050 - protein, 25 aa, Mycobacterium
LPVMAVAAVLFWVLCIDGTLSRVDG

SEQ ID NO: 362051 - protein, 25 aa, Mycobacterium
LPVQFGRDWFWLHAARTAAVTIPLL

SEQ ID NO: 362052 - protein, 25 aa, Mycobacterium
LPVQLGKDWIWLHAARIAATTLPLL

SEQ ID NO: 362053 - protein, 38 aa, Mycobacterium
LPVSEAIAYLLEILPALAYLHALGLVYNDLKPENIMLT

SEQ ID NO: 362054 - protein, 21 aa, Mycobacterium
LPVSIPRTAVVAALVLAVCAV

SEQ ID NO: 362055 - protein, 20 aa, Mycobacterium
LPVWMVLTVPQRSANALWAS

SEQ ID NO: 362056 - protein, 20 aa, Mycobacterium
LPWAGFLVGAILSTAGAFST

SEQ ID NO: 362057 - protein, 17 aa, Mycobacterium
LPYFQTLGSPCSIGLLA

SEQ ID NO: 362058 - protein, 17 aa, Mycobacterium
LPYVQPSIGLAPGAYGS

SEQ ID NO: 362059 - protein, 28 aa, Mycobacterium
LQADIIGALFVLGFLRYALPPEDRIQLQ

SEQ ID NO: 362060 - protein, 28 aa, Mycobacterium
LQADIIGGLFVLGFLRYGLPPNDRIQLQ

SEQ ID NO: 362061 - protein, 36 aa, Mycobacterium
LQAFDVFSSFWFTAIYVLLFISLVGCLTPRMIEHVR

SEQ ID NO: 362062 - protein, 34 aa, Mycobacterium
LQAFDVFSSFWFTAIYVLLFVSLVGCLTPRMIEH

SEQ ID NO: 362063 - protein, 35 aa, Mycobacterium
LQAFDVFSSFWFTAVYVLLFVSLVGCLTPRMIEHA

SEQ ID NO: 362064 - protein, 33 aa, Mycobacterium
LQAGAIVSLALLLTRLYAPLTALANARVEIATA

SEQ ID NO: 362065 - protein, 29 aa, Mycobacterium
LQAGWSAVYLIFIAIITAGLSALAEREHR

SEQ ID NO: 362066 - protein, 18 aa, Mycobacterium
LQARRNLHDLLLAATSRA

SEQ ID NO: 362067 - protein, 30 aa, Mycobacterium
LQDARRARRRTKRPWVFAGAAVAVLAGGAV

SEQ ID NO: 362068 - protein, 26 aa, Mycobacterium
LQDGIVWELRLPRVLLAAACGSGLAL

SEQ ID NO: 362069 - protein, 33 aa, Mycobacterium
LQDLPAFNLAIFLAYLFVSFTVGAYLALRLLIP

SEQ ID NO: 362070 - protein, 28 aa, Mycobacterium
LQDLPPLNLAIFLTSVITLFLAGFALNL

SEQ ID NO: 362071 - protein, 18 aa, Mycobacterium
LQDTWLFDGTIAQNIAYG

SEQ ID NO: 362072 - protein, 19 aa, Mycobacterium
LQDTWLFGGTIVENIAYGR

SEQ ID NO: 362073 - protein, 20 aa, Mycobacterium
LQFDAPSTLQFLFNGAYAER

SEQ ID NO: 362074 - protein, 26 aa, Mycobacterium
LQFPGRDALFWVYIATLMVPATVTIV

SEQ ID NO: 362075 - protein, 19 aa, Mycobacterium
LQGAWALLLTSLTGQQDVV

SEQ ID NO: 362076 - protein, 17 aa, Mycobacterium
LQGSYSPIPPSMAGQIV

SEQ ID NO: 362077 - protein, 17 aa, Mycobacterium
LQHFPSLSTPIVRDLLV

SEQ ID NO: 362078 - protein, 30 aa, Mycobacterium
LQIASALCRHYWPLALFAAALSRRSRQVLV

SEQ ID NO: 362079 - protein, 17 aa, Mycobacterium
LQIFLFTSTIICALFGF

SEQ ID NO: 362080 - protein, 21 aa, Mycobacterium
LQIGFVILALAIAYVPLGDYM

SEQ ID NO: 362081 - protein, 19 aa, Mycobacterium
LQILAFRTTGRRVFRMAPF

SEQ ID NO: 362082 - protein, 19 aa, Mycobacterium
LQILGLALLGLGGAFMLGA

SEQ ID NO: 362083 - protein, 19 aa, Mycobacterium
LQILTFRTTGRRVFRMAPF

SEQ ID NO: 362084 - protein, 19 aa, Mycobacterium
LQINPIWNLGPYKPSHVSA

SEQ ID NO: 362085 - protein, 22 aa, Mycobacterium
LQKILLVILVVSLMPAFIAAWR

SEQ ID NO: 362086 - protein, 20 aa, Mycobacterium
LQKLFGWWGGSGVTGFRNSL

SEQ ID NO: 362087 - protein, 22 aa, Mycobacterium
LQLARNTLIDRKADAGAGLAGT

SEQ ID NO: 362088 - protein, 28 aa, Mycobacterium
LQLASALCRHYWPLALMAATMSRHFRRV

SEQ ID NO: 362089 - protein, 21 aa, Mycobacterium
LQLDRLLRLKVFPLAISLPWG

SEQ ID NO: 362090 - protein, 30 aa, Mycobacterium
LQLSVFQRSPAYTLPWRVHRFAPGELDDMK

SEQ ID NO: 362091 - protein, 20 aa, Mycobacterium
LQLWGFFALVLDSLAIAAQS

SEQ ID NO: 362092 - protein, 18 aa, Mycobacterium
LQMEFNVKLPWRKEVKLN

SEQ ID NO: 362093 - protein, 31 aa, Mycobacterium
LQMLRTIPFIAMVPLFVVWFGIGEESKVALI

SEQ ID NO: 362094 - protein, 18 aa, Mycobacterium
LQMTGMYQTIANDGVRIP

SEQ ID NO: 362095 - protein, 34 aa, Mycobacterium
LQNIGLSLAIITILIPLAAFGVLGLATVVLIHEA

SEQ ID NO: 362096 - protein, 35 aa, Mycobacterium
LQNIGLSLAIITILLPLALLGVLGLAAVVLVHELA

SEQ ID NO: 362097 - protein, 36 aa, Mycobacterium
LQNVGLSLALIAVLIPLALLGILGLAAVVAVHELAE

SEQ ID NO: 362098 - protein, 17 aa, Mycobacterium
LQPEWSLTFVERLDAVA

SEQ ID NO: 362099 - protein, 21 aa, Mycobacterium
LQPGIFAVHWYAGEQTNPMLP

SEQ ID NO: 362100 - protein, 24 aa, Mycobacterium
LQPGSLPALLPPERRAQPGARARL

SEQ ID NO: 362101 - protein, 18 aa, Mycobacterium
LQPKYMEMLNINEAWQFG

SEQ ID NO: 362102 - protein, 24 aa, Mycobacterium
LQQFDSLLTTIRPFLDTNREVLTH

SEQ ID NO: 362103 - protein, 20 aa, Mycobacterium
LQQQLLTRMAIMSDPASELV

SEQ ID NO: 362104 - protein, 26 aa, Mycobacterium
LQQVDFVFQVGPFSLVVALLAGAAGM

SEQ ID NO: 362105 - protein, 24 aa, Mycobacterium
LQRGDPLWRILVAKNLAMAAMITV

SEQ ID NO: 362106 - protein, 23 aa, Mycobacterium
LQRITWIVTMYLLGYIAAMPLLG

SEQ ID NO: 362107 - protein, 27 aa, Mycobacterium
LQRQKFFWNLLVDYWFRMEIDGWENIP

SEQ ID NO: 362108 - protein, 24 aa, Mycobacterium
LQRRNFIFVAILLGMLMAALDQTI

SEQ ID NO: 362109 - protein, 29 aa, Mycobacterium
LQSDIIGALFVLGFLRYGLPPGDRIQLQD

SEQ ID NO: 362110 - protein, 22 aa, Mycobacterium
LQSFAFWDISTFLINGSLWVFV

SEQ ID NO: 362111 - protein, 18 aa, Mycobacterium
LQSPLFTGTPLPESIAEL

SEQ ID NO: 362112 - protein, 20 aa, Mycobacterium
LQSVLSRGPLPPARAVHIIE

SEQ ID NO: 362113 - protein, 19 aa, Mycobacterium
LQTELAAARRDPAVDWVIV

SEQ ID NO: 362114 - protein, 20 aa, Mycobacterium
LQTFFIIAYMCACSAAALSS

SEQ ID NO: 362115 - protein, 18 aa, Mycobacterium
LQVRVVVSNLALSSLVIL

SEQ ID NO: 362116 - protein, 23 aa, Mycobacterium
LRAAIDKVPALAPGGRPMKLVPD

SEQ ID NO: 362117 - protein, 21 aa, Mycobacterium
LRADLARDPSFYLRFRREAQN

SEQ ID NO: 362118 - protein, 34 aa, Mycobacterium
LRADMRITHPLISRAHLLLRFDQGRWLAIDNNSL

SEQ ID NO: 362119 - protein, 19 aa, Mycobacterium
LRAEFLDNIPIVLGLAAGG

SEQ ID NO: 362120 - protein, 18 aa, Mycobacterium
LRAELLLVLGTSSAEPAL

SEQ ID NO: 362121 - protein, 22 aa, Mycobacterium
LRAESRLNRLLAQQAPPARVVT

SEQ ID NO: 362122 - protein, 27 aa, Mycobacterium
LRAGPRTYLILLALVVIAIAGATVEDA

SEQ ID NO: 362123 - protein, 27 aa, Mycobacterium
LRAKRWSIRWALACVAGLLVTTVLATT

SEQ ID NO: 362124 - protein, 17 aa, Mycobacterium
LRALLSLGAKDVAVLRG

SEQ ID NO: 362125 - protein, 36 aa, Mycobacterium
LRALLVFTVLLGVGYPLLIWLVAGLPGLHDKAQGSI

SEQ ID NO: 362126 - protein, 17 aa, Mycobacterium
LRALSVFGLIGCLVLVV

SEQ ID NO: 362127 - protein, 20 aa, Mycobacterium
LRANTFARFRQRFAGYGLRP

SEQ ID NO: 362128 - protein, 34 aa, Mycobacterium
LRAPHGGIFVFFAIGNLLWFVIAVALGTVVSALT

SEQ ID NO: 362129 - protein, 37 aa, Mycobacterium
LRARVWDSAACKAWLLGHSYLLAVALLVAFVIGDRYQ

SEQ ID NO: 362130 - protein, 19 aa, Mycobacterium
LRASLAGPRRWGPWLRKRI

SEQ ID NO: 362131 - protein, 25 aa, Mycobacterium
LRATTVIVYYLWDRAFVQFDAGYAA

SEQ ID NO: 362132 - protein, 30 aa, Mycobacterium
LRAVGPFDVLPFLLAVPGLILIAAGVWGLR

SEQ ID NO: 362133 - protein, 22 aa, Mycobacterium
LRAYLIDQRALPDAPLIAMVPV

SEQ ID NO: 362134 - protein, 27 aa, Mycobacterium
LRDDAIAAFMWLANWRFVAQKTDYFTQ

SEQ ID NO: 362135 - protein, 25 aa, Mycobacterium
LRDLVRLLARFLIRRLRLSQEVSLL

SEQ ID NO: 362136 - protein, 31 aa, Mycobacterium
LRDMTYVGLPPFYPPGWFWIGGRAAALTGTT

SEQ ID NO: 362137 - protein, 33 aa, Mycobacterium
LRDRDLVRPFRMPLWPLPPLLAVVGVVVTLATQ

SEQ ID NO: 362138 - protein, 22 aa, Mycobacterium
LRDVPWKRPRVRPAMLVEGLVV

SEQ ID NO: 362139 - protein, 40 aa, Mycobacterium
LRDWRSPIAWLSRYRPRLPRLSRWRVGFATWLTDAAVIAT

SEQ ID NO: 362140 - protein, 17 aa, Mycobacterium
LREAAVLRFGQLHRPDL

SEQ ID NO: 362141 - protein, 19 aa, Mycobacterium
LREAPPLGALLADDARREL

SEQ ID NO: 362142 - protein, 24 aa, Mycobacterium
LREARKFRYFFTSADFVPADEGAG

SEQ ID NO: 362143 - protein, 29 aa, Mycobacterium
LREEQLALLVAVPGVRRGVPLRVSLVVGT

SEQ ID NO: 362144 - protein, 26 aa, Mycobacterium
LREFGNIVFHFSLLGLLVAIAAGKLF

SEQ ID NO: 362145 - protein, 26 aa, Mycobacterium
LREFGNIVFHFSLLGLLVAVAAGKLF

SEQ ID NO: 362146 - protein, 26 aa, Mycobacterium
LREFGNIVFHFSLLGLLVAVAVGKLF

SEQ ID NO: 362147 - protein, 26 aa, Mycobacterium
LREFGNLVFHFSLLGLLVAVAVGKLF

SEQ ID NO: 362148 - protein, 33 aa, Mycobacterium
LREGFAFVLKTPWLLWTVLFASMFVLVVLGPIE

SEQ ID NO: 362149 - protein, 18 aa, Mycobacterium
LREILPAVQRLVVPATAN

SEQ ID NO: 362150 - protein, 26 aa, Mycobacterium
LREKAPALPSPLPEEPPVPFGYLMRL

SEQ ID NO: 362151 - protein, 19 aa, Mycobacterium
LRELLAERGPMPPYAVAAV

SEQ ID NO: 362152 - protein, 24 aa, Mycobacterium
LREPLIPLEIFRYRDFALSSLGVA

SEQ ID NO: 362153 - protein, 24 aa, Mycobacterium
LREQRLTYLRVLHALLAVLVGAIA

SEQ ID NO: 362154 - protein, 26 aa, Mycobacterium
LRERHPAWRLLRAGNATLILSFLGGF

SEQ ID NO: 362155 - protein, 17 aa, Mycobacterium
LRESLPLIGFMIVGLLY

SEQ ID NO: 362156 - protein, 18 aa, Mycobacterium
LRETPSIPGVPMIVVALA

SEQ ID NO: 362157 - protein, 39 aa, Mycobacterium
LREVLFGGRVSWIALLTLALVAVLIAFVGGWVGQKTAGT

SEQ ID NO: 362158 - protein, 32 aa, Mycobacterium
LREVLPLVVPVILASLLFAGGLVPLVGTWGFD

SEQ ID NO: 362159 - protein, 26 aa, Mycobacterium
LREVQDVWTWVRPYFDDRATAAAQQL

SEQ ID NO: 362160 - protein, 27 aa, Mycobacterium
LRFHRATAWALLALFVVQFPITSTHGR

SEQ ID NO: 362161 - protein, 19 aa, Mycobacterium
LRFPVFIEAYDQFGWQVKC

SEQ ID NO: 362162 - protein, 18 aa, Mycobacterium
LRFTGRRLGLYTALITVS

SEQ ID NO: 362163 - protein, 20 aa, Mycobacterium
LRFVWNLRVLRTLGLIDLTV

SEQ ID NO: 362164 - protein, 20 aa, Mycobacterium
LRGALLTEPALAPNGVAAAV

SEQ ID NO: 362165 - protein, 32 aa, Mycobacterium
LRGATVLGFKRRLLHRLLGPGDPALASTVFGV

SEQ ID NO: 362166 - protein, 24 aa, Mycobacterium
LRGHVVDFLSIGWWPVFNVADPAV

SEQ ID NO: 362167 - protein, 18 aa, Mycobacterium
LRGILRRVPLTATAAAGM

SEQ ID NO: 362168 - protein, 18 aa, Mycobacterium
LRGLRRDQWPPIVGLVLV

SEQ ID NO: 362169 - protein, 21 aa, Mycobacterium
LRGPRRRGALPTLIRAGAAAL

SEQ ID NO: 362170 - protein, 26 aa, Mycobacterium
LRGPVLQWWIAWVCSYAVSIAAIVTS

SEQ ID NO: 362171 - protein, 24 aa, Mycobacterium
LRGQWDRLRWQLPASFIGAAGGAW

SEQ ID NO: 362172 - protein, 22 aa, Mycobacterium
LRGRRAIMLPAGALVYIAVPPA

SEQ ID NO: 362173 - protein, 33 aa, Mycobacterium
LRGVGRLTIGLLGVATVLLLAPPAMAQPEVDAN

SEQ ID NO: 362174 - protein, 20 aa, Mycobacterium
LRGYLYWEQHCFNIPVCWAA

SEQ ID NO: 362175 - protein, 19 aa, Mycobacterium
LRHAGGYVQTYWMSPRDIS

SEQ ID NO: 362176 - protein, 25 aa, Mycobacterium
LRHPDFDEILWPLTVLFCVGFIARG

SEQ ID NO: 362177 - protein, 27 aa, Mycobacterium
LRHPLLRWAWSLLRLDFAGVAVGALFF

SEQ ID NO: 362178 - protein, 18 aa, Mycobacterium
LRHRLTGSVLLSVPVIAM

SEQ ID NO: 362179 - protein, 26 aa, Mycobacterium
LRHTGFVFLVLLVLGATLGMALTLWL

SEQ ID NO: 362180 - protein, 19 aa, Mycobacterium
LRIAIVLMPFAGIAFLWFL

SEQ ID NO: 362181 - protein, 18 aa, Mycobacterium
LRIAWDKHRVALFAGAPT

SEQ ID NO: 362182 - protein, 26 aa, Mycobacterium
LRIFPGLWICLMVIAFVIAPIAARVK

SEQ ID NO: 362183 - protein, 22 aa, Mycobacterium
LRIGNYLILIAVALVTLAVVVS

SEQ ID NO: 362184 - protein, 21 aa, Mycobacterium
LRIGTLTLWVGFMAVMFSIYL

SEQ ID NO: 362185 - protein, 22 aa, Mycobacterium
LRILGPWFWWPTLVRARPLRQA

SEQ ID NO: 362186 - protein, 22 aa, Mycobacterium
LRILGPWFWWPTLVRSRPLPQR

SEQ ID NO: 362187 - protein, 23 aa, Mycobacterium
LRILPGYYIVLAITAFVVAPLSV

SEQ ID NO: 362188 - protein, 18 aa, Mycobacterium
LRITALSIVLLALGAMVS

SEQ ID NO: 362189 - protein, 24 aa, Mycobacterium
LRITRLTRVLAVTGAVACVASFAA

SEQ ID NO: 362190 - protein, 27 aa, Mycobacterium
LRKRVRILRAVLAGTVVIALIAAIVAV

SEQ ID NO: 362191 - protein, 30 aa, Mycobacterium
LRKVNLRLMPFIFLLYLVNYVDRTALGIAA

SEQ ID NO: 362192 - protein, 19 aa, Mycobacterium
LRLALPMGGNGDASFLAGE

SEQ ID NO: 362193 - protein, 33 aa, Mycobacterium
LRLASRVLLLQLVLVTLTLVVAFALFAQFNRHR

SEQ ID NO: 362194 - protein, 26 aa, Mycobacterium
LRLCMLPGLALLIWAAPRLAQHLGAN

SEQ ID NO: 362195 - protein, 26 aa, Mycobacterium
LRLLDTRWMPLPAFVIAMVLLRSSLA

SEQ ID NO: 362196 - protein, 21 aa, Mycobacterium
LRLLRLYLRRDRVGLPLWVML

SEQ ID NO: 362197 - protein, 18 aa, Mycobacterium
LRLLVVCVALTAIALLAA

SEQ ID NO: 362198 - protein, 28 aa, Mycobacterium
LRLPADLFGWFTLAWVFVLGVVSCSLLG

SEQ ID NO: 362199 - protein, 26 aa, Mycobacterium
LRLVPALCRLIDPPLIVLIREGEVSR

SEQ ID NO: 362200 - protein, 17 aa, Mycobacterium
LRMAFLLGAAMLIDFRF

SEQ ID NO: 362201 - protein, 18 aa, Mycobacterium
LRMLLRVTRFDVGLAMLV

SEQ ID NO: 362202 - protein, 17 aa, Mycobacterium
LRNALFDAFGPKGPDGK

SEQ ID NO: 362203 - protein, 32 aa, Mycobacterium
LRNGINQILRFITYLLIPAGALIIYTQLFTTD

SEQ ID NO: 362204 - protein, 26 aa, Mycobacterium
LRNILLTGWALLIPAVVMYIAIMFVE

SEQ ID NO: 362205 - protein, 20 aa, Mycobacterium
LRNIVAAHQGWLFKHTGDGV

SEQ ID NO: 362206 - protein, 40 aa, Mycobacterium
LRNKLVFILPGAMLLSQFVPWLLSPILMLGATYLCYEGAE

SEQ ID NO: 362207 - protein, 24 aa, Mycobacterium
LRNPVLLIMFGLAFLLMGGFVTVY

SEQ ID NO: 362208 - protein, 22 aa, Mycobacterium
LRNVYLWVVYFLGESALTLTFV

SEQ ID NO: 362209 - protein, 28 aa, Mycobacterium
LRPDIVMTCILPPLLYNAALESSLVGIR

SEQ ID NO: 362210 - protein, 17 aa, Mycobacterium
LRPGSLEALLPPEQRAR

SEQ ID NO: 362211 - protein, 35 aa, Mycobacterium
LRPGWIALALVVIAFTYLCFTVLAPWQLGKNTKTS

SEQ ID NO: 362212 - protein, 24 aa, Mycobacterium
LRPGWIVLALVVIAFAYLCFTVLA

SEQ ID NO: 362213 - protein, 21 aa, Mycobacterium
LRPHLPGWRLALVIAFIPMAD

SEQ ID NO: 362214 - protein, 26 aa, Mycobacterium
LRPHLRPLLAIIVFTAMLGPKMARHL

SEQ ID NO: 362215 - protein, 18 aa, Mycobacterium
LRPPRLWAGLRLGAAAAA

SEQ ID NO: 362216 - protein, 24 aa, Mycobacterium
LRPRNVALLGLGAAVLATGALFAV

SEQ ID NO: 362217 - protein, 19 aa, Mycobacterium
LRPVAGFPLLHVEKPQYSG

SEQ ID NO: 362218 - protein, 25 aa, Mycobacterium
LRPVMRVLSLRTIVIVAALSVVVLV

SEQ ID NO: 362219 - protein, 17 aa, Mycobacterium
LRPYRYLGSAAVLVGAF

SEQ ID NO: 362220 - protein, 26 aa, Mycobacterium
LRQEAALTWLLLVSVPVMAVANYWVM

SEQ ID NO: 362221 - protein, 28 aa, Mycobacterium
LRQGTFPLAALWPLLLLALATVFTYRLH

SEQ ID NO: 362222 - protein, 34 aa, Mycobacterium
LRQHTSQFIWWLGVLYILYTFLPLLVSGIVTDEA

SEQ ID NO: 362223 - protein, 20 aa, Mycobacterium
LRQLYFLIEGLLDRLVYLSY

SEQ ID NO: 362224 - protein, 30 aa, Mycobacterium
LRQNIFAWSTVWCLVLLSLALTAATFFPHL

SEQ ID NO: 362225 - protein, 30 aa, Mycobacterium
LRQNIIAWTTVWCLVLLSLALTVTTFFPRL

SEQ ID NO: 362226 - protein, 24 aa, Mycobacterium
LRQRAIHVTLLGILAYGMNVATGA

SEQ ID NO: 362227 - protein, 18 aa, Mycobacterium
LRRDAEVLHLSHGLLRVR

SEQ ID NO: 362228 - protein, 29 aa, Mycobacterium
LRRDRVVLPLWVLLLSVPLATVYVSSIEK

SEQ ID NO: 362229 - protein, 20 aa, Mycobacterium
LRRLPRRQLLWTGAALLIVI

SEQ ID NO: 362230 - protein, 17 aa, Mycobacterium
LRRPVVQAKLWLQDAIA

SEQ ID NO: 362231 - protein, 17 aa, Mycobacterium
LRRPVVQAKLWLQDAIT

SEQ ID NO: 362232 - protein, 28 aa, Mycobacterium
LRRRALVPYEFPWTVPVVMYGSTLLIVG

SEQ ID NO: 362233 - protein, 27 aa, Mycobacterium
LRRRDATGKFFRILAGYLAAVVMHGLW

SEQ ID NO: 362234 - protein, 18 aa, Mycobacterium
LRRRLMIVGFIVALPIDL

SEQ ID NO: 362235 - protein, 28 aa, Mycobacterium
LRRRLSAGLLLLIGLAVAGGVAATLTPQ

SEQ ID NO: 362236 - protein, 25 aa, Mycobacterium
LRRRVTDLGWFRALACFKSAATWSL

SEQ ID NO: 362237 - protein, 31 aa, Mycobacterium
LRRTDRLEALLLLVALIASLFLIPATAVVGA

SEQ ID NO: 362238 - protein, 27 aa, Mycobacterium
LRSDAIAAFLWMANWRFVAQKTDYFTQ

SEQ ID NO: 362239 - protein, 23 aa, Mycobacterium
LRSFALYWHAVCGIPLMVPQFTY

SEQ ID NO: 362240 - protein, 26 aa, Mycobacterium
LRSGGPLAILFSLVVIGIAAFSFLID

SEQ ID NO: 362241 - protein, 25 aa, Mycobacterium
LRSIHYMLIHYRVELIRLIAQMGLG

SEQ ID NO: 362242 - protein, 38 aa, Mycobacterium
LRSRDRVLVAPPFFHGFGLAALLGPLALGGTVMCRRRF

SEQ ID NO: 362243 - protein, 26 aa, Mycobacterium
LRSRLRSLLLLLVLGSAALAATVLSA

SEQ ID NO: 362244 - protein, 28 aa, Mycobacterium
LRSVHPRYAGVPWWGAVLAAVTATAIGF

SEQ ID NO: 362245 - protein, 40 aa, Mycobacterium
LRSVLEPWLTFLRALPPLAYFFLLVIWLGIDEAPKITLLA

SEQ ID NO: 362246 - protein, 25 aa, Mycobacterium
LRTAGQWVVFIAQTVWLLPTTVRRY

SEQ ID NO: 362247 - protein, 32 aa, Mycobacterium
LRTALPITFVTFGLGYLAIIGIPPLAGFFSKD

SEQ ID NO: 362248 - protein, 17 aa, Mycobacterium
LRTAWRPILQIAGLVVI

SEQ ID NO: 362249 - protein, 27 aa, Mycobacterium
LRTFIGSAVVLLPIVLAGTAIVLMRTE

SEQ ID NO: 362250 - protein, 23 aa, Mycobacterium
LRTGFVMLGLASLMDLSKAGRGG

SEQ ID NO: 362251 - protein, 20 aa, Mycobacterium
LRTHPVIGPWLNELQAFDVF

SEQ ID NO: 362252 - protein, 24 aa, Mycobacterium
LRTIRMNMVWAFGYNVAAIPIAAA

SEQ ID NO: 362253 - protein, 19 aa, Mycobacterium
LRTIRTNMIWAFGYNVAAI

SEQ ID NO: 362254 - protein, 18 aa, Mycobacterium
LRTLAAQAGLAVALMGAV

SEQ ID NO: 362255 - protein, 29 aa, Mycobacterium
LRTPGVILRLMLAWVLSTAVPLLAIVLAV

SEQ ID NO: 362256 - protein, 31 aa, Mycobacterium
LRTSTVVLIVAFFALWWLQQTYQPEPARTET

SEQ ID NO: 362257 - protein, 30 aa, Mycobacterium
LRTVPSLAWVPLLLLWFGIGETPKVTLVAI

SEQ ID NO: 362258 - protein, 38 aa, Mycobacterium; identical to SEQ ID NO: 318605

SEQ ID NO: 362259 - protein, 34 aa, Mycobacterium
LRVAVRLGLALLLAPGVPLLFVLGRPRLQRAYCR

SEQ ID NO: 362260 - protein, 24 aa, Mycobacterium
LRVELPNAMPLLLGGLRSATLQVV

SEQ ID NO: 362261 - protein, 24 aa, Mycobacterium
LRVFPFFIVATLVTLPLAAMSWFV

SEQ ID NO: 362262 - protein, 33 aa, Mycobacterium
LRVFYAREQPWTPILIIIIITSVKIGASVLAPH

SEQ ID NO: 362263 - protein, 21 aa, Mycobacterium
LRVIPSMMFGGAITGALCMAF

SEQ ID NO: 362264 - protein, 25 aa, Mycobacterium
LRVKMWLFPVLSGLTALGILAILVQ

SEQ ID NO: 362265 - protein, 22 aa, Mycobacterium
LRVRLVHSLARKGLRSAWGPDN

SEQ ID NO: 362266 - protein, 18 aa, Mycobacterium
LRVSAHRYLVRRTECALL

SEQ ID NO: 362267 - protein, 17 aa, Mycobacterium
LRVSAPINRQLTAGADQ

SEQ ID NO: 362268 - protein, 19 aa, Mycobacterium
LRVTRFDVGLAMLVAGAVN

SEQ ID NO: 362269 - protein, 19 aa, Mycobacterium
LRWGLLAVWGPGLVVMLAD

SEQ ID NO: 362270 - protein, 20 aa, Mycobacterium
LRWQYDTMRYAQIAGVQALQ

SEQ ID NO: 362271 - protein, 18 aa, Mycobacterium
LRYAPHCLVRVNAGRVGD

SEQ ID NO: 362272 - protein, 23 aa, Mycobacterium
LRYGYYPALILGLLVGVVILYRV

SEQ ID NO: 362273 - protein, 19 aa, Mycobacterium
LRYTLFAFFVVVLAGLGSV

SEQ ID NO: 362274 - protein, 18 aa, Mycobacterium
LRYWVALILVALAAVFVV

SEQ ID NO: 362275 - protein, 28 aa, Mycobacterium
LSAAAVLVLLAGRRLWHRFRGQPDPADL

SEQ ID NO: 362276 - protein, 29 aa, Mycobacterium
LSAFLSYFAQILMAVLMATMTLVVLPRAS

SEQ ID NO: 362277 - protein, 27 aa, Mycobacterium
LSAFTLIPYALVLLQLRVFYARHEAWT

SEQ ID NO: 362278 - protein, 29 aa, Mycobacterium
LSAFTLIPYTMVLLQLRVFYAREEPWTPI

SEQ ID NO: 362279 - protein, 19 aa, Mycobacterium
LSALGLTMSGPRPGGFGLL

SEQ ID NO: 362280 - protein, 23 aa, Mycobacterium
LSALIQLYIVGVFISFTLSQIGM

SEQ ID NO: 362281 - protein, 22 aa, Mycobacterium
LSALLCPLLVYGWLGLPRMELA

SEQ ID NO: 362282 - protein, 17 aa, Mycobacterium
LSALVLAVLAVLGFLPS

SEQ ID NO: 362283 - protein, 29 aa, Mycobacterium
LSAMLSGLLLNYFLIAPRHSFTIAEPNSA

SEQ ID NO: 362284 - protein, 19 aa, Mycobacterium
LSAPLPPPPPTWSPPGMSP

SEQ ID NO: 362285 - protein, 17 aa, Mycobacterium
LSAPLRSLTKPSLTIDQ

SEQ ID NO: 362286 - protein, 24 aa, Mycobacterium
LSASGFLLWHHHNAVAQRERAAAY

SEQ ID NO: 362287 - protein, 23 aa, Mycobacterium
LSATILVFTLVFMKSAGLNDFIS

SEQ ID NO: 362288 - protein, 26 aa, Mycobacterium
LSATTFPWVFLFPAGVLVLILVCANL

SEQ ID NO: 362289 - protein, 18 aa, Mycobacterium
LSAVLLAGLLVNSLFAWS

SEQ ID NO: 362290 - protein, 26 aa, Mycobacterium
LSAVLMLYTILIIRGLRTAIAIRDSF

SEQ ID NO: 362291 - protein, 30 aa, Mycobacterium
LSAVLSGLLLNYFLIEPRYTFTIADPDNAV

SEQ ID NO: 362292 - protein, 27 aa, Mycobacterium
LSAVLSSLLLNYYLTDPRHTFTIAEPS

SEQ ID NO: 362293 - protein, 22 aa, Mycobacterium
LSAVYMLWLYQRVMTGPVATGN

SEQ ID NO: 362294 - protein, 31 aa, Mycobacterium
LSAWGLSVAIWQYGIGLPLHWAVAPCSFIFL

SEQ ID NO: 362295 - protein, 18 aa, Mycobacterium
LSAWVRYHSDERLPKELS

SEQ ID NO: 362296 - protein, 18 aa, Mycobacterium
LSAYLLWPSNFPGTITQS

SEQ ID NO: 362297 - protein, 30 aa, Mycobacterium
LSDAKKVLSSWLPPGPVAIADYPAVLLNGS

SEQ ID NO: 362298 - protein, 27 aa, Mycobacterium
LSDDELFFFAVLLLVAGYESTAHMIST

SEQ ID NO: 362299 - protein, 38 aa, Mycobacterium
LSDGLTAWIAAPLLFIGFMFGLLLLTGTTIREVPDAVR

SEQ ID NO: 362300 - protein, 25 aa, Mycobacterium
LSDNVAALPPLLRELAAGPARRVVD

SEQ ID NO: 362301 - protein, 23 aa, Mycobacterium
LSDPITPLLATGALASALLGSPL

SEQ ID NO: 362302 - protein, 18 aa, Mycobacterium
LSDREIFTTLVMTAALGV

SEQ ID NO: 362303 - protein, 29 aa, Mycobacterium
LSDRVGRKPLWWFSLAGLFVAGLPMFMLM

SEQ ID NO: 362304 - protein, 23 aa, Mycobacterium
LSEAVSEPALVALLLGKTAQADE

SEQ ID NO: 362305 - protein, 30 aa, Mycobacterium
LSEEPAPTALWVWIALTGVAAAVLVLGWGS

SEQ ID NO: 362306 - protein, 29 aa, Mycobacterium
LSEGGIGWMPYLLERIDYSFGRHKYWCNI

SEQ ID NO: 362307 - protein, 24 aa, Mycobacterium
LSEHFRAPVVTSPRPQLAAATGAA

SEQ ID NO: 362308 - protein, 17 aa, Mycobacterium
LSEQFVDALLDNLFRGI

SEQ ID NO: 362309 - protein, 25 aa, Mycobacterium
LSERLRCPIIAAPHPQLAVAFGAAF

SEQ ID NO: 362310 - protein, 26 aa, Mycobacterium
LSERMRVPVITAPQPQLAAARGVALL

SEQ ID NO: 362311 - protein, 19 aa, Mycobacterium
LSFAMPARWGYAAAASTVD

SEQ ID NO: 362312 - protein, 25 aa, Mycobacterium
LSFDHQLLVPMLLVASAFAMVLVTT

SEQ ID NO: 362313 - protein, 22 aa, Mycobacterium
LSFIVGFAMLGALTFLPTFMQF

SEQ ID NO: 362314 - protein, 17 aa, Mycobacterium
LSFQINLALPLQASMLA

SEQ ID NO: 362315 - protein, 26 aa, Mycobacterium
LSFRETLLVAVLLGAAYIPVALMSSP

SEQ ID NO: 362316 - protein, 19 aa, Mycobacterium
LSFRYGYLHIFVFGAIVAT

SEQ ID NO: 362317 - protein, 20 aa, Mycobacterium
LSFWLFVCGALIALGGFVIP

SEQ ID NO: 362318 - protein, 18 aa, Mycobacterium
LSFWVVAFENSGHYIEAA

SEQ ID NO: 362319 - protein, 25 aa, Mycobacterium
LSGALAFWVCGLLLCLFVGPSQSSA

SEQ ID NO: 362320 - protein, 23 aa, Mycobacterium
LSGAPWMVYYARALGARVGNGVD

SEQ ID NO: 362321 - protein, 26 aa, Mycobacterium
LSGAVAWIIALFYKGIYVGGLINEVT

SEQ ID NO: 362322 - protein, 17 aa, Mycobacterium
LSGLFRVIQGFAGGAFS

SEQ ID NO: 362323 - protein, 19 aa, Mycobacterium
LSGLGLTMTGARPGGFGAL

SEQ ID NO: 362324 - protein, 18 aa, Mycobacterium
LSGLLIGLGVLMVVSLTA

SEQ ID NO: 362325 - protein, 22 aa, Mycobacterium
LSGLSINRFIAIDFSGFAKMVD

SEQ ID NO: 362326 - protein, 19 aa, Mycobacterium
LSGMLLVLNIFSGGRVEPV

SEQ ID NO: 362327 - protein, 25 aa, Mycobacterium
LSGMTLLPAILVLAGPRGWVKPRRE

SEQ ID NO: 362328 - protein, 24 aa, Mycobacterium
LSGNFSWLNWLTILLACSAVDQTS

SEQ ID NO: 362329 - protein, 28 aa, Mycobacterium
LSGPMAFWACGLLLCLFIGPTLSSARTL

SEQ ID NO: 362330 - protein, 26 aa, Mycobacterium
LSGQWYHLWAYGTVFLLATLAAQPVS

SEQ ID NO: 362331 - protein, 29 aa, Mycobacterium
LSGRLRNPWILLAAAALAVLLVFAAQGIW

SEQ ID NO: 362332 - protein, 40 aa, Mycobacterium
LSGSGERLLIYLGIGAALGLLTSWLLSRRIKTHTRGLDIA

SEQ ID NO: 362333 - protein, 25 aa, Mycobacterium
LSGTVPWWFVLTLLARDAALAATLP

SEQ ID NO: 362334 - protein, 17 aa, Mycobacterium
LSGVLRGGLGGGGFGGG

SEQ ID NO: 362335 - protein, 19 aa, Mycobacterium
LSHFGEHSVGWLLVSALGA

SEQ ID NO: 362336 - protein, 28 aa, Mycobacterium
LSHLFGCTPVGPLAWGQALLAAAVAGSA

SEQ ID NO: 362337 - protein, 28 aa, Mycobacterium
LSIARAFTVLFLPYSLLGPFAGALMDRW

SEQ ID NO: 362338 - protein, 19 aa, Mycobacterium
LSICFVLLITGVGSLIHIY

SEQ ID NO: 362339 - protein, 17 aa, Mycobacterium
LSIEKWLPAGLLVVAFL

SEQ ID NO: 362340 - protein, 36 aa, Mycobacterium
LSIGAIILLITRLRLHPFLALLLGSGTLAAAASVPF

SEQ ID NO: 362341 - protein, 48 aa, Mycobacterium
LSILACGYLLYSLHWYTWIAFGGWVGIALIFYLFWGRHHSRLNAPALH

SEQ ID NO: 362342 - protein, 21 aa, Mycobacterium
LSILLTYLLVAVAVMMFAGIG

SEQ ID NO: 362343 - protein, 32 aa, Mycobacterium
LSINLVLNAGWSWLFFRFHRLGASALGAAVLA

SEQ ID NO: 362344 - protein, 24 aa, Mycobacterium
LSINRFIAIDFVGFARMVEALGGV

SEQ ID NO: 362345 - protein, 28 aa, Mycobacterium
LSIPIVIGWIALSAYLTVGLPPLEVVGQ

SEQ ID NO: 362346 - protein, 18 aa, Mycobacterium
LSITLACLVALILILPLA

SEQ ID NO: 362347 - protein, 28 aa, Mycobacterium
LSIVSWFPMWFSYLLLIAVYPAFLTMFW

SEQ ID NO: 362348 - protein, 28 aa, Mycobacterium
LSIVTWFPMWFSYLLLIVVYPAFLTMFW

SEQ ID NO: 362349 - protein, 21 aa, Mycobacterium
LSIVYSVLALVGYPVIWEMAT

SEQ ID NO: 362350 - protein, 30 aa, Mycobacterium
LSKNALPPCPPPAPKTPPPPAPTAAGRTPT

SEQ ID NO: 362351 - protein, 25 aa, Mycobacterium
LSKWPVGWMVVLLYAVCVVLRLARY

SEQ ID NO: 362352 - protein, 19 aa, Mycobacterium
LSLASILISLYPAATVVLA

SEQ ID NO: 362353 - protein, 27 aa, Mycobacterium
LSLATRLTLVTLIPIVAFMTVGGPAIG

SEQ ID NO: 362354 - protein, 27 aa, Mycobacterium
LSLATRLTMLTLIPIVALMTVGGPAIG

SEQ ID NO: 362355 - protein, 21 aa, Mycobacterium
LSLDWVIFGNNWLNGWPGLVA

SEQ ID NO: 362356 - protein, 18 aa, Mycobacterium
LSLGTIEAFIQYVRQFNQ

SEQ ID NO: 362357 - protein, 24 aa, Mycobacterium
LSLHLPVMLVCGFLLGAAGQFVKL

SEQ ID NO: 362358 - protein, 30 aa, Mycobacterium
LSLIAGLLFFFFVLPRWPELNGATGHTFGT

SEQ ID NO: 362359 - protein, 21 aa, Mycobacterium
LSLIHLRLSLVPILIGLAIAI

SEQ ID NO: 362360 - protein, 22 aa, Mycobacterium
LSLILLIMMIVTRSLVAAIVIV

SEQ ID NO: 362361 - protein, 18 aa, Mycobacterium
LSLPLMVLVGWLVSRSRN

SEQ ID NO: 362362 - protein, 20 aa, Mycobacterium
LSLPLRALATGIQATTALTV

SEQ ID NO: 362363 - protein, 27 aa, Mycobacterium
LSLPVMAVVLFFVFGGVIAAGLPLMVG

SEQ ID NO: 362364 - protein, 25 aa, Mycobacterium
LSLQGATGVPWLLVSGPLGQTDESN

SEQ ID NO: 362365 - protein, 19 aa, Mycobacterium
LSLSVLRLPHRYASLLLGG

SEQ ID NO: 362366 - protein, 18 aa, Mycobacterium
LSLSWPRVTAVFLVDIAI

SEQ ID NO: 362367 - protein, 24 aa, Mycobacterium
LSLTAFFALVVLYFIGMDQGATSV

SEQ ID NO: 362368 - protein, 24 aa, Mycobacterium
LSLTTQIWRFLITGGLSAIVDFGL

SEQ ID NO: 362369 - protein, 28 aa, Mycobacterium
LSLVAMALFPMYFLKSFAYAGVAVVAFS

SEQ ID NO: 362370 - protein, 20 aa, Mycobacterium
LSLVPIVLGLLIAVPLGALV

SEQ ID NO: 362371 - protein, 28 aa, Mycobacterium
LSMAALALFPMYYLRSFAYAGIATVAFA

SEQ ID NO: 362372 - protein, 28 aa, Mycobacterium
LSMACAVWLTVLFVAAVRRGGRRWWLGY

SEQ ID NO: 362373 - protein, 30 aa, Mycobacterium
LSMATAILFPMYFLKSFAYAGVATVAFAAL

SEQ ID NO: 362374 - protein, 26 aa, Mycobacterium
LSMATLVLFPQYFLKSFGYAGVAVVA

SEQ ID NO: 362375 - protein, 27 aa, Mycobacterium
LSMAVMALFPMYFLKSSAYTIVVTAII

SEQ ID NO: 362376 - protein, 25 aa, Mycobacterium
LSMDYEVFLISRIREYWLASDHGPG

SEQ ID NO: 362377 - protein, 26 aa, Mycobacterium
LSMDYEVFLLARIREFWLRSGRSAAD

SEQ ID NO: 362378 - protein, 27 aa, Mycobacterium
LSMDYEVFLLARIREYWLQSPRARADN

SEQ ID NO: 362379 - protein, 25 aa, Mycobacterium
LSMDYEVFLLSRIREYWLASGAARP

SEQ ID NO: 362380 - protein, 18 aa, Mycobacterium
LSMGALCAMLTLFVAASH

SEQ ID NO: 362381 - protein, 27 aa, Mycobacterium
LSMLGDLPWWVTVLILAREIGVTVLRL

SEQ ID NO: 362382 - protein, 22 aa, Mycobacterium
LSMPMFHSNAVMAGWSVAVAAG

SEQ ID NO: 362383 - protein, 22 aa, Mycobacterium
LSMTLLQMTAIYQTIANDGVRV

SEQ ID NO: 362384 - protein, 18 aa, Mycobacterium
LSMTLLQMTGMYQTIAND

SEQ ID NO: 362385 - protein, 27 aa, Mycobacterium
LSMVAMVLFPMYFLKSFAYAGIAVVAL

SEQ ID NO: 362386 - protein, 27 aa, Mycobacterium
LSMVAMVLFPMYFLKSFAYAGIAVVSF

SEQ ID NO: 362387 - protein, 17 aa, Mycobacterium
LSNPYSGLMGCTLFAVI

SEQ ID NO: 362388 - protein, 38 aa, Mycobacterium
LSNTFVRFWTVSFPVVAYRSWRWWLGTAAGFFAVVLLM

SEQ ID NO: 362389 - protein, 18 aa, Mycobacterium
LSPFFLKMASRYASAFLG

SEQ ID NO: 362390 - protein, 30 aa, Mycobacterium
LSPGGRTTFRFLLVAAAAVILTAALVGLGV

SEQ ID NO: 362391 - protein, 30 aa, Mycobacterium
LSPLVAAGIFYLLLTIPLTHLVNYIDAKLR

SEQ ID NO: 362392 - protein, 39 aa, Mycobacterium
LSPTRIKRTLTVVRLLAPVLLPLLYKAAIAVRGVLDQRR

SEQ ID NO: 362393 - protein, 34 aa, Mycobacterium
LSPYSGWLTLVFLAAVLILMLFNQTYGRWMLAAM

SEQ ID NO: 362394 - protein, 25 aa, Mycobacterium
LSQGLAFILFFIGVKLILHALHENE

SEQ ID NO: 362395 - protein, 19 aa, Mycobacterium
LSQIALFVLLTTFSLTYLQ

SEQ ID NO: 362396 - protein, 27 aa, Mycobacterium
LSQLGVTILVLTLGVWVWVGVTNDQYD

SEQ ID NO: 362397 - protein, 30 aa, Mycobacterium
LSQLQLWTTPLWLILMVAPFGYLLISHPES

SEQ ID NO: 362398 - protein, 27 aa, Mycobacterium
LSRLEGDYFMRVLPQRLPNIRVTSDRP

SEQ ID NO: 362399 - protein, 22 aa, Mycobacterium
LSRLLCAETLTPLPIKTFDVRL

SEQ ID NO: 362400 - protein, 22 aa, Mycobacterium
LSRLQTLGRVELRLVWPAILSA

SEQ ID NO: 362401 - protein, 24 aa, Mycobacterium
LSRLRRIPRGRLILVGIVSALAVG

SEQ ID NO: 362402 - protein, 21 aa, Mycobacterium
LSRLVLGVHYPTDVAAGAALG

SEQ ID NO: 362403 - protein, 19 aa, Mycobacterium
LSRNDFEQLIATPLDRFVG

SEQ ID NO: 362404 - protein, 23 aa, Mycobacterium
LSRPFLHDKRRLELWPLVREEVA

SEQ ID NO: 362405 - protein, 34 aa, Mycobacterium
LSRRTLTIIKANLFWAFGYNIAAIPLAALGMLNP

SEQ ID NO: 362406 - protein, 25 aa, Mycobacterium
LSRWQWLIKWILAIPHYIVLVFLYL

SEQ ID NO: 362407 - protein, 36 aa, Mycobacterium
LSSDNYAGLIFWDTELWMYPNLLLAHPEIARNIIDY

SEQ ID NO: 362408 - protein, 20 aa, Mycobacterium
LSSIIALRRDQLGQLLRSTE

SEQ ID NO: 362409 - protein, 19 aa, Mycobacterium
LSSIRRGNLYPLMAPDVRP

SEQ ID NO: 362410 - protein, 17 aa, Mycobacterium
LSSLLVADFSRVLAGPF

SEQ ID NO: 362411 - protein, 28 aa, Mycobacterium
LSSPIPAPWAVLAILADGPGLSKEAALI

SEQ ID NO: 362412 - protein, 25 aa, Mycobacterium
LSSPPSHLWQARLAPDAMPYRGRYR

SEQ ID NO: 362413 - protein, 26 aa, Mycobacterium
LSSPSPAVVFWTLAGLLTIAIVCDVA

SEQ ID NO: 362414 - protein, 25 aa, Mycobacterium
LSSRPRPLGQLIAFWLGGITTCVTL

SEQ ID NO: 362415 - protein, 20 aa, Mycobacterium
LSSRSLLISNAVVAFAVIGF

SEQ ID NO: 362416 - protein, 26 aa, Mycobacterium
LSSSLILGFLFYQATALIFISRAAEL

SEQ ID NO: 362417 - protein, 25 aa, Mycobacterium
LSSVCQCAPFHPPSRLSLADALARA

SEQ ID NO: 362418 - protein, 26 aa, Mycobacterium
LSSVDMIVAAPPRPGFRAALSARLGV

SEQ ID NO: 362419 - protein, 18 aa, Mycobacterium
LSSVRLWPDRQLSRRDLE

SEQ ID NO: 362420 - protein, 30 aa, Mycobacterium
LSTDGIYPLLIMTLLPVLVGLDVSSRRAAV

SEQ ID NO: 362421 - protein, 24 aa, Mycobacterium
LSTDTLLAPQYISTPPSYPPFNAQ

SEQ ID NO: 362422 - protein, 28 aa, Mycobacterium
LSTITLGFLLMPLATRALSFWLNPGVPT

SEQ ID NO: 362423 - protein, 24 aa, Mycobacterium
LSTKAYLLAKMAVFFVFAIVQSTI

SEQ ID NO: 362424 - protein, 23 aa, Mycobacterium
LSTLDRFLPVWIGLAMAAGLLLG

SEQ ID NO: 362425 - protein, 34 aa, Mycobacterium
LSTNGLHPLLIMTALPILIGLDVSSRRAAVVLIF

SEQ ID NO: 362426 - protein, 23 aa, Mycobacterium
LSTPPVPLPAPRYVDIAREVAAT

SEQ ID NO: 362427 - protein, 20 aa, Mycobacterium
LSTSMLLIAAAPPLTIGFPR

SEQ ID NO: 362428 - protein, 18 aa, Mycobacterium
LSTVFTRADWEPEALVLV

SEQ ID NO: 362429 - protein, 31 aa, Mycobacterium
LSTVGYINGWLPFWVTIPINASVTFVMFTVV

SEQ ID NO: 362430 - protein, 25 aa, Mycobacterium
LSTVWLLSGFFFLIPVIVARKKYAD

SEQ ID NO: 362431 - protein, 25 aa, Mycobacterium
LSTVWLLSGFFFLIPVVVARKKYAD

SEQ ID NO: 362432 - protein, 24 aa, Mycobacterium
LSVAAVVLGVIIWSGHRDQVAERG

SEQ ID NO: 362433 - protein, 18 aa, Mycobacterium
LSVCFVLLITGVGSLIHI

SEQ ID NO: 362434 - protein, 27 aa, Mycobacterium
LSVDSSYFDLAWPALILSAGIGLCTAP

SEQ ID NO: 362435 - protein, 18 aa, Mycobacterium
LSVDVGIKKLLQLAAAAE

SEQ ID NO: 362436 - protein, 19 aa, Mycobacterium
LSVFAALGPACAIAVFVGF

SEQ ID NO: 362437 - protein, 18 aa, Mycobacterium
LSVGMWQLRDGNSAGREP

SEQ ID NO: 362438 - protein, 18 aa, Mycobacterium
LSVIAIGALLPWTRPMFM

SEQ ID NO: 362439 - protein, 22 aa, Mycobacterium
LSVITLVVLLGTWVWVGVTNDQ

SEQ ID NO: 362440 - protein, 49 aa, Mycobacterium
LSVLACGYLLYSLHWYTWIAFTAWVAAALLFYLFWGRHHSALNNRALLA

SEQ ID NO: 362441 - protein, 18 aa, Mycobacterium
LSVLGLGSLFGRAGLGAG

SEQ ID NO: 362442 - protein, 25 aa, Mycobacterium
LSVLIWQHLIGIELHWMVLAMSVII

SEQ ID NO: 362443 - protein, 18 aa, Mycobacterium
LSVLLWQHILSIELHYMV

SEQ ID NO: 362444 - protein, 24 aa, Mycobacterium
LSVLSFGPILWRLSEPVSIGGMTL

SEQ ID NO: 362445 - protein, 23 aa, Mycobacterium
LSVLVWQHICGIQINWVVLAMSV

SEQ ID NO: 362446 - protein, 24 aa, Mycobacterium
LSVLVWQHLLGIQINWVVLAMSVI

SEQ ID NO: 362447 - protein, 26 aa, Mycobacterium
LSVLVWQYLLGMQLHWTVLSTSVIVL

SEQ ID NO: 362448 - protein, 36 aa, Mycobacterium
LSVMMWQHLIGLPLHWLILPLSFIILVAVGSDYNLL

SEQ ID NO: 362449 - protein, 18 aa, Mycobacterium
LSVPILVQKGIDDGIPPL

SEQ ID NO: 362450 - protein, 25 aa, Mycobacterium
LSVPPLAVFVLLVSLIYLSISSVVA

SEQ ID NO: 362451 - protein, 18 aa, Mycobacterium
LSVPVPRGLTPAALNAIV

SEQ ID NO: 362452 - protein, 26 aa, Mycobacterium
LSVQGLTLFLLIIAIQWRARPWLKRV

SEQ ID NO: 362453 - protein, 18 aa, Mycobacterium
LSVRLVRALAVSVAFLLF

SEQ ID NO: 362454 - protein, 26 aa, Mycobacterium
LSVSLPMLLAARFLLGLAVGVSIVVV

SEQ ID NO: 362455 - protein, 24 aa, Mycobacterium
LSVTAFLALAVLYFVGLDQGATSV

SEQ ID NO: 362456 - protein, 28 aa, Mycobacterium
LSVVLVAIAAGWMMLLNVLKPTGIVGDS

SEQ ID NO: 362457 - protein, 18 aa, Mycobacterium
LSVWTYLAGLLVGVGASL

SEQ ID NO: 362458 - protein, 20 aa, Mycobacterium
LSWATAIRYQALFTEAGGLT

SEQ ID NO: 362459 - protein, 18 aa, Mycobacterium
LSWAVLGNVLIACSGLAL

SEQ ID NO: 362460 - protein, 20 aa, Mycobacterium
LSWCIIIYGLAASVLPVWFL

SEQ ID NO: 362461 - protein, 20 aa, Mycobacterium
LSWCIIIYGLAASVLPVWLL

SEQ ID NO: 362462 - protein, 20 aa, Mycobacterium
LSWDLLGYGFAYLVLFVLAH

SEQ ID NO: 362463 - protein, 21 aa, Mycobacterium
LSWFSPIAWAQQMRSFVDLRW

SEQ ID NO: 362464 - protein, 19 aa, Mycobacterium
LSWGWRVAFWLSAVVVLIG

SEQ ID NO: 362465 - protein, 22 aa, Mycobacterium
LSWILNAYNIVFAAFLVAAGRM

SEQ ID NO: 362466 - protein, 28 aa, Mycobacterium
LSWILNGYNIVFAAFLVASGRLADVLGR

SEQ ID NO: 362467 - protein, 26 aa, Mycobacterium
LSWRDWLLAVVVIAVIRPAAMLLSLV

SEQ ID NO: 362468 - protein, 18 aa, Mycobacterium
LSYAMLALVAVMVLDGFY

SEQ ID NO: 362469 - protein, 17 aa, Mycobacterium
LSYFFPTLLAVTGLTAV

SEQ ID NO: 362470 - protein, 22 aa, Mycobacterium
LSYGTYIYAYPIQQLLVVSGLA

SEQ ID NO: 362471 - protein, 17 aa, Mycobacterium
LSYGVYIYAFPAQQLLA

SEQ ID NO: 362472 - protein, 22 aa, Mycobacterium
LSYGVYIYAFPIQQLLVICWPG

SEQ ID NO: 362473 - protein, 26 aa, Mycobacterium
LTAALLILLMFLWSAAYSSLFYLVAL

SEQ ID NO: 362474 - protein, 23 aa, Mycobacterium
LTAAMSLMWGWRLAVVCVTVAAA

SEQ ID NO: 362475 - protein, 28 aa, Mycobacterium
LTAAQLVRFPWDFRRLYGLDPDEQPVAD

SEQ ID NO: 362476 - protein, 18 aa, Mycobacterium
LTACLCAAVWLLCHRPNR

SEQ ID NO: 362477 - protein, 17 aa, Mycobacterium
LTAFLLLTSIIIVGALA

SEQ ID NO: 362478 - protein, 17 aa, Mycobacterium
LTAFMSWVESRPSPRAQ

SEQ ID NO: 362479 - protein, 17 aa, Mycobacterium
LTAILFDGNRLGLVHIG

SEQ ID NO: 362480 - protein, 23 aa, Mycobacterium
LTALIQLYIVGVFISFTLSQIGM

SEQ ID NO: 362481 - protein, 26 aa, Mycobacterium
LTALQIVDGFLRTHSISRALIVASDA

SEQ ID NO: 362482 - protein, 18 aa, Mycobacterium
LTALVIGSFWGGVFGFVA

SEQ ID NO: 362483 - protein, 17 aa, Mycobacterium
LTAPLMTAGVAGAEPGV

SEQ ID NO: 362484 - protein, 18 aa, Mycobacterium
LTAPVIVLIIVVIYGLSS

SEQ ID NO: 362485 - protein, 27 aa, Mycobacterium
LTAPVLYAVMARPLGARWVPAVLLDHW

SEQ ID NO: 362486 - protein, 23 aa, Mycobacterium
LTAPVLYLLALLGVVAMLIQQSA

SEQ ID NO: 362487 - protein, 29 aa, Mycobacterium
LTARKRIAWLLLLGNMILAAGLNAADIAA

SEQ ID NO: 362488 - protein, 26 aa, Mycobacterium
LTARKRIAWLLLLGNMVLAAFLNAAD

SEQ ID NO: 362489 - protein, 27 aa, Mycobacterium
LTARKRIAWLVLLGQIILAAGVNVADM

SEQ ID NO: 362490 - protein, 38 aa, Mycobacterium
LTASDKLFCNSPFFWIGGFAFGLLATLVAGSTLVCSNA

SEQ ID NO: 362491 - protein, 29 aa, Mycobacterium
LTASLVTAWLTPFGPVALGLKVVALAVGA

SEQ ID NO: 362492 - protein, 21 aa, Mycobacterium
LTASRFVACPFADAQLPGQRM

SEQ ID NO: 362493 - protein, 17 aa, Mycobacterium
LTATFALGNALPLLAFA

SEQ ID NO: 362494 - protein, 34 aa, Mycobacterium
LTATLVTVPIWVVFLAWASFFFVGGGPAGWVRSV

SEQ ID NO: 362495 - protein, 35 aa, Mycobacterium
LTATPVGHFIGMLGAFLIPVLEGSPIDLCDVWDPG

SEQ ID NO: 362496 - protein, 25 aa, Mycobacterium
LTATTPVWHLLIVFAVFGVGFSMVN

SEQ ID NO: 362497 - protein, 25 aa, Mycobacterium
LTAVAFDTYFQPGKLPASLSDYLNG

SEQ ID NO: 362498 - protein, 26 aa, Mycobacterium
LTAVTWLMRVGFFGAPLLVGVVADAA

SEQ ID NO: 362499 - protein, 17 aa, Mycobacterium
LTCALAPGAGRPRWWCA

SEQ ID NO: 362500 - protein, 20 aa, Mycobacterium
LTCVASAMLGLALSAIAKSN

SEQ ID NO: 362501 - protein, 20 aa, Mycobacterium
LTCVASAMLGLALSAVAKSN

SEQ ID NO: 362502 - protein, 24 aa, Mycobacterium
LTDEPLVQLLGRINAELAVYTGLI

SEQ ID NO: 362503 - protein, 17 aa, Mycobacterium
LTDLDQVVPLMPGARLT

SEQ ID NO: 362504 - protein, 24 aa, Mycobacterium
LTDMLTRLPALSDPIPGLPDTPLP

SEQ ID NO: 362505 - protein, 27 aa, Mycobacterium
LTDPNPPLPAWLTPSPRVPGTGDPDDA

SEQ ID NO: 362506 - protein, 25 aa, Mycobacterium
LTDRHIELTPVYRGGPTLKNGDIIG

SEQ ID NO: 362507 - protein, 24 aa, Mycobacterium
LTDRQVELTPPYRGGPTLQDGDTI

SEQ ID NO: 362508 - protein, 26 aa, Mycobacterium
LTDTTPLKFRLAYIADLEATFTPFFK

SEQ ID NO: 362509 - protein, 20 aa, Mycobacterium
LTDVLIIVLVAQAAGPALSP

SEQ ID NO: 362510 - protein, 24 aa, Mycobacterium
LTDVSWRLAFLVNVPIGLAVICLA

SEQ ID NO: 362511 - protein, 30 aa, Mycobacterium
LTEDIGLRPWWVRPLWKLLHIDGRPSRYRS

SEQ ID NO: 362512 - protein, 18 aa, Mycobacterium
LTERYFYESFADRDEFVR

SEQ ID NO: 362513 - protein, 19 aa, Mycobacterium
LTERYFYESFTDREHFVRA

SEQ ID NO: 362514 - protein, 19 aa, Mycobacterium
LTEVLSRIYGRPVSVQLHV

SEQ ID NO: 362515 - protein, 24 aa, Mycobacterium
LTEVSWRLAFLVNVPIGLVMMYLA

SEQ ID NO: 362516 - protein, 24 aa, Mycobacterium
LTEYAPLPLVLTYLVHAGLCLPAL

SEQ ID NO: 362517 - protein, 24 aa, Mycobacterium
LTFALAIALFLMFYEWTHYLIHTD

SEQ ID NO: 362518 - protein, 31 aa, Mycobacterium
LTFDMSPTTPIWRLVLPFFAMGVGMAFVWSP

SEQ ID NO: 362519 - protein, 19 aa, Mycobacterium
LTFFDLIFVLTGGGPGDAT

SEQ ID NO: 362520 - protein, 49 aa, Mycobacterium
LTFGAQVRLILRRQVRVFLASRLYLVFLALLPFALGALTLLIPGDSGLD

SEQ ID NO: 362521 - protein, 17 aa, Mycobacterium
LTFGLPVIVLPLVYFWT

SEQ ID NO: 362522 - protein, 18 aa, Mycobacterium
LTFLLIGANAFFVGAEFA

SEQ ID NO: 362523 - protein, 17 aa, Mycobacterium
LTFPRYLAATRPGSHNV

SEQ ID NO: 362524 - protein, 32 aa, Mycobacterium
LTFSIPPRWRTSWGWGWITIGLVAIVCNQTFT

SEQ ID NO: 362525 - protein, 19 aa, Mycobacterium
LTFSLTLITLQLASSQYTP

SEQ ID NO: 362526 - protein, 20 aa, Mycobacterium
LTFTFAVVALAWRKPRFDTN

SEQ ID NO: 362527 - protein, 20 aa, Mycobacterium
LTFVLLGANAFFVASEFALI

SEQ ID NO: 362528 - protein, 30 aa, Mycobacterium
LTGAIVWNMLTWLLGIPSSSSMALFGGLIG

SEQ ID NO: 362529 - protein, 18 aa, Mycobacterium
LTGFFLERPIAVEAAFKN

SEQ ID NO: 362530 - protein, 23 aa, Mycobacterium
LTGGKWFHILSGNLSFQIEHHLF

SEQ ID NO: 362531 - protein, 27 aa, Mycobacterium
LTGGVVLALLVGRRLWHRFRGQPDRAD

SEQ ID NO: 362532 - protein, 24 aa, Mycobacterium
LTGHLDGHAVRLGRPGWLDPADLA

SEQ ID NO: 362533 - protein, 27 aa, Mycobacterium
LTGHSWQVFGALWLYSMAVGGAVTGVA

SEQ ID NO: 362534 - protein, 26 aa, Mycobacterium
LTGIALIRLLGTRAAIPAGLLAGILY

SEQ ID NO: 362535 - protein, 26 aa, Mycobacterium
LTGIHPTLLHTLSFAIALAIVVTLHV

SEQ ID NO: 362536 - protein, 23 aa, Mycobacterium
LTGLCHRRALFRQLNALLLSHRE

SEQ ID NO: 362537 - protein, 28 aa, Mycobacterium
LTGLFAAVIGSLAVLRRPPWPDITIRDC

SEQ ID NO: 362538 - protein, 18 aa, Mycobacterium
LTGLMPTVTIAYALLFVV

SEQ ID NO: 362539 - protein, 17 aa, Mycobacterium
LTGLWARPTLETSVTVR

SEQ ID NO: 362540 - protein, 29 aa, Mycobacterium
LTGPEAFLAFGWRIPFLSSIVLVVVGLAI

SEQ ID NO: 362541 - protein, 24 aa, Mycobacterium
LTGQWPAELGEQPALWIPGSSISS

SEQ ID NO: 362542 - protein, 23 aa, Mycobacterium
LTGRALFRWPFQWREFVLQCWFI

SEQ ID NO: 362543 - protein, 24 aa, Mycobacterium
LTGRYAVLVVGLWVLAAAAANLAV

SEQ ID NO: 362544 - protein, 24 aa, Mycobacterium
LTGSFLDNWLPLAPQQTIRAGGTL

SEQ ID NO: 362545 - protein, 26 aa, Mycobacterium
LTGSVITAWITPVGPVALGFKVVALA

SEQ ID NO: 362546 - protein, 17 aa, Mycobacterium
LTGTTCFVGFLASYLFN

SEQ ID NO: 362547 - protein, 27 aa, Mycobacterium
LTGVFYVVTYIGFALPLLLATAEPGVS

SEQ ID NO: 362548 - protein, 28 aa, Mycobacterium
LTGVTILNNWIRQGVVERGLVVSGEYIS

SEQ ID NO: 362549 - protein, 29 aa, Mycobacterium
LTGVTVVLIALLLLAVYRSVITAAIPLVA

SEQ ID NO: 362550 - protein, 21 aa, Mycobacterium
LTGVVWTVALTRPPDITEAAV

SEQ ID NO: 362551 - protein, 35 aa, Mycobacterium
LTGVWAFVLLNRTPDWWPALRWVVLIGSVVVAVLL

SEQ ID NO: 362552 - protein, 17 aa, Mycobacterium
LTGWRQLNNWPAVFPLG

SEQ ID NO: 362553 - protein, 18 aa, Mycobacterium
LTHDGILAIRWRLPSGTE

SEQ ID NO: 362554 - protein, 20 aa, Mycobacterium
LTHVFAGFYIVGCIAAVLAV

SEQ ID NO: 362555 - protein, 26 aa, Mycobacterium
LTIASYAPWRTLLPAGLAAGFAEVVL

SEQ ID NO: 362556 - protein, 18 aa, Mycobacterium
LTIGFPREKLRHTAVIMN

SEQ ID NO: 362557 - protein, 23 aa, Mycobacterium
LTIGLLTALPWVAAAIGTLVLPR

SEQ ID NO: 362558 - protein, 19 aa, Mycobacterium
LTILALAVPILAFLVVLVL

SEQ ID NO: 362559 - protein, 20 aa, Mycobacterium
LTIPGIATPVAWAQAAGMVA

SEQ ID NO: 362560 - protein, 21 aa, Mycobacterium
LTIPTIALASLWLSGPLLLGL

SEQ ID NO: 362561 - protein, 20 aa, Mycobacterium
LTIQIGFAVLLILLGGAAVT

SEQ ID NO: 362562 - protein, 21 aa, Mycobacterium
LTIRDLIGERPIFLREQAVGL

SEQ ID NO: 362563 - protein, 33 aa, Mycobacterium
LTITVPFAIYLVLAWLILLLRRRDAVLNIGLPA

SEQ ID NO: 362564 - protein, 19 aa, Mycobacterium
LTIYTQLFTTHAGWRQSVL

SEQ ID NO: 362565 - protein, 22 aa, Mycobacterium
LTKRPTSFYTLPISDFGADSNG

SEQ ID NO: 362566 - protein, 26 aa, Mycobacterium
LTKRQRFWTALYLPLTMKLLCRAIVV

SEQ ID NO: 362567 - protein, 25 aa, Mycobacterium
LTKRQRFWTALYLPLTMKVLCRAIV

SEQ ID NO: 362568 - protein, 26 aa, Mycobacterium
LTKRQRFWTSLYFPLTMRMLCNAIVV

SEQ ID NO: 362569 - protein, 17 aa, Mycobacterium
LTKTVYSVLLAILVGIG

SEQ ID NO: 362570 - protein, 20 aa, Mycobacterium
LTLCVMPFVLYPWAEQTIDS

SEQ ID NO: 362571 - protein, 18 aa, Mycobacterium
LTLDLVGTFAFALNGALT

SEQ ID NO: 362572 - protein, 25 aa, Mycobacterium
LTLDWGALLIIAVVTFLLARGTKIS

SEQ ID NO: 362573 - protein, 27 aa, Mycobacterium
LTLFPTGHLFWGGMAVWLFAMFDMLDG

SEQ ID NO: 362574 - protein, 20 aa, Mycobacterium
LTLGFLQPIILACAAALVVV

SEQ ID NO: 362575 - protein, 25 aa, Mycobacterium
LTLGLSLAVILVLGFVLTSQITDRI

SEQ ID NO: 362576 - protein, 26 aa, Mycobacterium
LTLGLSLAVILVLGFVLTSQITDRIL

SEQ ID NO: 362577 - protein, 20 aa, Mycobacterium
LTLHTLQVIAPYAFGAALVG

SEQ ID NO: 362578 - protein, 19 aa, Mycobacterium
LTLLATGLIFILASAAQAR

SEQ ID NO: 362579 - protein, 18 aa, Mycobacterium
LTLLATGLIFILVSAAQA

SEQ ID NO: 362580 - protein, 25 aa, Mycobacterium
LTLLGAGMLWAGWYAFNGGSALAAG

SEQ ID NO: 362581 - protein, 17 aa, Mycobacterium
LTLPLLASLSALLAGSR

SEQ ID NO: 362582 - protein, 23 aa, Mycobacterium
LTLRLTFYGTVLGFLLGVALAAA

SEQ ID NO: 362583 - protein, 22 aa, Mycobacterium
LTLRMLIPVMRWQRRDMLLGDR

SEQ ID NO: 362584 - protein, 17 aa, Mycobacterium
LTLRPVAGFPLLHVEKP

SEQ ID NO: 362585 - protein, 20 aa, Mycobacterium
LTLSVLGVALLMLGAARLYA

SEQ ID NO: 362586 - protein, 18 aa, Mycobacterium
LTLVLIAATPWCAAGLLA

SEQ ID NO: 362587 - protein, 18 aa, Mycobacterium
LTLYAVARVWTKAFWRPR

SEQ ID NO: 362588 - protein, 18 aa, Mycobacterium
LTLYVVARVWTKAFWRAR

SEQ ID NO: 362589 - protein, 18 aa, Mycobacterium
LTLYVVARVWTKAFWRTR

SEQ ID NO: 362590 - protein, 23 aa, Mycobacterium
LTMAAEHFLFARPAPETIPALNA

SEQ ID NO: 362591 - protein, 19 aa, Mycobacterium
LTMYLLLAIGWHGGEELAK

SEQ ID NO: 362592 - protein, 24 aa, Mycobacterium
LTNKNPYPLGIAALGLMAAAYIGE

SEQ ID NO: 362593 - protein, 25 aa, Mycobacterium
LTNNNPFPLGIAALGLMAAAYVGEI

SEQ ID NO: 362594 - protein, 19 aa, Mycobacterium
LTNNTVVAYFPAANALYPG

SEQ ID NO: 362595 - protein, 24 aa, Mycobacterium
LTNNTVVAYFPAANALYPGDKVQI

SEQ ID NO: 362596 - protein, 19 aa, Mycobacterium
LTNNTVVAYFPSANALYPG

SEQ ID NO: 362597 - protein, 57 aa, Mycobacterium
LTNPLQAIITYGPLLFALSYQIFFNLVGWPTWALILSSPFLLPAALGLALSAIAFTP

SEQ ID NO: 362598 - protein, 30 aa, Mycobacterium
LTNPVQALITWGPFLLAVVYQAVSWVGASI

SEQ ID NO: 362599 - protein, 25 aa, Mycobacterium
LTNSYTGIVALFARLAREQQTLEVY

SEQ ID NO: 362600 - protein, 25 aa, Mycobacterium
LTNVALAFPFLVTALSVVTLNRGTA

SEQ ID NO: 362601 - protein, 25 aa, Mycobacterium
LTPAQVLWINLVTSSTLGLALAFEP

SEQ ID NO: 362602 - protein, 29 aa, Mycobacterium
LTPATRWAPILQWLMVGAAGVLILVAMRH

SEQ ID NO: 362603 - protein, 25 aa, Mycobacterium
LTPAVFLLYFLLRRDIHTLLRTAAT

SEQ ID NO: 362604 - protein, 23 aa, Mycobacterium
LTPAVFLLYFLLRRDNRAALTAL

SEQ ID NO: 362605 - protein, 20 aa, Mycobacterium
LTPCWGEHLLVLRSLNPLSS

SEQ ID NO: 362606 - protein, 20 aa, Mycobacterium
LTPGDWLAFAPPRVPELKSL

SEQ ID NO: 362607 - protein, 31 aa, Mycobacterium
LTPLGIAVLLVVLDWRLGLVCVAVFPVLLGL

SEQ ID NO: 362608 - protein, 17 aa, Mycobacterium
LTPLGLFGGFIDASGGG

SEQ ID NO: 362609 - protein, 23 aa, Mycobacterium
LTPLPVLIPMLGAAATLIAGRRP

SEQ ID NO: 362610 - protein, 23 aa, Mycobacterium
LTPLRLSPRHWWVWVACLIATDF

SEQ ID NO: 362611 - protein, 30 aa, Mycobacterium
LTPRMTVLQVLAWVGYLVMVIPAFMRVSRM

SEQ ID NO: 362612 - protein, 18 aa, Mycobacterium
LTPRWPLPVLESALLLVL

SEQ ID NO: 362613 - protein, 17 aa, Mycobacterium
LTPTKWAIQFGAFAGLA

SEQ ID NO: 362614 - protein, 19 aa, Mycobacterium
LTQERLLRRDMGVGELLGM

SEQ ID NO: 362615 - protein, 24 aa, Mycobacterium
LTQQTAKVWLLAAALLAVGVVLYL

SEQ ID NO: 362616 - protein, 27 aa, Mycobacterium
LTQTFLIMLTALFLAGTLILTVARRSY

SEQ ID NO: 362617 - protein, 23 aa, Mycobacterium
LTRAQKWVFGIVLFAGIALSPLF

SEQ ID NO: 362618 - protein, 24 aa, Mycobacterium
LTRFVQGIVTPLLALVSGILIADL

SEQ ID NO: 362619 - protein, 19 aa, Mycobacterium
LTRLNYFNSLGIPAGIGLA

SEQ ID NO: 362620 - protein, 23 aa, Mycobacterium
LTRLPEYRAVLRRQTRAAVVTLT

SEQ ID NO: 362621 - protein, 23 aa, Mycobacterium
LTRMLKVELPLSIPVLVASLRVV

SEQ ID NO: 362622 - protein, 20 aa, Mycobacterium
LTRMLLGLLLISNAINLLIL

SEQ ID NO: 362623 - protein, 26 aa, Mycobacterium
LTRNDLGLVLLLLAPAALVSGVLCNM

SEQ ID NO: 362624 - protein, 19 aa, Mycobacterium
LTRPQWAILSALVIVHMGP

SEQ ID NO: 362625 - protein, 26 aa, Mycobacterium
LTRPVRALSWLVAAISAFGLLNFSRS

SEQ ID NO: 362626 - protein, 26 aa, Mycobacterium
LTRPVRITAWLVAGLSALGLLNLSRA

SEQ ID NO: 362627 - protein, 30 aa, Mycobacterium
LTRRSRILILIALGVIAVLLAGPRLIDAYV

SEQ ID NO: 362628 - protein, 24 aa, Mycobacterium
LTRSLRLLSLFRYERSDPARFYDA

SEQ ID NO: 362629 - protein, 31 aa, Mycobacterium
LTRWVQRRWTWWRRRRAATPPQWPAALDVPT

SEQ ID NO: 362630 - protein, 21 aa, Mycobacterium
LTRYRKPLLLCFLITMGGTLA

SEQ ID NO: 362631 - protein, 26 aa, Mycobacterium
LTSALLAFVLYLIFALEHPYVGALSV

SEQ ID NO: 362632 - protein, 18 aa, Mycobacterium
LTSAWYRLPKPDAGHPLV

SEQ ID NO: 362633 - protein, 26 aa, Mycobacterium
LTSGFYPILMFGLPAAALAMIHVANK

SEQ ID NO: 362634 - protein, 23 aa, Mycobacterium
LTSGVWFLVDPLTANRFWGDPGE

SEQ ID NO: 362635 - protein, 25 aa, Mycobacterium
LTSLLAKVSWRRRRTRIVTWVASAA

SEQ ID NO: 362636 - protein, 17 aa, Mycobacterium
LTSLMPDATQPADPDLL

SEQ ID NO: 362637 - protein, 31 aa, Mycobacterium
LTSLPPPPSPPWWSIMWQLLQTLADIVSQTV

SEQ ID NO: 362638 - protein, 23 aa, Mycobacterium
LTSRALAMWVHVSFQAGNGLDSA

SEQ ID NO: 362639 - protein, 39 aa, Mycobacterium
LTSTFVRFWTVSFPVVAYRAGRWWLATAVAFFAVVVLIA

SEQ ID NO: 362640 - protein, 17 aa, Mycobacterium
LTSVFGLVLLVTLPIVV

SEQ ID NO: 362641 - protein, 23 aa, Mycobacterium
LTSVYLLVHLLAPAALGAGDVKL

SEQ ID NO: 362642 - protein, 25 aa, Mycobacterium
LTTAFAYLLLPQVLAYGLTSVFMAI

SEQ ID NO: 362643 - protein, 26 aa, Mycobacterium
LTTAQGLILGFLGPAFLPAPDQSIVM

SEQ ID NO: 362644 - protein, 18 aa, Mycobacterium
LTTFAAFTALCVFLPGII

SEQ ID NO: 362645 - protein, 20 aa, Mycobacterium
LTTGIFLFLGGMAAASSNTA

SEQ ID NO: 362646 - protein, 20 aa, Mycobacterium
LTTGVLLGLAIAVAGLVDQT

SEQ ID NO: 362647 - protein, 19 aa, Mycobacterium
LTTLVFIALATWVSSRGIT

SEQ ID NO: 362648 - protein, 24 aa, Mycobacterium
LTTPSWNYAALQRFITLPESEAAP

SEQ ID NO: 362649 - protein, 21 aa, Mycobacterium
LTTRFLITATGFLSQPRLPDI

SEQ ID NO: 362650 - protein, 23 aa, Mycobacterium
LTTRLLNLFGPKGAPLAMGITGV

SEQ ID NO: 362651 - protein, 28 aa, Mycobacterium
LTTTSQLLYLRVPALHALFPDYRTSVLD

SEQ ID NO: 362652 - protein, 24 aa, Mycobacterium
LTTVFGLLVLVLVLSALNATVFEG

SEQ ID NO: 362653 - protein, 29 aa, Mycobacterium
LTTVTVIFFMLLLVYRSVSTVIALLSMVG

SEQ ID NO: 362654 - protein, 25 aa, Mycobacterium
LTVAFAYLLLPQVLAYGLTSVFMAI

SEQ ID NO: 362655 - protein, 18 aa, Mycobacterium
LTVAFILGVLLIGTPGWQ

SEQ ID NO: 362656 - protein, 32 aa, Mycobacterium
LTVALALVALILFPMYFLKSFGYAGVAVVFVG

SEQ ID NO: 362657 - protein, 17 aa, Mycobacterium
LTVAMKHIKETPPPLPA

SEQ ID NO: 362658 - protein, 22 aa, Mycobacterium
LTVFAVITMIIGVGVYLSAQDK

SEQ ID NO: 362659 - protein, 23 aa, Mycobacterium
LTVFAVITMIIGVGVYLSAQDKD

SEQ ID NO: 362660 - protein, 31 aa, Mycobacterium
LTVFGIDIPKALFWVLFAYVSMATVVAFWIG

SEQ ID NO: 362661 - protein, 21 aa, Mycobacterium
LTVFQLLSTDGVYPLLIMAML

SEQ ID NO: 362662 - protein, 17 aa, Mycobacterium
LTVFVVAANLIGIGVVI

SEQ ID NO: 362663 - protein, 18 aa, Mycobacterium
LTVIGMIAAPLFIVLGVT

SEQ ID NO: 362664 - protein, 32 aa, Mycobacterium
LTVILTNPPLFGVLLLIPIGLSLAIIRLQTKA

SEQ ID NO: 362665 - protein, 26 aa, Mycobacterium
LTVLAVLVMMVTISPLLAVLTMVTVP

SEQ ID NO: 362666 - protein, 25 aa, Mycobacterium
LTVLGVAGYWLVHRSLRPLAEVEAT

SEQ ID NO: 362667 - protein, 17 aa, Mycobacterium
LTVLIAALLIKIVFGPT

SEQ ID NO: 362668 - protein, 28 aa, Mycobacterium
LTVLILAPEVYWPLRRVGIQFHSAADGT

SEQ ID NO: 362669 - protein, 20 aa, Mycobacterium
LTVLLLAANAFFVAAEFALI

SEQ ID NO: 362670 - protein, 31 aa, Mycobacterium
LTVLMLNRPRPLLQLFVFLCGAFAMGLSLGL

SEQ ID NO: 362671 - protein, 18 aa, Mycobacterium
LTVLVFLYEALPEELIFR

SEQ ID NO: 362672 - protein, 18 aa, Mycobacterium
LTVPYTVLLVFTFNILLI

SEQ ID NO: 362673 - protein, 26 aa, Mycobacterium
LTVVVLLMVGTFFLIRSMNSHLRKLP

SEQ ID NO: 362674 - protein, 24 aa, Mycobacterium
LTWLGIGVLAVRLWRFTPGQYMAG

SEQ ID NO: 362675 - protein, 19 aa, Mycobacterium
LTWVRFAVWLVVGTAIYVG

SEQ ID NO: 362676 - protein, 19 aa, Mycobacterium
LTWVRFGVWLVVGTAIYVG

SEQ ID NO: 362677 - protein, 18 aa, Mycobacterium
LTWVVLALRRGQVGVDII

SEQ ID NO: 362678 - protein, 18 aa, Mycobacterium
LTYAIFAAVGLAALLSIT

SEQ ID NO: 362679 - protein, 18 aa, Mycobacterium
LTYTSVVLVFLAFMVALV

SEQ ID NO: 362680 - protein, 21 aa, Mycobacterium
LTYYLFITFVISYGTSTLGLS

SEQ ID NO: 362681 - protein, 25 aa, Mycobacterium
LVAAALAIGLLMTKSTPAPPTSSPN

SEQ ID NO: 362682 - protein, 19 aa, Mycobacterium
LVAAALLACLAGAAAVTIF

SEQ ID NO: 362683 - protein, 17 aa, Mycobacterium
LVAADGTKYLGAALTVE

SEQ ID NO: 362684 - protein, 20 aa, Mycobacterium
LVAALPLSLVAVAAAGLVML

SEQ ID NO: 362685 - protein, 32 aa, Mycobacterium
LVAAPLSALVLTALWLLPLSVVVSAVVVAGTG

SEQ ID NO: 362686 - protein, 25 aa, Mycobacterium
LVAARYLTPWGRQFWRITRGYFVGP

SEQ ID NO: 362687 - protein, 17 aa, Mycobacterium
LVAAVARRFDVSAPLVL

SEQ ID NO: 362688 - protein, 17 aa, Mycobacterium
LVACVVGFLPIYLANIA

SEQ ID NO: 362689 - protein, 28 aa, Mycobacterium
LVADHWGWRWIFVPLVPVALAGFVGTLR

SEQ ID NO: 362690 - protein, 19 aa, Mycobacterium
LVAELSLLPGVRAVQWYAG

SEQ ID NO: 362691 - protein, 17 aa, Mycobacterium
LVAFDRISWPAAGLIAA

SEQ ID NO: 362692 - protein, 24 aa, Mycobacterium
LVAFIADLLLSRRFAHSVGRRRAR

SEQ ID NO: 362693 - protein, 18 aa, Mycobacterium
LVAFLIAGMGGLMTVINC

SEQ ID NO: 362694 - protein, 26 aa, Mycobacterium
LVAGDQPWRWFLIGFMVIFHLNILSN

SEQ ID NO: 362695 - protein, 31 aa, Mycobacterium
LVAGFLMYASFPPTNWWWAAIVSVALLTWVL

SEQ ID NO: 362696 - protein, 22 aa, Mycobacterium
LVAGLALVLRYLAGGRYELGET

SEQ ID NO: 362697 - protein, 19 aa, Mycobacterium
LVAGLIAIIPLYSLSVLAA

SEQ ID NO: 362698 - protein, 24 aa, Mycobacterium
LVAGRVAAYVPTLLALSASSPFWS

SEQ ID NO: 362699 - protein, 26 aa, Mycobacterium
LVAGVLLVLGLFTPVAAAGALAFLIN

SEQ ID NO: 362700 - protein, 21 aa, Mycobacterium
LVAGWATTGLYLSLGAPLVAQ

SEQ ID NO: 362701 - protein, 18 aa, Mycobacterium
LVAIPIGVTLSIQFALLA

SEQ ID NO: 362702 - protein, 23 aa, Mycobacterium
LVAIVLLFQVWTSGILLKPLNVT

SEQ ID NO: 362703 - protein, 19 aa, Mycobacterium
LVALAVWLLAGKDVSLILP

SEQ ID NO: 362704 - protein, 29 aa, Mycobacterium
LVALGPVFMWAFIGLLVLFSAIVILRAVL

SEQ ID NO: 362705 - protein, 28 aa, Mycobacterium
LVALIALFPPYIMWAPNAIWKSFDLFVG

SEQ ID NO: 362706 - protein, 18 aa, Mycobacterium
LVALPIGVTLSIQFALLA

SEQ ID NO: 362707 - protein, 29 aa, Mycobacterium
LVALSAAALLVWRLRWASAGGWLAPTIFG

SEQ ID NO: 362708 - protein, 19 aa, Mycobacterium
LVALSLFGFDFDTVGRRRP

SEQ ID NO: 362709 - protein, 25 aa, Mycobacterium
LVALVGLVWLVELVGLVGLAGVVVA

SEQ ID NO: 362710 - protein, 17 aa, Mycobacterium
LVALVYVAYPFISSAPV

SEQ ID NO: 362711 - protein, 20 aa, Mycobacterium
LVALYRIRVGRRISSAALVA

SEQ ID NO: 362712 - protein, 48 aa, Mycobacterium
LVAMASTMFFGAYPWAGWLAFAATVPVQFVAGWPFLKAAAQQARAGTS

SEQ ID NO: 362713 - protein, 25 aa, Mycobacterium
LVAMLAFPAFWPPMSPTLSADEVAA

SEQ ID NO: 362714 - protein, 33 aa, Mycobacterium
LVARPRAVLWSQWRFTFEPMFVVALSALLRSAT

SEQ ID NO: 362715 - protein, 25 aa, Mycobacterium
LVARWPAPMLVASALVLAICALPVS

SEQ ID NO: 362716 - protein, 29 aa, Mycobacterium
LVASLSQCHMLWYLALCAQAGIVVTAYRD

SEQ ID NO: 362717 - protein, 17 aa, Mycobacterium
LVATALVITAVLTAWVV

SEQ ID NO: 362718 - protein, 24 aa, Mycobacterium
LVATLLCLLLAFPLAYVIAFKAGR

SEQ ID NO: 362719 - protein, 27 aa, Mycobacterium
LVATRSRPWWLHRQVPRGYGWVRRTVQ

SEQ ID NO: 362720 - protein, 31 aa, Mycobacterium
LVATSFPLQLPWLPLAAPLGALVIYLLAIRP

SEQ ID NO: 362721 - protein, 27 aa, Mycobacterium
LVATSFPLQLPWLPLTAPLAALAVYVL

SEQ ID NO: 362722 - protein, 28 aa, Mycobacterium
LVATSFPLQVPWLPLVAPVAVVAIYVLA

SEQ ID NO: 362723 - protein, 25 aa, Mycobacterium
LVAVAPLVMVLWSVTVKGVRAITST

SEQ ID NO: 362724 - protein, 28 aa, Mycobacterium
LVAVARSILVIIWNLLHDPTARFHDLGA

SEQ ID NO: 362725 - protein, 28 aa, Mycobacterium
LVAVFGMRLLFPLLIVWVTAGLDPVRAM

SEQ ID NO: 362726 - protein, 26 aa, Mycobacterium
LVAVLALLFAVLPVAAAPVAGAQPGA

SEQ ID NO: 362727 - protein, 26 aa, Mycobacterium
LVAWGALAVYLLWRSGFRPSSVGLGR

SEQ ID NO: 362728 - protein, 17 aa, Mycobacterium
LVCAVYLVLLAIAGLGA

SEQ ID NO: 362729 - protein, 22 aa, Mycobacterium
LVCFLIGFAGLLWLPMHGTAVW

SEQ ID NO: 362730 - protein, 17 aa, Mycobacterium
LVCFLVGVVVASVCRRH

SEQ ID NO: 362731 - protein, 32 aa, Mycobacterium
LVCFVPVLLYRIWRLWRYPSLLPGKAVTGFGV

SEQ ID NO: 362732 - protein, 18 aa, Mycobacterium
LVCGLYAVLLICGAIGVT

SEQ ID NO: 362733 - protein, 19 aa, Mycobacterium
LVCGSVLVGLVALAAFSAP

SEQ ID NO: 362734 - protein, 18 aa, Mycobacterium
LVCGVAVLAIVSIVTAVL

SEQ ID NO: 362735 - protein, 17 aa, Mycobacterium
LVCMVVSVIMLVVGSNI

SEQ ID NO: 362736 - protein, 25 aa, Mycobacterium
LVCSFSLATLLGSALLTALHLPQDA

SEQ ID NO: 362737 - protein, 23 aa, Mycobacterium
LVDAKLMIIRYLTAHPKLLNDIF

SEQ ID NO: 362738 - protein, 36 aa, Mycobacterium
LVDATIIRMLLVPSFMRLLGRFNWWAPKPLVTLHER

SEQ ID NO: 362739 - protein, 24 aa, Mycobacterium
LVDATLVRALLVPAFMHVFGSLNW

SEQ ID NO: 362740 - protein, 40 aa, Mycobacterium
LVDATLVRMLLVPAFMHLLGRWNWWAPPPLARLHARIGVS

SEQ ID NO: 362741 - protein, 34 aa, Mycobacterium
LVDATLVRMLLVPAFMHVFGRLNWWAPAPLARLR

SEQ ID NO: 362742 - protein, 29 aa, Mycobacterium
LVDATLVRMLLVPAFMQVLGRLNWWAPEP

SEQ ID NO: 362743 - protein, 38 aa, Mycobacterium
LVDATLVRMVLLPAYMKLLGRFNWWAPRLPTRAVVRER

SEQ ID NO: 362744 - protein, 24 aa, Mycobacterium
LVDATLVRVLLVPAFMHVFGGLNW

SEQ ID NO: 362745 - protein, 19 aa, Mycobacterium
LVDDPLFCDLLANQHLHLE

SEQ ID NO: 362746 - protein, 27 aa, Mycobacterium
LVDGLGWQWIFFVNVPIGVAGLALAYW

SEQ ID NO: 362747 - protein, 27 aa, Mycobacterium
LVDGLGWQWIFFVNVPVGVIGLALAYW

SEQ ID NO: 362748 - protein, 17 aa, Mycobacterium
LVDGRVYGVLLVGSSQP

SEQ ID NO: 362749 - protein, 17 aa, Mycobacterium
LVDLPKFPNEKIDPARS

SEQ ID NO: 362750 - protein, 17 aa, Mycobacterium
LVDLVMKAQPPGSPCYF

SEQ ID NO: 362751 - protein, 22 aa, Mycobacterium
LVDLYRDFPGTELMSACFMPDA

SEQ ID NO: 362752 - protein, 22 aa, Mycobacterium
LVDRLEQLLSDPILRDQLGAKA

SEQ ID NO: 362753 - protein, 28 aa, Mycobacterium
LVDTLGWEWIFFVNIPIGVLGVALAVRF

SEQ ID NO: 362754 - protein, 28 aa, Mycobacterium
LVDTLGWQWIFFVNIPVGIVGLVLAVRF

SEQ ID NO: 362755 - protein, 30 aa, Mycobacterium
LVEASSWRLVFLVNIPLGIVAVLVAGRVLT

SEQ ID NO: 362756 - protein, 21 aa, Mycobacterium
LVEFLCLLPLTIPALVIVVGL

SEQ ID NO: 362757 - protein, 18 aa, Mycobacterium
LVEIPILHLSRWIPELKT

SEQ ID NO: 362758 - protein, 26 aa, Mycobacterium
LVEKIRYFVIALLGGVGLLGAYCFYL

SEQ ID NO: 362759 - protein, 25 aa, Mycobacterium
LVELAAGLLLLWNRTWVLGALGSVF

SEQ ID NO: 362760 - protein, 20 aa, Mycobacterium
LVELLGVLLIIWATPRLAQR

SEQ ID NO: 362761 - protein, 29 aa, Mycobacterium
LVEMQGDGPYILVGWSLGGVLAYACAIGL

SEQ ID NO: 362762 - protein, 18 aa, Mycobacterium
LVENSIGTRRLWPAAVAI

SEQ ID NO: 362763 - protein, 19 aa, Mycobacterium
LVEPTILLAVFALSIPAGS

SEQ ID NO: 362764 - protein, 27 aa, Mycobacterium
LVESALWLAIPYLCIGFVWTVFHAEEA

SEQ ID NO: 362765 - protein, 17 aa, Mycobacterium
LVETLLRWFGAKRMPYA

SEQ ID NO: 362766 - protein, 24 aa, Mycobacterium
LVETLVLVIFVLVLRTLPAEADAA

SEQ ID NO: 362767 - protein, 25 aa, Mycobacterium
LVETVGFVFWLVAAVLLMVGGMIAA

SEQ ID NO: 362768 - protein, 26 aa, Mycobacterium
LVFAAFLYRRWNLPVAVLAGAAAGVA

SEQ ID NO: 362769 - protein, 17 aa, Mycobacterium
LVFAFTMCAMVVSDLRI

SEQ ID NO: 362770 - protein, 17 aa, Mycobacterium
LVFAFTMLAMLASDLRT

SEQ ID NO: 362771 - protein, 18 aa, Mycobacterium
LVFAFTMMAMIVSDLRVV

SEQ ID NO: 362772 - protein, 19 aa, Mycobacterium
LVFAFTMMAMIVSDLRVVG

SEQ ID NO: 362773 - protein, 28 aa, Mycobacterium
LVFAGLWATFVYFPVAHWVFAFDGFASE

SEQ ID NO: 362774 - protein, 26 aa, Mycobacterium
LVFAQYLQNFLGFTPIKAALLLTPMA

SEQ ID NO: 362775 - protein, 17 aa, Mycobacterium
LVFAYTTYISIAAMIVL

SEQ ID NO: 362776 - protein, 17 aa, Mycobacterium
LVFCWIAVTAWVIVAVA

SEQ ID NO: 362777 - protein, 21 aa, Mycobacterium
LVFKPLFFPNVSSTAGTLAAF

SEQ ID NO: 362778 - protein, 17 aa, Mycobacterium
LVFLIVMAITRTLAGSV

SEQ ID NO: 362779 - protein, 17 aa, Mycobacterium
LVFLSGYVVPRVSSWLT

SEQ ID NO: 362780 - protein, 20 aa, Mycobacterium
LVFPKLFFPGSDPLTGALLS

SEQ ID NO: 362781 - protein, 34 aa, Mycobacterium
LVFTDKAIYLRVGLLLALWAAVIASFAALTYRRQ

SEQ ID NO: 362782 - protein, 21 aa, Mycobacterium
LVGALGLFRAGGLRQALGSAI

SEQ ID NO: 362783 - protein, 19 aa, Mycobacterium
LVGALLLIKAADVGYRTFT

SEQ ID NO: 362784 - protein, 17 aa, Mycobacterium
LVGALMRIPYTAAIGIF

SEQ ID NO: 362785 - protein, 18 aa, Mycobacterium
LVGALPWLTASALGSSLT

SEQ ID NO: 362786 - protein, 30 aa, Mycobacterium
LVGALVTRIRWPMWLRTALATVALGAVLSC

SEQ ID NO: 362787 - protein, 26 aa, Mycobacterium
LVGATRWYTQLPFLVEAMLAAFIGVV

SEQ ID NO: 362788 - protein, 26 aa, Mycobacterium
LVGATRWYTQLPFLVEAMLAALIGVI

SEQ ID NO: 362789 - protein, 24 aa, Mycobacterium
LVGCLVLAFTLPLSSVLAGLAVVA

SEQ ID NO: 362790 - protein, 19 aa, Mycobacterium
LVGFLWATVAGSVSWLILL

SEQ ID NO: 362791 - protein, 27 aa, Mycobacterium
LVGFMPVLLYRIWRVARFPASVPALAA

SEQ ID NO: 362792 - protein, 23 aa, Mycobacterium
LVGFVLALFLRQVPLRELHDSTI

SEQ ID NO: 362793 - protein, 28 aa, Mycobacterium
LVGGIVWNLLTWLFGIPSSSSHALIGGI

SEQ ID NO: 362794 - protein, 28 aa, Mycobacterium
LVGGIVWNLLTWLLGIPSSSSHALIGGI

SEQ ID NO: 362795 - protein, 29 aa, Mycobacterium
LVGGLGWEWIFFVNIPIGVLGLALAAWLV

SEQ ID NO: 362796 - protein, 18 aa, Mycobacterium
LVGGPWDWQRWAPASPWA

SEQ ID NO: 362797 - protein, 25 aa, Mycobacterium
LVGGQATLWLTWPFGPSGALGGFAA

SEQ ID NO: 362798 - protein, 26 aa, Mycobacterium
LVGGQVTIWLSWPYGARGVLAGFGAM

SEQ ID NO: 362799 - protein, 22 aa, Mycobacterium
LVGIILALIFRGIFIALGAVAI

SEQ ID NO: 362800 - protein, 20 aa, Mycobacterium
LVGIVIAAALFWAVQGYADI

SEQ ID NO: 362801 - protein, 20 aa, Mycobacterium
LVGLAFALGMLLTFTLMVGP

SEQ ID NO: 362802 - protein, 17 aa, Mycobacterium
LVGLALAVPLGAAVRRA

SEQ ID NO: 362803 - protein, 18 aa, Mycobacterium
LVGLLIIAVFGDGKPYLV

SEQ ID NO: 362804 - protein, 23 aa, Mycobacterium
LVGLLILVRMTPLIALWVARVRP

SEQ ID NO: 362805 - protein, 18 aa, Mycobacterium
LVGLVALAAFSAPLVAAL

SEQ ID NO: 362806 - protein, 45 aa, Mycobacterium
LVGLVVYLLTPLVSAVLLPLAIGLALLPISWQLGLAALAGVPLLL

SEQ ID NO: 362807 - protein, 27 aa, Mycobacterium
LVGLVYPWGDLVLLALAAGMLPILGLR

SEQ ID NO: 362808 - protein, 18 aa, Mycobacterium
LVGMFITPLLVIGAIRLS

SEQ ID NO: 362809 - protein, 17 aa, Mycobacterium
LVGMFITPLLVIGAVRL

SEQ ID NO: 362810 - protein, 17 aa, Mycobacterium
LVGMLIVAVLRNGLTQA

SEQ ID NO: 362811 - protein, 28 aa, Mycobacterium
LVGNPLIVIAIMAALRYPVRVGFLAGLT

SEQ ID NO: 362812 - protein, 17 aa, Mycobacterium
LVGPAVMFALAWLLLPD

SEQ ID NO: 362813 - protein, 20 aa, Mycobacterium
LVGPFLVIAALTGALYAMAP

SEQ ID NO: 362814 - protein, 24 aa, Mycobacterium
LVGQSLTPPGWTPSSPGWVKNVKV

SEQ ID NO: 362815 - protein, 24 aa, Mycobacterium
LVGQWLAAILFLRALHAEHAPLRT

SEQ ID NO: 362816 - protein, 21 aa, Mycobacterium
LVGRFGPRKLLLGGVSAMVVV

SEQ ID NO: 362817 - protein, 18 aa, Mycobacterium
LVGSFASWLLALGGMALI

SEQ ID NO: 362818 - protein, 19 aa, Mycobacterium
LVGSFTSWLLALGGIALVL

SEQ ID NO: 362819 - protein, 20 aa, Mycobacterium
LVGSFTSWLLALGGIGLVLA

SEQ ID NO: 362820 - protein, 36 aa, Mycobacterium
LVGSTILLRFAYLRPPGMTWLDALYFSTETIATVGY

SEQ ID NO: 362821 - protein, 23 aa, Mycobacterium
LVGTLLSWYALVAALTTVPLVRW

SEQ ID NO: 362822 - protein, 27 aa, Mycobacterium
LVGTPAIWWLAVPVLLWATWATVVRRD

SEQ ID NO: 362823 - protein, 31 aa, Mycobacterium
LVGVILLVVYRSPITIALPLLVAGAGLGVGR

SEQ ID NO: 362824 - protein, 22 aa, Mycobacterium
LVGVVVSVLLWPRGATASVTRA

SEQ ID NO: 362825 - protein, 20 aa, Mycobacterium
LVGWLERLLAASGRVPDALV

SEQ ID NO: 362826 - protein, 23 aa, Mycobacterium
LVGWRGTRWWRRGVAVLSIPLCV

SEQ ID NO: 362827 - protein, 20 aa, Mycobacterium
LVGWRYAFLVLAPGPAIGAA

SEQ ID NO: 362828 - protein, 17 aa, Mycobacterium
LVGYCAGWLPWFANIDR

SEQ ID NO: 362829 - protein, 17 aa, Mycobacterium
LVGYFDEPSRHLMVLTG

SEQ ID NO: 362830 - protein, 17 aa, Mycobacterium
LVHFLQKVAPESTFGTV

SEQ ID NO: 362831 - protein, 30 aa, Mycobacterium
LVHLHGTLLIAYLALLLGLGFGLAAVGVTR

SEQ ID NO: 362832 - protein, 36 aa, Mycobacterium
LVHLKMINPLLALPFRPLLAFLTTGFLAPVFREVLG

SEQ ID NO: 362833 - protein, 17 aa, Mycobacterium
LVIAALTGALYAMAPTV

SEQ ID NO: 362834 - protein, 38 aa, Mycobacterium
LVIAVMLFFVYRSVVTMFLVLLTVLVQLLAARGIIALL

SEQ ID NO: 362835 - protein, 28 aa, Mycobacterium
LVIAVMLLFIYRSVVTAFLVLIMVGIDL

SEQ ID NO: 362836 - protein, 20 aa, Mycobacterium
LVIAVPIALARLYSGGLWAS

SEQ ID NO: 362837 - protein, 30 aa, Mycobacterium
LVIAYCLGLGIPFILLAFGTAGAVAGLGWL

SEQ ID NO: 362838 - protein, 25 aa, Mycobacterium
LVIAYCLGLGIPFVLLAFGSARAVA

SEQ ID NO: 362839 - protein, 23 aa, Mycobacterium
LVIAYCLGLGMPFLLLAFGSARA

SEQ ID NO: 362840 - protein, 21 aa, Mycobacterium
LVIHDSALIHLLVVAPDGQLS

SEQ ID NO: 362841 - protein, 35 aa, Mycobacterium
LVILAIWLVIVGWLTLWPFLTWLTTHFVITDRRVM

SEQ ID NO: 362842 - protein, 18 aa, Mycobacterium
LVILAVVIAGGFTVHRIR

SEQ ID NO: 362843 - protein, 19 aa, Mycobacterium
LVIMDLRDHWMAKAPYILG

SEQ ID NO: 362844 - protein, 25 aa, Mycobacterium
LVIPALFALIGDRIWWPTSPANAEP

SEQ ID NO: 362845 - protein, 18 aa, Mycobacterium
LVISAGVLWIASRLGWVV

SEQ ID NO: 362846 - protein, 24 aa, Mycobacterium
LVISFGIILPFRTIGDFAGSESVA

SEQ ID NO: 362847 - protein, 19 aa, Mycobacterium
LVISLLAGAAAYLMWALHI

SEQ ID NO: 362848 - protein, 20 aa, Mycobacterium
LVISLLFLVGGVPGLLLVDR

SEQ ID NO: 362849 - protein, 23 aa, Mycobacterium
LVISYVFTVLTVVAVIVSILLTM

SEQ ID NO: 362850 - protein, 18 aa, Mycobacterium
LVIVAVIIVGGFSVHRIR

SEQ ID NO: 362851 - protein, 17 aa, Mycobacterium
LVIVTSVSMVFGELVPK

SEQ ID NO: 362852 - protein, 30 aa, Mycobacterium
LVKAGLIGTVLMILVVAVGLQPERLLQWAT

SEQ ID NO: 362853 - protein, 21 aa, Mycobacterium
LVKHRISAFVLPHGLITVRLP

SEQ ID NO: 362854 - protein, 18 aa, Mycobacterium
LVKPLLAHAAIAFIAVEV

SEQ ID NO: 362855 - protein, 20 aa, Mycobacterium
LVKRLAPQRRLSIAVISLGI

SEQ ID NO: 362856 - protein, 19 aa, Mycobacterium
LVKRLAPQRRLSLAVITLG

SEQ ID NO: 362857 - protein, 18 aa, Mycobacterium
LVKVLALVVFLVVGTVFL

SEQ ID NO: 362858 - protein, 25 aa, Mycobacterium
LVLAAAIVFIYRPLLFASVNAQVAE

SEQ ID NO: 362859 - protein, 37 aa, Mycobacterium
LVLAAIAIALVVVLLVARALVRPLRVLRDGALKVAHT

SEQ ID NO: 362860 - protein, 23 aa, Mycobacterium
LVLAAISRRFGLATPLVLVVTGL

SEQ ID NO: 362861 - protein, 26 aa, Mycobacterium
LVLAAIWLLHYGNRGWFFPLSIRQVP

SEQ ID NO: 362862 - protein, 18 aa, Mycobacterium
LVLAALLAVITIPAHLFG

SEQ ID NO: 362863 - protein, 25 aa, Mycobacterium
LVLAAVVFTYLSYTAAFTPTDKVTV

SEQ ID NO: 362864 - protein, 34 aa, Mycobacterium
LVLAGAYPLYLDAYPLPPFAIYGAVSLHTIKQVL

SEQ ID NO: 362865 - protein, 24 aa, Mycobacterium
LVLAVLVFAWIVVALNPAIASPDS

SEQ ID NO: 362866 - protein, 19 aa, Mycobacterium
LVLCVIWLRFLGGESWRST

SEQ ID NO: 362867 - protein, 25 aa, Mycobacterium
LVLCYALVPVLWVLSLSLKPTSSVK

SEQ ID NO: 362868 - protein, 17 aa, Mycobacterium
LVLELAIGAAVVAKGWS

SEQ ID NO: 362869 - protein, 18 aa, Mycobacterium
LVLFFVGAVLTHVKARVL

SEQ ID NO: 362870 - protein, 20 aa, Mycobacterium
LVLGLFWLGWIIVFTSTFMI

SEQ ID NO: 362871 - protein, 17 aa, Mycobacterium
LVLGPRIGFKKDAMRPH

SEQ ID NO: 362872 - protein, 28 aa, Mycobacterium
LVLGVVLMMLWRVAAPPFFQGQTLPRRS

SEQ ID NO: 362873 - protein, 24 aa, Mycobacterium
LVLGWAIFLSYGLALMGLPALAVL

SEQ ID NO: 362874 - protein, 20 aa, Mycobacterium
LVLGYRQFWAKVRRGALFKA

SEQ ID NO: 362875 - protein, 22 aa, Mycobacterium
LVLHAFLFVVTMLVLGLLVMGT

SEQ ID NO: 362876 - protein, 22 aa, Mycobacterium
LVLIAPAWSRRLVRRGWPKPLA

SEQ ID NO: 362877 - protein, 29 aa, Mycobacterium
LVLIHPTTWGPARRTLLSSAARMMAATLT

SEQ ID NO: 362878 - protein, 27 aa, Mycobacterium
LVLIPVTFLLILPLLWMLVTSLQTEGE

SEQ ID NO: 362879 - protein, 26 aa, Mycobacterium
LVLITTFLIFPILGLAIRALVRSWMD

SEQ ID NO: 362880 - protein, 24 aa, Mycobacterium
LVLIVAFFAVWWVYDTYRPEPAPK

SEQ ID NO: 362881 - protein, 34 aa, Mycobacterium
LVLKDLRIPAIGLALLLLSSLVVGAGWPLIVEQF

SEQ ID NO: 362882 - protein, 17 aa, Mycobacterium
LVLLAIGGIGAALFMDN

SEQ ID NO: 362883 - protein, 17 aa, Mycobacterium
LVLLALTVVISMLTVVP

SEQ ID NO: 362884 - protein, 17 aa, Mycobacterium
LVLLCVGAVFMGTALTI

SEQ ID NO: 362885 - protein, 17 aa, Mycobacterium
LVLLGLGVALWDAFDEG

SEQ ID NO: 362886 - protein, 18 aa, Mycobacterium
LVLLIPTAGTIALLANPG

SEQ ID NO: 362887 - protein, 18 aa, Mycobacterium
LVLLLVVAAYFMVRAIGA

SEQ ID NO: 362888 - protein, 17 aa, Mycobacterium
LVLLPEYAVLVLLVGAL

SEQ ID NO: 362889 - protein, 23 aa, Mycobacterium
LVLLPSALLLLRLGEPFAISAMA

SEQ ID NO: 362890 - protein, 28 aa, Mycobacterium
LVLLTHPGLPLWPYLVCAALTGLGGGNF

SEQ ID NO: 362891 - protein, 24 aa, Mycobacterium
LVLLVFLAARYWLWIAVATGVVVA

SEQ ID NO: 362892 - protein, 24 aa, Mycobacterium
LVLLVGVLAFFRGIIGRLAIFGAV

SEQ ID NO: 362893 - protein, 18 aa, Mycobacterium
LVLLVIHGGLYGATFVVL

SEQ ID NO: 362894 - protein, 20 aa, Mycobacterium
LVLLVPTMIWVRLRAPWAKG

SEQ ID NO: 362895 - protein, 42 aa, Mycobacterium
LVLLVTFVVIIVLLLFFYRSISTVLLLLVVVGIQLLVARGVV

SEQ ID NO: 362896 - protein, 19 aa, Mycobacterium
LVLNAHIAFSVWYLWSVMV

SEQ ID NO: 362897 - protein, 32 aa, Mycobacterium
LVLPLIGFALTVWLWFSLDGLALIIGLCWLAI

SEQ ID NO: 362898 - protein, 25 aa, Mycobacterium
LVLPVPRGLRLIATLPVPVAVAQLI

SEQ ID NO: 362899 - protein, 18 aa, Mycobacterium
LVLRFDQGRWIAIDNGSL

SEQ ID NO: 362900 - protein, 24 aa, Mycobacterium
LVLSAIYILWMYQRMMTGPVPPSL

SEQ ID NO: 362901 - protein, 24 aa, Mycobacterium
LVLSAIYMLWLYQRVMTGPLAKGN

SEQ ID NO: 362902 - protein, 24 aa, Mycobacterium
LVLSAIYMLWLYQRVMTGPVAAGN

SEQ ID NO: 362903 - protein, 22 aa, Mycobacterium
LVLSVMGVVVFTGAIAGAVLVG

SEQ ID NO: 362904 - protein, 24 aa, Mycobacterium
LVLTAVLIVWRRDLRSIVWLLAAQ

SEQ ID NO: 362905 - protein, 19 aa, Mycobacterium
LVLTVFVGSVVWIIGASWG

SEQ ID NO: 362906 - protein, 26 aa, Mycobacterium
LVLVAYGAFLPLLVRAVWLAQRNTGV

SEQ ID NO: 362907 - protein, 36 aa, Mycobacterium
LVLVNESFLLLFLAYLVLVVLLKTWAWRRTTIQVGG

SEQ ID NO: 362908 - protein, 20 aa, Mycobacterium
LVLVPRFGWQAAFIVAIIPA

SEQ ID NO: 362909 - protein, 26 aa, Mycobacterium
LVLVVAALTWVGWTAGIERLTRIYPT

SEQ ID NO: 362910 - protein, 18 aa, Mycobacterium
LVMELINGEPLNSVLKRT

SEQ ID NO: 362911 - protein, 23 aa, Mycobacterium
LVMETLFAAAIWYMVVVTLAGFG

SEQ ID NO: 362912 - protein, 21 aa, Mycobacterium
LVMILIALIVYGIIELISDRQ

SEQ ID NO: 362913 - protein, 25 aa, Mycobacterium
LVMIRHTSQWPLIIAGLVVGVVLGV

SEQ ID NO: 362914 - protein, 28 aa, Mycobacterium
LVMLLCLFGMLFVLLRRGRVPGLASGPA

SEQ ID NO: 362915 - protein, 17 aa, Mycobacterium
LVMLRSYGWLIDKSASL

SEQ ID NO: 362916 - protein, 18 aa, Mycobacterium
LVMMLTISPMLTLLTVVT

SEQ ID NO: 362917 - protein, 17 aa, Mycobacterium
LVMTWGPSLCRVERNNS

SEQ ID NO: 362918 - protein, 25 aa, Mycobacterium
LVNDGTSSWLLWDGKRSRMDLADHA

SEQ ID NO: 362919 - protein, 17 aa, Mycobacterium
LVNGAWAVVFYLVTVRL

SEQ ID NO: 362920 - protein, 41 aa, Mycobacterium
LVNHRGIPVFIALGVLSMLLAGGFAWLFAGRAVRPLHQLTD

SEQ ID NO: 362921 - protein, 35 aa, Mycobacterium
LVNLHAPPLPEPMIKVLVYLGFGAERYRYPSNLPK

SEQ ID NO: 362922 - protein, 18 aa, Mycobacterium
LVNLLMRFYDVDSGRILV

SEQ ID NO: 362923 - protein, 23 aa, Mycobacterium
LVPAFMHVLGHWNWWAPPLLSRL

SEQ ID NO: 362924 - protein, 20 aa, Mycobacterium
LVPEPLRPAAVDRTVFALFL

SEQ ID NO: 362925 - protein, 18 aa, Mycobacterium
LVPGWTRVRDALLGCAPT

SEQ ID NO: 362926 - protein, 17 aa, Mycobacterium
LVPKLAAQLPPLIATLK

SEQ ID NO: 362927 - protein, 25 aa, Mycobacterium
LVPLWAAMLMWLTLWVLYLSIVNVG

SEQ ID NO: 362928 - protein, 27 aa, Mycobacterium
LVPQAPGPPPGYGPLPGPPPASAAAPA

SEQ ID NO: 362929 - protein, 41 aa, Mycobacterium
LVPSARFPGWGFVLTALAAPIVTWAAWPFHSVALRNARHRT

SEQ ID NO: 362930 - protein, 18 aa, Mycobacterium
LVPTAFSAAYGASEAGSA

SEQ ID NO: 362931 - protein, 24 aa, Mycobacterium
LVPTLLVSIPFTVLVAFTLNILLR

SEQ ID NO: 362932 - protein, 20 aa, Mycobacterium
LVPVAFALVTLWLTRRGRIP

SEQ ID NO: 362933 - protein, 18 aa, Mycobacterium
LVPVFLVFLFTDGGHEFF

SEQ ID NO: 362934 - protein, 18 aa, Mycobacterium
LVPVGMVALLWPIYVIIN

SEQ ID NO: 362935 - protein, 19 aa, Mycobacterium
LVQALDRTAGWYADAETGN

SEQ ID NO: 362936 - protein, 28 aa, Mycobacterium
LVQALGWQWIFFINVPIGLAGLVLAALL

SEQ ID NO: 362937 - protein, 19 aa, Mycobacterium
LVQFLLTMGWVGVNTWVVL

SEQ ID NO: 362938 - protein, 17 aa, Mycobacterium
LVQILLLDLVFSLDSVI

SEQ ID NO: 362939 - protein, 17 aa, Mycobacterium
LVQIMVVALLTAVIYVM

SEQ ID NO: 362940 - protein, 17 aa, Mycobacterium
LVQLLGRINAELSVYTG

SEQ ID NO: 362941 - protein, 21 aa, Mycobacterium
LVQLLLILLLFASDALNFMLD

SEQ ID NO: 362942 - protein, 17 aa, Mycobacterium
LVQVSAFLKNLRLDFAN

SEQ ID NO: 362943 - protein, 25 aa, Mycobacterium
LVRAGFIGTVLVIMVIAVGLSPEQL

SEQ ID NO: 362944 - protein, 21 aa, Mycobacterium
LVRALAVSVAFLLFYLVCLGE

SEQ ID NO: 362945 - protein, 19 aa, Mycobacterium
LVRALLLPRDGKSANPSGT

SEQ ID NO: 362946 - protein, 18 aa, Mycobacterium
LVRAVLCQLATWHSPRDV

SEQ ID NO: 362947 - protein, 19 aa, Mycobacterium
LVRDPQGNWLLVGAPKPAE

SEQ ID NO: 362948 - protein, 27 aa, Mycobacterium
LVRKGFWRLLGILVLTGFIVGFVSMII

SEQ ID NO: 362949 - protein, 24 aa, Mycobacterium
LVRLELPLAWPVIMTGIRVSAQML

SEQ ID NO: 362950 - protein, 23 aa, Mycobacterium
LVRLRGPAPAWKKARGKIAVVEV

SEQ ID NO: 362951 - protein, 22 aa, Mycobacterium
LVRSIPPRVLVIAGGILVLGAM

SEQ ID NO: 362952 - protein, 18 aa, Mycobacterium
LVRSLAFQACFISAAAVA

SEQ ID NO: 362953 - protein, 25 aa, Mycobacterium
LVRSRVVWLLVLAIGATLTVQVLEV

SEQ ID NO: 362954 - protein, 21 aa, Mycobacterium
LVRSWTLIPGLAAAGLAIGIC

SEQ ID NO: 362955 - protein, 24 aa, Mycobacterium
LVRVAGLALLALAALAAAHERPAP

SEQ ID NO: 362956 - protein, 36 aa, Mycobacterium
LVSAAINFVLIAAVVYFLIVLPYNRLRRKGEVEQAD

SEQ ID NO: 362957 - protein, 32 aa, Mycobacterium
LVSAGLLIFCGLSLWWWPLHAGTGNLDLTPSS

SEQ ID NO: 362958 - protein, 26 aa, Mycobacterium
LVSAQFLHSTVRLERPRILSTAARAI

SEQ ID NO: 362959 - protein, 23 aa, Mycobacterium
LVSARFIQLTPAYTGGAVLADGA

SEQ ID NO: 362960 - protein, 29 aa, Mycobacterium
LVSFYAVPLVLFYPVMIVLVGINAMSVII

SEQ ID NO: 362961 - protein, 19 aa, Mycobacterium
LVSFYSALPICGTALFVAA

SEQ ID NO: 362962 - protein, 36 aa, Mycobacterium
LVSGWLAAITWRLSFLWLAVAGLLLTLALARTVPEP

SEQ ID NO: 362963 - protein, 30 aa, Mycobacterium
LVSLGTIAAYLWSLWVLFANAGHTHGDVHV

SEQ ID NO: 362964 - protein, 24 aa, Mycobacterium
LVSLIFSRQWKLLGAYAAAGLITM

SEQ ID NO: 362965 - protein, 17 aa, Mycobacterium
LVSLPISVTLSIQFALL

SEQ ID NO: 362966 - protein, 26 aa, Mycobacterium
LVSPSARWWVVFGPLPVITAIWAYQA

SEQ ID NO: 362967 - protein, 24 aa, Mycobacterium
LVSSAALVTVLYLTQYRIDRQTDT

SEQ ID NO: 362968 - protein, 20 aa, Mycobacterium
LVSSTFIYGWSTMPVVGESY

SEQ ID NO: 362969 - protein, 17 aa, Mycobacterium
LVSSVLPLVLRKLRVDP

SEQ ID NO: 362970 - protein, 33 aa, Mycobacterium
LVSTIGWIAVPAFLWVAFALLVTDDYAASNLLL

SEQ ID NO: 362971 - protein, 38 aa, Mycobacterium
LVSVGVIFLMLLLLYRSIITVIILLFTVGIELQVARGL

SEQ ID NO: 362972 - protein, 17 aa, Mycobacterium
LVSWRRVSGRWSKSGDP

SEQ ID NO: 362973 - protein, 24 aa, Mycobacterium
LVTAGLLVLAWRNRSGWLPAARAH

SEQ ID NO: 362974 - protein, 24 aa, Mycobacterium
LVTALQVTALLFALPIYARFAHHR

SEQ ID NO: 362975 - protein, 32 aa, Mycobacterium
LVTAVEMTLLWWLRRFFAAPLPTIRIPLPQRW

SEQ ID NO: 362976 - protein, 19 aa, Mycobacterium
LVTAVRLVDFHRLVYAIKA

SEQ ID NO: 362977 - protein, 17 aa, Mycobacterium
LVTAVVLVSFGYTGLPF

SEQ ID NO: 362978 - protein, 17 aa, Mycobacterium
LVTCLALTWLNPHVYLD

SEQ ID NO: 362979 - protein, 25 aa, Mycobacterium
LVTEILMLSLLALSVLFAGGGPQGW

SEQ ID NO: 362980 - protein, 17 aa, Mycobacterium
LVTFGVGLILQQVARDI

SEQ ID NO: 362981 - protein, 17 aa, Mycobacterium
LVTFTVADGIRLGDRTE

SEQ ID NO: 362982 - protein, 17 aa, Mycobacterium
LVTFTVASNLRLGERTE

SEQ ID NO: 362983 - protein, 26 aa, Mycobacterium
LVTGGLLHFWTWQSIFVTFTIASVGL

SEQ ID NO: 362984 - protein, 25 aa, Mycobacterium
LVTGLYRWFPPITVWTGLSLLAVAV

SEQ ID NO: 362985 - protein, 28 aa, Mycobacterium
LVTHFGWQSIFLVNLPVGVIALIIAARH

SEQ ID NO: 362986 - protein, 19 aa, Mycobacterium
LVTLLAERISLLVTVPAVY

SEQ ID NO: 362987 - protein, 18 aa, Mycobacterium
LVTMIALAVWMLNNADWS

SEQ ID NO: 362988 - protein, 17 aa, Mycobacterium
LVTMPLVVWILRSYFQD

SEQ ID NO: 362989 - protein, 24 aa, Mycobacterium
LVTTAVGLLLLAPPIRAVAGPGLT

SEQ ID NO: 362990 - protein, 25 aa, Mycobacterium
LVTTLRLPPFIVTLGTFTAILAGTR

SEQ ID NO: 362991 - protein, 25 aa, Mycobacterium
LVTTRLMAAIIAVIPLYLACLAISY

SEQ ID NO: 362992 - protein, 22 aa, Mycobacterium
LVTTVFFLKAALIIPLGLAIFW

SEQ ID NO: 362993 - protein, 21 aa, Mycobacterium
LVTVFTVMRQPPAPVSANLPP

SEQ ID NO: 362994 - protein, 36 aa, Mycobacterium
LVTVGVIFLMLLLLYRRVLIVLILLATVAIELQVAR

SEQ ID NO: 362995 - protein, 24 aa, Mycobacterium
LVTVPAVYSLLLRHKDFGAADVSG

SEQ ID NO: 362996 - protein, 19 aa, Mycobacterium
LVTYFRAWGALCILLAAGI

SEQ ID NO: 362997 - protein, 22 aa, Mycobacterium
LVVAAGLILMWPTSARPQPEAL

SEQ ID NO: 362998 - protein, 24 aa, Mycobacterium
LVVAALLLMAVSRVALRPLDRLTT

SEQ ID NO: 362999 - protein, 17 aa, Mycobacterium
LVVAAVAALLWANSPWS

SEQ ID NO: 363000 - protein, 25 aa, Mycobacterium
LVVAAVFVLLVLPPALAVFGRKLFW

SEQ ID NO: 363001 - protein, 18 aa, Mycobacterium
LVVAAVIEWILGGGAALG

SEQ ID NO: 363002 - protein, 20 aa, Mycobacterium
LVVACLVCFLIGFAGLLWLP

SEQ ID NO: 363003 - protein, 29 aa, Mycobacterium
LVVAIVVGLVRYRRRKIKLSAPEPKKTID

SEQ ID NO: 363004 - protein, 19 aa, Mycobacterium
LVVALIDLDKFKALNDTHG

SEQ ID NO: 363005 - protein, 17 aa, Mycobacterium
LVVAPTLHHGFRPALVI

SEQ ID NO: 363006 - protein, 26 aa, Mycobacterium
LVVASSVVAVLIWPRADEGTDPRTKA

SEQ ID NO: 363007 - protein, 30 aa, Mycobacterium
LVVCTLAMLVLVGCLIYLLATTARNTRDLH

SEQ ID NO: 363008 - protein, 19 aa, Mycobacterium
LVVELFGLLLSPISWTHHW

SEQ ID NO: 363009 - protein, 46 aa, Mycobacterium
LVVFAALTVWFVIDPALWLLIVVTVLALLLGWHLVASIGGGDMPVV

SEQ ID NO: 363010 - protein, 27 aa, Mycobacterium
LVVFQSILAVAFGAGLFVAFDELWRWN

SEQ ID NO: 363011 - protein, 27 aa, Mycobacterium
LVVFVGCWIVWPFTLRSGQPMGGRPDS

SEQ ID NO: 363012 - protein, 20 aa, Mycobacterium
LVVGFPIAMAITAIATWAAE

SEQ ID NO: 363013 - protein, 33 aa, Mycobacterium
LVVGTIVVFVFAWSFWLNTGTPMTFVVLLPTTW

SEQ ID NO: 363014 - protein, 27 aa, Mycobacterium
LVVGVIVWGLIFWASAFHRKKATDTEL

SEQ ID NO: 363015 - protein, 26 aa, Mycobacterium
LVVGVIVWGLIFWSATFHRKKKTDTD

SEQ ID NO: 363016 - protein, 26 aa, Mycobacterium
LVVGVIVWGLIFWTAVFHRKKRSDAD

SEQ ID NO: 363017 - protein, 32 aa, Mycobacterium
LVVGYLLSVVLVALLIWLLARDGGAANGGRAA

SEQ ID NO: 363018 - protein, 26 aa, Mycobacterium
LVVIAFAYLCFTVLAPWQLGKHNRTS

SEQ ID NO: 363019 - protein, 39 aa, Mycobacterium
LVVLFYSTFFFFFFLAELLDNWLWKWAAYLIVFGIMVVL

SEQ ID NO: 363020 - protein, 44 aa, Mycobacterium
LVVLFYSTFFFFFFLAELLDTWLWRWVAFLIVFAIMLVVTGALA

SEQ ID NO: 363021 - protein, 42 aa, Mycobacterium
LVVLFYSTFFFFFFVAELLDTWLWRWVAYLIVFGIMVVVGAV

SEQ ID NO: 363022 - protein, 42 aa, Mycobacterium
LVVLFYSTFFLFFFLAELLDSWLWRWVAFLIVFALMVVTTVV

SEQ ID NO: 363023 - protein, 41 aa, Mycobacterium
LVVLFYSTFFLFFFLAELLDTWLWRWVAFLIVFGLMVLTTG

SEQ ID NO: 363024 - protein, 21 aa, Mycobacterium
LVVLGVFVWWQSANRGEPLIP

SEQ ID NO: 363025 - protein, 52 aa, Mycobacterium
LVVLQSILAVVFGAGLFIAFDQLWRWNSIVALVLSVLVILGLVVGVRVVRKT

SEQ ID NO: 363026 - protein, 18 aa, Mycobacterium
LVVLSCQLLIVTMLTRLE

SEQ ID NO: 363027 - protein, 19 aa, Mycobacterium
LVVLVPWTAINLIDFYIVH

SEQ ID NO: 363028 - protein, 31 aa, Mycobacterium; identical to SEQ ID NO: 22499

SEQ ID NO: 363029 - protein, 32 aa, Mycobacterium
LVVMNWLDLSWRWLFGLSIIPALISLIIRYRV

SEQ ID NO: 363030 - protein, 28 aa, Mycobacterium
LVVNLLTPLIGAVLLPAAIAVALVAVSP

SEQ ID NO: 363031 - protein, 19 aa, Mycobacterium
LVVPLVIYGLTMAAVIGIP

SEQ ID NO: 363032 - protein, 23 aa, Mycobacterium
LVVPTEFMAIRLHQLGWLNDISD

SEQ ID NO: 363033 - protein, 25 aa, Mycobacterium
LVVPVSLILWRTFRPGFGQFYAWVS

SEQ ID NO: 363034 - protein, 31 aa, Mycobacterium
LVVQPTFLYELIWNVLVFAILIYADRRFGLG

SEQ ID NO: 363035 - protein, 18 aa, Mycobacterium
LVVRLWALQRSAMYRDMA

SEQ ID NO: 363036 - protein, 30 aa, Mycobacterium
LVVRPDLPETLLPQNFKPPPDLAPPPGTEV

SEQ ID NO: 363037 - protein, 19 aa, Mycobacterium
LVVRYWRPILQMGGLVVAL

SEQ ID NO: 363038 - protein, 25 aa, Mycobacterium
LVVSILPWCLASFRLDVARYADGDE

SEQ ID NO: 363039 - protein, 19 aa, Mycobacterium
LVVVAIPIALARLYSGGLL

SEQ ID NO: 363040 - protein, 19 aa, Mycobacterium
LVVVFGDFRFGPTNVYHAT

SEQ ID NO: 363041 - protein, 27 aa, Mycobacterium
LVVVGVGLALILYFTPAMSARNIVVVG

SEQ ID NO: 363042 - protein, 27 aa, Mycobacterium
LVVVLVLFFALLAIRLHIGLSLMASAF

SEQ ID NO: 363043 - protein, 20 aa, Mycobacterium
LVVVVAVGLRWLPASGAAAP

SEQ ID NO: 363044 - protein, 17 aa, Mycobacterium
LVVVVICIFYLVPQYQG

SEQ ID NO: 363045 - protein, 17 aa, Mycobacterium
LVVVVICVFYLAPQYQG

SEQ ID NO: 363046 - protein, 18 aa, Mycobacterium
LVVWLVLASLTLGYLLID

SEQ ID NO: 363047 - protein, 23 aa, Mycobacterium
LVWGASFLFIKVGLQGLSALQVA

SEQ ID NO: 363048 - protein, 25 aa, Mycobacterium
LVWQWTPFMMLLILAGLQSMPRDVL

SEQ ID NO: 363049 - protein, 17 aa, Mycobacterium
LVWRQIILFAHNIIIFV

SEQ ID NO: 363050 - protein, 29 aa, Mycobacterium
LVWSTESRWRPVAAILGVVVALGAVATAV

SEQ ID NO: 363051 - protein, 26 aa, Mycobacterium
LVYAPVFWVFLPLAVIGFLIYQMITD

SEQ ID NO: 363052 - protein, 19 aa, Mycobacterium
LVYAWLMPASTVLQAIIGG

SEQ ID NO: 363053 - protein, 20 aa, Mycobacterium
LVYGAWQLWRSPRLQPYRFL

SEQ ID NO: 363054 - protein, 24 aa, Mycobacterium
LVYGFICGTALLVVIFRLRNIDEL

SEQ ID NO: 363055 - protein, 20 aa, Mycobacterium
LVYGLQHLLVMYASTITVPV

SEQ ID NO: 363056 - protein, 17 aa, Mycobacterium
LVYLASKSSTLAKPAYN

SEQ ID NO: 363057 - protein, 30 aa, Mycobacterium
LVYLAYGVAILALPFMILIGLVLGRQWKLL

SEQ ID NO: 363058 - protein, 20 aa, Mycobacterium
LWAMTLSQFDPAFSGAVLII

SEQ ID NO: 363059 - protein, 18 aa, Mycobacterium
LWAVLVLAALRGLGFGIL

SEQ ID NO: 363060 - protein, 25 aa, Mycobacterium
LWDERRLVLPCTYFTSTPFQNWTRN

SEQ ID NO: 363061 - protein, 29 aa, Mycobacterium
LWDPDTHQLLGRPLDAGVPLYALDFSEDS

SEQ ID NO: 363062 - protein, 17 aa, Mycobacterium
LWDYKVSSWLIAAGACV

SEQ ID NO: 363063 - protein, 20 aa, Mycobacterium
LWERFSFYGMLTILGYYLYY

SEQ ID NO: 363064 - protein, 21 aa, Mycobacterium
LWFGAIAYLLIIEPPLYFPAA

SEQ ID NO: 363065 - protein, 19 aa, Mycobacterium
LWFQPFFDDSSWDGPAWSI

SEQ ID NO: 363066 - protein, 17 aa, Mycobacterium
LWFVPFFDDSSWDGPAW

SEQ ID NO: 363067 - protein, 17 aa, Mycobacterium
LWIAMQYVQGSDAHSES

SEQ ID NO: 363068 - protein, 28 aa, Mycobacterium
LWIGLVVLWLFVLVPMLINKRDVVKRTS

SEQ ID NO: 363069 - protein, 28 aa, Mycobacterium
LWISLVVLWLFVLVPMLISKREAVRRTS

SEQ ID NO: 363070 - protein, 29 aa, Mycobacterium
LWISLVVLWLFVLVPMLVSKRDAVRRTSD

SEQ ID NO: 363071 - protein, 20 aa, Mycobacterium
LWLGVGLMLIAWLRLGRGVL

SEQ ID NO: 363072 - protein, 18 aa, Mycobacterium
LWLGYGVALALSIVLDAY

SEQ ID NO: 363073 - protein, 22 aa, Mycobacterium
LWLITTLALAVAIPAAWTQLHV

SEQ ID NO: 363074 - protein, 18 aa, Mycobacterium
LWLLTTAALAVTIAAAWA

SEQ ID NO: 363075 - protein, 21 aa, Mycobacterium
LWLLTTMALAVAIPAVWTQWN

SEQ ID NO: 363076 - protein, 21 aa, Mycobacterium
LWLLTTVLLAAAVPSAWAQKN

SEQ ID NO: 363077 - protein, 20 aa, Mycobacterium
LWLVRWLLFRVEFGAGLIKM

SEQ ID NO: 363078 - protein, 20 aa, Mycobacterium
LWPHSWPFVAQVLTAILVAD

SEQ ID NO: 363079 - protein, 31 aa, Mycobacterium
LWPKLGAPWYAFWRLLPKIPPWLGLQTTLSG

SEQ ID NO: 363080 - protein, 19 aa, Mycobacterium
LWQVLAAVTIATVFALAWA

SEQ ID NO: 363081 - protein, 33 aa, Mycobacterium
LWQVRELQFAVLAAVLLSVGWIVGRFGGYEGVV

SEQ ID NO: 363082 - protein, 27 aa, Mycobacterium
LWRETPAPYGPLFLWIGQGISALTGEN

SEQ ID NO: 363083 - protein, 23 aa, Mycobacterium
LWRGRGLFAPRLILAAMSAVTGV

SEQ ID NO: 363084 - protein, 19 aa, Mycobacterium
LWRIHAVGALLMVPQTVTV

SEQ ID NO: 363085 - protein, 20 aa, Mycobacterium
LWRLAIYVVVSVLGMFTLVA

SEQ ID NO: 363086 - protein, 17 aa, Mycobacterium
LWRLCGSTAIGLLLLIL

SEQ ID NO: 363087 - protein, 26 aa, Mycobacterium
LWRQLVGGSYLWWALAVIVAIGTVTL

SEQ ID NO: 363088 - protein, 22 aa, Mycobacterium
LWSLFWEVMCYLVVAIIGVAGL

SEQ ID NO: 363089 - protein, 34 aa, Mycobacterium
LWSVALIIGLLALFGGMMWISFASGARSFTGAGS

SEQ ID NO: 363090 - protein, 25 aa, Mycobacterium
LWSVIPKLFVWPPARSIATLLERLS

SEQ ID NO: 363091 - protein, 26 aa, Mycobacterium
LWVAIAVVAVLLVVAIVVGLVRYRRR

SEQ ID NO: 363092 - protein, 20 aa, Mycobacterium
LWVATAVAVFVLIPAGILGG

SEQ ID NO: 363093 - protein, 17 aa, Mycobacterium
LWVCLAIIAFVIAPTSV

SEQ ID NO: 363094 - protein, 26 aa, Mycobacterium
LWVGPMLVYILLPLLDLGFGPDGQNP

SEQ ID NO: 363095 - protein, 17 aa, Mycobacterium
LWVLRLAATAAVAIGTL

SEQ ID NO: 363096 - protein, 24 aa, Mycobacterium
LWWALLLVVGFWGVLRVSEALGIG

SEQ ID NO: 363097 - protein, 19 aa, Mycobacterium
LWWRHLISFLIAPVTMTLV

SEQ ID NO: 363098 - protein, 23 aa, Mycobacterium
LWWRHLMSVLLFPATMTLVVPAL

SEQ ID NO: 363099 - protein, 18 aa, Mycobacterium
LYAFLAAGLIGLYQFFGF

SEQ ID NO: 363100 - protein, 17 aa, Mycobacterium
LYAFLCATALVVVRTEE

SEQ ID NO: 363101 - protein, 25 aa, Mycobacterium
LYAQFRGAFIPKTKLTMLAPRAGLV

SEQ ID NO: 363102 - protein, 17 aa, Mycobacterium
LYCDVAILIGICVVTTT

SEQ ID NO: 363103 - protein, 26 aa, Mycobacterium
LYDDRRIKLWVVFVEDFSGQNYIGWA

SEQ ID NO: 363104 - protein, 25 aa, Mycobacterium
LYDQQHVRLWVVYVKDFEGTDPTAW

SEQ ID NO: 363105 - protein, 23 aa, Mycobacterium
LYEGELFVCGRSKDLIIVRGVNC

SEQ ID NO: 363106 - protein, 18 aa, Mycobacterium
LYEHSVTMMLIASAILMA

SEQ ID NO: 363107 - protein, 22 aa, Mycobacterium
LYESFLGADYRPVALTAGSRAL

SEQ ID NO: 363108 - protein, 25 aa, Mycobacterium
LYGAVLAWFAPPVLRRLTGGGVSPS

SEQ ID NO: 363109 - protein, 20 aa, Mycobacterium
LYGAVLAWLAPPVLRRLTGG

SEQ ID NO: 363110 - protein, 18 aa, Mycobacterium
LYGGIFVVAFSLSQFDAA

SEQ ID NO: 363111 - protein, 21 aa, Mycobacterium
LYGILVLAIIAVFVGGLLVGR

SEQ ID NO: 363112 - protein, 28 aa, Mycobacterium
LYGMVNTLFIPRFLLVVSFGGVVVATAS

SEQ ID NO: 363113 - protein, 27 aa, Mycobacterium
LYGTAAVYYWVICLVLSFGQARFEHRL

SEQ ID NO: 363114 - protein, 27 aa, Mycobacterium
LYGTAAVYYWVICLVLSFGQSRIERRL

SEQ ID NO: 363115 - protein, 32 aa, Mycobacterium
LYGYIVILVIIVAYFLHIPFALRTKRFLAAHP

SEQ ID NO: 363116 - protein, 19 aa, Mycobacterium
LYHLSTDWQTYFGEGGAGL

SEQ ID NO: 363117 - protein, 20 aa, Mycobacterium
LYIIVAVGGTYFLGSGIVRG

SEQ ID NO: 363118 - protein, 25 aa, Mycobacterium
LYLIDAITCLAPIWATFRLTPMPVG

SEQ ID NO: 363119 - protein, 21 aa, Mycobacterium
LYLLFAALGFGWRSWSQHRRT

SEQ ID NO: 363120 - protein, 18 aa, Mycobacterium
LYMSFQRWDLFTPPKFVG

SEQ ID NO: 363121 - protein, 18 aa, Mycobacterium
LYMSFQRWDVFTPPKFVG

SEQ ID NO: 363122 - protein, 27 aa, Mycobacterium
LYNGRCGVALFFAALEKVAPDLGFGES

SEQ ID NO: 363123 - protein, 17 aa, Mycobacterium
LYNGWRPALYAAVKALA

SEQ ID NO: 363124 - protein, 25 aa, Mycobacterium
LYNQRGIGLWVVYVKDFGGLTPAKW

SEQ ID NO: 363125 - protein, 27 aa, Mycobacterium
LYPNGAQWVVAMLAAARIGAVVVPFST

SEQ ID NO: 363126 - protein, 18 aa, Mycobacterium
LYPPAFAAATQWFGTVRA

SEQ ID NO: 363127 - protein, 26 aa, Mycobacterium
LYQREPLLILAYAVLLIPLAVGSVRA

SEQ ID NO: 363128 - protein, 25 aa, Mycobacterium
LYQVQPLMLIAPAGALFVTVLGFNI

SEQ ID NO: 363129 - protein, 20 aa, Mycobacterium
LYQWREVIPARWPLVGVSVV

SEQ ID NO: 363130 - protein, 19 aa, Mycobacterium
LYRANMPGPFLFPGEDLPQ

SEQ ID NO: 363131 - protein, 17 aa, Mycobacterium
LYRLVTSAFLHYGATHL

SEQ ID NO: 363132 - protein, 24 aa, Mycobacterium
LYRRDDLMRISRHPAVLGPGGRGG

SEQ ID NO: 363133 - protein, 18 aa, Mycobacterium
LYRRIGASVVRWPKPILV

SEQ ID NO: 363134 - protein, 17 aa, Mycobacterium
LYRVSLPKPLPTHRLLT

SEQ ID NO: 363135 - protein, 18 aa, Mycobacterium
LYTERHVRLWVVYVDDFS

SEQ ID NO: 363136 - protein, 24 aa, Mycobacterium
LYVIRFMIDIYLTQRFIIAWRMWL

SEQ ID NO: 363137 - protein, 18 aa, Mycobacterium
LYVTLLVGGLVLLASIVA

SEQ ID NO: 363138 - protein, 18 aa, Mycobacterium
LYYDTLAEIWFATEAAAQ

SEQ ID NO: 363139 - protein, 21 aa, Mycobacterium
LYYGLPMWLIMTLRVTIIVLG

SEQ ID NO: 363140 - protein, 18 aa, Mycobacterium
LYYLQRCLHLAPLWAGVA

SEQ ID NO: 363141 - protein, 18 aa, Mycobacterium
MAAFVVWADVALAVGAAL

SEQ ID NO: 363142 - protein, 19 aa, Mycobacterium
MAAIVVTIPLYVACLAVSY

SEQ ID NO: 363143 - protein, 30 aa, Mycobacterium
MAALGDKAWWIPAWLDRLLPDLDIEGDALQ

SEQ ID NO: 363144 - protein, 33 aa, Mycobacterium
MAALMASLLIFRPLTPYLPLGISLFVVGVGLGL

SEQ ID NO: 363145 - protein, 17 aa, Mycobacterium
MAALVLVIVTSVSMVFG

SEQ ID NO: 363146 - protein, 22 aa, Mycobacterium
MAAVQLARLWGLEVFATASPGK

SEQ ID NO: 363147 - protein, 23 aa, Mycobacterium
MACILGFLLAGVAYLAYATHATP

SEQ ID NO: 363148 - protein, 28 aa, Mycobacterium
MADFANLFPFQLFLVLYGLPVADRDRLI

SEQ ID NO: 363149 - protein, 28 aa, Mycobacterium
MADFARLYPYQVFMDLYGLPLEDRDRVI

SEQ ID NO: 363150 - protein, 20 aa, Mycobacterium
MADGWVDRGRLVCPWHGSWF

SEQ ID NO: 363151 - protein, 30 aa, Mycobacterium
MADLDLALPINQPPPCLTGFIPASEWRSPA

SEQ ID NO: 363152 - protein, 25 aa, Mycobacterium
MADSVPVLLIGRIFSGLSAGIFTGT

SEQ ID NO: 363153 - protein, 24 aa, Mycobacterium
MADTDLLRLVPGLAGGARKLSVLG

SEQ ID NO: 363154 - protein, 19 aa, Mycobacterium
MAFALLAALFWAGYIVVGK

SEQ ID NO: 363155 - protein, 17 aa, Mycobacterium
MAFIYNLVTTIAQMVYA

SEQ ID NO: 363156 - protein, 20 aa, Mycobacterium
MAFLLRGLLLGRHLRVLLIV

SEQ ID NO: 363157 - protein, 35 aa, Mycobacterium
MAFVLLRRIPTWQPWLRWVLLIGGLVVAIALTLGV

SEQ ID NO: 363158 - protein, 19 aa, Mycobacterium
MAFVRRSGIYFGFAIGLVQ

SEQ ID NO: 363159 - protein, 18 aa, Mycobacterium
MAGAIVIIPLYAMAILLS

SEQ ID NO: 363160 - protein, 20 aa, Mycobacterium
MAGAPWLVYYARALGNRVGS

SEQ ID NO: 363161 - protein, 31 aa, Mycobacterium
MAGASLTLAVLLFRLMWRGWRARAQRQTDVV

SEQ ID NO: 363162 - protein, 22 aa, Mycobacterium
MAGLLVSLLVRRRRVWVRITPA

SEQ ID NO: 363163 - protein, 31 aa, Mycobacterium
MAGPLGLCYLPAFLCLGIVPVVAGLAGDVLQ

SEQ ID NO: 363164 - protein, 31 aa, Mycobacterium
MAGRYFPPMGSILYWLRPGTIRLPPWPNRVP

SEQ ID NO: 363165 - protein, 21 aa, Mycobacterium
MAGYLPLFTVLALHGDWLHAL

SEQ ID NO: 363166 - protein, 28 aa, Mycobacterium
MAIARAFTVLFLPYSLLGPFAGALMDRW

SEQ ID NO: 363167 - protein, 20 aa, Mycobacterium
MAIGLIDDRWGLDALTKFAG

SEQ ID NO: 363168 - protein, 21 aa, Mycobacterium
MAITILLIHTYFGYFASGGPA

SEQ ID NO: 363169 - protein, 20 aa, Mycobacterium
MAKLFLFDLGTLDGIFRVVV

SEQ ID NO: 363170 - protein, 29 aa, Mycobacterium
MALACFTVPPRSVWWWPCVAVIGATVLLM

SEQ ID NO: 363171 - protein, 25 aa, Mycobacterium
MALAPLYYQLHVMIALALFAIWPFT

SEQ ID NO: 363172 - protein, 18 aa, Mycobacterium
MALAWRWGGTVKAFVISC

SEQ ID NO: 363173 - protein, 19 aa, Mycobacterium
MALAWWQWTRFESNSGTFQ

SEQ ID NO: 363174 - protein, 17 aa, Mycobacterium
MALERLIVAAGAAVIPL

SEQ ID NO: 363175 - protein, 25 aa, Mycobacterium
MALFAMFALPPLFGALRRGSDRAKI

SEQ ID NO: 363176 - protein, 21 aa, Mycobacterium
MALIIAYIFRPAGLGVVFGLA

SEQ ID NO: 363177 - protein, 17 aa, Mycobacterium
MALLIAGVAARGPGRRR

SEQ ID NO: 363178 - protein, 17 aa, Mycobacterium
MALLIRAELTTPGLAFL

SEQ ID NO: 363179 - protein, 19 aa, Mycobacterium
MALLLLACLPLNGLVTMAA

SEQ ID NO: 363180 - protein, 21 aa, Mycobacterium
MALLRGLLALSGAPPAMASTA

SEQ ID NO: 363181 - protein, 24 aa, Mycobacterium
MALSRILLGVHYPSDVAAGIAVGA

SEQ ID NO: 363182 - protein, 24 aa, Mycobacterium
MALSRILLGVHYPSDVAAGVALGA

SEQ ID NO: 363183 - protein, 22 aa, Mycobacterium
MALTCWWLISREVIPRLGHAVK

SEQ ID NO: 363184 - protein, 24 aa, Mycobacterium
MALTLFHWGLHAWAIYVVVGLGMA

SEQ ID NO: 363185 - protein, 19 aa, Mycobacterium
MAMPLHFSGWEILVAALTT

SEQ ID NO: 363186 - protein, 17 aa, Mycobacterium
MAMVLLRERISGLAAVG

SEQ ID NO: 363187 - protein, 19 aa, Mycobacterium
MAMWLVLWVLYLSIVNVGQ

SEQ ID NO: 363188 - protein, 26 aa, Mycobacterium
MANFDDFYRPLRNYLYWEKHCFDIPM

SEQ ID NO: 363189 - protein, 24 aa, Mycobacterium
MANPVFIPRFLFSMSVVGVLVATS

SEQ ID NO: 363190 - protein, 26 aa, Mycobacterium
MAPALLITIFIYWGFDTAVACNEETD

SEQ ID NO: 363191 - protein, 24 aa, Mycobacterium
MAPATPVWRLAVPIAFLGVGMVFA

SEQ ID NO: 363192 - protein, 31 aa, Mycobacterium
MAPLIFGCVLMWILAWLTATPVRVVRAALAR

SEQ ID NO: 363193 - protein, 17 aa, Mycobacterium
MAPLLILRIMRAPVSAL

SEQ ID NO: 363194 - protein, 17 aa, Mycobacterium
MAPLPIVAALLTPIIGK

SEQ ID NO: 363195 - protein, 20 aa, Mycobacterium
MAPNPLAVAGFLLLFTAIEL

SEQ ID NO: 363196 - protein, 25 aa, Mycobacterium
MAQGFGYLLAGFGPFLFGLLHDVTG

SEQ ID NO: 363197 - protein, 28 aa, Mycobacterium
MARFPVAVAAAVALYLASAAQLPAAWAH

SEQ ID NO: 363198 - protein, 17 aa, Mycobacterium
MARGWPVLTFSRPVSLG

SEQ ID NO: 363199 - protein, 22 aa, Mycobacterium
MARLRLIGIGVPLAIGVLAGFV

SEQ ID NO: 363200 - protein, 19 aa, Mycobacterium
MARYWSEPEPRWPRSEPIA

SEQ ID NO: 363201 - protein, 18 aa, Mycobacterium
MASWAPWSSAGPAPKRGL

SEQ ID NO: 363202 - protein, 27 aa, Mycobacterium
MATAAQLLYLRVPALNALFPDYRGSVL

SEQ ID NO: 363203 - protein, 26 aa, Mycobacterium
MATGSLVLLVLLSGIALLVSRQVVVP

SEQ ID NO: 363204 - protein, 31 aa, Mycobacterium
MATLLAVSTTLLRFAYRHPPGMTWLDALYFS

SEQ ID NO: 363205 - protein, 31 aa, Mycobacterium
MATLVFGFVLMWILAWLTATPVRVVRAALQR

SEQ ID NO: 363206 - protein, 27 aa, Mycobacterium
MATVSQLLYLRVPALNALFPDYRGSVL

SEQ ID NO: 363207 - protein, 18 aa, Mycobacterium
MATYLSRDWARDWGSLRK

SEQ ID NO: 363208 - protein, 31 aa, Mycobacterium
MAVDPGTPTWRRLLDDLSYEPLVSPLRGPAH

SEQ ID NO: 363209 - protein, 32 aa, Mycobacterium
MAVHFLIVGYLFYWAIIGIDPGPRRLPYPGRI

SEQ ID NO: 363210 - protein, 33 aa, Mycobacterium
MAVHFLIVGYLFYWAIIGIDPGPRRLPYPGRIG

SEQ ID NO: 363211 - protein, 23 aa, Mycobacterium
MAVIITMWTWNEFLLPLVMVVSD

SEQ ID NO: 363212 - protein, 34 aa, Mycobacterium
MAVKLAILAIIFIPLERLFALRPLHVLRRGWRTD

SEQ ID NO: 363213 - protein, 20 aa, Mycobacterium
MAVLGIPMLLGPIGGPILGG

SEQ ID NO: 363214 - protein, 27 aa, Mycobacterium
MAVLMPVGLIGWPLLAGAFGAAVVVSR

SEQ ID NO: 363215 - protein, 23 aa, Mycobacterium
MAVLTFLVPFAPTPVLSGLFRVI

SEQ ID NO: 363216 - protein, 30 aa, Mycobacterium
MAVLTYHIAKPWRWGYLGVLFVIFGFPLIT

SEQ ID NO: 363217 - protein, 30 aa, Mycobacterium
MAVLTYHIVKPWRWGYLAVLLVIFGFPLLT

SEQ ID NO: 363218 - protein, 25 aa, Mycobacterium
MAVPVMLQRILALADLDRRDARQLS

SEQ ID NO: 363219 - protein, 31 aa, Mycobacterium
MAVVVLFVPAALPWYYTWPLAVIAALAQSRR

SEQ ID NO: 363220 - protein, 17 aa, Mycobacterium
MAYAAGVDFYRMACDEV

SEQ ID NO: 363221 - protein, 47 aa, Mycobacterium
MAYPWHSRRDYWLIGIAAFVVIVLFAWWRGLYLTTILHRRVAMMRRR

SEQ ID NO: 363222 - protein, 18 aa, Mycobacterium
MCAGWLGFNGVFYGLLTW

SEQ ID NO: 363223 - protein, 19 aa, Mycobacterium
MCSAATMYSPARVTFFCIG

SEQ ID NO: 363224 - protein, 20 aa, Mycobacterium
MCVALVAYFVMLGRLAFAMI

SEQ ID NO: 363225 - protein, 33 aa, Mycobacterium
MCWPTAPRWVGVPLYLLLGWVAVWYTATILHNA

SEQ ID NO: 363226 - protein, 19 aa, Mycobacterium
MDAALLLAALAARAGDHVD

SEQ ID NO: 363227 - protein, 18 aa, Mycobacterium
MDANAALRWSLIAGASCN

SEQ ID NO: 363228 - protein, 24 aa, Mycobacterium
MDDVRALFDAIINDDPLPGEKNPD

SEQ ID NO: 363229 - protein, 30 aa, Mycobacterium
MDDWRDRVLAAMVLLFFATAALLGILTRRA

SEQ ID NO: 363230 - protein, 18 aa, Mycobacterium
MDDWRDRVLAAMVLVFFA

SEQ ID NO: 363231 - protein, 23 aa, Mycobacterium
MDGKMHRHWGFGGGPHRCLGSHL

SEQ ID NO: 363232 - protein, 22 aa, Mycobacterium
MDGKVHRHWGFGGGPHRCLGSH

SEQ ID NO: 363233 - protein, 34 aa, Mycobacterium
MDGYEAMRRIRAEPRWRHLPIVALTAKAMKGDRQ

SEQ ID NO: 363234 - protein, 36 aa, Mycobacterium
MDIRSVSWLPLYHDMGLIMILFPPLCGGHITLMSPL

SEQ ID NO: 363235 - protein, 32 aa, Mycobacterium
MDLRPHALLSRVPFVVLVIGSLGVGLGLTLWL

SEQ ID NO: 363236 - protein, 29 aa, Mycobacterium
MDLVTRPSTFLWLIVLAGTLLTVTGRMDP

SEQ ID NO: 363237 - protein, 19 aa, Mycobacterium
MDNPLLGDLLLDAPTVMGV

SEQ ID NO: 363238 - protein, 22 aa, Mycobacterium
MDPQQRLMLEVSWEALERSGID

SEQ ID NO: 363239 - protein, 18 aa, Mycobacterium
MDQLMRFMTNPLGTLQDM

SEQ ID NO: 363240 - protein, 24 aa, Mycobacterium
MDRFGVRPVLTVSLLLITTGSALS

SEQ ID NO: 363241 - protein, 24 aa, Mycobacterium
MDRIAAYERYWLYPGAENLAVFRA

SEQ ID NO: 363242 - protein, 27 aa, Mycobacterium
MDRIAAYERYWLYPGAKNLATFRAHLE

SEQ ID NO: 363243 - protein, 19 aa, Mycobacterium
MDRIGAYERYWLYPGAQNL

SEQ ID NO: 363244 - protein, 17 aa, Mycobacterium
MDRYGRRLIAVPSLVVI

SEQ ID NO: 363245 - protein, 21 aa, Mycobacterium
MDSFYLPLLVRRRITFLAKAE

SEQ ID NO: 363246 - protein, 23 aa, Mycobacterium
MDSNYRWFHPAPSTLAAAVGSPR

SEQ ID NO: 363247 - protein, 23 aa, Mycobacterium
MDSNYRWFHPAPTTLAAAVGSPR

SEQ ID NO: 363248 - protein, 20 aa, Mycobacterium
MDTARLHDEWKFQPAFTAEE

SEQ ID NO: 363249 - protein, 28 aa, Mycobacterium
MDTKTLSPPYSILAIGDPPTLAAAMNIP

SEQ ID NO: 363250 - protein, 34 aa, Mycobacterium
MDTLISLGTVSAFLWSLYALFFGTAGTPGMKHPF

SEQ ID NO: 363251 - protein, 19 aa, Mycobacterium
MDTLLTTGIFLFLGGMAAA

SEQ ID NO: 363252 - protein, 26 aa, Mycobacterium
MDTYGWRIPFLIAAPLGLVGLYIRLR

SEQ ID NO: 363253 - protein, 23 aa, Mycobacterium
MDYEVFLLSRIREYWLESPRTPA

SEQ ID NO: 363254 - protein, 18 aa, Mycobacterium
MDYEVFLVSRIREFWLQS

SEQ ID NO: 363255 - protein, 19 aa, Mycobacterium
MDYEVFLVSRIREYWLASQ

SEQ ID NO: 363256 - protein, 24 aa, Mycobacterium
MDYIKTGFLASLPFIAALVGVLFS

SEQ ID NO: 363257 - protein, 24 aa, Mycobacterium
MEDPIKFSTLYISGPYVPPATAET

SEQ ID NO: 363258 - protein, 26 aa, Mycobacterium
MEIVAALLIALRPWWPRVSAAGSALA

SEQ ID NO: 363259 - protein, 19 aa, Mycobacterium
MELGAGAALFTRFCYDTGA

SEQ ID NO: 363260 - protein, 19 aa, Mycobacterium
MELPPYRFPSLNNVLITMW

SEQ ID NO: 363261 - protein, 23 aa, Mycobacterium
MEPDTPVWRLVLPFCAIGVGMAF

SEQ ID NO: 363262 - protein, 17 aa, Mycobacterium
MEPPPRPSQLRPGRVPA

SEQ ID NO: 363263 - protein, 23 aa, Mycobacterium
MERAPGRFALLQALSAGAIGAGT

SEQ ID NO: 363264 - protein, 19 aa, Mycobacterium
MERFRKLLSDVMFVAGIGA

SEQ ID NO: 363265 - protein, 17 aa, Mycobacterium
MERLLILSLGLGGQVGA

SEQ ID NO: 363266 - protein, 17 aa, Mycobacterium
MESVFPALFGAGAVLVR

SEQ ID NO: 363267 - protein, 18 aa, Mycobacterium
MFAFAIKAPLWPLHRWLP

SEQ ID NO: 363268 - protein, 19 aa, Mycobacterium
MFAFAVKAPLWPFHRWLPD

SEQ ID NO: 363269 - protein, 30 aa, Mycobacterium
MFAFAVKAPLWPLHTWLPDAAVHATPSSAV

SEQ ID NO: 363270 - protein, 17 aa, Mycobacterium
MFALAWLLLPDLPEYRT

SEQ ID NO: 363271 - protein, 20 aa, Mycobacterium
MFDAGYFWHYNELWIGGAAG

SEQ ID NO: 363272 - protein, 24 aa, Mycobacterium
MFDDELYIIGRIKDLLIVDGRNHY

SEQ ID NO: 363273 - protein, 18 aa, Mycobacterium
MFDDPLQFYSRSIALGIV

SEQ ID NO: 363274 - protein, 38 aa, Mycobacterium
MFEPIRLGLVVLLLSRRRPLVQLLVFLGGGFAMGVGAG

SEQ ID NO: 363275 - protein, 18 aa, Mycobacterium
MFFNIAAFGLALAWLATI

SEQ ID NO: 363276 - protein, 18 aa, Mycobacterium
MFFVLRRAVIRQAVAEGV

SEQ ID NO: 363277 - protein, 25 aa, Mycobacterium
MFGADLRSTLLRAMTFMIVASPCAV

SEQ ID NO: 363278 - protein, 23 aa, Mycobacterium
MFGADVWWLAALGAPLLTGVVAL

SEQ ID NO: 363279 - protein, 26 aa, Mycobacterium
MFGGWSDVLGRRPLLLTGAGFAILSS

SEQ ID NO: 363280 - protein, 18 aa, Mycobacterium
MFGILWAMSIVVLMAPAA

SEQ ID NO: 363281 - protein, 25 aa, Mycobacterium
MFGSPYAIFLLREHFRMIPNDLVNA

SEQ ID NO: 363282 - protein, 23 aa, Mycobacterium
MFGTIYLVIILAASLAAIPLMIV

SEQ ID NO: 363283 - protein, 20 aa, Mycobacterium
MFGVFIGLTTVFFGFGGGFV

SEQ ID NO: 363284 - protein, 32 aa, Mycobacterium
MFIVEMVIFTIFLAALTFSPNFVALLSFLFGA

SEQ ID NO: 363285 - protein, 30 aa, Mycobacterium
MFKLPFPWREFLLQTWFVARVSIIPTLLLT

SEQ ID NO: 363286 - protein, 18 aa, Mycobacterium
MFLIHDSPGYLWAGLALL

SEQ ID NO: 363287 - protein, 19 aa, Mycobacterium
MFLSQLPYVPLGTLRTVVC

SEQ ID NO: 363288 - protein, 18 aa, Mycobacterium
MFMGLTAVLLARRGSTSP

SEQ ID NO: 363289 - protein, 24 aa, Mycobacterium
MFNRAGIFLGPLIGLAFVTSNFRM

SEQ ID NO: 363290 - protein, 17 aa, Mycobacterium
MFPVLVYVYARLARSEE

SEQ ID NO: 363291 - protein, 28 aa, Mycobacterium
MFRMPIFTWNILVTSILVLIAFPLLTAA

SEQ ID NO: 363292 - protein, 28 aa, Mycobacterium
MFRMPIFTWNILVTSILVLIAFPPLTAA

SEQ ID NO: 363293 - protein, 22 aa, Mycobacterium
MFRMPIFTWNILVTSILVLLAF

SEQ ID NO: 363294 - protein, 37 aa, Mycobacterium
MFRMPIFTWNILVTSILVLLIFPLLTAALFGLAADRH

SEQ ID NO: 363295 - protein, 17 aa, Mycobacterium
MFSIVPFVFEPKSTAVQ

SEQ ID NO: 363296 - protein, 28 aa, Mycobacterium
MFSMHMIAHMLLSMLVPILLVLGAPVTM

SEQ ID NO: 363297 - protein, 23 aa, Mycobacterium
MFTDLPAWFHPGVALASSVGAVP

SEQ ID NO: 363298 - protein, 18 aa, Mycobacterium
MFVIGFLASFLALQTSAS

SEQ ID NO: 363299 - protein, 17 aa, Mycobacterium
MFVLSRWDLGTDPLDVL

SEQ ID NO: 363300 - protein, 25 aa, Mycobacterium
MFVRDTWVLALLYVGTFGTFIGFSF

SEQ ID NO: 363301 - protein, 18 aa, Mycobacterium
MFVVLLSALTIASFVYAI

SEQ ID NO: 363302 - protein, 18 aa, Mycobacterium
MGAFLFLGGMAAASCNTA

SEQ ID NO: 363303 - protein, 18 aa, Mycobacterium
MGAIISIFNALPFRMESP

SEQ ID NO: 363304 - protein, 18 aa, Mycobacterium
MGALLFLGGMAAASCNPA

SEQ ID NO: 363305 - protein, 26 aa, Mycobacterium
MGAVSILFYVLFTLVSRNLLSALIGS

SEQ ID NO: 363306 - protein, 28 aa, Mycobacterium
MGDDAMFSLLAFWFFAAGWAASKATSAW

SEQ ID NO: 363307 - protein, 30 aa, Mycobacterium; identical to SEQ ID NO: 24559

SEQ ID NO: 363308 - protein, 24 aa, Mycobacterium
MGEIFTVFFGVVLAGAVGLSQGDT

SEQ ID NO: 363309 - protein, 19 aa, Mycobacterium
MGFLVLIVLLIFIAQNTTS

SEQ ID NO: 363310 - protein, 29 aa, Mycobacterium
MGGAGFMVLFAFPFFWLAGANSGWTLLIA

SEQ ID NO: 363311 - protein, 24 aa, Mycobacterium
MGGIPMFLMVWLLSAYAILVLSPR

SEQ ID NO: 363312 - protein, 31 aa, Mycobacterium
MGHARPLYGPGLRFLIPFVDKMIRVDQRLVT

SEQ ID NO: 363313 - protein, 19 aa, Mycobacterium
MGIDPWYITDATLTGLWAR

SEQ ID NO: 363314 - protein, 33 aa, Mycobacterium
MGLGLSLTGSLLRLPRLPDLVAVPPTLIDHLPR

SEQ ID NO: 363315 - protein, 23 aa, Mycobacterium
MGLIFIVMLGITRALAASAVIVG

SEQ ID NO: 363316 - protein, 22 aa, Mycobacterium
MGLIFVLLIVYPFLEKRFTGDY

SEQ ID NO: 363317 - protein, 18 aa, Mycobacterium
MGLLSTVLTYSVENSKKA

SEQ ID NO: 363318 - protein, 22 aa, Mycobacterium
MGLLVDDLLTLARLDVQRPLER

SEQ ID NO: 363319 - protein, 24 aa, Mycobacterium
MGMYLPISLTLVIPVGAVLGRIYD

SEQ ID NO: 363320 - protein, 27 aa, Mycobacterium
MGPFAHSLFTTMFALGVWFALHRRTRL

SEQ ID NO: 363321 - protein, 26 aa, Mycobacterium
MGPLTRLTARWRLPAVIQLAVRSLTR

SEQ ID NO: 363322 - protein, 25 aa, Mycobacterium
MGQLVEDLLLLARLDAHRPMEQRLV

SEQ ID NO: 363323 - protein, 26 aa, Mycobacterium
MGQQIRRLILFLIERLNRVAPKRVSA

SEQ ID NO: 363324 - protein, 32 aa, Mycobacterium
MGRLAFYPLALVPFGSLIWVLARWPGNSPGVR

SEQ ID NO: 363325 - protein, 17 aa, Mycobacterium
MGRTMMVWLLGSGGPLV

SEQ ID NO: 363326 - protein, 24 aa, Mycobacterium
MGSVTLLLGGCRFAKEHLSAAPVA

SEQ ID NO: 363327 - protein, 17 aa, Mycobacterium
MGTAIMVVGFLLLSRMD

SEQ ID NO: 363328 - protein, 23 aa, Mycobacterium
MGVAETFLLLALAKQVFGLDQDL

SEQ ID NO: 363329 - protein, 23 aa, Mycobacterium
MGVAWSMIYIPFGGVGTIVLDQM

SEQ ID NO: 363330 - protein, 17 aa, Mycobacterium
MGVLCYRHRIRVALAAC

SEQ ID NO: 363331 - protein, 25 aa, Mycobacterium
MGVLIIMVMVCWLLLAVLRGRLHPI

SEQ ID NO: 363332 - protein, 24 aa, Mycobacterium
MGVPLEWNVFMIFGVLALFVSHAN

SEQ ID NO: 363333 - protein, 23 aa, Mycobacterium
MGVVHLKWYDYPLTAVVSLIVLF

SEQ ID NO: 363334 - protein, 24 aa, Mycobacterium
MGVVTVLWVLYGYSIAFGDDVGNF

SEQ ID NO: 363335 - protein, 24 aa, Mycobacterium
MGVVTVLWVLYGYSVAFGNDMGGV

SEQ ID NO: 363336 - protein, 20 aa, Mycobacterium
MGYLAISLWAVRDVAVRAAD

SEQ ID NO: 363337 - protein, 18 aa, Mycobacterium
MHEPLVLAALLQLLSAVA

SEQ ID NO: 363338 - protein, 17 aa, Mycobacterium
MHFVWDAPLPDDYDGPL

SEQ ID NO: 363339 - protein, 28 aa, Mycobacterium
MHGRVLLTPLFCLLAPVSVIPLLLPDGR

SEQ ID NO: 363340 - protein, 19 aa, Mycobacterium
MHLDAGQQVWLITATPYEL

SEQ ID NO: 363341 - protein, 17 aa, Mycobacterium
MHLDAGQQVWLVTATPR

SEQ ID NO: 363342 - protein, 19 aa, Mycobacterium
MHLWFLAVYVVLAALTPIA

SEQ ID NO: 363343 - protein, 20 aa, Mycobacterium
MHPSFLYEIGFQLAAFAVLL

SEQ ID NO: 363344 - protein, 17 aa, Mycobacterium
MHRPPVNFLLAPAILSA

SEQ ID NO: 363345 - protein, 28 aa, Mycobacterium
MHTWGWRIPFLVALPMGLIGWYLRSRLD

SEQ ID NO: 363346 - protein, 41 aa, Mycobacterium
MHWAAFRALLVLTVIVGLGYPLLVWLVAQLPGLRDKADGSI

SEQ ID NO: 363347 - protein, 20 aa, Mycobacterium
MHWSVPGLTFVILVAVGADY

SEQ ID NO: 363348 - protein, 21 aa, Mycobacterium
MHYQQVFLTLLIPVAVCIAAV

SEQ ID NO: 363349 - protein, 19 aa, Mycobacterium
MIAAGLWMAPGGLAMMVAA

SEQ ID NO: 363350 - protein, 25 aa, Mycobacterium
MIAGTPVFWILLAGVLLCNLYHSVT

SEQ ID NO: 363351 - protein, 23 aa, Mycobacterium
MIAKFFLCFAIIQQIVDFTQNIA

SEQ ID NO: 363352 - protein, 21 aa, Mycobacterium
MIALVLFCLWPFTRLVHVFSA

SEQ ID NO: 363353 - protein, 18 aa, Mycobacterium
MIAWVCIAASLVGVILLI

SEQ ID NO: 363354 - protein, 19 aa, Mycobacterium
MIFAAVPWLQRFGELVAPL

SEQ ID NO: 363355 - protein, 25 aa, Mycobacterium
MIFGELVPKNFALARPVWTSRATSG

SEQ ID NO: 363356 - protein, 33 aa, Mycobacterium
MIGALADWFAVTALFKHPLGIPIPHTAIIKRKK

SEQ ID NO: 363357 - protein, 24 aa, Mycobacterium
MIGFLAVPGLFALAALWLTRGGRI

SEQ ID NO: 363358 - protein, 17 aa, Mycobacterium
MIGGFPILSVIGFIVMF

SEQ ID NO: 363359 - protein, 20 aa, Mycobacterium
MIGIAVCVVLVLVIRGRTMP

SEQ ID NO: 363360 - protein, 17 aa, Mycobacterium
MIGLIIAVIWGLSTDYE

SEQ ID NO: 363361 - protein, 22 aa, Mycobacterium
MIGMIYIWMPLAMGSIARWTMG

SEQ ID NO: 363362 - protein, 22 aa, Mycobacterium
MIGQLAQWLLSLVGLAYLVWDY

SEQ ID NO: 363363 - protein, 20 aa, Mycobacterium
MIGVPWLLSFAQPTIWVISR

SEQ ID NO: 363364 - protein, 31 aa, Mycobacterium
MIHRLAVPIVLLWIGLVVVLSIFVPSLEQVG

SEQ ID NO: 363365 - protein, 24 aa, Mycobacterium
MIKIRGWRRIGTVVVRWPGPVLAA

SEQ ID NO: 363366 - protein, 25 aa, Mycobacterium
MIKTRGWRRIGTATVRWPGPVFAAS

SEQ ID NO: 363367 - protein, 17 aa, Mycobacterium
MILGAFVAALFADVSPL

SEQ ID NO: 363368 - protein, 17 aa, Mycobacterium
MILIRAPEDLRTSANIG

SEQ ID NO: 363369 - protein, 17 aa, Mycobacterium
MILLYPLAVVWPSGWAW

SEQ ID NO: 363370 - protein, 18 aa, Mycobacterium
MILRARYPNIFRSAPARL

SEQ ID NO: 363371 - protein, 29 aa, Mycobacterium
MIMMSFISIPLVTVAWLLAGYSLAFSDGA

SEQ ID NO: 363372 - protein, 19 aa, Mycobacterium
MIPISIVWFGIGENSKYFL

SEQ ID NO: 363373 - protein, 23 aa, Mycobacterium
MISFTTILWNLSGPVTLPFIGYE

SEQ ID NO: 363374 - protein, 23 aa, Mycobacterium
MISLTYFPPLWRKVMDHRVLAHY

SEQ ID NO: 363375 - protein, 24 aa, Mycobacterium
MISLTYVPPLWRKVMDHRVLEHYD

SEQ ID NO: 363376 - protein, 25 aa, Mycobacterium
MISRPRPGPSLLAYWIGGLTVCVPE

SEQ ID NO: 363377 - protein, 27 aa, Mycobacterium
MITKFAPLNWFWPAVSLVVLQALASLA

SEQ ID NO: 363378 - protein, 20 aa, Mycobacterium
MITVLLPPVLVLTWSGLRAA

SEQ ID NO: 363379 - protein, 25 aa, Mycobacterium
MITVLLPPVLVLTWSGLRAADRPDA

SEQ ID NO: 363380 - protein, 26 aa, Mycobacterium
MITVLLPPVLVLTWSGLRAGAPPAAE

SEQ ID NO: 363381 - protein, 20 aa, Mycobacterium
MIVALFATGMRLISPQTLFF

SEQ ID NO: 363382 - protein, 40 aa, Mycobacterium
MIVALFATGMRLISPTMLFFPFVLLLAATALYRGGDNKMR

SEQ ID NO: 363383 - protein, 18 aa, Mycobacterium
MIVFFGALFGRTALILAV

SEQ ID NO: 363384 - protein, 25 aa, Mycobacterium
MIVPATIAMYTPYGQPASVAIQAGA

SEQ ID NO: 363385 - protein, 38 aa, Mycobacterium
MIVRSLVVPCLLRLLGPWFWWPTFIRQRPLRTPDRFAR

SEQ ID NO: 363386 - protein, 29 aa, Mycobacterium
MIVSLFIVAFLFITQTWLASLLAGGREAF

SEQ ID NO: 363387 - protein, 17 aa, Mycobacterium
MIVSVLTLMIRYIDVLA

SEQ ID NO: 363388 - protein, 17 aa, Mycobacterium
MIWAFGYNVAAIPIAAA

SEQ ID NO: 363389 - protein, 17 aa, Mycobacterium
MIWVRLRAPWAKGLVEF

SEQ ID NO: 363390 - protein, 18 aa, Mycobacterium
MKAAIMVALLFRTLDAWR

SEQ ID NO: 363391 - protein, 22 aa, Mycobacterium
MKCEPWDPETGTYGPIWDEASG

SEQ ID NO: 363392 - protein, 31 aa, Mycobacterium
MKHLAMLAYVFIALPLLSALVPWAILALEPS

SEQ ID NO: 363393 - protein, 19 aa, Mycobacterium
MKPAKVMRWIIVPQALRVM

SEQ ID NO: 363394 - protein, 18 aa, Mycobacterium
MKQNLWWGAGYNLVSVPL

SEQ ID NO: 363395 - protein, 25 aa, Mycobacterium
MKRFWIPLLLVVVVAVGAYAIVRIR

SEQ ID NO: 363396 - protein, 21 aa, Mycobacterium
MKRGAFLRWRELGKSALEFMR

SEQ ID NO: 363397 - protein, 22 aa, Mycobacterium
MKTVLGEPFYRSLQLSWHTDLL

SEQ ID NO: 363398 - protein, 26 aa, Mycobacterium
MKYRDSWIIAFLYIGTFGSFIGFSFA

SEQ ID NO: 363399 - protein, 17 aa, Mycobacterium
MLAAGGIQLLCSVAAVY

SEQ ID NO: 363400 - protein, 19 aa, Mycobacterium
MLAALPQWPEAIGSSNMAF

SEQ ID NO: 363401 - protein, 17 aa, Mycobacterium
MLAAVVLVSMWRGALTA

SEQ ID NO: 363402 - protein, 27 aa, Mycobacterium
MLACLIVPFILGLVWRRGTTTAALAAI

SEQ ID NO: 363403 - protein, 26 aa, Mycobacterium
MLADRDGTTWLLWDGKRSQINLTDHA

SEQ ID NO: 363404 - protein, 28 aa, Mycobacterium
MLAGGLALLLMVVWVGIALAVSASLGTE

SEQ ID NO: 363405 - protein, 25 aa, Mycobacterium
MLAIGFSLLCIGLAAFSFLIDFDAA

SEQ ID NO: 363406 - protein, 25 aa, Mycobacterium
MLAIGSLFPVKWMAQGFRSVLLPPE

SEQ ID NO: 363407 - protein, 20 aa, Mycobacterium
MLALGWRPGAPFPHGSALLA

SEQ ID NO: 363408 - protein, 36 aa, Mycobacterium
MLALLGALARRFALSPIPVYLLAGLALGKGGILPVA

SEQ ID NO: 363409 - protein, 27 aa, Mycobacterium
MLALMTRRWALAWIALVGSALASATGL

SEQ ID NO: 363410 - protein, 26 aa, Mycobacterium
MLALMTRRWTLAWVALAGSALASGTG

SEQ ID NO: 363411 - protein, 25 aa, Mycobacterium
MLALVTRRWALAWVALAGSAIAGAA

SEQ ID NO: 363412 - protein, 25 aa, Mycobacterium
MLAQLWWQQHGWLPAAVSWGLAAVF

SEQ ID NO: 363413 - protein, 25 aa, Mycobacterium
MLASLTLLPALLDLAGRRGLAQPRT

SEQ ID NO: 363414 - protein, 19 aa, Mycobacterium
MLATLPTLSDPGPGLAGAP

SEQ ID NO: 363415 - protein, 25 aa, Mycobacterium
MLATTAFWLTPLLLSVPLFSRDTYS

SEQ ID NO: 363416 - protein, 17 aa, Mycobacterium
MLCAAFNVLLRALCGRD

SEQ ID NO: 363417 - protein, 17 aa, Mycobacterium
MLCLWWGAAVSKLNHHF

SEQ ID NO: 363418 - protein, 17 aa, Mycobacterium
MLDHPLSPLTNPTQPAL

SEQ ID NO: 363419 - protein, 23 aa, Mycobacterium
MLEFYDFYLYGALSATIFGALYF

SEQ ID NO: 363420 - protein, 18 aa, Mycobacterium
MLENDRFYRWGTYAYLPA

SEQ ID NO: 363421 - protein, 19 aa, Mycobacterium
MLESQARHIVRLMKVLRAH

SEQ ID NO: 363422 - protein, 22 aa, Mycobacterium
MLEWAPECFGTPGDLKLAALAI

SEQ ID NO: 363423 - protein, 23 aa, Mycobacterium
MLEWAPECFGTPGDLKLAALAIS

SEQ ID NO: 363424 - protein, 19 aa, Mycobacterium
MLFAALIFWRTDRLLFLLG

SEQ ID NO: 363425 - protein, 19 aa, Mycobacterium
MLFAVGFLVTFLFGGLTGV

SEQ ID NO: 363426 - protein, 19 aa, Mycobacterium
MLFGAELWEWVNPNNVTRT

SEQ ID NO: 363427 - protein, 21 aa, Mycobacterium
MLFGALLILGISPGPQLVGEH

SEQ ID NO: 363428 - protein, 21 aa, Mycobacterium
MLFIIFDIEIVFLYPWAVHFD

SEQ ID NO: 363429 - protein, 19 aa, Mycobacterium
MLFITVRGFARQLTTMRPY

SEQ ID NO: 363430 - protein, 25 aa, Mycobacterium
MLGAPLQPVLLRAMTFMIVASPCAV

SEQ ID NO: 363431 - protein, 19 aa, Mycobacterium
MLGCGLIVVLVYAGLGLID

SEQ ID NO: 363432 - protein, 33 aa, Mycobacterium
MLGFFSSIWIWNIFITFLPLFLQDTLDVSIAQT

SEQ ID NO: 363433 - protein, 18 aa, Mycobacterium
MLGGIIIGNVLGGGMRGG

SEQ ID NO: 363434 - protein, 25 aa, Mycobacterium
MLGGLAHRMRCTTTFFGIAALGASG

SEQ ID NO: 363435 - protein, 19 aa, Mycobacterium
MLGIRDTPWMIRDGRFFAP

SEQ ID NO: 363436 - protein, 30 aa, Mycobacterium
MLGLATVPAMLLLPLLIRAPDTARWYVLKG

SEQ ID NO: 363437 - protein, 33 aa, Mycobacterium
MLGLATVPAMLLLPLLIRMPDTPRWYVMKGRIQ

SEQ ID NO: 363438 - protein, 27 aa, Mycobacterium
MLGPADRIYRRGLTDFYAGRYTDAIDE

SEQ ID NO: 363439 - protein, 17 aa, Mycobacterium
MLGTLWLVVRARSSTRA

SEQ ID NO: 363440 - protein, 26 aa, Mycobacterium
MLGWWVGLLVYFLPRRSWLRAAAEDT

SEQ ID NO: 363441 - protein, 22 aa, Mycobacterium
MLHFPRSWPYMNISPNLEPALS

SEQ ID NO: 363442 - protein, 29 aa, Mycobacterium
MLIGLCAVIWLAFVGMLVGAIVVIAGMGE

SEQ ID NO: 363443 - protein, 18 aa, Mycobacterium
MLIGPIVFLTIVGGIAGV

SEQ ID NO: 363444 - protein, 17 aa, Mycobacterium
MLILAGREPTSGTVERP

SEQ ID NO: 363445 - protein, 25 aa, Mycobacterium
MLLGVALGLMTLGLVKGPEWGWIST

SEQ ID NO: 363446 - protein, 28 aa, Mycobacterium
MLLKNSQHFLGMYRALKGLITDPVGTIV

SEQ ID NO: 363447 - protein, 17 aa, Mycobacterium
MLLNVLKPTGIVGDSPI

SEQ ID NO: 363448 - protein, 24 aa, Mycobacterium
MLLPAFIALFGIVAALFLVGGTGA

SEQ ID NO: 363449 - protein, 21 aa, Mycobacterium
MLLPAFIAVFGIIAALFLVRS

SEQ ID NO: 363450 - protein, 22 aa, Mycobacterium
MLLPAFVALLGVVAALFMVGSG

SEQ ID NO: 363451 - protein, 22 aa, Mycobacterium
MLLPLGFMILTREAGPARLGRL

SEQ ID NO: 363452 - protein, 22 aa, Mycobacterium
MLLPLGFMILTREAGPRRLGRL

SEQ ID NO: 363453 - protein, 18 aa, Mycobacterium
MLLQALILVSVTLGAVST

SEQ ID NO: 363454 - protein, 17 aa, Mycobacterium
MLLSGWSSPTNGAIARW

SEQ ID NO: 363455 - protein, 33 aa, Mycobacterium
MLLVALRRQRIDLRPLWGIDARLKRFGTMAAAM

SEQ ID NO: 363456 - protein, 20 aa, Mycobacterium
MLMPFAGISFLWFIGVVRDG

SEQ ID NO: 363457 - protein, 18 aa, Mycobacterium
MLMPLAFAAKVGPLLILV

SEQ ID NO: 363458 - protein, 17 aa, Mycobacterium
MLPAGALVYIALPPARD

SEQ ID NO: 363459 - protein, 17 aa, Mycobacterium
MLPLFRRMQGLIDGINR

SEQ ID NO: 363460 - protein, 25 aa, Mycobacterium
MLPTLLVAIPFTVLVSFTLNILLRE

SEQ ID NO: 363461 - protein, 30 aa, Mycobacterium
MLQADIIGALFVLGFLRFGLPPEDRIQLQD

SEQ ID NO: 363462 - protein, 29 aa, Mycobacterium
MLQADIIGALFVLGFLRYGLPPQDRIELQ

SEQ ID NO: 363463 - protein, 29 aa, Mycobacterium
MLQKLVFKVLIMVLWLAPIGAFGAIANVV

SEQ ID NO: 363464 - protein, 19 aa, Mycobacterium
MLQRKLRVGFAKAGRLMDL

SEQ ID NO: 363465 - protein, 24 aa, Mycobacterium
MLQTEFNVLLPWSKQVELPEPAKE

SEQ ID NO: 363466 - protein, 22 aa, Mycobacterium
MLQWAPECFGTPGDLKLAALAI

SEQ ID NO: 363467 - protein, 34 aa, Mycobacterium
MLRGGRSRLGFGTLAVLLCLLLGIAIVTQVRQTE

SEQ ID NO: 363468 - protein, 32 aa, Mycobacterium
MLRGSRSRMLFGALAILLCLVLGVAIVTQVRQ

SEQ ID NO: 363469 - protein, 19 aa, Mycobacterium
MLRLRVENWMLQVPEQTLT

SEQ ID NO: 363470 - protein, 17 aa, Mycobacterium
MLRPTMFFVLVTGIVSA

SEQ ID NO: 363471 - protein, 18 aa, Mycobacterium
MLRYCLQLFPGASTYFRP

SEQ ID NO: 363472 - protein, 20 aa, Mycobacterium
MLSGYLLARKIVGAQAPRPA

SEQ ID NO: 363473 - protein, 26 aa, Mycobacterium
MLSKWQVGWVVVLLYAVCVVLRLARF

SEQ ID NO: 363474 - protein, 17 aa, Mycobacterium
MLSMMVFLPFAGRISDR

SEQ ID NO: 363475 - protein, 22 aa, Mycobacterium
MLSRIPAHYPLRGVVHAAGILD

SEQ ID NO: 363476 - protein, 22 aa, Mycobacterium
MLSTVLIVLMACAWLTDTIGIY

SEQ ID NO: 363477 - protein, 27 aa, Mycobacterium
MLTAGATFLAAWLPFNNGLRPEPLIAF

SEQ ID NO: 363478 - protein, 21 aa, Mycobacterium
MLTGFLARRYGENARFLFGPM

SEQ ID NO: 363479 - protein, 25 aa, Mycobacterium
MLTHTFGLERWREAFLAIADQGASG

SEQ ID NO: 363480 - protein, 19 aa, Mycobacterium
MLTIFLRTIAPTEHLAAVY

SEQ ID NO: 363481 - protein, 28 aa, Mycobacterium
MLVAAAWLAVFALPLLFVAQRLSGPAEL

SEQ ID NO: 363482 - protein, 30 aa, Mycobacterium
MLVGAWFRSGYSLLFLAVPLAGFVIVASSI

SEQ ID NO: 363483 - protein, 19 aa, Mycobacterium
MLVGFGVITLLLGVVGEYL

SEQ ID NO: 363484 - protein, 29 aa, Mycobacterium
MLVGTPAMWWLAVPVLLYAAWRMFVRRDW

SEQ ID NO: 363485 - protein, 33 aa, Mycobacterium
MLVGTPAMWWLAVPVLLYAAWRMFVRRDWRYAA

SEQ ID NO: 363486 - protein, 30 aa, Mycobacterium
MLVGTPAMWWLAVPVLLYACWRAFVRRDWR

SEQ ID NO: 363487 - protein, 35 aa, Mycobacterium
MLVGTPAMWWVAVPVLIFALWRMLVRRDWRYAAVL

SEQ ID NO: 363488 - protein, 26 aa, Mycobacterium
MLVGTPTMWFLAVPVLAWAVWRAFVK

SEQ ID NO: 363489 - protein, 17 aa, Mycobacterium
MLVLDRVAKLTFHLPGI

SEQ ID NO: 363490 - protein, 18 aa, Mycobacterium
MLVLIVLAGCAGLVRFNY

SEQ ID NO: 363491 - protein, 19 aa, Mycobacterium
MLVLVGIVSALYERERSGK

SEQ ID NO: 363492 - protein, 17 aa, Mycobacterium
MLVNIPASRERVVAVSF

SEQ ID NO: 363493 - protein, 25 aa, Mycobacterium
MLVNRLLLPTILGWSLGRAVAGIAV

SEQ ID NO: 363494 - protein, 19 aa, Mycobacterium
MLVPLLSGCLRVRASLTIS

SEQ ID NO: 363495 - protein, 24 aa, Mycobacterium
MLVRLARVTFFADPTRFGLIVLEE

SEQ ID NO: 363496 - protein, 24 aa, Mycobacterium
MLVSMLIFVILGLPSAGATVPLEA

SEQ ID NO: 363497 - protein, 17 aa, Mycobacterium
MLVSPLLAAAALAQTVG

SEQ ID NO: 363498 - protein, 27 aa, Mycobacterium
MLVTALQVTVLLFALPLYARLAHHRIT

SEQ ID NO: 363499 - protein, 18 aa, Mycobacterium
MLVTFGVVAAGLARYRLR

SEQ ID NO: 363500 - protein, 29 aa, Mycobacterium
MLVVVVVVAVFLGSKMWHSLFGGTTGDYA

SEQ ID NO: 363501 - protein, 18 aa, Mycobacterium
MLWSGDRAWRQAGERRML

SEQ ID NO: 363502 - protein, 19 aa, Mycobacterium
MLYGCYAMFGLSLLASLNI

SEQ ID NO: 363503 - protein, 22 aa, Mycobacterium
MMALAMVLYVLVSQVGFIVGNQ

SEQ ID NO: 363504 - protein, 21 aa, Mycobacterium
MMAMMVGWMFVLHHLVGRPND

SEQ ID NO: 363505 - protein, 18 aa, Mycobacterium
MMGLPRLYRIPVHTIHKF

SEQ ID NO: 363506 - protein, 17 aa, Mycobacterium
MMLPLIFYAQSVCGLSP

SEQ ID NO: 363507 - protein, 19 aa, Mycobacterium
MMMCFSAVAVVWLLWVIFG

SEQ ID NO: 363508 - protein, 30 aa, Mycobacterium
MMMMSFISIPLVTVAWLLIGYTLAFSEDGA

SEQ ID NO: 363509 - protein, 17 aa, Mycobacterium
MMRLDHSVIFLFIAASY

SEQ ID NO: 363510 - protein, 18 aa, Mycobacterium
MMWIPVAAFAVWLVIWRV

SEQ ID NO: 363511 - protein, 27 aa, Mycobacterium
MMYELFFPSLLEKRLLRLLFRVDAAVF

SEQ ID NO: 363512 - protein, 19 aa, Mycobacterium
MMYVVACFIFFFIGGLMAL

SEQ ID NO: 363513 - protein, 25 aa, Mycobacterium
MNALAALAFWVTVYLPAADFYTNQE

SEQ ID NO: 363514 - protein, 24 aa, Mycobacterium
MNATQLVIGTSRRSRWARLFEEGI

SEQ ID NO: 363515 - protein, 24 aa, Mycobacterium
MNATQLVLGTSRRSRWARVLDEGI

SEQ ID NO: 363516 - protein, 20 aa, Mycobacterium
MNFIIGLVLIYGIAIVWGLP

SEQ ID NO: 363517 - protein, 25 aa, Mycobacterium
MNGKFEGVMALPVPIGKINTIMTAN

SEQ ID NO: 363518 - protein, 17 aa, Mycobacterium
MNLLMRFYEVDSGRILI

SEQ ID NO: 363519 - protein, 17 aa, Mycobacterium
MNNVPPPKPGTVYQMWL

SEQ ID NO: 363520 - protein, 24 aa, Mycobacterium
MNRKWIENWILWIVTDTFSVGVYL

SEQ ID NO: 363521 - protein, 24 aa, Mycobacterium
MNSLTLMSALALALVYGLGGALAI

SEQ ID NO: 363522 - protein, 24 aa, Mycobacterium
MNSLTLMSALALALVYGLGGVLAI

SEQ ID NO: 363523 - protein, 25 aa, Mycobacterium
MNVKLVMHQLLRQFRWRVAPGYRPL

SEQ ID NO: 363524 - protein, 31 aa, Mycobacterium
MPALGLANWYIVHSMLPIFRRMQRLIDGINR

SEQ ID NO: 363525 - protein, 23 aa, Mycobacterium
MPALKPLRFFEQTALLESLVTTM

SEQ ID NO: 363526 - protein, 25 aa, Mycobacterium
MPAPMRPLLAARPDAYRKLVDLTLW

SEQ ID NO: 363527 - protein, 25 aa, Mycobacterium
MPAPMRPLMAARPDAYRKLIDLTLW

SEQ ID NO: 363528 - protein, 30 aa, Mycobacterium
MPARGRLITMLLIGVVLLGLGYSGGLGSPV

SEQ ID NO: 363529 - protein, 20 aa, Mycobacterium
MPARPLVALPGASAIAPGTG

SEQ ID NO: 363530 - protein, 24 aa, Mycobacterium
MPEPLGHYRALLTALARLAGTHRS

SEQ ID NO: 363531 - protein, 30 aa, Mycobacterium
MPETGGGWRFLAFTLGICAIFLLRARSFVD

SEQ ID NO: 363532 - protein, 19 aa, Mycobacterium
MPEVLFTIFLGVPVLIGCF

SEQ ID NO: 363533 - protein, 18 aa, Mycobacterium
MPFAGIAFLWFLGVVRDG

SEQ ID NO: 363534 - protein, 20 aa, Mycobacterium
MPFWGTSFSAAYVSGVAALV

SEQ ID NO: 363535 - protein, 18 aa, Mycobacterium
MPGELTLDPIRMSDPKLL

SEQ ID NO: 363536 - protein, 19 aa, Mycobacterium
MPIDLGWQLWAYGVFAIAA

SEQ ID NO: 363537 - protein, 17 aa, Mycobacterium
MPILGWANHRVGARLGS

SEQ ID NO: 363538 - protein, 18 aa, Mycobacterium
MPKLQAALGIPVFTPADG

SEQ ID NO: 363539 - protein, 17 aa, Mycobacterium
MPKLTRRSRILILIALG

SEQ ID NO: 363540 - protein, 17 aa, Mycobacterium
MPLFDRLGRRFPKHFGP

SEQ ID NO: 363541 - protein, 19 aa, Mycobacterium
MPLGYLNLCVWLIPAMFGV

SEQ ID NO: 363542 - protein, 23 aa, Mycobacterium
MPLLGKIAVWLTGAAWAIATFFV

SEQ ID NO: 363543 - protein, 25 aa, Mycobacterium
MPPHAVAAVFNPLLGGLAVAHRSGL

SEQ ID NO: 363544 - protein, 22 aa, Mycobacterium
MPPLSRLLAWTLAVGVVCFVVR

SEQ ID NO: 363545 - protein, 17 aa, Mycobacterium
MPPPRISKRHPKLAHLD

SEQ ID NO: 363546 - protein, 31 aa, Mycobacterium
MPPVGGFLYWLRPKTIRLPPWPAKVPFTDGD

SEQ ID NO: 363547 - protein, 27 aa, Mycobacterium
MPRALVFLTYIYVIVTTLIAFRIGRPL

SEQ ID NO: 363548 - protein, 18 aa, Mycobacterium
MPREQFVAHLTTIMVGVI

SEQ ID NO: 363549 - protein, 32 aa, Mycobacterium
MPRMLKWLSPLVPLVAGPLPVAFFIGVLAGEE

SEQ ID NO: 363550 - protein, 27 aa, Mycobacterium
MPRPMPATPAFPPPAGPPPVIAAPAPP

SEQ ID NO: 363551 - protein, 18 aa, Mycobacterium
MPRRRALTVPPNVSVWLP

SEQ ID NO: 363552 - protein, 18 aa, Mycobacterium
MPSILVGWRYAAGTALLA

SEQ ID NO: 363553 - protein, 24 aa, Mycobacterium
MPTWFNPILNFGIAASFFAVVVAP

SEQ ID NO: 363554 - protein, 17 aa, Mycobacterium
MPVALNIAQLSALAALF

SEQ ID NO: 363555 - protein, 18 aa, Mycobacterium
MPVPRPAGYSKQRSTSVA

SEQ ID NO: 363556 - protein, 27 aa, Mycobacterium
MPVSLGWQLWLYGVFAIIAVGVTSSSL

SEQ ID NO: 363557 - protein, 17 aa, Mycobacterium
MPYFQTLGVPCSVGLLV

SEQ ID NO: 363558 - protein, 32 aa, Mycobacterium
MPYPQRRSKRRLVVGILLAVALVAALTVAIVY

SEQ ID NO: 363559 - protein, 39 aa, Mycobacterium
MPYRVGLIGGLALLPLLALLALIPVRRPVRAAAPARPWN

SEQ ID NO: 363560 - protein, 18 aa, Mycobacterium
MQELLSRINAELSVYTGL

SEQ ID NO: 363561 - protein, 20 aa, Mycobacterium
MQMGYLPGTIWIIIGAVLAG

SEQ ID NO: 363562 - protein, 32 aa, Mycobacterium
MQMIRALPHLGLIPLFIVWFGIGELPKVLLVA

SEQ ID NO: 363563 - protein, 33 aa, Mycobacterium
MQMIRALPHLGLIPLFIVWFGIGELPKVLMVAL

SEQ ID NO: 363564 - protein, 27 aa, Mycobacterium
MQMRVDARLPLPALPPARSGAPSDILL

SEQ ID NO: 363565 - protein, 26 aa, Mycobacterium
MQSCDRPMIFPLSNPTSRMEAMPADV

SEQ ID NO: 363566 - protein, 20 aa, Mycobacterium
MQSTILPDAARLYRATSERV

SEQ ID NO: 363567 - protein, 22 aa, Mycobacterium
MQTIWHFTGNTAWYRLTKFFGK

SEQ ID NO: 363568 - protein, 30 aa, Mycobacterium
MQVGSLVAFLSYFLQILMSMMMLTMLAVMV

SEQ ID NO: 363569 - protein, 19 aa, Mycobacterium
MQVPTLLGIGRLAVTLELP

SEQ ID NO: 363570 - protein, 18 aa, Mycobacterium
MQVPTLLGLGRITVTLQL

SEQ ID NO: 363571 - protein, 26 aa, Mycobacterium
MQYAGTFLYLCRGLFGIPALSGRTEP

SEQ ID NO: 363572 - protein, 17 aa, Mycobacterium
MRALFDAIINDDPLPEE

SEQ ID NO: 363573 - protein, 18 aa, Mycobacterium
MRALRYRALDFGDGQPVA

SEQ ID NO: 363574 - protein, 24 aa, Mycobacterium
MRAPRLFDDLVGPAPPWGDWVVIG

SEQ ID NO: 363575 - protein, 17 aa, Mycobacterium
MRDPVLLAIPFFLLLLT

SEQ ID NO: 363576 - protein, 33 aa, Mycobacterium
MREIPPTLRMLFVFGVLTLLAMAGSLTLAGTPG

SEQ ID NO: 363577 - protein, 27 aa, Mycobacterium
MRFKHSWVMSFLYIGTFGSFIGFSFAF

SEQ ID NO: 363578 - protein, 22 aa, Mycobacterium
MRGGKWWTKPFVRSAYGNAVIA

SEQ ID NO: 363579 - protein, 18 aa, Mycobacterium
MRHRTVWTVIAVLALFGW

SEQ ID NO: 363580 - protein, 18 aa, Mycobacterium
MRHRYFELEIKAIAVEHA

SEQ ID NO: 363581 - protein, 31 aa, Mycobacterium
MRIRGWRKIGAAIVRWPGPILVATMAITLVG

SEQ ID NO: 363582 - protein, 25 aa, Mycobacterium
MRIRRYLQLLLIGLSGNIVGALVFV

SEQ ID NO: 363583 - protein, 25 aa, Mycobacterium
MRIRTWRRIGAAITRWPGPILAASM

SEQ ID NO: 363584 - protein, 28 aa, Mycobacterium
MRLESRDFRLWLRSYRTAINSLTSSCTT

SEQ ID NO: 363585 - protein, 23 aa, Mycobacterium
MRLEYVALAVALMLSLLGAALLM

SEQ ID NO: 363586 - protein, 21 aa, Mycobacterium
MRLGWEVLIPVALVWIVVVGV

SEQ ID NO: 363587 - protein, 23 aa, Mycobacterium
MRLLPDLLRLFKRLAADPTLPRG

SEQ ID NO: 363588 - protein, 17 aa, Mycobacterium
MRLNMIEPLKEPAWRRF

SEQ ID NO: 363589 - protein, 18 aa, Mycobacterium
MRLPTLAMALTCWWVISR

SEQ ID NO: 363590 - protein, 28 aa, Mycobacterium
MRLVGATRWYTQLPFLLEAVIAALAGVA

SEQ ID NO: 363591 - protein, 34 aa, Mycobacterium
MRMIEALTFTVIIIMLLMVYRSIITVILSLVMVV

SEQ ID NO: 363592 - protein, 18 aa, Mycobacterium
MRMILEVPALQAYSMLMY

SEQ ID NO: 363593 - protein, 17 aa, Mycobacterium
MRMLWTQRSVTFKGKYH

SEQ ID NO: 363594 - protein, 61 aa, Mycobacterium
MRNPLEALVAWGPLLFFIAYEAFFIPFGFTFWGVMLSAPLWLPLLLVGLAQLVNPVPVEAD

SEQ ID NO: 363595 - protein, 18 aa, Mycobacterium
MRPDYPATPPPAPSAPPP

SEQ ID NO: 363596 - protein, 31 aa, Mycobacterium
MRPFVALRCWPFALLVLLAVALIALAAVAEA

SEQ ID NO: 363597 - protein, 35 aa, Mycobacterium
MRPHNLPFVLLGVGLLWFGWFGFNAGSALAANGLA

SEQ ID NO: 363598 - protein, 33 aa, Mycobacterium
MRRDDRLLAVLPFFHIYGMTVLLNAALHARAQL

SEQ ID NO: 363599 - protein, 34 aa, Mycobacterium
MRRETNSWRWPAVAFSYMFGLAWVAAFAARSIAI

SEQ ID NO: 363600 - protein, 17 aa, Mycobacterium
MRRFGLPVLPLIIGVIL

SEQ ID NO: 363601 - protein, 29 aa, Mycobacterium
MRRQAVITLAPWLLTAAILVPLNLHAPAT

SEQ ID NO: 363602 - protein, 17 aa, Mycobacterium
MRRVVLAGLLARSPRAL

SEQ ID NO: 363603 - protein, 33 aa, Mycobacterium
MRRWNDDLWERAWLTWFWMGMALGYCVLALIAF

SEQ ID NO: 363604 - protein, 28 aa, Mycobacterium
MRRYSFPVFVFTVILITLVLIPGIGTYS

SEQ ID NO: 363605 - protein, 24 aa, Mycobacterium
MRSPDGYTQTYRFTPDTTVITHRG

SEQ ID NO: 363606 - protein, 28 aa, Mycobacterium
MRTAAPPPPPPPPPAAAPVPPPAGAGGT

SEQ ID NO: 363607 - protein, 30 aa, Mycobacterium
MRTPWLVPGWLFISAVVYVPLALIGFPVWM

SEQ ID NO: 363608 - protein, 22 aa, Mycobacterium
MRTRGWRKLGAAVVRWPAPILV

SEQ ID NO: 363609 - protein, 31 aa, Mycobacterium
MRTSTLVLIIAFFLVWWTYDTYRPAPAPKPP

SEQ ID NO: 363610 - protein, 20 aa, Mycobacterium
MRVHASGFRFDTICAVAIED

SEQ ID NO: 363611 - protein, 20 aa, Mycobacterium
MRVIPIERGNLRTLPRVVGT

SEQ ID NO: 363612 - protein, 21 aa, Mycobacterium
MRVLSLRTIVVVAALSVITLV

SEQ ID NO: 363613 - protein, 17 aa, Mycobacterium
MRYPVFLAFDIVGGISW

SEQ ID NO: 363614 - protein, 35 aa, Mycobacterium
MSAIPLQALSVLLTPISRLLVLLGNALTPGRGFRN

SEQ ID NO: 363615 - protein, 25 aa, Mycobacterium
MSALWARFPLPVIPAPGDPTPSAPS

SEQ ID NO: 363616 - protein, 17 aa, Mycobacterium
MSDLLIAAIAAFVLIFL

SEQ ID NO: 363617 - protein, 18 aa, Mycobacterium
MSEVHLARDLRLHRDVAI

SEQ ID NO: 363618 - protein, 17 aa, Mycobacterium
MSEVHLARDVRLHRDVA

SEQ ID NO: 363619 - protein, 27 aa, Mycobacterium
MSFVLQQFVLFILPKIIPGYGGPNAQQ

SEQ ID NO: 363620 - protein, 17 aa, Mycobacterium
MSGCRFFDVMLGAAPHY

SEQ ID NO: 363621 - protein, 17 aa, Mycobacterium
MSGPWVGAAAPGENLTS

SEQ ID NO: 363622 - protein, 25 aa, Mycobacterium
MSHKQWHDWVFPDIDYIRLCPNLPV

SEQ ID NO: 363623 - protein, 19 aa, Mycobacterium
MSHLADHGWICVSIDYRVS

SEQ ID NO: 363624 - protein, 18 aa, Mycobacterium
MSHLAELGWICVAINYRH

SEQ ID NO: 363625 - protein, 21 aa, Mycobacterium
MSILFGFVANYPFALAAGLGI

SEQ ID NO: 363626 - protein, 17 aa, Mycobacterium
MSILLSLLTTHPADRLI

SEQ ID NO: 363627 - protein, 17 aa, Mycobacterium
MSIMHEGGIWATADLYP

SEQ ID NO: 363628 - protein, 17 aa, Mycobacterium
MSLFFIDVVVTAVGVKA

SEQ ID NO: 363629 - protein, 33 aa, Mycobacterium
MSLFTASGYVLWWAVLFPAISVPIIASLVLAIS

SEQ ID NO: 363630 - protein, 34 aa, Mycobacterium
MSLSGFEHAWFFLFLLVVAGLAALYIVMQLARQR

SEQ ID NO: 363631 - protein, 34 aa, Mycobacterium
MSLSGFEHPWFFLFFFVVIGLVALYIVVQLARQK

SEQ ID NO: 363632 - protein, 42 aa, Mycobacterium
MSLSGFEHSWFFLFLLVVFGLAALYILMQLARQRRMLRFANM

SEQ ID NO: 363633 - protein, 24 aa, Mycobacterium
MSNGELFIMGRIKDLVIVDGRNHY

SEQ ID NO: 363634 - protein, 18 aa, Mycobacterium
MSPAALAALLPDVLALLS

SEQ ID NO: 363635 - protein, 21 aa, Mycobacterium
MSQFWQQMFLTIGIVIAVFGM

SEQ ID NO: 363636 - protein, 25 aa, Mycobacterium
MSRRTRRWIAAGLTALVVVIGVAVA

SEQ ID NO: 363637 - protein, 17 aa, Mycobacterium
MSSAVFLLLQPLGSPTF

SEQ ID NO: 363638 - protein, 24 aa, Mycobacterium
MSSPWLLAAIVAALLFFPILGNFR

SEQ ID NO: 363639 - protein, 19 aa, Mycobacterium
MSTGRRLAVAFAAAAVLFA

SEQ ID NO: 363640 - protein, 19 aa, Mycobacterium
MSTGRRLGVAFAAAAVLFA

SEQ ID NO: 363641 - protein, 18 aa, Mycobacterium
MSTLPLVAFALLSLEFMP

SEQ ID NO: 363642 - protein, 24 aa, Mycobacterium
MSTLVLFDVPFLRSFGYAGVATVV

SEQ ID NO: 363643 - protein, 32 aa, Mycobacterium
MSTSAYDIGLFYRYAWQNPIFADIVATRTFDF

SEQ ID NO: 363644 - protein, 31 aa, Mycobacterium
MSTSAYDIGLFYRYAWQNPTFANIVATRTFD

SEQ ID NO: 363645 - protein, 32 aa, Mycobacterium
MSTSAYDIGLFYRYAWRNPTFADIVATRSYDF

SEQ ID NO: 363646 - protein, 31 aa, Mycobacterium
MSTSVYDMGLFYRYAWHNPVFADIVATRATQ

SEQ ID NO: 363647 - protein, 21 aa, Mycobacterium
MSVGTWILAAYGPGAGLAGAA

SEQ ID NO: 363648 - protein, 29 aa, Mycobacterium
MSVLARTSRWPWLVLGAIAVAAVGIPLIA

SEQ ID NO: 363649 - protein, 18 aa, Mycobacterium
MSVQFLRRIAFSAFAFTI

SEQ ID NO: 363650 - protein, 31 aa, Mycobacterium
MSVQGQFYIAFLLLVFGMAFLLRGLLLGRHL

SEQ ID NO: 363651 - protein, 35 aa, Mycobacterium
MSVQGQFYIAFLVLIFGFAYLFRRVFGRHLRTVFI

SEQ ID NO: 363652 - protein, 38 aa, Mycobacterium
MSVQGQFYLAFLLLVFGIGFLLRRLLVGRHLRVLLIVL

SEQ ID NO: 363653 - protein, 26 aa, Mycobacterium
MSVRWAGIALALFLTGLVAQLNGAAE

SEQ ID NO: 363654 - protein, 18 aa, Mycobacterium
MSVSFLRRIAFSGFAFTI

SEQ ID NO: 363655 - protein, 18 aa, Mycobacterium
MSVWKFFALLGYAAIYAY

SEQ ID NO: 363656 - protein, 22 aa, Mycobacterium
MSWVTLVVWAVTGAVLATLATA

SEQ ID NO: 363657 - protein, 25 aa, Mycobacterium
MSYVRQVLLVQLWFVPFFDDSSWDG

SEQ ID NO: 363658 - protein, 17 aa, Mycobacterium
MSYVWWALAVIVVAGLT

SEQ ID NO: 363659 - protein, 27 aa, Mycobacterium
MTAAAVLVLLAGRRLWHRFRGQPDRAD

SEQ ID NO: 363660 - protein, 29 aa, Mycobacterium
MTAKTLMSYPGLLLYEMSVAFSPDGKRIA

SEQ ID NO: 363661 - protein, 18 aa, Mycobacterium
MTALLLGAATDYAIFIVA

SEQ ID NO: 363662 - protein, 25 aa, Mycobacterium
MTALWAWARKKPWLAGVLIGLGVAA

SEQ ID NO: 363663 - protein, 22 aa, Mycobacterium
MTAMFLGFRERELILSVFETIT

SEQ ID NO: 363664 - protein, 25 aa, Mycobacterium
MTAPLYIWALLISLALNKVWRRHRL

SEQ ID NO: 363665 - protein, 48 aa, Mycobacterium
MTARGWRRRVLLGVVALVFAALLAVSGVLGWMTWKQHQLTQAGEQARQ

SEQ ID NO: 363666 - protein, 28 aa, Mycobacterium
MTATTPVWLLLVIFAVFGIGFALVNAPI

SEQ ID NO: 363667 - protein, 26 aa, Mycobacterium
MTAVVPVFVVFPLALMIGLFAGYRRS

SEQ ID NO: 363668 - protein, 30 aa, Mycobacterium
MTAVVVVLALRRVWWLYKLIMSGQPASGRT

SEQ ID NO: 363669 - protein, 25 aa, Mycobacterium
MTCSARLPVFTLLVGLLVSPQTQWW

SEQ ID NO: 363670 - protein, 20 aa, Mycobacterium
MTDAYLAPVKLRTTTLTLIY

SEQ ID NO: 363671 - protein, 17 aa, Mycobacterium
MTDLYVTQRFLIRWRVW

SEQ ID NO: 363672 - protein, 25 aa, Mycobacterium
MTGNVIFLGFWFVPHSGVDLTAAVV

SEQ ID NO: 363673 - protein, 30 aa, Mycobacterium
MTGSLLLPIKAVLLNMLSLTAAFGALVWIF

SEQ ID NO: 363674 - protein, 22 aa, Mycobacterium
MTGSWRLLGVLALADPARNDSA

SEQ ID NO: 363675 - protein, 28 aa, Mycobacterium
MTIGTLAAFLLYLRMFFEPMQEISQFFN

SEQ ID NO: 363676 - protein, 28 aa, Mycobacterium
MTIGTLTAFLLYLRMFFEPMQEISQFFN

SEQ ID NO: 363677 - protein, 18 aa, Mycobacterium
MTIMRDMLLVWHGTLQSF

SEQ ID NO: 363678 - protein, 25 aa, Mycobacterium
MTIPIALFMGCYLRFLRPGRVAEVS

SEQ ID NO: 363679 - protein, 26 aa, Mycobacterium
MTIPIALFMGVYLRYLRPGKVSEVTV

SEQ ID NO: 363680 - protein, 19 aa, Mycobacterium
MTISSWWLRRRCGYRTPVP

SEQ ID NO: 363681 - protein, 23 aa, Mycobacterium
MTIYLWHWVVTFLLSYGVYLTFR

SEQ ID NO: 363682 - protein, 20 aa, Mycobacterium
MTLAVLASILTDPSGWKPLA

SEQ ID NO: 363683 - protein, 21 aa, Mycobacterium
MTLDRWLLFNWMRWGRALEYL

SEQ ID NO: 363684 - protein, 36 aa, Mycobacterium
MTLDTFVSMFRPPFAWREYLLQCWFVARVSTLPGVL

SEQ ID NO: 363685 - protein, 25 aa, Mycobacterium
MTLDVFITIARPPFAWREYLNQTWF

SEQ ID NO: 363686 - protein, 31 aa, Mycobacterium
MTLSGFAHSWFFLFIFVIAGLIAVYVVLQLA

SEQ ID NO: 363687 - protein, 34 aa, Mycobacterium
MTLSGFEHSWFFLFLFVIVGLVALYIVLQLARQK

SEQ ID NO: 363688 - protein, 30 aa, Mycobacterium
MTLSRLLAGLAPRLNPWLTGAGIVGCVALG

SEQ ID NO: 363689 - protein, 21 aa, Mycobacterium
MTLYLWHMPALLGVHLLFDGL

SEQ ID NO: 363690 - protein, 25 aa, Mycobacterium
MTLYLWHMPVLLAVQLLFDTAGHPR

SEQ ID NO: 363691 - protein, 25 aa, Mycobacterium
MTLYLWHMPVLLGVHLLFDYLGSPR

SEQ ID NO: 363692 - protein, 22 aa, Mycobacterium
MTNINAFYPQRLKGWALGLNAG

SEQ ID NO: 363693 - protein, 30 aa, Mycobacterium
MTPAVAALLGRWFWWPQKFRSAASERRLAR

SEQ ID NO: 363694 - protein, 20 aa, Mycobacterium
MTPMLVLVARFALAGAILAT

SEQ ID NO: 363695 - protein, 31 aa, Mycobacterium
MTPSIAAALGRWFWWPLNTFEITRHGRGGPE

SEQ ID NO: 363696 - protein, 31 aa, Mycobacterium
MTPSIAAALGRWFWWPLNTFEITRRGRQAPH

SEQ ID NO: 363697 - protein, 31 aa, Mycobacterium
MTPSIAALLGRWFWWPQKIRTRPVPVPWGAG

SEQ ID NO: 363698 - protein, 33 aa, Mycobacterium
MTPSIASLLGRWFWWPMVVRPRPRPQPWPQPLH

SEQ ID NO: 363699 - protein, 25 aa, Mycobacterium
MTSGSLYHYFPNKSELLDAVAEDVE

SEQ ID NO: 363700 - protein, 36 aa, Mycobacterium
MTTARRLGVTFGVAAALLLLIALSPAALQVHLTVFA

SEQ ID NO: 363701 - protein, 21 aa, Mycobacterium
MTTLPYFQSMALPCAISILVI

SEQ ID NO: 363702 - protein, 21 aa, Mycobacterium
MTTLPYFQTMGLPCAIAVGVI

SEQ ID NO: 363703 - protein, 17 aa, Mycobacterium
MTTMHEHGLWATADIYP

SEQ ID NO: 363704 - protein, 27 aa, Mycobacterium
MTTWYAAMLFAVVPLRNALPGSPPFGS

SEQ ID NO: 363705 - protein, 22 aa, Mycobacterium
MTTWYAAMLFAVVPLRNALPNA

SEQ ID NO: 363706 - protein, 29 aa, Mycobacterium
MTVIAFLPPLPIILVLCALVGFVYGPIAP

SEQ ID NO: 363707 - protein, 25 aa, Mycobacterium
MTVIAFLPPLPLILALCAVVGVMGS

SEQ ID NO: 363708 - protein, 17 aa, Mycobacterium
MTVTLAIGVQRMSRRRA

SEQ ID NO: 363709 - protein, 22 aa, Mycobacterium
MTVTPFLLLLADLGLSTYVLQV

SEQ ID NO: 363710 - protein, 17 aa, Mycobacterium
MTYGLLRYLNSDVDLTG

SEQ ID NO: 363711 - protein, 17 aa, Mycobacterium
MTYSALHRGAAAVASGL

SEQ ID NO: 363712 - protein, 24 aa, Mycobacterium
MVAIFVIMIILIAVLGLVVVNALG

SEQ ID NO: 363713 - protein, 19 aa, Mycobacterium
MVALLWPIYVIINVILDGK

SEQ ID NO: 363714 - protein, 18 aa, Mycobacterium
MVALPRIHRAIPESLAAV

SEQ ID NO: 363715 - protein, 19 aa, Mycobacterium
MVAMCALALAFSRTRRWLG

SEQ ID NO: 363716 - protein, 27 aa, Mycobacterium
MVASGVPLPLLLFGVALTGLVAAATIV

SEQ ID NO: 363717 - protein, 26 aa, Mycobacterium
MVASLTLLPALIALAGRYGLAQPRNP

SEQ ID NO: 363718 - protein, 25 aa, Mycobacterium
MVEAPLWFHIHVLLGLTLFCLWPFT

SEQ ID NO: 363719 - protein, 18 aa, Mycobacterium
MVFCVLGARIWSGSVAAV

SEQ ID NO: 363720 - protein, 18 aa, Mycobacterium
MVFVVAILAATLALVAIA

SEQ ID NO: 363721 - protein, 24 aa, Mycobacterium
MVFVYGLPAFLLLIAVEYYSYFRE

SEQ ID NO: 363722 - protein, 33 aa, Mycobacterium
MVGALADWFAVTALFKHPLGLPIPHTAIIKRKK

SEQ ID NO: 363723 - protein, 41 aa, Mycobacterium
MVGALADWFAVTALFRHPLGLKIPHTAIIKRKKDQLGEGLG

SEQ ID NO: 363724 - protein, 29 aa, Mycobacterium
MVGATIALFVIPLWLGADLQSALLRAMTF

SEQ ID NO: 363725 - protein, 18 aa, Mycobacterium
MVGLLGQDWRYLGYARRA

SEQ ID NO: 363726 - protein, 25 aa, Mycobacterium
MVGLPFAAFFAFSVGCWPAGLGTRR

SEQ ID NO: 363727 - protein, 29 aa, Mycobacterium
MVGLTRGLNPLRVLIVLAALVLATVVFQP

SEQ ID NO: 363728 - protein, 18 aa, Mycobacterium
MVHPPFAWREYIAQAWFV

SEQ ID NO: 363729 - protein, 20 aa, Mycobacterium
MVIDLLLKRAASLGVQIRYE

SEQ ID NO: 363730 - protein, 21 aa, Mycobacterium
MVIGYLLGLMLWAATLTEFDT

SEQ ID NO: 363731 - protein, 18 aa, Mycobacterium
MVKPPFAWREFISQSWFV

SEQ ID NO: 363732 - protein, 17 aa, Mycobacterium
MVLAMSVIILLAVGADY

SEQ ID NO: 363733 - protein, 18 aa, Mycobacterium
MVLARLPLPPVPTQGAPS

SEQ ID NO: 363734 - protein, 17 aa, Mycobacterium
MVLATRGGPHRRAEVAA

SEQ ID NO: 363735 - protein, 19 aa, Mycobacterium
MVLAVFFVIAVFAYILHGA

SEQ ID NO: 363736 - protein, 19 aa, Mycobacterium
MVLFWIVWGGAIAGVLLKM

SEQ ID NO: 363737 - protein, 22 aa, Mycobacterium
MVLLPAIRRQQIPLRPLWGLDD

SEQ ID NO: 363738 - protein, 25 aa, Mycobacterium
MVLNDLAWIVFIAPVGMVVAQFVLL

SEQ ID NO: 363739 - protein, 24 aa, Mycobacterium
MVLQDTWLFAGTIYDNIAYGRPDA

SEQ ID NO: 363740 - protein, 18 aa, Mycobacterium
MVLQHRDATRQRERVAEF

SEQ ID NO: 363741 - protein, 21 aa, Mycobacterium
MVLSVDWFGVVVLAVWGTLAA

SEQ ID NO: 363742 - protein, 17 aa, Mycobacterium
MVLTLIAWGALIDKFGE

SEQ ID NO: 363743 - protein, 17 aa, Mycobacterium
MVMVSWLLLAVFRGRLH

SEQ ID NO: 363744 - protein, 18 aa, Mycobacterium
MVNIPIAVITIAGGMLFV

SEQ ID NO: 363745 - protein, 34 aa, Mycobacterium; identical to SEQ ID NO: 22524

SEQ ID NO: 363746 - protein, 17 aa, Mycobacterium
MVPLLVFCVVAARIWSG

SEQ ID NO: 363747 - protein, 21 aa, Mycobacterium
MVPTRYGIVDTLPLTINGKLD

SEQ ID NO: 363748 - protein, 18 aa, Mycobacterium
MVPVWVAAGGLTGALLIG

SEQ ID NO: 363749 - protein, 24 aa, Mycobacterium
MVQPALWLLIFGQTFSRLHVVDTG

SEQ ID NO: 363750 - protein, 27 aa, Mycobacterium
MVRNPPLTLNLLLIDFKGGATFLDYAR

SEQ ID NO: 363751 - protein, 17 aa, Mycobacterium
MVRPFMVSPPSTPAAGM

SEQ ID NO: 363752 - protein, 17 aa, Mycobacterium
MVRTVLAWMLGSGVPAA

SEQ ID NO: 363753 - protein, 24 aa, Mycobacterium
MVSAWLVVVPLTFATALVLGAIVA

SEQ ID NO: 363754 - protein, 30 aa, Mycobacterium
MVSVSFVLVQILGGTWLWQVSSINVLGAMI

SEQ ID NO: 363755 - protein, 24 aa, Mycobacterium
MVTAAYVLITFWQYRNACVTAPGL

SEQ ID NO: 363756 - protein, 25 aa, Mycobacterium
MVTAAYVLITFWQYRNACVTAPGLG

SEQ ID NO: 363757 - protein, 18 aa, Mycobacterium
MVTFFVHAFLAIPIALRR

SEQ ID NO: 363758 - protein, 27 aa, Mycobacterium
MVTILVIIVMLLIVYRSVSTVMIMLAM

SEQ ID NO: 363759 - protein, 17 aa, Mycobacterium
MVTKLRLIKLAQTGTIV

SEQ ID NO: 363760 - protein, 25 aa, Mycobacterium
MVTSVLVLMIFPLLTAALFGLAADR

SEQ ID NO: 363761 - protein, 20 aa, Mycobacterium
MVVTRLVAGLAPGLTAAGLA

SEQ ID NO: 363762 - protein, 19 aa, Mycobacterium
MVVVCMIWRLFMQDKRSDG

SEQ ID NO: 363763 - protein, 23 aa, Mycobacterium
MVVVLMAFAVYAVISAALYSDID

SEQ ID NO: 363764 - protein, 25 aa, Mycobacterium
MVVVLMAFAVYAVISAALYSDIDNQ

SEQ ID NO: 363765 - protein, 25 aa, Mycobacterium
MVVVLMSFAVYAVISAALYSDIDNQ

SEQ ID NO: 363766 - protein, 19 aa, Mycobacterium
MVVVPVMLSRILEAVEKMD

SEQ ID NO: 363767 - protein, 18 aa, Mycobacterium
MVWVWTRHLRQRRGYRPP

SEQ ID NO: 363768 - protein, 17 aa, Mycobacterium
MVYLTLLALVALAMAGA

SEQ ID NO: 363769 - protein, 25 aa, Mycobacterium
MVYTQFGFLVWMAVATTALSFVLAH

SEQ ID NO: 363770 - protein, 25 aa, Mycobacterium
MWGGWGWSGWILMSAVMVLFSAALI

SEQ ID NO: 363771 - protein, 19 aa, Mycobacterium
MWGGWILMGAVMVMLSAVL

SEQ ID NO: 363772 - protein, 22 aa, Mycobacterium
MWLCASAPLAPGLGAPPIGSPT

SEQ ID NO: 363773 - protein, 20 aa, Mycobacterium
MWQALRYAAPAFLVPIAFVL

SEQ ID NO: 363774 - protein, 20 aa, Mycobacterium
MWSDWWMIPIGIVSAFAVIW

SEQ ID NO: 363775 - protein, 40 aa, Mycobacterium
MWTGFAAVALSRNWFRRWQLVLCDQAIVIALMLAGRLVVD

SEQ ID NO: 363776 - protein, 30 aa, Mycobacterium
MYAAFAHHYAIWFLVLLAAGKMLACSLTIG

SEQ ID NO: 363777 - protein, 19 aa, Mycobacterium
MYCLSFTRLPYFQTLGSPC

SEQ ID NO: 363778 - protein, 17 aa, Mycobacterium
MYFMFQNAPHRPGTPAP

SEQ ID NO: 363779 - protein, 19 aa, Mycobacterium
MYQWRDAIPARWPLVAVST

SEQ ID NO: 363780 - protein, 18 aa, Mycobacterium
MYRTGDLVRWRADGQLEY

SEQ ID NO: 363781 - protein, 19 aa, Mycobacterium
MYTVTCFVFFFIGGLMALL

SEQ ID NO: 363782 - protein, 18 aa, Mycobacterium
MYWLIMLSGVTILPYFVE

SEQ ID NO: 363783 - protein, 24 aa, Mycobacterium
NAAADLKALKPFIKEYQPVLVGVG

SEQ ID NO: 363784 - protein, 21 aa, Mycobacterium
NAAIYNGKLVCENFRRGLTVD

SEQ ID NO: 363785 - protein, 35 aa, Mycobacterium
NAAKKLVLPPAPPPPDPRPRRVALIGIAVCAAFLA

SEQ ID NO: 363786 - protein, 26 aa, Mycobacterium
NAALGVAFPLCFWVMGVYATLRDLSL

SEQ ID NO: 363787 - protein, 17 aa, Mycobacterium
NAALVWAAGRWTTSTRL

SEQ ID NO: 363788 - protein, 25 aa, Mycobacterium
NAAMPPLWVIVACALSMAAGTYLGG

SEQ ID NO: 363789 - protein, 26 aa, Mycobacterium
NAASYLPVVIALLLIRPHAPVITGNV

SEQ ID NO: 363790 - protein, 34 aa, Mycobacterium
NAATPVLWWVGPLLLYVLLPILDLFFGPDGQNPP

SEQ ID NO: 363791 - protein, 24 aa, Mycobacterium
NADKFVPIFRNINKLSRNWFEHMW

SEQ ID NO: 363792 - protein, 23 aa, Mycobacterium
NADVLRMVIGGAALALLGMRRYV

SEQ ID NO: 363793 - protein, 34 aa, Mycobacterium
NAESSFLVILALVLLIVRLCYTWIVSGRRASAWG

SEQ ID NO: 363794 - protein, 17 aa, Mycobacterium
NAFACRSTIRPVWAVRR

SEQ ID NO: 363795 - protein, 25 aa, Mycobacterium
NAFAVPWRLTVIQSVLWAGGVALFT

SEQ ID NO: 363796 - protein, 23 aa, Mycobacterium
NAFVSFLQAFPSVLSPRSSLLVL

SEQ ID NO: 363797 - protein, 18 aa, Mycobacterium
NAFYPQRLKGWALGLNAG

SEQ ID NO: 363798 - protein, 17 aa, Mycobacterium
NAGALVDLLVTMKKLIG

SEQ ID NO: 363799 - protein, 23 aa, Mycobacterium
NAGIPYFPNLLVPLSIGALGIGA

SEQ ID NO: 363800 - protein, 35 aa, Mycobacterium
NAGLAAFALLLPLTGVILLILVLVTASYRQVVIAY

SEQ ID NO: 363801 - protein, 30 aa, Mycobacterium
NAGRDFVSTAWWLELFPGLAIVGCTLAVTV

SEQ ID NO: 363802 - protein, 22 aa, Mycobacterium
NAGWWPVLWFTAKVWGFLFMYF

SEQ ID NO: 363803 - protein, 18 aa, Mycobacterium
NAHRWSLLALSADPPAAP

SEQ ID NO: 363804 - protein, 27 aa, Mycobacterium
NAIILAAAGFWWFLAPGPTGQVLLLVI

SEQ ID NO: 363805 - protein, 24 aa, Mycobacterium
NAKNVLFSVYAFSGLLAGLSGVML

SEQ ID NO: 363806 - protein, 26 aa, Mycobacterium
NAKRWGVLHVIWRQGLYPGIGAPSWT

SEQ ID NO: 363807 - protein, 38 aa, Mycobacterium
NALAAMIFAAVPWLHRFGDLIAPLTFIGAAYVTVFVST

SEQ ID NO: 363808 - protein, 20 aa, Mycobacterium
NALQRVAVERLLQLREAQKR

SEQ ID NO: 363809 - protein, 29 aa, Mycobacterium
NALRLMFDPVFGALFWGKIFSVVAVWTHG

SEQ ID NO: 363810 - protein, 23 aa, Mycobacterium
NALWAMMFGFFMILVDATIVSVA

SEQ ID NO: 363811 - protein, 22 aa, Mycobacterium
NALWSMMIGFFMIMLDSTIVAI

SEQ ID NO: 363812 - protein, 18 aa, Mycobacterium
NAMLLTFGATIPIAAGVS

SEQ ID NO: 363813 - protein, 23 aa, Mycobacterium
NANFKRIMKLFLSPDGHAARFII

SEQ ID NO: 363814 - protein, 30 aa, Mycobacterium
NANLQRPLLGWALFAVLIGWSAACAVAYLR

SEQ ID NO: 363815 - protein, 22 aa, Mycobacterium
NANLTMLALFDAPTVRNLAQQL

SEQ ID NO: 363816 - protein, 21 aa, Mycobacterium
NAPLHYERFGPPPVIDGVPFE

SEQ ID NO: 363817 - protein, 22 aa, Mycobacterium
NAPLPWSFTIVTTLPSMSANIM

SEQ ID NO: 363818 - protein, 24 aa, Mycobacterium
NAPNGLLLVDSWMCAISGRAEQFG

SEQ ID NO: 363819 - protein, 18 aa, Mycobacterium
NAPTKPYRLRVIVHEDDN

SEQ ID NO: 363820 - protein, 28 aa, Mycobacterium
NAPTPAYPGYPPYQPYPQPGQHAPHGGA

SEQ ID NO: 363821 - protein, 17 aa, Mycobacterium
NAPVPIQPPPPGPNVAP

SEQ ID NO: 363822 - protein, 20 aa, Mycobacterium
NAPWQVVGLLVDGPVLSKEA

SEQ ID NO: 363823 - protein, 20 aa, Mycobacterium
NAQDWRWLVITDADKRAAVA

SEQ ID NO: 363824 - protein, 24 aa, Mycobacterium
NAQQPLMLVTPRPVWTFGPFDVSG

SEQ ID NO: 363825 - protein, 24 aa, Mycobacterium
NARDFLRIDIVIFGLTIYALLGIV

SEQ ID NO: 363826 - protein, 37 aa, Mycobacterium
NARDRWSTWWSSHVGLGLSLLAGAAALVLLSGYVVPR

SEQ ID NO: 363827 - protein, 22 aa, Mycobacterium
NARGLIELILLNIGLEAGVITP

SEQ ID NO: 363828 - protein, 24 aa, Mycobacterium
NARGQYLPFTLGYQGVPAIFVSGT

SEQ ID NO: 363829 - protein, 21 aa, Mycobacterium
NARQMLLVNMMTDALPAAALA

SEQ ID NO: 363830 - protein, 25 aa, Mycobacterium
NASIWTIVLALPGPAPTWLLVVLIV

SEQ ID NO: 363831 - protein, 23 aa, Mycobacterium
NASPWAWYIVVAAAAGAALRARV

SEQ ID NO: 363832 - protein, 21 aa, Mycobacterium
NASWSWIFFNRGKLGTAAIAA

SEQ ID NO: 363833 - protein, 22 aa, Mycobacterium
NATIFFSVILPALAPSLLSGAG

SEQ ID NO: 363834 - protein, 19 aa, Mycobacterium
NATLILSFLGGFFVEDNRG

SEQ ID NO: 363835 - protein, 23 aa, Mycobacterium
NATQLVIGTSRRSRWARLFEEGI

SEQ ID NO: 363836 - protein, 25 aa, Mycobacterium
NATRFMFAVTFFGSCLLFPAYFQQV

SEQ ID NO: 363837 - protein, 22 aa, Mycobacterium
NAVAALTWDIPPGPASAPFNVR

SEQ ID NO: 363838 - protein, 21 aa, Mycobacterium
NAVAALTWDIPPGPASVPPSV

SEQ ID NO: 363839 - protein, 17 aa, Mycobacterium
NAVALLILALPVGNLTA

SEQ ID NO: 363840 - protein, 17 aa, Mycobacterium
NAVKFRHKDRRPRVVIE

SEQ ID NO: 363841 - protein, 32 aa, Mycobacterium
NAVMAVVFAVIPLLYRLGELVPALALVIAANV

SEQ ID NO: 363842 - protein, 32 aa, Mycobacterium
NAVNLIVRFKDFLIPLVAGLVAYKTVMLAITV

SEQ ID NO: 363843 - protein, 23 aa, Mycobacterium
NAVPASFRVGYADYLRTANNMDL

SEQ ID NO: 363844 - protein, 26 aa, Mycobacterium
NAVREGHDLPPIPTLLVVADEFTLML

SEQ ID NO: 363845 - protein, 21 aa, Mycobacterium
NAWQTFWRVTLPSIRWGLTYG

SEQ ID NO: 363846 - protein, 17 aa, Mycobacterium
NAWVPAGAIAFGLIVVT

SEQ ID NO: 363847 - protein, 24 aa, Mycobacterium
NAYGKVLFAITLTAAAVLVALAGR

SEQ ID NO: 363848 - protein, 25 aa, Mycobacterium
NAYGKVLFAITLTAAAVLVTLAGRR

SEQ ID NO: 363849 - protein, 25 aa, Mycobacterium
NAYGKVLFVITLTGGVVLALLVGRR

SEQ ID NO: 363850 - protein, 31 aa, Mycobacterium
NAYKPLARKGFLSIWSWMFGLVVTEFPLQTM

SEQ ID NO: 363851 - protein, 31 aa, Mycobacterium
NAYRPLARSGYLSLFSWMFGLVVTELPLQTL

SEQ ID NO: 363852 - protein, 17 aa, Mycobacterium
NAYVYFKSDTLALRAMH

SEQ ID NO: 363853 - protein, 29 aa, Mycobacterium
NCLDVARWERSGWRVFRLGARAPVGDTQN

SEQ ID NO: 363854 - protein, 22 aa, Mycobacterium
NCRLRVLVLGYSGLLAGIAGFI

SEQ ID NO: 363855 - protein, 30 aa, Mycobacterium
NCTIKVMVGFLFLYPAFVAKAHDADGWVQL

SEQ ID NO: 363856 - protein, 29 aa, Mycobacterium
NCTIKVMVGFLFLYPAFVAKAHDANGWVQ

SEQ ID NO: 363857 - protein, 30 aa, Mycobacterium
NCTIKVMVGFLFLYPAFVAKAHDASGWAQV

SEQ ID NO: 363858 - protein, 30 aa, Mycobacterium
NCTIKVMVGFLFLYPAFVAKAHQASGWVQL

SEQ ID NO: 363859 - protein, 29 aa, Mycobacterium
NCTIKVMVGFLFLYPAFVAKSHDASGWEQ

SEQ ID NO: 363860 - protein, 30 aa, Mycobacterium
NCTVKVMVGFLFLYPAFVAKAHDASGWEQL

SEQ ID NO: 363861 - protein, 27 aa, Mycobacterium
NDADRVFWLIVLLSLFSWMISSRIVRG

SEQ ID NO: 363862 - protein, 31 aa, Mycobacterium
NDEIRSRTRLWLPYLPLLVAAAVGLGHAVGL

SEQ ID NO: 363863 - protein, 25 aa, Mycobacterium
NDGLALPFVMIFLATAQGAGSDVLW

SEQ ID NO: 363864 - protein, 24 aa, Mycobacterium
NDGLALPFVMIFLATAQGAGSELV

SEQ ID NO: 363865 - protein, 24 aa, Mycobacterium
NDIEQLLVLLPQATAVQAGGDVPN

SEQ ID NO: 363866 - protein, 19 aa, Mycobacterium
NDIIALKFHISLNATTWIG

SEQ ID NO: 363867 - protein, 19 aa, Mycobacterium
NDIIWLVVAVVFLVVVVTS

SEQ ID NO: 363868 - protein, 27 aa, Mycobacterium
NDILTMMLATFGLVFLIVMAITRTLAG

SEQ ID NO: 363869 - protein, 31 aa, Mycobacterium
NDILTMMLATFGLVFLIVMVITRTLAGSVIV

SEQ ID NO: 363870 - protein, 27 aa, Mycobacterium
NDINGWRDWVLGAMVLIVLGAAALLGL

SEQ ID NO: 363871 - protein, 24 aa, Mycobacterium
NDIYYLPNLVAWACAKDPGALSFS

SEQ ID NO: 363872 - protein, 22 aa, Mycobacterium
NDMAWFFFIAPVGTIVVANLCL

SEQ ID NO: 363873 - protein, 27 aa, Mycobacterium
NDMQAWGWRLPFLVAAPLGLVGIYLRT

SEQ ID NO: 363874 - protein, 18 aa, Mycobacterium
NDNGPPPPFTSWQPPGVP

SEQ ID NO: 363875 - protein, 25 aa, Mycobacterium
NDPLSFLDCLYYATVSLSTTGYGDI

SEQ ID NO: 363876 - protein, 40 aa, Mycobacterium
NDQYIVSVLILWTPVMVFGFVLMWMLAWMTATPVGVVRAA

SEQ ID NO: 363877 - protein, 32 aa, Mycobacterium
NDRRRTWALISPALSILVAMAVLFGVGDAWHI

SEQ ID NO: 363878 - protein, 18 aa, Mycobacterium
NDRVLPRIIADKPDFVFT

SEQ ID NO: 363879 - protein, 18 aa, Mycobacterium
NDRYYIPASLPSIQGFQA

SEQ ID NO: 363880 - protein, 23 aa, Mycobacterium
NDSGNRLAPRPVSRPPVDPASRR

SEQ ID NO: 363881 - protein, 20 aa, Mycobacterium
NEAELLDWIHAAADAGEPVV

SEQ ID NO: 363882 - protein, 38 aa, Mycobacterium
NEDTGRKWNKWWLLAVVPLLLLAGLVAFAVMRHRARPG

SEQ ID NO: 363883 - protein, 23 aa, Mycobacterium
NEGRGDFFAVVRSLALFVNALHQ

SEQ ID NO: 363884 - protein, 29 aa, Mycobacterium
NEGRGDFFAVVRSLALFVNALHQDDKQFV

SEQ ID NO: 363885 - protein, 31 aa, Mycobacterium
NEIALNILLAALTIIFVFAVATLQPLAIYAK

SEQ ID NO: 363886 - protein, 33 aa, Mycobacterium
NEIALNILLASLTIIFVFTVVTLQPLAIYSKAN

SEQ ID NO: 363887 - protein, 21 aa, Mycobacterium
NEIFPKWFAYVSIWQIITEVI

SEQ ID NO: 363888 - protein, 33 aa, Mycobacterium
NEIPEVVPPNKFQKLLPLLMGVAIIGMIGIFLS

SEQ ID NO: 363889 - protein, 18 aa, Mycobacterium
NELGPVIRSWLGAQSLTL

SEQ ID NO: 363890 - protein, 24 aa, Mycobacterium
NELHLRVLLICASVIGGTVVVGWV

SEQ ID NO: 363891 - protein, 17 aa, Mycobacterium
NELLTVMLIIGVSAPVS

SEQ ID NO: 363892 - protein, 18 aa, Mycobacterium
NEPPPPGIPALDVVAPAP

SEQ ID NO: 363893 - protein, 26 aa, Mycobacterium
NEQIMPLLVVSLMLQLVLAGGVVPVT

SEQ ID NO: 363894 - protein, 17 aa, Mycobacterium
NERALTAANWGEGGAAA

SEQ ID NO: 363895 - protein, 31 aa, Mycobacterium
NERVLRLPLRGTVPTVLPFLVGHPDNVAVDT

SEQ ID NO: 363896 - protein, 24 aa, Mycobacterium
NESDWLFVSILGPIGFAGIALVSS

SEQ ID NO: 363897 - protein, 20 aa, Mycobacterium
NETFRNIVQATWTAIKNVIG

SEQ ID NO: 363898 - protein, 20 aa, Mycobacterium
NETLVLCVIALFAVNVVLTT

SEQ ID NO: 363899 - protein, 30 aa, Mycobacterium
NEVLQFFVILAFLVPLTIFGLIKVGGWSGL

SEQ ID NO: 363900 - protein, 26 aa, Mycobacterium
NEVTTALLAQTVRLLYSVRAEVAVLD

SEQ ID NO: 363901 - protein, 32 aa, Mycobacterium
NEWLQSWTIFYWAWWISWTPFVGMFIARISRG

SEQ ID NO: 363902 - protein, 29 aa, Mycobacterium
NFADPPPGWRLLNLDAVRPFATGAGITVA

SEQ ID NO: 363903 - protein, 24 aa, Mycobacterium
NFDDFLRPLRNYLYWEPHCYDIPM

SEQ ID NO: 363904 - protein, 23 aa, Mycobacterium
NFEKFAWLFMRFSGIALFVLAIG

SEQ ID NO: 363905 - protein, 23 aa, Mycobacterium
NFEKFAWLFMRFSGVALIVLAVG

SEQ ID NO: 363906 - protein, 23 aa, Mycobacterium
NFEKYAWLFMRFSGVVLVFLALG

SEQ ID NO: 363907 - protein, 25 aa, Mycobacterium
NFFAWALSVMFLVFTLRAILYKPFV

SEQ ID NO: 363908 - protein, 25 aa, Mycobacterium
NFFRTLYVLPWVCAPLAIAVMWRWI

SEQ ID NO: 363909 - protein, 31 aa, Mycobacterium
NFGVPWSNSFPKWRWSLTTALLELSVVVLVV

SEQ ID NO: 363910 - protein, 19 aa, Mycobacterium
NFLGFFPGLNDVVPIIINA

SEQ ID NO: 363911 - protein, 19 aa, Mycobacterium
NFLGFRLSAAPFNLPQTVV

SEQ ID NO: 363912 - protein, 27 aa, Mycobacterium
NFLGLPLNFLFFAVLAVCTVSAGATVI

SEQ ID NO: 363913 - protein, 27 aa, Mycobacterium
NFLQVFLTWLIFNVLISVGSFVCYIGL

SEQ ID NO: 363914 - protein, 20 aa, Mycobacterium
NFLRITALSIVLLALGAMVS

SEQ ID NO: 363915 - protein, 31 aa, Mycobacterium
NFNRPYALWVPIVLLVPLGLVLMLARRRPSF

SEQ ID NO: 363916 - protein, 23 aa, Mycobacterium
NFPDALLLLRLKQIGFSVVGVIM

SEQ ID NO: 363917 - protein, 24 aa, Mycobacterium
NFQLWQLLVFIPIAAILGGQVGYW

SEQ ID NO: 363918 - protein, 25 aa, Mycobacterium
NFRDVLVALGMYPGGGALGAEGAGV

SEQ ID NO: 363919 - protein, 21 aa, Mycobacterium
NFSRRFVPTSFIVSAITLLIT

SEQ ID NO: 363920 - protein, 25 aa, Mycobacterium
NFSRRFVPTSFIVSALTLAVTGDVR

SEQ ID NO: 363921 - protein, 22 aa, Mycobacterium
NFVFAVLPPYWPAKAFWLASDH

SEQ ID NO: 363922 - protein, 21 aa, Mycobacterium
NFVIYAITIVCVVFLNLLEGV

SEQ ID NO: 363923 - protein, 43 aa, Mycobacterium
NFWGALEAVIMLVLTETWFAIGVMLIPLLLSALVLEVVDVIGS

SEQ ID NO: 363924 - protein, 17 aa, Mycobacterium
NFWRLSFVQVANTFAAT

SEQ ID NO: 363925 - protein, 23 aa, Mycobacterium
NGAIWVSLAAVIVLQVLVVQLDV

SEQ ID NO: 363926 - protein, 19 aa, Mycobacterium
NGALFRLTVPLVRGHKVTT

SEQ ID NO: 363927 - protein, 23 aa, Mycobacterium
NGATIPYYICQFGLRGTDLNGKT

SEQ ID NO: 363928 - protein, 25 aa, Mycobacterium
NGATSALMLLALLAGLLALAFGLPT

SEQ ID NO: 363929 - protein, 24 aa, Mycobacterium
NGAVRARFLTDRLIFDSQYTKEIC

SEQ ID NO: 363930 - protein, 22 aa, Mycobacterium
NGAWWPYLIGGVVYNLAIAWAL

SEQ ID NO: 363931 - protein, 17 aa, Mycobacterium
NGDPPDAHLPFRSGRAF

SEQ ID NO: 363932 - protein, 27 aa, Mycobacterium
NGEAARSVMFWLLGSLGASSWDKVPVA

SEQ ID NO: 363933 - protein, 17 aa, Mycobacterium
NGEPPLGPMLLAADARR

SEQ ID NO: 363934 - protein, 32 aa, Mycobacterium
NGEQLLLTMFIPITLLIGLILLPLGSFGPNRA

SEQ ID NO: 363935 - protein, 30 aa, Mycobacterium
NGEQLLLTMFIPITLLIGLTLLPLGQFPGS

SEQ ID NO: 363936 - protein, 30 aa, Mycobacterium
NGEQLLLTMFIPITLLIGLTLLPLGSFGDD

SEQ ID NO: 363937 - protein, 31 aa, Mycobacterium
NGEQLLLTMFIPITLLIGLTLLPLGSFGQHR

SEQ ID NO: 363938 - protein, 27 aa, Mycobacterium
NGEQLLLTMFIPITLLVGLTLLPFGSF

SEQ ID NO: 363939 - protein, 28 aa, Mycobacterium
NGEQLLLTMFIPITLLVGLTLLPLGSFG

SEQ ID NO: 363940 - protein, 29 aa, Mycobacterium
NGEQLLLTMFIPITLLVGLTLLPLGSFGQ

SEQ ID NO: 363941 - protein, 21 aa, Mycobacterium
NGFDLVPYYPLILTGFLLLTS

SEQ ID NO: 363942 - protein, 22 aa, Mycobacterium
NGFHGKWPWQMTHQMDGAVQID

SEQ ID NO: 363943 - protein, 35 aa, Mycobacterium
NGFIGKWPAELGGQPALWIPGSSISAARLAGAATQ

SEQ ID NO: 363944 - protein, 35 aa, Mycobacterium
NGFLARYFFPQPRPEWLWIALSLLVLAAGLAVAVW

SEQ ID NO: 363945 - protein, 21 aa, Mycobacterium
NGFTELLLGLALAFRRTRIVG

SEQ ID NO: 363946 - protein, 18 aa, Mycobacterium
NGGGGGGPVWPFPFGGGH

SEQ ID NO: 363947 - protein, 24 aa, Mycobacterium
NGGIAWVPFFIGVGAAIVLIALYE

SEQ ID NO: 363948 - protein, 35 aa, Mycobacterium
NGGSVGRWIVAVAALAVLTIVVVIAFNTFGGTARD

SEQ ID NO: 363949 - protein, 24 aa, Mycobacterium
NGHRPFAGQLLLPNVAGLTLLEAA

SEQ ID NO: 363950 - protein, 25 aa, Mycobacterium
NGHTTFLELAPNPVALMQVGLTTAA

SEQ ID NO: 363951 - protein, 22 aa, Mycobacterium
NGIAATTFLLTAGVPLIVELGA

SEQ ID NO: 363952 - protein, 25 aa, Mycobacterium
NGIATWKQAITHLPPTIRKAVAKSG

SEQ ID NO: 363953 - protein, 23 aa, Mycobacterium
NGIIFLSAVAILFVVAFKAEVTA

SEQ ID NO: 363954 - protein, 29 aa, Mycobacterium
NGINRILQFITYLLVPAGLLTIYTQLFTT

SEQ ID NO: 363955 - protein, 28 aa, Mycobacterium
NGINRILQFITYLLVPAGLLTVYTQLFT

SEQ ID NO: 363956 - protein, 23 aa, Mycobacterium
NGISIVAFPWLVLQRTGSALDAS

SEQ ID NO: 363957 - protein, 25 aa, Mycobacterium
NGLDAAHRLGLIHRDIKPSNILITD

SEQ ID NO: 363958 - protein, 27 aa, Mycobacterium
NGLGGYFFRYLFSNPIPYARAGLDPKR

SEQ ID NO: 363959 - protein, 27 aa, Mycobacterium
NGLSAFYYALLLLLAGFTGSIVVSTLV

SEQ ID NO: 363960 - protein, 24 aa, Mycobacterium
NGLTLLLLAAWLADEAIRRLIHPP

SEQ ID NO: 363961 - protein, 19 aa, Mycobacterium
NGMFLVLLGLLWPHLHLSH

SEQ ID NO: 363962 - protein, 18 aa, Mycobacterium
NGMRLLTNRSWRAAASPV

SEQ ID NO: 363963 - protein, 32 aa, Mycobacterium
NGMTRTVLGASLPWTMIVTPSPGITGGSITAT

SEQ ID NO: 363964 - protein, 22 aa, Mycobacterium
NGPLPYIVMEYVDGVTLRDIVH

SEQ ID NO: 363965 - protein, 21 aa, Mycobacterium
NGPLRSVLEDNYRALKIIETS

SEQ ID NO: 363966 - protein, 26 aa, Mycobacterium
NGPPPPFTSWMPPDYPPQAPQIPYPK

SEQ ID NO: 363967 - protein, 26 aa, Mycobacterium
NGQPPIQIPLLPDNVSRQAFPPEPSK

SEQ ID NO: 363968 - protein, 23 aa, Mycobacterium
NGRMPLPNRLLATKPFVSLGAMA

SEQ ID NO: 363969 - protein, 17 aa, Mycobacterium
NGRRIRTLAARSALAIA

SEQ ID NO: 363970 - protein, 17 aa, Mycobacterium
NGSLWSLVWEVICYLAV

SEQ ID NO: 363971 - protein, 23 aa, Mycobacterium
NGTPGKFMPILPSQQQAPLPPPP

SEQ ID NO: 363972 - protein, 17 aa, Mycobacterium
NGVLYRGFLLGASNVFR

SEQ ID NO: 363973 - protein, 17 aa, Mycobacterium
NGVRRIVMLTGDHPDIA

SEQ ID NO: 363974 - protein, 33 aa, Mycobacterium
NGWDPGRQVIGLNLILSFSPAWTYVRDDCPRYG

SEQ ID NO: 363975 - protein, 24 aa, Mycobacterium
NGWGTALWFILIGGGVLAGGWALI

SEQ ID NO: 363976 - protein, 27 aa, Mycobacterium
NHAVAYDYFYDVLGRRSYDNAGAPVIV

SEQ ID NO: 363977 - protein, 29 aa, Mycobacterium
NHDAGTWLFDMGILGLLSLVMAGFVRWRI

SEQ ID NO: 363978 - protein, 39 aa, Mycobacterium
NHDLRFIIAMTICVVLLILIALLRAVVAPLYLIGTVIVS

SEQ ID NO: 363979 - protein, 24 aa, Mycobacterium
NHDWPFASTAFATALPWLAARIGT

SEQ ID NO: 363980 - protein, 22 aa, Mycobacterium
NHMSWLDVFAIGAVLPGSFVAR

SEQ ID NO: 363981 - protein, 34 aa, Mycobacterium
NHPALAKAFLRFNTHLLFASTLPARVRELAILRV

SEQ ID NO: 363982 - protein, 23 aa, Mycobacterium
NHPAVFTPLMWTAQLVKGGVGDT

SEQ ID NO: 363983 - protein, 17 aa, Mycobacterium
NHRLTTWIGWGVAVLIS

SEQ ID NO: 363984 - protein, 29 aa, Mycobacterium
NHRMDPVDLLPFLLLGTTFGVRLLGIAYG

SEQ ID NO: 363985 - protein, 24 aa, Mycobacterium
NHRVTTLLGWIIAALISALNVVLI

SEQ ID NO: 363986 - protein, 25 aa, Mycobacterium
NHVAQLVIPFLLFAPQPVASTAAAV

SEQ ID NO: 363987 - protein, 21 aa, Mycobacterium
NIAPAPWILVPGGEAAAVVGP

SEQ ID NO: 363988 - protein, 18 aa, Mycobacterium
NIAQWYAFEFFFTTSHYA

SEQ ID NO: 363989 - protein, 29 aa, Mycobacterium
NIDATLIRMLVIFGIVTAVALAAATIAGV

SEQ ID NO: 363990 - protein, 25 aa, Mycobacterium
NIDIGPNLPFLLSLYAPPAEAESEI

SEQ ID NO: 363991 - protein, 27 aa, Mycobacterium
NIDLSRTVGWFTTKYPVSLAVGGLRWT

SEQ ID NO: 363992 - protein, 29 aa, Mycobacterium
NIEPALRFYVVFFLALLFVTWHCYLRSKT

SEQ ID NO: 363993 - protein, 29 aa, Mycobacterium
NIGAALTRWLRLANTCVIFLFAAAVVVMA

SEQ ID NO: 363994 - protein, 22 aa, Mycobacterium
NIGLAWMVFATLLPLGILQLYH

SEQ ID NO: 363995 - protein, 23 aa, Mycobacterium
NIGLAWMVFVTLLPLGVLQLYHS

SEQ ID NO: 363996 - protein, 20 aa, Mycobacterium
NIGVFGVNLIGLSAGAPLDT

SEQ ID NO: 363997 - protein, 23 aa, Mycobacterium
NIGVPLAFHLGYHSVPFGVMAGF

SEQ ID NO: 363998 - protein, 26 aa, Mycobacterium
NIGVPLWIDVVLPIIVWALYIGSRRH

SEQ ID NO: 363999 - protein, 26 aa, Mycobacterium
NIIDTAMWALLSWLVVRWVRTRRDGL

SEQ ID NO: 364000 - protein, 17 aa, Mycobacterium
NIIFYYSTTLWQSVGFS

SEQ ID NO: 364001 - protein, 29 aa, Mycobacterium
NIIVRFNLLFIFIALFAVASVTAPQFLTS

SEQ ID NO: 364002 - protein, 18 aa, Mycobacterium
NIIVTPDDFAYLVDFGIA

SEQ ID NO: 364003 - protein, 25 aa, Mycobacterium
NIIYATFTFIFFALEGSIMAQGLKL

SEQ ID NO: 364004 - protein, 33 aa, Mycobacterium
NIKTPAWLRGLMPVVIIPLIASLAVGLIMFFLI

SEQ ID NO: 364005 - protein, 19 aa, Mycobacterium
NILGYKLIPWSDVVGLSFP

SEQ ID NO: 364006 - protein, 23 aa, Mycobacterium
NILITGNDFAYLVDFGIAAAATD

SEQ ID NO: 364007 - protein, 19 aa, Mycobacterium
NILLAFPMGVPLEWNVFMI

SEQ ID NO: 364008 - protein, 26 aa, Mycobacterium
NILLDADDFAYLIDFGIARAAGELGL

SEQ ID NO: 364009 - protein, 32 aa, Mycobacterium
NILTGLRLVLVPIFLYALFYDGGHQTPARVAA

SEQ ID NO: 364010 - protein, 28 aa, Mycobacterium
NILVIVYALIPVLWILSLSLKPTSSVKD

SEQ ID NO: 364011 - protein, 20 aa, Mycobacterium
NILVTADDFAYLVDFGIASA

SEQ ID NO: 364012 - protein, 25 aa, Mycobacterium
NIMALYLWHMIPVVIVAIVGYPAGL

SEQ ID NO: 364013 - protein, 20 aa, Mycobacterium
NINAFYPQRFKGWALGLNAG

SEQ ID NO: 364014 - protein, 20 aa, Mycobacterium
NINAFYPQRLKGWALGLNAG

SEQ ID NO: 364015 - protein, 17 aa, Mycobacterium
NINRFLGVDFAGFSKMV

SEQ ID NO: 364016 - protein, 24 aa, Mycobacterium
NIPAWLLLVALVILVAGGAVLIQM

SEQ ID NO: 364017 - protein, 20 aa, Mycobacterium
NIPICWAMRSVFDGLDGVDK

SEQ ID NO: 364018 - protein, 18 aa, Mycobacterium
NIPPTRFKRKEHWLDVHF

SEQ ID NO: 364019 - protein, 18 aa, Mycobacterium
NIRVAMLLAAAWLAVLAS

SEQ ID NO: 364020 - protein, 39 aa, Mycobacterium
NITIITIILIIVMLLLVYRSFSTLLLPLAGVLIEMLVTK

SEQ ID NO: 364021 - protein, 19 aa, Mycobacterium
NIVAGLIVGVLLFLSGILM

SEQ ID NO: 364022 - protein, 24 aa, Mycobacterium
NIVEAVLFHRLVVLLGVALIVWAT

SEQ ID NO: 364023 - protein, 19 aa, Mycobacterium
NIVFAAFLVAAGRMADLLG

SEQ ID NO: 364024 - protein, 21 aa, Mycobacterium
NIVGQRYLGLSLGKKGSPDQL

SEQ ID NO: 364025 - protein, 23 aa, Mycobacterium
NIVWYLIVGAFVLRFLLKVKPIK

SEQ ID NO: 364026 - protein, 31 aa, Mycobacterium
NIWLDRLRTLARRTCVVTLPYAQADLDALQR

SEQ ID NO: 364027 - protein, 22 aa, Mycobacterium
NKDAWMVGFTPSLSTAVWVGTD

SEQ ID NO: 364028 - protein, 28 aa, Mycobacterium
NKGRAVRLLMGLLLSAFTTIGIAAPALA

SEQ ID NO: 364029 - protein, 31 aa, Mycobacterium
NKGVALRVRLQKALPPLWADEQRLSQVLGNL

SEQ ID NO: 364030 - protein, 18 aa, Mycobacterium
NKIFFPDVSPAIGLIAAM

SEQ ID NO: 364031 - protein, 26 aa, Mycobacterium
NKNLSPPYSILAIGDPPTLAAAMNIP

SEQ ID NO: 364032 - protein, 26 aa, Mycobacterium
NKPAVKFTILGFGAVVAVLVVRKVAG

SEQ ID NO: 364033 - protein, 17 aa, Mycobacterium
NKPRRAFRRLTRSTLET

SEQ ID NO: 364034 - protein, 31 aa, Mycobacterium
NKSIEQSLVILPALFSALLTVAGGAPMDEGA

SEQ ID NO: 364035 - protein, 19 aa, Mycobacterium
NKTVLLITLVTVGVIFLML

SEQ ID NO: 364036 - protein, 19 aa, Mycobacterium
NKTWLGVAAVAVVAALIGG

SEQ ID NO: 364037 - protein, 28 aa, Mycobacterium
NKVQTVVTPAWYAPLVLTVGGIGQNGVP

SEQ ID NO: 364038 - protein, 23 aa, Mycobacterium
NLADIWMRPDLPRDGKAPVLLQV

SEQ ID NO: 364039 - protein, 25 aa, Mycobacterium
NLAGGWLIMWLVMTAYPKLHEKTTT

SEQ ID NO: 364040 - protein, 20 aa, Mycobacterium
NLAMPLTLIGALGGLALVLV

SEQ ID NO: 364041 - protein, 22 aa, Mycobacterium
NLARSLFAFLTLAGVVFCIASV

SEQ ID NO: 364042 - protein, 17 aa, Mycobacterium
NLATSMLKILRPGRSAP

SEQ ID NO: 364043 - protein, 17 aa, Mycobacterium
NLAVWLIPGMFGVAYRR

SEQ ID NO: 364044 - protein, 18 aa, Mycobacterium
NLCGILILPFFMVIVVQM

SEQ ID NO: 364045 - protein, 21 aa, Mycobacterium
NLCGILVLPFFMVIAVQMKRM

SEQ ID NO: 364046 - protein, 19 aa, Mycobacterium
NLDDFLRPLKNYFYWEPHC

SEQ ID NO: 364047 - protein, 18 aa, Mycobacterium
NLDDFMRPLRNYFYWEPH

SEQ ID NO: 364048 - protein, 19 aa, Mycobacterium
NLDDFMRPLRNYFYWEPHC

SEQ ID NO: 364049 - protein, 21 aa, Mycobacterium
NLDFFCAVIIAGLLAGLAGLS

SEQ ID NO: 364050 - protein, 20 aa, Mycobacterium
NLDIRWVVALIAINLAITFV

SEQ ID NO: 364051 - protein, 24 aa, Mycobacterium
NLEKIILGILFISLLPVMTAAWRT

SEQ ID NO: 364052 - protein, 18 aa, Mycobacterium
NLFGIVLAGVLVLWVRPR

SEQ ID NO: 364053 - protein, 24 aa, Mycobacterium
NLFTLLAIIPFVGELLVLVAGIVI

SEQ ID NO: 364054 - protein, 31 aa, Mycobacterium
NLFTVEFLWGRLPLYIVAIYPMMATVSFEIV

SEQ ID NO: 364055 - protein, 19 aa, Mycobacterium
NLFVTYWSFRAMIGLAAGS

SEQ ID NO: 364056 - protein, 23 aa, Mycobacterium
NLGAIALWALSRTAGAPFGPNAG

SEQ ID NO: 364057 - protein, 24 aa, Mycobacterium
NLGAIALWVFSRSAGVPFGPHAGG

SEQ ID NO: 364058 - protein, 27 aa, Mycobacterium
NLGDLKYLFFGLALVVLMIFRPQGLFP

SEQ ID NO: 364059 - protein, 23 aa, Mycobacterium
NLGEVCFALLTTVLTGRSLLNAR

SEQ ID NO: 364060 - protein, 22 aa, Mycobacterium
NLGEVSFALITTILTGRSVLNA

SEQ ID NO: 364061 - protein, 23 aa, Mycobacterium
NLGEVSFALITTLLTGRSVFNAR

SEQ ID NO: 364062 - protein, 28 aa, Mycobacterium
NLGYALQWPMFAGFCFYAYYKFVRYEEA

SEQ ID NO: 364063 - protein, 17 aa, Mycobacterium
NLHFLLSGYLFYWVVIG

SEQ ID NO: 364064 - protein, 24 aa, Mycobacterium
NLHSSYLEFAWPTLVLATGIGICT

SEQ ID NO: 364065 - protein, 30 aa, Mycobacterium
NLIATVVRFVLLRGWVFHPARTRRPSQAPS

SEQ ID NO: 364066 - protein, 20 aa, Mycobacterium
NLIAVGPPYVVPPGGPNLTD

SEQ ID NO: 364067 - protein, 19 aa, Mycobacterium
NLIAVVRDGVVIGSAVFSE

SEQ ID NO: 364068 - protein, 28 aa, Mycobacterium
NLIDPNPPLPPWQPYPMPRVPGTSDPDD

SEQ ID NO: 364069 - protein, 17 aa, Mycobacterium
NLKALYHQTGTSSEVVI

SEQ ID NO: 364070 - protein, 25 aa, Mycobacterium
NLLATVVRFVLLRGWVFHPRRTTTG

SEQ ID NO: 364071 - protein, 25 aa, Mycobacterium
NLLAWGALALYLLWRSGIGPKAIGL

SEQ ID NO: 364072 - protein, 23 aa, Mycobacterium
NLLILLVGFYLTCAVFVFGVLGV

SEQ ID NO: 364073 - protein, 23 aa, Mycobacterium
NLLLTMRMREEVFLHGAGLRTGM

SEQ ID NO: 364074 - protein, 19 aa, Mycobacterium
NLLLVARFKQELGAGLNTA

SEQ ID NO: 364075 - protein, 56 aa, Mycobacterium
NLLTPLTSAILLPAAIAVALLPISWPLGIAALGGVPLLLGALWASARLARRADAAA

SEQ ID NO: 364076 - protein, 23 aa, Mycobacterium
NLMLIPIFYLIFGSVITGGSDTD

SEQ ID NO: 364077 - protein, 17 aa, Mycobacterium
NLNLAMPLTLIGALGGL

SEQ ID NO: 364078 - protein, 29 aa, Mycobacterium
NLPAGFAIGWAMWPLVACSVLQAIAAVVV

SEQ ID NO: 364079 - protein, 24 aa, Mycobacterium
NLPATLVLLPLVAPAGPVAVLAVL

SEQ ID NO: 364080 - protein, 23 aa, Mycobacterium
NLPATLVLLPLVAPSGPVAILAV

SEQ ID NO: 364081 - protein, 23 aa, Mycobacterium
NLPKMISVLVEPWYSLAGDREQV

SEQ ID NO: 364082 - protein, 17 aa, Mycobacterium
NLPTGILPQGGPFTEAG

SEQ ID NO: 364083 - protein, 25 aa, Mycobacterium
NLPTIIYSLYWKRFNTRGALWSMYG

SEQ ID NO: 364084 - protein, 25 aa, Mycobacterium
NLPTIVYSLYWKRFNTRGALWSMYG

SEQ ID NO: 364085 - protein, 19 aa, Mycobacterium
NLPTLRQLSSLTGPTSAIS

SEQ ID NO: 364086 - protein, 26 aa, Mycobacterium
NLQPLDLVLLLIFGLMGLMMRRFGLP

SEQ ID NO: 364087 - protein, 22 aa, Mycobacterium
NLRAWFHRKAFYGTSAAPLTVR

SEQ ID NO: 364088 - protein, 25 aa, Mycobacterium
NLRDDAVATFFWMSNWIFVAQDTDY

SEQ ID NO: 364089 - protein, 20 aa, Mycobacterium
NLREALSQMWGLFRGETPGF

SEQ ID NO: 364090 - protein, 26 aa, Mycobacterium
NLRSLPVPFVLNQPPQPPGPPPAPGP

SEQ ID NO: 364091 - protein, 38 aa, Mycobacterium
NLRSQPVPFILNPAPQPPGPLPAPGPALAPPPEAPPAQ

SEQ ID NO: 364092 - protein, 26 aa, Mycobacterium
NLRSQPVPFIMNQPPPPPGPVPGPGQ

SEQ ID NO: 364093 - protein, 20 aa, Mycobacterium
NLSFDFNWFDPFSGLAMGAF

SEQ ID NO: 364094 - protein, 30 aa, Mycobacterium
NLSPLVAAGLFYLMLTIPLTHLVNYIDNRL

SEQ ID NO: 364095 - protein, 24 aa, Mycobacterium
NLSVKMWFFPVLSILTLAAITAVL

SEQ ID NO: 364096 - protein, 32 aa, Mycobacterium
NLTGLTWIRFLIWMAIGVVIYFLYGRRRSVLA

SEQ ID NO: 364097 - protein, 19 aa, Mycobacterium
NLTLIVVLGFGAYAAGHGY

SEQ ID NO: 364098 - protein, 20 aa, Mycobacterium
NLTLLAFAAAYFGSSLLIPT

SEQ ID NO: 364099 - protein, 19 aa, Mycobacterium
NLTLLVFTVGYVGAGLTLP

SEQ ID NO: 364100 - protein, 42 aa, Mycobacterium
NLTNRVMRRPLVFAIPIVLGMILLVIPLFNLSLGGMSEKYLP

SEQ ID NO: 364101 - protein, 28 aa, Mycobacterium
NLTTASRLLYLRVPALNALFPSYRTSVL

SEQ ID NO: 364102 - protein, 25 aa, Mycobacterium
NLVASLMVLLVRDPPRRVWRVLPLG

SEQ ID NO: 364103 - protein, 23 aa, Mycobacterium
NLVDFAPMMLLAFGTGALNTSFV

SEQ ID NO: 364104 - protein, 24 aa, Mycobacterium
NLVDLAAIRRIVNERFMSDAPAAL

SEQ ID NO: 364105 - protein, 20 aa, Mycobacterium
NLVGDRYLELLDGPGSPKRL

SEQ ID NO: 364106 - protein, 27 aa, Mycobacterium
NLVGGWVIMWLIMLGFPKLHAQTVESA

SEQ ID NO: 364107 - protein, 19 aa, Mycobacterium
NLVPLKIAIGLLCLSIVVL

SEQ ID NO: 364108 - protein, 20 aa, Mycobacterium
NLVPLLPFDGGHIGIAMFEK

SEQ ID NO: 364109 - protein, 20 aa, Mycobacterium
NLVTVFVYSALTLGSLAVVL

SEQ ID NO: 364110 - protein, 24 aa, Mycobacterium
NLVYLAYSVAIVALPFVILVSLIF

SEQ ID NO: 364111 - protein, 27 aa, Mycobacterium
NLWASLGIVAVLIPATIFGLGIGPAVL

SEQ ID NO: 364112 - protein, 22 aa, Mycobacterium
NLWNWPPAFFSWFAAGMVLAEL

SEQ ID NO: 364113 - protein, 19 aa, Mycobacterium
NMAFPLPYSPREAPAATPV

SEQ ID NO: 364114 - protein, 24 aa, Mycobacterium
NMAMGFIAGILLAIAVAVAREAND

SEQ ID NO: 364115 - protein, 24 aa, Mycobacterium
NMCDRLLILAPGGRLAYFGPPQQA

SEQ ID NO: 364116 - protein, 18 aa, Mycobacterium
NMEWIPVVTFLQVSADMA

SEQ ID NO: 364117 - protein, 29 aa, Mycobacterium
NMFGFTQPFLFGMPKFDFVACLTMIIVLM

SEQ ID NO: 364118 - protein, 36 aa, Mycobacterium
NMHRPRFAHLVRIFAVPIILGWVFVAVALAVVTPSL

SEQ ID NO: 364119 - protein, 31 aa, Mycobacterium
NMIMMSFISIPLVTVAWLLLGYTIAFSEDGA

SEQ ID NO: 364120 - protein, 31 aa, Mycobacterium
NMNVKAIMLHLLRHFRWHVPAGYQPRMTWGT

SEQ ID NO: 364121 - protein, 32 aa, Mycobacterium
NMPLELVLTVTPFLIISVLFYFTVVVQEKMLH

SEQ ID NO: 364122 - protein, 21 aa, Mycobacterium
NMQTQLPFTGLNSPTGLVVNG

SEQ ID NO: 364123 - protein, 17 aa, Mycobacterium
NMSANFVRNLWTFSIIF

SEQ ID NO: 364124 - protein, 25 aa, Mycobacterium
NMSRRLWQAWVSPGIDYVEACPGLQ

SEQ ID NO: 364125 - protein, 25 aa, Mycobacterium
NMTGNVIFLGFWLAPRTSIDLTAVV

SEQ ID NO: 364126 - protein, 25 aa, Mycobacterium
NMTGNVIFLGFWLAPRTSVDLTAVV

SEQ ID NO: 364127 - protein, 25 aa, Mycobacterium
NMVFSSWWLRRHCGYRTPVMFLLWV

SEQ ID NO: 364128 - protein, 19 aa, Mycobacterium
NMVPVWVAAGGLTGALLIG

SEQ ID NO: 364129 - protein, 22 aa, Mycobacterium
NNACLILLGLFPLFVMFIITAI

SEQ ID NO: 364130 - protein, 28 aa, Mycobacterium
NNEFFYWMSIALMMLIHAGFLAYEIGAS

SEQ ID NO: 364131 - protein, 26 aa, Mycobacterium
NNELAINLGRWMPLGATVILAVYCLS

SEQ ID NO: 364132 - protein, 17 aa, Mycobacterium
NNILLQAGSLLEQNRDA

SEQ ID NO: 364133 - protein, 31 aa, Mycobacterium
NNITIFTIILIVVMLLLVYRSAACLLVPLPA

SEQ ID NO: 364134 - protein, 32 aa, Mycobacterium
NNITIVTIFLIIFMLLMVYRSVTTMLVPLFGV

SEQ ID NO: 364135 - protein, 25 aa, Mycobacterium
NNLDNPVLGIFGTGNLPVQWDKVPA

SEQ ID NO: 364136 - protein, 17 aa, Mycobacterium
NNLPAVLMLLPLVAAAG

SEQ ID NO: 364137 - protein, 22 aa, Mycobacterium
NNLPAVLVLLPLVAGSGPAAVL

SEQ ID NO: 364138 - protein, 35 aa, Mycobacterium
NNLYGNYAWWFRLSGLGVLALLAWIALRRRNQCSL

SEQ ID NO: 364139 - protein, 25 aa, Mycobacterium
NNPADWDWIKWLPHNQHPLRLDALG

SEQ ID NO: 364140 - protein, 19 aa, Mycobacterium
NNPLPRVADEQPSHSTVPL

SEQ ID NO: 364141 - protein, 33 aa, Mycobacterium
NNRFFPPMGSILYWMRFGTIRLPPWPDRVPLTK

SEQ ID NO: 364142 - protein, 36 aa, Mycobacterium
NNRFFPPMGSVLYWLRPRTIRLPPWPNRVPLTAGDT

SEQ ID NO: 364143 - protein, 18 aa, Mycobacterium
NNSWVPLAAYVIILTLIT

SEQ ID NO: 364144 - protein, 42 aa, Mycobacterium
NNVFATFSGVPWLVTVNWWVLLAAFVLFITPVGRMSITVIGA

SEQ ID NO: 364145 - protein, 21 aa, Mycobacterium
NNVLVFPGIGLGIIVAGARLL

SEQ ID NO: 364146 - protein, 20 aa, Mycobacterium
NNYDLLIAAIAALSLIFLIM

SEQ ID NO: 364147 - protein, 35 aa, Mycobacterium
NPAAAIVTWTPLFYVFAYAATFAVMGTPIYAAIMG

SEQ ID NO: 364148 - protein, 30 aa, Mycobacterium
NPACGCYYDDVYWITFAGIAPADDPRYVIG

SEQ ID NO: 364149 - protein, 29 aa, Mycobacterium
NPAGLSLNPLSWAGGLWRASVATTGAAAH

SEQ ID NO: 364150 - protein, 25 aa, Mycobacterium
NPAPRSLWVWIAISGATVVVLVAGW

SEQ ID NO: 364151 - protein, 17 aa, Mycobacterium
NPCGFAFLPGYLGLVIA

SEQ ID NO: 364152 - protein, 17 aa, Mycobacterium
NPDALLVLLLVVAAYFM

SEQ ID NO: 364153 - protein, 23 aa, Mycobacterium
NPDGSINILVALRVKVASDQTEN

SEQ ID NO: 364154 - protein, 22 aa, Mycobacterium
NPDLLPHLFERFVRADKSRSRA

SEQ ID NO: 364155 - protein, 26 aa, Mycobacterium
NPDPRLSTAPPPRPYQPAFNTPPPSP

SEQ ID NO: 364156 - protein, 26 aa, Mycobacterium
NPDRGLRRLAIERGWQVLSFSRPVSL

SEQ ID NO: 364157 - protein, 22 aa, Mycobacterium
NPDRWNILLAPLPGPTPPQYPS

SEQ ID NO: 364158 - protein, 25 aa, Mycobacterium
NPEDPKWSWLKWLPHTQHQTDTDAA

SEQ ID NO: 364159 - protein, 18 aa, Mycobacterium
NPEELLVASLSQCHMLWY

SEQ ID NO: 364160 - protein, 20 aa, Mycobacterium
NPFTLLAVTAARWPNRVAVI

SEQ ID NO: 364161 - protein, 29 aa, Mycobacterium
NPGADYLRSLVMKMWPQIKDIGGRRAEDG

SEQ ID NO: 364162 - protein, 29 aa, Mycobacterium
NPGADYLRSLVMRMWPQIKSIGGRRSEDG

SEQ ID NO: 364163 - protein, 23 aa, Mycobacterium
NPGIGFPGYVDYLPATRGTPQPP

SEQ ID NO: 364164 - protein, 21 aa, Mycobacterium
NPGIPLVGNPVLLESLENTRK

SEQ ID NO: 364165 - protein, 26 aa, Mycobacterium
NPGLMMPTFFLGSIGGLVLVLIATFG

SEQ ID NO: 364166 - protein, 21 aa, Mycobacterium
NPIAKLVWRVLHIDGRAARYR

SEQ ID NO: 364167 - protein, 23 aa, Mycobacterium
NPKLGWWLMEIPATVVFAIFYLT

SEQ ID NO: 364168 - protein, 24 aa, Mycobacterium
NPLGWGILGLFFSILTLIVVIVIP

SEQ ID NO: 364169 - protein, 17 aa, Mycobacterium
NPLLGGLAVAHRSGLVH

SEQ ID NO: 364170 - protein, 19 aa, Mycobacterium
NPLLWVTLVGTMCVLAPSP

SEQ ID NO: 364171 - protein, 25 aa, Mycobacterium
NPLNWPPAFFSWFAAGMLLAEWVHS

SEQ ID NO: 364172 - protein, 28 aa, Mycobacterium
NPLQWAYHLILPWITLAVLFVGFYSRVL

SEQ ID NO: 364173 - protein, 24 aa, Mycobacterium
NPLSFLDCLYYATVSLSTTGYGDI

SEQ ID NO: 364174 - protein, 32 aa, Mycobacterium
NPMTTTYITVPFVPVPIPIQVPSREQPQPQYP

SEQ ID NO: 364175 - protein, 18 aa, Mycobacterium
NPPPPNRRNPWPIIAAVA

SEQ ID NO: 364176 - protein, 22 aa, Mycobacterium
NPPPRMFRLPADRALLNRMGFN

SEQ ID NO: 364177 - protein, 21 aa, Mycobacterium
NPPYMTFRWSSQGPGGQVGSS

SEQ ID NO: 364178 - protein, 26 aa, Mycobacterium
NPQAVFFSFAVTVAAALVIMLIHTYY

SEQ ID NO: 364179 - protein, 50 aa, Mycobacterium
NPQRIPPYRTTALVFLIVSAVVLGFVWLQFRGRLTPTTQLTMLAPRAGLV

SEQ ID NO: 364180 - protein, 20 aa, Mycobacterium
NPRMPALRTDIAQLAALGDT

SEQ ID NO: 364181 - protein, 27 aa, Mycobacterium
NPTAWTNWVEIFLLLVISSALPRTFGR

SEQ ID NO: 364182 - protein, 31 aa, Mycobacterium
NPTDGDLPMWPFVVAVVVSVGAALIWTQRRQ

SEQ ID NO: 364183 - protein, 32 aa, Mycobacterium
NPTGWTNWLEIFLILVIGFSLPRTFGRMVGNT

SEQ ID NO: 364184 - protein, 25 aa, Mycobacterium
NPTSAHKWSLFLPLISGRVGNVKGS

SEQ ID NO: 364185 - protein, 17 aa, Mycobacterium
NPVMFIVEVGAVWSTIL

SEQ ID NO: 364186 - protein, 25 aa, Mycobacterium
NPVNLIMLVLVPLVFVLVAAGSIAD

SEQ ID NO: 364187 - protein, 22 aa, Mycobacterium
NPWQTFWRITLPSIRWGLTYGI

SEQ ID NO: 364188 - protein, 17 aa, Mycobacterium
NPYWLVSVQMLDGVGAG

SEQ ID NO: 364189 - protein, 24 aa, Mycobacterium
NQADNFFIGTTLLVGMAAVVAVIA

SEQ ID NO: 364190 - protein, 18 aa, Mycobacterium
NQADVRLVLLRPGKEEDE

SEQ ID NO: 364191 - protein, 25 aa, Mycobacterium
NQALGWLVGLALSGALSYSLDLAFT

SEQ ID NO: 364192 - protein, 53 aa, Mycobacterium
NQAYGYMFPHGTFFLVGHLLQLPGWITQRLWWALLLTIGFWGLLRVAEALGIG

SEQ ID NO: 364193 - protein, 41 aa, Mycobacterium
NQDDLLVMELIAIPLSFLVLVWVFGGLLAAALPMALGALAV

SEQ ID NO: 364194 - protein, 39 aa, Mycobacterium
NQFVMPDLSGMFWTDAEPRLRALGWTGILDKGADVDAGG

SEQ ID NO: 364195 - protein, 38 aa, Mycobacterium
NQFVMPDLSGMFWTDAEPRLRALGWTGSLDKGPDVDAG

SEQ ID NO: 364196 - protein, 31 aa, Mycobacterium
NQFVMPDLSGMFWTDAEPRLRALGWTGVLDK

SEQ ID NO: 364197 - protein, 18 aa, Mycobacterium
NQGMFLVGGTWADRLGYK

SEQ ID NO: 364198 - protein, 39 aa, Mycobacterium
NQGSILGSLLLYLLPVILLVVLFFAFSRMQSGGRGMGFG

SEQ ID NO: 364199 - protein, 26 aa, Mycobacterium
NQLQRITWIVTWYLLGYIAAMPLLGR

SEQ ID NO: 364200 - protein, 21 aa, Mycobacterium
NQLVAWVCIGASALGVVLLIV

SEQ ID NO: 364201 - protein, 20 aa, Mycobacterium
NQMVLAIFACTFAYSTGGLH

SEQ ID NO: 364202 - protein, 35 aa, Mycobacterium
NQPIPIHYDLFIRVLAWFFGLMVFNRIDGSSDSIA

SEQ ID NO: 364203 - protein, 20 aa, Mycobacterium
NQVELPFNGLNYPEGIAVDA

SEQ ID NO: 364204 - protein, 18 aa, Mycobacterium
NQVFLCAAFVALAGFILA

SEQ ID NO: 364205 - protein, 25 aa, Mycobacterium
NRAQLMLENSGLRAGWRKVSGISSG

SEQ ID NO: 364206 - protein, 30 aa, Mycobacterium
NRAQRVFYRLIHVLDPLIALESLYRYVRKF

SEQ ID NO: 364207 - protein, 35 aa, Mycobacterium
NRARRKFRRRVSAGLLLLIALVVAGGLASTFTPTP

SEQ ID NO: 364208 - protein, 20 aa, Mycobacterium
NRATMLLFIQGRRGTPPDIR

SEQ ID NO: 364209 - protein, 22 aa, Mycobacterium
NRDAWMVGFTPSLSTAVWVGTV

SEQ ID NO: 364210 - protein, 18 aa, Mycobacterium
NRFATPFFDALRAYAAAP

SEQ ID NO: 364211 - protein, 26 aa, Mycobacterium
NRFLAYGWRIGFLLSLLLVVIGIVVR

SEQ ID NO: 364212 - protein, 23 aa, Mycobacterium
NRFRSPLRGPWLTSVFGLVLLVT

SEQ ID NO: 364213 - protein, 24 aa, Mycobacterium
NRGEPLIPLRLFADRNFSLAGVGI

SEQ ID NO: 364214 - protein, 32 aa, Mycobacterium
NRGGRGLFTRRTSRLLAVIAVAALAGGLAGAE

SEQ ID NO: 364215 - protein, 24 aa, Mycobacterium
NRIAQARMTLLYFARKRVGSVGGE

SEQ ID NO: 364216 - protein, 25 aa, Mycobacterium
NRIAWWVGVGIAVLVTLLSVVTYRG

SEQ ID NO: 364217 - protein, 19 aa, Mycobacterium
NRIMLLHHIGRRSGNRRYA

SEQ ID NO: 364218 - protein, 24 aa, Mycobacterium
NRKRVVAVSFPRDLAITPMQCEAW

SEQ ID NO: 364219 - protein, 19 aa, Mycobacterium
NRLGLFCVAILVGLGAGLG

SEQ ID NO: 364220 - protein, 19 aa, Mycobacterium
NRLLRLPLPKPYAPTRLEA

SEQ ID NO: 364221 - protein, 18 aa, Mycobacterium
NRLLSNVVGFQLPHALSA

SEQ ID NO: 364222 - protein, 18 aa, Mycobacterium
NRLLTFLVVLTAAAAVIA

SEQ ID NO: 364223 - protein, 19 aa, Mycobacterium
NRLVTFIAIFLAGGVMFTL

SEQ ID NO: 364224 - protein, 18 aa, Mycobacterium
NRLVTFTAIFLAGGLMFS

SEQ ID NO: 364225 - protein, 18 aa, Mycobacterium
NRMITFLVVLTAAAAVLA

SEQ ID NO: 364226 - protein, 27 aa, Mycobacterium
NRPDILDPALLRPGRFDRQIPVTNPDL

SEQ ID NO: 364227 - protein, 28 aa, Mycobacterium
NRPEFLAVVLAIWRLAATAVLISPAWKR

SEQ ID NO: 364228 - protein, 21 aa, Mycobacterium
NRPFQYWSWANLASVVCAIGL

SEQ ID NO: 364229 - protein, 17 aa, Mycobacterium
NRRCVLTLYPHCAPKIG

SEQ ID NO: 364230 - protein, 21 aa, Mycobacterium
NRRDALRWVWLGVAGAVAMTL

SEQ ID NO: 364231 - protein, 32 aa, Mycobacterium
NRREQRNWLRRLWLAMPLALLASVSTMVFGAY

SEQ ID NO: 364232 - protein, 18 aa, Mycobacterium
NRRFLAQHRAAAPAQPQP

SEQ ID NO: 364233 - protein, 21 aa, Mycobacterium
NRRNGLIGVLVIAAVLAATGV

SEQ ID NO: 364234 - protein, 30 aa, Mycobacterium
NRRNLTLYVTALLFVLAWATSGINGWFYVG

SEQ ID NO: 364235 - protein, 24 aa, Mycobacterium
NRRNPWPIIAAVAAVLVVIVGGLG

SEQ ID NO: 364236 - protein, 27 aa, Mycobacterium
NRRPRRLLIGTLLALALVGALTATIVY

SEQ ID NO: 364237 - protein, 23 aa, Mycobacterium
NRRSWWTWVLLAGPGWVVFGAIK

SEQ ID NO: 364238 - protein, 26 aa, Mycobacterium
NRRTLRNVYIPWTFTMTPISNSDVGS

SEQ ID NO: 364239 - protein, 18 aa, Mycobacterium
NRRTVLKSSYAQFLFLMS

SEQ ID NO: 364240 - protein, 24 aa, Mycobacterium
NRRVLGVWVVFVLAAASWAVGGYI

SEQ ID NO: 364241 - protein, 35 aa, Mycobacterium
NRRVVGVWVVFVLALASWLLAGYIGAAVAVVVGIA

SEQ ID NO: 364242 - protein, 21 aa, Mycobacterium
NRSILPIIIACAICITIIMSL

SEQ ID NO: 364243 - protein, 24 aa, Mycobacterium
NRTDQFLDALAAQQQPFVTDRDDV

SEQ ID NO: 364244 - protein, 21 aa, Mycobacterium
NRTMFAAVVLFLVALSFASVN

SEQ ID NO: 364245 - protein, 25 aa, Mycobacterium
NRTRVLWITVLIWSVAMALGGISAG

SEQ ID NO: 364246 - protein, 23 aa, Mycobacterium
NRVAAAFSWGLAFLGRTRGQMAI

SEQ ID NO: 364247 - protein, 36 aa, Mycobacterium
NRVDVVQPVLWAIMVSLAELWRSAGVLPDAVIGHSQ

SEQ ID NO: 364248 - protein, 19 aa, Mycobacterium
NRVLGLAGLLLISCCGFLA

SEQ ID NO: 364249 - protein, 22 aa, Mycobacterium
NRVRVRLKPMYARSIPATVTAR

SEQ ID NO: 364250 - protein, 17 aa, Mycobacterium
NRYAIVVIGLWVVAAGL

SEQ ID NO: 364251 - protein, 22 aa, Mycobacterium
NRYFSRLPRRLVDRITPKPGTG

SEQ ID NO: 364252 - protein, 21 aa, Mycobacterium
NRYYAAQRTFWVDPVTGTIVK

SEQ ID NO: 364253 - protein, 26 aa, Mycobacterium
NSAITELVLLLIAVAVAVLVDFAAKR

SEQ ID NO: 364254 - protein, 24 aa, Mycobacterium
NSAMFLFAVSFFGAGLLFPSYFQE

SEQ ID NO: 364255 - protein, 25 aa, Mycobacterium
NSANIMFLVLLLAGFGWMVSSRMVR

SEQ ID NO: 364256 - protein, 20 aa, Mycobacterium
NSASLPWIRTWIAAYAVLML

SEQ ID NO: 364257 - protein, 26 aa, Mycobacterium
NSDKFVPIFTRLNRLSDKFFEEVWDP

SEQ ID NO: 364258 - protein, 25 aa, Mycobacterium
NSFGTWLFFILAVVLFIGFFVRMIQ

SEQ ID NO: 364259 - protein, 27 aa, Mycobacterium
NSFLDGLAVHRRALGLPGVSVAWGLWE

SEQ ID NO: 364260 - protein, 20 aa, Mycobacterium
NSGCQVFIESSPHPVLMAGI

SEQ ID NO: 364261 - protein, 24 aa, Mycobacterium
NSGHLFYNRRLRAATTRFSVRMKH

SEQ ID NO: 364262 - protein, 36 aa, Mycobacterium
NSHLARQVTLLRNFLLPLGALLLFLVKASQVPAGEG

SEQ ID NO: 364263 - protein, 26 aa, Mycobacterium
NSISIVAVLLWIVAALIVGSVVYLSA

SEQ ID NO: 364264 - protein, 29 aa, Mycobacterium
NSISIVAVLLWIVAVLIVGSVVYLSALER

SEQ ID NO: 364265 - protein, 26 aa, Mycobacterium
NSKGETFRWSFTSLNGRPPNISLSDL

SEQ ID NO: 364266 - protein, 34 aa, Mycobacterium
NSKPKKRRLRWLIAAVLVVLIALAGLAIARRVVL

SEQ ID NO: 364267 - protein, 32 aa, Mycobacterium
NSLAPAVWRFDQYYWFTAILTARGFQTATGRL

SEQ ID NO: 364268 - protein, 20 aa, Mycobacterium
NSLFAWSWADPIAALAIAVI

SEQ ID NO: 364269 - protein, 17 aa, Mycobacterium
NSLFGFSWADHVVALII

SEQ ID NO: 364270 - protein, 22 aa, Mycobacterium
NSLLIHLMAAALWAGGLLALAA

SEQ ID NO: 364271 - protein, 26 aa, Mycobacterium
NSMAGLKLPSWGSLRLALPVGGNGDA

SEQ ID NO: 364272 - protein, 24 aa, Mycobacterium
NSPAVLNLLLIDFKGGATFLDYAR

SEQ ID NO: 364273 - protein, 36 aa, Mycobacterium
NSPLALFLGSFFFNAAIGVLLFIFLGGRKLLGQTTA

SEQ ID NO: 364274 - protein, 21 aa, Mycobacterium
NSQFKQIRGLLAKLPEMERKF

SEQ ID NO: 364275 - protein, 21 aa, Mycobacterium
NSRLRYAIATLALAVSLGGSI

SEQ ID NO: 364276 - protein, 36 aa, Mycobacterium
NSRSRRRLHRRLSGGLLLLIALTVAGGLAAVLTPTP

SEQ ID NO: 364277 - protein, 26 aa, Mycobacterium
NSSGAIILFVYWLIALSQIILRRRTP

SEQ ID NO: 364278 - protein, 20 aa, Mycobacterium
NSVALLLYTASLRARRRDRR

SEQ ID NO: 364279 - protein, 27 aa, Mycobacterium
NSVILRILIFYVGAVLLLVLIVPWNDE

SEQ ID NO: 364280 - protein, 32 aa, Mycobacterium
NSVLAFTVIKWLGVVYLAYLAWRQWRSVAVDL

SEQ ID NO: 364281 - protein, 20 aa, Mycobacterium
NSYWLVGVQLLDGIGAGIFG

SEQ ID NO: 364282 - protein, 29 aa, Mycobacterium
NTAEGSLHLWLNLTLLAGVALVVVGAVAA

SEQ ID NO: 364283 - protein, 32 aa, Mycobacterium
NTALGLAMLFGRFLPMILVLALAGSLARQGAT

SEQ ID NO: 364284 - protein, 23 aa, Mycobacterium
NTAVLDWATLPPVDRMELLTTHD

SEQ ID NO: 364285 - protein, 28 aa, Mycobacterium
NTAVRRLTIGLLAVALAGLLVPSVASAT

SEQ ID NO: 364286 - protein, 41 aa, Mycobacterium
NTDVLRMVIGGAALALLGVRRYVFARPPLLGPSGQLVAGGV

SEQ ID NO: 364287 - protein, 40 aa, Mycobacterium
NTDVLRMVIGGAALALLGVRRYVFARPPLLGPSGRMVATG

SEQ ID NO: 364288 - protein, 25 aa, Mycobacterium
NTELQFDAPATLQFLFNGAFAERDD

SEQ ID NO: 364289 - protein, 19 aa, Mycobacterium
NTETGWKLGFYAASRASQL

SEQ ID NO: 364290 - protein, 20 aa, Mycobacterium
NTFLLVLAALALLILTIAVN

SEQ ID NO: 364291 - protein, 20 aa, Mycobacterium
NTFWALVIPFMFGSPYAIFL

SEQ ID NO: 364292 - protein, 25 aa, Mycobacterium
NTIPGILLSLFLIGSALVGKPLTEL

SEQ ID NO: 364293 - protein, 24 aa, Mycobacterium
NTKTDLYPHWRAVVAANSAHLQRA

SEQ ID NO: 364294 - protein, 45 aa, Mycobacterium
NTLAAVAAIVAVLVWGVGANLGWWKGLAGLWKWATDASHKAAATS

SEQ ID NO: 364295 - protein, 27 aa, Mycobacterium
NTLATLSLVFAFVFAPAGAVLGHLGLA

SEQ ID NO: 364296 - protein, 26 aa, Mycobacterium
NTMNLLLLLLVTFLPFSSALMSHYLV

SEQ ID NO: 364297 - protein, 24 aa, Mycobacterium
NTPLTLIILFCSVGLYQNLGIALA

SEQ ID NO: 364298 - protein, 33 aa, Mycobacterium
NTPLTTALAYLLLPQVFFYGLSSLFMAILNTRN

SEQ ID NO: 364299 - protein, 29 aa, Mycobacterium
NTPNGGIFARFPWLKIPLADIESNGAWEP

SEQ ID NO: 364300 - protein, 21 aa, Mycobacterium
NTPRIIAFVGTGVLAAAVGAA

SEQ ID NO: 364301 - protein, 19 aa, Mycobacterium
NTQAAWTSPLLPTADELAD

SEQ ID NO: 364302 - protein, 18 aa, Mycobacterium
NTRQLLLVNTMTDALPAA

SEQ ID NO: 364303 - protein, 17 aa, Mycobacterium
NTRRNRLLASTPLMIVA

SEQ ID NO: 364304 - protein, 30 aa, Mycobacterium
NTRSFTAAGIWLAIASFAAAGVVAALAWVS

SEQ ID NO: 364305 - protein, 29 aa, Mycobacterium
NTSNLLVGGPFVYLIDFGATPTATDTADA

SEQ ID NO: 364306 - protein, 24 aa, Mycobacterium
NTSTAWTYLMYLGSWVGGPMRMEY

SEQ ID NO: 364307 - protein, 23 aa, Mycobacterium
NTSTLWTYLTYLGGWAGGGMRLE

SEQ ID NO: 364308 - protein, 24 aa, Mycobacterium
NTSTLWTYLVTLGAWIGGSVRLEY

SEQ ID NO: 364309 - protein, 23 aa, Mycobacterium
NTSTVWTYLLYAASWVGGPMRLE

SEQ ID NO: 364310 - protein, 21 aa, Mycobacterium
NTSYWVLIMATTSALFPALGA

SEQ ID NO: 364311 - protein, 22 aa, Mycobacterium
NTVAWASPLLKALNSSPTCNAD

SEQ ID NO: 364312 - protein, 29 aa, Mycobacterium
NTVGLRQRILDYAPLLLTAEAAVTGSTHS

SEQ ID NO: 364313 - protein, 18 aa, Mycobacterium
NTVLAFALPLIAEDFRPS

SEQ ID NO: 364314 - protein, 24 aa, Mycobacterium
NTVPVRIILFYVLTLAVIMALYPW

SEQ ID NO: 364315 - protein, 19 aa, Mycobacterium
NTVRALRWYIEGRPPNRAE

SEQ ID NO: 364316 - protein, 26 aa, Mycobacterium
NTWDFKPAPVPWYRTRGAAVALTAAG

SEQ ID NO: 364317 - protein, 22 aa, Mycobacterium
NTWMFDLIWEFLQDPIGNTIKI

SEQ ID NO: 364318 - protein, 22 aa, Mycobacterium
NTWVEWLAHPITVTVLTILAVG

SEQ ID NO: 364319 - protein, 32 aa, Mycobacterium
NVAELAPFLVWALSGGLFPLALGVLQIIALDI

SEQ ID NO: 364320 - protein, 19 aa, Mycobacterium
NVAMFLYIVSTFGAGVLFP

SEQ ID NO: 364321 - protein, 28 aa, Mycobacterium
NVDYRTGAINWRLGGKRSTFALGDGVEF

SEQ ID NO: 364322 - protein, 28 aa, Mycobacterium
NVEDFFRPIKSYFYWERHCFDIPICWTF

SEQ ID NO: 364323 - protein, 29 aa, Mycobacterium
NVFGIVSLIFWSVMIIVTLTYITLVMRAD

SEQ ID NO: 364324 - protein, 39 aa, Mycobacterium
NVFGPPAWAPVWNNLVAIATLVLYWLMPGELTLDPIRMS

SEQ ID NO: 364325 - protein, 24 aa, Mycobacterium
NVFNEAFAPYGLPPTAVKPSYGMA

SEQ ID NO: 364326 - protein, 24 aa, Mycobacterium
NVGLLLLFIYRPLADNIRLSFFDW

SEQ ID NO: 364327 - protein, 24 aa, Mycobacterium
NVGLQHQLSQLTNRAWPVSMTGGA

SEQ ID NO: 364328 - protein, 21 aa, Mycobacterium
NVGLQYQLSQLTNRAWPVSMT

SEQ ID NO: 364329 - protein, 33 aa, Mycobacterium
NVGLSLAIITVLMPLSLFGTLGLAAVVFVHELT

SEQ ID NO: 364330 - protein, 33 aa, Mycobacterium
NVGLSLGIITVLMPLAMFGTLGLATVVLVHELA

SEQ ID NO: 364331 - protein, 34 aa, Mycobacterium
NVGLSLTIITVLMPLALFGTLGLAAVVLVHEVAE

SEQ ID NO: 364332 - protein, 37 aa, Mycobacterium
NVGRIMLDLFMAQRFMLAWRQWLTARLTSDWLDGKAY

SEQ ID NO: 364333 - protein, 20 aa, Mycobacterium
NVHFLLSGYLFYWVVIGVDP

SEQ ID NO: 364334 - protein, 29 aa, Mycobacterium
NVHKLEPLIRLPLILGLAHALSRIPLPAS

SEQ ID NO: 364335 - protein, 30 aa, Mycobacterium
NVIDPPRERRPWRRLRISQLIIGMSAVVAM

SEQ ID NO: 364336 - protein, 20 aa, Mycobacterium
NVIEILAILIIPVCLTRTYS

SEQ ID NO: 364337 - protein, 25 aa, Mycobacterium
NVIGTWELLRLALTTHRKSFHLVSS

SEQ ID NO: 364338 - protein, 25 aa, Mycobacterium
NVIRVRIGIHMGRSVRRGDDLFGRN

SEQ ID NO: 364339 - protein, 23 aa, Mycobacterium
NVIWILLFGLWLAIGHLVSAVAM

SEQ ID NO: 364340 - protein, 19 aa, Mycobacterium
NVLAVVVFLGVITAAVVLA

SEQ ID NO: 364341 - protein, 20 aa, Mycobacterium
NVLEMVIGILMLPTIGLRIP

SEQ ID NO: 364342 - protein, 21 aa, Mycobacterium
NVLHNIAFPGVFLALALGSVA

SEQ ID NO: 364343 - protein, 17 aa, Mycobacterium
NVLIVVHIPGNGGPISA

SEQ ID NO: 364344 - protein, 27 aa, Mycobacterium
NVLLGWNQWLSLIVAALIVLTYTALGG

SEQ ID NO: 364345 - protein, 17 aa, Mycobacterium
NVLLLTSLFACVLSFHN

SEQ ID NO: 364346 - protein, 24 aa, Mycobacterium
NVLLTGDDFAYLVDFGIAHGGGEA

SEQ ID NO: 364347 - protein, 20 aa, Mycobacterium
NVLLTGDDFAYLVDFGIAHV

SEQ ID NO: 364348 - protein, 27 aa, Mycobacterium
NVLPNDPRWWFGLPAVIALICNGLAAV

SEQ ID NO: 364349 - protein, 27 aa, Mycobacterium
NVLVTATINFVLIAAVVYFLVVLPYNT

SEQ ID NO: 364350 - protein, 17 aa, Mycobacterium
NVLYAVFLTLPLVIARI

SEQ ID NO: 364351 - protein, 17 aa, Mycobacterium
NVPIGLVMIYLARTALR

SEQ ID NO: 364352 - protein, 26 aa, Mycobacterium
NVPLALLVLLLVWRLVPESRSQARLV

SEQ ID NO: 364353 - protein, 20 aa, Mycobacterium
NVPLTLAHVLPAAAGTRLAS

SEQ ID NO: 364354 - protein, 29 aa, Mycobacterium
NVPPPSPGTVYQMWLVDAKGPTSAGTMGP

SEQ ID NO: 364355 - protein, 25 aa, Mycobacterium
NVPRAMFWTVLVYVLIVTVVAIWLG

SEQ ID NO: 364356 - protein, 27 aa, Mycobacterium
NVQPAQLLQPFLEYAFGFRNGVDIGQP

SEQ ID NO: 364357 - protein, 19 aa, Mycobacterium
NVRELIEITLVKNPGMRYK

SEQ ID NO: 364358 - protein, 23 aa, Mycobacterium
NVRELIEITLVKNPGMRYKSGGP

SEQ ID NO: 364359 - protein, 27 aa, Mycobacterium
NVRRRNLGWRMWYGGPWFSTRLVTATK

SEQ ID NO: 364360 - protein, 17 aa, Mycobacterium
NVSFMRMFGLGLTLAVL

SEQ ID NO: 364361 - protein, 27 aa, Mycobacterium
NVSPHPALYWPARAWILVVRAVPELIL

SEQ ID NO: 364362 - protein, 26 aa, Mycobacterium
NVSYLLWMLMGYLLASAVLVVLFGRL

SEQ ID NO: 364363 - protein, 23 aa, Mycobacterium
NVTAAMMPIAGYSRGHNLAGGRP

SEQ ID NO: 364364 - protein, 17 aa, Mycobacterium
NVTTFMAFAPQTRSTRS

SEQ ID NO: 364365 - protein, 19 aa, Mycobacterium
NVWNDFLWPLLMIQRNSLA

SEQ ID NO: 364366 - protein, 23 aa, Mycobacterium
NVWNDFLWPLLMLQHNRLATLTL

SEQ ID NO: 364367 - protein, 28 aa, Mycobacterium
NWALMKPIALAWVITLPSAAILSAVGLV

SEQ ID NO: 364368 - protein, 23 aa, Mycobacterium
NWHESAVIYLAATLAGMVVNPIL

SEQ ID NO: 364369 - protein, 25 aa, Mycobacterium
NWIAPVFGLIILLAVGSDYNLLLVS

SEQ ID NO: 364370 - protein, 23 aa, Mycobacterium
NWIEVPLAMRDSLGLRLELKLHD

SEQ ID NO: 364371 - protein, 17 aa, Mycobacterium
NWLAMVCLMTAVSAPMW

SEQ ID NO: 364372 - protein, 22 aa, Mycobacterium
NWLEVPLAMRDGLGLRLELKLH

SEQ ID NO: 364373 - protein, 27 aa, Mycobacterium
NWLSVTLRSYLVPLDGYCLYPESPLRL

SEQ ID NO: 364374 - protein, 20 aa, Mycobacterium
NWLVLARRGFLMQVSNPKAV

SEQ ID NO: 364375 - protein, 24 aa, Mycobacterium
NWMQHGVWVAALTAILAAAAMFPG

SEQ ID NO: 364376 - protein, 22 aa, Mycobacterium
NWRRGLIFGLFVFAAFATPGSD

SEQ ID NO: 364377 - protein, 18 aa, Mycobacterium
NWRRVGLATWIADAGVIA

SEQ ID NO: 364378 - protein, 19 aa, Mycobacterium
NWSIFGWTAPSNWIGSIEP

SEQ ID NO: 364379 - protein, 25 aa, Mycobacterium
NWTTFSAFVLLIPTAGTIVLLANPG

SEQ ID NO: 364380 - protein, 17 aa, Mycobacterium
NWVLDGMVDTKALSAKD

SEQ ID NO: 364381 - protein, 18 aa, Mycobacterium
NYADRFLPAVLAEPIRED

SEQ ID NO: 364382 - protein, 21 aa, Mycobacterium
NYAPWKRLRDTVASMPALFGS

SEQ ID NO: 364383 - protein, 22 aa, Mycobacterium
NYDIRVPPPRLGKEFDAVAAAF

SEQ ID NO: 364384 - protein, 17 aa, Mycobacterium
NYFPVTRGIPQPPIIRN

SEQ ID NO: 364385 - protein, 32 aa, Mycobacterium
NYFRPENLTALRQLALLWLADQVDAALEKYRS

SEQ ID NO: 364386 - protein, 30 aa, Mycobacterium
NYFRTGNLTALRELALLWLADQVDAALAKY

SEQ ID NO: 364387 - protein, 31 aa, Mycobacterium
NYFRTGNLTALRELALLWLADQVDAALEKYR

SEQ ID NO: 364388 - protein, 26 aa, Mycobacterium
NYGMALLWTLALLIPVLYVNQEMVVR

SEQ ID NO: 364389 - protein, 26 aa, Mycobacterium
NYGYSLLWVLVLLVPVLIVNQEMVVR

SEQ ID NO: 364390 - protein, 19 aa, Mycobacterium
NYRKLVRLGVNGATIPYYI

SEQ ID NO: 364391 - protein, 26 aa, Mycobacterium
NYTLLVVFAVLFVALLLFPQGISRRG

SEQ ID NO: 364392 - protein, 33 aa, Mycobacterium
NYVRQLFMVQLWFRPYFDLSSWNGPAWSISAEW

SEQ ID NO: 364393 - protein, 25 aa, Mycobacterium
PAAAFYLGWSYWFAWVVTGIADLVA

SEQ ID NO: 364394 - protein, 22 aa, Mycobacterium
PAAAGLYLFVWLELASADPGSL

SEQ ID NO: 364395 - protein, 27 aa, Mycobacterium
PAAAIALFQAVILYCVVRFALGMHAVH

SEQ ID NO: 364396 - protein, 23 aa, Mycobacterium
PAAALATWLGALLAFLVLTTLSA

SEQ ID NO: 364397 - protein, 24 aa, Mycobacterium
PAAALGLLILVRWRGLGWTELGLG

SEQ ID NO: 364398 - protein, 33 aa, Mycobacterium
PAAARLLIRFTGPELWWVAGVARWAAGLPGATV

SEQ ID NO: 364399 - protein, 28 aa, Mycobacterium
PAAAVLIGKLSWWPTKPPAPEPAPTEPT

SEQ ID NO: 364400 - protein, 45 aa, Mycobacterium
PAADAKGEQRKWLRRVWLAAPLGLVSMAAPMLFGASWAGWLAFAA

SEQ ID NO: 364401 - protein, 17 aa, Mycobacterium
PAAFGLFAFVWLELASP

SEQ ID NO: 364402 - protein, 21 aa, Mycobacterium
PAAFVLHRAWIGPMVLLVLDD

SEQ ID NO: 364403 - protein, 24 aa, Mycobacterium
PAAGPWDPLLPKIPSAGAPGDPVA

SEQ ID NO: 364404 - protein, 19 aa, Mycobacterium
PAAGPWDPLLPKVASAGAP

SEQ ID NO: 364405 - protein, 20 aa, Mycobacterium
PAAGPWDPLLPKVASAGAPG

SEQ ID NO: 364406 - protein, 37 aa, Mycobacterium
PAAGVMLSGLWVAATGQLVLIIHHLAVDGVSWRILLE

SEQ ID NO: 364407 - protein, 20 aa, Mycobacterium
PAAIAWVFMPALFGVTLSAA

SEQ ID NO: 364408 - protein, 23 aa, Mycobacterium
PAAKLLLEIAPKYAGLIALNVNA

SEQ ID NO: 364409 - protein, 20 aa, Mycobacterium
PAALFRLVHEARRGGQNPFT

SEQ ID NO: 364410 - protein, 22 aa, Mycobacterium
PAALGILVALLAALTLGPAVLT

SEQ ID NO: 364411 - protein, 34 aa, Mycobacterium
PAALKQRNWGWVLAIVVIVLALAAIAILGTVLLT

SEQ ID NO: 364412 - protein, 27 aa, Mycobacterium
PAALPYFGLLPIVLGLRAAWLAWRDRR

SEQ ID NO: 364413 - protein, 18 aa, Mycobacterium
PAALWLMELSVRVFGLSG

SEQ ID NO: 364414 - protein, 18 aa, Mycobacterium
PAAMIAVAALVIPLCIAN

SEQ ID NO: 364415 - protein, 35 aa, Mycobacterium
PAAMVPFLIFGLLGKWLHWPQLGLFCYLMTLVVAV

SEQ ID NO: 364416 - protein, 22 aa, Mycobacterium
PAANFVICLVLLYGIALVWGLP

SEQ ID NO: 364417 - protein, 26 aa, Mycobacterium
PAAPAPAPAPVAPPPAPAPIPAAPPV

SEQ ID NO: 364418 - protein, 24 aa, Mycobacterium
PAAPHPWLNLPAVLLIIMCAILLI

SEQ ID NO: 364419 - protein, 30 aa, Mycobacterium
PAAPPRPVPVPVLAPPVFVPPPRVPVMRPR

SEQ ID NO: 364420 - protein, 41 aa, Mycobacterium
PAAPPVVAPVVLPPPVVVLPRPQWNPPRPAWTWPNQRPDVD

SEQ ID NO: 364421 - protein, 28 aa, Mycobacterium
PAARAASPFVFVYNYLKQVVAEMRKVIW

SEQ ID NO: 364422 - protein, 28 aa, Mycobacterium
PAARALLWVLFWLGWAIALLATFLINHF

SEQ ID NO: 364423 - protein, 21 aa, Mycobacterium
PAARPLLALAAVAVLVPAALA

SEQ ID NO: 364424 - protein, 22 aa, Mycobacterium
PAARQRLVWMTLALAVITLIVT

SEQ ID NO: 364425 - protein, 27 aa, Mycobacterium
PAARSANPFIFVYNYIKQVVAEMRKVI

SEQ ID NO: 364426 - protein, 18 aa, Mycobacterium
PAASYRSFVTWLSERDQV

SEQ ID NO: 364427 - protein, 26 aa, Mycobacterium
PAATIALFQATILYCVVRFALGVHAV

SEQ ID NO: 364428 - protein, 23 aa, Mycobacterium
PAAVFGPVLLFAAWGQYTFTTFG

SEQ ID NO: 364429 - protein, 20 aa, Mycobacterium
PAAVIFGAIAAWATRWYLGT

SEQ ID NO: 364430 - protein, 18 aa, Mycobacterium
PAAYLVLALLVLNTAGRR

SEQ ID NO: 364431 - protein, 24 aa, Mycobacterium
PADAKSLLAILRRSYRGKVELSSV

SEQ ID NO: 364432 - protein, 24 aa, Mycobacterium
PADFPTLSVLCGVVWLAGSLGYLS

SEQ ID NO: 364433 - protein, 28 aa, Mycobacterium
PADFTPGIAPLPPALTGPPPPPGPGPSP

SEQ ID NO: 364434 - protein, 22 aa, Mycobacterium
PADGKTPLPPPRQARRPETVPT

SEQ ID NO: 364435 - protein, 17 aa, Mycobacterium
PADQPRRFNPISQLLLC

SEQ ID NO: 364436 - protein, 27 aa, Mycobacterium
PADQRALGAALWYAATAKDAVIVAAAG

SEQ ID NO: 364437 - protein, 18 aa, Mycobacterium
PADYANIPPTRFKRKEHW

SEQ ID NO: 364438 - protein, 25 aa, Mycobacterium
PAEFSKILLLIFFSAVLIAKRGLFT

SEQ ID NO: 364439 - protein, 25 aa, Mycobacterium
PAEFSKILLLIFFSAVLTAKRGLFT

SEQ ID NO: 364440 - protein, 25 aa, Mycobacterium
PAEFSKILLLIFFSAVLVAKRGLFT

SEQ ID NO: 364441 - protein, 25 aa, Mycobacterium
PAEFSKILLLIFFSAVLVAKRRLFT

SEQ ID NO: 364442 - protein, 25 aa, Mycobacterium
PAEFSKILLLIFFSAVLVSKRSLFT

SEQ ID NO: 364443 - protein, 26 aa, Mycobacterium
PAEKLRVKMWLFPALSILTVAGIIAV

SEQ ID NO: 364444 - protein, 27 aa, Mycobacterium
PAELNDTWWRIPVLLLLAFGNGWAEEI

SEQ ID NO: 364445 - protein, 24 aa, Mycobacterium
PAELPLREILPAVQRLVIPATSNG

SEQ ID NO: 364446 - protein, 20 aa, Mycobacterium
PAELVRFLDLLYTDLDALVD

SEQ ID NO: 364447 - protein, 24 aa, Mycobacterium
PAFEKAYAWVMGLKGRSFVGTESR

SEQ ID NO: 364448 - protein, 20 aa, Mycobacterium
PAFFWTWPAVFVGQFLVALC

SEQ ID NO: 364449 - protein, 19 aa, Mycobacterium
PAFLAYLVSFVFIGSSWLA

SEQ ID NO: 364450 - protein, 19 aa, Mycobacterium
PAFLTALDGVLARGAHLRN

SEQ ID NO: 364451 - protein, 28 aa, Mycobacterium
PAFMHLMGGVNWWAPRFLTRIHRRLGFS

SEQ ID NO: 364452 - protein, 21 aa, Mycobacterium
PAFMQLMGRLNWWAPGPLARW

SEQ ID NO: 364453 - protein, 36 aa, Mycobacterium
PAFMRFVRRFAVPILTTWLFMTVAVNVLVPPIESVA

SEQ ID NO: 364454 - protein, 36 aa, Mycobacterium
PAGAGLLIRFTGPEVWWLLSVARWASGMPAATVPTP

SEQ ID NO: 364455 - protein, 25 aa, Mycobacterium
PAGAPPPRAIPPPPPPPTVTVTQTV

SEQ ID NO: 364456 - protein, 32 aa, Mycobacterium
PAGAQLLIRFTGPEMWWVLRVAHWAAGVPMAT

SEQ ID NO: 364457 - protein, 25 aa, Mycobacterium
PAGELFFVEVFGRALPHIRDDKLRE

SEQ ID NO: 364458 - protein, 23 aa, Mycobacterium
PAGLLAQLHWPTLVGGAHRASSA

SEQ ID NO: 364459 - protein, 18 aa, Mycobacterium
PAGLLPLVLVTSGVVFAY

SEQ ID NO: 364460 - protein, 30 aa, Mycobacterium
PAGLSRLLYRLPIYVYRAGLGWVFGNRIML

SEQ ID NO: 364461 - protein, 18 aa, Mycobacterium
PAGLVLLAVRRTKRRREA

SEQ ID NO: 364462 - protein, 24 aa, Mycobacterium
PAGSVDFFFLTASAAGIFGIPGQG

SEQ ID NO: 364463 - protein, 35 aa, Mycobacterium
PAGTMRLFFWSGAAPVLDPLPRWVRAEVLSSGDLV

SEQ ID NO: 364464 - protein, 17 aa, Mycobacterium
PAGWLIDRFGPRKLITA

SEQ ID NO: 364465 - protein, 18 aa, Mycobacterium
PAGYSKQRSTSVARWLIA

SEQ ID NO: 364466 - protein, 23 aa, Mycobacterium
PAHEFAYFGILGLVAIVVGIVVF

SEQ ID NO: 364467 - protein, 25 aa, Mycobacterium
PAHKPVEQLFWYRSTKLVMRRWAPI

SEQ ID NO: 364468 - protein, 28 aa, Mycobacterium
PAHTPFTALFRGIYLRRVVFVGVFFTAH

SEQ ID NO: 364469 - protein, 17 aa, Mycobacterium
PAHVSFMRMLGLGLTLG

SEQ ID NO: 364470 - protein, 22 aa, Mycobacterium
PAIAMGSFLLLSGDHRVGQPKT

SEQ ID NO: 364471 - protein, 20 aa, Mycobacterium
PAIATLLREASWWPTKATNP

SEQ ID NO: 364472 - protein, 29 aa, Mycobacterium
PAIATMLGRWFWWPINIRTRPAPKPFGPK

SEQ ID NO: 364473 - protein, 22 aa, Mycobacterium
PAIDYLGIMVITLATTALITAT

SEQ ID NO: 364474 - protein, 29 aa, Mycobacterium
PAIEAEPLPWYKRAAVVFSLAAAGLAILV

SEQ ID NO: 364475 - protein, 25 aa, Mycobacterium
PAIGVPAVLLYRVLTCWLPVFVGWP

SEQ ID NO: 364476 - protein, 23 aa, Mycobacterium
PAIKGMWTVPVFSNPTGTVYSWE

SEQ ID NO: 364477 - protein, 29 aa, Mycobacterium
PAILAVILAVLYALLRSALAPPTLLAATI

SEQ ID NO: 364478 - protein, 19 aa, Mycobacterium
PAILVGLVLLLVARPLSVV

SEQ ID NO: 364479 - protein, 18 aa, Mycobacterium
PAIPRMPSWWPLDMTWGG

SEQ ID NO: 364480 - protein, 24 aa, Mycobacterium
PAISISIIIAFVAAITLLPSILVL

SEQ ID NO: 364481 - protein, 26 aa, Mycobacterium
PAISPWALYGLLFTIVILFALQGAQI

SEQ ID NO: 364482 - protein, 19 aa, Mycobacterium
PAITLYDAALCAVFGALVS

SEQ ID NO: 364483 - protein, 20 aa, Mycobacterium
PAIVLYVTLLGRSPAGWVVI

SEQ ID NO: 364484 - protein, 35 aa, Mycobacterium
PAKFEVIIKFVMGIPLLALAWLLGPRVMRLPFSRR

SEQ ID NO: 364485 - protein, 35 aa, Mycobacterium
PAKHHIRWARAIVYALLPGLALSLAVAAGFLKWQG

SEQ ID NO: 364486 - protein, 17 aa, Mycobacterium
PAKKPMTTARRLGVTFG

SEQ ID NO: 364487 - protein, 17 aa, Mycobacterium
PAKLLVLGLFWLGWIIV

SEQ ID NO: 364488 - protein, 26 aa, Mycobacterium
PAKNEPWYTALWHTIADAPHLPPAAA

SEQ ID NO: 364489 - protein, 27 aa, Mycobacterium
PAKQFGIFILLFLLLAPVLNQWLFEFV

SEQ ID NO: 364490 - protein, 29 aa, Mycobacterium
PAKQWGFVILLFLLLAPVLNHWFFGIVLS

SEQ ID NO: 364491 - protein, 25 aa, Mycobacterium
PAKSFVIDRLPKLCRTYLLSPSRQA

SEQ ID NO: 364492 - protein, 23 aa, Mycobacterium
PAKSPRLDLPAWPGLLADNALDD

SEQ ID NO: 364493 - protein, 26 aa, Mycobacterium
PALAPITWILQVMPLFFLAGGAAGTY

SEQ ID NO: 364494 - protein, 25 aa, Mycobacterium
PALDLDALIGGFKPVFRALDPDKVN

SEQ ID NO: 364495 - protein, 28 aa, Mycobacterium
PALDLDALIGGFRPLFHALDPDQINALS

SEQ ID NO: 364496 - protein, 26 aa, Mycobacterium
PALDLDALIGGFRPLFRALDPDQVNT

SEQ ID NO: 364497 - protein, 25 aa, Mycobacterium
PALDLDALIGGFRPLLKALDPEQVN

SEQ ID NO: 364498 - protein, 22 aa, Mycobacterium
PALDLDALLGGLRPVLKGFDAA

SEQ ID NO: 364499 - protein, 22 aa, Mycobacterium
PALDLDALLGGLRPVLKGLDAD

SEQ ID NO: 364500 - protein, 19 aa, Mycobacterium
PALDLDVLLGGLRPVIQGL

SEQ ID NO: 364501 - protein, 27 aa, Mycobacterium
PALFAIPFFLFLLALEWTAARKLERIE

SEQ ID NO: 364502 - protein, 19 aa, Mycobacterium
PALGPYSLAITVGVVLIIC

SEQ ID NO: 364503 - protein, 22 aa, Mycobacterium
PALKHTGGLRQWWLLTRRNVDV

SEQ ID NO: 364504 - protein, 27 aa, Mycobacterium
PALLAGFLVQVLFGSLAYLIPMVVGGR

SEQ ID NO: 364505 - protein, 26 aa, Mycobacterium
PALLRGLVAIFWYGIQTYLASTAVIV

SEQ ID NO: 364506 - protein, 17 aa, Mycobacterium
PALLRRFGRGRTLGMAL

SEQ ID NO: 364507 - protein, 30 aa, Mycobacterium
PALPQDQLLRLWHTRPDLRQALAQLPACPP

SEQ ID NO: 364508 - protein, 24 aa, Mycobacterium
PALPRGFWVPGYPVTPILSILACG

SEQ ID NO: 364509 - protein, 39 aa, Mycobacterium
PALREFRLFFFHRLLMMTPLIALFFWSLAAVLGTYVLHD

SEQ ID NO: 364510 - protein, 20 aa, Mycobacterium
PALRRKLAPAKALQLGIKAL

SEQ ID NO: 364511 - protein, 24 aa, Mycobacterium
PALSLLLPMVFIALGGIGLPGAAV

SEQ ID NO: 364512 - protein, 38 aa, Mycobacterium
PALSTALGWAIFHTLMIFWPFIQLAIQMAVVLAPVVVA

SEQ ID NO: 364513 - protein, 20 aa, Mycobacterium
PALTPARWAAVHAAALLLPA

SEQ ID NO: 364514 - protein, 26 aa, Mycobacterium
PALTPITWLVQVMPLFFLAGGAAGAY

SEQ ID NO: 364515 - protein, 25 aa, Mycobacterium
PALTPLTWLVQVMPLFFLAGGAAGA

SEQ ID NO: 364516 - protein, 25 aa, Mycobacterium
PALVMFAVIFFWTPPHTWALAMRYK

SEQ ID NO: 364517 - protein, 25 aa, Mycobacterium
PALVPPPQLPAPLSPPAPVAPKPGD

SEQ ID NO: 364518 - protein, 23 aa, Mycobacterium
PALWAAGLVLLGAWMPFNNGLRP

SEQ ID NO: 364519 - protein, 18 aa, Mycobacterium
PALWAVMVSLAELWRSVG

SEQ ID NO: 364520 - protein, 26 aa, Mycobacterium
PALWAVVCWLLVRWTRSLRERLPDDR

SEQ ID NO: 364521 - protein, 24 aa, Mycobacterium
PAMSLLLPMVFIALGGIGLPGAAV

SEQ ID NO: 364522 - protein, 22 aa, Mycobacterium
PAMYLWALAGIMLITLLAIRLL

SEQ ID NO: 364523 - protein, 17 aa, Mycobacterium
PANILIAAPASQAKRIM

SEQ ID NO: 364524 - protein, 20 aa, Mycobacterium
PANILLGHPGTDDQRIMLAD

SEQ ID NO: 364525 - protein, 26 aa, Mycobacterium
PANINMVRLWWDKPLALKLGAIARLP

SEQ ID NO: 364526 - protein, 33 aa, Mycobacterium
PANVNMCRLWWNKPWPMRIAALARLPLQIPMIT

SEQ ID NO: 364527 - protein, 27 aa, Mycobacterium
PANVNMVRLWWNKPWPLRLGAIARLPL

SEQ ID NO: 364528 - protein, 28 aa, Mycobacterium
PANVSYLLWMLMGYLVVTAVLVVLFGRL

SEQ ID NO: 364529 - protein, 35 aa, Mycobacterium
PANYRKLARLGSYGSWIMYYVCGISIRVTDLQGRT

SEQ ID NO: 364530 - protein, 25 aa, Mycobacterium
PAPALLLTAVLLLSAIPLLYAGGSV

SEQ ID NO: 364531 - protein, 40 aa, Mycobacterium
PAPAPAPAAPPLQWPVLPRLPIPTFVLPAAPSSAPEPTAT

SEQ ID NO: 364532 - protein, 40 aa, Mycobacterium
PAPAPGVVPAPIPLPIPIIIPPWPNWSPGMPTPSTVTVTP

SEQ ID NO: 364533 - protein, 19 aa, Mycobacterium
PAPAPIPAAPPVVAPVVLP

SEQ ID NO: 364534 - protein, 19 aa, Mycobacterium
PAPAPVPAAPAPAPVPIPV

SEQ ID NO: 364535 - protein, 38 aa, Mycobacterium
PAPDPAVVVPPLLPFLVPPVLATGPETLLRPPVPQAPA

SEQ ID NO: 364536 - protein, 25 aa, Mycobacterium
PAPEGMAMWIIGMVAAIGVAMWIGS

SEQ ID NO: 364537 - protein, 39 aa, Mycobacterium
PAPGRPPLARFLYRFSIPILVLWLGAAGLLNLAVPQLET

SEQ ID NO: 364538 - protein, 27 aa, Mycobacterium
PAPKSVVIPWYRLPGVIIVATVVAVLL

SEQ ID NO: 364539 - protein, 27 aa, Mycobacterium
PAPLVATVFDFFYQPGKLPASLADYLR

SEQ ID NO: 364540 - protein, 20 aa, Mycobacterium
PAPNQRRPYRPPPRPSSETL

SEQ ID NO: 364541 - protein, 17 aa, Mycobacterium
PAPPANRPPPPAPVPPP

SEQ ID NO: 364542 - protein, 23 aa, Mycobacterium
PAPPLKFAQLVGFVFAICGIIGF

SEQ ID NO: 364543 - protein, 18 aa, Mycobacterium
PAPPPGGPPPGPPAPPPP

SEQ ID NO: 364544 - protein, 45 aa, Mycobacterium
PAPQAPAPVPIPVPLPPVIVVPPLTPPWTPPWATPTSPTTPPTST

SEQ ID NO: 364545 - protein, 21 aa, Mycobacterium
PAPQPRVRPKPPIPYPGDAHA

SEQ ID NO: 364546 - protein, 23 aa, Mycobacterium
PAPRTLIDILYDTARRFPDAPAI

SEQ ID NO: 364547 - protein, 25 aa, Mycobacterium
PAPTALWLWIAMTGLAAAVFLVGWR

SEQ ID NO: 364548 - protein, 20 aa, Mycobacterium
PAPTPQQPPYYPAAAAPAAG

SEQ ID NO: 364549 - protein, 26 aa, Mycobacterium
PAPTTLWLWIAMSGLAAAVFLVGWRG

SEQ ID NO: 364550 - protein, 20 aa, Mycobacterium
PAPVILVVTATAVFGIFAHR

SEQ ID NO: 364551 - protein, 36 aa, Mycobacterium
PAPVLRPPRTWSLRTRLILTQLLLLAVVCAGVGVAT

SEQ ID NO: 364552 - protein, 29 aa, Mycobacterium
PAPVPIPVPVQIPVPPIFGPGGGGGFPGG

SEQ ID NO: 364553 - protein, 31 aa, Mycobacterium
PAPVWVALLMGLIFVLLIIYPFLEKRFSGDY

SEQ ID NO: 364554 - protein, 22 aa, Mycobacterium
PAPYGPLFLWIGRGISRITGEN

SEQ ID NO: 364555 - protein, 21 aa, Mycobacterium
PAQIKLHFHLADPDGVALDSF

SEQ ID NO: 364556 - protein, 19 aa, Mycobacterium
PAQILFALLALYAVTSGAC

SEQ ID NO: 364557 - protein, 22 aa, Mycobacterium
PAQIWVLVFSMTMMGGLLVSLI

SEQ ID NO: 364558 - protein, 23 aa, Mycobacterium
PAQVQFYCLDFGGGTLTSLAQLP

SEQ ID NO: 364559 - protein, 22 aa, Mycobacterium
PAQVWVLVFAMTMMAGLLVSLV

SEQ ID NO: 364560 - protein, 23 aa, Mycobacterium
PARALESPWLPAVLAGAGVATVL

SEQ ID NO: 364561 - protein, 24 aa, Mycobacterium
PARFGGRNWTIVSALLLLIPTVLA

SEQ ID NO: 364562 - protein, 18 aa, Mycobacterium
PARFVLGALAGLRMVGLL

SEQ ID NO: 364563 - protein, 28 aa, Mycobacterium
PARGRLVTMLLVGVVLLAVGYSGGLGSP

SEQ ID NO: 364564 - protein, 29 aa, Mycobacterium
PARGRLVTMLLVGVVLLAVGYSGGLGSPL

SEQ ID NO: 364565 - protein, 19 aa, Mycobacterium
PARGVIAVCDFGGSGTSIT

SEQ ID NO: 364566 - protein, 25 aa, Mycobacterium
PARGVWWWVSICVMGLAVLAMLVNR

SEQ ID NO: 364567 - protein, 48 aa, Mycobacterium
PARHRPAAWSLSNWPVGWKVVAIAVVPLLLATVFGVLRIDAAMANSGN

SEQ ID NO: 364568 - protein, 17 aa, Mycobacterium
PARIVVGLLVAIGVAVA

SEQ ID NO: 364569 - protein, 29 aa, Mycobacterium
PARLDDARFLLPVLGVPPPNNAASEPEVA

SEQ ID NO: 364570 - protein, 22 aa, Mycobacterium
PARLVVPGLYGYVSATKWVVEL

SEQ ID NO: 364571 - protein, 19 aa, Mycobacterium
PARPIAFAGAIAFLLFAVW

SEQ ID NO: 364572 - protein, 37 aa, Mycobacterium
PARRITVRVIYALGALFAAVLIVYLDRDGYRDSQENP

SEQ ID NO: 364573 - protein, 24 aa, Mycobacterium
PARRNRILVAALAAVAVLGAAGVL

SEQ ID NO: 364574 - protein, 34 aa, Mycobacterium
PARRRVKVVPAILIALLLLSGGGATWLYFKQYRP

SEQ ID NO: 364575 - protein, 25 aa, Mycobacterium
PARTVPAGAIFTVIPGPAGPFALTR

SEQ ID NO: 364576 - protein, 29 aa, Mycobacterium
PARVRQLGDEYLRIVRWAMAVAEAEPDRA

SEQ ID NO: 364577 - protein, 34 aa, Mycobacterium
PARYLALFLVLLIGAFLLVFFTGDKKPDPKLGID

SEQ ID NO: 364578 - protein, 20 aa, Mycobacterium
PARYTKMTAMPQLVAFFNGV

SEQ ID NO: 364579 - protein, 22 aa, Mycobacterium
PASAIAAARRAAGGPMGPLGAK

SEQ ID NO: 364580 - protein, 18 aa, Mycobacterium
PASFRRWLNPVNTAAATA

SEQ ID NO: 364581 - protein, 19 aa, Mycobacterium
PASGLYPLATFALGMVAFA

SEQ ID NO: 364582 - protein, 24 aa, Mycobacterium
PASLAFLGGWLVGLVAFTAAFVAG

SEQ ID NO: 364583 - protein, 22 aa, Mycobacterium
PASLVVFLVALPLSLGIAIASG

SEQ ID NO: 364584 - protein, 22 aa, Mycobacterium
PASLVVFLVALPLSLGIAIASN

SEQ ID NO: 364585 - protein, 23 aa, Mycobacterium
PASPATELLLGPVARGSTVSLGR

SEQ ID NO: 364586 - protein, 18 aa, Mycobacterium
PASPTGQPAWAPASGPIP

SEQ ID NO: 364587 - protein, 23 aa, Mycobacterium
PASRLWDVGIAAVALLGTGALLG

SEQ ID NO: 364588 - protein, 23 aa, Mycobacterium
PASRLWNVGIAAVSLLGLGALLG

SEQ ID NO: 364589 - protein, 20 aa, Mycobacterium
PASSLLIAMASWSPSSPTAP

SEQ ID NO: 364590 - protein, 43 aa, Mycobacterium
PASSSKPIWPLVAIGVIVVVVLLLLFVLYRARRRRRAPGSVAG

SEQ ID NO: 364591 - protein, 21 aa, Mycobacterium
PATCWWWQKTSGENRARIQVI

SEQ ID NO: 364592 - protein, 21 aa, Mycobacterium
PATCWWWQKTSGENRARVQVI

SEQ ID NO: 364593 - protein, 22 aa, Mycobacterium
PATDVVQLLNRFFAVIVDEVER

SEQ ID NO: 364594 - protein, 26 aa, Mycobacterium
PATFQDWYYFALALAGGLIAFAVGHW

SEQ ID NO: 364595 - protein, 41 aa, Mycobacterium
PATGAMSHIKLALIAGLVGVLALAGLAGWLGYQTYESHQAE

SEQ ID NO: 364596 - protein, 26 aa, Mycobacterium
PATLRRFAKRFAAFNLDPRVLRPSYG

SEQ ID NO: 364597 - protein, 33 aa, Mycobacterium
PATRVLALPAGVWRLILIIAFFGGVEILAQSGA

SEQ ID NO: 364598 - protein, 25 aa, Mycobacterium
PATRWAPLLQWTLVGAAGAVVLVAI

SEQ ID NO: 364599 - protein, 31 aa, Mycobacterium
PATVLVGLIYPWGDLVLLALAVGMLPILGWR

SEQ ID NO: 364600 - protein, 30 aa, Mycobacterium
PAVAALLGRWFWWPQRVRQRPARAFHASAG

SEQ ID NO: 364601 - protein, 17 aa, Mycobacterium
PAVALLLVPVAVGAGAA

SEQ ID NO: 364602 - protein, 27 aa, Mycobacterium
PAVAQRLPWRALPLVAWVTSALWAFSL

SEQ ID NO: 364603 - protein, 41 aa, Mycobacterium
PAVERRPSRLGRGWLVGISAALVLVAGGIGTGGYLALRAHQ

SEQ ID NO: 364604 - protein, 17 aa, Mycobacterium
PAVFLPMRAAITSAPLR

SEQ ID NO: 364605 - protein, 27 aa, Mycobacterium
PAVGGVVLGLLLLALPQLYGVGYPVMY

SEQ ID NO: 364606 - protein, 30 aa, Mycobacterium
PAVGRVLIMALLMLQLVSAGGLYPVETTSR

SEQ ID NO: 364607 - protein, 29 aa, Mycobacterium
PAVGRVLIMALLMLQLVSAGGMYPVETTS

SEQ ID NO: 364608 - protein, 29 aa, Mycobacterium
PAVGRVLLMALLMLQLVSAGGMYPVETTS

SEQ ID NO: 364609 - protein, 26 aa, Mycobacterium
PAVLGMFLFGPLLNLALRRFLANLRR

SEQ ID NO: 364610 - protein, 28 aa, Mycobacterium
PAVLLDHWVQLVLITPVMMYVGWPIHRT

SEQ ID NO: 364611 - protein, 18 aa, Mycobacterium
PAVLLFVGTLAAGFIAVN

SEQ ID NO: 364612 - protein, 24 aa, Mycobacterium
PAVLTTIFIYWGWDTAVACNEESD

SEQ ID NO: 364613 - protein, 27 aa, Mycobacterium
PAVPALPGPPPLIPPGGHQGPHGPPPP

SEQ ID NO: 364614 - protein, 25 aa, Mycobacterium
PAVQSTWYRRLRKPGFQPPPKAFPI

SEQ ID NO: 364615 - protein, 39 aa, Mycobacterium
PAVVRRRLRWWPAIGYGLLPALALLLAGGTGFAKWQDCA

SEQ ID NO: 364616 - protein, 23 aa, Mycobacterium
PAVVSWAAFLSWINLHGTWASWV

SEQ ID NO: 364617 - protein, 26 aa, Mycobacterium
PAVYDQKFLSKMRALGWTITDADGMT

SEQ ID NO: 364618 - protein, 23 aa, Mycobacterium
PAWLTMVLAVIAWTVLRNLPGFP

SEQ ID NO: 364619 - protein, 19 aa, Mycobacterium
PAWPFAVGVVAAVGAAALW

SEQ ID NO: 364620 - protein, 17 aa, Mycobacterium
PAWRDYRTAWATNFGVV

SEQ ID NO: 364621 - protein, 17 aa, Mycobacterium
PAWVGWSHFFNLFLMMF

SEQ ID NO: 364622 - protein, 21 aa, Mycobacterium
PAWVIAEIAVVVLLMLSTKVV

SEQ ID NO: 364623 - protein, 25 aa, Mycobacterium
PAWVPYAVLLPVAAAVLLWFSKTEV

SEQ ID NO: 364624 - protein, 18 aa, Mycobacterium
PAYIVVALALGAYWITRR

SEQ ID NO: 364625 - protein, 19 aa, Mycobacterium
PAYIVVALVLGTYWITRRT

SEQ ID NO: 364626 - protein, 18 aa, Mycobacterium
PAYLWSWPLVFVGQMAVA

SEQ ID NO: 364627 - protein, 28 aa, Mycobacterium
PAYPVRSWKSLLALVLLAFAVAVVHTSP

SEQ ID NO: 364628 - protein, 28 aa, Mycobacterium
PAYVPPPPPANYLPPAPPPAAPPYVPPV

SEQ ID NO: 364629 - protein, 31 aa, Mycobacterium
PAYVVDYPVYDWPQSPPAPPTPPPAPEPVIQ

SEQ ID NO: 364630 - protein, 19 aa, Mycobacterium
PAYWKPGTVQALRNALRTH

SEQ ID NO: 364631 - protein, 17 aa, Mycobacterium
PCAIGMLVAVLAALTLG

SEQ ID NO: 364632 - protein, 22 aa, Mycobacterium
PCAISILVIVIAALTLAPAVLT

SEQ ID NO: 364633 - protein, 18 aa, Mycobacterium
PCEPFRPDAFFAEAAQLG

SEQ ID NO: 364634 - protein, 20 aa, Mycobacterium
PCGFAMLPAYLFLVVRGLHP

SEQ ID NO: 364635 - protein, 19 aa, Mycobacterium
PCGFAMLPAYLLLVVRGRR

SEQ ID NO: 364636 - protein, 27 aa, Mycobacterium
PCIMLFLHTRYWWAGIAIVAVATIVAT

SEQ ID NO: 364637 - protein, 24 aa, Mycobacterium
PCSALLLPSFFAYSFDRTGLLLRS

SEQ ID NO: 364638 - protein, 24 aa, Mycobacterium
PCSIGLLAVILASLTLAPAVIALT

SEQ ID NO: 364639 - protein, 20 aa, Mycobacterium
PCSLVRIVPATLGPDTLMIG

SEQ ID NO: 364640 - protein, 18 aa, Mycobacterium
PCVPWFIHSNWNVAFGVL

SEQ ID NO: 364641 - protein, 19 aa, Mycobacterium
PDAELRDVARRRGWEVRDF

SEQ ID NO: 364642 - protein, 29 aa, Mycobacterium
PDAKSALASWLPPGPAPVADYPTVLLSGS

SEQ ID NO: 364643 - protein, 30 aa, Mycobacterium
PDAKSALASWLPPGPVPVADYPTVLLSGSW

SEQ ID NO: 364644 - protein, 20 aa, Mycobacterium
PDALNLVLVDFKGGATFLGL

SEQ ID NO: 364645 - protein, 21 aa, Mycobacterium
PDALNLVLVDFKGGATFLGLD

SEQ ID NO: 364646 - protein, 24 aa, Mycobacterium
PDAQTRLMGLLPSGYPAGACTPET

SEQ ID NO: 364647 - protein, 18 aa, Mycobacterium
PDARLTFVLADAGPVVAV

SEQ ID NO: 364648 - protein, 28 aa, Mycobacterium
PDDIDTGCWLWLAALPLMIVSYMAANVG

SEQ ID NO: 364649 - protein, 17 aa, Mycobacterium
PDDLAPFEPGAFVDALL

SEQ ID NO: 364650 - protein, 31 aa, Mycobacterium
PDDPRYPYREPLPAPPPGGPPPGPPAPAPPE

SEQ ID NO: 364651 - protein, 28 aa, Mycobacterium
PDDQFLAWGWRIPFLVSAILIVIGLVVR

SEQ ID NO: 364652 - protein, 20 aa, Mycobacterium
PDDRYPRCIDFAKALAAGPG

SEQ ID NO: 364653 - protein, 30 aa, Mycobacterium
PDDSRPLLERFLARRLLIKDLRDGEVIVEV

SEQ ID NO: 364654 - protein, 18 aa, Mycobacterium
PDDWRRWYRLARAYDYAG

SEQ ID NO: 364655 - protein, 23 aa, Mycobacterium
PDDWRRWYRLARAYDYAGDRRRA

SEQ ID NO: 364656 - protein, 23 aa, Mycobacterium
PDEANRRFLAQNRPPPPRRTQTP

SEQ ID NO: 364657 - protein, 23 aa, Mycobacterium
PDEGLIVLGIYRSDGHYAAHPAP

SEQ ID NO: 364658 - protein, 26 aa, Mycobacterium
PDELPATGARLRWVPLRGPSATPAQG

SEQ ID NO: 364659 - protein, 20 aa, Mycobacterium
PDELPATGARLRWVRAQGSS

SEQ ID NO: 364660 - protein, 19 aa, Mycobacterium
PDELSSHTPRLAIRALRIG

SEQ ID NO: 364661 - protein, 32 aa, Mycobacterium
PDETEFRARLWLPYLPLILAAAAGWAHAAGHS

SEQ ID NO: 364662 - protein, 18 aa, Mycobacterium
PDFLVLRAGRHHVPLATA

SEQ ID NO: 364663 - protein, 19 aa, Mycobacterium
PDFLVLRAGRHQVPLATAL

SEQ ID NO: 364664 - protein, 18 aa, Mycobacterium
PDFPLPFTYPPFAAVVFW

SEQ ID NO: 364665 - protein, 19 aa, Mycobacterium
PDFPLPFTYPPFAAVVFYP

SEQ ID NO: 364666 - protein, 19 aa, Mycobacterium
PDFRLFWDNAYAVHTLTHD

SEQ ID NO: 364667 - protein, 22 aa, Mycobacterium
PDFRLGILLIGLFASVLGWLPT

SEQ ID NO: 364668 - protein, 25 aa, Mycobacterium
PDFYDHPVAKWLGTPLAGGLTATTR

SEQ ID NO: 364669 - protein, 18 aa, Mycobacterium
PDGAKLWLPGYLVWFIGG

SEQ ID NO: 364670 - protein, 23 aa, Mycobacterium
PDGARLWLPSYLAWFLGGMLLTV

SEQ ID NO: 364671 - protein, 17 aa, Mycobacterium
PDGARLWLPTYLAWFLA

SEQ ID NO: 364672 - protein, 23 aa, Mycobacterium
PDGARLWLPTYLAWFLAGMLLAV

SEQ ID NO: 364673 - protein, 17 aa, Mycobacterium
PDGHHLMVGWPALAHPP

SEQ ID NO: 364674 - protein, 34 aa, Mycobacterium
PDGLPAWIGWTHFFNLFMMMFIIRTGIQILCDHP

SEQ ID NO: 364675 - protein, 28 aa, Mycobacterium
PDGPPRVLIIAAALLAVAALGTILVIAA

SEQ ID NO: 364676 - protein, 24 aa, Mycobacterium
PDGSKPLVFSSRSWILATEREATC

SEQ ID NO: 364677 - protein, 38 aa, Mycobacterium
PDGSMARRFAVLILLLCLFGMLVILLRRGHVPGVASGP

SEQ ID NO: 364678 - protein, 25 aa, Mycobacterium
PDGTVLSMTLAWPGGLLDADDVSEL

SEQ ID NO: 364679 - protein, 18 aa, Mycobacterium
PDHALIRLRQRAGELLMT

SEQ ID NO: 364680 - protein, 23 aa, Mycobacterium
PDILDPALLRPGRFDRQIPVSNP

SEQ ID NO: 364681 - protein, 24 aa, Mycobacterium
PDILDPALLRPGRFDRQIPVSSPD

SEQ ID NO: 364682 - protein, 36 aa, Mycobacterium
PDINSVSWLPLFHDMGLLMIMFPALAGGYLTLMSPV

SEQ ID NO: 364683 - protein, 24 aa, Mycobacterium
PDIQRYFHSGISDLSWVLNAYNIV

SEQ ID NO: 364684 - protein, 20 aa, Mycobacterium
PDIWRIDRPWPLAWAGLVDI

SEQ ID NO: 364685 - protein, 24 aa, Mycobacterium
PDLARLDVTIWLTGSLDLPTAKEM

SEQ ID NO: 364686 - protein, 28 aa, Mycobacterium
PDLERGFKAPWVPLLPIASIAACVWLML

SEQ ID NO: 364687 - protein, 28 aa, Mycobacterium
PDLESPDWSWLKWLPHIDIPGELDGVGP

SEQ ID NO: 364688 - protein, 26 aa, Mycobacterium
PDLIAGIVCWLLLSREVLPRLGPAVA

SEQ ID NO: 364689 - protein, 42 aa, Mycobacterium
PDLKRGFRTPWVPVLPILSIIACVWLMLNLTGLTWIRFSVWM

SEQ ID NO: 364690 - protein, 17 aa, Mycobacterium
PDLRGASLLAIALGLLT

SEQ ID NO: 364691 - protein, 24 aa, Mycobacterium
PDLTMFPRADWLRALRRAFQVTPH

SEQ ID NO: 364692 - protein, 23 aa, Mycobacterium
PDPEIFVILRFLSGIGLGAELCS

SEQ ID NO: 364693 - protein, 27 aa, Mycobacterium
PDPGRWPWPTFAVNIVGAFLLGYFTTR

SEQ ID NO: 364694 - protein, 23 aa, Mycobacterium
PDPHSFAVLFAPPRLAAQLTGQP

SEQ ID NO: 364695 - protein, 32 aa, Mycobacterium
PDQDRYAEAAPLPWYKRAAVVFSLAAAGLAIL

SEQ ID NO: 364696 - protein, 36 aa, Mycobacterium
PDQKWSPYYLGNPVYAFLLMVLFQYGVALHELETER

SEQ ID NO: 364697 - protein, 44 aa, Mycobacterium
PDQPLLTRTLVGRILLVSTLLVASAWWLFEWEVGKGASVEAART

SEQ ID NO: 364698 - protein, 38 aa, Mycobacterium
PDQVRWIVLQLCVVVALFALWQARRLGPLVAESLPVVV

SEQ ID NO: 364699 - protein, 25 aa, Mycobacterium
PDRAILWQMVLLDPLLSWVGRTVFG

SEQ ID NO: 364700 - protein, 24 aa, Mycobacterium
PDRDLLLFCTLVVVLVTLIGQGIT

SEQ ID NO: 364701 - protein, 28 aa, Mycobacterium
PDRDRYPAVMWILLAGNLLVRSAGFAYP

SEQ ID NO: 364702 - protein, 22 aa, Mycobacterium
PDRGLRREALERGWPVMSFSRP

SEQ ID NO: 364703 - protein, 21 aa, Mycobacterium
PDRGWAARLRADPGRAGAIGL

SEQ ID NO: 364704 - protein, 20 aa, Mycobacterium
PDRKSLLRLAATLAGFPVVV

SEQ ID NO: 364705 - protein, 21 aa, Mycobacterium
PDRPAVWKPPRGRVASWFAEP

SEQ ID NO: 364706 - protein, 28 aa, Mycobacterium
PDRPRRFRVGLSRPRWTTVAAAVALLCT

SEQ ID NO: 364707 - protein, 38 aa, Mycobacterium
PDRPTAAPFLTALVVIVLVVIGVFLVNAFSGGDGLSEE

SEQ ID NO: 364708 - protein, 24 aa, Mycobacterium
PDRQSQFLQWLKDIGYVDLYNKLI

SEQ ID NO: 364709 - protein, 26 aa, Mycobacterium
PDRRGDLAMTWLLAGLVAGLLSGAVS

SEQ ID NO: 364710 - protein, 31 aa, Mycobacterium
PDRRRFFGYLNLFLASMLLLVVADNYALLYV

SEQ ID NO: 364711 - protein, 31 aa, Mycobacterium; identical to SEQ ID NO: 163268

SEQ ID NO: 364712 - protein, 35 aa, Mycobacterium
PDRSSLVRLLAILAGFPLVVAVVRPIFLELGPDAN

SEQ ID NO: 364713 - protein, 22 aa, Mycobacterium
PDRVELVLFVNQLVAVGDQAPQ

SEQ ID NO: 364714 - protein, 24 aa, Mycobacterium
PDSALTIVVLLAVAVAVAALVDGA

SEQ ID NO: 364715 - protein, 24 aa, Mycobacterium
PDSRDLLLSCGAALHHCVIAFAAL

SEQ ID NO: 364716 - protein, 26 aa, Mycobacterium
PDSVTWRVFLHPSVAPMIVLVTALLE

SEQ ID NO: 364717 - protein, 20 aa, Mycobacterium
PDSVWWWVCVSLLALVVLVM

SEQ ID NO: 364718 - protein, 22 aa, Mycobacterium
PDSYSLPLRRLLGFVAAGLDVS

SEQ ID NO: 364719 - protein, 24 aa, Mycobacterium
PDTRPRLILGSSLIASSFLGLRHL

SEQ ID NO: 364720 - protein, 35 aa, Mycobacterium
PDTSKPVWITMLWPLADRPRLAPGVPGGTIPVRLV

SEQ ID NO: 364721 - protein, 19 aa, Mycobacterium
PDVALLWALIQIYRQSQVF

SEQ ID NO: 364722 - protein, 21 aa, Mycobacterium
PDVNTWWAIRSSCTPTGCLAA

SEQ ID NO: 364723 - protein, 24 aa, Mycobacterium
PDVPGGRWIAPLLGTVMYVVGGRP

SEQ ID NO: 364724 - protein, 19 aa, Mycobacterium
PDWLPYAVLLPVAAVVLIG

SEQ ID NO: 364725 - protein, 25 aa, Mycobacterium
PDYAPGCKRILFSSDYYPALARPNV

SEQ ID NO: 364726 - protein, 27 aa, Mycobacterium
PEADRRRLIVLGLLGFGVLSGVAGAVI

SEQ ID NO: 364727 - protein, 29 aa, Mycobacterium
PEAFLSYGWRIAFLVSIVLVIFGVVVRFR

SEQ ID NO: 364728 - protein, 30 aa, Mycobacterium
PEAGLSFLPTPLAWLLAVVALAAAVAVVVF

SEQ ID NO: 364729 - protein, 25 aa, Mycobacterium
PEAIALIVVIARYLEPFTAVSELAP

SEQ ID NO: 364730 - protein, 24 aa, Mycobacterium
PEAIALIVVIVRYLEPFTTISELA

SEQ ID NO: 364731 - protein, 25 aa, Mycobacterium
PEAKAFFWLNIRRFCLLAGINIAVV

SEQ ID NO: 364732 - protein, 19 aa, Mycobacterium
PEARPRLILGSAMVALPAF

SEQ ID NO: 364733 - protein, 27 aa, Mycobacterium
PEAVFRFVLYAFLCATALIVVRIEERH

SEQ ID NO: 364734 - protein, 19 aa, Mycobacterium
PEDERQVVFARFSRGSTAS

SEQ ID NO: 364735 - protein, 31 aa, Mycobacterium
PEDFWRSAGLPEFRWPDPNGTRFPNGAPPPA

SEQ ID NO: 364736 - protein, 24 aa, Mycobacterium
PEDKQLPTVLFQTTVSKLRDLLAA

SEQ ID NO: 364737 - protein, 23 aa, Mycobacterium
PEDLATKRFWQGRELFVIIDGAT

SEQ ID NO: 364738 - protein, 20 aa, Mycobacterium
PEDLIRIRRITTLVAAGVNI

SEQ ID NO: 364739 - protein, 22 aa, Mycobacterium
PEDLWTVMGLVPQRGYLFSGTV

SEQ ID NO: 364740 - protein, 25 aa, Mycobacterium
PEDSRLPTVLFQTTLSKLRDLLAAA

SEQ ID NO: 364741 - protein, 17 aa, Mycobacterium
PEDTGPRRIAFGGGALC

SEQ ID NO: 364742 - protein, 18 aa, Mycobacterium
PEDYANIPPTRFKRKEHW

SEQ ID NO: 364743 - protein, 18 aa, Mycobacterium
PEEFTGKVFIIFQRLHGR

SEQ ID NO: 364744 - protein, 23 aa, Mycobacterium
PEEKLLVKMWGYPALTILTAIGI

SEQ ID NO: 364745 - protein, 29 aa, Mycobacterium
PEELRGRIMALWLVGFLGSRPFAAALLGG

SEQ ID NO: 364746 - protein, 26 aa, Mycobacterium
PEELRGRIMALWLVGFLGSRPIAAAV

SEQ ID NO: 364747 - protein, 24 aa, Mycobacterium
PEERRLVFERFYRSDAARAMPGSG

SEQ ID NO: 364748 - protein, 25 aa, Mycobacterium
PEEVAALVGWLASPSARMVTGASYT

SEQ ID NO: 364749 - protein, 21 aa, Mycobacterium
PEFEHLDYVPFSRHYDLPRAA

SEQ ID NO: 364750 - protein, 17 aa, Mycobacterium
PEFLAPQDKGPWGAFDM

SEQ ID NO: 364751 - protein, 22 aa, Mycobacterium
PEFSLLDWIFRAISVVLSVVVS

SEQ ID NO: 364752 - protein, 26 aa, Mycobacterium
PEFYGWMLVLPIGLMLQQSSLRAGSL

SEQ ID NO: 364753 - protein, 27 aa, Mycobacterium
PEGAADRWNWVLDGMVDIGALSQADRD

SEQ ID NO: 364754 - protein, 31 aa, Mycobacterium
PEGKMAAVAKRRGWPILRFNSRGPVGLRRQL

SEQ ID NO: 364755 - protein, 18 aa, Mycobacterium
PEGPWRLAVGGGGTLEDV

SEQ ID NO: 364756 - protein, 23 aa, Mycobacterium
PEHLPRLFERFYRADAARDREHG

SEQ ID NO: 364757 - protein, 23 aa, Mycobacterium
PEHLRRRKLLTPPLHGAALNGYV

SEQ ID NO: 364758 - protein, 31 aa, Mycobacterium
PEIALEVVKPTRISKLFILASRSVRRETASA

SEQ ID NO: 364759 - protein, 38 aa, Mycobacterium
PEIPRPVPSPIIAKIMPLVMVVAMVGMIAFFVTSGSFG

SEQ ID NO: 364760 - protein, 22 aa, Mycobacterium
PEIPRWEFVVLVGTAAVILVVV

SEQ ID NO: 364761 - protein, 31 aa, Mycobacterium
PEKAAMLLVPPYLIYMRAARPFIALYDRSAK

SEQ ID NO: 364762 - protein, 28 aa, Mycobacterium
PEKLRVRMWFFPWLPILTVVGIVVVLVR

SEQ ID NO: 364763 - protein, 23 aa, Mycobacterium
PEKLWQVRELQFAALAAVLLTAG

SEQ ID NO: 364764 - protein, 24 aa, Mycobacterium
PEKNQFLDRFSLKRLHQVAIVAVL

SEQ ID NO: 364765 - protein, 36 aa, Mycobacterium
PEKRPGPARLLRVLAIPVVIFWVAAAAALNIFVPTL

SEQ ID NO: 364766 - protein, 26 aa, Mycobacterium
PELAAAFPFYGPTPEAPDFAGSRDVA

SEQ ID NO: 364767 - protein, 21 aa, Mycobacterium
PELAPALAKQNWAALPGLQTN

SEQ ID NO: 364768 - protein, 26 aa, Mycobacterium
PELHPWLRDHTVDGVVLFPGAGFVEL

SEQ ID NO: 364769 - protein, 19 aa, Mycobacterium
PELIGWLYDFGFLSFIGTM

SEQ ID NO: 364770 - protein, 26 aa, Mycobacterium
PELSALLRRAVAPPGTLTVPIGIVDR

SEQ ID NO: 364771 - protein, 20 aa, Mycobacterium
PELSGLWTAGFVMAPYNTRI

SEQ ID NO: 364772 - protein, 29 aa, Mycobacterium
PELVMLLNDLAWIVFIAPIGMVVSQFVML

SEQ ID NO: 364773 - protein, 18 aa, Mycobacterium
PELYCLFHHGANVLPKVT

SEQ ID NO: 364774 - protein, 22 aa, Mycobacterium
PEMRQWLRNWVGKAVGKSPDSI

SEQ ID NO: 364775 - protein, 32 aa, Mycobacterium
PENAASPWRAIGKRILIAVGTLFAAVLVVYAD

SEQ ID NO: 364776 - protein, 17 aa, Mycobacterium
PEPAFKAAIARASQAAA

SEQ ID NO: 364777 - protein, 26 aa, Mycobacterium
PEPDNYLIWAILTTLFCCLPLGIVSI

SEQ ID NO: 364778 - protein, 26 aa, Mycobacterium
PEPDNYLVWAILATILCCLPFGIVSI

SEQ ID NO: 364779 - protein, 26 aa, Mycobacterium
PEPHPPIPTTPWQHHRHWITTKRSGH

SEQ ID NO: 364780 - protein, 26 aa, Mycobacterium
PEPLERRRAWLHKLTPGKVVVAVVGL

SEQ ID NO: 364781 - protein, 17 aa, Mycobacterium
PEPVHAMAPLAMADTGQ

SEQ ID NO: 364782 - protein, 24 aa, Mycobacterium
PEQDVMDGTLWMSLRTVEHQRVLA

SEQ ID NO: 364783 - protein, 32 aa, Mycobacterium
PEQLLHVLAGLLFLLFGLWMLFDGAFGWRSVA

SEQ ID NO: 364784 - protein, 34 aa, Mycobacterium
PERKPFPLLASIVTSIFVIGVAALALSLAVSIRS

SEQ ID NO: 364785 - protein, 17 aa, Mycobacterium
PERLGTRNPIFQAAVSL

SEQ ID NO: 364786 - protein, 23 aa, Mycobacterium
PERTTVFIFTSGHMRIPAVTSKG

SEQ ID NO: 364787 - protein, 24 aa, Mycobacterium
PESEHFISGPYLPADLRLYDYDAF

SEQ ID NO: 364788 - protein, 24 aa, Mycobacterium
PESEQFISGPYLPADLSLYDYDNY

SEQ ID NO: 364789 - protein, 30 aa, Mycobacterium
PESERLWGVVKLRRAAFSGVVLTASLVTAW

SEQ ID NO: 364790 - protein, 25 aa, Mycobacterium
PESGDWLYFVTIDAEGTTLFTADYN

SEQ ID NO: 364791 - protein, 57 aa, Mycobacterium
PESPIMVSVFAFIKMMSGGLFLLLVGRKLVWGVAWHRFAAFFNIYFKRNADGSVALG

SEQ ID NO: 364792 - protein, 37 aa, Mycobacterium
PESTAMLLIPVYLLYIRIARPFIAFYNWCANSTLRAF

SEQ ID NO: 364793 - protein, 35 aa, Mycobacterium
PETDKPVWITMLWPLADRPRLAPGVPGGTIPVRLI

SEQ ID NO: 364794 - protein, 23 aa, Mycobacterium
PETPLQQRDLLTRVIVSAARADR

SEQ ID NO: 364795 - protein, 21 aa, Mycobacterium
PETPMQRRDLLTRVIVAAAKA

SEQ ID NO: 364796 - protein, 43 aa, Mycobacterium
PETPTRPRWPRRRMFFVVTLAVLFVLSGMAVGWWVIQRNYYVT

SEQ ID NO: 364797 - protein, 35 aa, Mycobacterium
PETTKPVWITMLWPLADRPRLAPGVPGGTIPVRLV

SEQ ID NO: 364798 - protein, 27 aa, Mycobacterium
PEVANPALWILAGAVAGLIAIAAAMLR

SEQ ID NO: 364799 - protein, 25 aa, Mycobacterium
PEVANPALWILGGAVAGLVAIAVIM

SEQ ID NO: 364800 - protein, 19 aa, Mycobacterium
PEVLASRHHATLIPTPQGT

SEQ ID NO: 364801 - protein, 21 aa, Mycobacterium
PEVLASRHHATLIPTPQGTEI

SEQ ID NO: 364802 - protein, 17 aa, Mycobacterium
PEVWPNPTQFLPQRWDP

SEQ ID NO: 364803 - protein, 20 aa, Mycobacterium
PEWKFGFTTMLLGLSVLALL

SEQ ID NO: 364804 - protein, 18 aa, Mycobacterium
PEWRRRLDDLSYTPVLAP

SEQ ID NO: 364805 - protein, 27 aa, Mycobacterium
PFAAATYFFVIMIALTIITGVVRRICW

SEQ ID NO: 364806 - protein, 28 aa, Mycobacterium
PFAGQRPWTPLIGLLAQAADLGLRVIVT

SEQ ID NO: 364807 - protein, 21 aa, Mycobacterium
PFAILLVSLLGPIAATVIRLA

SEQ ID NO: 364808 - protein, 17 aa, Mycobacterium
PFAWIAVRHRGFFARFV

SEQ ID NO: 364809 - protein, 18 aa, Mycobacterium
PFDAFNEVRARRGLPGPA

SEQ ID NO: 364810 - protein, 20 aa, Mycobacterium
PFDFVTFLLAISLSAGWQLT

SEQ ID NO: 364811 - protein, 21 aa, Mycobacterium
PFDWYATLLSWLTQVSTVGVW

SEQ ID NO: 364812 - protein, 36 aa, Mycobacterium
PFENPTPWTNWLENFLILLIPFSLPRTFGRMVGSAR

SEQ ID NO: 364813 - protein, 32 aa, Mycobacterium
PFFARAVRVLALPIVAFWILVTIGTNIFVPQA

SEQ ID NO: 364814 - protein, 17 aa, Mycobacterium
PFFKAYVVNLFPGQFVQ

SEQ ID NO: 364815 - protein, 21 aa, Mycobacterium
PFFSRAVFRRLLSYSRKDFHP

SEQ ID NO: 364816 - protein, 24 aa, Mycobacterium
PFGEYLPMPWLFKHLSGYAGRAGS

SEQ ID NO: 364817 - protein, 26 aa, Mycobacterium
PFGEYLPMPWLFRHLSGYADRAGHFV

SEQ ID NO: 364818 - protein, 25 aa, Mycobacterium
PFGHQWFTVQRTIFRLAFPGGTPRP

SEQ ID NO: 364819 - protein, 17 aa, Mycobacterium
PFGPSLLHFDLQDLSFP

SEQ ID NO: 364820 - protein, 19 aa, Mycobacterium
PFGTLLLIDVAIAVFVCTL

SEQ ID NO: 364821 - protein, 21 aa, Mycobacterium
PFIDLRFFRSVPFASATLVAV

SEQ ID NO: 364822 - protein, 32 aa, Mycobacterium
PFIPRMVRAFAIPIIFFWGLLAVATNTFMPQV

SEQ ID NO: 364823 - protein, 32 aa, Mycobacterium
PFIPRMVRAFAIPIIFFWGLLAVTTNTFMPQV

SEQ ID NO: 364824 - protein, 20 aa, Mycobacterium
PFIVACLVVFMLFNAGGLQL

SEQ ID NO: 364825 - protein, 17 aa, Mycobacterium
PFKARLFRVAADDHVLV

SEQ ID NO: 364826 - protein, 22 aa, Mycobacterium
PFLLIMGGFMYFASRRQKRAMQ

SEQ ID NO: 364827 - protein, 17 aa, Mycobacterium
PFLPFANGIRFTGVPWY

SEQ ID NO: 364828 - protein, 24 aa, Mycobacterium
PFLPLAIIMYWLANNIWTFGQQHY

SEQ ID NO: 364829 - protein, 20 aa, Mycobacterium
PFLPLVQLGGVALLSMAIML

SEQ ID NO: 364830 - protein, 25 aa, Mycobacterium
PFLSYGIQWIAFGIIAPIGVGYFVY

SEQ ID NO: 364831 - protein, 24 aa, Mycobacterium
PFLSYGIQWIAFGILAPIGLGYFV

SEQ ID NO: 364832 - protein, 24 aa, Mycobacterium
PFLSYGIQWISFGIVAPLGLGYFV

SEQ ID NO: 364833 - protein, 26 aa, Mycobacterium
PFLSYGIQWITFGILAPIGLGYFAYA

SEQ ID NO: 364834 - protein, 21 aa, Mycobacterium
PFMILPFFALIAMYRQIDDLS

SEQ ID NO: 364835 - protein, 39 aa, Mycobacterium
PFMVPLGIFSALSFWYVPKLGLRLVLSVGTLLMAVGFAC

SEQ ID NO: 364836 - protein, 31 aa, Mycobacterium
PFNNACLILLGLFPLFVMFIITSITMQRERA

SEQ ID NO: 364837 - protein, 20 aa, Mycobacterium
PFQMPQLPCILPAPFCPPST

SEQ ID NO: 364838 - protein, 25 aa, Mycobacterium
PFRRRLLRVTRWDVGLAMVLAGGVN

SEQ ID NO: 364839 - protein, 43 aa, Mycobacterium
PFRRRNPRPAIVVVVLLVVVTAVVWTIALTRPAKVHEVAVCNP

SEQ ID NO: 364840 - protein, 19 aa, Mycobacterium
PFSLLFVSYTLEGVGYIIA

SEQ ID NO: 364841 - protein, 22 aa, Mycobacterium
PFVFGMPKFDFVACLTMIIVLM

SEQ ID NO: 364842 - protein, 17 aa, Mycobacterium
PFVFGYEVGNLVIQWIS

SEQ ID NO: 364843 - protein, 25 aa, Mycobacterium
PFVGFIPWIIYWVVADGPSTWMFGA

SEQ ID NO: 364844 - protein, 19 aa, Mycobacterium
PFVRPVAAWQLGKLRPIIG

SEQ ID NO: 364845 - protein, 25 aa, Mycobacterium
PFVTVGAYLFNALALVGYSPSTGQA

SEQ ID NO: 364846 - protein, 19 aa, Mycobacterium
PFWGTSFSAAYVSGVAALV

SEQ ID NO: 364847 - protein, 25 aa, Mycobacterium
PFYCPVDQTAYFDTGFFDVLKTQFG

SEQ ID NO: 364848 - protein, 17 aa, Mycobacterium
PFYLLVEVTIVVAVWAL

SEQ ID NO: 364849 - protein, 25 aa, Mycobacterium
PGAAMFVLDGLLRPVPPGVVGELYI

SEQ ID NO: 364850 - protein, 23 aa, Mycobacterium
PGAARYYAVLPDGLQPISPVLAA

SEQ ID NO: 364851 - protein, 30 aa, Mycobacterium
PGAFRLAVLVLIVLALLRRRIRLAVFLVVT

SEQ ID NO: 364852 - protein, 23 aa, Mycobacterium
PGAFYVLLWVGLVALSVCVGPVW

SEQ ID NO: 364853 - protein, 22 aa, Mycobacterium
PGAIIGFALLCLVAATIWLRSR

SEQ ID NO: 364854 - protein, 17 aa, Mycobacterium
PGALPRVWALINATSED

SEQ ID NO: 364855 - protein, 23 aa, Mycobacterium
PGAPIWQLVLPFAALGVGMAMLW

SEQ ID NO: 364856 - protein, 20 aa, Mycobacterium
PGAPPPLRRPLTPADGVPVG

SEQ ID NO: 364857 - protein, 21 aa, Mycobacterium
PGAPPPPGAPVPPGAPPGPLP

SEQ ID NO: 364858 - protein, 24 aa, Mycobacterium
PGARALVVAILVFVLLGSFILPHT

SEQ ID NO: 364859 - protein, 27 aa, Mycobacterium
PGARALVVAILVFVLLGSFLLPHTGSS

SEQ ID NO: 364860 - protein, 17 aa, Mycobacterium
PGATGLMILPFSAGVAV

SEQ ID NO: 364861 - protein, 22 aa, Mycobacterium
PGAWIDQAVVLWVLIALVSAMG

SEQ ID NO: 364862 - protein, 23 aa, Mycobacterium
PGAYWLFHDGKVGHLKDLLINCG

SEQ ID NO: 364863 - protein, 33 aa, Mycobacterium
PGCWQPITHDLWPAPFLVMDVGASVAPYNHVEL

SEQ ID NO: 364864 - protein, 31 aa, Mycobacterium
PGCWQPITHDLWPAPYLVLDTGASIAPYNHF

SEQ ID NO: 364865 - protein, 28 aa, Mycobacterium
PGCWVFTLGVFLFWLLTTSRADYASRWL

SEQ ID NO: 364866 - protein, 27 aa, Mycobacterium
PGDALYGLRTMLFGEQVQMRDDAVILA

SEQ ID NO: 364867 - protein, 28 aa, Mycobacterium
PGDHVLVVRPSIWYRLRRSVRFRSHATI

SEQ ID NO: 364868 - protein, 25 aa, Mycobacterium
PGDLPRRWYLAPPGGAPLDESMTLA

SEQ ID NO: 364869 - protein, 24 aa, Mycobacterium
PGDVSFYCLDYGGGQLRVLDGLAH

SEQ ID NO: 364870 - protein, 17 aa, Mycobacterium
PGEASLLVASYPEVPKR

SEQ ID NO: 364871 - protein, 23 aa, Mycobacterium
PGEFWFGVLFYGAPVVPVVVIAL

SEQ ID NO: 364872 - protein, 32 aa, Mycobacterium
PGELIFDDVTVRPPYSVLAIGDPPTLAAAMNI

SEQ ID NO: 364873 - protein, 28 aa, Mycobacterium
PGELPTPPPPPPVPALAPAPLDQVDGGQ

SEQ ID NO: 364874 - protein, 23 aa, Mycobacterium
PGERDALRFVACGRPLPGHEIRI

SEQ ID NO: 364875 - protein, 25 aa, Mycobacterium
PGESTFHWLTLGLAVIWAVGALASG

SEQ ID NO: 364876 - protein, 26 aa, Mycobacterium
PGESTFYWLTLTLAAVWALGALASGP

SEQ ID NO: 364877 - protein, 25 aa, Mycobacterium
PGETISFLPIIALAIIFGLSSDYQV

SEQ ID NO: 364878 - protein, 19 aa, Mycobacterium
PGFLPLKVPIEVHFTQRVA

SEQ ID NO: 364879 - protein, 18 aa, Mycobacterium
PGFPAHDLYLFRLYSFTT

SEQ ID NO: 364880 - protein, 27 aa, Mycobacterium
PGFSDPTQWGLVQAGSTLLKFFGGLRN

SEQ ID NO: 364881 - protein, 47 aa, Mycobacterium
PGFVPNPNPGVPVPIPVIVPFPGWQPGYPRPPYNPPYTPPSTTTITP

SEQ ID NO: 364882 - protein, 17 aa, Mycobacterium
PGGAWMIGMRRPQAYPL

SEQ ID NO: 364883 - protein, 28 aa, Mycobacterium
PGGGGPQTVLPFTGLKAPAGVAVDSSGA

SEQ ID NO: 364884 - protein, 26 aa, Mycobacterium
PGGITSPDALWQFLCDRRSAIGKVPD

SEQ ID NO: 364885 - protein, 28 aa, Mycobacterium
PGGLRLKMWLFPWLSYATIALMASVILA

SEQ ID NO: 364886 - protein, 25 aa, Mycobacterium
PGGPGGMFFLPGPPPPGMGPGMGPG

SEQ ID NO: 364887 - protein, 25 aa, Mycobacterium
PGGPPYGAALYGPGGVPLWPGVPPA

SEQ ID NO: 364888 - protein, 22 aa, Mycobacterium
PGGRLVFAQLRNKVGRNGIHVF

SEQ ID NO: 364889 - protein, 19 aa, Mycobacterium
PGGWPFPPVPFVNGLASFF

SEQ ID NO: 364890 - protein, 26 aa, Mycobacterium
PGHLHAAAALPAWSMVTAHVVAVVAG

SEQ ID NO: 364891 - protein, 19 aa, Mycobacterium
PGHLVPSSLRPVDAIPLLP

SEQ ID NO: 364892 - protein, 38 aa, Mycobacterium
PGHRRAVLGLTLSYVFITLAVIALVVWLLLGDHGGDNG

SEQ ID NO: 364893 - protein, 27 aa, Mycobacterium
PGIDDKWLPGPALPAPTRPTVQREVCA

SEQ ID NO: 364894 - protein, 26 aa, Mycobacterium
PGIEIALPFERPLYQVPAAVAVESTI

SEQ ID NO: 364895 - protein, 21 aa, Mycobacterium
PGIKVPNPVTIPKAPQAPATS

SEQ ID NO: 364896 - protein, 32 aa, Mycobacterium
PGILIIVFIETGLLFPLLPGESLLFTGGLLAA

SEQ ID NO: 364897 - protein, 18 aa, Mycobacterium
PGIPVWSLVLLGSAAMAV

SEQ ID NO: 364898 - protein, 44 aa, Mycobacterium
PGKTSPLVISGWTLMVWLMLGVGSFFGYLASLAAAVFAGTRIAR

SEQ ID NO: 364899 - protein, 32 aa, Mycobacterium
PGLALGLMVIAILVVWRWAPARVAKIPGPLVA

SEQ ID NO: 364900 - protein, 27 aa, Mycobacterium
PGLAQHGPWIAILTAALTALALHLGFI

SEQ ID NO: 364901 - protein, 29 aa, Mycobacterium
PGLAVDIPVVFYQLSFARTGRWNKLFADG

SEQ ID NO: 364902 - protein, 18 aa, Mycobacterium
PGLAVFRAVFYFAADSHF

SEQ ID NO: 364903 - protein, 35 aa, Mycobacterium
PGLDGLFAAFLRNNVKLIPLVPFPVDHATSTTTAM

SEQ ID NO: 364904 - protein, 17 aa, Mycobacterium
PGLFALMVLFSTVAGLA

SEQ ID NO: 364905 - protein, 20 aa, Mycobacterium
PGLKRNPLLWVTLVGTMCVL

SEQ ID NO: 364906 - protein, 20 aa, Mycobacterium
PGLKVTLMPSPTVLMLGMPA

SEQ ID NO: 364907 - protein, 22 aa, Mycobacterium
PGLMTWPMILLAIGSVFSGGLL

SEQ ID NO: 364908 - protein, 20 aa, Mycobacterium
PGLQALLGGGWLFAGVLTAL

SEQ ID NO: 364909 - protein, 24 aa, Mycobacterium
PGMAAPPVRLLPTNLAPDAVGSLY

SEQ ID NO: 364910 - protein, 24 aa, Mycobacterium
PGMAAPPVRLLPTNLAPEAVGALY

SEQ ID NO: 364911 - protein, 34 aa, Mycobacterium
PGMFLGVLVIAIMVAWRWAPAKLAPIPGPLVAIV

SEQ ID NO: 364912 - protein, 34 aa, Mycobacterium
PGMPRLLKWLSPLVPLVAGPLPVAFFIGVLAGEE

SEQ ID NO: 364913 - protein, 34 aa, Mycobacterium
PGMPRRLRWISPLVPLVAGPLPVAFFIGVLAGEE

SEQ ID NO: 364914 - protein, 42 aa, Mycobacterium
PGNGRWLMYALGTIGAIVLMQRFFRGFWSTIAVLLGLVAGTV

SEQ ID NO: 364915 - protein, 20 aa, Mycobacterium
PGNPLPVVPLAFDPPEHTRY

SEQ ID NO: 364916 - protein, 19 aa, Mycobacterium
PGNSLIEWLRLPGDFVFIL

SEQ ID NO: 364917 - protein, 34 aa, Mycobacterium
PGNVNMVRLWWDKPWAMRIVALARLPLQIPMITT

SEQ ID NO: 364918 - protein, 21 aa, Mycobacterium
PGPAPHAPFPLPTPPNEQGPQ

SEQ ID NO: 364919 - protein, 43 aa, Mycobacterium
PGPAPHAPFPLPVPPNTLGPPPPPLPYYAPPDQIVPPYGRTPP

SEQ ID NO: 364920 - protein, 24 aa, Mycobacterium
PGPAWLRRWWLAVVAAAAATVWLE

SEQ ID NO: 364921 - protein, 29 aa, Mycobacterium
PGPAWVRRLWLAMIIVAPASIWLEPLSSN

SEQ ID NO: 364922 - protein, 23 aa, Mycobacterium
PGPGGAWQFRWPTLTLDNTNRIY

SEQ ID NO: 364923 - protein, 17 aa, Mycobacterium
PGPGQFVLALPPALNAV

SEQ ID NO: 364924 - protein, 17 aa, Mycobacterium
PGPIPYPGAPPYGAQQY

SEQ ID NO: 364925 - protein, 21 aa, Mycobacterium
PGPLTFLGTSFRIGSFSTTYG

SEQ ID NO: 364926 - protein, 18 aa, Mycobacterium
PGPRFLDAPGQPAGMVAA

SEQ ID NO: 364927 - protein, 23 aa, Mycobacterium
PGPRGFVVAILIFVLLGSFILPH

SEQ ID NO: 364928 - protein, 20 aa, Mycobacterium
PGPRKVSVGVIVALVSVVVV

SEQ ID NO: 364929 - protein, 18 aa, Mycobacterium
PGPVFVASLLIALVGMMV

SEQ ID NO: 364930 - protein, 19 aa, Mycobacterium
PGPVLVATLLISLIGLLAL

SEQ ID NO: 364931 - protein, 29 aa, Mycobacterium
PGQAGPPPPPPWTYGGPFPGPPPQRPSGN

SEQ ID NO: 364932 - protein, 22 aa, Mycobacterium
PGQAWVLVFAVTMMAGLLVSLL

SEQ ID NO: 364933 - protein, 29 aa, Mycobacterium
PGQFVSGLSLFLAILIATSISMIFGELVP

SEQ ID NO: 364934 - protein, 22 aa, Mycobacterium
PGQILVLLNVGAIFMGTALTIR

SEQ ID NO: 364935 - protein, 45 aa, Mycobacterium
PGQPLLTRALVTRILLVSTLLVASAWWLFEWEISRGASLPEARAT

SEQ ID NO: 364936 - protein, 26 aa, Mycobacterium
PGRAIWRPMFVAPLAVPAFINSYAWV

SEQ ID NO: 364937 - protein, 25 aa, Mycobacterium
PGRFRSGRWMVLAEGLLVSAFAIGG

SEQ ID NO: 364938 - protein, 17 aa, Mycobacterium
PGRILSIGMVLAALVIA

SEQ ID NO: 364939 - protein, 22 aa, Mycobacterium
PGRRPFILAYNRIRRPLMRFGH

SEQ ID NO: 364940 - protein, 22 aa, Mycobacterium
PGRSLWWSWAWVAGMVAYAGDL

SEQ ID NO: 364941 - protein, 19 aa, Mycobacterium
PGRVVPSRALWAALFESLL

SEQ ID NO: 364942 - protein, 19 aa, Mycobacterium
PGRWRQVIAAGLQVIDTAG

SEQ ID NO: 364943 - protein, 19 aa, Mycobacterium
PGSLGWFTNRLLVPAVLIE

SEQ ID NO: 364944 - protein, 27 aa, Mycobacterium
PGSRTEFYWVFTGIAMVLMFYELFAMV

SEQ ID NO: 364945 - protein, 27 aa, Mycobacterium
PGSSRILFGVLLLVTLLSLTAAVVPHL

SEQ ID NO: 364946 - protein, 25 aa, Mycobacterium
PGSVPGWLLLRIPVGTVWSEEAAFR

SEQ ID NO: 364947 - protein, 17 aa, Mycobacterium
PGSVWTPDGFHLDVEHG

SEQ ID NO: 364948 - protein, 22 aa, Mycobacterium
PGSWIDQAVVLWVLIGLVTAMS

SEQ ID NO: 364949 - protein, 25 aa, Mycobacterium
PGTGQGLAVAWLDRLRAMAKHTCVT

SEQ ID NO: 364950 - protein, 29 aa, Mycobacterium
PGTLARPDRFWYALNRVGAFAGADAGAFS

SEQ ID NO: 364951 - protein, 21 aa, Mycobacterium
PGTLIMLATAVTLLVVIRERE

SEQ ID NO: 364952 - protein, 26 aa, Mycobacterium
PGTNGSQFFLVYKDSQLPPQYTVFGT

SEQ ID NO: 364953 - protein, 25 aa, Mycobacterium
PGTNGSQFFLVYQDSQLPPNYTVFG

SEQ ID NO: 364954 - protein, 24 aa, Mycobacterium
PGTNLFFMFYYVMTGMHLCHVLLG

SEQ ID NO: 364955 - protein, 22 aa, Mycobacterium
PGTPPFPVGPPGPPAPGVAPAP

SEQ ID NO: 364956 - protein, 35 aa, Mycobacterium
PGTVAAPRHRFSARARWAVALVCAMLVAVAATCSA

SEQ ID NO: 364957 - protein, 17 aa, Mycobacterium
PGTVTYRITGNRALLDL

SEQ ID NO: 364958 - protein, 29 aa, Mycobacterium
PGVIIGVLVIAILVAWRWVPAKVRRVPGP

SEQ ID NO: 364959 - protein, 21 aa, Mycobacterium
PGVILRQILTWMLSTAVPLMA

SEQ ID NO: 364960 - protein, 26 aa, Mycobacterium
PGVLTSPVAFLQRPARWIQAMAQAVP

SEQ ID NO: 364961 - protein, 22 aa, Mycobacterium
PGVMMAGRLLVPVTGAIGVYDP

SEQ ID NO: 364962 - protein, 20 aa, Mycobacterium
PGVPGQLPPQLQLPAPVGSA

SEQ ID NO: 364963 - protein, 25 aa, Mycobacterium
PGVPWLPIVAIVACGWLMLNLAVRT

SEQ ID NO: 364964 - protein, 17 aa, Mycobacterium
PGVWWQSIIVWFAAAIV

SEQ ID NO: 364965 - protein, 25 aa, Mycobacterium
PGWGLIVAWITVLLLIYHWARVVWQ

SEQ ID NO: 364966 - protein, 24 aa, Mycobacterium
PGWKLRLQQLFLTLVGLIVAATAA

SEQ ID NO: 364967 - protein, 20 aa, Mycobacterium
PGWLPGWLRPVHSRRVTVAA

SEQ ID NO: 364968 - protein, 21 aa, Mycobacterium
PGWMVQLVMVVLVAPVGVVVL

SEQ ID NO: 364969 - protein, 18 aa, Mycobacterium
PGWRHEHSYFPRPGPGPR

SEQ ID NO: 364970 - protein, 25 aa, Mycobacterium
PGWRRLKHFNGFTTSFWVTPSDITT

SEQ ID NO: 364971 - protein, 23 aa, Mycobacterium
PGYAQPWLRPFLQRLLRNDRPTL

SEQ ID NO: 364972 - protein, 18 aa, Mycobacterium
PGYGLLALGYLVAYAVSA

SEQ ID NO: 364973 - protein, 19 aa, Mycobacterium
PGYHRFIFWAYARNGDTDP

SEQ ID NO: 364974 - protein, 20 aa, Mycobacterium
PGYLWPGLALLAATASCSDL

SEQ ID NO: 364975 - protein, 20 aa, Mycobacterium
PGYQERFRREAYAAARLASP

SEQ ID NO: 364976 - protein, 29 aa, Mycobacterium
PGYQPQQGYWYPPPHPSGWQQPQPYPYQP

SEQ ID NO: 364977 - protein, 17 aa, Mycobacterium
PGYRERFRREAYGVAQL

SEQ ID NO: 364978 - protein, 26 aa, Mycobacterium
PHADDRWDWLKWLPHHTNTPYDGAAH

SEQ ID NO: 364979 - protein, 19 aa, Mycobacterium
PHALYWLAGLAAVAAALVT

SEQ ID NO: 364980 - protein, 24 aa, Mycobacterium
PHAPRRWLPLVLAGLVAVAVLLRG

SEQ ID NO: 364981 - protein, 18 aa, Mycobacterium
PHCFDIPVCWSLRSIFDA

SEQ ID NO: 364982 - protein, 32 aa, Mycobacterium
PHEDALAALLGQWRDDLRWPPASALVSPDEAV

SEQ ID NO: 364983 - protein, 19 aa, Mycobacterium
PHEGLTYRFPFDTEKKTYQ

SEQ ID NO: 364984 - protein, 23 aa, Mycobacterium
PHERRLVFERFYRSTTARAMPGS

SEQ ID NO: 364985 - protein, 32 aa, Mycobacterium
PHERSLLARIPWPSILLLCGLLTYLGLMQKIG

SEQ ID NO: 364986 - protein, 24 aa, Mycobacterium
PHEVTARFWRRSGIRIVRRPRAHL

SEQ ID NO: 364987 - protein, 24 aa, Mycobacterium
PHEVTFYCLDYGGGQLRSLEGLAH

SEQ ID NO: 364988 - protein, 21 aa, Mycobacterium
PHGLWPRLIHGVLVASALVVG

SEQ ID NO: 364989 - protein, 19 aa, Mycobacterium
PHGSRLLTPPLLTDYQARE

SEQ ID NO: 364990 - protein, 17 aa, Mycobacterium
PHHEFLAFWSIHLLVVW

SEQ ID NO: 364991 - protein, 19 aa, Mycobacterium
PHHSFLSRLYTGTGAFEVV

SEQ ID NO: 364992 - protein, 33 aa, Mycobacterium
PHKHGATWFLVLPIVLLIFIVPPALSARSIAPA

SEQ ID NO: 364993 - protein, 27 aa, Mycobacterium
PHKLSLPLSFWLYSGFTAITMIGFATF

SEQ ID NO: 364994 - protein, 17 aa, Mycobacterium
PHLAARFYERFDPPIQA

SEQ ID NO: 364995 - protein, 24 aa, Mycobacterium
PHLEWYDYPLSGVLSLVVLFTVVE

SEQ ID NO: 364996 - protein, 23 aa, Mycobacterium
PHPHTFAYFLPDGHEYQITLIVV

SEQ ID NO: 364997 - protein, 26 aa, Mycobacterium
PHRGLLIAAHLVWLAALAGGALGLVA

SEQ ID NO: 364998 - protein, 44 aa, Mycobacterium
PHRPRWSRRRMVVVAALAVLLVVAGLTVGWWVIQRNYYVAEYNG

SEQ ID NO: 364999 - protein, 23 aa, Mycobacterium
PHRVMRILYEQFVAYSRAYVGKL

SEQ ID NO: 365000 - protein, 18 aa, Mycobacterium
PHSSWLVVRWVVASALGG

SEQ ID NO: 365001 - protein, 20 aa, Mycobacterium
PHSWWPILISLSFSTAAVGA

SEQ ID NO: 365002 - protein, 28 aa, Mycobacterium
PHTGQRWLPLLLAGFSAGFLMLRGRSYV

SEQ ID NO: 365003 - protein, 28 aa, Mycobacterium
PHTGQRWLPLLLAGFTAGFLLLRGRSYV

SEQ ID NO: 365004 - protein, 26 aa, Mycobacterium
PHTNVTVLLPRRTFARLLGRLLHDRT

SEQ ID NO: 365005 - protein, 23 aa, Mycobacterium
PHTPPAPIIIKPGAGLAGEIVAG

SEQ ID NO: 365006 - protein, 19 aa, Mycobacterium
PHTPYPDLLDHAPDPATLP

SEQ ID NO: 365007 - protein, 18 aa, Mycobacterium
PHVFLNAIFGLFGAFALI

SEQ ID NO: 365008 - protein, 25 aa, Mycobacterium
PHVFLNAMFGLFGALALIAATIVLF

SEQ ID NO: 365009 - protein, 26 aa, Mycobacterium
PHWAQGAIGWCVLPLMLALPTRTGAA

SEQ ID NO: 365010 - protein, 25 aa, Mycobacterium
PHYPILILLYLIYPFSTVAAGVAIL

SEQ ID NO: 365011 - protein, 26 aa, Mycobacterium
PIAAEVLAFRVVLASYLPAAAIALFQ

SEQ ID NO: 365012 - protein, 18 aa, Mycobacterium
PIAAGLCLLVFAGFMLYF

SEQ ID NO: 365013 - protein, 17 aa, Mycobacterium
PIALVFLVALCRQRWGL

SEQ ID NO: 365014 - protein, 17 aa, Mycobacterium
PIAWFNPDLILSKPDWL

SEQ ID NO: 365015 - protein, 19 aa, Mycobacterium
PIDEISLGAAIDYAVNAKN

SEQ ID NO: 365016 - protein, 26 aa, Mycobacterium
PIDGDLEWTLFLSAQWVAAAGSIFAA

SEQ ID NO: 365017 - protein, 22 aa, Mycobacterium
PIDPRFPTFLATNLSEALPGPF

SEQ ID NO: 365018 - protein, 23 aa, Mycobacterium
PIDPRFPTFLATNLSEALPGPFS

SEQ ID NO: 365019 - protein, 25 aa, Mycobacterium
PIDQAALGAALRYAVAEKDAVVVAA

SEQ ID NO: 365020 - protein, 28 aa, Mycobacterium
PIDVRITVLWWILFTLIATYVLFKTRIG

SEQ ID NO: 365021 - protein, 23 aa, Mycobacterium
PIEDGRNILPPNKFPMIPPQVDP

SEQ ID NO: 365022 - protein, 19 aa, Mycobacterium
PIEDLPLYRRDDDAVAAAR

SEQ ID NO: 365023 - protein, 26 aa, Mycobacterium
PIEKVQLVIFGIQIALGELLKAHGAR

SEQ ID NO: 365024 - protein, 43 aa, Mycobacterium
PIELAIAVLVLVVLLMIYRSAVTMLLPLLSIGTSLVIAQAVVA

SEQ ID NO: 365025 - protein, 30 aa, Mycobacterium
PIETYNKTWLGFIAIAVIASLIGAMLLIKA

SEQ ID NO: 365026 - protein, 26 aa, Mycobacterium
PIEVGLPEWIYLPAAVGALFVLTPLA

SEQ ID NO: 365027 - protein, 21 aa, Mycobacterium
PIEWMALRAIAGAVSALVFVI

SEQ ID NO: 365028 - protein, 19 aa, Mycobacterium
PIFWLLDTTNFLAILAAMV

SEQ ID NO: 365029 - protein, 25 aa, Mycobacterium
PIGAPAWMRIFAVATVVTLVVAVDK

SEQ ID NO: 365030 - protein, 29 aa, Mycobacterium
PIGLAAVALLLLLGAPFLHARWGYPDDRV

SEQ ID NO: 365031 - protein, 22 aa, Mycobacterium
PIGLDLPFTYPPLAAVVFSPFA

SEQ ID NO: 365032 - protein, 30 aa, Mycobacterium
PIGLSVVALLLLLGAPFLGVKWGFPDERVL

SEQ ID NO: 365033 - protein, 27 aa, Mycobacterium
PIGQPGTPPLPLPFPRTGQGGEPHLKL

SEQ ID NO: 365034 - protein, 17 aa, Mycobacterium
PIGSPTAWAAFFVLDEW

SEQ ID NO: 365035 - protein, 29 aa, Mycobacterium
PIGWAMWGFLITVIISFVLLPLLGKDALA

SEQ ID NO: 365036 - protein, 19 aa, Mycobacterium
PIIALVIAVFLMRTEPNPE

SEQ ID NO: 365037 - protein, 20 aa, Mycobacterium
PIILAWVVLTVIVNVAVPRL

SEQ ID NO: 365038 - protein, 44 aa, Mycobacterium
PIIMAIMGTFFFLNPVLVFFQGVMLIINWIIGNLALAGPALSTY

SEQ ID NO: 365039 - protein, 24 aa, Mycobacterium
PIIQAGLLAISAMSLQCGLGTPDD

SEQ ID NO: 365040 - protein, 20 aa, Mycobacterium
PIIVFVLIFQRRIIAGLTSG

SEQ ID NO: 365041 - protein, 25 aa, Mycobacterium
PIIYSQTWMILQLPYGVVGVTILTA

SEQ ID NO: 365042 - protein, 36 aa, Mycobacterium
PIKEWAIQALGPLDKPFLAIVVLVVIATLAALAGTL

SEQ ID NO: 365043 - protein, 25 aa, Mycobacterium
PIKEWAIQTLGSLDKLFLAVAVLVV

SEQ ID NO: 365044 - protein, 18 aa, Mycobacterium
PILAELLVAPSKSILVAR

SEQ ID NO: 365045 - protein, 25 aa, Mycobacterium
PILGAPINWFPLYLGPALAVELIAL

SEQ ID NO: 365046 - protein, 41 aa, Mycobacterium
PILGGWLIGAYGWKWIFLINLPIGLTAFALAAIMFAKDRSA

SEQ ID NO: 365047 - protein, 26 aa, Mycobacterium
PILHGVVATILYFLVGAAVLIAGFLM

SEQ ID NO: 365048 - protein, 20 aa, Mycobacterium
PILHLSRWIPELKTYGLAGV

SEQ ID NO: 365049 - protein, 19 aa, Mycobacterium
PILNIYRKYYGTKMMLTLL

SEQ ID NO: 365050 - protein, 35 aa, Mycobacterium
PILRILMRRRQTVGLWPLLAPMLAAGTVILAVVFA

SEQ ID NO: 365051 - protein, 31 aa, Mycobacterium
PILRILVRRHRLVGTWPLVAPMLAAGTVILT

SEQ ID NO: 365052 - protein, 20 aa, Mycobacterium
PILTHAVWGLIMVLALPPLF

SEQ ID NO: 365053 - protein, 17 aa, Mycobacterium
PILVVSAVFLAALGLVI

SEQ ID NO: 365054 - protein, 19 aa, Mycobacterium
PINVIFKRLPDGLGPLLPL

SEQ ID NO: 365055 - protein, 19 aa, Mycobacterium
PINVVFKRLPDGLGPLLPI

SEQ ID NO: 365056 - protein, 25 aa, Mycobacterium
PIPAGWKLWLYGVFAITAVGVTSSS

SEQ ID NO: 365057 - protein, 28 aa, Mycobacterium
PIPTLEELLVALPQMRFNIDIKADSAVE

SEQ ID NO: 365058 - protein, 21 aa, Mycobacterium
PIPVRIDVTAAAQLPPAKPLR

SEQ ID NO: 365059 - protein, 20 aa, Mycobacterium
PIRAYALFIITGIVVALLIG

SEQ ID NO: 365060 - protein, 18 aa, Mycobacterium
PIRLVVGWTYFSAFWRRV

SEQ ID NO: 365061 - protein, 20 aa, Mycobacterium
PIRNYFYWEPHCYNIPICWS

SEQ ID NO: 365062 - protein, 20 aa, Mycobacterium
PIRNYFYWEPHCYNIPVCHS

SEQ ID NO: 365063 - protein, 20 aa, Mycobacterium
PIRPVAPEAYALYGFSRIAP

SEQ ID NO: 365064 - protein, 20 aa, Mycobacterium
PIRRLRADAPPFFVLHGHDD

SEQ ID NO: 365065 - protein, 18 aa, Mycobacterium
PIRSYFYWEKHCADIPIC

SEQ ID NO: 365066 - protein, 27 aa, Mycobacterium
PIRVITRRVAIALVVLIAAAVIVYVDR

SEQ ID NO: 365067 - protein, 29 aa, Mycobacterium
PISEGMFNALPARGPWQLPPIPAAGEPNT

SEQ ID NO: 365068 - protein, 24 aa, Mycobacterium
PISEGMFNALPDSGPWRLPSIDAA

SEQ ID NO: 365069 - protein, 25 aa, Mycobacterium
PISQGLFNALPNRGPWQLPQIPAAG

SEQ ID NO: 365070 - protein, 26 aa, Mycobacterium
PISSLFDFLTFGLMLGVLHAGAVEFR

SEQ ID NO: 365071 - protein, 25 aa, Mycobacterium
PISVFVTMIAVAIYLLCRLVGRYRH

SEQ ID NO: 365072 - protein, 29 aa, Mycobacterium
PISWTHHWVWLIPLMIWLLHGPLRDRLGA

SEQ ID NO: 365073 - protein, 27 aa, Mycobacterium
PITELIRLIRRLLPAMVVVLAACALLT

SEQ ID NO: 365074 - protein, 19 aa, Mycobacterium
PITERITRFSDKFFEEVWD

SEQ ID NO: 365075 - protein, 25 aa, Mycobacterium
PITGEYTTFALTKDGPDKGKPDYVT

SEQ ID NO: 365076 - protein, 23 aa, Mycobacterium
PITVLCQTPLLLRQVALRASVTG

SEQ ID NO: 365077 - protein, 17 aa, Mycobacterium
PIVAGAAALVVVLVVAA

SEQ ID NO: 365078 - protein, 26 aa, Mycobacterium
PIVAIIPLFFLLRHVGLTNNLAGLIL

SEQ ID NO: 365079 - protein, 29 aa, Mycobacterium
PIVIAVAAGATFWLVRRSLRSVDAIRARV

SEQ ID NO: 365080 - protein, 24 aa, Mycobacterium
PIVRDLLVPAFAPGWQVYRDRSGA

SEQ ID NO: 365081 - protein, 37 aa, Mycobacterium
PIVRLADRYAAWFLPLSLLLASAAWLASGSAVRAVAV

SEQ ID NO: 365082 - protein, 34 aa, Mycobacterium
PIVRLADRYAAWFLPMALVLAAASWLASGSAVRA

SEQ ID NO: 365083 - protein, 26 aa, Mycobacterium
PIVRRILLRTVLFIAPGSAVWGLLPV

SEQ ID NO: 365084 - protein, 19 aa, Mycobacterium
PIVTQFADGLPLTQWCAAT

SEQ ID NO: 365085 - protein, 23 aa, Mycobacterium
PIVVGWVALVVILALAAPQLEQV

SEQ ID NO: 365086 - protein, 29 aa, Mycobacterium
PIVVIVMAVFILMLPRLFPGSFEADPERV

SEQ ID NO: 365087 - protein, 36 aa, Mycobacterium
PIVVSVAWWLAGVNLLLGLFNLLPGAPLDGGRLVRA

SEQ ID NO: 365088 - protein, 20 aa, Mycobacterium
PIVWGLNHFGWHLAAQVPLW

SEQ ID NO: 365089 - protein, 22 aa, Mycobacterium
PKAISLFLGAAFLVGAPLPLIG

SEQ ID NO: 365090 - protein, 18 aa, Mycobacterium
PKAPWIPQSAFGGSRFGG

SEQ ID NO: 365091 - protein, 40 aa, Mycobacterium
PKDSHWRHTPGAWWFDIAMLVLISLFYLGFVRWKIRLRGG

SEQ ID NO: 365092 - protein, 43 aa, Mycobacterium
PKEPKFERRPLGVSWLIGVVVIPLLLAALGYGAYQRPTSVDGP

SEQ ID NO: 365093 - protein, 21 aa, Mycobacterium
PKFVIAAVLIVFILVVAAFPS

SEQ ID NO: 365094 - protein, 23 aa, Mycobacterium
PKGLLFFLAVMPQFVNPAAPLLA

SEQ ID NO: 365095 - protein, 21 aa, Mycobacterium
PKHGFFVRLYTGTGAFEVIGK

SEQ ID NO: 365096 - protein, 20 aa, Mycobacterium
PKHGFFVRLYTGTGAFEVVG

SEQ ID NO: 365097 - protein, 26 aa, Mycobacterium
PKIGPWALYGLLFTIVILFALQGDQI

SEQ ID NO: 365098 - protein, 24 aa, Mycobacterium
PKILVAVLMAFFPIVISGLAGLRS

SEQ ID NO: 365099 - protein, 20 aa, Mycobacterium
PKLALPTLGIFLAALGSFVL

SEQ ID NO: 365100 - protein, 27 aa, Mycobacterium
PKLVIMNLRDHMFAKAPYFLDGKESPL

SEQ ID NO: 365101 - protein, 21 aa, Mycobacterium
PKLVIMNLRDHMFAKAPYILG

SEQ ID NO: 365102 - protein, 24 aa, Mycobacterium
PKPDQALYRLRVVNRRLHVLLADA

SEQ ID NO: 365103 - protein, 33 aa, Mycobacterium
PKPGAFYRVSNIDQMLFAFDALNPTPRSDDSKP

SEQ ID NO: 365104 - protein, 30 aa, Mycobacterium
PKPLFYEPGASWWWAAWGPVAAGSMILIEI

SEQ ID NO: 365105 - protein, 27 aa, Mycobacterium
PKPVEELFWYRSTKFVMRHALPAGLAV

SEQ ID NO: 365106 - protein, 30 aa, Mycobacterium
PKPVLISHRSLANQLLWRRDELGLGVGDAV

SEQ ID NO: 365107 - protein, 18 aa, Mycobacterium
PKQALRIRPFTAAPMLEE

SEQ ID NO: 365108 - protein, 20 aa, Mycobacterium
PKREIISRCYNMILKSTLSA

SEQ ID NO: 365109 - protein, 36 aa, Mycobacterium
PKRELWLAWWTLVVFYNIFFPMFFIVAQVQPPPQPT

SEQ ID NO: 365110 - protein, 23 aa, Mycobacterium
PKRGRIAMLFLALSQFIIAGVVV

SEQ ID NO: 365111 - protein, 27 aa, Mycobacterium
PKRPLVLRLGRWDVPMMSGLTGLIFRA

SEQ ID NO: 365112 - protein, 33 aa, Mycobacterium
PKRPSRWRHVPAILLALSLVLLTTAMAGPTHDV

SEQ ID NO: 365113 - protein, 25 aa, Mycobacterium
PKRRRWPKVLAAVLAVAVLAGVVTA

SEQ ID NO: 365114 - protein, 21 aa, Mycobacterium
PKRTLLLGLVIIIAGAGLAGT

SEQ ID NO: 365115 - protein, 23 aa, Mycobacterium
PKSFVADRLPKLCRSYLLAPSRQ

SEQ ID NO: 365116 - protein, 22 aa, Mycobacterium
PKSLHLAAFHPTGTVAAGADDQ

SEQ ID NO: 365117 - protein, 25 aa, Mycobacterium
PKTRKFALIGLAVYLIYMLGNVARN

SEQ ID NO: 365118 - protein, 25 aa, Mycobacterium
PKVGPWALYGLLFTIVILFALQGDQ

SEQ ID NO: 365119 - protein, 24 aa, Mycobacterium
PKVRLLERLLSDKVSATTLDLLRT

SEQ ID NO: 365120 - protein, 17 aa, Mycobacterium
PKWKTIVRIVIPTALSG

SEQ ID NO: 365121 - protein, 21 aa, Mycobacterium
PKYLKLIPRNVNADISATTVF

SEQ ID NO: 365122 - protein, 31 aa, Mycobacterium
PLAAAIAVPIALPIALPLGIDAYVRGSSDLG

SEQ ID NO: 365123 - protein, 19 aa, Mycobacterium
PLAALGLLNPVVAGAAMGL

SEQ ID NO: 365124 - protein, 22 aa, Mycobacterium
PLAALGMLNPVVAGAAMGFSSV

SEQ ID NO: 365125 - protein, 21 aa, Mycobacterium
PLAALGMLNPVVAGAAMGLSS

SEQ ID NO: 365126 - protein, 17 aa, Mycobacterium
PLAALSWYLVEKPAMSL

SEQ ID NO: 365127 - protein, 39 aa, Mycobacterium
PLADGLTPWIAAPLLFIGFMFGLLLLTGTTIREVPVVMR

SEQ ID NO: 365128 - protein, 26 aa, Mycobacterium
PLADLSFFVLDDWLRPLQAGAVGELY

SEQ ID NO: 365129 - protein, 17 aa, Mycobacterium
PLAFLQNTAYYSTQQAV

SEQ ID NO: 365130 - protein, 19 aa, Mycobacterium
PLAFLRDPLSWVRQMTHHG

SEQ ID NO: 365131 - protein, 31 aa, Mycobacterium
PLAKAALTMTIPLTIISFVIGLVIALGVALA

SEQ ID NO: 365132 - protein, 34 aa, Mycobacterium
PLALALTFGLTMDYEIFLLARVRERYLRTGDCGD

SEQ ID NO: 365133 - protein, 23 aa, Mycobacterium
PLALGMLVLIAVAMTFGPAVVTV

SEQ ID NO: 365134 - protein, 24 aa, Mycobacterium
PLALGSYWGLLATVPAAAALVVRI

SEQ ID NO: 365135 - protein, 18 aa, Mycobacterium
PLALGVAALLFGFPIFFD

SEQ ID NO: 365136 - protein, 31 aa, Mycobacterium
PLALGVAALLFGFPIFFDAGLVVFLPIIMTV

SEQ ID NO: 365137 - protein, 22 aa, Mycobacterium
PLAMRQHIFGTYPLDPNLIAQG

SEQ ID NO: 365138 - protein, 18 aa, Mycobacterium
PLANLLWAPVYLIELAVV

SEQ ID NO: 365139 - protein, 26 aa, Mycobacterium
PLANPAHYFIIIGLFGIFLGGMTAVV

SEQ ID NO: 365140 - protein, 31 aa, Mycobacterium
PLANPAHYFILFGLFLLFIAGTLAMVLPYDK

SEQ ID NO: 365141 - protein, 30 aa, Mycobacterium
PLANPAHYFILVGLFLLFIAGVLAMVLPYE

SEQ ID NO: 365142 - protein, 21 aa, Mycobacterium
PLAPWALVLVAAAVAIYFMTF

SEQ ID NO: 365143 - protein, 30 aa, Mycobacterium
PLARKGYSTVLVFWFGWPASEVPGVYFSAS

SEQ ID NO: 365144 - protein, 30 aa, Mycobacterium
PLARKGYSTVLVFWFGWPTSEVPGIYFSIS

SEQ ID NO: 365145 - protein, 26 aa, Mycobacterium
PLARRYLTVMILMWGAGSLPLIFIGF

SEQ ID NO: 365146 - protein, 32 aa, Mycobacterium
PLARWVLSLVGLLLIGYLAAVALQPAILDQLP

SEQ ID NO: 365147 - protein, 19 aa, Mycobacterium
PLASIVFLGAFIPLIGALI

SEQ ID NO: 365148 - protein, 20 aa, Mycobacterium
PLASLVFLGAFIPLLGALIS

SEQ ID NO: 365149 - protein, 26 aa, Mycobacterium
PLASPIYRALWIAQFVSNLGTWMQTV

SEQ ID NO: 365150 - protein, 21 aa, Mycobacterium
PLAVAPGYFDAPGDAGVDALA

SEQ ID NO: 365151 - protein, 22 aa, Mycobacterium
PLAVLIVLVLEALVFGPTGFPT

SEQ ID NO: 365152 - protein, 25 aa, Mycobacterium
PLAVLSAAALLAWTAGLRRIPSWSK

SEQ ID NO: 365153 - protein, 18 aa, Mycobacterium
PLAYCLPGVRSRVVVSEG

SEQ ID NO: 365154 - protein, 19 aa, Mycobacterium
PLAYVIDLLAAVPSIVYGL

SEQ ID NO: 365155 - protein, 24 aa, Mycobacterium
PLDGHKLLCREKLAAAIAILRQHK

SEQ ID NO: 365156 - protein, 24 aa, Mycobacterium
PLDPDKFYLPPKLVSLYGTPMWDE

SEQ ID NO: 365157 - protein, 24 aa, Mycobacterium
PLDPDKFYLPPRLVSLYGTAMWDE

SEQ ID NO: 365158 - protein, 46 aa, Mycobacterium
PLEALLDFLTLHFAAGFFMLWYYGFLWYHFVVMPAWQFVIDPLLVV

SEQ ID NO: 365159 - protein, 26 aa, Mycobacterium
PLEATPSFFRWLAEFEPMHQVFLGAR

SEQ ID NO: 365160 - protein, 25 aa, Mycobacterium
PLEEQFWYRSTRYVLRHSLPVGLSV

SEQ ID NO: 365161 - protein, 25 aa, Mycobacterium
PLEFAFMFVAFPLYVIHAVLTGLSL

SEQ ID NO: 365162 - protein, 18 aa, Mycobacterium
PLELWICALAPVVNLFMA

SEQ ID NO: 365163 - protein, 25 aa, Mycobacterium
PLEQSAPPGPAPPAPIAAAEYDPAT

SEQ ID NO: 365164 - protein, 18 aa, Mycobacterium
PLERLLILSLGAGGQVAA

SEQ ID NO: 365165 - protein, 21 aa, Mycobacterium
PLESYNKTWLGFAAVAVVAVV

SEQ ID NO: 365166 - protein, 38 aa, Mycobacterium
PLESYNKTWLGFIAVAVVAVIIGVMLLVHAVGAGYRHY

SEQ ID NO: 365167 - protein, 28 aa, Mycobacterium
PLESYNKTWLGFIAVAVVAVVIGVMLLV

SEQ ID NO: 365168 - protein, 17 aa, Mycobacterium
PLEVLFSSLLWIDGRNL

SEQ ID NO: 365169 - protein, 26 aa, Mycobacterium
PLEWNVFFIFSLFYLFGHYASVQATD

SEQ ID NO: 365170 - protein, 27 aa, Mycobacterium
PLEWNVFFIFSLFYLFGHYGAIQATGL

SEQ ID NO: 365171 - protein, 25 aa, Mycobacterium
PLEWNVFFIFSLFYLFGHYGAVRAT

SEQ ID NO: 365172 - protein, 25 aa, Mycobacterium
PLEWNVFFIFSLFYLFGHYGSIRAI

SEQ ID NO: 365173 - protein, 17 aa, Mycobacterium
PLFANIFGPLTELARPI

SEQ ID NO: 365174 - protein, 19 aa, Mycobacterium
PLFSLSMLQADIIGALFVL

SEQ ID NO: 365175 - protein, 18 aa, Mycobacterium
PLFVARIRGIPTIIHCHS

SEQ ID NO: 365176 - protein, 22 aa, Mycobacterium
PLFYTGYCVLLLLASTLVIIRM

SEQ ID NO: 365177 - protein, 25 aa, Mycobacterium
PLGALHLDLRFVNGKSWLVFGPYAG

SEQ ID NO: 365178 - protein, 37 aa, Mycobacterium; identical to SEQ ID NO: 24730

SEQ ID NO: 365179 - protein, 40 aa, Mycobacterium
PLGILSALSFWYVPKLGLRLVLLVGMLVMSVGFLCMRGLS

SEQ ID NO: 365180 - protein, 29 aa, Mycobacterium
PLGLLVVVVLVIATLFLLRSMNRQLRKVP

SEQ ID NO: 365181 - protein, 20 aa, Mycobacterium
PLGRAMLQFTDQTPGNLIVV

SEQ ID NO: 365182 - protein, 30 aa, Mycobacterium
PLGSVTGLVFFGPTRRLAYAANLTATCPEM

SEQ ID NO: 365183 - protein, 25 aa, Mycobacterium
PLGVLLFAARRRPSFLRPALAPDYG

SEQ ID NO: 365184 - protein, 22 aa, Mycobacterium
PLHLSFVVHIVMAVLAGAAVFA

SEQ ID NO: 365185 - protein, 19 aa, Mycobacterium
PLHRVSRALRPDWSRTPAA

SEQ ID NO: 365186 - protein, 34 aa, Mycobacterium
PLHTLVVVVLLPPLMLAVWRRPATPHWPPVVEGP

SEQ ID NO: 365187 - protein, 24 aa, Mycobacterium
PLIAFLRIAFLAIALVSVWLLYKY

SEQ ID NO: 365188 - protein, 34 aa, Mycobacterium
PLIARIIHAFAVPIILGWIAICVALSVFIPSLEE

SEQ ID NO: 365189 - protein, 36 aa, Mycobacterium
PLIGLAVFLVIATALTWLVYVTLRRDVKGATVSYGA

SEQ ID NO: 365190 - protein, 18 aa, Mycobacterium
PLIGVRKAGLFTSSNFVL

SEQ ID NO: 365191 - protein, 19 aa, Mycobacterium
PLILIGLPVDVASVLALAV

SEQ ID NO: 365192 - protein, 23 aa, Mycobacterium
PLILVMGAFLFFANRRQRKALDA

SEQ ID NO: 365193 - protein, 20 aa, Mycobacterium
PLIPVFMVLIGLATADRSAA

SEQ ID NO: 365194 - protein, 18 aa, Mycobacterium
PLIPVFMVLIGLATRDRS

SEQ ID NO: 365195 - protein, 18 aa, Mycobacterium
PLIRKPILFGLVAGLGIG

SEQ ID NO: 365196 - protein, 27 aa, Mycobacterium
PLISRVHLLLRFDQGRWIAIDNGSLNG

SEQ ID NO: 365197 - protein, 19 aa, Mycobacterium
PLITVGSPLLMTYFLVDVS

SEQ ID NO: 365198 - protein, 17 aa, Mycobacterium
PLIVVLAVIGVIYGAIV

SEQ ID NO: 365199 - protein, 31 aa, Mycobacterium
PLLARMIRRLALPIIVVWIAVIAALNIFVPQ

SEQ ID NO: 365200 - protein, 21 aa, Mycobacterium
PLLAYLLLVLICRRQWQPKLV

SEQ ID NO: 365201 - protein, 20 aa, Mycobacterium
PLLGFVTLVLLVVVLAAFRG

SEQ ID NO: 365202 - protein, 36 aa, Mycobacterium
PLLGGYFTDYLTWRWAFWINVPISVVVILVAAAAIP

SEQ ID NO: 365203 - protein, 26 aa, Mycobacterium
PLLGIPPWMVFFSFSISLIYQFWVHT

SEQ ID NO: 365204 - protein, 26 aa, Mycobacterium
PLLGVPPWMVFFAFSVSLIYQFWVHT

SEQ ID NO: 365205 - protein, 27 aa, Mycobacterium
PLLGVPPWVVFFSWSINLTYQFWVHTE

SEQ ID NO: 365206 - protein, 20 aa, Mycobacterium
PLLIMVVLAPIIWTTGVAVL

SEQ ID NO: 365207 - protein, 27 aa, Mycobacterium
PLLLAGTALLYLWNLSISGWANPFYSA

SEQ ID NO: 365208 - protein, 18 aa, Mycobacterium
PLLLLGLLGARIWVDRPV

SEQ ID NO: 365209 - protein, 19 aa, Mycobacterium
PLLMGRLIAVGGGWEAHRG

SEQ ID NO: 365210 - protein, 20 aa, Mycobacterium
PLLPALIFMIVVTQIPFLFT

SEQ ID NO: 365211 - protein, 25 aa, Mycobacterium
PLLSLGLPVLFIALGGIGLPGGAVY

SEQ ID NO: 365212 - protein, 21 aa, Mycobacterium
PLLVQLVLIYTGLAAAGLYQF

SEQ ID NO: 365213 - protein, 20 aa, Mycobacterium
PLLVVFGLFLGIAGTVFAVG

SEQ ID NO: 365214 - protein, 22 aa, Mycobacterium
PLLVVLVAIVYPLLRVLSDSAE

SEQ ID NO: 365215 - protein, 34 aa, Mycobacterium
PLMGGLLVEYFWWGAIFLINVPLALLVLLLVWRL

SEQ ID NO: 365216 - protein, 22 aa, Mycobacterium
PLMIIVLAVLFRLFVRTRLIDA

SEQ ID NO: 365217 - protein, 22 aa, Mycobacterium
PLNATRFVACPWGGPGTRMYRT

SEQ ID NO: 365218 - protein, 38 aa, Mycobacterium
PLNKPKTPPYKLAGLILGLVGVLVLALTWMQFRGQFED

SEQ ID NO: 365219 - protein, 23 aa, Mycobacterium
PLNLTIFQPYSWVAVIVVLVLLA

SEQ ID NO: 365220 - protein, 21 aa, Mycobacterium
PLNQAMTFRYFYNGADREAYL

SEQ ID NO: 365221 - protein, 25 aa, Mycobacterium
PLNRLGRWWPAALVAPIAVLMAAIG

SEQ ID NO: 365222 - protein, 26 aa, Mycobacterium
PLNTRQLLLINTLTDALPATAVAVST

SEQ ID NO: 365223 - protein, 27 aa, Mycobacterium
PLNTRQLLLVNMLTDALPAAALAVSKP

SEQ ID NO: 365224 - protein, 26 aa, Mycobacterium
PLNTRQLLLVNMLTDALPAAALSVSK

SEQ ID NO: 365225 - protein, 24 aa, Mycobacterium
PLNWPPAFFSWFAAGMLLAEWAHS

SEQ ID NO: 365226 - protein, 24 aa, Mycobacterium
PLNWPPAFFSWFAAGMLLAEWVHS

SEQ ID NO: 365227 - protein, 22 aa, Mycobacterium
PLPADELPPPASLAPVSDPVSP

SEQ ID NO: 365228 - protein, 17 aa, Mycobacterium
PLPEPITTTILGPNSSP

SEQ ID NO: 365229 - protein, 26 aa, Mycobacterium
PLPERVKPPRLYKAAAWVVIVAGIVF

SEQ ID NO: 365230 - protein, 17 aa, Mycobacterium
PLPGLRIHLLDNNLQPV

SEQ ID NO: 365231 - protein, 28 aa, Mycobacterium
PLPGVFYVLLWVGLVAVSLLIGPVWRLI

SEQ ID NO: 365232 - protein, 21 aa, Mycobacterium
PLPGVLAVAVLLLATRGLHID

SEQ ID NO: 365233 - protein, 19 aa, Mycobacterium
PLPMLRRLARRLLPALIVV

SEQ ID NO: 365234 - protein, 17 aa, Mycobacterium
PLPMLVVVIDEFYEWFR

SEQ ID NO: 365235 - protein, 18 aa, Mycobacterium
PLPMLVVVIDEFYEWFRI

SEQ ID NO: 365236 - protein, 20 aa, Mycobacterium
PLPQTIPFLPAYIPQDVDMT

SEQ ID NO: 365237 - protein, 23 aa, Mycobacterium
PLPSEIYWRRRALAIGVVVVVVA

SEQ ID NO: 365238 - protein, 19 aa, Mycobacterium
PLPSHRLILGAMLATTVFV

SEQ ID NO: 365239 - protein, 20 aa, Mycobacterium
PLPTHRLILGAVLAMAVFLI

SEQ ID NO: 365240 - protein, 19 aa, Mycobacterium
PLPTHRLLLGTVLATVVFL

SEQ ID NO: 365241 - protein, 26 aa, Mycobacterium
PLPTQRPIPVWFGAASDRAYERAGRL

SEQ ID NO: 365242 - protein, 25 aa, Mycobacterium
PLPTQRPIPVWIGAASDRGLERAGR

SEQ ID NO: 365243 - protein, 34 aa, Mycobacterium
PLPTRGRSQSRRLLPYTWLGAGAVALGVGAALTG

SEQ ID NO: 365244 - protein, 24 aa, Mycobacterium
PLPVQYVDYTLWQRAQLGDLGDGD

SEQ ID NO: 365245 - protein, 21 aa, Mycobacterium
PLPVTRYGLLRAPQAFRDMSQ

SEQ ID NO: 365246 - protein, 17 aa, Mycobacterium
PLPYAFPASPDSGESDV

SEQ ID NO: 365247 - protein, 23 aa, Mycobacterium
PLQAGLLMLPVPVGFGIASLLAG

SEQ ID NO: 365248 - protein, 22 aa, Mycobacterium
PLQIAVSLMWPVGVAALVYAVR

SEQ ID NO: 365249 - protein, 19 aa, Mycobacterium
PLQRLLSRRRFANALNGIA

SEQ ID NO: 365250 - protein, 19 aa, Mycobacterium
PLREILPAVQRLVIPVAED

SEQ ID NO: 365251 - protein, 24 aa, Mycobacterium
PLRERLLDELAGLTPKPGRIALHS

SEQ ID NO: 365252 - protein, 20 aa, Mycobacterium
PLRFAPFVRRSAFRSLLLGG

SEQ ID NO: 365253 - protein, 20 aa, Mycobacterium
PLRFENGRLLTWRRGKLDEN

SEQ ID NO: 365254 - protein, 17 aa, Mycobacterium
PLRNYFYWEKHCYDIPI

SEQ ID NO: 365255 - protein, 21 aa, Mycobacterium
PLRNYLYWEQHCYNIPVCWAT

SEQ ID NO: 365256 - protein, 21 aa, Mycobacterium
PLRRDMIAIVPPRLPAPGLLV

SEQ ID NO: 365257 - protein, 21 aa, Mycobacterium
PLRRLDMLAGLPQLLLAGSIV

SEQ ID NO: 365258 - protein, 24 aa, Mycobacterium
PLRSPDFRRLWLAGIPTVIGANLT

SEQ ID NO: 365259 - protein, 21 aa, Mycobacterium
PLRSYFYWERHCYDIPICWSL

SEQ ID NO: 365260 - protein, 33 aa, Mycobacterium
PLRTARAVVLPQWLFSALFTPAIRLTNGAANWI

SEQ ID NO: 365261 - protein, 44 aa, Mycobacterium
PLRTGIFGIALVACLVLVSFGYSSLPFFPQGKAYEAYFADAGGI

SEQ ID NO: 365262 - protein, 17 aa, Mycobacterium
PLRVALSSYLPAATIGI

SEQ ID NO: 365263 - protein, 19 aa, Mycobacterium
PLRVFPADVAGGYWLDYMV

SEQ ID NO: 365264 - protein, 26 aa, Mycobacterium
PLRVGLVAAALVLVACGLLASGIAVT

SEQ ID NO: 365265 - protein, 39 aa, Mycobacterium
PLSDGLTVWIAAPLLFIGALFGLLLLTGTTIREVPDVLR

SEQ ID NO: 365266 - protein, 26 aa, Mycobacterium
PLSFAVLVWVFGGLVAAALPIILGAL

SEQ ID NO: 365267 - protein, 18 aa, Mycobacterium
PLSFAVLVWVLGGVVAAA

SEQ ID NO: 365268 - protein, 26 aa, Mycobacterium
PLSFIGYWVVPFSLLGLAALASRLLS

SEQ ID NO: 365269 - protein, 23 aa, Mycobacterium
PLSFLFALLPLFVVRSLIGMYQI

SEQ ID NO: 365270 - protein, 19 aa, Mycobacterium
PLSFVFLVAVGADYNMLLV

SEQ ID NO: 365271 - protein, 26 aa, Mycobacterium
PLSGKLAALWRGTLVVLQSILAVVFG

SEQ ID NO: 365272 - protein, 19 aa, Mycobacterium
PLSLLKLVAWVIFQLLSSS

SEQ ID NO: 365273 - protein, 18 aa, Mycobacterium
PLSVVLSLSGFRIPWRDQ

SEQ ID NO: 365274 - protein, 34 aa, Mycobacterium
PLTFALFTPLGVPGFAWWAAALNSLPLLAALAWV

SEQ ID NO: 365275 - protein, 31 aa, Mycobacterium
PLTFTLFTPLAVPGFTWWAAALNSLPMLAAM

SEQ ID NO: 365276 - protein, 20 aa, Mycobacterium
PLTGLLNRRGIYAEWQRLYG

SEQ ID NO: 365277 - protein, 18 aa, Mycobacterium
PLTIIWPSGWSWGHGSSH

SEQ ID NO: 365278 - protein, 18 aa, Mycobacterium
PLTLLFSTNKWLTLAAAA

SEQ ID NO: 365279 - protein, 25 aa, Mycobacterium
PLTLLGAGMLWAGWYAFNGGSALSA

SEQ ID NO: 365280 - protein, 29 aa, Mycobacterium
PLTMIGLALGYVGLLGWIAYLAIANRESL

SEQ ID NO: 365281 - protein, 22 aa, Mycobacterium
PLTNFYQAMVLATPAGITAHEV

SEQ ID NO: 365282 - protein, 31 aa, Mycobacterium
PLTTAFAYLLLPQVLFYGLSSVFMAILNTRN

SEQ ID NO: 365283 - protein, 26 aa, Mycobacterium
PLTTLAALPWVTWLAVGNNIAHDLHL

SEQ ID NO: 365284 - protein, 20 aa, Mycobacterium
PLVAFALLSLEFMPRLRVNV

SEQ ID NO: 365285 - protein, 31 aa, Mycobacterium
PLVELPWTQWLTWPFQAVPVFFLVAGYAGAV

SEQ ID NO: 365286 - protein, 18 aa, Mycobacterium
PLVFRVRGALDVDALRDA

SEQ ID NO: 365287 - protein, 19 aa, Mycobacterium
PLVGHRWTVGTVAFSPDGK

SEQ ID NO: 365288 - protein, 35 aa, Mycobacterium
PLVGRPRTWPAIALSAIAALLAVGAMVIAMTRPTS

SEQ ID NO: 365289 - protein, 19 aa, Mycobacterium
PLVLAVLAAAVLAARITTW

SEQ ID NO: 365290 - protein, 17 aa, Mycobacterium
PLVLEDIEKYKVTAMVV

SEQ ID NO: 365291 - protein, 19 aa, Mycobacterium
PLVLGLIAAITFTLLFLLT

SEQ ID NO: 365292 - protein, 18 aa, Mycobacterium
PLVLRKLRVDPAVVSAPM

SEQ ID NO: 365293 - protein, 17 aa, Mycobacterium
PLVPAMFSGVLSRLRRT

SEQ ID NO: 365294 - protein, 20 aa, Mycobacterium
PLVPPALLRPGSQVNAYVGA

SEQ ID NO: 365295 - protein, 20 aa, Mycobacterium
PLVSGLYFLGARRWTTAIWA

SEQ ID NO: 365296 - protein, 19 aa, Mycobacterium
PLVYLFERAFERGLPFVVD

SEQ ID NO: 365297 - protein, 18 aa, Mycobacterium
PLWSSRYVAAAALLYTAA

SEQ ID NO: 365298 - protein, 28 aa, Mycobacterium
PLWTVAAIVLTILFGLARWFTTTYRIEP

SEQ ID NO: 365299 - protein, 22 aa, Mycobacterium
PLYDYGFLDIAERYLQRVIGRL

SEQ ID NO: 365300 - protein, 20 aa, Mycobacterium
PLYFVIRRRAGLDGPAAFGV

SEQ ID NO: 365301 - protein, 34 aa, Mycobacterium
PLYGILRPPFEIAVVLILVMFLAGTLAIEQRPVA

SEQ ID NO: 365302 - protein, 22 aa, Mycobacterium
PLYSIAVILSFLASKLTTVVLF

SEQ ID NO: 365303 - protein, 30 aa, Mycobacterium
PMALGRTTFLPPLGTWFAALLFAVVPLRNF

SEQ ID NO: 365304 - protein, 25 aa, Mycobacterium
PMALSRLVLGVHYPTDVLAGVVVGA

SEQ ID NO: 365305 - protein, 17 aa, Mycobacterium
PMARFFYDAGIIKGIPA

SEQ ID NO: 365306 - protein, 19 aa, Mycobacterium
PMAYLIMSQAPLAGGKSTA

SEQ ID NO: 365307 - protein, 18 aa, Mycobacterium
PMERLLILSLGVGGQFAA

SEQ ID NO: 365308 - protein, 27 aa, Mycobacterium
PMFHGLGFGMLTLTIGLGGTVLTRRRF

SEQ ID NO: 365309 - protein, 27 aa, Mycobacterium
PMFVAGLRQGWAFAWRSLMAGELVVLI

SEQ ID NO: 365310 - protein, 19 aa, Mycobacterium
PMGFLRDPISWLRHMSHHG

SEQ ID NO: 365311 - protein, 26 aa, Mycobacterium
PMGKLFIGTLVVWFFVLFDMLDGAMA

SEQ ID NO: 365312 - protein, 26 aa, Mycobacterium
PMGRTRLMLGFALLPTTLAGSAVVAL

SEQ ID NO: 365313 - protein, 25 aa, Mycobacterium
PMHVKKTGQYPLPQPPQDPIALLSG

SEQ ID NO: 365314 - protein, 29 aa, Mycobacterium
PMLALTPLLALLIASAYRWPPPGVNDNES

SEQ ID NO: 365315 - protein, 20 aa, Mycobacterium
PMLDLPIINPFLRREFTECD

SEQ ID NO: 365316 - protein, 20 aa, Mycobacterium
PMLFSLGFLVTFLAGGLTGV

SEQ ID NO: 365317 - protein, 17 aa, Mycobacterium
PMLIILNGIPKIVLYPV

SEQ ID NO: 365318 - protein, 17 aa, Mycobacterium
PMLPATWEPSALGAGSP

SEQ ID NO: 365319 - protein, 19 aa, Mycobacterium
PMMAFHHGPPPPPMGGPMG

SEQ ID NO: 365320 - protein, 18 aa, Mycobacterium
PMPMAPQPPATLLQAVAA

SEQ ID NO: 365321 - protein, 20 aa, Mycobacterium
PMQMAVFGAIFVLIALVSDS

SEQ ID NO: 365322 - protein, 23 aa, Mycobacterium
PMRARAMAMFALTWRLGYSSGRS

SEQ ID NO: 365323 - protein, 18 aa, Mycobacterium
PMSEGMFNALPAMGAWQL

SEQ ID NO: 365324 - protein, 32 aa, Mycobacterium
PMTLTGFAHPWFFLVLLLVAALIALYVVAQYL

SEQ ID NO: 365325 - protein, 37 aa, Mycobacterium
PNAISAMLIYRLISWLFIAAIGWVVFFFMFRTEKAAD

SEQ ID NO: 365326 - protein, 35 aa, Mycobacterium
PNAISAMLIYRLISWLFIAAIGWVVFFFMFRTENV

SEQ ID NO: 365327 - protein, 40 aa, Mycobacterium
PNAISAMLIYRLISWLLISAIGWVVFFFVFRTENVAVPDD

SEQ ID NO: 365328 - protein, 27 aa, Mycobacterium
PNALAGLNLPAWGSLRLALPMGGNGDA

SEQ ID NO: 365329 - protein, 23 aa, Mycobacterium
PNAVRALTVLTLVAGLSSTVFAP

SEQ ID NO: 365330 - protein, 34 aa, Mycobacterium
PNDFMNIMLAALLAAALWLLFANRMGYPVSTTHS

SEQ ID NO: 365331 - protein, 31 aa, Mycobacterium
PNEIALNILLAALTIIFVFAVATLQPLAIYS

SEQ ID NO: 365332 - protein, 32 aa, Mycobacterium; identical to SEQ ID NO: 24743

SEQ ID NO: 365333 - protein, 33 aa, Mycobacterium
PNEIALNILLAALTIIFVFAVVTLQPLAIYSKA

SEQ ID NO: 365334 - protein, 34 aa, Mycobacterium
PNEIALNILLASLTIIFLLAVVALGPMGNYGGEQ

SEQ ID NO: 365335 - protein, 33 aa, Mycobacterium
PNEPGLLLALTNLGASFLGLALTIRDLIGERVI

SEQ ID NO: 365336 - protein, 26 aa, Mycobacterium
PNFALTPLLIIWMGIGEGPKIVLITT

SEQ ID NO: 365337 - protein, 25 aa, Mycobacterium
PNFEKFAWLFMRFSGVVLVFLALGH

SEQ ID NO: 365338 - protein, 41 aa, Mycobacterium
PNFGTGMAPFFLTLALFFGALVLWMVLRPLQSRAIAAEVLE

SEQ ID NO: 365339 - protein, 41 aa, Mycobacterium
PNFGTGMAPFFLTLALFFGALVLWMVLRPLQTRPIAAEVLA

SEQ ID NO: 365340 - protein, 20 aa, Mycobacterium
PNFTVLVILRLLYGIGMGGE

SEQ ID NO: 365341 - protein, 19 aa, Mycobacterium
PNGTDWVLTALAVTRIGAI

SEQ ID NO: 365342 - protein, 25 aa, Mycobacterium
PNGVYSLDWAFGTAPPPPSGLRYLQ

SEQ ID NO: 365343 - protein, 18 aa, Mycobacterium
PNILITRDDFAYLVDFGI

SEQ ID NO: 365344 - protein, 51 aa, Mycobacterium
PNKPLSWRDRAVKWARIARLSIVVKVAALLIVFGFAGLSAYFVWNHSQVTQ

SEQ ID NO: 365345 - protein, 25 aa, Mycobacterium
PNLVAARFIQLTPAYTGGAVLPDGA

SEQ ID NO: 365346 - protein, 25 aa, Mycobacterium
PNLVAARFIQLTPAYTGGAVLPDGG

SEQ ID NO: 365347 - protein, 18 aa, Mycobacterium
PNLVFPVGLVDRPFKHDQ

SEQ ID NO: 365348 - protein, 22 aa, Mycobacterium
PNMLRFAGVWWAFVFPLGMYSA

SEQ ID NO: 365349 - protein, 35 aa, Mycobacterium
PNPDTRPRLILGSSLIALSFLGLRHLWAGSPESPE

SEQ ID NO: 365350 - protein, 20 aa, Mycobacterium
PNPLALIGFVLLLTSIELQV

SEQ ID NO: 365351 - protein, 25 aa, Mycobacterium
PNPLPTQAPTLPGFPAIRLQPCKPP

SEQ ID NO: 365352 - protein, 21 aa, Mycobacterium
PNPYIYPENLPRVNARGGPGG

SEQ ID NO: 365353 - protein, 20 aa, Mycobacterium
PNPYMYPENLPRVNAHGGPG

SEQ ID NO: 365354 - protein, 28 aa, Mycobacterium
PNQRYPTCTAFALALTQHGPHRDAALAA

SEQ ID NO: 365355 - protein, 24 aa, Mycobacterium
PNSRFTMGMLWPGEKGWTEAGERR

SEQ ID NO: 365356 - protein, 27 aa, Mycobacterium
PNVDVDIPWYCWVAGAVIGALLGALLP

SEQ ID NO: 365357 - protein, 32 aa, Mycobacterium
PNVRLVVATALHRALLLPLVLTVPSGSTTIIL

SEQ ID NO: 365358 - protein, 19 aa, Mycobacterium
PNVTTWWAIQSSCIPTGCL

SEQ ID NO: 365359 - protein, 18 aa, Mycobacterium
PNWLTLPAAVVIITVGLW

SEQ ID NO: 365360 - protein, 26 aa, Mycobacterium
PPAAARWRRFFGFAVAVPAIAAIHAV

SEQ ID NO: 365361 - protein, 44 aa, Mycobacterium
PPADTTIVSWLPFYHDMGLIVGVFIPMMLGRPAVLMSPVAFMMK

SEQ ID NO: 365362 - protein, 19 aa, Mycobacterium
PPALLNAWPFIALGALGWL

SEQ ID NO: 365363 - protein, 19 aa, Mycobacterium
PPALPRAPSWWPLNMTWGG

SEQ ID NO: 365364 - protein, 20 aa, Mycobacterium
PPALPVAMWLLAAASVVTCV

SEQ ID NO: 365365 - protein, 25 aa, Mycobacterium
PPALVLAPFWLLPASLYVHIEMTVP

SEQ ID NO: 365366 - protein, 20 aa, Mycobacterium
PPAMAALLSRAADLLALGAD

SEQ ID NO: 365367 - protein, 25 aa, Mycobacterium
PPAMPPALAWWASSLQLSGLGPEQA

SEQ ID NO: 365368 - protein, 22 aa, Mycobacterium
PPANRPPPPAPVPPPANQPPPA

SEQ ID NO: 365369 - protein, 27 aa, Mycobacterium
PPAPPAAPGLLPRLLPAVAAVAGMGVL

SEQ ID NO: 365370 - protein, 23 aa, Mycobacterium
PPAPPQMPVPPPAPTGPPRAPGQ

SEQ ID NO: 365371 - protein, 37 aa, Mycobacterium
PPARGLHAWWGPLSLLLALWVIRAIAHWFQARLGQRG

SEQ ID NO: 365372 - protein, 18 aa, Mycobacterium
PPARVVLWGLFGLGWVVV

SEQ ID NO: 365373 - protein, 24 aa, Mycobacterium
PPATTLLFSGLGTILFLIITQNRL

SEQ ID NO: 365374 - protein, 21 aa, Mycobacterium
PPAVLVFPFLTMAYALRLTDT

SEQ ID NO: 365375 - protein, 24 aa, Mycobacterium
PPDAALPLLPLVAAICLFAALLWS

SEQ ID NO: 365376 - protein, 46 aa, Mycobacterium
PPDAEPPVPWYRKPAALVGLGALGAVLIALIVFGLAKAITGDSDSE

SEQ ID NO: 365377 - protein, 19 aa, Mycobacterium
PPDAHLPFRSGRAFSASVS

SEQ ID NO: 365378 - protein, 28 aa, Mycobacterium
PPDIPADRLNMPPIPLSTTPAPTQQPTQ

SEQ ID NO: 365379 - protein, 31 aa, Mycobacterium
PPDIPEERLTLPPIPLQVPPAAPAPAPRQTQ

SEQ ID NO: 365380 - protein, 48 aa, Mycobacterium
PPDQPPAPEPVPWYRKPAALVGLGALGALIVALVIYAVIQLFSSDDSS

SEQ ID NO: 365381 - protein, 21 aa, Mycobacterium
PPDTAGPRALFPWPYNGIPGG

SEQ ID NO: 365382 - protein, 23 aa, Mycobacterium
PPEARLLPMVRPTALAALAIGVV

SEQ ID NO: 365383 - protein, 19 aa, Mycobacterium
PPELLLTPRRRNLVFLAVL

SEQ ID NO: 365384 - protein, 17 aa, Mycobacterium
PPEPVGLKLLRPIDPER

SEQ ID NO: 365385 - protein, 33 aa, Mycobacterium
PPFGAWIDVRVVVWVIVVLVISMAIYISCWWRH

SEQ ID NO: 365386 - protein, 23 aa, Mycobacterium
PPFGNLWIQILKSSSLLYLIGIT

SEQ ID NO: 365387 - protein, 36 aa, Mycobacterium
PPFVPRTIRRFAVLVLLLWLAYTAIVNLAVPQLEVV

SEQ ID NO: 365388 - protein, 19 aa, Mycobacterium
PPGALPRVRAFVDAMAAAE

SEQ ID NO: 365389 - protein, 30 aa, Mycobacterium
PPGAWIDQALVLWVLIALVVAMVLYVEAWW

SEQ ID NO: 365390 - protein, 36 aa, Mycobacterium
PPGFSDPMQWGFMQAGSTLLKFFGGLRNVSDGKPLL

SEQ ID NO: 365391 - protein, 26 aa, Mycobacterium
PPGFTPARPRRLPQWGRIAAGAAVVI

SEQ ID NO: 365392 - protein, 21 aa, Mycobacterium
PPGHPLPVVPLAFDPPQHTRY

SEQ ID NO: 365393 - protein, 21 aa, Mycobacterium
PPGNPLPVVPLAFDPPEHTRY

SEQ ID NO: 365394 - protein, 26 aa, Mycobacterium
PPGPAPGSAFRPLPGPAPGPGSAPPN

SEQ ID NO: 365395 - protein, 31 aa, Mycobacterium
PPGTSFYVLLPGRPMPPSAYPAPPAGYTDEE

SEQ ID NO: 365396 - protein, 22 aa, Mycobacterium
PPGVVALWALALLITGTGIGIA

SEQ ID NO: 365397 - protein, 22 aa, Mycobacterium
PPHPPVFVLVVMGLTLAGFAVG

SEQ ID NO: 365398 - protein, 17 aa, Mycobacterium
PPIDLTAAAFFDVDNTL

SEQ ID NO: 365399 - protein, 19 aa, Mycobacterium
PPIGGLHLQFGRDAATEVV

SEQ ID NO: 365400 - protein, 26 aa, Mycobacterium
PPILALMMPWLFLRVRFFRRKWTAVT

SEQ ID NO: 365401 - protein, 18 aa, Mycobacterium
PPILTLWLVRWLLFRVEF

SEQ ID NO: 365402 - protein, 17 aa, Mycobacterium
PPISAPRIRGLGGAAPG

SEQ ID NO: 365403 - protein, 22 aa, Mycobacterium
PPITAILIAIALWWSATSVLSG

SEQ ID NO: 365404 - protein, 27 aa, Mycobacterium
PPKPGTVYQMWLLGDQGATSAGTMNTA

SEQ ID NO: 365405 - protein, 19 aa, Mycobacterium
PPKSAPGWYPDPAGVGHGL

SEQ ID NO: 365406 - protein, 21 aa, Mycobacterium
PPLGPAWVALLIIGAASGVAL

SEQ ID NO: 365407 - protein, 25 aa, Mycobacterium
PPLIAYYALRAFGVTPYLALAGAII

SEQ ID NO: 365408 - protein, 23 aa, Mycobacterium
PPLIVLAPLWLLPAPIYMRLEMT

SEQ ID NO: 365409 - protein, 30 aa, Mycobacterium
PPLKSRRHETWLMMLLGAGFGLGVALTLSR

SEQ ID NO: 365410 - protein, 37 aa, Mycobacterium
PPLLAGLIRRLSVPIILGWLGMIAIVTFAVPSLEQVG

SEQ ID NO: 365411 - protein, 30 aa, Mycobacterium
PPLLALCGKRLFWPFIPKVGATALTESGVW

SEQ ID NO: 365412 - protein, 22 aa, Mycobacterium
PPLLRRVWEAIIGEFTPPSTPR

SEQ ID NO: 365413 - protein, 19 aa, Mycobacterium
PPLLTLRSTVVFSAAAMAA

SEQ ID NO: 365414 - protein, 19 aa, Mycobacterium
PPLPMLVVVIDEFYEWFRI

SEQ ID NO: 365415 - protein, 28 aa, Mycobacterium
PPLPPPYHPGYPYPPPPPGYPGPYPTPP

SEQ ID NO: 365416 - protein, 49 aa, Mycobacterium
PPLRERLLVRLASIDLNPRRLAARVPFVVLIISALGLGLGVTLWLSTDA

SEQ ID NO: 365417 - protein, 34 aa, Mycobacterium
PPLRWHSGRRVHFDLDPLLPFPRWHEHAAVVEEP

SEQ ID NO: 365418 - protein, 20 aa, Mycobacterium
PPLTPTLSRPVKGADGLGFV

SEQ ID NO: 365419 - protein, 21 aa, Mycobacterium
PPLVLALTFGLSMDYEIFLLT

SEQ ID NO: 365420 - protein, 18 aa, Mycobacterium
PPLVLQDIEKHKVTAMVV

SEQ ID NO: 365421 - protein, 20 aa, Mycobacterium
PPLWPLVIITYCAIAVSPPL

SEQ ID NO: 365422 - protein, 33 aa, Mycobacterium
PPPALSPIDWTKIPPPQLPPIDWTKIPPPQIPQ

SEQ ID NO: 365423 - protein, 21 aa, Mycobacterium
PPPEPPPSNPMLPPEGQRPIT

SEQ ID NO: 365424 - protein, 19 aa, Mycobacterium
PPPMPPHPPAPPSPARPPS

SEQ ID NO: 365425 - protein, 25 aa, Mycobacterium
PPPPLPAYEFTPPPAPPPASDTPAA

SEQ ID NO: 365426 - protein, 23 aa, Mycobacterium
PPPPPGPPPGYPGGSPWGAAQPN

SEQ ID NO: 365427 - protein, 19 aa, Mycobacterium
PPPPPPPPPPDEPSWVGMP

SEQ ID NO: 365428 - protein, 21 aa, Mycobacterium
PPPPPVYVNAPTGKLGLREVL

SEQ ID NO: 365429 - protein, 29 aa, Mycobacterium
PPPPQTVTVQLPPPPPPPPPDGASWHPRA

SEQ ID NO: 365430 - protein, 42 aa, Mycobacterium
PPPQLPRVVPPSLLRRVLPFLIVILIVGMIVALFATGMRLIS

SEQ ID NO: 365431 - protein, 31 aa, Mycobacterium
PPPQRPSGNRMWWIMGTVIAVGVLALAGGIA

SEQ ID NO: 365432 - protein, 21 aa, Mycobacterium
PPPQTVPVLPAYIPVDVDMTM

SEQ ID NO: 365433 - protein, 19 aa, Mycobacterium
PPPRRRPNRRKARRPRRRH

SEQ ID NO: 365434 - protein, 23 aa, Mycobacterium
PPPSNFGPPPPAYSPPPRKSGGD

SEQ ID NO: 365435 - protein, 24 aa, Mycobacterium
PPPVTPPPALSPGARTAIRVALIA

SEQ ID NO: 365436 - protein, 24 aa, Mycobacterium
PPQAPQQPYWPQPAGNYPGYPGQP

SEQ ID NO: 365437 - protein, 28 aa, Mycobacterium
PPQGQVVLPFNGLNFRFSPGGVAVDDQG

SEQ ID NO: 365438 - protein, 38 aa, Mycobacterium
PPQLPRVIPPSLLRRAMPYLMGILIVGMIVAMVATGMR

SEQ ID NO: 365439 - protein, 22 aa, Mycobacterium
PPQLVPLLEFTTTYLSGVLVGL

SEQ ID NO: 365440 - protein, 18 aa, Mycobacterium
PPQPGKLFQNVLVSVPAA

SEQ ID NO: 365441 - protein, 23 aa, Mycobacterium
PPQPSIPLQAKPIAVLAARQLRD

SEQ ID NO: 365442 - protein, 24 aa, Mycobacterium
PPQRSHRITPRFGRILLTDLCIIR

SEQ ID NO: 365443 - protein, 18 aa, Mycobacterium
PPQRWRAQRDAVVAAYRS

SEQ ID NO: 365444 - protein, 19 aa, Mycobacterium
PPRILIIAAVVLAVATVGV

SEQ ID NO: 365445 - protein, 17 aa, Mycobacterium
PPRIRELAILRVAHRRQ

SEQ ID NO: 365446 - protein, 26 aa, Mycobacterium
PPRLFRSPVFTVCCVLAFVVGFAMLG

SEQ ID NO: 365447 - protein, 21 aa, Mycobacterium
PPRLPVSYPGLPPAPGGYRNR

SEQ ID NO: 365448 - protein, 24 aa, Mycobacterium
PPRPVRSWVLIPALAGAGLVMGVC

SEQ ID NO: 365449 - protein, 28 aa, Mycobacterium
PPRRSNTFWLWVVGIGALVVIIALIITL

SEQ ID NO: 365450 - protein, 25 aa, Mycobacterium
PPSAAQPPFRLPGYVTDNAGVLSGS

SEQ ID NO: 365451 - protein, 17 aa, Mycobacterium
PPSFVIVTIACAVWLVV

SEQ ID NO: 365452 - protein, 18 aa, Mycobacterium
PPSILLTGVIVNKLGRRF

SEQ ID NO: 365453 - protein, 19 aa, Mycobacterium
PPSLAPIGGILSAVPFKSE

SEQ ID NO: 365454 - protein, 24 aa, Mycobacterium
PPSPSPTVTALPPPPPEPGTNCRE

SEQ ID NO: 365455 - protein, 29 aa, Mycobacterium
PPSQATPAWHRRRPWQLGGAAAALVIAVV

SEQ ID NO: 365456 - protein, 34 aa, Mycobacterium
PPSWASWLRIVVGVLLILWGAYRWLKRASSEHMP

SEQ ID NO: 365457 - protein, 17 aa, Mycobacterium
PPSWGYATAASAPAPAA

SEQ ID NO: 365458 - protein, 26 aa, Mycobacterium
PPTAIPLRHEGLAYRFPFHTEKKSYP

SEQ ID NO: 365459 - protein, 25 aa, Mycobacterium
PPTAIPLRHEGLSYRFPFHTEKKSY

SEQ ID NO: 365460 - protein, 26 aa, Mycobacterium
PPTAMPLRHDGLAYRFPFHTEKKTYP

SEQ ID NO: 365461 - protein, 26 aa, Mycobacterium
PPTAMPLRHDGLSYRFPFHTEKKTYP

SEQ ID NO: 365462 - protein, 30 aa, Mycobacterium
PPTERLLNRARLQRILVLGMVMTLGTVTVL

SEQ ID NO: 365463 - protein, 25 aa, Mycobacterium
PPTFPRWYGYLNLWVATLSLPGCVV

SEQ ID NO: 365464 - protein, 23 aa, Mycobacterium
PPTHLWQARLVRDAKPYPGFHRI

SEQ ID NO: 365465 - protein, 24 aa, Mycobacterium
PPTHRFPHLPPLPSVITIPGVPTT

SEQ ID NO: 365466 - protein, 17 aa, Mycobacterium
PPTLTLKLPRPTEVSGM

SEQ ID NO: 365467 - protein, 27 aa, Mycobacterium
PPTPENPLPRRLAFLGAGVCLIAVVVV

SEQ ID NO: 365468 - protein, 25 aa, Mycobacterium
PPVLTLWMVRLLLFRVEFGAGLIKM

SEQ ID NO: 365469 - protein, 26 aa, Mycobacterium
PPVNRAFFGAVYWIVAYLGVDPALAQ

SEQ ID NO: 365470 - protein, 18 aa, Mycobacterium
PPVPPPGAPVPPGAPPPP

SEQ ID NO: 365471 - protein, 19 aa, Mycobacterium
PPVRLLPTNLAPEAVGALY

SEQ ID NO: 365472 - protein, 44 aa, Mycobacterium
PPYKTAGVVFLVLALVIFVLVYLQFRGDFTPKVKLTMFSERAGL

SEQ ID NO: 365473 - protein, 19 aa, Mycobacterium
PPYLFGAIAGVVALVLFFL

SEQ ID NO: 365474 - protein, 25 aa, Mycobacterium
PPYLVLVLCLAILLPLGMFLDGISM

SEQ ID NO: 365475 - protein, 36 aa, Mycobacterium
PQAAPPPRGPKPPPRWLWIVAGAAVLLVVALVVALV

SEQ ID NO: 365476 - protein, 39 aa, Mycobacterium
PQAPATARRSWGWVIAVVLVIAALVAIAILGTVLLTRDS

SEQ ID NO: 365477 - protein, 17 aa, Mycobacterium
PQCPLPRQPIGPGTYNL

SEQ ID NO: 365478 - protein, 43 aa, Mycobacterium
PQDGRKRLIINWLAAILVPPATALFIHFFDTAFGVGSKSALFL

SEQ ID NO: 365479 - protein, 20 aa, Mycobacterium
PQDIWWLLPVVKTASAAGLI

SEQ ID NO: 365480 - protein, 27 aa, Mycobacterium
PQDPKELPVPVLLLGVQNDPIVGNEGV

SEQ ID NO: 365481 - protein, 27 aa, Mycobacterium
PQDVAMSIQILPKLGLPTPAGRIDFGT

SEQ ID NO: 365482 - protein, 25 aa, Mycobacterium
PQERRLVFERFYRSASARAMPGSGL

SEQ ID NO: 365483 - protein, 24 aa, Mycobacterium
PQERRLVFERFYRSTSARAMPGSG

SEQ ID NO: 365484 - protein, 23 aa, Mycobacterium
PQERRLVFERFYRSTTARAMPGS

SEQ ID NO: 365485 - protein, 51 aa, Mycobacterium
PQFGIDLGFYAFDLPFYRLVLTYLFVGVFLAFLANLLGHYLFGGIRLAGRS

SEQ ID NO: 365486 - protein, 39 aa, Mycobacterium
PQFGLDLGFFAFDLPFYRFVLTYLFIAASIALIVNGLVH

SEQ ID NO: 365487 - protein, 24 aa, Mycobacterium
PQFLPDVWWLPYAAVSLPFLLLFR

SEQ ID NO: 365488 - protein, 18 aa, Mycobacterium
PQFVLLAVALFAARQWRM

SEQ ID NO: 365489 - protein, 21 aa, Mycobacterium
PQFYALVLQELSLIGHRGPAE

SEQ ID NO: 365490 - protein, 33 aa, Mycobacterium
PQGIRRVLPALVNQFIALLKASALVYFLGLVAK

SEQ ID NO: 365491 - protein, 17 aa, Mycobacterium
PQGLVAVAPLLVGARAI

SEQ ID NO: 365492 - protein, 27 aa, Mycobacterium
PQGVLWTFALVWLITDRGWSAASAGIL

SEQ ID NO: 365493 - protein, 37 aa, Mycobacterium
PQGVPYPPQQPAKKKRKWPAIVGGVIALMIVGSIFND

SEQ ID NO: 365494 - protein, 29 aa, Mycobacterium
PQHKPVDQLFWYRSTKFVMRRALPVGLAV

SEQ ID NO: 365495 - protein, 25 aa, Mycobacterium
PQHVDTPVRILPRVGLPAPGERIDF

SEQ ID NO: 365496 - protein, 18 aa, Mycobacterium
PQHWIALTPPRIPELRTL

SEQ ID NO: 365497 - protein, 29 aa, Mycobacterium
PQLAFTGANLPLLLKGFARITSEGAYANA

SEQ ID NO: 365498 - protein, 22 aa, Mycobacterium
PQLLDFYNAFFPRLEEAIDYCD

SEQ ID NO: 365499 - protein, 25 aa, Mycobacterium
PQLRPIATWLNRSMGWCFLFADGNA

SEQ ID NO: 365500 - protein, 26 aa, Mycobacterium
PQNMMTPMMLFIKSPHDLRSPTALAD

SEQ ID NO: 365501 - protein, 25 aa, Mycobacterium
PQNMMTPMMLFIKSPRDLRNPTALA

SEQ ID NO: 365502 - protein, 35 aa, Mycobacterium
PQNYRKLVRLGSYGSWLNLYICGVSIRVSDLQGRT

SEQ ID NO: 365503 - protein, 21 aa, Mycobacterium
PQPAWRNLRFPLAWAPPEANV

SEQ ID NO: 365504 - protein, 26 aa, Mycobacterium
PQPGTVYQMWLIDTEGPHSAGTMDSE

SEQ ID NO: 365505 - protein, 30 aa, Mycobacterium
PQPGYQPYPPQPYPYPVPTPHQQPGPAPDE

SEQ ID NO: 365506 - protein, 27 aa, Mycobacterium
PQPTELYWVLTMLATALLLVEIYLTTR

SEQ ID NO: 365507 - protein, 28 aa, Mycobacterium
PQQALNVPLPWSIVLSSTKPGIPANLVA

SEQ ID NO: 365508 - protein, 27 aa, Mycobacterium
PQQALNVPLPWSKVLSSTKPGIPANLV

SEQ ID NO: 365509 - protein, 26 aa, Mycobacterium
PQQIVRWCLSLALIPAVVLLVLAGFG

SEQ ID NO: 365510 - protein, 23 aa, Mycobacterium
PQQQLQLLVELRSGLDEDGDDPS

SEQ ID NO: 365511 - protein, 23 aa, Mycobacterium
PQQQPNYWHPPAQPPQQPYWQQP

SEQ ID NO: 365512 - protein, 18 aa, Mycobacterium
PQQRLLLEVCWEALETSR

SEQ ID NO: 365513 - protein, 18 aa, Mycobacterium
PQRASTVALISLVAVELG

SEQ ID NO: 365514 - protein, 23 aa, Mycobacterium
PQRPQIPLHAKPIAVLATQQLRD

SEQ ID NO: 365515 - protein, 24 aa, Mycobacterium
PQRRNLIFVAIVLGMLLAALDQTI

SEQ ID NO: 365516 - protein, 27 aa, Mycobacterium
PQSKEPLPEYFSAPGGPPLPPVIEAFP

SEQ ID NO: 365517 - protein, 26 aa, Mycobacterium
PQSMTVTFMLVWLTGNHGWSVRAAGA

SEQ ID NO: 365518 - protein, 23 aa, Mycobacterium
PQSTLRVFLARALNGGLRSDVAS

SEQ ID NO: 365519 - protein, 23 aa, Mycobacterium
PQTRGLWYSFTAGSVRVISLAND

SEQ ID NO: 365520 - protein, 20 aa, Mycobacterium
PQTVAWTLLGVALAAYEQWL

SEQ ID NO: 365521 - protein, 26 aa, Mycobacterium
PQTVTVTFMLVWLIDRRGWSVAGAGG

SEQ ID NO: 365522 - protein, 17 aa, Mycobacterium
PQTVVSLVFLAYLAGTW

SEQ ID NO: 365523 - protein, 21 aa, Mycobacterium
PQTVWRNLRFPTKTAPPGANV

SEQ ID NO: 365524 - protein, 21 aa, Mycobacterium
PQVHDLVPEQLRWFGAPNSAV

SEQ ID NO: 365525 - protein, 21 aa, Mycobacterium
PQVLGLLLVIAGAMIRLRGNA

SEQ ID NO: 365526 - protein, 21 aa, Mycobacterium
PQVQLLGRINAQLAVYTGLIE

SEQ ID NO: 365527 - protein, 25 aa, Mycobacterium
PQVVVWTFTLVWLVTDRGWSIGAAS

SEQ ID NO: 365528 - protein, 21 aa, Mycobacterium
PQWWTWTLAQRTSTLIRLSRA

SEQ ID NO: 365529 - protein, 22 aa, Mycobacterium
PQYLYDPLVIFPAHLAGRIAAS

SEQ ID NO: 365530 - protein, 49 aa, Mycobacterium
PRAGPLRLRWRPLLIAAAILLAWSVVLLLLMRWVSPLPLDEPPAPQGAS

SEQ ID NO: 365531 - protein, 21 aa, Mycobacterium
PRALVIAILVFVLLVTLLLPH

SEQ ID NO: 365532 - protein, 24 aa, Mycobacterium
PRARARFLAICGGGGFLLYLQMHD

SEQ ID NO: 365533 - protein, 23 aa, Mycobacterium
PRARLILVVAVTTPLWASYLVKA

SEQ ID NO: 365534 - protein, 31 aa, Mycobacterium
PRARRRRLLAIAMLLLLVPLATGCLRVRASL

SEQ ID NO: 365535 - protein, 21 aa, Mycobacterium
PRARRRVLVALLIGVLAALPA

SEQ ID NO: 365536 - protein, 24 aa, Mycobacterium
PRARWSSWRRVGLATWIADAGVIA

SEQ ID NO: 365537 - protein, 17 aa, Mycobacterium
PRATLPWPYTWDRVLGQ

SEQ ID NO: 365538 - protein, 25 aa, Mycobacterium
PRDRDTWMVIDDKAWFFALSDQMSI

SEQ ID NO: 365539 - protein, 24 aa, Mycobacterium
PRDRDTWMVIDDNAWFFALTDHVS

SEQ ID NO: 365540 - protein, 32 aa, Mycobacterium
PRDRDTWMVIDEKPWFFALTDHISIAEAEEFA

SEQ ID NO: 365541 - protein, 30 aa, Mycobacterium
PRDRDTWMVIDEKPWFFALTDHISVAEAEE

SEQ ID NO: 365542 - protein, 25 aa, Mycobacterium
PRDVPLVFIPWPSLIVVIVGVTAIG

SEQ ID NO: 365543 - protein, 24 aa, Mycobacterium
PRDVTFYCLDYGGGKLRALEDLAH

SEQ ID NO: 365544 - protein, 33 aa, Mycobacterium
PRDYWLLGIAAAVVIVLFGWWGGLYFTTLVRRR

SEQ ID NO: 365545 - protein, 17 aa, Mycobacterium
PREAGWHRAWLGGLLVG

SEQ ID NO: 365546 - protein, 28 aa, Mycobacterium
PREIKLAATYLLISPLIALTGSAVAMAM

SEQ ID NO: 365547 - protein, 24 aa, Mycobacterium
PREVTFYCLDYGGGKLRAMEGLAH

SEQ ID NO: 365548 - protein, 23 aa, Mycobacterium
PREWVLVTLVAIAPVLITFVGWL

SEQ ID NO: 365549 - protein, 17 aa, Mycobacterium
PRFFPIVIGVALLVMAV

SEQ ID NO: 365550 - protein, 18 aa, Mycobacterium
PRFLLGLAVYLCGFTLLL

SEQ ID NO: 365551 - protein, 18 aa, Mycobacterium
PRFMPDPQPMRTPGAQPL

SEQ ID NO: 365552 - protein, 37 aa, Mycobacterium
PRFMRAVRTFAVPIIVAWLLLTIAVNVLVPWIEFVAR

SEQ ID NO: 365553 - protein, 35 aa, Mycobacterium
PRFMRFVRTFAWPIIIGWLLLTVALNVLVPPIESV

SEQ ID NO: 365554 - protein, 36 aa, Mycobacterium
PRFMRMVRAFAIPIILIWLLLTIAVNVFVPQIEFVA

SEQ ID NO: 365555 - protein, 21 aa, Mycobacterium
PRGFFVSILVFVLLGSFILPH

SEQ ID NO: 365556 - protein, 19 aa, Mycobacterium
PRGMPLELAAPIITAVGSA

SEQ ID NO: 365557 - protein, 37 aa, Mycobacterium
PRGRALGMVAFMAYFFSLYLRAGVAQLPWMIGAVLVG

SEQ ID NO: 365558 - protein, 24 aa, Mycobacterium
PRGRGAAVWVLGGLAVLVVIVLTV

SEQ ID NO: 365559 - protein, 31 aa, Mycobacterium
PRGRNPWPIVAAVAIVLVLIVGGIGVWMITQ

SEQ ID NO: 365560 - protein, 23 aa, Mycobacterium
PRGRRLRFRPGRAAGGVVLLVVS

SEQ ID NO: 365561 - protein, 20 aa, Mycobacterium
PRGTEWLWLLGVTVSGLVLF

SEQ ID NO: 365562 - protein, 25 aa, Mycobacterium
PRHRARLDTWRYGWVLNIGAAIAGA

SEQ ID NO: 365563 - protein, 20 aa, Mycobacterium
PRHRMRMRMILEVPALQAYS

SEQ ID NO: 365564 - protein, 34 aa, Mycobacterium
PRIARTMRVLALPIIVVWLLIAIGVNVFVPQLEK

SEQ ID NO: 365565 - protein, 19 aa, Mycobacterium
PRIFLADFGIARQLDDISG

SEQ ID NO: 365566 - protein, 25 aa, Mycobacterium
PRIGPWALYGLLFTIVVLFALQGQQ

SEQ ID NO: 365567 - protein, 19 aa, Mycobacterium
PRILFAAGAVVVLALGSAL

SEQ ID NO: 365568 - protein, 17 aa, Mycobacterium
PRIWALALVYFGIAYGL

SEQ ID NO: 365569 - protein, 21 aa, Mycobacterium
PRKISFLPGMRYYAGNWDTSL

SEQ ID NO: 365570 - protein, 20 aa, Mycobacterium
PRKISFLPGMRYYAGNWDTT

SEQ ID NO: 365571 - protein, 45 aa, Mycobacterium
PRKQDLRQYLRRSILPLLLVASLAVSGFLGWRQWQDHRVRLAGEQ

SEQ ID NO: 365572 - protein, 27 aa, Mycobacterium
PRKRVFEWGWEVLAALAIAAVFAIAAA

SEQ ID NO: 365573 - protein, 26 aa, Mycobacterium
PRKVELIFIPWQTLPWVIPTAVAVAF

SEQ ID NO: 365574 - protein, 21 aa, Mycobacterium
PRKYRLIVTITRDGDQLKMSK

SEQ ID NO: 365575 - protein, 23 aa, Mycobacterium
PRLAALPLWTWLLTVAVISMGGP

SEQ ID NO: 365576 - protein, 29 aa, Mycobacterium
PRLAPPPAMPPTLAWWASSLQLSGLSAGQ

SEQ ID NO: 365577 - protein, 17 aa, Mycobacterium
PRLAPRPVDRPPVDPAS

SEQ ID NO: 365578 - protein, 40 aa, Mycobacterium
PRLGGKLRTSRQFNWGWILAIVVIVLALAAIAILGTVLLT

SEQ ID NO: 365579 - protein, 20 aa, Mycobacterium
PRLGVRWWRFGAGILLGLAC

SEQ ID NO: 365580 - protein, 22 aa, Mycobacterium
PRLGVRWWRFGAGVLLGLAFAT

SEQ ID NO: 365581 - protein, 26 aa, Mycobacterium
PRLIDAYVDWLWFGELGYRSVFTTVL

SEQ ID NO: 365582 - protein, 26 aa, Mycobacterium
PRLIDTYVDWLWFGELGYRSVFTTVL

SEQ ID NO: 365583 - protein, 35 aa, Mycobacterium
PRLILGSAMVALPAFGLWHLWAGAPADPVERRHAG

SEQ ID NO: 365584 - protein, 18 aa, Mycobacterium
PRLIWYAPHRVEGESPPP

SEQ ID NO: 365585 - protein, 17 aa, Mycobacterium
PRLLTTVAGAPLLGAVF

SEQ ID NO: 365586 - protein, 18 aa, Mycobacterium
PRLPRLLVCVGAGLLLYA

SEQ ID NO: 365587 - protein, 30 aa, Mycobacterium
PRLRADMVAALLLGIGVLRVLLHKEPIATA

SEQ ID NO: 365588 - protein, 20 aa, Mycobacterium
PRLRLHWVARRDEKSLAAAI

SEQ ID NO: 365589 - protein, 22 aa, Mycobacterium
PRLRSTIRRLTRPAEPPSSSAP

SEQ ID NO: 365590 - protein, 17 aa, Mycobacterium
PRLSDYVAGLPAALDGV

SEQ ID NO: 365591 - protein, 26 aa, Mycobacterium
PRLTPARALTPPPTPHWQLITTGRGD

SEQ ID NO: 365592 - protein, 26 aa, Mycobacterium
PRLVDTYINWLWFGELGFRGVFTTVL

SEQ ID NO: 365593 - protein, 20 aa, Mycobacterium
PRLYVLHVLLVPAIMIALIS

SEQ ID NO: 365594 - protein, 24 aa, Mycobacterium
PRMRGWIHFYSAWLAIIAGATLVS

SEQ ID NO: 365595 - protein, 25 aa, Mycobacterium
PRMRGWIHFYSAWLAIITGATLVSV

SEQ ID NO: 365596 - protein, 26 aa, Mycobacterium
PRMVHAIYILKLIFGYALGGVIVATL

SEQ ID NO: 365597 - protein, 20 aa, Mycobacterium
PRMVSFLPGMRYYAGNWDTT

SEQ ID NO: 365598 - protein, 18 aa, Mycobacterium
PRNVAFAGAAALALLVGI

SEQ ID NO: 365599 - protein, 25 aa, Mycobacterium
PRPIAPGLFNAIPEAAPLAAPAIPD

SEQ ID NO: 365600 - protein, 70 aa, Mycobacterium
PRPLDPLRSFKFKTAVLVGVALLIATCLLWITAEWKLRYALTLALFVSFGVTWFLAHGMTSPLRDMTAAA

SEQ ID NO: 365601 - protein, 21 aa, Mycobacterium
PRPLDPPPSPAPPPDAFSGIA

SEQ ID NO: 365602 - protein, 17 aa, Mycobacterium
PRPPVFVLVVVALTLVG

SEQ ID NO: 365603 - protein, 17 aa, Mycobacterium
PRPQPWPQPLHAGAAEA

SEQ ID NO: 365604 - protein, 25 aa, Mycobacterium
PRPRHRLADWWSIAGLFGVVAVVYG

SEQ ID NO: 365605 - protein, 28 aa, Mycobacterium
PRPRVPLTLTGILAAVALLAVGGAAIAL

SEQ ID NO: 365606 - protein, 19 aa, Mycobacterium
PRPSVLRPGRVPPALDEVI

SEQ ID NO: 365607 - protein, 29 aa, Mycobacterium
PRPTATRFRLLWLRQLSDAVRTFRNDVNP

SEQ ID NO: 365608 - protein, 26 aa, Mycobacterium
PRPVAPGLFNAIPQAPPLAAPGIPNA

SEQ ID NO: 365609 - protein, 19 aa, Mycobacterium
PRQLGLVAALPLSLVAVAA

SEQ ID NO: 365610 - protein, 25 aa, Mycobacterium
PRQLRERTWWTGPELYVVVDDYDLV

SEQ ID NO: 365611 - protein, 18 aa, Mycobacterium
PRQRLGRAGVLTLATVVV

SEQ ID NO: 365612 - protein, 17 aa, Mycobacterium
PRRDAWLRGGDTVYLVG

SEQ ID NO: 365613 - protein, 30 aa, Mycobacterium
PRRGVPRGPLPRPAPPLPLAAPSPVRGAPP

SEQ ID NO: 365614 - protein, 20 aa, Mycobacterium
PRRIIAIGVLVFIAAAVFGV

SEQ ID NO: 365615 - protein, 19 aa, Mycobacterium
PRRIIAIGVLVFVAAAIFG

SEQ ID NO: 365616 - protein, 19 aa, Mycobacterium
PRRILVVAALVMIAAGIFG

SEQ ID NO: 365617 - protein, 17 aa, Mycobacterium
PRRLPGMALHAAMSAAA

SEQ ID NO: 365618 - protein, 23 aa, Mycobacterium
PRRNVWPWVNWGLALATVPAAAI

SEQ ID NO: 365619 - protein, 18 aa, Mycobacterium
PRRRGFYGSFSSLGAPGG

SEQ ID NO: 365620 - protein, 24 aa, Mycobacterium
PRRRLWRNPYMPSPYLWRGAPDWP

SEQ ID NO: 365621 - protein, 25 aa, Mycobacterium
PRRRNWLISGVIFAATAAVAGLVAG

SEQ ID NO: 365622 - protein, 17 aa, Mycobacterium
PRRRQFFRIVLPQAMRS

SEQ ID NO: 365623 - protein, 20 aa, Mycobacterium
PRRRRELKTPWWETAQPAGQ

SEQ ID NO: 365624 - protein, 27 aa, Mycobacterium
PRRRRSWRWVVVILLVLAVIAGVDAYL

SEQ ID NO: 365625 - protein, 21 aa, Mycobacterium
PRRSLPLAYLISIGVVIVLYV

SEQ ID NO: 365626 - protein, 18 aa, Mycobacterium
PRRVIAVVVLVMIGTAIF

SEQ ID NO: 365627 - protein, 32 aa, Mycobacterium
PRSAEVVVYGLAFFFGAFFTVQEAFASVRQGR

SEQ ID NO: 365628 - protein, 27 aa, Mycobacterium
PRSLREQINWTWVRRGSLIAAVVLIVL

SEQ ID NO: 365629 - protein, 24 aa, Mycobacterium
PRSPSRPWWRRKAVAISAAALLVV

SEQ ID NO: 365630 - protein, 30 aa, Mycobacterium
PRSRRRPIIAATVLVLVVLAGLAVGREIVR

SEQ ID NO: 365631 - protein, 22 aa, Mycobacterium
PRSRTMLALCGLAIGLRLKVSA

SEQ ID NO: 365632 - protein, 22 aa, Mycobacterium
PRSSNRFAFFFGLTAINPVTLV

SEQ ID NO: 365633 - protein, 31 aa, Mycobacterium
PRSSSGNRAFWIIAAVFVVGILGAVAAVALF

SEQ ID NO: 365634 - protein, 35 aa, Mycobacterium
PRSSSGNRLFWILAAVFVVVILGVVGGIVAFAGSH

SEQ ID NO: 365635 - protein, 30 aa, Mycobacterium
PRSWIFYATLLVIFWGVWGAFSALPATWYG

SEQ ID NO: 365636 - protein, 22 aa, Mycobacterium
PRTDLKLHWSWHGVGLGLLFGF

SEQ ID NO: 365637 - protein, 19 aa, Mycobacterium
PRTENLGSLGFYRVKSHVN

SEQ ID NO: 365638 - protein, 25 aa, Mycobacterium
PRTGAWQAQPPLPVPLHHAAAATYR

SEQ ID NO: 365639 - protein, 26 aa, Mycobacterium
PRTGAWQTGPPLPMPLHHAAAAAYRG

SEQ ID NO: 365640 - protein, 23 aa, Mycobacterium
PRTIGLVGIAITVVIALAALNFD

SEQ ID NO: 365641 - protein, 17 aa, Mycobacterium
PRTLWRNPVMFIVELGA

SEQ ID NO: 365642 - protein, 22 aa, Mycobacterium
PRTWGLVGWISDLVPHLGYGVV

SEQ ID NO: 365643 - protein, 27 aa, Mycobacterium
PRVAALPLWTWLLTVAVLSLGGPGDDV

SEQ ID NO: 365644 - protein, 28 aa, Mycobacterium
PRVAGRNPLFNLFVGYHLRSGTDSDMFG

SEQ ID NO: 365645 - protein, 28 aa, Mycobacterium
PRVDQPLIPPFLPRMIHKLALPIVLVWL

SEQ ID NO: 365646 - protein, 45 aa, Mycobacterium
PRVDQPLIPPFLPRMIHRLALPIVLVWLGIVFVTNTVAPQLEVVS

SEQ ID NO: 365647 - protein, 26 aa, Mycobacterium
PRVGPWALYGLLFTIVILFALQGHAI

SEQ ID NO: 365648 - protein, 36 aa, Mycobacterium
PRVIPPSMLRRAMPVLIVILIVGMIIALVATGMKMI

SEQ ID NO: 365649 - protein, 33 aa, Mycobacterium
PRVLLLVYYAGRGVSLLLLPSLLSPQAEPSTWV

SEQ ID NO: 365650 - protein, 25 aa, Mycobacterium
PRVNRWLTTLIGRALNRFTDMPGRD

SEQ ID NO: 365651 - protein, 31 aa, Mycobacterium
PRVVGDPTLLTMLWQNLIGNAIKFRRQDRAP

SEQ ID NO: 365652 - protein, 36 aa, Mycobacterium
PRVVPPSFLRRAMPVVIVILIVGMVVALVASGIRLI

SEQ ID NO: 365653 - protein, 24 aa, Mycobacterium
PRWPFLLRLWGRHPLVRPTDRIEA

SEQ ID NO: 365654 - protein, 24 aa, Mycobacterium
PRWRVVALPFTALLGPVFFVVRFL

SEQ ID NO: 365655 - protein, 21 aa, Mycobacterium
PRWVVAGWIVALAALAVFACP

SEQ ID NO: 365656 - protein, 40 aa, Mycobacterium
PRYDERERGGSLGRWLIAVAVLAVLTVLVTIGINAFGGET

SEQ ID NO: 365657 - protein, 17 aa, Mycobacterium
PRYLSFTAPAMALILGV

SEQ ID NO: 365658 - protein, 17 aa, Mycobacterium
PRYLSFTVPGMALILGV

SEQ ID NO: 365659 - protein, 18 aa, Mycobacterium
PRYPPPPGYGPPPGWQPP

SEQ ID NO: 365660 - protein, 27 aa, Mycobacterium
PRYPYREPPPAPAPGGPPPGPPAPPVP

SEQ ID NO: 365661 - protein, 28 aa, Mycobacterium
PSAEFCVAAYAPYLAWLAATSAASAEIA

SEQ ID NO: 365662 - protein, 27 aa, Mycobacterium
PSAGWQPWIWAVLVAGLGFMSAFVYWQ

SEQ ID NO: 365663 - protein, 19 aa, Mycobacterium
PSALGYGALGVVVGLTAWA

SEQ ID NO: 365664 - protein, 21 aa, Mycobacterium
PSALRIFLLTLAVVDDLLAII

SEQ ID NO: 365665 - protein, 20 aa, Mycobacterium
PSAPARPAKAAKRPAAKRAP

SEQ ID NO: 365666 - protein, 23 aa, Mycobacterium
PSAPARPTPPPPAPPTAPVNLAG

SEQ ID NO: 365667 - protein, 19 aa, Mycobacterium
PSAPLLLLPVLVSALIIRL

SEQ ID NO: 365668 - protein, 25 aa, Mycobacterium
PSARAYLLVLALVGAVSFAFSLVAT

SEQ ID NO: 365669 - protein, 26 aa, Mycobacterium
PSASASALLLNLPRQTDTIYAEKVMR

SEQ ID NO: 365670 - protein, 25 aa, Mycobacterium
PSAVYLLYLTKIALYIAVPAAIISL

SEQ ID NO: 365671 - protein, 32 aa, Mycobacterium
PSAYSTGWALWVVLVFIVFQSVAAVGALLLDA

SEQ ID NO: 365672 - protein, 25 aa, Mycobacterium
PSDKGITTWLLWDGKRSQIDLADHA

SEQ ID NO: 365673 - protein, 33 aa, Mycobacterium
PSDPIYIGIYFGLIIFFTYFYVSITFNPDERAD

SEQ ID NO: 365674 - protein, 38 aa, Mycobacterium
PSDRQLIGIGLVVVLLAAVLTIALLVKSTGRLNDYVRV

SEQ ID NO: 365675 - protein, 23 aa, Mycobacterium
PSDWRAYLAILLAFLARGALTKY

SEQ ID NO: 365676 - protein, 19 aa, Mycobacterium
PSEFSLAGPWVDVAATGEG

SEQ ID NO: 365677 - protein, 28 aa, Mycobacterium
PSERFDFIGMLLLLPGIAMLLLGVSAIP

SEQ ID NO: 365678 - protein, 25 aa, Mycobacterium
PSERRLMVATVLPLLPFGIPFAAFS

SEQ ID NO: 365679 - protein, 23 aa, Mycobacterium
PSERTFLGIFPMITSTNLSLQIL

SEQ ID NO: 365680 - protein, 22 aa, Mycobacterium
PSERTFLGLIPMFTSTNLALRL

SEQ ID NO: 365681 - protein, 32 aa, Mycobacterium
PSFRYLQQVYNLYIRPFYPGSPVLGVTTPEQF

SEQ ID NO: 365682 - protein, 18 aa, Mycobacterium
PSGDLRMVLKSAARFKHL

SEQ ID NO: 365683 - protein, 23 aa, Mycobacterium
PSGFVALTEFPLTPSGKLDRRAL

SEQ ID NO: 365684 - protein, 26 aa, Mycobacterium
PSGLALVPKPAWAAPAAPPAGAPPPR

SEQ ID NO: 365685 - protein, 20 aa, Mycobacterium
PSGLLLLLPVPLETRTVVAL

SEQ ID NO: 365686 - protein, 26 aa, Mycobacterium
PSGMVPVFFVLWALSNFAGPLVLGHL

SEQ ID NO: 365687 - protein, 22 aa, Mycobacterium
PSGPSAWLTRIRADPGRAGVIA

SEQ ID NO: 365688 - protein, 24 aa, Mycobacterium
PSGSPLVILLIACATLGAAVGGFS

SEQ ID NO: 365689 - protein, 26 aa, Mycobacterium
PSHLGWGAHFWLAVFPISLMANIAFW

SEQ ID NO: 365690 - protein, 24 aa, Mycobacterium
PSHMPTFLSVLLLAMVVLLVALLC

SEQ ID NO: 365691 - protein, 28 aa, Mycobacterium
PSIAALLGKWFWWPQHVRQRPVPSPWPK

SEQ ID NO: 365692 - protein, 29 aa, Mycobacterium
PSIAALLGKWFWWPQMVRRRPKPSPWPKP

SEQ ID NO: 365693 - protein, 28 aa, Mycobacterium
PSIAALLGKWFWWPQRVRQRPVPSPWPK

SEQ ID NO: 365694 - protein, 28 aa, Mycobacterium
PSIAALLGKWFWWPQVVRQRPAPQPWPT

SEQ ID NO: 365695 - protein, 29 aa, Mycobacterium
PSIAALLGPWFWWPQRVRTRPVPAPWPRS

SEQ ID NO: 365696 - protein, 28 aa, Mycobacterium
PSIAALLGRWFWWPQIVRPRPASQMLRS

SEQ ID NO: 365697 - protein, 27 aa, Mycobacterium
PSIAALLGRWFWWPQRVRPRPASQMLR

SEQ ID NO: 365698 - protein, 27 aa, Mycobacterium
PSIAALLGRWFWWPQRVRPRPPSALLT

SEQ ID NO: 365699 - protein, 27 aa, Mycobacterium
PSIAALLGRWFWWPQRVRQRPASAMLR

SEQ ID NO: 365700 - protein, 27 aa, Mycobacterium
PSIAALLGRWFWWPQRVRTRPASYMLR

SEQ ID NO: 365701 - protein, 29 aa, Mycobacterium
PSIAALLGRWFWWPQVVRARPARGVVARA

SEQ ID NO: 365702 - protein, 29 aa, Mycobacterium
PSIAAVLGRWFWWPLQVRSRPGHVAPLPA

SEQ ID NO: 365703 - protein, 24 aa, Mycobacterium
PSIMTVMGRWFWWPKRVRVRPASL

SEQ ID NO: 365704 - protein, 24 aa, Mycobacterium
PSIVAALFIFSLWIATLGFQQSSF

SEQ ID NO: 365705 - protein, 26 aa, Mycobacterium
PSIVAALFIYALWVATLGFQRSGFAV

SEQ ID NO: 365706 - protein, 26 aa, Mycobacterium
PSIVAALFIYALWVATLGLPRSGLAV

SEQ ID NO: 365707 - protein, 27 aa, Mycobacterium
PSIVAALFIYALWVAVLGFPRSQLAVS

SEQ ID NO: 365708 - protein, 29 aa, Mycobacterium
PSIVAALFLYALWVGVLGFPRSEFAVSLA

SEQ ID NO: 365709 - protein, 27 aa, Mycobacterium
PSLFERLSVLIANLIRIGFRAGGAGLA

SEQ ID NO: 365710 - protein, 27 aa, Mycobacterium
PSLKYLSYRLFMKRQKSRWLVTRMTTI

SEQ ID NO: 365711 - protein, 17 aa, Mycobacterium
PSLLFYLAGYTVTNSAA

SEQ ID NO: 365712 - protein, 19 aa, Mycobacterium
PSLLLFLGVGVLVGEGGLG

SEQ ID NO: 365713 - protein, 21 aa, Mycobacterium
PSLPALLTGLGLASALVGAAM

SEQ ID NO: 365714 - protein, 32 aa, Mycobacterium
PSLPAPQRERLVLGMLTHAIAVAFSAAGTVAV

SEQ ID NO: 365715 - protein, 29 aa, Mycobacterium
PSLSLRWRVMLLAMSMVAMVVVLMAFAVY

SEQ ID NO: 365716 - protein, 36 aa, Mycobacterium
PSLTQRSRFLIAVSAVLVLLLLLGPRFIDTYVDWLW

SEQ ID NO: 365717 - protein, 25 aa, Mycobacterium
PSPGTVYQMWLLGANGPTSAGTMGP

SEQ ID NO: 365718 - protein, 28 aa, Mycobacterium
PSPIDRLINWIFDQLDYLEFRAGELPGG

SEQ ID NO: 365719 - protein, 17 aa, Mycobacterium
PSPPYYQGAGWGGAPPP

SEQ ID NO: 365720 - protein, 29 aa, Mycobacterium
PSPSGNRVWWILGTVIVIGVIALAGGIAA

SEQ ID NO: 365721 - protein, 26 aa, Mycobacterium
PSPTEFLWIVDIYPLIMASLMLMAGA

SEQ ID NO: 365722 - protein, 24 aa, Mycobacterium
PSQIGGHYLGTIDPALRGETYTEI

SEQ ID NO: 365723 - protein, 18 aa, Mycobacterium
PSQLAQVAIVAIAGVLLF

SEQ ID NO: 365724 - protein, 18 aa, Mycobacterium
PSQLVQVAIMVVAGALLF

SEQ ID NO: 365725 - protein, 27 aa, Mycobacterium
PSQQLVIAVPAHWGPTTLRALRNALRT

SEQ ID NO: 365726 - protein, 24 aa, Mycobacterium
PSQWLDIAVLAVAFIAAISGWRSG

SEQ ID NO: 365727 - protein, 23 aa, Mycobacterium
PSRAIYGLFPTLDALKKAFNDDI

SEQ ID NO: 365728 - protein, 31 aa, Mycobacterium
PSRFRHIPAMLLALSLVLFTVAMAGPTHDVR

SEQ ID NO: 365729 - protein, 20 aa, Mycobacterium
PSRHMPAMTSVPVAPANPGS

SEQ ID NO: 365730 - protein, 17 aa, Mycobacterium
PSRSLRRDWPALMGIDD

SEQ ID NO: 365731 - protein, 31 aa, Mycobacterium
PSRVGRGWLAAIAVLLALCAGAIGAGGYLAQ

SEQ ID NO: 365732 - protein, 28 aa, Mycobacterium
PSSDLWRMMPYLLPYRGRWIVMIVVALA

SEQ ID NO: 365733 - protein, 30 aa, Mycobacterium
PSSGGTFIYAGSPYQYYYGGQNRGIGTVAT

SEQ ID NO: 365734 - protein, 24 aa, Mycobacterium
PSSLAFLGGWLLSLAALTALAVAA

SEQ ID NO: 365735 - protein, 25 aa, Mycobacterium
PSSLARTALLLAGALLCLSVAAWPV

SEQ ID NO: 365736 - protein, 18 aa, Mycobacterium
PSSLPTLLVPHVPFALET

SEQ ID NO: 365737 - protein, 21 aa, Mycobacterium
PSSLRPVDAIPLLPNGKRDNN

SEQ ID NO: 365738 - protein, 19 aa, Mycobacterium
PSSSPPPLTPTLSRPVKGA

SEQ ID NO: 365739 - protein, 17 aa, Mycobacterium
PSTCWWWERTRGENRAR

SEQ ID NO: 365740 - protein, 22 aa, Mycobacterium
PSTGGLYRFSNVTYRGIEVGKV

SEQ ID NO: 365741 - protein, 24 aa, Mycobacterium
PSTGKYLYEAWADRFAVTARLNNA

SEQ ID NO: 365742 - protein, 24 aa, Mycobacterium
PSTPPTGFPSFGPPPPVSAGTGSQ

SEQ ID NO: 365743 - protein, 24 aa, Mycobacterium
PSTPPTGFPSFSPPPAAGAGSVGS

SEQ ID NO: 365744 - protein, 43 aa, Mycobacterium
PSTRFTGWEWVLTALALPVVTWAAWPFHRVALRNARHHGASME

SEQ ID NO: 365745 - protein, 18 aa, Mycobacterium
PSTTLLTPSPDDIAYMIY

SEQ ID NO: 365746 - protein, 29 aa, Mycobacterium
PSVAALLGRWFWWPQLVRPRPASTMLRPT

SEQ ID NO: 365747 - protein, 41 aa, Mycobacterium
PSVADPVYLAYYPLVYAGLLLLMRARFKRLPIPIQLDSLVC

SEQ ID NO: 365748 - protein, 24 aa, Mycobacterium
PSVARLLGRWFWWPQRVRPRPAST

SEQ ID NO: 365749 - protein, 23 aa, Mycobacterium
PSVFFGHSPFQIATTLLLPAAVA

SEQ ID NO: 365750 - protein, 21 aa, Mycobacterium
PSVIMLTFFGVFPILRNVVVG

SEQ ID NO: 365751 - protein, 21 aa, Mycobacterium
PSVIMLVFFGSLPILRNVLVG

SEQ ID NO: 365752 - protein, 24 aa, Mycobacterium
PSVPRWVWLLVVAGSLFTIVNGGA

SEQ ID NO: 365753 - protein, 26 aa, Mycobacterium
PSWGMVATLVLWGWVLDRVGERIVLT

SEQ ID NO: 365754 - protein, 22 aa, Mycobacterium
PSWIDGIVLASVLPPSFHFVVA

SEQ ID NO: 365755 - protein, 17 aa, Mycobacterium
PSWISFLADKKKALASG

SEQ ID NO: 365756 - protein, 23 aa, Mycobacterium
PSWVLAEIAIAVLLMWSNTVVAT

SEQ ID NO: 365757 - protein, 20 aa, Mycobacterium
PSWVLYPCALAMMVFSKSFS

SEQ ID NO: 365758 - protein, 19 aa, Mycobacterium
PSWVLYPCALGMMVLSKSF

SEQ ID NO: 365759 - protein, 20 aa, Mycobacterium
PSYLAIMLFALVAVTAVLGA

SEQ ID NO: 365760 - protein, 20 aa, Mycobacterium
PSYLAIMLFALVAVTAVLGS

SEQ ID NO: 365761 - protein, 28 aa, Mycobacterium
PSYMVPVVLVALPRLPLTVNGKLDLDAL

SEQ ID NO: 365762 - protein, 26 aa, Mycobacterium
PSYPPGFAPYPFPPAPRPPVSGVTAL

SEQ ID NO: 365763 - protein, 27 aa, Mycobacterium
PTAAETALLWYPVGATASLLLLSESVR

SEQ ID NO: 365764 - protein, 31 aa, Mycobacterium
PTALGLIALVTFVLLFLLTGSVVLPLQALVC

SEQ ID NO: 365765 - protein, 33 aa, Mycobacterium
PTAMDGLRLPNWGTLKLALPKLDNGDTAYLVAE

SEQ ID NO: 365766 - protein, 24 aa, Mycobacterium
PTAPPPRRRWPALAATAVVAAAIG

SEQ ID NO: 365767 - protein, 25 aa, Mycobacterium
PTARVVLLLVALLGAFAWTMIALLR

SEQ ID NO: 365768 - protein, 57 aa, Mycobacterium
PTASLRQRLLISLVLTVPVILMAMVPRLQFTNWQWLSLTLAAPVVVWGAWPFHRAGW

SEQ ID NO: 365769 - protein, 31 aa, Mycobacterium
PTAWTNWVEIFLLLVISFSLPRTFGRMVGSP

SEQ ID NO: 365770 - protein, 31 aa, Mycobacterium
PTDGRARAFGWLWQALAATLVAAVFAAAVAQ

SEQ ID NO: 365771 - protein, 21 aa, Mycobacterium
PTDLLWSFLQAIVMSVVVMLV

SEQ ID NO: 365772 - protein, 29 aa, Mycobacterium
PTDLWLNLYWLMLCGMLIYLLGYGSRALL

SEQ ID NO: 365773 - protein, 23 aa, Mycobacterium
PTDPFSLILFRGLDTVIGVAAGV

SEQ ID NO: 365774 - protein, 24 aa, Mycobacterium
PTDSVDFLYLTASAGTVFGVPGQG

SEQ ID NO: 365775 - protein, 19 aa, Mycobacterium
PTELTARFPLDVAAATVGE

SEQ ID NO: 365776 - protein, 27 aa, Mycobacterium
PTFAVYPILVVLFGVGVWPIVVLASTF

SEQ ID NO: 365777 - protein, 19 aa, Mycobacterium
PTFETWLVARREMFVLAPL

SEQ ID NO: 365778 - protein, 20 aa, Mycobacterium
PTFGLARILARFDDRMLDRV

SEQ ID NO: 365779 - protein, 39 aa, Mycobacterium
PTFGTGFAPFFLPLALFIGALIVWMLLSPLRSRPIVNGL

SEQ ID NO: 365780 - protein, 27 aa, Mycobacterium
PTFVVGILLLQFFSFGLHLIPASDNGS

SEQ ID NO: 365781 - protein, 19 aa, Mycobacterium
PTGAPQPTPWTGATGWGTG

SEQ ID NO: 365782 - protein, 17 aa, Mycobacterium
PTGILPQGGPFTEAGAG

SEQ ID NO: 365783 - protein, 19 aa, Mycobacterium
PTGLAFLGGWLLGLAAVTA

SEQ ID NO: 365784 - protein, 24 aa, Mycobacterium
PTGPLPYIVMEYVDGVTLRDIVHS

SEQ ID NO: 365785 - protein, 30 aa, Mycobacterium
PTGPSPSLGAAPWERFFEPPPDDNIHRWQP

SEQ ID NO: 365786 - protein, 26 aa, Mycobacterium
PTKGDPWYTSLWHTIADAPHLPPAAA

SEQ ID NO: 365787 - protein, 22 aa, Mycobacterium
PTKWAIQFGAFAGLAGALGAVT

SEQ ID NO: 365788 - protein, 17 aa, Mycobacterium
PTKWAIQFGAFASLAGA

SEQ ID NO: 365789 - protein, 19 aa, Mycobacterium
PTKWAIQFGIFAGLSGALG

SEQ ID NO: 365790 - protein, 18 aa, Mycobacterium
PTLGLWVSIPMALGRKKF

SEQ ID NO: 365791 - protein, 27 aa, Mycobacterium
PTLGMLLLGVLLWGLGLVPPTVALLLL

SEQ ID NO: 365792 - protein, 26 aa, Mycobacterium
PTLGVLLFGTLLFGLGLGPSLVALML

SEQ ID NO: 365793 - protein, 26 aa, Mycobacterium
PTLGVLLLGTLLFGLGLGPPLVALML

SEQ ID NO: 365794 - protein, 27 aa, Mycobacterium
PTLGVLLLGVLLWGLGLIPPTVALMLL

SEQ ID NO: 365795 - protein, 27 aa, Mycobacterium
PTLGVLLLGVLLWGLGLVPPTVALMLL

SEQ ID NO: 365796 - protein, 23 aa, Mycobacterium
PTLPWTEKPWWVRHYTFTGTTVG

SEQ ID NO: 365797 - protein, 32 aa, Mycobacterium
PTLREIAMALRRPILPVGAVLRRIGSVAEFQL

SEQ ID NO: 365798 - protein, 21 aa, Mycobacterium
PTLTYPPTPPPGASSAPPWPA

SEQ ID NO: 365799 - protein, 19 aa, Mycobacterium
PTMFFRLGNVDLHAFWSAW

SEQ ID NO: 365800 - protein, 18 aa, Mycobacterium
PTMHWFNRFVLSISTPII

SEQ ID NO: 365801 - protein, 20 aa, Mycobacterium
PTMMPISVLVSMAQIDGKWL

SEQ ID NO: 365802 - protein, 21 aa, Mycobacterium
PTMSNSFYHAFRKPHVRLETT

SEQ ID NO: 365803 - protein, 20 aa, Mycobacterium
PTPAPAPAPPPPPAPVVPPA

SEQ ID NO: 365804 - protein, 27 aa, Mycobacterium
PTPKTLRLFVLLVIAFALIPVGAVPGF

SEQ ID NO: 365805 - protein, 25 aa, Mycobacterium
PTPPLGPVWVALLIVGAASAVALGQ

SEQ ID NO: 365806 - protein, 37 aa, Mycobacterium
PTPSLQRRVILLVVALLAVLLVVLGVTIDVSLGLQAR

SEQ ID NO: 365807 - protein, 24 aa, Mycobacterium
PTPSPTVTALPPPPPQPGTNCRAV

SEQ ID NO: 365808 - protein, 23 aa, Mycobacterium
PTQAQVLFTMRVVPASGSSRNAP

SEQ ID NO: 365809 - protein, 20 aa, Mycobacterium
PTQPDYGAPAGWHAPGWPPP

SEQ ID NO: 365810 - protein, 21 aa, Mycobacterium
PTQPDYGAPAGWRAPGWPPQA

SEQ ID NO: 365811 - protein, 17 aa, Mycobacterium
PTRIPTAVPPQPGTPPS

SEQ ID NO: 365812 - protein, 18 aa, Mycobacterium
PTRLLRLAPAAQTMLHGG

SEQ ID NO: 365813 - protein, 22 aa, Mycobacterium
PTRPITRLLALVRNTWRTLTSM

SEQ ID NO: 365814 - protein, 21 aa, Mycobacterium
PTRPLIPLAVSGFLTSRKKAA

SEQ ID NO: 365815 - protein, 24 aa, Mycobacterium
PTRRSPWVAIIFTTVIAFGLIAYV

SEQ ID NO: 365816 - protein, 40 aa, Mycobacterium
PTRRVEWSRVVAFLVLPALALVLAAGAGYLKWLDDSYRDG

SEQ ID NO: 365817 - protein, 23 aa, Mycobacterium
PTSELAIALAFDEASRRKVDLTV

SEQ ID NO: 365818 - protein, 22 aa, Mycobacterium
PTSRRPLLRLALTEAALFGVAV

SEQ ID NO: 365819 - protein, 24 aa, Mycobacterium
PTSTIIPVAKWLGAPLARGGSTTT

SEQ ID NO: 365820 - protein, 24 aa, Mycobacterium
PTTGPAAFFLLAAGWFIALTVVSA

SEQ ID NO: 365821 - protein, 17 aa, Mycobacterium
PTTLWASNATISAALQF

SEQ ID NO: 365822 - protein, 23 aa, Mycobacterium
PTTLYAVFLIKPPTLGAYRGAAL

SEQ ID NO: 365823 - protein, 24 aa, Mycobacterium
PTTVADFLPPVLRTLTIGVPEKPS

SEQ ID NO: 365824 - protein, 33 aa, Mycobacterium
PTTVAHFLPPVLRKLSIFLPQSPSPNESDTAIQ

SEQ ID NO: 365825 - protein, 28 aa, Mycobacterium
PTTVAHFLPPVLRKLTIFVPESPSAAES

SEQ ID NO: 365826 - protein, 32 aa, Mycobacterium
PTTVAHFLPPVLRKLTIYLPQSPSTAESDTAI

SEQ ID NO: 365827 - protein, 19 aa, Mycobacterium
PTTWRIPVTMVAVLMALVV

SEQ ID NO: 365828 - protein, 18 aa, Mycobacterium
PTVEFTRAGFRYPGAERA

SEQ ID NO: 365829 - protein, 17 aa, Mycobacterium
PTVFFGVDRYTVTVELP

SEQ ID NO: 365830 - protein, 24 aa, Mycobacterium
PTVGALFAILLLDASLIGANAVGL

SEQ ID NO: 365831 - protein, 19 aa, Mycobacterium
PTVILIASLLIVAEALDAT

SEQ ID NO: 365832 - protein, 27 aa, Mycobacterium
PTVKMLALSFLLLIGVFLIADGFGIKI

SEQ ID NO: 365833 - protein, 18 aa, Mycobacterium
PTVLDRIVLPLNAGQSPR

SEQ ID NO: 365834 - protein, 21 aa, Mycobacterium
PTVLGLLLVLAAVVQAPAAVL

SEQ ID NO: 365835 - protein, 32 aa, Mycobacterium
PTVLQLTGYLAYLVVVLVLFLRPVTPTGHTTP

SEQ ID NO: 365836 - protein, 26 aa, Mycobacterium
PTVQTLPIWIFSNLFRPNQAPVINVV

SEQ ID NO: 365837 - protein, 24 aa, Mycobacterium
PTVTHYRLLRLRRALDGVRALRDD

SEQ ID NO: 365838 - protein, 24 aa, Mycobacterium
PTVTVLLWFPTTVAKLAMFVRATE

SEQ ID NO: 365839 - protein, 17 aa, Mycobacterium
PTWPQCFPGSFTPVAVA

SEQ ID NO: 365840 - protein, 18 aa, Mycobacterium
PTWSPRWVDHLVGDRIHR

SEQ ID NO: 365841 - protein, 19 aa, Mycobacterium
PTYAHPWLRTFLERLLEGD

SEQ ID NO: 365842 - protein, 33 aa, Mycobacterium
PVAALMFRYNNPDALLVLLLVVAAYLMVRAIQT

SEQ ID NO: 365843 - protein, 46 aa, Mycobacterium
PVADAKGEQRKWLRRVWLALPLGLLSMAAPMLFGGAWAGWLAFAAT

SEQ ID NO: 365844 - protein, 23 aa, Mycobacterium
PVAFVRRPYRWIKELGADDRPMF

SEQ ID NO: 365845 - protein, 22 aa, Mycobacterium
PVAFWACGLALCLFIGPTQSSA

SEQ ID NO: 365846 - protein, 17 aa, Mycobacterium
PVALRDAEFDWQAAVSG

SEQ ID NO: 365847 - protein, 26 aa, Mycobacterium
PVALRLLWTVPLLSFFAAGAGIGIGS

SEQ ID NO: 365848 - protein, 17 aa, Mycobacterium
PVALVTVALLIGLATGL

SEQ ID NO: 365849 - protein, 18 aa, Mycobacterium
PVALWMYWRYGRPNSQRW

SEQ ID NO: 365850 - protein, 25 aa, Mycobacterium
PVANLLAYWLGLMAAGVGLAVIALT

SEQ ID NO: 365851 - protein, 30 aa, Mycobacterium
PVAPVPVAVPPVPPVPVVVAPPGAPAGGGG

SEQ ID NO: 365852 - protein, 17 aa, Mycobacterium
PVAQSFWYRTAKLVTRH

SEQ ID NO: 365853 - protein, 31 aa, Mycobacterium
PVATVPPGAPLPTFPELPAAVLDQATTSSET

SEQ ID NO: 365854 - protein, 17 aa, Mycobacterium
PVAVARPLSWRAALWSV

SEQ ID NO: 365855 - protein, 17 aa, Mycobacterium
PVAYTIGTDFRPAARPP

SEQ ID NO: 365856 - protein, 25 aa, Mycobacterium
PVDFDYWLFAVLVFLNGLGGGIFTA

SEQ ID NO: 365857 - protein, 21 aa, Mycobacterium
PVDFGFEYDQQYGFNQPFFDY

SEQ ID NO: 365858 - protein, 29 aa, Mycobacterium
PVDLLRRTGFLWWRCWPRLIGIWLAGWLV

SEQ ID NO: 365859 - protein, 17 aa, Mycobacterium
PVDLPPMTGPPPPLADA

SEQ ID NO: 365860 - protein, 18 aa, Mycobacterium
PVDPSMLPGPRPPAPIEP

SEQ ID NO: 365861 - protein, 18 aa, Mycobacterium
PVDVVLYAALLAVLVIAL

SEQ ID NO: 365862 - protein, 17 aa, Mycobacterium
PVDWVVVLLITAGSVLG

SEQ ID NO: 365863 - protein, 24 aa, Mycobacterium
PVEDPRNILPPNKFPNIPPGAEPD

SEQ ID NO: 365864 - protein, 26 aa, Mycobacterium
PVERALLYLLAALAALLLGGAAVWLR

SEQ ID NO: 365865 - protein, 21 aa, Mycobacterium
PVERHLVGVRGRRLQRREFGI

SEQ ID NO: 365866 - protein, 29 aa, Mycobacterium
PVETYNKTWLGFIAIAVIGALVGGMLLVK

SEQ ID NO: 365867 - protein, 26 aa, Mycobacterium
PVEYPWLTMSLLIVLGAGLAAAAGAL

SEQ ID NO: 365868 - protein, 19 aa, Mycobacterium
PVFAKALAKDPKDRYQRCI

SEQ ID NO: 365869 - protein, 26 aa, Mycobacterium
PVFAKALAKDPKDRYQRCIDFARALS

SEQ ID NO: 365870 - protein, 32 aa, Mycobacterium
PVFETIRVILADLWVFPICLLLGVSVGAFHIL

SEQ ID NO: 365871 - protein, 19 aa, Mycobacterium
PVFLLFIYKIVLGEQVHKV

SEQ ID NO: 365872 - protein, 17 aa, Mycobacterium
PVFRERMKREARIAGRL

SEQ ID NO: 365873 - protein, 17 aa, Mycobacterium
PVFRERMKREARITGRL

SEQ ID NO: 365874 - protein, 26 aa, Mycobacterium
PVFRSVAWVYLWIFRGTPVYVQLVFW

SEQ ID NO: 365875 - protein, 20 aa, Mycobacterium
PVFTLGMLQADIIGALFVLG

SEQ ID NO: 365876 - protein, 19 aa, Mycobacterium
PVFTLGMLQADIIGALLVL

SEQ ID NO: 365877 - protein, 23 aa, Mycobacterium
PVFTLLAILVIPAGIAALLGLGV

SEQ ID NO: 365878 - protein, 20 aa, Mycobacterium
PVFYHDMPLQRLGFWGDHRI

SEQ ID NO: 365879 - protein, 21 aa, Mycobacterium
PVGAAFLVARRKLGGGLPPDP

SEQ ID NO: 365880 - protein, 21 aa, Mycobacterium
PVGATLWRRVGVTLRLLVIGS

SEQ ID NO: 365881 - protein, 27 aa, Mycobacterium
PVGFLIAALVLLLFSIGFVAMTPYVPE

SEQ ID NO: 365882 - protein, 25 aa, Mycobacterium
PVGGRIFALLAVAALLMAGSPGIAY

SEQ ID NO: 365883 - protein, 23 aa, Mycobacterium
PVGLIVLLLLLVAVFFLVWSMNR

SEQ ID NO: 365884 - protein, 23 aa, Mycobacterium
PVGLIVLPLMIFHQIQLITCAAL

SEQ ID NO: 365885 - protein, 24 aa, Mycobacterium
PVGLPAPALPWLTVDQIQALIVPA

SEQ ID NO: 365886 - protein, 18 aa, Mycobacterium
PVGLRRITAILAGASLMI

SEQ ID NO: 365887 - protein, 30 aa, Mycobacterium
PVGLSVIALLLLLGVPFLGVRWGFPDERVL

SEQ ID NO: 365888 - protein, 23 aa, Mycobacterium
PVGMPFQLHTLMGLALGLLLVFR

SEQ ID NO: 365889 - protein, 26 aa, Mycobacterium
PVGNRWILPLYLFLATLACYATVSGL

SEQ ID NO: 365890 - protein, 28 aa, Mycobacterium
PVGPRPLDPPPSPPPPPAPSAGPDAFSG

SEQ ID NO: 365891 - protein, 24 aa, Mycobacterium
PVGPSRRKLLTTGLASAAVGAGIG

SEQ ID NO: 365892 - protein, 36 aa, Mycobacterium
PVGPTPWNQPPPKRNPWPIVAGVAALVFVLIVGGIG

SEQ ID NO: 365893 - protein, 19 aa, Mycobacterium
PVGRAIVVMVPADLTPDLA

SEQ ID NO: 365894 - protein, 20 aa, Mycobacterium
PVGRVLAPRVGLGFQVLEQH

SEQ ID NO: 365895 - protein, 48 aa, Mycobacterium
PVIAMAMAPPLQFTYWQWLSLTLAAPVVVWGAWPFHRATWANLRHGTA

SEQ ID NO: 365896 - protein, 24 aa, Mycobacterium
PVIDYWGIVLIGLGASALTLATSW

SEQ ID NO: 365897 - protein, 38 aa, Mycobacterium
PVIGGVLLHHFWWGSVFLINVPVLIVLLLTADALIPEY

SEQ ID NO: 365898 - protein, 26 aa, Mycobacterium
PVIGPWALYGLLFTIVILFALQGDQI

SEQ ID NO: 365899 - protein, 30 aa, Mycobacterium
PVIKRRGKYWWIRWAILIVLAIVLAVEIGF

SEQ ID NO: 365900 - protein, 20 aa, Mycobacterium
PVIPPITVFGTAAAALCALW

SEQ ID NO: 365901 - protein, 19 aa, Mycobacterium
PVIQLLCDRAFEWALGASD

SEQ ID NO: 365902 - protein, 21 aa, Mycobacterium
PVKEWAIATLGALDKLFLAVV

SEQ ID NO: 365903 - protein, 36 aa, Mycobacterium
PVKEWAIQTLGPLDKPFLAVVLLVVIATIAAIAGTL

SEQ ID NO: 365904 - protein, 30 aa, Mycobacterium; identical to SEQ ID NO: 24809

SEQ ID NO: 365905 - protein, 18 aa, Mycobacterium
PVLAATCVIAFIGLLALP

SEQ ID NO: 365906 - protein, 19 aa, Mycobacterium
PVLAFPLWTGACLVFAISF

SEQ ID NO: 365907 - protein, 20 aa, Mycobacterium
PVLALIVPGIVGFLLSLTGE

SEQ ID NO: 365908 - protein, 33 aa, Mycobacterium
PVLARAIRLLSVPIIVFWLALAAVTNTVVPQLE

SEQ ID NO: 365909 - protein, 20 aa, Mycobacterium
PVLAVAPLTIIWFGTEMTSK

SEQ ID NO: 365910 - protein, 24 aa, Mycobacterium
PVLFAIPFFLLLLAIEWTAARKLE

SEQ ID NO: 365911 - protein, 18 aa, Mycobacterium
PVLFQIPGGAWTTGNKRG

SEQ ID NO: 365912 - protein, 23 aa, Mycobacterium
PVLGILLLAVFSLSLKNLSATQF

SEQ ID NO: 365913 - protein, 25 aa, Mycobacterium
PVLGIMVFAYITARLLLYATAWAAT

SEQ ID NO: 365914 - protein, 22 aa, Mycobacterium
PVLGLMVFAYITSRLILFSTCW

SEQ ID NO: 365915 - protein, 18 aa, Mycobacterium
PVLGPYSLAITVGVVLVI

SEQ ID NO: 365916 - protein, 20 aa, Mycobacterium
PVLGRLYSAEFYALAARALA

SEQ ID NO: 365917 - protein, 19 aa, Mycobacterium
PVLGRLYSTEFYALVGHAL

SEQ ID NO: 365918 - protein, 18 aa, Mycobacterium
PVLICLAAMIVGLALFGI

SEQ ID NO: 365919 - protein, 17 aa, Mycobacterium
PVLILLTVSGKWLYSHA

SEQ ID NO: 365920 - protein, 24 aa, Mycobacterium
PVLKTPAWEWKIAAYLFSGGLSAG

SEQ ID NO: 365921 - protein, 17 aa, Mycobacterium
PVLLALRVAVRLGLALL

SEQ ID NO: 365922 - protein, 18 aa, Mycobacterium
PVLLLLVHGPIATNILNL

SEQ ID NO: 365923 - protein, 21 aa, Mycobacterium
PVLLPMIGVLLWTAGICAVCA

SEQ ID NO: 365924 - protein, 17 aa, Mycobacterium
PVLMIGMIYIWMPLAMG

SEQ ID NO: 365925 - protein, 52 aa, Mycobacterium
PVLPAPAPVYQPPGYIPPVVVLPRVPSIFRPPWEPQRPPQQNPWNPPWDPPK

SEQ ID NO: 365926 - protein, 17 aa, Mycobacterium
PVLSGLFRVIQGFAGGA

SEQ ID NO: 365927 - protein, 17 aa, Mycobacterium
PVLTRALAKNPADRYPR

SEQ ID NO: 365928 - protein, 20 aa, Mycobacterium
PVLVITLMYFMFQNAPHRPG

SEQ ID NO: 365929 - protein, 17 aa, Mycobacterium
PVLWAIAILTMVVGTVT

SEQ ID NO: 365930 - protein, 18 aa, Mycobacterium
PVLWSTVLLLIVFAQIFQ

SEQ ID NO: 365931 - protein, 31 aa, Mycobacterium
PVMMYVGWPIHRTGWLALAHRSADMNSLITL

SEQ ID NO: 365932 - protein, 18 aa, Mycobacterium
PVMRPRAPAPAFRGPFGG

SEQ ID NO: 365933 - protein, 27 aa, Mycobacterium
PVNFNYWVFALLIFLNGLGSAIFTAPN

SEQ ID NO: 365934 - protein, 24 aa, Mycobacterium
PVNGAIARWIGWAHLPLGHVTPDR

SEQ ID NO: 365935 - protein, 26 aa, Mycobacterium
PVNGLLHLLIAYIIARIAFGFAGEAD

SEQ ID NO: 365936 - protein, 17 aa, Mycobacterium
PVPAGVVGELYLGGAGV

SEQ ID NO: 365937 - protein, 32 aa, Mycobacterium
PVPAVIGYFVAGLLFVVAMLLLVRAGRDHDVR

SEQ ID NO: 365938 - protein, 22 aa, Mycobacterium
PVPAWTLALVVSVPLLIGCVAA

SEQ ID NO: 365939 - protein, 26 aa, Mycobacterium
PVPGVALFVLDQWMRPAPPGVAGELY

SEQ ID NO: 365940 - protein, 18 aa, Mycobacterium
PVPGWPYLQVFATGFLMF

SEQ ID NO: 365941 - protein, 18 aa, Mycobacterium
PVPIVVSLVLLIHNDRPY

SEQ ID NO: 365942 - protein, 18 aa, Mycobacterium
PVPPGVVGELYLAGRGVG

SEQ ID NO: 365943 - protein, 25 aa, Mycobacterium
PVPSLLRALLSDHLDPGYAAAAAKR

SEQ ID NO: 365944 - protein, 26 aa, Mycobacterium
PVPSLLRALLSEHLDPGYAASAAKRD

SEQ ID NO: 365945 - protein, 37 aa, Mycobacterium
PVPTARWSAPLQLMFSFLALPLIRLTNGTANWILRRL

SEQ ID NO: 365946 - protein, 28 aa, Mycobacterium
PVQALWPKLQARWRRQSAVRRLAYVGAV

SEQ ID NO: 365947 - protein, 28 aa, Mycobacterium
PVQHAMAVTWQGNPIVLGGWRTEGSKKV

SEQ ID NO: 365948 - protein, 17 aa, Mycobacterium
PVQIVLPGGLGRAEHTP

SEQ ID NO: 365949 - protein, 19 aa, Mycobacterium
PVRAAWVALAGVTMIIVAG

SEQ ID NO: 365950 - protein, 24 aa, Mycobacterium
PVRDLLLFCTLVVVLVTLIGQGST

SEQ ID NO: 365951 - protein, 22 aa, Mycobacterium
PVRLDKVSFRYPGADRDALREI

SEQ ID NO: 365952 - protein, 19 aa, Mycobacterium
PVRLGVALFLISKPRPMVN

SEQ ID NO: 365953 - protein, 19 aa, Mycobacterium
PVRLLVICVALTALAMVAA

SEQ ID NO: 365954 - protein, 17 aa, Mycobacterium
PVRPIKIWAAAGGALLV

SEQ ID NO: 365955 - protein, 25 aa, Mycobacterium
PVRPRLFHRMIINALPLAFQRGSML

SEQ ID NO: 365956 - protein, 35 aa, Mycobacterium
PVRPRLYQRMIINTLPFFFRGSVLWVAALIGEEIF

SEQ ID NO: 365957 - protein, 27 aa, Mycobacterium
PVRQRFFALFLYVVMLVFVVATAPVAV

SEQ ID NO: 365958 - protein, 28 aa, Mycobacterium
PVRQRFFALFLYVVMLVVVVATAPLVVV

SEQ ID NO: 365959 - protein, 19 aa, Mycobacterium
PVRRRLRLLLGVAAVVLVA

SEQ ID NO: 365960 - protein, 18 aa, Mycobacterium
PVRYIAAVAVLALLLLAW

SEQ ID NO: 365961 - protein, 30 aa, Mycobacterium
PVSEELWRRIGVSLRLLLLGSILGTVIGVV

SEQ ID NO: 365962 - protein, 23 aa, Mycobacterium
PVSFVRRPYRWIKELGASDVPTF

SEQ ID NO: 365963 - protein, 31 aa, Mycobacterium
PVSKDLNPGGWPFPPVPWVNSLASFFGQLGL

SEQ ID NO: 365964 - protein, 33 aa, Mycobacterium
PVSLTGFQNPWFFLALLAVLLVIGLYVVQQFAR

SEQ ID NO: 365965 - protein, 17 aa, Mycobacterium
PVSMIVWSLVVSALLRK

SEQ ID NO: 365966 - protein, 17 aa, Mycobacterium
PVSPPLPMAFEAGLAKL

SEQ ID NO: 365967 - protein, 17 aa, Mycobacterium
PVSVHDFLFAGLDDADA

SEQ ID NO: 365968 - protein, 36 aa, Mycobacterium
PVSVTGFQNAWFFLFLLAVLLILGIYVVLQFARRRR

SEQ ID NO: 365969 - protein, 24 aa, Mycobacterium
PVSYLIPVIFLVLVSGFVGLQVKA

SEQ ID NO: 365970 - protein, 24 aa, Mycobacterium
PVTAAAIVAWRDANGRFTSVDQLG

SEQ ID NO: 365971 - protein, 23 aa, Mycobacterium
PVTAAAIVAWRQANGKFTSVDQL

SEQ ID NO: 365972 - protein, 23 aa, Mycobacterium
PVTAAAIVAWRQANGRFTSVDQL

SEQ ID NO: 365973 - protein, 24 aa, Mycobacterium
PVTAAAIVAWRQANGRFTSVDQLA

SEQ ID NO: 365974 - protein, 30 aa, Mycobacterium
PVTDRIFLDQLSWLTPARWGYAASAATVNL

SEQ ID NO: 365975 - protein, 23 aa, Mycobacterium
PVTIPALFAEQVVRAPDAVALVS

SEQ ID NO: 365976 - protein, 34 aa, Mycobacterium
PVTKNVPSLRYLSYRLTLVRSDGDWRITQMPALT

SEQ ID NO: 365977 - protein, 17 aa, Mycobacterium
PVTLLVFAGAFNGLILP

SEQ ID NO: 365978 - protein, 18 aa, Mycobacterium
PVTMVAVLMALVVTGAVS

SEQ ID NO: 365979 - protein, 25 aa, Mycobacterium
PVTNGPVWVLAGFGAQHRKMAKSLY

SEQ ID NO: 365980 - protein, 25 aa, Mycobacterium
PVTNGPVWVLAGFGAQHRKMGKSLY

SEQ ID NO: 365981 - protein, 32 aa, Mycobacterium
PVTTALPFGVTAWFLSVAGAVATLLGASAFWR

SEQ ID NO: 365982 - protein, 35 aa, Mycobacterium
PVTVPGRYFYLKWWKLLLVLLGVWSAAAVAGFGLS

SEQ ID NO: 365983 - protein, 26 aa, Mycobacterium
PVVAGLAGWILLGQTLSWVRGLAMVV

SEQ ID NO: 365984 - protein, 23 aa, Mycobacterium
PVVARPRPSAPVPILVGGASDAA

SEQ ID NO: 365985 - protein, 25 aa, Mycobacterium
PVVGFIVIATLFFALGNAILVIPLG

SEQ ID NO: 365986 - protein, 24 aa, Mycobacterium
PVVGIALVAIFQIALRNLSETQFA

SEQ ID NO: 365987 - protein, 28 aa, Mycobacterium
PVVGWWLYDIFYITPFLAIPYLHSVNRE

SEQ ID NO: 365988 - protein, 17 aa, Mycobacterium
PVVLARLLSLLRELAWT

SEQ ID NO: 365989 - protein, 18 aa, Mycobacterium
PVVLPFDGLSYPTGVTAD

SEQ ID NO: 365990 - protein, 17 aa, Mycobacterium
PVVMHIYLVAHPASSTI

SEQ ID NO: 365991 - protein, 35 aa, Mycobacterium
PVVRLADRYAAWFLPLTLLVAGAAWLASGSPVRAV

SEQ ID NO: 365992 - protein, 17 aa, Mycobacterium
PVVSFVILPLFALVNAG

SEQ ID NO: 365993 - protein, 17 aa, Mycobacterium
PVVTSPQPQLVAAAGAA

SEQ ID NO: 365994 - protein, 25 aa, Mycobacterium
PVVTTVLWVVIALAGLWLGLLGIAM

SEQ ID NO: 365995 - protein, 18 aa, Mycobacterium
PVVTWFLIGFFEAVPRSL

SEQ ID NO: 365996 - protein, 28 aa, Mycobacterium
PVVVWGALPFHRAAWLNLRHGTATMDTL

SEQ ID NO: 365997 - protein, 20 aa, Mycobacterium
PVVWVRVWPAVTAGPGVLGV

SEQ ID NO: 365998 - protein, 20 aa, Mycobacterium
PVWAMAGFGAQHRKMGKNLY

SEQ ID NO: 365999 - protein, 17 aa, Mycobacterium
PVWLRYSGQIVSGYIEG

SEQ ID NO: 366000 - protein, 20 aa, Mycobacterium
PVWLYQVWAFITPGLYAKER

SEQ ID NO: 366001 - protein, 17 aa, Mycobacterium
PVWSLLVLTAAASLVAA

SEQ ID NO: 366002 - protein, 18 aa, Mycobacterium
PVYFVEFLDFECEGCRAV

SEQ ID NO: 366003 - protein, 22 aa, Mycobacterium
PVYLIIIRLHLYDTLLAIILPS

SEQ ID NO: 366004 - protein, 30 aa, Mycobacterium
PVYQRFGLEQLAWLTPARWGYAAGASSIDF

SEQ ID NO: 366005 - protein, 19 aa, Mycobacterium
PWAALALVFAVGVSGTSLV

SEQ ID NO: 366006 - protein, 30 aa, Mycobacterium
PWAGFTLGWLYWYYYVIIIAVEAVAGAQIL

SEQ ID NO: 366007 - protein, 21 aa, Mycobacterium
PWAIILARFAPFVRTFVPVIA

SEQ ID NO: 366008 - protein, 26 aa, Mycobacterium
PWALHRPFIPWLGWPMLAVVAASQAL

SEQ ID NO: 366009 - protein, 28 aa, Mycobacterium
PWALHRPFIPWLGWPMVAVLVLSQGLRW

SEQ ID NO: 366010 - protein, 29 aa, Mycobacterium
PWALHRPFIPWLGWPMVGVLLLSQGLRWW

SEQ ID NO: 366011 - protein, 31 aa, Mycobacterium
PWEIGLLVVVILFTVLLYLGAIMGIIGFLAD

SEQ ID NO: 366012 - protein, 20 aa, Mycobacterium
PWGSPTIIGLFAGSVIALCL

SEQ ID NO: 366013 - protein, 20 aa, Mycobacterium
PWGWIAHRLLSAPVTAARMA

SEQ ID NO: 366014 - protein, 23 aa, Mycobacterium
PWIIYWVLVGNVPFLTAVLIALA

SEQ ID NO: 366015 - protein, 22 aa, Mycobacterium
PWIVYWVLVGNVPFAAAVLVAL

SEQ ID NO: 366016 - protein, 17 aa, Mycobacterium
PWLFSVFIDVFDSYRAG

SEQ ID NO: 366017 - protein, 18 aa, Mycobacterium
PWLLGLSVAVRLAWAYLT

SEQ ID NO: 366018 - protein, 31 aa, Mycobacterium
PWLPARWRHWWWALLLAFVPIHLVISAIVPA

SEQ ID NO: 366019 - protein, 31 aa, Mycobacterium
PWLPARWRHWWWGLLLAFVPIHLVISAIVPA

SEQ ID NO: 366020 - protein, 31 aa, Mycobacterium
PWLPARWRRWWWALLLAFVPIHLVVSAVVPA

SEQ ID NO: 366021 - protein, 31 aa, Mycobacterium
PWLPQRLRRWWWGLLLAFVPIHLVVSAVVPA

SEQ ID NO: 366022 - protein, 22 aa, Mycobacterium
PWLVYWVLVGNVPFHTAVLVAL

SEQ ID NO: 366023 - protein, 26 aa, Mycobacterium
PWNPPWDPPKQAPKPQWPGSGPGGWD

SEQ ID NO: 366024 - protein, 20 aa, Mycobacterium
PWPPPLKEPAFKEAIARATR

SEQ ID NO: 366025 - protein, 39 aa, Mycobacterium
PWQSTRDYWLIGIAAVVVIVLFGWWRGLHFTTIVRRRLA

SEQ ID NO: 366026 - protein, 17 aa, Mycobacterium
PWRLILDGVIVATSLFV

SEQ ID NO: 366027 - protein, 51 aa, Mycobacterium
PWRPRTFLRALSQALRFTYMLLFSIPVLAPLFLRLTLSVPALRRNAVDNIP

SEQ ID NO: 366028 - protein, 24 aa, Mycobacterium
PWSALAPRRLAALVALAAACAARI

SEQ ID NO: 366029 - protein, 27 aa, Mycobacterium
PWSNAFPAWHYAFATALLGLTVVVLLA

SEQ ID NO: 366030 - protein, 26 aa, Mycobacterium
PWSNSFPAWHYAFATALLGLTVLVLL

SEQ ID NO: 366031 - protein, 27 aa, Mycobacterium
PWSNSFPQWHFGISTVFFGLSVLAILI

SEQ ID NO: 366032 - protein, 26 aa, Mycobacterium
PWSNSFPRLRWSLTTALLELSVIVLV

SEQ ID NO: 366033 - protein, 19 aa, Mycobacterium
PWSVFTKQVLWTVIGLFAF

SEQ ID NO: 366034 - protein, 17 aa, Mycobacterium
PWTLSVTTTLPSVSVNV

SEQ ID NO: 366035 - protein, 21 aa, Mycobacterium
PWTVILARFVPFARTFVPVIA

SEQ ID NO: 366036 - protein, 19 aa, Mycobacterium
PWVIPVMGGLLFFVLVYVW

SEQ ID NO: 366037 - protein, 34 aa, Mycobacterium
PWVTNSPVWFSLFCTVFFGLGWLVTLRNGDLPAY

SEQ ID NO: 366038 - protein, 21 aa, Mycobacterium
PWWLAPLISGVLFAGSVEFIL

SEQ ID NO: 366039 - protein, 37 aa, Mycobacterium
PWYRKPATLIGWALLCLILIALIIYGITQLMGDQQGS

SEQ ID NO: 366040 - protein, 29 aa, Mycobacterium
PYAGRRETWLIMRLPIIDNAQALRWRTSV

SEQ ID NO: 366041 - protein, 25 aa, Mycobacterium
PYAVWVPVVLLVPLGVLLLAARRRP

SEQ ID NO: 366042 - protein, 24 aa, Mycobacterium
PYDWAMYAQFPPALPRAPSWWPLN

SEQ ID NO: 366043 - protein, 17 aa, Mycobacterium
PYFVTSLLDHPQCRPEH

SEQ ID NO: 366044 - protein, 17 aa, Mycobacterium
PYGWPVAKDSGLAEPLR

SEQ ID NO: 366045 - protein, 26 aa, Mycobacterium
PYIGQRPWTPLIGLLGQAGDLGLRVI

SEQ ID NO: 366046 - protein, 20 aa, Mycobacterium
PYIVYFTPLFDTLVRYHWGH

SEQ ID NO: 366047 - protein, 18 aa, Mycobacterium
PYIYPENLPRVNARGGPG

SEQ ID NO: 366048 - protein, 35 aa, Mycobacterium
PYKVYTFVVVVVLAVIFTLVYIQFRGGFTPKTELT

SEQ ID NO: 366049 - protein, 17 aa, Mycobacterium
PYLADRAVVAVKLNVAR

SEQ ID NO: 366050 - protein, 19 aa, Mycobacterium
PYLAWLMQASTDTAGAAAA

SEQ ID NO: 366051 - protein, 18 aa, Mycobacterium
PYLLLVLAFVVYDAFQTI

SEQ ID NO: 366052 - protein, 28 aa, Mycobacterium
PYLTVLVWAIVPTLLYYLGILLAVEIDA

SEQ ID NO: 366053 - protein, 25 aa, Mycobacterium
PYLVCAVYLVLLAIAGLGAALFMDN

SEQ ID NO: 366054 - protein, 18 aa, Mycobacterium
PYLVLFTLFLAPAEHWLG

SEQ ID NO: 366055 - protein, 20 aa, Mycobacterium
PYNHFEVGSPLAVDFVWGRQ

SEQ ID NO: 366056 - protein, 18 aa, Mycobacterium
PYPGPGWAIVFLGLAILA

SEQ ID NO: 366057 - protein, 20 aa, Mycobacterium
PYQPQLDVPTAWLVAPVQAD

SEQ ID NO: 366058 - protein, 22 aa, Mycobacterium
PYQVLVVASLLQREAKPRDFAK

SEQ ID NO: 366059 - protein, 19 aa, Mycobacterium
PYQWWRVALVVGSGLAYVV

SEQ ID NO: 366060 - protein, 23 aa, Mycobacterium
PYRGRWIVMIVVALASLAATISI

SEQ ID NO: 366061 - protein, 25 aa, Mycobacterium
PYRGSRVLWLIHGVSVLLVVPQVVV

SEQ ID NO: 366062 - protein, 21 aa, Mycobacterium
PYSLELLSLRHLHPSVFAVLT

SEQ ID NO: 366063 - protein, 19 aa, Mycobacterium
PYSSWLVVRWVVASALGGP

SEQ ID NO: 366064 - protein, 22 aa, Mycobacterium
PYSSWLVVRWVVASALGGPLLI

SEQ ID NO: 366065 - protein, 20 aa, Mycobacterium
PYTEDFPTTPHGYRLVHGPS

SEQ ID NO: 366066 - protein, 28 aa, Mycobacterium
PYTGYLTLVFLFAVLVLMGFSYPIGTWT

SEQ ID NO: 366067 - protein, 18 aa, Mycobacterium
PYTYALIGAAWALTFTFA

SEQ ID NO: 366068 - protein, 27 aa, Mycobacterium
PYVIYQGLTMYLLLAIGWHGGEELAKI

SEQ ID NO: 366069 - protein, 22 aa, Mycobacterium
PYVLIWVIIIAYLCHVPFAIRN

SEQ ID NO: 366070 - protein, 25 aa, Mycobacterium
PYVRPWTVLQSYRRSVQFPSTAYEF

SEQ ID NO: 366071 - protein, 24 aa, Mycobacterium
PYYARMHTWIKRAVLVCLVALVIE

SEQ ID NO: 366072 - protein, 24 aa, Mycobacterium
QAAAIGLFILPLSGPFRVAAAVVM

SEQ ID NO: 366073 - protein, 23 aa, Mycobacterium
QAAFWCALSLPPLLLGMLGSLAY

SEQ ID NO: 366074 - protein, 31 aa, Mycobacterium
QAAGVPVVFLTAFYGLSVLAGLKAGERVLIH

SEQ ID NO: 366075 - protein, 21 aa, Mycobacterium
QAAHLLDYGFSTPAGTQVGSL

SEQ ID NO: 366076 - protein, 19 aa, Mycobacterium
QAALFPVAYTIGTDFRPAA

SEQ ID NO: 366077 - protein, 39 aa, Mycobacterium
QAALGRHARYVGRVGALAVALGIGLALGSAAVASADTDE

SEQ ID NO: 366078 - protein, 17 aa, Mycobacterium
QAALLVEALTDAGFDNV

SEQ ID NO: 366079 - protein, 17 aa, Mycobacterium
QAANLIALLLTAIGNTA

SEQ ID NO: 366080 - protein, 18 aa, Mycobacterium
QAARLLDYGFATAPGTKV

SEQ ID NO: 366081 - protein, 21 aa, Mycobacterium
QAARLLDYGFATPPGTKVGTL

SEQ ID NO: 366082 - protein, 24 aa, Mycobacterium
QAARLSRLWFDALAGICAHVRSGG

SEQ ID NO: 366083 - protein, 23 aa, Mycobacterium
QAAVLLFLNSRAASYISGQVVWV

SEQ ID NO: 366084 - protein, 17 aa, Mycobacterium
QADCYAGVWAHYASITR

SEQ ID NO: 366085 - protein, 27 aa, Mycobacterium
QADIIGALLVLGFLRFGLPPEDRIQLQ

SEQ ID NO: 366086 - protein, 37 aa, Mycobacterium
QADLLVMEMIALPLSFLILIWVFGGLLAAALPMALGA

SEQ ID NO: 366087 - protein, 33 aa, Mycobacterium
QAESQLRQLLAEYLLPICPPPRATSPPGSPSTG

SEQ ID NO: 366088 - protein, 20 aa, Mycobacterium
QAFDFVFSLAALVATAPVLV

SEQ ID NO: 366089 - protein, 19 aa, Mycobacterium
QAFIFAILTILYFSQAMEI

SEQ ID NO: 366090 - protein, 19 aa, Mycobacterium
QAFIFALLTILYFSQAMEL

SEQ ID NO: 366091 - protein, 20 aa, Mycobacterium
QAFIFALLTILYFSQAMELE

SEQ ID NO: 366092 - protein, 18 aa, Mycobacterium
QAFIFSILTILYFSQAME

SEQ ID NO: 366093 - protein, 18 aa, Mycobacterium
QAFKYALPAFLVPFAFVL

SEQ ID NO: 366094 - protein, 25 aa, Mycobacterium
QAFLAYIVMGWLPEVFIDSGVGKTQ

SEQ ID NO: 366095 - protein, 17 aa, Mycobacterium
QAFLTAAALLLLVAATS

SEQ ID NO: 366096 - protein, 24 aa, Mycobacterium
QAFRAQMMALYFFSVGLGTSMSGV

SEQ ID NO: 366097 - protein, 21 aa, Mycobacterium
QAFVTPYRPGPIVLAVIGAAF

SEQ ID NO: 366098 - protein, 20 aa, Mycobacterium
QAGIRLWTAALALTAGWMVL

SEQ ID NO: 366099 - protein, 35 aa, Mycobacterium
QAGLAAFALLLPITGVILLILVLVAASYRQVVMAY

SEQ ID NO: 366100 - protein, 27 aa, Mycobacterium
QAGLFSVVLLLLFIIGVAVWGVLDGRA

SEQ ID NO: 366101 - protein, 27 aa, Mycobacterium
QAGLFSVVLLLLFVIGVAVWGVLDGRA

SEQ ID NO: 366102 - protein, 28 aa, Mycobacterium
QAGLISLVLLLLYVIAVIVWGTLDGRAD

SEQ ID NO: 366103 - protein, 37 aa, Mycobacterium
QAGSLFFRPKLLPPTPVPPVPPLLPPAPPPMPHGYVP

SEQ ID NO: 366104 - protein, 25 aa, Mycobacterium
QAGSTLLKFFGGLRNNSDGKPLLGE

SEQ ID NO: 366105 - protein, 17 aa, Mycobacterium
QAGWYFGSFLSGVFLLI

SEQ ID NO: 366106 - protein, 19 aa, Mycobacterium
QAIAAIQPGFYKLRTKIAG

SEQ ID NO: 366107 - protein, 26 aa, Mycobacterium
QAIAAWLQLCQAYGWAPGVMGASLAG

SEQ ID NO: 366108 - protein, 25 aa, Mycobacterium
QAIDAWLGLCQTYGWAPGVMGASTQ

SEQ ID NO: 366109 - protein, 25 aa, Mycobacterium
QAIEAWLTLCETYGWAPGVMGASAT

SEQ ID NO: 366110 - protein, 17 aa, Mycobacterium
QAIFIVAFLILATSKVF

SEQ ID NO: 366111 - protein, 39 aa, Mycobacterium
QAISWTYVWIFRSIPLIVQLLFWFNIAYLYDTIGFGIPF

SEQ ID NO: 366112 - protein, 18 aa, Mycobacterium
QAITMPLFFASNALYPVD

SEQ ID NO: 366113 - protein, 29 aa, Mycobacterium
QAKARVTLHDMKFARFVRSGPIGVVHTGS

SEQ ID NO: 366114 - protein, 20 aa, Mycobacterium
QALAYLGIGLLLLCIVLRGV

SEQ ID NO: 366115 - protein, 19 aa, Mycobacterium
QALFAAMTVVGPDGALWSD

SEQ ID NO: 366116 - protein, 26 aa, Mycobacterium
QALGAKIPRGVLLYGPPGTGKTLLAR

SEQ ID NO: 366117 - protein, 27 aa, Mycobacterium
QALGAKIPRGVLLYGPPGTGKTLLARA

SEQ ID NO: 366118 - protein, 21 aa, Mycobacterium
QALGSLLWGLIAGAAGSVTAL

SEQ ID NO: 366119 - protein, 20 aa, Mycobacterium
QALRVDWVGLVLAVAMGSLS

SEQ ID NO: 366120 - protein, 37 aa, Mycobacterium
QALRVLTIGACVLLYLAPLILGLWRGQTTYDRHAAAR

SEQ ID NO: 366121 - protein, 17 aa, Mycobacterium
QALSYFNCTDFADLFTL

SEQ ID NO: 366122 - protein, 27 aa, Mycobacterium
QALTWVFQIMPLFFFAGVAACVQSWRP

SEQ ID NO: 366123 - protein, 25 aa, Mycobacterium
QALTWVFQIMPLFFFAGVAASVGSW

SEQ ID NO: 366124 - protein, 26 aa, Mycobacterium
QAMTATWINLAGLIFLMLLQPVGGII

SEQ ID NO: 366125 - protein, 29 aa, Mycobacterium
QAMTATWINLFGLIFLMLLQPVGGLISDK

SEQ ID NO: 366126 - protein, 24 aa, Mycobacterium
QANNVLVFPGIGLGVIVAGARLLT

SEQ ID NO: 366127 - protein, 38 aa, Mycobacterium
QAPATQQLPTPPPIPPIPQIPPIPQIPGIGFPQVPQVP

SEQ ID NO: 366128 - protein, 21 aa, Mycobacterium
QAPDHLLTAVPFRGTHQAGIV

SEQ ID NO: 366129 - protein, 24 aa, Mycobacterium
QAPHVCKLWPLVFARVAASLVIFA

SEQ ID NO: 366130 - protein, 23 aa, Mycobacterium
QAPKAFVVLFVIPGTKEASQCKG

SEQ ID NO: 366131 - protein, 28 aa, Mycobacterium
QAPKMTVIAGRRLPLPPSALATGIDQIS

SEQ ID NO: 366132 - protein, 27 aa, Mycobacterium
QAPLRQSMFIANAVWVIVVAVAAVALL

SEQ ID NO: 366133 - protein, 24 aa, Mycobacterium
QAPNNYLVWSILVTLFCCLPFGIV

SEQ ID NO: 366134 - protein, 27 aa, Mycobacterium
QAPTTFYWNVIAPAWNNFIRHADITVA

SEQ ID NO: 366135 - protein, 17 aa, Mycobacterium
QAPVLLGVGRMTVTLDL

SEQ ID NO: 366136 - protein, 18 aa, Mycobacterium
QAPVMLGIGRMTVTLKLP

SEQ ID NO: 366137 - protein, 21 aa, Mycobacterium
QAPVPPPPPDAPTAGFQGGTI

SEQ ID NO: 366138 - protein, 25 aa, Mycobacterium
QAQNQAYGYLFPHGAFFSLGHLLGV

SEQ ID NO: 366139 - protein, 25 aa, Mycobacterium
QAQPSYPPYPPYPPPGQPAQEGGSP

SEQ ID NO: 366140 - protein, 17 aa, Mycobacterium
QAQTPRFMPDPQPMRTP

SEQ ID NO: 366141 - protein, 25 aa, Mycobacterium
QAQTVFNAFAWLIGEIITVATVGRG

SEQ ID NO: 366142 - protein, 17 aa, Mycobacterium
QARFLITATGFLSQPHT

SEQ ID NO: 366143 - protein, 27 aa, Mycobacterium
QARPDLPEVLLPQNYQPPPNLAPPPGT

SEQ ID NO: 366144 - protein, 17 aa, Mycobacterium
QARWFIVGGLVAAVMGV

SEQ ID NO: 366145 - protein, 37 aa, Mycobacterium
QARWRGWLDHSLVIALIATITWLIAALVMVAERQALT

SEQ ID NO: 366146 - protein, 24 aa, Mycobacterium
QASKYLVLDIVRPELKALTGACGL

SEQ ID NO: 366147 - protein, 31 aa, Mycobacterium
QASLGMAMLLGRFLPIIFTLALAGSLATQRK

SEQ ID NO: 366148 - protein, 19 aa, Mycobacterium
QASSLFLVSKLNCSITTSD

SEQ ID NO: 366149 - protein, 22 aa, Mycobacterium
QATILVTLVMLPTIVLAVGDRD

SEQ ID NO: 366150 - protein, 23 aa, Mycobacterium
QATPWNTYVRPGLPATPICSPGN

SEQ ID NO: 366151 - protein, 25 aa, Mycobacterium
QATRLSRLWFEALAGICAHVRGGGG

SEQ ID NO: 366152 - protein, 23 aa, Mycobacterium
QAVAIGLFVLPLSGALHTAAVVV

SEQ ID NO: 366153 - protein, 25 aa, Mycobacterium
QAVALMVVVVRFLEPFTVLADLAGA

SEQ ID NO: 366154 - protein, 20 aa, Mycobacterium
QAVGSLLWGLLAGGTSSVIS

SEQ ID NO: 366155 - protein, 18 aa, Mycobacterium
QAVLMGLVVMLVHTYYGY

SEQ ID NO: 366156 - protein, 20 aa, Mycobacterium
QAVLPWSLHFTTNLAAVMGN

SEQ ID NO: 366157 - protein, 20 aa, Mycobacterium
QAVPQWTLALIALLAVLAMN

SEQ ID NO: 366158 - protein, 18 aa, Mycobacterium
QAWLAAHRVGDVVVLPAT

SEQ ID NO: 366159 - protein, 23 aa, Mycobacterium
QAYTPWFDRVIAFVIDQLPIAVV

SEQ ID NO: 366160 - protein, 25 aa, Mycobacterium
QCARRPLPLLPAMAKVLVAALIGAL

SEQ ID NO: 366161 - protein, 26 aa, Mycobacterium
QCARRPLPPIPALAKLLVAAVAGALA

SEQ ID NO: 366162 - protein, 25 aa, Mycobacterium
QCARRPLPPLPAMGKLLAAALVGAL

SEQ ID NO: 366163 - protein, 25 aa, Mycobacterium
QCGTASIIRFMLLRVAGAIDQARRE

SEQ ID NO: 366164 - protein, 17 aa, Mycobacterium
QCHSYAFDFSVWEIWAA

SEQ ID NO: 366165 - protein, 17 aa, Mycobacterium
QCIIFAILLGLPIPYVL

SEQ ID NO: 366166 - protein, 25 aa, Mycobacterium
QCIRSFMPDLPLPYAFPASPDSGES

SEQ ID NO: 366167 - protein, 21 aa, Mycobacterium
QDALLRNLLQIAPVPIREIAN

SEQ ID NO: 366168 - protein, 25 aa, Mycobacterium
QDANAEFWVVLILQPRPDGTLSGEF

SEQ ID NO: 366169 - protein, 22 aa, Mycobacterium
QDAPWQVVRLLVDGPVLSKDAA

SEQ ID NO: 366170 - protein, 23 aa, Mycobacterium
QDARLNIVMKKLTGWAAIIAVPT

SEQ ID NO: 366171 - protein, 40 aa, Mycobacterium
QDDLLVMEMIALPLSFVVLIWVFGGLLAAALPMALGALAV

SEQ ID NO: 366172 - protein, 19 aa, Mycobacterium
QDDPWRNPGAPVALGTPAV

SEQ ID NO: 366173 - protein, 36 aa, Mycobacterium
QDERDRISLWGRILPITFTALGLVALVGGAVLGTFS

SEQ ID NO: 366174 - protein, 43 aa, Mycobacterium
QDGIFTTIIQPPLILFCAVPGAYWLFHDAKIGRLKDLLINCGY

SEQ ID NO: 366175 - protein, 17 aa, Mycobacterium
QDGLWLRIMDIPAALEA

SEQ ID NO: 366176 - protein, 27 aa, Mycobacterium
QDHAAFLLLRFLIALPIGALIGGWLAT

SEQ ID NO: 366177 - protein, 25 aa, Mycobacterium
QDIFYSLLKTVIFVWIASTIQCYYG

SEQ ID NO: 366178 - protein, 17 aa, Mycobacterium
QDILFTLISTSASQYEQ

SEQ ID NO: 366179 - protein, 23 aa, Mycobacterium
QDLGLLLLRVGVGAVLIAHGLRK

SEQ ID NO: 366180 - protein, 24 aa, Mycobacterium
QDLLAGFFIITERQYGFGDLVELN

SEQ ID NO: 366181 - protein, 27 aa, Mycobacterium
QDNGSFRARFLTDKLLFESQTGKEICN

SEQ ID NO: 366182 - protein, 27 aa, Mycobacterium
QDPAVFLKLMLRWLNAFVPKPGQTIPG

SEQ ID NO: 366183 - protein, 19 aa, Mycobacterium
QDPLRARWVLWVGGGALVG

SEQ ID NO: 366184 - protein, 25 aa, Mycobacterium
QDQIMPMLVFSIMSQLVFSGGMIWV

SEQ ID NO: 366185 - protein, 25 aa, Mycobacterium
QDQLTGFVYAFDDLLARNNASWADL

SEQ ID NO: 366186 - protein, 25 aa, Mycobacterium
QDQLVNYIFGGLRQPWRPKTFARAL

SEQ ID NO: 366187 - protein, 25 aa, Mycobacterium
QDRFPTVPFWTWIVGFAALTTVLNL

SEQ ID NO: 366188 - protein, 47 aa, Mycobacterium
QDRLPIEIAIAVLVLGVLLLVYRNVVTMLLPLVTIGSSLIIAQSVVA

SEQ ID NO: 366189 - protein, 25 aa, Mycobacterium
QDRLTGFIYAFDDMLARNKASWADL

SEQ ID NO: 366190 - protein, 30 aa, Mycobacterium
QDRLTGFIYAFDDMLVRYRKSWSDLAAVVT

SEQ ID NO: 366191 - protein, 18 aa, Mycobacterium
QDSDAPLFALLRSSGDPD

SEQ ID NO: 366192 - protein, 38 aa, Mycobacterium
QDSGGERRKWLRRVWLTWPLALLATASTMVFGAAPWAG

SEQ ID NO: 366193 - protein, 31 aa, Mycobacterium
QDSIHSLFDKLPLMALILIVTTTVLMFLAFG

SEQ ID NO: 366194 - protein, 21 aa, Mycobacterium
QDYGPDFGLTYVLDGLAAMGQ

SEQ ID NO: 366195 - protein, 34 aa, Mycobacterium
QEAGRPARWSWLWPREHHLVSWLAAVVVPSLICA

SEQ ID NO: 366196 - protein, 24 aa, Mycobacterium
QEALIQLLADRAFQWSLNAGEVIQ

SEQ ID NO: 366197 - protein, 28 aa, Mycobacterium
QEDKRLLPYMIGAFVLIVGVSVGVGLWA

SEQ ID NO: 366198 - protein, 26 aa, Mycobacterium
QEESRAWRMRLWVRRVGAQAKVSNVE

SEQ ID NO: 366199 - protein, 31 aa, Mycobacterium; identical to SEQ ID NO: 163405

SEQ ID NO: 366200 - protein, 27 aa, Mycobacterium
QEGQSHGWALWIWATVLAGVAVMAAFV

SEQ ID NO: 366201 - protein, 25 aa, Mycobacterium
QEGTGVPFLKPLTEQDIRDALSAAS

SEQ ID NO: 366202 - protein, 23 aa, Mycobacterium
QELRGLWYSFTAGSVRVISLSND

SEQ ID NO: 366203 - protein, 27 aa, Mycobacterium
QELSLSARWWIVIVSLIVTASSFLFIN

SEQ ID NO: 366204 - protein, 32 aa, Mycobacterium
QEPDQPNPWYKQPAVLIALAGAGVAVVAVIAA

SEQ ID NO: 366205 - protein, 37 aa, Mycobacterium
QEPEPTPWYRRPAMLIAWLISVVILIGLIVFGIIELI

SEQ ID NO: 366206 - protein, 27 aa, Mycobacterium
QEQAPPTPPYPTPPYYGAAQPHEPEPY

SEQ ID NO: 366207 - protein, 26 aa, Mycobacterium
QERLFDTLFVFENYPVDTGVLSGADG

SEQ ID NO: 366208 - protein, 23 aa, Mycobacterium
QESRLWHVGLAAVSLLGLGTLLG

SEQ ID NO: 366209 - protein, 19 aa, Mycobacterium
QEWRLVWDSALDRAEIGSG

SEQ ID NO: 366210 - protein, 19 aa, Mycobacterium
QFAAFMAGLGADPVFRMLK

SEQ ID NO: 366211 - protein, 19 aa, Mycobacterium
QFAFAGFLLALNGATFALA

SEQ ID NO: 366212 - protein, 27 aa, Mycobacterium
QFALGQQLHWSVPPLAFVVLVAVGADY

SEQ ID NO: 366213 - protein, 20 aa, Mycobacterium
QFDSLLSTVRPFLDKNREVL

SEQ ID NO: 366214 - protein, 19 aa, Mycobacterium
QFELSLPVPVGAVVVAYDA

SEQ ID NO: 366215 - protein, 18 aa, Mycobacterium
QFFAQLVAGLGLAADEIP

SEQ ID NO: 366216 - protein, 30 aa, Mycobacterium
QFFGGIHEIYFPYVLMKPKLIIATILGGMT

SEQ ID NO: 366217 - protein, 20 aa, Mycobacterium
QFGWRATCLITVAAGVLQLI

SEQ ID NO: 366218 - protein, 17 aa, Mycobacterium
QFILMRTVGLVDTPWAM

SEQ ID NO: 366219 - protein, 24 aa, Mycobacterium
QFLELFMKAWTQIGQLLVNAAFSF

SEQ ID NO: 366220 - protein, 36 aa, Mycobacterium
QFLPDVWWLPYAAVSLPFLLLFRLTCYYYRGAYYRT

SEQ ID NO: 366221 - protein, 21 aa, Mycobacterium
QFLRRIAFSAFAFTIVLLVLV

SEQ ID NO: 366222 - protein, 29 aa, Mycobacterium
QFLSWGWRIPFILGAVLMLVGLWLRRAIT

SEQ ID NO: 366223 - protein, 27 aa, Mycobacterium
QFLVETLTLVIFVLVLRALPAESDIQQ

SEQ ID NO: 366224 - protein, 21 aa, Mycobacterium
QFLVIGLSVTIFLSAGIAALV

SEQ ID NO: 366225 - protein, 26 aa, Mycobacterium
QFMALGWKLLIPVSLLWIMIAAVIRA

SEQ ID NO: 366226 - protein, 27 aa, Mycobacterium
QFMGLGWKLLIPASLVWVLIAAVIRTL

SEQ ID NO: 366227 - protein, 26 aa, Mycobacterium
QFMGLGWKLLIPASLVWVLIAAVVRT

SEQ ID NO: 366228 - protein, 19 aa, Mycobacterium
QFPRAANLVYYLGAGAPGS

SEQ ID NO: 366229 - protein, 21 aa, Mycobacterium
QFPWLKARFRSIADPWNQVGV

SEQ ID NO: 366230 - protein, 19 aa, Mycobacterium
QFRDAIPARWTWVAASFAI

SEQ ID NO: 366231 - protein, 25 aa, Mycobacterium
QFRIGYLPFEAPIPSTLLTGADPVI

SEQ ID NO: 366232 - protein, 30 aa, Mycobacterium
QFRMPNIMGKFWTDAEPMLYQAGWQGGGLS

SEQ ID NO: 366233 - protein, 19 aa, Mycobacterium
QFRPGLLRAFRTADFAGIM

SEQ ID NO: 366234 - protein, 17 aa, Mycobacterium
QFSLWLVPLAVLALPHR

SEQ ID NO: 366235 - protein, 18 aa, Mycobacterium
QFSVRLLRTFLRDVPNQV

SEQ ID NO: 366236 - protein, 20 aa, Mycobacterium
QFSYAMMYELFFPSLLEKRL

SEQ ID NO: 366237 - protein, 20 aa, Mycobacterium
QFTVGYVAALLAVSCAILAL

SEQ ID NO: 366238 - protein, 18 aa, Mycobacterium
QFVLALPPALNAVAYVVI

SEQ ID NO: 366239 - protein, 20 aa, Mycobacterium
QFYCLAFSSAALSSVSGLPH

SEQ ID NO: 366240 - protein, 18 aa, Mycobacterium
QFYSRAVSAGIVIAVLIC

SEQ ID NO: 366241 - protein, 21 aa, Mycobacterium
QGAFGLWFKFIAENVPFMILP

SEQ ID NO: 366242 - protein, 18 aa, Mycobacterium
QGAGFTLSAPLRSLTKPS

SEQ ID NO: 366243 - protein, 22 aa, Mycobacterium
QGALINAWQTQAGLISLVLLLL

SEQ ID NO: 366244 - protein, 25 aa, Mycobacterium
QGAPAEIWEVFTLQPGPGGAFTGEF

SEQ ID NO: 366245 - protein, 26 aa, Mycobacterium
QGAVLLIAVLFLLINLLVDVLYAVVD

SEQ ID NO: 366246 - protein, 20 aa, Mycobacterium
QGAVWVLPTLGVILGLGAGA

SEQ ID NO: 366247 - protein, 21 aa, Mycobacterium
QGDKPVLLIVEDDPTFARMLS

SEQ ID NO: 366248 - protein, 21 aa, Mycobacterium
QGEWPQQWPAPQEAAAPEEVA

SEQ ID NO: 366249 - protein, 18 aa, Mycobacterium
QGGLLMAIRALCDRVRSA

SEQ ID NO: 366250 - protein, 21 aa, Mycobacterium
QGGSIGLGFAIPVDQAKRVAD

SEQ ID NO: 366251 - protein, 23 aa, Mycobacterium
QGGSPARLLLSPAPFAYVLNNAV

SEQ ID NO: 366252 - protein, 28 aa, Mycobacterium
QGGYQPPPPPGWGPPPVPPGRPGGSGGS

SEQ ID NO: 366253 - protein, 20 aa, Mycobacterium
QGHVLWLLGLALGLANIVGA

SEQ ID NO: 366254 - protein, 28 aa, Mycobacterium
QGHWSLLVGYGCLPWIALTVIRLRTATN

SEQ ID NO: 366255 - protein, 51 aa, Mycobacterium
QGIALVLGVLFIAILVASLWVIRKTVDLISILIAIVVGALIAFGPLVLMLQ

SEQ ID NO: 366256 - protein, 22 aa, Mycobacterium
QGIEYIVGFLGALFAGWCPVPL

SEQ ID NO: 366257 - protein, 17 aa, Mycobacterium
QGKNFYYFPDQLSIDRY

SEQ ID NO: 366258 - protein, 29 aa, Mycobacterium
QGLEARVQYWLPGYAIPLALAATALTSVA

SEQ ID NO: 366259 - protein, 23 aa, Mycobacterium
QGLGWLRIAIFAAPAILVSLAGN

SEQ ID NO: 366260 - protein, 17 aa, Mycobacterium
QGLIALAPLLVGARAIG

SEQ ID NO: 366261 - protein, 19 aa, Mycobacterium
QGLITVRLTPDFDMALVTR

SEQ ID NO: 366262 - protein, 22 aa, Mycobacterium
QGLLAFVYLVAGGLKVLRPREQ

SEQ ID NO: 366263 - protein, 17 aa, Mycobacterium
QGLLFHSTFARGIGDDV

SEQ ID NO: 366264 - protein, 23 aa, Mycobacterium
QGLLFIVVVGFFPAGIAGLGVAL

SEQ ID NO: 366265 - protein, 18 aa, Mycobacterium
QGLLLNIVVGIVGALLGG

SEQ ID NO: 366266 - protein, 23 aa, Mycobacterium
QGLRFVWNLRVLRALALIDLTVT

SEQ ID NO: 366267 - protein, 20 aa, Mycobacterium
QGLRLLGLVALQDPPRDEVS

SEQ ID NO: 366268 - protein, 25 aa, Mycobacterium
QGLSWALYAVMAMWTGFAAVALSRN

SEQ ID NO: 366269 - protein, 35 aa, Mycobacterium
QGLTAWIAAPLLVMAIVFGVLLLTGTTIRDVPDTL

SEQ ID NO: 366270 - protein, 18 aa, Mycobacterium
QGLVPLRLVLVGTAVGYG

SEQ ID NO: 366271 - protein, 23 aa, Mycobacterium
QGNQFALILFLAAVLPLTLLSYR

SEQ ID NO: 366272 - protein, 34 aa, Mycobacterium
QGNTTYYLVRAEHLPLLQPLRDLTNPIGASFVLD

SEQ ID NO: 366273 - protein, 18 aa, Mycobacterium
QGPLAVLVAIGCSLALVA

SEQ ID NO: 366274 - protein, 27 aa, Mycobacterium
QGQAQPPYPPYPPYPPPSLPDPDGGKS

SEQ ID NO: 366275 - protein, 25 aa, Mycobacterium
QGQQRPFSLAFPLRGGTGANWNIEA

SEQ ID NO: 366276 - protein, 17 aa, Mycobacterium
QGRLAPTWSFHFGLLLL

SEQ ID NO: 366277 - protein, 20 aa, Mycobacterium
QGRRALLLPAGALVYIAIPP

SEQ ID NO: 366278 - protein, 24 aa, Mycobacterium
QGRRVTAPIWLGVLGALTVSASFA

SEQ ID NO: 366279 - protein, 23 aa, Mycobacterium
QGSGPPLWVVFSAGTAIAIGTYL

SEQ ID NO: 366280 - protein, 30 aa, Mycobacterium
QGSVLLVQALLVLSLLFALPISARLARRAV

SEQ ID NO: 366281 - protein, 27 aa, Mycobacterium
QGVSMPYFPNYLSLAGPYAFLGLNFFN

SEQ ID NO: 366282 - protein, 28 aa, Mycobacterium
QGVTMPYFPNYIGLASPFAFSGLSFFHT

SEQ ID NO: 366283 - protein, 22 aa, Mycobacterium
QGVVMFLLYLCGGTAALIAASV

SEQ ID NO: 366284 - protein, 17 aa, Mycobacterium
QGVWPMMLLIAAFALPL

SEQ ID NO: 366285 - protein, 21 aa, Mycobacterium
QGYAVPPMYPGLPGQDPFGPQ

SEQ ID NO: 366286 - protein, 21 aa, Mycobacterium
QGYWVRIQLFLHGGDFGVRDP

SEQ ID NO: 366287 - protein, 17 aa, Mycobacterium
QGYYGRSREECFDTDGW

SEQ ID NO: 366288 - protein, 17 aa, Mycobacterium
QHAFDIFSSPRAHRSAE

SEQ ID NO: 366289 - protein, 26 aa, Mycobacterium
QHARRTVLIWVAVVLAITGMVAAAAW

SEQ ID NO: 366290 - protein, 33 aa, Mycobacterium
QHARSLHFLVLVYFLFFILVHVTMVLTTEALRN

SEQ ID NO: 366291 - protein, 26 aa, Mycobacterium
QHAVMLRLLVPALGSFALLAHVGPRI

SEQ ID NO: 366292 - protein, 17 aa, Mycobacterium
QHCFNIPICWAMRSVFD

SEQ ID NO: 366293 - protein, 25 aa, Mycobacterium
QHGVKVFLLVRFLLGMRTPLYLAIG

SEQ ID NO: 366294 - protein, 25 aa, Mycobacterium
QHLNDWINELLYRLLEKGSSVSGGW

SEQ ID NO: 366295 - protein, 21 aa, Mycobacterium
QHLRALILKHPGLQETLDEAV

SEQ ID NO: 366296 - protein, 19 aa, Mycobacterium
QHLVGLELHWMVLAMAVIV

SEQ ID NO: 366297 - protein, 21 aa, Mycobacterium
QHLVSIEPQLAFTGANLPLLL

SEQ ID NO: 366298 - protein, 24 aa, Mycobacterium
QHNALWARRLAWVSLAVLLIEGGI

SEQ ID NO: 366299 - protein, 26 aa, Mycobacterium
QHPETASWWRTLLAPIIGGAGMLYVI

SEQ ID NO: 366300 - protein, 21 aa, Mycobacterium
QHPRLPRRDALKVLPAAVSAD

SEQ ID NO: 366301 - protein, 22 aa, Mycobacterium
QHPWLLVVFGVLGVVAGFGMWL

SEQ ID NO: 366302 - protein, 28 aa, Mycobacterium
QHRITAREWMWAILLAGAVAVIVTAGDP

SEQ ID NO: 366303 - protein, 20 aa, Mycobacterium
QHRLRINLDYERRLLEGGPR

SEQ ID NO: 366304 - protein, 26 aa, Mycobacterium
QHRTDLTPWILAARSAPALVNQARRL

SEQ ID NO: 366305 - protein, 18 aa, Mycobacterium
QHSFLSRLYTGTGAFEVV

SEQ ID NO: 366306 - protein, 42 aa, Mycobacterium
QHTAALRALLALTVVLGLGYPVFIWLVAQLPGLQDKADGSII

SEQ ID NO: 366307 - protein, 28 aa, Mycobacterium
QHTAGAWLFDMGMLAALSIGYAGLVRWR

SEQ ID NO: 366308 - protein, 17 aa, Mycobacterium
QHTLGPYPFDPNLIAQG

SEQ ID NO: 366309 - protein, 34 aa, Mycobacterium
QHTSYYLVIWVTSAYLLTYAAPLLVAGRLGDRFG

SEQ ID NO: 366310 - protein, 26 aa, Mycobacterium
QHTVSALVWLQIGIGVAVLVVVGIAG

SEQ ID NO: 366311 - protein, 18 aa, Mycobacterium
QHWGLRPAGIAFALAVCV

SEQ ID NO: 366312 - protein, 19 aa, Mycobacterium
QHWGYWPAAFGLFAFVWLE

SEQ ID NO: 366313 - protein, 21 aa, Mycobacterium
QHWVPAGAIAFGLFIVTNAAK

SEQ ID NO: 366314 - protein, 27 aa, Mycobacterium
QIAAYKLIMLLLWWGAATSKLNHHFPY

SEQ ID NO: 366315 - protein, 33 aa, Mycobacterium
QIAEWLNETIFRLLQKAASLPGGWLTATVLVIL

SEQ ID NO: 366316 - protein, 26 aa, Mycobacterium
QIAGSFAVLFLPYSALGPFAGALLDR

SEQ ID NO: 366317 - protein, 17 aa, Mycobacterium
QIASLPRGPMVGIPGAP

SEQ ID NO: 366318 - protein, 23 aa, Mycobacterium
QIATTLLLPAAVAATVYLLAAVA

SEQ ID NO: 366319 - protein, 18 aa, Mycobacterium
QIAWIWPVGPVTLGQIAG

SEQ ID NO: 366320 - protein, 23 aa, Mycobacterium
QIAWLLPTALLLAILGIVLLRNN

SEQ ID NO: 366321 - protein, 21 aa, Mycobacterium
QIDAARLLTWRASWMAANGVS

SEQ ID NO: 366322 - protein, 24 aa, Mycobacterium
QIDDRGLVYIVDRLKELIKYKGYQ

SEQ ID NO: 366323 - protein, 31 aa, Mycobacterium
QIDGEIVLLLFLPAILYWESLNTSFRELRWN

SEQ ID NO: 366324 - protein, 17 aa, Mycobacterium
QIEPALRSGDWGGAAVA

SEQ ID NO: 366325 - protein, 23 aa, Mycobacterium
QIFELGVLIPVVAFAAALIAPLL

SEQ ID NO: 366326 - protein, 17 aa, Mycobacterium
QIFELGVLIPVVGFVAV

SEQ ID NO: 366327 - protein, 18 aa, Mycobacterium
QIFGGVLLILVGAALVTG

SEQ ID NO: 366328 - protein, 23 aa, Mycobacterium
QIFRMGYYGLLFPGTALAKDATG

SEQ ID NO: 366329 - protein, 24 aa, Mycobacterium
QIGGFGIHPALLDAALHALVLTAE

SEQ ID NO: 366330 - protein, 31 aa, Mycobacterium
QIGGTALVVLFAVVLVFYIVTSHDKKGGGAT

SEQ ID NO: 366331 - protein, 27 aa, Mycobacterium
QIGGTAVVVIFLVALVSYIVVTHHKKT

SEQ ID NO: 366332 - protein, 27 aa, Mycobacterium
QIGILAPILLLLLRIVQGFALGGEWAG

SEQ ID NO: 366333 - protein, 17 aa, Mycobacterium
QIGLWAAVVLLVVRLIQ

SEQ ID NO: 366334 - protein, 29 aa, Mycobacterium
QIGPWLPFVHMYRFLDVDWLFPSYAMPWG

SEQ ID NO: 366335 - protein, 51 aa, Mycobacterium
QIGTFIGLGLLFDTLIVRSFMVPSIAALLGRWFWWPINVRTRPARARPVRP

SEQ ID NO: 366336 - protein, 28 aa, Mycobacterium
QIHFGLGLALLAWFGFYLYKVSHGDVEE

SEQ ID NO: 366337 - protein, 29 aa, Mycobacterium
QIHLALGIALLAWFGFYLFTISRGEAEEP

SEQ ID NO: 366338 - protein, 29 aa, Mycobacterium
QIIFERVITGLLLVIAVGFAASFFVKTPP

SEQ ID NO: 366339 - protein, 27 aa, Mycobacterium
QIIKDYLGWPLISAGAFALVQLAARGR

SEQ ID NO: 366340 - protein, 31 aa, Mycobacterium
QILAVWVGLPLWLMAMLLMAALTLTNLISVR

SEQ ID NO: 366341 - protein, 20 aa, Mycobacterium
QILIYTWLTVLATLALTPAT

SEQ ID NO: 366342 - protein, 17 aa, Mycobacterium
QILLRHALPNALGPVIA

SEQ ID NO: 366343 - protein, 20 aa, Mycobacterium
QILNLLSIAAVFMGTALTIR

SEQ ID NO: 366344 - protein, 17 aa, Mycobacterium
QILRFFDAKRRILAEMA

SEQ ID NO: 366345 - protein, 20 aa, Mycobacterium
QILTLLSIAAVFMGTALTIR

SEQ ID NO: 366346 - protein, 17 aa, Mycobacterium
QILVLLCVGAVFMGTAL

SEQ ID NO: 366347 - protein, 23 aa, Mycobacterium
QIMGTAILLFLIFAITDRRNIRM

SEQ ID NO: 366348 - protein, 20 aa, Mycobacterium
QIMPLLVVAVMSQLVFSGGM

SEQ ID NO: 366349 - protein, 19 aa, Mycobacterium
QIMPLLVVSLMLQLVLCGG

SEQ ID NO: 366350 - protein, 17 aa, Mycobacterium
QINPIWNLGPYKPAHVS

SEQ ID NO: 366351 - protein, 18 aa, Mycobacterium
QINPIWNLGPYKPSHVSA

SEQ ID NO: 366352 - protein, 21 aa, Mycobacterium
QIPFWTFLRNSVVITSALAVV

SEQ ID NO: 366353 - protein, 17 aa, Mycobacterium
QISLFVVILGYGLTARF

SEQ ID NO: 366354 - protein, 27 aa, Mycobacterium
QITTKALIALVVFLALVGLYITVRYER

SEQ ID NO: 366355 - protein, 31 aa, Mycobacterium
QITVVTVILLVMYWPLGVVVLVSIVPITLTV

SEQ ID NO: 366356 - protein, 28 aa, Mycobacterium
QIVKDYLGWPMISAGAFALAQLALRGRL

SEQ ID NO: 366357 - protein, 28 aa, Mycobacterium
QIVQPFGEYLPWRGFFKHLSSYADRAGY

SEQ ID NO: 366358 - protein, 26 aa, Mycobacterium
QIVQPFGEYLPWRGFFRLFSSSADRA

SEQ ID NO: 366359 - protein, 19 aa, Mycobacterium
QKERWLPELMTLEKVAAWA

SEQ ID NO: 366360 - protein, 22 aa, Mycobacterium
QKIEKVVLVSAFLAAAALAQAV

SEQ ID NO: 366361 - protein, 24 aa, Mycobacterium
QKISELYDRVGFAAAGKFNEFDNL

SEQ ID NO: 366362 - protein, 27 aa, Mycobacterium
QKLVFKVLAMILWLAPIGAFGAIANVV

SEQ ID NO: 366363 - protein, 33 aa, Mycobacterium
QKLVFKVLGMLLWLAPIGAFGWIASIIGATGWG

SEQ ID NO: 366364 - protein, 34 aa, Mycobacterium
QKLVHFFDIQWPWSTAIYTLIVVAWVSLVVYAWR

SEQ ID NO: 366365 - protein, 21 aa, Mycobacterium
QKMSGLNINRFLGVDFAGFSK

SEQ ID NO: 366366 - protein, 40 aa, Mycobacterium
QKPRRRRVFRIGLQSKLLLTLLLCSILSIGVIGFIGASSG

SEQ ID NO: 366367 - protein, 25 aa, Mycobacterium
QKRAFDFCFALTALLVASPVLIAAA

SEQ ID NO: 366368 - protein, 33 aa, Mycobacterium
QKRTFDFCFALAALILVSPLLIASAIAIKLSSK

SEQ ID NO: 366369 - protein, 25 aa, Mycobacterium
QKVLRALVLLPLVLPPVVGGIALLY

SEQ ID NO: 366370 - protein, 26 aa, Mycobacterium
QKWNPYYLGNLAWATALMVFFEWGVM

SEQ ID NO: 366371 - protein, 17 aa, Mycobacterium
QLAAARGVALLATRPDL

SEQ ID NO: 366372 - protein, 25 aa, Mycobacterium
QLAFVGANLPLMLKGFARITQEGTY

SEQ ID NO: 366373 - protein, 24 aa, Mycobacterium
QLAGAWLDYVLRRGWPLLKSDVVE

SEQ ID NO: 366374 - protein, 32 aa, Mycobacterium
QLAGGPAWLYWTLYLACYAAGGWEPGLAGLQA

SEQ ID NO: 366375 - protein, 20 aa, Mycobacterium
QLAIFAIVGMVGVAVMAVWY

SEQ ID NO: 366376 - protein, 20 aa, Mycobacterium
QLAIFTIVGIVGVVVMVLMY

SEQ ID NO: 366377 - protein, 17 aa, Mycobacterium
QLAIFTIVGVVGVIVMA

SEQ ID NO: 366378 - protein, 30 aa, Mycobacterium
QLAKAWMSMYQAKWWWLLAAMVAAAASMHS

SEQ ID NO: 366379 - protein, 22 aa, Mycobacterium
QLARYRAVLNPLFRPRALAWLM

SEQ ID NO: 366380 - protein, 18 aa, Mycobacterium
QLASALCRHYWPVALLAA

SEQ ID NO: 366381 - protein, 21 aa, Mycobacterium
QLATYTALGWVFKSVVEIVML

SEQ ID NO: 366382 - protein, 25 aa, Mycobacterium
QLCALLPFALPFVVLAYGIKRLAGA

SEQ ID NO: 366383 - protein, 26 aa, Mycobacterium
QLDDHRLLSLILLARDHVVHGWVLAS

SEQ ID NO: 366384 - protein, 29 aa, Mycobacterium
QLDGFLAWVLVFILLLVVADLLILGPIER

SEQ ID NO: 366385 - protein, 17 aa, Mycobacterium
QLDHLAARMRRNGANLL

SEQ ID NO: 366386 - protein, 24 aa, Mycobacterium
QLDRTLMLWVLPLLIAPPMYSKDV

SEQ ID NO: 366387 - protein, 25 aa, Mycobacterium
QLDTEVIAIPAYSLQLLSELPDLGS

SEQ ID NO: 366388 - protein, 24 aa, Mycobacterium
QLDWPGQLMFAPAVALLAYAIIEA

SEQ ID NO: 366389 - protein, 26 aa, Mycobacterium
QLEVNTLFQSLIDLLHKIDPVELNGT

SEQ ID NO: 366390 - protein, 37 aa, Mycobacterium
QLEYDYRLLLGHRPGGLPWPDAARPPELPWFATDGTW

SEQ ID NO: 366391 - protein, 28 aa, Mycobacterium
QLFGVGPFLVPLYFAFGVVAALLGELTV

SEQ ID NO: 366392 - protein, 23 aa, Mycobacterium
QLFRELVLYLPWVAQGELWRTVT

SEQ ID NO: 366393 - protein, 17 aa, Mycobacterium
QLFTTDAGWREAVLRMV

SEQ ID NO: 366394 - protein, 19 aa, Mycobacterium
QLGALRGALLTEPALAPNG

SEQ ID NO: 366395 - protein, 19 aa, Mycobacterium
QLGIFLVAGIIGVVAMVLF

SEQ ID NO: 366396 - protein, 30 aa, Mycobacterium
QLGITIHWLVPALLMLVLNSILTYFDVNLT

SEQ ID NO: 366397 - protein, 18 aa, Mycobacterium
QLGLVGRLPAAVLTLDQQ

SEQ ID NO: 366398 - protein, 23 aa, Mycobacterium
QLGNILFGGFLPLISLSLVDATG

SEQ ID NO: 366399 - protein, 23 aa, Mycobacterium
QLGRKRLALAMLLAALVNAGTFA

SEQ ID NO: 366400 - protein, 17 aa, Mycobacterium
QLGSTVGTLYYMAPERF

SEQ ID NO: 366401 - protein, 26 aa, Mycobacterium
QLGVDQFLLVQWLAPLASEAPEFIIA

SEQ ID NO: 366402 - protein, 30 aa, Mycobacterium
QLGWQQFSPVLFWIGPLLVYVILPLLDLNF

SEQ ID NO: 366403 - protein, 45 aa, Mycobacterium
QLIAFGILTVISLLVLGVYYLQIPSLMGIGRYTLKAELPASGGLY

SEQ ID NO: 366404 - protein, 37 aa, Mycobacterium
QLIAFGILTVISLLVLGVYYLQLPSLAGIGRYTLKAE

SEQ ID NO: 366405 - protein, 23 aa, Mycobacterium
QLIGAQPLAFLLGGHLGGWLLVV

SEQ ID NO: 366406 - protein, 19 aa, Mycobacterium
QLIIFSIAAVVGLGSMVFV

SEQ ID NO: 366407 - protein, 19 aa, Mycobacterium
QLIIFTIASIVGVAVMIFS

SEQ ID NO: 366408 - protein, 19 aa, Mycobacterium
QLIIFTIASIVGVAVMLFA

SEQ ID NO: 366409 - protein, 40 aa, Mycobacterium
QLIIFTILTVVALGVLGLYYLRLPSLVGVGQYTLYAELPR

SEQ ID NO: 366410 - protein, 20 aa, Mycobacterium
QLIIFTITSVVASAMMVFSY

SEQ ID NO: 366411 - protein, 18 aa, Mycobacterium
QLILMPILYVVQEMTVRL

SEQ ID NO: 366412 - protein, 44 aa, Mycobacterium
QLIMFGTLTVLSLLVLGVYYLQIPALLGVGRYPLKAELPASGGL

SEQ ID NO: 366413 - protein, 21 aa, Mycobacterium
QLIPATNAMLLTFGATIPIAA

SEQ ID NO: 366414 - protein, 25 aa, Mycobacterium
QLKRNERVFILFAGLKGAVPILLGE

SEQ ID NO: 366415 - protein, 30 aa, Mycobacterium
QLLAPDSPFREIFTYPARFILRSTMHYMSV

SEQ ID NO: 366416 - protein, 17 aa, Mycobacterium
QLLFFMTPIIWNESTLQ

SEQ ID NO: 366417 - protein, 26 aa, Mycobacterium
QLLGPGPKWWGVTLLVIGAFSAMYGV

SEQ ID NO: 366418 - protein, 19 aa, Mycobacterium
QLLGRPLVGRPRTWPAIAL

SEQ ID NO: 366419 - protein, 18 aa, Mycobacterium
QLLIQVTCTMLVTAPIMC

SEQ ID NO: 366420 - protein, 21 aa, Mycobacterium
QLLKWLSAVVIVAATAVALVV

SEQ ID NO: 366421 - protein, 34 aa, Mycobacterium
QLLPSLLATVRWRRRRARLTTWVASAAAAVVLGI

SEQ ID NO: 366422 - protein, 35 aa, Mycobacterium
QLLPTLLATVRWRRRRTRLAIWVASSAAAVFLGIG

SEQ ID NO: 366423 - protein, 19 aa, Mycobacterium
QLLSFFALLLLTAAGMAFI

SEQ ID NO: 366424 - protein, 37 aa, Mycobacterium
QLLSWGWRIPFLLSFVLMLFAIWLRLNLKESPVFEER

SEQ ID NO: 366425 - protein, 19 aa, Mycobacterium
QLLSYFTTVFIAAPAALIT

SEQ ID NO: 366426 - protein, 28 aa, Mycobacterium
QLLVNAAFSFVLWSYNLIQALVNLNFWG

SEQ ID NO: 366427 - protein, 18 aa, Mycobacterium
QLMLTIVVPVLLVQGAPV

SEQ ID NO: 366428 - protein, 21 aa, Mycobacterium
QLMRERFPAVLPVGEVLAIIS

SEQ ID NO: 366429 - protein, 18 aa, Mycobacterium
QLMRQQLIRQLRSGLGAE

SEQ ID NO: 366430 - protein, 18 aa, Mycobacterium
QLNGINIIFYYSTTLWQS

SEQ ID NO: 366431 - protein, 26 aa, Mycobacterium
QLNHDLIRTLIYLKLSVSGHLTVFVT

SEQ ID NO: 366432 - protein, 17 aa, Mycobacterium
QLPAGVIGEIYVTGGQL

SEQ ID NO: 366433 - protein, 30 aa, Mycobacterium
QLPGPAWLRRLWLAVIIVAPASLWLEPISS

SEQ ID NO: 366434 - protein, 21 aa, Mycobacterium
QLPPLSQIFELGVLIPVVAFA

SEQ ID NO: 366435 - protein, 20 aa, Mycobacterium
QLPPQLQLPAPVGSAPAVPL

SEQ ID NO: 366436 - protein, 18 aa, Mycobacterium
QLPRLEIGPFPPAEFPGG

SEQ ID NO: 366437 - protein, 20 aa, Mycobacterium
QLPRWYWSGLAIGSLLGAVF

SEQ ID NO: 366438 - protein, 28 aa, Mycobacterium
QLQLWTTPLWLVLMVVPFVYLVVRHPDS

SEQ ID NO: 366439 - protein, 21 aa, Mycobacterium
QLQQGLYGFALRRLGTQFVER

SEQ ID NO: 366440 - protein, 19 aa, Mycobacterium
QLQRLGLTPVLLTGDNHTV

SEQ ID NO: 366441 - protein, 21 aa, Mycobacterium
QLQWVIDIYTLGLASLLMLSG

SEQ ID NO: 366442 - protein, 37 aa, Mycobacterium
QLRGLLIAVGLVTLLIAALLLIAVSRAALRPLDRLTA

SEQ ID NO: 366443 - protein, 23 aa, Mycobacterium
QLRITRWFAARWSAGRSLVVGAG

SEQ ID NO: 366444 - protein, 28 aa, Mycobacterium
QLRKIDFEPYRLWQPPLNQPVAIDELVD

SEQ ID NO: 366445 - protein, 28 aa, Mycobacterium
QLRKIKFEPYRLWQPPLTVPVAIDELVN

SEQ ID NO: 366446 - protein, 17 aa, Mycobacterium
QLRLLHSDDFREGTKAF

SEQ ID NO: 366447 - protein, 18 aa, Mycobacterium
QLRQLSKNALPPCPPPAP

SEQ ID NO: 366448 - protein, 26 aa, Mycobacterium
QLRQPGSWWLLAGAVFAILAAIITVA

SEQ ID NO: 366449 - protein, 30 aa, Mycobacterium
QLRRINFEPYRLWQPPLTQPVAIDDLVNRF

SEQ ID NO: 366450 - protein, 25 aa, Mycobacterium
QLRRVALAGLLARSPRLLILDEPLA

SEQ ID NO: 366451 - protein, 18 aa, Mycobacterium
QLSGLPTLAELPGRRGNT

SEQ ID NO: 366452 - protein, 24 aa, Mycobacterium
QLSLTLLAILYAPNVILGSCALAV

SEQ ID NO: 366453 - protein, 29 aa, Mycobacterium
QLSVALQPWLAGHAVAGTVLFPGAGFVEL

SEQ ID NO: 366454 - protein, 20 aa, Mycobacterium
QLTIFAIVTVFTVGAISLFY

SEQ ID NO: 366455 - protein, 17 aa, Mycobacterium
QLTKRGYRLVFSNGIIT

SEQ ID NO: 366456 - protein, 21 aa, Mycobacterium
QLTMRVFTGLTLLDTIQGTVG

SEQ ID NO: 366457 - protein, 24 aa, Mycobacterium
QLTRQLLIGFLSAGALILTVGAIA

SEQ ID NO: 366458 - protein, 34 aa, Mycobacterium
QLTVFTIVTMLAMSVLGWHYLRLPSVVGMGQYSL

SEQ ID NO: 366459 - protein, 24 aa, Mycobacterium
QLTYWENMLAGMPERLALPTDRPY

SEQ ID NO: 366460 - protein, 17 aa, Mycobacterium
QLVALGATVLLIAGLIT

SEQ ID NO: 366461 - protein, 17 aa, Mycobacterium
QLVALLTSPRRQWPVYL

SEQ ID NO: 366462 - protein, 23 aa, Mycobacterium
QLVAWGALAIYLLWRSGDGPARI

SEQ ID NO: 366463 - protein, 21 aa, Mycobacterium
QLVEDMLLLARLDAGRPLERD

SEQ ID NO: 366464 - protein, 43 aa, Mycobacterium
QLVFSGGMIWVTNRFLLDQLSWLTPARWGFAASASTIDTHRLV

SEQ ID NO: 366465 - protein, 21 aa, Mycobacterium
QLVIWLLVFCLFTLAVVATVI

SEQ ID NO: 366466 - protein, 18 aa, Mycobacterium
QLVLHGLATVLLMMAAFA

SEQ ID NO: 366467 - protein, 37 aa, Mycobacterium
QLVMFAVLTAITAVALGWYYLQIPTAMGIGQYTLKAE

SEQ ID NO: 366468 - protein, 21 aa, Mycobacterium
QLVMIVHHLAVDGVSWRILLE

SEQ ID NO: 366469 - protein, 28 aa, Mycobacterium
QLVRDLLAGFFIIVERQYGFGDLVKLTI

SEQ ID NO: 366470 - protein, 27 aa, Mycobacterium
QLVRDLLSGFFILVERQYGFGDLVTLT

SEQ ID NO: 366471 - protein, 19 aa, Mycobacterium
QLVSFYIATVACCSVLLLT

SEQ ID NO: 366472 - protein, 25 aa, Mycobacterium
QLVSLVGMLVLLKAVAYWFDRYELL

SEQ ID NO: 366473 - protein, 43 aa, Mycobacterium
QLVTIAAVTACALVLSLIGVWAIRRRLLRQTHGLRPDELRVMY

SEQ ID NO: 366474 - protein, 47 aa, Mycobacterium
QLVTSILTVLAVLFMMVWISPLLALITVLTVPLSLLVTRVITRRSQG

SEQ ID NO: 366475 - protein, 22 aa, Mycobacterium
QLWAGCLLPLANVFWAPVYVIE

SEQ ID NO: 366476 - protein, 19 aa, Mycobacterium
QLWFVPFFDDSSWDGPAWS

SEQ ID NO: 366477 - protein, 18 aa, Mycobacterium
QLWIVDVYSLVLAALLVA

SEQ ID NO: 366478 - protein, 17 aa, Mycobacterium
QLWQAFNLQRREDKRLL

SEQ ID NO: 366479 - protein, 19 aa, Mycobacterium
QLWRRVHSAVSVLLGGNLG

SEQ ID NO: 366480 - protein, 31 aa, Mycobacterium
QLWRSPRLQPYRFLGLTFLIVVVIFAVTGGR

SEQ ID NO: 366481 - protein, 21 aa, Mycobacterium
QLWVFLQQVVAELRKVIWPNR

SEQ ID NO: 366482 - protein, 17 aa, Mycobacterium
QLWVVYTDNFSRFKPDN

SEQ ID NO: 366483 - protein, 20 aa, Mycobacterium
QLYSKWVPRTLPPGWKPGSR

SEQ ID NO: 366484 - protein, 21 aa, Mycobacterium
QMFAYIAVVLILSCLLTVLLA

SEQ ID NO: 366485 - protein, 18 aa, Mycobacterium
QMFHSILDSLLIFGALTA

SEQ ID NO: 366486 - protein, 23 aa, Mycobacterium
QMGYLPGIIWIVVGVVLAGAVQD

SEQ ID NO: 366487 - protein, 23 aa, Mycobacterium
QMGYLPGTIWIVAGAVFAGCVHD

SEQ ID NO: 366488 - protein, 23 aa, Mycobacterium
QMIQLVLFGALVYVAYPFISTAP

SEQ ID NO: 366489 - protein, 32 aa, Mycobacterium
QMIRALPHLGLIPLFILWFGIGELPKVLLVAL

SEQ ID NO: 366490 - protein, 17 aa, Mycobacterium
QMISLLAQQGVQPGASP

SEQ ID NO: 366491 - protein, 24 aa, Mycobacterium
QMLQWAPECFGTPGDLKLAALAIS

SEQ ID NO: 366492 - protein, 24 aa, Mycobacterium
QMLSRFFVVFLAGALFYQYQDKIP

SEQ ID NO: 366493 - protein, 21 aa, Mycobacterium
QMPQIRHDIQRLADLADIYGD

SEQ ID NO: 366494 - protein, 20 aa, Mycobacterium
QMQPTAVPYPFVPPPVPAQP

SEQ ID NO: 366495 - protein, 40 aa, Mycobacterium
QMQVGSLIAFLSYFLLILMSVLILMEFLELLPRASVCAGR

SEQ ID NO: 366496 - protein, 19 aa, Mycobacterium
QMQWVIDIYTLMVASLLLL

SEQ ID NO: 366497 - protein, 26 aa, Mycobacterium
QMRDWARDLGPWFPLAFLGAHTIVTV

SEQ ID NO: 366498 - protein, 22 aa, Mycobacterium
QMSEPFLFVFRPTLDNWQAVLD

SEQ ID NO: 366499 - protein, 23 aa, Mycobacterium
QMSPFWRQMFLTIGVLVAVFGMR

SEQ ID NO: 366500 - protein, 24 aa, Mycobacterium
QMSRFWQQMFLTVGILIAVFGMRL

SEQ ID NO: 366501 - protein, 20 aa, Mycobacterium
QMVRRMSLLSDPAVVLVGNP

SEQ ID NO: 366502 - protein, 18 aa, Mycobacterium
QMYFFYATPMVPFLVMMI

SEQ ID NO: 366503 - protein, 32 aa, Mycobacterium
QMYWMSTKIPNDQFLLFCFDSPTADLDTVRSV

SEQ ID NO: 366504 - protein, 27 aa, Mycobacterium
QNAAPGKFMPLLPTQQQAPVPPPPVDQ

SEQ ID NO: 366505 - protein, 23 aa, Mycobacterium
QNAARFAVMFFAGALIYQCRNVL

SEQ ID NO: 366506 - protein, 29 aa, Mycobacterium
QNAQPGKFMPLLPTQQQAPVPPPPPDAPT

SEQ ID NO: 366507 - protein, 21 aa, Mycobacterium
QNDALQRGSYPDYQAFTCPEQ

SEQ ID NO: 366508 - protein, 26 aa, Mycobacterium
QNDMDTLLILLAAAGVAFVITVPGAD

SEQ ID NO: 366509 - protein, 25 aa, Mycobacterium
QNEAAPVRLPTLKPPRIPRPSSGSP

SEQ ID NO: 366510 - protein, 24 aa, Mycobacterium
QNEQLLLALMPEPVVQRYRAGGEV

SEQ ID NO: 366511 - protein, 24 aa, Mycobacterium
QNGGFLVIIAWVLVAIRPRMRGYR

SEQ ID NO: 366512 - protein, 24 aa, Mycobacterium
QNGLPFLARLLYGRRTVVLVHHCH

SEQ ID NO: 366513 - protein, 32 aa, Mycobacterium
QNIDVAIKNLPTYGFTAPPTVIPVPSPESKGQ

SEQ ID NO: 366514 - protein, 22 aa, Mycobacterium
QNIVGQRYLGLSLGKEGSPELL

SEQ ID NO: 366515 - protein, 27 aa, Mycobacterium
QNLGNGKFFINLPVSVPYKAVEVGSTI

SEQ ID NO: 366516 - protein, 26 aa, Mycobacterium
QNLGWAFGYNTAAIPLAALGVLNPVV

SEQ ID NO: 366517 - protein, 26 aa, Mycobacterium
QNLGYALQWPLFAAFVIWAYRRFVQY

SEQ ID NO: 366518 - protein, 31 aa, Mycobacterium; identical to SEQ ID NO: 21218

SEQ ID NO: 366519 - protein, 32 aa, Mycobacterium
QNLGYALQWPLFAWFCVYAYRKYVRYEEMPPE

SEQ ID NO: 366520 - protein, 32 aa, Mycobacterium
QNLGYALQWPMFAWFCVYAYRKFVRYEETPPQ

SEQ ID NO: 366521 - protein, 17 aa, Mycobacterium
QNLLRAGEKFTWLGRGM

SEQ ID NO: 366522 - protein, 27 aa, Mycobacterium
QNMNSPYLIWIPAVLLIALGVAAYQAR

SEQ ID NO: 366523 - protein, 21 aa, Mycobacterium
QNMVFQILERLKAGKLPSLAE

SEQ ID NO: 366524 - protein, 34 aa, Mycobacterium
QNVGLSLALITVLIPLALLGVLGLAAVVLVHELA

SEQ ID NO: 366525 - protein, 17 aa, Mycobacterium
QNWRRWYRLARAYDYAG

SEQ ID NO: 366526 - protein, 28 aa, Mycobacterium
QNYGMTLLWTLALLIPVLYVNQEMVLRL

SEQ ID NO: 366527 - protein, 27 aa, Mycobacterium
QNYGYSLLWVLLLLIPVLIVNQEMVVR

SEQ ID NO: 366528 - protein, 27 aa, Mycobacterium
QPAAAWLNRTLGWFFLFASGDGPVDEG

SEQ ID NO: 366529 - protein, 25 aa, Mycobacterium
QPAAGPWDPLLPKLPSAGAPGDPVA

SEQ ID NO: 366530 - protein, 25 aa, Mycobacterium
QPAAQWRSLPDAPTPRLMTAWTVLG

SEQ ID NO: 366531 - protein, 37 aa, Mycobacterium
QPAAQWRTLPDAPTARLMMAWTVLDNKIWIMGGVREG

SEQ ID NO: 366532 - protein, 36 aa, Mycobacterium
QPAERKPFLLVGAPLLLVFGICSIALAVSLTVTVRS

SEQ ID NO: 366533 - protein, 17 aa, Mycobacterium
QPALWIPGSSISSARLK

SEQ ID NO: 366534 - protein, 18 aa, Mycobacterium
QPASQWRTLPDAPTARLM

SEQ ID NO: 366535 - protein, 20 aa, Mycobacterium
QPAWRNLRFPLTWAPPEADV

SEQ ID NO: 366536 - protein, 24 aa, Mycobacterium
QPDNYLVWSILVTLFCCLPLGIVA

SEQ ID NO: 366537 - protein, 24 aa, Mycobacterium
QPDRTRFRPFLPRLKQLIVEVVAH

SEQ ID NO: 366538 - protein, 18 aa, Mycobacterium
QPDYGAPAGWHAPGWPPH

SEQ ID NO: 366539 - protein, 26 aa, Mycobacterium
QPELRESLALRWIMSGASPVPPSLIK

SEQ ID NO: 366540 - protein, 20 aa, Mycobacterium
QPERLLSWATAIRYQALFTE

SEQ ID NO: 366541 - protein, 32 aa, Mycobacterium
QPFEWREFIWNGWFLMRVSLLPTIAVSIPETV

SEQ ID NO: 366542 - protein, 18 aa, Mycobacterium
QPFLGRWLLLTAVMFALS

SEQ ID NO: 366543 - protein, 30 aa, Mycobacterium
QPFPSPADFFYLVFTILAVLSVLTMARYGA

SEQ ID NO: 366544 - protein, 41 aa, Mycobacterium
QPGILSLFWEGILLLLQVPGELLALLLAGQFLPALVLALIA

SEQ ID NO: 366545 - protein, 18 aa, Mycobacterium
QPGLWIPGSSVSAARLVQ

SEQ ID NO: 366546 - protein, 17 aa, Mycobacterium
QPGPPAPAPPPLAVPQP

SEQ ID NO: 366547 - protein, 20 aa, Mycobacterium
QPGYIWAWIVSGLMAAYVMV

SEQ ID NO: 366548 - protein, 21 aa, Mycobacterium
QPGYPPPFPPPYYPDYSAPRS

SEQ ID NO: 366549 - protein, 26 aa, Mycobacterium
QPGYPPPFPPPYYPEYSRPGGYYGPA

SEQ ID NO: 366550 - protein, 23 aa, Mycobacterium
QPHPFWIAMLVVEIVIPALFFAI

SEQ ID NO: 366551 - protein, 24 aa, Mycobacterium
QPHQPWVAPVAPKAPWIPQSAFGG

SEQ ID NO: 366552 - protein, 20 aa, Mycobacterium
QPHQSVWTMALRFGGFAVVV

SEQ ID NO: 366553 - protein, 17 aa, Mycobacterium
QPIPKYHRLGFRELVKI

SEQ ID NO: 366554 - protein, 20 aa, Mycobacterium
QPKRRLRLLLTVAAVVLFLD

SEQ ID NO: 366555 - protein, 27 aa, Mycobacterium
QPLLTLIWAVLLLDERFSPAVPLTAAV

SEQ ID NO: 366556 - protein, 24 aa, Mycobacterium
QPLMAPMIGLIIAVIWGLSTDYEV

SEQ ID NO: 366557 - protein, 32 aa, Mycobacterium
QPLTTAFAFLLLPQIIFYGLSSVFMAILNTRN

SEQ ID NO: 366558 - protein, 26 aa, Mycobacterium
QPMLSSMVLVIWLLLGVIAVRLFGFT

SEQ ID NO: 366559 - protein, 26 aa, Mycobacterium
QPMTDPFWQHYALMELARVLPGQPQA

SEQ ID NO: 366560 - protein, 35 aa, Mycobacterium
QPNPDARPRLILGATLIALSVLGLRHLWSGSPEDP

SEQ ID NO: 366561 - protein, 30 aa, Mycobacterium
QPPFGTWYAAMLFAVVPLRNILPGSPPAGA

SEQ ID NO: 366562 - protein, 19 aa, Mycobacterium
QPPMQWKPITNARISRDAA

SEQ ID NO: 366563 - protein, 17 aa, Mycobacterium
QPPPCLTGFIPAEQWRS

SEQ ID NO: 366564 - protein, 38 aa, Mycobacterium
QPPQQPPPPMPPPPQTPPPGPQFPWLPPQQAPPQQAPA

SEQ ID NO: 366565 - protein, 21 aa, Mycobacterium
QPQALLGLAARADVLLDCFRP

SEQ ID NO: 366566 - protein, 19 aa, Mycobacterium
QPQNAGPPPMFPWMAPAPQ

SEQ ID NO: 366567 - protein, 21 aa, Mycobacterium
QPQPLLDIVLLDEISAYPETR

SEQ ID NO: 366568 - protein, 31 aa, Mycobacterium
QPQPQPVAPYWYPYWQQWAPVAPAPAAAPPR

SEQ ID NO: 366569 - protein, 20 aa, Mycobacterium
QPQYPPQYPQQYPQNPQYPQ

SEQ ID NO: 366570 - protein, 18 aa, Mycobacterium
QPRERKRMSWQRWALLFV

SEQ ID NO: 366571 - protein, 23 aa, Mycobacterium
QPRGWRFWHRPRRQLQTQVVLDW

SEQ ID NO: 366572 - protein, 17 aa, Mycobacterium
QPRPLVPAMFSGVLSRL

SEQ ID NO: 366573 - protein, 21 aa, Mycobacterium
QPRPNRDAFLPFQSGRPFAAA

SEQ ID NO: 366574 - protein, 17 aa, Mycobacterium
QPRWVTRLGLAVGVALT

SEQ ID NO: 366575 - protein, 24 aa, Mycobacterium
QPSAFLWPRSLQARATRRALLLTA

SEQ ID NO: 366576 - protein, 29 aa, Mycobacterium
QPTIWVIPRPWYLAWAGLIYIVATVATLA

SEQ ID NO: 366577 - protein, 25 aa, Mycobacterium
QPTLEIAPGITIPWGPPTTVPVGPP

SEQ ID NO: 366578 - protein, 30 aa, Mycobacterium
QPTRWRHLPAILMVCSLVLFTIAMAGPTHD

SEQ ID NO: 366579 - protein, 23 aa, Mycobacterium
QPVFGFIFPIVFPVVLVIFVRSM

SEQ ID NO: 366580 - protein, 23 aa, Mycobacterium
QPVFGFIFPIVFPVVLVVFVRSM

SEQ ID NO: 366581 - protein, 27 aa, Mycobacterium
QPVGYLALFGMLLRDTRWWLGGLGDIA

SEQ ID NO: 366582 - protein, 26 aa, Mycobacterium
QPVHQFLLIYRNFMPGWLALALAVIL

SEQ ID NO: 366583 - protein, 17 aa, Mycobacterium
QPVLVGMQLALTELWRA

SEQ ID NO: 366584 - protein, 26 aa, Mycobacterium
QPVSIFLPTYLVLSAGVFMAFLAGDL

SEQ ID NO: 366585 - protein, 19 aa, Mycobacterium
QPWEPYFLGNPVYAFLLMV

SEQ ID NO: 366586 - protein, 27 aa, Mycobacterium
QPWTQWLTWPFQAVPVFFLVAGYAGAV

SEQ ID NO: 366587 - protein, 20 aa, Mycobacterium
QPYASFLYNTEGLPYFSIGM

SEQ ID NO: 366588 - protein, 24 aa, Mycobacterium
QQAIAIAIVLLINTAIGYATERRA

SEQ ID NO: 366589 - protein, 28 aa, Mycobacterium
QQAMAVTWQGNPIVLGGWRAAGAQKVAS

SEQ ID NO: 366590 - protein, 21 aa, Mycobacterium
QQAQLFIVDYRRTLLGVVETE

SEQ ID NO: 366591 - protein, 28 aa, Mycobacterium
QQCMDLIFTIGGYLLLALAVNTFGVQDE

SEQ ID NO: 366592 - protein, 19 aa, Mycobacterium
QQFGFIAGPLLAGVLLKWV

SEQ ID NO: 366593 - protein, 29 aa, Mycobacterium
QQFLDWIDELLYRLAYEGSTVPGGWFTIS

SEQ ID NO: 366594 - protein, 20 aa, Mycobacterium
QQGAPINALALAKVMAVPMA

SEQ ID NO: 366595 - protein, 18 aa, Mycobacterium
QQGKNFYYFPDQLSIDRY

SEQ ID NO: 366596 - protein, 24 aa, Mycobacterium
QQGKNFYYFPDQLSIDRYIGPDGN

SEQ ID NO: 366597 - protein, 26 aa, Mycobacterium
QQGVRWARRLAWISLAVLVTEGAVGV

SEQ ID NO: 366598 - protein, 28 aa, Mycobacterium
QQINPACGCYFDDVYWITFAGIATTDDP

SEQ ID NO: 366599 - protein, 31 aa, Mycobacterium
QQINPACGCYFDNVYWITFAGLATVDNPRYV

SEQ ID NO: 366600 - protein, 33 aa, Mycobacterium; identical to SEQ ID NO: 22666

SEQ ID NO: 366601 - protein, 18 aa, Mycobacterium
QQITLVVVYVLAAAGALL

SEQ ID NO: 366602 - protein, 17 aa, Mycobacterium
QQLLQGYQRPQVRLFTG

SEQ ID NO: 366603 - protein, 24 aa, Mycobacterium
QQLVGINVIFYYSNVLWQAVGFGE

SEQ ID NO: 366604 - protein, 21 aa, Mycobacterium
QQPNHWYPPPQAPQQPYWPQP

SEQ ID NO: 366605 - protein, 23 aa, Mycobacterium
QQPNPCVYTPGGPPPAVYLPQSG

SEQ ID NO: 366606 - protein, 25 aa, Mycobacterium
QQPPQQQGYWYPGPPQQQGWQGNAP

SEQ ID NO: 366607 - protein, 18 aa, Mycobacterium
QQPPYYPAAAAPAAGSPP

SEQ ID NO: 366608 - protein, 19 aa, Mycobacterium
QQPVLYPRGTLAMANAGPG

SEQ ID NO: 366609 - protein, 24 aa, Mycobacterium
QQRGLDLPLVWQLSRGAGQTVAVI

SEQ ID NO: 366610 - protein, 17 aa, Mycobacterium
QQSALIVAYALAALWAL

SEQ ID NO: 366611 - protein, 20 aa, Mycobacterium
QQVGFTLSAPLRSLTKPSLS

SEQ ID NO: 366612 - protein, 27 aa, Mycobacterium
QQVMRRPWLSALGASIFLLALAAPSLQ

SEQ ID NO: 366613 - protein, 26 aa, Mycobacterium
QQVQTIVSPAWYSPLVLTVGSIAPNG

SEQ ID NO: 366614 - protein, 37 aa, Mycobacterium
QQYGDAPVFLRSKPVWYTVSGVLLLLTVGGWVTFMVR

SEQ ID NO: 366615 - protein, 23 aa, Mycobacterium
QRAAVRAVPLWGALKGAPHLLIG

SEQ ID NO: 366616 - protein, 23 aa, Mycobacterium
QRALGAALWYAATVKDAVIVAAA

SEQ ID NO: 366617 - protein, 25 aa, Mycobacterium
QRARVPMPIVPVSSLLRSHAVTSND

SEQ ID NO: 366618 - protein, 20 aa, Mycobacterium
QRATEMLAARSARLDAIPGP

SEQ ID NO: 366619 - protein, 18 aa, Mycobacterium
QRAWQDPRFQRAAGLYFG

SEQ ID NO: 366620 - protein, 18 aa, Mycobacterium
QRCFANRFQSWLPALKEM

SEQ ID NO: 366621 - protein, 20 aa, Mycobacterium
QRCLHLAPLWAGVAFLPFSA

SEQ ID NO: 366622 - protein, 24 aa, Mycobacterium
QRDLLMMEGLAIPLSFLVLVWVFG

SEQ ID NO: 366623 - protein, 32 aa, Mycobacterium
QRDSRAPLFSAALLCLVAIAAVLATAPVALRH

SEQ ID NO: 366624 - protein, 23 aa, Mycobacterium
QREPLLILAYAVLFVPMAIGSIR

SEQ ID NO: 366625 - protein, 37 aa, Mycobacterium
QREVLPLAVPVILASALFGGGLLPLVGTWGFDQISWL

SEQ ID NO: 366626 - protein, 27 aa, Mycobacterium
QRFQKQVFDFLFSLAALIGTAPILIAA

SEQ ID NO: 366627 - protein, 18 aa, Mycobacterium
QRFRIQLPAGWAPEHDPA

SEQ ID NO: 366628 - protein, 18 aa, Mycobacterium
QRFWRITIPMLRPTTFFV

SEQ ID NO: 366629 - protein, 18 aa, Mycobacterium
QRFWRITLPMLRPTTFFV

SEQ ID NO: 366630 - protein, 24 aa, Mycobacterium
QRGVAVSFWLTAPYIAAESIRELV

SEQ ID NO: 366631 - protein, 28 aa, Mycobacterium
QRGVIARLLALPPLVWLGTISYGVYLWH

SEQ ID NO: 366632 - protein, 19 aa, Mycobacterium
QRHLIPFPSRPAPSTGDLV

SEQ ID NO: 366633 - protein, 17 aa, Mycobacterium
QRHWAYALTYYWGLVLS

SEQ ID NO: 366634 - protein, 18 aa, Mycobacterium
QRILAWVAAGALASVVAL

SEQ ID NO: 366635 - protein, 27 aa, Mycobacterium
QRITRYYPTWLPSRRFIAAVIAIGGMQ

SEQ ID NO: 366636 - protein, 20 aa, Mycobacterium
QRIWGASPLVASWQLVMSGV

SEQ ID NO: 366637 - protein, 25 aa, Mycobacterium
QRKLAVFFIFAMLLGGALQLTNAYG

SEQ ID NO: 366638 - protein, 23 aa, Mycobacterium
QRKMLWIIAGIFIVLFTAGLGVI

SEQ ID NO: 366639 - protein, 31 aa, Mycobacterium
QRLADRAAGWLFWFALGTAAITAAAWSIVGD

SEQ ID NO: 366640 - protein, 31 aa, Mycobacterium
QRLADRAAGWLFWFALGTAAITAVAWSIVGD

SEQ ID NO: 366641 - protein, 17 aa, Mycobacterium
QRLFVAQWTSIGRLNAH

SEQ ID NO: 366642 - protein, 36 aa, Mycobacterium
QRLGKPYMWWAAALVPLYWMLQSIAALKAVFQLVTR

SEQ ID NO: 366643 - protein, 25 aa, Mycobacterium
QRLGRPVAVKLLYPSVSTQPDTRRR

SEQ ID NO: 366644 - protein, 27 aa, Mycobacterium
QRLKKPILVWWIAWVVSTATSLFAIAT

SEQ ID NO: 366645 - protein, 18 aa, Mycobacterium
QRLLSRLDALGLAAASTA

SEQ ID NO: 366646 - protein, 26 aa, Mycobacterium
QRLRRPIVVWWITWAVSNAVSLFAIA

SEQ ID NO: 366647 - protein, 20 aa, Mycobacterium
QRLTIARALLADTPILILDE

SEQ ID NO: 366648 - protein, 18 aa, Mycobacterium
QRNPWPIVAGAAALVVVL

SEQ ID NO: 366649 - protein, 33 aa, Mycobacterium
QRPDKTLVRFIPLLILIAIGVLILSLIVFGLIF

SEQ ID NO: 366650 - protein, 22 aa, Mycobacterium
QRPLLGAVLTRLAGRGAPAHRV

SEQ ID NO: 366651 - protein, 25 aa, Mycobacterium
QRPNLRFRIVSAWRALRPTLASTAS

SEQ ID NO: 366652 - protein, 20 aa, Mycobacterium
QRPRAWRMRITVQQVGDEAK

SEQ ID NO: 366653 - protein, 18 aa, Mycobacterium
QRPRLAQLLFLVVAVFLL

SEQ ID NO: 366654 - protein, 24 aa, Mycobacterium
QRPWTPLIGILSQAADLGLRVIVT

SEQ ID NO: 366655 - protein, 24 aa, Mycobacterium
QRQFEWLLSALRLADLFLPHGIWL

SEQ ID NO: 366656 - protein, 18 aa, Mycobacterium
QRQHWFTVGYQTGDPKKC

SEQ ID NO: 366657 - protein, 23 aa, Mycobacterium
QRQLRDRSWWHGPEIYVVIDDYD

SEQ ID NO: 366658 - protein, 23 aa, Mycobacterium
QRQRLTIARLLLGRSRVVVLDEA

SEQ ID NO: 366659 - protein, 18 aa, Mycobacterium
QRQWAFELTYYWGLTLSA

SEQ ID NO: 366660 - protein, 34 aa, Mycobacterium
QRRAARPGVLISTLLGLALLVAGGVFAGAKLTRD

SEQ ID NO: 366661 - protein, 19 aa, Mycobacterium
QRRELLTRVIVSAATADRE

SEQ ID NO: 366662 - protein, 21 aa, Mycobacterium
QRRGKRPLIIAGVAVAVLAGG

SEQ ID NO: 366663 - protein, 20 aa, Mycobacterium
QRRILLADFGVARHLGDISG

SEQ ID NO: 366664 - protein, 18 aa, Mycobacterium
QRRLSIAVITLGLAGTVI

SEQ ID NO: 366665 - protein, 18 aa, Mycobacterium
QRRRFWEVPGADGPADAT

SEQ ID NO: 366666 - protein, 17 aa, Mycobacterium
QRSLIMRALTGAPVEPT

SEQ ID NO: 366667 - protein, 18 aa, Mycobacterium
QRTILPDAQLLYEETANR

SEQ ID NO: 366668 - protein, 22 aa, Mycobacterium
QRTLLYLLVTVLSAALLVGSVM

SEQ ID NO: 366669 - protein, 26 aa, Mycobacterium
QRTLRTDLWWWAPLVTNIGFLAFIVY

SEQ ID NO: 366670 - protein, 33 aa, Mycobacterium
QRVADTAAGWLFWFALAAAIITAVTWTALGHPD

SEQ ID NO: 366671 - protein, 25 aa, Mycobacterium
QRVDLRPMWGIDERLKRFGTMAAAM

SEQ ID NO: 366672 - protein, 18 aa, Mycobacterium
QRVLAIHLPNGSSLLISK

SEQ ID NO: 366673 - protein, 23 aa, Mycobacterium
QRWCWGLLIMLASVGLQAAALGE

SEQ ID NO: 366674 - protein, 17 aa, Mycobacterium
QRWTGVDLTLDVSGNVG

SEQ ID NO: 366675 - protein, 19 aa, Mycobacterium
QRWTLARALLADPAVLVLH

SEQ ID NO: 366676 - protein, 20 aa, Mycobacterium
QRYHWIAGTFEPIPFDAGAA

SEQ ID NO: 366677 - protein, 21 aa, Mycobacterium
QRYWLLIVACLDVSLVISSMV

SEQ ID NO: 366678 - protein, 26 aa, Mycobacterium
QSATTFPWVFLFPAGVLVLILVCANL

SEQ ID NO: 366679 - protein, 26 aa, Mycobacterium
QSATTFPWVFLFPAGVLVLILVCANV

SEQ ID NO: 366680 - protein, 26 aa, Mycobacterium
QSATTYPWVFLFPAGVLVLILVCANL

SEQ ID NO: 366681 - protein, 28 aa, Mycobacterium
QSAVSRRGMWAIPLAVIGAVGIAGAVLA

SEQ ID NO: 366682 - protein, 23 aa, Mycobacterium
QSDNEAQLLDWIHAAADASEPVI

SEQ ID NO: 366683 - protein, 18 aa, Mycobacterium
QSERCRLRWMPMTAATDD

SEQ ID NO: 366684 - protein, 19 aa, Mycobacterium
QSGQWIPVAIGVAIALVVS

SEQ ID NO: 366685 - protein, 24 aa, Mycobacterium
QSGTAVQFPLLLAAAAMAVILMGP

SEQ ID NO: 366686 - protein, 18 aa, Mycobacterium
QSGYAMRVGLRKSGGAWT

SEQ ID NO: 366687 - protein, 31 aa, Mycobacterium
QSHFPVADVLPLTPLQQGLLFHAGIAKSSGD

SEQ ID NO: 366688 - protein, 26 aa, Mycobacterium
QSHFRSGRWLLLVDAVLLIALGVAGL

SEQ ID NO: 366689 - protein, 30 aa, Mycobacterium
QSKFWTRWTGWVMRRPWLSAMAAAAVLLTF

SEQ ID NO: 366690 - protein, 21 aa, Mycobacterium
QSLGPWFPLAFLVAHIVVTVV

SEQ ID NO: 366691 - protein, 24 aa, Mycobacterium
QSLMLVPIFFLIIVSTQLTGADAK

SEQ ID NO: 366692 - protein, 38 aa, Mycobacterium
QSMAMLAGVTLTAVLCLGALFWSFVRPAGSAGQARIVA

SEQ ID NO: 366693 - protein, 25 aa, Mycobacterium
QSNSLQRVFAIIELLRAVAAFMVAP

SEQ ID NO: 366694 - protein, 32 aa, Mycobacterium
QSPIRHLPIAVSLLSLVLLTIALATPTHDMRI

SEQ ID NO: 366695 - protein, 24 aa, Mycobacterium
QSPVFRALWIAQFVSNLGTWMQTV

SEQ ID NO: 366696 - protein, 25 aa, Mycobacterium
QSQYLTGPLLDRLAAAPGDLLLVEP

SEQ ID NO: 366697 - protein, 17 aa, Mycobacterium
QSRFLRVSPLRKHSIPF

SEQ ID NO: 366698 - protein, 35 aa, Mycobacterium
QSRFWARWVGWVMRRPWITALSASLVLLLMAAPAT

SEQ ID NO: 366699 - protein, 21 aa, Mycobacterium
QSRLMSYLPSGYTSGTCTPTS

SEQ ID NO: 366700 - protein, 35 aa, Mycobacterium
QSRRERRKWWRRVWLAFPLGLVAMASTMFFGAYPW

SEQ ID NO: 366701 - protein, 28 aa, Mycobacterium
QSRSVLMGVLIFITGLVGCFVFSLIRPN

SEQ ID NO: 366702 - protein, 37 aa, Mycobacterium
QSRSVLVGALILVTGLIGCFLFSLIRPAGDVGTDSIL

SEQ ID NO: 366703 - protein, 27 aa, Mycobacterium
QSSPRARLRILPGDRVHAASLAGRFLV

SEQ ID NO: 366704 - protein, 26 aa, Mycobacterium
QSTFAPAVFLWFAGIGGLTVVMSGGV

SEQ ID NO: 366705 - protein, 25 aa, Mycobacterium
QSTLWQWRVLISRLFLRTSIGELFT

SEQ ID NO: 366706 - protein, 34 aa, Mycobacterium
QSTPAFWIGILFILLFAVRLRVLPAAGYGGAAHL

SEQ ID NO: 366707 - protein, 21 aa, Mycobacterium
QSVALVVLLFTSIGLAICIQV

SEQ ID NO: 366708 - protein, 18 aa, Mycobacterium
QSVLALRLTLTKRDGRWL

SEQ ID NO: 366709 - protein, 22 aa, Mycobacterium
QSVLPFNGIDFRLSPGGVALDS

SEQ ID NO: 366710 - protein, 21 aa, Mycobacterium
QSWFVARVAMLPTLLVAIPFT

SEQ ID NO: 366711 - protein, 23 aa, Mycobacterium
QSYAFWDITTFLINGSLWVFVGV

SEQ ID NO: 366712 - protein, 27 aa, Mycobacterium
QSYGYSLLWVLLLLIPVLIVNQEMVVR

SEQ ID NO: 366713 - protein, 22 aa, Mycobacterium
QSYPPYAAPYPDGGPGPVYPGA

SEQ ID NO: 366714 - protein, 20 aa, Mycobacterium
QSYWQHWQPAAPAPPRPFAP

SEQ ID NO: 366715 - protein, 25 aa, Mycobacterium
QTAAAPWYLSLAMLAGLVIVGAVGG

SEQ ID NO: 366716 - protein, 25 aa, Mycobacterium
QTALFVAGVLMIALLGGIARAALSA

SEQ ID NO: 366717 - protein, 21 aa, Mycobacterium
QTALTVLLFTSLAVAIAVQVL

SEQ ID NO: 366718 - protein, 24 aa, Mycobacterium
QTAVRAPFFLLTPEWARIPMVLLA

SEQ ID NO: 366719 - protein, 22 aa, Mycobacterium
QTAYFDTSFFQDVLVKQLHSSN

SEQ ID NO: 366720 - protein, 25 aa, Mycobacterium
QTDLTPLWVDYVNGALTLADGGRRS

SEQ ID NO: 366721 - protein, 24 aa, Mycobacterium
QTDRWRRVLATPPALPAACPELDT

SEQ ID NO: 366722 - protein, 24 aa, Mycobacterium
QTEIFPLTLFAIAGMMLFPACNDL

SEQ ID NO: 366723 - protein, 23 aa, Mycobacterium
QTELFPLLMLSVGGMLVFPASND

SEQ ID NO: 366724 - protein, 25 aa, Mycobacterium
QTEVFPLTMFAIGGMLLFPAADDLL

SEQ ID NO: 366725 - protein, 25 aa, Mycobacterium
QTFVSLPFLVISLQGALTTTGQRYD

SEQ ID NO: 366726 - protein, 17 aa, Mycobacterium
QTGGAVMLWVIAAGLVA

SEQ ID NO: 366727 - protein, 25 aa, Mycobacterium
QTGNLVTWWTGDALLVFNTGKLTQR

SEQ ID NO: 366728 - protein, 25 aa, Mycobacterium
QTGSSFKVFALVAALQQGIGLGYQL

SEQ ID NO: 366729 - protein, 29 aa, Mycobacterium
QTHQAPPAGPPPIGMPPKTAVPQSIPPRD

SEQ ID NO: 366730 - protein, 32 aa, Mycobacterium
QTIFQKATQLGNKWFEEPWKPEVDTPNMRVNL

SEQ ID NO: 366731 - protein, 28 aa, Mycobacterium
QTIGDMAPSVDWWAFRSLCTSAGCVATG

SEQ ID NO: 366732 - protein, 22 aa, Mycobacterium
QTIVPLPWVIQAPRLFAGQIEF

SEQ ID NO: 366733 - protein, 58 aa, Mycobacterium
QTKVLAAPLPPIPPPPVLPSPRHWRTRLILAVLGIVSTLILVLVLALARGSSGLTSPT

SEQ ID NO: 366734 - protein, 27 aa, Mycobacterium
QTLKDYVAFPLLAGPFAPFVFAGNLTA

SEQ ID NO: 366735 - protein, 29 aa, Mycobacterium
QTLQLVFVPFFFVVLLGIPLGVLLYVTAP

SEQ ID NO: 366736 - protein, 24 aa, Mycobacterium
QTLRLKVELPFIGLYVHTGGVAVD

SEQ ID NO: 366737 - protein, 22 aa, Mycobacterium
QTLRYFPDLVVVLALLAAVALC

SEQ ID NO: 366738 - protein, 21 aa, Mycobacterium
QTLRYLPDLVVVLALLGAVAC

SEQ ID NO: 366739 - protein, 33 aa, Mycobacterium
QTLSMGVILLGLLWYAGLPLRVFLTSLGAVLVS

SEQ ID NO: 366740 - protein, 26 aa, Mycobacterium
QTLTHIIIPAIRRPLLTGIRLAVSLA

SEQ ID NO: 366741 - protein, 17 aa, Mycobacterium
QTPRFMPDPQPMRTPGA

SEQ ID NO: 366742 - protein, 28 aa, Mycobacterium
QTPVVSHFFGCTPLGPVAWTGVFGATAG

SEQ ID NO: 366743 - protein, 25 aa, Mycobacterium
QTQQPPIISIPGLPPIGGGDSDRGS

SEQ ID NO: 366744 - protein, 26 aa, Mycobacterium
QTQSFILITLVLLPLGVLAFGARDRP

SEQ ID NO: 366745 - protein, 20 aa, Mycobacterium
QTRAVWRLANFLLEGLVFLL

SEQ ID NO: 366746 - protein, 33 aa, Mycobacterium
QTRAVWRLVNFLLEGLVFLLIGHQLPAILDDLG

SEQ ID NO: 366747 - protein, 23 aa, Mycobacterium
QTTDAIRLWARSLAGFTGQVVTN

SEQ ID NO: 366748 - protein, 21 aa, Mycobacterium
QTVLVTLFFFGIATASLIYAR

SEQ ID NO: 366749 - protein, 29 aa, Mycobacterium
QTVSLGIILLGLLWYAGLPLKVFVSSLFA

SEQ ID NO: 366750 - protein, 26 aa, Mycobacterium
QTVSLVFFWDALLAWSIVVIAGLLRI

SEQ ID NO: 366751 - protein, 19 aa, Mycobacterium
QTWTSYNFFAFWMSDVHSV

SEQ ID NO: 366752 - protein, 28 aa, Mycobacterium
QVAAVLVAAWLLSIPMQSSNQPNISAAA

SEQ ID NO: 366753 - protein, 19 aa, Mycobacterium
QVADRLRLALRSPFMVQGS

SEQ ID NO: 366754 - protein, 24 aa, Mycobacterium
QVAGWTLFTLAVACAVLSLPSLPG

SEQ ID NO: 366755 - protein, 22 aa, Mycobacterium
QVAIVAIAGVLLFGGAKVLGQL

SEQ ID NO: 366756 - protein, 18 aa, Mycobacterium
QVALRFLVSPDGTAARFI

SEQ ID NO: 366757 - protein, 17 aa, Mycobacterium
QVALVLAICYLIPLVRP

SEQ ID NO: 366758 - protein, 26 aa, Mycobacterium
QVAMFAVLGWFYLSVLPGWLHLTQTT

SEQ ID NO: 366759 - protein, 18 aa, Mycobacterium
QVASILLTLAFTVALVNS

SEQ ID NO: 366760 - protein, 21 aa, Mycobacterium
QVATMMLLVTGLFLALRPLEN

SEQ ID NO: 366761 - protein, 24 aa, Mycobacterium
QVDDLLACLYGLHALLRLHFLQEE

SEQ ID NO: 366762 - protein, 31 aa, Mycobacterium
QVDDLLACLYGLHALLRLHFVQEEESYFTLA

SEQ ID NO: 366763 - protein, 26 aa, Mycobacterium
QVEDIWAMSPLQLGVYYQSTLADAGP

SEQ ID NO: 366764 - protein, 24 aa, Mycobacterium
QVEEAALLGILFSIAEGLEHYAVT

SEQ ID NO: 366765 - protein, 25 aa, Mycobacterium
QVELFSDRRFGLAQTPFAATLSASH

SEQ ID NO: 366766 - protein, 30 aa, Mycobacterium
QVELPTYPFQHHRYWLTPRSGTDAAGLGLD

SEQ ID NO: 366767 - protein, 46 aa, Mycobacterium
QVETVHRPRWSWRRMALVATLVVLLVVAGLFISRAVIRNNYYVAEF

SEQ ID NO: 366768 - protein, 24 aa, Mycobacterium
QVFMFAVLGWFYLSVLPGWLGLEQ

SEQ ID NO: 366769 - protein, 24 aa, Mycobacterium
QVGEAAMLAFLFSISEGLEEYAVA

SEQ ID NO: 366770 - protein, 24 aa, Mycobacterium
QVGEAAMLGFLFSISEGLEEYAVS

SEQ ID NO: 366771 - protein, 37 aa, Mycobacterium
QVGHLELFWLSLRDSRWWLGALGAIANYLLQAAALTL

SEQ ID NO: 366772 - protein, 26 aa, Mycobacterium
QVGHLRLFGLSLRDGRWWLGGAAAVL

SEQ ID NO: 366773 - protein, 40 aa, Mycobacterium
QVGKVEFAGFFAWLAWLVLHLYYLIGHRNRLAAMFAWGIS

SEQ ID NO: 366774 - protein, 26 aa, Mycobacterium
QVGLPTYAFARRRFWLDGSASAADVG

SEQ ID NO: 366775 - protein, 20 aa, Mycobacterium
QVGRPRKYFGDTLVAVTGAG

SEQ ID NO: 366776 - protein, 18 aa, Mycobacterium
QVGSLIAFLSYFMQILMS

SEQ ID NO: 366777 - protein, 20 aa, Mycobacterium
QVHIAWLVPLIGVDFDIGRL

SEQ ID NO: 366778 - protein, 25 aa, Mycobacterium
QVIASQWLVIVDPRTGAELPEGEIG

SEQ ID NO: 366779 - protein, 23 aa, Mycobacterium
QVKPTLPVLLANLVTVGQIGVTY

SEQ ID NO: 366780 - protein, 24 aa, Mycobacterium
QVLAALLYGLRVGVMTPMGFLRDP

SEQ ID NO: 366781 - protein, 25 aa, Mycobacterium
QVLALAVWAAISWARGKRLRAGLAA

SEQ ID NO: 366782 - protein, 22 aa, Mycobacterium
QVLAVLTTPPDFGPLADPARRT

SEQ ID NO: 366783 - protein, 19 aa, Mycobacterium
QVLGWLLIALGSPSLRVEI

SEQ ID NO: 366784 - protein, 35 aa, Mycobacterium
QVLKDYVIFPALTGPLFPITFLGNMSANFVRNLWT

SEQ ID NO: 366785 - protein, 25 aa, Mycobacterium
QVLMFAALGWFYLSVLPGWLGLSQT

SEQ ID NO: 366786 - protein, 19 aa, Mycobacterium
QVLRLLVMNIAAIIGSKLL

SEQ ID NO: 366787 - protein, 26 aa, Mycobacterium
QVLRVLLMLFAAPLLARVMIRLTGRQ

SEQ ID NO: 366788 - protein, 24 aa, Mycobacterium
QVLTADPMIAWRYLDLRGDDLTPD

SEQ ID NO: 366789 - protein, 31 aa, Mycobacterium
QVLWTAIGLVAFYFALRIRVATLRKLAFPGF

SEQ ID NO: 366790 - protein, 23 aa, Mycobacterium
QVMHHRTVWTVIAILALFGWPQI

SEQ ID NO: 366791 - protein, 25 aa, Mycobacterium
QVNEVAPPWLKTVPKRLSALLNTSG

SEQ ID NO: 366792 - protein, 27 aa, Mycobacterium
QVNEVAPPWLKTVPKRLSALLNTSGLP

SEQ ID NO: 366793 - protein, 24 aa, Mycobacterium
QVNRGPVLLLLFASVVAAIGNGVS

SEQ ID NO: 366794 - protein, 32 aa, Mycobacterium
QVPGRYQYLKWWKLLLVILGVWFGAAEVGLSL

SEQ ID NO: 366795 - protein, 20 aa, Mycobacterium
QVPIMVGCGFLLGVTGQMVK

SEQ ID NO: 366796 - protein, 19 aa, Mycobacterium
QVPIPFRTVFRHRAYKAAL

SEQ ID NO: 366797 - protein, 18 aa, Mycobacterium
QVPQVPQVPQWPGAGSGS

SEQ ID NO: 366798 - protein, 34 aa, Mycobacterium
QVPTDLWLGVYWTILCAILIYLLAYGARAILILR

SEQ ID NO: 366799 - protein, 19 aa, Mycobacterium
QVQIPALPPYEPPKPVPVQ

SEQ ID NO: 366800 - protein, 17 aa, Mycobacterium
QVRGWRRVGTAIVRWPL

SEQ ID NO: 366801 - protein, 30 aa, Mycobacterium
QVRISRFRTLLLKWGLMTVLALLTSAVYLA

SEQ ID NO: 366802 - protein, 18 aa, Mycobacterium
QVRRGEVIAGRRGFALDL

SEQ ID NO: 366803 - protein, 30 aa, Mycobacterium
QVSDALLTRLWPVPLLGVVVAIAAGLTVPA

SEQ ID NO: 366804 - protein, 67 aa, Mycobacterium
QVSERKYRFRKRVLALFALILVASAAAAFLVTPTAWWVCGTTATLTVLYLAYLRRQTRIEEQLRRRR

SEQ ID NO: 366805 - protein, 26 aa, Mycobacterium
QVTAAALMFHRLFNPVGELMYNFDEI

SEQ ID NO: 366806 - protein, 20 aa, Mycobacterium
QVTALLFALPIYARVTRRRV

SEQ ID NO: 366807 - protein, 23 aa, Mycobacterium
QVTGWRFVMRRIASGIALHDTRM

SEQ ID NO: 366808 - protein, 22 aa, Mycobacterium
QVTGWRFVMRRIASGVALHDAR

SEQ ID NO: 366809 - protein, 19 aa, Mycobacterium
QVTGYKFLVNRLTHALTRH

SEQ ID NO: 366810 - protein, 20 aa, Mycobacterium
QVTVWLTWPFHAAGALAGFG

SEQ ID NO: 366811 - protein, 26 aa, Mycobacterium
QVVEGVGLWLLKRWGEYFAVVATSLF

SEQ ID NO: 366812 - protein, 25 aa, Mycobacterium
QVVEGVGLWLLKRWGEYFAVVATSV

SEQ ID NO: 366813 - protein, 25 aa, Mycobacterium
QVVIRLAVCWLLSRHGLAAGIGDVG

SEQ ID NO: 366814 - protein, 18 aa, Mycobacterium
QVVLGTDFMAVNPPSPSG

SEQ ID NO: 366815 - protein, 17 aa, Mycobacterium
QVVLLRAMTFMIVASPC

SEQ ID NO: 366816 - protein, 25 aa, Mycobacterium
QVVLQLWSFLALVLDSLAIAAQSLV

SEQ ID NO: 366817 - protein, 25 aa, Mycobacterium
QVVMFAALGWFYLSVLPGWLGLPQT

SEQ ID NO: 366818 - protein, 19 aa, Mycobacterium
QVVQVVLGPDFKSVATPQP

SEQ ID NO: 366819 - protein, 17 aa, Mycobacterium
QVWAFITPGLYAKERRF

SEQ ID NO: 366820 - protein, 17 aa, Mycobacterium
QVWLVDPRRQLLTALGS

SEQ ID NO: 366821 - protein, 28 aa, Mycobacterium
QVWTTPLWLVMMVIPFVYLLVRHPDSIG

SEQ ID NO: 366822 - protein, 17 aa, Mycobacterium
QVYEAMRDIWKFVPAGT

SEQ ID NO: 366823 - protein, 23 aa, Mycobacterium
QWALTRRLYWAVRHDPLTGLPNR

SEQ ID NO: 366824 - protein, 18 aa, Mycobacterium
QWDRLRWQLPASLAGATL

SEQ ID NO: 366825 - protein, 39 aa, Mycobacterium
QWEYLDLPRLWQVLLIVGMFLWIAIIWRGIRGRLKTESK

SEQ ID NO: 366826 - protein, 39 aa, Mycobacterium
QWGQQFWRVNAPFFWGRGTWRTWALLAFVMWHTVYMARV

SEQ ID NO: 366827 - protein, 23 aa, Mycobacterium
QWGYRMVLPQLILMPVLYVVQEM

SEQ ID NO: 366828 - protein, 19 aa, Mycobacterium
QWISQWIMGLNLGMLPTLL

SEQ ID NO: 366829 - protein, 29 aa, Mycobacterium
QWIVHDLRIPRTVLGLLVGLALGLSGTLI

SEQ ID NO: 366830 - protein, 18 aa, Mycobacterium
QWIYWVDLTVCVAVGYTA

SEQ ID NO: 366831 - protein, 19 aa, Mycobacterium
QWKRLRWQIPASLIGAIIG

SEQ ID NO: 366832 - protein, 27 aa, Mycobacterium
QWLASLIGLLYLIWNYGYRQGTTGSSV

SEQ ID NO: 366833 - protein, 17 aa, Mycobacterium
QWLIVARFLLGVAEAGF

SEQ ID NO: 366834 - protein, 28 aa, Mycobacterium
QWPALVMFLIIFFWTPPHTWALAMRYKD

SEQ ID NO: 366835 - protein, 17 aa, Mycobacterium
QWPILVVSAVFLAALGL

SEQ ID NO: 366836 - protein, 22 aa, Mycobacterium
QWPIYEGLMWGGVQAALCCLRF

SEQ ID NO: 366837 - protein, 21 aa, Mycobacterium
QWPLFAGFCFYAYFKFVRYEE

SEQ ID NO: 366838 - protein, 18 aa, Mycobacterium
QWPSFIRVSGELPRTATF

SEQ ID NO: 366839 - protein, 21 aa, Mycobacterium
QWPVYEGLMWGGVQAALCCLR

SEQ ID NO: 366840 - protein, 21 aa, Mycobacterium
QWRIRRWWWKTVPWETGFATL

SEQ ID NO: 366841 - protein, 19 aa, Mycobacterium
QWRKRRLFIAVLSTGLIFG

SEQ ID NO: 366842 - protein, 18 aa, Mycobacterium
QWRRLPLVPATIVGWGGL

SEQ ID NO: 366843 - protein, 24 aa, Mycobacterium
QWRTEGAIILHVLLDGQVAAALRL

SEQ ID NO: 366844 - protein, 17 aa, Mycobacterium
QWSPRWVDHLVGDRIHR

SEQ ID NO: 366845 - protein, 26 aa, Mycobacterium
QYALAATAFHLLAGVPPFDHSNRAVV

SEQ ID NO: 366846 - protein, 45 aa, Mycobacterium
QYEEPRRNPLSRWLVGLAALVVLTIIVTFAIILGNGPSRDVQVPD

SEQ ID NO: 366847 - protein, 17 aa, Mycobacterium
QYFLLSPTLIVFGIAVV

SEQ ID NO: 366848 - protein, 17 aa, Mycobacterium
QYGLGAVASPLVGLAGE

SEQ ID NO: 366849 - protein, 25 aa, Mycobacterium
QYGPPPVYPTYGPPPGYPPPPGHGV

SEQ ID NO: 366850 - protein, 19 aa, Mycobacterium
QYIGLHRGAVGARTRWNLD

SEQ ID NO: 366851 - protein, 23 aa, Mycobacterium
QYLAPIMDAIKFNYLPFGMNLAS

SEQ ID NO: 366852 - protein, 25 aa, Mycobacterium
QYLDKLLVNLFGWHLPHAISAAPWD

SEQ ID NO: 366853 - protein, 17 aa, Mycobacterium
QYLSFAWAFGISGGMLL

SEQ ID NO: 366854 - protein, 26 aa, Mycobacterium
QYLTPLIVLQAIWFAAISAAFRSATD

SEQ ID NO: 366855 - protein, 23 aa, Mycobacterium
QYPSALRITIVERVPLVVKDFPD

SEQ ID NO: 366856 - protein, 24 aa, Mycobacterium
QYPSALRITIVERVPLVVKDFPDG

SEQ ID NO: 366857 - protein, 42 aa, Mycobacterium
QYPYPPTGPYQYPPPPYPPPGQPFPPGPYPQGPPPGGPGSKL

SEQ ID NO: 366858 - protein, 24 aa, Mycobacterium
QYQTAHVPYLSWLHETSAVSAGVA

SEQ ID NO: 366859 - protein, 18 aa, Mycobacterium
QYQYFVFPLVFGWLGCKL

SEQ ID NO: 366860 - protein, 20 aa, Mycobacterium
QYTARFLQAAALKAGNPVTV

SEQ ID NO: 366861 - protein, 18 aa, Mycobacterium
QYYVVLPDGIAAVNATTA

SEQ ID NO: 366862 - protein, 19 aa, Mycobacterium
RAAADAIRLSRRTLNTIKT

SEQ ID NO: 366863 - protein, 18 aa, Mycobacterium
RAAALLPLPGQVGGATTS

SEQ ID NO: 366864 - protein, 35 aa, Mycobacterium
RAAEPILPMRLFRSPVFTVCCVLSFIVGFAMLGAL

SEQ ID NO: 366865 - protein, 23 aa, Mycobacterium
RAAGLAHTGLLLAGLALLGVAAQ

SEQ ID NO: 366866 - protein, 23 aa, Mycobacterium
RAAGLLALVFMWTLHRPGRGHTT

SEQ ID NO: 366867 - protein, 18 aa, Mycobacterium
RAAGVTILAEGLLVMIYL

SEQ ID NO: 366868 - protein, 26 aa, Mycobacterium
RAAIKITTIFGSRYIDLHPTGAGVPP

SEQ ID NO: 366869 - protein, 25 aa, Mycobacterium
RAAIKITTLFGSRYVDLRPAGAGTP

SEQ ID NO: 366870 - protein, 20 aa, Mycobacterium
RAAILAAVVCALTLTVAGPV

SEQ ID NO: 366871 - protein, 20 aa, Mycobacterium
RAAILAAVVCVLTLTIAGPV

SEQ ID NO: 366872 - protein, 17 aa, Mycobacterium
RAAITRPIASLAAACRR

SEQ ID NO: 366873 - protein, 30 aa, Mycobacterium
RAAKIVRRLAVPIVLFWVAIAAVTNATVPQ

SEQ ID NO: 366874 - protein, 22 aa, Mycobacterium
RAALLDAALSQGLTYAQRLAIA

SEQ ID NO: 366875 - protein, 19 aa, Mycobacterium
RAALPPPPTWFAALVLIFA

SEQ ID NO: 366876 - protein, 27 aa, Mycobacterium
RAALRHVWRDRPLLLALLAVSTVGFAS

SEQ ID NO: 366877 - protein, 18 aa, Mycobacterium
RAALTILVLISALFVVAC

SEQ ID NO: 366878 - protein, 21 aa, Mycobacterium
RAAMLWTAIAIWLEPLRSTFD

SEQ ID NO: 366879 - protein, 25 aa, Mycobacterium
RAAPGPYRLPPPRPLHRAGRRPPIS

SEQ ID NO: 366880 - protein, 17 aa, Mycobacterium
RAARILPLLGLAGLAAA

SEQ ID NO: 366881 - protein, 28 aa, Mycobacterium
RAARIPLRWILPRMLIEAPFLVLAVLLP

SEQ ID NO: 366882 - protein, 27 aa, Mycobacterium
RAASIPIILIWVAIAAFLNVSVPQLEE

SEQ ID NO: 366883 - protein, 35 aa, Mycobacterium
RAATDLRRLLPYLLPYRARWVTMVVVAIVSLGATI

SEQ ID NO: 366884 - protein, 23 aa, Mycobacterium
RAATVLVVVLVGALGVALALMGR

SEQ ID NO: 366885 - protein, 33 aa, Mycobacterium
RAAVGGTRWWSPRTWPLRARLVGTQVALLAVVC

SEQ ID NO: 366886 - protein, 24 aa, Mycobacterium
RAAVKFLMYNLFGGLVMLAAVIGL

SEQ ID NO: 366887 - protein, 18 aa, Mycobacterium
RAAYWSEPEPRWPKSEPI

SEQ ID NO: 366888 - protein, 24 aa, Mycobacterium
RADDNFFFYTMLGASAIAYAVCYL

SEQ ID NO: 366889 - protein, 18 aa, Mycobacterium
RADFWFSALGAMASWSVL

SEQ ID NO: 366890 - protein, 22 aa, Mycobacterium
RADIWRRPDLPRDGKAPVLLQV

SEQ ID NO: 366891 - protein, 18 aa, Mycobacterium
RADLARDPSFYLRFRREA

SEQ ID NO: 366892 - protein, 23 aa, Mycobacterium
RADPGLGLLAALTAAIAAAAVAA

SEQ ID NO: 366893 - protein, 24 aa, Mycobacterium
RADQDGYMYFTGRLSSLIKTAGAN

SEQ ID NO: 366894 - protein, 22 aa, Mycobacterium
RADQLLVDRPLRVVVAGQLKQG

SEQ ID NO: 366895 - protein, 25 aa, Mycobacterium
RADQRLLSTAFWYSLTMAIVLMAAV

SEQ ID NO: 366896 - protein, 17 aa, Mycobacterium
RADRLGIPLAELGQYSG

SEQ ID NO: 366897 - protein, 17 aa, Mycobacterium
RADRWLVSLRAGLSSSA

SEQ ID NO: 366898 - protein, 19 aa, Mycobacterium
RADVRIAHPLISRAHLVLR

SEQ ID NO: 366899 - protein, 23 aa, Mycobacterium
RADYLRYLSVVRENLRTHAAAQR

SEQ ID NO: 366900 - protein, 27 aa, Mycobacterium
RADYTRLWAWFLTFLRLCVAGQMLFYG

SEQ ID NO: 366901 - protein, 17 aa, Mycobacterium
RAEEFVRWLKKKKRIDD

SEQ ID NO: 366902 - protein, 25 aa, Mycobacterium
RAEKRLSYLLAQQTPPARKVIVGPD

SEQ ID NO: 366903 - protein, 24 aa, Mycobacterium
RAELDDLLRRPLDGVFTALDDLLS

SEQ ID NO: 366904 - protein, 20 aa, Mycobacterium
RAEMWPGIATPTLWARTAGI

SEQ ID NO: 366905 - protein, 45 aa, Mycobacterium
RAERGVALWLLLGGGFGLALLLIFLFWPWEYKPKAAPGSLLYDLT

SEQ ID NO: 366906 - protein, 44 aa, Mycobacterium
RAERGVALWLLLGGGGFGLALLLIFLFWPWEYKPKEAADSWLYS

SEQ ID NO: 366907 - protein, 43 aa, Mycobacterium
RAERGVAVWLLLGGAFGLALLLVFLFWPWQYKASGESGSFLYS

SEQ ID NO: 366908 - protein, 27 aa, Mycobacterium
RAESRLNRLLALQIPPARKVVTGQDGQ

SEQ ID NO: 366909 - protein, 17 aa, Mycobacterium
RAFLAGPQFLILDEATS

SEQ ID NO: 366910 - protein, 24 aa, Mycobacterium
RAFPGLAVPWLVAGLAVGLALGAV

SEQ ID NO: 366911 - protein, 20 aa, Mycobacterium
RAFQLATLSGPPPSLDAPLM

SEQ ID NO: 366912 - protein, 19 aa, Mycobacterium
RAFSAAPNFAFDLAARKTT

SEQ ID NO: 366913 - protein, 23 aa, Mycobacterium
RAFSRLFPGRRFGGGALAVYQDG

SEQ ID NO: 366914 - protein, 34 aa, Mycobacterium
RAFVVPSIVALLGRWFWWPSRPPRRAMAEAVKTP

SEQ ID NO: 366915 - protein, 25 aa, Mycobacterium
RAGAAYLPLELDLPIDRLRTIIDNA

SEQ ID NO: 366916 - protein, 24 aa, Mycobacterium
RAGDTAYLVGPYRELLATLRKGQP

SEQ ID NO: 366917 - protein, 48 aa, Mycobacterium
RAGGDVVAWSVWVVELLAGMTALGGGIKLIAWGIKPAITAVSVAGKHR

SEQ ID NO: 366918 - protein, 38 aa, Mycobacterium
RAGGRYSVYVWALVAMALARFRLGPLRRVRPDVVVDTQ

SEQ ID NO: 366919 - protein, 19 aa, Mycobacterium
RAGHVSLLQVTWIYDRAVD

SEQ ID NO: 366920 - protein, 18 aa, Mycobacterium
RAGLFYVPLAVVAAVCAF

SEQ ID NO: 366921 - protein, 18 aa, Mycobacterium
RAGLLPRLRREDRRFVVM

SEQ ID NO: 366922 - protein, 21 aa, Mycobacterium
RAGLLVWGGWLAVTGVVFSFM

SEQ ID NO: 366923 - protein, 18 aa, Mycobacterium
RAGLRPVGRLTEAAERVA

SEQ ID NO: 366924 - protein, 23 aa, Mycobacterium
RAGLTAARFVACPFRVGASGQRM

SEQ ID NO: 366925 - protein, 22 aa, Mycobacterium
RAGMIVVHPSWWSAARVAVVTR

SEQ ID NO: 366926 - protein, 27 aa, Mycobacterium
RAGQSYFAVLLALLPLSATAIGVLVMH

SEQ ID NO: 366927 - protein, 20 aa, Mycobacterium
RAGRHHVPLATALRVNDTAD

SEQ ID NO: 366928 - protein, 17 aa, Mycobacterium
RAGRLGDGWFPMTAPGP

SEQ ID NO: 366929 - protein, 17 aa, Mycobacterium
RAGSPILFYPAGALAVT

SEQ ID NO: 366930 - protein, 28 aa, Mycobacterium
RAGSWFGPYRLVRLLRQGGMGEVYEAED

SEQ ID NO: 366931 - protein, 24 aa, Mycobacterium
RAGTPLFFQQVAGALIATLVAVAA

SEQ ID NO: 366932 - protein, 26 aa, Mycobacterium
RAHPDARFAIIGFAARPSIDWPLSAD

SEQ ID NO: 366933 - protein, 18 aa, Mycobacterium
RAHRPLLIIALGAVASMA

SEQ ID NO: 366934 - protein, 18 aa, Mycobacterium
RAIAHWFQARLGQRGASA

SEQ ID NO: 366935 - protein, 22 aa, Mycobacterium
RAIALLTWPALAAPVVAPVLGG

SEQ ID NO: 366936 - protein, 22 aa, Mycobacterium
RAIAMLGGWLSALAGAWFVVGT

SEQ ID NO: 366937 - protein, 26 aa, Mycobacterium
RAIEYGGQWISWEQVGTLAQRIAGLS

SEQ ID NO: 366938 - protein, 17 aa, Mycobacterium
RAIFGELLGIPAPNLIA

SEQ ID NO: 366939 - protein, 24 aa, Mycobacterium
RAIGVFMISILVSWLLFAVLRGRL

SEQ ID NO: 366940 - protein, 17 aa, Mycobacterium
RAIIPLFGVLITLATAR

SEQ ID NO: 366941 - protein, 18 aa, Mycobacterium
RAIIPLVGVLITLATARG

SEQ ID NO: 366942 - protein, 18 aa, Mycobacterium
RAIMLPAGALVYIAVPPA

SEQ ID NO: 366943 - protein, 18 aa, Mycobacterium
RAIQLRRRAEVAEGPDEG

SEQ ID NO: 366944 - protein, 39 aa, Mycobacterium
RAIRRALPRPWSLRARLLAVQAALLAFVCVGIGAGTLLA

SEQ ID NO: 366945 - protein, 34 aa, Mycobacterium
RAIRTRGWRRIGTAIVRWPGAVLASACALALIGL

SEQ ID NO: 366946 - protein, 28 aa, Mycobacterium
RAKDFYLPGIWMYLALAVLFTASVLARR

SEQ ID NO: 366947 - protein, 23 aa, Mycobacterium
RAKIDAWRFGWIVSIGRAITGGV

SEQ ID NO: 366948 - protein, 30 aa, Mycobacterium
RAKKKGVLGRFWLVLTIAAVVALSGFVVYR

SEQ ID NO: 366949 - protein, 25 aa, Mycobacterium
RAKTFFLLVGMSALIVFVGSLFGRT

SEQ ID NO: 366950 - protein, 23 aa, Mycobacterium
RAKTFLLLAVFSGLIVAVGAMFG

SEQ ID NO: 366951 - protein, 22 aa, Mycobacterium
RAKVFRRIRIGIIVLACLVTLQ

SEQ ID NO: 366952 - protein, 24 aa, Mycobacterium
RALAGLQAWLARPDTSGTALVVLT

SEQ ID NO: 366953 - protein, 25 aa, Mycobacterium
RALAHRTCVAPLPYAQTDLDALQRV

SEQ ID NO: 366954 - protein, 24 aa, Mycobacterium
RALALPAAVLVFLAALPAFPAADT

SEQ ID NO: 366955 - protein, 17 aa, Mycobacterium
RALAMAPRKLQEIGLQR

SEQ ID NO: 366956 - protein, 28 aa, Mycobacterium
RALASLVEIWMLFGSPAIICSILSPKAK

SEQ ID NO: 366957 - protein, 19 aa, Mycobacterium
RALAVSSLPFWVGDALRAA

SEQ ID NO: 366958 - protein, 17 aa, Mycobacterium
RALFLEKALDQFYQANL

SEQ ID NO: 366959 - protein, 27 aa, Mycobacterium
RALFVSVLALLLATGWVANHFVALMPV

SEQ ID NO: 366960 - protein, 18 aa, Mycobacterium
RALGLTGRLPAAVLTLDQ

SEQ ID NO: 366961 - protein, 29 aa, Mycobacterium
RALGVRPIQLCRTVLAQAALIAGLGYLAG

SEQ ID NO: 366962 - protein, 48 aa, Mycobacterium
RALHAILGWRPVLLIPLTFALFTPLGVPGFAWWAAALNSLPMLAALAW

SEQ ID NO: 366963 - protein, 18 aa, Mycobacterium
RALIFVAGGLLPVAYQIF

SEQ ID NO: 366964 - protein, 24 aa, Mycobacterium
RALIPPLAMFLPGAAITLAVVELT

SEQ ID NO: 366965 - protein, 18 aa, Mycobacterium
RALKLRREAELAEAKKQA

SEQ ID NO: 366966 - protein, 20 aa, Mycobacterium
RALKMPFYRTLISVTNWCLG

SEQ ID NO: 366967 - protein, 26 aa, Mycobacterium
RALLFGGIFPPFWLAGTAMLAVSKIL

SEQ ID NO: 366968 - protein, 28 aa, Mycobacterium
RALPDGLTYGLLRYLNPAVDLAASDPSI

SEQ ID NO: 366969 - protein, 36 aa, Mycobacterium
RALQMPFYRTVISVATWLVGGAIFVAVTWSSTHSSV

SEQ ID NO: 366970 - protein, 29 aa, Mycobacterium
RALRAQWPILLVGLIFAVAFALAGANFWR

SEQ ID NO: 366971 - protein, 17 aa, Mycobacterium
RALRLMSQRVASAAGMG

SEQ ID NO: 366972 - protein, 20 aa, Mycobacterium
RALRMPYYRTLSTVAYWCIG

SEQ ID NO: 366973 - protein, 27 aa, Mycobacterium
RALSWAMPLAPWVYASATLGFVTIPTR

SEQ ID NO: 366974 - protein, 18 aa, Mycobacterium
RALTFQPKKIREQLNKAW

SEQ ID NO: 366975 - protein, 30 aa, Mycobacterium; identical to SEQ ID NO: 21259

SEQ ID NO: 366976 - protein, 22 aa, Mycobacterium
RAMAKHTCVTPLPYAQASLDAV

SEQ ID NO: 366977 - protein, 21 aa, Mycobacterium
RAMFVFIAITLIQIPVLLMSH

SEQ ID NO: 366978 - protein, 24 aa, Mycobacterium
RAMFWSVFVYVAFATVIAFWLGRP

SEQ ID NO: 366979 - protein, 21 aa, Mycobacterium
RAMFWTVLVYVVVATLVAIWL

SEQ ID NO: 366980 - protein, 35 aa, Mycobacterium
RAMRDDVNPLLFPAMLLALTLLLASTIVVHFSYTK

SEQ ID NO: 366981 - protein, 25 aa, Mycobacterium
RAMTPLAVLSWAAFAKCLLLEGTWA

SEQ ID NO: 366982 - protein, 22 aa, Mycobacterium
RANEPGFRARFSREALIAARLT

SEQ ID NO: 366983 - protein, 23 aa, Mycobacterium
RANGIRRVVMLTGDHPDIAEVVA

SEQ ID NO: 366984 - protein, 18 aa, Mycobacterium
RANLLIGSGLLSVDPRRA

SEQ ID NO: 366985 - protein, 20 aa, Mycobacterium
RANRAVALSAAGLALTGLIE

SEQ ID NO: 366986 - protein, 24 aa, Mycobacterium
RAPAGILPPRLFRNQVFAVCSVLS

SEQ ID NO: 366987 - protein, 19 aa, Mycobacterium
RAPAYIYFTSGSTGRPKPV

SEQ ID NO: 366988 - protein, 30 aa, Mycobacterium
RAPEFYAWMTVLPIGLMLQQSSLRAGSLTA

SEQ ID NO: 366989 - protein, 36 aa, Mycobacterium
RAPHGGIFVFFAIGNLLWFVIALVVGTVVAGLTVVA

SEQ ID NO: 366990 - protein, 20 aa, Mycobacterium
RAPIMARFHGMWSLGALLGA

SEQ ID NO: 366991 - protein, 20 aa, Mycobacterium
RAPIMARFHGMWSVGTLVGA

SEQ ID NO: 366992 - protein, 19 aa, Mycobacterium
RAPLLLVVAIPIAVARLYT

SEQ ID NO: 366993 - protein, 17 aa, Mycobacterium
RAPLRATSSLSLRWRVM

SEQ ID NO: 366994 - protein, 18 aa, Mycobacterium
RAPLRVAGWMRRGTRTMS

SEQ ID NO: 366995 - protein, 22 aa, Mycobacterium
RAPRRVWATVMTVLIGVLTTVV

SEQ ID NO: 366996 - protein, 30 aa, Mycobacterium
RAPVGTRQLLLVNLLTDMFPALAVAITSQY

SEQ ID NO: 366997 - protein, 29 aa, Mycobacterium
RAPVGTRQLLLVNLLTDMFPALAVAVTPQ

SEQ ID NO: 366998 - protein, 30 aa, Mycobacterium; identical to SEQ ID NO: 21263

SEQ ID NO: 366999 - protein, 28 aa, Mycobacterium
RAPVLGIVFALFLLAFAGIPLTSGFVSK

SEQ ID NO: 367000 - protein, 26 aa, Mycobacterium
RAPVVAALLVEPLLAAVLGALAGVLL

SEQ ID NO: 367001 - protein, 30 aa, Mycobacterium
RAQAAGRLLAPLRFALILSGVLQVVATLVQ

SEQ ID NO: 367002 - protein, 32 aa, Mycobacterium
RAQAAGRLLAPLRWALILSGLLQAVITLVQLA

SEQ ID NO: 367003 - protein, 24 aa, Mycobacterium
RAQLKVPAPPPPRDARPGWVAMAI

SEQ ID NO: 367004 - protein, 25 aa, Mycobacterium
RAQRLCRPVFWYLAAWTGALVVVRA

SEQ ID NO: 367005 - protein, 28 aa, Mycobacterium
RAQRLCRPVFWYLAVWAAVLAAARVVLG

SEQ ID NO: 367006 - protein, 19 aa, Mycobacterium
RARARAAQLKREALALAED

SEQ ID NO: 367007 - protein, 18 aa, Mycobacterium
RARDTAVRGAAVCLVALT

SEQ ID NO: 367008 - protein, 26 aa, Mycobacterium
RARGKPLRIMILLVIVTAVASALLDN

SEQ ID NO: 367009 - protein, 26 aa, Mycobacterium
RARGPLWLIILGFSAGVALLAGFRQF

SEQ ID NO: 367010 - protein, 21 aa, Mycobacterium
RARGSPLRVMILLALVTAIAS

SEQ ID NO: 367011 - protein, 23 aa, Mycobacterium
RARGWRRIGAATVRWPGAVLVMA

SEQ ID NO: 367012 - protein, 28 aa, Mycobacterium
RARIRRWVFLKRVFFGLACLGLTGFVIT

SEQ ID NO: 367013 - protein, 29 aa, Mycobacterium
RARLAFLLTPPLAWLVVAYLGSLAVLLVS

SEQ ID NO: 367014 - protein, 30 aa, Mycobacterium
RARLVLSPLRDLFAAIFFLAIGLSVHPSDL

SEQ ID NO: 367015 - protein, 19 aa, Mycobacterium
RARPDLVYLLRSHPARQAV

SEQ ID NO: 367016 - protein, 24 aa, Mycobacterium
RARPEWEWLKWLPHNQHPAAADEL

SEQ ID NO: 367017 - protein, 19 aa, Mycobacterium
RARPVAVGPPRRGLSRAER

SEQ ID NO: 367018 - protein, 20 aa, Mycobacterium
RARQVLTWLLGGLGGARWDN

SEQ ID NO: 367019 - protein, 20 aa, Mycobacterium
RARRLFVEQWAVIGRLNAHV

SEQ ID NO: 367020 - protein, 23 aa, Mycobacterium
RARRPRLRRRSTAKTPRPGKDEP

SEQ ID NO: 367021 - protein, 17 aa, Mycobacterium
RARRTRQPAPQNGLRSA

SEQ ID NO: 367022 - protein, 25 aa, Mycobacterium
RARSQLWLGLLSWAVVIGLYVVARR

SEQ ID NO: 367023 - protein, 19 aa, Mycobacterium
RARTIMLQNVGLSLALIAV

SEQ ID NO: 367024 - protein, 19 aa, Mycobacterium
RARTKVMIAHRLSAIRNAD

SEQ ID NO: 367025 - protein, 19 aa, Mycobacterium
RARTPWVATGLLLVIPVFL

SEQ ID NO: 367026 - protein, 48 aa, Mycobacterium
RARVLSIAALLAVLISSSFILVQFLTQAWIWQITLINIAATLVFATVP

SEQ ID NO: 367027 - protein, 20 aa, Mycobacterium
RARVSISVRTLVIAAVICVA

SEQ ID NO: 367028 - protein, 19 aa, Mycobacterium
RARVSLSAFLLTFALVHVL

SEQ ID NO: 367029 - protein, 30 aa, Mycobacterium
RASACLHGVWILLFTIPFAGLVDEIPTAAL

SEQ ID NO: 367030 - protein, 31 aa, Mycobacterium
RASAIMHGVWILLFTIPFAGLVEQIPTAALA

SEQ ID NO: 367031 - protein, 19 aa, Mycobacterium
RASREAELLALFAGSVLRG

SEQ ID NO: 367032 - protein, 30 aa, Mycobacterium
RASTILHGFWVLLFALPFAGLIEQIPSAAL

SEQ ID NO: 367033 - protein, 32 aa, Mycobacterium
RASYRKMKQNLWWAAGYNLISVPLAAGVAAPI

SEQ ID NO: 367034 - protein, 35 aa, Mycobacterium
RATEPVLPIRLFASPVFTVCCVLSFIVGFAMLGAL

SEQ ID NO: 367035 - protein, 28 aa, Mycobacterium
RATLWVLFGLFFLFPLYAMADFSTRNLI

SEQ ID NO: 367036 - protein, 28 aa, Mycobacterium
RATPSFLTVLGVLLLPFVLISCNTVVAT

SEQ ID NO: 367037 - protein, 17 aa, Mycobacterium
RATPVLAPLPALALEQL

SEQ ID NO: 367038 - protein, 26 aa, Mycobacterium
RATRLAKLFALASTLLVVWGSTSITL

SEQ ID NO: 367039 - protein, 30 aa, Mycobacterium
RATSSLSLRWRVMLLAMSMVAMVVVLMSFA

SEQ ID NO: 367040 - protein, 24 aa, Mycobacterium
RATTAFWLAPLLLSVPIFSRDTYS

SEQ ID NO: 367041 - protein, 27 aa, Mycobacterium
RATVLRQALLSYLLGAVVLAVTINLIA

SEQ ID NO: 367042 - protein, 19 aa, Mycobacterium
RATVPGSHRSRPGLVGRAA

SEQ ID NO: 367043 - protein, 17 aa, Mycobacterium
RATVYGLVVLTLATAIA

SEQ ID NO: 367044 - protein, 19 aa, Mycobacterium
RATYAALILIGVFYAVTSW

SEQ ID NO: 367045 - protein, 19 aa, Mycobacterium
RATYAAVLIIGGFYALTCW

SEQ ID NO: 367046 - protein, 20 aa, Mycobacterium
RAVAFAIVLLVALAASTSLA

SEQ ID NO: 367047 - protein, 28 aa, Mycobacterium
RAVAGVGFLLVFMLPALAGYVTASFTTR

SEQ ID NO: 367048 - protein, 18 aa, Mycobacterium
RAVAIVRQIAAALDAAHS

SEQ ID NO: 367049 - protein, 17 aa, Mycobacterium
RAVAMGAVLLVTGLAGC

SEQ ID NO: 367050 - protein, 17 aa, Mycobacterium
RAVAVGCAILIAGMLIL

SEQ ID NO: 367051 - protein, 23 aa, Mycobacterium
RAVCREAGLTERYFYECFNDRDG

SEQ ID NO: 367052 - protein, 27 aa, Mycobacterium
RAVFLGRFIALLRILAGPLAGALKMHY

SEQ ID NO: 367053 - protein, 23 aa, Mycobacterium
RAVFWINLPVCVLAFVLTAVFVP

SEQ ID NO: 367054 - protein, 22 aa, Mycobacterium
RAVHSALLLRAWSDDIVVLTNG

SEQ ID NO: 367055 - protein, 20 aa, Mycobacterium
RAVINRLWLRATVGIAGAIG

SEQ ID NO: 367056 - protein, 20 aa, Mycobacterium
RAVKISLLGLGATALVQVVI

SEQ ID NO: 367057 - protein, 20 aa, Mycobacterium
RAVKISLLVLGITAIAQIAV

SEQ ID NO: 367058 - protein, 26 aa, Mycobacterium
RAVLALPFTVAVLVPLVILYGTGIGV

SEQ ID NO: 367059 - protein, 17 aa, Mycobacterium
RAVLMGVVLLVTAVAGC

SEQ ID NO: 367060 - protein, 21 aa, Mycobacterium
RAVMLPAPFISMLGSLVLALG

SEQ ID NO: 367061 - protein, 24 aa, Mycobacterium
RAVMPITFVTFGLGYLAIIGVPPF

SEQ ID NO: 367062 - protein, 18 aa, Mycobacterium
RAVRAYPRTASVVIWYSP

SEQ ID NO: 367063 - protein, 24 aa, Mycobacterium
RAVSKWLSLLFLATFTVVTVGMPL

SEQ ID NO: 367064 - protein, 33 aa, Mycobacterium
RAVSWVFISAIGWVIFFFLFRDESQIDPDATPA

SEQ ID NO: 367065 - protein, 26 aa, Mycobacterium
RAVTADAHISLWRALLGLDSMERVRV

SEQ ID NO: 367066 - protein, 17 aa, Mycobacterium
RAVVLGEDRQQLISGLT

SEQ ID NO: 367067 - protein, 19 aa, Mycobacterium
RAVVRKLPPSPGLRARVVG

SEQ ID NO: 367068 - protein, 23 aa, Mycobacterium
RAWAWVIIVVGVVSVLYGALVAL

SEQ ID NO: 367069 - protein, 20 aa, Mycobacterium
RAWELLLGVLVGALVAGTRW

SEQ ID NO: 367070 - protein, 17 aa, Mycobacterium
RAWQLTRRTRRWDPDYY

SEQ ID NO: 367071 - protein, 20 aa, Mycobacterium
RAWRRIGTMVVRWPGPILVA

SEQ ID NO: 367072 - protein, 20 aa, Mycobacterium
RAYPRTASVVIWYSPAQCDT

SEQ ID NO: 367073 - protein, 21 aa, Mycobacterium
RAYPRTASVVVWYSPERCDTA

SEQ ID NO: 367074 - protein, 20 aa, Mycobacterium
RCAGLRADLLHRAGAVGRRD

SEQ ID NO: 367075 - protein, 34 aa, Mycobacterium
RCIDDRTRLYLPMPFFWVGGFGGGLLSALVAGAT

SEQ ID NO: 367076 - protein, 34 aa, Mycobacterium
RCISGETRLYLPMPFFWVGGFGSGILSVLLAGAT

SEQ ID NO: 367077 - protein, 18 aa, Mycobacterium
RCPMWLRTVLAVVALAAI

SEQ ID NO: 367078 - protein, 24 aa, Mycobacterium
RCRPDHPFLVCDSDRISYAQADLR

SEQ ID NO: 367079 - protein, 25 aa, Mycobacterium
RCTAREWMWAVLLAGAVAVIVLAGD

SEQ ID NO: 367080 - protein, 27 aa, Mycobacterium
RCTPRDALYPLVDFLTRSAGKIEAMRD

SEQ ID NO: 367081 - protein, 33 aa, Mycobacterium
RCVTADTRLYLPMPFFWVGGFGAGIVTALVAGA

SEQ ID NO: 367082 - protein, 30 aa, Mycobacterium
RCWLGSLLILSALWALRAVTHWLQARLGQR

SEQ ID NO: 367083 - protein, 26 aa, Mycobacterium
RDAAIRDTVFVLGAILVAVVVVLLVA

SEQ ID NO: 367084 - protein, 17 aa, Mycobacterium
RDAALVVVVLHVNLLIG

SEQ ID NO: 367085 - protein, 18 aa, Mycobacterium
RDAFLPFQSGRPFAAALA

SEQ ID NO: 367086 - protein, 18 aa, Mycobacterium
RDAGLNRLVMLTGDRAEP

SEQ ID NO: 367087 - protein, 32 aa, Mycobacterium
RDAIDRVPAFAPGGRQLKLIPDARAALEALAA

SEQ ID NO: 367088 - protein, 21 aa, Mycobacterium
RDALFWVYIATLMVPGTVTVV

SEQ ID NO: 367089 - protein, 23 aa, Mycobacterium
RDARPGWVAMAITGLAVVSVLGL

SEQ ID NO: 367090 - protein, 22 aa, Mycobacterium
RDDDGVFYFVGRAGSMIKTAGA

SEQ ID NO: 367091 - protein, 20 aa, Mycobacterium
RDDILVRLTAFMIEHGLAVN

SEQ ID NO: 367092 - protein, 23 aa, Mycobacterium
RDDLAMSWLLAGLFAGVVSGAVA

SEQ ID NO: 367093 - protein, 23 aa, Mycobacterium
RDDLDAWPPAPVPEYRAPVLVPP

SEQ ID NO: 367094 - protein, 23 aa, Mycobacterium
RDDLVMWTLTDPAQPTRIVMDTS

SEQ ID NO: 367095 - protein, 39 aa, Mycobacterium
RDDVFTLLLSLPVVFYSAWIFFDGAWRALRARTLDMMVL

SEQ ID NO: 367096 - protein, 17 aa, Mycobacterium
RDEAVHGYYIGYKFQRG

SEQ ID NO: 367097 - protein, 23 aa, Mycobacterium
RDELETLMRPPLTGVLDTLDNAL

SEQ ID NO: 367098 - protein, 35 aa, Mycobacterium
RDERDRLALWSRVLPITFTAIGLVALVGGGLLTSF

SEQ ID NO: 367099 - protein, 34 aa, Mycobacterium
RDERDRLALWSRVLPITFTAVGLIALVGGGLLAS

SEQ ID NO: 367100 - protein, 23 aa, Mycobacterium
RDEVVHGWVLASASFMLCAAFNV

SEQ ID NO: 367101 - protein, 17 aa, Mycobacterium
RDFILEQRKIRDIAKVV

SEQ ID NO: 367102 - protein, 21 aa, Mycobacterium
RDFLAPPRRLTAKAPGVDLVL

SEQ ID NO: 367103 - protein, 17 aa, Mycobacterium
RDFLRIDVIIFGLVVYA

SEQ ID NO: 367104 - protein, 17 aa, Mycobacterium
RDGATLISLISPALRPD

SEQ ID NO: 367105 - protein, 18 aa, Mycobacterium
RDGDRLRIAVADTGEGIA

SEQ ID NO: 367106 - protein, 20 aa, Mycobacterium
RDGFWLSMLVFSVLAVVNVV

SEQ ID NO: 367107 - protein, 17 aa, Mycobacterium
RDGKIVHPTLGVSTRSV

SEQ ID NO: 367108 - protein, 22 aa, Mycobacterium
RDGLGWLVVAGFAVAVSATLVL

SEQ ID NO: 367109 - protein, 26 aa, Mycobacterium
RDGLTLGQALIFWASGRDQLLPRDLV

SEQ ID NO: 367110 - protein, 34 aa, Mycobacterium
RDGPPPPEGPKTPRWLWIAAGAAVVLVIGLVIAL

SEQ ID NO: 367111 - protein, 26 aa, Mycobacterium
RDGVMFVPQLPYLPLGNLRAGVSYPA

SEQ ID NO: 367112 - protein, 30 aa, Mycobacterium
RDGVRAELGIVLVLLVVCLGLESQGPDAQL

SEQ ID NO: 367113 - protein, 18 aa, Mycobacterium
RDGWAFVAIRLTSTAPIV

SEQ ID NO: 367114 - protein, 27 aa, Mycobacterium
RDGYPTIPVFAFGWPTSELSPLYMAGS

SEQ ID NO: 367115 - protein, 30 aa, Mycobacterium
RDHLADFDDFWRPLRSYFYWEQHCFDIPIC

SEQ ID NO: 367116 - protein, 23 aa, Mycobacterium
RDHVINLPGFPALGGATNPDAPF

SEQ ID NO: 367117 - protein, 20 aa, Mycobacterium
RDIDRLLRRVTPGDIVVLDA

SEQ ID NO: 367118 - protein, 17 aa, Mycobacterium
RDIKPSNILITDKDFVY

SEQ ID NO: 367119 - protein, 17 aa, Mycobacterium
RDIKWLKWIEAPFARVG

SEQ ID NO: 367120 - protein, 30 aa, Mycobacterium
RDILVFVGAVLFTVIWWNIEHTRSNWLVMF

SEQ ID NO: 367121 - protein, 21 aa, Mycobacterium
RDINRLLQRLNPGDIAVIDIL

SEQ ID NO: 367122 - protein, 36 aa, Mycobacterium
RDIPFPIVVATIVVMLLPIAVLLWEFSRGTVLQGSS

SEQ ID NO: 367123 - protein, 28 aa, Mycobacterium
RDIVVFLCAVLFTIVWWNIDHDRTNWLP

SEQ ID NO: 367124 - protein, 18 aa, Mycobacterium
RDIWIAGILGVVIVALAT

SEQ ID NO: 367125 - protein, 36 aa, Mycobacterium
RDKIPRIIRTFAVPIILVWIALIAVLNTVVPQLDEV

SEQ ID NO: 367126 - protein, 35 aa, Mycobacterium
RDKIPRLIRTFAVPIILGWIAIIAVLNVSVPQLEE

SEQ ID NO: 367127 - protein, 35 aa, Mycobacterium
RDLAHLLDTLPLLIGWLWPLWDSRRRTFADLLLRT

SEQ ID NO: 367128 - protein, 20 aa, Mycobacterium
RDLFMIMLTVFLVSTFGLNF

SEQ ID NO: 367129 - protein, 22 aa, Mycobacterium
RDLFSGFGWLAVVLLAVAGACA

SEQ ID NO: 367130 - protein, 20 aa, Mycobacterium
RDLILMEALAIPLSFAVLVW

SEQ ID NO: 367131 - protein, 18 aa, Mycobacterium
RDLMGVPRLSFWAHPQTA

SEQ ID NO: 367132 - protein, 19 aa, Mycobacterium
RDLMGVPRLTFWDYPLAAA

SEQ ID NO: 367133 - protein, 29 aa, Mycobacterium
RDLMYTFDDFFRPIRNYFYWEKHCADIPI

SEQ ID NO: 367134 - protein, 17 aa, Mycobacterium
RDLQLVVNSLWAGGAEA

SEQ ID NO: 367135 - protein, 17 aa, Mycobacterium
RDLQLVVNSLWASGAEA

SEQ ID NO: 367136 - protein, 24 aa, Mycobacterium
RDLRTGLLRKLSRLPLGWFTARGS

SEQ ID NO: 367137 - protein, 19 aa, Mycobacterium
RDLTWWDLTVFGVSVVIGA

SEQ ID NO: 367138 - protein, 45 aa, Mycobacterium
RDLWRIKVNLRPVSIILVVLVMISGGIAAWLYVKTYRPDQQVDPA

SEQ ID NO: 367139 - protein, 18 aa, Mycobacterium
RDMFAHRTVEALAPLLGD

SEQ ID NO: 367140 - protein, 38 aa, Mycobacterium
RDMRNRFLVALALSIPIMLWSPMGRDMFGFTVPAPFGL

SEQ ID NO: 367141 - protein, 23 aa, Mycobacterium
RDPHDPDFLVLRAGLHDQPLDVT

SEQ ID NO: 367142 - protein, 17 aa, Mycobacterium
RDPLLIMVVLAPIIWTT

SEQ ID NO: 367143 - protein, 32 aa, Mycobacterium
RDPLRTGIFGVVLVVCVVLIAFGYSGLPFWPQ

SEQ ID NO: 367144 - protein, 23 aa, Mycobacterium
RDPLTGLLNRRAFYSAVNQLLAD

SEQ ID NO: 367145 - protein, 23 aa, Mycobacterium
RDPRFRVRFMREADLAAGLHHPN

SEQ ID NO: 367146 - protein, 28 aa, Mycobacterium
RDPVMFAIPFFLLLLTIEWTAARRLEHV

SEQ ID NO: 367147 - protein, 19 aa, Mycobacterium
RDQLLPRDLVYPPDKTREE

SEQ ID NO: 367148 - protein, 38 aa, Mycobacterium
RDRALGAMVLLFFVTAVLLGLLIRDTVARPLAALAAAC

SEQ ID NO: 367149 - protein, 23 aa, Mycobacterium
RDRGSLVGALPFCVHRVWAGPVP

SEQ ID NO: 367150 - protein, 26 aa, Mycobacterium
RDRHLQLWVVYIDNFSRFKPENWADR

SEQ ID NO: 367151 - protein, 20 aa, Mycobacterium
RDRMYTALYGVGTLFGGMAS

SEQ ID NO: 367152 - protein, 22 aa, Mycobacterium
RDRRLSGMLLAFAGATVLGFSG

SEQ ID NO: 367153 - protein, 28 aa, Mycobacterium
RDRRRLIPTLMLLSAAALTWCAVAPTLS

SEQ ID NO: 367154 - protein, 23 aa, Mycobacterium
RDRRRLMLAPFARDAVARQTGVM

SEQ ID NO: 367155 - protein, 36 aa, Mycobacterium
RDRSRRRLRRRLSGGLLLLIALTIAGGVAAVLTPRP

SEQ ID NO: 367156 - protein, 19 aa, Mycobacterium
RDRTSFIIAHRLSTIRDAD

SEQ ID NO: 367157 - protein, 20 aa, Mycobacterium
RDRTSFIIAHRLSTIRTADR

SEQ ID NO: 367158 - protein, 26 aa, Mycobacterium
RDRVGLPLWVMLLSVPLATVYVGSIQ

SEQ ID NO: 367159 - protein, 25 aa, Mycobacterium
RDSASRMWEVFTLQPGPNGTFTGEY

SEQ ID NO: 367160 - protein, 35 aa, Mycobacterium
RDSFFDWDMYRQAIPALFHTGLPNTLILTVSASAI

SEQ ID NO: 367161 - protein, 31 aa, Mycobacterium
RDSLAIWSNILPITFAALGVVALVGGGLLGS

SEQ ID NO: 367162 - protein, 25 aa, Mycobacterium
RDSPWPVVRNPLIASTLAGLGLARA

SEQ ID NO: 367163 - protein, 17 aa, Mycobacterium
RDTLALRERPLVRMLRL

SEQ ID NO: 367164 - protein, 22 aa, Mycobacterium
RDVARLYRLAGTVAPGLLAGTQ

SEQ ID NO: 367165 - protein, 34 aa, Mycobacterium
RDVDAFERRRAIWQWLLVLLATVATAGATNSASG

SEQ ID NO: 367166 - protein, 26 aa, Mycobacterium
RDVFALLSPFLLVVAVVFVPALDMLL

SEQ ID NO: 367167 - protein, 18 aa, Mycobacterium
RDVKPGNILITPTGQVKL

SEQ ID NO: 367168 - protein, 18 aa, Mycobacterium
RDVKPPNILITRDDFAYL

SEQ ID NO: 367169 - protein, 26 aa, Mycobacterium
RDVVLLVCVVLFTIIWWDVDHGRGNW

SEQ ID NO: 367170 - protein, 19 aa, Mycobacterium
RDWRFAVIVTLAWFAVTFT

SEQ ID NO: 367171 - protein, 21 aa, Mycobacterium
RDWWIARIAGRNPLLRRADRV

SEQ ID NO: 367172 - protein, 35 aa, Mycobacterium
RDYFAVEVEPPFRWGLPLVALVSALLIAAAIAGST

SEQ ID NO: 367173 - protein, 31 aa, Mycobacterium
RDYYQQDIRFIIIATLIVVLLTLTVLLRTVI

SEQ ID NO: 367174 - protein, 24 aa, Mycobacterium
REAAVATTALALRGARKAEVGAES

SEQ ID NO: 367175 - protein, 23 aa, Mycobacterium
REAFAALRDLVINAPSRLDTLTQ

SEQ ID NO: 367176 - protein, 18 aa, Mycobacterium
REAGFDRLVMLTGDRPEP

SEQ ID NO: 367177 - protein, 25 aa, Mycobacterium
REAGYLIPVIPLLVGGQVTIWLSWP

SEQ ID NO: 367178 - protein, 23 aa, Mycobacterium
REAGYLIPVVPLLIGGQLTVWLS

SEQ ID NO: 367179 - protein, 24 aa, Mycobacterium
REALLLTQLLGLSYADAAAVCGCP

SEQ ID NO: 367180 - protein, 18 aa, Mycobacterium
REALRRLALLGVGGAAAT

SEQ ID NO: 367181 - protein, 27 aa, Mycobacterium
RECVALLWFLGVYLVVLAFVPALTRMS

SEQ ID NO: 367182 - protein, 26 aa, Mycobacterium
RECVALLWFLGVYLVVLAFVPVLTRL

SEQ ID NO: 367183 - protein, 25 aa, Mycobacterium
REDKRLLPYMIGAFVLIVAASVGVG

SEQ ID NO: 367184 - protein, 23 aa, Mycobacterium
REDMPLLGELLAVAPDRVTVWAD

SEQ ID NO: 367185 - protein, 24 aa, Mycobacterium
REELVDFVTYFQAGTLWAQRTGSS

SEQ ID NO: 367186 - protein, 17 aa, Mycobacterium
REFVELLQKFVVKRKFS

SEQ ID NO: 367187 - protein, 26 aa, Mycobacterium
REFVLQCWFIMRVAFLPTIMVSIPLT

SEQ ID NO: 367188 - protein, 36 aa, Mycobacterium
REFVNDFIFNFPDTSFAWAFVLALLAAALAARKRIA

SEQ ID NO: 367189 - protein, 27 aa, Mycobacterium
REGDTWVLAMLYLGTFGSWIGFSFAFG

SEQ ID NO: 367190 - protein, 24 aa, Mycobacterium
REGHQLWRRVQSAVSVLLGGNAGE

SEQ ID NO: 367191 - protein, 23 aa, Mycobacterium
REGLETTLFFWTAAKAAGETTGP

SEQ ID NO: 367192 - protein, 22 aa, Mycobacterium
REITMPVLSPGSTPLRVLHISD

SEQ ID NO: 367193 - protein, 23 aa, Mycobacterium
REITMPVLTPGSTPLRVLHISDL

SEQ ID NO: 367194 - protein, 29 aa, Mycobacterium
REKDHSPPPPRWAWKVLIPIGVVGQVLMA

SEQ ID NO: 367195 - protein, 45 aa, Mycobacterium
REKPSPWVAALSSFFLFAIGAVIPLVPYLLGYESLWAGLACGGVG

SEQ ID NO: 367196 - protein, 20 aa, Mycobacterium
REKYAPMPTLGWSRAYRSGD

SEQ ID NO: 367197 - protein, 29 aa, Mycobacterium
RELARWQPSWLRYSPLTFTGLITIVAALG

SEQ ID NO: 367198 - protein, 26 aa, Mycobacterium
RELGGLACLVQLLLAALIGAALTADT

SEQ ID NO: 367199 - protein, 17 aa, Mycobacterium
RELGVMPLLPVLAMVWG

SEQ ID NO: 367200 - protein, 24 aa, Mycobacterium
RELPPAVAFWLMLGIPLGTVWSEE

SEQ ID NO: 367201 - protein, 24 aa, Mycobacterium
RELTAQFWRRSGIRIVRRPIPHLV

SEQ ID NO: 367202 - protein, 19 aa, Mycobacterium
RELTSKVLPLTLAGGAAVT

SEQ ID NO: 367203 - protein, 18 aa, Mycobacterium
RELTSKVLPLTLAGGASV

SEQ ID NO: 367204 - protein, 25 aa, Mycobacterium
RELVFTYGPLGFLRTSAYYSFEQSL

SEQ ID NO: 367205 - protein, 29 aa, Mycobacterium
RELYRGGMNLYTLLAVAAARWPDRTAIID

SEQ ID NO: 367206 - protein, 26 aa, Mycobacterium
REMSLPVDFPPADPLPAVAMPAPPLA

SEQ ID NO: 367207 - protein, 23 aa, Mycobacterium
RENDRLMLALMPESVLQRYREGE

SEQ ID NO: 367208 - protein, 19 aa, Mycobacterium
REPGWRYRLAINLSAGILS

SEQ ID NO: 367209 - protein, 26 aa, Mycobacterium
REPQRLWHVRKLRRATLSGALLGASV

SEQ ID NO: 367210 - protein, 24 aa, Mycobacterium
REPRNIWVMIGVPALIVALIGTIV

SEQ ID NO: 367211 - protein, 19 aa, Mycobacterium
REPVLPPRLFRSPVFTVCC

SEQ ID NO: 367212 - protein, 17 aa, Mycobacterium
REQFLRHGYRATSLRAI

SEQ ID NO: 367213 - protein, 23 aa, Mycobacterium
REQLIPRYSLGCKRPSFHNSYLA

SEQ ID NO: 367214 - protein, 26 aa, Mycobacterium
REQPWTPILIIVVITGVKIVASLLAP

SEQ ID NO: 367215 - protein, 27 aa, Mycobacterium
REQPWTPIVIILVITAVKILGSVLAPH

SEQ ID NO: 367216 - protein, 26 aa, Mycobacterium
RERAWTPIIVIIVITVVKIAGSVAAP

SEQ ID NO: 367217 - protein, 19 aa, Mycobacterium
RERFGAHLVIDPAEKSPFD

SEQ ID NO: 367218 - protein, 17 aa, Mycobacterium
RERGLPGLSVAWGLWEQ

SEQ ID NO: 367219 - protein, 17 aa, Mycobacterium
RERGWLAILSLRLIPAV

SEQ ID NO: 367220 - protein, 21 aa, Mycobacterium
RERHHEAFLFFAVSGVGVLLS

SEQ ID NO: 367221 - protein, 23 aa, Mycobacterium
RERLGPVLRRLTANYPPIMFHPL

SEQ ID NO: 367222 - protein, 35 aa, Mycobacterium; identical to SEQ ID NO: 236824

SEQ ID NO: 367223 - protein, 25 aa, Mycobacterium
RERLILAAILLTITVVYLWDISQNG

SEQ ID NO: 367224 - protein, 25 aa, Mycobacterium
RERLLGWITVGLSAGGLMLAGAVLS

SEQ ID NO: 367225 - protein, 19 aa, Mycobacterium
RERLSVLIAVVLGVLMVCA

SEQ ID NO: 367226 - protein, 17 aa, Mycobacterium
RERLTRGLTYSAVGPVD

SEQ ID NO: 367227 - protein, 24 aa, Mycobacterium
RERMFRWLLAVLGLAARLLPNGLR

SEQ ID NO: 367228 - protein, 17 aa, Mycobacterium
RERPARVPLSFAQSRLW

SEQ ID NO: 367229 - protein, 25 aa, Mycobacterium
RERRDLFSGFAWLAVVSLATAGACA

SEQ ID NO: 367230 - protein, 30 aa, Mycobacterium
RERRDLFSGFGWLAVLLLAVASACAPPGSL

SEQ ID NO: 367231 - protein, 24 aa, Mycobacterium
RERRWLMPALLLSALGDWVLAIPW

SEQ ID NO: 367232 - protein, 23 aa, Mycobacterium
RERVVAVSFPRDLAITPMKCEPW

SEQ ID NO: 367233 - protein, 27 aa, Mycobacterium
RESGTLIWLILLLAAFSWMISARIVRG

SEQ ID NO: 367234 - protein, 18 aa, Mycobacterium
RESLFPMGVTMVTVLYWR

SEQ ID NO: 367235 - protein, 24 aa, Mycobacterium
RETLHFLWLRLARVWPVYLVTMHL

SEQ ID NO: 367236 - protein, 27 aa, Mycobacterium
REVLDYPAYGWPAVAPPQPPVHPGPMP

SEQ ID NO: 367237 - protein, 25 aa, Mycobacterium
REVLPLLVPVVLVSALFNGSLVQLV

SEQ ID NO: 367238 - protein, 24 aa, Mycobacterium
REVQTIVSPAWYDPLVLTVGSIGQ

SEQ ID NO: 367239 - protein, 18 aa, Mycobacterium
REWISPDVDYIALCPNLP

SEQ ID NO: 367240 - protein, 20 aa, Mycobacterium
REWRPAFVPMLPLAGATAAT

SEQ ID NO: 367241 - protein, 17 aa, Mycobacterium
REYFTYQDLARFAYAQA

SEQ ID NO: 367242 - protein, 24 aa, Mycobacterium
RFAALEFSGFFGSTYCPGVMSLVQ

SEQ ID NO: 367243 - protein, 42 aa, Mycobacterium
RFADRAAFWLVLVALIGGTATFLVWWAVGAGVQTALLFAITV

SEQ ID NO: 367244 - protein, 33 aa, Mycobacterium
RFAPSVFVRVRLSWWIGTLAPAIGIIALCGMAL

SEQ ID NO: 367245 - protein, 17 aa, Mycobacterium
RFATPFFDALRAYAAAP

SEQ ID NO: 367246 - protein, 17 aa, Mycobacterium
RFAYFPVLFVALAVAVN

SEQ ID NO: 367247 - protein, 29 aa, Mycobacterium
RFDFAARKDLYVAYIPFAVAAGTAALWAK

SEQ ID NO: 367248 - protein, 17 aa, Mycobacterium
RFDPLKPGRPLPAALTA

SEQ ID NO: 367249 - protein, 18 aa, Mycobacterium
RFDPTKIVGVLRGAPETL

SEQ ID NO: 367250 - protein, 19 aa, Mycobacterium
RFEFPYVIYQGLTMYLLLA

SEQ ID NO: 367251 - protein, 18 aa, Mycobacterium
RFGELVAPLTFVGAAYVS

SEQ ID NO: 367252 - protein, 23 aa, Mycobacterium
RFGFLLAIPAVFASGLFSLPDAF

SEQ ID NO: 367253 - protein, 17 aa, Mycobacterium
RFGLFAYGDPGDGLWMI

SEQ ID NO: 367254 - protein, 17 aa, Mycobacterium
RFGLPVLPLIIGVILGP

SEQ ID NO: 367255 - protein, 20 aa, Mycobacterium
RFGMPLFDRLGRRFPKHFGP

SEQ ID NO: 367256 - protein, 25 aa, Mycobacterium
RFGPARFIQPLLYLGAVGLATVATG

SEQ ID NO: 367257 - protein, 17 aa, Mycobacterium
RFGPKNVYLIGLAIFTA

SEQ ID NO: 367258 - protein, 33 aa, Mycobacterium
RFGRRRVMLVGWAVGLFWSPLVMPLIGSGDTVG

SEQ ID NO: 367259 - protein, 26 aa, Mycobacterium
RFGTHLLTIVLLAGLLWLVWMDRNPA

SEQ ID NO: 367260 - protein, 34 aa, Mycobacterium
RFGVDLIAVLSLIGTLLVGEYLAGALIAVMLAGG

SEQ ID NO: 367261 - protein, 19 aa, Mycobacterium
RFGVLCRFTAYVAGELRDG

SEQ ID NO: 367262 - protein, 21 aa, Mycobacterium
RFGVPMIAFAITASLALAFPL

SEQ ID NO: 367263 - protein, 23 aa, Mycobacterium
RFIGQAFALLVFALRRGSKLATA

SEQ ID NO: 367264 - protein, 18 aa, Mycobacterium
RFLGHPWQKDYGSARNLV

SEQ ID NO: 367265 - protein, 18 aa, Mycobacterium
RFLLPVVGVPPDKSDRAT

SEQ ID NO: 367266 - protein, 23 aa, Mycobacterium
RFLRVSPLRKHSIPFWRKWTQQV

SEQ ID NO: 367267 - protein, 23 aa, Mycobacterium
RFMPPIGGILYWLRPNTIRLPAW

SEQ ID NO: 367268 - protein, 24 aa, Mycobacterium
RFMPPIGGILYWLRPNTIRLPAWP

SEQ ID NO: 367269 - protein, 27 aa, Mycobacterium
RFMTPLRVMFVIALVFLALGWSTKAAC

SEQ ID NO: 367270 - protein, 24 aa, Mycobacterium
RFNERFAAFGLPDTAMRPSYGLAE

SEQ ID NO: 367271 - protein, 26 aa, Mycobacterium
RFNNPDALLVFLMIAAVWAMMRAVED

SEQ ID NO: 367272 - protein, 19 aa, Mycobacterium
RFPPAVRALFARVPLTQRV

SEQ ID NO: 367273 - protein, 18 aa, Mycobacterium
RFPQWLLDLEPFGHIPRI

SEQ ID NO: 367274 - protein, 20 aa, Mycobacterium
RFQILLRHALPNALGPVIAV

SEQ ID NO: 367275 - protein, 18 aa, Mycobacterium
RFRDFAYVAFTVGMTYQV

SEQ ID NO: 367276 - protein, 26 aa, Mycobacterium
RFRGELLLGIVLIGLAYFPLTAQSSA

SEQ ID NO: 367277 - protein, 24 aa, Mycobacterium
RFRGELLLGLLLTGLAYFPLTAQS

SEQ ID NO: 367278 - protein, 25 aa, Mycobacterium
RFRKGLMGVIVVALIIGVGSTLTSV

SEQ ID NO: 367279 - protein, 24 aa, Mycobacterium
RFRQPIHWTPARYLMLAASSGFGF

SEQ ID NO: 367280 - protein, 17 aa, Mycobacterium
RFRRGCAAVPARRAGTA

SEQ ID NO: 367281 - protein, 22 aa, Mycobacterium
RFSALALWCFIAMGVSGVINAL

SEQ ID NO: 367282 - protein, 18 aa, Mycobacterium
RFSQLLIGFSAVVAMTAI

SEQ ID NO: 367283 - protein, 30 aa, Mycobacterium
RFSSRYAVLIIGLWVLLAGAGNLLVPQVES

SEQ ID NO: 367284 - protein, 31 aa, Mycobacterium
RFTDRFQRVFVPVILVGVVLLLFAGFVVDEP

SEQ ID NO: 367285 - protein, 27 aa, Mycobacterium
RFTGKAVWWAASRQLLFGAAAVAATYL

SEQ ID NO: 367286 - protein, 19 aa, Mycobacterium
RFVACPFGVPGARMYRTGD

SEQ ID NO: 367287 - protein, 26 aa, Mycobacterium
RFVFPMTAFFLVWYAIYVALGAFAHD

SEQ ID NO: 367288 - protein, 26 aa, Mycobacterium
RFVFPMTAVFLVWYTTYVLLGAFATD

SEQ ID NO: 367289 - protein, 18 aa, Mycobacterium
RFVHVAIPVMTLPITVVA

SEQ ID NO: 367290 - protein, 18 aa, Mycobacterium
RFVWATAIVWILGGFGTW

SEQ ID NO: 367291 - protein, 33 aa, Mycobacterium
RFWKGVAHHYLRMIYDLLAAGIAFALLAFAFIG

SEQ ID NO: 367292 - protein, 30 aa, Mycobacterium
RFWQHAPKTWLLDMAMLAALSLLYGGFVRW

SEQ ID NO: 367293 - protein, 19 aa, Mycobacterium
RFWRRVGTAVVRWPAPILV

SEQ ID NO: 367294 - protein, 17 aa, Mycobacterium
RFYAWVTTVYLIASVSA

SEQ ID NO: 367295 - protein, 17 aa, Mycobacterium
RFYGARARRLLPASATV

SEQ ID NO: 367296 - protein, 23 aa, Mycobacterium
RGAAFLAMFFASAGLFGVVLSLL

SEQ ID NO: 367297 - protein, 21 aa, Mycobacterium
RGAAIAIVLASVATLAVVIVM

SEQ ID NO: 367298 - protein, 17 aa, Mycobacterium
RGAAPETFVALALPRSI

SEQ ID NO: 367299 - protein, 29 aa, Mycobacterium
RGAAVLAARIMWRLAARPSTHARRVQQLL

SEQ ID NO: 367300 - protein, 21 aa, Mycobacterium
RGAGMLAVPLCLLSAALVLNL

SEQ ID NO: 367301 - protein, 17 aa, Mycobacterium
RGALICVALTVCVALVS

SEQ ID NO: 367302 - protein, 22 aa, Mycobacterium
RGALLSLKVLGALVMAVLMVVG

SEQ ID NO: 367303 - protein, 30 aa, Mycobacterium
RGALPSIPRWLWILLALGFGTAALAGGSPM

SEQ ID NO: 367304 - protein, 27 aa, Mycobacterium
RGALTALPFVGLALGALAAAVVWAGGW

SEQ ID NO: 367305 - protein, 20 aa, Mycobacterium
RGAMAFGKLLPVGIGALIGG

SEQ ID NO: 367306 - protein, 22 aa, Mycobacterium
RGANVFFMLGGQRLDLSSLQKV

SEQ ID NO: 367307 - protein, 27 aa, Mycobacterium
RGARRTRLVLAGAFALLLLAAAASAQW

SEQ ID NO: 367308 - protein, 26 aa, Mycobacterium
RGARTALIERAAFLGGTATGAMVASF

SEQ ID NO: 367309 - protein, 25 aa, Mycobacterium
RGASFVFRHRAGNAAIGVLIVVAAA

SEQ ID NO: 367310 - protein, 34 aa, Mycobacterium
RGASFVFRHRAGNAVILVLMLVAATQLFVLQVSN

SEQ ID NO: 367311 - protein, 20 aa, Mycobacterium
RGATIVMLRQFDPKRIWEVF

SEQ ID NO: 367312 - protein, 31 aa, Mycobacterium
RGDAAADVFAFLLRGIGFDADLLDDQRPAGA

SEQ ID NO: 367313 - protein, 18 aa, Mycobacterium
RGDCLPSQLPFRSLFAGP

SEQ ID NO: 367314 - protein, 29 aa, Mycobacterium
RGDLDRTLLLWTLPLLIAPPMYSKDVYSY

SEQ ID NO: 367315 - protein, 29 aa, Mycobacterium
RGDLDRTLLLWVLPLLIAPPMYSKDVYSY

SEQ ID NO: 367316 - protein, 28 aa, Mycobacterium
RGDQLLAVPIWWAYAASLLLITAGLFTK

SEQ ID NO: 367317 - protein, 18 aa, Mycobacterium
RGDTWTELLLTAVSLAVA

SEQ ID NO: 367318 - protein, 22 aa, Mycobacterium
RGDVFFGLILPHGLLELTAVFL

SEQ ID NO: 367319 - protein, 25 aa, Mycobacterium
RGEIGRIFVGNFFPFEGYTGGGGKQ

SEQ ID NO: 367320 - protein, 17 aa, Mycobacterium
RGEPISVLGLALLTSLA

SEQ ID NO: 367321 - protein, 23 aa, Mycobacterium
RGEQYLPAMFFFAVLGFANFADM

SEQ ID NO: 367322 - protein, 20 aa, Mycobacterium
RGEVIAGRRGFALDLADGGH

SEQ ID NO: 367323 - protein, 22 aa, Mycobacterium
RGEYVYLPPAWFAGETPPRLPV

SEQ ID NO: 367324 - protein, 25 aa, Mycobacterium
RGFSLGFWVAMYPLAMLAGQILDIN

SEQ ID NO: 367325 - protein, 18 aa, Mycobacterium
RGFVVAILVFVLVGSFIL

SEQ ID NO: 367326 - protein, 20 aa, Mycobacterium
RGFVVPLCALALLFVDIAAT

SEQ ID NO: 367327 - protein, 25 aa, Mycobacterium
RGGARFRMPGIERVDIMSLEPFNVS

SEQ ID NO: 367328 - protein, 17 aa, Mycobacterium
RGGDTVYLVGPYRELLA

SEQ ID NO: 367329 - protein, 19 aa, Mycobacterium
RGGDTVYLVGPYRELLETL

SEQ ID NO: 367330 - protein, 23 aa, Mycobacterium
RGGILRILRYVAIAIWAAVIVYR

SEQ ID NO: 367331 - protein, 19 aa, Mycobacterium
RGGPYLVRGNQDLLPVAEM

SEQ ID NO: 367332 - protein, 41 aa, Mycobacterium
RGGRHTWLSCVGLLLTLVVSVAYLLIGVLHVRPLASNYALT

SEQ ID NO: 367333 - protein, 22 aa, Mycobacterium
RGGRRWWLGYGAALVGAVTVNV

SEQ ID NO: 367334 - protein, 22 aa, Mycobacterium
RGGTPVAIVLILAIATTLLGVA

SEQ ID NO: 367335 - protein, 29 aa, Mycobacterium
RGHDRAFSWLPMYHDMGFIQVLGGLLYGL

SEQ ID NO: 367336 - protein, 28 aa, Mycobacterium
RGHKVTTSPLPIKPIPPAATTTTGPQHA

SEQ ID NO: 367337 - protein, 30 aa, Mycobacterium
RGHMGFLFGLLNQLLLLGIAVGLLAVIVRG

SEQ ID NO: 367338 - protein, 33 aa, Mycobacterium
RGHRQQVWLSVAGLVLILVVATAYLLVGALRVK

SEQ ID NO: 367339 - protein, 26 aa, Mycobacterium
RGIAVMMQLLLLPVAWYAAVGSHQLA

SEQ ID NO: 367340 - protein, 18 aa, Mycobacterium
RGILMAMLVLVITGTAVL

SEQ ID NO: 367341 - protein, 29 aa, Mycobacterium
RGIRAVQLIFAWMVLSVRLLVARPRAVLW

SEQ ID NO: 367342 - protein, 17 aa, Mycobacterium
RGKLILCAAVGVLSVVV

SEQ ID NO: 367343 - protein, 26 aa, Mycobacterium
RGKPSMLFPLWFMSNANLTTLATGMV

SEQ ID NO: 367344 - protein, 36 aa, Mycobacterium
RGKVQGLQTLLLVVLLALIAVGLGSILYFTPLMSVR

SEQ ID NO: 367345 - protein, 21 aa, Mycobacterium
RGLERGVLTQKLLSVLSSPHG

SEQ ID NO: 367346 - protein, 20 aa, Mycobacterium
RGLEVLPADKIPVLLDETAQ

SEQ ID NO: 367347 - protein, 18 aa, Mycobacterium
RGLFSLLGIMERGQLLPA

SEQ ID NO: 367348 - protein, 19 aa, Mycobacterium
RGLITVRLTPDFDIAQLTR

SEQ ID NO: 367349 - protein, 17 aa, Mycobacterium
RGLITVRLTPDFDMAQV

SEQ ID NO: 367350 - protein, 23 aa, Mycobacterium
RGLKPLPWQILMFSSFGALSIGF

SEQ ID NO: 367351 - protein, 27 aa, Mycobacterium
RGLKRPWLFFVASFFTSFAFPLACYFA

SEQ ID NO: 367352 - protein, 20 aa, Mycobacterium
RGLLPIPRFLARSSFRNSPS

SEQ ID NO: 367353 - protein, 24 aa, Mycobacterium
RGLRRPWLYFVSSLFTSFAFALAF

SEQ ID NO: 367354 - protein, 20 aa, Mycobacterium
RGLRTRLLRAIGPEARRVLV

SEQ ID NO: 367355 - protein, 27 aa, Mycobacterium
RGLRTRLLRAMGPQARRLVVAAPFAGE

SEQ ID NO: 367356 - protein, 18 aa, Mycobacterium
RGLRVTWIAAFGSLVLGF

SEQ ID NO: 367357 - protein, 21 aa, Mycobacterium
RGLRYTTAIALVAVLVGGVYV

SEQ ID NO: 367358 - protein, 18 aa, Mycobacterium
RGLYRRSLRRTFLDELPT

SEQ ID NO: 367359 - protein, 36 aa, Mycobacterium
RGMAPPPPEGPKSPRWLWIAAGAAVLLVVALVIALA

SEQ ID NO: 367360 - protein, 18 aa, Mycobacterium
RGMFSLLGVMERGRMLPP

SEQ ID NO: 367361 - protein, 20 aa, Mycobacterium
RGMIAFLGYHEIIGLSVFAT

SEQ ID NO: 367362 - protein, 32 aa, Mycobacterium
RGMPARGRLVAVLLIGLVLLTAGYTGALGSPI

SEQ ID NO: 367363 - protein, 31 aa, Mycobacterium
RGNQFVMPDLTGQFWTDAEPRLRALGWTGVL

SEQ ID NO: 367364 - protein, 18 aa, Mycobacterium
RGPAATKVGPPRFGAGAK

SEQ ID NO: 367365 - protein, 22 aa, Mycobacterium
RGPAWRLIGTTAVGLLLLTFTP

SEQ ID NO: 367366 - protein, 38 aa, Mycobacterium
RGPAWRLMGIIFATMFFLMFTPTKWIHHFGLFAAVGGA

SEQ ID NO: 367367 - protein, 27 aa, Mycobacterium
RGPAYAVLGAALWIALYLAGIHPTLAG

SEQ ID NO: 367368 - protein, 30 aa, Mycobacterium
RGPELIPVLRDTGLAMLVWAAAVAAALAVA

SEQ ID NO: 367369 - protein, 17 aa, Mycobacterium
RGPMPGGPPPMPVPPAG

SEQ ID NO: 367370 - protein, 23 aa, Mycobacterium
RGPNLAWVLAAYGAAGVLAVGLV

SEQ ID NO: 367371 - protein, 19 aa, Mycobacterium
RGPRLTFQLAAPAAAPTAS

SEQ ID NO: 367372 - protein, 24 aa, Mycobacterium
RGPRSGLMFLALMCTVAAVASALG

SEQ ID NO: 367373 - protein, 22 aa, Mycobacterium
RGPVLLITALHRDFASTDTLAA

SEQ ID NO: 367374 - protein, 23 aa, Mycobacterium
RGQDPWWLLVLSAVLAGTPTMLA

SEQ ID NO: 367375 - protein, 29 aa, Mycobacterium
RGQLDRTLLLWLLPLLVAPPMYSKDVYSY

SEQ ID NO: 367376 - protein, 18 aa, Mycobacterium
RGQRFDRLPPGRAVLLSD

SEQ ID NO: 367377 - protein, 18 aa, Mycobacterium
RGQRFSRLPAGRAMLLGD

SEQ ID NO: 367378 - protein, 26 aa, Mycobacterium
RGQRILLWTVPPAAALFVLAYFLFPV

SEQ ID NO: 367379 - protein, 19 aa, Mycobacterium
RGQRTLLTRAIPFAVLGGV

SEQ ID NO: 367380 - protein, 20 aa, Mycobacterium
RGQRTMVLLRRAYGDRLIEE

SEQ ID NO: 367381 - protein, 25 aa, Mycobacterium
RGQSHRALLLLNLHKLREINQSVGR

SEQ ID NO: 367382 - protein, 25 aa, Mycobacterium
RGQSVPFTLSYPLRAGDRPSLGVQQ

SEQ ID NO: 367383 - protein, 27 aa, Mycobacterium
RGQVVVLGLLAFLLMLSEGSATDWSSL

SEQ ID NO: 367384 - protein, 21 aa, Mycobacterium
RGQWNRLRWQLPASLAGAALG

SEQ ID NO: 367385 - protein, 32 aa, Mycobacterium
RGQWVAVYGLTSLLLAGLPLLAAVTGLAVIAA

SEQ ID NO: 367386 - protein, 20 aa, Mycobacterium
RGQWWVRQVAAPGYGWLARL

SEQ ID NO: 367387 - protein, 21 aa, Mycobacterium
RGRALFLFTVGISLLVLAVLV

SEQ ID NO: 367388 - protein, 25 aa, Mycobacterium
RGRARWRAVRPYLTAFLFGAGGDTR

SEQ ID NO: 367389 - protein, 17 aa, Mycobacterium
RGRDTLFVLYLGTLMVP

SEQ ID NO: 367390 - protein, 22 aa, Mycobacterium
RGRDTLFVLYLGTLMVPLTVTV

SEQ ID NO: 367391 - protein, 18 aa, Mycobacterium
RGRFRSVHPLLYVVAMLF

SEQ ID NO: 367392 - protein, 19 aa, Mycobacterium
RGRGTPTVTFASLIVGFAV

SEQ ID NO: 367393 - protein, 17 aa, Mycobacterium
RGRHSVIAWAMVAALLL

SEQ ID NO: 367394 - protein, 17 aa, Mycobacterium
RGRIAMLLFALSQFVIA

SEQ ID NO: 367395 - protein, 25 aa, Mycobacterium
RGRIPGQRWFAWLSILAIPTPFLAN

SEQ ID NO: 367396 - protein, 26 aa, Mycobacterium
RGRLPLLCCLVAFILTFFVTRTFARI

SEQ ID NO: 367397 - protein, 26 aa, Mycobacterium
RGRLPLLCCLVAFILTFFVTRTFVRV

SEQ ID NO: 367398 - protein, 21 aa, Mycobacterium
RGRLVCPWHGSWFAIESGDVV

SEQ ID NO: 367399 - protein, 19 aa, Mycobacterium
RGRLVLCFQIAIGVGILAA

SEQ ID NO: 367400 - protein, 18 aa, Mycobacterium
RGRNFKLVGSAVAAVFVI

SEQ ID NO: 367401 - protein, 29 aa, Mycobacterium
RGRPKYPGLKALHDMIFELLDDARATGAL

SEQ ID NO: 367402 - protein, 37 aa, Mycobacterium
RGRPSWRVVLIGLAVILAWLLIVVVTSRLLTPHGVGQ

SEQ ID NO: 367403 - protein, 28 aa, Mycobacterium
RGRQRLFEWLFLLVALGNRFLPIFVRQG

SEQ ID NO: 367404 - protein, 22 aa, Mycobacterium
RGRRILVNWVLALLTVPAAALV

SEQ ID NO: 367405 - protein, 21 aa, Mycobacterium
RGRRLRFRPGRAVTGVALLVV

SEQ ID NO: 367406 - protein, 17 aa, Mycobacterium
RGRWGRSGPMTRGLSAL

SEQ ID NO: 367407 - protein, 24 aa, Mycobacterium
RGSDNWWRFIRNSRIPEPPVVLLE

SEQ ID NO: 367408 - protein, 32 aa, Mycobacterium
RGSLIAAVVLIVLPLLTFGMAYMIVDVPKPGD

SEQ ID NO: 367409 - protein, 23 aa, Mycobacterium
RGSLLVYSIPAAIFTLGCFYVAG

SEQ ID NO: 367410 - protein, 24 aa, Mycobacterium
RGSSMPFLATWNCTAFVVNPDGWV

SEQ ID NO: 367411 - protein, 24 aa, Mycobacterium
RGSTATIAALLLASGALAGLPPAY

SEQ ID NO: 367412 - protein, 22 aa, Mycobacterium
RGSVYPIIIWELLAGITLLRRR

SEQ ID NO: 367413 - protein, 32 aa, Mycobacterium
RGSWLGHPVHPLLIFLPLGSWMTALLFDLGLR

SEQ ID NO: 367414 - protein, 24 aa, Mycobacterium
RGTAVLWRIHLASALLMVPQTVVL

SEQ ID NO: 367415 - protein, 21 aa, Mycobacterium
RGTLLMLAVLFIVGALWCADA

SEQ ID NO: 367416 - protein, 31 aa, Mycobacterium
RGTPLLLQLFLIFFALPEFGVKISPFPAAVI

SEQ ID NO: 367417 - protein, 31 aa, Mycobacterium
RGTPLLVQLFLVFYALPEFGVRIDPFPAAVI

SEQ ID NO: 367418 - protein, 26 aa, Mycobacterium
RGTPTLALLFVAAALRFVSGTLGQGL

SEQ ID NO: 367419 - protein, 31 aa, Mycobacterium
RGTPVLVQLIFWFNFAALYPHLSFGIPGVDI

SEQ ID NO: 367420 - protein, 25 aa, Mycobacterium
RGTRLPIAPWEQAAHLLDYGFSTPR

SEQ ID NO: 367421 - protein, 22 aa, Mycobacterium
RGVALSFWLIAPYIAVESVRSL

SEQ ID NO: 367422 - protein, 23 aa, Mycobacterium
RGVAVSFWLTAPYIAAESIRHLA

SEQ ID NO: 367423 - protein, 37 aa, Mycobacterium
RGVFDVLKQALASSYIWFFLCPGLPELAIWSRISVSV

SEQ ID NO: 367424 - protein, 30 aa, Mycobacterium
RGVIYDIALWMVPFGLIGGRLYHLSTDWQT

SEQ ID NO: 367425 - protein, 18 aa, Mycobacterium
RGVIYDIALWTVPFGLIG

SEQ ID NO: 367426 - protein, 17 aa, Mycobacterium
RGVNFFTSTFSQLSLAI

SEQ ID NO: 367427 - protein, 25 aa, Mycobacterium
RGVQKWWVLVPLSVATWVLMHESGV

SEQ ID NO: 367428 - protein, 33 aa, Mycobacterium
RGVRGALVIGVLLLAIVGGATGWLVWQTQRAEQ

SEQ ID NO: 367429 - protein, 20 aa, Mycobacterium
RGVRLLGLVALEDPPREGIG

SEQ ID NO: 367430 - protein, 26 aa, Mycobacterium
RGVRRWALILIPLGAASFVLPGVGNR

SEQ ID NO: 367431 - protein, 26 aa, Mycobacterium
RGVRTPFLLLPLAVVAWALMHASGVH

SEQ ID NO: 367432 - protein, 42 aa, Mycobacterium
RGVVLGVAAGILVAALLGGGGFVGWQLWQTKQVIAAGNQARD

SEQ ID NO: 367433 - protein, 29 aa, Mycobacterium
RGVVPTIPWWMWLLVAFGALTATFAGGSP

SEQ ID NO: 367434 - protein, 19 aa, Mycobacterium
RGVVRGLKMLLATVVVVVV

SEQ ID NO: 367435 - protein, 17 aa, Mycobacterium
RGWALRVLAVLVAIIGA

SEQ ID NO: 367436 - protein, 20 aa, Mycobacterium
RGWAQRPFIGSFVALLAGIA

SEQ ID NO: 367437 - protein, 22 aa, Mycobacterium
RGWLAILSLRLIPAVPFAALNY

SEQ ID NO: 367438 - protein, 27 aa, Mycobacterium
RGWRRVGVAVVRWPGPILVGAVLVTVI

SEQ ID NO: 367439 - protein, 27 aa, Mycobacterium
RGWSDRALLLAGVAVLAILGLVTGLLL

SEQ ID NO: 367440 - protein, 27 aa, Mycobacterium
RGYDVLPETRWIPVVTFLQVSADMAVA

SEQ ID NO: 367441 - protein, 30 aa, Mycobacterium
RGYDVLPQTRWIPLVTFLQVSADMAVAVDV

SEQ ID NO: 367442 - protein, 27 aa, Mycobacterium
RGYDVLPQTRWIPVVTFLQVSADMAVA

SEQ ID NO: 367443 - protein, 30 aa, Mycobacterium
RGYDVLPSMEWIPFVTFLQVSADMAVAVDV

SEQ ID NO: 367444 - protein, 17 aa, Mycobacterium
RGYFFANVAERWSSTVA

SEQ ID NO: 367445 - protein, 17 aa, Mycobacterium
RGYGYFFDEAYFVVAGR

SEQ ID NO: 367446 - protein, 20 aa, Mycobacterium
RGYLAIALPVGTVGLLASRS

SEQ ID NO: 367447 - protein, 20 aa, Mycobacterium
RGYLAVALPVGTIGLLMSRN

SEQ ID NO: 367448 - protein, 20 aa, Mycobacterium
RGYLAVALPVGTLGLLLERR

SEQ ID NO: 367449 - protein, 20 aa, Mycobacterium
RGYLAVALPVGTLGLLTSRN

SEQ ID NO: 367450 - protein, 18 aa, Mycobacterium
RGYPLVSFFMFDANSRRQ

SEQ ID NO: 367451 - protein, 18 aa, Mycobacterium
RGYRLVFSNGIITLTALS

SEQ ID NO: 367452 - protein, 24 aa, Mycobacterium
RHADTWILALLYIGTFGSFIGYSA

SEQ ID NO: 367453 - protein, 20 aa, Mycobacterium
RHAGGFLGFALGGPLSDGLT

SEQ ID NO: 367454 - protein, 26 aa, Mycobacterium
RHALAYTVFAVLLLVSVLWSEHVRHR

SEQ ID NO: 367455 - protein, 24 aa, Mycobacterium
RHDALRIRLHRPAPMLWSLETTAA

SEQ ID NO: 367456 - protein, 17 aa, Mycobacterium
RHDALVLRPGALRTLDR

SEQ ID NO: 367457 - protein, 18 aa, Mycobacterium
RHDLPASLVVFLVALPLS

SEQ ID NO: 367458 - protein, 24 aa, Mycobacterium
RHDPFLDLRFFRSIPFTTATINAI

SEQ ID NO: 367459 - protein, 44 aa, Mycobacterium
RHDTVTLLRPSGVLRRLGLVAALPLSLVAIAAAAIAIFAVRHQD

SEQ ID NO: 367460 - protein, 18 aa, Mycobacterium
RHDWPFAAGAFAAALPWL

SEQ ID NO: 367461 - protein, 25 aa, Mycobacterium
RHDWPFAAQAFDAALPWLAGRLGVP

SEQ ID NO: 367462 - protein, 17 aa, Mycobacterium
RHDWREWISPDVDYIAL

SEQ ID NO: 367463 - protein, 26 aa, Mycobacterium
RHEGIRLRTKLRLFGFEVIETVSEEA

SEQ ID NO: 367464 - protein, 34 aa, Mycobacterium
RHESPVMDLVIFLPLLIIMGAFMFFASRRQKKAM

SEQ ID NO: 367465 - protein, 22 aa, Mycobacterium
RHFPHLPPLPSVITIPGMPSPI

SEQ ID NO: 367466 - protein, 28 aa, Mycobacterium
RHFPISQSIPQYILIQSPKDLRNPQALA

SEQ ID NO: 367467 - protein, 25 aa, Mycobacterium
RHFVSRAVGLVPWRSWRREQNGEAG

SEQ ID NO: 367468 - protein, 22 aa, Mycobacterium
RHGPRWLMTAGSLWGPAALIGV

SEQ ID NO: 367469 - protein, 18 aa, Mycobacterium
RHGQWWLGSAAALSSFTL

SEQ ID NO: 367470 - protein, 45 aa, Mycobacterium
RHGRPFRRRNYIPGIVLFVALAVVTLMVWVMALNQPIDVQQALEC

SEQ ID NO: 367471 - protein, 24 aa, Mycobacterium
RHHQLLRKLPILRLSERLMIWTIF

SEQ ID NO: 367472 - protein, 18 aa, Mycobacterium
RHHVEGLIVFAIALALTS

SEQ ID NO: 367473 - protein, 28 aa, Mycobacterium
RHIAIALALFAVALSAPLWGLSPPILLA

SEQ ID NO: 367474 - protein, 19 aa, Mycobacterium
RHIAYRVLAQRDWGHDWAG

SEQ ID NO: 367475 - protein, 21 aa, Mycobacterium
RHIRLWVVYVDNFSGQSAMNW

SEQ ID NO: 367476 - protein, 25 aa, Mycobacterium
RHITRRALPFSVASGALVGLLSVAR

SEQ ID NO: 367477 - protein, 18 aa, Mycobacterium
RHIVRLMKVLRAHPGSVI

SEQ ID NO: 367478 - protein, 21 aa, Mycobacterium
RHLLDRTLFARAFGVLGPVEA

SEQ ID NO: 367479 - protein, 30 aa, Mycobacterium
RHLRTTITWIAVPSVLWIAFASLITDDYHA

SEQ ID NO: 367480 - protein, 32 aa, Mycobacterium
RHLVRLALFAGFLLGMFYLVAVARVIDIAGIR

SEQ ID NO: 367481 - protein, 22 aa, Mycobacterium
RHMGLFVVGRLAARHGIRVGLR

SEQ ID NO: 367482 - protein, 22 aa, Mycobacterium
RHMLLYAAAMGVAWLLDVPALI

SEQ ID NO: 367483 - protein, 27 aa, Mycobacterium
RHPFIDLRFFRSIPFASATLTAICACM

SEQ ID NO: 367484 - protein, 19 aa, Mycobacterium
RHPFLVMELVEGGTLRELL

SEQ ID NO: 367485 - protein, 34 aa, Mycobacterium
RHPGKTAPLVISGWMLVVWMLVAVGSGIGYAASV

SEQ ID NO: 367486 - protein, 26 aa, Mycobacterium
RHPHWKRLIWPVVALLLATALASFGS

SEQ ID NO: 367487 - protein, 28 aa, Mycobacterium
RHPHWTRLVWPVVVLILITGLAALGSGF

SEQ ID NO: 367488 - protein, 25 aa, Mycobacterium
RHPLMTGLLICFWSASTFTAGHLLW

SEQ ID NO: 367489 - protein, 19 aa, Mycobacterium
RHQMVAFLRACVIAAILLG

SEQ ID NO: 367490 - protein, 26 aa, Mycobacterium
RHQVSGWRFVMRRIASGIALHDTRML

SEQ ID NO: 367491 - protein, 24 aa, Mycobacterium
RHRDIAYLLVLIWALIGIAVRLHD

SEQ ID NO: 367492 - protein, 19 aa, Mycobacterium
RHRILALFAAGAVGLVVVL

SEQ ID NO: 367493 - protein, 21 aa, Mycobacterium
RHRILALIAAAAMALVVVLVV

SEQ ID NO: 367494 - protein, 23 aa, Mycobacterium
RHRKIFLIGLGVVGVLVISLCIA

SEQ ID NO: 367495 - protein, 33 aa, Mycobacterium
RHRNPVLEFLGYFWAPIPWMIEVALALSVAARH

SEQ ID NO: 367496 - protein, 25 aa, Mycobacterium
RHRPPSLFFIRTTDDRGRVVIMLND

SEQ ID NO: 367497 - protein, 19 aa, Mycobacterium
RHRRELVYLPPAWFNSNPP

SEQ ID NO: 367498 - protein, 17 aa, Mycobacterium
RHRRLLVTLSVAVAIGA

SEQ ID NO: 367499 - protein, 28 aa, Mycobacterium
RHRTDAVWPLRWLRNAALAFTFLNALVD

SEQ ID NO: 367500 - protein, 29 aa, Mycobacterium
RHTARMWRVWLFTVIGCNPVLFTLAAGML

SEQ ID NO: 367501 - protein, 25 aa, Mycobacterium
RHTVSPWFRSIWILQPRGDLMVQAP

SEQ ID NO: 367502 - protein, 25 aa, Mycobacterium
RHVPPYSLLIAVIIPAVLIVGSLIS

SEQ ID NO: 367503 - protein, 30 aa, Mycobacterium
RHVYAVIDTLVPLLRRPAVIVGKSTVPVGT

SEQ ID NO: 367504 - protein, 17 aa, Mycobacterium
RHWQWCLIAVGMFQIAI

SEQ ID NO: 367505 - protein, 19 aa, Mycobacterium
RHYRFAVAYLMVLPVIILV

SEQ ID NO: 367506 - protein, 21 aa, Mycobacterium
RIAAAYSWGLAFLGRTRGQMA

SEQ ID NO: 367507 - protein, 23 aa, Mycobacterium
RIAEPQWGPPIGRVLASLLAEGR

SEQ ID NO: 367508 - protein, 38 aa, Mycobacterium
RIAETIRVLLLITLAIVFMNFFPVTAVMIVFLALLNDG

SEQ ID NO: 367509 - protein, 17 aa, Mycobacterium
RIAFWLSAVVVLIGYYI

SEQ ID NO: 367510 - protein, 19 aa, Mycobacterium
RIAIFYVGSLVLLALLLPY

SEQ ID NO: 367511 - protein, 24 aa, Mycobacterium
RIAKPLVPAIMITAAAIAVLGSVF

SEQ ID NO: 367512 - protein, 24 aa, Mycobacterium
RIAKPLVPGVMIAAALIAMIGSLL

SEQ ID NO: 367513 - protein, 17 aa, Mycobacterium
RIALAELAAALAVADDE

SEQ ID NO: 367514 - protein, 23 aa, Mycobacterium
RIALGLTAVAWALLYLIHRRNVA

SEQ ID NO: 367515 - protein, 23 aa, Mycobacterium
RIARPLVPAIMALAAAIAAVGAV

SEQ ID NO: 367516 - protein, 23 aa, Mycobacterium
RIARPLVPAIMALAAGIAAVGAV

SEQ ID NO: 367517 - protein, 24 aa, Mycobacterium
RIARPLVPGIMIAGAATAAVGSVF

SEQ ID NO: 367518 - protein, 24 aa, Mycobacterium
RIARPLVPGIMVTGALIAGTGSVL

SEQ ID NO: 367519 - protein, 23 aa, Mycobacterium
RIATYVVRWPGPVLAGSMAVLAI

SEQ ID NO: 367520 - protein, 24 aa, Mycobacterium
RIDFLRTRGLLPVLRYIIAGIGGS

SEQ ID NO: 367521 - protein, 24 aa, Mycobacterium
RIDGELILLWTLPATLIIWIAGFV

SEQ ID NO: 367522 - protein, 23 aa, Mycobacterium
RIDHWLNVLFLTLVIRSGIEILS

SEQ ID NO: 367523 - protein, 34 aa, Mycobacterium
RIDRLRAALPYDLPASLVVFLVALPLSLGIAIAS

SEQ ID NO: 367524 - protein, 21 aa, Mycobacterium
RIDTALSVPQLSRSEWRLRIH

SEQ ID NO: 367525 - protein, 28 aa, Mycobacterium
RIESLLPAILEGRQLWQRVQAAVSVLLG

SEQ ID NO: 367526 - protein, 18 aa, Mycobacterium
RIFPGLWVCLAIIAFVIA

SEQ ID NO: 367527 - protein, 24 aa, Mycobacterium
RIFPGLWVCLLITAFVIAPVSVWI

SEQ ID NO: 367528 - protein, 26 aa, Mycobacterium
RIGAAVVRWPGPILVVTCGIALVGLL

SEQ ID NO: 367529 - protein, 36 aa, Mycobacterium
RIGARPRAVWWELVRLRLRGAAPSLRRARRAAEDVA

SEQ ID NO: 367530 - protein, 18 aa, Mycobacterium
RIGHIHFPLIMAVYDSFI

SEQ ID NO: 367531 - protein, 28 aa, Mycobacterium
RIGLDQLSWITPARWGFAASASTVDLIR

SEQ ID NO: 367532 - protein, 25 aa, Mycobacterium
RIGRPLIRRFFLNERLNAMFRYALV

SEQ ID NO: 367533 - protein, 38 aa, Mycobacterium
RIGTLLVPAQLPLNTLRRWQRMVPAIEALLTAAMDREH

SEQ ID NO: 367534 - protein, 22 aa, Mycobacterium
RIGTPFFFQNVVGAAIATLVAV

SEQ ID NO: 367535 - protein, 22 aa, Mycobacterium
RIGVKPIMWTGCALLIVGSIPA

SEQ ID NO: 367536 - protein, 31 aa, Mycobacterium
RIHGIKNWKTAILAATLVLFLGGGVAGIMFG

SEQ ID NO: 367537 - protein, 32 aa, Mycobacterium
RIKGDPMLLTMLWQNLIGNAVKFRHKDRRPRV

SEQ ID NO: 367538 - protein, 34 aa, Mycobacterium
RIKPAWWTWILIAALGVFFFTTGSLFAGTFRSFV

SEQ ID NO: 367539 - protein, 20 aa, Mycobacterium
RILAWYVFRVGRRRLDEQLR

SEQ ID NO: 367540 - protein, 33 aa, Mycobacterium
RILLVATMLVATAWWLFEWEIGKGASVEVARTA

SEQ ID NO: 367541 - protein, 24 aa, Mycobacterium
RILMVWIGFLMTALGFREGAHIAL

SEQ ID NO: 367542 - protein, 23 aa, Mycobacterium
RILPAFYICLIITAVVIAPLGVA

SEQ ID NO: 367543 - protein, 26 aa, Mycobacterium
RILQLWVPQIPLWVLSLGLLLALTAT

SEQ ID NO: 367544 - protein, 23 aa, Mycobacterium
RILRVLRGFEPDVVHLASPALLG

SEQ ID NO: 367545 - protein, 20 aa, Mycobacterium
RILSIGMVLAALVIASAFAT

SEQ ID NO: 367546 - protein, 26 aa, Mycobacterium
RIMAGLVVIIPLYALAMIMSFFSPQM

SEQ ID NO: 367547 - protein, 36 aa, Mycobacterium
RIMVQNIAFSLAIIAVLIPLAAFGVLGLATVVLIHE

SEQ ID NO: 367548 - protein, 30 aa, Mycobacterium
RINASWPQVMPWTALWLGALSTAILVQSGH

SEQ ID NO: 367549 - protein, 17 aa, Mycobacterium
RINPGLVVGALGILVMV

SEQ ID NO: 367550 - protein, 20 aa, Mycobacterium
RINVTWFSWLSAVGEIGTGL

SEQ ID NO: 367551 - protein, 18 aa, Mycobacterium
RIPALIGAAWAYSVWHNG

SEQ ID NO: 367552 - protein, 34 aa, Mycobacterium
RIPARVSLAVLFVWGFGMALWTTLYGMANPVFIP

SEQ ID NO: 367553 - protein, 27 aa, Mycobacterium
RIPGRRWFAWFALLTIPAPFLANMFGW

SEQ ID NO: 367554 - protein, 26 aa, Mycobacterium
RIPNQRWFSWFALLTIPTPFLANISG

SEQ ID NO: 367555 - protein, 34 aa, Mycobacterium
RIPRGVLPSIPGWLWFLLLLGAVTATFAGGTPEF

SEQ ID NO: 367556 - protein, 17 aa, Mycobacterium
RIPVIRGVHSYLLRRRF

SEQ ID NO: 367557 - protein, 18 aa, Mycobacterium
RIPYAMAANWFGGRNWTM

SEQ ID NO: 367558 - protein, 30 aa, Mycobacterium
RIQPGVLILVLYFFLWLTTYGVALLNFDPS

SEQ ID NO: 367559 - protein, 31 aa, Mycobacterium
RIQRSPLPFGRHRWVVDARAPDIAREPTQPR

SEQ ID NO: 367560 - protein, 25 aa, Mycobacterium
RIRAALIIWGGWLVVTAVVFSYMNG

SEQ ID NO: 367561 - protein, 17 aa, Mycobacterium
RIRAWRRIGTMVVRWPG

SEQ ID NO: 367562 - protein, 24 aa, Mycobacterium
RIRGWRRLGAFVVRWPGAVLMATV

SEQ ID NO: 367563 - protein, 22 aa, Mycobacterium
RIRIQLILTTFVVIANLLGIAV

SEQ ID NO: 367564 - protein, 21 aa, Mycobacterium
RIRISVLLRGWNKMPAMAAAQ

SEQ ID NO: 367565 - protein, 23 aa, Mycobacterium
RIRLRLIISCALVLIPWTVFLGL

SEQ ID NO: 367566 - protein, 18 aa, Mycobacterium
RIRLTEIPVLVVGLAVML

SEQ ID NO: 367567 - protein, 21 aa, Mycobacterium
RIRRGTLIGLPIYALQRDPRW

SEQ ID NO: 367568 - protein, 26 aa, Mycobacterium
RIRRLIVRWWIAWVASYLVSVFAMFT

SEQ ID NO: 367569 - protein, 19 aa, Mycobacterium
RIRSWRKIGTTIVRWPGPV

SEQ ID NO: 367570 - protein, 28 aa, Mycobacterium
RIRTQLAARLPGYMVPAAVVVIDALPLT

SEQ ID NO: 367571 - protein, 17 aa, Mycobacterium
RIRTTFLAYLALTKPRV

SEQ ID NO: 367572 - protein, 26 aa, Mycobacterium
RISGATIFFFLFVHVLDAAMLRVSPQ

SEQ ID NO: 367573 - protein, 24 aa, Mycobacterium
RISGATIFFFLFVHVLDTALVRVS

SEQ ID NO: 367574 - protein, 19 aa, Mycobacterium
RISLIAFGRLVISAGLVGL

SEQ ID NO: 367575 - protein, 21 aa, Mycobacterium
RITGFARIVLLAAILGAALSS

SEQ ID NO: 367576 - protein, 23 aa, Mycobacterium
RITGFIRIVLLAAILGAALSSAF

SEQ ID NO: 367577 - protein, 18 aa, Mycobacterium
RITHRDAGGTRRSWISLT

SEQ ID NO: 367578 - protein, 17 aa, Mycobacterium
RITIALARLSPSRPAVD

SEQ ID NO: 367579 - protein, 17 aa, Mycobacterium
RITRRALPFSVAGGALV

SEQ ID NO: 367580 - protein, 21 aa, Mycobacterium
RITRRALPFSVASGGLVGLLS

SEQ ID NO: 367581 - protein, 25 aa, Mycobacterium
RITRREWLSAVLLAAALATLITAGD

SEQ ID NO: 367582 - protein, 17 aa, Mycobacterium
RITRWFAAHWRVSRSLV

SEQ ID NO: 367583 - protein, 17 aa, Mycobacterium
RITRWFGRRWGSGRSLA

SEQ ID NO: 367584 - protein, 33 aa, Mycobacterium
RITSATRLYLPMPFFWVGGFGGGILSALLAGAT

SEQ ID NO: 367585 - protein, 25 aa, Mycobacterium
RIVAGFVVIIPLYAMAIIMSFLSAQ

SEQ ID NO: 367586 - protein, 17 aa, Mycobacterium
RIVLLPQAFRAVVIPLG

SEQ ID NO: 367587 - protein, 18 aa, Mycobacterium
RIVLVPVFVVVLFTEGGH

SEQ ID NO: 367588 - protein, 17 aa, Mycobacterium
RIVMLTGDHPDIAKVVA

SEQ ID NO: 367589 - protein, 17 aa, Mycobacterium
RIVPIPLADAALVDLVR

SEQ ID NO: 367590 - protein, 26 aa, Mycobacterium
RIVQPFGEYLPWRSFFSKLSSYADRA

SEQ ID NO: 367591 - protein, 33 aa, Mycobacterium
RIVRRPRVHLIGSLIVLAILASSTLLVRFNYDD

SEQ ID NO: 367592 - protein, 18 aa, Mycobacterium
RIVVGLLVAIGVAVAVGA

SEQ ID NO: 367593 - protein, 17 aa, Mycobacterium
RIWDSAACKAWLLTQPY

SEQ ID NO: 367594 - protein, 23 aa, Mycobacterium
RIYHVITDWKTYFGPTGKGFGAA

SEQ ID NO: 367595 - protein, 24 aa, Mycobacterium
RKARLLAIVTGFLGALLAIATPLL

SEQ ID NO: 367596 - protein, 23 aa, Mycobacterium
RKAVYSAVFLACTMISLAVLYIA

SEQ ID NO: 367597 - protein, 20 aa, Mycobacterium
RKEHWLDVHFAHGSSSVLMP

SEQ ID NO: 367598 - protein, 18 aa, Mycobacterium
RKELAHILTTAKPRVFVT

SEQ ID NO: 367599 - protein, 19 aa, Mycobacterium
RKELWLRAANAVAFILMVC

SEQ ID NO: 367600 - protein, 33 aa, Mycobacterium
RKEMIAYTTTVLFFLIFMVAMIGGVDLGLARLI

SEQ ID NO: 367601 - protein, 21 aa, Mycobacterium
RKFSAPYMSGLVGLAYNRAAT

SEQ ID NO: 367602 - protein, 37 aa, Mycobacterium
RKGRFWISLHAASTRRALLLTALGGLLIAGLITALPR

SEQ ID NO: 367603 - protein, 22 aa, Mycobacterium
RKGTRLGVRTLAIGSGAVLLAG

SEQ ID NO: 367604 - protein, 20 aa, Mycobacterium
RKIENVVLVSAFLAAAALAH

SEQ ID NO: 367605 - protein, 25 aa, Mycobacterium
RKIGTTIVRWPGPVLAAAMAIAIIG

SEQ ID NO: 367606 - protein, 18 aa, Mycobacterium
RKIHTFSVPPNMVAPLLA

SEQ ID NO: 367607 - protein, 20 aa, Mycobacterium
RKKLLQLSLLLVGAATFLMG

SEQ ID NO: 367608 - protein, 23 aa, Mycobacterium
RKKLLVLSLLLMGSATVAIGLIP

SEQ ID NO: 367609 - protein, 29 aa, Mycobacterium
RKKRSQPWILLAATMAMAVLIVVGVIGYR

SEQ ID NO: 367610 - protein, 32 aa, Mycobacterium
RKLARVGSYGAWFPYYICGISFRASDLEGRTV

SEQ ID NO: 367611 - protein, 26 aa, Mycobacterium
RKLEAFAMFNIFYQAGILLGPLVGLA

SEQ ID NO: 367612 - protein, 21 aa, Mycobacterium
RKLGAAIARWPGPILITASVL

SEQ ID NO: 367613 - protein, 26 aa, Mycobacterium
RKLLIGIAVFGAIAALAVLFGVLKYA

SEQ ID NO: 367614 - protein, 18 aa, Mycobacterium
RKLLRGNAPARVRLIGGS

SEQ ID NO: 367615 - protein, 33 aa, Mycobacterium
RKLVIACGLLLLIWVTRVPVPVGLRRITAILAG

SEQ ID NO: 367616 - protein, 21 aa, Mycobacterium
RKMKQNLWWGAGYNLIAVPLA

SEQ ID NO: 367617 - protein, 28 aa, Mycobacterium
RKMLAVRMLFLVFAVIAGLGISLLGPNV

SEQ ID NO: 367618 - protein, 24 aa, Mycobacterium
RKNWIIGAAVVAVLLVVAGATAFV

SEQ ID NO: 367619 - protein, 24 aa, Mycobacterium
RKPRRRVRPLLLAGVAVAVLAGGA

SEQ ID NO: 367620 - protein, 40 aa, Mycobacterium
RKQSWLGRFVSTYGWRAYALPVLMVLTVVVGYQTVTGTTS

SEQ ID NO: 367621 - protein, 26 aa, Mycobacterium
RKRDDGICRVPWPIELHDSKGSNLHW

SEQ ID NO: 367622 - protein, 25 aa, Mycobacterium
RKRDRLYTALWGVGTLFGGLASASR

SEQ ID NO: 367623 - protein, 26 aa, Mycobacterium
RKRKLPRALTGLAVVGLLGAGAVAFS

SEQ ID NO: 367624 - protein, 22 aa, Mycobacterium
RKRLLMTGLVIFGLVSIPAAFA

SEQ ID NO: 367625 - protein, 22 aa, Mycobacterium
RKRMFVFGVVLFTIASGLCAVA

SEQ ID NO: 367626 - protein, 26 aa, Mycobacterium
RKRMSWQRWALLFVGIAQVAVGIVQG

SEQ ID NO: 367627 - protein, 18 aa, Mycobacterium
RKRRIGPVWLTAAGYTVA

SEQ ID NO: 367628 - protein, 21 aa, Mycobacterium
RKRRQYTIIGSAVGGVLVVAA

SEQ ID NO: 367629 - protein, 29 aa, Mycobacterium
RKRRWALRFAVFFTFATGFWVFVTAVLAA

SEQ ID NO: 367630 - protein, 27 aa, Mycobacterium
RKRVAVVSFPRDLAIQPTLCEVWNEDT

SEQ ID NO: 367631 - protein, 22 aa, Mycobacterium
RKRVLMFTILLMAVSTTATGLL

SEQ ID NO: 367632 - protein, 23 aa, Mycobacterium
RKRVVAVSFPRDLAITPIQCEAW

SEQ ID NO: 367633 - protein, 23 aa, Mycobacterium
RKRYMWLYGMIPPTAIFIATALV

SEQ ID NO: 367634 - protein, 40 aa, Mycobacterium
RKSNGWKIFRNVMIALVLLAIVIPLATFALAYSVVDIPKP

SEQ ID NO: 367635 - protein, 22 aa, Mycobacterium
RKSPTLIPAPIPPTSGPELPTS

SEQ ID NO: 367636 - protein, 33 aa, Mycobacterium
RKTAAWAWRLLVILFALLALLWVVKKLEVIIVP

SEQ ID NO: 367637 - protein, 37 aa, Mycobacterium
RKVASTLLESFLFYSGFYLPMYWSSRAKLTNTADMIR

SEQ ID NO: 367638 - protein, 23 aa, Mycobacterium
RKVFVLGVVWFALASIACGLAPS

SEQ ID NO: 367639 - protein, 31 aa, Mycobacterium
RKVGALVVRWPGPILVLTIGVALVGLLTLPG

SEQ ID NO: 367640 - protein, 29 aa, Mycobacterium
RKVLGPLRDLFAAIFFLAIGLSVSPKELL

SEQ ID NO: 367641 - protein, 17 aa, Mycobacterium
RKWTQQVMRRPWLSALG

SEQ ID NO: 367642 - protein, 17 aa, Mycobacterium
RKYLTLMSFRVPALILA

SEQ ID NO: 367643 - protein, 25 aa, Mycobacterium
RKYQFRKRMLMAMAVVLVGSATAAF

SEQ ID NO: 367644 - protein, 30 aa, Mycobacterium
RKYRWLVFTGWLLALVPAVYLALTQSGNLT

SEQ ID NO: 367645 - protein, 29 aa, Mycobacterium
RLADLFLPHGIWLLGYQIYLWDMRFRVRR

SEQ ID NO: 367646 - protein, 30 aa, Mycobacterium
RLADRAAGWLFWFALVTALVTAAAWSAIGD

SEQ ID NO: 367647 - protein, 23 aa, Mycobacterium
RLAFTIQARALTFQPKRVRQQLE

SEQ ID NO: 367648 - protein, 18 aa, Mycobacterium
RLAGRGAPAHRVWLPPLT

SEQ ID NO: 367649 - protein, 24 aa, Mycobacterium
RLAGVPGRALRLAAAALGAGGEVQ

SEQ ID NO: 367650 - protein, 26 aa, Mycobacterium
RLAHHRVKPREWIWALVLAAGLAVVI

SEQ ID NO: 367651 - protein, 19 aa, Mycobacterium
RLAIFGAVVIGYLLALVLG

SEQ ID NO: 367652 - protein, 25 aa, Mycobacterium
RLAKRLLIGFLSAGALILVLGSVFV

SEQ ID NO: 367653 - protein, 18 aa, Mycobacterium
RLALLQYERAAVAEWPIA

SEQ ID NO: 367654 - protein, 26 aa, Mycobacterium
RLANKPPWYRSLFVQLLVAIVAGVVI

SEQ ID NO: 367655 - protein, 20 aa, Mycobacterium
RLAPGWHHLADIPGAGRTGR

SEQ ID NO: 367656 - protein, 19 aa, Mycobacterium
RLAPIRPIRWVCTVIVEFF

SEQ ID NO: 367657 - protein, 21 aa, Mycobacterium
RLAPTWSFHFGLLLLGWGVFN

SEQ ID NO: 367658 - protein, 18 aa, Mycobacterium
RLAQVLFHPFVAGVVLAA

SEQ ID NO: 367659 - protein, 22 aa, Mycobacterium
RLARALTAAPIPLAAGFMALVF

SEQ ID NO: 367660 - protein, 22 aa, Mycobacterium
RLARRRTAFFVPLLGCVAQVAL

SEQ ID NO: 367661 - protein, 49 aa, Mycobacterium
RLARSTLRTIKGNLFWAFAYNVAALPLAALGLLNPLIAGAAMAFSSVFV

SEQ ID NO: 367662 - protein, 19 aa, Mycobacterium
RLATLVRLELPLAWPVIMT

SEQ ID NO: 367663 - protein, 20 aa, Mycobacterium
RLAVASWLSAVFAAIAAWVG

SEQ ID NO: 367664 - protein, 18 aa, Mycobacterium
RLAVLPRTRQTLLDTVRR

SEQ ID NO: 367665 - protein, 19 aa, Mycobacterium
RLAWFILTSLGQSGHALRY

SEQ ID NO: 367666 - protein, 32 aa, Mycobacterium
RLAWSLTVLVAVAWIARGIFLGRPVTALHAAA

SEQ ID NO: 367667 - protein, 17 aa, Mycobacterium
RLAWTVQYAIWILATIG

SEQ ID NO: 367668 - protein, 26 aa, Mycobacterium
RLDALDFRRFLRRVLRRPKPGQRPLE

SEQ ID NO: 367669 - protein, 25 aa, Mycobacterium
RLDCQTLYRRATMLAHALLSRLPRN

SEQ ID NO: 367670 - protein, 19 aa, Mycobacterium
RLDDARFLLPVLGVPPDQP

SEQ ID NO: 367671 - protein, 24 aa, Mycobacterium
RLDDSRFLLPVLGVPPAEGSDGAG

SEQ ID NO: 367672 - protein, 28 aa, Mycobacterium
RLDEAAGFAIPFLPRGLDDIPRAPHDQD

SEQ ID NO: 367673 - protein, 27 aa, Mycobacterium
RLDEAAGFAIPFLPRGLDEIPRSPNDN

SEQ ID NO: 367674 - protein, 28 aa, Mycobacterium
RLDEAAGFAIPFLPRGLDQIPRSPNDQD

SEQ ID NO: 367675 - protein, 27 aa, Mycobacterium
RLDEAAGFVIPFLPRGLDEIPPSPNDQ

SEQ ID NO: 367676 - protein, 25 aa, Mycobacterium
RLDIAGFLYLVVIFAVSIGTIYLGL

SEQ ID NO: 367677 - protein, 22 aa, Mycobacterium
RLDNARFLLPVVGVPPDQGGDL

SEQ ID NO: 367678 - protein, 22 aa, Mycobacterium
RLDNARFLLPVVGVPPDRADDV

SEQ ID NO: 367679 - protein, 19 aa, Mycobacterium
RLDNARFLLPVVGVPPDRD

SEQ ID NO: 367680 - protein, 18 aa, Mycobacterium
RLEARAVARLRHPGLVAV

SEQ ID NO: 367681 - protein, 17 aa, Mycobacterium
RLEATFDTDPLLRKHFN

SEQ ID NO: 367682 - protein, 18 aa, Mycobacterium
RLEGLIAPGTWNIDPSAQ

SEQ ID NO: 367683 - protein, 21 aa, Mycobacterium
RLEIVDFRRTLLGAVDSDRLT

SEQ ID NO: 367684 - protein, 17 aa, Mycobacterium
RLELWRSDMVRMLSYGA

SEQ ID NO: 367685 - protein, 18 aa, Mycobacterium
RLESRLMVVLGAGFGLGV

SEQ ID NO: 367686 - protein, 18 aa, Mycobacterium
RLETATLLLERIAMHLQH

SEQ ID NO: 367687 - protein, 19 aa, Mycobacterium
RLEYVALTLSLVLSLVGVA

SEQ ID NO: 367688 - protein, 18 aa, Mycobacterium
RLFIIGRQDDMIISGGEN

SEQ ID NO: 367689 - protein, 26 aa, Mycobacterium
RLFQGALINAWQTQAGLISLALLALY

SEQ ID NO: 367690 - protein, 19 aa, Mycobacterium
RLFTPFFITVGLVEAAYFI

SEQ ID NO: 367691 - protein, 18 aa, Mycobacterium
RLFVGAVFLFTLGSLLCA

SEQ ID NO: 367692 - protein, 26 aa, Mycobacterium
RLGALPLWTWLATLLVLMTITPGDDI

SEQ ID NO: 367693 - protein, 17 aa, Mycobacterium
RLGAVMLAAGGIQLLCS

SEQ ID NO: 367694 - protein, 18 aa, Mycobacterium
RLGDWSGRRFKRPPWVAL

SEQ ID NO: 367695 - protein, 28 aa, Mycobacterium
RLGGSGFFALAFWIALAGLTPTGLLLAA

SEQ ID NO: 367696 - protein, 31 aa, Mycobacterium
RLGIFSLVLMLFSVMIIIVFGQIRFDRTYAY

SEQ ID NO: 367697 - protein, 19 aa, Mycobacterium
RLGIVMLGATGLQVLCSVG

SEQ ID NO: 367698 - protein, 22 aa, Mycobacterium
RLGLAEILWDVIPFDWANDSNT

SEQ ID NO: 367699 - protein, 27 aa, Mycobacterium
RLGNVDLHAFWSAWGPNTISPQWVSDA

SEQ ID NO: 367700 - protein, 24 aa, Mycobacterium
RLGQVVAWVVIVAGVVFVAAVIFF

SEQ ID NO: 367701 - protein, 27 aa, Mycobacterium
RLGRKLTLILVLLVSAVALVGLLYAGQ

SEQ ID NO: 367702 - protein, 20 aa, Mycobacterium
RLGRLIAIGGIPLVLAPIGA

SEQ ID NO: 367703 - protein, 26 aa, Mycobacterium
RLGRLMSILSIPMLLAPIGGPILGGW

SEQ ID NO: 367704 - protein, 37 aa, Mycobacterium
RLGRRRIMLVGWSCCLLWSFLVMPLLNTGKPVGYAVA

SEQ ID NO: 367705 - protein, 24 aa, Mycobacterium
RLGVDLIAVLSLGGTLLVGEYLAG

SEQ ID NO: 367706 - protein, 27 aa, Mycobacterium
RLHARLSARRLLPALALFAAAGMGVTL

SEQ ID NO: 367707 - protein, 25 aa, Mycobacterium
RLHDAWWTVILFAAIVAAILVTTVS

SEQ ID NO: 367708 - protein, 24 aa, Mycobacterium
RLHGSLLDRHRPLWEAHLVEGLND

SEQ ID NO: 367709 - protein, 23 aa, Mycobacterium
RLHLYDTLLAIILPSIAFAIPLS

SEQ ID NO: 367710 - protein, 23 aa, Mycobacterium
RLHPLLLLCISAISFSWIEAPYD

SEQ ID NO: 367711 - protein, 28 aa, Mycobacterium
RLHQLRSYRLASLLRIGVVALMIAAMLT

SEQ ID NO: 367712 - protein, 20 aa, Mycobacterium
RLHQVLANLLANAGIHTPAG

SEQ ID NO: 367713 - protein, 18 aa, Mycobacterium
RLHRDVAIKVLRADLARD

SEQ ID NO: 367714 - protein, 29 aa, Mycobacterium
RLHRGLVLIKWWLLAIPHYLILAAFFSGG

SEQ ID NO: 367715 - protein, 17 aa, Mycobacterium
RLHVHGQSPAWPALYPH

SEQ ID NO: 367716 - protein, 19 aa, Mycobacterium
RLIDPAGVRFRPFLAALAA

SEQ ID NO: 367717 - protein, 18 aa, Mycobacterium
RLIEPAGVRFRPFLAALG

SEQ ID NO: 367718 - protein, 22 aa, Mycobacterium
RLIFPLVMVLSFYFFFAGHNVP

SEQ ID NO: 367719 - protein, 23 aa, Mycobacterium
RLIIGLLMTAIVLVFAAKRVLWL

SEQ ID NO: 367720 - protein, 19 aa, Mycobacterium
RLILVGIVSALAVGGVLAV

SEQ ID NO: 367721 - protein, 20 aa, Mycobacterium
RLIRFENMLPPRAHLAFTAM

SEQ ID NO: 367722 - protein, 20 aa, Mycobacterium
RLITLLPALAILAAGIDPTR

SEQ ID NO: 367723 - protein, 20 aa, Mycobacterium
RLITLLPALVILAVGIHPSR

SEQ ID NO: 367724 - protein, 18 aa, Mycobacterium
RLITLWRFDSLVGVAGVV

SEQ ID NO: 367725 - protein, 31 aa, Mycobacterium
RLIVADRAYFIFLALLPFVMGALALTVPGST

SEQ ID NO: 367726 - protein, 24 aa, Mycobacterium
RLKHFNGFVTSLWLTPSDITTDKL

SEQ ID NO: 367727 - protein, 24 aa, Mycobacterium
RLKTFLLLVGMSAMIVFFGALFGR

SEQ ID NO: 367728 - protein, 25 aa, Mycobacterium
RLKTFLLLVGMSGLIVFVGSLFGRN

SEQ ID NO: 367729 - protein, 24 aa, Mycobacterium
RLKTFLLLVVMSAMIVFVGRLFGT

SEQ ID NO: 367730 - protein, 26 aa, Mycobacterium
RLKTLPPSAVIGLWTFDGHEGRSEVP

SEQ ID NO: 367731 - protein, 27 aa, Mycobacterium
RLLAALAALGLLIFAAVSWRCRPKLRL

SEQ ID NO: 367732 - protein, 22 aa, Mycobacterium
RLLAGWATVLLLIALIAGWRGL

SEQ ID NO: 367733 - protein, 18 aa, Mycobacterium
RLLALNPVTLISALVLIA

SEQ ID NO: 367734 - protein, 31 aa, Mycobacterium
RLLAMQVPGQLLFSLASQLSLILLAGATAAL

SEQ ID NO: 367735 - protein, 41 aa, Mycobacterium
RLLARRDVRLILADRLYSAFLVILPFVLAGLTLLIPGDSGF

SEQ ID NO: 367736 - protein, 28 aa, Mycobacterium
RLLATVFGFLVLVLLLSGLNAAVFSGAP

SEQ ID NO: 367737 - protein, 17 aa, Mycobacterium
RLLAVQDPPARRRVGAL

SEQ ID NO: 367738 - protein, 21 aa, Mycobacterium
RLLAYLRSVGVTTLNLWVGVG

SEQ ID NO: 367739 - protein, 19 aa, Mycobacterium
RLLDPWAIALFATAVSAAW

SEQ ID NO: 367740 - protein, 23 aa, Mycobacterium
RLLFDWRFDLVLGTAAIVLALVY

SEQ ID NO: 367741 - protein, 17 aa, Mycobacterium
RLLGPMERLLIVGLGLA

SEQ ID NO: 367742 - protein, 21 aa, Mycobacterium
RLLGWQRQLLAAIEVPYRVID

SEQ ID NO: 367743 - protein, 20 aa, Mycobacterium
RLLLGGCAVIWLAALGAAVA

SEQ ID NO: 367744 - protein, 17 aa, Mycobacterium
RLLLGVAAVVLVADIVT

SEQ ID NO: 367745 - protein, 17 aa, Mycobacterium
RLLLSVAAIVLALDIVT

SEQ ID NO: 367746 - protein, 18 aa, Mycobacterium
RLLLTVAAVVLFLDVVTK

SEQ ID NO: 367747 - protein, 23 aa, Mycobacterium
RLLPTALALIVFIGVATAGLGVL

SEQ ID NO: 367748 - protein, 18 aa, Mycobacterium
RLLPVAIAIIIGALTLFS

SEQ ID NO: 367749 - protein, 35 aa, Mycobacterium
RLLQDGRDMFWSLIPLVIGCVVLAGLLGMCSFQLD

SEQ ID NO: 367750 - protein, 34 aa, Mycobacterium
RLLQDGRDMFWSLIPLVLACIVLAGLVGMCSFAP

SEQ ID NO: 367751 - protein, 31 aa, Mycobacterium
RLLQDGRDMFWSLVPLVIGCILLAGMVGMCS

SEQ ID NO: 367752 - protein, 28 aa, Mycobacterium
RLLQRLTVAEFFRLVWQFGDGSGQPIHA

SEQ ID NO: 367753 - protein, 18 aa, Mycobacterium
RLLRFTALAYILVLVVVP

SEQ ID NO: 367754 - protein, 17 aa, Mycobacterium
RLLSLLRELAWTARLPV

SEQ ID NO: 367755 - protein, 17 aa, Mycobacterium
RLLSSHLVIALAAPAAA

SEQ ID NO: 367756 - protein, 20 aa, Mycobacterium
RLLSSWYRLPPKDATKPLLV

SEQ ID NO: 367757 - protein, 22 aa, Mycobacterium
RLLTALLGVVLLTGAVWLIGYG

SEQ ID NO: 367758 - protein, 20 aa, Mycobacterium
RLLTAMICHLAVFHPPDLLQ

SEQ ID NO: 367759 - protein, 21 aa, Mycobacterium
RLLTAMICHLAVFHPPDLLQI

SEQ ID NO: 367760 - protein, 17 aa, Mycobacterium
RLLTRLDALSLAAASTP

SEQ ID NO: 367761 - protein, 17 aa, Mycobacterium
RLLVITAIGLTVAFLFK

SEQ ID NO: 367762 - protein, 19 aa, Mycobacterium
RLLVRPGITGLWQVSGRSD

SEQ ID NO: 367763 - protein, 22 aa, Mycobacterium
RLMFVWLVLSALTLAYLWIDHS

SEQ ID NO: 367764 - protein, 19 aa, Mycobacterium
RLMKVIPIDRARLRRLPTV

SEQ ID NO: 367765 - protein, 19 aa, Mycobacterium
RLMQHLQSLEAMRSTLLER

SEQ ID NO: 367766 - protein, 24 aa, Mycobacterium
RLNALSYWLFLCGGLITLAGFIAP

SEQ ID NO: 367767 - protein, 21 aa, Mycobacterium
RLNAYFGPLLQSLPAFGQMAV

SEQ ID NO: 367768 - protein, 25 aa, Mycobacterium
RLNDLCDRLWLIAAIEHYTAVLGDF

SEQ ID NO: 367769 - protein, 31 aa, Mycobacterium
RLNEGVWTVVWTPELYALLLVALGGFVGGQL

SEQ ID NO: 367770 - protein, 26 aa, Mycobacterium
RLNPQTIIIVLLLNIGLSISLPGISL

SEQ ID NO: 367771 - protein, 20 aa, Mycobacterium
RLNRWRLVALALGVVAVLAA

SEQ ID NO: 367772 - protein, 24 aa, Mycobacterium
RLNSLFRLDHLAARMRRNGANLLV

SEQ ID NO: 367773 - protein, 19 aa, Mycobacterium
RLPAALIAVAALGLPLLFL

SEQ ID NO: 367774 - protein, 17 aa, Mycobacterium
RLPARFVLGALAGLRMV

SEQ ID NO: 367775 - protein, 33 aa, Mycobacterium
RLPAWFVLIQVYLDALWVFLVLTFSASKGLTFF

SEQ ID NO: 367776 - protein, 18 aa, Mycobacterium
RLPDGLGPLLPLEHDGKP

SEQ ID NO: 367777 - protein, 20 aa, Mycobacterium
RLPFSPWHLVLIPVTFLLIL

SEQ ID NO: 367778 - protein, 17 aa, Mycobacterium
RLPGDILRRLDDFAMES

SEQ ID NO: 367779 - protein, 21 aa, Mycobacterium
RLPIEIAIAVLVLAVLLLVYR

SEQ ID NO: 367780 - protein, 17 aa, Mycobacterium
RLPLAYFDGRQRGELLS

SEQ ID NO: 367781 - protein, 18 aa, Mycobacterium
RLPLSYFDSRQRGEVLSR

SEQ ID NO: 367782 - protein, 30 aa, Mycobacterium
RLPLWAAMLVWVLLWVLYLSIVNVGQAWYS

SEQ ID NO: 367783 - protein, 21 aa, Mycobacterium
RLPPRLPIHKAALLGLSCLGD

SEQ ID NO: 367784 - protein, 18 aa, Mycobacterium
RLPPWPERVPWTAGTKRK

SEQ ID NO: 367785 - protein, 27 aa, Mycobacterium
RLPTTGPVTFFLLATVWFAVMALRAAP

SEQ ID NO: 367786 - protein, 18 aa, Mycobacterium
RLPWSRFHWRVVVGLGGV

SEQ ID NO: 367787 - protein, 25 aa, Mycobacterium
RLPYAMISLVVLFYTQARSGSFGWA

SEQ ID NO: 367788 - protein, 35 aa, Mycobacterium
RLQAFDVFSSFWFTAIYVLLFVSLVGCLTPRMIEH

SEQ ID NO: 367789 - protein, 36 aa, Mycobacterium
RLQAFNVFSSFWFTAIYVLLFVSLVGCLTPRMIEHV

SEQ ID NO: 367790 - protein, 17 aa, Mycobacterium
RLQFTGWLQYLITAVVA

SEQ ID NO: 367791 - protein, 19 aa, Mycobacterium
RLQGLLPEGYAPGACQPLE

SEQ ID NO: 367792 - protein, 25 aa, Mycobacterium
RLQILIAGLLIGLFGAVLALPGTAG

SEQ ID NO: 367793 - protein, 18 aa, Mycobacterium
RLQPKYMDMLNLQEAWQF

SEQ ID NO: 367794 - protein, 20 aa, Mycobacterium
RLQVPVITTARPALDGAVGA

SEQ ID NO: 367795 - protein, 21 aa, Mycobacterium
RLQYWLLTVEVVVLIAFAVVA

SEQ ID NO: 367796 - protein, 18 aa, Mycobacterium
RLRADAPRFALAGDTIAG

SEQ ID NO: 367797 - protein, 26 aa, Mycobacterium
RLRAGDTVYLVGPYRELLATLRKGQP

SEQ ID NO: 367798 - protein, 23 aa, Mycobacterium
RLRAWQAGLLLAGQRFNRDAAGA

SEQ ID NO: 367799 - protein, 17 aa, Mycobacterium
RLRDLFGRYVGTDVARR

SEQ ID NO: 367800 - protein, 25 aa, Mycobacterium
RLRDLTSKVLPLTLAGGAAVTGLAL

SEQ ID NO: 367801 - protein, 20 aa, Mycobacterium
RLRDRIIERIPIINRFHEPP

SEQ ID NO: 367802 - protein, 28 aa, Mycobacterium
RLRDRWRTLAWALAALVAIVITGLILSK

SEQ ID NO: 367803 - protein, 24 aa, Mycobacterium
RLRDSFLHAGVLMLFYAAAPVFIG

SEQ ID NO: 367804 - protein, 17 aa, Mycobacterium
RLRHLIFKVMTANVEGL

SEQ ID NO: 367805 - protein, 20 aa, Mycobacterium
RLRMMRFFFDGENNQLTLSK

SEQ ID NO: 367806 - protein, 20 aa, Mycobacterium
RLRRQAETPLLLAVDGKLVG

SEQ ID NO: 367807 - protein, 23 aa, Mycobacterium
RLRTLRRQQDELLLGMVCSQSAT

SEQ ID NO: 367808 - protein, 32 aa, Mycobacterium
RLRVRGQRLLALYFPLVPLTCSLATTLVLFEG

SEQ ID NO: 367809 - protein, 22 aa, Mycobacterium
RLRWDPYPFILLNLAFSTQAAY

SEQ ID NO: 367810 - protein, 17 aa, Mycobacterium
RLSAIVCLLLAPAAGIG

SEQ ID NO: 367811 - protein, 31 aa, Mycobacterium
RLSARDPRWLLWLVALMTAALIPFSTLGLLV

SEQ ID NO: 367812 - protein, 27 aa, Mycobacterium
RLSERLMIWTIFEFLALALVDAKPVAR

SEQ ID NO: 367813 - protein, 18 aa, Mycobacterium
RLSGLSWRDWLLAVVVIA

SEQ ID NO: 367814 - protein, 31 aa, Mycobacterium
RLSHRRVTRWEWIWAVLLAGAVAVIVTVGNP

SEQ ID NO: 367815 - protein, 25 aa, Mycobacterium
RLSIFSLVLLVFTVMIIVVFGQMRF

SEQ ID NO: 367816 - protein, 26 aa, Mycobacterium
RLSIFSVVLLIFTVMIFVVFGQMRFD

SEQ ID NO: 367817 - protein, 18 aa, Mycobacterium
RLSLARAILTRPRILVLD

SEQ ID NO: 367818 - protein, 17 aa, Mycobacterium
RLSLITIVVVVVLTAMA

SEQ ID NO: 367819 - protein, 19 aa, Mycobacterium
RLSQLWFDALTGICAHVRA

SEQ ID NO: 367820 - protein, 34 aa, Mycobacterium
RLSRRSLVVGNAVIAFAVIGFASLAAAIAIAVRP

SEQ ID NO: 367821 - protein, 22 aa, Mycobacterium
RLSTLLRLEIPLAWPVIMTGVR

SEQ ID NO: 367822 - protein, 19 aa, Mycobacterium
RLSYGWGFVISGIVLLIAA

SEQ ID NO: 367823 - protein, 30 aa, Mycobacterium
RLTAGAAKIPGGWFTVAVLVVLLAVAVIVA

SEQ ID NO: 367824 - protein, 26 aa, Mycobacterium
RLTANYPPIMFHPLNTITAYKGQVIY

SEQ ID NO: 367825 - protein, 22 aa, Mycobacterium
RLTDAYLAPIKLRTTTLTLIYP

SEQ ID NO: 367826 - protein, 36 aa, Mycobacterium
RLTIAALICAAGFVAAIWLPSKSTMPARPLVALPGA

SEQ ID NO: 367827 - protein, 17 aa, Mycobacterium
RLTKMTAMPQLVAFFNG

SEQ ID NO: 367828 - protein, 17 aa, Mycobacterium
RLTLARLWLIEPGTRLW

SEQ ID NO: 367829 - protein, 22 aa, Mycobacterium
RLTLFITGIWLVSIVGVALLIK

SEQ ID NO: 367830 - protein, 19 aa, Mycobacterium
RLTLWPPALALHDEYYRLV

SEQ ID NO: 367831 - protein, 17 aa, Mycobacterium
RLTMPPIPLQVPAQAPS

SEQ ID NO: 367832 - protein, 24 aa, Mycobacterium
RLTMVMMGLLFYLNPALQMLWGVF

SEQ ID NO: 367833 - protein, 19 aa, Mycobacterium
RLTRGLTYSAVGPVDVTRG

SEQ ID NO: 367834 - protein, 36 aa, Mycobacterium
RLTRIYPTWPQMMPWTALWLATLGAAILLQWGSPSR

SEQ ID NO: 367835 - protein, 19 aa, Mycobacterium
RLTTLVRLELPLAWPVIMT

SEQ ID NO: 367836 - protein, 19 aa, Mycobacterium
RLTVLLDLRRKVFRHFQRL

SEQ ID NO: 367837 - protein, 27 aa, Mycobacterium
RLVAASLVIVVLLLIGPRLVDTYINWL

SEQ ID NO: 367838 - protein, 19 aa, Mycobacterium
RLVAWLLSVAGILAFPRSL

SEQ ID NO: 367839 - protein, 33 aa, Mycobacterium
RLVDAFFGGPRWVWLRYITLWAGLTVGAVLGAA

SEQ ID NO: 367840 - protein, 17 aa, Mycobacterium
RLVDGGAGGLRIIGQHP

SEQ ID NO: 367841 - protein, 17 aa, Mycobacterium
RLVDLLPLPSLRVQRLI

SEQ ID NO: 367842 - protein, 20 aa, Mycobacterium
RLVEVLPGETAWPFLVALIA

SEQ ID NO: 367843 - protein, 18 aa, Mycobacterium
RLVGPLWRRVAVFDFNGT

SEQ ID NO: 367844 - protein, 17 aa, Mycobacterium
RLVLLRPGKEEDEPEQR

SEQ ID NO: 367845 - protein, 18 aa, Mycobacterium
RLVLPAVFLIIASAAAAF

SEQ ID NO: 367846 - protein, 24 aa, Mycobacterium
RLVLTGRTPLPPRRDWELDTLDGE

SEQ ID NO: 367847 - protein, 35 aa, Mycobacterium
RLVQIGGTAFVVIFAVVLVFYIVTSNHKKPAATGA

SEQ ID NO: 367848 - protein, 29 aa, Mycobacterium
RLVRGRVAFIPWVMFGITAVLTALGALGP

SEQ ID NO: 367849 - protein, 25 aa, Mycobacterium
RLVRVALGAYLLFAVPHLVFHVTHL

SEQ ID NO: 367850 - protein, 27 aa, Mycobacterium
RLVSVLRLGVLVFLIGAMLIGTPQHEW

SEQ ID NO: 367851 - protein, 19 aa, Mycobacterium
RLVSWLIGCAVLVITSSSG

SEQ ID NO: 367852 - protein, 27 aa, Mycobacterium
RLVSYWFEPRRVPLVTQLTYICGQLGQ

SEQ ID NO: 367853 - protein, 32 aa, Mycobacterium
RLVVADRAYFVFLALLPFVMGALSLTVPGHTG

SEQ ID NO: 367854 - protein, 23 aa, Mycobacterium
RLVVMAGAIIWAGSLVWYLQRVG

SEQ ID NO: 367855 - protein, 29 aa, Mycobacterium
RLVVPRFLALVLIAPILCTIVIASGVAAA

SEQ ID NO: 367856 - protein, 32 aa, Mycobacterium
RLVVSDRAYFVFLAVLPFVMGALSLTVPGSAG

SEQ ID NO: 367857 - protein, 36 aa, Mycobacterium
RLVVSDRWYTVFLAALPFMLGLLTLTVPGHSGFGVA

SEQ ID NO: 367858 - protein, 19 aa, Mycobacterium
RLVVTMLRGTRLPIAPWEQ

SEQ ID NO: 367859 - protein, 17 aa, Mycobacterium
RLWLIEPGTRLWHLPLF

SEQ ID NO: 367860 - protein, 18 aa, Mycobacterium
RLWLPTYLAWFLAGMMLT

SEQ ID NO: 367861 - protein, 18 aa, Mycobacterium
RLWLPTYLAWFVAGMMLA

SEQ ID NO: 367862 - protein, 18 aa, Mycobacterium
RLWSPLGTGRRWLLRTGI

SEQ ID NO: 367863 - protein, 32 aa, Mycobacterium
RLYAVAIIYLRRIASWFAEHWPGEEMPPPPPE

SEQ ID NO: 367864 - protein, 22 aa, Mycobacterium
RLYHLATDWRTYFGHGGAGFAA

SEQ ID NO: 367865 - protein, 22 aa, Mycobacterium
RLYHLATDWRTYWGPGGAGLGA

SEQ ID NO: 367866 - protein, 21 aa, Mycobacterium
RLYVPAGIEQMWFGDAVAAPR

SEQ ID NO: 367867 - protein, 18 aa, Mycobacterium
RMAGIFSAAGIPATLAGS

SEQ ID NO: 367868 - protein, 21 aa, Mycobacterium
RMFEQFFYAAPVISAIVLVPA

SEQ ID NO: 367869 - protein, 22 aa, Mycobacterium
RMFKYFVKRFALKRGVLLFGKL

SEQ ID NO: 367870 - protein, 17 aa, Mycobacterium
RMGGLAMFLGVLAAVFL

SEQ ID NO: 367871 - protein, 34 aa, Mycobacterium
RMGPVLRRATFNYAPILLHPINQISAYKGQIIYD

SEQ ID NO: 367872 - protein, 17 aa, Mycobacterium
RMLAFNQGFYNLFLGIV

SEQ ID NO: 367873 - protein, 21 aa, Mycobacterium
RMLAKRPILLTNLATIFVGMG

SEQ ID NO: 367874 - protein, 17 aa, Mycobacterium
RMLGVFRRYGALVGAVC

SEQ ID NO: 367875 - protein, 22 aa, Mycobacterium
RMLKVELPLSIPVLVAGLRVVV

SEQ ID NO: 367876 - protein, 20 aa, Mycobacterium
RMLKVELPLSIPVLVSGLRV

SEQ ID NO: 367877 - protein, 17 aa, Mycobacterium
RMLLGPTTLDRLVALDT

SEQ ID NO: 367878 - protein, 30 aa, Mycobacterium
RMPARGRLITMLLVGVVLLASTYSGGLGSP

SEQ ID NO: 367879 - protein, 18 aa, Mycobacterium
RMPHLFGLRAEKPVYRYG

SEQ ID NO: 367880 - protein, 18 aa, Mycobacterium
RMPIFTWNILVTSVLVLL

SEQ ID NO: 367881 - protein, 21 aa, Mycobacterium
RMPSWWPLDMTWGGLPLFVPV

SEQ ID NO: 367882 - protein, 19 aa, Mycobacterium
RMPSWWPLNVTWGGLPLFV

SEQ ID NO: 367883 - protein, 24 aa, Mycobacterium
RMPSWWPMNMTWGGGLPSAVPIGY

SEQ ID NO: 367884 - protein, 17 aa, Mycobacterium
RMPTSLSARFDRACAQS

SEQ ID NO: 367885 - protein, 28 aa, Mycobacterium
RMRDSKLGLLPLYRRLFGANTLSYFRPG

SEQ ID NO: 367886 - protein, 18 aa, Mycobacterium
RMRGVRLAPLPASPKRQL

SEQ ID NO: 367887 - protein, 26 aa, Mycobacterium
RMRHLPAVLMILSLVSFTIAMAGPTH

SEQ ID NO: 367888 - protein, 22 aa, Mycobacterium
RMRPIRIIAMAAAVVMVLLAIA

SEQ ID NO: 367889 - protein, 17 aa, Mycobacterium
RMRVAVIGVFASFGLVV

SEQ ID NO: 367890 - protein, 38 aa, Mycobacterium
RMSAILHGVWILLFASLFTNLVELIPKAALAGLLIVIG

SEQ ID NO: 367891 - protein, 26 aa, Mycobacterium
RMTCGPLRWLIATPQFHHWHHARQPQ

SEQ ID NO: 367892 - protein, 22 aa, Mycobacterium
RMTFGPELWRWVDPNGASDTDR

SEQ ID NO: 367893 - protein, 21 aa, Mycobacterium
RMTFPAPQLVYPMRLSVAALD

SEQ ID NO: 367894 - protein, 40 aa, Mycobacterium
RMTRAAIVVLMLLPLVYGALYLWAYWDPFGHVNKMPVALV

SEQ ID NO: 367895 - protein, 18 aa, Mycobacterium
RMVLKSAARFKHLAPESI

SEQ ID NO: 367896 - protein, 25 aa, Mycobacterium
RMVLPQLILMPILYVVQEMTVRLGI

SEQ ID NO: 367897 - protein, 19 aa, Mycobacterium
RMWLRSLLCITPSMLIVRL

SEQ ID NO: 367898 - protein, 19 aa, Mycobacterium
RMWVLQRSSMYRDMATVGV

SEQ ID NO: 367899 - protein, 17 aa, Mycobacterium
RMYAPAGTLFRQTLTAT

SEQ ID NO: 367900 - protein, 20 aa, Mycobacterium
RMYRTGDLVRWRADGQLDYL

SEQ ID NO: 367901 - protein, 26 aa, Mycobacterium
RNAATTLLLLGLIATTLLMGIIMLAR

SEQ ID NO: 367902 - protein, 41 aa, Mycobacterium
RNADVLRMVIGGAALALLGVRRYVFKRPPLLGPSGRMVATG

SEQ ID NO: 367903 - protein, 44 aa, Mycobacterium
RNAILLAMAVTFGLTIVLLAVVLRRALVRPLDALAAACRRIAEG

SEQ ID NO: 367904 - protein, 18 aa, Mycobacterium
RNALLLEKAAKDSTLVGL

SEQ ID NO: 367905 - protein, 28 aa, Mycobacterium
RNARIIRRFFYLVLLMTAFNWMSHGTQD

SEQ ID NO: 367906 - protein, 24 aa, Mycobacterium
RNAYLWLFAVLLIWLGVRAARSVA

SEQ ID NO: 367907 - protein, 22 aa, Mycobacterium
RNCLDAERWKRAGWRVFRLGAR

SEQ ID NO: 367908 - protein, 26 aa, Mycobacterium
RNDVNPMFFKALAAMATLLAVSTTLL

SEQ ID NO: 367909 - protein, 27 aa, Mycobacterium
RNDVNPMFYRALAAMAVLLVGSTILLR

SEQ ID NO: 367910 - protein, 20 aa, Mycobacterium
RNFIFLAVVLGMLLAALDQT

SEQ ID NO: 367911 - protein, 33 aa, Mycobacterium
RNFPPPGMPPMPPWPPPPPPPPPPPADATATAL

SEQ ID NO: 367912 - protein, 18 aa, Mycobacterium
RNGFVAIGVLYALVSVAA

SEQ ID NO: 367913 - protein, 31 aa, Mycobacterium
RNGINKILQFITYLLLPAGALIIYTQLFTTD

SEQ ID NO: 367914 - protein, 32 aa, Mycobacterium
RNGINKILQFITYLLVPAGLLTIYTQLFTTDA

SEQ ID NO: 367915 - protein, 31 aa, Mycobacterium
RNGINRILQFITYLLVPAGLLTIYTQLFTTH

SEQ ID NO: 367916 - protein, 23 aa, Mycobacterium
RNGRRLMAVLLHGTRQPIAPWEQ

SEQ ID NO: 367917 - protein, 18 aa, Mycobacterium
RNGVLLVLLVIVPAAFVL

SEQ ID NO: 367918 - protein, 27 aa, Mycobacterium
RNIDNWVRRLFALPAFPDGSADDVLQV

SEQ ID NO: 367919 - protein, 20 aa, Mycobacterium
RNLFLLTLAVYLIATVATAF

SEQ ID NO: 367920 - protein, 33 aa, Mycobacterium
RNLGLTYLYLYDDKFIRWPVIIALAVVVGAMYV

SEQ ID NO: 367921 - protein, 41 aa, Mycobacterium
RNLHKLEPLLRLPLALGLIYLLGRIPLPGSVARPVWRDAFA

SEQ ID NO: 367922 - protein, 21 aa, Mycobacterium
RNLRWIVPTAVVIVVLAVLTV

SEQ ID NO: 367923 - protein, 20 aa, Mycobacterium
RNLTLYVTALLFVLAVATSG

SEQ ID NO: 367924 - protein, 22 aa, Mycobacterium
RNLTRMVLGLLLIGNAVNLLIL

SEQ ID NO: 367925 - protein, 17 aa, Mycobacterium
RNPELVMLLNDLAWIVF

SEQ ID NO: 367926 - protein, 66 aa, Mycobacterium
RNPGAALATWLPFLLVLASMTYVLFAQVFWLFWAALLSAPLWLPLLILAAWQYLQPPAVDAAPADE

SEQ ID NO: 367927 - protein, 33 aa, Mycobacterium
RNPKYAGWTLTTRLLAIIANALRWLVWAKTKDG

SEQ ID NO: 367928 - protein, 25 aa, Mycobacterium
RNPRTMLLPLIAIGASMVIAQAVVA

SEQ ID NO: 367929 - protein, 17 aa, Mycobacterium
RNPRVLLGTPTSGFGRT

SEQ ID NO: 367930 - protein, 25 aa, Mycobacterium
RNQVERWFALLTDKKLRRGAHRSIQ

SEQ ID NO: 367931 - protein, 20 aa, Mycobacterium
RNRGGFPVLPMAFTPDFAVV

SEQ ID NO: 367932 - protein, 31 aa, Mycobacterium
RNRLKTVTGLTLPPTLIFDHRAPSALAQHLG

SEQ ID NO: 367933 - protein, 21 aa, Mycobacterium
RNRLVTFIAIFLAGGVMFSLT

SEQ ID NO: 367934 - protein, 26 aa, Mycobacterium
RNRMAFLAALMFILALCFATTNGWWY

SEQ ID NO: 367935 - protein, 32 aa, Mycobacterium
RNRMAFLAAVLFMLALCWATTNGWWYVSSYGV

SEQ ID NO: 367936 - protein, 24 aa, Mycobacterium
RNRMAFLAGVLFILAMCFASTNGW

SEQ ID NO: 367937 - protein, 21 aa, Mycobacterium
RNRVGLMGITVLVLVVAVGQS

SEQ ID NO: 367938 - protein, 23 aa, Mycobacterium
RNSAMLWRIHLTSVLLVIPQVVV

SEQ ID NO: 367939 - protein, 20 aa, Mycobacterium
RNSIGPSLRREDWAGAAIAA

SEQ ID NO: 367940 - protein, 24 aa, Mycobacterium
RNSPEPILLMLAAVKCGAISGMLN

SEQ ID NO: 367941 - protein, 24 aa, Mycobacterium
RNSWTLLPIVPFVGGLLGVIAIII

SEQ ID NO: 367942 - protein, 26 aa, Mycobacterium
RNTFLAAWRVAVVDLILWGSGAVLLT

SEQ ID NO: 367943 - protein, 27 aa, Mycobacterium
RNTFLAPWRIARFDLILWGVGAVVLTT

SEQ ID NO: 367944 - protein, 30 aa, Mycobacterium
RNTFLTPWRVAIVDLILWGVGAALLTTLYG

SEQ ID NO: 367945 - protein, 26 aa, Mycobacterium
RNTFVAPWRIALVDLVLWGVGTILLT

SEQ ID NO: 367946 - protein, 43 aa, Mycobacterium
RNTIRGLKVLMWAALVSVLAVALGLLLYFTPIMSARNVEVSGL

SEQ ID NO: 367947 - protein, 36 aa, Mycobacterium
RNTLLAPFRFAIFHLLVWGTFTILLTALYGMANSMF

SEQ ID NO: 367948 - protein, 29 aa, Mycobacterium
RNTRKPIFGVAMITPLVFAGAVSGAAPEL

SEQ ID NO: 367949 - protein, 25 aa, Mycobacterium
RNTTAYNRWWEARTLWGSIVINCRA

SEQ ID NO: 367950 - protein, 18 aa, Mycobacterium
RNVDRLLRRVCPGDIVVL

SEQ ID NO: 367951 - protein, 25 aa, Mycobacterium
RNVVFRFLCPLLGGAMLLVIFAISI

SEQ ID NO: 367952 - protein, 27 aa, Mycobacterium
RNYFTYRDVIGFIYAQAKFQILGKENS

SEQ ID NO: 367953 - protein, 19 aa, Mycobacterium
RNYRLIVTVARDGRQLKMS

SEQ ID NO: 367954 - protein, 43 aa, Mycobacterium
RPAARPPVTSRWRWVPAFFGWFVGIQAILNFLSSISPFIRMVT

SEQ ID NO: 367955 - protein, 19 aa, Mycobacterium
RPAASYRSFVTWLSERDQV

SEQ ID NO: 367956 - protein, 17 aa, Mycobacterium
RPALPDQMLPRNYQPPK

SEQ ID NO: 367957 - protein, 33 aa, Mycobacterium
RPAQIPLSFAQARLWFLDQLQGPSPVYNMATAL

SEQ ID NO: 367958 - protein, 23 aa, Mycobacterium
RPARALAFAGLAFNGAVLIVLGT

SEQ ID NO: 367959 - protein, 26 aa, Mycobacterium
RPAREGYPAVIWLLLGGNLVVRAAGF

SEQ ID NO: 367960 - protein, 20 aa, Mycobacterium
RPARRLMVGHAPLVVTAVAT

SEQ ID NO: 367961 - protein, 32 aa, Mycobacterium
RPARVPLSFAQSRLWFLDQLQGPSAIYNMTAA

SEQ ID NO: 367962 - protein, 17 aa, Mycobacterium
RPASIIKVLVAMAAINE

SEQ ID NO: 367963 - protein, 17 aa, Mycobacterium
RPASVQVLAIWVLVGLL

SEQ ID NO: 367964 - protein, 28 aa, Mycobacterium
RPAVMYIVIGAYGWVRLPTGQRLSHYGD

SEQ ID NO: 367965 - protein, 29 aa, Mycobacterium
RPDGWATLFLPQLPYLPLGNLRETIVYPL

SEQ ID NO: 367966 - protein, 25 aa, Mycobacterium
RPDILDPALLRPGRFDRQIPVTNPD

SEQ ID NO: 367967 - protein, 18 aa, Mycobacterium
RPDLDAVRPCPPVVLWSL

SEQ ID NO: 367968 - protein, 54 aa, Mycobacterium
RPDLERGFRAPWVPWLPIASLCACLWLMVNLTALTWIRFGVWLVLGTAIYVGYG

SEQ ID NO: 367969 - protein, 24 aa, Mycobacterium
RPDLPRSFRTPGVPWLPIVAIVAC

SEQ ID NO: 367970 - protein, 20 aa, Mycobacterium
RPDNPLPCAGAVSGPFGGPG

SEQ ID NO: 367971 - protein, 17 aa, Mycobacterium
RPDQPRGWRFWHRPRRQ

SEQ ID NO: 367972 - protein, 28 aa, Mycobacterium
RPDRNIYVPLAFHLGYHSLPIGGVMPGF

SEQ ID NO: 367973 - protein, 22 aa, Mycobacterium
RPDRRLFLGALAFVAGFSVLVR

SEQ ID NO: 367974 - protein, 18 aa, Mycobacterium
RPEIGTVRRTGLSGLARG

SEQ ID NO: 367975 - protein, 23 aa, Mycobacterium
RPERFVLAVLGIALAIACVTVVR

SEQ ID NO: 367976 - protein, 19 aa, Mycobacterium
RPFIARTIQKFSLPVILLW

SEQ ID NO: 367977 - protein, 38 aa, Mycobacterium
RPFQWREFILQCWFIMRVALLPAILVSVPFTVLLIFTL

SEQ ID NO: 367978 - protein, 30 aa, Mycobacterium
RPFQWRELILQCWFVMRVALLPTIMVSIPL

SEQ ID NO: 367979 - protein, 23 aa, Mycobacterium
RPFRGYLYWEQHCFNIPVCWASR

SEQ ID NO: 367980 - protein, 34 aa, Mycobacterium
RPFRRRNPRPAIVVVILLAIATAAAWTVALTRPT

SEQ ID NO: 367981 - protein, 32 aa, Mycobacterium
RPGCWQPITRDLWPFPYLVMDTGASIAPYNHF

SEQ ID NO: 367982 - protein, 23 aa, Mycobacterium
RPGEEKLVFNRFWRADPSRKRHS

SEQ ID NO: 367983 - protein, 26 aa, Mycobacterium
RPGEEKLVFSRFWRADPSRVRRSGGT

SEQ ID NO: 367984 - protein, 26 aa, Mycobacterium
RPGEEKLVFSRFWRSDPSRVRRSGGT

SEQ ID NO: 367985 - protein, 18 aa, Mycobacterium
RPGFLRPPAVIDGPRREF

SEQ ID NO: 367986 - protein, 32 aa, Mycobacterium
RPGNLGQPLYNLLLMLLFEWGVAVHDTDIEGL

SEQ ID NO: 367987 - protein, 25 aa, Mycobacterium
RPGSLEALLPPNLRARPGARANLFG

SEQ ID NO: 367988 - protein, 26 aa, Mycobacterium
RPGVGPGLPAATWLQVGTGALTRLPV

SEQ ID NO: 367989 - protein, 20 aa, Mycobacterium
RPGWIALALVVVAFAYLCFT

SEQ ID NO: 367990 - protein, 20 aa, Mycobacterium
RPGWIALGLVVVAFTYLCFT

SEQ ID NO: 367991 - protein, 32 aa, Mycobacterium
RPHNIPFVMLGAALLWFGWFGFNVGSEGAADM

SEQ ID NO: 367992 - protein, 32 aa, Mycobacterium
RPHNIPWVMLGAALLWFGWFGFNVGSEGAADA

SEQ ID NO: 367993 - protein, 33 aa, Mycobacterium
RPHNLPFVLLGVGLLWFGWFGFNAGSALAANGL

SEQ ID NO: 367994 - protein, 31 aa, Mycobacterium
RPHNLPFVMLGAGLLWFGWYGFNAGSATSAN

SEQ ID NO: 367995 - protein, 34 aa, Mycobacterium; identical to SEQ ID NO: 21322

SEQ ID NO: 367996 - protein, 31 aa, Mycobacterium
RPHNLPLTMLGLMLIFTGFFGFLMGCIIYAG

SEQ ID NO: 367997 - protein, 34 aa, Mycobacterium
RPHNLPLVLLGVGLLWFGWFGFNAGSALAANGTA

SEQ ID NO: 367998 - protein, 23 aa, Mycobacterium
RPHPAARPVPPPAPGPIPAMEPA

SEQ ID NO: 367999 - protein, 21 aa, Mycobacterium
RPIISFGFVVLAASMVTFWHA

SEQ ID NO: 368000 - protein, 33 aa, Mycobacterium
RPILRILVRRHRLVGTWPLVAPMLAAGTVILTV

SEQ ID NO: 368001 - protein, 17 aa, Mycobacterium
RPIMRAATLGAEPRLAV

SEQ ID NO: 368002 - protein, 26 aa, Mycobacterium
RPKLLRFTGAWWTLVFPLGMYSVATY

SEQ ID NO: 368003 - protein, 17 aa, Mycobacterium
RPKRFAWLLGAALAATC

SEQ ID NO: 368004 - protein, 33 aa, Mycobacterium
RPLAARLIRAFSVPIVLFWLAVCVVVSVFVPSL

SEQ ID NO: 368005 - protein, 18 aa, Mycobacterium
RPLAWVQRLTALPEYVRA

SEQ ID NO: 368006 - protein, 21 aa, Mycobacterium
RPLHLLTLIAGFALLAYVVAI

SEQ ID NO: 368007 - protein, 22 aa, Mycobacterium
RPLLAGLAFSIGFLALLLGRSE

SEQ ID NO: 368008 - protein, 19 aa, Mycobacterium
RPLPDLTAPLLAMALCSDA

SEQ ID NO: 368009 - protein, 23 aa, Mycobacterium
RPLRSYFYWERHCYDIPICFSLR

SEQ ID NO: 368010 - protein, 18 aa, Mycobacterium
RPLRYVVLGFAVSAVLCP

SEQ ID NO: 368011 - protein, 18 aa, Mycobacterium
RPLSVLADLPRRVRVSQA

SEQ ID NO: 368012 - protein, 25 aa, Mycobacterium
RPLYQPHYLTFTTPALALLIGLCVV

SEQ ID NO: 368013 - protein, 25 aa, Mycobacterium
RPMFAAAPNFAFALAAQRGLPPEGE

SEQ ID NO: 368014 - protein, 20 aa, Mycobacterium
RPMSVGFWFSLGHSSIVFIM

SEQ ID NO: 368015 - protein, 20 aa, Mycobacterium
RPNHRWLDVVAVAVVAALGG

SEQ ID NO: 368016 - protein, 42 aa, Mycobacterium
RPNRRWWRHTAWFMLALLLATLWWLVALTQLRGVSPPFLDFI

SEQ ID NO: 368017 - protein, 21 aa, Mycobacterium
RPNWTLLRKTVRDLRRRPAQS

SEQ ID NO: 368018 - protein, 27 aa, Mycobacterium
RPPEQPPTLFLNPLPGSQYDAALRAAP

SEQ ID NO: 368019 - protein, 49 aa, Mycobacterium
RPPPPRRGTFSPGQKALMWAAAVLGIFAIIIAALILLQASEKKNQTPSI

SEQ ID NO: 368020 - protein, 18 aa, Mycobacterium
RPPQLGAGLRLGGIVASA

SEQ ID NO: 368021 - protein, 37 aa, Mycobacterium
RPPRIARLIRTLSIPIILFWLGIAIVLNIVTPSLDEV

SEQ ID NO: 368022 - protein, 19 aa, Mycobacterium
RPPVFVLVVVALTLAGFAV

SEQ ID NO: 368023 - protein, 23 aa, Mycobacterium
RPPVNFLLAPAILSAAGLVFGLW

SEQ ID NO: 368024 - protein, 27 aa, Mycobacterium
RPQTGLLHQYYLAAVLVLAFGVLLLVV

SEQ ID NO: 368025 - protein, 35 aa, Mycobacterium
RPQWLALIVVVLAFAYLCFTVLAPWQLGKNTKTSR

SEQ ID NO: 368026 - protein, 30 aa, Mycobacterium
RPQYRPLWVFLLVPVLILLTVSGRWLYTNA

SEQ ID NO: 368027 - protein, 32 aa, Mycobacterium
RPQYRSLWVFLLLPVLILLTVSGRWLYTNAAP

SEQ ID NO: 368028 - protein, 31 aa, Mycobacterium
RPQYRTLWVFVLVPVLILLTVSGRWLYTNAA

SEQ ID NO: 368029 - protein, 26 aa, Mycobacterium
RPRDRHQWLRWYPLAMLFAGTVLITM

SEQ ID NO: 368030 - protein, 34 aa, Mycobacterium
RPRIASFIRRFSVLIILAWIVVAALATFAIPPLE

SEQ ID NO: 368031 - protein, 41 aa, Mycobacterium
RPRLRPLASYNKTWLGFVGLSLAVVLIGALLLVKQAGIGYR

SEQ ID NO: 368032 - protein, 26 aa, Mycobacterium
RPRLWACYALALMLAILLNLNLVLLV

SEQ ID NO: 368033 - protein, 17 aa, Mycobacterium
RPRTWRHAATALLVVGL

SEQ ID NO: 368034 - protein, 24 aa, Mycobacterium
RPRYINLIVLLRMTCEVSATVLMA

SEQ ID NO: 368035 - protein, 25 aa, Mycobacterium
RPRYINLVVLLRITCEITATVLLVL

SEQ ID NO: 368036 - protein, 25 aa, Mycobacterium
RPRYINLVVLLRITCEITATVLLVV

SEQ ID NO: 368037 - protein, 25 aa, Mycobacterium
RPRYINLVVLLRIVCEITATAFLVV

SEQ ID NO: 368038 - protein, 25 aa, Mycobacterium
RPRYINLVVLLRIVCEITATALLVV

SEQ ID NO: 368039 - protein, 25 aa, Mycobacterium
RPSGLAFLGGWLLSLAALTALSVAA

SEQ ID NO: 368040 - protein, 24 aa, Mycobacterium
RPSLWKVLAVLCTGIAIVGGVLAW

SEQ ID NO: 368041 - protein, 22 aa, Mycobacterium
RPSRPMPLRNMAMGLTAGVLLG

SEQ ID NO: 368042 - protein, 21 aa, Mycobacterium
RPSRPWWRRKAVVITAAALLT

SEQ ID NO: 368043 - protein, 33 aa, Mycobacterium
RPSWRVLLIGLGVIVAWLLVATLLARLVVPQEV

SEQ ID NO: 368044 - protein, 31 aa, Mycobacterium
RPSYRFMREVYDLFVAPHYFGDSLFGVQTPA

SEQ ID NO: 368045 - protein, 18 aa, Mycobacterium
RPTEVAGLRLLPSRSALP

SEQ ID NO: 368046 - protein, 21 aa, Mycobacterium
RPTFYIDFPTSVSPLTRPHRS

SEQ ID NO: 368047 - protein, 26 aa, Mycobacterium
RPTHPRKFLGLFPFQGLLHAQREQIT

SEQ ID NO: 368048 - protein, 27 aa, Mycobacterium
RPTTSPPWTFFWIGLAALTAVQGGFYS

SEQ ID NO: 368049 - protein, 18 aa, Mycobacterium
RPVAPEAYALYGISRVLP

SEQ ID NO: 368050 - protein, 19 aa, Mycobacterium
RPVASPPARVAPPAPAPRI

SEQ ID NO: 368051 - protein, 21 aa, Mycobacterium
RPVEELLPVPPIAMHLRTVIG

SEQ ID NO: 368052 - protein, 18 aa, Mycobacterium
RPVFLRLGLGQQAEWTFS

SEQ ID NO: 368053 - protein, 26 aa, Mycobacterium
RPVIPHTIRIFAVPIILAWVVLTVIV

SEQ ID NO: 368054 - protein, 31 aa, Mycobacterium
RPVIPHTIRILAVPIILGWVLLTVLVNVVVP

SEQ ID NO: 368055 - protein, 19 aa, Mycobacterium
RPVLWAISILTMAVATITA

SEQ ID NO: 368056 - protein, 22 aa, Mycobacterium
RPVPRLLATGLLRRVDAETVIL

SEQ ID NO: 368057 - protein, 19 aa, Mycobacterium
RPVRLLVISVVLTAAAMLV

SEQ ID NO: 368058 - protein, 17 aa, Mycobacterium
RPVSILPSEAPVLVATR

SEQ ID NO: 368059 - protein, 25 aa, Mycobacterium
RPVVGFGFFVVAIALTWFSIEMAPT

SEQ ID NO: 368060 - protein, 17 aa, Mycobacterium
RPVWLSRNFGQHPATLA

SEQ ID NO: 368061 - protein, 17 aa, Mycobacterium
RPYGYDETARWVPRLWR

SEQ ID NO: 368062 - protein, 17 aa, Mycobacterium
RPYGYDHTPRFVPRLWR

SEQ ID NO: 368063 - protein, 26 aa, Mycobacterium
RPYGYDHTPRFVPRLWRRDIRAGHFS

SEQ ID NO: 368064 - protein, 19 aa, Mycobacterium
RPYQPAFNTPPPSPSAAPY

SEQ ID NO: 368065 - protein, 18 aa, Mycobacterium
RPYRPPPRPSSETLHAVV

SEQ ID NO: 368066 - protein, 21 aa, Mycobacterium
RQALAQLPACPPSLAAQVQFS

SEQ ID NO: 368067 - protein, 30 aa, Mycobacterium
RQAPPPAMPPQLAWWASSLQLSGLAPSQAE

SEQ ID NO: 368068 - protein, 22 aa, Mycobacterium
RQAQLLLRRWTALGANVREHPI

SEQ ID NO: 368069 - protein, 24 aa, Mycobacterium
RQATPTVPAPVAPAPAPAPGVVPA

SEQ ID NO: 368070 - protein, 25 aa, Mycobacterium
RQDPRKFRLIVTITRDGDQLKMSKV

SEQ ID NO: 368071 - protein, 25 aa, Mycobacterium
RQEALIQLLADRAFEWSLNAGEVIQ

SEQ ID NO: 368072 - protein, 24 aa, Mycobacterium
RQFNDLLRVLPPLPQDETSPESAE

SEQ ID NO: 368073 - protein, 23 aa, Mycobacterium
RQFQVFLDDVRLPADALVGSEDA

SEQ ID NO: 368074 - protein, 26 aa, Mycobacterium
RQFRWRVAPGYRPLMTWGTGPTPADG

SEQ ID NO: 368075 - protein, 20 aa, Mycobacterium
RQFWAKVRRGALFKAAAVLV

SEQ ID NO: 368076 - protein, 22 aa, Mycobacterium
RQGRAYWIHLLMASQQIETRAE

SEQ ID NO: 368077 - protein, 28 aa, Mycobacterium
RQHARRMVLIWVAVVLAITGLVATAAWT

SEQ ID NO: 368078 - protein, 26 aa, Mycobacterium
RQHISLRPLWGIDDRLKRFGAMAAAM

SEQ ID NO: 368079 - protein, 17 aa, Mycobacterium
RQHWFTVGYQTGDPKQC

SEQ ID NO: 368080 - protein, 30 aa, Mycobacterium
RQILKTPVWNWMIAAYLFSGGLSAGSALLA

SEQ ID NO: 368081 - protein, 17 aa, Mycobacterium
RQIVVAGRILLLGSRSK

SEQ ID NO: 368082 - protein, 26 aa, Mycobacterium
RQKRTFMKITAIAAAGLMAGMLLTAS

SEQ ID NO: 368083 - protein, 29 aa, Mycobacterium
RQLAPAAMLLVGVVTFVVSLSLAISQQMS

SEQ ID NO: 368084 - protein, 17 aa, Mycobacterium
RQLFFDVITANANGVAA

SEQ ID NO: 368085 - protein, 33 aa, Mycobacterium
RQLFGITEGFFSPLFFVWLGASLQVRELGAHPR

SEQ ID NO: 368086 - protein, 21 aa, Mycobacterium
RQLVGLLAAFVLSGIIGLERE

SEQ ID NO: 368087 - protein, 18 aa, Mycobacterium
RQMYFFYATVMAPFLVLA

SEQ ID NO: 368088 - protein, 29 aa, Mycobacterium
RQNIVAWSIVWCLVLLSLALTATTFFPDL

SEQ ID NO: 368089 - protein, 19 aa, Mycobacterium
RQPFAFAAAFLAAGLALRY

SEQ ID NO: 368090 - protein, 27 aa, Mycobacterium
RQPGFAAHMLGIEPQLAFVGANLPLML

SEQ ID NO: 368091 - protein, 23 aa, Mycobacterium
RQPIAQSFWYRTAKFVMRHAIPV

SEQ ID NO: 368092 - protein, 21 aa, Mycobacterium
RQPKFRWISVGAAIAIVTWVC

SEQ ID NO: 368093 - protein, 18 aa, Mycobacterium
RQPLLDVRLFADPGFATG

SEQ ID NO: 368094 - protein, 20 aa, Mycobacterium
RQPLRLLRAVLPVAAVFLIW

SEQ ID NO: 368095 - protein, 20 aa, Mycobacterium
RQPWDFVIVTERSALQELST

SEQ ID NO: 368096 - protein, 24 aa, Mycobacterium
RQQTWLSVAGLVLTLVVAAAYLLV

SEQ ID NO: 368097 - protein, 24 aa, Mycobacterium
RQRDNIALALPRLAKYQVTLGETV

SEQ ID NO: 368098 - protein, 18 aa, Mycobacterium
RQREFWRTALAGAPDELA

SEQ ID NO: 368099 - protein, 18 aa, Mycobacterium
RQRFFALGLYVAALAMAV

SEQ ID NO: 368100 - protein, 19 aa, Mycobacterium
RQRLALARALLSRSQLILM

SEQ ID NO: 368101 - protein, 21 aa, Mycobacterium
RQRLSLARAILAAPRILVLDD

SEQ ID NO: 368102 - protein, 17 aa, Mycobacterium
RQRRLYDIPSRFVKTIG

SEQ ID NO: 368103 - protein, 18 aa, Mycobacterium
RQRVLAIVILLMSASTLA

SEQ ID NO: 368104 - protein, 30 aa, Mycobacterium
RQRYREWLAVFYFIPLLLSSAAIAITYKAL

SEQ ID NO: 368105 - protein, 24 aa, Mycobacterium
RQSAILFGAWGVTGGIFMLLNLGG

SEQ ID NO: 368106 - protein, 20 aa, Mycobacterium
RQSVVTLMSLDFNKAEEDVQ

SEQ ID NO: 368107 - protein, 27 aa, Mycobacterium
RQTALELLRSAFIPWLVTINPEDHHPM

SEQ ID NO: 368108 - protein, 23 aa, Mycobacterium
RQTAWNYLVFALSKSSTLLMTIV

SEQ ID NO: 368109 - protein, 26 aa, Mycobacterium
RQTIDCVFVMLVLMLVQVTARPWTVA

SEQ ID NO: 368110 - protein, 18 aa, Mycobacterium
RQTYDMALVFRHRVRRDR

SEQ ID NO: 368111 - protein, 21 aa, Mycobacterium
RQVELPFSGLNYPEGIAVDAQ

SEQ ID NO: 368112 - protein, 25 aa, Mycobacterium
RQVLPLVVPVILASALFNGSLVQLV

SEQ ID NO: 368113 - protein, 22 aa, Mycobacterium
RQVWSAHMFAAPPRPSIMRRGV

SEQ ID NO: 368114 - protein, 45 aa, Mycobacterium
RQWARSLHFLGLIAFLIFIVIHLSMIFFWGWGRLTALMIFGSVRN

SEQ ID NO: 368115 - protein, 17 aa, Mycobacterium
RQYAPPPTARPAPQGPP

SEQ ID NO: 368116 - protein, 29 aa, Mycobacterium
RQYKLPGPWRILVTVPLRYLRPSHHPSTE

SEQ ID NO: 368117 - protein, 31 aa, Mycobacterium
RRAAEPILPIRLFASPVFAVCCVLSFVVGFA

SEQ ID NO: 368118 - protein, 23 aa, Mycobacterium
RRAGRRFYWATAIIGIACFAVGT

SEQ ID NO: 368119 - protein, 22 aa, Mycobacterium
RRAGWLIAFTGLVIGFSVWLPW

SEQ ID NO: 368120 - protein, 20 aa, Mycobacterium
RRALAPLRRVAQTAGQVADL

SEQ ID NO: 368121 - protein, 23 aa, Mycobacterium
RRALLRITRWDVGIAMLVAGAVN

SEQ ID NO: 368122 - protein, 31 aa, Mycobacterium
RRANKKGLLARFWLVLTIAAVVALSGFVVYR

SEQ ID NO: 368123 - protein, 20 aa, Mycobacterium
RRAPAWAVLYRVAALAGVTA

SEQ ID NO: 368124 - protein, 28 aa, Mycobacterium
RRAPSWAKWFQRISPILFLAFAVGDFIN

SEQ ID NO: 368125 - protein, 20 aa, Mycobacterium
RRARRIMLQNVGLSLALITV

SEQ ID NO: 368126 - protein, 20 aa, Mycobacterium
RRASQEAELLTLFAGSVLRG

SEQ ID NO: 368127 - protein, 27 aa, Mycobacterium
RRASQEAELLTLFAGSVLRGADLETLL

SEQ ID NO: 368128 - protein, 26 aa, Mycobacterium
RRASWVYYAVVPDALASLAVLLGADL

SEQ ID NO: 368129 - protein, 24 aa, Mycobacterium
RRAVLIVFGLWILTTGIVFSYMQG

SEQ ID NO: 368130 - protein, 29 aa, Mycobacterium
RRAVLKSSYAQFFFLLSGADHDQMDRMRT

SEQ ID NO: 368131 - protein, 24 aa, Mycobacterium
RRAVRAVWVPLVVGPVVVAALSGL

SEQ ID NO: 368132 - protein, 18 aa, Mycobacterium
RRAVTAVGALALLTAPLM

SEQ ID NO: 368133 - protein, 28 aa, Mycobacterium
RRDAGWARRLAWISLAALLVEGAIGLWQ

SEQ ID NO: 368134 - protein, 19 aa, Mycobacterium
RRDALKWVWIGVGAAVVMT

SEQ ID NO: 368135 - protein, 26 aa, Mycobacterium
RRDGDRGHYIFLLPDDGMVYGNGAGA

SEQ ID NO: 368136 - protein, 30 aa, Mycobacterium
RRDKMVRAIWVLRALLREHGRRLAEAGVLH

SEQ ID NO: 368137 - protein, 18 aa, Mycobacterium
RRDLLLGLFASVVGTAIT

SEQ ID NO: 368138 - protein, 26 aa, Mycobacterium
RRDLTHRFWRILGTRIVRRPRVHLIG

SEQ ID NO: 368139 - protein, 28 aa, Mycobacterium
RRDRLSLPLWVFLLSVPLATVYVGSIEK

SEQ ID NO: 368140 - protein, 26 aa, Mycobacterium
RRDRMVRAIWVLRDLLREYGRRLVEA

SEQ ID NO: 368141 - protein, 24 aa, Mycobacterium
RRDRNLVYFLFASALFRDGLAAIF

SEQ ID NO: 368142 - protein, 22 aa, Mycobacterium
RRDRPVLIFVLESGMAGLTQGK

SEQ ID NO: 368143 - protein, 17 aa, Mycobacterium
RRDVVLVTGPWLAGTSS

SEQ ID NO: 368144 - protein, 34 aa, Mycobacterium
RREARSLLISLLRPYRWIVAVLALVVIVENAARL

SEQ ID NO: 368145 - protein, 25 aa, Mycobacterium
RREAVERGWPVLSFSRPVSLRDRIP

SEQ ID NO: 368146 - protein, 23 aa, Mycobacterium
RREILVYAWLMPVSTVVQAVIGG

SEQ ID NO: 368147 - protein, 17 aa, Mycobacterium
RRELAAYAPLSVPNSDL

SEQ ID NO: 368148 - protein, 23 aa, Mycobacterium
RREMRFRALSLQWLASAVIAQVV

SEQ ID NO: 368149 - protein, 26 aa, Mycobacterium
RRERISLRPLWGIDARLKKFGMMALA

SEQ ID NO: 368150 - protein, 26 aa, Mycobacterium
RRERISLRPLWGIDDRLKKFGAMAAA

SEQ ID NO: 368151 - protein, 34 aa, Mycobacterium
RRETNSWRWPAFAWCYMFVLAWTMAFVARSIAVG

SEQ ID NO: 368152 - protein, 19 aa, Mycobacterium
RRFAPYTDPLLLPIVALLN

SEQ ID NO: 368153 - protein, 20 aa, Mycobacterium
RRFGFLLIAACLFIAMFILL

SEQ ID NO: 368154 - protein, 34 aa, Mycobacterium
RRFGRDPVSVLLIFIIVFALIIAGLIGAELYVRH

SEQ ID NO: 368155 - protein, 30 aa, Mycobacterium
RRFRWAVFAVWLLLLLPSVYLAMNQAGNLT

SEQ ID NO: 368156 - protein, 32 aa, Mycobacterium
RRFRWLVFTGWMLALVPAIYLALTQSGNLTGG

SEQ ID NO: 368157 - protein, 24 aa, Mycobacterium
RRFSAIALWCWVAMALSGVMNAVV

SEQ ID NO: 368158 - protein, 18 aa, Mycobacterium
RRFTIGHGRLFASYVALY

SEQ ID NO: 368159 - protein, 29 aa, Mycobacterium
RRGGRRPGWVLLTTLLVLAIGASSALVFT

SEQ ID NO: 368160 - protein, 26 aa, Mycobacterium
RRGHGHRPMLLAARSVAALLAVLAVA

SEQ ID NO: 368161 - protein, 20 aa, Mycobacterium
RRGLLIGGAVAAVVVIAAAV

SEQ ID NO: 368162 - protein, 25 aa, Mycobacterium
RRGLRHPWLYFVSSLFTSFAFAFAF

SEQ ID NO: 368163 - protein, 26 aa, Mycobacterium
RRGLRHPWLYFVSSLFTSFAFAFAFY

SEQ ID NO: 368164 - protein, 41 aa, Mycobacterium
RRGLRRMKAVALSFLLGATVVFLVCSWWQSAGAPGWVGYVR

SEQ ID NO: 368165 - protein, 24 aa, Mycobacterium
RRGQLGTMFALRRYGPDKVANAIL

SEQ ID NO: 368166 - protein, 34 aa, Mycobacterium
RRGQLLFERVITGLLLIIAVGFTASFFVATPPPD

SEQ ID NO: 368167 - protein, 24 aa, Mycobacterium
RRGQSLWRVRIAPALGLIGLVGAL

SEQ ID NO: 368168 - protein, 24 aa, Mycobacterium
RRGRALFVFTIGIVLIVLALAFFL

SEQ ID NO: 368169 - protein, 26 aa, Mycobacterium
RRGRGGRWVLVALLMLLTATAISAAV

SEQ ID NO: 368170 - protein, 24 aa, Mycobacterium
RRGRRRWMVAAAVAAVLAIAGAGV

SEQ ID NO: 368171 - protein, 18 aa, Mycobacterium
RRGRWRIFAAASTVLALT

SEQ ID NO: 368172 - protein, 24 aa, Mycobacterium
RRGSKKRVWVIAGAATVVVVAGGA

SEQ ID NO: 368173 - protein, 26 aa, Mycobacterium
RRGSSRHAARPAAKRPRKGLIAATVG

SEQ ID NO: 368174 - protein, 17 aa, Mycobacterium
RRGSYGFLAPGFDARVV

SEQ ID NO: 368175 - protein, 24 aa, Mycobacterium
RRGVLTRRPMFSRITPTGVTWPDG

SEQ ID NO: 368176 - protein, 20 aa, Mycobacterium
RRGVNFFTSTWSRVLLATTG

SEQ ID NO: 368177 - protein, 20 aa, Mycobacterium
RRGVPLRVSLVVGTLVLVAL

SEQ ID NO: 368178 - protein, 21 aa, Mycobacterium
RRGWIAPRRDLTSRLWRRSGV

SEQ ID NO: 368179 - protein, 21 aa, Mycobacterium
RRGWIKPRRDLTHRFWRILGT

SEQ ID NO: 368180 - protein, 20 aa, Mycobacterium
RRGWQFIGLIIVGAAFAYAM

SEQ ID NO: 368181 - protein, 19 aa, Mycobacterium
RRHFAWLKDWYEFAVTDIG

SEQ ID NO: 368182 - protein, 28 aa, Mycobacterium
RRHKRFLPSRWWSMTPLDGLVSAMLVWW

SEQ ID NO: 368183 - protein, 28 aa, Mycobacterium
RRHPGEASFYWLTLALAAVWTAGALVSG

SEQ ID NO: 368184 - protein, 27 aa, Mycobacterium
RRHRRRRRQFQLRPAESGPRRQRRLSP

SEQ ID NO: 368185 - protein, 24 aa, Mycobacterium
RRHTLLYAASMGVAWLLGVPALMR

SEQ ID NO: 368186 - protein, 23 aa, Mycobacterium
RRHVRWRHRICLAAAIIAMLATP

SEQ ID NO: 368187 - protein, 25 aa, Mycobacterium
RRHWQGPEIFLIIDDSERLPVGFDS

SEQ ID NO: 368188 - protein, 17 aa, Mycobacterium
RRIAAALGRPVIRLGFE

SEQ ID NO: 368189 - protein, 34 aa, Mycobacterium
RRIAALVLGYTLIIVMIGLAALMAYIKPAGQVGN

SEQ ID NO: 368190 - protein, 23 aa, Mycobacterium
RRIGKPAQLRWLSMIAPSDDEAV

SEQ ID NO: 368191 - protein, 19 aa, Mycobacterium
RRIGTATVRWPGAVFAASS

SEQ ID NO: 368192 - protein, 41 aa, Mycobacterium
RRIMLQNVDLSLGLILALVPLALFGILGLAAVVLVHELAEI

SEQ ID NO: 368193 - protein, 24 aa, Mycobacterium
RRIPMLLRRLITVCPALVILAVGF

SEQ ID NO: 368194 - protein, 18 aa, Mycobacterium
RRIPPLRRALDAVRADLY

SEQ ID NO: 368195 - protein, 21 aa, Mycobacterium
RRIRTLAARSALAIALMGAVN

SEQ ID NO: 368196 - protein, 19 aa, Mycobacterium
RRIVGIAFLVLVGAAVFGL

SEQ ID NO: 368197 - protein, 29 aa, Mycobacterium
RRKYPFLHGVLVPSAHRLLRPKFGRTIHA

SEQ ID NO: 368198 - protein, 28 aa, Mycobacterium
RRLDRDHPLWECWIIEGLPERRWAALIK

SEQ ID NO: 368199 - protein, 21 aa, Mycobacterium
RRLEGLIAPGTWNIDPDASAQ

SEQ ID NO: 368200 - protein, 25 aa, Mycobacterium
RRLETRLMMVLGVGFGLGVALTLSR

SEQ ID NO: 368201 - protein, 29 aa, Mycobacterium
RRLETRMMALFGIFFGLGAALTVSRLVAY

SEQ ID NO: 368202 - protein, 22 aa, Mycobacterium
RRLFPTLNYSASALDACERADA

SEQ ID NO: 368203 - protein, 24 aa, Mycobacterium
RRLGALMIDWLISYGLAALALRFG

SEQ ID NO: 368204 - protein, 27 aa, Mycobacterium
RRLGIARIWLYLVISIGVAISVGLPLF

SEQ ID NO: 368205 - protein, 28 aa, Mycobacterium
RRLGRLMSILSIPMLLAPIAGPILGGWL

SEQ ID NO: 368206 - protein, 21 aa, Mycobacterium
RRLHRMVINTLPLAFQRGSML

SEQ ID NO: 368207 - protein, 18 aa, Mycobacterium
RRLIRAVAKHYLPEGYPV

SEQ ID NO: 368208 - protein, 22 aa, Mycobacterium
RRLIRRLFPALVVVLTACAGLT

SEQ ID NO: 368209 - protein, 41 aa, Mycobacterium
RRLISVRKLAGLALWLITAVVLIVVWVQFRGGFTPKITLTA

SEQ ID NO: 368210 - protein, 25 aa, Mycobacterium
RRLLAMVLLLLVVAPSLIGCVRVRA

SEQ ID NO: 368211 - protein, 22 aa, Mycobacterium
RRLLLRVTRLDVVLAMAVAGTV

SEQ ID NO: 368212 - protein, 24 aa, Mycobacterium
RRLNHLCDRLWLIAAIEHYTAVMG

SEQ ID NO: 368213 - protein, 22 aa, Mycobacterium
RRLPGWPIWVAAVWAVQEWAKS

SEQ ID NO: 368214 - protein, 17 aa, Mycobacterium
RRLPWWAVTAVAVTAVV

SEQ ID NO: 368215 - protein, 22 aa, Mycobacterium
RRLREAGLTRLILLTGDRAEPT

SEQ ID NO: 368216 - protein, 29 aa, Mycobacterium
RRLSYPRLLAWFTLFLRLCLGGQMLFYGF

SEQ ID NO: 368217 - protein, 17 aa, Mycobacterium
RRLYPRVELRPDALYVD

SEQ ID NO: 368218 - protein, 30 aa, Mycobacterium
RRMEVLAVPLVAVVLFLVFGGAVAAGLPAI

SEQ ID NO: 368219 - protein, 18 aa, Mycobacterium
RRMKAVATGFLIGATVLF

SEQ ID NO: 368220 - protein, 18 aa, Mycobacterium
RRMMIADHLAFGALERLR

SEQ ID NO: 368221 - protein, 19 aa, Mycobacterium
RRMNSQLFYWLAGRLTDDR

SEQ ID NO: 368222 - protein, 26 aa, Mycobacterium
RRMTPDDPLKFWLSRADSVGVEQARQ

SEQ ID NO: 368223 - protein, 18 aa, Mycobacterium
RRNLFILTLAIYLVATVA

SEQ ID NO: 368224 - protein, 17 aa, Mycobacterium
RRNLHDLLLAATSRADA

SEQ ID NO: 368225 - protein, 20 aa, Mycobacterium
RRNLVFLAVLFGMLLAALDQ

SEQ ID NO: 368226 - protein, 20 aa, Mycobacterium
RRNRLLASTPLMIVAAIMVI

SEQ ID NO: 368227 - protein, 26 aa, Mycobacterium
RRNRPRWWICYALALALSILLNVNLV

SEQ ID NO: 368228 - protein, 22 aa, Mycobacterium
RRPERFVLSVLGIALAIACVTV

SEQ ID NO: 368229 - protein, 32 aa, Mycobacterium
RRPQNRPLWVFLLVPVLILLTVSGRWLYANAA

SEQ ID NO: 368230 - protein, 33 aa, Mycobacterium
RRPQYRPLWVFLLLPVLILLTVSGRWLYTNAAP

SEQ ID NO: 368231 - protein, 21 aa, Mycobacterium
RRPRIRSAVRQLLLGGAAIAL

SEQ ID NO: 368232 - protein, 20 aa, Mycobacterium
RRPRLWPELVRHRGQALRVI

SEQ ID NO: 368233 - protein, 33 aa, Mycobacterium
RRPTRLGNGWVATICAVLLLLAGGAVAAGVLSL

SEQ ID NO: 368234 - protein, 33 aa, Mycobacterium
RRPVFLTMALFTILYAFPLFWLVETEVAVLIWI

SEQ ID NO: 368235 - protein, 22 aa, Mycobacterium
RRPVPHLVGSVLVLALLGGFTL

SEQ ID NO: 368236 - protein, 17 aa, Mycobacterium
RRQLLVPAAFTTGVLLI

SEQ ID NO: 368237 - protein, 30 aa, Mycobacterium
RRQPHRALVVWISFAAALVAVGALAGCVAL

SEQ ID NO: 368238 - protein, 18 aa, Mycobacterium
RRQPYGRLFATLVAPRLG

SEQ ID NO: 368239 - protein, 25 aa, Mycobacterium
RRQQIPLRPLWGLDDRLKQFGGMAA

SEQ ID NO: 368240 - protein, 25 aa, Mycobacterium
RRQRYGWLALVTALLGWAAGEVIWA

SEQ ID NO: 368241 - protein, 24 aa, Mycobacterium
RRQVRAYARFLAENVPGCGHAFVV

SEQ ID NO: 368242 - protein, 36 aa, Mycobacterium
RRQVRLVVADRAYFTFLAALPFVLGALSLTVPGDTG

SEQ ID NO: 368243 - protein, 26 aa, Mycobacterium
RRRAARRITMFFKHAALVFAYTTYIS

SEQ ID NO: 368244 - protein, 28 aa, Mycobacterium
RRRALRRMKLVALSFLLGATVVFLACRW

SEQ ID NO: 368245 - protein, 19 aa, Mycobacterium
RRRDCLHLYLRDEFTRLDG

SEQ ID NO: 368246 - protein, 20 aa, Mycobacterium
RRRDLAMTWLLAGLVAGVLS

SEQ ID NO: 368247 - protein, 25 aa, Mycobacterium
RRREVLFYAWLMPASTVAQAIIGGI

SEQ ID NO: 368248 - protein, 19 aa, Mycobacterium
RRRFGGRVPLPRKPMTPDR

SEQ ID NO: 368249 - protein, 20 aa, Mycobacterium
RRRFRGLVRDAWPPSARAQP

SEQ ID NO: 368250 - protein, 17 aa, Mycobacterium
RRRGFFVGLALFVASSV

SEQ ID NO: 368251 - protein, 22 aa, Mycobacterium
RRRGIPLPAFLDAAAPAVVLAQ

SEQ ID NO: 368252 - protein, 17 aa, Mycobacterium
RRRGMMAGFLPLGTLTG

SEQ ID NO: 368253 - protein, 17 aa, Mycobacterium
RRRGRVLGWVFGGAAGG

SEQ ID NO: 368254 - protein, 19 aa, Mycobacterium
RRRHGVPRQLGLVAALPLS

SEQ ID NO: 368255 - protein, 23 aa, Mycobacterium
RRRIMLFGWAGCLAWSFVVIPLI

SEQ ID NO: 368256 - protein, 18 aa, Mycobacterium
RRRIVVSVFLLIGAGLLG

SEQ ID NO: 368257 - protein, 23 aa, Mycobacterium
RRRLHERVILATAIGFAVITPLA

SEQ ID NO: 368258 - protein, 24 aa, Mycobacterium
RRRLTWGFLFLFNSLAVYWMETIG

SEQ ID NO: 368259 - protein, 26 aa, Mycobacterium
RRRPAAKRRWLAYSGAGLAAAACVAV

SEQ ID NO: 368260 - protein, 17 aa, Mycobacterium
RRRPKFVVAAALILLIL

SEQ ID NO: 368261 - protein, 24 aa, Mycobacterium
RRRPWRGMVLALTAIVLVAAVGTY

SEQ ID NO: 368262 - protein, 17 aa, Mycobacterium
RRRQRALRLMSQRVASA

SEQ ID NO: 368263 - protein, 25 aa, Mycobacterium
RRRQRFMLSLYVPLVMRILCSAILV

SEQ ID NO: 368264 - protein, 25 aa, Mycobacterium
RRRREWWLLVPLAVATWALVHASGV

SEQ ID NO: 368265 - protein, 21 aa, Mycobacterium
RRRRILLVCITVTVLLAGFIT

SEQ ID NO: 368266 - protein, 19 aa, Mycobacterium
RRRRPPIGVAPLAVRTVMN

SEQ ID NO: 368267 - protein, 35 aa, Mycobacterium
RRRRPRFRVSIQSKLMVLLLLSSIVSVAAIVAVGF

SEQ ID NO: 368268 - protein, 23 aa, Mycobacterium
RRRRRALRWGLIFAVGCVFWAAV

SEQ ID NO: 368269 - protein, 18 aa, Mycobacterium
RRRRRRTIDDRGYRHEYA

SEQ ID NO: 368270 - protein, 24 aa, Mycobacterium
RRRSGFHLLLLGALAAIVCADLSM

SEQ ID NO: 368271 - protein, 25 aa, Mycobacterium
RRRTLAWVAALSVAGVVLLVIVAVV

SEQ ID NO: 368272 - protein, 21 aa, Mycobacterium
RRRTRKKVLMGSAVVAGIAAV

SEQ ID NO: 368273 - protein, 35 aa, Mycobacterium
RRSAAIYELPPPPRGFLPLFPPGMGPPGRHLRVFD

SEQ ID NO: 368274 - protein, 27 aa, Mycobacterium
RRSALATLRIAFLSALVLELLATLGVA

SEQ ID NO: 368275 - protein, 18 aa, Mycobacterium
RRSGAWLIADLRGRRTAL

SEQ ID NO: 368276 - protein, 18 aa, Mycobacterium
RRSGFHLLLLGVLAAVVC

SEQ ID NO: 368277 - protein, 26 aa, Mycobacterium
RRSLLLRVELPLAVPYILAGLRTSLV

SEQ ID NO: 368278 - protein, 24 aa, Mycobacterium
RRSNALQDWAYGRQFRYSETMSLG

SEQ ID NO: 368279 - protein, 24 aa, Mycobacterium
RRSQPLFVAQWRNTGRLAAHLEET

SEQ ID NO: 368280 - protein, 32 aa, Mycobacterium
RRSRRDPLSIFLILIIVFSLVLAGVIASELYA

SEQ ID NO: 368281 - protein, 40 aa, Mycobacterium
RRSRRRPMLLAGRSLAAMFAVLALVLTGGAWQWSASKNER

SEQ ID NO: 368282 - protein, 31 aa, Mycobacterium
RRSRVLILIALGVIALLLAGPRLIDAYVDWL

SEQ ID NO: 368283 - protein, 21 aa, Mycobacterium
RRSSMIFEFGPPPPPGMGMPP

SEQ ID NO: 368284 - protein, 26 aa, Mycobacterium
RRTATLTRWAVIVDGPLRIAIGCQHE

SEQ ID NO: 368285 - protein, 23 aa, Mycobacterium
RRTDAWGHWLGCAAALAAFGVGL

SEQ ID NO: 368286 - protein, 18 aa, Mycobacterium
RRTFGELEQLLAYRQRLF

SEQ ID NO: 368287 - protein, 18 aa, Mycobacterium
RRTFGLRRDLVNLRRVAL

SEQ ID NO: 368288 - protein, 21 aa, Mycobacterium
RRTFTFGVVIFTIASGLCAVA

SEQ ID NO: 368289 - protein, 25 aa, Mycobacterium
RRTKAFPLIALLRQDWRGLAVVIGI

SEQ ID NO: 368290 - protein, 46 aa, Mycobacterium
RRTLNTIKTNLFWAFGYNVAALPLAAFGLLNPMLAGAAMAFSSVFV

SEQ ID NO: 368291 - protein, 31 aa, Mycobacterium
RRTLSTIKTNLFWAFAYNVAAIPVAALGMLN

SEQ ID NO: 368292 - protein, 21 aa, Mycobacterium
RRTMAAPCSLVRIVPATLGPD

SEQ ID NO: 368293 - protein, 17 aa, Mycobacterium
RRTRQPAPQNGLRSASF

SEQ ID NO: 368294 - protein, 26 aa, Mycobacterium
RRTTNPLSLRRWFNPVNAAAATALVS

SEQ ID NO: 368295 - protein, 23 aa, Mycobacterium
RRTVPLAIILTVLIGGATFLSVS

SEQ ID NO: 368296 - protein, 33 aa, Mycobacterium
RRVAFMFTALCLFASLFIMLRRKRVPGVARGPA

SEQ ID NO: 368297 - protein, 31 aa, Mycobacterium
RRVASWLAAFLVPSAICAVIVTALDPYLGTS

SEQ ID NO: 368298 - protein, 18 aa, Mycobacterium
RRVFAIASGITAVLSLDA

SEQ ID NO: 368299 - protein, 17 aa, Mycobacterium
RRVGAATVRWPGAILVA

SEQ ID NO: 368300 - protein, 25 aa, Mycobacterium
RRVGTAIVRWPGPILAVSVAIALIG

SEQ ID NO: 368301 - protein, 24 aa, Mycobacterium
RRVGTAIVRWPGPVLAATCLVASI

SEQ ID NO: 368302 - protein, 25 aa, Mycobacterium
RRVGTAIVRWPGPVLAATCVIAFIG

SEQ ID NO: 368303 - protein, 29 aa, Mycobacterium
RRVGTAIVRWPLPILAVTCAVALVGLITL

SEQ ID NO: 368304 - protein, 25 aa, Mycobacterium
RRVGTVVVRWPAPVLAAACAIAVIG

SEQ ID NO: 368305 - protein, 19 aa, Mycobacterium
RRVIDAVFHLPIAIPSVAI

SEQ ID NO: 368306 - protein, 21 aa, Mycobacterium
RRVILFPDTFNNRLHTDVGVA

SEQ ID NO: 368307 - protein, 22 aa, Mycobacterium
RRVLAGLLVVLAAVAAWRGDPD

SEQ ID NO: 368308 - protein, 29 aa, Mycobacterium
RRVLPALVNQFIALLKASALVYFLGLIAQ

SEQ ID NO: 368309 - protein, 43 aa, Mycobacterium
RRVNVARWAAALILAVVLAGAGYEGWLLFQHHQKDVAAAQALT

SEQ ID NO: 368310 - protein, 26 aa, Mycobacterium
RRVTRWEWMWAALLAGAVAVIVTVGN

SEQ ID NO: 368311 - protein, 24 aa, Mycobacterium
RRVVFVGVFFTAHVIPLFAVYTFG

SEQ ID NO: 368312 - protein, 19 aa, Mycobacterium
RRVVRIEIPLRAAGPVRRF

SEQ ID NO: 368313 - protein, 25 aa, Mycobacterium
RRWERAMFVFIAVTLLQIPMLLMSH

SEQ ID NO: 368314 - protein, 18 aa, Mycobacterium
RRWGGGVRGLFQAGTLLG

SEQ ID NO: 368315 - protein, 17 aa, Mycobacterium
RRWRLLGWSATIGALAL

SEQ ID NO: 368316 - protein, 23 aa, Mycobacterium
RRWVVRAVLLGVALLAGVTAAAI

SEQ ID NO: 368317 - protein, 23 aa, Mycobacterium
RRWYVITFLMGLFFILGQAYEYY

SEQ ID NO: 368318 - protein, 21 aa, Mycobacterium
RRYYSSWPVPQGDVALMGARA

SEQ ID NO: 368319 - protein, 23 aa, Mycobacterium
RSADLDWQTVWEKGWSVAAAAQD

SEQ ID NO: 368320 - protein, 25 aa, Mycobacterium
RSAGLWTWLTDAAVIGGLLLWHVVG

SEQ ID NO: 368321 - protein, 19 aa, Mycobacterium
RSALLMAPLPIVAALLTPI

SEQ ID NO: 368322 - protein, 25 aa, Mycobacterium
RSAMATLRIAFLSALVLELLATLGV

SEQ ID NO: 368323 - protein, 30 aa, Mycobacterium
RSAPIVRRILLRTVLFIAPGSALWGLLAVI

SEQ ID NO: 368324 - protein, 18 aa, Mycobacterium
RSAPLIRGLAALGRALSL

SEQ ID NO: 368325 - protein, 18 aa, Mycobacterium
RSARLLSSWYRLPPKDAT

SEQ ID NO: 368326 - protein, 19 aa, Mycobacterium
RSARPILVHRAIAGSPGLA

SEQ ID NO: 368327 - protein, 18 aa, Mycobacterium
RSARPNHRWLDVVAVAVV

SEQ ID NO: 368328 - protein, 35 aa, Mycobacterium
RSASFVFRHRTGNAVIFLLLVVAAAQLFTLQVPRA

SEQ ID NO: 368329 - protein, 28 aa, Mycobacterium
RSAVCDLLERPTFRAALIRTSGNQHRFV

SEQ ID NO: 368330 - protein, 26 aa, Mycobacterium
RSDIAQLLRMLRMRHDVTYRTRTEID

SEQ ID NO: 368331 - protein, 25 aa, Mycobacterium
RSDIQAEFAPLPPAPPIALGDHGEL

SEQ ID NO: 368332 - protein, 26 aa, Mycobacterium
RSDIYSLGCALFRLLTSHTPYEDNSL

SEQ ID NO: 368333 - protein, 25 aa, Mycobacterium
RSDMQFAIATTLGVGLAAIAAIAVI

SEQ ID NO: 368334 - protein, 24 aa, Mycobacterium
RSDRLSHTLLPKRIALPVFASDAM

SEQ ID NO: 368335 - protein, 21 aa, Mycobacterium
RSDSRLFLEDPAEYRREAVAA

SEQ ID NO: 368336 - protein, 25 aa, Mycobacterium
RSEIAKYPTGPLIGIPGAPAAMPVN

SEQ ID NO: 368337 - protein, 25 aa, Mycobacterium
RSELAVCLALVLLMLPVIVRATEEM

SEQ ID NO: 368338 - protein, 24 aa, Mycobacterium
RSELLGHTYITPFDSLIVAAGAGQ

SEQ ID NO: 368339 - protein, 26 aa, Mycobacterium
RSERQYPFLVMELIEGGTLRELLTER

SEQ ID NO: 368340 - protein, 17 aa, Mycobacterium
RSFKLIRNGFWRVLGIR

SEQ ID NO: 368341 - protein, 32 aa, Mycobacterium
RSFLMPSIAALLGRWFWWPQIVRSRPASQLLR

SEQ ID NO: 368342 - protein, 24 aa, Mycobacterium
RSFSTMFPARRFGGGALAVYLDGQ

SEQ ID NO: 368343 - protein, 23 aa, Mycobacterium
RSGAIDYPGLLRAGLEELDFYDS

SEQ ID NO: 368344 - protein, 61 aa, Mycobacterium
RSGDDAAELIAWSGLLLLALTALGGGIKLAMWGARPVIAALFDRAKERLAEPVLAVVASGA

SEQ ID NO: 368345 - protein, 24 aa, Mycobacterium
RSGHPLLPLSLFTARNFAAVNLVT

SEQ ID NO: 368346 - protein, 19 aa, Mycobacterium
RSGIYFGFAIGLVQMVAWA

SEQ ID NO: 368347 - protein, 19 aa, Mycobacterium
RSGLLPDLIPIGLLAGLSA

SEQ ID NO: 368348 - protein, 22 aa, Mycobacterium
RSGLVYDMWGAAVSLAYQMQSG

SEQ ID NO: 368349 - protein, 20 aa, Mycobacterium
RSGRVLVYGAGSLGLCAIAI

SEQ ID NO: 368350 - protein, 24 aa, Mycobacterium
RSHFDILRHLYLPALTTFVFAGVR

SEQ ID NO: 368351 - protein, 30 aa, Mycobacterium
RSHRGIIMAFAMLAGVLVIVGLGYVGYMAV

SEQ ID NO: 368352 - protein, 27 aa, Mycobacterium
RSKDFWLPAMFALTVLYFTVVGFQMGH

SEQ ID NO: 368353 - protein, 31 aa, Mycobacterium
RSKDTSPPAPRWAWPTLVTVGLIGLIVMVFR

SEQ ID NO: 368354 - protein, 26 aa, Mycobacterium
RSLFDTNFFGLIRLTNEVLPHMRRRG

SEQ ID NO: 368355 - protein, 24 aa, Mycobacterium
RSLGLPFWRVLTLIVLPQAMRSVL

SEQ ID NO: 368356 - protein, 24 aa, Mycobacterium
RSLIVSSWRLIGKCLRPLPNKWKG

SEQ ID NO: 368357 - protein, 24 aa, Mycobacterium
RSLKTANPWWVLAAALAAMASMHS

SEQ ID NO: 368358 - protein, 22 aa, Mycobacterium
RSLLIFIVTVVILVTVLVQGST

SEQ ID NO: 368359 - protein, 24 aa, Mycobacterium
RSLLRNPLAWTVTLFFGCQAFLAY

SEQ ID NO: 368360 - protein, 32 aa, Mycobacterium
RSLMTPSIATLLGRWFWWPQRVRERPVPSKWP

SEQ ID NO: 368361 - protein, 23 aa, Mycobacterium
RSLNTSYYRLMLKLENGPADVAE

SEQ ID NO: 368362 - protein, 19 aa, Mycobacterium
RSLPSRLISAGLQATTELA

SEQ ID NO: 368363 - protein, 23 aa, Mycobacterium
RSLQKVLIGSWYFSLAAMVVISA

SEQ ID NO: 368364 - protein, 23 aa, Mycobacterium
RSLRALLSLVPPTATVIRDGHET

SEQ ID NO: 368365 - protein, 28 aa, Mycobacterium
RSLSQAVLPALLWTPVATLAATAVYVLV

SEQ ID NO: 368366 - protein, 26 aa, Mycobacterium
RSLTHSAFRIGIFSNRWIIVGVTVQA

SEQ ID NO: 368367 - protein, 23 aa, Mycobacterium
RSMSFFRTVLFLPQVIATVVIAT

SEQ ID NO: 368368 - protein, 23 aa, Mycobacterium
RSNDLNFVWITDFQPYQPQLDVP

SEQ ID NO: 368369 - protein, 23 aa, Mycobacterium
RSNHAPLPWWILAALVVVVVALA

SEQ ID NO: 368370 - protein, 22 aa, Mycobacterium
RSNRVLMGLLLGTALTQIAASW

SEQ ID NO: 368371 - protein, 22 aa, Mycobacterium
RSNWIVLRMRLYENLAAIDRRG

SEQ ID NO: 368372 - protein, 18 aa, Mycobacterium
RSNWPQPLQRWWLYRRVA

SEQ ID NO: 368373 - protein, 23 aa, Mycobacterium
RSPAGWVVILLYAVCVVLRLARY

SEQ ID NO: 368374 - protein, 18 aa, Mycobacterium
RSPALQRLRLLETSYGAG

SEQ ID NO: 368375 - protein, 24 aa, Mycobacterium
RSPARETLWWVSDAGVRYGLMSSR

SEQ ID NO: 368376 - protein, 25 aa, Mycobacterium
RSPDYWLGWWVIIGTIPISVIGLLF

SEQ ID NO: 368377 - protein, 22 aa, Mycobacterium
RSPLACRVSLLVLIASLALMPV

SEQ ID NO: 368378 - protein, 20 aa, Mycobacterium
RSPLAWTVTVFFGSQAFLAY

SEQ ID NO: 368379 - protein, 19 aa, Mycobacterium
RSPLGAAAVILLWVYAAES

SEQ ID NO: 368380 - protein, 17 aa, Mycobacterium
RSPLLERTFEWLEAHWP

SEQ ID NO: 368381 - protein, 24 aa, Mycobacterium
RSPLRGPWLTAVFGSVLLVTLPIV

SEQ ID NO: 368382 - protein, 19 aa, Mycobacterium
RSPRRPWLEPLEDPEPIDV

SEQ ID NO: 368383 - protein, 31 aa, Mycobacterium
RSPVEPVHPRWWFISTTPGRILSIGIVLAVL

SEQ ID NO: 368384 - protein, 17 aa, Mycobacterium
RSPWPIELHDGEKPKLH

SEQ ID NO: 368385 - protein, 39 aa, Mycobacterium
RSQAATMMAPLPPPPPPPPPPPPPQFAATPPPGGAATYQ

SEQ ID NO: 368386 - protein, 19 aa, Mycobacterium
RSQFDRLRLRLSRSVTVVV

SEQ ID NO: 368387 - protein, 29 aa, Mycobacterium
RSQNSSPPPPRWVWLPLIAVGAVGMVLMA

SEQ ID NO: 368388 - protein, 32 aa, Mycobacterium
RSRARAVRLLRPLILLPLVLPPVVGGIALLYA

SEQ ID NO: 368389 - protein, 32 aa, Mycobacterium
RSRARLVRLLRPLILLPLVLPPVVGGIALLYA

SEQ ID NO: 368390 - protein, 19 aa, Mycobacterium
RSRFVKIYGLRIDLQRLET

SEQ ID NO: 368391 - protein, 21 aa, Mycobacterium
RSRIGMVLQDTWLLAGTIAEN

SEQ ID NO: 368392 - protein, 19 aa, Mycobacterium
RSRIPFRIAMVVLVAGLVV

SEQ ID NO: 368393 - protein, 24 aa, Mycobacterium
RSRLHGIKKWKAAILATTLLLFLG

SEQ ID NO: 368394 - protein, 29 aa, Mycobacterium
RSRLSRIPRRWVIVALGVLVVAAGLAVAA

SEQ ID NO: 368395 - protein, 23 aa, Mycobacterium
RSRPFIARTIRTLSPLIILGWLV

SEQ ID NO: 368396 - protein, 31 aa, Mycobacterium
RSRRILLGSAVVVLLVGLLGVGIAIGRKTTG

SEQ ID NO: 368397 - protein, 19 aa, Mycobacterium
RSRRWRTVWLPAAALAGAS

SEQ ID NO: 368398 - protein, 27 aa, Mycobacterium
RSRVAARRLLELTTPTPLRSRPDVATV

SEQ ID NO: 368399 - protein, 21 aa, Mycobacterium
RSRWALLLDWREPEAPAYPMR

SEQ ID NO: 368400 - protein, 33 aa, Mycobacterium
RSRWLRPVLICVLVAVLAIGAYLVWPSRTGQKV

SEQ ID NO: 368401 - protein, 22 aa, Mycobacterium
RSRWQRFRMLLAVLGPGLIVMV

SEQ ID NO: 368402 - protein, 23 aa, Mycobacterium
RSSRFVKLFGLRIDLQRLESGLA

SEQ ID NO: 368403 - protein, 26 aa, Mycobacterium
RSSTRGWFMSWLARSHPELVGRYREL

SEQ ID NO: 368404 - protein, 35 aa, Mycobacterium
RSSVAVPMFHGFGLGMLMLTFALGGTVLTHRRFDA

SEQ ID NO: 368405 - protein, 17 aa, Mycobacterium
RSSWSPLIGLTAGFPPT

SEQ ID NO: 368406 - protein, 21 aa, Mycobacterium
RSTGLFYLGMLTVLAPLGAGV

SEQ ID NO: 368407 - protein, 17 aa, Mycobacterium
RSTKLVMRRWAPIGLTV

SEQ ID NO: 368408 - protein, 19 aa, Mycobacterium
RSTLLERMSTSLSARFDRA

SEQ ID NO: 368409 - protein, 26 aa, Mycobacterium
RSTLQLVLDNLWPLAKAALTMTIPLT

SEQ ID NO: 368410 - protein, 24 aa, Mycobacterium
RSTMATLRISFLSALVLELLATLG

SEQ ID NO: 368411 - protein, 30 aa, Mycobacterium
RSTPVIRRAVLTLYPHCAPKIGVLGRNPDV

SEQ ID NO: 368412 - protein, 24 aa, Mycobacterium
RSTWQLIGDNLWPLAKAAVTMTIP

SEQ ID NO: 368413 - protein, 26 aa, Mycobacterium
RSVAALLAVLAVAMTGGAWQWSTSKN

SEQ ID NO: 368414 - protein, 18 aa, Mycobacterium
RSVAHEIAWRPWTAPSET

SEQ ID NO: 368415 - protein, 27 aa, Mycobacterium
RSVDNWARRVWALPVFPDGSADSVVQV

SEQ ID NO: 368416 - protein, 27 aa, Mycobacterium
RSVDNWVRRLLALPAFPDGSADRLMQV

SEQ ID NO: 368417 - protein, 26 aa, Mycobacterium
RSVDNWVRRMLALPVFPARSSDHRMQ

SEQ ID NO: 368418 - protein, 26 aa, Mycobacterium
RSVDVAFWFWVVSAAALFLNGLAGVT

SEQ ID NO: 368419 - protein, 24 aa, Mycobacterium
RSVFEHRAVVVGADRAQLLQGLAG

SEQ ID NO: 368420 - protein, 24 aa, Mycobacterium
RSVFEHRAVVVGADRTQLIQGLAG

SEQ ID NO: 368421 - protein, 29 aa, Mycobacterium
RSVFTTVLATRLIVFVVVALAIGAIVFAG

SEQ ID NO: 368422 - protein, 29 aa, Mycobacterium
RSVFTTVLVTRIVVFLAGGLLVGGIVFAG

SEQ ID NO: 368423 - protein, 27 aa, Mycobacterium
RSVGGGWWKTLFAAVLPQSMPALVGSS

SEQ ID NO: 368424 - protein, 39 aa, Mycobacterium
RSVLEPWLTFLRALPPLAYFFLLVIWLGIDEAPKITLLA

SEQ ID NO: 368425 - protein, 27 aa, Mycobacterium
RSVTTFPWVFLFPAGVLVLIAFCANLV

SEQ ID NO: 368426 - protein, 17 aa, Mycobacterium
RSWGPPFVADQSAYYLS

SEQ ID NO: 368427 - protein, 23 aa, Mycobacterium
RSWLITLGVVLFGVGFMVLIGPN

SEQ ID NO: 368428 - protein, 27 aa, Mycobacterium
RSWMRTTAISCAIACSAMVVGPGMAGT

SEQ ID NO: 368429 - protein, 25 aa, Mycobacterium
RSWPAAQRFPFYTSVKHLLLDQAAE

SEQ ID NO: 368430 - protein, 26 aa, Mycobacterium
RSWPVDRPFALLPAARALMLDVIVKV

SEQ ID NO: 368431 - protein, 18 aa, Mycobacterium
RSYHHGVDRWRAAILTAT

SEQ ID NO: 368432 - protein, 22 aa, Mycobacterium
RTAALNLFVVVEAFYLFSCRSL

SEQ ID NO: 368433 - protein, 42 aa, Mycobacterium
RTAGFAFRHRTGNIIIFLTLAIAAIQLFTLQGPRAAGLRAEA

SEQ ID NO: 368434 - protein, 21 aa, Mycobacterium
RTAGRGFILFGLLAPNLFATL

SEQ ID NO: 368435 - protein, 19 aa, Mycobacterium
RTAGVLSYLLTRPSRLERT

SEQ ID NO: 368436 - protein, 18 aa, Mycobacterium
RTALKALWPAVLAALGVA

SEQ ID NO: 368437 - protein, 19 aa, Mycobacterium
RTALLERMPASLSARFDRA

SEQ ID NO: 368438 - protein, 17 aa, Mycobacterium
RTALWPITQASVTAGLA

SEQ ID NO: 368439 - protein, 21 aa, Mycobacterium
RTANWTWALLGLAVSALTYVG

SEQ ID NO: 368440 - protein, 24 aa, Mycobacterium
RTASALDLDLLLGGLKPVIQGLDP

SEQ ID NO: 368441 - protein, 25 aa, Mycobacterium
RTATDSTFYPLPRSHAQLAAGRWDP

SEQ ID NO: 368442 - protein, 22 aa, Mycobacterium
RTATVLVFTSSAAVLVVEITAL

SEQ ID NO: 368443 - protein, 24 aa, Mycobacterium
RTAWTLQYAVWTLAVLGVLITRRK

SEQ ID NO: 368444 - protein, 17 aa, Mycobacterium
RTAYLVMELINGEPLNS

SEQ ID NO: 368445 - protein, 24 aa, Mycobacterium
RTAYYRLPVVYSNYGLRASALPAR

SEQ ID NO: 368446 - protein, 24 aa, Mycobacterium
RTDDDGFVYFVGRLSAMVKTAGAN

SEQ ID NO: 368447 - protein, 27 aa, Mycobacterium
RTDFRLRWSWRELWIGIAFGFGGLFVT

SEQ ID NO: 368448 - protein, 21 aa, Mycobacterium
RTDIYALTAVLYECLTGQTAV

SEQ ID NO: 368449 - protein, 24 aa, Mycobacterium
RTDIYSLGCTLFHLLTGHAPFSDR

SEQ ID NO: 368450 - protein, 32 aa, Mycobacterium
RTDLPTYGFVRRRYWLKELGVDQTKLTGAGLT

SEQ ID NO: 368451 - protein, 23 aa, Mycobacterium
RTDRFIEALSLEQPVYSTDPEEA

SEQ ID NO: 368452 - protein, 23 aa, Mycobacterium
RTDRWWLAPLLTNLGLATFVIYA

SEQ ID NO: 368453 - protein, 22 aa, Mycobacterium
RTDTILLVHLPGIGSSTPATMV

SEQ ID NO: 368454 - protein, 23 aa, Mycobacterium
RTEFEQLISPPLDRFVTSLQDTL

SEQ ID NO: 368455 - protein, 17 aa, Mycobacterium
RTEFQQVVLPFTGLRDP

SEQ ID NO: 368456 - protein, 22 aa, Mycobacterium
RTEGVLALPLPIAKINKMMTAD

SEQ ID NO: 368457 - protein, 25 aa, Mycobacterium
RTELIITLVGLFIASYHTTMVALTN

SEQ ID NO: 368458 - protein, 24 aa, Mycobacterium
RTELLTGPKLPPAPRPIVVAPGRE

SEQ ID NO: 368459 - protein, 22 aa, Mycobacterium
RTELQADCYAGIWAHYAATVNQ

SEQ ID NO: 368460 - protein, 30 aa, Mycobacterium
RTELVFAGLAGSLLLTGWLLAAFADTPRSA

SEQ ID NO: 368461 - protein, 33 aa, Mycobacterium
RTEPALDLDALIGGFRPLFRALDPDQVNKLTGQ

SEQ ID NO: 368462 - protein, 21 aa, Mycobacterium
RTEQVTFVYLVSSMLDTLLEL

SEQ ID NO: 368463 - protein, 24 aa, Mycobacterium
RTESALDLDLLLGGLKPVIQGLNP

SEQ ID NO: 368464 - protein, 32 aa, Mycobacterium
RTFSSGQRALLWAAGVLGALAIIIAVLIVINS

SEQ ID NO: 368465 - protein, 30 aa, Mycobacterium
RTFSSGQRALLWAAGVLGALAIVIAILIVL

SEQ ID NO: 368466 - protein, 18 aa, Mycobacterium
RTFVRAISQALRLTYMIF

SEQ ID NO: 368467 - protein, 30 aa, Mycobacterium
RTGAHRVPGAFRLAVLAGALALAGLAVVGF

SEQ ID NO: 368468 - protein, 31 aa, Mycobacterium
RTGGYGYDLWIPLIFLVLVSGFIAIQIKAAR

SEQ ID NO: 368469 - protein, 20 aa, Mycobacterium
RTGLKAVLPLAVHNKWVVLH

SEQ ID NO: 368470 - protein, 24 aa, Mycobacterium
RTGLPVFPASLLLGLLAVGFALRD

SEQ ID NO: 368471 - protein, 20 aa, Mycobacterium
RTHLRRVTATTPSAYRRAFR

SEQ ID NO: 368472 - protein, 22 aa, Mycobacterium
RTHWLYILVIVAVVAGIVVGLV

SEQ ID NO: 368473 - protein, 17 aa, Mycobacterium
RTIIFNGWNWSVSQAIV

SEQ ID NO: 368474 - protein, 30 aa, Mycobacterium
RTIQKFSLPVILLWIALTVGANLLAPQLEE

SEQ ID NO: 368475 - protein, 33 aa, Mycobacterium
RTISGWVYLHGAWPWLFILGLVAVGAAIWWRTN

SEQ ID NO: 368476 - protein, 17 aa, Mycobacterium
RTIVFLPLAISSVVMAV

SEQ ID NO: 368477 - protein, 19 aa, Mycobacterium
RTIYQNLGWAFGYNTAAIP

SEQ ID NO: 368478 - protein, 26 aa, Mycobacterium
RTIYQNLGWAFGYNTAAIPLAALGSL

SEQ ID NO: 368479 - protein, 17 aa, Mycobacterium
RTKAVEKPLWSSFVWRN

SEQ ID NO: 368480 - protein, 18 aa, Mycobacterium
RTLATRLAARRRRARAGS

SEQ ID NO: 368481 - protein, 19 aa, Mycobacterium
RTLNRLLAVQDPPARRRVG

SEQ ID NO: 368482 - protein, 20 aa, Mycobacterium
RTLRSLATLPRTPLFAGLGA

SEQ ID NO: 368483 - protein, 29 aa, Mycobacterium
RTLSTIKTNLFWAFVYNVAAIPVAALGML

SEQ ID NO: 368484 - protein, 30 aa, Mycobacterium
RTLTLALALYLVSSVLIWAQARLLNLTVQR

SEQ ID NO: 368485 - protein, 31 aa, Mycobacterium
RTLTSMGTALVLLFLLALAAIPGALLPQRSL

SEQ ID NO: 368486 - protein, 30 aa, Mycobacterium
RTLTSMGTALVLLFLLALGAIPGALLPQRS

SEQ ID NO: 368487 - protein, 23 aa, Mycobacterium
RTLYAAIVLFVLSLSFSSVNGWW

SEQ ID NO: 368488 - protein, 27 aa, Mycobacterium
RTMPRALIAALLIVTAFYLVVALAALG

SEQ ID NO: 368489 - protein, 25 aa, Mycobacterium
RTNDIIRLTLAAVFLPAVIASSLFT

SEQ ID NO: 368490 - protein, 24 aa, Mycobacterium
RTNDILRLVLASLFLALVITGSVV

SEQ ID NO: 368491 - protein, 18 aa, Mycobacterium
RTNPFPGEPPRYVRARLY

SEQ ID NO: 368492 - protein, 25 aa, Mycobacterium
RTPAFVVMYLIMVIAAAAALLAIVY

SEQ ID NO: 368493 - protein, 34 aa, Mycobacterium
RTPATVWMGLVYPWIDLVLLALAAGMLPILGWRN

SEQ ID NO: 368494 - protein, 24 aa, Mycobacterium
RTPDAPWFDNWIVALSAAVVVVTG

SEQ ID NO: 368495 - protein, 22 aa, Mycobacterium
RTPELYACILVALGGVAWSQSA

SEQ ID NO: 368496 - protein, 24 aa, Mycobacterium
RTPELYAWLVVALAGFAWEQAAFR

SEQ ID NO: 368497 - protein, 29 aa, Mycobacterium
RTPIIGAFPKMFIPFIVVIPGMICAVLVP

SEQ ID NO: 368498 - protein, 29 aa, Mycobacterium
RTPPAWASWLRVVLGSALILFGGYRWLTR

SEQ ID NO: 368499 - protein, 24 aa, Mycobacterium
RTPRRGFWLSWLGASMLAAIALVT

SEQ ID NO: 368500 - protein, 19 aa, Mycobacterium
RTPVTFLLRLLVPTAASVA

SEQ ID NO: 368501 - protein, 18 aa, Mycobacterium
RTPWPVFTLGMLQADIIG

SEQ ID NO: 368502 - protein, 29 aa, Mycobacterium
RTQAPLGWLYVLCGALVFAALAWVTPRVQ

SEQ ID NO: 368503 - protein, 23 aa, Mycobacterium
RTQGVIALPLPIAKINRIMTANQ

SEQ ID NO: 368504 - protein, 18 aa, Mycobacterium
RTQILVPPATWNLQADDA

SEQ ID NO: 368505 - protein, 18 aa, Mycobacterium
RTQILVPPATWNLQGDDA

SEQ ID NO: 368506 - protein, 20 aa, Mycobacterium
RTQLLVPPATWNLQADDAHV

SEQ ID NO: 368507 - protein, 27 aa, Mycobacterium
RTQVIQLVLLIALVYVAYPFISTVPTF

SEQ ID NO: 368508 - protein, 17 aa, Mycobacterium
RTRHAFWSKPAPAPILL

SEQ ID NO: 368509 - protein, 35 aa, Mycobacterium
RTRIELAIVVLLFVILLVIYRNPVTMVLPLLTIGM

SEQ ID NO: 368510 - protein, 21 aa, Mycobacterium
RTRLIAAAAVLVAALLTASVV

SEQ ID NO: 368511 - protein, 20 aa, Mycobacterium
RTRLLPWVLIDTAVTWGFGI

SEQ ID NO: 368512 - protein, 17 aa, Mycobacterium
RTRLLVSAVLTVPVIAM

SEQ ID NO: 368513 - protein, 31 aa, Mycobacterium
RTRLMTPLRVMFLIGLVFLALGWSTKAACLQ

SEQ ID NO: 368514 - protein, 26 aa, Mycobacterium
RTRLPSAPLLVLVGIGYALVPGPNIS

SEQ ID NO: 368515 - protein, 21 aa, Mycobacterium
RTRRFWAWTVAGYALTLITVP

SEQ ID NO: 368516 - protein, 27 aa, Mycobacterium
RTRRGLRSLLSLVPPKASVLRDGTEIT

SEQ ID NO: 368517 - protein, 27 aa, Mycobacterium
RTRRGLRSLLSLVPPKASVLRHGTETT

SEQ ID NO: 368518 - protein, 25 aa, Mycobacterium
RTRSWLLALALPYALYYVADPMNGV

SEQ ID NO: 368519 - protein, 19 aa, Mycobacterium
RTRVLFPALLAVPVLASIG

SEQ ID NO: 368520 - protein, 17 aa, Mycobacterium
RTSFALLVNGVLLTLKN

SEQ ID NO: 368521 - protein, 21 aa, Mycobacterium
RTSFYGIVLIGYVAAFTLLWA

SEQ ID NO: 368522 - protein, 25 aa, Mycobacterium
RTSGFLILTVLVGSVTWIIGAAWGW

SEQ ID NO: 368523 - protein, 23 aa, Mycobacterium
RTSLIVLTLIVLTVSLSVHGQSG

SEQ ID NO: 368524 - protein, 25 aa, Mycobacterium
RTSLIVVVLVTLFISLAVYGGSGNF

SEQ ID NO: 368525 - protein, 21 aa, Mycobacterium
RTSRWTLASLKDMPAAITLNA

SEQ ID NO: 368526 - protein, 24 aa, Mycobacterium
RTTALVLAGLPLAGIALGQAIGAA

SEQ ID NO: 368527 - protein, 22 aa, Mycobacterium
RTTIFAFPVFGFGVIFGAIWAE

SEQ ID NO: 368528 - protein, 17 aa, Mycobacterium
RTTIMVGVMLLILGVAT

SEQ ID NO: 368529 - protein, 21 aa, Mycobacterium
RTTMLWGLGLLTLASCMFATF

SEQ ID NO: 368530 - protein, 25 aa, Mycobacterium
RTTNQLYLVLPDSSQLRPVYNLTSA

SEQ ID NO: 368531 - protein, 34 aa, Mycobacterium
RTTPALDLDALIGGFKPLFRALDPQKVNTIATAL

SEQ ID NO: 368532 - protein, 26 aa, Mycobacterium
RTTPGRISLLLKAVAWALLYIVHRRN

SEQ ID NO: 368533 - protein, 21 aa, Mycobacterium
RTVAWLLGCATLLFTTSSGLG

SEQ ID NO: 368534 - protein, 21 aa, Mycobacterium
RTVGLLVGLFVLLIVLVEPLG

SEQ ID NO: 368535 - protein, 32 aa, Mycobacterium; identical to SEQ ID NO: 327983

SEQ ID NO: 368536 - protein, 20 aa, Mycobacterium
RTVKLRNVVAVALVSALLVG

SEQ ID NO: 368537 - protein, 25 aa, Mycobacterium
RTVLRRAFGLLGPLEAVLTLTAFLV

SEQ ID NO: 368538 - protein, 30 aa, Mycobacterium
RTVRARAFGWLWQALAATLVAAVFAAAVAQ

SEQ ID NO: 368539 - protein, 22 aa, Mycobacterium
RTVSWLIGCVVLLFATSSGLGM

SEQ ID NO: 368540 - protein, 21 aa, Mycobacterium
RTVVRWIRISVLILTGLVTLQ

SEQ ID NO: 368541 - protein, 17 aa, Mycobacterium
RTWDIFCLWMTSAHSLG

SEQ ID NO: 368542 - protein, 25 aa, Mycobacterium
RTWHITGACIFVFLLAMLRGNHVGH

SEQ ID NO: 368543 - protein, 24 aa, Mycobacterium
RTWHVQLSLFWTAAAFLAGGIFLV

SEQ ID NO: 368544 - protein, 29 aa, Mycobacterium
RTWRNSVLIAMIVAFFAMAVVLAVLVRNA

SEQ ID NO: 368545 - protein, 20 aa, Mycobacterium
RTYASLLQKAWQLPNALYAI

SEQ ID NO: 368546 - protein, 30 aa, Mycobacterium
RVAAALVAVLALVLTGGAWQWQSAKNNLLN

SEQ ID NO: 368547 - protein, 26 aa, Mycobacterium
RVAFKLYPRRAFLGLALFTGQAFLYN

SEQ ID NO: 368548 - protein, 32 aa, Mycobacterium
RVAFRFCVVYFGLFCVLLTQIPFALLGVVGRV

SEQ ID NO: 368549 - protein, 23 aa, Mycobacterium
RVAFVFTAMCLFPSLFMMLRRKH

SEQ ID NO: 368550 - protein, 26 aa, Mycobacterium
RVAFWVGVGLAVLVALLSLVTYHGLT

SEQ ID NO: 368551 - protein, 27 aa, Mycobacterium
RVAGLSRWWRVALLAAISTFLAAESLS

SEQ ID NO: 368552 - protein, 17 aa, Mycobacterium
RVAILAAPAILVSMAGN

SEQ ID NO: 368553 - protein, 23 aa, Mycobacterium
RVALELLGLARLMLGYRATMIGL

SEQ ID NO: 368554 - protein, 27 aa, Mycobacterium
RVAPPHPSRWRHVPTILLATSLVLLTT

SEQ ID NO: 368555 - protein, 31 aa, Mycobacterium
RVAPTPRYRRWLHIVGPRHWQWCLIAVGMFQ

SEQ ID NO: 368556 - protein, 21 aa, Mycobacterium
RVAQKLLLLWGVGAVLLTVLY

SEQ ID NO: 368557 - protein, 33 aa, Mycobacterium
RVARIQFWSMLITFVLLLTVFATALLTTSRPVG

SEQ ID NO: 368558 - protein, 21 aa, Mycobacterium
RVARLAMIGAPANGGQLLDQY

SEQ ID NO: 368559 - protein, 23 aa, Mycobacterium
RVASPLVPAVMVAAAIIAVAGSV

SEQ ID NO: 368560 - protein, 17 aa, Mycobacterium
RVASWLAAVIVPSLICA

SEQ ID NO: 368561 - protein, 31 aa, Mycobacterium
RVAVFYVGSLILLALLLPYGTYKAGESPFVT

SEQ ID NO: 368562 - protein, 19 aa, Mycobacterium
RVAVGIVLLAALTAATSLA

SEQ ID NO: 368563 - protein, 24 aa, Mycobacterium
RVAVWGPWVSIGAAALAVVCGLLT

SEQ ID NO: 368564 - protein, 25 aa, Mycobacterium
RVDDDGYFYFLGRAGAMIKTAGANV

SEQ ID NO: 368565 - protein, 18 aa, Mycobacterium
RVDEKWLPAATSPAPPRP

SEQ ID NO: 368566 - protein, 19 aa, Mycobacterium
RVDIDGTLSFLLLPRLTNV

SEQ ID NO: 368567 - protein, 30 aa, Mycobacterium
RVDIYSLGCTLYRLLTGHPPFPATNGAAGV

SEQ ID NO: 368568 - protein, 17 aa, Mycobacterium
RVDLKGFWIRRARRLLP

SEQ ID NO: 368569 - protein, 22 aa, Mycobacterium
RVDLPTYAFQRRRFWEVPGADG

SEQ ID NO: 368570 - protein, 18 aa, Mycobacterium
RVDLTDSNLLLLGRPRSG

SEQ ID NO: 368571 - protein, 43 aa, Mycobacterium
RVDPWSTLKVSLLLSVVLFFVWMIAVAFLYLVLGGMGVWSKLN

SEQ ID NO: 368572 - protein, 43 aa, Mycobacterium
RVDPWTVLKVSLVLSVVLFFVWMIAVAFLYLVLGGMGVWSKLN

SEQ ID NO: 368573 - protein, 36 aa, Mycobacterium
RVDTTEVGPFKKGPFRLAMAAGIPIVPIVIRNAELV

SEQ ID NO: 368574 - protein, 19 aa, Mycobacterium
RVDVVQPMLFAVMVSLART

SEQ ID NO: 368575 - protein, 25 aa, Mycobacterium
RVEAFAMFNLFYQAGILLGPLVGLV

SEQ ID NO: 368576 - protein, 22 aa, Mycobacterium
RVEALIFCLVVVVAVLAVPVVG

SEQ ID NO: 368577 - protein, 24 aa, Mycobacterium
RVEFDGVWFSYRPGTPVVEDLSLV

SEQ ID NO: 368578 - protein, 17 aa, Mycobacterium
RVEHWLNLLFVTLIIRS

SEQ ID NO: 368579 - protein, 20 aa, Mycobacterium
RVENWMLQVPEQTLTAPCLQ

SEQ ID NO: 368580 - protein, 17 aa, Mycobacterium
RVERWIYRAIGADPHAE

SEQ ID NO: 368581 - protein, 17 aa, Mycobacterium
RVEVPNALPLMLGGLRN

SEQ ID NO: 368582 - protein, 25 aa, Mycobacterium
RVEVTAPSPLLKGGLAFIDTPGVGG

SEQ ID NO: 368583 - protein, 18 aa, Mycobacterium
RVFGFHRAMDTFGAVFGP

SEQ ID NO: 368584 - protein, 25 aa, Mycobacterium
RVFGFSPFTMLLPQALMGVASVAVL

SEQ ID NO: 368585 - protein, 25 aa, Mycobacterium
RVFGIFYATFFLGFGSSPLLVAWLR

SEQ ID NO: 368586 - protein, 19 aa, Mycobacterium
RVFLMVPGMLRYGIHPPNI

SEQ ID NO: 368587 - protein, 25 aa, Mycobacterium
RVFVEQRWLSVALLSVGLAGFCVHA

SEQ ID NO: 368588 - protein, 29 aa, Mycobacterium
RVGARVLILIGLGLLMLGLLTLIASEHRS

SEQ ID NO: 368589 - protein, 17 aa, Mycobacterium
RVGLIMPNGTRWVQIAV

SEQ ID NO: 368590 - protein, 17 aa, Mycobacterium
RVGLKGFWIRRARRLLP

SEQ ID NO: 368591 - protein, 26 aa, Mycobacterium
RVGLQAGLGCLLVWLTRAPVGLRPPR

SEQ ID NO: 368592 - protein, 24 aa, Mycobacterium
RVGNKPDFLGAWLPGQLLQGLGVG

SEQ ID NO: 368593 - protein, 24 aa, Mycobacterium
RVGPWALYGLLFTIVVLFALQGEQ

SEQ ID NO: 368594 - protein, 25 aa, Mycobacterium
RVGRKPMWAFSLTGLLVLSLPMFWL

SEQ ID NO: 368595 - protein, 26 aa, Mycobacterium
RVGRKPMWWFSVVGLFVAGVPMFMLM

SEQ ID NO: 368596 - protein, 23 aa, Mycobacterium
RVGRPPVTRRAILTLVAGQAPQV

SEQ ID NO: 368597 - protein, 25 aa, Mycobacterium
RVGRRPLYLFGSAAGPLALGLFFLA

SEQ ID NO: 368598 - protein, 25 aa, Mycobacterium
RVGRRTWFGLASLLLPVFLVSMDVS

SEQ ID NO: 368599 - protein, 23 aa, Mycobacterium
RVGRSLHVFLKLVGQTKDTQNLR

SEQ ID NO: 368600 - protein, 17 aa, Mycobacterium
RVGRVMAVLGIPMVLAP

SEQ ID NO: 368601 - protein, 25 aa, Mycobacterium
RVGSRNFRLIYSVRSPADVYYAKEL

SEQ ID NO: 368602 - protein, 23 aa, Mycobacterium
RVGTAIVRWPGPILAATVAVALI

SEQ ID NO: 368603 - protein, 24 aa, Mycobacterium
RVGTAIVRWPGPILAVSIAIALIG

SEQ ID NO: 368604 - protein, 24 aa, Mycobacterium
RVGTAVVRWPVPILAGAIAVALVG

SEQ ID NO: 368605 - protein, 18 aa, Mycobacterium
RVGVYLEFIGVDGGSLWG

SEQ ID NO: 368606 - protein, 22 aa, Mycobacterium
RVGWRQRFVTAWAGFRGAVSLA

SEQ ID NO: 368607 - protein, 24 aa, Mycobacterium
RVHDAMREIWTFTPAGAISVRGSQ

SEQ ID NO: 368608 - protein, 27 aa, Mycobacterium
RVHNLALGWWSVSSLLVCNWIALFENH

SEQ ID NO: 368609 - protein, 23 aa, Mycobacterium
RVIDPSRYPALMEALLAASLCND

SEQ ID NO: 368610 - protein, 29 aa, Mycobacterium
RVIFDNIRRFAVYLLSCNLAEVLVVALAV

SEQ ID NO: 368611 - protein, 25 aa, Mycobacterium
RVIGAFIVTIPLYSVAVLLSFFSAQ

SEQ ID NO: 368612 - protein, 25 aa, Mycobacterium
RVITGLLLVIAIGFAASFFVKTAPP

SEQ ID NO: 368613 - protein, 21 aa, Mycobacterium
RVITPAPPPPPPDHRARNIAI

SEQ ID NO: 368614 - protein, 17 aa, Mycobacterium
RVIVWTLAMGWSALVGF

SEQ ID NO: 368615 - protein, 19 aa, Mycobacterium
RVIWPACMAAGGAVPFVTV

SEQ ID NO: 368616 - protein, 24 aa, Mycobacterium
RVKEVPPPVYIPPPDRGPITAVVI

SEQ ID NO: 368617 - protein, 17 aa, Mycobacterium
RVKVVVIDGAALRGDHR

SEQ ID NO: 368618 - protein, 18 aa, Mycobacterium
RVKVVVIDGAALRGDNRA

SEQ ID NO: 368619 - protein, 19 aa, Mycobacterium
RVLAGPYRFLPHPNYVAVV

SEQ ID NO: 368620 - protein, 21 aa, Mycobacterium
RVLAMSGAAAAGWFLVEGRRR

SEQ ID NO: 368621 - protein, 24 aa, Mycobacterium
RVLAWTAALTMAGVVLLVIVAVVV

SEQ ID NO: 368622 - protein, 23 aa, Mycobacterium
RVLEVLQRWLADDLPAVLVVCTR

SEQ ID NO: 368623 - protein, 24 aa, Mycobacterium
RVLFDWRFDLLFGTAAIVGALVYL

SEQ ID NO: 368624 - protein, 20 aa, Mycobacterium
RVLFTVLTAIPFVLTLVLIA

SEQ ID NO: 368625 - protein, 40 aa, Mycobacterium
RVLGGFVFGLLVVFVVVVVVFGTKLWNVMLGTGGDYAGPG

SEQ ID NO: 368626 - protein, 27 aa, Mycobacterium
RVLGPLRDLFAAIFFLGIGLSVAPKEL

SEQ ID NO: 368627 - protein, 20 aa, Mycobacterium
RVLHVAQPLAYCLPGVRSRV

SEQ ID NO: 368628 - protein, 30 aa, Mycobacterium
RVLIAFALVAVLLLLLGPRLIDTYVDWLWF

SEQ ID NO: 368629 - protein, 17 aa, Mycobacterium
RVLIPPPLRALTALSGV

SEQ ID NO: 368630 - protein, 17 aa, Mycobacterium
RVLLWLTVATLVLNIAL

SEQ ID NO: 368631 - protein, 25 aa, Mycobacterium
RVLMALLALTAFLIAASPLAGREGL

SEQ ID NO: 368632 - protein, 20 aa, Mycobacterium
RVLPGYMVPTRYGIVDTLPL

SEQ ID NO: 368633 - protein, 20 aa, Mycobacterium
RVLRLPTPVASLRTIVIVAA

SEQ ID NO: 368634 - protein, 23 aa, Mycobacterium
RVLRMPFYRTVVSLVVWAIGSAV

SEQ ID NO: 368635 - protein, 19 aa, Mycobacterium
RVLSGLTKRHRTALVHITH

SEQ ID NO: 368636 - protein, 28 aa, Mycobacterium
RVLTAVAALLLLYLHPVSIAAGFTCLLC

SEQ ID NO: 368637 - protein, 20 aa, Mycobacterium
RVLTDNPEDPKWSWLKWLPH

SEQ ID NO: 368638 - protein, 19 aa, Mycobacterium
RVLVIRALTGAGIITPADA

SEQ ID NO: 368639 - protein, 18 aa, Mycobacterium
RVLYPVCLALWSLATLFM

SEQ ID NO: 368640 - protein, 18 aa, Mycobacterium
RVMFEPMLIILNGIPKIV

SEQ ID NO: 368641 - protein, 34 aa, Mycobacterium
RVMLCGAIFQVLWAYPYFWLLDTRGIPALYVAVV

SEQ ID NO: 368642 - protein, 23 aa, Mycobacterium
RVMTPLLLVMLAVGGSDVLFAFD

SEQ ID NO: 368643 - protein, 19 aa, Mycobacterium
RVMWFRIHAEPSGDEWHVI

SEQ ID NO: 368644 - protein, 22 aa, Mycobacterium
RVNEALAKLQSWLAGDDPGVLV

SEQ ID NO: 368645 - protein, 31 aa, Mycobacterium
RVNGEIVLLLFLPAILYWEGLNTSFREIRAN

SEQ ID NO: 368646 - protein, 23 aa, Mycobacterium
RVNPNVYIPWSITVTPISNSEIG

SEQ ID NO: 368647 - protein, 28 aa, Mycobacterium
RVNTFTATFVFVAAVVYVIVAPKGREAP

SEQ ID NO: 368648 - protein, 20 aa, Mycobacterium
RVNWRQRFVTVWAGFRGAVS

SEQ ID NO: 368649 - protein, 18 aa, Mycobacterium
RVPGLYPPQIYNGQLHVD

SEQ ID NO: 368650 - protein, 18 aa, Mycobacterium
RVPTLWIVLGPLGQSITV

SEQ ID NO: 368651 - protein, 26 aa, Mycobacterium
RVPVHGFLFLFLGNGLLCVFMSLPKL

SEQ ID NO: 368652 - protein, 17 aa, Mycobacterium
RVPWGLLALPTAGPTRE

SEQ ID NO: 368653 - protein, 18 aa, Mycobacterium
RVPWTLKPRERTSTGRKS

SEQ ID NO: 368654 - protein, 36 aa, Mycobacterium
RVQAFDVFSSFWFTAIYVLLFVSLVGCIIPRTVEHA

SEQ ID NO: 368655 - protein, 23 aa, Mycobacterium
RVQGPWLLGALLLGIPALVAGWY

SEQ ID NO: 368656 - protein, 17 aa, Mycobacterium
RVQLPPPPYPPPLSSQS

SEQ ID NO: 368657 - protein, 22 aa, Mycobacterium
RVQPHYMDMLDLAEAWRFGRGA

SEQ ID NO: 368658 - protein, 17 aa, Mycobacterium
RVQQELGVPVKLVGLGE

SEQ ID NO: 368659 - protein, 26 aa, Mycobacterium
RVQQLALSVFLTGGLVFGLIPGFVAT

SEQ ID NO: 368660 - protein, 28 aa, Mycobacterium
RVQRYRGKPVLTWWQGRKQSGHGLGASY

SEQ ID NO: 368661 - protein, 17 aa, Mycobacterium
RVRDALLGCAPTAMAPS

SEQ ID NO: 368662 - protein, 18 aa, Mycobacterium
RVRFWLPAPIVFEILLVV

SEQ ID NO: 368663 - protein, 25 aa, Mycobacterium
RVRGGLMGIILLVVVIGVGQSFASV

SEQ ID NO: 368664 - protein, 17 aa, Mycobacterium
RVRKPAWPDIPITNDDY

SEQ ID NO: 368665 - protein, 25 aa, Mycobacterium
RVRKYLTLMAFRIPALILAAIAYGL

SEQ ID NO: 368666 - protein, 27 aa, Mycobacterium
RVRKYLTLMAFRIPALILAALAYGAWH

SEQ ID NO: 368667 - protein, 29 aa, Mycobacterium
RVRKYLTLMAFRIPALILAALAYGAWHNG

SEQ ID NO: 368668 - protein, 27 aa, Mycobacterium
RVRKYLTLMAFRIPALILAAVAYGAWH

SEQ ID NO: 368669 - protein, 26 aa, Mycobacterium
RVRKYLTLMAFRIPALILAAVAYNIW

SEQ ID NO: 368670 - protein, 25 aa, Mycobacterium
RVRPAFFFALGLPALIIVLLAFARH

SEQ ID NO: 368671 - protein, 20 aa, Mycobacterium
RVRPSDPMVILFTSGSSGPP

SEQ ID NO: 368672 - protein, 19 aa, Mycobacterium
RVRRGVWIALPVTATVAAL

SEQ ID NO: 368673 - protein, 23 aa, Mycobacterium
RVRSLMRSMLCSLAVFHNPRDVK

SEQ ID NO: 368674 - protein, 17 aa, Mycobacterium
RVRVVRIGGAGRGFCSG

SEQ ID NO: 368675 - protein, 18 aa, Mycobacterium
RVRWWRAIRSHAMPNRPE

SEQ ID NO: 368676 - protein, 21 aa, Mycobacterium
RVRYALAAMLALFGAEIALGF

SEQ ID NO: 368677 - protein, 31 aa, Mycobacterium
RVSAVFVPIVIALAVATLGFWLGTGGSVAAA

SEQ ID NO: 368678 - protein, 39 aa, Mycobacterium
RVSAVLRLPLIGLIAVLVWIWEVNHWLPGLYAAILGSYA

SEQ ID NO: 368679 - protein, 26 aa, Mycobacterium
RVSGPLLLQYPLYGGIIGLLGYLPSQ

SEQ ID NO: 368680 - protein, 26 aa, Mycobacterium
RVSGPLLLQYPLYGGIIGLLGYVPAG

SEQ ID NO: 368681 - protein, 20 aa, Mycobacterium
RVSRSIWLRAIGTTFVDIFR

SEQ ID NO: 368682 - protein, 32 aa, Mycobacterium
RVTLELAYFGGLGALIILLAAMALGRLSVRSV

SEQ ID NO: 368683 - protein, 18 aa, Mycobacterium
RVTLFVTGIWIVSIIGMA

SEQ ID NO: 368684 - protein, 25 aa, Mycobacterium
RVTLLSFRLQPTLSVLLVAAGAFGF

SEQ ID NO: 368685 - protein, 24 aa, Mycobacterium
RVTLTRAPHRALLARSARITVAGA

SEQ ID NO: 368686 - protein, 26 aa, Mycobacterium
RVTRWEWTWAVLLAVSLAVVVIVGDP

SEQ ID NO: 368687 - protein, 25 aa, Mycobacterium
RVTSWLAALIVPSIICAITVTALDP

SEQ ID NO: 368688 - protein, 29 aa, Mycobacterium
RVTVGKRVISLPWRLATIQDLPSVDAPSD

SEQ ID NO: 368689 - protein, 25 aa, Mycobacterium
RVVAGLIVIIPLYGLAMTMAFLSQQ

SEQ ID NO: 368690 - protein, 20 aa, Mycobacterium
RVVAVSFPRDLAITPIQCEA

SEQ ID NO: 368691 - protein, 20 aa, Mycobacterium
RVVAVSFPRDLAITPVKCEA

SEQ ID NO: 368692 - protein, 27 aa, Mycobacterium
RVVDVMFAFPVLLLALAIVAILGPGVT

SEQ ID NO: 368693 - protein, 28 aa, Mycobacterium
RVVEGPYVLPPLDLLIAGDPPKLRTAAN

SEQ ID NO: 368694 - protein, 27 aa, Mycobacterium
RVVEGPYVLPPLDLLVAGEPPKRLTAA

SEQ ID NO: 368695 - protein, 18 aa, Mycobacterium
RVVFVIALGFLILGWTSK

SEQ ID NO: 368696 - protein, 18 aa, Mycobacterium
RVVLGNRSVLWFAAAMIG

SEQ ID NO: 368697 - protein, 17 aa, Mycobacterium
RVVLWVVFWFGWAIVFA

SEQ ID NO: 368698 - protein, 28 aa, Mycobacterium
RVVQDLLSGFFLITEKQYGFGDLVELYV

SEQ ID NO: 368699 - protein, 23 aa, Mycobacterium
RVVSVMMPVNFLALVILGASAGV

SEQ ID NO: 368700 - protein, 29 aa, Mycobacterium
RVVVLEWRMPRMLMALLIGAALGVSGAIF

SEQ ID NO: 368701 - protein, 33 aa, Mycobacterium
RVWDSAACKAWLLAQPFLAAGVLLVIYAATGRY

SEQ ID NO: 368702 - protein, 17 aa, Mycobacterium
RVWGLTAALTVDARTGL

SEQ ID NO: 368703 - protein, 19 aa, Mycobacterium
RVWVWVRRPRFALGSAVVL

SEQ ID NO: 368704 - protein, 27 aa, Mycobacterium
RVYSTAPYWIAALVAILLSLCPKVGAV

SEQ ID NO: 368705 - protein, 19 aa, Mycobacterium
RWARLRTLMVISGPGLIVM

SEQ ID NO: 368706 - protein, 26 aa, Mycobacterium
RWAVTTVALLLLVLAAARPVTGSAAG

SEQ ID NO: 368707 - protein, 24 aa, Mycobacterium
RWDALGFLQDFFATAVFLGIVTFA

SEQ ID NO: 368708 - protein, 24 aa, Mycobacterium
RWDNLWLPLAVVGAGLVVLMAHGR

SEQ ID NO: 368709 - protein, 17 aa, Mycobacterium
RWDVFGIGLGRAAWFTI

SEQ ID NO: 368710 - protein, 24 aa, Mycobacterium
RWEHILFPIVLIGLGIVILIGGLA

SEQ ID NO: 368711 - protein, 20 aa, Mycobacterium
RWEHVLFPIVLIALGIFILV

SEQ ID NO: 368712 - protein, 18 aa, Mycobacterium
RWERAMFVFIAITLIQIP

SEQ ID NO: 368713 - protein, 30 aa, Mycobacterium
RWERAMFVFIAITLLQIPMFLLAEPQWGRA

SEQ ID NO: 368714 - protein, 25 aa, Mycobacterium
RWERERRFDLAAAPLTRYTLVRRRD

SEQ ID NO: 368715 - protein, 23 aa, Mycobacterium
RWFFWAAFAVATLLIAGVVSSFA

SEQ ID NO: 368716 - protein, 27 aa, Mycobacterium
RWFPRSLRGQLLLGVLAVVTVVLVAVG

SEQ ID NO: 368717 - protein, 17 aa, Mycobacterium
RWGALMLVVSIVLQAAA

SEQ ID NO: 368718 - protein, 18 aa, Mycobacterium
RWGNLLTLPMGDGGLLYV

SEQ ID NO: 368719 - protein, 18 aa, Mycobacterium
RWGNLLTLPVADGGLLYV

SEQ ID NO: 368720 - protein, 20 aa, Mycobacterium
RWGPVVQCLLISIGIFACIA

SEQ ID NO: 368721 - protein, 17 aa, Mycobacterium
RWGVEGQPFPWSIETCR

SEQ ID NO: 368722 - protein, 21 aa, Mycobacterium
RWIPVLPTHTHRFDWIGVALS

SEQ ID NO: 368723 - protein, 18 aa, Mycobacterium
RWLELWSGELTNAALACF

SEQ ID NO: 368724 - protein, 23 aa, Mycobacterium
RWLERFSWIALVVAIVFGLIAAF

SEQ ID NO: 368725 - protein, 21 aa, Mycobacterium
RWLERFSWIGLVVAVVAGLTA

SEQ ID NO: 368726 - protein, 24 aa, Mycobacterium
RWLPAILLFSYIDLVGYIPGVIAH

SEQ ID NO: 368727 - protein, 18 aa, Mycobacterium
RWLPDWLRPRPSSPTSLA

SEQ ID NO: 368728 - protein, 28 aa, Mycobacterium
RWLRSHYRRWGLIAVGVFQVAIAAAQIS

SEQ ID NO: 368729 - protein, 18 aa, Mycobacterium
RWLVITDADKRAAVADIY

SEQ ID NO: 368730 - protein, 19 aa, Mycobacterium
RWNVMAPHRDGGQAQFIPP

SEQ ID NO: 368731 - protein, 19 aa, Mycobacterium
RWPAPILVASAFIVLIGVV

SEQ ID NO: 368732 - protein, 17 aa, Mycobacterium
RWPAPVVFALFLVGAAL

SEQ ID NO: 368733 - protein, 20 aa, Mycobacterium
RWPGPIFVASLLIALVGMLV

SEQ ID NO: 368734 - protein, 22 aa, Mycobacterium
RWQARVIRMDGRRIDLLELTEL

SEQ ID NO: 368735 - protein, 20 aa, Mycobacterium
RWQLRFPVRAATVGTAAAAF

SEQ ID NO: 368736 - protein, 20 aa, Mycobacterium
RWRFVLVTAGMWIAAAAAGA

SEQ ID NO: 368737 - protein, 41 aa, Mycobacterium
RWRKQTWIGRFVSTYGWRAYALPLLVVLTAVVIYQTITGTS

SEQ ID NO: 368738 - protein, 26 aa, Mycobacterium
RWRRDHLIAVIELKPRPFTPTVIVDG

SEQ ID NO: 368739 - protein, 27 aa, Mycobacterium
RWRRLATAIVRWPAPILATSVILAIVG

SEQ ID NO: 368740 - protein, 27 aa, Mycobacterium
RWRWWAVRRSIRLLARLTGTAITVHGL

SEQ ID NO: 368741 - protein, 21 aa, Mycobacterium
RWSLLTLVIVSVFAAAARPGI

SEQ ID NO: 368742 - protein, 30 aa, Mycobacterium
RWSMFHSIAFDFSVWELWGALLHGGCVVVV

SEQ ID NO: 368743 - protein, 23 aa, Mycobacterium
RWSYGLFIWHLAALDMVFPVIGT

SEQ ID NO: 368744 - protein, 23 aa, Mycobacterium
RWSYGLFIWHLAALDMVFPVLGV

SEQ ID NO: 368745 - protein, 22 aa, Mycobacterium
RWSYGLFIWHLAALNMVFTVIG

SEQ ID NO: 368746 - protein, 23 aa, Mycobacterium
RWSYGLFVWHLAALAMVFPMLGE

SEQ ID NO: 368747 - protein, 23 aa, Mycobacterium
RWSYGLFVWHLAALAMVFPVIGA

SEQ ID NO: 368748 - protein, 20 aa, Mycobacterium
RWTAHLPRRQVLVLSLTCLT

SEQ ID NO: 368749 - protein, 18 aa, Mycobacterium
RWTIAGVVLVAALIAVML

SEQ ID NO: 368750 - protein, 17 aa, Mycobacterium
RWTWWAPKPLERLRNRS

SEQ ID NO: 368751 - protein, 19 aa, Mycobacterium
RWVATIAGLLGALLAIATP

SEQ ID NO: 368752 - protein, 19 aa, Mycobacterium
RWVTALGAFVLSVAPGWFG

SEQ ID NO: 368753 - protein, 21 aa, Mycobacterium
RWWQLLFRVVLPMSGPTMVAF

SEQ ID NO: 368754 - protein, 17 aa, Mycobacterium
RWYRLARAYDYAGDRRR

SEQ ID NO: 368755 - protein, 33 aa, Mycobacterium
RWYRQYRNIMWWTVLWAATWLLALVTWVVRDSV

SEQ ID NO: 368756 - protein, 19 aa, Mycobacterium
RWYRRLLRSTVQDPELRKA

SEQ ID NO: 368757 - protein, 18 aa, Mycobacterium
RYCTYAFIPFQMVSLVLA

SEQ ID NO: 368758 - protein, 17 aa, Mycobacterium
RYCTYAFIPLQMVSLVL

SEQ ID NO: 368759 - protein, 17 aa, Mycobacterium
RYDLLIAGIAAIGLIFI

SEQ ID NO: 368760 - protein, 18 aa, Mycobacterium
RYDLLIVGIAAVTLIFAV

SEQ ID NO: 368761 - protein, 27 aa, Mycobacterium
RYDRLQPWVWAVLRLVLAAAMFYFGMA

SEQ ID NO: 368762 - protein, 18 aa, Mycobacterium
RYEIPTRITIVDAIPRTP

SEQ ID NO: 368763 - protein, 18 aa, Mycobacterium
RYFFYIAVLISLVNTYDA

SEQ ID NO: 368764 - protein, 23 aa, Mycobacterium
RYGYDFMGFDRWGYDRWGYDRWG

SEQ ID NO: 368765 - protein, 21 aa, Mycobacterium
RYGYVPFMLIGLNGAGIVFTA

SEQ ID NO: 368766 - protein, 20 aa, Mycobacterium
RYHPVLISTLLYTAATMASG

SEQ ID NO: 368767 - protein, 22 aa, Mycobacterium
RYIEPITIAGLIFLAASYPTSV

SEQ ID NO: 368768 - protein, 17 aa, Mycobacterium
RYLARTGPPPAPPPAEK

SEQ ID NO: 368769 - protein, 27 aa, Mycobacterium
RYLRVVLRWGALTAAGLLLVLAAARPG

SEQ ID NO: 368770 - protein, 19 aa, Mycobacterium
RYMTPAFGTIVMGISALFF

SEQ ID NO: 368771 - protein, 29 aa, Mycobacterium
RYRERLWVPLWWWLPGLGLAALIALEVDQ

SEQ ID NO: 368772 - protein, 28 aa, Mycobacterium
RYSEVPMMILGVVLVGIAAAVFVLRRHE

SEQ ID NO: 368773 - protein, 24 aa, Mycobacterium
RYVETAHRLFPGAILHFEDFGPLN

SEQ ID NO: 368774 - protein, 20 aa, Mycobacterium
RYVIGIMMDAPQRAADGSPG

SEQ ID NO: 368775 - protein, 34 aa, Mycobacterium
RYVIPPHFILAPFWLLPGGLLLHTAITLPIYVWA

SEQ ID NO: 368776 - protein, 20 aa, Mycobacterium
RYVLGLWTMPALLAGVSAMV

SEQ ID NO: 368777 - protein, 21 aa, Mycobacterium
RYVLIPVIIGLVLITAFVFHA

SEQ ID NO: 368778 - protein, 22 aa, Mycobacterium
RYVWAWRLLRLDFTGVALGALF

SEQ ID NO: 368779 - protein, 21 aa, Mycobacterium
RYWNWIAVAVVRRPVPLLVAS

SEQ ID NO: 368780 - protein, 19 aa, Mycobacterium
RYYEPLFVADLAAAAGLSP

SEQ ID NO: 368781 - protein, 22 aa, Mycobacterium
RYYREAAQRHLIPFPSRPAPST

SEQ ID NO: 368782 - protein, 19 aa, Mycobacterium
SAAALTLVIAYGVAWFGAY

SEQ ID NO: 368783 - protein, 29 aa, Mycobacterium
SAAALYVTFAFIGGSLWVLALGTALIGGL

SEQ ID NO: 368784 - protein, 25 aa, Mycobacterium
SAAAPLLCPALIELIALTNLSNDIG

SEQ ID NO: 368785 - protein, 40 aa, Mycobacterium
SAAEPTFLAKWIRRLSIPIVIGWLAIVFALNTFVPQLEQV

SEQ ID NO: 368786 - protein, 22 aa, Mycobacterium
SAAFLRDRLGLRRILALVLGVA

SEQ ID NO: 368787 - protein, 27 aa, Mycobacterium
SAAGDWLLAIPWWTPSFVFGLGSFLLA

SEQ ID NO: 368788 - protein, 26 aa, Mycobacterium
SAAGDWLLAIPWWTQSFVLGLGSFLL

SEQ ID NO: 368789 - protein, 25 aa, Mycobacterium
SAAGQILLFALVLAALVGAAARRAA

SEQ ID NO: 368790 - protein, 26 aa, Mycobacterium
SAALLLIPCLLLAWAVAHPGLSFAAL

SEQ ID NO: 368791 - protein, 25 aa, Mycobacterium
SAALLLIPCLLLAWAVSHPGIPFAV

SEQ ID NO: 368792 - protein, 17 aa, Mycobacterium
SAALNLLGAFLSTAVAA

SEQ ID NO: 368793 - protein, 27 aa, Mycobacterium
SAALVICLGALLYSFLSPAGQVGDSPI

SEQ ID NO: 368794 - protein, 21 aa, Mycobacterium
SAAMRLVVVPQGVRRVLPALV

SEQ ID NO: 368795 - protein, 24 aa, Mycobacterium
SAAMVVFLAAWWRQTRAEEHPVPK

SEQ ID NO: 368796 - protein, 22 aa, Mycobacterium
SAANRYPEFLPERLRGLVAGHI

SEQ ID NO: 368797 - protein, 32 aa, Mycobacterium
SAAPLFHEIASWLLQRHNVPLSPDPGPPLTLQ

SEQ ID NO: 368798 - protein, 46 aa, Mycobacterium
SAAPSHGKKFTWHWWWLVAVVPVVLLIVMFVLVALGVRRRRTGQPD

SEQ ID NO: 368799 - protein, 26 aa, Mycobacterium
SAAPVTDWDWLKWLPHQRSSQEGRHH

SEQ ID NO: 368800 - protein, 28 aa, Mycobacterium
SAARGMVAFLGYFKLIGLSTFATNLLVT

SEQ ID NO: 368801 - protein, 27 aa, Mycobacterium
SAARGMVAFLGYFQLIGLSTFATNLLV

SEQ ID NO: 368802 - protein, 19 aa, Mycobacterium
SAARLLFSFAPFEYVLKNI

SEQ ID NO: 368803 - protein, 23 aa, Mycobacterium
SAATVESLWWISESGVRFGVPRQ

SEQ ID NO: 368804 - protein, 18 aa, Mycobacterium
SAAVFTALFIAWQDRDEA

SEQ ID NO: 368805 - protein, 25 aa, Mycobacterium
SAAVLTLVLAFAAAALLWLVVEELL

SEQ ID NO: 368806 - protein, 22 aa, Mycobacterium
SAAVQLPAVWLLSAVTVALFGL

SEQ ID NO: 368807 - protein, 24 aa, Mycobacterium
SACALFACLALLIVASSQLSPRER

SEQ ID NO: 368808 - protein, 25 aa, Mycobacterium
SADAIKFAFRRPFQWREFLEQSWFV

SEQ ID NO: 368809 - protein, 41 aa, Mycobacterium
SADALARLLSLLPLGYAPGTCRPFLPPKDALASVICDKNVD

SEQ ID NO: 368810 - protein, 25 aa, Mycobacterium
SADALARLLSTLPLGYAPGTCRAFL

SEQ ID NO: 368811 - protein, 28 aa, Mycobacterium
SADGIYPLLMMTLLPILVGVDVSSRRAM

SEQ ID NO: 368812 - protein, 25 aa, Mycobacterium
SADLVAAIWAIIAAGAAYLPVDLAY

SEQ ID NO: 368813 - protein, 24 aa, Mycobacterium
SADNWLHFALAVLMIGLGVALGRQ

SEQ ID NO: 368814 - protein, 23 aa, Mycobacterium
SADPFLRLLTATATLWILSQVFI

SEQ ID NO: 368815 - protein, 25 aa, Mycobacterium
SADSLAVRLRREGPVPWPEALHIGV

SEQ ID NO: 368816 - protein, 22 aa, Mycobacterium
SAEAISLLKRAGLTPIMVTGDN

SEQ ID NO: 368817 - protein, 27 aa, Mycobacterium
SAEELLSRSWWSGPEIFLIVDDIQQLP

SEQ ID NO: 368818 - protein, 18 aa, Mycobacterium
SAEFYALAARALAPGGLM

SEQ ID NO: 368819 - protein, 18 aa, Mycobacterium
SAEYLGHQITFVGLVLAA

SEQ ID NO: 368820 - protein, 20 aa, Mycobacterium
SAFAFAFAFISPIVALYGIF

SEQ ID NO: 368821 - protein, 18 aa, Mycobacterium
SAFDHRFGWSPVPPWLSV

SEQ ID NO: 368822 - protein, 23 aa, Mycobacterium
SAFEHRAVVVGADRQQLLTGLAT

SEQ ID NO: 368823 - protein, 19 aa, Mycobacterium
SAFFTPRFVNWFGLFTTHV

SEQ ID NO: 368824 - protein, 28 aa, Mycobacterium
SAFFTPRFVRWFGLINTHVIIAAALALT

SEQ ID NO: 368825 - protein, 18 aa, Mycobacterium
SAFFWAYAAMQIPAGWLI

SEQ ID NO: 368826 - protein, 19 aa, Mycobacterium
SAFGLRVALVPLFITDVMG

SEQ ID NO: 368827 - protein, 37 aa, Mycobacterium
SAFGLSVLLWQHIVGIPLHWMVLPMSVIVLLAVGADY

SEQ ID NO: 368828 - protein, 23 aa, Mycobacterium
SAFLIVLGALWWSAMPAYLNASN

SEQ ID NO: 368829 - protein, 28 aa, Mycobacterium
SAFLSYFAQILMAVLMATMTLVVLPRAA

SEQ ID NO: 368830 - protein, 21 aa, Mycobacterium
SAFTMAGPWVGIAAPGEDITS

SEQ ID NO: 368831 - protein, 22 aa, Mycobacterium
SAFVLPHGLITVRLPGLDGAAH

SEQ ID NO: 368832 - protein, 22 aa, Mycobacterium
SAFWDIATFLLNGSLWVFVGVQ

SEQ ID NO: 368833 - protein, 28 aa, Mycobacterium
SAGAALVLLVWAALLGLWSRLVSPRSMA

SEQ ID NO: 368834 - protein, 28 aa, Mycobacterium
SAGAAYKRRLALALTLTASYALVEVVGG

SEQ ID NO: 368835 - protein, 32 aa, Mycobacterium
SAGAIALLALTMLIAIIVVLWVSRTDGVVLHW

SEQ ID NO: 368836 - protein, 32 aa, Mycobacterium
SAGAIALLALTMLIAIIVVLWVSRTDGVVVHW

SEQ ID NO: 368837 - protein, 29 aa, Mycobacterium
SAGAIALLALTMLIAVIVALWVSRSDGVV

SEQ ID NO: 368838 - protein, 29 aa, Mycobacterium
SAGAIALLALTMLIAVIVALWVSRTDGVV

SEQ ID NO: 368839 - protein, 25 aa, Mycobacterium
SAGAWLPHYLVWFIGGMMLAVLATM

SEQ ID NO: 368840 - protein, 18 aa, Mycobacterium
SAGFRWPRALQASATRRG

SEQ ID NO: 368841 - protein, 22 aa, Mycobacterium
SAGILTYELLTGQTPFSGDSAL

SEQ ID NO: 368842 - protein, 24 aa, Mycobacterium
SAGLGLFFAFWSWVGFESTAMYGE

SEQ ID NO: 368843 - protein, 28 aa, Mycobacterium
SAGLHVIFAVFLVLVTFPTRPKLDPDGD

SEQ ID NO: 368844 - protein, 22 aa, Mycobacterium
SAGLPVLTVRDLAFRPVSDQTS

SEQ ID NO: 368845 - protein, 19 aa, Mycobacterium
SAGLVPPIDQWSGSTFSNL

SEQ ID NO: 368846 - protein, 26 aa, Mycobacterium
SAGPGLLPRLLPVAISVVSIGIMAAA

SEQ ID NO: 368847 - protein, 27 aa, Mycobacterium
SAGQRRRLLIARALISAFPVVLLDEPT

SEQ ID NO: 368848 - protein, 22 aa, Mycobacterium
SAGQRRRLLLARALVSNAQTVL

SEQ ID NO: 368849 - protein, 18 aa, Mycobacterium
SAGSLSDRYGRRGWLIAG

SEQ ID NO: 368850 - protein, 18 aa, Mycobacterium
SAGTWVVVLLFASKADTY

SEQ ID NO: 368851 - protein, 24 aa, Mycobacterium
SAGVGLFFAFWSWVGFESSAMYAE

SEQ ID NO: 368852 - protein, 24 aa, Mycobacterium
SAGVGLFFAFWSWVGFESSAMYGE

SEQ ID NO: 368853 - protein, 27 aa, Mycobacterium
SAGVKSAWDLLWRYGGQYVATVLAPVA

SEQ ID NO: 368854 - protein, 25 aa, Mycobacterium
SAGVTFLFFATFGFFFVSMQYIQLI

SEQ ID NO: 368855 - protein, 23 aa, Mycobacterium
SAGWLRLGALVLALAGLAALLIN

SEQ ID NO: 368856 - protein, 24 aa, Mycobacterium
SAGWYLALVALWPAGSRPYIAGST

SEQ ID NO: 368857 - protein, 23 aa, Mycobacterium
SAGYLRKWLLLGVTIGVIAGLGA

SEQ ID NO: 368858 - protein, 25 aa, Mycobacterium
SAHVPVFFIVWALSNFVGPLVLGRL

SEQ ID NO: 368859 - protein, 24 aa, Mycobacterium
SAIALIAIFLLIRAVPSLLADNAN

SEQ ID NO: 368860 - protein, 37 aa, Mycobacterium
SAIAPFLGALTIIVAVVIGIWLINVFSGEELTDAQQI

SEQ ID NO: 368861 - protein, 29 aa, Mycobacterium
SAIAVAVMVLLPLITFGMAYMIVDVPEPG

SEQ ID NO: 368862 - protein, 47 aa, Mycobacterium
SAIDYAMRNWMWFIGGIVFTFVLLNTMFGWWVLSRVIRRLSVIPDVH

SEQ ID NO: 368863 - protein, 27 aa, Mycobacterium
SAIGAPITLLRLLYTAGAAATVPADPS

SEQ ID NO: 368864 - protein, 29 aa, Mycobacterium
SAIGLIAAPLYLLLGITAIVLALRDSTIS

SEQ ID NO: 368865 - protein, 20 aa, Mycobacterium
SAIIFLYVFVALLVHRERVR

SEQ ID NO: 368866 - protein, 24 aa, Mycobacterium
SAINELYADRHIRLWVVYVDNFSG

SEQ ID NO: 368867 - protein, 22 aa, Mycobacterium
SAIPFVYEHKVFFAVSAIVLVT

SEQ ID NO: 368868 - protein, 20 aa, Mycobacterium
SAIRLAQRLTPHAGLIAAVL

SEQ ID NO: 368869 - protein, 22 aa, Mycobacterium
SAIRLLRRLTPQRGMTIAVMLL

SEQ ID NO: 368870 - protein, 17 aa, Mycobacterium
SAKFRALFGRRRTRRRA

SEQ ID NO: 368871 - protein, 25 aa, Mycobacterium
SALAGFLPLTWLSLVYGWGLAGIWS

SEQ ID NO: 368872 - protein, 40 aa, Mycobacterium
SALAGFLPLVWLSLAFGWGLLGIWAGLSTFMVLRLVFVGW

SEQ ID NO: 368873 - protein, 19 aa, Mycobacterium
SALAGMLGWLGHASPDPGD

SEQ ID NO: 368874 - protein, 20 aa, Mycobacterium
SALAMPLFPELRSISLLQVL

SEQ ID NO: 368875 - protein, 22 aa, Mycobacterium
SALAWVMFAILLGLTVMQLRIA

SEQ ID NO: 368876 - protein, 26 aa, Mycobacterium
SALCRHYWPVALLAAALSRHFRRVVL

SEQ ID NO: 368877 - protein, 25 aa, Mycobacterium
SALDLNGFIWRRQSYGYGGSFTSGT

SEQ ID NO: 368878 - protein, 21 aa, Mycobacterium
SALFPGLFGLLAVVVRGLPGW

SEQ ID NO: 368879 - protein, 22 aa, Mycobacterium
SALFVLDEWLRPVPVGVVGELY

SEQ ID NO: 368880 - protein, 17 aa, Mycobacterium
SALGAAIRYAAVDKDAV

SEQ ID NO: 368881 - protein, 24 aa, Mycobacterium
SALGALLMVPGVRGLGPGPVTTGA

SEQ ID NO: 368882 - protein, 28 aa, Mycobacterium
SALGKGIGLLRRALAPVSAVLSASVAPI

SEQ ID NO: 368883 - protein, 26 aa, Mycobacterium
SALGLLLLLPPTRAVLRPLLAFVAAR

SEQ ID NO: 368884 - protein, 23 aa, Mycobacterium
SALGQFIPVVWLGALGATLATLS

SEQ ID NO: 368885 - protein, 30 aa, Mycobacterium
SALGTLAGFAILCSVVIAPSWADPAQDAMA

SEQ ID NO: 368886 - protein, 18 aa, Mycobacterium
SALIIVGAVPMLLRARRM

SEQ ID NO: 368887 - protein, 25 aa, Mycobacterium
SALLCPLLVYGWLGMPRLGLSGSAV

SEQ ID NO: 368888 - protein, 28 aa, Mycobacterium
SALNLALTISRLTLRHAFQALRESENVS

SEQ ID NO: 368889 - protein, 26 aa, Mycobacterium
SALPAYLVLGLIVGVLMLATNPMPTL

SEQ ID NO: 368890 - protein, 17 aa, Mycobacterium
SALPICGTALFVAAVAL

SEQ ID NO: 368891 - protein, 34 aa, Mycobacterium
SALPITLAGLLPAFALVLALKHEVWTRLIAMIAF

SEQ ID NO: 368892 - protein, 35 aa, Mycobacterium
SALPLTLAGILPAIALLLALRREVWIRYAAAVVFS

SEQ ID NO: 368893 - protein, 36 aa, Mycobacterium
SALSFAVGALLPLVAILLPPAAWRIPVTVVAVLVAL

SEQ ID NO: 368894 - protein, 25 aa, Mycobacterium
SALSVFIVGGLWLLVTHHPSHYGTA

SEQ ID NO: 368895 - protein, 23 aa, Mycobacterium
SALSWFSPLAWAQQMRPFVDLRW

SEQ ID NO: 368896 - protein, 17 aa, Mycobacterium
SALTCENTFMADLTNTC

SEQ ID NO: 368897 - protein, 26 aa, Mycobacterium
SALTLIFMIMLLLTRSVVAALVIVGT

SEQ ID NO: 368898 - protein, 20 aa, Mycobacterium
SALTRRWPSIVGRAAVAVAV

SEQ ID NO: 368899 - protein, 26 aa, Mycobacterium
SALTVDLLLFAYVLGIVPALLIGGPM

SEQ ID NO: 368900 - protein, 18 aa, Mycobacterium
SALVYFLGLVADQRELFQ

SEQ ID NO: 368901 - protein, 20 aa, Mycobacterium
SALVYFLGLVAKQRELFQIG

SEQ ID NO: 368902 - protein, 24 aa, Mycobacterium
SALWARFPLPVIPAPGDPTPSAPS

SEQ ID NO: 368903 - protein, 24 aa, Mycobacterium
SAMATLRIAFLSALVLELLATLGV

SEQ ID NO: 368904 - protein, 31 aa, Mycobacterium
SAMCRHYWPVTLIAALLFRRCRRVVLVAAIV

SEQ ID NO: 368905 - protein, 30 aa, Mycobacterium
SAMLALGLLLMWILSWLTTTPVKVVCAALK

SEQ ID NO: 368906 - protein, 21 aa, Mycobacterium
SAMPSFGMVLTLIAWGALIDK

SEQ ID NO: 368907 - protein, 19 aa, Mycobacterium
SAMVLWRFTGNRTLSQTAE

SEQ ID NO: 368908 - protein, 17 aa, Mycobacterium
SAMWLRRAERRPRFLGS

SEQ ID NO: 368909 - protein, 24 aa, Mycobacterium
SANRDAWMVGYTPSLSTAVWVGTV

SEQ ID NO: 368910 - protein, 25 aa, Mycobacterium
SAPDNPVIFWTPDTGARVVRGAINA

SEQ ID NO: 368911 - protein, 18 aa, Mycobacterium
SAPLGVVLLLLTLGLEFS

SEQ ID NO: 368912 - protein, 20 aa, Mycobacterium
SAPLLLIPVLLSALIVRLRT

SEQ ID NO: 368913 - protein, 39 aa, Mycobacterium
SAPLVRLADRYAAYFLPLALAMAGIAWLASGSAVRAVAV

SEQ ID NO: 368914 - protein, 26 aa, Mycobacterium
SAPLWGLSPPILLAASVLLGAAAGSL

SEQ ID NO: 368915 - protein, 23 aa, Mycobacterium
SAPPVRLLPTDLSPDALAPLYPA

SEQ ID NO: 368916 - protein, 27 aa, Mycobacterium
SAPRQWPVLTGRWLFYGALGAAAAAVA

SEQ ID NO: 368917 - protein, 19 aa, Mycobacterium
SAPTFVIANLLILGALQAN

SEQ ID NO: 368918 - protein, 26 aa, Mycobacterium
SAQFAFLGWHWSLPLGVAILFAAVAG

SEQ ID NO: 368919 - protein, 17 aa, Mycobacterium
SAQHWGLRPAGIAFALA

SEQ ID NO: 368920 - protein, 24 aa, Mycobacterium
SAQLTSAIPLLPPPARPGGHTTAS

SEQ ID NO: 368921 - protein, 23 aa, Mycobacterium
SAQSTAAQLRRRYREGRLAADIA

SEQ ID NO: 368922 - protein, 26 aa, Mycobacterium
SAQSTASELRRRYRQGRLAREVAAAQ

SEQ ID NO: 368923 - protein, 22 aa, Mycobacterium
SAQVWLIDPRRQLLTALGSNYV

SEQ ID NO: 368924 - protein, 26 aa, Mycobacterium
SAQWALDNQTWPTTLWASNATISAAL

SEQ ID NO: 368925 - protein, 24 aa, Mycobacterium
SARGRFLMLLGYPSSAVAAYWLTT

SEQ ID NO: 368926 - protein, 21 aa, Mycobacterium
SARLLSLYIAGGMLLSLYVVP

SEQ ID NO: 368927 - protein, 25 aa, Mycobacterium
SARNPTMLILPATMSLSLMVMAVSA

SEQ ID NO: 368928 - protein, 28 aa, Mycobacterium
SARNRMAFLSLVLFVLAFCFASTNGWWY

SEQ ID NO: 368929 - protein, 25 aa, Mycobacterium
SARPGMGWLVAVAFLGAVVSAVAVA

SEQ ID NO: 368930 - protein, 24 aa, Mycobacterium
SARPVLFGFMMISNLAGVALVLVL

SEQ ID NO: 368931 - protein, 25 aa, Mycobacterium
SARQAPWVLIRTFAPGPALSRADAL

SEQ ID NO: 368932 - protein, 21 aa, Mycobacterium
SARRLLAHYALGLAIAYVLAV

SEQ ID NO: 368933 - protein, 20 aa, Mycobacterium
SARRLTKFGALVRVPRSVEA

SEQ ID NO: 368934 - protein, 31 aa, Mycobacterium
SARRSPIIAAFPKMFIPFVVVIPGMIAGAVI

SEQ ID NO: 368935 - protein, 25 aa, Mycobacterium
SARVPTLWIVLGPLGQSITAAGLLG

SEQ ID NO: 368936 - protein, 18 aa, Mycobacterium
SARYGFYLRDIVTRFEYP

SEQ ID NO: 368937 - protein, 18 aa, Mycobacterium
SASFFTFYIVPAQFMATH

SEQ ID NO: 368938 - protein, 22 aa, Mycobacterium
SASGRLVVGWFPPEQRGLVMGI

SEQ ID NO: 368939 - protein, 27 aa, Mycobacterium
SASWAPWIWFMLLSGVVLMALFVYWQA

SEQ ID NO: 368940 - protein, 25 aa, Mycobacterium
SATDKPVIFWTPEHGPYVVRGAINS

SEQ ID NO: 368941 - protein, 24 aa, Mycobacterium
SATGTFYDDFQRRSKPFIQVVQHF

SEQ ID NO: 368942 - protein, 22 aa, Mycobacterium
SATLCELARYRLGRRTLRDDDG

SEQ ID NO: 368943 - protein, 21 aa, Mycobacterium
SATLLAWVMLVSALGAGLTMV

SEQ ID NO: 368944 - protein, 28 aa, Mycobacterium
SATMAFWVFLVFYVICAAVTWYAYVRRP

SEQ ID NO: 368945 - protein, 32 aa, Mycobacterium
SATQPLVFAFVALIAFVMLLVSIRSVFLAFKG

SEQ ID NO: 368946 - protein, 29 aa, Mycobacterium
SATQPLVFVFVALIAFVMLLVSIRSVVLA

SEQ ID NO: 368947 - protein, 27 aa, Mycobacterium
SATRSPWYSSLFIQLLVAIVAGIVVGW

SEQ ID NO: 368948 - protein, 25 aa, Mycobacterium
SATTFLALLALYFVGIDQCAVSLFG

SEQ ID NO: 368949 - protein, 34 aa, Mycobacterium
SAVAAIAVFVLAVRFVFYGVPFPGFGSLVSLMLV

SEQ ID NO: 368950 - protein, 25 aa, Mycobacterium
SAVALWAAITVLCGLLAALTRKVLD

SEQ ID NO: 368951 - protein, 26 aa, Mycobacterium
SAVAVVWLLWVIFGYSMAFGTDIGGG

SEQ ID NO: 368952 - protein, 29 aa, Mycobacterium
SAVAWFLHFLLRHNMYWFVGYRIVVGVGV

SEQ ID NO: 368953 - protein, 20 aa, Mycobacterium
SAVAYTLLLFIGSVASARAT

SEQ ID NO: 368954 - protein, 18 aa, Mycobacterium
SAVFGGWLAGLAGAWFVV

SEQ ID NO: 368955 - protein, 17 aa, Mycobacterium
SAVFWVAMTALVAVWDT

SEQ ID NO: 368956 - protein, 18 aa, Mycobacterium
SAVGTLYTDRHIRLWVVY

SEQ ID NO: 368957 - protein, 28 aa, Mycobacterium
SAVIAQHFDWHALFWCAAALGLASVLLF

SEQ ID NO: 368958 - protein, 27 aa, Mycobacterium
SAVIIAIIGVVILIAAAVTAAIVLSGK

SEQ ID NO: 368959 - protein, 17 aa, Mycobacterium
SAVLALLLIRAAGWQLS

SEQ ID NO: 368960 - protein, 26 aa, Mycobacterium
SAVLHLVFAMFLLAVRFPAPPQRRPG

SEQ ID NO: 368961 - protein, 27 aa, Mycobacterium
SAVLSGLLLNYFLTSPRHTFTMSDPDS

SEQ ID NO: 368962 - protein, 28 aa, Mycobacterium
SAVLSSLLLNYFLTAPRHTFTIAEPDAA

SEQ ID NO: 368963 - protein, 27 aa, Mycobacterium
SAVMFQTLIRRPLWWAGTAAAIAGFVF

SEQ ID NO: 368964 - protein, 23 aa, Mycobacterium
SAVQPYRELVQRLQSRTTGQLDS

SEQ ID NO: 368965 - protein, 32 aa, Mycobacterium
SAVRLPEAGFRFLLYAFLCCAAFLVVRIEERH

SEQ ID NO: 368966 - protein, 25 aa, Mycobacterium
SAVSILALHLFLTKTPAGISIRAAA

SEQ ID NO: 368967 - protein, 26 aa, Mycobacterium
SAVSLPMLLVARLLLGVAIGVAVVVV

SEQ ID NO: 368968 - protein, 32 aa, Mycobacterium
SAVWLIVIGYWFGWKFLRTYRNYLLGLEWLVV

SEQ ID NO: 368969 - protein, 24 aa, Mycobacterium
SAVWWKVTLPLLMPGLVSGAVLAF

SEQ ID NO: 368970 - protein, 21 aa, Mycobacterium
SAWAYPWWAYIDGGDLRYLNP

SEQ ID NO: 368971 - protein, 20 aa, Mycobacterium
SAWGFSKWWVAVGTVIVLAF

SEQ ID NO: 368972 - protein, 18 aa, Mycobacterium
SAWGLYRFNQILAGLSAA

SEQ ID NO: 368973 - protein, 28 aa, Mycobacterium
SAWMLTRWLIPWWTARVTVWAVAIGATF

SEQ ID NO: 368974 - protein, 21 aa, Mycobacterium
SAWTIFGKQVLWVCVGLVGFY

SEQ ID NO: 368975 - protein, 19 aa, Mycobacterium
SAYALTPWIGLAVAAVMLV

SEQ ID NO: 368976 - protein, 22 aa, Mycobacterium
SAYFAGGLSLRDATRAICSRSH

SEQ ID NO: 368977 - protein, 18 aa, Mycobacterium
SAYFVWNHSQVTQRQERA

SEQ ID NO: 368978 - protein, 24 aa, Mycobacterium
SAYHALTFGWLMSGLGRAVTGKGM

SEQ ID NO: 368979 - protein, 25 aa, Mycobacterium
SAYHALTYGWLMSGLVRAVTGQGMR

SEQ ID NO: 368980 - protein, 24 aa, Mycobacterium
SAYLIGKIIMFGLVAAVQAAILTA

SEQ ID NO: 368981 - protein, 18 aa, Mycobacterium
SAYMVLQHRDATRQRERV

SEQ ID NO: 368982 - protein, 27 aa, Mycobacterium
SAYPGMLPPPVPYPKRRRWPKVLAAVL

SEQ ID NO: 368983 - protein, 18 aa, Mycobacterium
SAYPQVAGFWGAALVLVL

SEQ ID NO: 368984 - protein, 19 aa, Mycobacterium
SAYRLIELALRGGGPDNVT

SEQ ID NO: 368985 - protein, 19 aa, Mycobacterium
SAYYPMFVAVFTALVIISN

SEQ ID NO: 368986 - protein, 19 aa, Mycobacterium
SCMIALIVGGFLAGAAGAG

SEQ ID NO: 368987 - protein, 28 aa, Mycobacterium
SCPRADTIVLIAALFRALVEREIEGLRA

SEQ ID NO: 368988 - protein, 24 aa, Mycobacterium
SCRQGLPGVIWLLLGGNLVVRAAG

SEQ ID NO: 368989 - protein, 29 aa, Mycobacterium
SCVAFGCITGALLLLRARTSDGAKMLTFA

SEQ ID NO: 368990 - protein, 25 aa, Mycobacterium
SDADAILTGLLTPGALFGPERTVVV

SEQ ID NO: 368991 - protein, 26 aa, Mycobacterium
SDAGRRRLIMLGLLGFGVVTGVTGAV

SEQ ID NO: 368992 - protein, 22 aa, Mycobacterium
SDALRAAGIPVLRRLMTRDVTT

SEQ ID NO: 368993 - protein, 27 aa, Mycobacterium
SDALTAVPLWIAFALSTKAATRRYTYG

SEQ ID NO: 368994 - protein, 35 aa, Mycobacterium; identical to SEQ ID NO: 22797

SEQ ID NO: 368995 - protein, 25 aa, Mycobacterium
SDDKDLYLTFDFSTALWAPRTIERM

SEQ ID NO: 368996 - protein, 24 aa, Mycobacterium
SDEAGIVFITFLAAYFPIMVSTRH

SEQ ID NO: 368997 - protein, 41 aa, Mycobacterium
SDFDDFFRPLRSYFYWERHCYDIPICWSLRSIFDALDGIDK

SEQ ID NO: 368998 - protein, 22 aa, Mycobacterium
SDFEDFFRPLRSYFYWERHCYD

SEQ ID NO: 368999 - protein, 26 aa, Mycobacterium
SDFEDFWRPLRNYFYWEKHCYDIPIC

SEQ ID NO: 369000 - protein, 36 aa, Mycobacterium
SDGLTAWIAAPLLFIGALFGLLLLTGTTVREVPDAL

SEQ ID NO: 369001 - protein, 36 aa, Mycobacterium
SDGLTAWIAAPLLFIGVLFGLLLITGTTIREVPSTV

SEQ ID NO: 369002 - protein, 34 aa, Mycobacterium
SDGLTAWIAAPLLFIGVLFGVLLLTGTTIREVPA

SEQ ID NO: 369003 - protein, 17 aa, Mycobacterium
SDGQFWISMDFVDGTDA

SEQ ID NO: 369004 - protein, 18 aa, Mycobacterium
SDGRPLPDLTAPLLAMAL

SEQ ID NO: 369005 - protein, 25 aa, Mycobacterium
SDHFFTAAFMFTGLLVVLAAVAAVA

SEQ ID NO: 369006 - protein, 35 aa, Mycobacterium
SDISLWIRLPDLIASLVCWLLISREVLPRLGPAVA

SEQ ID NO: 369007 - protein, 24 aa, Mycobacterium
SDKANRYAIFWPEGHEFELLMIVA

SEQ ID NO: 369008 - protein, 26 aa, Mycobacterium
SDKPWTPYSLQACNWYLGALGAILDI

SEQ ID NO: 369009 - protein, 20 aa, Mycobacterium
SDLEWVAIRSALIIGRSVDN

SEQ ID NO: 369010 - protein, 23 aa, Mycobacterium
SDLFKRIVAILTWVWVGAFAGMT

SEQ ID NO: 369011 - protein, 18 aa, Mycobacterium
SDLFLTLVGVTYLFAIAQ

SEQ ID NO: 369012 - protein, 18 aa, Mycobacterium
SDLGLTMTGARPGGFGAL

SEQ ID NO: 369013 - protein, 20 aa, Mycobacterium
SDLIRRTFAEMLTIVRSREN

SEQ ID NO: 369014 - protein, 21 aa, Mycobacterium
SDLITSLEYIARLALLERAER

SEQ ID NO: 369015 - protein, 18 aa, Mycobacterium
SDLLWSFLQAIVMAIAVM

SEQ ID NO: 369016 - protein, 18 aa, Mycobacterium
SDLLWSFLQAIVMSIAVM

SEQ ID NO: 369017 - protein, 22 aa, Mycobacterium
SDLLWSFLQAIVMSIAVMLVHT

SEQ ID NO: 369018 - protein, 21 aa, Mycobacterium
SDLNWKSVWDNGWSAAEAADA

SEQ ID NO: 369019 - protein, 32 aa, Mycobacterium
SDLQHTLRSLVWLQIAIGVGVLVLVGIASFAV

SEQ ID NO: 369020 - protein, 30 aa, Mycobacterium
SDLRLPAVGWALFAVLIGWSAACAFAYLRG

SEQ ID NO: 369021 - protein, 18 aa, Mycobacterium
SDLSWRDCTSRVFGDAGV

SEQ ID NO: 369022 - protein, 21 aa, Mycobacterium
SDLVMMKYLAFGLIAALILDA

SEQ ID NO: 369023 - protein, 31 aa, Mycobacterium
SDLVYLAYGAAILALPFVILIGLIVSRQWKL

SEQ ID NO: 369024 - protein, 32 aa, Mycobacterium
SDLVYLVYGIAILALPFMILIGLIVSRQWKLL

SEQ ID NO: 369025 - protein, 20 aa, Mycobacterium
SDMGAMLGGIIIGNVLGGGM

SEQ ID NO: 369026 - protein, 18 aa, Mycobacterium
SDMYSLGATLYALIAGNA

SEQ ID NO: 369027 - protein, 37 aa, Mycobacterium
SDNELLAPLPLAAVTPTWVARRLLGMAAGGPGLPVTC

SEQ ID NO: 369028 - protein, 30 aa, Mycobacterium
SDNIIDIVDLLPLLQHPLGLQLDSISIVTI

SEQ ID NO: 369029 - protein, 25 aa, Mycobacterium
SDNLYPNFILHGLPVVVSGLLVASI

SEQ ID NO: 369030 - protein, 25 aa, Mycobacterium
SDNMLVLYIFWETTTVLSFLLVGHY

SEQ ID NO: 369031 - protein, 22 aa, Mycobacterium
SDNPISFWEFTRKGALVTAVSI

SEQ ID NO: 369032 - protein, 27 aa, Mycobacterium
SDNSGLWGLLGLLGLGGLAGLMRRKDA

SEQ ID NO: 369033 - protein, 41 aa, Mycobacterium
SDPAIRIARLARRLPAVIATVILLLLACAPVASAQPAAGPW

SEQ ID NO: 369034 - protein, 25 aa, Mycobacterium
SDPLSFLDCFYYATVSLSTTGYGDI

SEQ ID NO: 369035 - protein, 20 aa, Mycobacterium
SDPLTPVMALGSAASAVLGS

SEQ ID NO: 369036 - protein, 26 aa, Mycobacterium
SDPNPCTVGFLPSSQWRAPEDETTID

SEQ ID NO: 369037 - protein, 21 aa, Mycobacterium
SDPPACTVGFLPPSQWRNPAD

SEQ ID NO: 369038 - protein, 24 aa, Mycobacterium
SDPVFLDWLVGLAFPCQRPFGHKN

SEQ ID NO: 369039 - protein, 20 aa, Mycobacterium
SDPVFRERMKREARITGRLQ

SEQ ID NO: 369040 - protein, 26 aa, Mycobacterium
SDPVQLTVLWPLADRPRLAAGAPGGT

SEQ ID NO: 369041 - protein, 23 aa, Mycobacterium
SDQILPLLVVAIMAQLVFSSGII

SEQ ID NO: 369042 - protein, 29 aa, Mycobacterium
SDQWALDNQSWPTTLWATNATISAAILSG

SEQ ID NO: 369043 - protein, 17 aa, Mycobacterium
SDRAAWAPALEDITEPT

SEQ ID NO: 369044 - protein, 24 aa, Mycobacterium
SDRFGRRLILQLALAGFAIGSVIT

SEQ ID NO: 369045 - protein, 18 aa, Mycobacterium
SDRIGAHLSLARGSGAIG

SEQ ID NO: 369046 - protein, 23 aa, Mycobacterium
SDRLSHTLLPKRIALPVFASDAL

SEQ ID NO: 369047 - protein, 17 aa, Mycobacterium
SDRLWTLGVVAISLLGT

SEQ ID NO: 369048 - protein, 25 aa, Mycobacterium
SDRQWLITAYVLTLGGLLLLGGRVA

SEQ ID NO: 369049 - protein, 19 aa, Mycobacterium
SDRRWLLGALAVIVAFMIG

SEQ ID NO: 369050 - protein, 36 aa, Mycobacterium
SDRSRRRLRRRLSGGLLLLIALTIAGGLAAVLTPRP

SEQ ID NO: 369051 - protein, 28 aa, Mycobacterium
SDRVGRKPLWWFSLIGLFVAGIPAFLLM

SEQ ID NO: 369052 - protein, 26 aa, Mycobacterium
SDSAAFALFLALYVAAALITWTMYVR

SEQ ID NO: 369053 - protein, 24 aa, Mycobacterium
SDSDIFTLSFPWEPWDRPENVADG

SEQ ID NO: 369054 - protein, 28 aa, Mycobacterium
SDSGWAFITILVLTLIQAGAALTVLLFD

SEQ ID NO: 369055 - protein, 22 aa, Mycobacterium
SDSLGRTLDTLPAALKVLNDSR

SEQ ID NO: 369056 - protein, 23 aa, Mycobacterium
SDSLTNRYLPSSVGRWSPDSGET

SEQ ID NO: 369057 - protein, 20 aa, Mycobacterium
SDSRLFLEDPQRYKRDAVAA

SEQ ID NO: 369058 - protein, 21 aa, Mycobacterium
SDSSIFTLSFPYEPWTRKEGV

SEQ ID NO: 369059 - protein, 44 aa, Mycobacterium
SDSSWWWVCVAILALVTLLMSVNRWLAPALTGWTLGRALCGIAV

SEQ ID NO: 369060 - protein, 26 aa, Mycobacterium
SDTRGWLFFIVKVTAFSVGLATMFAL

SEQ ID NO: 369061 - protein, 28 aa, Mycobacterium
SDVGFAMWQYYLATGDRQWLRHDGWPVL

SEQ ID NO: 369062 - protein, 20 aa, Mycobacterium
SDVNAMLVIPGRSIYTANQQ

SEQ ID NO: 369063 - protein, 28 aa, Mycobacterium
SDVTRFGLLILVTLLGGYLAIRRQRTGS

SEQ ID NO: 369064 - protein, 25 aa, Mycobacterium
SEAFLPRLAILVVVAFVITAGVYGV

SEQ ID NO: 369065 - protein, 17 aa, Mycobacterium
SEAPAVPGVPMIVVALA

SEQ ID NO: 369066 - protein, 22 aa, Mycobacterium
SEARLSWLLSGLAGMVGAVAFL

SEQ ID NO: 369067 - protein, 22 aa, Mycobacterium
SEARRMASLVDELLLLSRLGEG

SEQ ID NO: 369068 - protein, 20 aa, Mycobacterium
SEASALMQLQILPDAQRLYE

SEQ ID NO: 369069 - protein, 31 aa, Mycobacterium
SEASRMGMLVDDLLLLARLDVQRPLEHNRVD

SEQ ID NO: 369070 - protein, 35 aa, Mycobacterium
SEATSWPTWAVVAVTLVFALLVGAVVRGTAGGPGR

SEQ ID NO: 369071 - protein, 27 aa, Mycobacterium
SEAVTPLYHLWLVSAAGQILLFALVLA

SEQ ID NO: 369072 - protein, 37 aa, Mycobacterium
SEDQPWQPYYLGNPVYAFLLMVLFQYGVALHELETER

SEQ ID NO: 369073 - protein, 22 aa, Mycobacterium
SEDQWFAFTPPRVPVLQTAQQF

SEQ ID NO: 369074 - protein, 23 aa, Mycobacterium
SEDQWFGFTPPRVPVLQTAGEFL

SEQ ID NO: 369075 - protein, 25 aa, Mycobacterium
SEDTDLPTVLFQTALTKLRDILAAA

SEQ ID NO: 369076 - protein, 23 aa, Mycobacterium
SEFARFLRKPEQLGELAKAGFRV

SEQ ID NO: 369077 - protein, 19 aa, Mycobacterium
SEFKMSVVFNDGKEVPANL

SEQ ID NO: 369078 - protein, 24 aa, Mycobacterium
SEGALLAALIQRPSRLDPAVDLPE

SEQ ID NO: 369079 - protein, 25 aa, Mycobacterium
SEGALLAALIRRPSALDPAIDPKGA

SEQ ID NO: 369080 - protein, 23 aa, Mycobacterium
SEGKLVAPVKYPSLYAGDEDGKV

SEQ ID NO: 369081 - protein, 25 aa, Mycobacterium
SEGVIFFRIVLPSAVPYIAAGVRLG

SEQ ID NO: 369082 - protein, 32 aa, Mycobacterium
SEIDVLGWPLWLLYVVVFSLTLFIGARLCVAI

SEQ ID NO: 369083 - protein, 24 aa, Mycobacterium
SEIPAPRPIALGLFNAIPEAPPLT

SEQ ID NO: 369084 - protein, 21 aa, Mycobacterium
SELLRDIAPLTRKPLRATLMV

SEQ ID NO: 369085 - protein, 24 aa, Mycobacterium
SELTLWSVGPPQVPWPAMADDPVL

SEQ ID NO: 369086 - protein, 28 aa, Mycobacterium
SEMGGLVRRRPLLTAAFTVGVLSIAGLP

SEQ ID NO: 369087 - protein, 19 aa, Mycobacterium
SEMRRALAMAPRKLQEIGL

SEQ ID NO: 369088 - protein, 17 aa, Mycobacterium
SEMRRALAMAPRKSREI

SEQ ID NO: 369089 - protein, 19 aa, Mycobacterium
SEPIYYPRYLIFTAPAMAI

SEQ ID NO: 369090 - protein, 70 aa, Mycobacterium
SEQARSGIRFWSRRAWLAWPLGLLASGLTMFFGAYAWAGWLAFAATIPVQFIAGWPFLVGAVQQARARSA

SEQ ID NO: 369091 - protein, 24 aa, Mycobacterium
SEQIMPLLVVAIMSQLVFSGGMIP

SEQ ID NO: 369092 - protein, 31 aa, Mycobacterium
SEQRSGSGWIWWFGGAWLVAAVVGAGVILFR

SEQ ID NO: 369093 - protein, 23 aa, Mycobacterium
SEQSRVLSTFNIAFFGRTGAGKS

SEQ ID NO: 369094 - protein, 24 aa, Mycobacterium
SERNPFIIGAIGLGAVFTLMLVSL

SEQ ID NO: 369095 - protein, 24 aa, Mycobacterium
SERPHPYPRWVATAGWAGFALGIA

SEQ ID NO: 369096 - protein, 25 aa, Mycobacterium
SERRLAFWLIAPAVLLMLAVTAYPI

SEQ ID NO: 369097 - protein, 25 aa, Mycobacterium
SESATTLDWILIGAGLGIGVVLGIP

SEQ ID NO: 369098 - protein, 33 aa, Mycobacterium
SESFDSWGWRLPFLAAFPLLGVALWIRLTMEES

SEQ ID NO: 369099 - protein, 23 aa, Mycobacterium
SESPLLPLAYVGGAPLVSFALVL

SEQ ID NO: 369100 - protein, 23 aa, Mycobacterium
SESPTYLQLINPLVGEVATLGET

SEQ ID NO: 369101 - protein, 24 aa, Mycobacterium
SETFDVIGMLLLSPGLPVLLYGMS

SEQ ID NO: 369102 - protein, 24 aa, Mycobacterium
SETLDIIGMLLLSPGLATFLYGLS

SEQ ID NO: 369103 - protein, 25 aa, Mycobacterium
SETLFILAIPFFLRRFGIKTVMLMS

SEQ ID NO: 369104 - protein, 19 aa, Mycobacterium
SETMSLGRSFLAPVASAVV

SEQ ID NO: 369105 - protein, 19 aa, Mycobacterium
SEVMFAVIIAWIMVGEAMT

SEQ ID NO: 369106 - protein, 27 aa, Mycobacterium
SEVPGIYFSISLLDALRRARRGHFAGR

SEQ ID NO: 369107 - protein, 24 aa, Mycobacterium
SEVQYPLLTKMRSASRRAVVSLVE

SEQ ID NO: 369108 - protein, 23 aa, Mycobacterium
SEVTFYCLDYGGGQLRALQDLAH

SEQ ID NO: 369109 - protein, 34 aa, Mycobacterium
SEVVGLLQEGILKAPPLKLFDVRSAQQAYRYVSQ

SEQ ID NO: 369110 - protein, 24 aa, Mycobacterium
SEVVTLALFVPLLIGTGGNTGNQA

SEQ ID NO: 369111 - protein, 25 aa, Mycobacterium
SEWDWRAIFWVGVPLGLLGTVWSYR

SEQ ID NO: 369112 - protein, 25 aa, Mycobacterium
SEWDWRAIFWVGVPVGILGTVWSYR

SEQ ID NO: 369113 - protein, 18 aa, Mycobacterium
SEWLLVQSLIHARPEHNT

SEQ ID NO: 369114 - protein, 18 aa, Mycobacterium
SFAAAYVSGLAALVRQRF

SEQ ID NO: 369115 - protein, 20 aa, Mycobacterium
SFAAGRLYTTLSVADAAAAT

SEQ ID NO: 369116 - protein, 23 aa, Mycobacterium
SFAALLVYHGAGWVFAMMIAVIA

SEQ ID NO: 369117 - protein, 22 aa, Mycobacterium
SFAASRVLRLPDPTPQPLTAWH

SEQ ID NO: 369118 - protein, 30 aa, Mycobacterium
SFAHQPTWLRVFSISLMFAGVTLTAILVAF

SEQ ID NO: 369119 - protein, 19 aa, Mycobacterium
SFALIIALLGWVGVPGATA

SEQ ID NO: 369120 - protein, 21 aa, Mycobacterium
SFALITIFFVGAFLIMPNPLP

SEQ ID NO: 369121 - protein, 17 aa, Mycobacterium
SFALQVWVNNAWVTAQC

SEQ ID NO: 369122 - protein, 30 aa, Mycobacterium
SFAQAAAVPVVFLTALFGLQDLAKIQPGES

SEQ ID NO: 369123 - protein, 18 aa, Mycobacterium
SFAQPTIWVIPRPWYLAW

SEQ ID NO: 369124 - protein, 20 aa, Mycobacterium
SFAVNYLLQWLAGGPNEPLW

SEQ ID NO: 369125 - protein, 24 aa, Mycobacterium
SFDLAIEIPLYARVFRIAEEEHVL

SEQ ID NO: 369126 - protein, 28 aa, Mycobacterium
SFDTSVWEVFWPLSVGATLVVARPGGHR

SEQ ID NO: 369127 - protein, 20 aa, Mycobacterium
SFEFPLLIIMLNLVGILTYE

SEQ ID NO: 369128 - protein, 18 aa, Mycobacterium
SFELFTTVAATCVASAIL

SEQ ID NO: 369129 - protein, 23 aa, Mycobacterium
SFEVAKWMLLILSLSALALIAWR

SEQ ID NO: 369130 - protein, 19 aa, Mycobacterium
SFEVVVVALMIMLVCTYYG

SEQ ID NO: 369131 - protein, 19 aa, Mycobacterium
SFFDWDMYRQAIPTLFKTG

SEQ ID NO: 369132 - protein, 19 aa, Mycobacterium
SFFPNLITEPFHAGLVVVF

SEQ ID NO: 369133 - protein, 20 aa, Mycobacterium
SFFQMLVTGLILVAALIMNY

SEQ ID NO: 369134 - protein, 26 aa, Mycobacterium
SFFVEAIFLGIYLYGWGRMPPRRHLL

SEQ ID NO: 369135 - protein, 29 aa, Mycobacterium
SFGGLLTFLGFLGIVLIAVGFTFGFGSLV

SEQ ID NO: 369136 - protein, 19 aa, Mycobacterium
SFGLILFLPAGTLRYWQAW

SEQ ID NO: 369137 - protein, 37 aa, Mycobacterium
SFGLSVLIWQDLFGIRIHWIVMALSVIILLAVGSDYN

SEQ ID NO: 369138 - protein, 38 aa, Mycobacterium; identical to SEQ ID NO: 163682

SEQ ID NO: 369139 - protein, 39 aa, Mycobacterium
SFGLSVLIWQHLLGLELHWLVLAFTLIVLLAVGSDYNLL

SEQ ID NO: 369140 - protein, 30 aa, Mycobacterium
SFGLSVLLWQHLLRIELHWLVLAMSVIVLL

SEQ ID NO: 369141 - protein, 24 aa, Mycobacterium
SFGTSGLLWFVVPNGLAVMVMVPF

SEQ ID NO: 369142 - protein, 17 aa, Mycobacterium
SFHLVSSTFIYGWSTMP

SEQ ID NO: 369143 - protein, 29 aa, Mycobacterium
SFHNVIARYQFALARKGLLPKPLATVHPS

SEQ ID NO: 369144 - protein, 17 aa, Mycobacterium
SFIFLVAVGADYNLLLV

SEQ ID NO: 369145 - protein, 33 aa, Mycobacterium
SFLDGLAAYRRAHGLAGLSLAWGLWEQASAMTA

SEQ ID NO: 369146 - protein, 21 aa, Mycobacterium
SFLRRIAFSGFAFTIVLLVLV

SEQ ID NO: 369147 - protein, 19 aa, Mycobacterium
SFLVLLYVATERISWVVIG

SEQ ID NO: 369148 - protein, 19 aa, Mycobacterium
SFLVRPLGGLVWGPLGDRI

SEQ ID NO: 369149 - protein, 24 aa, Mycobacterium
SFLVYGKLAILLLFCVAGLAFVDG

SEQ ID NO: 369150 - protein, 21 aa, Mycobacterium
SFLYAIVFGGFVAFANYLPTY

SEQ ID NO: 369151 - protein, 34 aa, Mycobacterium
SFMMPAVATLLGRWFWWPRPLAWQTRKPQMVSQR

SEQ ID NO: 369152 - protein, 35 aa, Mycobacterium
SFMTPAIATILGRWFWWPLNVRTRPLPPPRTPQPD

SEQ ID NO: 369153 - protein, 34 aa, Mycobacterium
SFMTPAVATLLGRWFWWPLNVRTRPLPPPRTTVA

SEQ ID NO: 369154 - protein, 37 aa, Mycobacterium
SFMTPTIAALLGRWFWWPLLVRPRPASLLLRSVGTRP

SEQ ID NO: 369155 - protein, 24 aa, Mycobacterium
SFNGAAIFVSIAALLVGALVASMA

SEQ ID NO: 369156 - protein, 18 aa, Mycobacterium
SFPLLLIVRVVSAVANAG

SEQ ID NO: 369157 - protein, 21 aa, Mycobacterium
SFQVVPYEPLGNRRAPLPVEI

SEQ ID NO: 369158 - protein, 27 aa, Mycobacterium
SFRAMIGFLAIPLLFAVAALWLTRGGR

SEQ ID NO: 369159 - protein, 19 aa, Mycobacterium
SFRIVWAFLGSLAIATIPF

SEQ ID NO: 369160 - protein, 21 aa, Mycobacterium
SFRLHDQTPLYVLQPGLTEDA

SEQ ID NO: 369161 - protein, 23 aa, Mycobacterium
SFRLPSIPRWTGMHAALLVVGAA

SEQ ID NO: 369162 - protein, 17 aa, Mycobacterium
SFRRVLLPQLRPTTFFL

SEQ ID NO: 369163 - protein, 28 aa, Mycobacterium
SFSFDMSWEELLWLIEGHEVHICDEVLR

SEQ ID NO: 369164 - protein, 43 aa, Mycobacterium
SFSGAFGLGILIWQHIIGLNLHWMVLPLTFILLVAVGSDYNLL

SEQ ID NO: 369165 - protein, 27 aa, Mycobacterium
SFSHQHPWLRVFSITLMFAGVTTTAIL

SEQ ID NO: 369166 - protein, 27 aa, Mycobacterium
SFSNKPLVFIFYLGAVIFMISSLAAGY

SEQ ID NO: 369167 - protein, 23 aa, Mycobacterium
SFSSMFPARRFGGGALAVYVDGQ

SEQ ID NO: 369168 - protein, 18 aa, Mycobacterium
SFTIIFLGGAATAVLMML

SEQ ID NO: 369169 - protein, 19 aa, Mycobacterium
SFTLVYDALVARSGSESVL

SEQ ID NO: 369170 - protein, 28 aa, Mycobacterium
SFTSTFVFIGAVVYIILAPKGREDPASV

SEQ ID NO: 369171 - protein, 21 aa, Mycobacterium
SFVAGLVVVFAVGAVAPDDRV

SEQ ID NO: 369172 - protein, 23 aa, Mycobacterium
SFVAPRLPTAWRVGLQAGLGCLL

SEQ ID NO: 369173 - protein, 34 aa, Mycobacterium
SFVFRHRAGNAVIFALMMVAATQLFYLQVSNAAD

SEQ ID NO: 369174 - protein, 27 aa, Mycobacterium
SFVGIVAVLLLWRRPAAERMLPAERPL

SEQ ID NO: 369175 - protein, 25 aa, Mycobacterium
SFVIGRPLIWLSFRNEKLNAAFRYA

SEQ ID NO: 369176 - protein, 19 aa, Mycobacterium
SFVLGSYYIVPSILAVRGA

SEQ ID NO: 369177 - protein, 19 aa, Mycobacterium
SFVPFMRPSFDISKVLPES

SEQ ID NO: 369178 - protein, 24 aa, Mycobacterium
SFVRLLLVPVFLYLLLVAHAQGWA

SEQ ID NO: 369179 - protein, 21 aa, Mycobacterium
SFVSLPFLVVSLEGALRSAGA

SEQ ID NO: 369180 - protein, 21 aa, Mycobacterium
SFVSLPFLVVSLEGALRSAGD

SEQ ID NO: 369181 - protein, 25 aa, Mycobacterium
SFVVDLIAMIFGMPRALFPQMAHES

SEQ ID NO: 369182 - protein, 21 aa, Mycobacterium
SFVVLLWLIELFDTLTGHRLD

SEQ ID NO: 369183 - protein, 21 aa, Mycobacterium
SFYFVGWFLYNAMPSGFIEFN

SEQ ID NO: 369184 - protein, 20 aa, Mycobacterium
SFYRVIWLLYLSMTFGWFMG

SEQ ID NO: 369185 - protein, 25 aa, Mycobacterium
SGAAALITVLAWPQVRRADKLSDDD

SEQ ID NO: 369186 - protein, 25 aa, Mycobacterium
SGAALFGALTLWGTFQGALDVAMNT

SEQ ID NO: 369187 - protein, 24 aa, Mycobacterium
SGAANFLIVWLIPVALGVGYARRL

SEQ ID NO: 369188 - protein, 23 aa, Mycobacterium
SGAFWALLWVSLALAAVAAAWTT

SEQ ID NO: 369189 - protein, 38 aa, Mycobacterium
SGAGESLLVYLGLGAALGLLASWLLSRRIKRQTGGLEV

SEQ ID NO: 369190 - protein, 24 aa, Mycobacterium
SGAHKHLLIILDDPAYDLNGVNSP

SEQ ID NO: 369191 - protein, 17 aa, Mycobacterium
SGAIVFGYMRGMVHAYY

SEQ ID NO: 369192 - protein, 23 aa, Mycobacterium
SGALVDAPLFCDLLGSHYVHFEH

SEQ ID NO: 369193 - protein, 19 aa, Mycobacterium
SGALYAKIDGRLYPALNLT

SEQ ID NO: 369194 - protein, 28 aa, Mycobacterium
SGAMDPVDILPFLLLGTTFGVRLLGIAY

SEQ ID NO: 369195 - protein, 25 aa, Mycobacterium
SGAMQPVTLLPFLVLGTTFGARLLG

SEQ ID NO: 369196 - protein, 23 aa, Mycobacterium
SGAPRYYAVLPDGLQQISPVLAA

SEQ ID NO: 369197 - protein, 26 aa, Mycobacterium
SGATAFWVCGLLLCLFIGPSQSSARA

SEQ ID NO: 369198 - protein, 25 aa, Mycobacterium
SGAVAWFIGLFYKNLYVEGLINELT

SEQ ID NO: 369199 - protein, 24 aa, Mycobacterium
SGAVILFVYLLIAISQIVLRRRTD

SEQ ID NO: 369200 - protein, 24 aa, Mycobacterium
SGAVILFVYLLIALSQIVLRRRTP

SEQ ID NO: 369201 - protein, 24 aa, Mycobacterium
SGAVILFVYWVIALSQIVLRRRTP

SEQ ID NO: 369202 - protein, 25 aa, Mycobacterium
SGAVPIFYAVWALSNFAGPILLGRL

SEQ ID NO: 369203 - protein, 23 aa, Mycobacterium
SGAVSLLTQPRPWPAVDGRPRRA

SEQ ID NO: 369204 - protein, 25 aa, Mycobacterium
SGAVSWFIGLFYKSIYTESLLNEIT

SEQ ID NO: 369205 - protein, 25 aa, Mycobacterium
SGAVSWLIALVYKGLYTGGLINELT

SEQ ID NO: 369206 - protein, 24 aa, Mycobacterium
SGCLALGWWQWTRFESTSGSFQNL

SEQ ID NO: 369207 - protein, 22 aa, Mycobacterium
SGDFLAYYEQFTEQFVAPAAKQ

SEQ ID NO: 369208 - protein, 23 aa, Mycobacterium
SGDIVYWLWVPDGQSPSLADPLY

SEQ ID NO: 369209 - protein, 35 aa, Mycobacterium
SGDLPRWLPRSLRRQLLLGVLAVVSVVLMTVGFVS

SEQ ID NO: 369210 - protein, 24 aa, Mycobacterium
SGDQLFVLLPNGIQHISPFVASLL

SEQ ID NO: 369211 - protein, 27 aa, Mycobacterium
SGDSALFFVGVLLVGLLGGVAPAVVSA

SEQ ID NO: 369212 - protein, 18 aa, Mycobacterium
SGDYSLCWSFTDGGIQPG

SEQ ID NO: 369213 - protein, 33 aa, Mycobacterium
SGEHPHPRLEHRILLVLLIQADGAVVGVDGRLH

SEQ ID NO: 369214 - protein, 25 aa, Mycobacterium
SGEIIMFAILPLLGVPPWVVFFSWS

SEQ ID NO: 369215 - protein, 36 aa, Mycobacterium
SGEILMWIPLPLLGIPPWMVFFSFSVNLIYQFWIHT

SEQ ID NO: 369216 - protein, 24 aa, Mycobacterium
SGELCIRGPYLMQGYYGRSREECF

SEQ ID NO: 369217 - protein, 25 aa, Mycobacterium
SGEPVLLLHPFLLSQAVWEKVARQL

SEQ ID NO: 369218 - protein, 26 aa, Mycobacterium
SGESALFFVGVLVVALLGGVAPAVLS

SEQ ID NO: 369219 - protein, 25 aa, Mycobacterium
SGEVGLAPRWLPYLAVVEGAGVVGL

SEQ ID NO: 369220 - protein, 21 aa, Mycobacterium
SGFLARFRLEARAVARLRHPG

SEQ ID NO: 369221 - protein, 20 aa, Mycobacterium
SGFLITASWLRKPKLRDFAI

SEQ ID NO: 369222 - protein, 22 aa, Mycobacterium
SGFLLAILWMDLMFDSQVVFRR

SEQ ID NO: 369223 - protein, 24 aa, Mycobacterium
SGFVRPWAIPLITTGGALLSAFIV

SEQ ID NO: 369224 - protein, 28 aa, Mycobacterium
SGGAIAMLVLAMLVAVIVALWVSRADTA

SEQ ID NO: 369225 - protein, 26 aa, Mycobacterium
SGGAPWRLFLRQRSFWALAVGFFGTL

SEQ ID NO: 369226 - protein, 28 aa, Mycobacterium
SGGASALGALLMLPGVRGLGPGPVTTGA

SEQ ID NO: 369227 - protein, 29 aa, Mycobacterium
SGGAWSTALLPLAMLLLAAAVAAIAVRGW

SEQ ID NO: 369228 - protein, 21 aa, Mycobacterium
SGGFAGMLFGSVSAAVVLLSH

SEQ ID NO: 369229 - protein, 31 aa, Mycobacterium
SGGGNMLPWLLPLLYVLVALSLVAAAGLRHS

SEQ ID NO: 369230 - protein, 40 aa, Mycobacterium
SGGGSVSWFGVIVALALIALALTILVLWQRRRRRKRREAE

SEQ ID NO: 369231 - protein, 22 aa, Mycobacterium
SGGITAWLYAKLYRPDQQVGPS

SEQ ID NO: 369232 - protein, 24 aa, Mycobacterium
SGGKQFYVLLPEGVQKITSFVADL

SEQ ID NO: 369233 - protein, 35 aa, Mycobacterium
SGGLDMTLRLWPGPAAWPDLLCDKLVANMSHKQWH

SEQ ID NO: 369234 - protein, 24 aa, Mycobacterium
SGGLVIFRGVELPRLPLGTRNVTV

SEQ ID NO: 369235 - protein, 32 aa, Mycobacterium
SGGLVVVLLVSAWWLFDALWHPVRGRLADLLT

SEQ ID NO: 369236 - protein, 26 aa, Mycobacterium
SGGTCDPLVIHWPKGIKAKGEVRHQY

SEQ ID NO: 369237 - protein, 22 aa, Mycobacterium
SGGTLRQLWIKLRLRDTETSPL

SEQ ID NO: 369238 - protein, 20 aa, Mycobacterium
SGGWYAPFGLLLVAITVLGV

SEQ ID NO: 369239 - protein, 22 aa, Mycobacterium
SGGWYLVLVELWPAASRPYIGG

SEQ ID NO: 369240 - protein, 27 aa, Mycobacterium
SGHARAILIYGLLLTAATAGAAALIPR

SEQ ID NO: 369241 - protein, 22 aa, Mycobacterium
SGHLFYNRRLRAATTRFSVRMK

SEQ ID NO: 369242 - protein, 31 aa, Mycobacterium; identical to SEQ ID NO: 25151

SEQ ID NO: 369243 - protein, 19 aa, Mycobacterium
SGHTTFLELAPNPVALMQV

SEQ ID NO: 369244 - protein, 24 aa, Mycobacterium
SGIAAFGFWGIVLGPVLMIVIVTT

SEQ ID NO: 369245 - protein, 18 aa, Mycobacterium
SGIALAMGALLWIVVRRN

SEQ ID NO: 369246 - protein, 24 aa, Mycobacterium
SGIATWVWDWSADPGTALGAGCTP

SEQ ID NO: 369247 - protein, 34 aa, Mycobacterium
SGIFPRWFPSSLRRQLLLGVLAVVSVVLVTVGIV

SEQ ID NO: 369248 - protein, 24 aa, Mycobacterium
SGIGMFLLVFGLQEGPSAGWQPWI

SEQ ID NO: 369249 - protein, 26 aa, Mycobacterium
SGIIFLYVFMALLLNREKLRTLIGQL

SEQ ID NO: 369250 - protein, 29 aa, Mycobacterium
SGINKILQFITYLLIPAGLLTIYTQLFTT

SEQ ID NO: 369251 - protein, 23 aa, Mycobacterium
SGIRPSFPILAANLANFGRIGVI

SEQ ID NO: 369252 - protein, 17 aa, Mycobacterium
SGKAPVLFQIPGGAWTT

SEQ ID NO: 369253 - protein, 20 aa, Mycobacterium
SGKFVVWDRVLRDLRLAGDE

SEQ ID NO: 369254 - protein, 22 aa, Mycobacterium
SGKIRGHRFSRLPAGRGLLLDD

SEQ ID NO: 369255 - protein, 22 aa, Mycobacterium
SGKRSLLSRLSWPALFSGRWGN

SEQ ID NO: 369256 - protein, 24 aa, Mycobacterium
SGKTTLMLVLAGREPTSGSVERAG

SEQ ID NO: 369257 - protein, 24 aa, Mycobacterium
SGKTTLMLVLAGRQPTSGTVERPG

SEQ ID NO: 369258 - protein, 26 aa, Mycobacterium
SGLALAYLGLLWWMMVCWAQPVRNRP

SEQ ID NO: 369259 - protein, 20 aa, Mycobacterium
SGLALWCFAAMAVSGFVNAA

SEQ ID NO: 369260 - protein, 25 aa, Mycobacterium
SGLATWLWDWSADPGTALGAGCTPA

SEQ ID NO: 369261 - protein, 22 aa, Mycobacterium
SGLAVLLYVALLVAWVTVAMHT

SEQ ID NO: 369262 - protein, 31 aa, Mycobacterium
SGLGYVAIFAIPLARKAFMLDPGNLAVTGPA

SEQ ID NO: 369263 - protein, 23 aa, Mycobacterium
SGLIFGWLAFLLVFGLFVRKVWD

SEQ ID NO: 369264 - protein, 24 aa, Mycobacterium
SGLIWLLIVFVILKSAFPSSASAD

SEQ ID NO: 369265 - protein, 40 aa, Mycobacterium
SGLKARLSFLLVMLFVKPLLILFPIFDAGLRQLKWLDRGA

SEQ ID NO: 369266 - protein, 19 aa, Mycobacterium
SGLLLIPQTLAAAAVMPIV

SEQ ID NO: 369267 - protein, 23 aa, Mycobacterium
SGLLLPDYRIVGALPLAYGIIAS

SEQ ID NO: 369268 - protein, 20 aa, Mycobacterium
SGLLLVVLGIYGALIPFVGP

SEQ ID NO: 369269 - protein, 22 aa, Mycobacterium
SGLPARLWRSPLRGPWLTAVFG

SEQ ID NO: 369270 - protein, 27 aa, Mycobacterium
SGLRAFATAVWILAAALLVALTAAFTT

SEQ ID NO: 369271 - protein, 34 aa, Mycobacterium
SGLSDAVNLIVRFKDFLIPLVAGLAAYKTVMLAI

SEQ ID NO: 369272 - protein, 26 aa, Mycobacterium
SGLTLAYLGLLWWMMVCWAQPVRNRP

SEQ ID NO: 369273 - protein, 26 aa, Mycobacterium
SGLVGPWLLRALFGPQYQASGALLAW

SEQ ID NO: 369274 - protein, 26 aa, Mycobacterium
SGLVLAYLGLLWWMMVCWSQPLRGRS

SEQ ID NO: 369275 - protein, 26 aa, Mycobacterium
SGLVLTYLGLLWWMMVCWAQPLRVRP

SEQ ID NO: 369276 - protein, 28 aa, Mycobacterium
SGMGIVAYGLLWMLMPPGDDVAAVSATD

SEQ ID NO: 369277 - protein, 20 aa, Mycobacterium
SGMLFILPILSTGPLPVRQS

SEQ ID NO: 369278 - protein, 23 aa, Mycobacterium
SGMQFYFLVAASLVLLVLGIERV

SEQ ID NO: 369279 - protein, 29 aa, Mycobacterium
SGMRLTVLLALLANLFFPWGIAGDRPSLV

SEQ ID NO: 369280 - protein, 24 aa, Mycobacterium
SGMRLTVLLALLANLFVPWGIAGA

SEQ ID NO: 369281 - protein, 33 aa, Mycobacterium
SGMSLGHWEFYMALAYFKLAIIAAGIDFRRRMS

SEQ ID NO: 369282 - protein, 32 aa, Mycobacterium
SGMSLGHWEFYMALGYFKLAIIAAGIDFRRRM

SEQ ID NO: 369283 - protein, 27 aa, Mycobacterium
SGNPFRVHGLLGLLGITRPTEVTIAIP

SEQ ID NO: 369284 - protein, 23 aa, Mycobacterium
SGNRLAPRPISRPPVDPASRQLF

SEQ ID NO: 369285 - protein, 24 aa, Mycobacterium
SGNTLFVAFAARLAHRMGRVLPDG

SEQ ID NO: 369286 - protein, 29 aa, Mycobacterium
SGPAIYNYAWLVLQLPFGMIGVTVLTVVM

SEQ ID NO: 369287 - protein, 30 aa, Mycobacterium
SGPAIYNYTWMVLMLPFGMIGVTVLTVVMP

SEQ ID NO: 369288 - protein, 22 aa, Mycobacterium
SGPAPFDLLYVPTAEYLGPWAV

SEQ ID NO: 369289 - protein, 17 aa, Mycobacterium
SGPLGIAILFAFAGFMG

SEQ ID NO: 369290 - protein, 23 aa, Mycobacterium
SGPLPYIVMEYVNGVTLRDIVHT

SEQ ID NO: 369291 - protein, 23 aa, Mycobacterium
SGPMVLFSAVFAFAIRALNGTAN

SEQ ID NO: 369292 - protein, 19 aa, Mycobacterium
SGPPLPPVIEAFPGYHEVQ

SEQ ID NO: 369293 - protein, 26 aa, Mycobacterium
SGPRRQRRLSPVGGPGNRHRRRRRKW

SEQ ID NO: 369294 - protein, 28 aa, Mycobacterium
SGPTPAPWSILTLLPAGPELSRRGASIA

SEQ ID NO: 369295 - protein, 37 aa, Mycobacterium
SGPTSPIPGFPDFGAPDMPIPVLAGLPDLSGGVAGLA

SEQ ID NO: 369296 - protein, 17 aa, Mycobacterium
SGPVVMHIYLVAHPASS

SEQ ID NO: 369297 - protein, 37 aa, Mycobacterium
SGPYYSAYIPNLDLPPILQPFLDYAFGFRRGVDAGQP

SEQ ID NO: 369298 - protein, 23 aa, Mycobacterium
SGQFYTPWSWLPRIVTQFVAGAL

SEQ ID NO: 369299 - protein, 27 aa, Mycobacterium
SGQLLLVIHHLVIDGVSWRILSEDLSR

SEQ ID NO: 369300 - protein, 24 aa, Mycobacterium
SGQVNWMLALLMLMILVGAIAGVA

SEQ ID NO: 369301 - protein, 28 aa, Mycobacterium
SGQVVFQRGFQLPPLPPGTETVIVNGVE

SEQ ID NO: 369302 - protein, 23 aa, Mycobacterium
SGQWSRLKWQIPAVLLGALIGSF

SEQ ID NO: 369303 - protein, 28 aa, Mycobacterium
SGRITYLLLLVVLLPHSPHAATAILCLL

SEQ ID NO: 369304 - protein, 22 aa, Mycobacterium
SGRLVVFSSIAGHRVRRANYVY

SEQ ID NO: 369305 - protein, 23 aa, Mycobacterium
SGRPPEVPSWRRKLRPYILSVPA

SEQ ID NO: 369306 - protein, 21 aa, Mycobacterium
SGRRMWAWRNGPLLERSMSNL

SEQ ID NO: 369307 - protein, 25 aa, Mycobacterium
SGRSLAIGMLILALSFLPLIALPDD

SEQ ID NO: 369308 - protein, 19 aa, Mycobacterium
SGRVAYLLGLEGPAVSVDT

SEQ ID NO: 369309 - protein, 24 aa, Mycobacterium
SGRVLIGAIVAAVLMLAGSAGLAG

SEQ ID NO: 369310 - protein, 17 aa, Mycobacterium
SGRVLVYGAGSLGLCAL

SEQ ID NO: 369311 - protein, 21 aa, Mycobacterium
SGRVTLLVALGVIVVAVVILL

SEQ ID NO: 369312 - protein, 25 aa, Mycobacterium
SGRWPVPPRRGGLLALKPLELAILA

SEQ ID NO: 369313 - protein, 31 aa, Mycobacterium
SGSHSDLDWLWWFGAGWVAVAIVGAGVILWR

SEQ ID NO: 369314 - protein, 33 aa, Mycobacterium
SGSPGWGFKIASAVVLVLLGIGIGWGMYGSSPT

SEQ ID NO: 369315 - protein, 30 aa, Mycobacterium
SGSQQIILDRDLQLVLNSLWASGAEAVSVD

SEQ ID NO: 369316 - protein, 24 aa, Mycobacterium
SGSRAPHTAVLLAPAKAARALKLV

SEQ ID NO: 369317 - protein, 33 aa, Mycobacterium
SGSTTIILAVDWLPETWWSRALPVGFSAASLLL

SEQ ID NO: 369318 - protein, 22 aa, Mycobacterium
SGSVLVSVIWLSVALGGAGFAQ

SEQ ID NO: 369319 - protein, 21 aa, Mycobacterium
SGSWSFRLTVPGTGTPGPPAG

SEQ ID NO: 369320 - protein, 23 aa, Mycobacterium
SGSYALYVAILSVLAAGAAYVPV

SEQ ID NO: 369321 - protein, 32 aa, Mycobacterium
SGTAMARNPVFLAFPLMMLVSALASGLTGRAR

SEQ ID NO: 369322 - protein, 30 aa, Mycobacterium
SGTDTFVSWLPLYHDMGLIGAWLGCMYFGV

SEQ ID NO: 369323 - protein, 20 aa, Mycobacterium
SGTFLLLIGLLNLISLIGIY

SEQ ID NO: 369324 - protein, 30 aa, Mycobacterium
SGTGAFVVLLLIHIWQWTPFAVLIAFAALG

SEQ ID NO: 369325 - protein, 25 aa, Mycobacterium
SGTIMQNWWLRGLGAKIGRGVWCET

SEQ ID NO: 369326 - protein, 26 aa, Mycobacterium
SGTLAMLRLYLRRDRLSLPLWVFLLS

SEQ ID NO: 369327 - protein, 17 aa, Mycobacterium
SGTLITFPTLVALGYPP

SEQ ID NO: 369328 - protein, 17 aa, Mycobacterium
SGTLITFPTLVTLGFPP

SEQ ID NO: 369329 - protein, 18 aa, Mycobacterium
SGTLLRRVFAIASGITAV

SEQ ID NO: 369330 - protein, 31 aa, Mycobacterium
SGTLSWLSPLGWSLLVKPYAGDRWWVLLLHL

SEQ ID NO: 369331 - protein, 23 aa, Mycobacterium
SGTPGIFRLFQDTQADHIAWLLP

SEQ ID NO: 369332 - protein, 32 aa, Mycobacterium
SGTRPLRFVSMMGILFALLGFGVAIYSMIQKL

SEQ ID NO: 369333 - protein, 26 aa, Mycobacterium
SGTVEFYAVIFLSIGASLGAALLGRL

SEQ ID NO: 369334 - protein, 28 aa, Mycobacterium
SGTVSFLTYFYFLVTGFLEPLHTLVVVA

SEQ ID NO: 369335 - protein, 23 aa, Mycobacterium
SGTWFAVAAWAALALGVIALVVM

SEQ ID NO: 369336 - protein, 22 aa, Mycobacterium
SGTWTKLVGMPTPRGSYGATYI

SEQ ID NO: 369337 - protein, 27 aa, Mycobacterium
SGVAAPFLWLAWLLRIPTVFVESITRI

SEQ ID NO: 369338 - protein, 24 aa, Mycobacterium
SGVANFLIVWLIPVVIGVGYARRL

SEQ ID NO: 369339 - protein, 31 aa, Mycobacterium
SGVFVPIVIAIAVITLGAWLGAGFSVTAAFT

SEQ ID NO: 369340 - protein, 29 aa, Mycobacterium
SGVFWWSGPFLMFVVIPLADYLVGADSEN

SEQ ID NO: 369341 - protein, 26 aa, Mycobacterium
SGVGAFLRLPYTFAVPIFGGRNWTTI

SEQ ID NO: 369342 - protein, 26 aa, Mycobacterium
SGVGAFLRLPYTFAVPLFGGRNWTTI

SEQ ID NO: 369343 - protein, 26 aa, Mycobacterium
SGVGALLRLPYTFAVPIFGGRNWTII

SEQ ID NO: 369344 - protein, 25 aa, Mycobacterium
SGVLHLLVAYIIAKLAFVGGGAGGG

SEQ ID NO: 369345 - protein, 27 aa, Mycobacterium
SGVLHLLVAYIILRLAFGSGGNADQSG

SEQ ID NO: 369346 - protein, 17 aa, Mycobacterium
SGVLTYEFWLKVGIVAL

SEQ ID NO: 369347 - protein, 25 aa, Mycobacterium
SGVRGFWISLLTFSLLAAILVTRVL

SEQ ID NO: 369348 - protein, 31 aa, Mycobacterium; identical to SEQ ID NO: 22811

SEQ ID NO: 369349 - protein, 17 aa, Mycobacterium
SGYDLRLRRLPNWLTVP

SEQ ID NO: 369350 - protein, 19 aa, Mycobacterium
SHADGVRRLWLGTSGFIAC

SEQ ID NO: 369351 - protein, 24 aa, Mycobacterium
SHAGSLITWWTGDSVLVFETGNLS

SEQ ID NO: 369352 - protein, 27 aa, Mycobacterium
SHELRTPLNSILILAGLLTESDEPLNA

SEQ ID NO: 369353 - protein, 26 aa, Mycobacterium
SHFFNLFLMMFIIRSGIQILCDHPRL

SEQ ID NO: 369354 - protein, 24 aa, Mycobacterium
SHGAFIFLGPGFTPGSPSGGSGGS

SEQ ID NO: 369355 - protein, 17 aa, Mycobacterium
SHGGWPTALAATVMICF

SEQ ID NO: 369356 - protein, 23 aa, Mycobacterium
SHGRAHYAMGLYALLIGAGAVTL

SEQ ID NO: 369357 - protein, 23 aa, Mycobacterium
SHHLEWIFALYSVVLAAIGLVTT

SEQ ID NO: 369358 - protein, 17 aa, Mycobacterium
SHIGMVLQDTWLFDGTI

SEQ ID NO: 369359 - protein, 30 aa, Mycobacterium
SHINAPRAKLFAALFLILGLVVVGEVAGVV

SEQ ID NO: 369360 - protein, 48 aa, Mycobacterium
SHLAIRMYNALLEAVLWFLSRKTPRLMKWLLRRTAIKNLPVGYDVDTH

SEQ ID NO: 369361 - protein, 33 aa, Mycobacterium
SHLARQVSLLRNYLLPLGALLLLVVKVSQVPAG

SEQ ID NO: 369362 - protein, 32 aa, Mycobacterium
SHNSGAWLVLFMIFNVIWTYVLVRGSAVNNET

SEQ ID NO: 369363 - protein, 34 aa, Mycobacterium
SHRDFDGLPPHFLNWLFGLFGALALIAAAIVLFR

SEQ ID NO: 369364 - protein, 19 aa, Mycobacterium
SHRGIDVLPLLLAGLGWIS

SEQ ID NO: 369365 - protein, 21 aa, Mycobacterium
SHRKALLFFPIAAAATLAVFI

SEQ ID NO: 369366 - protein, 29 aa, Mycobacterium
SHRKAVLIIYLWVAIIAFGAASTIFFEPR

SEQ ID NO: 369367 - protein, 23 aa, Mycobacterium
SHRMLLAVAVVIAFIAAVTGIVV

SEQ ID NO: 369368 - protein, 31 aa, Mycobacterium
SHRVPWQVRILPPFLSRKHLPSRLARLRELE

SEQ ID NO: 369369 - protein, 23 aa, Mycobacterium
SHRWVLLKGRLVAGIASAFVMAI

SEQ ID NO: 369370 - protein, 25 aa, Mycobacterium
SHSRVGWIVVLLYAVCIVLRLARFN

SEQ ID NO: 369371 - protein, 33 aa, Mycobacterium
SHTGGAWLILFMIFNVIWTYALVRGAAAVVGNL

SEQ ID NO: 369372 - protein, 31 aa, Mycobacterium
SHTGGAWLILFMIFNVIWTYVLVRGSAVNNG

SEQ ID NO: 369373 - protein, 31 aa, Mycobacterium
SHTGGAWLVLFMIFNVVWTYVLVRGSAVNNG

SEQ ID NO: 369374 - protein, 19 aa, Mycobacterium
SHTSALDALLLNAIGLSQS

SEQ ID NO: 369375 - protein, 18 aa, Mycobacterium
SIAAAILVLLPAAGLTAA

SEQ ID NO: 369376 - protein, 27 aa, Mycobacterium
SIAAGVLYFFFVLPRTPELLGDTSHTL

SEQ ID NO: 369377 - protein, 27 aa, Mycobacterium
SIAALLGRWFWWPMVVRPRPASALLRP

SEQ ID NO: 369378 - protein, 28 aa, Mycobacterium
SIAALMGKWFWWPQRVRQRPLPAPWPQP

SEQ ID NO: 369379 - protein, 26 aa, Mycobacterium
SIAALMGRWFWWPQQVRTRPASQLLR

SEQ ID NO: 369380 - protein, 28 aa, Mycobacterium
SIAATVVFPLLPFSPKIRTGYNVPISHV

SEQ ID NO: 369381 - protein, 28 aa, Mycobacterium
SIADPEYLAFYPFVYAGILLLMRSSLKR

SEQ ID NO: 369382 - protein, 27 aa, Mycobacterium
SIAIGLLFDTLVVRSFLMPSIAALLGR

SEQ ID NO: 369383 - protein, 22 aa, Mycobacterium
SIALIPWITYLAFTLPENYVAQ

SEQ ID NO: 369384 - protein, 22 aa, Mycobacterium
SIALLVWFWPHLGPDKLTLPVT

SEQ ID NO: 369385 - protein, 24 aa, Mycobacterium
SIAVLLLLIIKMKVEPFIALIVVS

SEQ ID NO: 369386 - protein, 28 aa, Mycobacterium
SIAVPLSFVVLTWVFGGLLAAAVPMLVG

SEQ ID NO: 369387 - protein, 20 aa, Mycobacterium
SIDLLWSFVTVIAAAIAVML

SEQ ID NO: 369388 - protein, 25 aa, Mycobacterium
SIDLSRTVGWFTTKYPVSLDLDGLA

SEQ ID NO: 369389 - protein, 32 aa, Mycobacterium
SIEMTPTTPIWRLLLPLTAMGAAMAFIWSPLA

SEQ ID NO: 369390 - protein, 33 aa, Mycobacterium
SIEPALRFYIAFFLALLGVTWYCYLRRHNAITR

SEQ ID NO: 369391 - protein, 33 aa, Mycobacterium
SIEPALRFYVGFFLALLVVTWFCYLRRTSAYRA

SEQ ID NO: 369392 - protein, 24 aa, Mycobacterium
SIEYYDFFIYGLAAALVFPAVFFP

SEQ ID NO: 369393 - protein, 18 aa, Mycobacterium
SIFNALPFRMESPPFNIS

SEQ ID NO: 369394 - protein, 30 aa, Mycobacterium
SIFVGFLGLLFGPPLLTIAAPLLLNGAVIG

SEQ ID NO: 369395 - protein, 20 aa, Mycobacterium
SIGLARWWHLGVDVLWLLNG

SEQ ID NO: 369396 - protein, 19 aa, Mycobacterium
SIGLARWWHLGVDVLWLVN

SEQ ID NO: 369397 - protein, 18 aa, Mycobacterium
SIGPFVAGAVIFGIVVIA

SEQ ID NO: 369398 - protein, 21 aa, Mycobacterium
SIGPYLHYFTMMLSTKDIAYS

SEQ ID NO: 369399 - protein, 29 aa, Mycobacterium
SIGVILVMLLVIYRSILTTILALLIVGIE

SEQ ID NO: 369400 - protein, 25 aa, Mycobacterium
SIGWTMMHYLPPTPGFRFVDHTVIG

SEQ ID NO: 369401 - protein, 19 aa, Mycobacterium
SIHSLFDKLPLMGLVLIVT

SEQ ID NO: 369402 - protein, 25 aa, Mycobacterium
SIIANRLSYFLDLRGPSVAVDTACS

SEQ ID NO: 369403 - protein, 25 aa, Mycobacterium
SIIANRVSYFYDFRGPSVAIDTACS

SEQ ID NO: 369404 - protein, 27 aa, Mycobacterium
SIIANRVSYFYDFRGPSVALDTACSSS

SEQ ID NO: 369405 - protein, 21 aa, Mycobacterium
SIIANRVSYFYDFRGPSVAVD

SEQ ID NO: 369406 - protein, 20 aa, Mycobacterium
SIIFTIPSLALFVVLPLIIP

SEQ ID NO: 369407 - protein, 18 aa, Mycobacterium
SIIKTVVFVWIASTVQCY

SEQ ID NO: 369408 - protein, 25 aa, Mycobacterium
SIIPTLLLAIPFTVLVVFTLNILLV

SEQ ID NO: 369409 - protein, 21 aa, Mycobacterium
SIIPTLLLTIPFTVLVVFTMN

SEQ ID NO: 369410 - protein, 18 aa, Mycobacterium
SIKATHYALRGPLGDMVV

SEQ ID NO: 369411 - protein, 27 aa, Mycobacterium
SIKAVTFLVTVFSLARLCFAPVSGQLV

SEQ ID NO: 369412 - protein, 33 aa, Mycobacterium
SILANFLSIIGLIGFIFFISQHLQLVLGLSPLT

SEQ ID NO: 369413 - protein, 17 aa, Mycobacterium
SILCLVNEFSLTGIWLA

SEQ ID NO: 369414 - protein, 24 aa, Mycobacterium
SILGDLPWWVTVVILVREVAVTVL

SEQ ID NO: 369415 - protein, 21 aa, Mycobacterium
SILIRGLMNYTFWVPNGSPEY

SEQ ID NO: 369416 - protein, 24 aa, Mycobacterium
SILKGWYMSFWPVLALALVMVSSA

SEQ ID NO: 369417 - protein, 41 aa, Mycobacterium
SILKMTMIGALIIFIVLLFVYRSVITVILLLLTVGIEVFAA

SEQ ID NO: 369418 - protein, 25 aa, Mycobacterium
SILLGIPIPYILFQNAANLGLNAGL

SEQ ID NO: 369419 - protein, 21 aa, Mycobacterium
SILLMALMPLWGRLSDRIGRK

SEQ ID NO: 369420 - protein, 29 aa, Mycobacterium
SILLWTGVALMLIAWLWLGRRVIDRTATE

SEQ ID NO: 369421 - protein, 25 aa, Mycobacterium
SILQDWRMIVSNRSFVWFAACMTGR

SEQ ID NO: 369422 - protein, 24 aa, Mycobacterium
SILSWFSPIAWAQQMRPFVALRCW

SEQ ID NO: 369423 - protein, 27 aa, Mycobacterium
SILTLIVFFYIFFNLVVDILYALLDPR

SEQ ID NO: 369424 - protein, 20 aa, Mycobacterium
SILVLIAFPLLTAALFGLAA

SEQ ID NO: 369425 - protein, 23 aa, Mycobacterium
SIMLLPLVIDLQRAPSAALGALA

SEQ ID NO: 369426 - protein, 18 aa, Mycobacterium
SINRFIAIDFVGFAKMVQ

SEQ ID NO: 369427 - protein, 17 aa, Mycobacterium
SINRFIAVDFSGFAKMV

SEQ ID NO: 369428 - protein, 23 aa, Mycobacterium
SIPAFLLIRFGGIYPVIFIGVLL

SEQ ID NO: 369429 - protein, 17 aa, Mycobacterium
SIPDFRLGILLIGLFAS

SEQ ID NO: 369430 - protein, 17 aa, Mycobacterium
SIPDLFPGLPGLGDLFS

SEQ ID NO: 369431 - protein, 25 aa, Mycobacterium
SIPEQLGLLAFMIIASKGAAGVSGA

SEQ ID NO: 369432 - protein, 18 aa, Mycobacterium
SIPFWRKWTQQVMRRPWL

SEQ ID NO: 369433 - protein, 22 aa, Mycobacterium
SIPQWVLALLALIVVLSMNLIS

SEQ ID NO: 369434 - protein, 21 aa, Mycobacterium
SIPRSDLWWGALSGFGTAVGM

SEQ ID NO: 369435 - protein, 24 aa, Mycobacterium
SIPVWGRLALLLMLVMVAVRINIL

SEQ ID NO: 369436 - protein, 25 aa, Mycobacterium
SIRHKVLIIGMWVVTAAALAVLFPQ

SEQ ID NO: 369437 - protein, 22 aa, Mycobacterium
SIRLDWGALLIVSIVSLLVAYG

SEQ ID NO: 369438 - protein, 18 aa, Mycobacterium
SIRRLGHMLAFFVEAIAS

SEQ ID NO: 369439 - protein, 24 aa, Mycobacterium
SIRRRSLIYLGYSSFRAAAEDRPA

SEQ ID NO: 369440 - protein, 19 aa, Mycobacterium
SIRVTTILGSRYLDLRPRG

SEQ ID NO: 369441 - protein, 18 aa, Mycobacterium
SISAAILVLLPAAGLTSA

SEQ ID NO: 369442 - protein, 17 aa, Mycobacterium
SISFWGSIIAFGKLQEI

SEQ ID NO: 369443 - protein, 18 aa, Mycobacterium
SISQIIEPLPLIVQAPRL

SEQ ID NO: 369444 - protein, 29 aa, Mycobacterium
SISTLYLPILATAVIGIAWLAAHRAVTEK

SEQ ID NO: 369445 - protein, 28 aa, Mycobacterium
SISWNYTTWLNIAFLAVAAVLVIRFFTS

SEQ ID NO: 369446 - protein, 23 aa, Mycobacterium
SITALLIHVGLYTDLTGLAAALA

SEQ ID NO: 369447 - protein, 19 aa, Mycobacterium
SITFGTGLLLGWRLPMWRA

SEQ ID NO: 369448 - protein, 28 aa, Mycobacterium
SITMVTMVGWWALSRVLGRLLGVPDVHK

SEQ ID NO: 369449 - protein, 25 aa, Mycobacterium
SIVAALFVYALFVTTLGLPRSELAV

SEQ ID NO: 369450 - protein, 22 aa, Mycobacterium
SIVAILALTFGTAVFVAAEFSL

SEQ ID NO: 369451 - protein, 28 aa, Mycobacterium
SIVFGLWGIFVLAPWLTPAAEFLNDNLG

SEQ ID NO: 369452 - protein, 26 aa, Mycobacterium
SIVLLTISFVVLLLLRVVGTRAARRD

SEQ ID NO: 369453 - protein, 24 aa, Mycobacterium
SIVTVLVLIYLLTNLMVDLLYAAL

SEQ ID NO: 369454 - protein, 30 aa, Mycobacterium
SIVVLMAPAALPWYYSWPLAIAAPLLQSRG

SEQ ID NO: 369455 - protein, 22 aa, Mycobacterium
SIVYGLWGIYVLAPAIAPVALW

SEQ ID NO: 369456 - protein, 18 aa, Mycobacterium
SIWLSFVIAAGTCALAAL

SEQ ID NO: 369457 - protein, 26 aa, Mycobacterium
SKAGLLPLHAWLPRAHPEAPSPASAL

SEQ ID NO: 369458 - protein, 40 aa, Mycobacterium
SKALKADPLLYPFQPIHVTIAAWFTIGIPSFILSLAPNNE

SEQ ID NO: 369459 - protein, 23 aa, Mycobacterium
SKALVLVTVAMIVIICVFSMLIA

SEQ ID NO: 369460 - protein, 21 aa, Mycobacterium
SKAVVGAFKPSLHLPGDTTTL

SEQ ID NO: 369461 - protein, 25 aa, Mycobacterium
SKAYAAYSTPFWRANGFSGQALSDT

SEQ ID NO: 369462 - protein, 27 aa, Mycobacterium
SKAYAAYSTPFWRINGFTGQSLSDIGP

SEQ ID NO: 369463 - protein, 23 aa, Mycobacterium
SKGYFLLGIWMSLVWAVVVAASV

SEQ ID NO: 369464 - protein, 21 aa, Mycobacterium
SKHLAGIEPQLAFTGDNLPLL

SEQ ID NO: 369465 - protein, 26 aa, Mycobacterium
SKLLAPLFPMIVAVPGWAYLALPVVA

SEQ ID NO: 369466 - protein, 21 aa, Mycobacterium
SKNLRVLAPLGGAALLIGVAG

SEQ ID NO: 369467 - protein, 20 aa, Mycobacterium
SKNPLLPLRVVCDRTRGAAF

SEQ ID NO: 369468 - protein, 25 aa, Mycobacterium
SKNPLSLIFSLGGLLALVLLGQAVA

SEQ ID NO: 369469 - protein, 26 aa, Mycobacterium
SKPGQVLLWCGLWLVAAAGLGYVAWQ

SEQ ID NO: 369470 - protein, 32 aa, Mycobacterium
SKPLFYEPGASWYWLLAGPIAAVSMILIEMSG

SEQ ID NO: 369471 - protein, 17 aa, Mycobacterium
SKPWSWPMSLRPVLYAI

SEQ ID NO: 369472 - protein, 21 aa, Mycobacterium
SKQTLLCTYLSAVLLAGLLVN

SEQ ID NO: 369473 - protein, 33 aa, Mycobacterium
SKQTLLCTYLSAVLLVGLLLNSIFGWSWADPIA

SEQ ID NO: 369474 - protein, 30 aa, Mycobacterium
SKRKKAICTVLFPLTMRWLAGEIMTPPRSF

SEQ ID NO: 369475 - protein, 23 aa, Mycobacterium
SKRMTPEMYAMNTALAFGSDAAR

SEQ ID NO: 369476 - protein, 23 aa, Mycobacterium
SKSAIVPMHFWLPGAMAAPTPVS

SEQ ID NO: 369477 - protein, 24 aa, Mycobacterium
SKSFALKSLPLSWAQPAAPAPNAA

SEQ ID NO: 369478 - protein, 17 aa, Mycobacterium
SKTWHDDKWLIDQAKAV

SEQ ID NO: 369479 - protein, 25 aa, Mycobacterium
SKVTALELYLVFPLSNEESTISLVR

SEQ ID NO: 369480 - protein, 21 aa, Mycobacterium
SLAAAIWLFPVSAAVLTWRAV

SEQ ID NO: 369481 - protein, 32 aa, Mycobacterium
SLAAGYLIIDRLFFRVLLGGWPSLIVSIWMLG

SEQ ID NO: 369482 - protein, 25 aa, Mycobacterium
SLAAPFFVKVLWPPENSAWKKSAPG

SEQ ID NO: 369483 - protein, 19 aa, Mycobacterium
SLAATLWSLRQLGYRSRPL

SEQ ID NO: 369484 - protein, 25 aa, Mycobacterium
SLACVLYECLTGRVPFSGGGVEGLT

SEQ ID NO: 369485 - protein, 29 aa, Mycobacterium
SLADPNPPLPPWMAPAPPVPGTANSALPV

SEQ ID NO: 369486 - protein, 20 aa, Mycobacterium
SLAELWRSVGVVPDAVIGHS

SEQ ID NO: 369487 - protein, 19 aa, Mycobacterium
SLAFLPWPVRVLAGRFNLF

SEQ ID NO: 369488 - protein, 24 aa, Mycobacterium
SLAGMALVWARRWPGRVQSQVFSI

SEQ ID NO: 369489 - protein, 19 aa, Mycobacterium
SLAITVGVVLIICYANLRG

SEQ ID NO: 369490 - protein, 18 aa, Mycobacterium
SLAITVGVVLVICYLNLR

SEQ ID NO: 369491 - protein, 21 aa, Mycobacterium
SLAIVAVSIPLPWMAVLIAND

SEQ ID NO: 369492 - protein, 22 aa, Mycobacterium
SLAKITLFTLGAIAIMLLLVYR

SEQ ID NO: 369493 - protein, 22 aa, Mycobacterium
SLAKVIVFVIIVIVLQVRPQGL

SEQ ID NO: 369494 - protein, 35 aa, Mycobacterium
SLALLRALYVILGWRRVLLIPLTFALFTPLGVPGF

SEQ ID NO: 369495 - protein, 32 aa, Mycobacterium
SLARQPWLADHLVGGAVLFPGTGFVELAIRAG

SEQ ID NO: 369496 - protein, 28 aa, Mycobacterium
SLARRFSVLILLVCLFGVIALLLRRGSV

SEQ ID NO: 369497 - protein, 24 aa, Mycobacterium
SLARTRRGLRALLSLVPDEATVLR

SEQ ID NO: 369498 - protein, 24 aa, Mycobacterium
SLARTRRGLRALLSLVPDQATVVR

SEQ ID NO: 369499 - protein, 26 aa, Mycobacterium
SLASWAVVIVLFWLNRMFVSRRPQTP

SEQ ID NO: 369500 - protein, 28 aa, Mycobacterium
SLATASKLLYLRVPALNALFPNYRGSVF

SEQ ID NO: 369501 - protein, 26 aa, Mycobacterium
SLATRLTMITLIPIVALMTVGGPAIG

SEQ ID NO: 369502 - protein, 20 aa, Mycobacterium
SLATSPVLLAIRPELQQPLS

SEQ ID NO: 369503 - protein, 40 aa, Mycobacterium
SLAVIFITLLIVYRSITTVILLLLMVGLQLQVARGIVAFL

SEQ ID NO: 369504 - protein, 17 aa, Mycobacterium
SLAVWKVHEMSAPGPVP

SEQ ID NO: 369505 - protein, 20 aa, Mycobacterium
SLAWMLLGAVVMAGAVLAGL

SEQ ID NO: 369506 - protein, 18 aa, Mycobacterium
SLAWTARLTPPGSFTAIP

SEQ ID NO: 369507 - protein, 22 aa, Mycobacterium
SLCGVSWLYRYAVGVYRDDRGC

SEQ ID NO: 369508 - protein, 21 aa, Mycobacterium
SLCVLIAVLAWCIAVLALITT

SEQ ID NO: 369509 - protein, 25 aa, Mycobacterium
SLDAVWKQLMPNRYTRPHLRLFSGQ

SEQ ID NO: 369510 - protein, 31 aa, Mycobacterium
SLDILLFYVFFEAMLIPMYFLIGGFGGEHRG

SEQ ID NO: 369511 - protein, 20 aa, Mycobacterium
SLDRLDALMPKLLSTLPPTI

SEQ ID NO: 369512 - protein, 26 aa, Mycobacterium
SLDRSYYGLYLPSMIWREITGFCTGA

SEQ ID NO: 369513 - protein, 22 aa, Mycobacterium
SLEALLPHELRAQPGARASLFG

SEQ ID NO: 369514 - protein, 18 aa, Mycobacterium
SLFALVLAMPVALGVAIF

SEQ ID NO: 369515 - protein, 38 aa, Mycobacterium
SLFDKAPLMLVLLLGATMLLMFLAFGSVVLPVKAAVMS

SEQ ID NO: 369516 - protein, 22 aa, Mycobacterium
SLFFRPKQPAPVPPTAWAVPGD

SEQ ID NO: 369517 - protein, 21 aa, Mycobacterium
SLFIGNLLQLMSPLNILIVVI

SEQ ID NO: 369518 - protein, 20 aa, Mycobacterium
SLFLVNVLFIGAVSAFSFVA

SEQ ID NO: 369519 - protein, 37 aa, Mycobacterium
SLFSRLTMLLRPDWTRTVLARRIAAGGLVLLAGVAAL

SEQ ID NO: 369520 - protein, 17 aa, Mycobacterium
SLFVVVTLFVVIRASKR

SEQ ID NO: 369521 - protein, 25 aa, Mycobacterium
SLGADYWYRNIRQTVRFDRAVRYCH

SEQ ID NO: 369522 - protein, 40 aa, Mycobacterium
SLGASFGLSVLLWQHLIGIPLHWMVLPMAVIVLLAVGADY

SEQ ID NO: 369523 - protein, 21 aa, Mycobacterium
SLGATLYALIAGNAAHERKKG

SEQ ID NO: 369524 - protein, 22 aa, Mycobacterium
SLGATLYALIAGSAAHERKKGE

SEQ ID NO: 369525 - protein, 25 aa, Mycobacterium
SLGDGLYWVLIGVVIFVAVVAGGLA

SEQ ID NO: 369526 - protein, 26 aa, Mycobacterium
SLGELRPAFDDIRPLRHGSIDDALTD

SEQ ID NO: 369527 - protein, 18 aa, Mycobacterium
SLGFWRGMLAIALGNAVL

SEQ ID NO: 369528 - protein, 21 aa, Mycobacterium
SLGGDLWLSSPGDPAAPLRGA

SEQ ID NO: 369529 - protein, 24 aa, Mycobacterium
SLGIAMMLGANWRTCAIAALTAAT

SEQ ID NO: 369530 - protein, 20 aa, Mycobacterium
SLGIRPIPYLVTTRLMASVI

SEQ ID NO: 369531 - protein, 22 aa, Mycobacterium
SLGLCAIAILRALYPDVAVAVV

SEQ ID NO: 369532 - protein, 29 aa, Mycobacterium
SLGLFGITAGWWIYLAAFAIFIGIHLAGV

SEQ ID NO: 369533 - protein, 21 aa, Mycobacterium
SLGQVFLWAATVAAVAFVLAL

SEQ ID NO: 369534 - protein, 25 aa, Mycobacterium
SLGSVVGIFLFHYIDKHFYTDSLGT

SEQ ID NO: 369535 - protein, 23 aa, Mycobacterium
SLGTGLFFASFTLYFVGIVKIGA

SEQ ID NO: 369536 - protein, 40 aa, Mycobacterium
SLGTLTAFIYSTYQLFAGGPLFFDTAALIIAFVVLGRYFE

SEQ ID NO: 369537 - protein, 30 aa, Mycobacterium
SLGVEEQFYLVWPALIIATAWLVRRARRRP

SEQ ID NO: 369538 - protein, 21 aa, Mycobacterium
SLGVEVWFLAALAAPLMTALW

SEQ ID NO: 369539 - protein, 28 aa, Mycobacterium
SLGVGQMLVAVLAGAALFTGGRYVTGLA

SEQ ID NO: 369540 - protein, 20 aa, Mycobacterium
SLGYLIGLAAALILLAGLQR

SEQ ID NO: 369541 - protein, 22 aa, Mycobacterium
SLGYLLLPIVLVLAGRFVLSAH

SEQ ID NO: 369542 - protein, 23 aa, Mycobacterium
SLGYLNLAVWLIPAMFGVAYRRR

SEQ ID NO: 369543 - protein, 18 aa, Mycobacterium
SLHGPWVGLAAPGADIVG

SEQ ID NO: 369544 - protein, 25 aa, Mycobacterium
SLHPEHWGTFINLRCVCLAPPDAHH

SEQ ID NO: 369545 - protein, 31 aa, Mycobacterium
SLIAFLSYFMQILMSVLMATFILVIIPRASV

SEQ ID NO: 369546 - protein, 19 aa, Mycobacterium
SLIAIVMVVLMASLAIYGV

SEQ ID NO: 369547 - protein, 25 aa, Mycobacterium
SLIFDLGIILVLISLPTLGLWVSIP

SEQ ID NO: 369548 - protein, 22 aa, Mycobacterium
SLIGLVLLFFFGAGEEISWGQR

SEQ ID NO: 369549 - protein, 21 aa, Mycobacterium
SLIISTFFRFVARRLDTRPED

SEQ ID NO: 369550 - protein, 18 aa, Mycobacterium
SLIKAVIFVWIASTIQCY

SEQ ID NO: 369551 - protein, 19 aa, Mycobacterium
SLIKILLILGVVGCVIGLK

SEQ ID NO: 369552 - protein, 21 aa, Mycobacterium
SLILLIMMIITRSLIAALVIV

SEQ ID NO: 369553 - protein, 18 aa, Mycobacterium
SLIPIVLGLLIAVPLGAL

SEQ ID NO: 369554 - protein, 18 aa, Mycobacterium
SLIRLAVLGLVMGPIILG

SEQ ID NO: 369555 - protein, 28 aa, Mycobacterium
SLISLIPYLLLYLWLATTGIVMLRRSVP

SEQ ID NO: 369556 - protein, 25 aa, Mycobacterium
SLKLTRWQSFRLILLPSAMPDIAAG

SEQ ID NO: 369557 - protein, 21 aa, Mycobacterium
SLLAFVALTAGTALFVAAEFS

SEQ ID NO: 369558 - protein, 28 aa, Mycobacterium
SLLAVALGMITFYQPTLLPLCFTPRDAN

SEQ ID NO: 369559 - protein, 25 aa, Mycobacterium
SLLGDPATWIERALVVLVAASPCAL

SEQ ID NO: 369560 - protein, 25 aa, Mycobacterium
SLLGSVSPLIRYLIKVPREFINDYL

SEQ ID NO: 369561 - protein, 33 aa, Mycobacterium
SLLGVFAFVCVLAFVMLLATLRSPVLALKGVVM

SEQ ID NO: 369562 - protein, 23 aa, Mycobacterium
SLLHGWFPLSVQGLTLFLLIIAI

SEQ ID NO: 369563 - protein, 21 aa, Mycobacterium
SLLHGWFPPAVQGLALLVLIV

SEQ ID NO: 369564 - protein, 21 aa, Mycobacterium
SLLIVAVSIPLPWMAVLIAND

SEQ ID NO: 369565 - protein, 20 aa, Mycobacterium
SLLLPVFLVSMDVSVLFLAM

SEQ ID NO: 369566 - protein, 24 aa, Mycobacterium
SLLLPVTGLILLIVGIRKRSAARK

SEQ ID NO: 369567 - protein, 19 aa, Mycobacterium
SLLLWGGVALMVLAWVWLG

SEQ ID NO: 369568 - protein, 19 aa, Mycobacterium
SLLPLFTQAATAATPKFIN

SEQ ID NO: 369569 - protein, 17 aa, Mycobacterium
SLLPPGFSDPMQWGFMQ

SEQ ID NO: 369570 - protein, 19 aa, Mycobacterium
SLLQVTWIYDRAVDLDGLR

SEQ ID NO: 369571 - protein, 22 aa, Mycobacterium
SLLRFIAHPWTALTLLVVGVYG

SEQ ID NO: 369572 - protein, 22 aa, Mycobacterium
SLLRQWSELAGWLRDERKDLRD

SEQ ID NO: 369573 - protein, 17 aa, Mycobacterium
SLLSFVGVLLGAIAGVL

SEQ ID NO: 369574 - protein, 24 aa, Mycobacterium
SLLTGRIFAYFRYRLRSAFLLDTS

SEQ ID NO: 369575 - protein, 18 aa, Mycobacterium
SLLVATALIALLYTALRL

SEQ ID NO: 369576 - protein, 27 aa, Mycobacterium
SLLVGLQLWLFIWGPMHGHALSISLGY

SEQ ID NO: 369577 - protein, 20 aa, Mycobacterium
SLLVGYGCLPWVATAMLTLR

SEQ ID NO: 369578 - protein, 22 aa, Mycobacterium
SLLVIPCLLLSWAVSHPGIPFV

SEQ ID NO: 369579 - protein, 20 aa, Mycobacterium
SLLVLALFLQVRHGLRADHA

SEQ ID NO: 369580 - protein, 17 aa, Mycobacterium
SLLWEGLWTTVLVTVFG

SEQ ID NO: 369581 - protein, 21 aa, Mycobacterium
SLLYLQFRGDLTPATKLTMVA

SEQ ID NO: 369582 - protein, 21 aa, Mycobacterium
SLLYVYGAVIVAGLFTILIAP

SEQ ID NO: 369583 - protein, 20 aa, Mycobacterium
SLMHGWVPTTIQVLAAVVLT

SEQ ID NO: 369584 - protein, 33 aa, Mycobacterium
SLMNVLGQHRLLFLAWLPLSGFLLYAGKLSRRD

SEQ ID NO: 369585 - protein, 25 aa, Mycobacterium
SLMQTLVIPLIPQLPTLLSTSPANA

SEQ ID NO: 369586 - protein, 21 aa, Mycobacterium
SLNLLLFFVIATVATVPLAAF

SEQ ID NO: 369587 - protein, 29 aa, Mycobacterium
SLNPWPALWAMLVGYFMIVLDSTVVMLAN

SEQ ID NO: 369588 - protein, 18 aa, Mycobacterium
SLPAAFSGWLLAGPVAIG

SEQ ID NO: 369589 - protein, 27 aa, Mycobacterium
SLPAALPVAALIPPIIDILGDRIPRDT

SEQ ID NO: 369590 - protein, 25 aa, Mycobacterium
SLPAGPRPWHGPVAVLVAVLCGAAL

SEQ ID NO: 369591 - protein, 25 aa, Mycobacterium
SLPHTIWVTFLLMALSWAVQTPASL

SEQ ID NO: 369592 - protein, 22 aa, Mycobacterium
SLPLLLGVCTVALSVAIVLALS

SEQ ID NO: 369593 - protein, 23 aa, Mycobacterium
SLPPVMLLLLTGQFYTPWSWLPR

SEQ ID NO: 369594 - protein, 24 aa, Mycobacterium
SLPQIWAAFLLFSIGFYVMAGAQG

SEQ ID NO: 369595 - protein, 20 aa, Mycobacterium
SLPRWYWAGLAVATLLGTVF

SEQ ID NO: 369596 - protein, 23 aa, Mycobacterium
SLPSLLIPNVPLNLDTLKIIAPY

SEQ ID NO: 369597 - protein, 17 aa, Mycobacterium
SLPTLGVLLFGTLLFGL

SEQ ID NO: 369598 - protein, 22 aa, Mycobacterium
SLPTVALWALALLITGAGIGIA

SEQ ID NO: 369599 - protein, 22 aa, Mycobacterium
SLPYFVVLAVLAGGSLALCVLW

SEQ ID NO: 369600 - protein, 29 aa, Mycobacterium
SLQACPERPPRPIWLPVLGDPTPVDELVA

SEQ ID NO: 369601 - protein, 18 aa, Mycobacterium
SLQESILLLAIWIGVGFV

SEQ ID NO: 369602 - protein, 26 aa, Mycobacterium
SLQGAAGVPWLLMSGPLGQSDESNTA

SEQ ID NO: 369603 - protein, 19 aa, Mycobacterium
SLQLRVVALTLGLSLAVIL

SEQ ID NO: 369604 - protein, 30 aa, Mycobacterium
SLRAIGRILPLALLLIVVLGVATALLGVVL

SEQ ID NO: 369605 - protein, 19 aa, Mycobacterium
SLRAVPHRSPRRPWLEPLE

SEQ ID NO: 369606 - protein, 17 aa, Mycobacterium
SLRDPMKLPTTPALIVT

SEQ ID NO: 369607 - protein, 22 aa, Mycobacterium
SLRDRVTAYVPLLLTAEDAINA

SEQ ID NO: 369608 - protein, 17 aa, Mycobacterium
SLRGLIAPNWRQRLPNN

SEQ ID NO: 369609 - protein, 18 aa, Mycobacterium
SLRLIPAVPFAALNYGAG

SEQ ID NO: 369610 - protein, 17 aa, Mycobacterium
SLRLLIIGSVVGTILGV

SEQ ID NO: 369611 - protein, 22 aa, Mycobacterium
SLRLRLLVGQIVVLAIVCVGIT

SEQ ID NO: 369612 - protein, 19 aa, Mycobacterium
SLRLRRFDRLPTAPKEIPA

SEQ ID NO: 369613 - protein, 42 aa, Mycobacterium
SLRNKILIILPVALLLSQFVPWLLTPILMLGATYLCFEGAEK

SEQ ID NO: 369614 - protein, 41 aa, Mycobacterium
SLRNKLLIILPAAMLLSQFVPWLLTPILMLGATYLCYEGAE

SEQ ID NO: 369615 - protein, 29 aa, Mycobacterium
SLRPDRNLFVPLAFHLGYHSLPIGNVMPG

SEQ ID NO: 369616 - protein, 20 aa, Mycobacterium
SLRRRWSPDGRPIVGFVGRL

SEQ ID NO: 369617 - protein, 36 aa, Mycobacterium
SLSAFTLIPYALVLLQLRVFYARERAWTPIIVIIVI

SEQ ID NO: 369618 - protein, 31 aa, Mycobacterium
SLSEYLRALRVAILPAPPPPGPAFRTQQEAP

SEQ ID NO: 369619 - protein, 18 aa, Mycobacterium
SLSFLAGWVLGLAALTAA

SEQ ID NO: 369620 - protein, 19 aa, Mycobacterium
SLSFLPSLYGQPAPLGMLR

SEQ ID NO: 369621 - protein, 27 aa, Mycobacterium
SLSGFRIPWRDQVFLSWAGLRGAVPIV

SEQ ID NO: 369622 - protein, 28 aa, Mycobacterium
SLSGTNLLWYIVISVASVLGLGAALTFL

SEQ ID NO: 369623 - protein, 30 aa, Mycobacterium
SLSPVTLSWLLIIYGFTASVLPVWLLLAPR

SEQ ID NO: 369624 - protein, 26 aa, Mycobacterium
SLSQQPWSMFGIPAPLVAFVLGFLVL

SEQ ID NO: 369625 - protein, 20 aa, Mycobacterium
SLSTLWGAPLLGAVFGLGWT

SEQ ID NO: 369626 - protein, 19 aa, Mycobacterium
SLSYFPFVYVPAAATLRRL

SEQ ID NO: 369627 - protein, 21 aa, Mycobacterium
SLTAIQTYPGLPARGIVALCD

SEQ ID NO: 369628 - protein, 17 aa, Mycobacterium
SLTGMLAALPMLSDPPA

SEQ ID NO: 369629 - protein, 17 aa, Mycobacterium
SLTIDQPGIFPILVNVN

SEQ ID NO: 369630 - protein, 25 aa, Mycobacterium
SLTPSLLPRDWLFAGLIGGVNAAIG

SEQ ID NO: 369631 - protein, 25 aa, Mycobacterium
SLTPSLLPRDWLFQGLIGGINAAIG

SEQ ID NO: 369632 - protein, 25 aa, Mycobacterium
SLTSVWLLLGLLAISAVLASYGVVS

SEQ ID NO: 369633 - protein, 20 aa, Mycobacterium
SLTTAVLLLGWRGVALAVSR

SEQ ID NO: 369634 - protein, 30 aa, Mycobacterium
SLTVFTLLYGALAVAWFYLMRRYVVEGPLE

SEQ ID NO: 369635 - protein, 22 aa, Mycobacterium
SLTVIVLALALYRDTRVRLIAE

SEQ ID NO: 369636 - protein, 31 aa, Mycobacterium
SLVAAAGVPVVFLTALYGLSVLAGLRCGERV

SEQ ID NO: 369637 - protein, 33 aa, Mycobacterium
SLVAAAGVPVVFLTAWYGLSVLAGVRAGQKVLV

SEQ ID NO: 369638 - protein, 23 aa, Mycobacterium
SLVAIVCVVLFASLALYGVDPNF

SEQ ID NO: 369639 - protein, 19 aa, Mycobacterium
SLVALAVFLLVSLGITWWQ

SEQ ID NO: 369640 - protein, 19 aa, Mycobacterium
SLVFLAYLAGTWASARAGA

SEQ ID NO: 369641 - protein, 25 aa, Mycobacterium
SLVGPMPWLVLATVSALFPGLFGLL

SEQ ID NO: 369642 - protein, 17 aa, Mycobacterium
SLVHALFVAYLLITIID

SEQ ID NO: 369643 - protein, 23 aa, Mycobacterium
SLVIVLALVAGFVGWKLYQKLTN

SEQ ID NO: 369644 - protein, 18 aa, Mycobacterium
SLVLLGCLLATLGLWRWS

SEQ ID NO: 369645 - protein, 19 aa, Mycobacterium
SLVLSVIIGWVYRYTHKNV

SEQ ID NO: 369646 - protein, 23 aa, Mycobacterium
SLVMVFQWGWAEKLGFPHLSSID

SEQ ID NO: 369647 - protein, 26 aa, Mycobacterium
SLVPAPTVIIVGLPAGLRLAVDNAIA

SEQ ID NO: 369648 - protein, 27 aa, Mycobacterium
SLVPSSTILMLGLPAGLRLVIDNAIKN

SEQ ID NO: 369649 - protein, 26 aa, Mycobacterium
SLVPTLLVSIPFTVLVAFTLNILLRE

SEQ ID NO: 369650 - protein, 32 aa, Mycobacterium
SLVQLVSLWGLQQISWFVPAQWGFAASASTVN

SEQ ID NO: 369651 - protein, 42 aa, Mycobacterium
SLVQSWRTTLARAAALLLLGLGFAAVIVIGGWALSTESSPGK

SEQ ID NO: 369652 - protein, 19 aa, Mycobacterium
SLVRVLAPVFGRDMGLGLG

SEQ ID NO: 369653 - protein, 18 aa, Mycobacterium
SLVSARLIPLFLSQTIMS

SEQ ID NO: 369654 - protein, 18 aa, Mycobacterium
SLVSTPVVIAVTPKLRQA

SEQ ID NO: 369655 - protein, 19 aa, Mycobacterium
SLVTALFLLGWRAVANRVS

SEQ ID NO: 369656 - protein, 25 aa, Mycobacterium
SLVTFSVVVSWWAAALGGTSTAAWD

SEQ ID NO: 369657 - protein, 18 aa, Mycobacterium
SLVTSPVLLAIRPELQQA

SEQ ID NO: 369658 - protein, 19 aa, Mycobacterium
SLVVATRVRRGVWIALPVT

SEQ ID NO: 369659 - protein, 18 aa, Mycobacterium
SLVVFLVALPLSLGIAIA

SEQ ID NO: 369660 - protein, 19 aa, Mycobacterium
SLVVFLVALPLSLGIAIAS

SEQ ID NO: 369661 - protein, 23 aa, Mycobacterium
SLVVLFLVGVVVNLKLLMPVFRW

SEQ ID NO: 369662 - protein, 32 aa, Mycobacterium
SLVVMNWLGLSWRWLFALSIVPALVSLIIRYR

SEQ ID NO: 369663 - protein, 24 aa, Mycobacterium
SLVVVFQWGWLEQLGFPRISSLDS

SEQ ID NO: 369664 - protein, 20 aa, Mycobacterium
SLVVYLFFLKNKSQTYLDRE

SEQ ID NO: 369665 - protein, 17 aa, Mycobacterium
SLVWELLCYLFVAAIGL

SEQ ID NO: 369666 - protein, 17 aa, Mycobacterium
SLVWEVICYLAVAGVGL

SEQ ID NO: 369667 - protein, 18 aa, Mycobacterium
SLVWFCVFGGAAIHEQQN

SEQ ID NO: 369668 - protein, 24 aa, Mycobacterium
SLWAGGLLALLGHALRGGSHTDIA

SEQ ID NO: 369669 - protein, 21 aa, Mycobacterium
SLWRSISQRPVESYNKAWLGA

SEQ ID NO: 369670 - protein, 21 aa, Mycobacterium
SLYRMVITAVPFLLPLQFQLQ

SEQ ID NO: 369671 - protein, 19 aa, Mycobacterium
SMAIALTPLAWVLCSVLVN

SEQ ID NO: 369672 - protein, 20 aa, Mycobacterium
SMAIYISCWWRHLKPASDKP

SEQ ID NO: 369673 - protein, 18 aa, Mycobacterium
SMALLIAQELSRRGREVT

SEQ ID NO: 369674 - protein, 29 aa, Mycobacterium
SMAPYNHFDLGSPLFLEHVWGRQVGDYTI

SEQ ID NO: 369675 - protein, 27 aa, Mycobacterium
SMAVMVLFPMHFLKSFAYAGVATVAFA

SEQ ID NO: 369676 - protein, 17 aa, Mycobacterium
SMCFVLLITGVGSLIHI

SEQ ID NO: 369677 - protein, 24 aa, Mycobacterium
SMDANYRWFHPAPTTLAAAVGSSR

SEQ ID NO: 369678 - protein, 24 aa, Mycobacterium
SMDANYRWFHPAPTTLSAAVGSPR

SEQ ID NO: 369679 - protein, 25 aa, Mycobacterium
SMDYEIFLLTRIRERFLHTGQTRDA

SEQ ID NO: 369680 - protein, 25 aa, Mycobacterium
SMDYEIFLLTRIRERFLHTGRTRDA

SEQ ID NO: 369681 - protein, 19 aa, Mycobacterium
SMDYEIFLLTRIRERFLQT

SEQ ID NO: 369682 - protein, 25 aa, Mycobacterium
SMDYEIFLLTRIRERFLQTGNTRDA

SEQ ID NO: 369683 - protein, 23 aa, Mycobacterium
SMDYEVFLLSRIREFWLGSPQQS

SEQ ID NO: 369684 - protein, 20 aa, Mycobacterium
SMDYEVFLLSRIREYWLASE

SEQ ID NO: 369685 - protein, 24 aa, Mycobacterium
SMDYEVFLLSRIREYWLASGAARP

SEQ ID NO: 369686 - protein, 24 aa, Mycobacterium
SMEEPVTCWQWVKAAGEQQSRTVL

SEQ ID NO: 369687 - protein, 24 aa, Mycobacterium
SMFGPYRLIRPLGRGGMGQVYEAE

SEQ ID NO: 369688 - protein, 20 aa, Mycobacterium
SMFIAAIVVLPFGIPAVPTL

SEQ ID NO: 369689 - protein, 20 aa, Mycobacterium
SMFSSIADFLKPGPRHVLVA

SEQ ID NO: 369690 - protein, 33 aa, Mycobacterium
SMGIALRMFLSFMGSALWRAPSAWIASALGSVS

SEQ ID NO: 369691 - protein, 27 aa, Mycobacterium
SMGLLVSMLIFVIFGLPSAGATVPLEA

SEQ ID NO: 369692 - protein, 33 aa, Mycobacterium
SMGRTFVWAGLWFYPIPIVLGLLGLVGLGFGVT

SEQ ID NO: 369693 - protein, 26 aa, Mycobacterium
SMGTALALLVLLALGAIPGAMLPQRA

SEQ ID NO: 369694 - protein, 19 aa, Mycobacterium
SMGWLRLGALVLVAAALAA

SEQ ID NO: 369695 - protein, 20 aa, Mycobacterium
SMHGPWVGVAAPAENIIALG

SEQ ID NO: 369696 - protein, 19 aa, Mycobacterium
SMHGPWVGVAAPAENIVAL

SEQ ID NO: 369697 - protein, 21 aa, Mycobacterium
SMHGRTPILTPSQPAFAAACG

SEQ ID NO: 369698 - protein, 20 aa, Mycobacterium
SMILFNWFGVCLVPILALIV

SEQ ID NO: 369699 - protein, 31 aa, Mycobacterium
SMIPALQFTNWQWLALTLASPVVVWGALPFH

SEQ ID NO: 369700 - protein, 17 aa, Mycobacterium
SMIPFTIAVLRYAVDVD

SEQ ID NO: 369701 - protein, 21 aa, Mycobacterium
SMIRLMYVTIVIITVMLLIVY

SEQ ID NO: 369702 - protein, 25 aa, Mycobacterium
SMISLTYFPPLWRKVMDHRVLEHYD

SEQ ID NO: 369703 - protein, 25 aa, Mycobacterium
SMISLTYFPPLWRKVMDHRVLEHYG

SEQ ID NO: 369704 - protein, 25 aa, Mycobacterium
SMLGELPWWVTIVILVREFGVTVLR

SEQ ID NO: 369705 - protein, 19 aa, Mycobacterium
SMLGWLFAIVLMDASILGA

SEQ ID NO: 369706 - protein, 44 aa, Mycobacterium
SMLKITGLTFIVIIIMLLFFYRSIFTVLMVLLMVGIQLGAARGM

SEQ ID NO: 369707 - protein, 28 aa, Mycobacterium
SMLKVKMWLFPVLSILTAAAIFAILVQM

SEQ ID NO: 369708 - protein, 21 aa, Mycobacterium
SMLLGIAALALGLVAALFMRP

SEQ ID NO: 369709 - protein, 31 aa, Mycobacterium
SMLLGVVVMLIWWAISPGFFRGRTLRRHSAD

SEQ ID NO: 369710 - protein, 29 aa, Mycobacterium
SMQTKFLIPALWFAVLLSAAVLGPRALLR

SEQ ID NO: 369711 - protein, 18 aa, Mycobacterium
SMRDGLGLRLELKLHDPR

SEQ ID NO: 369712 - protein, 19 aa, Mycobacterium
SMRLVVVPQGVRRVLPALM

SEQ ID NO: 369713 - protein, 17 aa, Mycobacterium
SMRPSRTLIPRYVPELP

SEQ ID NO: 369714 - protein, 22 aa, Mycobacterium
SMRRGNLYPIMAPDTRPADPEL

SEQ ID NO: 369715 - protein, 23 aa, Mycobacterium
SMSRRFAVLVMLLCLFGMLFVLL

SEQ ID NO: 369716 - protein, 33 aa, Mycobacterium
SMTAGRLWFVEVLVWTLIALAALFCIPAMDRLE

SEQ ID NO: 369717 - protein, 30 aa, Mycobacterium
SMTAGRLWFVEVLVWVLVGLALLCATRWGD

SEQ ID NO: 369718 - protein, 27 aa, Mycobacterium
SMTAPKFWWLMTVFAALIALGAYLGGW

SEQ ID NO: 369719 - protein, 19 aa, Mycobacterium
SMTFGWFMGSVAFQFVLWT

SEQ ID NO: 369720 - protein, 29 aa, Mycobacterium
SMTLTLPWTLLVTPLLTSGPFWAYLAAMA

SEQ ID NO: 369721 - protein, 19 aa, Mycobacterium
SMTMVWLAVLLYVKIDEPD

SEQ ID NO: 369722 - protein, 19 aa, Mycobacterium
SMTMVWLSVLLYVKIGEPD

SEQ ID NO: 369723 - protein, 38 aa, Mycobacterium
SMTRRFAVLVLLLCLFGSLVVLLRRGWVGGLARGPAWR

SEQ ID NO: 369724 - protein, 25 aa, Mycobacterium
SMTVLAVFPMYFLKSSAYTVVATAV

SEQ ID NO: 369725 - protein, 21 aa, Mycobacterium
SMTWEILWALILGFTLSAMVQ

SEQ ID NO: 369726 - protein, 25 aa, Mycobacterium
SMVALLTRRWALAWIALAGSTVASF

SEQ ID NO: 369727 - protein, 27 aa, Mycobacterium
SMVALVLIPVLATLAGVLGASGFMISG

SEQ ID NO: 369728 - protein, 23 aa, Mycobacterium
SMVALVLIPVVATFTGVIGASGF

SEQ ID NO: 369729 - protein, 18 aa, Mycobacterium
SMVFGELVPKYLAVARPL

SEQ ID NO: 369730 - protein, 20 aa, Mycobacterium
SMVFVYLQAPVMLGIGRMTV

SEQ ID NO: 369731 - protein, 23 aa, Mycobacterium
SMVKGWYMSFWPIIAIAVITVTS

SEQ ID NO: 369732 - protein, 20 aa, Mycobacterium
SMVMVWLAVLLFVKIGQPDD

SEQ ID NO: 369733 - protein, 23 aa, Mycobacterium
SMVSAVLVILFSSLAIYGKTGNF

SEQ ID NO: 369734 - protein, 21 aa, Mycobacterium
SMVWLSVIVLLPLAAIAWQAA

SEQ ID NO: 369735 - protein, 21 aa, Mycobacterium
SMWTHTGLLIRLALRRDRIRL

SEQ ID NO: 369736 - protein, 26 aa, Mycobacterium
SNAILLIFTVLVIVGYPLILETATRG

SEQ ID NO: 369737 - protein, 23 aa, Mycobacterium
SNAPRLRIFLLTLAVLDDIGALT

SEQ ID NO: 369738 - protein, 22 aa, Mycobacterium
SNATTVLPFHGLYQPQGLAVDG

SEQ ID NO: 369739 - protein, 32 aa, Mycobacterium
SNDIAKYFAIIPALFVGLFPGLDLLNIMRLHS

SEQ ID NO: 369740 - protein, 23 aa, Mycobacterium
SNELLTSLIWIAKGWAIAAVCTL

SEQ ID NO: 369741 - protein, 27 aa, Mycobacterium
SNEVLAFVCIAAAAVGVVLMIIDAIRD

SEQ ID NO: 369742 - protein, 27 aa, Mycobacterium
SNFVNALLLWLIVFASAIVGFLLCGVG

SEQ ID NO: 369743 - protein, 23 aa, Mycobacterium
SNHISWLDVFAIGAVLPGSFVAR

SEQ ID NO: 369744 - protein, 29 aa, Mycobacterium
SNIDATLIRMLIIFGIVTAIALAAATIAG

SEQ ID NO: 369745 - protein, 21 aa, Mycobacterium
SNLDDFFRPIKSYFYWEKHCF

SEQ ID NO: 369746 - protein, 29 aa, Mycobacterium
SNLLMVGEGFVYLIDFGLVHEADATRLTL

SEQ ID NO: 369747 - protein, 30 aa, Mycobacterium
SNLYSQWVPRTLPPGWKPGSLAAPPPVLPD

SEQ ID NO: 369748 - protein, 22 aa, Mycobacterium
SNNPLFRPRFIKRMFFAKFPDD

SEQ ID NO: 369749 - protein, 22 aa, Mycobacterium
SNPFALILVALLGPIAATVVRL

SEQ ID NO: 369750 - protein, 18 aa, Mycobacterium
SNPMLPPEGQRPITPAAF

SEQ ID NO: 369751 - protein, 20 aa, Mycobacterium
SNQIASLPRGPLVGIPGAPS

SEQ ID NO: 369752 - protein, 22 aa, Mycobacterium
SNQSVLPFTGLTAPWGITVDGA

SEQ ID NO: 369753 - protein, 31 aa, Mycobacterium
SNQYFIIPTAHLPLLDPVRAIPVIGPPLAAL

SEQ ID NO: 369754 - protein, 21 aa, Mycobacterium
SNRIPVFVFHPAGGSTVVYEP

SEQ ID NO: 369755 - protein, 24 aa, Mycobacterium
SNRLLMGLGWPVVVLVSIVVARRA

SEQ ID NO: 369756 - protein, 24 aa, Mycobacterium
SNRLLMGLGWPVVVLVSIVVARRS

SEQ ID NO: 369757 - protein, 23 aa, Mycobacterium
SNRSLWRLHIPLGATGIYGGYFG

SEQ ID NO: 369758 - protein, 23 aa, Mycobacterium
SNSIEIPWFRLPAAGEIAPGSWP

SEQ ID NO: 369759 - protein, 43 aa, Mycobacterium
SNTVYLIYGIAILGLPFFILIGLILARQWKLLGAYGAAGVIAI

SEQ ID NO: 369760 - protein, 25 aa, Mycobacterium
SNVARLYISIIRGTPLLVQLFLVFY

SEQ ID NO: 369761 - protein, 17 aa, Mycobacterium
SNVGTLMLAQRLGPEKF

SEQ ID NO: 369762 - protein, 27 aa, Mycobacterium
SNYQTIPLLIVASLWYLVLTAVLSAGQ

SEQ ID NO: 369763 - protein, 25 aa, Mycobacterium
SNYVVAEANLFYLGGRRLAANVLKV

SEQ ID NO: 369764 - protein, 31 aa, Mycobacterium
SPAAGLWAALPPLLVYAILGSSRQLSVGPES

SEQ ID NO: 369765 - protein, 39 aa, Mycobacterium
SPAEPAHPRWWFISTTPGRILTIGIVLAALGGISAFATS

SEQ ID NO: 369766 - protein, 28 aa, Mycobacterium
SPAEPAHPRWWFVSTTPGRILTIGIVLA

SEQ ID NO: 369767 - protein, 29 aa, Mycobacterium
SPAEPAHPRWWFVSTTPGRILTIGIVLAA

SEQ ID NO: 369768 - protein, 22 aa, Mycobacterium
SPAGWVVILLYAVCVVLRLARF

SEQ ID NO: 369769 - protein, 25 aa, Mycobacterium
SPALALLAVIWWLAGAGWAIAAALV

SEQ ID NO: 369770 - protein, 19 aa, Mycobacterium
SPAMLVLVLIMVVDGFFLG

SEQ ID NO: 369771 - protein, 21 aa, Mycobacterium
SPAQIHWYRRHRAMLGVIHEP

SEQ ID NO: 369772 - protein, 25 aa, Mycobacterium
SPAQYWHDFWRGQIGEWIITRGLRI

SEQ ID NO: 369773 - protein, 25 aa, Mycobacterium
SPARRNIIFMALMLGVLVAAMDQTI

SEQ ID NO: 369774 - protein, 31 aa, Mycobacterium
SPARRTRTPWLLAVAVLVVVIVVVGTGIFLA

SEQ ID NO: 369775 - protein, 17 aa, Mycobacterium
SPAWRKLGTAIAKWPAA

SEQ ID NO: 369776 - protein, 28 aa, Mycobacterium
SPDAASGPSWWAAGGIAVVAAALGAAAA

SEQ ID NO: 369777 - protein, 19 aa, Mycobacterium
SPDGPVLPVGRPAGGGHLN

SEQ ID NO: 369778 - protein, 24 aa, Mycobacterium
SPDIPQALWLIGCLVVLVCSLAMI

SEQ ID NO: 369779 - protein, 25 aa, Mycobacterium
SPDPATNLMWLDLIGRRLAEIGDKQ

SEQ ID NO: 369780 - protein, 19 aa, Mycobacterium
SPEQWFAFTPPRVPVLETL

SEQ ID NO: 369781 - protein, 20 aa, Mycobacterium
SPEQWFAFTPPRVPVLETLQ

SEQ ID NO: 369782 - protein, 24 aa, Mycobacterium
SPESYSLPLRRLLGFLAAGLDASL

SEQ ID NO: 369783 - protein, 24 aa, Mycobacterium
SPEVLNLLLIDFKGGATFLDLEKA

SEQ ID NO: 369784 - protein, 24 aa, Mycobacterium
SPFMGWLYNFLPVYTFSALLGVFE

SEQ ID NO: 369785 - protein, 39 aa, Mycobacterium
SPGARTAIRVALIALSGALITGLVVALSGAAWGLSSLRV

SEQ ID NO: 369786 - protein, 19 aa, Mycobacterium
SPGASLPRPAPPASTPTTT

SEQ ID NO: 369787 - protein, 22 aa, Mycobacterium
SPGGIFNPLPKLDDEQAAKMAQ

SEQ ID NO: 369788 - protein, 22 aa, Mycobacterium
SPGLLPAYLPEYRSVPDLSAAA

SEQ ID NO: 369789 - protein, 44 aa, Mycobacterium
SPGSSGRVALLVTLAIILAALAVLLLIMRYRRRRRRAADLAAAR

SEQ ID NO: 369790 - protein, 44 aa, Mycobacterium
SPGSSGRVILLATLAGILIALAGLLLVMRHRGQRRRAAALAAAR

SEQ ID NO: 369791 - protein, 27 aa, Mycobacterium
SPGVILRLMLAWVLSTAVPLLAIVLAV

SEQ ID NO: 369792 - protein, 19 aa, Mycobacterium
SPHMSWLDVFAIGSVLPGS

SEQ ID NO: 369793 - protein, 22 aa, Mycobacterium
SPHQYLLTRRLERAAALLSATD

SEQ ID NO: 369794 - protein, 22 aa, Mycobacterium
SPHSWWPIMIALAAATTAVGVA

SEQ ID NO: 369795 - protein, 23 aa, Mycobacterium
SPHSWWPIMIALSGSITAVGMAM

SEQ ID NO: 369796 - protein, 27 aa, Mycobacterium
SPHTTWVLYAVIIVSALIIAGAIPILL

SEQ ID NO: 369797 - protein, 30 aa, Mycobacterium
SPIRVITRRLAIALVVLFGAAVIVYLDRDG

SEQ ID NO: 369798 - protein, 18 aa, Mycobacterium
SPKPSAPARPAKAAKRPA

SEQ ID NO: 369799 - protein, 34 aa, Mycobacterium
SPLAAVLLLSTVLFFLRWVGLFWSVPSILGGRED

SEQ ID NO: 369800 - protein, 24 aa, Mycobacterium
SPLAHVGFFVLDRSLRPVPAGVVG

SEQ ID NO: 369801 - protein, 19 aa, Mycobacterium
SPLEASTFPAPLQALNTAQ

SEQ ID NO: 369802 - protein, 26 aa, Mycobacterium
SPLLTLFTVVTVPASLWVTRWITRRS

SEQ ID NO: 369803 - protein, 24 aa, Mycobacterium
SPLRGPWLTSVFGLVLLVAMPIVI

SEQ ID NO: 369804 - protein, 22 aa, Mycobacterium
SPLTAALSLMWGWRLAAVCVTV

SEQ ID NO: 369805 - protein, 28 aa, Mycobacterium
SPLVAAGLFYLILTIPLTHLVNYIDARL

SEQ ID NO: 369806 - protein, 28 aa, Mycobacterium
SPMDLLSEWFDELLYRLTAGAAKIPGGW

SEQ ID NO: 369807 - protein, 29 aa, Mycobacterium
SPMLTLLTVVTVPLSLWVTRSIAKRSRKL

SEQ ID NO: 369808 - protein, 25 aa, Mycobacterium
SPNDGSPLLTRVLKHIPGTYGDTGM

SEQ ID NO: 369809 - protein, 19 aa, Mycobacterium
SPNSSAFAVAFHGILRAGA

SEQ ID NO: 369810 - protein, 32 aa, Mycobacterium
SPPAWASWARIVVGSLLILFGIYRWLNRHGEV

SEQ ID NO: 369811 - protein, 20 aa, Mycobacterium
SPPIAWLLAVIAVAAAAAIL

SEQ ID NO: 369812 - protein, 18 aa, Mycobacterium
SPPLDRFVTSLQDTLRRN

SEQ ID NO: 369813 - protein, 24 aa, Mycobacterium
SPPRLRVLPARFVGGVLGIGSGLV

SEQ ID NO: 369814 - protein, 26 aa, Mycobacterium
SPPRWSSWLRVVFGSALIVYGIYKWL

SEQ ID NO: 369815 - protein, 29 aa, Mycobacterium
SPQDNPLNPVQFPKALLLNVTGPISQQFP

SEQ ID NO: 369816 - protein, 30 aa, Mycobacterium
SPQPIPMSTALYDAIPATDPLIIPTIPNAG

SEQ ID NO: 369817 - protein, 37 aa, Mycobacterium
SPRALASLVRSFWQFGPTPAMLLAASAIRFPDRAALI

SEQ ID NO: 369818 - protein, 22 aa, Mycobacterium
SPRHEGLLRSFVPRVGVPAAAR

SEQ ID NO: 369819 - protein, 24 aa, Mycobacterium
SPRKWRKLAITGGAIVVVAILAVT

SEQ ID NO: 369820 - protein, 17 aa, Mycobacterium
SPRPVLFISPSARLARV

SEQ ID NO: 369821 - protein, 39 aa, Mycobacterium
SPRRKWWIAAIVAAFALALLLLAIDPPFSSPPPPAPTTT

SEQ ID NO: 369822 - protein, 24 aa, Mycobacterium
SPSGLPPWIVLPAVFVVVAALMAG

SEQ ID NO: 369823 - protein, 25 aa, Mycobacterium
SPSIEVLIMLRFVQGFAGAAGIVIA

SEQ ID NO: 369824 - protein, 37 aa, Mycobacterium
SPSLADPLYLAFYPFGYAGLLLLMRARLKRVPVGVRL

SEQ ID NO: 369825 - protein, 24 aa, Mycobacterium
SPSLRTFYVGRVRRILPAATAVLI

SEQ ID NO: 369826 - protein, 25 aa, Mycobacterium
SPTAPLHIPLTAGVGLWAFLTRFAL

SEQ ID NO: 369827 - protein, 28 aa, Mycobacterium
SPTAWAAFFVLDEWLRPVPAGVVGELYL

SEQ ID NO: 369828 - protein, 24 aa, Mycobacterium
SPTMTAPIWIAFPPEVHSTLLSSG

SEQ ID NO: 369829 - protein, 24 aa, Mycobacterium
SPTVFFWVLLLNMLCYMPSLSLAI

SEQ ID NO: 369830 - protein, 19 aa, Mycobacterium
SPVAWWRDPWRPPRILVGV

SEQ ID NO: 369831 - protein, 20 aa, Mycobacterium
SPVAYWTVSSIALATALVVF

SEQ ID NO: 369832 - protein, 21 aa, Mycobacterium
SPVLAFVWVVPALNLGGIPPF

SEQ ID NO: 369833 - protein, 24 aa, Mycobacterium
SPVLALLAVIWWLAGTGWAIVTAL

SEQ ID NO: 369834 - protein, 26 aa, Mycobacterium
SPVLLVVGLVWWLLGAGWAMALLVAA

SEQ ID NO: 369835 - protein, 23 aa, Mycobacterium
SPVRAAYRLLPLARRPPPVAYPR

SEQ ID NO: 369836 - protein, 20 aa, Mycobacterium
SPVSWFGRPGSMATIAIVVG

SEQ ID NO: 369837 - protein, 26 aa, Mycobacterium
SPVTNLELYLIFPLNSEDSTIALVRG

SEQ ID NO: 369838 - protein, 23 aa, Mycobacterium
SPVVGIYTLFAYALATGGPPMIW

SEQ ID NO: 369839 - protein, 31 aa, Mycobacterium
SPWAACKIFFSFLWAALRNAPSVWLGGMLSS

SEQ ID NO: 369840 - protein, 20 aa, Mycobacterium
SPWWSWRRRPTVADNFMGLA

SEQ ID NO: 369841 - protein, 30 aa, Mycobacterium
SPYIVYFTPLFDILVRYHWGHEFMAVHFLI

SEQ ID NO: 369842 - protein, 24 aa, Mycobacterium
SPYSSWLVVRWVIASALGGPLLIA

SEQ ID NO: 369843 - protein, 18 aa, Mycobacterium
SPYWSQPEPRWPKSPSQP

SEQ ID NO: 369844 - protein, 28 aa, Mycobacterium
SQAFLAYIMMGWLPQVFIDNGIDKVQAG

SEQ ID NO: 369845 - protein, 24 aa, Mycobacterium
SQAGLWFAVWMPAAFFVYCLGVVA

SEQ ID NO: 369846 - protein, 25 aa, Mycobacterium
SQAVWSMVWWIPLSVLLEFLIGWMW

SEQ ID NO: 369847 - protein, 28 aa, Mycobacterium
SQDDSPPPPRWVWPPLIAVGGVGIVLMA

SEQ ID NO: 369848 - protein, 26 aa, Mycobacterium
SQEFTEPEMWFLRKAHQLCPAGVVVA

SEQ ID NO: 369849 - protein, 25 aa, Mycobacterium
SQFAGAWLDYVLRKGWPLLASDNTK

SEQ ID NO: 369850 - protein, 25 aa, Mycobacterium
SQFTIAFMTVILLGAGTDYSVFLIS

SEQ ID NO: 369851 - protein, 29 aa, Mycobacterium
SQFYDYLHGWWGLAIALVLGLAGGIGQLA

SEQ ID NO: 369852 - protein, 22 aa, Mycobacterium
SQGLAFILFFIGVKLVLHALHE

SEQ ID NO: 369853 - protein, 23 aa, Mycobacterium
SQGRPARIIPAVGLVGCVIVSLA

SEQ ID NO: 369854 - protein, 37 aa, Mycobacterium
SQGSQYYLIVFLSGTLPLVYLVYRSGWRWSDPEDRPG

SEQ ID NO: 369855 - protein, 30 aa, Mycobacterium
SQIAALALPGLAGILLLTGAGGLLGYRQAK

SEQ ID NO: 369856 - protein, 20 aa, Mycobacterium
SQIPVFVFHPAGGSTVVYEP

SEQ ID NO: 369857 - protein, 17 aa, Mycobacterium
SQITNKALWALGVFLVL

SEQ ID NO: 369858 - protein, 22 aa, Mycobacterium
SQLFDFYVLFVRGTPLLVQIFA

SEQ ID NO: 369859 - protein, 26 aa, Mycobacterium
SQLLGCTPVGPLGWAQGLGTATAAVL

SEQ ID NO: 369860 - protein, 41 aa, Mycobacterium
SQLLVLAAVLISLLFGWPWWAALLIAIVSLALVLGRWGGQT

SEQ ID NO: 369861 - protein, 18 aa, Mycobacterium
SQLPLGQTIGIPGAPYAT

SEQ ID NO: 369862 - protein, 19 aa, Mycobacterium
SQLSLGCVAVLLVAGVVGA

SEQ ID NO: 369863 - protein, 17 aa, Mycobacterium
SQLSWPIAVAVGPALTY

SEQ ID NO: 369864 - protein, 17 aa, Mycobacterium
SQLVFSGGMIWVTDRIL

SEQ ID NO: 369865 - protein, 25 aa, Mycobacterium
SQNQAYGYLFPHGTFFLTGHLLGIP

SEQ ID NO: 369866 - protein, 30 aa, Mycobacterium
SQPDFYLMWTEGLARLWPAWELYVWGHTVP

SEQ ID NO: 369867 - protein, 25 aa, Mycobacterium
SQPIGLLPFLIQAPHLFAGSFKLGY

SEQ ID NO: 369868 - protein, 31 aa, Mycobacterium
SQPSSRASLWLPYLPVLLAIVVGAVHFWPAD

SEQ ID NO: 369869 - protein, 25 aa, Mycobacterium
SQPTNWWPPHWYPQNYWTATRQIPF

SEQ ID NO: 369870 - protein, 18 aa, Mycobacterium
SQQVILDRDLQLVVNSLW

SEQ ID NO: 369871 - protein, 41 aa, Mycobacterium
SQQWEFLDLPRLWQILLTVGLFLWIAIIWRGIRGKLKGASK

SEQ ID NO: 369872 - protein, 38 aa, Mycobacterium
SQQWEYLDLPRLFQILLIIGMFVWIAIIFRGMRARLKG

SEQ ID NO: 369873 - protein, 38 aa, Mycobacterium
SQQWEYLDLPRLWQILLIVGMFVWIAIIFRGMRARLKG

SEQ ID NO: 369874 - protein, 25 aa, Mycobacterium
SQRFLPRLVILVVVALIITAVVYGA

SEQ ID NO: 369875 - protein, 24 aa, Mycobacterium
SQRSQPFIDVLLRTQSKSVGTVTE

SEQ ID NO: 369876 - protein, 23 aa, Mycobacterium
SQSFLERWLLTLSNAGILVVTLV

SEQ ID NO: 369877 - protein, 26 aa, Mycobacterium
SQSGSLVTWWTGDALLVFDSGKLTQR

SEQ ID NO: 369878 - protein, 23 aa, Mycobacterium
SQSLLLPALIALLGVGAALFMSD

SEQ ID NO: 369879 - protein, 27 aa, Mycobacterium
SQTEFNVSLPWTKAVILNPGIQNPSVV

SEQ ID NO: 369880 - protein, 23 aa, Mycobacterium
SQTIVPLPWVIQAPRLFAGQIDF

SEQ ID NO: 369881 - protein, 18 aa, Mycobacterium
SQTVLPFNGLKNPDGVAV

SEQ ID NO: 369882 - protein, 25 aa, Mycobacterium
SQVFAWLTLVFGVGFSMLALMTRRW

SEQ ID NO: 369883 - protein, 32 aa, Mycobacterium
SQVLVLSASDLSYRFVLPTTTKPLGPGTNMAG

SEQ ID NO: 369884 - protein, 21 aa, Mycobacterium
SQWLDIAVLAVAFIAAVSGWR

SEQ ID NO: 369885 - protein, 21 aa, Mycobacterium
SQWLDVAVLAVAFIAAVSGWR

SEQ ID NO: 369886 - protein, 19 aa, Mycobacterium
SQWVYALQALAGDSTDAAP

SEQ ID NO: 369887 - protein, 21 aa, Mycobacterium
SRAFDTFGETFLLLAAVVAVL

SEQ ID NO: 369888 - protein, 20 aa, Mycobacterium
SRAGLFYVPLAVVAAVCAFA

SEQ ID NO: 369889 - protein, 23 aa, Mycobacterium
SRAHLLLRFDQGRWLAIDNNSLN

SEQ ID NO: 369890 - protein, 23 aa, Mycobacterium
SRALRGFLFLSTGARVQYMHIND

SEQ ID NO: 369891 - protein, 24 aa, Mycobacterium
SRALWAALFESLLTDRNAPVRLDS

SEQ ID NO: 369892 - protein, 31 aa, Mycobacterium
SRARLMRLMRPLILLPLVLPPVVGGIALLYA

SEQ ID NO: 369893 - protein, 32 aa, Mycobacterium
SRARRVFMIGAVSVLVVLALVGGYFGLRKAGV

SEQ ID NO: 369894 - protein, 29 aa, Mycobacterium
SRAVAIAWRRSLQLRVVALTLGLSLAVIL

SEQ ID NO: 369895 - protein, 29 aa, Mycobacterium
SRAVAVAWRRSLQLRVVALTLGLSLAVIL

SEQ ID NO: 369896 - protein, 38 aa, Mycobacterium
SRAVLTGALILVTGLVGCFIFSLFRPGGVPGNNAILAD

SEQ ID NO: 369897 - protein, 28 aa, Mycobacterium
SRDPAQLWVLIFALTMMAGLVVSLVIKR

SEQ ID NO: 369898 - protein, 24 aa, Mycobacterium
SRERIIMTTFLIGGLLAGAAALLY

SEQ ID NO: 369899 - protein, 27 aa, Mycobacterium
SRERLWQTIGFLSLVALLFMVATIRDE

SEQ ID NO: 369900 - protein, 18 aa, Mycobacterium
SRESLFWVSDNGVRFGIA

SEQ ID NO: 369901 - protein, 27 aa, Mycobacterium
SRFGRVLAVVILLLSAATYALGVIWRG

SEQ ID NO: 369902 - protein, 26 aa, Mycobacterium
SRFMAAYFSLPLFVLGNMPGLTYAVF

SEQ ID NO: 369903 - protein, 34 aa, Mycobacterium
SRFWTRWVGWVMHRPWITALSASVVLLLMAAPAA

SEQ ID NO: 369904 - protein, 32 aa, Mycobacterium
SRGIHPAILSKGGLGPALRALARRCPVPVDLE

SEQ ID NO: 369905 - protein, 43 aa, Mycobacterium
SRGLLAVGDVFRRSWKWLSVVGLVAILVICVGYVMFGTLKVNP

SEQ ID NO: 369906 - protein, 18 aa, Mycobacterium
SRGLVPLALMVFGFGMVI

SEQ ID NO: 369907 - protein, 34 aa, Mycobacterium
SRGNQFVMPDLSGMFWTDAEPRLRALGWTGVLDK

SEQ ID NO: 369908 - protein, 27 aa, Mycobacterium
SRGTPTLALLFIAVGLRFIATTLGEGL

SEQ ID NO: 369909 - protein, 19 aa, Mycobacterium
SRHHAFLTLTPLGTEIRDA

SEQ ID NO: 369910 - protein, 18 aa, Mycobacterium
SRHHAFLTPTPVGTEIND

SEQ ID NO: 369911 - protein, 18 aa, Mycobacterium
SRHHAFLTQTPLGTEIRD

SEQ ID NO: 369912 - protein, 18 aa, Mycobacterium
SRHHALLLPTPGGLEIQD

SEQ ID NO: 369913 - protein, 31 aa, Mycobacterium
SRHLMVLTGLALLIWVPAIRCPAGVAVVAGV

SEQ ID NO: 369914 - protein, 18 aa, Mycobacterium
SRIALHRLIELAGRDVNP

SEQ ID NO: 369915 - protein, 23 aa, Mycobacterium
SRIFVWLAMIFGVGFSMLALLTR

SEQ ID NO: 369916 - protein, 26 aa, Mycobacterium
SRIKPTLLGVLPWRWGDPQARLLKPW

SEQ ID NO: 369917 - protein, 18 aa, Mycobacterium
SRILLINQFGINVGFYML

SEQ ID NO: 369918 - protein, 32 aa, Mycobacterium
SRIPQLIQVWLLELFFVMPLTFFIGKVIDIHG

SEQ ID NO: 369919 - protein, 19 aa, Mycobacterium
SRLGAFFMALTGAVAVVVG

SEQ ID NO: 369920 - protein, 29 aa, Mycobacterium
SRLPLVCCLVAFILTFFITRTIVRYIRSQ

SEQ ID NO: 369921 - protein, 18 aa, Mycobacterium
SRLRRFVFPMTAFFLVWY

SEQ ID NO: 369922 - protein, 17 aa, Mycobacterium
SRLRRFVFPMTAVFLVW

SEQ ID NO: 369923 - protein, 24 aa, Mycobacterium
SRLSTWGPWVSVGAAALCGVCALL

SEQ ID NO: 369924 - protein, 23 aa, Mycobacterium
SRLTGFARIVLLAAILGAALSSA

SEQ ID NO: 369925 - protein, 24 aa, Mycobacterium
SRLVAYARPGLAPVGLAVGLVAGA

SEQ ID NO: 369926 - protein, 18 aa, Mycobacterium
SRLYAWVTTLYLVGSVVA

SEQ ID NO: 369927 - protein, 19 aa, Mycobacterium
SRLYAWVTTLYLVGSVVAA

SEQ ID NO: 369928 - protein, 18 aa, Mycobacterium
SRLYAWVTTLYLVGSVVS

SEQ ID NO: 369929 - protein, 31 aa, Mycobacterium
SRMLVAAAILTAFFFVELITALMINSIALLA

SEQ ID NO: 369930 - protein, 33 aa, Mycobacterium
SRNLRRFRWLVFTGWFLALVPAIYLAMTQSGNL

SEQ ID NO: 369931 - protein, 23 aa, Mycobacterium
SRNRLTLAILLGSPVLVTVMMAT

SEQ ID NO: 369932 - protein, 34 aa, Mycobacterium
SRNRMAFLAALLFTLALCWATTNGWWYVSSYGVP

SEQ ID NO: 369933 - protein, 27 aa, Mycobacterium
SRNRMAFLAAVLFLMALCFATTNGWWY

SEQ ID NO: 369934 - protein, 23 aa, Mycobacterium
SRNVWLWVNWGLALATVPAAAIV

SEQ ID NO: 369935 - protein, 22 aa, Mycobacterium
SRPALFTVLIAVTALSLLAVAV

SEQ ID NO: 369936 - protein, 46 aa, Mycobacterium
SRPRRRRPHPKSSWAAVLAWVVLPSLALLLAITAGVLRWQYDTMRY

SEQ ID NO: 369937 - protein, 26 aa, Mycobacterium
SRQLDPFNPVQFPAALLLNVTNPIRA

SEQ ID NO: 369938 - protein, 33 aa, Mycobacterium
SRQSLLCIYLSGILLVGLLLNSLFGFSWADHVV

SEQ ID NO: 369939 - protein, 18 aa, Mycobacterium
SRQWKLLGAYAAAAIMAV

SEQ ID NO: 369940 - protein, 17 aa, Mycobacterium
SRRAAVVLIFSMAGFAI

SEQ ID NO: 369941 - protein, 24 aa, Mycobacterium
SRRAAVVLIFSMLGFAIAVLQDPV

SEQ ID NO: 369942 - protein, 34 aa, Mycobacterium
SRRERRTWLRRVLLAFPLGLVAMASTMFFGAYPW

SEQ ID NO: 369943 - protein, 21 aa, Mycobacterium
SRRFWRRSGVNIVRRPKAHLL

SEQ ID NO: 369944 - protein, 18 aa, Mycobacterium
SRRHAFLVQTALGTEIRD

SEQ ID NO: 369945 - protein, 27 aa, Mycobacterium
SRRHPMRLLLPFFAVAFGLNVAVGAAV

SEQ ID NO: 369946 - protein, 24 aa, Mycobacterium
SRRMPRRFHLRSVLLAAVTAVAGF

SEQ ID NO: 369947 - protein, 31 aa, Mycobacterium
SRRNLALYVTALLFILAWATSGLNGWFYVGN

SEQ ID NO: 369948 - protein, 30 aa, Mycobacterium
SRRNLALYVTALLFILAWSTSGINGWFYVG

SEQ ID NO: 369949 - protein, 29 aa, Mycobacterium
SRRNLALYVTALLFVLAWATSGINGWFYN

SEQ ID NO: 369950 - protein, 28 aa, Mycobacterium
SRRNLTLYVTALLFVLAWATSGINGWFY

SEQ ID NO: 369951 - protein, 24 aa, Mycobacterium
SRRQPRWRTAVFASAAAIAVGLGA

SEQ ID NO: 369952 - protein, 25 aa, Mycobacterium
SRRRVRGLTRMRLGAAVVGAAAAAA

SEQ ID NO: 369953 - protein, 28 aa, Mycobacterium
SRRVATVLFLIPTALLFAGLIVPRVFDI

SEQ ID NO: 369954 - protein, 20 aa, Mycobacterium
SRRYPRFPGSRPGDLEPGSA

SEQ ID NO: 369955 - protein, 26 aa, Mycobacterium
SRSAQIPFHRWLPATLAAPTPVSALL

SEQ ID NO: 369956 - protein, 42 aa, Mycobacterium
SRSPTTPAHPRWWFLWTTPGRILTIGLVLSALVIASAFATST

SEQ ID NO: 369957 - protein, 20 aa, Mycobacterium
SRSQWFLRQLKALGAAEFPR

SEQ ID NO: 369958 - protein, 23 aa, Mycobacterium
SRSQWMRANLRHDFPASLVVFLV

SEQ ID NO: 369959 - protein, 24 aa, Mycobacterium
SRTAPALDLDLLLGGLKPVTQGLN

SEQ ID NO: 369960 - protein, 17 aa, Mycobacterium
SRTFGPIVGWLGGWGII

SEQ ID NO: 369961 - protein, 17 aa, Mycobacterium
SRTFSDALPWLAAQIRT

SEQ ID NO: 369962 - protein, 23 aa, Mycobacterium
SRTPLLLIMFAALMAGAGNGISI

SEQ ID NO: 369963 - protein, 19 aa, Mycobacterium
SRVAGGVRAAFGFSLDDVV

SEQ ID NO: 369964 - protein, 24 aa, Mycobacterium
SRVALFWVAFILTRPLGATVGDFI

SEQ ID NO: 369965 - protein, 25 aa, Mycobacterium
SRVFTWLALVFSVGFSVLALLTRRW

SEQ ID NO: 369966 - protein, 24 aa, Mycobacterium
SRVIRPAPPPPPPDHRARDIAIGF

SEQ ID NO: 369967 - protein, 18 aa, Mycobacterium
SRVLQLDRLLRLKVFPLA

SEQ ID NO: 369968 - protein, 28 aa, Mycobacterium
SRVLTRLLSFALTALTLVAASLAGAGAA

SEQ ID NO: 369969 - protein, 23 aa, Mycobacterium
SRVMLTGIVLWMLAAYPAFAGIR

SEQ ID NO: 369970 - protein, 19 aa, Mycobacterium
SRVRRLIEPALVVSTVGLL

SEQ ID NO: 369971 - protein, 25 aa, Mycobacterium
SRVSQLPNIIAIRGLTRPNGEPLEQ

SEQ ID NO: 369972 - protein, 27 aa, Mycobacterium
SRVTNLELYLIFPLANEQATIALVRGT

SEQ ID NO: 369973 - protein, 24 aa, Mycobacterium
SRVWAAFLWCLPVSPVLFSLTLLG

SEQ ID NO: 369974 - protein, 19 aa, Mycobacterium
SRWILVNLRHDVPASLVVF

SEQ ID NO: 369975 - protein, 18 aa, Mycobacterium
SRWRIQDLIILTLGTHKL

SEQ ID NO: 369976 - protein, 22 aa, Mycobacterium
SSAAFPLIPDLGSAFTDLPGAP

SEQ ID NO: 369977 - protein, 25 aa, Mycobacterium
SSAAPLFHNIASWLLRRENVPLSAD

SEQ ID NO: 369978 - protein, 26 aa, Mycobacterium
SSADQFLDWLNDLIYRMLQKTATVPG

SEQ ID NO: 369979 - protein, 36 aa, Mycobacterium
SSAISAMLIYRLISWLLIAAVGWVVFFFVFRTENVD

SEQ ID NO: 369980 - protein, 32 aa, Mycobacterium
SSALAFTIGALLPLIAILVPPTTARVPVTVVA

SEQ ID NO: 369981 - protein, 19 aa, Mycobacterium
SSALLAWLTAAAVAIAMLT

SEQ ID NO: 369982 - protein, 21 aa, Mycobacterium
SSALMWLVDLLLVVPSFLLIA

SEQ ID NO: 369983 - protein, 35 aa, Mycobacterium
SSALSFAIGALLPLIAILAPPTTWRIPVTMVAVLM

SEQ ID NO: 369984 - protein, 25 aa, Mycobacterium
SSANILMLVLLLAGFGWMISSRMVR

SEQ ID NO: 369985 - protein, 33 aa, Mycobacterium
SSAPYLAHALGFRPLLGILVAALIGGAALVASS

SEQ ID NO: 369986 - protein, 25 aa, Mycobacterium
SSASCALLMLLTARRRGKALASLGV

SEQ ID NO: 369987 - protein, 22 aa, Mycobacterium
SSATQLLLGPVVRGTTVSLAKE

SEQ ID NO: 369988 - protein, 22 aa, Mycobacterium
SSAVLILMLDSFLFSLISGNQT

SEQ ID NO: 369989 - protein, 17 aa, Mycobacterium
SSCHALKVLLEPTSPRG

SEQ ID NO: 369990 - protein, 25 aa, Mycobacterium
SSDGTVRIWNPLGSQPLLGHTAAVR

SEQ ID NO: 369991 - protein, 27 aa, Mycobacterium
SSDPRALAVLNLLVALGLLTMAPPMAR

SEQ ID NO: 369992 - protein, 36 aa, Mycobacterium
SSDQKWRPYYLGNPVYAFLLMVLFQYGVALHEMESE

SEQ ID NO: 369993 - protein, 22 aa, Mycobacterium
SSDQWFAFTPPRVPVLQSLQQL

SEQ ID NO: 369994 - protein, 18 aa, Mycobacterium
SSDQWLAFTPPRVPTLKT

SEQ ID NO: 369995 - protein, 31 aa, Mycobacterium
SSEQIMPLLVVSLMLQLVLAGGLVPVTNRLF

SEQ ID NO: 369996 - protein, 19 aa, Mycobacterium
SSEQWFAFTPPRVPVLETL

SEQ ID NO: 369997 - protein, 25 aa, Mycobacterium
SSERPYLLVLALVAVLSFAASLLAT

SEQ ID NO: 369998 - protein, 33 aa, Mycobacterium
SSETLPMMLAPWVLLPTILALRATSERPLRTLA

SEQ ID NO: 369999 - protein, 30 aa, Mycobacterium; identical to SEQ ID NO: 163766

SEQ ID NO: 370000 - protein, 31 aa, Mycobacterium
SSETLPMMLAPWVLLPVILALQGGSGGVGRA

SEQ ID NO: 370001 - protein, 30 aa, Mycobacterium
SSETLPMMLAPWVLLPVILALRGQHSVRLM

SEQ ID NO: 370002 - protein, 41 aa, Mycobacterium
SSFAIALVPLVWLLWVVIERGWYAIIRVDWWTHSLRGVLPE

SEQ ID NO: 370003 - protein, 34 aa, Mycobacterium
SSFAMFAIGALLPLIPYLLGFGSLVAGLACGGAG

SEQ ID NO: 370004 - protein, 34 aa, Mycobacterium
SSFAMFAIGAVMPLIPYLLGFGSLSAGLIFGGAG

SEQ ID NO: 370005 - protein, 39 aa, Mycobacterium
SSFGHWIRRCLSRWRSIVLMLLLISTIGSAAGLFYFQYR

SEQ ID NO: 370006 - protein, 22 aa, Mycobacterium
SSFGVLIYYAIANAAAYTLAGR

SEQ ID NO: 370007 - protein, 36 aa, Mycobacterium
SSFVMFAVGAIIPLIPYLLGFESLWGGLACGGVGLL

SEQ ID NO: 370008 - protein, 25 aa, Mycobacterium
SSGAIILFVYLLIAISQIVLRYRTP

SEQ ID NO: 370009 - protein, 18 aa, Mycobacterium
SSGPWLPLAVLICVAWGV

SEQ ID NO: 370010 - protein, 21 aa, Mycobacterium
SSGVLLLWSWLAMSLAQGYYS

SEQ ID NO: 370011 - protein, 24 aa, Mycobacterium
SSHTSLMHGWLPTTIQLVAAVVLT

SEQ ID NO: 370012 - protein, 24 aa, Mycobacterium
SSIALVIGSLLWRAVNRRFGVRGM

SEQ ID NO: 370013 - protein, 20 aa, Mycobacterium
SSISQHRRWRDVRPALRLRC

SEQ ID NO: 370014 - protein, 23 aa, Mycobacterium
SSIVVTFLILMRQGYRWTRTILT

SEQ ID NO: 370015 - protein, 25 aa, Mycobacterium
SSLCLIFIIMLVITRSLAAAVVIVG

SEQ ID NO: 370016 - protein, 22 aa, Mycobacterium
SSLIASSFLGLRHLWAGSPETP

SEQ ID NO: 370017 - protein, 24 aa, Mycobacterium
SSLLRFIAHPWTALTLLVVGVYGL

SEQ ID NO: 370018 - protein, 23 aa, Mycobacterium
SSLVVFLIALPLSVGIAIASDAP

SEQ ID NO: 370019 - protein, 34 aa, Mycobacterium
SSLVVMNWLGLSWRWLFGLSIIPALISLIIRYRV

SEQ ID NO: 370020 - protein, 19 aa, Mycobacterium
SSMLAGLPTITQLPAILSQ

SEQ ID NO: 370021 - protein, 48 aa, Mycobacterium
SSMLTLVAVLAMMLSISPLLAVITLATVPLSLWVTRTIARRSQRLFVA

SEQ ID NO: 370022 - protein, 43 aa, Mycobacterium
SSMRFVEALTFLVITIMLVLFFRSIVTTLLILVMVGLSLMTVR

SEQ ID NO: 370023 - protein, 29 aa, Mycobacterium
SSPAMVSPPPMFPWMSPTPQQAPTQLPGC

SEQ ID NO: 370024 - protein, 19 aa, Mycobacterium
SSPRLVLNPMAGRQWEALA

SEQ ID NO: 370025 - protein, 20 aa, Mycobacterium
SSPVTSFPALPAPLSVGDEG

SEQ ID NO: 370026 - protein, 32 aa, Mycobacterium
SSPVYIAIYFGLIIFFTYFYVSITFNPEERAD

SEQ ID NO: 370027 - protein, 24 aa, Mycobacterium
SSPYTLKIMTWAALVFAPLVVVYQ

SEQ ID NO: 370028 - protein, 23 aa, Mycobacterium
SSQLLDIIDERYILSWQGWETVP

SEQ ID NO: 370029 - protein, 23 aa, Mycobacterium
SSQLLLLPQLVLVLLSTGIAPAE

SEQ ID NO: 370030 - protein, 23 aa, Mycobacterium
SSQPVALLPLAFVQGALSFAVGS

SEQ ID NO: 370031 - protein, 28 aa, Mycobacterium
SSQVANLELYLIFPLKNEQATIQLVRGT

SEQ ID NO: 370032 - protein, 28 aa, Mycobacterium
SSQVANLELYLIFPLKNEQATITLVRGT

SEQ ID NO: 370033 - protein, 30 aa, Mycobacterium
SSRGWRRIGVSVVRWPGPVLAATLALALVG

SEQ ID NO: 370034 - protein, 28 aa, Mycobacterium
SSRLVNFLIVAAWIAVAVIANLAVVLAP

SEQ ID NO: 370035 - protein, 19 aa, Mycobacterium
SSRPLLALSLLECNFGGLL

SEQ ID NO: 370036 - protein, 20 aa, Mycobacterium
SSRRAMVVLAFTIVGFTIAG

SEQ ID NO: 370037 - protein, 18 aa, Mycobacterium
SSRRILWTQFGLHLSWVA

SEQ ID NO: 370038 - protein, 26 aa, Mycobacterium
SSRRMWAIPLVVIGIVGIGGALLVRR

SEQ ID NO: 370039 - protein, 28 aa, Mycobacterium
SSRVANLELYLIFPLANEQATITLVRGT

SEQ ID NO: 370040 - protein, 33 aa, Mycobacterium
SSSAFLQWGWRVPFLLSALLIAFALYVRLEINE

SEQ ID NO: 370041 - protein, 18 aa, Mycobacterium
SSSFVFRHRTGNLAILAV

SEQ ID NO: 370042 - protein, 17 aa, Mycobacterium
SSSGRVTLLVALGVIVV

SEQ ID NO: 370043 - protein, 18 aa, Mycobacterium
SSSLVAIHWAMASLRSGE

SEQ ID NO: 370044 - protein, 24 aa, Mycobacterium
SSSRLPLAAAAVAGVLALVVALLV

SEQ ID NO: 370045 - protein, 27 aa, Mycobacterium
SSTAINVLLIRLGVTGAFLAIMIIDGR

SEQ ID NO: 370046 - protein, 23 aa, Mycobacterium
SSTALAAMLLLSGLILNPFLPES

SEQ ID NO: 370047 - protein, 39 aa, Mycobacterium
SSTFTRFWTVSFPVVAYRTWRWWLATAAAFFAVVVVIAL

SEQ ID NO: 370048 - protein, 40 aa, Mycobacterium
SSTFVRFWTVSFPVVAYRAWRWWLATAVAFFAVAALVGFW

SEQ ID NO: 370049 - protein, 32 aa, Mycobacterium
SSTGLFCDLGWFGVWAILDAVVPRGSAASALI

SEQ ID NO: 370050 - protein, 25 aa, Mycobacterium
SSTGLTPIAPGRPPAAQPVASLPAG

SEQ ID NO: 370051 - protein, 17 aa, Mycobacterium
SSTLEFWGLTNNVPLTL

SEQ ID NO: 370052 - protein, 23 aa, Mycobacterium
SSTPPPRTPTLSAPVRGADGLGF

SEQ ID NO: 370053 - protein, 28 aa, Mycobacterium
SSTVDIVYQFLPVLIANGYHMVTVSHLL

SEQ ID NO: 370054 - protein, 18 aa, Mycobacterium
SSVALIWFGGLRIDAGQM

SEQ ID NO: 370055 - protein, 33 aa, Mycobacterium
SSVGRLWMCAAILVPLGRLLWITIKNYHYRHDR

SEQ ID NO: 370056 - protein, 22 aa, Mycobacterium
SSVHYLLDVLRRIATDFDRSQR

SEQ ID NO: 370057 - protein, 21 aa, Mycobacterium
SSVHYLLDVLRRIATDFDRTQ

SEQ ID NO: 370058 - protein, 19 aa, Mycobacterium
SSVHYLLDVLRRVAIDFDR

SEQ ID NO: 370059 - protein, 25 aa, Mycobacterium
SSVPNLELYLIFPLNNEESTIALVR

SEQ ID NO: 370060 - protein, 25 aa, Mycobacterium
SSVPRRAIAAIPTWSTLEVQQGAHK

SEQ ID NO: 370061 - protein, 29 aa, Mycobacterium
SSVRALVWSQVGIGAAVLLVLGVVGYVVV

SEQ ID NO: 370062 - protein, 43 aa, Mycobacterium
STAALITLLVTALWVLAVVARPYRWWRLGLVIACGLAYVAIFS

SEQ ID NO: 370063 - protein, 24 aa, Mycobacterium
STAAPLLVVWVIAAALHVAVGSVT

SEQ ID NO: 370064 - protein, 30 aa, Mycobacterium
STAAVAAVTLLYLAYLRRQTRIEEQVRRRR

SEQ ID NO: 370065 - protein, 21 aa, Mycobacterium
STAAYWIAGLAAILLGLSPKV

SEQ ID NO: 370066 - protein, 26 aa, Mycobacterium
STAFAFFGWHWSLPLGVAILLAAVGG

SEQ ID NO: 370067 - protein, 30 aa, Mycobacterium
STALPAGRWLLAVLAVWSLYRLATRSHATA

SEQ ID NO: 370068 - protein, 31 aa, Mycobacterium
STARAVVGVQLLFSLLFTPAIRLTNGVANWI

SEQ ID NO: 370069 - protein, 31 aa, Mycobacterium
STARLVRLLRPLILLPLVLPPVVGGIALLYA

SEQ ID NO: 370070 - protein, 34 aa, Mycobacterium
STASIWMRLPDLICSVICWLLLSREVLPRLGPAV

SEQ ID NO: 370071 - protein, 24 aa, Mycobacterium
STASVWMRLPTLAMGLLCWAVISR

SEQ ID NO: 370072 - protein, 24 aa, Mycobacterium
STASWLAWVLALAVAAAPILFVAM

SEQ ID NO: 370073 - protein, 27 aa, Mycobacterium
STAVPPLPPVSLLPRRNPGSSGIADVP

SEQ ID NO: 370074 - protein, 23 aa, Mycobacterium
STAWPFLTGTILGWLVARGWRRP

SEQ ID NO: 370075 - protein, 24 aa, Mycobacterium
STDAFRRFHTALYTPELQPQENSG

SEQ ID NO: 370076 - protein, 32 aa, Mycobacterium
STDGIYSLLIMTLLPVLVALDISSRRAAVVLA

SEQ ID NO: 370077 - protein, 33 aa, Mycobacterium
STDGVYPLLIMAMLPVLLGLDVSSRRAAVVLIF

SEQ ID NO: 370078 - protein, 25 aa, Mycobacterium
STDLLWSFLTVIAAAIAIMLVHTHY

SEQ ID NO: 370079 - protein, 33 aa, Mycobacterium
STEALIEWAWRLPFLMSLILVGLALYVHVKLED

SEQ ID NO: 370080 - protein, 33 aa, Mycobacterium
STELAFFVFNMKITPGPLWATWSAATALTLFGT

SEQ ID NO: 370081 - protein, 18 aa, Mycobacterium
STELLPGWTSAVDRDTAK

SEQ ID NO: 370082 - protein, 28 aa, Mycobacterium
STFAPGLPPGPPFPPGPGPQLPGPFITP

SEQ ID NO: 370083 - protein, 17 aa, Mycobacterium
STFAVLIVTCTAPWMVV

SEQ ID NO: 370084 - protein, 25 aa, Mycobacterium
STFGPAVFLWFVGIGGLTVVMSGGI

SEQ ID NO: 370085 - protein, 25 aa, Mycobacterium
STFHEPFVMMGYLAAVTSLELVTGV

SEQ ID NO: 370086 - protein, 26 aa, Mycobacterium
STFHEPFVVFGYLAALTSLELVTGVI

SEQ ID NO: 370087 - protein, 20 aa, Mycobacterium
STFLLLATYALVSVAAVAFA

SEQ ID NO: 370088 - protein, 39 aa, Mycobacterium
STFLNPVDLLWSFLQAILMAIAILLVHTYFGFFAAGGPS

SEQ ID NO: 370089 - protein, 22 aa, Mycobacterium
STFVFIGAVVYIMAAPRGREDP

SEQ ID NO: 370090 - protein, 25 aa, Mycobacterium
STGRDWWWAAALGVLGTGLLGGSAL

SEQ ID NO: 370091 - protein, 20 aa, Mycobacterium
STGSWRLMLGLAAVPAALVL

SEQ ID NO: 370092 - protein, 23 aa, Mycobacterium
STGVPLLAIILALVASKFSILTA

SEQ ID NO: 370093 - protein, 17 aa, Mycobacterium
STHVHYLDWLNYLLGWG

SEQ ID NO: 370094 - protein, 17 aa, Mycobacterium
STIFPAEKIRTALLGYR

SEQ ID NO: 370095 - protein, 26 aa, Mycobacterium
STIKQADSVLLQYPLEWPMSREAATN

SEQ ID NO: 370096 - protein, 30 aa, Mycobacterium
STIKSNLFWAFAYNVAALPLAAAGLLNPMI

SEQ ID NO: 370097 - protein, 17 aa, Mycobacterium
STILLALLLPYTAYREH

SEQ ID NO: 370098 - protein, 30 aa, Mycobacterium
STILYGLANPLFIPRFLFTVSICGVLVATG

SEQ ID NO: 370099 - protein, 29 aa, Mycobacterium
STIMHGVWILLFALPFAGLVEQIPTAALA

SEQ ID NO: 370100 - protein, 27 aa, Mycobacterium
STIRRFMSFGLIFLMLNVLQITVVTVI

SEQ ID NO: 370101 - protein, 43 aa, Mycobacterium
STKASLFDLIPPNVSWIVWQLALVVLLVAAWKGRRPGPLVAEE

SEQ ID NO: 370102 - protein, 18 aa, Mycobacterium
STKGLLYRRIGASVVRWP

SEQ ID NO: 370103 - protein, 28 aa, Mycobacterium
STLAFSKPFFDQGLLNRRTVLKSSYAQF

SEQ ID NO: 370104 - protein, 17 aa, Mycobacterium
STLAWIMAGLTVPTSGA

SEQ ID NO: 370105 - protein, 17 aa, Mycobacterium
STLAYIYIHLEGADSLA

SEQ ID NO: 370106 - protein, 23 aa, Mycobacterium
STLGLALVIWQHVLGIQLHWSVP

SEQ ID NO: 370107 - protein, 26 aa, Mycobacterium
STLGWAPVIGPFFHRGIMLLDFEEHR

SEQ ID NO: 370108 - protein, 36 aa, Mycobacterium
STLKVSALLSVALFFIWMIAVAFLYLVLGGMGVWAK

SEQ ID NO: 370109 - protein, 21 aa, Mycobacterium
STLLQAILGLGPPPTGRIRVD

SEQ ID NO: 370110 - protein, 21 aa, Mycobacterium
STLQQWWVLVGRFTKPRLRDP

SEQ ID NO: 370111 - protein, 28 aa, Mycobacterium
STLTSVPMLFAVPTYYGQFADTGGLNIG

SEQ ID NO: 370112 - protein, 23 aa, Mycobacterium
STLTWRQVYVRASNLARYLNSLN

SEQ ID NO: 370113 - protein, 18 aa, Mycobacterium
STLVFVGAVAYILLAPKG

SEQ ID NO: 370114 - protein, 33 aa, Mycobacterium
STLVVALAPILIFGILLSAVTVPYVALGPGPTF

SEQ ID NO: 370115 - protein, 19 aa, Mycobacterium
STLYLPLLAILFGMIVRSV

SEQ ID NO: 370116 - protein, 22 aa, Mycobacterium
STMGILTWMFVDGHGSGLMNYT

SEQ ID NO: 370117 - protein, 24 aa, Mycobacterium
STMRSLVYTQVGIGAAVLLVLGIA

SEQ ID NO: 370118 - protein, 19 aa, Mycobacterium
STMSLLAAGLFGVVRVALD

SEQ ID NO: 370119 - protein, 42 aa, Mycobacterium
STMVFGAAPWAGWLAFAATVPVQFVAGWPILKAAAQQARALS

SEQ ID NO: 370120 - protein, 40 aa, Mycobacterium
STNAGQRRPLYARLLYGLSIPIVILWVLLACGLNAAGPQL

SEQ ID NO: 370121 - protein, 20 aa, Mycobacterium
STNHILGFPFTDHGLRLGVE

SEQ ID NO: 370122 - protein, 25 aa, Mycobacterium
STPALVQSLYLVLLGAGIGLSMQVL

SEQ ID NO: 370123 - protein, 24 aa, Mycobacterium
STPIAFLLFAFFGGFAIMIGAELN

SEQ ID NO: 370124 - protein, 24 aa, Mycobacterium
STPIAFLLFAFFGGFAIMLGAELN

SEQ ID NO: 370125 - protein, 27 aa, Mycobacterium
STPIPIQLFFVYFGLPVVGIRPSALVT

SEQ ID NO: 370126 - protein, 23 aa, Mycobacterium
STPPTGFPSFSPPPSVSAGTGSQ

SEQ ID NO: 370127 - protein, 26 aa, Mycobacterium
STPQQALVWLGWLTAATVSGWVIDAI

SEQ ID NO: 370128 - protein, 23 aa, Mycobacterium
STPTFVIANLLILAALRVNWAVG

SEQ ID NO: 370129 - protein, 25 aa, Mycobacterium
STPTFVIASLLILGALRVNWALGVQ

SEQ ID NO: 370130 - protein, 20 aa, Mycobacterium
STPVVIAVTPKLRQAIPNDK

SEQ ID NO: 370131 - protein, 26 aa, Mycobacterium
STQIPLPVILVVLATLLFGAFANRWL

SEQ ID NO: 370132 - protein, 25 aa, Mycobacterium
STQPAQLLVLLIIGGALMGCAASIR

SEQ ID NO: 370133 - protein, 24 aa, Mycobacterium
STQTPLFTIFGAVALLVFSDFPGN

SEQ ID NO: 370134 - protein, 22 aa, Mycobacterium
STQVELPFTGLTGPMGVAVDSA

SEQ ID NO: 370135 - protein, 17 aa, Mycobacterium
STQVQIPALPPYEPPKP

SEQ ID NO: 370136 - protein, 26 aa, Mycobacterium
STRATLHFLWLRLARVWPVYLVTMHL

SEQ ID NO: 370137 - protein, 25 aa, Mycobacterium
STRATLHFLWLRLSRVWPVYLVTLH

SEQ ID NO: 370138 - protein, 25 aa, Mycobacterium
STRDRLPLPNRLLAAGPLVTLGAMA

SEQ ID NO: 370139 - protein, 39 aa, Mycobacterium
STRHLGRWLGPLAILLALWAIRALTHWLQARLGQRGASA

SEQ ID NO: 370140 - protein, 26 aa, Mycobacterium
STRIPIPVILVVTATLLFGVFANRWL

SEQ ID NO: 370141 - protein, 24 aa, Mycobacterium
STRLAALPLWTWLLAVAMISMGGP

SEQ ID NO: 370142 - protein, 37 aa, Mycobacterium
STRLWRRVGIRVARWPKPIFVTTFAALIVLMMVIPTA

SEQ ID NO: 370143 - protein, 22 aa, Mycobacterium
STRPLPVWGTWKTLLRVQDGYT

SEQ ID NO: 370144 - protein, 26 aa, Mycobacterium
STRVFHWLTAILVFAALFIGFVMVNS

SEQ ID NO: 370145 - protein, 25 aa, Mycobacterium
STRVPFPVILIVLSTMIAGVLGHRW

SEQ ID NO: 370146 - protein, 17 aa, Mycobacterium
STSALFVLDEWLRPVPV

SEQ ID NO: 370147 - protein, 29 aa, Mycobacterium
STSAYDIALFYRYAWQNPVFADIVHTQSY

SEQ ID NO: 370148 - protein, 30 aa, Mycobacterium
STSAYDIGLFYRYAWQNPTFADIVATRTFD

SEQ ID NO: 370149 - protein, 24 aa, Mycobacterium
STSLPVDASWRFRYRRSRSVANSF

SEQ ID NO: 370150 - protein, 19 aa, Mycobacterium
STSLTLRLLKNMQLKRRLK

SEQ ID NO: 370151 - protein, 21 aa, Mycobacterium
STSMRLVVVPQGVRRVLPALM

SEQ ID NO: 370152 - protein, 20 aa, Mycobacterium
STSQQLLLGPVARGTTISVS

SEQ ID NO: 370153 - protein, 25 aa, Mycobacterium
STSRIGWIVVLLYAVCIVLRLARFN

SEQ ID NO: 370154 - protein, 24 aa, Mycobacterium
STTETVLPPPPPPPSSSEQPPATT

SEQ ID NO: 370155 - protein, 22 aa, Mycobacterium
STTGIFKAGILMSAEDFVKAVE

SEQ ID NO: 370156 - protein, 17 aa, Mycobacterium
STTILLSLLAVALGMIT

SEQ ID NO: 370157 - protein, 21 aa, Mycobacterium
STTQAQVLFTMRVAPARSSSR

SEQ ID NO: 370158 - protein, 30 aa, Mycobacterium
STTYGVVAMLLVYAVVWYALSQTAWGKHVY

SEQ ID NO: 370159 - protein, 25 aa, Mycobacterium
STTYSYWFEPNPAWSRLFAPGAEVK

SEQ ID NO: 370160 - protein, 17 aa, Mycobacterium
STVAVLIIACPCALGLA

SEQ ID NO: 370161 - protein, 37 aa, Mycobacterium
STVDPGFFRAEPKAAVRWGLPVLSALTALVVVAAIAA

SEQ ID NO: 370162 - protein, 31 aa, Mycobacterium
STVGWGWTLLALAGAFLLGWVVVVPAMGSHL

SEQ ID NO: 370163 - protein, 29 aa, Mycobacterium
STVLHGFWVMLFALPFAGLIELIPSAALA

SEQ ID NO: 370164 - protein, 19 aa, Mycobacterium
STVPFGFLGLAAVVAASGV

SEQ ID NO: 370165 - protein, 26 aa, Mycobacterium
STVPTLVFILTLLLTAALVIRKVRGG

SEQ ID NO: 370166 - protein, 25 aa, Mycobacterium
STVSIVLLGWMVLGVLSVLGVNIAP

SEQ ID NO: 370167 - protein, 25 aa, Mycobacterium
STVTHGIISALHRPVPLSGDGSDTD

SEQ ID NO: 370168 - protein, 21 aa, Mycobacterium
STWDSMWHGNTIRYILDTGQA

SEQ ID NO: 370169 - protein, 30 aa, Mycobacterium
STYELFAGGPLFFDTSALIIAFVVLGRYLE

SEQ ID NO: 370170 - protein, 17 aa, Mycobacterium
STYLSHDWGRDWGSLRK

SEQ ID NO: 370171 - protein, 26 aa, Mycobacterium
SVAALLGRWFWWPQQVRTRPASQLLR

SEQ ID NO: 370172 - protein, 27 aa, Mycobacterium
SVAALLGRWFWWPQRVRQRPASSMLRP

SEQ ID NO: 370173 - protein, 25 aa, Mycobacterium
SVAALLISLLIVALTVWYYKLNVNP

SEQ ID NO: 370174 - protein, 25 aa, Mycobacterium
SVAALMGRWFWWPQRVRTRPASQLL

SEQ ID NO: 370175 - protein, 22 aa, Mycobacterium
SVAAVVLGTLIWSAHRDEVAER

SEQ ID NO: 370176 - protein, 26 aa, Mycobacterium
SVADFWRFWVVHLWVEDFLELFTTVM

SEQ ID NO: 370177 - protein, 17 aa, Mycobacterium
SVAFAVGVVRLGQRRCL

SEQ ID NO: 370178 - protein, 20 aa, Mycobacterium
SVAFLLFYLVCLGETATHRL

SEQ ID NO: 370179 - protein, 17 aa, Mycobacterium
SVAFRPLDSLLQRSPRP

SEQ ID NO: 370180 - protein, 19 aa, Mycobacterium
SVAFRPLRLLVVCVALTAI

SEQ ID NO: 370181 - protein, 21 aa, Mycobacterium
SVAFRPVRLFAISIAITAVAV

SEQ ID NO: 370182 - protein, 30 aa, Mycobacterium
SVAGIAAIALIIWLITVIARQFSEPDPPPL

SEQ ID NO: 370183 - protein, 21 aa, Mycobacterium
SVAIIAFIYIKIFGAAAPGSD

SEQ ID NO: 370184 - protein, 37 aa, Mycobacterium
SVAILDPFLDVGGKSALFFVGVLVVALLGGVAPAALS

SEQ ID NO: 370185 - protein, 22 aa, Mycobacterium
SVAIRPIPFLVTTRLMAAIIAV

SEQ ID NO: 370186 - protein, 26 aa, Mycobacterium
SVALARRWRGLTLGLRPAEMAELVRT

SEQ ID NO: 370187 - protein, 25 aa, Mycobacterium
SVALLWFLGVYLVALAFVPALVRLR

SEQ ID NO: 370188 - protein, 19 aa, Mycobacterium
SVALRRFVRTHSLVPELPI

SEQ ID NO: 370189 - protein, 20 aa, Mycobacterium
SVAQRWHDFWRGHIGEWIIT

SEQ ID NO: 370190 - protein, 22 aa, Mycobacterium
SVARRFAVLALILALAVVVAMS

SEQ ID NO: 370191 - protein, 23 aa, Mycobacterium
SVARRFAVLTLLLALVVSVAMTL

SEQ ID NO: 370192 - protein, 24 aa, Mycobacterium
SVARRHPWLLAFVGLALGYAEAPT

SEQ ID NO: 370193 - protein, 37 aa, Mycobacterium
SVASGPYFKIVLSNLLPYWILQPFVDAAFKKRGIDPE

SEQ ID NO: 370194 - protein, 23 aa, Mycobacterium
SVCGWTMRLMTALELSLGDGTPD

SEQ ID NO: 370195 - protein, 27 aa, Mycobacterium
SVDAVWKQLMRGYTRPHVRLFTGSVDT

SEQ ID NO: 370196 - protein, 27 aa, Mycobacterium
SVDAVWTQILGPKYPRPNVKLFSNQVN

SEQ ID NO: 370197 - protein, 34 aa, Mycobacterium
SVDLRPRTLLSKVPFVVLVIGSLGVGLALTLWLS

SEQ ID NO: 370198 - protein, 31 aa, Mycobacterium
SVDMRFRDRYLISLPLFHVAALAPLVGCVYR

SEQ ID NO: 370199 - protein, 22 aa, Mycobacterium
SVDNLFIFLIIMASFKVPRIYQ

SEQ ID NO: 370200 - protein, 23 aa, Mycobacterium
SVDNLFIFLIIMASFKVPRIYQQ

SEQ ID NO: 370201 - protein, 22 aa, Mycobacterium
SVDNLFIFLIIMASFKVPRVYQ

SEQ ID NO: 370202 - protein, 24 aa, Mycobacterium
SVDNLFVFLMIMASFRVPREDQQK

SEQ ID NO: 370203 - protein, 25 aa, Mycobacterium
SVDPVAALTWQLPAGDQPSGAAAKQ

SEQ ID NO: 370204 - protein, 26 aa, Mycobacterium
SVDPVAALTWQLPAGNQPPAAAAKPV

SEQ ID NO: 370205 - protein, 26 aa, Mycobacterium
SVDSLAPVLPFRASGTDAPLFCVHPA

SEQ ID NO: 370206 - protein, 25 aa, Mycobacterium
SVDSLLLMGIYLFLGGMAAASCNSA

SEQ ID NO: 370207 - protein, 23 aa, Mycobacterium
SVEHFNWLEDLGFQFERSYFPGK

SEQ ID NO: 370208 - protein, 25 aa, Mycobacterium
SVELMYFLAIPVAVVGALLAGPLIR

SEQ ID NO: 370209 - protein, 20 aa, Mycobacterium
SVELMYFVAVPIAVVGVLLA

SEQ ID NO: 370210 - protein, 24 aa, Mycobacterium
SVESTRRRLFGDLAHEIRTPVAVL

SEQ ID NO: 370211 - protein, 26 aa, Mycobacterium
SVFEWLGYAMLYLSFVLGAATGGVIA

SEQ ID NO: 370212 - protein, 21 aa, Mycobacterium
SVFGALLLLPPTRAAARPLVT

SEQ ID NO: 370213 - protein, 27 aa, Mycobacterium
SVFGDPLVWIERALVVLVAASPCALAI

SEQ ID NO: 370214 - protein, 17 aa, Mycobacterium
SVFGPGPLKWIYLTMSV

SEQ ID NO: 370215 - protein, 26 aa, Mycobacterium
SVFGSPAVWIERALVVLVAASPCALA

SEQ ID NO: 370216 - protein, 18 aa, Mycobacterium
SVFKPVVLVLLVAVGVFV

SEQ ID NO: 370217 - protein, 28 aa, Mycobacterium
SVFTTVLVTRFLVFLVAGVLVGGIVFAG

SEQ ID NO: 370218 - protein, 21 aa, Mycobacterium
SVFVFSLYAFLCATALVVVRT

SEQ ID NO: 370219 - protein, 24 aa, Mycobacterium
SVFVSAFIALTLGLALPAVASAHA

SEQ ID NO: 370220 - protein, 28 aa, Mycobacterium
SVGAIDYLLIAIYFVFVLGIGYVARSQI

SEQ ID NO: 370221 - protein, 27 aa, Mycobacterium
SVGALVTYLLYVEMLFAPVDKLSQMFD

SEQ ID NO: 370222 - protein, 20 aa, Mycobacterium
SVGFWKIGVRLPLLQGVAFA

SEQ ID NO: 370223 - protein, 27 aa, Mycobacterium
SVGIRFVVPVLLLVAWQVAAAWELVSP

SEQ ID NO: 370224 - protein, 24 aa, Mycobacterium
SVGKAIIFVWIASAVQCYYGFCAD

SEQ ID NO: 370225 - protein, 23 aa, Mycobacterium
SVGMLYAGILQLPTWMVKLSPVM

SEQ ID NO: 370226 - protein, 29 aa, Mycobacterium
SVGRWVAVVAVLAVLTIAVTIAINTFGGN

SEQ ID NO: 370227 - protein, 26 aa, Mycobacterium
SVGRWVAVVAVLAVLTIVVTIAINTF

SEQ ID NO: 370228 - protein, 25 aa, Mycobacterium
SVGSGPFFKAYIPNLIPGQFSQPFI

SEQ ID NO: 370229 - protein, 29 aa, Mycobacterium
SVGSVILFMFGFISLLALYRFSAALLKPK

SEQ ID NO: 370230 - protein, 20 aa, Mycobacterium
SVGTWILTAYGPGAGLAGAA

SEQ ID NO: 370231 - protein, 27 aa, Mycobacterium
SVGVIIVMILFIYRSIVTMLISMVIIG

SEQ ID NO: 370232 - protein, 23 aa, Mycobacterium
SVGVMVYELLTGRTPFTGDSSLA

SEQ ID NO: 370233 - protein, 17 aa, Mycobacterium
SVGVWHYLKRPGAGDRV

SEQ ID NO: 370234 - protein, 30 aa, Mycobacterium
SVHSNAYGKPLFFITISAATVLFALTGRRL

SEQ ID NO: 370235 - protein, 42 aa, Mycobacterium
SVHSNAYGKVLFFITLSAGAVLFLLAGRRLWHRFRGQPDRAD

SEQ ID NO: 370236 - protein, 25 aa, Mycobacterium
SVIKAVVFVWIASTIQCYFGFNASG

SEQ ID NO: 370237 - protein, 24 aa, Mycobacterium
SVINLLQIGFTIGVGLLLDITIVR

SEQ ID NO: 370238 - protein, 22 aa, Mycobacterium
SVINLPALFFGPIYFVAKGMWR

SEQ ID NO: 370239 - protein, 18 aa, Mycobacterium
SVIRLVLIAVFAYALLGA

SEQ ID NO: 370240 - protein, 28 aa, Mycobacterium
SVIRLVLVPVFLYLLLVADLTGWAVAVL

SEQ ID NO: 370241 - protein, 22 aa, Mycobacterium
SVISFTAILWNLSGTLNIFGLS

SEQ ID NO: 370242 - protein, 23 aa, Mycobacterium
SVISFTAILWNLSGTLNIWGVSF

SEQ ID NO: 370243 - protein, 17 aa, Mycobacterium
SVISWVSVALLFVMVAV

SEQ ID NO: 370244 - protein, 22 aa, Mycobacterium
SVITALRRRLPQHRFVESPWLG

SEQ ID NO: 370245 - protein, 29 aa, Mycobacterium
SVITQAWGWQWLFWLSAAGLAVNVALLAL

SEQ ID NO: 370246 - protein, 30 aa, Mycobacterium
SVIVLTSLLLIIVALLWTFIRHERRAPFPL

SEQ ID NO: 370247 - protein, 17 aa, Mycobacterium
SVIVMLNHCYFGYFASG

SEQ ID NO: 370248 - protein, 26 aa, Mycobacterium
SVKTLTFLGFIVVLLVINIFGNRAIK

SEQ ID NO: 370249 - protein, 31 aa, Mycobacterium
SVKVHWSVLVILWLFTWSLATTLPGAVKGYA

SEQ ID NO: 370250 - protein, 30 aa, Mycobacterium
SVLAAIAVPWWFLVAQLPFAGIVFALDGVL

SEQ ID NO: 370251 - protein, 36 aa, Mycobacterium
SVLAAIGVPWWFLVAQLPFAGMVFALDGVLLGAGDA

SEQ ID NO: 370252 - protein, 20 aa, Mycobacterium
SVLAAPLLVRLMLGRAPQVN

SEQ ID NO: 370253 - protein, 23 aa, Mycobacterium
SVLAGKWVFYGLLGAVLSLVLVA

SEQ ID NO: 370254 - protein, 18 aa, Mycobacterium
SVLASRFLLQRSKQLRVA

SEQ ID NO: 370255 - protein, 29 aa, Mycobacterium
SVLATIGVPWWFLVAQLPVAGIVFALDGV

SEQ ID NO: 370256 - protein, 35 aa, Mycobacterium
SVLFHAFAVQMNLISPLWFAIRAYRQMKTQDGTGC

SEQ ID NO: 370257 - protein, 24 aa, Mycobacterium
SVLGLSGLVFFLSQYFQLVHGYGP

SEQ ID NO: 370258 - protein, 26 aa, Mycobacterium
SVLGNPAVWIERALVVLVAASPCALA

SEQ ID NO: 370259 - protein, 17 aa, Mycobacterium
SVLGTPFFLMDFVEGVV

SEQ ID NO: 370260 - protein, 30 aa, Mycobacterium
SVLGTVPMGLLAYRYRLRVLLAATVAAGVI

SEQ ID NO: 370261 - protein, 20 aa, Mycobacterium
SVLIAVVLGVLMVCAGLELG

SEQ ID NO: 370262 - protein, 21 aa, Mycobacterium
SVLIVLYACLAACAAALAFAP

SEQ ID NO: 370263 - protein, 19 aa, Mycobacterium
SVLIWQDLLGMDLHWFVVP

SEQ ID NO: 370264 - protein, 20 aa, Mycobacterium
SVLIWQHLVGLELHWMVLAM

SEQ ID NO: 370265 - protein, 24 aa, Mycobacterium
SVLLAAAFVLGLRRFPRPDSDESP

SEQ ID NO: 370266 - protein, 18 aa, Mycobacterium
SVLLAILVGIGGLSAKIF

SEQ ID NO: 370267 - protein, 26 aa, Mycobacterium
SVLLPAFIALFGIIAALFLVGFAPWS

SEQ ID NO: 370268 - protein, 24 aa, Mycobacterium
SVLLTFYPGWVTIGLMAALVLVAA

SEQ ID NO: 370269 - protein, 30 aa, Mycobacterium
SVLLVQALLMCSLLFALPINARLFRRRVTG

SEQ ID NO: 370270 - protein, 17 aa, Mycobacterium
SVLLVTLPIVVLTGLLS

SEQ ID NO: 370271 - protein, 26 aa, Mycobacterium
SVLMSLFVSWLLFTWMIARLPRETVT

SEQ ID NO: 370272 - protein, 18 aa, Mycobacterium
SVLPQLTAKHRVIVAAVA

SEQ ID NO: 370273 - protein, 25 aa, Mycobacterium
SVLTAFVLLGHWFEMRARGGANDAI

SEQ ID NO: 370274 - protein, 28 aa, Mycobacterium
SVLVLLILEGVAVNFWLLRRDSVSLGTD

SEQ ID NO: 370275 - protein, 20 aa, Mycobacterium
SVLVLLVFPLLAAAAIGLEA

SEQ ID NO: 370276 - protein, 33 aa, Mycobacterium
SVLVWQDIIGFKLHWMVLAMSIILMLAVGSDYN

SEQ ID NO: 370277 - protein, 25 aa, Mycobacterium
SVLVWQDILGFELHWMVLAMSVILL

SEQ ID NO: 370278 - protein, 26 aa, Mycobacterium
SVLVWQHFVGIELHWMVLPMAVIILL

SEQ ID NO: 370279 - protein, 31 aa, Mycobacterium
SVLVWQYIFGVQLYWVVLALAVILLLAVGSD

SEQ ID NO: 370280 - protein, 19 aa, Mycobacterium
SVLWFLAYQHISLVGQTLI

SEQ ID NO: 370281 - protein, 20 aa, Mycobacterium
SVMFLSQLPYAPLGDLRSVV

SEQ ID NO: 370282 - protein, 32 aa, Mycobacterium
SVMLESFLFYSGFYLPMYWSSRGKLTNTADII

SEQ ID NO: 370283 - protein, 19 aa, Mycobacterium
SVMLIIFQVLQTVAYFGFG

SEQ ID NO: 370284 - protein, 19 aa, Mycobacterium
SVNAPSAWSAPPAAATPSA

SEQ ID NO: 370285 - protein, 26 aa, Mycobacterium
SVNEPCQAAPFLPLYEGVRVECAKYG

SEQ ID NO: 370286 - protein, 23 aa, Mycobacterium
SVNLALLYFGPYELSLVGIETQQ

SEQ ID NO: 370287 - protein, 19 aa, Mycobacterium
SVNLIPRDAPSLQTVDRMG

SEQ ID NO: 370288 - protein, 31 aa, Mycobacterium
SVNSPPALLLLPVLAWAAFRLEVIGAALASA

SEQ ID NO: 370289 - protein, 19 aa, Mycobacterium
SVPAPAIPAALPVPPQIGD

SEQ ID NO: 370290 - protein, 20 aa, Mycobacterium
SVPIEDAWDLLTDLDQVVPL

SEQ ID NO: 370291 - protein, 26 aa, Mycobacterium
SVPIILGWLGIAVLISVAVPSLEQVS

SEQ ID NO: 370292 - protein, 20 aa, Mycobacterium
SVPSDLSVYALYRAARDDGA

SEQ ID NO: 370293 - protein, 26 aa, Mycobacterium
SVPSDLSVYLLYRRAIEDGTGELCDT

SEQ ID NO: 370294 - protein, 31 aa, Mycobacterium
SVPSLWRETPAPYGPLFLWIGKGISWLTGDD

SEQ ID NO: 370295 - protein, 31 aa, Mycobacterium
SVPSLWRETPAPYGPLFLWIGRGISALTGEN

SEQ ID NO: 370296 - protein, 30 aa, Mycobacterium
SVPSLWRETPAPYGPLFLWIGRGISDLTGE

SEQ ID NO: 370297 - protein, 31 aa, Mycobacterium; identical to SEQ ID NO: 21445

SEQ ID NO: 370298 - protein, 31 aa, Mycobacterium
SVPTLWRETPAPYGPLFLWMGRGISAITGEN

SEQ ID NO: 370299 - protein, 19 aa, Mycobacterium
SVPVLAVANYWIMTHLLPL

SEQ ID NO: 370300 - protein, 35 aa, Mycobacterium
SVQGQFYIAFLALILLCAFVFRRVFGRHARAAFVV

SEQ ID NO: 370301 - protein, 26 aa, Mycobacterium
SVQSLFAVGLFLLLGGMAAASSNSAS

SEQ ID NO: 370302 - protein, 26 aa, Mycobacterium
SVQVLAIWVLVGLLVLVRMTPTIALW

SEQ ID NO: 370303 - protein, 26 aa, Mycobacterium
SVREGYFILGSIWPLLVAAVITAAAA

SEQ ID NO: 370304 - protein, 21 aa, Mycobacterium
SVRLLSLYIAGGMLLSLYVIP

SEQ ID NO: 370305 - protein, 23 aa, Mycobacterium
SVRNLLGYKLIPWKDVVGVSFPG

SEQ ID NO: 370306 - protein, 26 aa, Mycobacterium
SVRPLTWRAALWSVMSVRWAGIALAL

SEQ ID NO: 370307 - protein, 26 aa, Mycobacterium
SVRQGRFEIDFLMLVSAAGAAALGEV

SEQ ID NO: 370308 - protein, 19 aa, Mycobacterium
SVRTLVIAAVICVAASAIG

SEQ ID NO: 370309 - protein, 20 aa, Mycobacterium
SVRWFGEFEFWFSGIKVAAI

SEQ ID NO: 370310 - protein, 30 aa, Mycobacterium
SVSAALVICLGALLWSFISPSGQLNESPII

SEQ ID NO: 370311 - protein, 28 aa, Mycobacterium
SVSGGWFTLTVLFILAVIAVIVAVHIAR

SEQ ID NO: 370312 - protein, 24 aa, Mycobacterium
SVSGLFLYLIAILNVIILAGILRV

SEQ ID NO: 370313 - protein, 21 aa, Mycobacterium
SVSILIAFVASVTFLPAVLVL

SEQ ID NO: 370314 - protein, 23 aa, Mycobacterium
SVSRPYLVIAGLVCSFSLATLLG

SEQ ID NO: 370315 - protein, 35 aa, Mycobacterium
SVSTMVFGAYPWAGWLAFAATVPVQFVAGWPFLRG

SEQ ID NO: 370316 - protein, 28 aa, Mycobacterium
SVSYLDLCDQLLLLAPGGKTAYFGPPDQ

SEQ ID NO: 370317 - protein, 18 aa, Mycobacterium
SVTAGLAWFLTHDVLDHP

SEQ ID NO: 370318 - protein, 23 aa, Mycobacterium
SVTGWFTRLPVAPRSARAAAALL

SEQ ID NO: 370319 - protein, 19 aa, Mycobacterium
SVTKLLRHGGTGYVGWGIA

SEQ ID NO: 370320 - protein, 25 aa, Mycobacterium
SVTPSALRQSFLWGLAGVIAAEHPE

SEQ ID NO: 370321 - protein, 23 aa, Mycobacterium
SVTPYLLVLALVGAVSFGVSWVT

SEQ ID NO: 370322 - protein, 26 aa, Mycobacterium
SVTTFLLAWELMALSSLVLLLTNHRR

SEQ ID NO: 370323 - protein, 21 aa, Mycobacterium
SVTVFALMWGVPYLTVAQGLS

SEQ ID NO: 370324 - protein, 26 aa, Mycobacterium
SVTVRTYLVPLDGFCLYPESPLRLAN

SEQ ID NO: 370325 - protein, 23 aa, Mycobacterium
SVVAIAVLIFGNAIFVAAEFSLT

SEQ ID NO: 370326 - protein, 23 aa, Mycobacterium
SVVAIIPLYVACLTISYLSCQIM

SEQ ID NO: 370327 - protein, 18 aa, Mycobacterium
SVVAWVVFAVIYGILIAL

SEQ ID NO: 370328 - protein, 27 aa, Mycobacterium
SVVDDTLLWVLGMFCVIAAVALIAAIT

SEQ ID NO: 370329 - protein, 20 aa, Mycobacterium
SVVELWRRRSHVGIRLLLAA

SEQ ID NO: 370330 - protein, 19 aa, Mycobacterium
SVVFQHPYLFHGSIRENVL

SEQ ID NO: 370331 - protein, 29 aa, Mycobacterium
SVVIAVMLLFIYRSVVTAFLVLIMVGIDL

SEQ ID NO: 370332 - protein, 18 aa, Mycobacterium
SVVLPLKALVLNGLSLTA

SEQ ID NO: 370333 - protein, 20 aa, Mycobacterium
SVVLPLKALVLNVLSLTAAF

SEQ ID NO: 370334 - protein, 31 aa, Mycobacterium
SVVMAIPATLLLLRYRWLRAEPLPTPRPVNV

SEQ ID NO: 370335 - protein, 23 aa, Mycobacterium
SVVPPLLALYWWAHAGSSADRLR

SEQ ID NO: 370336 - protein, 20 aa, Mycobacterium
SVVQLLFFMTPIIWNESTLQ

SEQ ID NO: 370337 - protein, 19 aa, Mycobacterium
SVVRALYVSLAALGILLAV

SEQ ID NO: 370338 - protein, 25 aa, Mycobacterium
SVVTRIEGLLTWLGGGHWGELGERH

SEQ ID NO: 370339 - protein, 21 aa, Mycobacterium
SVVVAPLWRYRVHRWEVDPTA

SEQ ID NO: 370340 - protein, 24 aa, Mycobacterium
SVVVLLIVLVIRPLSVFAMFGRRK

SEQ ID NO: 370341 - protein, 27 aa, Mycobacterium
SVVVLVAAVIVWKFVGDALSDRSDAAA

SEQ ID NO: 370342 - protein, 20 aa, Mycobacterium
SVVVLVLTLGTWVWIGVTND

SEQ ID NO: 370343 - protein, 26 aa, Mycobacterium
SVVVPFMAVVYIVLALIIVLTNASEI

SEQ ID NO: 370344 - protein, 27 aa, Mycobacterium
SVVVVVAAVILWRFVGDTLSDRSDIAA

SEQ ID NO: 370345 - protein, 18 aa, Mycobacterium
SVVYLPDLFGISGQIWAI

SEQ ID NO: 370346 - protein, 27 aa, Mycobacterium
SVVYNLPKMISLLVEPWYALVGEREQA

SEQ ID NO: 370347 - protein, 26 aa, Mycobacterium
SVVYNLPKMISLLVEPWYSLDGEREQ

SEQ ID NO: 370348 - protein, 23 aa, Mycobacterium
SVWFWIPLAILVIGISSIPSVIG

SEQ ID NO: 370349 - protein, 17 aa, Mycobacterium
SVWLFPTSAAMLTWRLL

SEQ ID NO: 370350 - protein, 20 aa, Mycobacterium
SVWYLLWLVAAAALGYVVWR

SEQ ID NO: 370351 - protein, 22 aa, Mycobacterium
SVYGTFFLVILAGVFAAKASGA

SEQ ID NO: 370352 - protein, 18 aa, Mycobacterium
SWAAALMVPSLICAFSVA

SEQ ID NO: 370353 - protein, 21 aa, Mycobacterium
SWAAPLLALLAICAAAAVLAP

SEQ ID NO: 370354 - protein, 19 aa, Mycobacterium
SWATPARWGFAASASTVDL

SEQ ID NO: 370355 - protein, 27 aa, Mycobacterium
SWAVADLIWLLCDYVLHIEPFPSPADL

SEQ ID NO: 370356 - protein, 19 aa, Mycobacterium
SWFVTRWVVASALGGPILF

SEQ ID NO: 370357 - protein, 19 aa, Mycobacterium
SWFVTRWVVASALGGPLLI

SEQ ID NO: 370358 - protein, 22 aa, Mycobacterium
SWGTRVIAFVALIFGTLNVIGG

SEQ ID NO: 370359 - protein, 19 aa, Mycobacterium
SWHCYPIGLLFGLGFDTAT

SEQ ID NO: 370360 - protein, 25 aa, Mycobacterium
SWIDQAVVIWVLIALATAMVVYVIA

SEQ ID NO: 370361 - protein, 18 aa, Mycobacterium
SWILAALAGLVGAAAFTH

SEQ ID NO: 370362 - protein, 19 aa, Mycobacterium
SWIVWGVGLVAYIVAVLDR

SEQ ID NO: 370363 - protein, 19 aa, Mycobacterium
SWLEVPLAMRDGLGLRLEL

SEQ ID NO: 370364 - protein, 22 aa, Mycobacterium
SWLEVPLAMRDGLGLRLELKLH

SEQ ID NO: 370365 - protein, 27 aa, Mycobacterium
SWLGALMVAAMIALVLLVQCVGAGHHN

SEQ ID NO: 370366 - protein, 31 aa, Mycobacterium
SWLGNWTIFYWGWWISWAPFVGMFIARISRG

SEQ ID NO: 370367 - protein, 19 aa, Mycobacterium
SWLIAFFEYCLAVPANRLG

SEQ ID NO: 370368 - protein, 24 aa, Mycobacterium
SWLKQVFLVQLWFQPYFDGSSWNG

SEQ ID NO: 370369 - protein, 17 aa, Mycobacterium
SWLLFTWMIARLPREKV

SEQ ID NO: 370370 - protein, 18 aa, Mycobacterium
SWLRFGHGLVVSSLLLWG

SEQ ID NO: 370371 - protein, 17 aa, Mycobacterium
SWLRFPIGTLKTLGTVG

SEQ ID NO: 370372 - protein, 20 aa, Mycobacterium
SWMDQLTKWLQQYTQNFAWP

SEQ ID NO: 370373 - protein, 26 aa, Mycobacterium
SWNYTTWLNIIFLGIAAVLVTRFITS

SEQ ID NO: 370374 - protein, 29 aa, Mycobacterium
SWPQAIDAWLRLCQTYGWSPGVMGASSQG

SEQ ID NO: 370375 - protein, 18 aa, Mycobacterium
SWQRILSSYWISPRKHQD

SEQ ID NO: 370376 - protein, 17 aa, Mycobacterium
SWRAALPHFLGSSGVRL

SEQ ID NO: 370377 - protein, 21 aa, Mycobacterium
SWRAWVFAVIVIAAIRPAAML

SEQ ID NO: 370378 - protein, 20 aa, Mycobacterium
SWRGPFFGVSVLMVVALVVT

SEQ ID NO: 370379 - protein, 20 aa, Mycobacterium
SWRNALPHFLGSSGVRLLLV

SEQ ID NO: 370380 - protein, 18 aa, Mycobacterium
SWRQTYLVLAALLAVITI

SEQ ID NO: 370381 - protein, 22 aa, Mycobacterium
SWRRGLIFAMFVFAAVFTPGSD

SEQ ID NO: 370382 - protein, 25 aa, Mycobacterium
SWRRGLIFTMFVFAAVFTPGSDPFS

SEQ ID NO: 370383 - protein, 19 aa, Mycobacterium
SWRVLPLATWATACGWAFS

SEQ ID NO: 370384 - protein, 23 aa, Mycobacterium
SWSHHWVWFVPLVVHLGYRGYVL

SEQ ID NO: 370385 - protein, 23 aa, Mycobacterium
SWSHHWVWMLPAVVVTGVLAWRR

SEQ ID NO: 370386 - protein, 24 aa, Mycobacterium
SWSHHWVWMLPVLVVTAVLAYRRR

SEQ ID NO: 370387 - protein, 24 aa, Mycobacterium
SWSHHWVWVLPAVLVTAVLGWRRR

SEQ ID NO: 370388 - protein, 17 aa, Mycobacterium
SWSVPQDGRKRLIINWL

SEQ ID NO: 370389 - protein, 20 aa, Mycobacterium
SWTHNGLFAFTRVDAGSGVE

SEQ ID NO: 370390 - protein, 19 aa, Mycobacterium
SWTLERLIRHPAVLDKAVA

SEQ ID NO: 370391 - protein, 26 aa, Mycobacterium
SWTPVAPLVFWMALAGLTPTGLVLAA

SEQ ID NO: 370392 - protein, 24 aa, Mycobacterium
SWTRFGPWLREPVGPIHWAGTETA

SEQ ID NO: 370393 - protein, 17 aa, Mycobacterium
SWTRRRVRRLQLPQPVD

SEQ ID NO: 370394 - protein, 26 aa, Mycobacterium
SWTVLALAALVVWLLAARSIHGARTT

SEQ ID NO: 370395 - protein, 26 aa, Mycobacterium
SWVDITVVIWVLVALVASMVLYIGCW

SEQ ID NO: 370396 - protein, 27 aa, Mycobacterium
SWVLNAYNIVFAAFLVAAGRLADLLGR

SEQ ID NO: 370397 - protein, 25 aa, Mycobacterium
SWVPYPILFAIVAGVLLWFSRIRVE

SEQ ID NO: 370398 - protein, 18 aa, Mycobacterium
SWVVIGLALFAAGSVVAY

SEQ ID NO: 370399 - protein, 18 aa, Mycobacterium
SWWALYLGPALVVELVAL

SEQ ID NO: 370400 - protein, 17 aa, Mycobacterium
SYAFYDFERGWALVGLA

SEQ ID NO: 370401 - protein, 17 aa, Mycobacterium
SYAFYDFERGWSLVALA

SEQ ID NO: 370402 - protein, 43 aa, Mycobacterium
SYAGAFGLSILFWQHLVGLHLHWLVLPLTFIILVAVGSDYNLL

SEQ ID NO: 370403 - protein, 25 aa, Mycobacterium
SYALVRLLERLLLSWRNGFAGFEAT

SEQ ID NO: 370404 - protein, 19 aa, Mycobacterium
SYAPLMAYLVRSMQSGSEL

SEQ ID NO: 370405 - protein, 31 aa, Mycobacterium
SYATFGEFLAWVIGWNLVLELAIGAAVVAKG

SEQ ID NO: 370406 - protein, 29 aa, Mycobacterium
SYATFGEFLAWVIGWNLVLELAVGAAVVA

SEQ ID NO: 370407 - protein, 17 aa, Mycobacterium
SYDLVRAIGLLPNDIRA

SEQ ID NO: 370408 - protein, 20 aa, Mycobacterium
SYERLPRRLPGMALHAAMSA

SEQ ID NO: 370409 - protein, 20 aa, Mycobacterium
SYFMSPAAFVRKPIRWMRML

SEQ ID NO: 370410 - protein, 20 aa, Mycobacterium
SYFNCTDFADLFTLLEQDKA

SEQ ID NO: 370411 - protein, 18 aa, Mycobacterium
SYFYDLRGPSVTIDTACS

SEQ ID NO: 370412 - protein, 34 aa, Mycobacterium
SYGAKDMFVLLSPFLLVIAVMLVPALDALLAIIR

SEQ ID NO: 370413 - protein, 39 aa, Mycobacterium
SYGGVLMFGMLTSFAGLGMFNPLSLGAGFVLGRKAYKED

SEQ ID NO: 370414 - protein, 17 aa, Mycobacterium
SYGLLWVAAVAVIVGAV

SEQ ID NO: 370415 - protein, 27 aa, Mycobacterium
SYGVNPPFLWQHITGRYTNISVRTAGD

SEQ ID NO: 370416 - protein, 22 aa, Mycobacterium
SYHALMMLAMAWMYVAMSDQLL

SEQ ID NO: 370417 - protein, 36 aa, Mycobacterium
SYLIVLGTWQFSSRSLFALLSVTLAGAVLALATPVV

SEQ ID NO: 370418 - protein, 17 aa, Mycobacterium
SYLVKQLAPQLYVLAEV

SEQ ID NO: 370419 - protein, 18 aa, Mycobacterium
SYLWFDYAVDGTPKAGAV

SEQ ID NO: 370420 - protein, 24 aa, Mycobacterium
SYPPKPPVGAALWKLMERARQIGL

SEQ ID NO: 370421 - protein, 24 aa, Mycobacterium
SYPTAMRLVVVPQGIRRVLPALVN

SEQ ID NO: 370422 - protein, 17 aa, Mycobacterium
SYRKMKQNLWWGAGYNL

SEQ ID NO: 370423 - protein, 30 aa, Mycobacterium
SYRKMKQNLWWGAGYNLIAVPLAAGVLAPI

SEQ ID NO: 370424 - protein, 17 aa, Mycobacterium
SYRLVSVLRLGVLVFLI

SEQ ID NO: 370425 - protein, 24 aa, Mycobacterium
SYSAAMRLVVVPQGIRRVLPALVN

SEQ ID NO: 370426 - protein, 25 aa, Mycobacterium
SYSLLPSLSWFWPGGMDFGTVIAPA

SEQ ID NO: 370427 - protein, 17 aa, Mycobacterium
SYSWQLHAFPAIAVSRD

SEQ ID NO: 370428 - protein, 25 aa, Mycobacterium
SYTSTYLRFVWTLSATAVVVCYGLW

SEQ ID NO: 370429 - protein, 23 aa, Mycobacterium
SYTSTYLRFVWTLSATAVVVSYG

SEQ ID NO: 370430 - protein, 21 aa, Mycobacterium
SYVLTFQVYLALPLQAALLTD

SEQ ID NO: 370431 - protein, 24 aa, Mycobacterium
TAAAFFCLGIWALSPIYPDEIAYR

SEQ ID NO: 370432 - protein, 25 aa, Mycobacterium
TAAALAWTIALLCRNPIALGKAYAE

SEQ ID NO: 370433 - protein, 26 aa, Mycobacterium
TAAALLVFFWRDWLRIVAGFVSSLRH

SEQ ID NO: 370434 - protein, 25 aa, Mycobacterium
TAAALSWVLLFARRRRITSALTSAS

SEQ ID NO: 370435 - protein, 31 aa, Mycobacterium
TAAAMLVGFWQLTLPWVPLAAPVAVGAVYLI

SEQ ID NO: 370436 - protein, 25 aa, Mycobacterium
TAAAPVVVAIWMLSALSGGLAPALV

SEQ ID NO: 370437 - protein, 20 aa, Mycobacterium
TAAAWWLCSAATVVTMLYLA

SEQ ID NO: 370438 - protein, 25 aa, Mycobacterium
TAAEWLGYFLLFASFVVGATVGGFI

SEQ ID NO: 370439 - protein, 22 aa, Mycobacterium
TAAFGALVWIFQDGHLSGLGTT

SEQ ID NO: 370440 - protein, 25 aa, Mycobacterium
TAAGLIVAVLPLCAPPLASAEPGFT

SEQ ID NO: 370441 - protein, 24 aa, Mycobacterium
TAAGPRAPDYFRRAELCRERLGPV

SEQ ID NO: 370442 - protein, 23 aa, Mycobacterium
TAAGTFLAVWLPLDNGLRPEPII

SEQ ID NO: 370443 - protein, 24 aa, Mycobacterium
TAAGVYVGLFALAFIVVMKAEAGR

SEQ ID NO: 370444 - protein, 17 aa, Mycobacterium
TAAGWLLAGGSPDRAFS

SEQ ID NO: 370445 - protein, 26 aa, Mycobacterium
TAAIFVTIAFLIIQFTQWGRQFWRIT

SEQ ID NO: 370446 - protein, 22 aa, Mycobacterium
TAAIFVWLGMVLAISFLEAPLK

SEQ ID NO: 370447 - protein, 27 aa, Mycobacterium
TAAITLIFIVMLVITRALFASFVIIGT

SEQ ID NO: 370448 - protein, 26 aa, Mycobacterium
TAALFITAAILFRFTERRTLAEFAPF

SEQ ID NO: 370449 - protein, 20 aa, Mycobacterium
TAALIPFSTLGLLVASPGLA

SEQ ID NO: 370450 - protein, 58 aa, Mycobacterium
TAALITLLASSLWVLAVVARPYQWWRVLLVACSMLAYVLIFSIPLAQELFMLDPTNMK

SEQ ID NO: 370451 - protein, 27 aa, Mycobacterium
TAALLGILTRRAVTIPLAALAAACRRV

SEQ ID NO: 370452 - protein, 25 aa, Mycobacterium
TAALLPVFFLLPISVAFQDRPLLTA

SEQ ID NO: 370453 - protein, 29 aa, Mycobacterium
TAALTGWVVGYTLRPLRRLGAIAANVAAM

SEQ ID NO: 370454 - protein, 28 aa, Mycobacterium
TAALTVWVVGITLRPLRRVAATAATVAA

SEQ ID NO: 370455 - protein, 17 aa, Mycobacterium
TAAPILSILIGGAMAVA

SEQ ID NO: 370456 - protein, 23 aa, Mycobacterium
TAAPLDRRLLLGMLAELAAGAGV

SEQ ID NO: 370457 - protein, 18 aa, Mycobacterium
TAAPLFHNIASWLMRREN

SEQ ID NO: 370458 - protein, 22 aa, Mycobacterium
TAARVLWIAAVAALAWTAMIAL

SEQ ID NO: 370459 - protein, 26 aa, Mycobacterium
TAASGLLLWYRWHHNSWLPTAYSAVI

SEQ ID NO: 370460 - protein, 37 aa, Mycobacterium
TAASIPDFWFAITGVWLFAVLLGWLPTSGVDSGVLSW

SEQ ID NO: 370461 - protein, 25 aa, Mycobacterium
TAASVPVVFLTAFYGLRVLAEVRSG

SEQ ID NO: 370462 - protein, 31 aa, Mycobacterium
TAATGLLGWWRWHHNSWLPTVYAGVIGALML

SEQ ID NO: 370463 - protein, 25 aa, Mycobacterium
TAATRYMLMTYIKPGSVVLFHDTYS

SEQ ID NO: 370464 - protein, 34 aa, Mycobacterium
TAAVIFIMLLLVYRSPLTVVLLLLTVGAEFTVAR

SEQ ID NO: 370465 - protein, 22 aa, Mycobacterium
TAAVQLPGVWLLSAVTIALFGV

SEQ ID NO: 370466 - protein, 31 aa, Mycobacterium
TAAVVQPFRFLFMAFLWTIALTFEAGYYLVT

SEQ ID NO: 370467 - protein, 30 aa, Mycobacterium
TAAWAWRLLVILAAAVALLWVVKKLEVIVV

SEQ ID NO: 370468 - protein, 25 aa, Mycobacterium
TAAWSWRLLVIFAAALAVIWVISKL

SEQ ID NO: 370469 - protein, 26 aa, Mycobacterium
TAAYPLAWALCGLFPLAAVPLVPTRL

SEQ ID NO: 370470 - protein, 19 aa, Mycobacterium
TACTLLLGAITKPAVHHAI

SEQ ID NO: 370471 - protein, 40 aa, Mycobacterium
TADAVPPWYADVLLPDLGAAWRIMHAIPAAKAARRRGIEI

SEQ ID NO: 370472 - protein, 34 aa, Mycobacterium
TADDKLFCNSPFFWIGGFAFGLLATLVAGSTLVC

SEQ ID NO: 370473 - protein, 34 aa, Mycobacterium
TADDKLFCNSPFFWVGGLAFALLASMIAGATLVC

SEQ ID NO: 370474 - protein, 30 aa, Mycobacterium
TADEVLDHFPGWDFGWLDLDKMIRGAEYVV

SEQ ID NO: 370475 - protein, 25 aa, Mycobacterium
TADGDLLRQLPLFAGLPAATMAELR

SEQ ID NO: 370476 - protein, 31 aa, Mycobacterium
TADPDLLEPPPPPPPPIPAAPVAPGARDGGG

SEQ ID NO: 370477 - protein, 25 aa, Mycobacterium
TADYSFLAFYPYYGFQGLTPHYANP

SEQ ID NO: 370478 - protein, 25 aa, Mycobacterium
TADYSFLSFYPYWGFQGLTSHYANP

SEQ ID NO: 370479 - protein, 24 aa, Mycobacterium
TADYSFLSFYPYYGFQGLTSHYAN

SEQ ID NO: 370480 - protein, 24 aa, Mycobacterium
TAERIVICSGFTQGLRLVCDALAA

SEQ ID NO: 370481 - protein, 24 aa, Mycobacterium
TAERRYLRMRLSALGIYTTDAHAN

SEQ ID NO: 370482 - protein, 28 aa, Mycobacterium
TAESSLHLWLNLTLVAGVALVVLGVLAA

SEQ ID NO: 370483 - protein, 22 aa, Mycobacterium
TAFALHAWYRTDHPLIDLRLFT

SEQ ID NO: 370484 - protein, 29 aa, Mycobacterium
TAFALVFAIVIVAVARWRGLRALVGIVIA

SEQ ID NO: 370485 - protein, 19 aa, Mycobacterium
TAFATWKALGAKFVAARPA

SEQ ID NO: 370486 - protein, 40 aa, Mycobacterium
TAFAYSTYGLFAGGPLFFDTAALIIAFVVLGRYFEARATG

SEQ ID NO: 370487 - protein, 31 aa, Mycobacterium
TAFGFATFAIWWAWMNFTWFASAYDTDDWVY

SEQ ID NO: 370488 - protein, 28 aa, Mycobacterium
TAFIVAEIVLVHLFKRVAPENAFGAIFL

SEQ ID NO: 370489 - protein, 18 aa, Mycobacterium
TAFLLGDLALWAAVGVIT

SEQ ID NO: 370490 - protein, 24 aa, Mycobacterium
TAFRVPFLRNWKVSRAYLNWLADR

SEQ ID NO: 370491 - protein, 17 aa, Mycobacterium
TAFVPLVLLPTAASAGQ

SEQ ID NO: 370492 - protein, 40 aa, Mycobacterium
TAFVYSTYQLLVGGPLFFDTSALIIAFVVLGRYFEARAHG

SEQ ID NO: 370493 - protein, 30 aa, Mycobacterium
TAGALAAVLLLVVGGVYFALSPDNKQGSTG

SEQ ID NO: 370494 - protein, 17 aa, Mycobacterium
TAGATLGFLLGGAWFVG

SEQ ID NO: 370495 - protein, 25 aa, Mycobacterium
TAGAVFVAAWLPFNNGLRPEPLIAL

SEQ ID NO: 370496 - protein, 21 aa, Mycobacterium
TAGAYLFDALALVGVSPSKGQ

SEQ ID NO: 370497 - protein, 38 aa, Mycobacterium
TAGFPPTCLLAILGLVFFLVVRQWWGVLTAVVVIALQA

SEQ ID NO: 370498 - protein, 34 aa, Mycobacterium
TAGGFYLAFLFPLIGFLVVLLRKTWKPGSFSLRA

SEQ ID NO: 370499 - protein, 20 aa, Mycobacterium
TAGGRLVSAWFPSHQRGLAM

SEQ ID NO: 370500 - protein, 24 aa, Mycobacterium
TAGGYYLAFLFPLVTGLVARLRGK

SEQ ID NO: 370501 - protein, 27 aa, Mycobacterium
TAGLALPFLFWVWMRHLHERRGYRPAH

SEQ ID NO: 370502 - protein, 26 aa, Mycobacterium
TAGLALPFLFWVWMRHLRDDRGYRPP

SEQ ID NO: 370503 - protein, 21 aa, Mycobacterium
TAGLLQLFLGLFGVGRFYIDS

SEQ ID NO: 370504 - protein, 23 aa, Mycobacterium
TAGPGFIFFGLLAPNIFAPLGIL

SEQ ID NO: 370505 - protein, 21 aa, Mycobacterium
TAGPGFWWTFVIVGIGQCIVA

SEQ ID NO: 370506 - protein, 20 aa, Mycobacterium
TAGRGFIFFGLLAPNLFATI

SEQ ID NO: 370507 - protein, 24 aa, Mycobacterium
TAGTWLFDVGMLVLLTVVYAGIVG

SEQ ID NO: 370508 - protein, 24 aa, Mycobacterium
TAGVIMLLLRRPFGRYLIVVGAVV

SEQ ID NO: 370509 - protein, 22 aa, Mycobacterium
TAGVYIPARLLVRRAAPPVQAR

SEQ ID NO: 370510 - protein, 30 aa, Mycobacterium
TAGWLPGHSWYAFDLSPRISADSWWVTIIT

SEQ ID NO: 370511 - protein, 27 aa, Mycobacterium
TAHAPLLWLALLFLVIGGIADMVSAAF

SEQ ID NO: 370512 - protein, 29 aa, Mycobacterium
TAHVAFSIWYLWSVMVLFMPVSTYGFSTG

SEQ ID NO: 370513 - protein, 28 aa, Mycobacterium
TAHVGFSIWYLWSVMMLFMPQSVYGFST

SEQ ID NO: 370514 - protein, 25 aa, Mycobacterium
TAIAAFPLFWLIDTRNAWAITAAVA

SEQ ID NO: 370515 - protein, 25 aa, Mycobacterium
TAIALLFAAYFLRGYFVLIVVAAVG

SEQ ID NO: 370516 - protein, 20 aa, Mycobacterium
TAIFLGARHTARMWRVWLFT

SEQ ID NO: 370517 - protein, 17 aa, Mycobacterium
TAIGLTVAFLFKDNGGL

SEQ ID NO: 370518 - protein, 18 aa, Mycobacterium
TAILVISLLLLAAGTLYR

SEQ ID NO: 370519 - protein, 26 aa, Mycobacterium
TAIPVAIALLLSWRFGPRALGPDDTR

SEQ ID NO: 370520 - protein, 18 aa, Mycobacterium
TAISAWMLTRWLIPWWTA

SEQ ID NO: 370521 - protein, 25 aa, Mycobacterium
TAITVLTCWIVFGTALVAAAAVRAR

SEQ ID NO: 370522 - protein, 17 aa, Mycobacterium
TAIVPVLIALLLSLRFA

SEQ ID NO: 370523 - protein, 23 aa, Mycobacterium
TAIVRWPAPILVASLAVALVGLL

SEQ ID NO: 370524 - protein, 29 aa, Mycobacterium
TAIVVITLPLIPIFMVLIGLATADRSTAA

SEQ ID NO: 370525 - protein, 18 aa, Mycobacterium
TAIYLLVHWVAPGGMGAG

SEQ ID NO: 370526 - protein, 25 aa, Mycobacterium
TAKTRLVERLFDGKLGSNSLELLKT

SEQ ID NO: 370527 - protein, 27 aa, Mycobacterium
TALAADRWQALLAPVATLVISLSSVAL

SEQ ID NO: 370528 - protein, 18 aa, Mycobacterium
TALACGVAVIWWLAHRPN

SEQ ID NO: 370529 - protein, 21 aa, Mycobacterium
TALALLLMPVLGRANHRLGAR

SEQ ID NO: 370530 - protein, 24 aa, Mycobacterium
TALAQQVLLPRLPPKGLSQEELRA

SEQ ID NO: 370531 - protein, 25 aa, Mycobacterium
TALCLFTAVFIMLRRKRIPGVARGP

SEQ ID NO: 370532 - protein, 23 aa, Mycobacterium
TALEWYDFILYGTASALVFATVF

SEQ ID NO: 370533 - protein, 22 aa, Mycobacterium
TALEWYDYFLFGTAAALVFNRL

SEQ ID NO: 370534 - protein, 20 aa, Mycobacterium
TALFLAFLFYTRTGLAIRAT

SEQ ID NO: 370535 - protein, 18 aa, Mycobacterium
TALGLLMIQTLNNGLDIL

SEQ ID NO: 370536 - protein, 24 aa, Mycobacterium
TALGRFYPVLLSTVVYVAAIMATG

SEQ ID NO: 370537 - protein, 22 aa, Mycobacterium
TALIELLAGLRPLGSGVLTVDG

SEQ ID NO: 370538 - protein, 24 aa, Mycobacterium
TALIGYVAVLGIGYVLGAKAGRRR

SEQ ID NO: 370539 - protein, 22 aa, Mycobacterium
TALIHLYIVGVFVSFTFSQIGM

SEQ ID NO: 370540 - protein, 26 aa, Mycobacterium
TALISFSIWYFWADRFSLLALSVLIG

SEQ ID NO: 370541 - protein, 22 aa, Mycobacterium
TALIVLIAVLFLGSSISLTKVV

SEQ ID NO: 370542 - protein, 28 aa, Mycobacterium
TALKILCAAVLFWLAWKSMRTAFRGKHL

SEQ ID NO: 370543 - protein, 20 aa, Mycobacterium
TALLGRWRYGHLGWAPAIYC

SEQ ID NO: 370544 - protein, 19 aa, Mycobacterium
TALLKRMPTSLSARFDRAC

SEQ ID NO: 370545 - protein, 27 aa, Mycobacterium
TALLLAPEAFWPLRRVGAAFHSAQDGK

SEQ ID NO: 370546 - protein, 28 aa, Mycobacterium
TALLLAPEVFWPLRRVGAAFHAAQDGKT

SEQ ID NO: 370547 - protein, 23 aa, Mycobacterium
TALLPFTIVMLLFSSRAGALSGR

SEQ ID NO: 370548 - protein, 18 aa, Mycobacterium
TALLPVAMLLLAAAVAAL

SEQ ID NO: 370549 - protein, 28 aa, Mycobacterium
TALPILPTQILWINMTTAIALGLMLAFE

SEQ ID NO: 370550 - protein, 20 aa, Mycobacterium
TALQSIFLDVLLVISAPLAR

SEQ ID NO: 370551 - protein, 18 aa, Mycobacterium
TALQVTALLFALPIYARL

SEQ ID NO: 370552 - protein, 17 aa, Mycobacterium
TALRRFLHAYSTVVAPV

SEQ ID NO: 370553 - protein, 24 aa, Mycobacterium
TALTFVFLLYRRWIARPGCATESI

SEQ ID NO: 370554 - protein, 23 aa, Mycobacterium
TALTLLFFEVFPHFPVGVSEVHL

SEQ ID NO: 370555 - protein, 20 aa, Mycobacterium
TALTWAMERLAWRLTRVTRF

SEQ ID NO: 370556 - protein, 18 aa, Mycobacterium
TALVFFNTYVWLMAATIS

SEQ ID NO: 370557 - protein, 18 aa, Mycobacterium
TALVIGLIFAPRFTRLVA

SEQ ID NO: 370558 - protein, 20 aa, Mycobacterium
TALYFGPVALWMYWRYGRPN

SEQ ID NO: 370559 - protein, 29 aa, Mycobacterium
TALYGMANSMFIPRFLFALSFCGLGVTTA

SEQ ID NO: 370560 - protein, 19 aa, Mycobacterium
TALYRLVEVLPGETAWPFL

SEQ ID NO: 370561 - protein, 21 aa, Mycobacterium
TAMHHFSVATLFTLAESLQAS

SEQ ID NO: 370562 - protein, 21 aa, Mycobacterium
TAMLFAPHRFGGHDYAAMLER

SEQ ID NO: 370563 - protein, 25 aa, Mycobacterium
TAMLGIFLAPIAWVAAFRLARPTSP

SEQ ID NO: 370564 - protein, 19 aa, Mycobacterium
TAMLLFYATPIVFGFANVV

SEQ ID NO: 370565 - protein, 18 aa, Mycobacterium
TAMPVRLVDGGAGGLRII

SEQ ID NO: 370566 - protein, 17 aa, Mycobacterium
TANRGLEVLPADKIPVL

SEQ ID NO: 370567 - protein, 18 aa, Mycobacterium
TANWSWALMGLTVSALTY

SEQ ID NO: 370568 - protein, 24 aa, Mycobacterium
TAPGLVLRGFVERVGDRAPLVAAD

SEQ ID NO: 370569 - protein, 28 aa, Mycobacterium
TAPLWRAAQLFRLLSCGYALGFHIAINA

SEQ ID NO: 370570 - protein, 19 aa, Mycobacterium
TAPPVAFFSLHTRAWELAV

SEQ ID NO: 370571 - protein, 18 aa, Mycobacterium
TAPVCCLALIFALPDLAW

SEQ ID NO: 370572 - protein, 32 aa, Mycobacterium
TAPVVISGWALLTWILMAFGTCLSRLASVVVA

SEQ ID NO: 370573 - protein, 22 aa, Mycobacterium
TAQIRYLDLIGNRYLEIKRGQG

SEQ ID NO: 370574 - protein, 18 aa, Mycobacterium
TAQLLLRSMGYRDALIGA

SEQ ID NO: 370575 - protein, 26 aa, Mycobacterium
TARGVLIAELSLVAVLFTVCVYYEMQ

SEQ ID NO: 370576 - protein, 19 aa, Mycobacterium
TARHMGLFVVGRLADQHGL

SEQ ID NO: 370577 - protein, 33 aa, Mycobacterium
TARHNTHILSFVYWLGLLLLMFVSGAEVQQLFG

SEQ ID NO: 370578 - protein, 19 aa, Mycobacterium
TARINGRYGPLAPGPQNSI

SEQ ID NO: 370579 - protein, 27 aa, Mycobacterium
TARPAVLAMLVVVLGLAGLVAFLGYRV

SEQ ID NO: 370580 - protein, 26 aa, Mycobacterium
TARRQVALGALLWRSLNPDTTPRTQI

SEQ ID NO: 370581 - protein, 34 aa, Mycobacterium
TARRTVVPGALQKGWLPAVTVIALGIGSLAVWKV

SEQ ID NO: 370582 - protein, 25 aa, Mycobacterium
TARVPTLWIVLGPLGQSITAAGLLG

SEQ ID NO: 370583 - protein, 27 aa, Mycobacterium
TASALWRPLALVVVLLAAWWAVTETEL

SEQ ID NO: 370584 - protein, 26 aa, Mycobacterium
TASFGPMPLVLQYLGDHIDKLTIKTA

SEQ ID NO: 370585 - protein, 26 aa, Mycobacterium
TASFGVAPLMLWQQLTKHYTNISVQT

SEQ ID NO: 370586 - protein, 25 aa, Mycobacterium
TASFYRCLFALRLLAPLAVAEWRGG

SEQ ID NO: 370587 - protein, 23 aa, Mycobacterium
TASGLMYILGFGPLPAYAASALP

SEQ ID NO: 370588 - protein, 29 aa, Mycobacterium
TASIPARWRPAWIGWWLGIAVAATVDADF

SEQ ID NO: 370589 - protein, 26 aa, Mycobacterium
TASLGFVFLAGWRWFPRGGAGMLGDA

SEQ ID NO: 370590 - protein, 17 aa, Mycobacterium
TASMFFIRDRPGYLWAG

SEQ ID NO: 370591 - protein, 20 aa, Mycobacterium
TASRFVACPFGETGERMYRT

SEQ ID NO: 370592 - protein, 23 aa, Mycobacterium
TASRHAHWLNPEPKHLWGSGDSA

SEQ ID NO: 370593 - protein, 25 aa, Mycobacterium
TASVAPPIPLLPRLVERDAIVGEAA

SEQ ID NO: 370594 - protein, 19 aa, Mycobacterium
TASVLALGGLLVLPGYRAS

SEQ ID NO: 370595 - protein, 23 aa, Mycobacterium
TASVLALGGLLVLPGYRASFDDR

SEQ ID NO: 370596 - protein, 24 aa, Mycobacterium
TASVLPVWLLLAPRDYLSTFMKVG

SEQ ID NO: 370597 - protein, 24 aa, Mycobacterium
TASVRYLNLIGDRYLELARGDSNT

SEQ ID NO: 370598 - protein, 23 aa, Mycobacterium
TASVTWFVGLGYGARYLAGVFER

SEQ ID NO: 370599 - protein, 34 aa, Mycobacterium
TASVVALLLIATYRSPVLWLVPLLVVGFADRVAA

SEQ ID NO: 370600 - protein, 38 aa, Mycobacterium
TASVVALLLILTYRSPVLWLLPLLVIAFADRVATTVGT

SEQ ID NO: 370601 - protein, 22 aa, Mycobacterium
TASWLAIVLALAVAATPILAVA

SEQ ID NO: 370602 - protein, 24 aa, Mycobacterium
TASYLLVWLQRIGQLWVFPAYTAT

SEQ ID NO: 370603 - protein, 23 aa, Mycobacterium
TATALLVVFFRHNLSMNGGLFLA

SEQ ID NO: 370604 - protein, 29 aa, Mycobacterium
TATALVWFPLWFVILGIGWALVRRRPGHL

SEQ ID NO: 370605 - protein, 26 aa, Mycobacterium
TATDQLMLPFSWQGVSLHAAGAARLR

SEQ ID NO: 370606 - protein, 30 aa, Mycobacterium
TATENGFTLMIPPVLVRPEIMRGTGFLGAH

SEQ ID NO: 370607 - protein, 23 aa, Mycobacterium
TATLLALKPWYPKASVLGGVISS

SEQ ID NO: 370608 - protein, 17 aa, Mycobacterium
TATLLYGIPVLGILLVL

SEQ ID NO: 370609 - protein, 27 aa, Mycobacterium
TATNLGAWCPLAFWIAVAGLTPTGTVL

SEQ ID NO: 370610 - protein, 34 aa, Mycobacterium
TATNRLRLGLNIPYLLLLLAFVVYDIFQTIRSGG

SEQ ID NO: 370611 - protein, 20 aa, Mycobacterium
TATQLLLGPVARGTTVSLAE

SEQ ID NO: 370612 - protein, 23 aa, Mycobacterium
TATSVAVLVFFARDRRGQSLWRV

SEQ ID NO: 370613 - protein, 34 aa, Mycobacterium
TATVLLVVFLYDNFGLKWGLFGAAAIMVVTSFVV

SEQ ID NO: 370614 - protein, 34 aa, Mycobacterium
TATVPGGWFTATVLLILLAIAVFVAFHVARRTMR

SEQ ID NO: 370615 - protein, 27 aa, Mycobacterium
TAVEMVLLWWLRRLFEAPLPTVGVALP

SEQ ID NO: 370616 - protein, 22 aa, Mycobacterium
TAVFGIFAHRWLARRTRRRINP

SEQ ID NO: 370617 - protein, 23 aa, Mycobacterium
TAVLFAFHVVTGRPLGLFAAYGA

SEQ ID NO: 370618 - protein, 19 aa, Mycobacterium
TAVLKHRYFRRLNIAAADL

SEQ ID NO: 370619 - protein, 35 aa, Mycobacterium
TAVLLGLLLNTLAGWWWADPLAGYVLVLYALREVK

SEQ ID NO: 370620 - protein, 34 aa, Mycobacterium
TAVLLSPMSFLRRPARWMQLLASHPKCFSAAPNF

SEQ ID NO: 370621 - protein, 18 aa, Mycobacterium
TAVLLVVLDWRLGLMCLA

SEQ ID NO: 370622 - protein, 17 aa, Mycobacterium
TAVLMDRWDPAQAVALM

SEQ ID NO: 370623 - protein, 28 aa, Mycobacterium
TAVLTAWVVGYALRPLRRLAATAAEVAA

SEQ ID NO: 370624 - protein, 18 aa, Mycobacterium
TAVMCCAIVIAAAALCGV

SEQ ID NO: 370625 - protein, 22 aa, Mycobacterium
TAVMIVFLALLNDGAILAIAYD

SEQ ID NO: 370626 - protein, 20 aa, Mycobacterium
TAVMSLMWGWRLAAVCVTVA

SEQ ID NO: 370627 - protein, 25 aa, Mycobacterium
TAVPFLLPLLFQLEFGWSAFTAGLM

SEQ ID NO: 370628 - protein, 26 aa, Mycobacterium
TAVPFLLPLQFQLQFGWTPLAAGAMV

SEQ ID NO: 370629 - protein, 24 aa, Mycobacterium
TAVPFSALYLFKFDFNPISLGSAF

SEQ ID NO: 370630 - protein, 23 aa, Mycobacterium
TAVPLLCLLAIDVGLVILGALAF

SEQ ID NO: 370631 - protein, 29 aa, Mycobacterium
TAVSAWLITRAWQMPPVLHLTVAAVTVRA

SEQ ID NO: 370632 - protein, 24 aa, Mycobacterium
TAVSVIFLNLLHGVLIGLALAIAL

SEQ ID NO: 370633 - protein, 28 aa, Mycobacterium
TAVSVLIILLIIYRNVVTMLVPLATIGI

SEQ ID NO: 370634 - protein, 33 aa, Mycobacterium
TAVSVLVILLMVYRNIVTMLVPLATIGLSLATA

SEQ ID NO: 370635 - protein, 24 aa, Mycobacterium
TAVSVVFLNLLHGVLIGLALAIAL

SEQ ID NO: 370636 - protein, 23 aa, Mycobacterium
TAVTLLYLGYLRRQTRIEEKVRR

SEQ ID NO: 370637 - protein, 21 aa, Mycobacterium
TAVVILSRIFWGEITVLLIRL

SEQ ID NO: 370638 - protein, 18 aa, Mycobacterium
TAVVIVSRIFWGEITTLL

SEQ ID NO: 370639 - protein, 19 aa, Mycobacterium
TAVVRWPAPILAVSAAVVL

SEQ ID NO: 370640 - protein, 21 aa, Mycobacterium
TAVVRWPAPILAVTIGIALVG

SEQ ID NO: 370641 - protein, 19 aa, Mycobacterium
TAVVRWPAPILVASAFIVL

SEQ ID NO: 370642 - protein, 20 aa, Mycobacterium
TAVVRWPAPVLAVTIAVALV

SEQ ID NO: 370643 - protein, 26 aa, Mycobacterium
TAVVRWPIPIILVTGLVAAIGFASLL

SEQ ID NO: 370644 - protein, 30 aa, Mycobacterium
TAVWTAALVFLTAWLPFNNGLRPEPIIVFG

SEQ ID NO: 370645 - protein, 24 aa, Mycobacterium
TAWVLTVIHLRLSLIPVLIGMAIA

SEQ ID NO: 370646 - protein, 35 aa, Mycobacterium
TAYLEFVADIRRTGWRPLFAEYCVMARLMAVAVLQ

SEQ ID NO: 370647 - protein, 22 aa, Mycobacterium
TAYLINRRWTFQAAPSGARFAA

SEQ ID NO: 370648 - protein, 21 aa, Mycobacterium
TAYLINRRWTFQAAPSTARFV

SEQ ID NO: 370649 - protein, 25 aa, Mycobacterium
TAYSDMNAMFYIPGRSKYTAKQQGQ

SEQ ID NO: 370650 - protein, 24 aa, Mycobacterium
TAYVLTFGGLMLLGGRLGDTIGRK

SEQ ID NO: 370651 - protein, 26 aa, Mycobacterium
TCALFPALFGLCAVLVRGLPGWPVWF

SEQ ID NO: 370652 - protein, 17 aa, Mycobacterium
TCFITAVAGLMQILLGF

SEQ ID NO: 370653 - protein, 17 aa, Mycobacterium
TCFVGFLASYLFNVYFQ

SEQ ID NO: 370654 - protein, 22 aa, Mycobacterium
TCGIGAFIWGIVDAILILTDKV

SEQ ID NO: 370655 - protein, 25 aa, Mycobacterium
TCLGVVAIFYLPETITRPPDARPPL

SEQ ID NO: 370656 - protein, 17 aa, Mycobacterium
TCLIPAGGLALPDSLVR

SEQ ID NO: 370657 - protein, 25 aa, Mycobacterium
TCSARLPVFALLVGLLVSPQIHWWG

SEQ ID NO: 370658 - protein, 24 aa, Mycobacterium
TCTFYLITVFALTLAKNGAGESTA

SEQ ID NO: 370659 - protein, 18 aa, Mycobacterium
TCTRLTDAYLAPIKLRTT

SEQ ID NO: 370660 - protein, 19 aa, Mycobacterium
TCVASAMLGLALSAIAKSN

SEQ ID NO: 370661 - protein, 34 aa, Mycobacterium; identical to SEQ ID NO: 345880

SEQ ID NO: 370662 - protein, 24 aa, Mycobacterium
TDAAKLLRDRYPRGMPLELAAPII

SEQ ID NO: 370663 - protein, 24 aa, Mycobacterium
TDAARLLAERYPDGMPPALVARLV

SEQ ID NO: 370664 - protein, 23 aa, Mycobacterium
TDADIPTWPFAVGAIAAVAAGAL

SEQ ID NO: 370665 - protein, 25 aa, Mycobacterium
TDADPFPVLFKPGVGLLLDLQSSSA

SEQ ID NO: 370666 - protein, 27 aa, Mycobacterium
TDAELFNIIHLLIFAGLDTVTASMSCI

SEQ ID NO: 370667 - protein, 23 aa, Mycobacterium
TDAEYRARFLREADLAAGLSHPH

SEQ ID NO: 370668 - protein, 23 aa, Mycobacterium
TDALAPRPIALGLFNAIPEAPPL

SEQ ID NO: 370669 - protein, 19 aa, Mycobacterium
TDALRTRLLVSAVLTVPVI

SEQ ID NO: 370670 - protein, 23 aa, Mycobacterium
TDARLLHRLLGLTVLKVSTGQEA

SEQ ID NO: 370671 - protein, 25 aa, Mycobacterium
TDARSFLTALFRNVAALDSGARGAT

SEQ ID NO: 370672 - protein, 31 aa, Mycobacterium
TDATSRNPMFLFFPAMMAVSLIGTLAYGSRG

SEQ ID NO: 370673 - protein, 25 aa, Mycobacterium
TDATYFWPIWPILGAGIGLASHAVS

SEQ ID NO: 370674 - protein, 23 aa, Mycobacterium
TDDGQLWIAMQFVDGIDADEALR

SEQ ID NO: 370675 - protein, 35 aa, Mycobacterium
TDDLRRPVLGWVLFAGLIVWSAACATVYLTGSRRR

SEQ ID NO: 370676 - protein, 21 aa, Mycobacterium
TDDMRALFDAIINDDPLPEER

SEQ ID NO: 370677 - protein, 25 aa, Mycobacterium
TDEAGIVFITFLAAYFPIMVSTRHA

SEQ ID NO: 370678 - protein, 23 aa, Mycobacterium
TDEPLIPLVIFRDRDFGLCNAGV

SEQ ID NO: 370679 - protein, 21 aa, Mycobacterium
TDFFDVLKTQFGSSGGPLAQE

SEQ ID NO: 370680 - protein, 19 aa, Mycobacterium
TDFFQVLVTQFGSSGGPFA

SEQ ID NO: 370681 - protein, 19 aa, Mycobacterium
TDFGIYQPSGTPTAWMVSP

SEQ ID NO: 370682 - protein, 25 aa, Mycobacterium
TDFRFLGWHWTLPLGVAILLAAVVG

SEQ ID NO: 370683 - protein, 22 aa, Mycobacterium
TDFVAFLDSDVVPRRGWLEALL

SEQ ID NO: 370684 - protein, 25 aa, Mycobacterium
TDGFAQVFPEHKYHIVRLLQARGHI

SEQ ID NO: 370685 - protein, 22 aa, Mycobacterium
TDGGFIVFPLTYVIGDVLSEVY

SEQ ID NO: 370686 - protein, 25 aa, Mycobacterium
TDGVTLLLIGFMLALSAASLPVQFG

SEQ ID NO: 370687 - protein, 21 aa, Mycobacterium
TDHYHVTNLFLANKFLGPPDS

SEQ ID NO: 370688 - protein, 30 aa, Mycobacterium
TDIRKIFDAIINDDPLPGELLPDGTRVPMP

SEQ ID NO: 370689 - protein, 22 aa, Mycobacterium
TDLAGAWRVLHALPAARAATDN

SEQ ID NO: 370690 - protein, 24 aa, Mycobacterium
TDLCGVSWVYRYAVAVYRDDRGCG

SEQ ID NO: 370691 - protein, 24 aa, Mycobacterium
TDLCGVTWVYRYAVAVYRDDRGCG

SEQ ID NO: 370692 - protein, 17 aa, Mycobacterium
TDLLKLDGSFTSSITSV

SEQ ID NO: 370693 - protein, 21 aa, Mycobacterium
TDLLLDALAQRRPVSVEDPDV

SEQ ID NO: 370694 - protein, 31 aa, Mycobacterium
TDLLPAFAYFAVWYLLCGCAFLLLGFETRGK

SEQ ID NO: 370695 - protein, 21 aa, Mycobacterium
TDPAFQIIARTDARWVYGDVK

SEQ ID NO: 370696 - protein, 17 aa, Mycobacterium
TDPATLAALQVLTALRP

SEQ ID NO: 370697 - protein, 26 aa, Mycobacterium
TDPDARDLMLSCGAALHHCVVALAAL

SEQ ID NO: 370698 - protein, 29 aa, Mycobacterium
TDPEEAELAFLLAGWRDDVRQAPMTGIIN

SEQ ID NO: 370699 - protein, 26 aa, Mycobacterium
TDPFRVLFRGWVVLPALVAFGVVCWW

SEQ ID NO: 370700 - protein, 27 aa, Mycobacterium
TDPGRRRSLLTIGLLAAGAVSGVAGVV

SEQ ID NO: 370701 - protein, 35 aa, Mycobacterium
TDPLLFPFQPIHVTIAAWFTIGIPAFVLSLAPNNE

SEQ ID NO: 370702 - protein, 22 aa, Mycobacterium
TDPLLLPIVALLNGLGLVMIHR

SEQ ID NO: 370703 - protein, 23 aa, Mycobacterium
TDPLLLPIVALLNGLGLVMIHRL

SEQ ID NO: 370704 - protein, 24 aa, Mycobacterium
TDPNPPLPPWQPNPSPRVPGTADP

SEQ ID NO: 370705 - protein, 33 aa, Mycobacterium
TDPSNYWYIAIYFTLIVFFTFFYVSITFNPDER

SEQ ID NO: 370706 - protein, 24 aa, Mycobacterium
TDPVLLDWLVGLAFPCQRPFDHRN

SEQ ID NO: 370707 - protein, 31 aa, Mycobacterium
TDRDESVWHPGLVAALIGGGLGLVLLTAGIT

SEQ ID NO: 370708 - protein, 28 aa, Mycobacterium
TDRILLDQASWLMPSRWGYAAQGSTVDL

SEQ ID NO: 370709 - protein, 23 aa, Mycobacterium
TDRLPLVLGLMAAITFALLFLLT

SEQ ID NO: 370710 - protein, 31 aa, Mycobacterium
TDRLWGAALTLILLIALLNVGARFVAKIFAP

SEQ ID NO: 370711 - protein, 26 aa, Mycobacterium
TDRRRATGLLLLSLAALIILMSTVSG

SEQ ID NO: 370712 - protein, 60 aa, Mycobacterium
TDRTAPFDVATPPLLRLTVIRLPGGRDRMLFTYHFLLFDGWSRELVLRDLFALYDSDAQH

SEQ ID NO: 370713 - protein, 26 aa, Mycobacterium
TDRVVRLANLALLLYVAGAAGASLLL

SEQ ID NO: 370714 - protein, 17 aa, Mycobacterium
TDRYWWTALTVTLAITV

SEQ ID NO: 370715 - protein, 31 aa, Mycobacterium
TDSRLRRGAHWRAIVVVGLLVSSAALVTVLY

SEQ ID NO: 370716 - protein, 19 aa, Mycobacterium
TDTGLLILRLALGATMLQA

SEQ ID NO: 370717 - protein, 21 aa, Mycobacterium
TDTILLVHLAGLGSSTPTALV

SEQ ID NO: 370718 - protein, 24 aa, Mycobacterium
TDTRAIPDLYMQPISLAVTPDGNS

SEQ ID NO: 370719 - protein, 26 aa, Mycobacterium
TDTSAYWVFLLFYVGAALLTWSRYGR

SEQ ID NO: 370720 - protein, 21 aa, Mycobacterium
TDVRPLLLRLVGRRTETVTDD

SEQ ID NO: 370721 - protein, 26 aa, Mycobacterium
TDVSYGMYIYAYPMQQLLAVLGLLSL

SEQ ID NO: 370722 - protein, 22 aa, Mycobacterium
TDYAVFLISRYHDYLRRGADFD

SEQ ID NO: 370723 - protein, 21 aa, Mycobacterium
TDYAVFLISRYHDYLRRGAEA

SEQ ID NO: 370724 - protein, 20 aa, Mycobacterium
TDYAVFLISRYHECLRRGVD

SEQ ID NO: 370725 - protein, 29 aa, Mycobacterium
TEAFGVRGIRRLLWQLEPLGVELVVSTGA

SEQ ID NO: 370726 - protein, 17 aa, Mycobacterium
TEAPPPEPPPSNPMLPP

SEQ ID NO: 370727 - protein, 25 aa, Mycobacterium
TEATFLRWVWYAARRARLRLDGADD

SEQ ID NO: 370728 - protein, 26 aa, Mycobacterium
TEATFRFLLYAFLCVTAFVAVRVEER

SEQ ID NO: 370729 - protein, 19 aa, Mycobacterium
TEDTKLPTVLFQTTTNKLR

SEQ ID NO: 370730 - protein, 22 aa, Mycobacterium
TEEGLPMRTPGARLVPGGVAAA

SEQ ID NO: 370731 - protein, 24 aa, Mycobacterium
TEEPPPGPFGLPPAPPPPPQQPAG

SEQ ID NO: 370732 - protein, 25 aa, Mycobacterium
TEFQAVQFMPLVIAPQLLLCGIIVP

SEQ ID NO: 370733 - protein, 22 aa, Mycobacterium
TEFWFAMIKIVAILALIVVGLV

SEQ ID NO: 370734 - protein, 20 aa, Mycobacterium
TEFWLVMTLHHRPDGNLAGE

SEQ ID NO: 370735 - protein, 36 aa, Mycobacterium
TEGARLVNILVITPLRLLFLIVLVGTTVEALTERSR

SEQ ID NO: 370736 - protein, 38 aa, Mycobacterium
TEHLAAVYLIGILVISVIWRLRLALAMSIASAIVFDCI

SEQ ID NO: 370737 - protein, 17 aa, Mycobacterium
TEIAIVDAIPRTPSGKP

SEQ ID NO: 370738 - protein, 18 aa, Mycobacterium
TEILIAILMFFSIGFVPL

SEQ ID NO: 370739 - protein, 24 aa, Mycobacterium
TEKKSYPYFDPIAQKPFDANYDSE

SEQ ID NO: 370740 - protein, 33 aa, Mycobacterium
TEKPFLARMIHAFAVPIILAWVAVCVALSVFIP

SEQ ID NO: 370741 - protein, 23 aa, Mycobacterium
TELAHFLVFPWLDPSGAGYVPGM

SEQ ID NO: 370742 - protein, 33 aa, Mycobacterium
TELGPTRLIILGFSLFILFVVGAIVSTYLLLPV

SEQ ID NO: 370743 - protein, 21 aa, Mycobacterium
TELPVLLYDIPGRSAVPIESE

SEQ ID NO: 370744 - protein, 22 aa, Mycobacterium
TELQADCYAGVWAHYAAITKQE

SEQ ID NO: 370745 - protein, 30 aa, Mycobacterium
TELVFAGLAGALLLTGWLLAAFADTPRSAE

SEQ ID NO: 370746 - protein, 22 aa, Mycobacterium
TELVYLPPAWFGRNPAPRLPAV

SEQ ID NO: 370747 - protein, 30 aa, Mycobacterium
TELWRSLVWIGWVWPLTAAIFVTIAFLIIQ

SEQ ID NO: 370748 - protein, 19 aa, Mycobacterium
TEMLRGTGAWTPYVAPTAT

SEQ ID NO: 370749 - protein, 40 aa, Mycobacterium
TENDLLRMEFIAIPLSFAALVWVFGGLLAAALPILVGGFA

SEQ ID NO: 370750 - protein, 24 aa, Mycobacterium
TENLRYYYLILPTVDGSLSRRFGF

SEQ ID NO: 370751 - protein, 22 aa, Mycobacterium
TEPALDLDALLGGLKPVVKGLD

SEQ ID NO: 370752 - protein, 40 aa, Mycobacterium
TEPALLARWIRRLAIPIMLGWLAIIVLINILVPSLQQVAA

SEQ ID NO: 370753 - protein, 23 aa, Mycobacterium
TEPDAPAPPRPAPARPVAPPSDD

SEQ ID NO: 370754 - protein, 25 aa, Mycobacterium
TEPDPPLYFIVYTAVLAVACLIAGG

SEQ ID NO: 370755 - protein, 29 aa, Mycobacterium
TEPLVLGFVALIAFVMLLVSVHSVFLALK

SEQ ID NO: 370756 - protein, 18 aa, Mycobacterium
TEPNFLREWLPGQLLQGI

SEQ ID NO: 370757 - protein, 22 aa, Mycobacterium
TEPPLPIDQDSPIRICMQQTGQ

SEQ ID NO: 370758 - protein, 25 aa, Mycobacterium
TEPVLRILFYYFLLSTVMSLPIAIA

SEQ ID NO: 370759 - protein, 20 aa, Mycobacterium
TEPVRRRWLTWWRYTRTWES

SEQ ID NO: 370760 - protein, 17 aa, Mycobacterium
TEQIGLLVFMIVASKGA

SEQ ID NO: 370761 - protein, 23 aa, Mycobacterium
TEQPTFYLDFPTSVSPLTRPHRS

SEQ ID NO: 370762 - protein, 23 aa, Mycobacterium
TERFSWVVLGLALFAAGSIAAYF

SEQ ID NO: 370763 - protein, 28 aa, Mycobacterium
TERITRLVEDLLLLARLDSGRPLEREPV

SEQ ID NO: 370764 - protein, 28 aa, Mycobacterium
TERMTRLVEDLLLLARLDSGRPLEREPV

SEQ ID NO: 370765 - protein, 34 aa, Mycobacterium
TESARLVNVLVITPLRVAFLIVLIGTTVETLTTQ

SEQ ID NO: 370766 - protein, 23 aa, Mycobacterium
TESGLILGLLLSGAGISTLAVYL

SEQ ID NO: 370767 - protein, 28 aa, Mycobacterium
TESHNLITHLSFLAVTLTASALAALARA

SEQ ID NO: 370768 - protein, 23 aa, Mycobacterium
TESLTWAQLYRRTLNVAHEVTRH

SEQ ID NO: 370769 - protein, 22 aa, Mycobacterium
TESNFPALVTFLSNAIADQQAS

SEQ ID NO: 370770 - protein, 21 aa, Mycobacterium
TESSFVLMFLSGLPSMAVLIR

SEQ ID NO: 370771 - protein, 25 aa, Mycobacterium
TESSLWTSALWAVALLVAGTGIGMA

SEQ ID NO: 370772 - protein, 25 aa, Mycobacterium
TETPWLLYTVIGISVLVIAAAIPLL

SEQ ID NO: 370773 - protein, 21 aa, Mycobacterium
TETTRLLLGAVPAAFHAGPQE

SEQ ID NO: 370774 - protein, 23 aa, Mycobacterium
TEVFPLTMFAVAGMLLFPAADDL

SEQ ID NO: 370775 - protein, 29 aa, Mycobacterium
TEVSWRLAFLVNVPIGLIMIYLARKTLRE

SEQ ID NO: 370776 - protein, 25 aa, Mycobacterium
TEVSWRWAFLVNVPIGLVMVYLART

SEQ ID NO: 370777 - protein, 20 aa, Mycobacterium
TFAALGWFYLSVLPGWLHLP

SEQ ID NO: 370778 - protein, 31 aa, Mycobacterium
TFAAPDKPVIFWTPDYGAVIVRGAMNAAWEK

SEQ ID NO: 370779 - protein, 28 aa, Mycobacterium
TFADWLENLWILNVIVFVAGLTYFWLSG

SEQ ID NO: 370780 - protein, 19 aa, Mycobacterium
TFAFVLLTALAFGGHLAPM

SEQ ID NO: 370781 - protein, 17 aa, Mycobacterium
TFAQWMTVLAMGLGFAI

SEQ ID NO: 370782 - protein, 24 aa, Mycobacterium
TFATIFVWLMILLAHFRFRAQQHH

SEQ ID NO: 370783 - protein, 25 aa, Mycobacterium
TFAVGYVILHRLKIGRRIYAVGGNR

SEQ ID NO: 370784 - protein, 24 aa, Mycobacterium
TFCLSFTRLPYFQTMGVPLAIGMF

SEQ ID NO: 370785 - protein, 19 aa, Mycobacterium
TFCLSFTRMPYFQTLGIPC

SEQ ID NO: 370786 - protein, 24 aa, Mycobacterium
TFEIFIVAAIYYLALTTIWTFIQA

SEQ ID NO: 370787 - protein, 20 aa, Mycobacterium
TFERTAVVLVIVSIVTIPAA

SEQ ID NO: 370788 - protein, 28 aa, Mycobacterium
TFGLGSRYFRLLPRRLVERIVPKPGTGP

SEQ ID NO: 370789 - protein, 23 aa, Mycobacterium
TFGPYRLTRLLGRGGMGEVYEAE

SEQ ID NO: 370790 - protein, 21 aa, Mycobacterium
TFGQNLRIVLLPQAFRAVVIP

SEQ ID NO: 370791 - protein, 26 aa, Mycobacterium
TFGTAYPPPPPGPPAPWPGYAEDFPA

SEQ ID NO: 370792 - protein, 18 aa, Mycobacterium
TFGVLMLRIEETAIGAVI

SEQ ID NO: 370793 - protein, 31 aa, Mycobacterium
TFHRHRWSRRRIMLVAVLAAVLVVAALFIGR

SEQ ID NO: 370794 - protein, 18 aa, Mycobacterium
TFIASTLVLLLFAVGFTA

SEQ ID NO: 370795 - protein, 24 aa, Mycobacterium
TFIENPLLLFTYSAVLGPLVGAAL

SEQ ID NO: 370796 - protein, 20 aa, Mycobacterium
TFILGMFWRRMTSTAGWTGL

SEQ ID NO: 370797 - protein, 17 aa, Mycobacterium
TFILLVAVGSDYNLLLI

SEQ ID NO: 370798 - protein, 18 aa, Mycobacterium
TFLAWQRTALGLLAAAVA

SEQ ID NO: 370799 - protein, 21 aa, Mycobacterium
TFLGALCFLVAALMVLPRAVP

SEQ ID NO: 370800 - protein, 26 aa, Mycobacterium
TFLLLPMLVVVWLSLHRWDLLGPIEF

SEQ ID NO: 370801 - protein, 38 aa, Mycobacterium
TFLNPIDLLWSFLQAILMAITILLIHTYFGYFASGGPS

SEQ ID NO: 370802 - protein, 18 aa, Mycobacterium
TFLTVEAWAFLQLGSRQQ

SEQ ID NO: 370803 - protein, 19 aa, Mycobacterium
TFLTVEAWAFLQLGSRQQS

SEQ ID NO: 370804 - protein, 17 aa, Mycobacterium
TFLVPSDLLWSFLQAIV

SEQ ID NO: 370805 - protein, 25 aa, Mycobacterium
TFMKIALMMWQIGSPVLFPVAIWWF

SEQ ID NO: 370806 - protein, 23 aa, Mycobacterium
TFMVLRLVFVGWRALSGRWLVPG

SEQ ID NO: 370807 - protein, 35 aa, Mycobacterium
TFNPEFHWPIIGDTFLWHLWDELLGIGTVIGIVTL

SEQ ID NO: 370808 - protein, 36 aa, Mycobacterium
TFPDRDALAPNRLPRKRLRVAGMTFGAVAVAVVASA

SEQ ID NO: 370809 - protein, 26 aa, Mycobacterium
TFQALTWIFQIMPLFFFAGAAACVPS

SEQ ID NO: 370810 - protein, 24 aa, Mycobacterium
TFQRTPAWIIPKPNPALSPRAQRI

SEQ ID NO: 370811 - protein, 17 aa, Mycobacterium
TFRRVLLPQLRPTTFFL

SEQ ID NO: 370812 - protein, 24 aa, Mycobacterium
TFSIPLIPHRASFWALSSLSRPAM

SEQ ID NO: 370813 - protein, 29 aa, Mycobacterium
TFSSGQRALLWAAGVLGALAIVIAILIVL

SEQ ID NO: 370814 - protein, 29 aa, Mycobacterium
TFSSLLAAVQIGFIIGVGLLLDTFLVRTI

SEQ ID NO: 370815 - protein, 18 aa, Mycobacterium
TFSYFLPEGHEYQITLIA

SEQ ID NO: 370816 - protein, 19 aa, Mycobacterium
TFTAIFLAGGLMFSLTVCI

SEQ ID NO: 370817 - protein, 18 aa, Mycobacterium
TFTAIFVPVLARAEQDDP

SEQ ID NO: 370818 - protein, 33 aa, Mycobacterium
TFTGTALGLIFLWFSMTPSLLPRGPLYQGLVSG

SEQ ID NO: 370819 - protein, 36 aa, Mycobacterium
TFTGTAVGLVFLFLSLTPSLLPRGPLFQGLVSGGAG

SEQ ID NO: 370820 - protein, 26 aa, Mycobacterium
TFTINMAAVLYLLISKRLFGLRGGRQ

SEQ ID NO: 370821 - protein, 26 aa, Mycobacterium
TFTINVAAVLYLLFSKRLFGLRGGRA

SEQ ID NO: 370822 - protein, 25 aa, Mycobacterium
TFTLLDGVVIFAFLLWHVIGANSSD

SEQ ID NO: 370823 - protein, 25 aa, Mycobacterium
TFTQGQWILNGYILTLAALEIVAGA

SEQ ID NO: 370824 - protein, 29 aa, Mycobacterium
TFTVIIAMLLLVYRSVITVLLTLVMVVLE

SEQ ID NO: 370825 - protein, 29 aa, Mycobacterium
TFTVIIGMLLLVYRSVITVLLTLVMVVLE

SEQ ID NO: 370826 - protein, 19 aa, Mycobacterium
TFTWPAGYMLVLLAVVIWL

SEQ ID NO: 370827 - protein, 35 aa, Mycobacterium
TFVALALPRSIDMVVALFAVLRAGAAYLPLELDLP

SEQ ID NO: 370828 - protein, 17 aa, Mycobacterium
TFVGVRRVADGSPIIWL

SEQ ID NO: 370829 - protein, 21 aa, Mycobacterium
TFVLGSFYIIPSILAVRGTGM

SEQ ID NO: 370830 - protein, 17 aa, Mycobacterium
TFVLGSFYIVPSILAVR

SEQ ID NO: 370831 - protein, 35 aa, Mycobacterium
TFVPRTIRRLALPILLFWVGLAALTNIAVPQLEDV

SEQ ID NO: 370832 - protein, 27 aa, Mycobacterium
TFVQAFQYWLKLTAIAIPALALLGLFI

SEQ ID NO: 370833 - protein, 20 aa, Mycobacterium
TFVQAFQYWLKLTAVAIPAL

SEQ ID NO: 370834 - protein, 18 aa, Mycobacterium
TFVQVPIGQLARSLPDVD

SEQ ID NO: 370835 - protein, 17 aa, Mycobacterium
TFVTFAAAYFGAALLLP

SEQ ID NO: 370836 - protein, 18 aa, Mycobacterium
TFVTFGLAYLAIIGVPPF

SEQ ID NO: 370837 - protein, 18 aa, Mycobacterium
TFYIDFPTSVSPLTRPHR

SEQ ID NO: 370838 - protein, 21 aa, Mycobacterium
TGACCLYWETLGPAGQVLSLQ

SEQ ID NO: 370839 - protein, 31 aa, Mycobacterium
TGADTFVSWLPLYHDMGLIGAWLGCMYFGVP

SEQ ID NO: 370840 - protein, 25 aa, Mycobacterium
TGAFEVVGRRRLWFGISGAIVAVAL

SEQ ID NO: 370841 - protein, 24 aa, Mycobacterium
TGAFEVVGRRRLWFGISGGIVAVA

SEQ ID NO: 370842 - protein, 31 aa, Mycobacterium
TGAGVWLGIASFAAAGVVALLAWMNRDRSPR

SEQ ID NO: 370843 - protein, 46 aa, Mycobacterium
TGAHAPLWREFLRFWTVSFPVVAYRSWRWWLGTAIGFFIVTIALAM

SEQ ID NO: 370844 - protein, 24 aa, Mycobacterium
TGAIYVMVDHRLHPALNLVSARLI

SEQ ID NO: 370845 - protein, 18 aa, Mycobacterium
TGAKWDLMIAATAAITLI

SEQ ID NO: 370846 - protein, 29 aa, Mycobacterium
TGALGPSLFGLNLWWSLLAFVVGHVIGGA

SEQ ID NO: 370847 - protein, 32 aa, Mycobacterium
TGALGVYLPGGVLVLSLIGFIAGFGPFYTGKA

SEQ ID NO: 370848 - protein, 22 aa, Mycobacterium
TGALLALGLAPIAIGALVITLL

SEQ ID NO: 370849 - protein, 31 aa, Mycobacterium
TGASLVKLFDWLPMFVLIAGIFGWVTDALPD

SEQ ID NO: 370850 - protein, 26 aa, Mycobacterium
TGASWLRVFELAAGLILLVFLSRSPR

SEQ ID NO: 370851 - protein, 29 aa, Mycobacterium
TGATGFLGPFLLASLLRRTSHTIHALVRA

SEQ ID NO: 370852 - protein, 26 aa, Mycobacterium
TGATVFMGYPFFRGALRSIRSGRAGT

SEQ ID NO: 370853 - protein, 25 aa, Mycobacterium
TGAVVWLGIASFAAAGVVGLLAWVG

SEQ ID NO: 370854 - protein, 29 aa, Mycobacterium
TGAWIDVAVILWVLLALSAAMVVFLAAWW

SEQ ID NO: 370855 - protein, 19 aa, Mycobacterium
TGAYLVVLVFGMSAGIREQ

SEQ ID NO: 370856 - protein, 30 aa, Mycobacterium
TGDAPLGTCAFWPVPPTSKPHVVYAPDLVP

SEQ ID NO: 370857 - protein, 24 aa, Mycobacterium
TGDPLTPILGLCSAATALLGSPAD

SEQ ID NO: 370858 - protein, 28 aa, Mycobacterium
TGDPRTLSPFAVQRWLNPVNAAAAAALM

SEQ ID NO: 370859 - protein, 19 aa, Mycobacterium
TGDRQWLRHDGWPVLQAVA

SEQ ID NO: 370860 - protein, 33 aa, Mycobacterium
TGEDFVALIHSDLLGWLAIAIAIAIGVALVAVP

SEQ ID NO: 370861 - protein, 28 aa, Mycobacterium
TGEIDGQLYLVMPIINGVDLEVALQRDG

SEQ ID NO: 370862 - protein, 19 aa, Mycobacterium
TGEIMIFVGKDFVITVRHG

SEQ ID NO: 370863 - protein, 28 aa, Mycobacterium
TGELVSPLHWYWAVIAAFVVFAGTNSWG

SEQ ID NO: 370864 - protein, 25 aa, Mycobacterium
TGFFRTVYVLPWICAPLAIAVLWRW

SEQ ID NO: 370865 - protein, 27 aa, Mycobacterium
TGFGVLLWLWLLAFTDSVWSVLPTWLR

SEQ ID NO: 370866 - protein, 21 aa, Mycobacterium
TGFLILIVLLIFIAQNTESAQ

SEQ ID NO: 370867 - protein, 49 aa, Mycobacterium
TGFQVGLRRFSYLLLQVAIALMVIILVSNLLLAKPIIDSVLFSLAIAVG

SEQ ID NO: 370868 - protein, 21 aa, Mycobacterium
TGFWGPPFRVFAPSEITLLTL

SEQ ID NO: 370869 - protein, 21 aa, Mycobacterium
TGFWIGVLPIALYSLLPVLSS

SEQ ID NO: 370870 - protein, 28 aa, Mycobacterium
TGFWIRRARRLLPALVLMVLTVAAAREL

SEQ ID NO: 370871 - protein, 28 aa, Mycobacterium
TGFWIRRARRLLPALVLMVLTVAAARQL

SEQ ID NO: 370872 - protein, 29 aa, Mycobacterium
TGFWIRRARRLLPALVLMVLTVAAARQLL

SEQ ID NO: 370873 - protein, 19 aa, Mycobacterium
TGFWLWAVALPLLVAGYLI

SEQ ID NO: 370874 - protein, 34 aa, Mycobacterium
TGGALLVLAVFFPWNLYFGFRIPGSSNYVLAVLL

SEQ ID NO: 370875 - protein, 30 aa, Mycobacterium
TGGAWEILFMIFLVIATYALFRGAAVNTLG

SEQ ID NO: 370876 - protein, 25 aa, Mycobacterium
TGGEEFLLIDILPVAQAEALPDELC

SEQ ID NO: 370877 - protein, 17 aa, Mycobacterium
TGGFWRVLGIRLLTAIV

SEQ ID NO: 370878 - protein, 18 aa, Mycobacterium
TGGKLFHILSGNLSFQIE

SEQ ID NO: 370879 - protein, 26 aa, Mycobacterium
TGGLLVSLLIFVILGLPSAGATVPLE

SEQ ID NO: 370880 - protein, 21 aa, Mycobacterium
TGGSTLLFGNGGAGGSGVAWA

SEQ ID NO: 370881 - protein, 33 aa, Mycobacterium
TGGVIVLLLLLAWWLLDALWRPVRGRLADVAAL

SEQ ID NO: 370882 - protein, 21 aa, Mycobacterium
TGGVQKPILWGPGKAAAVQRF

SEQ ID NO: 370883 - protein, 26 aa, Mycobacterium
TGGVVLLGLLAAIALLVARQIVLPVR

SEQ ID NO: 370884 - protein, 37 aa, Mycobacterium
TGHFSVALSLLWNYAMLWFGFVVLPALQIVFDPLLVV

SEQ ID NO: 370885 - protein, 19 aa, Mycobacterium
TGHLDGQAIRLGRPGWIDP

SEQ ID NO: 370886 - protein, 30 aa, Mycobacterium
TGHTAGLNGFFFYGGHQYRYYYGSSGTVGQ

SEQ ID NO: 370887 - protein, 21 aa, Mycobacterium
TGIAFITIMSPDGIRFTHTDP

SEQ ID NO: 370888 - protein, 19 aa, Mycobacterium
TGIFGIVLVTAVVLVSFGY

SEQ ID NO: 370889 - protein, 30 aa, Mycobacterium
TGILTGVLIVGFIWMLRSAPRRVLASALRE

SEQ ID NO: 370890 - protein, 27 aa, Mycobacterium
TGISPCILPVLPVLLLSGAGGSRGISG

SEQ ID NO: 370891 - protein, 22 aa, Mycobacterium
TGKAPVLFQIPGGAWTTGNKRG

SEQ ID NO: 370892 - protein, 25 aa, Mycobacterium
TGLFRTLYVLPWICAPLAIAVLWRW

SEQ ID NO: 370893 - protein, 24 aa, Mycobacterium
TGLFRTVFVLPWICAPLAIAVLWR

SEQ ID NO: 370894 - protein, 18 aa, Mycobacterium
TGLIIIAVPIFVLGFLAQ

SEQ ID NO: 370895 - protein, 26 aa, Mycobacterium
TGLIWGIWHWPLPWVGYFGGELAVSQ

SEQ ID NO: 370896 - protein, 21 aa, Mycobacterium
TGLLGMFLVILLVIGAVRLSR

SEQ ID NO: 370897 - protein, 32 aa, Mycobacterium
TGLLMESLILFLPFLLIMGGFMYFASRRQKRA

SEQ ID NO: 370898 - protein, 26 aa, Mycobacterium
TGLLVLSLPMFWLMGQGFGWAIVGFA

SEQ ID NO: 370899 - protein, 36 aa, Mycobacterium
TGLMIKLSMWWPDSAWIVMGIYTMLALIALIVVGAT

SEQ ID NO: 370900 - protein, 26 aa, Mycobacterium
TGLQIIDGFMRSRAIRRALVVASDAD

SEQ ID NO: 370901 - protein, 25 aa, Mycobacterium
TGLQWATWLALANNVFATFSGVPWL

SEQ ID NO: 370902 - protein, 33 aa, Mycobacterium
TGLRLISPTTLFFPFVLLLAATALYRGTDNKMR

SEQ ID NO: 370903 - protein, 21 aa, Mycobacterium
TGLRRLVFDAVPMQLKLAITA

SEQ ID NO: 370904 - protein, 24 aa, Mycobacterium
TGLSIPLFLTSFAERWVLVPAPSG

SEQ ID NO: 370905 - protein, 26 aa, Mycobacterium
TGLTFGLWWVYFLVPAAELLHVHRRL

SEQ ID NO: 370906 - protein, 39 aa, Mycobacterium
TGLTFLVIVVMLLFFYRSIFTVIMVFMLVGIQLSAARGV

SEQ ID NO: 370907 - protein, 22 aa, Mycobacterium
TGLTIIFAGLIGGILWNLLTWL

SEQ ID NO: 370908 - protein, 37 aa, Mycobacterium
TGLTIIFAGLIGGILWNLLTWLFGIPSSSSHALFGGL

SEQ ID NO: 370909 - protein, 26 aa, Mycobacterium
TGLTLSPTLIFDYPSPAALAEHLGIR

SEQ ID NO: 370910 - protein, 26 aa, Mycobacterium
TGLTLSPTLIFDYPTPAALAEHLSTQ

SEQ ID NO: 370911 - protein, 26 aa, Mycobacterium
TGLTLSPTLIFDYPTPTVLAGHLDTQ

SEQ ID NO: 370912 - protein, 33 aa, Mycobacterium
TGLTVWNIARWPLLLVLVVFGVAMLYYVSPNVR

SEQ ID NO: 370913 - protein, 22 aa, Mycobacterium
TGLVKHWFGARTAGWHWKAALN

SEQ ID NO: 370914 - protein, 23 aa, Mycobacterium
TGLVLLFLFITLRIACAIWWHSH

SEQ ID NO: 370915 - protein, 25 aa, Mycobacterium
TGLVRAASLVLLEAAPRGIEPEAIG

SEQ ID NO: 370916 - protein, 17 aa, Mycobacterium
TGLVRIWHVMAVAFAMG

SEQ ID NO: 370917 - protein, 22 aa, Mycobacterium
TGLYLTVLLLGDAPLFCPSYPQ

SEQ ID NO: 370918 - protein, 18 aa, Mycobacterium
TGMAPFWHREPGSISGIV

SEQ ID NO: 370919 - protein, 22 aa, Mycobacterium
TGMILPLMFFAQAVCGLTPTRA

SEQ ID NO: 370920 - protein, 33 aa, Mycobacterium
TGMRLISPQTLFFPFVMLLAATSLFRGNDNKMR

SEQ ID NO: 370921 - protein, 26 aa, Mycobacterium
TGMTVGFFTFGILGAPLLLATVVITS

SEQ ID NO: 370922 - protein, 23 aa, Mycobacterium
TGNNPYPLGIAALGLMAAAYIGE

SEQ ID NO: 370923 - protein, 26 aa, Mycobacterium
TGNPLWLIVVVLVLAGIMGLFVVFPI

SEQ ID NO: 370924 - protein, 22 aa, Mycobacterium
TGPAVFFLLAAGWFATLTALRA

SEQ ID NO: 370925 - protein, 28 aa, Mycobacterium
TGPAVPAPWAMLAMLPRGPELSSAAASV

SEQ ID NO: 370926 - protein, 21 aa, Mycobacterium
TGPIYLLLVRRSPAPAIATTP

SEQ ID NO: 370927 - protein, 19 aa, Mycobacterium
TGPPAWNPPPPNRRNPWPI

SEQ ID NO: 370928 - protein, 17 aa, Mycobacterium
TGPSIWLSFVIAAGTCA

SEQ ID NO: 370929 - protein, 17 aa, Mycobacterium
TGQQFFPQLITAPFHAG

SEQ ID NO: 370930 - protein, 29 aa, Mycobacterium
TGQWALDNQTWPTTLWASNATISAALQFG

SEQ ID NO: 370931 - protein, 22 aa, Mycobacterium
TGQWHRYWPYSWSIFPDAWNDI

SEQ ID NO: 370932 - protein, 18 aa, Mycobacterium
TGRELLNVVWTPITFERD

SEQ ID NO: 370933 - protein, 34 aa, Mycobacterium
TGRISLTAFWIRRARRLLPALVLMVLTVTAAREF

SEQ ID NO: 370934 - protein, 23 aa, Mycobacterium
TGRRWQFFDFASVAALLILTVLT

SEQ ID NO: 370935 - protein, 27 aa, Mycobacterium
TGRYKIFPVLGTALMTLAFLLMSRMDE

SEQ ID NO: 370936 - protein, 26 aa, Mycobacterium
TGSFLAAALTLWLHLVDARFARDLRT

SEQ ID NO: 370937 - protein, 29 aa, Mycobacterium
TGSIFGNPLVWIERALVVLVAASPCALAI

SEQ ID NO: 370938 - protein, 17 aa, Mycobacterium
TGSIFSFWGWDTCLTLG

SEQ ID NO: 370939 - protein, 24 aa, Mycobacterium
TGSILILAIIALAIGLMGTLLVAT

SEQ ID NO: 370940 - protein, 26 aa, Mycobacterium
TGSILLTILVLMALAPQLFTFGKDPR

SEQ ID NO: 370941 - protein, 26 aa, Mycobacterium
TGSPASSPTPPARRVGDVPDPAAAVN

SEQ ID NO: 370942 - protein, 24 aa, Mycobacterium
TGSSFKVFALVAALQQGIGLGYQI

SEQ ID NO: 370943 - protein, 29 aa, Mycobacterium
TGSTYFDFAWPLFIMSIGVGLSTAPVTSA

SEQ ID NO: 370944 - protein, 49 aa, Mycobacterium
TGSVEAILRWIAVLAALFVVLTVVYRFGARLLMFAIARESHLLRVESSA

SEQ ID NO: 370945 - protein, 34 aa, Mycobacterium
TGTAVGLVFLWLSMTPSLLPRGPLFQALVSGGSG

SEQ ID NO: 370946 - protein, 19 aa, Mycobacterium
TGTAVVSALAFDYFRSWPD

SEQ ID NO: 370947 - protein, 29 aa, Mycobacterium
TGTETPAFWIFLLCYIAAAALTWVRYARP

SEQ ID NO: 370948 - protein, 22 aa, Mycobacterium
TGTFLIITLTVAAGMTFLESSA

SEQ ID NO: 370949 - protein, 26 aa, Mycobacterium
TGTFTRYVKPGLLPWLAGSAVVVIGL

SEQ ID NO: 370950 - protein, 25 aa, Mycobacterium
TGTGIKGRFLAWFYTVVGQVPIDRT

SEQ ID NO: 370951 - protein, 18 aa, Mycobacterium
TGTLTDLGLLLARSYHHG

SEQ ID NO: 370952 - protein, 24 aa, Mycobacterium
TGTPMTFVVLLPTTWVALRYSTPV

SEQ ID NO: 370953 - protein, 29 aa, Mycobacterium
TGTTVGLVFVWFSMTPSLLPRGALFQGLV

SEQ ID NO: 370954 - protein, 29 aa, Mycobacterium
TGVAHFIAPWVFDLITRPLFPDDTAGWIR

SEQ ID NO: 370955 - protein, 26 aa, Mycobacterium
TGVALWLPWLIVAGVVFVLASAAGLV

SEQ ID NO: 370956 - protein, 22 aa, Mycobacterium
TGVDAVLLLKSGLDIPSDLDAQ

SEQ ID NO: 370957 - protein, 26 aa, Mycobacterium
TGVDHRSLALPLSRYPRLSGFTEAND

SEQ ID NO: 370958 - protein, 26 aa, Mycobacterium
TGVFGWVRNPIFTAMLTFAAGSALMT

SEQ ID NO: 370959 - protein, 21 aa, Mycobacterium
TGVIALMVIVAGAGAVCLYIE

SEQ ID NO: 370960 - protein, 26 aa, Mycobacterium
TGVITLLTFVFLPVYGRLTDLFGVRR

SEQ ID NO: 370961 - protein, 24 aa, Mycobacterium
TGVIWRIILFYVGSIFLVVCILPW

SEQ ID NO: 370962 - protein, 33 aa, Mycobacterium
TGVRQLSPYMLMMPLMMIMGTVGFMAGGGSGGK

SEQ ID NO: 370963 - protein, 17 aa, Mycobacterium
TGVVCFVGFFASYMFNV

SEQ ID NO: 370964 - protein, 18 aa, Mycobacterium
TGVVCFVGFLGAYLFNVY

SEQ ID NO: 370965 - protein, 36 aa, Mycobacterium
TGVVIGIVWMGRRLVSPWWALGLGMILGGALGNLVD

SEQ ID NO: 370966 - protein, 24 aa, Mycobacterium
TGVVVLLMWIPLRNKPGVGTIANI

SEQ ID NO: 370967 - protein, 18 aa, Mycobacterium
TGWLVWQTQRAEQDQRMN

SEQ ID NO: 370968 - protein, 23 aa, Mycobacterium
TGYRLRVKMAFAEGQYRISKLDQ

SEQ ID NO: 370969 - protein, 23 aa, Mycobacterium
TGYRLRVRMTPTDGQYKISKLDQ

SEQ ID NO: 370970 - protein, 23 aa, Mycobacterium
TGYRLRVRMTPTEGQYKISKLDQ

SEQ ID NO: 370971 - protein, 27 aa, Mycobacterium
TGYSKFWWPDIPAWLPVVITVSLILGC

SEQ ID NO: 370972 - protein, 17 aa, Mycobacterium
TGYTYFHSDRRALLDAG

SEQ ID NO: 370973 - protein, 25 aa, Mycobacterium
THDWPFATQAFKASLPWLAGAIGTP

SEQ ID NO: 370974 - protein, 24 aa, Mycobacterium
THFKPRYDPWDQRLCLILSGDFYD

SEQ ID NO: 370975 - protein, 23 aa, Mycobacterium
THGGQLCLPFYGALVTNCGLDRS

SEQ ID NO: 370976 - protein, 23 aa, Mycobacterium
THHPLVQVMFAWQNIPGQIDDSG

SEQ ID NO: 370977 - protein, 29 aa, Mycobacterium
THINAYNLDLYLRIAPELYLKRLCVGGVE

SEQ ID NO: 370978 - protein, 29 aa, Mycobacterium
THINTYSMDLFLRIAPELYLKRLCVGGVE

SEQ ID NO: 370979 - protein, 22 aa, Mycobacterium
THLIVRFDQGRWIAIDNGSLNG

SEQ ID NO: 370980 - protein, 19 aa, Mycobacterium
THMQEYYGFLGTEGVDRLT

SEQ ID NO: 370981 - protein, 17 aa, Mycobacterium
THPVYRSALVVYFVVMS

SEQ ID NO: 370982 - protein, 26 aa, Mycobacterium
THQPVLWIAIIAWIVMTVAMMGPATL

SEQ ID NO: 370983 - protein, 18 aa, Mycobacterium
THQSAFIDFRRTADAPSQ

SEQ ID NO: 370984 - protein, 19 aa, Mycobacterium
THQTLYYPSVFHAWVAVFC

SEQ ID NO: 370985 - protein, 19 aa, Mycobacterium
THRFPWTTLLINLTGSALI

SEQ ID NO: 370986 - protein, 28 aa, Mycobacterium
THRLRADAPPFFILHGQDDSIIPVPEGR

SEQ ID NO: 370987 - protein, 23 aa, Mycobacterium
THSLVPELPIALNLRGFAAVTID

SEQ ID NO: 370988 - protein, 27 aa, Mycobacterium
THSTTAWLFDMAMLAALSVVYSAVVWW

SEQ ID NO: 370989 - protein, 31 aa, Mycobacterium
THSVAWNVVSSIPWLGSPFKTGQQVTEVVLG

SEQ ID NO: 370990 - protein, 20 aa, Mycobacterium
THVFAGFYIAGCVAAVLAVR

SEQ ID NO: 370991 - protein, 18 aa, Mycobacterium
THVFAGFYVAGCVAAVLA

SEQ ID NO: 370992 - protein, 28 aa, Mycobacterium
THVGSSTWIAWAAWAAIALAVVTLVFTN

SEQ ID NO: 370993 - protein, 23 aa, Mycobacterium
THVVRWPGPVLAGSLAVLALAIL

SEQ ID NO: 370994 - protein, 26 aa, Mycobacterium
THWQEWMPAGLFFAAVAVFQLCWARL

SEQ ID NO: 370995 - protein, 17 aa, Mycobacterium
THYQIYPLFGDHRILGV

SEQ ID NO: 370996 - protein, 22 aa, Mycobacterium
TIAAAVMIVLLVLAARRRGAQD

SEQ ID NO: 370997 - protein, 22 aa, Mycobacterium
TIAALFAIGLLASGLASASVGA

SEQ ID NO: 370998 - protein, 32 aa, Mycobacterium
TIAAQPILPIRLFAAPVFSVCCVLAFVVGFAM

SEQ ID NO: 370999 - protein, 21 aa, Mycobacterium
TIAASLLAGLLAYVVDRLAGL

SEQ ID NO: 371000 - protein, 26 aa, Mycobacterium
TIAASMLFVFFQRVAWYLTSTDPSVD

SEQ ID NO: 371001 - protein, 34 aa, Mycobacterium
TIAATFIAVLVTWDLLGHLPLPLGVAGHEGSTVL

SEQ ID NO: 371002 - protein, 32 aa, Mycobacterium
TIACIASMILIFGIMLLITRSVVAALVIVGTV

SEQ ID NO: 371003 - protein, 19 aa, Mycobacterium
TIADVLLRPGFLRPPAVID

SEQ ID NO: 371004 - protein, 47 aa, Mycobacterium
TIAIGLLLDTLIVRSLLMPSIATLLGRWFWWPQVVYPRGDNHFRRPT

SEQ ID NO: 371005 - protein, 17 aa, Mycobacterium
TIALARLSPSRPAVDDE

SEQ ID NO: 371006 - protein, 30 aa, Mycobacterium
TIAMFLGSTLVLRRKFKPPLVLEDIEKYKV

SEQ ID NO: 371007 - protein, 30 aa, Mycobacterium
TIAMFLGSTLVLRRKFKPPLVLQDIEKHKV

SEQ ID NO: 371008 - protein, 36 aa, Mycobacterium
TIAMFLGSTLVLRRKFKPPLVLQDIEKYKVTAMVVV

SEQ ID NO: 371009 - protein, 28 aa, Mycobacterium
TIAMFLGSTLVLRRKFKPQLVLEDIEKH

SEQ ID NO: 371010 - protein, 17 aa, Mycobacterium
TIARAFLAGPQFLILDE

SEQ ID NO: 371011 - protein, 26 aa, Mycobacterium
TIARSLLRVVLIIGVLYILATYPQIL

SEQ ID NO: 371012 - protein, 19 aa, Mycobacterium
TIAYDILVGGLLVPILGGF

SEQ ID NO: 371013 - protein, 18 aa, Mycobacterium
TICGMYLASDSASRPERV

SEQ ID NO: 371014 - protein, 48 aa, Mycobacterium
TICIGLIFDMMIVRLFLVMPLARILGPWFWWPQKLPTPKRATFRDKPE

SEQ ID NO: 371015 - protein, 19 aa, Mycobacterium
TICWIAVAAALFVYALRVA

SEQ ID NO: 371016 - protein, 25 aa, Mycobacterium
TIDAWLVGIVGWLAPWAAVMLVHWF

SEQ ID NO: 371017 - protein, 18 aa, Mycobacterium
TIDRTIAYFPDFATAIFV

SEQ ID NO: 371018 - protein, 27 aa, Mycobacterium
TIEIGDDEYWLLLAGPDLTSHDRRVLN

SEQ ID NO: 371019 - protein, 22 aa, Mycobacterium
TIEWYDFFLYATAASLVFNQAF

SEQ ID NO: 371020 - protein, 18 aa, Mycobacterium
TIFLAAWVVLFGSFAALL

SEQ ID NO: 371021 - protein, 21 aa, Mycobacterium
TIFVVAFWFIATERADKVKTV

SEQ ID NO: 371022 - protein, 26 aa, Mycobacterium
TIGAWAPILLVAMRLLGGIALGGEWG

SEQ ID NO: 371023 - protein, 20 aa, Mycobacterium
TIGIWAPILLVLARIFQGLS

SEQ ID NO: 371024 - protein, 25 aa, Mycobacterium
TIGLGLLFDTLIVRSLMTPSVAALL

SEQ ID NO: 371025 - protein, 26 aa, Mycobacterium
TIGLGLLFDTLVIRAFMTPSIAALLG

SEQ ID NO: 371026 - protein, 25 aa, Mycobacterium
TIGLGLLFDTLVIRSFMTPSIAALL

SEQ ID NO: 371027 - protein, 25 aa, Mycobacterium
TIGLGLLFDTLVIRSFMTPSIAALM

SEQ ID NO: 371028 - protein, 25 aa, Mycobacterium
TIGLGLLFDTLVVRAFMTPSVAALL

SEQ ID NO: 371029 - protein, 25 aa, Mycobacterium
TIGLGLLFDTLVVRSFLTPAIATML

SEQ ID NO: 371030 - protein, 17 aa, Mycobacterium
TIGQIVPIRGAAPADPT

SEQ ID NO: 371031 - protein, 28 aa, Mycobacterium
TIGQVFDGALLIVIFATSGALEDVATTR

SEQ ID NO: 371032 - protein, 41 aa, Mycobacterium
TIGRRQLRLIISDRGYFIFLALLPFIMGTLSLSVPGTVGFG

SEQ ID NO: 371033 - protein, 22 aa, Mycobacterium
TIGSRLIGQLFTDSGGNPLPQY

SEQ ID NO: 371034 - protein, 25 aa, Mycobacterium
TIGVIFVMLLSVYRSLITVISVLVM

SEQ ID NO: 371035 - protein, 26 aa, Mycobacterium
TIGWGWTLLMLLATFLLGWGIVAPMA

SEQ ID NO: 371036 - protein, 24 aa, Mycobacterium
TIHAAFELWLFQAGLPPSGSKPIS

SEQ ID NO: 371037 - protein, 35 aa, Mycobacterium
TIIGEAVMFVLFWASAFVLLISPLLLVAAGAAVLL

SEQ ID NO: 371038 - protein, 20 aa, Mycobacterium
TIIGVAKWLGASLARGGSAA

SEQ ID NO: 371039 - protein, 17 aa, Mycobacterium
TIIPITIAILRYAVDVD

SEQ ID NO: 371040 - protein, 25 aa, Mycobacterium
TIKVMVGFLTLYPAFVAKSHDAHGF

SEQ ID NO: 371041 - protein, 18 aa, Mycobacterium
TIKWMYYTGLLLTAGEIL

SEQ ID NO: 371042 - protein, 27 aa, Mycobacterium
TILAWPAGIIPVCGLLILSGLLLFWVG

SEQ ID NO: 371043 - protein, 32 aa, Mycobacterium
TILDIVVVFLVTWPLVYLASKSPRLAKPAYNG

SEQ ID NO: 371044 - protein, 31 aa, Mycobacterium; identical to SEQ ID NO: 22910

SEQ ID NO: 371045 - protein, 29 aa, Mycobacterium
TILDLVVVFLVTWPLVYLASKSSTLAKPA

SEQ ID NO: 371046 - protein, 20 aa, Mycobacterium
TILGGWAAISALCAVATVGG

SEQ ID NO: 371047 - protein, 19 aa, Mycobacterium
TILMLLVIGYPIGYAMWLS

SEQ ID NO: 371048 - protein, 18 aa, Mycobacterium
TILRPEHHFPRRGAIDIT

SEQ ID NO: 371049 - protein, 18 aa, Mycobacterium
TILTDRYWWTALAVTLGI

SEQ ID NO: 371050 - protein, 19 aa, Mycobacterium
TILTLLRSFANGGSSLTGV

SEQ ID NO: 371051 - protein, 19 aa, Mycobacterium
TILVLISALFVVACMFALP

SEQ ID NO: 371052 - protein, 19 aa, Mycobacterium
TILVTITASLLAGLLAHVA

SEQ ID NO: 371053 - protein, 19 aa, Mycobacterium
TIMAFRIPALIGAAWAYSV

SEQ ID NO: 371054 - protein, 32 aa, Mycobacterium
TIMHSVWILVFTLFFAGLIQQIPTAALAGMLV

SEQ ID NO: 371055 - protein, 46 aa, Mycobacterium
TIMIGLLFDTLVVRSFMMPAIAALLGRWFWWPRRVPTHAASPPAVT

SEQ ID NO: 371056 - protein, 27 aa, Mycobacterium
TIMIGLLFDTLVVRSFMMPAVATLLGR

SEQ ID NO: 371057 - protein, 25 aa, Mycobacterium
TIMIGLLLDTLVVRSFLVPSIAALL

SEQ ID NO: 371058 - protein, 17 aa, Mycobacterium
TIMMAMMVGWMFVLHHL

SEQ ID NO: 371059 - protein, 18 aa, Mycobacterium
TIMVGVMLLILGVATAIQ

SEQ ID NO: 371060 - protein, 23 aa, Mycobacterium
TINDLLHGLLMYSGNDAAHALAM

SEQ ID NO: 371061 - protein, 31 aa, Mycobacterium
TINNEFYYWVSIALMFLIHAGFLAYEVGASR

SEQ ID NO: 371062 - protein, 29 aa, Mycobacterium
TINQPPPCLTGFLPAAQWRSPADTSLAPM

SEQ ID NO: 371063 - protein, 29 aa, Mycobacterium
TINTVLQAAWTQLLMRMTGQRDVAFGTAV

SEQ ID NO: 371064 - protein, 18 aa, Mycobacterium
TIPAAVMLARYQARRMVW

SEQ ID NO: 371065 - protein, 17 aa, Mycobacterium
TIPAIPYEQLEELDDEG

SEQ ID NO: 371066 - protein, 23 aa, Mycobacterium
TIPIAVFMGCYLRFLRPGRVAEV

SEQ ID NO: 371067 - protein, 25 aa, Mycobacterium
TIPTIALASIWLKGPLVLGLGAIQL

SEQ ID NO: 371068 - protein, 28 aa, Mycobacterium
TIRFELPMMAVAALLFWGLAADGNLSRL

SEQ ID NO: 371069 - protein, 23 aa, Mycobacterium
TIRIGFCLLLILLGGAALTNGLV

SEQ ID NO: 371070 - protein, 27 aa, Mycobacterium
TIRRFMSFGLVFLILNGLQITVVTAIL

SEQ ID NO: 371071 - protein, 24 aa, Mycobacterium
TISATFPAMFPTQVRFAGFAIAYN

SEQ ID NO: 371072 - protein, 23 aa, Mycobacterium
TISGRLLEVAWPPTSPELSASDS

SEQ ID NO: 371073 - protein, 24 aa, Mycobacterium
TISLAFRMFPMLSEEFRLLAAARR

SEQ ID NO: 371074 - protein, 31 aa, Mycobacterium
TISPLARTLGFTPLPWQFFAVLGAFVACYLV

SEQ ID NO: 371075 - protein, 23 aa, Mycobacterium
TISQGIIFLWLTDRDYGLVNAAL

SEQ ID NO: 371076 - protein, 25 aa, Mycobacterium
TISSLLFMFVWTMIVISYLVYRRRH

SEQ ID NO: 371077 - protein, 19 aa, Mycobacterium
TISVLGLAVPLAGGMAVGY

SEQ ID NO: 371078 - protein, 28 aa, Mycobacterium
TITADRRDGLWWLVIRDDGRGGATIQPG

SEQ ID NO: 371079 - protein, 32 aa, Mycobacterium; identical to SEQ ID NO: 164538

SEQ ID NO: 371080 - protein, 21 aa, Mycobacterium
TITASLLAGLLAHVADRLLGL

SEQ ID NO: 371081 - protein, 24 aa, Mycobacterium
TITAYLINRRWTFQASPSRARFAA

SEQ ID NO: 371082 - protein, 23 aa, Mycobacterium
TIVAALFGFIWDVSLHIGKGRDA

SEQ ID NO: 371083 - protein, 17 aa, Mycobacterium
TIVAYQSGGTTAAAREL

SEQ ID NO: 371084 - protein, 25 aa, Mycobacterium
TIVDVLIIAYTFFGIEEIAVEIESP

SEQ ID NO: 371085 - protein, 21 aa, Mycobacterium
TIVFAIYVFCALCAGIAGLMI

SEQ ID NO: 371086 - protein, 21 aa, Mycobacterium
TIVFPVWSIVLLACAVVLWAS

SEQ ID NO: 371087 - protein, 18 aa, Mycobacterium
TIVGDLLAEAALLGLIGG

SEQ ID NO: 371088 - protein, 26 aa, Mycobacterium
TIVGVPWLLLFAQPTIWQISRPWYLA

SEQ ID NO: 371089 - protein, 19 aa, Mycobacterium
TIVGWGGLALLLLTCTQLG

SEQ ID NO: 371090 - protein, 30 aa, Mycobacterium
TIVIITVMLLIVYRSFTTAFLTLLIVMVEL

SEQ ID NO: 371091 - protein, 29 aa, Mycobacterium
TIVMGISALFFYLVLKMLSENALLDSVAS

SEQ ID NO: 371092 - protein, 29 aa, Mycobacterium
TIVNVLLGWPLWVSVIAAAAIVLCYITLG

SEQ ID NO: 371093 - protein, 27 aa, Mycobacterium
TIVQMLFGELFPKNLAIARPEPLARWL

SEQ ID NO: 371094 - protein, 17 aa, Mycobacterium
TIVRIVIPTALSGIVTG

SEQ ID NO: 371095 - protein, 17 aa, Mycobacterium
TIVRIVVPTALPGMISG

SEQ ID NO: 371096 - protein, 20 aa, Mycobacterium
TIVVIIAMLLIAYRSITRAI

SEQ ID NO: 371097 - protein, 18 aa, Mycobacterium
TIVVRWPGPVLVAAALIS

SEQ ID NO: 371098 - protein, 23 aa, Mycobacterium
TIWGWTGFSVIVYLAALQGVPAE

SEQ ID NO: 371099 - protein, 28 aa, Mycobacterium
TIWLLAHPGLPLWPYLVCAALTGMGGAN

SEQ ID NO: 371100 - protein, 25 aa, Mycobacterium
TIWLLSHPGLPLWPYLACAALTGCG

SEQ ID NO: 371101 - protein, 26 aa, Mycobacterium
TIWQISRPWYLAWAGLVYIVAAVATL

SEQ ID NO: 371102 - protein, 26 aa, Mycobacterium
TIWVISRPWYLAWAGLVYPVATLTTL

SEQ ID NO: 371103 - protein, 40 aa, Mycobacterium
TIYQNLGWAFGYNTAAIPLAALGLLNPVIAGAAMGLSSVS

SEQ ID NO: 371104 - protein, 26 aa, Mycobacterium
TIYQNLGWAFGYNTAAIPLAALGMLN

SEQ ID NO: 371105 - protein, 25 aa, Mycobacterium
TKAAARWIRPLVPPFVARVIDNTTQ

SEQ ID NO: 371106 - protein, 25 aa, Mycobacterium
TKAAARWIRPLVPPFVGRVIGTTTA

SEQ ID NO: 371107 - protein, 26 aa, Mycobacterium
TKAWAAVQALLNIALTANPIGLIIAA

SEQ ID NO: 371108 - protein, 20 aa, Mycobacterium
TKFITWTLPTNIGEGLVILA

SEQ ID NO: 371109 - protein, 25 aa, Mycobacterium
TKGRMRLLYQFGPGFERITPGALWA

SEQ ID NO: 371110 - protein, 18 aa, Mycobacterium
TKGWQRLLGTLLGVPCGV

SEQ ID NO: 371111 - protein, 39 aa, Mycobacterium
TKIGKIEFAGFFAWLAWLLLHLLYLVGHRNRIAAAYSWG

SEQ ID NO: 371112 - protein, 37 aa, Mycobacterium
TKKMVIALVVFLVLAAIYITWRYERYMAISALATMVF

SEQ ID NO: 371113 - protein, 24 aa, Mycobacterium
TKLSRRSLVIGNAVIAFAVIGLAS

SEQ ID NO: 371114 - protein, 21 aa, Mycobacterium
TKLTLLAAGLIFLLALVLGVW

SEQ ID NO: 371115 - protein, 23 aa, Mycobacterium
TKMPGQLWVLGGFLLGAVGVEGL

SEQ ID NO: 371116 - protein, 19 aa, Mycobacterium
TKPLIPLAVSAFLTSRKKA

SEQ ID NO: 371117 - protein, 22 aa, Mycobacterium
TKQILIYTWLTVAATLALALAT

SEQ ID NO: 371118 - protein, 25 aa, Mycobacterium
TKRKPIDVALYALFLLVTLSALFAD

SEQ ID NO: 371119 - protein, 22 aa, Mycobacterium
TKRLFMGSVLIFTLGSLLCAVA

SEQ ID NO: 371120 - protein, 21 aa, Mycobacterium
TKRPFIASLLAFSAGSLLCAL

SEQ ID NO: 371121 - protein, 21 aa, Mycobacterium
TKRRWGKIVALSLLTAVLLAG

SEQ ID NO: 371122 - protein, 24 aa, Mycobacterium
TKRVGILTYILLKRLDDIAYGLGL

SEQ ID NO: 371123 - protein, 34 aa, Mycobacterium
TKTDLLIAAIAAFALIFLVMLVITRSVVAALVIV

SEQ ID NO: 371124 - protein, 27 aa, Mycobacterium
TKTPLSFLCYWIIPFGLVGLAAVASRL

SEQ ID NO: 371125 - protein, 29 aa, Mycobacterium
TKTPLSFVCYWVIPFALLGVAALVSRVLP

SEQ ID NO: 371126 - protein, 27 aa, Mycobacterium
TKTPVSFMCYWVIPVSLLGLAALASQL

SEQ ID NO: 371127 - protein, 25 aa, Mycobacterium
TKVGPPRFGAGAKKLRSGKFSDSLA

SEQ ID NO: 371128 - protein, 37 aa, Mycobacterium
TKVLGIPGLPFVALIILIVGGILLHKTRFGRYTYAIG

SEQ ID NO: 371129 - protein, 26 aa, Mycobacterium
TLAAFGWSIYALFWGTAGVPGMTHPF

SEQ ID NO: 371130 - protein, 25 aa, Mycobacterium
TLAALLFGAYFLRSYFVLIVVAAVG

SEQ ID NO: 371131 - protein, 17 aa, Mycobacterium
TLAALTLNLPTRNGRYL

SEQ ID NO: 371132 - protein, 18 aa, Mycobacterium
TLAALWPAEALEAVRLLI

SEQ ID NO: 371133 - protein, 23 aa, Mycobacterium
TLAARVLLPLMPAERARAGSAGR

SEQ ID NO: 371134 - protein, 25 aa, Mycobacterium
TLAGILGCVVVGLAVALWVVRTRAL

SEQ ID NO: 371135 - protein, 24 aa, Mycobacterium
TLAGLPAVLSISVLVLRYGLDKLC

SEQ ID NO: 371136 - protein, 18 aa, Mycobacterium
TLAGRRLWHRFRGQPDRA

SEQ ID NO: 371137 - protein, 20 aa, Mycobacterium
TLAIALVGLLALPGLRINYN

SEQ ID NO: 371138 - protein, 17 aa, Mycobacterium
TLAIFAQGCSEFMFAGL

SEQ ID NO: 371139 - protein, 24 aa, Mycobacterium
TLAKRWKLVVGALLACLAGATAVT

SEQ ID NO: 371140 - protein, 19 aa, Mycobacterium
TLALVIPGIIGFLLSLTGQ

SEQ ID NO: 371141 - protein, 18 aa, Mycobacterium
TLARFTLRHKALVIGVWL

SEQ ID NO: 371142 - protein, 24 aa, Mycobacterium
TLARPMMIALAPGLVPMVWLNVLR

SEQ ID NO: 371143 - protein, 19 aa, Mycobacterium
TLASLLLAAGLSWAAIEFT

SEQ ID NO: 371144 - protein, 27 aa, Mycobacterium
TLATLSIVFAFFFAPAGVVLGHVALAR

SEQ ID NO: 371145 - protein, 19 aa, Mycobacterium
TLAVLAGLSWLFFGSSLNP

SEQ ID NO: 371146 - protein, 22 aa, Mycobacterium
TLAVVIVMMISNPGPIHVQSIP

SEQ ID NO: 371147 - protein, 20 aa, Mycobacterium
TLAWSLFLLKGSSTGAWVAE

SEQ ID NO: 371148 - protein, 21 aa, Mycobacterium
TLCLHLARLSYFKALGIPSAL

SEQ ID NO: 371149 - protein, 20 aa, Mycobacterium
TLCLIFVVMLAITRSVVASA

SEQ ID NO: 371150 - protein, 23 aa, Mycobacterium
TLCLSLTRLPLFRSMGVPCALVI

SEQ ID NO: 371151 - protein, 30 aa, Mycobacterium
TLDAMIGHRSPRYLRFGWAAARFDDVLNYV

SEQ ID NO: 371152 - protein, 26 aa, Mycobacterium
TLDAMVGYRSPRYLRFGWAAARLDDL

SEQ ID NO: 371153 - protein, 26 aa, Mycobacterium
TLDDRRLLSLILLARDHVVHGWVLAS

SEQ ID NO: 371154 - protein, 21 aa, Mycobacterium
TLDGQWVLVTFTVADGIRLGD

SEQ ID NO: 371155 - protein, 21 aa, Mycobacterium
TLDPEWRLPYAVNRVSGFATV

SEQ ID NO: 371156 - protein, 21 aa, Mycobacterium
TLDRGWILYSHKPPRGTPLDR

SEQ ID NO: 371157 - protein, 22 aa, Mycobacterium
TLDRVDVVQPVLWAMMVSLAQL

SEQ ID NO: 371158 - protein, 19 aa, Mycobacterium
TLDYVTRFPLLKPLDMSDA

SEQ ID NO: 371159 - protein, 18 aa, Mycobacterium
TLELFVAVAATCFASAIV

SEQ ID NO: 371160 - protein, 25 aa, Mycobacterium
TLETRLMAVLAVGFGLGVALAVSRL

SEQ ID NO: 371161 - protein, 24 aa, Mycobacterium
TLEWYDWMIFGLLAAYLGPQFFAP

SEQ ID NO: 371162 - protein, 34 aa, Mycobacterium
TLFGLAVVVALAAPLGWFGFRVHLAGQAQARQGE

SEQ ID NO: 371163 - protein, 24 aa, Mycobacterium
TLFGSIRRLLTVRRTLARVHVESL

SEQ ID NO: 371164 - protein, 24 aa, Mycobacterium
TLFPIGQLWWGAVVVSFFVLADML

SEQ ID NO: 371165 - protein, 28 aa, Mycobacterium
TLFYESGASWYWLLAGPFSALSLILIEK

SEQ ID NO: 371166 - protein, 17 aa, Mycobacterium
TLGGIQAFIQYVRQFNQ

SEQ ID NO: 371167 - protein, 17 aa, Mycobacterium
TLGGMLVFRGATQYLLE

SEQ ID NO: 371168 - protein, 25 aa, Mycobacterium
TLGLLFSAFHMPIGWLIAALAGAGC

SEQ ID NO: 371169 - protein, 20 aa, Mycobacterium
TLGMFLFFGLMMYVAYRQRK

SEQ ID NO: 371170 - protein, 26 aa, Mycobacterium
TLGQAPFGKFLLIAAAVGIAAFGLYS

SEQ ID NO: 371171 - protein, 24 aa, Mycobacterium
TLGRVLPWIFLAVVLVFAITAFLA

SEQ ID NO: 371172 - protein, 27 aa, Mycobacterium
TLGSTWWQTFWRITLPSIRWGLTYGIV

SEQ ID NO: 371173 - protein, 17 aa, Mycobacterium
TLGWAAVALAFGCAIVR

SEQ ID NO: 371174 - protein, 22 aa, Mycobacterium
TLIAALLTRWRRSGRPAPAAAP

SEQ ID NO: 371175 - protein, 45 aa, Mycobacterium
TLIAVYGMAMTPLGWRWAGIVWAYALFWFLIEDRVKLGAYHWLDH

SEQ ID NO: 371176 - protein, 25 aa, Mycobacterium
TLIGWGLLELFPGTLARPDRFWYAL

SEQ ID NO: 371177 - protein, 27 aa, Mycobacterium
TLIRARWRRWIAWVLPVFGLAVLGAAA

SEQ ID NO: 371178 - protein, 18 aa, Mycobacterium
TLISIRRQALALVTATAG

SEQ ID NO: 371179 - protein, 37 aa, Mycobacterium
TLISLGVSAAYLWSLWALFIGHAGMPGMRMAFSLLPD

SEQ ID NO: 371180 - protein, 33 aa, Mycobacterium
TLISVGTLAAFLWSLYALFLGTAGEPGMRHPFE

SEQ ID NO: 371181 - protein, 23 aa, Mycobacterium
TLITLTYLPPLWRKVMDHRVIEH

SEQ ID NO: 371182 - protein, 19 aa, Mycobacterium
TLIVRAFMTPSIAAALGRW

SEQ ID NO: 371183 - protein, 22 aa, Mycobacterium
TLIVRFTTWGRQFWRVTRGYFT

SEQ ID NO: 371184 - protein, 24 aa, Mycobacterium
TLKDYVAFPLLAGPFAPFVFTGNL

SEQ ID NO: 371185 - protein, 25 aa, Mycobacterium
TLKDYVAFPLLAGPFAPWVFAGNLT

SEQ ID NO: 371186 - protein, 21 aa, Mycobacterium
TLKIGWAGLALVLVNESFLLL

SEQ ID NO: 371187 - protein, 17 aa, Mycobacterium
TLKRGAMAFGKLLPVGI

SEQ ID NO: 371188 - protein, 29 aa, Mycobacterium
TLLAATLMFTLNRWPMEIVALGSAFALVV

SEQ ID NO: 371189 - protein, 19 aa, Mycobacterium
TLLALAAPGILLAAGMWAL

SEQ ID NO: 371190 - protein, 22 aa, Mycobacterium
TLLALRAVALLPAARAGRTSVA

SEQ ID NO: 371191 - protein, 17 aa, Mycobacterium
TLLAPWVRFGQRASKPI

SEQ ID NO: 371192 - protein, 20 aa, Mycobacterium
TLLFWGHHVVLILAVAAVAY

SEQ ID NO: 371193 - protein, 19 aa, Mycobacterium
TLLGLGRITVTLQLPATGG

SEQ ID NO: 371194 - protein, 20 aa, Mycobacterium
TLLGPPQKLQFGRRSVDLFR

SEQ ID NO: 371195 - protein, 26 aa, Mycobacterium
TLLGVLRQRLGLDTAWLSSFHDDTQT

SEQ ID NO: 371196 - protein, 25 aa, Mycobacterium
TLLLHGLTLPWFIRVLGAEGDEAHS

SEQ ID NO: 371197 - protein, 26 aa, Mycobacterium
TLLLLGMIAVTLFMGIILLAKATGVQ

SEQ ID NO: 371198 - protein, 17 aa, Mycobacterium
TLLLMVTLLALLVVGRL

SEQ ID NO: 371199 - protein, 28 aa, Mycobacterium
TLLRGMPFALTWWSLTFPVGTFVTGTSQ

SEQ ID NO: 371200 - protein, 28 aa, Mycobacterium
TLLSLFSFMFLLFGLLLIYTAIQLFRHR

SEQ ID NO: 371201 - protein, 38 aa, Mycobacterium
TLLSRMAVSVRPEWTRTVLARRVVAGVLVVLAAVAALW

SEQ ID NO: 371202 - protein, 20 aa, Mycobacterium
TLLTAWAFSGSLITGLSAIF

SEQ ID NO: 371203 - protein, 27 aa, Mycobacterium
TLLTCGMWLPIWILVAIFGGGGTSAVA

SEQ ID NO: 371204 - protein, 26 aa, Mycobacterium
TLLTHWKLALGALLACTIGAAAVTAL

SEQ ID NO: 371205 - protein, 22 aa, Mycobacterium
TLLTRWKLVAAALLACLAGAAA

SEQ ID NO: 371206 - protein, 24 aa, Mycobacterium
TLLVGVVVGFPLRPLHPARARAYD

SEQ ID NO: 371207 - protein, 18 aa, Mycobacterium
TLLVLLFVGCYALPAALP

SEQ ID NO: 371208 - protein, 19 aa, Mycobacterium
TLLVLLTVLIEMAAARGIV

SEQ ID NO: 371209 - protein, 20 aa, Mycobacterium
TLLVTFGVGLILQQIARDIF

SEQ ID NO: 371210 - protein, 22 aa, Mycobacterium
TLLVVPCLLLSWAVSHPGIPFV

SEQ ID NO: 371211 - protein, 30 aa, Mycobacterium
TLLWLVPLAASVLIILLPPGLRQLAKWTGL

SEQ ID NO: 371212 - protein, 17 aa, Mycobacterium
TLMIIVITAVKVIGSVA

SEQ ID NO: 371213 - protein, 27 aa, Mycobacterium
TLMISFSIWYFWANRLSLPALPVLIGG

SEQ ID NO: 371214 - protein, 20 aa, Mycobacterium
TLMPSPTVLMLGMPAGLRLV

SEQ ID NO: 371215 - protein, 17 aa, Mycobacterium
TLMSFRVPALILAAVAY

SEQ ID NO: 371216 - protein, 18 aa, Mycobacterium
TLMSILLALLTTHSADRL

SEQ ID NO: 371217 - protein, 17 aa, Mycobacterium
TLMSILLSLLTTHPADR

SEQ ID NO: 371218 - protein, 19 aa, Mycobacterium
TLMSILLSLLTTHPADRLI

SEQ ID NO: 371219 - protein, 32 aa, Mycobacterium
TLMTPLTAKLAWFSKVLTIAILGLAAVTFAAG

SEQ ID NO: 371220 - protein, 18 aa, Mycobacterium
TLMTVAVVSLTLVPAPPA

SEQ ID NO: 371221 - protein, 21 aa, Mycobacterium
TLMVTLSGGALWRFAALMFLS

SEQ ID NO: 371222 - protein, 33 aa, Mycobacterium
TLNLWVGVGFVLSPLLIAWSLLVLPPRPRPHDD

SEQ ID NO: 371223 - protein, 42 aa, Mycobacterium
TLNPPATPGAAPWERLFAPPPEDSLLRWSGVSSGDAAGHHGG

SEQ ID NO: 371224 - protein, 21 aa, Mycobacterium
TLPITVVAVRAWWATGRSPFW

SEQ ID NO: 371225 - protein, 22 aa, Mycobacterium
TLPIYIWALLISLALNKVWRRH

SEQ ID NO: 371226 - protein, 22 aa, Mycobacterium
TLPLIPVFMVLIGLATAERSAA

SEQ ID NO: 371227 - protein, 17 aa, Mycobacterium
TLPMRKIHTFSVPPNMV

SEQ ID NO: 371228 - protein, 19 aa, Mycobacterium
TLPQLVQVSAFLKNLRLDF

SEQ ID NO: 371229 - protein, 19 aa, Mycobacterium
TLPSPRPRRWSRAAVSAAA

SEQ ID NO: 371230 - protein, 20 aa, Mycobacterium
TLPYAGFIGITILQAYHLLT

SEQ ID NO: 371231 - protein, 22 aa, Mycobacterium
TLQLPVMIVCGFVLGAAGQVVK

SEQ ID NO: 371232 - protein, 19 aa, Mycobacterium
TLQMDPWIRFQNSAKVAQL

SEQ ID NO: 371233 - protein, 26 aa, Mycobacterium
TLQNIAIGFNFWVAGALSGVVLLIAG

SEQ ID NO: 371234 - protein, 19 aa, Mycobacterium
TLQSVLLVLGAWRNDRQIE

SEQ ID NO: 371235 - protein, 28 aa, Mycobacterium
TLQVFFLVSGLLFIVPILSTGPLPVRQS

SEQ ID NO: 371236 - protein, 18 aa, Mycobacterium
TLRFALVLTLASGFMDAY

SEQ ID NO: 371237 - protein, 20 aa, Mycobacterium
TLRLLTAERVTLFRGWPDQA

SEQ ID NO: 371238 - protein, 19 aa, Mycobacterium
TLRLWDAATGAPIGAPLTG

SEQ ID NO: 371239 - protein, 26 aa, Mycobacterium
TLRPSPAVLMLGLPTGLRLVIDNAVA

SEQ ID NO: 371240 - protein, 22 aa, Mycobacterium
TLRRAVYFVLLAAFAVVAIPVL

SEQ ID NO: 371241 - protein, 27 aa, Mycobacterium
TLRRGMPFALTWWSLTFPVGTFVTGTT

SEQ ID NO: 371242 - protein, 17 aa, Mycobacterium
TLRRIILPQATRVAVPP

SEQ ID NO: 371243 - protein, 25 aa, Mycobacterium
TLRRRRFRWCVAAAYLSGVSTVAGV

SEQ ID NO: 371244 - protein, 24 aa, Mycobacterium
TLRSLAWVPVALLGFPVWMIFVLN

SEQ ID NO: 371245 - protein, 17 aa, Mycobacterium
TLRSPLWAAAAAAVLSF

SEQ ID NO: 371246 - protein, 23 aa, Mycobacterium
TLRTDTWWWAPLVTNIGFLAFIV

SEQ ID NO: 371247 - protein, 23 aa, Mycobacterium
TLSEAWDRYLKRWPWLKHVIRVV

SEQ ID NO: 371248 - protein, 20 aa, Mycobacterium
TLSGLLRRWLVDHLAVAPGV

SEQ ID NO: 371249 - protein, 26 aa, Mycobacterium
TLSLLASISPLVRWIIKVPREFINSY

SEQ ID NO: 371250 - protein, 30 aa, Mycobacterium
TLSLLASMSPLIRWIIKVPREFINSYLFNF

SEQ ID NO: 371251 - protein, 21 aa, Mycobacterium
TLSMRRISAFVLPQGLITVRL

SEQ ID NO: 371252 - protein, 23 aa, Mycobacterium
TLSPAYSILAIGDPPTLAAAMNI

SEQ ID NO: 371253 - protein, 17 aa, Mycobacterium
TLSVASFFWLWSTTNML

SEQ ID NO: 371254 - protein, 31 aa, Mycobacterium
TLTAFVYSTYQLFAGGPLFFDTSALIIAFVV

SEQ ID NO: 371255 - protein, 32 aa, Mycobacterium
TLTAIAVVVLLGWSFFYFSDDTRGYKPVDTSV

SEQ ID NO: 371256 - protein, 23 aa, Mycobacterium
TLTALLLAAGFSWAAIQLAHLTG

SEQ ID NO: 371257 - protein, 19 aa, Mycobacterium
TLTATVAFRHPTIEALATV

SEQ ID NO: 371258 - protein, 24 aa, Mycobacterium
TLTDRLPSYMVPAAIVVLESLPLT

SEQ ID NO: 371259 - protein, 20 aa, Mycobacterium
TLTFEPPFRLKVMRGIVETC

SEQ ID NO: 371260 - protein, 21 aa, Mycobacterium
TLTGFLGLSDTPRPQARQLLA

SEQ ID NO: 371261 - protein, 27 aa, Mycobacterium
TLTGMQWVVWLGLLNNVAAALDLVPWA

SEQ ID NO: 371262 - protein, 31 aa, Mycobacterium
TLTIPLNDPAVLRYGLRSLASPTAPLHIPLT

SEQ ID NO: 371263 - protein, 19 aa, Mycobacterium
TLTLSLPRPTEVAGLRLLP

SEQ ID NO: 371264 - protein, 42 aa, Mycobacterium
TLTLTLVVMLSISWQITVLALIVLPLFLIPARRIGAAMARLS

SEQ ID NO: 371265 - protein, 24 aa, Mycobacterium
TLTPALFVLFCVLVVSAWSNAVNF

SEQ ID NO: 371266 - protein, 25 aa, Mycobacterium
TLTPFPWNQLHQFLELFMKAWTQIG

SEQ ID NO: 371267 - protein, 24 aa, Mycobacterium
TLTPLPIKTFDVRLARQAYRFVSQ

SEQ ID NO: 371268 - protein, 23 aa, Mycobacterium
TLTPPYSVLAIGDPPTLAAAMNI

SEQ ID NO: 371269 - protein, 26 aa, Mycobacterium
TLTRTLLHTRLLTPSSPAALFRLVHE

SEQ ID NO: 371270 - protein, 26 aa, Mycobacterium
TLTTLAIFLGLANWIGAFYVVRCSEC

SEQ ID NO: 371271 - protein, 31 aa, Mycobacterium
TLTVIAVVLLLGWSFFYFSDDTRGYKPVDTT

SEQ ID NO: 371272 - protein, 32 aa, Mycobacterium
TLTVIGVVLLLGWSFFYFSDDTRGYKPVDTTV

SEQ ID NO: 371273 - protein, 19 aa, Mycobacterium
TLTVLLFSSLAVAIAITVL

SEQ ID NO: 371274 - protein, 18 aa, Mycobacterium
TLVFEFLCYIAIAVAGVA

SEQ ID NO: 371275 - protein, 17 aa, Mycobacterium
TLVFFMGLFVMVAGLTH

SEQ ID NO: 371276 - protein, 20 aa, Mycobacterium
TLVFGVLRLINFAHSEIFML

SEQ ID NO: 371277 - protein, 37 aa, Mycobacterium
TLVFQYGLGKEIAWPVPLLAFIILVAVGADYNMLLIS

SEQ ID NO: 371278 - protein, 26 aa, Mycobacterium
TLVFTAYFGFYLFYRAHNPELFLHSQ

SEQ ID NO: 371279 - protein, 31 aa, Mycobacterium
TLVGAVLLTVPLWLRLWRALGIERAARIRTE

SEQ ID NO: 371280 - protein, 24 aa, Mycobacterium
TLVGAVLRLPYTFATAWFGGRNWT

SEQ ID NO: 371281 - protein, 25 aa, Mycobacterium
TLVGFIVTLPFLPAAARELSLASAA

SEQ ID NO: 371282 - protein, 28 aa, Mycobacterium
TLVGMTTLDWRLGLAGALAIPAYIAGLH

SEQ ID NO: 371283 - protein, 17 aa, Mycobacterium
TLVIAYGVAWFGAYSIV

SEQ ID NO: 371284 - protein, 23 aa, Mycobacterium
TLVITGLVGSLLYLQFRGDLTPA

SEQ ID NO: 371285 - protein, 18 aa, Mycobacterium
TLVNSLLGNKIGAPALAI

SEQ ID NO: 371286 - protein, 27 aa, Mycobacterium
TLVPGDRFWWALNRVAGFSIASHRDFD

SEQ ID NO: 371287 - protein, 25 aa, Mycobacterium
TLVQLAPFVLLVELARILLSGAQES

SEQ ID NO: 371288 - protein, 25 aa, Mycobacterium
TLVQLAPFVLLVELARLLVSGAPAS

SEQ ID NO: 371289 - protein, 33 aa, Mycobacterium
TLVRMLLVPAFMRVMGRWNWWAPAPLARLHERI

SEQ ID NO: 371290 - protein, 35 aa, Mycobacterium
TLVRMVLVPAFIHLLGRWTWWAPRPLVSLRERSAI

SEQ ID NO: 371291 - protein, 30 aa, Mycobacterium
TLVRMVLVPAFIHWLGRWTWWAPKPLERLR

SEQ ID NO: 371292 - protein, 24 aa, Mycobacterium
TLVSLLVLLRVPLPREIKVWGHIA

SEQ ID NO: 371293 - protein, 26 aa, Mycobacterium
TLVVAALLLVLVSRAALAPLDRLAAL

SEQ ID NO: 371294 - protein, 18 aa, Mycobacterium
TLVVIAAAVLLVRIARRA

SEQ ID NO: 371295 - protein, 34 aa, Mycobacterium
TLVVIFTMLLFVYRSVMTVILLLIMVGIQVQAAR

SEQ ID NO: 371296 - protein, 22 aa, Mycobacterium
TLVWSAMARLPYAMISLVVLFY

SEQ ID NO: 371297 - protein, 29 aa, Mycobacterium
TLVYAVLAVIWFFLLKRYITEGPLEHDAE

SEQ ID NO: 371298 - protein, 29 aa, Mycobacterium
TLVYAVLAVIWFFLLRRYIVQGPSEHDSE

SEQ ID NO: 371299 - protein, 29 aa, Mycobacterium
TLVYAVLAVIWFWLLKRYIVEGPLEHDAE

SEQ ID NO: 371300 - protein, 28 aa, Mycobacterium
TLVYAVLAVIWFWLLKRYVVEGPQEHDA

SEQ ID NO: 371301 - protein, 24 aa, Mycobacterium
TLWGKNIGQFQLIQLKLAKMEIAR

SEQ ID NO: 371302 - protein, 17 aa, Mycobacterium
TLWLETPARLGITIPTV

SEQ ID NO: 371303 - protein, 30 aa, Mycobacterium
TLWLVPLAGSVLIILLPPGLRRLAKWTGVI

SEQ ID NO: 371304 - protein, 24 aa, Mycobacterium
TLWNPDVWWQSIVVWFAGAVVAHD

SEQ ID NO: 371305 - protein, 35 aa, Mycobacterium
TLWVVTVVPLLLATLAIAVWALPRLLGSAWAGLTT

SEQ ID NO: 371306 - protein, 20 aa, Mycobacterium
TLYQIGVIAALFLGVAAAMR

SEQ ID NO: 371307 - protein, 25 aa, Mycobacterium
TLYTDRHIRLWVVYVDDFSGQGAVN

SEQ ID NO: 371308 - protein, 21 aa, Mycobacterium
TMADYGPDFGLTYMLDGMARM

SEQ ID NO: 371309 - protein, 18 aa, Mycobacterium
TMAGPWVGIAAPGENIVS

SEQ ID NO: 371310 - protein, 25 aa, Mycobacterium
TMAGVVLLVIVAVVVLLRGREAPPS

SEQ ID NO: 371311 - protein, 21 aa, Mycobacterium
TMAHFLTFRFLLGVGESPNSP

SEQ ID NO: 371312 - protein, 26 aa, Mycobacterium
TMALRFGGFAVVVGLVAWLLNRRNRS

SEQ ID NO: 371313 - protein, 27 aa, Mycobacterium
TMATGSLVLLVLLAGIALLVSRQVVVP

SEQ ID NO: 371314 - protein, 23 aa, Mycobacterium
TMCAAVLATLYLTPVTGAPAWET

SEQ ID NO: 371315 - protein, 35 aa, Mycobacterium
TMDTLISLGTLSAFLWSLYALFFGTAGTPGMKHPF

SEQ ID NO: 371316 - protein, 20 aa, Mycobacterium
TMFLSQLPYVPLGSLRVVVC

SEQ ID NO: 371317 - protein, 38 aa, Mycobacterium
TMFRMPIFTWNILVTSILVLIVFPLLTAALFGLAADRH

SEQ ID NO: 371318 - protein, 37 aa, Mycobacterium
TMFRMPIFTWNILVTSWLVLIAFPLLTAALFGLAADR

SEQ ID NO: 371319 - protein, 19 aa, Mycobacterium
TMGALTSWLGFQTHQAHQA

SEQ ID NO: 371320 - protein, 22 aa, Mycobacterium
TMGLIVAGVAALLWVFAGADKA

SEQ ID NO: 371321 - protein, 29 aa, Mycobacterium
TMGNWILLWSVLAFACFWVQTTVWTSAVA

SEQ ID NO: 371322 - protein, 18 aa, Mycobacterium
TMHGTAMLLFYATPIVFG

SEQ ID NO: 371323 - protein, 24 aa, Mycobacterium
TMHGTIMLLFYATPIVFGFANLVL

SEQ ID NO: 371324 - protein, 23 aa, Mycobacterium
TMHGTIMLLLYATPIVFGFANLV

SEQ ID NO: 371325 - protein, 18 aa, Mycobacterium
TMHHIIADGWSYPVLFGD

SEQ ID NO: 371326 - protein, 19 aa, Mycobacterium
TMISAAVLLIPTAGAIVLL

SEQ ID NO: 371327 - protein, 34 aa, Mycobacterium
TMISVLVIFTMLLLVYRSIVTVTLLLITVGIELT

SEQ ID NO: 371328 - protein, 26 aa, Mycobacterium
TMITGGAVLLVLLAGIALLVSRQVVV

SEQ ID NO: 371329 - protein, 27 aa, Mycobacterium
TMITGGAVLLVLLAGIALLVSRQVVVP

SEQ ID NO: 371330 - protein, 17 aa, Mycobacterium
TMLALVCLLVIAVLATC

SEQ ID NO: 371331 - protein, 25 aa, Mycobacterium
TMLAVAALIGLWRGAVPGLAAALVV

SEQ ID NO: 371332 - protein, 20 aa, Mycobacterium
TMLDTEFALALIDLRKRGHP

SEQ ID NO: 371333 - protein, 17 aa, Mycobacterium
TMLFTIAAAMTLGPAAL

SEQ ID NO: 371334 - protein, 17 aa, Mycobacterium
TMLLALHTWLLSLASIL

SEQ ID NO: 371335 - protein, 17 aa, Mycobacterium
TMLLRLCMLPGLALLIW

SEQ ID NO: 371336 - protein, 19 aa, Mycobacterium
TMLVGVLVWFKLPQSPTEA

SEQ ID NO: 371337 - protein, 19 aa, Mycobacterium
TMMDLATRPSTFLWLIAVT

SEQ ID NO: 371338 - protein, 23 aa, Mycobacterium
TMMVLINFNLIAPTGWQVGLIRI

SEQ ID NO: 371339 - protein, 30 aa, Mycobacterium
TMNFFPVTAVMIVFLALLNDGAILAIAYDH

SEQ ID NO: 371340 - protein, 25 aa, Mycobacterium
TMPAIAWFPFAIIFFGLHTSAILFV

SEQ ID NO: 371341 - protein, 19 aa, Mycobacterium
TMPMDPWMRFQTSAKVAQL

SEQ ID NO: 371342 - protein, 18 aa, Mycobacterium
TMQILKAVPNFALTPLLI

SEQ ID NO: 371343 - protein, 17 aa, Mycobacterium
TMQVLRLLVMNIAAIIG

SEQ ID NO: 371344 - protein, 36 aa, Mycobacterium
TMRAVGRVSYSWYLWHWPVLLLATPLLGRPMGPLDG

SEQ ID NO: 371345 - protein, 17 aa, Mycobacterium
TMRLLAMQVPGQLLFSL

SEQ ID NO: 371346 - protein, 34 aa, Mycobacterium
TMRLLSMQVPGQLLFSLASQLALILLAGATTALT

SEQ ID NO: 371347 - protein, 22 aa, Mycobacterium
TMRPLRYVVVGFGLSAVLCPLL

SEQ ID NO: 371348 - protein, 24 aa, Mycobacterium
TMRRLRQAGFTRLILLTGDRAEPT

SEQ ID NO: 371349 - protein, 20 aa, Mycobacterium
TMTADYWYANVRQPVRFYDS

SEQ ID NO: 371350 - protein, 24 aa, Mycobacterium
TMTTLPYFQSMALPCAISVLVIVA

SEQ ID NO: 371351 - protein, 35 aa, Mycobacterium
TMVARWPGPVLVAAALVLLICTLPITGLTLGFNEP

SEQ ID NO: 371352 - protein, 19 aa, Mycobacterium
TMVAVSVLGLTLVLGLGTL

SEQ ID NO: 371353 - protein, 20 aa, Mycobacterium
TMVAYWLLAGRDVGAGLIAE

SEQ ID NO: 371354 - protein, 23 aa, Mycobacterium
TMVLILFMVFAELGAARGIVAFL

SEQ ID NO: 371355 - protein, 26 aa, Mycobacterium
TMVLLALFPPLWRRVMDPRVLAHYGG

SEQ ID NO: 371356 - protein, 29 aa, Mycobacterium
TMVLLLHPGLPLWPYLVCAALSGLGGGNF

SEQ ID NO: 371357 - protein, 21 aa, Mycobacterium
TMYGAFFIVLFNTVVDLAYAY

SEQ ID NO: 371358 - protein, 35 aa, Mycobacterium
TNAAGLGLALTGRALRWPRVPITLLAGVVAVDYQP

SEQ ID NO: 371359 - protein, 22 aa, Mycobacterium
TNFAWLYPILTGAAISPFMWNM

SEQ ID NO: 371360 - protein, 17 aa, Mycobacterium
TNFAWLYPVLTGLPISQ

SEQ ID NO: 371361 - protein, 27 aa, Mycobacterium
TNFFRTLYVLPWICAPLAIAVMWRWIL

SEQ ID NO: 371362 - protein, 28 aa, Mycobacterium
TNFNRPYALWLPLVLVVPLGVVVMFARR

SEQ ID NO: 371363 - protein, 24 aa, Mycobacterium
TNGALFANLLPRFPEIKSDLAMSN

SEQ ID NO: 371364 - protein, 17 aa, Mycobacterium
TNGLLVDSWMCAISGRA

SEQ ID NO: 371365 - protein, 18 aa, Mycobacterium
TNGRPPLPTLLVVVDEFS

SEQ ID NO: 371366 - protein, 23 aa, Mycobacterium
TNGSQFFMVYKDSKLPPQYTVFG

SEQ ID NO: 371367 - protein, 21 aa, Mycobacterium
TNILTGPYRGSNLRGAYQKAV

SEQ ID NO: 371368 - protein, 27 aa, Mycobacterium
TNISLAGFAWLTLLIRKPFTMAYAKDT

SEQ ID NO: 371369 - protein, 24 aa, Mycobacterium
TNIVLWFGAIAYLLIIEPPLYFPG

SEQ ID NO: 371370 - protein, 27 aa, Mycobacterium
TNKALWALGVFLVLAGIYIAVRYERYM

SEQ ID NO: 371371 - protein, 17 aa, Mycobacterium
TNLFLANKFLGPPDSMT

SEQ ID NO: 371372 - protein, 25 aa, Mycobacterium
TNLGYLILPFCALAGAIVIPSRDDS

SEQ ID NO: 371373 - protein, 18 aa, Mycobacterium
TNLRFMLGRFATIDVRFL

SEQ ID NO: 371374 - protein, 25 aa, Mycobacterium
TNLRSPRQLALFAQGFLLMGGFVAV

SEQ ID NO: 371375 - protein, 19 aa, Mycobacterium
TNLVLRSFSQRWASGGSVA

SEQ ID NO: 371376 - protein, 40 aa, Mycobacterium
TNNLHRRVLLICGFAIGAAAVFAWLLAAFAVRPFKQLAQQ

SEQ ID NO: 371377 - protein, 65 aa, Mycobacterium
TNPAGALATWWPFLFGVAYQVFFNLVGWPTWGMIFASPFLIPALAALGITGLVLLIDHVLNNPVD

SEQ ID NO: 371378 - protein, 27 aa, Mycobacterium
TNPSKPWYMWFCPGANHAPHHSPAEYA

SEQ ID NO: 371379 - protein, 26 aa, Mycobacterium
TNQAQVLDVRWAIGGLGITVVGIFLG

SEQ ID NO: 371380 - protein, 20 aa, Mycobacterium
TNQLYVIVSGQLHPVYNLTS

SEQ ID NO: 371381 - protein, 21 aa, Mycobacterium
TNRLKALPVTSEVGLWTFDGT

SEQ ID NO: 371382 - protein, 18 aa, Mycobacterium
TNRLLVPAVLIELAFSFV

SEQ ID NO: 371383 - protein, 30 aa, Mycobacterium
TNTVNLLFILGLSALLRPLAIQRRTLRLDL

SEQ ID NO: 371384 - protein, 25 aa, Mycobacterium
TNTYLDRSVLPYLRAPFAQLSETRD

SEQ ID NO: 371385 - protein, 23 aa, Mycobacterium
TNVTVLLPRRTFAPVLGRLLHDR

SEQ ID NO: 371386 - protein, 21 aa, Mycobacterium
TNVVNILLILGLSALLVPLGL

SEQ ID NO: 371387 - protein, 19 aa, Mycobacterium
TNWLTTCTALPRPWVRSFR

SEQ ID NO: 371388 - protein, 40 aa, Mycobacterium
TNWTGVLMLFAPLRFYGWRIPGLRTLYAFLPRRVQVIPAI

SEQ ID NO: 371389 - protein, 19 aa, Mycobacterium
TNYKRVLNYALQPDRIANV

SEQ ID NO: 371390 - protein, 25 aa, Mycobacterium
TPAAALMFRFDNPDALLVLVLVAAA

SEQ ID NO: 371391 - protein, 28 aa, Mycobacterium
TPAFWAFLVCYLCAAALTWARYVRPRSP

SEQ ID NO: 371392 - protein, 30 aa, Mycobacterium
TPAIAALMGRWFWWPMKVSKYATDPPPPPV

SEQ ID NO: 371393 - protein, 20 aa, Mycobacterium
TPAMLVLMIVMIVDGIFVGR

SEQ ID NO: 371394 - protein, 35 aa, Mycobacterium
TPANYRKLVRLGSYGSWLNLYICGVSVRVTDLQGR

SEQ ID NO: 371395 - protein, 18 aa, Mycobacterium
TPAPAGRDLPPGPAGPVG

SEQ ID NO: 371396 - protein, 17 aa, Mycobacterium
TPAPGWWHQSAPRTMAA

SEQ ID NO: 371397 - protein, 22 aa, Mycobacterium
TPAQARLFIVDYRRALLGVVES

SEQ ID NO: 371398 - protein, 25 aa, Mycobacterium
TPARQRFVWLTLLLAVITLIATPIT

SEQ ID NO: 371399 - protein, 21 aa, Mycobacterium
TPATQLLLGPLARGTTVSIDG

SEQ ID NO: 371400 - protein, 26 aa, Mycobacterium
TPATRWAPLLQWIMAAAAGAVILAGI

SEQ ID NO: 371401 - protein, 22 aa, Mycobacterium
TPAVFLLYFLLRRDHRAALTAL

SEQ ID NO: 371402 - protein, 20 aa, Mycobacterium
TPAVFLLYFLLRRDNRAALT

SEQ ID NO: 371403 - protein, 25 aa, Mycobacterium
TPDEPPLAGPALPKFVPSAEVGANC

SEQ ID NO: 371404 - protein, 23 aa, Mycobacterium
TPDLVVSVVWWLAAVNLMLGLFN

SEQ ID NO: 371405 - protein, 34 aa, Mycobacterium
TPDRDRLIFSYHFLLLDGWSREQLLRELFAEYTA

SEQ ID NO: 371406 - protein, 21 aa, Mycobacterium
TPEAPFGWYYDLLALWAHVST

SEQ ID NO: 371407 - protein, 22 aa, Mycobacterium
TPEAPFGWYYDLLALWAHVSTT

SEQ ID NO: 371408 - protein, 20 aa, Mycobacterium
TPEGDLWIAMQYVQGSDAHS

SEQ ID NO: 371409 - protein, 26 aa, Mycobacterium
TPEGPWAWLALLVAGLAVGIFITQGR

SEQ ID NO: 371410 - protein, 20 aa, Mycobacterium
TPEIPLGSWLADLPDERLIQ

SEQ ID NO: 371411 - protein, 24 aa, Mycobacterium
TPESPFGWYYDLLALWAHVSTASV

SEQ ID NO: 371412 - protein, 24 aa, Mycobacterium
TPFTFLGWHWSLPLGVAILLAAVG

SEQ ID NO: 371413 - protein, 26 aa, Mycobacterium
TPGAPPPPPAWTYGGPVTGPPPPSPS

SEQ ID NO: 371414 - protein, 20 aa, Mycobacterium
TPGLKLLRKLDKLGCRASHT

SEQ ID NO: 371415 - protein, 34 aa, Mycobacterium
TPGLPAWIGWTHFFNLFMMMFIIRTGIQILCDHP

SEQ ID NO: 371416 - protein, 17 aa, Mycobacterium
TPGLVVVCAAALAFVVC

SEQ ID NO: 371417 - protein, 23 aa, Mycobacterium
TPGRILTIGIVLAALGVSSAFAT

SEQ ID NO: 371418 - protein, 21 aa, Mycobacterium
TPGWPAPAWSGYTAPAAPRPR

SEQ ID NO: 371419 - protein, 19 aa, Mycobacterium
TPHPRFPHLIPGGDYVMGG

SEQ ID NO: 371420 - protein, 22 aa, Mycobacterium
TPIAFLLFAFFGGFAVMIGAEL

SEQ ID NO: 371421 - protein, 25 aa, Mycobacterium
TPIAFLLFAFMLGFAIVLGAELNAA

SEQ ID NO: 371422 - protein, 28 aa, Mycobacterium
TPILAVAMPWLFLRLRFFRRKWTVTALA

SEQ ID NO: 371423 - protein, 31 aa, Mycobacterium
TPILAVAMPWLFLRLRFFRRKWTVTTLATTA

SEQ ID NO: 371424 - protein, 21 aa, Mycobacterium
TPILAVFVPLALVAIVDGRRG

SEQ ID NO: 371425 - protein, 20 aa, Mycobacterium
TPIPFRASAARGLSLALTGR

SEQ ID NO: 371426 - protein, 17 aa, Mycobacterium
TPIWRLVLPFFATGVGM

SEQ ID NO: 371427 - protein, 35 aa, Mycobacterium
TPKPPKTGRRNWGWVIAIILVIAALAAAAVVGTLL

SEQ ID NO: 371428 - protein, 24 aa, Mycobacterium
TPLAAILLRIDWPDFVPLITSESS

SEQ ID NO: 371429 - protein, 30 aa, Mycobacterium
TPLEPDKFFLPPKLVSLYGTPLWESMSREQ

SEQ ID NO: 371430 - protein, 20 aa, Mycobacterium
TPLGGHYLALYPEGSTPLGK

SEQ ID NO: 371431 - protein, 32 aa, Mycobacterium
TPLLWPAIALVALLILNAFLTPGFLSVRVQDG

SEQ ID NO: 371432 - protein, 34 aa, Mycobacterium
TPLSALGMMLNPASLVPLLISQVGGLAAGLVGGA

SEQ ID NO: 371433 - protein, 18 aa, Mycobacterium
TPLWRAAQGFRLLSCLYA

SEQ ID NO: 371434 - protein, 21 aa, Mycobacterium
TPLYPGLPPAPPPGTPREPGP

SEQ ID NO: 371435 - protein, 17 aa, Mycobacterium
TPLYRIAATFVGPDAMV

SEQ ID NO: 371436 - protein, 23 aa, Mycobacterium
TPNIDRILPAMLGLAGLLEKRRP

SEQ ID NO: 371437 - protein, 27 aa, Mycobacterium
TPPADPLPRLVAYAGVGVLAAVVIAAA

SEQ ID NO: 371438 - protein, 24 aa, Mycobacterium
TPPAWASWLRIVLGIALIGSASYA

SEQ ID NO: 371439 - protein, 25 aa, Mycobacterium
TPPKWASWVRLVFGVALLALAAFHW

SEQ ID NO: 371440 - protein, 18 aa, Mycobacterium
TPPPAPAPIAAARRPGRG

SEQ ID NO: 371441 - protein, 18 aa, Mycobacterium
TPPYYQPAGPTWGPPPPG

SEQ ID NO: 371442 - protein, 25 aa, Mycobacterium
TPQPMPTWLWVLLAGGAALLGMAAA

SEQ ID NO: 371443 - protein, 23 aa, Mycobacterium
TPRGFSRLFGSQRPALEGQTLVA

SEQ ID NO: 371444 - protein, 27 aa, Mycobacterium
TPRGKYWWVRWVILGMVAIVLAVEVSL

SEQ ID NO: 371445 - protein, 23 aa, Mycobacterium
TPRGVGWLPLRMAAPFVRPVAAW

SEQ ID NO: 371446 - protein, 32 aa, Mycobacterium
TPRLAAILFVSPLLCIFIIFVGIFAGYLVNVG

SEQ ID NO: 371447 - protein, 23 aa, Mycobacterium
TPRLVIVPALFLSAAVLGFIMVG

SEQ ID NO: 371448 - protein, 18 aa, Mycobacterium
TPRPAAYPPPRPPAATRA

SEQ ID NO: 371449 - protein, 30 aa, Mycobacterium
TPRPALVAVLSLLGFLIALATLFDGFEGTT

SEQ ID NO: 371450 - protein, 23 aa, Mycobacterium
TPRPYLYAGILFFATLGAFAVNL

SEQ ID NO: 371451 - protein, 24 aa, Mycobacterium
TPRPYLYAGILFFATLGALAVNVQ

SEQ ID NO: 371452 - protein, 18 aa, Mycobacterium
TPRRISTVGGAPLLGAVF

SEQ ID NO: 371453 - protein, 22 aa, Mycobacterium
TPRRRNFIFLALVLGILLSSLD

SEQ ID NO: 371454 - protein, 28 aa, Mycobacterium
TPRTQILVPPLMWNLTAPDAQAVLTAVG

SEQ ID NO: 371455 - protein, 25 aa, Mycobacterium
TPRTQIVMPPLVWSLGPDDAQAILT

SEQ ID NO: 371456 - protein, 30 aa, Mycobacterium
TPSIAAALGRWFWWPINVFEIVRRGRETQA

SEQ ID NO: 371457 - protein, 30 aa, Mycobacterium
TPSIAALLGRWFWWPMKVRSRPARIRSAPR

SEQ ID NO: 371458 - protein, 30 aa, Mycobacterium
TPSIAALLGRWFWWPMRVRTRPARTPSSPT

SEQ ID NO: 371459 - protein, 28 aa, Mycobacterium
TPSIAALLGRWFWWPQKVRPRPASALLE

SEQ ID NO: 371460 - protein, 25 aa, Mycobacterium
TPSIMTVMGRWFWWPKRVRVRPASQ

SEQ ID NO: 371461 - protein, 30 aa, Mycobacterium
TPSLAALFGKWFWWPMHVRQRPRARPWPTL

SEQ ID NO: 371462 - protein, 30 aa, Mycobacterium
TPSLAGLLGPWFWWPLRVRTGPTAEARPNG

SEQ ID NO: 371463 - protein, 23 aa, Mycobacterium
TPSSALYYDTLAEIWFASEEAAQ

SEQ ID NO: 371464 - protein, 32 aa, Mycobacterium
TPSVAALLGRWFWWPLRVRPRPASYMLRPFGP

SEQ ID NO: 371465 - protein, 28 aa, Mycobacterium
TPSVAKILGRWFWWPQRVRPRPASTMLR

SEQ ID NO: 371466 - protein, 30 aa, Mycobacterium
TPSVATLLGRWFWWPLRVRPRPASQMLRPY

SEQ ID NO: 371467 - protein, 25 aa, Mycobacterium
TPTAAPPLTLTPPPAAALNPRTVVY

SEQ ID NO: 371468 - protein, 17 aa, Mycobacterium
TPTLMIIVITAVKVIGS

SEQ ID NO: 371469 - protein, 20 aa, Mycobacterium
TPTNLARLLGIASLLKAVAV

SEQ ID NO: 371470 - protein, 50 aa, Mycobacterium
TPTPVKPRRRILRRLLITSLGLATVLAVAFVAFVFWPNPTVPADQPNMTQ

SEQ ID NO: 371471 - protein, 23 aa, Mycobacterium
TPTRIRLTYWWPGQPDQMIVDGD

SEQ ID NO: 371472 - protein, 18 aa, Mycobacterium
TPTRRGRGHRRSRKALAA

SEQ ID NO: 371473 - protein, 28 aa, Mycobacterium
TPTSTIYRYPIPAIPSPPPIPPIPAIPQ

SEQ ID NO: 371474 - protein, 21 aa, Mycobacterium
TPTVLLTLLFLIGCGQALTAP

SEQ ID NO: 371475 - protein, 20 aa, Mycobacterium
TPTVLPFDGLNTPLAVAVDK

SEQ ID NO: 371476 - protein, 31 aa, Mycobacterium
TPTVLQFAAWLTYIVVVLALFLKPGRASSPA

SEQ ID NO: 371477 - protein, 32 aa, Mycobacterium
TPTVLQLAGWIIYLVLVLGLFLRPVAVAPKAN

SEQ ID NO: 371478 - protein, 22 aa, Mycobacterium
TPTVWAAVLWFVLVAASTVAAP

SEQ ID NO: 371479 - protein, 23 aa, Mycobacterium
TPTWEGVTFWVLGAIAVLGALGV

SEQ ID NO: 371480 - protein, 34 aa, Mycobacterium
TPVAALIFRFNNPDALLVLLLVVAAYCVQRGIEK

SEQ ID NO: 371481 - protein, 29 aa, Mycobacterium
TPVALHLFYVVKILLYILGAWVFASATRG

SEQ ID NO: 371482 - protein, 18 aa, Mycobacterium
TPVAWGVLIGFIALYLIG

SEQ ID NO: 371483 - protein, 26 aa, Mycobacterium
TPVDALLYGILLALLVFALLSDGTGP

SEQ ID NO: 371484 - protein, 22 aa, Mycobacterium
TPVEFDRVLAMIDRLSKAMKGD

SEQ ID NO: 371485 - protein, 24 aa, Mycobacterium
TPVEFDRVLGMLDKLSVSLKGDGN

SEQ ID NO: 371486 - protein, 21 aa, Mycobacterium
TPVLARLYSTEFYTLAARALA

SEQ ID NO: 371487 - protein, 22 aa, Mycobacterium
TPVLNMWLRGLGAHIGRGVWCE

SEQ ID NO: 371488 - protein, 51 aa, Mycobacterium
TPVLSIIACLFVLYGLPAVTWLWFSVWVGAVLLFYLLWGRRHSALNDGGDG

SEQ ID NO: 371489 - protein, 20 aa, Mycobacterium
TPVMNLWLRGLGATIGRGVW

SEQ ID NO: 371490 - protein, 24 aa, Mycobacterium
TPVPELTWIPAKPATQPAPGNATD

SEQ ID NO: 371491 - protein, 25 aa, Mycobacterium
TPVPFEDLLLPFLAVAENRLTEAAS

SEQ ID NO: 371492 - protein, 22 aa, Mycobacterium
TPVPFVLRLLIPTGASVVVTLL

SEQ ID NO: 371493 - protein, 29 aa, Mycobacterium
TPVSTLVEGLWLAVRQNQYTWNNQRPVAD

SEQ ID NO: 371494 - protein, 17 aa, Mycobacterium
TPVVWGVLIGFVALYLL

SEQ ID NO: 371495 - protein, 25 aa, Mycobacterium
TPYGGPQWPLPIPGDAPLPPEAPAP

SEQ ID NO: 371496 - protein, 17 aa, Mycobacterium
TPYLILFTLFLAPAEHW

SEQ ID NO: 371497 - protein, 24 aa, Mycobacterium
TPYREIAMQMLLLGGGLGLTTAPA

SEQ ID NO: 371498 - protein, 18 aa, Mycobacterium
TPYRLALQRSPSTAAFAL

SEQ ID NO: 371499 - protein, 22 aa, Mycobacterium
TPYTLKIMTWVTALFAPLTVVY

SEQ ID NO: 371500 - protein, 24 aa, Mycobacterium
TPYTLRIMTWASLALLPLVLGYQA

SEQ ID NO: 371501 - protein, 24 aa, Mycobacterium
TPYTQIALQMLLLGGGLGLTTAPA

SEQ ID NO: 371502 - protein, 30 aa, Mycobacterium
TQAEAHAWRPLFWIIAAIALAALVMALLTF

SEQ ID NO: 371503 - protein, 19 aa, Mycobacterium
TQAILAVSAVAVLLAWIAL

SEQ ID NO: 371504 - protein, 21 aa, Mycobacterium
TQALRVDWVGLLLAVSVGALS

SEQ ID NO: 371505 - protein, 33 aa, Mycobacterium
TQAPMTMYLHLPFVSIPIPINPPPPPAPPPEPA

SEQ ID NO: 371506 - protein, 35 aa, Mycobacterium
TQDLGLLILRVAIGGLLILHGLQKAFGWWGGPGFD

SEQ ID NO: 371507 - protein, 24 aa, Mycobacterium
TQDLGLLLLRVAVGALLIGHGLQK

SEQ ID NO: 371508 - protein, 25 aa, Mycobacterium
TQEYTPWLTRALAFVIDILPYVVVH

SEQ ID NO: 371509 - protein, 25 aa, Mycobacterium
TQFGPYRLRRLLGRGGMGEVYEAHD

SEQ ID NO: 371510 - protein, 19 aa, Mycobacterium
TQFYPLGPHGIWPRVVHGI

SEQ ID NO: 371511 - protein, 18 aa, Mycobacterium
TQGLFPVISLVLLGLGLA

SEQ ID NO: 371512 - protein, 23 aa, Mycobacterium
TQHLGLLILRVGLGFVLAAHGLQ

SEQ ID NO: 371513 - protein, 24 aa, Mycobacterium
TQHLGLLVLRVGLGAVLIAHGLQK

SEQ ID NO: 371514 - protein, 21 aa, Mycobacterium
TQHLGLLVLRVGLGVVLGAHG

SEQ ID NO: 371515 - protein, 17 aa, Mycobacterium
TQILDNLRARPADVVPA

SEQ ID NO: 371516 - protein, 17 aa, Mycobacterium
TQKFSWVVIGLALFAAG

SEQ ID NO: 371517 - protein, 26 aa, Mycobacterium
TQLAALVMWTAWLLSGAIVFGYMRGM

SEQ ID NO: 371518 - protein, 20 aa, Mycobacterium
TQLAYGKQWTWALLGVAVVA

SEQ ID NO: 371519 - protein, 22 aa, Mycobacterium
TQLLVWRWVMYISVLMTMTALA

SEQ ID NO: 371520 - protein, 25 aa, Mycobacterium
TQLRNRSWWAGPDIYLVVDDYDLVT

SEQ ID NO: 371521 - protein, 21 aa, Mycobacterium
TQLVEDMLLLARLDTGRPLDR

SEQ ID NO: 371522 - protein, 17 aa, Mycobacterium
TQPALDLDALLGGLRPV

SEQ ID NO: 371523 - protein, 25 aa, Mycobacterium
TQPGLPLYFVIYAAVLIAGCLIAAA

SEQ ID NO: 371524 - protein, 23 aa, Mycobacterium
TQPPPPPPPPPPPPTTEIPTATE

SEQ ID NO: 371525 - protein, 17 aa, Mycobacterium
TQRDIPFPIVVATIVVM

SEQ ID NO: 371526 - protein, 20 aa, Mycobacterium
TQRWAYPLLLVLSGVALGVS

SEQ ID NO: 371527 - protein, 36 aa, Mycobacterium
TQSRFWNRWIGWVMRRPWMSALAASLVLLVMAAPAA

SEQ ID NO: 371528 - protein, 26 aa, Mycobacterium
TQSVILLTLVLFPTAALVLGAHNRPD

SEQ ID NO: 371529 - protein, 18 aa, Mycobacterium
TQTAAVIGTAQYLSPEQA

SEQ ID NO: 371530 - protein, 20 aa, Mycobacterium
TQVELPFTGLHFPMGVAVDS

SEQ ID NO: 371531 - protein, 19 aa, Mycobacterium
TQVELPFTGLKSPMGVAVD

SEQ ID NO: 371532 - protein, 19 aa, Mycobacterium
TQVMTFGPLLITAQTALTG

SEQ ID NO: 371533 - protein, 19 aa, Mycobacterium
TQVTLPFTGLKQPGGVTVD

SEQ ID NO: 371534 - protein, 23 aa, Mycobacterium
TQVVAMLSLVPWGSNGVSLDLMR

SEQ ID NO: 371535 - protein, 25 aa, Mycobacterium
TQWGPWVEWALALIAGLAVLASAGL

SEQ ID NO: 371536 - protein, 21 aa, Mycobacterium
TRADPFLARTLAPEVDRAVAL

SEQ ID NO: 371537 - protein, 24 aa, Mycobacterium
TRAEWVWAVLLTAALVVVIAVGDP

SEQ ID NO: 371538 - protein, 31 aa, Mycobacterium
TRAGFLMLLWLFIWSVLRILRTDIYAPTGAV

SEQ ID NO: 371539 - protein, 29 aa, Mycobacterium
TRAGFLMLLWLFIWSVLRVLRTDIYAPTG

SEQ ID NO: 371540 - protein, 31 aa, Mycobacterium
TRAGFLMLLWVFIWSVLRILRTDIYAPTGAV

SEQ ID NO: 371541 - protein, 18 aa, Mycobacterium
TRALTWPSQAPVPLAAGF

SEQ ID NO: 371542 - protein, 17 aa, Mycobacterium
TRAMSVSVFLLALGILL

SEQ ID NO: 371543 - protein, 29 aa, Mycobacterium
TRASTIMHGFWILLFAVPFAGLVEKIPTA

SEQ ID NO: 371544 - protein, 26 aa, Mycobacterium
TRAVKISLVALLMTAAFQVAIVVVSG

SEQ ID NO: 371545 - protein, 22 aa, Mycobacterium
TRDLPAMWRYAGMAASALVAAA

SEQ ID NO: 371546 - protein, 29 aa, Mycobacterium
TRFMTPLRVMLIIALVFLALGYSTKAACL

SEQ ID NO: 371547 - protein, 19 aa, Mycobacterium
TRFPNGAPPPAPPVREGTP

SEQ ID NO: 371548 - protein, 20 aa, Mycobacterium
TRFWRRSGIRIVRRPVPHLV

SEQ ID NO: 371549 - protein, 23 aa, Mycobacterium
TRGADLLLVSFMLALSAAALPVQ

SEQ ID NO: 371550 - protein, 27 aa, Mycobacterium
TRGALTGLLLILLGAWGALVPFFGPNI

SEQ ID NO: 371551 - protein, 31 aa, Mycobacterium
TRGGFLLLLWVFIWSVLRILRTDIYAPTGQL

SEQ ID NO: 371552 - protein, 22 aa, Mycobacterium
TRGVDILLVSFMLALSAAALPV

SEQ ID NO: 371553 - protein, 17 aa, Mycobacterium
TRIASHMPLLLGVAFAL

SEQ ID NO: 371554 - protein, 17 aa, Mycobacterium
TRIGAILVPLSTMLTPT

SEQ ID NO: 371555 - protein, 18 aa, Mycobacterium
TRIGAVLVPLSTLLQAGE

SEQ ID NO: 371556 - protein, 21 aa, Mycobacterium
TRIGAVLVPLSTLLRPRELAS

SEQ ID NO: 371557 - protein, 20 aa, Mycobacterium
TRIMILLVLVMAFGSALLDN

SEQ ID NO: 371558 - protein, 29 aa, Mycobacterium
TRIVRRSNALLDWAYGRQLRYSESMSLGS

SEQ ID NO: 371559 - protein, 22 aa, Mycobacterium
TRKALPLYIAFLAGLGVLAGQL

SEQ ID NO: 371560 - protein, 23 aa, Mycobacterium
TRKALPLYIGFFAGLGILAGQLD

SEQ ID NO: 371561 - protein, 17 aa, Mycobacterium
TRKRRVVALKLISTQYS

SEQ ID NO: 371562 - protein, 23 aa, Mycobacterium
TRLFRPVFYFLAVVALITTLLRI

SEQ ID NO: 371563 - protein, 25 aa, Mycobacterium
TRLGRAWLITVLGAMVALGPLTIDM

SEQ ID NO: 371564 - protein, 21 aa, Mycobacterium
TRLRVLVLGYSGLLAGIAGFI

SEQ ID NO: 371565 - protein, 17 aa, Mycobacterium
TRLTEVLSRIYGRPVSV

SEQ ID NO: 371566 - protein, 19 aa, Mycobacterium
TRMALFAVLLVAFGIKAAV

SEQ ID NO: 371567 - protein, 26 aa, Mycobacterium
TRMATLLAHLAWLATLIVGGAGALIG

SEQ ID NO: 371568 - protein, 17 aa, Mycobacterium
TRMDYLSPFFNETAYCL

SEQ ID NO: 371569 - protein, 26 aa, Mycobacterium
TRMVAAWVITLPLAGLVGAITYWLVH

SEQ ID NO: 371570 - protein, 28 aa, Mycobacterium
TRNPEVWSWIVWLPHNLHDELFDACGFR

SEQ ID NO: 371571 - protein, 27 aa, Mycobacterium
TRNPEVWSWMVWLPHNLHDELFDACGF

SEQ ID NO: 371572 - protein, 28 aa, Mycobacterium
TRNPEVWSWMVWLPHNLHDELFDACGWR

SEQ ID NO: 371573 - protein, 25 aa, Mycobacterium
TRNRWSNRLLLTAATLLITGGPLVL

SEQ ID NO: 371574 - protein, 27 aa, Mycobacterium
TRPAGTFAWIWPSVIAAVAGALVLGTL

SEQ ID NO: 371575 - protein, 26 aa, Mycobacterium
TRPDRFPVAWLLARPDRKSLLRLAAT

SEQ ID NO: 371576 - protein, 26 aa, Mycobacterium
TRPGLPLYFWVYLAALIAACLAVAAA

SEQ ID NO: 371577 - protein, 24 aa, Mycobacterium
TRPGTFLWLIVAVGTPMITSGAMD

SEQ ID NO: 371578 - protein, 28 aa, Mycobacterium
TRPRLRRVTTFWFITHTLAAAAIGAAPP

SEQ ID NO: 371579 - protein, 24 aa, Mycobacterium
TRPVRAISWLVAGISALGLLNFNR

SEQ ID NO: 371580 - protein, 20 aa, Mycobacterium
TRPVSAWTPGAPARSTPRLP

SEQ ID NO: 371581 - protein, 28 aa, Mycobacterium
TRPVVRRLGWPVFPYTRMVRVSLWISVA

SEQ ID NO: 371582 - protein, 26 aa, Mycobacterium
TRQHAERLRELGWRNVRRRNLGWRMW

SEQ ID NO: 371583 - protein, 18 aa, Mycobacterium
TRQLLDIYSIALAAMIVP

SEQ ID NO: 371584 - protein, 30 aa, Mycobacterium
TRQLQALRSAFIPWLATINPDNGQPMRRVA

SEQ ID NO: 371585 - protein, 22 aa, Mycobacterium
TRQLRQLMIGAGLVTLVVAALL

SEQ ID NO: 371586 - protein, 31 aa, Mycobacterium
TRQLSPYMLMMPLMMIVMMVGTLAGGSGGGS

SEQ ID NO: 371587 - protein, 17 aa, Mycobacterium
TRQPAPQNGLRSASFVF

SEQ ID NO: 371588 - protein, 36 aa, Mycobacterium
TRQPRSRFRFGIQSKILITMLLSSILGVAVIGLIGA

SEQ ID NO: 371589 - protein, 25 aa, Mycobacterium
TRQRNFVMGCLLFGMAFVCLVGLLQ

SEQ ID NO: 371590 - protein, 17 aa, Mycobacterium
TRRAAVDEVLLVLDATI

SEQ ID NO: 371591 - protein, 20 aa, Mycobacterium
TRREPVFVTDLTVERLRAAV

SEQ ID NO: 371592 - protein, 25 aa, Mycobacterium
TRREWTWALLLAVALAVLIAIGDPT

SEQ ID NO: 371593 - protein, 20 aa, Mycobacterium
TRRLGGTLAALLFIAVFPAN

SEQ ID NO: 371594 - protein, 23 aa, Mycobacterium
TRRQRIIRRVRIGIVIAACLVTL

SEQ ID NO: 371595 - protein, 38 aa, Mycobacterium
TRRQVRLVIADRAYFAFLAILPFILGALSLTVPGDTGF

SEQ ID NO: 371596 - protein, 19 aa, Mycobacterium
TRRTLWIAGALAIVIAVVA

SEQ ID NO: 371597 - protein, 17 aa, Mycobacterium
TRRTVSWLIGCVVLLFA

SEQ ID NO: 371598 - protein, 26 aa, Mycobacterium
TRRVAWLWAVLAFAGVAMLGLTRHDD

SEQ ID NO: 371599 - protein, 22 aa, Mycobacterium
TRRWLMLAIGLLTTLCANVFIN

SEQ ID NO: 371600 - protein, 25 aa, Mycobacterium
TRSDRILPGLLWRRDTIGAAVAASQ

SEQ ID NO: 371601 - protein, 24 aa, Mycobacterium
TRSDTMMLVNIPANRKRVAVVSFP

SEQ ID NO: 371602 - protein, 26 aa, Mycobacterium
TRSFTAAGIWLGIGSLLAAGVVALLA

SEQ ID NO: 371603 - protein, 29 aa, Mycobacterium
TRSGSWSVLVTRWRLIGKCLRPLPDKWKG

SEQ ID NO: 371604 - protein, 26 aa, Mycobacterium
TRSLIVRRWRLIGKCLRPLPNKWKGL

SEQ ID NO: 371605 - protein, 23 aa, Mycobacterium
TRSRTWRSWWSRWSRCSPSESRP

SEQ ID NO: 371606 - protein, 23 aa, Mycobacterium
TRSTLRFLWLRLARVWPVYLVTM

SEQ ID NO: 371607 - protein, 39 aa, Mycobacterium
TRTAGWAVFFALIALLVVAGFGWVGWDFSLVVGAVLVGV

SEQ ID NO: 371608 - protein, 23 aa, Mycobacterium
TRTALIAMPLQIDAAIAPLRANE

SEQ ID NO: 371609 - protein, 26 aa, Mycobacterium
TRTALLMAPLPIVVGLLTPFIGKILD

SEQ ID NO: 371610 - protein, 25 aa, Mycobacterium
TRTWRRGALVWIPAGALTGAWIVLY

SEQ ID NO: 371611 - protein, 17 aa, Mycobacterium
TRVAAALCFLILMLAMF

SEQ ID NO: 371612 - protein, 42 aa, Mycobacterium
TRVARKLLIVDLPRPPVPLHLALLAVVLPLVAISPLQHDGFI

SEQ ID NO: 371613 - protein, 20 aa, Mycobacterium
TRVAVAAFLAAGLVVALIGI

SEQ ID NO: 371614 - protein, 30 aa, Mycobacterium
TRVGFLLLLWLFIWSVLRILRTDIYAPTGA

SEQ ID NO: 371615 - protein, 17 aa, Mycobacterium
TRVLAQPLPPSAGFTSA

SEQ ID NO: 371616 - protein, 36 aa, Mycobacterium
TRWHYWRHVGLPVLCPFLLAGWVLTFAWSLGQFSVP

SEQ ID NO: 371617 - protein, 20 aa, Mycobacterium
TRWVAMNDITLASAGALVLR

SEQ ID NO: 371618 - protein, 21 aa, Mycobacterium
TRYRKILQPYFSPHALSKSRP

SEQ ID NO: 371619 - protein, 27 aa, Mycobacterium
TRYVKPSLLPYLAATAGLLIALALVAI

SEQ ID NO: 371620 - protein, 20 aa, Mycobacterium
TRYYAAQREFWVDPVSGIIV

SEQ ID NO: 371621 - protein, 22 aa, Mycobacterium
TRYYAAQRTFWVDPVSGTIVKQ

SEQ ID NO: 371622 - protein, 23 aa, Mycobacterium
TRYYAAQRTFWVDPVTGTIVKQT

SEQ ID NO: 371623 - protein, 23 aa, Mycobacterium
TSAALIMIAVFIGFAFVGMPLVA

SEQ ID NO: 371624 - protein, 23 aa, Mycobacterium
TSAAMLTWRLLRPHWCEWRTAGA

SEQ ID NO: 371625 - protein, 45 aa, Mycobacterium
TSAAPPHSKKFTWHWWWLAAAIPVLLLVVFLVVMAVGLRRRRAGQ

SEQ ID NO: 371626 - protein, 32 aa, Mycobacterium
TSADAIGQFRKLGLRPFLLTGDNRRAALAVAA

SEQ ID NO: 371627 - protein, 24 aa, Mycobacterium
TSAGLVFAFTMMGMMVSSFTVIGQ

SEQ ID NO: 371628 - protein, 25 aa, Mycobacterium
TSAGPWFPLVFFVAHVVVTVFPFPR

SEQ ID NO: 371629 - protein, 22 aa, Mycobacterium
TSAILVFIFAWNDLLLAISLTA

SEQ ID NO: 371630 - protein, 28 aa, Mycobacterium
TSAMAHLFVHGHDLDFRTLFTKAEDPET

SEQ ID NO: 371631 - protein, 31 aa, Mycobacterium
TSAPESLYPALLGFILLSAVAATLLVAMIEA

SEQ ID NO: 371632 - protein, 23 aa, Mycobacterium
TSAQIRYLDLIGNRYLELKRGEG

SEQ ID NO: 371633 - protein, 23 aa, Mycobacterium
TSAQLLWLVLAVAVTAGLHLWRG

SEQ ID NO: 371634 - protein, 20 aa, Mycobacterium
TSAVAVWWLLRSPGPAEVGV

SEQ ID NO: 371635 - protein, 45 aa, Mycobacterium
TSAVLAVIMLFLYDLLWYPYYASYLLPFLIPALSGLSGLAALMHL

SEQ ID NO: 371636 - protein, 38 aa, Mycobacterium
TSAVLHGVWILLFASLFTGLVELIPKAALAGLLIVVGA

SEQ ID NO: 371637 - protein, 26 aa, Mycobacterium
TSAYDLGLFYKYAFADPTFADLVSAP

SEQ ID NO: 371638 - protein, 18 aa, Mycobacterium
TSAYLLGYAVPLLITGRL

SEQ ID NO: 371639 - protein, 23 aa, Mycobacterium
TSEPLIPLRIFGDRNFALCSFGV

SEQ ID NO: 371640 - protein, 26 aa, Mycobacterium
TSERWLPLMLAGFTSGFLMLRGRSYV

SEQ ID NO: 371641 - protein, 19 aa, Mycobacterium
TSFAAAYVSGLAALVRQRF

SEQ ID NO: 371642 - protein, 23 aa, Mycobacterium
TSFALTLALLTSTAFLLFAQIFM

SEQ ID NO: 371643 - protein, 18 aa, Mycobacterium
TSFHLIIAIAGLLTTLGL

SEQ ID NO: 371644 - protein, 28 aa, Mycobacterium
TSFREIRWNLRVIIMFSVGLVIATAVAV

SEQ ID NO: 371645 - protein, 27 aa, Mycobacterium
TSFRELRWNLRIVIMFSIGLVIATAVA

SEQ ID NO: 371646 - protein, 22 aa, Mycobacterium
TSFRSALMYPEPNHPGWHHHQH

SEQ ID NO: 371647 - protein, 18 aa, Mycobacterium
TSGFLVLTVFVGSVVWII

SEQ ID NO: 371648 - protein, 21 aa, Mycobacterium
TSGLPCTIGILTALAAALTLG

SEQ ID NO: 371649 - protein, 19 aa, Mycobacterium
TSGPFWAYLAAMALTYVLF

SEQ ID NO: 371650 - protein, 23 aa, Mycobacterium
TSGVMLIRWLIARRAAVFAHHGL

SEQ ID NO: 371651 - protein, 25 aa, Mycobacterium
TSHPSYALLLLLTAPIPGVMVAATV

SEQ ID NO: 371652 - protein, 24 aa, Mycobacterium
TSIAFAVGVIRLGQRRCLVQELPA

SEQ ID NO: 371653 - protein, 26 aa, Mycobacterium
TSIAKTPPLHFLAAAHRLLGVSRDGA

SEQ ID NO: 371654 - protein, 28 aa, Mycobacterium
TSIILQLVILWTVIGLALAKLAANQKIM

SEQ ID NO: 371655 - protein, 27 aa, Mycobacterium
TSIILQLVILWTVIGLALAKLAANQRI

SEQ ID NO: 371656 - protein, 27 aa, Mycobacterium
TSKKLLIMTVVGIVVALLVGGAALAVG

SEQ ID NO: 371657 - protein, 33 aa, Mycobacterium; identical to SEQ ID NO: 22938

SEQ ID NO: 371658 - protein, 35 aa, Mycobacterium
TSLAAIPGIMWQRWLFAWPAMLAALIVAIGQPAML

SEQ ID NO: 371659 - protein, 28 aa, Mycobacterium
TSLADPEVRLLFSLGLRILERRRHTGTP

SEQ ID NO: 371660 - protein, 26 aa, Mycobacterium
TSLAGLILLFYVTSALFVVVVLGSVM

SEQ ID NO: 371661 - protein, 24 aa, Mycobacterium
TSLDLTMLAVIGPTLLVSLVSWGL

SEQ ID NO: 371662 - protein, 22 aa, Mycobacterium
TSLIAIVLVVLLASLALYGTDP

SEQ ID NO: 371663 - protein, 21 aa, Mycobacterium
TSLIDSRFNYRIPVSLAWTRT

SEQ ID NO: 371664 - protein, 19 aa, Mycobacterium
TSLIFVLMVVIYAMFKRRD

SEQ ID NO: 371665 - protein, 17 aa, Mycobacterium
TSLLLYASFLVVVYLAT

SEQ ID NO: 371666 - protein, 22 aa, Mycobacterium
TSLLLYTSFLVVVYLATQRFSW

SEQ ID NO: 371667 - protein, 25 aa, Mycobacterium
TSLLMALMPLTAAAAVWLLLPRQLP

SEQ ID NO: 371668 - protein, 29 aa, Mycobacterium
TSLLSWGVILLLFAILRLTRRRTPEPGER

SEQ ID NO: 371669 - protein, 18 aa, Mycobacterium
TSLRLLLIGSVVGTALGV

SEQ ID NO: 371670 - protein, 27 aa, Mycobacterium
TSMPMRMVVPHMLLVSYSVHLVLLATD

SEQ ID NO: 371671 - protein, 20 aa, Mycobacterium
TSMTMVWLSVLLYVKVGEPD

SEQ ID NO: 371672 - protein, 39 aa, Mycobacterium
TSNELIAWVCIGASVLGVVLLIVDALRERSRGARTSARG

SEQ ID NO: 371673 - protein, 22 aa, Mycobacterium
TSNVVIFAIQIALGELLKHHGA

SEQ ID NO: 371674 - protein, 33 aa, Mycobacterium
TSPALDLDALIGGFKPLFRALDPQKVNTIATAL

SEQ ID NO: 371675 - protein, 18 aa, Mycobacterium
TSPAWRKLGTAIAKWPAA

SEQ ID NO: 371676 - protein, 22 aa, Mycobacterium
TSPEFIPWLLVALTGMVFQQSA

SEQ ID NO: 371677 - protein, 21 aa, Mycobacterium
TSPEFVPWLLVALAGMIFQQS

SEQ ID NO: 371678 - protein, 18 aa, Mycobacterium
TSPLLLITAIAIKATSRG

SEQ ID NO: 371679 - protein, 25 aa, Mycobacterium
TSPVPPGPPPPIGGPPKTAMPQSIP

SEQ ID NO: 371680 - protein, 29 aa, Mycobacterium
TSPVTKNIPSLRYLSYRLTMNRDGGEWRI

SEQ ID NO: 371681 - protein, 23 aa, Mycobacterium
TSQLVLMIHHLAVDGVSWRILLE

SEQ ID NO: 371682 - protein, 24 aa, Mycobacterium
TSQRLADVVIAVPSYWTVEATRAL

SEQ ID NO: 371683 - protein, 24 aa, Mycobacterium
TSRAAWAWFRHLHGLADRTLAPST

SEQ ID NO: 371684 - protein, 29 aa, Mycobacterium
TSRAWRNRMPPQRLALVMGSVAAVTMGAL

SEQ ID NO: 371685 - protein, 25 aa, Mycobacterium
TSRFLSPVTFIKHPIQWIRAMSKYR

SEQ ID NO: 371686 - protein, 24 aa, Mycobacterium
TSRLPLVLAVIAAITFVLLFVLTG

SEQ ID NO: 371687 - protein, 36 aa, Mycobacterium
TSRLPLVLGIIAGITFVLLFLLTGSVVLPLKALVLN

SEQ ID NO: 371688 - protein, 22 aa, Mycobacterium
TSSPYRIVAIGPANTIKSAFER

SEQ ID NO: 371689 - protein, 27 aa, Mycobacterium
TSTAFLLFAQIFMVAPILPALARDFGS

SEQ ID NO: 371690 - protein, 24 aa, Mycobacterium
TSTAWSYLMYFGGLVAGPARLEYV

SEQ ID NO: 371691 - protein, 35 aa, Mycobacterium
TSTAWWVCGGFGVLSVLYLGYLRRQTRIEEQLRRR

SEQ ID NO: 371692 - protein, 20 aa, Mycobacterium
TSTELPFTGLNTPLSVAVDK

SEQ ID NO: 371693 - protein, 17 aa, Mycobacterium
TSTLVLIVAFFAVWWVY

SEQ ID NO: 371694 - protein, 18 aa, Mycobacterium
TSTSQLVMIVHHLAVDGV

SEQ ID NO: 371695 - protein, 23 aa, Mycobacterium
TSTVWTYLLYVASWVGGPMRLEY

SEQ ID NO: 371696 - protein, 18 aa, Mycobacterium
TSVAFAVGVVRLGQRRCL

SEQ ID NO: 371697 - protein, 19 aa, Mycobacterium
TSVIAVLMVVLYVMFKRRD

SEQ ID NO: 371698 - protein, 35 aa, Mycobacterium
TSVITLFLAGFALNLKLLVPVFRWQRRDNLVAAAD

SEQ ID NO: 371699 - protein, 20 aa, Mycobacterium
TSVLFLLLGVVSTAAILVAA

SEQ ID NO: 371700 - protein, 28 aa, Mycobacterium
TSVLIALIPLLWVLYSVITKGIHAVTSP

SEQ ID NO: 371701 - protein, 27 aa, Mycobacterium
TSVMLMALGFRPLKAAVLALVANTAPV

SEQ ID NO: 371702 - protein, 25 aa, Mycobacterium
TSVQTFRARWIPTAQARVFLSVVIL

SEQ ID NO: 371703 - protein, 32 aa, Mycobacterium
TSVVALLLIATYRSPVLWLVPLLVVGFADRVA

SEQ ID NO: 371704 - protein, 23 aa, Mycobacterium
TSVVFQQPYLFDGSIRDNILVGD

SEQ ID NO: 371705 - protein, 26 aa, Mycobacterium
TSVVRWPIPIIVLTSLIAIIGFVSLM

SEQ ID NO: 371706 - protein, 24 aa, Mycobacterium
TSVVRWPIPIVLVTCVIAVVGFVA

SEQ ID NO: 371707 - protein, 17 aa, Mycobacterium
TSWMLYSGIGITIGIVV

SEQ ID NO: 371708 - protein, 17 aa, Mycobacterium
TSYGWLIVGKIVALVVL

SEQ ID NO: 371709 - protein, 20 aa, Mycobacterium
TSYLGRRELAAYAPLSVPNS

SEQ ID NO: 371710 - protein, 17 aa, Mycobacterium
TSYVFIMAIAGPVLARY

SEQ ID NO: 371711 - protein, 19 aa, Mycobacterium
TTAFLTLLIVMVELSCGRG

SEQ ID NO: 371712 - protein, 26 aa, Mycobacterium
TTAFTFLGWHWSLPLGVAILLAAVVG

SEQ ID NO: 371713 - protein, 26 aa, Mycobacterium
TTAFWTFLAFYVLASVVTWFCYVRRP

SEQ ID NO: 371714 - protein, 27 aa, Mycobacterium
TTAGAIIIRRALAPLRRVAQTATEVVD

SEQ ID NO: 371715 - protein, 22 aa, Mycobacterium
TTAILTFFFCWNDFLFAISLTS

SEQ ID NO: 371716 - protein, 23 aa, Mycobacterium
TTAKPFQILHPFDPMTYAVNGLR

SEQ ID NO: 371717 - protein, 23 aa, Mycobacterium
TTALAAVLLAPVATASPIGDAEA

SEQ ID NO: 371718 - protein, 22 aa, Mycobacterium
TTALLLLATALSVLAAPLLVRL

SEQ ID NO: 371719 - protein, 23 aa, Mycobacterium
TTAQIRYLDLIGNRYLELKRGEG

SEQ ID NO: 371720 - protein, 22 aa, Mycobacterium
TTASWLAVLLALAVAATPILAV

SEQ ID NO: 371721 - protein, 23 aa, Mycobacterium
TTASWLAVVLAIAVAAPPILAFA

SEQ ID NO: 371722 - protein, 22 aa, Mycobacterium
TTATLIMRPVGALLFGLWADRV

SEQ ID NO: 371723 - protein, 28 aa, Mycobacterium
TTAVGVALWLPWLLAAGAVFVLSAVAGL

SEQ ID NO: 371724 - protein, 26 aa, Mycobacterium
TTDATYFWPVWPILGAGIGVLSHALG

SEQ ID NO: 371725 - protein, 17 aa, Mycobacterium
TTDFVAFLDSDVAPRRG

SEQ ID NO: 371726 - protein, 33 aa, Mycobacterium
TTDLIEVFVLLRDLARIFDRFFKAYARDYEPML

SEQ ID NO: 371727 - protein, 17 aa, Mycobacterium
TTDPANLAPLLSGLQVS

SEQ ID NO: 371728 - protein, 25 aa, Mycobacterium
TTDPGWRWLWWQYGLADTRYRSDDP

SEQ ID NO: 371729 - protein, 28 aa, Mycobacterium
TTDPLRFTLFYWIPFLITQATSGYFAWL

SEQ ID NO: 371730 - protein, 27 aa, Mycobacterium
TTDQWRYYNALYFPYVMGVRAYAQGAT

SEQ ID NO: 371731 - protein, 19 aa, Mycobacterium
TTELPIEKVQLVIFGIQIA

SEQ ID NO: 371732 - protein, 28 aa, Mycobacterium
TTEPTFDIFLWEIFGPLSAGGRLVFPAL

SEQ ID NO: 371733 - protein, 24 aa, Mycobacterium
TTEQWRYYNSLYFPYVVGVRAYAQ

SEQ ID NO: 371734 - protein, 23 aa, Mycobacterium
TTFAAFTALIIFLPGISGVAVGR

SEQ ID NO: 371735 - protein, 25 aa, Mycobacterium
TTFAAFTALIVFLFAITGVAVARWR

SEQ ID NO: 371736 - protein, 17 aa, Mycobacterium
TTFALSNILFLVAAFRP

SEQ ID NO: 371737 - protein, 19 aa, Mycobacterium
TTFGVRLLGIAYGLGGIRG

SEQ ID NO: 371738 - protein, 19 aa, Mycobacterium
TTFTWASRAFGPVTGWLGG

SEQ ID NO: 371739 - protein, 21 aa, Mycobacterium
TTFTWASRTFGPIVGWLGGWG

SEQ ID NO: 371740 - protein, 35 aa, Mycobacterium
TTGFALSLTGSLLRLPRLPDLVAVPPTLADHLPRL

SEQ ID NO: 371741 - protein, 36 aa, Mycobacterium
TTGFPAWLRWQHFFNIVFMMFIIRSGLQILADHPRL

SEQ ID NO: 371742 - protein, 27 aa, Mycobacterium
TTGLPLPAVLVPPMALSRMLLGVHYPS

SEQ ID NO: 371743 - protein, 37 aa, Mycobacterium
TTGVPAPALLVPPMALSRLVLGVHYPTDVVTGVVVGA

SEQ ID NO: 371744 - protein, 24 aa, Mycobacterium
TTGWINMIFMWLIPAALGIGYQRR

SEQ ID NO: 371745 - protein, 23 aa, Mycobacterium
TTGYLRLLLVAAAVAALCIATSR

SEQ ID NO: 371746 - protein, 23 aa, Mycobacterium
TTHFLGFHWSLPVGVGYLLAAVA

SEQ ID NO: 371747 - protein, 21 aa, Mycobacterium
TTIAIERLGPLFNLVNGDLCY

SEQ ID NO: 371748 - protein, 24 aa, Mycobacterium
TTIEWYDFFLYATAASLVFNHAFF

SEQ ID NO: 371749 - protein, 22 aa, Mycobacterium
TTIGAMLAWLLASTTGTQRRAA

SEQ ID NO: 371750 - protein, 24 aa, Mycobacterium
TTIITFLLVALLQNTQRRSDDAVQ

SEQ ID NO: 371751 - protein, 32 aa, Mycobacterium
TTILDLVVVFLVTWPLVYLASKSPTMAKPKLN

SEQ ID NO: 371752 - protein, 34 aa, Mycobacterium
TTILDVVVVFLVTWPLVYLASKSPLWAKPSLNGL

SEQ ID NO: 371753 - protein, 30 aa, Mycobacterium
TTILDVVVVFLVTWPLVYLSSKSATLSKPA

SEQ ID NO: 371754 - protein, 20 aa, Mycobacterium
TTILLIGIQLIPAGAKMIVG

SEQ ID NO: 371755 - protein, 31 aa, Mycobacterium
TTILLTLLVVYFILALILAAITRWLENRFGL

SEQ ID NO: 371756 - protein, 28 aa, Mycobacterium
TTISSLCFMFIWTIILSSYLVYRRRRPQ

SEQ ID NO: 371757 - protein, 24 aa, Mycobacterium
TTISSLVLLIPTLGTIVLLAHPGL

SEQ ID NO: 371758 - protein, 21 aa, Mycobacterium
TTLAWVFDLLLHHPEALRRVR

SEQ ID NO: 371759 - protein, 19 aa, Mycobacterium
TTLFIPLALALTGIVLRGA

SEQ ID NO: 371760 - protein, 17 aa, Mycobacterium
TTLFRPHNLPFVMLGAG

SEQ ID NO: 371761 - protein, 17 aa, Mycobacterium
TTLGLWSILGGLALYMT

SEQ ID NO: 371762 - protein, 19 aa, Mycobacterium
TTLITVGAVLLGLGGLNIL

SEQ ID NO: 371763 - protein, 19 aa, Mycobacterium
TTLLLMLMAGVALFTIVML

SEQ ID NO: 371764 - protein, 24 aa, Mycobacterium
TTLLSFRLQPTLTILLAAAGAFGF

SEQ ID NO: 371765 - protein, 24 aa, Mycobacterium
TTLLSFRLQPTLTVLLVAAGAFGF

SEQ ID NO: 371766 - protein, 22 aa, Mycobacterium
TTLQGPWMDLAAPGELITSIGN

SEQ ID NO: 371767 - protein, 19 aa, Mycobacterium
TTLRRPVLLTNLASIAVGF

SEQ ID NO: 371768 - protein, 20 aa, Mycobacterium
TTLTAILFAGDRIGLVHIGD

SEQ ID NO: 371769 - protein, 30 aa, Mycobacterium
TTLTAWVLATLWIPPLIYFGLHRVEQRPKL

SEQ ID NO: 371770 - protein, 28 aa, Mycobacterium
TTLYGLVNTLFIPRFLIAVGICGILVAT

SEQ ID NO: 371771 - protein, 32 aa, Mycobacterium
TTLYGMANTMFIPRFLFAVSFCGLLVATGSYL

SEQ ID NO: 371772 - protein, 30 aa, Mycobacterium
TTLYGMANTMFIPRFLFAVTFCGVLVATGS

SEQ ID NO: 371773 - protein, 27 aa, Mycobacterium
TTMIGYICGFIALFIFCGVGKGSVFKL

SEQ ID NO: 371774 - protein, 24 aa, Mycobacterium
TTMLAIGIVYIPIFARVARASTLG

SEQ ID NO: 371775 - protein, 26 aa, Mycobacterium
TTMLEDWRDNLRWPPASALVTPEEAV

SEQ ID NO: 371776 - protein, 19 aa, Mycobacterium
TTMLVRAGDRWLGAIGLMD

SEQ ID NO: 371777 - protein, 30 aa, Mycobacterium
TTNPWPALWALLIGFFMILVDATIVAVANP

SEQ ID NO: 371778 - protein, 25 aa, Mycobacterium
TTPGRILTIGIVLAALGVASAFATS

SEQ ID NO: 371779 - protein, 33 aa, Mycobacterium
TTPYPLPHPLRTVRFWLAPIVVTLAVLAGLSWL

SEQ ID NO: 371780 - protein, 24 aa, Mycobacterium
TTQADGTIWIFGGIRSDGALTGLQ

SEQ ID NO: 371781 - protein, 25 aa, Mycobacterium
TTQTLAQRWRGQLVTIAAVTACALV

SEQ ID NO: 371782 - protein, 31 aa, Mycobacterium
TTRGFQMLLAMWVAVVVLAGLPIAVALGTKE

SEQ ID NO: 371783 - protein, 27 aa, Mycobacterium
TTRIFGARRFRVAYLLLLCILAGLVYV

SEQ ID NO: 371784 - protein, 17 aa, Mycobacterium
TTRRWPLAETGQPSGLP

SEQ ID NO: 371785 - protein, 21 aa, Mycobacterium
TTRWGSFLPDIDAFDAEFFEI

SEQ ID NO: 371786 - protein, 19 aa, Mycobacterium
TTRYGWLLMGKATALLLLG

SEQ ID NO: 371787 - protein, 27 aa, Mycobacterium
TTSAAPEPVWWLIAVDTLTGDSLFPAV

SEQ ID NO: 371788 - protein, 24 aa, Mycobacterium
TTSSPNVTALPPPPPQPGIDCRAV

SEQ ID NO: 371789 - protein, 28 aa, Mycobacterium
TTSTGPLLRLVPLAMSIATLIAMAATYV

SEQ ID NO: 371790 - protein, 17 aa, Mycobacterium
TTSTSWFVTRWVVASAL

SEQ ID NO: 371791 - protein, 24 aa, Mycobacterium
TTTAPYGPLFLLIARFVTQIVGDD

SEQ ID NO: 371792 - protein, 27 aa, Mycobacterium
TTTDAFWLFMVFYAGAAALTWKVYVRR

SEQ ID NO: 371793 - protein, 26 aa, Mycobacterium
TTTKPPPPPPPPPPPPTTEPPPPTAT

SEQ ID NO: 371794 - protein, 27 aa, Mycobacterium
TTTPLPIPSSVLSLFAAGPTLSRGDAL

SEQ ID NO: 371795 - protein, 28 aa, Mycobacterium
TTTPPPPPPPPPPTTEPPPPPPPPVVTE

SEQ ID NO: 371796 - protein, 28 aa, Mycobacterium
TTTRPTTPLLPLPTLPSTTPDPTTPGAT

SEQ ID NO: 371797 - protein, 20 aa, Mycobacterium
TTTYAFYDFERTWPLTAFAL

SEQ ID NO: 371798 - protein, 22 aa, Mycobacterium
TTTYLTVPFVPVPIPILVPDVP

SEQ ID NO: 371799 - protein, 30 aa, Mycobacterium
TTVAAAVALLCTAALLTVGGYLTRDHRKTV

SEQ ID NO: 371800 - protein, 24 aa, Mycobacterium
TTVGITFLLLSFAKMGVFQTVGVS

SEQ ID NO: 371801 - protein, 21 aa, Mycobacterium
TTVGPYTRYGLPLVAACAKAG

SEQ ID NO: 371802 - protein, 19 aa, Mycobacterium
TTVIPVVKPLGVFVVRNGE

SEQ ID NO: 371803 - protein, 20 aa, Mycobacterium
TTVLAFPFAWIAVRHRGFFA

SEQ ID NO: 371804 - protein, 24 aa, Mycobacterium
TTVLLILFMVFVELGAARGVVAIL

SEQ ID NO: 371805 - protein, 26 aa, Mycobacterium
TTVLSARHYLYRHLWLFGDKYDSVMI

SEQ ID NO: 371806 - protein, 24 aa, Mycobacterium
TTVPWGLEIFYRRDPSGFVDVHSL

SEQ ID NO: 371807 - protein, 25 aa, Mycobacterium
TTVQRYLPYATVLIGIFLVALGVWL

SEQ ID NO: 371808 - protein, 22 aa, Mycobacterium
TTVRVLIGAAVVLVPVLLAVVG

SEQ ID NO: 371809 - protein, 37 aa, Mycobacterium
TTVRWTVAFTPQWIGWFPLRWTAFAIRPFMSILLKRA

SEQ ID NO: 371810 - protein, 24 aa, Mycobacterium
TTVVLVFLVFMVALIAGADYGLAR

SEQ ID NO: 371811 - protein, 21 aa, Mycobacterium
TTVVTPSWFSDYVLTVGAVDE

SEQ ID NO: 371812 - protein, 21 aa, Mycobacterium
TTVVTPSWFSDYVLTVGAVDT

SEQ ID NO: 371813 - protein, 28 aa, Mycobacterium
TTWFGTMLFAIVPLRNILPGAPPPGAWI

SEQ ID NO: 371814 - protein, 22 aa, Mycobacterium
TTYSYFFEPNPSWSRLFSTGRE

SEQ ID NO: 371815 - protein, 22 aa, Mycobacterium
TVAAPLPMRTITAVLGVPGPDE

SEQ ID NO: 371816 - protein, 24 aa, Mycobacterium
TVAAVLLLLLPLPLQTRTVVGLLC

SEQ ID NO: 371817 - protein, 27 aa, Mycobacterium
TVADFWRFWVVHLWVEDFLELFTTVMV

SEQ ID NO: 371818 - protein, 17 aa, Mycobacterium
TVAFLASWGASLGLLHH

SEQ ID NO: 371819 - protein, 17 aa, Mycobacterium
TVAFLFKDNGGLAVLFG

SEQ ID NO: 371820 - protein, 18 aa, Mycobacterium
TVAFWLLGFHTEGSPLLV

SEQ ID NO: 371821 - protein, 24 aa, Mycobacterium
TVAGLLQLLGIFGFLGIGRMYIGQ

SEQ ID NO: 371822 - protein, 19 aa, Mycobacterium
TVAGPWVGVAAPGERIVSV

SEQ ID NO: 371823 - protein, 17 aa, Mycobacterium
TVALLFAIGLLASGLAS

SEQ ID NO: 371824 - protein, 19 aa, Mycobacterium
TVALLFAIGLLASGLASSS

SEQ ID NO: 371825 - protein, 18 aa, Mycobacterium
TVALLFAIGLLASGLAST

SEQ ID NO: 371826 - protein, 31 aa, Mycobacterium
TVALPLLATQILWINLLTDGAPALALGVDPQ

SEQ ID NO: 371827 - protein, 20 aa, Mycobacterium
TVALPLSALVLAVLAVLGFL

SEQ ID NO: 371828 - protein, 18 aa, Mycobacterium
TVALTRPPDITEAAVCNP

SEQ ID NO: 371829 - protein, 23 aa, Mycobacterium
TVALTWPLLPRDSEWFWSHLGDT

SEQ ID NO: 371830 - protein, 34 aa, Mycobacterium
TVAMIFAVCIAAILLARVFVRPIRRLEAGAQQIS

SEQ ID NO: 371831 - protein, 36 aa, Mycobacterium
TVAMRMVVPRVLPVRYRVHLFLLVIVERAGNVDMSG

SEQ ID NO: 371832 - protein, 22 aa, Mycobacterium
TVAPLWPVIVDGTILSATMAVL

SEQ ID NO: 371833 - protein, 27 aa, Mycobacterium
TVAPTTAAILMLLPLSAFEATTALPDA

SEQ ID NO: 371834 - protein, 26 aa, Mycobacterium
TVAPTTLAVLMLLPLSAFEATNALPA

SEQ ID NO: 371835 - protein, 26 aa, Mycobacterium
TVAPTTLAVLMLLPLSAFEATTALPA

SEQ ID NO: 371836 - protein, 23 aa, Mycobacterium
TVAQVLMHLGSRDAQKLRHLGDL

SEQ ID NO: 371837 - protein, 26 aa, Mycobacterium
TVASLLFMFVWTTIVVSYLVYRRRHP

SEQ ID NO: 371838 - protein, 30 aa, Mycobacterium
TVATAFAFAPWFFFVCRFFTGAGIGGEYAA

SEQ ID NO: 371839 - protein, 30 aa, Mycobacterium
TVATAFAFAPWYFFIARFFTGSGIGGEYAA

SEQ ID NO: 371840 - protein, 30 aa, Mycobacterium
TVATAFAFAPWYFFVARFFTGSGIGGEYAA

SEQ ID NO: 371841 - protein, 23 aa, Mycobacterium
TVATIMFLVLLAITYYQVRVMDR

SEQ ID NO: 371842 - protein, 31 aa, Mycobacterium
TVAVIFIMLLLVYRSVITVVVLLLTVGVELT

SEQ ID NO: 371843 - protein, 26 aa, Mycobacterium
TVAVTFLAMVFSKLAIFASIGPAISI

SEQ ID NO: 371844 - protein, 32 aa, Mycobacterium
TVAVVLVVRPLWLLLTQSLPRPLRTRLGNVSG

SEQ ID NO: 371845 - protein, 22 aa, Mycobacterium
TVAYLLVMLAIVEIPLVSHLVN

SEQ ID NO: 371846 - protein, 20 aa, Mycobacterium
TVCALTTGFTYFHSDRRALL

SEQ ID NO: 371847 - protein, 19 aa, Mycobacterium
TVCATAIFLGARHTARMWR

SEQ ID NO: 371848 - protein, 29 aa, Mycobacterium
TVDFLWGRLPLYIIAIYPMMATVAFEIVR

SEQ ID NO: 371849 - protein, 30 aa, Mycobacterium
TVDHGLWVAFWFFLAQLNLILGAINLLPLL

SEQ ID NO: 371850 - protein, 19 aa, Mycobacterium
TVDLDGLGRYRVVAFPSHM

SEQ ID NO: 371851 - protein, 23 aa, Mycobacterium
TVDPGRRWSLVALGLLTTGVVTG

SEQ ID NO: 371852 - protein, 25 aa, Mycobacterium
TVDQGAHVFDLARLGWALHGHPTAL

SEQ ID NO: 371853 - protein, 28 aa, Mycobacterium
TVDVGQWFLDGYTIPLCVFLLVSGAIGD

SEQ ID NO: 371854 - protein, 30 aa, Mycobacterium
TVEAGIWVAFWFFLAQLNFVLGGINLVPLL

SEQ ID NO: 371855 - protein, 35 aa, Mycobacterium
TVEIAPGITIPVGPPTTITLAPPPPPGAPPADNPP

SEQ ID NO: 371856 - protein, 23 aa, Mycobacterium
TVEMFRFVPVVVTFTLGIAVLFA

SEQ ID NO: 371857 - protein, 26 aa, Mycobacterium
TVERTELYWVFTGLAAVLALGEISLT

SEQ ID NO: 371858 - protein, 20 aa, Mycobacterium
TVEYFFLSPMLIVLGAAVLG

SEQ ID NO: 371859 - protein, 26 aa, Mycobacterium
TVFDKLPFVIVVLISVTTILMFLAFG

SEQ ID NO: 371860 - protein, 18 aa, Mycobacterium
TVFFVVVYLLSAWTTTGQ

SEQ ID NO: 371861 - protein, 24 aa, Mycobacterium
TVFITCIVIFAGGSLLCGMAGSMA

SEQ ID NO: 371862 - protein, 25 aa, Mycobacterium
TVFLAAWIPLFGAFGALLIYPDDGA

SEQ ID NO: 371863 - protein, 23 aa, Mycobacterium
TVFLATWVPLFASFGALLIYPDD

SEQ ID NO: 371864 - protein, 21 aa, Mycobacterium
TVFLVGYLTARISLGAALTIS

SEQ ID NO: 371865 - protein, 42 aa, Mycobacterium
TVFQRTPIYCLPKPDFPIPTWGGRLLHFLPGAQLATRTASQA

SEQ ID NO: 371866 - protein, 27 aa, Mycobacterium
TVFSALYLPLLAILFGMILRAVAIEWR

SEQ ID NO: 371867 - protein, 23 aa, Mycobacterium
TVGALFAIILLDASLIGANAVGL

SEQ ID NO: 371868 - protein, 34 aa, Mycobacterium
TVGDQFVLGVRTLQWFFVDLFTGRFQFQEFVRQG

SEQ ID NO: 371869 - protein, 23 aa, Mycobacterium
TVGILFAVVLLDASLIGANAIGL

SEQ ID NO: 371870 - protein, 18 aa, Mycobacterium
TVGLLVGLFVAVIVLVQP

SEQ ID NO: 371871 - protein, 17 aa, Mycobacterium
TVGLQWWRRFGPERPLH

SEQ ID NO: 371872 - protein, 18 aa, Mycobacterium
TVGLQWWRRFGPQRPLHG

SEQ ID NO: 371873 - protein, 32 aa, Mycobacterium
TVGLVTIVVMALIVLLLYGQFRGDLTPITQLT

SEQ ID NO: 371874 - protein, 33 aa, Mycobacterium
TVGRLHPVWVALPVVVLALLAFSTVYHVTLTRW

SEQ ID NO: 371875 - protein, 22 aa, Mycobacterium
TVGSLVLLVLIPTAVYSKLRNS

SEQ ID NO: 371876 - protein, 35 aa, Mycobacterium
TVGSVGRWIVAVAALAVLTIVVVIAFNTFGGGARD

SEQ ID NO: 371877 - protein, 43 aa, Mycobacterium
TVGVPESRWIAWPGYLWFGVLVYLFLVLLALEPVRLVLRRWTR

SEQ ID NO: 371878 - protein, 17 aa, Mycobacterium
TVGWYMVLSSLQVAWWA

SEQ ID NO: 371879 - protein, 33 aa, Mycobacterium
TVGYGSPVTIAAPAYWSGAQLGALRGALLTEPA

SEQ ID NO: 371880 - protein, 20 aa, Mycobacterium
TVHVSWVPELWMDFTLRFDA

SEQ ID NO: 371881 - protein, 28 aa, Mycobacterium
TVIAFAVSIPMWWLLAGQQLGNLPVWLR

SEQ ID NO: 371882 - protein, 21 aa, Mycobacterium
TVIAFWLGRPLIRLSFNNEKF

SEQ ID NO: 371883 - protein, 20 aa, Mycobacterium
TVIALGIGSLAVWKVHEMSA

SEQ ID NO: 371884 - protein, 23 aa, Mycobacterium
TVIDQIRIDPLVRALDFANAEPV

SEQ ID NO: 371885 - protein, 26 aa, Mycobacterium
TVIKLAGPWAPVAYILAGVFAGIMAL

SEQ ID NO: 371886 - protein, 27 aa, Mycobacterium
TVINPSLLLGLLLGLGTGIPLINRIKG

SEQ ID NO: 371887 - protein, 17 aa, Mycobacterium
TVISLSVILVLLTAASV

SEQ ID NO: 371888 - protein, 20 aa, Mycobacterium
TVISMLTLMIRYIDVLSTEA

SEQ ID NO: 371889 - protein, 26 aa, Mycobacterium
TVITGMLGGWWPVVLAGGVLVAAVAA

SEQ ID NO: 371890 - protein, 36 aa, Mycobacterium
TVIVIKKGLLKWAWIPGLPLLWDLAVTLTASWQKVF

SEQ ID NO: 371891 - protein, 23 aa, Mycobacterium
TVKAGLFTSSLFVLGSPSYTYPE

SEQ ID NO: 371892 - protein, 17 aa, Mycobacterium
TVKLVGWFVGWIVVASA

SEQ ID NO: 371893 - protein, 29 aa, Mycobacterium
TVKRTPISKLFILASRFVRRETSPCSAYL

SEQ ID NO: 371894 - protein, 23 aa, Mycobacterium
TVKVTLITLLVIAVMLFFVYRSV

SEQ ID NO: 371895 - protein, 29 aa, Mycobacterium
TVLALLLGAYFLRTFFVLIVMAAVGAYLF

SEQ ID NO: 371896 - protein, 26 aa, Mycobacterium
TVLFRTIYVIPWICAPLAIGVLWHWM

SEQ ID NO: 371897 - protein, 21 aa, Mycobacterium
TVLGSYPWTFLALGAILALTL

SEQ ID NO: 371898 - protein, 20 aa, Mycobacterium
TVLGVLLLLGAAVQAPAAVA

SEQ ID NO: 371899 - protein, 24 aa, Mycobacterium
TVLHGAWGLMLGRLLGRNRVVFGS

SEQ ID NO: 371900 - protein, 26 aa, Mycobacterium
TVLKSSYAQFLFLMSGADHDQMDRMR

SEQ ID NO: 371901 - protein, 32 aa, Mycobacterium
TVLLFPVVQPWYLLWAIIPLAAWATRPGFRGA

SEQ ID NO: 371902 - protein, 21 aa, Mycobacterium
TVLLGIFPQPLLDLADHAAQL

SEQ ID NO: 371903 - protein, 17 aa, Mycobacterium
TVLLIAPVTLLVCDRLA

SEQ ID NO: 371904 - protein, 19 aa, Mycobacterium
TVLLIVLVTKFLVGAWIAI

SEQ ID NO: 371905 - protein, 19 aa, Mycobacterium
TVLLLIALIAGWRGLAGSW

SEQ ID NO: 371906 - protein, 30 aa, Mycobacterium
TVLLTALFNIIWRIFEAIISIVIAAFALSL

SEQ ID NO: 371907 - protein, 17 aa, Mycobacterium
TVLLVFTFNILLIEFGA

SEQ ID NO: 371908 - protein, 23 aa, Mycobacterium
TVLLYLTIWFSNRERPKAFSVYL

SEQ ID NO: 371909 - protein, 20 aa, Mycobacterium
TVLMGIFAVVPMLMNASGLG

SEQ ID NO: 371910 - protein, 19 aa, Mycobacterium
TVLMLGMPAGLRLVIDNAI

SEQ ID NO: 371911 - protein, 26 aa, Mycobacterium
TVLPDRPFVELYLTLAATAVVSAVVG

SEQ ID NO: 371912 - protein, 24 aa, Mycobacterium
TVLQASMIFLLPGALAGFLVALVS

SEQ ID NO: 371913 - protein, 20 aa, Mycobacterium
TVLTILVAVGIWSQRGHRLS

SEQ ID NO: 371914 - protein, 29 aa, Mycobacterium
TVLTVAFLFVLFPIVWVTLASFKSPAQMS

SEQ ID NO: 371915 - protein, 30 aa, Mycobacterium
TVLVAAGLGWLLAGPAIRPLRKLTEHTSKL

SEQ ID NO: 371916 - protein, 17 aa, Mycobacterium
TVLVFFNGPVWTMAATV

SEQ ID NO: 371917 - protein, 30 aa, Mycobacterium
TVLVPVVAAVLFLASAVFAVTQFARSTPAA

SEQ ID NO: 371918 - protein, 19 aa, Mycobacterium
TVLVQPVPSAGLRAALRGQ

SEQ ID NO: 371919 - protein, 27 aa, Mycobacterium
TVLVVGWRTARWWRRAVALTAVPLTIL

SEQ ID NO: 371920 - protein, 20 aa, Mycobacterium
TVMALGWLVLAGLLGLSLIR

SEQ ID NO: 371921 - protein, 25 aa, Mycobacterium
TVMARLRLFGIGVPVFIGLLAGIVA

SEQ ID NO: 371922 - protein, 25 aa, Mycobacterium
TVMATPAMFIEFSRQRALSADGRCK

SEQ ID NO: 371923 - protein, 18 aa, Mycobacterium
TVMLIVSRRSLSKARRAV

SEQ ID NO: 371924 - protein, 26 aa, Mycobacterium
TVMVRILEAILPYYGPYRNDVLKAEG

SEQ ID NO: 371925 - protein, 17 aa, Mycobacterium
TVNFWRLSFVQVANTFA

SEQ ID NO: 371926 - protein, 27 aa, Mycobacterium
TVNMGGRTIIIWKKKPSTSTHTPGAGT

SEQ ID NO: 371927 - protein, 17 aa, Mycobacterium
TVPIIVFVLIFQRRIIA

SEQ ID NO: 371928 - protein, 21 aa, Mycobacterium
TVPIYIWSLLMALALNKVWRR

SEQ ID NO: 371929 - protein, 24 aa, Mycobacterium
TVPLSIWVTRVIAPRARRLFVEQW

SEQ ID NO: 371930 - protein, 23 aa, Mycobacterium
TVPLYIWSLLISLALNKVWRRHR

SEQ ID NO: 371931 - protein, 25 aa, Mycobacterium
TVPSFALLGLLIPLFGLGVIPSVAA

SEQ ID NO: 371932 - protein, 31 aa, Mycobacterium
TVPSRYVYLKWWKFVLVVLGVWFGAAQVGLS

SEQ ID NO: 371933 - protein, 27 aa, Mycobacterium
TVPVDRPVPTPIYLPDARVACTPYQGG

SEQ ID NO: 371934 - protein, 19 aa, Mycobacterium
TVPVMAVWYGWPTLSLTEI

SEQ ID NO: 371935 - protein, 24 aa, Mycobacterium
TVPVQFVAGWPFLRGAVQQARAGS

SEQ ID NO: 371936 - protein, 23 aa, Mycobacterium
TVPWGLEIFYRRDPAGFVDVHSL

SEQ ID NO: 371937 - protein, 22 aa, Mycobacterium
TVQYFFVDLITGRFQWHEFVRQ

SEQ ID NO: 371938 - protein, 17 aa, Mycobacterium
TVRADPGLGLLAALTAA

SEQ ID NO: 371939 - protein, 23 aa, Mycobacterium
TVRAGFIGVVLIVLVIAVGLAPE

SEQ ID NO: 371940 - protein, 24 aa, Mycobacterium
TVRDLLRMELIAIPLSFVVLVWAF

SEQ ID NO: 371941 - protein, 23 aa, Mycobacterium
TVRFWAAPLVITLALMSALCALY

SEQ ID NO: 371942 - protein, 25 aa, Mycobacterium
TVRKDLLGIWRLGRALMLGTLPLEE

SEQ ID NO: 371943 - protein, 19 aa, Mycobacterium
TVRLLTEAVPWPLADHPRT

SEQ ID NO: 371944 - protein, 25 aa, Mycobacterium
TVRQFNDLLRVLPPLPQESPQEAEE

SEQ ID NO: 371945 - protein, 23 aa, Mycobacterium
TVRQLLTGLLMNSGNDAAHALAV

SEQ ID NO: 371946 - protein, 22 aa, Mycobacterium
TVRTGLLWWTVAIHLLASMTMV

SEQ ID NO: 371947 - protein, 22 aa, Mycobacterium
TVRTGLLWWTVAIHLLTSMTMV

SEQ ID NO: 371948 - protein, 45 aa, Mycobacterium
TVSEGFYYTAFVPNLLLFELFQPFFDYFWGFKAYGTPGYPPDTAG

SEQ ID NO: 371949 - protein, 26 aa, Mycobacterium
TVSIVTGLLFFAFGLILISPELLAAL

SEQ ID NO: 371950 - protein, 30 aa, Mycobacterium
TVSMGIILLGLLWYAGLPLRVFASSLAAVV

SEQ ID NO: 371951 - protein, 27 aa, Mycobacterium
TVSMGIILLGLLWYAGLPLRVFMSSFA

SEQ ID NO: 371952 - protein, 25 aa, Mycobacterium
TVSPARLPDLLPGVPLVVSGRYRGS

SEQ ID NO: 371953 - protein, 27 aa, Mycobacterium
TVSRADWMWALLLTGALTVFVLLARTS

SEQ ID NO: 371954 - protein, 29 aa, Mycobacterium
TVSSQLLLLSLFLLAPYARRLLTAFFTDR

SEQ ID NO: 371955 - protein, 25 aa, Mycobacterium
TVSVLVSWLLFTWIIARLPRERVGF

SEQ ID NO: 371956 - protein, 21 aa, Mycobacterium
TVSVWFRSIWVLQPRGELMAL

SEQ ID NO: 371957 - protein, 20 aa, Mycobacterium
TVTGTVLLGLAWLRRRGPAP

SEQ ID NO: 371958 - protein, 19 aa, Mycobacterium
TVTGVLLLGWRAAAGLMLR

SEQ ID NO: 371959 - protein, 23 aa, Mycobacterium
TVTHGIISALHRAVPLSGEGSDT

SEQ ID NO: 371960 - protein, 31 aa, Mycobacterium
TVTLGLLYVVAPYWVLRPFLDPADAATIMIA

SEQ ID NO: 371961 - protein, 23 aa, Mycobacterium
TVTLPLLMPSLGAAAGLAIALSM

SEQ ID NO: 371962 - protein, 20 aa, Mycobacterium
TVTQLCVSVWFIAGSALRPG

SEQ ID NO: 371963 - protein, 28 aa, Mycobacterium
TVTSAIVPALLWAVPATAAAVLVYATLT

SEQ ID NO: 371964 - protein, 28 aa, Mycobacterium
TVTSGIATWLWDWSADPGSALAAGCTPA

SEQ ID NO: 371965 - protein, 28 aa, Mycobacterium
TVTSGITAWLWDWSADPGTALGAGCTPA

SEQ ID NO: 371966 - protein, 23 aa, Mycobacterium
TVTTGFLFTLRTLRPIMAGVPTD

SEQ ID NO: 371967 - protein, 18 aa, Mycobacterium
TVTVVVSPAWYDDYVLTV

SEQ ID NO: 371968 - protein, 21 aa, Mycobacterium
TVVAFAFGWPTSENGPLITTV

SEQ ID NO: 371969 - protein, 27 aa, Mycobacterium
TVVAFWIGRPIITLAFRNEKFNAAFRY

SEQ ID NO: 371970 - protein, 27 aa, Mycobacterium
TVVALLVVIVVTVLGLLRGDTWTELLL

SEQ ID NO: 371971 - protein, 24 aa, Mycobacterium
TVVAVLLALMLTGAVSAGLGGAPK

SEQ ID NO: 371972 - protein, 20 aa, Mycobacterium
TVVAYFPAANALYPGDKVQI

SEQ ID NO: 371973 - protein, 19 aa, Mycobacterium
TVVAYFPSANALYPGDKVQ

SEQ ID NO: 371974 - protein, 26 aa, Mycobacterium
TVVDLFLRRVFAIRWRVWLNTRLVDD

SEQ ID NO: 371975 - protein, 17 aa, Mycobacterium
TVVGIDPGTDIAVVRIT

SEQ ID NO: 371976 - protein, 26 aa, Mycobacterium
TVVGLALFAVLYQLSLTGYALIAAIA

SEQ ID NO: 371977 - protein, 20 aa, Mycobacterium
TVVHLRLSLVPVLVGLALAV

SEQ ID NO: 371978 - protein, 17 aa, Mycobacterium
TVVICIVGALLGLLIGG

SEQ ID NO: 371979 - protein, 22 aa, Mycobacterium
TVVLCLIWRLLSGGLTAAPVNY

SEQ ID NO: 371980 - protein, 31 aa, Mycobacterium
TVVLGWHLTGFLWATVGGAIAWLILLVASPA

SEQ ID NO: 371981 - protein, 18 aa, Mycobacterium
TVVLIKGKVWTGLLGMFI

SEQ ID NO: 371982 - protein, 25 aa, Mycobacterium
TVVLTFMLVWLMKNQHWSIATAGVL

SEQ ID NO: 371983 - protein, 20 aa, Mycobacterium
TVVRLVMVPALMAMFAQWNW

SEQ ID NO: 371984 - protein, 23 aa, Mycobacterium
TVVSMVWWAAGAVLPLAAIVLTI

SEQ ID NO: 371985 - protein, 27 aa, Mycobacterium
TVVSVLWLWWTTNLLSGLLALATVAFY

SEQ ID NO: 371986 - protein, 23 aa, Mycobacterium
TVVSWRVAYQWLRQRSRSLLHAS

SEQ ID NO: 371987 - protein, 19 aa, Mycobacterium
TVVTPSWFSDYVLTVGAVG

SEQ ID NO: 371988 - protein, 39 aa, Mycobacterium
TVVTVVIIKRGLLKWAWIPGVPLLWDLIVTMTASWQKIF

SEQ ID NO: 371989 - protein, 24 aa, Mycobacterium
TVVVALNSQLLRRLDLRPQTSARN

SEQ ID NO: 371990 - protein, 31 aa, Mycobacterium
TVVVGWVISLVMINPFRLLAQQARAINAQSN

SEQ ID NO: 371991 - protein, 30 aa, Mycobacterium
TVVVIFVMLLLVYRSPITVIMLLLTVGVEL

SEQ ID NO: 371992 - protein, 37 aa, Mycobacterium
TVVVIGLILLLVFRSWFTAMLPLLVMGVSLLIARGVI

SEQ ID NO: 371993 - protein, 34 aa, Mycobacterium; identical to SEQ ID NO: 332500

SEQ ID NO: 371994 - protein, 19 aa, Mycobacterium
TVVVRWPGPVLAATIAIAL

SEQ ID NO: 371995 - protein, 24 aa, Mycobacterium
TVVVRWPLPVLAATLAVALVGLLA

SEQ ID NO: 371996 - protein, 25 aa, Mycobacterium
TVVVRWPVPVLTATLAIALVGLLAL

SEQ ID NO: 371997 - protein, 27 aa, Mycobacterium
TVVVVYALLPVLWIFSLSLKPTSTVKD

SEQ ID NO: 371998 - protein, 21 aa, Mycobacterium
TVVVWLVTALATLVLPMLVLR

SEQ ID NO: 371999 - protein, 24 aa, Mycobacterium
TVVYAFICLFVINVVMTAIGVRIS

SEQ ID NO: 372000 - protein, 26 aa, Mycobacterium
TVVYEPLLKRLPADTPMYGFERVEGS

SEQ ID NO: 372001 - protein, 26 aa, Mycobacterium
TVVYEPLLNRLPADTPMYGFERVEGS

SEQ ID NO: 372002 - protein, 26 aa, Mycobacterium
TVVYEPLLNRLPADTPMYGFERVEGT

SEQ ID NO: 372003 - protein, 24 aa, Mycobacterium
TVWFWIPLAIMIIGVSSIPSVIGF

SEQ ID NO: 372004 - protein, 19 aa, Mycobacterium
TVWLVFRRRYAISRIPAAV

SEQ ID NO: 372005 - protein, 20 aa, Mycobacterium
TVWNTANLVRKEGFGAAVRS

SEQ ID NO: 372006 - protein, 21 aa, Mycobacterium
TVWQTANLMRKEGFGAAVRSS

SEQ ID NO: 372007 - protein, 19 aa, Mycobacterium
TVYAFLCAVLAVAVGVLLK

SEQ ID NO: 372008 - protein, 28 aa, Mycobacterium
TVYDPQLLLLTLLLLIGAGVLAVVGTAR

SEQ ID NO: 372009 - protein, 26 aa, Mycobacterium
TVYHYYASKSLILYDIYKSAADFTVE

SEQ ID NO: 372010 - protein, 25 aa, Mycobacterium
TVYPEILFWGFPIATGVVVLGAIPY

SEQ ID NO: 372011 - protein, 19 aa, Mycobacterium
TVYPLILFAQVVPKIAIAP

SEQ ID NO: 372012 - protein, 26 aa, Mycobacterium
TVYQRTPIWVVPKVDVRFPPAVRALF

SEQ ID NO: 372013 - protein, 18 aa, Mycobacterium
TWAKVFYHSLERLGATAM

SEQ ID NO: 372014 - protein, 41 aa, Mycobacterium
TWATALALINPTWFAWLIVTWLWLTVLFANLAEAVAEGRGK

SEQ ID NO: 372015 - protein, 26 aa, Mycobacterium
TWGALISVFVFIFLGIPSAGATIPLE

SEQ ID NO: 372016 - protein, 35 aa, Mycobacterium
TWGTTWGRAAALLLLGIGIAVLIVVGGWALTTEKS

SEQ ID NO: 372017 - protein, 22 aa, Mycobacterium
TWGYAGAYWIAAASALVSAAIA

SEQ ID NO: 372018 - protein, 33 aa, Mycobacterium
TWHADVLLPDLAAAWRMMSAIPAAREARRRGIE

SEQ ID NO: 372019 - protein, 20 aa, Mycobacterium
TWITDFKPYQPQLDVPTAWL

SEQ ID NO: 372020 - protein, 21 aa, Mycobacterium
TWKTRLLTLLAIVGPGIIVMV

SEQ ID NO: 372021 - protein, 36 aa, Mycobacterium
TWLAWVPRLAWIGVTVWLLIAVAVLLLRLSALRDLR

SEQ ID NO: 372022 - protein, 18 aa, Mycobacterium
TWLFTRAQRLCRPVFWYL

SEQ ID NO: 372023 - protein, 24 aa, Mycobacterium
TWLLQIMPLFFFAGAAACLSSWSP

SEQ ID NO: 372024 - protein, 27 aa, Mycobacterium
TWLVVNLPIMVLFPRGWSEFFRLNTRR

SEQ ID NO: 372025 - protein, 25 aa, Mycobacterium
TWPNHVFDFLAPRFAALEFSGFFGS

SEQ ID NO: 372026 - protein, 17 aa, Mycobacterium
TWSPRFIDHLVGDRIHR

SEQ ID NO: 372027 - protein, 22 aa, Mycobacterium
TWSTALLPMALLMLAAAVAALA

SEQ ID NO: 372028 - protein, 23 aa, Mycobacterium
TWTKGMLPGLMSVPLTIAGQIER

SEQ ID NO: 372029 - protein, 17 aa, Mycobacterium
TWVALRYSTPVSTLFVI

SEQ ID NO: 372030 - protein, 19 aa, Mycobacterium
TWVMSLLYIGTFGSFIGYS

SEQ ID NO: 372031 - protein, 31 aa, Mycobacterium
TWVVIAFVVMCFLGILWTLQHFDLKAIRHQT

SEQ ID NO: 372032 - protein, 18 aa, Mycobacterium
TWWSVVNILVIVYALIPV

SEQ ID NO: 372033 - protein, 25 aa, Mycobacterium
TWYAAMLFAVVPLRNALPGSPPFGG

SEQ ID NO: 372034 - protein, 25 aa, Mycobacterium
TWYAAMLFAVVPLRNALPGSPPIGA

SEQ ID NO: 372035 - protein, 20 aa, Mycobacterium
TWYRAGLFGGLALLPILACL

SEQ ID NO: 372036 - protein, 26 aa, Mycobacterium
TYAHHLFDAGLLDDGAHTPPLVLLGG

SEQ ID NO: 372037 - protein, 33 aa, Mycobacterium
TYDLMIVVVAALCLIFIIMLGITRSPVASAVIV

SEQ ID NO: 372038 - protein, 19 aa, Mycobacterium
TYEFWLKVGIVALGSRFVL

SEQ ID NO: 372039 - protein, 18 aa, Mycobacterium
TYELFAGGALFFETAALI

SEQ ID NO: 372040 - protein, 19 aa, Mycobacterium
TYEMAPFRRLLDGGYSDAG

SEQ ID NO: 372041 - protein, 19 aa, Mycobacterium
TYGEWLPVRAWFDELHRNL

SEQ ID NO: 372042 - protein, 22 aa, Mycobacterium
TYGFGWVLTFITALVGACILLF

SEQ ID NO: 372043 - protein, 25 aa, Mycobacterium
TYGSWAIGLMLGLLALISLACTYLL

SEQ ID NO: 372044 - protein, 25 aa, Mycobacterium
TYGVGAKPYWRPPYAKRNAAVDAVA

SEQ ID NO: 372045 - protein, 28 aa, Mycobacterium
TYHASLEQVLVLLPPFVAAIQSFVGTKN

SEQ ID NO: 372046 - protein, 30 aa, Mycobacterium
TYHPSLEQILVLLPPFVAAIASFTAPKSPI

SEQ ID NO: 372047 - protein, 27 aa, Mycobacterium
TYILIPNEHLPLLQPLRGIVPDSVLDG

SEQ ID NO: 372048 - protein, 17 aa, Mycobacterium
TYIVVIIRQVVGVRGPS

SEQ ID NO: 372049 - protein, 41 aa, Mycobacterium
TYKAEFLYHHFRSLRRWRPRYAYAFGFIDQAARLASAMPEL

SEQ ID NO: 372050 - protein, 19 aa, Mycobacterium
TYLMFSWMQVFTASGFAFS

SEQ ID NO: 372051 - protein, 31 aa, Mycobacterium
TYLSGVLLVGLLLNALFGWSWADPIVALVIA

SEQ ID NO: 372052 - protein, 24 aa, Mycobacterium
TYNHYFHTFLRLNDVGWSFAEVIL

SEQ ID NO: 372053 - protein, 27 aa, Mycobacterium
TYPDVRLLWSGDWSTYDGRDFWVTIVG

SEQ ID NO: 372054 - protein, 17 aa, Mycobacterium
TYPPFAAVVFYPLHLLP

SEQ ID NO: 372055 - protein, 24 aa, Mycobacterium
TYPQKPPVGAALWKLMERARQIGL

SEQ ID NO: 372056 - protein, 28 aa, Mycobacterium
TYRAGLEQLLVLLPPASAFYQSAVGSNN

SEQ ID NO: 372057 - protein, 19 aa, Mycobacterium
TYRDLLRDKVFVVLVLVAG

SEQ ID NO: 372058 - protein, 25 aa, Mycobacterium
TYRDPLLIMLVVAPVIWTSLVAVLT

SEQ ID NO: 372059 - protein, 24 aa, Mycobacterium
TYRIAFWVGVGLAALVALLSLITY

SEQ ID NO: 372060 - protein, 18 aa, Mycobacterium
TYRITGNRALLDLVTIIY

SEQ ID NO: 372061 - protein, 18 aa, Mycobacterium
TYRKMKQNLWWGAGYNLV

SEQ ID NO: 372062 - protein, 23 aa, Mycobacterium
TYSAPMLTLALLLATVAGVLAVL

SEQ ID NO: 372063 - protein, 20 aa, Mycobacterium
TYSIAFMVLSFPLLAAIDDS

SEQ ID NO: 372064 - protein, 24 aa, Mycobacterium
TYSSIFFATPLLVTLRERTDLVRT

SEQ ID NO: 372065 - protein, 20 aa, Mycobacterium
TYSTTPYPPASKSLAPVPPP

SEQ ID NO: 372066 - protein, 17 aa, Mycobacterium
TYTAIPAYWHQAADWLS

SEQ ID NO: 372067 - protein, 24 aa, Mycobacterium
TYTDLLIGMLVFSGGLALSATPAT

SEQ ID NO: 372068 - protein, 23 aa, Mycobacterium
TYVICLNCELFMGPQGQLWSFRI

SEQ ID NO: 372069 - protein, 23 aa, Mycobacterium
TYVPLMVLPTWMLAIGSLFPVKW

SEQ ID NO: 372070 - protein, 19 aa, Mycobacterium
TYWITRRTVIALRWAIEER

SEQ ID NO: 372071 - protein, 20 aa, Mycobacterium
TYWITRRTVLALRWAIEERA

SEQ ID NO: 372072 - protein, 23 aa, Mycobacterium
TYYAPMLTLSLLLATLAGVLVVL

SEQ ID NO: 372073 - protein, 31 aa, Mycobacterium
VAAAFRKIILPLLWPGIVAALLVAFFLSYND

SEQ ID NO: 372074 - protein, 18 aa, Mycobacterium
VAAAFTAAVAVLVIACPC

SEQ ID NO: 372075 - protein, 35 aa, Mycobacterium
VAAALDLVPWAQPVNWWLLLAGFGVFITPVGRMGI

SEQ ID NO: 372076 - protein, 21 aa, Mycobacterium
VAAALFIVILAVVTKVFAGVN

SEQ ID NO: 372077 - protein, 27 aa, Mycobacterium
VAAALVCCLALLLALPDLAWGVWGKVS

SEQ ID NO: 372078 - protein, 37 aa, Mycobacterium
VAAANSVLLLFGLLLPWLGALAVLGGLGYGIRHAVLR

SEQ ID NO: 372079 - protein, 27 aa, Mycobacterium
VAAARWLYTVFTVLAAVGFIASYQATH

SEQ ID NO: 372080 - protein, 23 aa, Mycobacterium
VAAAVLALVLVFTGGSDPQPPRI

SEQ ID NO: 372081 - protein, 25 aa, Mycobacterium
VAACAYVFRRPLGPRLRTLFVVLLS

SEQ ID NO: 372082 - protein, 26 aa, Mycobacterium
VAAEAVRAWPPLGGPWALLGASQWNQ

SEQ ID NO: 372083 - protein, 27 aa, Mycobacterium
VAAFAFVFCVVLLLLRSFVAAVAVVGT

SEQ ID NO: 372084 - protein, 24 aa, Mycobacterium
VAAFAYLCFTVLAPWQLGKNTQTS

SEQ ID NO: 372085 - protein, 41 aa, Mycobacterium
VAAFEVTPLAWWLCGTATAVTVLYLAYLRRQTRIEEKVRRR

SEQ ID NO: 372086 - protein, 18 aa, Mycobacterium
VAAFTILTSLVLANNDAA

SEQ ID NO: 372087 - protein, 32 aa, Mycobacterium
VAAFVLLKINPLALFTWVFPSVGIFTRMVPPN

SEQ ID NO: 372088 - protein, 25 aa, Mycobacterium
VAAGAFYLILTVPLTHLVNYIDARL

SEQ ID NO: 372089 - protein, 21 aa, Mycobacterium
VAAGFFAVAVTGVVGYALLGS

SEQ ID NO: 372090 - protein, 28 aa, Mycobacterium
VAAGGYWLMHYWPVDLLAYRHSIFGLFT

SEQ ID NO: 372091 - protein, 24 aa, Mycobacterium
VAAGIFYLMLTVPLTHLVNYIDAR

SEQ ID NO: 372092 - protein, 30 aa, Mycobacterium
VAAGLGIVVAKPWRSSAPRPGPTSPPAADA

SEQ ID NO: 372093 - protein, 26 aa, Mycobacterium
VAAGLGLWAWAPWDDGDDDALPAGAV

SEQ ID NO: 372094 - protein, 32 aa, Mycobacterium
VAAGLVLLYLFLPIFVIILFSFNKPAGKFNYS

SEQ ID NO: 372095 - protein, 19 aa, Mycobacterium
VAAGPVNYLKLMPATYVVL

SEQ ID NO: 372096 - protein, 30 aa, Mycobacterium
VAAGYAGLKWKWPAPFLIAPMLVALVTQLP

SEQ ID NO: 372097 - protein, 25 aa, Mycobacterium
VAAHAPYLAWLLESSAKSATAAALH

SEQ ID NO: 372098 - protein, 23 aa, Mycobacterium
VAAHLPYLAWLEQAAAESSVIAA

SEQ ID NO: 372099 - protein, 23 aa, Mycobacterium
VAAHLPYLAWLNQASAVSETTAA

SEQ ID NO: 372100 - protein, 21 aa, Mycobacterium
VAAHQPYLAWLLGAGADNSIA

SEQ ID NO: 372101 - protein, 24 aa, Mycobacterium
VAAHVPYLAWLTQASTDSAAMAAH

SEQ ID NO: 372102 - protein, 25 aa, Mycobacterium
VAAIAVIYGLFYRLHRPVKRWYQGI

SEQ ID NO: 372103 - protein, 29 aa, Mycobacterium
VAAIGFCMGGGLVWRLLAAGTPELAAAFP

SEQ ID NO: 372104 - protein, 30 aa, Mycobacterium
VAAIPLLLLFVLLGVFKMTAWKASLISLAV

SEQ ID NO: 372105 - protein, 29 aa, Mycobacterium
VAAITLLPSILVLIGRRGWIKPRRDLTHR

SEQ ID NO: 372106 - protein, 34 aa, Mycobacterium
VAAKFWTLLEVIPNVALIVLLGFGAYAVGHGLVT

SEQ ID NO: 372107 - protein, 25 aa, Mycobacterium
VAALAWTAMIALAPALTRGPPPHTR

SEQ ID NO: 372108 - protein, 17 aa, Mycobacterium
VAALLAAGGLAVTLTST

SEQ ID NO: 372109 - protein, 26 aa, Mycobacterium
VAALLIWDAVIPWTGVYAAAVFLLTT

SEQ ID NO: 372110 - protein, 22 aa, Mycobacterium
VAALLMAVLLPVSGALADRFSP

SEQ ID NO: 372111 - protein, 18 aa, Mycobacterium
VAALLWANSPWSSWYYRL

SEQ ID NO: 372112 - protein, 18 aa, Mycobacterium
VAALLWVFAGADKARARA

SEQ ID NO: 372113 - protein, 20 aa, Mycobacterium
VAALRAGLIALALLAVLALI

SEQ ID NO: 372114 - protein, 24 aa, Mycobacterium
VAALTFAGWALIAANPIAGMTAAV

SEQ ID NO: 372115 - protein, 18 aa, Mycobacterium
VAALTFKGSLGVASIVVF

SEQ ID NO: 372116 - protein, 23 aa, Mycobacterium
VAAMLAFWIVIVAAEWALPGIEA

SEQ ID NO: 372117 - protein, 25 aa, Mycobacterium
VAAMLGGWLAVLAGAWFVVGGQVAP

SEQ ID NO: 372118 - protein, 23 aa, Mycobacterium
VAAMLLIFAAVSRNPWAALALVF

SEQ ID NO: 372119 - protein, 24 aa, Mycobacterium
VAAMWVTYALFMGSLRSVVPVTLT

SEQ ID NO: 372120 - protein, 20 aa, Mycobacterium
VAAREYLGFALSGPGGAHCN

SEQ ID NO: 372121 - protein, 33 aa, Mycobacterium
VAARPTLIPVPSLLRALLSEHLDPGYAAAAEKR

SEQ ID NO: 372122 - protein, 26 aa, Mycobacterium
VAASAIGVLAWLYIGAQNKLSAEARA

SEQ ID NO: 372123 - protein, 26 aa, Mycobacterium
VAASITMMPLIPRLVFLVVGPAVDVK

SEQ ID NO: 372124 - protein, 22 aa, Mycobacterium
VAASLRWRAVLLAAVAACAACG

SEQ ID NO: 372125 - protein, 27 aa, Mycobacterium
VAASLTMLPLLPRLVFLVVGPAVDIKL

SEQ ID NO: 372126 - protein, 23 aa, Mycobacterium
VAATGWLGYLLGPPLIGHLADRV

SEQ ID NO: 372127 - protein, 30 aa, Mycobacterium
VAATVLVLDWRSARWWGRGASLMAVPLCVL

SEQ ID NO: 372128 - protein, 25 aa, Mycobacterium
VAAVALLWWAVRRNAGPTAALIAGL

SEQ ID NO: 372129 - protein, 26 aa, Mycobacterium
VAAVIYFVIVVPFKKIKERDAKVVST

SEQ ID NO: 372130 - protein, 28 aa, Mycobacterium
VAAVLAQPWQTTTQRWVLGVSIAAVIVL

SEQ ID NO: 372131 - protein, 24 aa, Mycobacterium
VAAVLLLIYPAWDAVANYIDAQRT

SEQ ID NO: 372132 - protein, 31 aa, Mycobacterium
VAAVLMLAGSAGLAGWLYYNEYRPDRETDPA

SEQ ID NO: 372133 - protein, 17 aa, Mycobacterium
VAAWLITVAATLAAWLV

SEQ ID NO: 372134 - protein, 25 aa, Mycobacterium
VAAWSLIYLIVARQLIAFFTATTVL

SEQ ID NO: 372135 - protein, 18 aa, Mycobacterium
VAAYLFSPLYRRLGKRFG

SEQ ID NO: 372136 - protein, 27 aa, Mycobacterium
VAAYPMVFVPLLFLLAVALVASIRYEE

SEQ ID NO: 372137 - protein, 25 aa, Mycobacterium
VACAGLGPVWYLLGPAPASGPTVRV

SEQ ID NO: 372138 - protein, 23 aa, Mycobacterium
VACGWFGIQTWFGGLGLNLALGA

SEQ ID NO: 372139 - protein, 19 aa, Mycobacterium
VACLALLAWFWPRLVEQGM

SEQ ID NO: 372140 - protein, 25 aa, Mycobacterium
VACLSFTRLPYFHSLGIPAALGILV

SEQ ID NO: 372141 - protein, 26 aa, Mycobacterium
VACLSFTRLPYFQSLGVPAALGILVA

SEQ ID NO: 372142 - protein, 26 aa, Mycobacterium
VACTALQLVFTYAPAMNAVFGSTPLG

SEQ ID NO: 372143 - protein, 25 aa, Mycobacterium
VADETAWLWAARLGQGIGAAAFSPA

SEQ ID NO: 372144 - protein, 21 aa, Mycobacterium
VADLLALRRVPAQMFGTFTSV

SEQ ID NO: 372145 - protein, 25 aa, Mycobacterium
VADNRREFKPALEKLNLVLDNLLER

SEQ ID NO: 372146 - protein, 37 aa, Mycobacterium
VADRLKFGAWLLFAGLWATFVYFPVAHWVFSFDGVTA

SEQ ID NO: 372147 - protein, 36 aa, Mycobacterium
VADRLKFGSWLLFAGLWVTVVYFPVAHWVFAFDGAA

SEQ ID NO: 372148 - protein, 25 aa, Mycobacterium
VAEAVGLVVLWRLLSRSRQEVEELR

SEQ ID NO: 372149 - protein, 36 aa, Mycobacterium
VAELAPFLVWALFGGLFPLALGVLQILALDLGTDTL

SEQ ID NO: 372150 - protein, 25 aa, Mycobacterium
VAELAPFVVWALSAGTFPLAIGVLQ

SEQ ID NO: 372151 - protein, 18 aa, Mycobacterium
VAELLAIAGVKYLVLGTG

SEQ ID NO: 372152 - protein, 21 aa, Mycobacterium
VAELNRWIVSGEALEPRHLHA

SEQ ID NO: 372153 - protein, 20 aa, Mycobacterium
VAETLVMFTLSMAGLAVAIA

SEQ ID NO: 372154 - protein, 27 aa, Mycobacterium
VAFAAAAVLFALIALSPAALQVHLVVF

SEQ ID NO: 372155 - protein, 43 aa, Mycobacterium
VAFAAYTWAVYLVLGLALVLLLLLLPRERWRWWAVRRSIRLLA

SEQ ID NO: 372156 - protein, 39 aa, Mycobacterium
VAFAIPTYAFIIGVLVMIGWGLFRIFVLGDPLRAESAGF

SEQ ID NO: 372157 - protein, 33 aa, Mycobacterium
VAFAIPTYLFMAGMFIMLGWGLFQIYVLDHSLR

SEQ ID NO: 372158 - protein, 26 aa, Mycobacterium
VAFCHSARLLVFILATALGAAAVCAA

SEQ ID NO: 372159 - protein, 18 aa, Mycobacterium
VAFCLLALTVVRIVPVLL

SEQ ID NO: 372160 - protein, 21 aa, Mycobacterium
VAFFAVVVLIAFWVAGSPEVQ

SEQ ID NO: 372161 - protein, 25 aa, Mycobacterium
VAFFGDNIPLLLKGLTRVGNRGAYG

SEQ ID NO: 372162 - protein, 24 aa, Mycobacterium
VAFFGDNIPLLLKGLVRVGNQGAY

SEQ ID NO: 372163 - protein, 28 aa, Mycobacterium
VAFGGWLVVVWLLFDFMTGKGGMFSPYY

SEQ ID NO: 372164 - protein, 26 aa, Mycobacterium
VAFGSGLAWLVASLALSEATSWPTWA

SEQ ID NO: 372165 - protein, 19 aa, Mycobacterium
VAFIAAISGWRSGALGSML

SEQ ID NO: 372166 - protein, 21 aa, Mycobacterium
VAFIAAVSGWRSGALGSLMSF

SEQ ID NO: 372167 - protein, 27 aa, Mycobacterium
VAFIALTLGILQPIIFATAAAMAVVPL

SEQ ID NO: 372168 - protein, 25 aa, Mycobacterium
VAFITMMLSLVWPIASLGFLLSMTQ

SEQ ID NO: 372169 - protein, 26 aa, Mycobacterium
VAFITMMLSLVWPIASLGFLLSMTQE

SEQ ID NO: 372170 - protein, 23 aa, Mycobacterium
VAFLAGDGLPVPAGARALPLVQA

SEQ ID NO: 372171 - protein, 19 aa, Mycobacterium
VAFLDSDVAPRRGWLEALL

SEQ ID NO: 372172 - protein, 24 aa, Mycobacterium
VAFLGPWLFSIFVDIFSAVRAGLG

SEQ ID NO: 372173 - protein, 22 aa, Mycobacterium
VAFNLYWRLRYLFVTEVAFGSH

SEQ ID NO: 372174 - protein, 30 aa, Mycobacterium
VAFPRLNAFSFWLFLFGALIATAGFITPGG

SEQ ID NO: 372175 - protein, 19 aa, Mycobacterium
VAFRPVRLLVISLGLTAVA

SEQ ID NO: 372176 - protein, 25 aa, Mycobacterium
VAFTLYPRRAVLGLALFIGQAFLYN

SEQ ID NO: 372177 - protein, 23 aa, Mycobacterium
VAFVLLVLVLLFRPTGILGESLG

SEQ ID NO: 372178 - protein, 22 aa, Mycobacterium
VAFVVLIWWRTSELLAMFGGHL

SEQ ID NO: 372179 - protein, 26 aa, Mycobacterium
VAGAITVVLLFVLGLFNVVVPGEVGS

SEQ ID NO: 372180 - protein, 29 aa, Mycobacterium
VAGALFCLSFTRLPYFQTLGVPAALGVLV

SEQ ID NO: 372181 - protein, 24 aa, Mycobacterium
VAGALRRWLLDRGELPKQSLVAAC

SEQ ID NO: 372182 - protein, 26 aa, Mycobacterium
VAGDRLLGLAWSPITLAPGGADSDVV

SEQ ID NO: 372183 - protein, 27 aa, Mycobacterium
VAGFGWRAVFLALAGLNLVMLLGALFM

SEQ ID NO: 372184 - protein, 29 aa, Mycobacterium
VAGFRQGFFFFAILLTALSIIPLGGGIVT

SEQ ID NO: 372185 - protein, 19 aa, Mycobacterium
VAGFWGAALVLVLVSYPLV

SEQ ID NO: 372186 - protein, 23 aa, Mycobacterium
VAGGAYVFFGQSPKPTAPPTTVV

SEQ ID NO: 372187 - protein, 28 aa, Mycobacterium
VAGGKVLNYWFPAPLWLCSLCLMVLMTT

SEQ ID NO: 372188 - protein, 27 aa, Mycobacterium
VAGGLAVLIMLMWVGTALIISTADSRS

SEQ ID NO: 372189 - protein, 27 aa, Mycobacterium
VAGGLFLVLYVVPFLKFPANPPAASAE

SEQ ID NO: 372190 - protein, 25 aa, Mycobacterium
VAGIAGLLLCLLVPVLPAKQTTATV

SEQ ID NO: 372191 - protein, 34 aa, Mycobacterium
VAGIFTFLIAPVFIKLLRFFPPVVTGTLITIIGL

SEQ ID NO: 372192 - protein, 44 aa, Mycobacterium
VAGLALLLLARPISVFLSLIGFRVPWREKMFLSWAGLRGAVPIV

SEQ ID NO: 372193 - protein, 26 aa, Mycobacterium
VAGLGLFNPLSVGAGLVMGRMAFKED

SEQ ID NO: 372194 - protein, 23 aa, Mycobacterium
VAGLGMFNLISLGAGAMLGKKTY

SEQ ID NO: 372195 - protein, 35 aa, Mycobacterium
VAGLGWLIGVWQPLLLWTPLGIGLLLLVISILDVI

SEQ ID NO: 372196 - protein, 17 aa, Mycobacterium
VAGLLALAFGSEVMVRG

SEQ ID NO: 372197 - protein, 30 aa, Mycobacterium
VAGLLARFCGPELWWLLRVADYASAGGTTA

SEQ ID NO: 372198 - protein, 18 aa, Mycobacterium
VAGLLQLIGLVGFVGFGR

SEQ ID NO: 372199 - protein, 24 aa, Mycobacterium
VAGLVAIAVIMLRAGRPARHHLNR

SEQ ID NO: 372200 - protein, 28 aa, Mycobacterium
VAGLVEWPVLLAVGGSALLLQRLSRKQE

SEQ ID NO: 372201 - protein, 30 aa, Mycobacterium
VAGLVLLYLFLPIFVIVLFSFNKPAGKFNY

SEQ ID NO: 372202 - protein, 24 aa, Mycobacterium
VAGLWAGFLWGANGQLPLLVSGVT

SEQ ID NO: 372203 - protein, 29 aa, Mycobacterium
VAGPTAPPPPFAPPPPWASGRNFPPPGMP

SEQ ID NO: 372204 - protein, 26 aa, Mycobacterium
VAGPVVWIGMLALAVWMLDSVGWSID

SEQ ID NO: 372205 - protein, 27 aa, Mycobacterium
VAGQLRITRWFSARWRPGRSVYIGVAL

SEQ ID NO: 372206 - protein, 17 aa, Mycobacterium
VAGQWMITHALLRTSER

SEQ ID NO: 372207 - protein, 32 aa, Mycobacterium
VAGRLRVAAFQTLLLSLLPRVLDALARDYPDL

SEQ ID NO: 372208 - protein, 26 aa, Mycobacterium
VAGSVLMLGIWLAVGLGGGGWYFWPV

SEQ ID NO: 372209 - protein, 27 aa, Mycobacterium
VAGTQPLWVAAAWLVAIAGLATLAGER

SEQ ID NO: 372210 - protein, 18 aa, Mycobacterium
VAGVFLLAGVIAGGAGAP

SEQ ID NO: 372211 - protein, 25 aa, Mycobacterium
VAGVIFIAWSILVAGALVFGYGKCY

SEQ ID NO: 372212 - protein, 43 aa, Mycobacterium
VAGVLGWVILLCLAFSALGKGITLLRRALAPLSAVWSASVDGV

SEQ ID NO: 372213 - protein, 23 aa, Mycobacterium
VAGVSIQLLWFLGAYVLVLAAMP

SEQ ID NO: 372214 - protein, 33 aa, Mycobacterium
VAGVVFVAAVIFFTGLFLGWSSSGHYGWHHGYG

SEQ ID NO: 372215 - protein, 25 aa, Mycobacterium
VAGVVYFLVVVPYNTLRKKGEVEQA

SEQ ID NO: 372216 - protein, 17 aa, Mycobacterium
VAGWFALSVPRFPRGWL

SEQ ID NO: 372217 - protein, 20 aa, Mycobacterium
VAGWFLYPGVGFIGLLFFVV

SEQ ID NO: 372218 - protein, 21 aa, Mycobacterium
VAGWMYFFNWAATAIVDVTAI

SEQ ID NO: 372219 - protein, 23 aa, Mycobacterium
VAGWWVGVLVYLLPRRTTIRVAG

SEQ ID NO: 372220 - protein, 18 aa, Mycobacterium
VAGYLLAGIPLYGLIGLV

SEQ ID NO: 372221 - protein, 26 aa, Mycobacterium
VAHCPAYFQLLVKALLMHGLRELAEN

SEQ ID NO: 372222 - protein, 29 aa, Mycobacterium
VAHCPAYFQLLVKSLLLHGLRELAENAVP

SEQ ID NO: 372223 - protein, 29 aa, Mycobacterium
VAHCPAYLQLLVKALLLHGLRELAENAVP

SEQ ID NO: 372224 - protein, 18 aa, Mycobacterium
VAHLKWYDYPVAAGLSLV

SEQ ID NO: 372225 - protein, 33 aa, Mycobacterium
VAHLLDTLSLFVGWLWPLWDSRRRTFADMVART

SEQ ID NO: 372226 - protein, 24 aa, Mycobacterium
VAHPLRRRVVMLLMLVGNVGFVAA

SEQ ID NO: 372227 - protein, 34 aa, Mycobacterium
VAIAALSWWLFEQPIRRWRPARVPLLPLAAATVA

SEQ ID NO: 372228 - protein, 31 aa, Mycobacterium
VAIAGYVAFWWPDLPLWIPALVTVAVLITLN

SEQ ID NO: 372229 - protein, 25 aa, Mycobacterium
VAIAVPSHWGPGTVGALRGALRTVP

SEQ ID NO: 372230 - protein, 29 aa, Mycobacterium
VAIAVVGLILVRAWFLDNALSQFYQAHLI

SEQ ID NO: 372231 - protein, 27 aa, Mycobacterium
VAIFFVLSGLLLFRPWVRAVATGAQAP

SEQ ID NO: 372232 - protein, 22 aa, Mycobacterium
VAIGHFLFAAFLVPPQPSGVLD

SEQ ID NO: 372233 - protein, 23 aa, Mycobacterium
VAIGHFLFAAFLVPPQPSGVLDV

SEQ ID NO: 372234 - protein, 26 aa, Mycobacterium
VAIGLAVAILFLLVRVVRAPIEAQPV

SEQ ID NO: 372235 - protein, 17 aa, Mycobacterium
VAIHWAMASLRSGECDM

SEQ ID NO: 372236 - protein, 17 aa, Mycobacterium
VAIIPLYSLAVLAAFFA

SEQ ID NO: 372237 - protein, 24 aa, Mycobacterium
VAILAAWYLLLRMFNYTLSSVAAP

SEQ ID NO: 372238 - protein, 28 aa, Mycobacterium
VAILARNHRWFLVSVYAAGKVGARIILL

SEQ ID NO: 372239 - protein, 18 aa, Mycobacterium
VAILAVPNLPPPPLPFAQ

SEQ ID NO: 372240 - protein, 26 aa, Mycobacterium
VAIMSFLFNHGWWDPARDEQPFLGDE

SEQ ID NO: 372241 - protein, 28 aa, Mycobacterium
VAIQWRARSWLKRVLPVALIAAVAVTAL

SEQ ID NO: 372242 - protein, 19 aa, Mycobacterium
VAISSRRALFARAATPYQG

SEQ ID NO: 372243 - protein, 22 aa, Mycobacterium
VAITFVWLGMVLAISFLEAPLK

SEQ ID NO: 372244 - protein, 33 aa, Mycobacterium
VAITGYARFWWPASPVWLPALLTVGLILTVNLF

SEQ ID NO: 372245 - protein, 27 aa, Mycobacterium
VAIVPAVAWVILALRSGRLGVDLIAVL

SEQ ID NO: 372246 - protein, 25 aa, Mycobacterium
VAIYWAYRWTARRWTHLMPRAVPLT

SEQ ID NO: 372247 - protein, 18 aa, Mycobacterium
VAKDSGLAEPLRLALEHL

SEQ ID NO: 372248 - protein, 51 aa, Mycobacterium
VAKIGPLEFGGFIAWLSWLVLHLVYLVGFKTKIVTLLSWTVTFLSTKRGQL

SEQ ID NO: 372249 - protein, 37 aa, Mycobacterium
VAKIPPAWVLPRMLIEAPFLILAVLLPFAEGGERVEF

SEQ ID NO: 372250 - protein, 25 aa, Mycobacterium
VAKLSYLRVPALKALFPDYRGSALE

SEQ ID NO: 372251 - protein, 51 aa, Mycobacterium
VAKVGPLEFSGFIAWLMWLVLHLVYLVGFKTKVSTLLSWTVTFLSTRRGQL

SEQ ID NO: 372252 - protein, 27 aa, Mycobacterium
VALAFAVAGFWWFDGYTLVQQRYWQGI

SEQ ID NO: 372253 - protein, 22 aa, Mycobacterium
VALAGWAYWYIQSEGWADRGNP

SEQ ID NO: 372254 - protein, 23 aa, Mycobacterium
VALALLDRGWRRRPPRTRGRAGL

SEQ ID NO: 372255 - protein, 21 aa, Mycobacterium
VALALLTAPPALAIDPPSIDP

SEQ ID NO: 372256 - protein, 19 aa, Mycobacterium
VALARYWGAEVFATASVGK

SEQ ID NO: 372257 - protein, 21 aa, Mycobacterium
VALAVLLRRLVQRYELPQIDM

SEQ ID NO: 372258 - protein, 27 aa, Mycobacterium
VALAVSILLTPALIRLFTRQGFGHHTR

SEQ ID NO: 372259 - protein, 17 aa, Mycobacterium
VALAYAAVGKQAATHAR

SEQ ID NO: 372260 - protein, 24 aa, Mycobacterium
VALCGVVCFVGFLASYLFNVYVQG

SEQ ID NO: 372261 - protein, 33 aa, Mycobacterium
VALDILLFYVFFEAMLIPMYFLIGGFGGENRSR

SEQ ID NO: 372262 - protein, 23 aa, Mycobacterium
VALESLLRQWGDLSGWLADEVED

SEQ ID NO: 372263 - protein, 17 aa, Mycobacterium
VALFLLRHVVSTRQLLL

SEQ ID NO: 372264 - protein, 18 aa, Mycobacterium
VALFVMFSRMQTGGRMGF

SEQ ID NO: 372265 - protein, 19 aa, Mycobacterium
VALFVVDVALVATGAAVAG

SEQ ID NO: 372266 - protein, 18 aa, Mycobacterium
VALFVYLIIAISQVILRR

SEQ ID NO: 372267 - protein, 26 aa, Mycobacterium
VALGDPLFWPSFVGAALIVMSNPVSF

SEQ ID NO: 372268 - protein, 35 aa, Mycobacterium
VALGITVLLFPVVQPWYLLWAIIPMAAWATRTGFR

SEQ ID NO: 372269 - protein, 27 aa, Mycobacterium
VALGMALIFYAFLRGLTHWQSIPSTWD

SEQ ID NO: 372270 - protein, 23 aa, Mycobacterium
VALGTLLLPWKLLASPETYVFVW

SEQ ID NO: 372271 - protein, 33 aa, Mycobacterium
VALGVIVVAVVILLVVTRYRARRRRADALAAAR

SEQ ID NO: 372272 - protein, 18 aa, Mycobacterium
VALGYIFVLLVVPVSLIL

SEQ ID NO: 372273 - protein, 23 aa, Mycobacterium
VALIALVAIFLILRAVPALNNDD

SEQ ID NO: 372274 - protein, 24 aa, Mycobacterium
VALILALRFHRGAALALLGMFVVQ

SEQ ID NO: 372275 - protein, 17 aa, Mycobacterium
VALILWIASFFLFPGFN

SEQ ID NO: 372276 - protein, 21 aa, Mycobacterium
VALIVLLLVVSAALRGYLPES

SEQ ID NO: 372277 - protein, 18 aa, Mycobacterium
VALLAGWAIDCNTLEVLV

SEQ ID NO: 372278 - protein, 30 aa, Mycobacterium
VALLAQLRPVLWVVGFIFVLQVALTGWRRA

SEQ ID NO: 372279 - protein, 17 aa, Mycobacterium
VALLFPATVCALAALLC

SEQ ID NO: 372280 - protein, 20 aa, Mycobacterium
VALLGVAVVLFFGLRNSALA

SEQ ID NO: 372281 - protein, 20 aa, Mycobacterium
VALLSILLRGFSFGIDFNGG

SEQ ID NO: 372282 - protein, 24 aa, Mycobacterium
VALLSPFHTWWPSSIPFVLQVLIA

SEQ ID NO: 372283 - protein, 31 aa, Mycobacterium
VALLTSPRRQWPVYLASFAAVQIIPARLVLD

SEQ ID NO: 372284 - protein, 21 aa, Mycobacterium
VALLTWQVLRLRTGPAPMLSP

SEQ ID NO: 372285 - protein, 19 aa, Mycobacterium
VALLVLRGAVLPALLAHAL

SEQ ID NO: 372286 - protein, 30 aa, Mycobacterium
VALLVVSLLMLWFATLVQTYLGLTGEVKAA

SEQ ID NO: 372287 - protein, 18 aa, Mycobacterium
VALLVWRLGRIEEKWTTA

SEQ ID NO: 372288 - protein, 21 aa, Mycobacterium
VALMFVPVAFLPKKPPAVRRN

SEQ ID NO: 372289 - protein, 20 aa, Mycobacterium
VALMLLGIPPLLAGTYAGVA

SEQ ID NO: 372290 - protein, 17 aa, Mycobacterium
VALMVFGLGMFFGNLVG

SEQ ID NO: 372291 - protein, 19 aa, Mycobacterium
VALNFLLCIGYLLFSLTLQ

SEQ ID NO: 372292 - protein, 27 aa, Mycobacterium
VALPEPLPTHRLLFGAVLATAVFLIAT

SEQ ID NO: 372293 - protein, 25 aa, Mycobacterium
VALPGVAGLLFLTVGGGMIGYRQAN

SEQ ID NO: 372294 - protein, 30 aa, Mycobacterium
VALPILVAVIPWLFLRVRFFRRKLTVTALA

SEQ ID NO: 372295 - protein, 18 aa, Mycobacterium
VALPLAGAAILLFGGRRT

SEQ ID NO: 372296 - protein, 18 aa, Mycobacterium
VALPLVGAAILLFGGRRT

SEQ ID NO: 372297 - protein, 24 aa, Mycobacterium
VALRLNTRWVAHVVLLIPTVIAVI

SEQ ID NO: 372298 - protein, 23 aa, Mycobacterium
VALRVIAFSFFALAAYVAVDSVR

SEQ ID NO: 372299 - protein, 28 aa, Mycobacterium
VALRVTLRVMLALLLAPGVALLAVPLPG

SEQ ID NO: 372300 - protein, 22 aa, Mycobacterium
VALRWRRTIACHAFAVAWSVVS

SEQ ID NO: 372301 - protein, 35 aa, Mycobacterium
VALSKLVLRFWLRHQKWWPLRDRVMITVKLGVVVL

SEQ ID NO: 372302 - protein, 29 aa, Mycobacterium
VALTAWAFAVWILLTWTPTVENLLVGLVV

SEQ ID NO: 372303 - protein, 23 aa, Mycobacterium
VALTFVWLGMVLAISFLEAPLKF

SEQ ID NO: 372304 - protein, 35 aa, Mycobacterium; identical to SEQ ID NO: 25420

SEQ ID NO: 372305 - protein, 24 aa, Mycobacterium
VALTILVLLFSPPTLRWVAGSDHR

SEQ ID NO: 372306 - protein, 32 aa, Mycobacterium
VALTLSRLMSGLAARLSPALSVVAAVTCAAMG

SEQ ID NO: 372307 - protein, 22 aa, Mycobacterium
VALTVWASATLAFLEVSRGNYE

SEQ ID NO: 372308 - protein, 21 aa, Mycobacterium
VALTYPAHWGPAAVDALGAAL

SEQ ID NO: 372309 - protein, 19 aa, Mycobacterium
VALVARPLDRRPKGAVIFC

SEQ ID NO: 372310 - protein, 19 aa, Mycobacterium
VALVFAMLVSRWPLEGSIY

SEQ ID NO: 372311 - protein, 24 aa, Mycobacterium
VALVLWWRMVRFEYALIVTAATAA

SEQ ID NO: 372312 - protein, 26 aa, Mycobacterium
VALVMVAVVLGVRLLRSPSAEPGSAA

SEQ ID NO: 372313 - protein, 24 aa, Mycobacterium
VALVTGPLLLARTPALHSVGTAAP

SEQ ID NO: 372314 - protein, 24 aa, Mycobacterium
VALVVVLMAVAVYAVVSRALYDDL

SEQ ID NO: 372315 - protein, 21 aa, Mycobacterium
VALYLIGSLAGFPQWLLDLEP

SEQ ID NO: 372316 - protein, 21 aa, Mycobacterium
VALYLLGSLSGFPQWLLNLEP

SEQ ID NO: 372317 - protein, 18 aa, Mycobacterium
VALYRIRVGRRIGSAALV

SEQ ID NO: 372318 - protein, 35 aa, Mycobacterium
VAMASTMFFGAYPWAGWLAFAATVPVQFVAGWPFL

SEQ ID NO: 372319 - protein, 18 aa, Mycobacterium
VAMFFYIVSTFGAGVLFP

SEQ ID NO: 372320 - protein, 23 aa, Mycobacterium
VAMHLWFLAVYLMVVALTPIAVA

SEQ ID NO: 372321 - protein, 25 aa, Mycobacterium
VAMHLWFLAVYVLVVSLTPIAVAAH

SEQ ID NO: 372322 - protein, 32 aa, Mycobacterium
VAMIVIICVFSMLIAQLMVRPIRRLEAGTEKI

SEQ ID NO: 372323 - protein, 21 aa, Mycobacterium
VAMLAAVSGWRSGAPGSLMAL

SEQ ID NO: 372324 - protein, 30 aa, Mycobacterium
VAMLLAAAWLAVLASPLLLVAHRLPDVGTV

SEQ ID NO: 372325 - protein, 22 aa, Mycobacterium
VAMLLVLRFLQGGACSAFIVVA

SEQ ID NO: 372326 - protein, 21 aa, Mycobacterium
VAMLYDVDRPYRSTYLFLAGG

SEQ ID NO: 372327 - protein, 28 aa, Mycobacterium
VAMPAAIFVLFCVILVMSWSNAVNFTDG

SEQ ID NO: 372328 - protein, 19 aa, Mycobacterium
VAMSVLALVYFRLRMMRFF

SEQ ID NO: 372329 - protein, 22 aa, Mycobacterium
VAMVFNLFFINLVIAGLHSYAG

SEQ ID NO: 372330 - protein, 17 aa, Mycobacterium
VAMVLLGLVLAGVVLLF

SEQ ID NO: 372331 - protein, 25 aa, Mycobacterium
VAMVLTLVLMLATPWAAAGLVALPL

SEQ ID NO: 372332 - protein, 22 aa, Mycobacterium
VANALRLLGMPMQSVTPAAPRV

SEQ ID NO: 372333 - protein, 24 aa, Mycobacterium
VANGIWWTGVFPGIAIVLVVLGMT

SEQ ID NO: 372334 - protein, 17 aa, Mycobacterium
VANLFLAKTVYSALLAL

SEQ ID NO: 372335 - protein, 17 aa, Mycobacterium
VANLFLTKTVYSALLAL

SEQ ID NO: 372336 - protein, 21 aa, Mycobacterium
VANYWVMSHMLPLFRRMQGLI

SEQ ID NO: 372337 - protein, 22 aa, Mycobacterium
VANYWVMSHMLPLFRRMQGLID

SEQ ID NO: 372338 - protein, 24 aa, Mycobacterium
VAPAARILAIRQTSPRYAPSSTGE

SEQ ID NO: 372339 - protein, 29 aa, Mycobacterium
VAPAPSQPLFVPPAPPAVLPPGQGPLLPN

SEQ ID NO: 372340 - protein, 25 aa, Mycobacterium
VAPEARLISIRQNSPRFAPRTPGAD

SEQ ID NO: 372341 - protein, 30 aa, Mycobacterium
VAPENAFGAIFLMGVLVVSAGWSMPLAVAT

SEQ ID NO: 372342 - protein, 26 aa, Mycobacterium
VAPGFRLPALNRRQFLGSLAASVVAG

SEQ ID NO: 372343 - protein, 18 aa, Mycobacterium
VAPGITIPIGPPTTVPVG

SEQ ID NO: 372344 - protein, 20 aa, Mycobacterium
VAPHRGWLEALLGHFCDPTV

SEQ ID NO: 372345 - protein, 19 aa, Mycobacterium
VAPIIGLDPVLIALAAGAG

SEQ ID NO: 372346 - protein, 29 aa, Mycobacterium
VAPKRPPKWRHVPAILLVASLVLLTIAMA

SEQ ID NO: 372347 - protein, 18 aa, Mycobacterium
VAPMNVIGRILYVMGKEG

SEQ ID NO: 372348 - protein, 17 aa, Mycobacterium
VAPPPPPPPPPPPPDEP

SEQ ID NO: 372349 - protein, 24 aa, Mycobacterium
VAPRLLVELVAGFLGGLVGFVVLG

SEQ ID NO: 372350 - protein, 19 aa, Mycobacterium
VAPSAPIALPEREPRNIWV

SEQ ID NO: 372351 - protein, 26 aa, Mycobacterium
VAPTTLAVLMLLPLSAFEAMTPLPAA

SEQ ID NO: 372352 - protein, 42 aa, Mycobacterium
VAPVAVLVYLFIVDWRVALVLLIPVLMYLVMTSSLAVQSGSR

SEQ ID NO: 372353 - protein, 20 aa, Mycobacterium
VAQAILSPFFLKMASRYASA

SEQ ID NO: 372354 - protein, 24 aa, Mycobacterium
VAQDQPWFRQYAMTYLLFAPICLG

SEQ ID NO: 372355 - protein, 22 aa, Mycobacterium
VAQDRLLLGVLIAALVTAGVGI

SEQ ID NO: 372356 - protein, 23 aa, Mycobacterium
VAQFFPQLILAPTSGKWADTGNP

SEQ ID NO: 372357 - protein, 26 aa, Mycobacterium
VAQLNYVRVPALNALFPGPEVRGSML

SEQ ID NO: 372358 - protein, 23 aa, Mycobacterium
VAQLSYVRVPALNALFPTYRGSV

SEQ ID NO: 372359 - protein, 17 aa, Mycobacterium
VAQRQWRWPLGEIDKPF

SEQ ID NO: 372360 - protein, 23 aa, Mycobacterium
VAQSYWMPVQLFLEGGDFGIKDP

SEQ ID NO: 372361 - protein, 33 aa, Mycobacterium
VAQTLALALALYLVSALLIWSQARLLNLTVQRT

SEQ ID NO: 372362 - protein, 27 aa, Mycobacterium
VAQVLPVILNGFFLGVVTLVGMTTLDW

SEQ ID NO: 372363 - protein, 27 aa, Mycobacterium
VARALTGVFFAFLLGLSLAIINAVFLP

SEQ ID NO: 372364 - protein, 24 aa, Mycobacterium
VARASRLLGIAVLVIAVVVIATIV

SEQ ID NO: 372365 - protein, 30 aa, Mycobacterium
VARFGQLAVWIFFGLTLVLAGLTQLAVRSR

SEQ ID NO: 372366 - protein, 20 aa, Mycobacterium
VARIGILAIRWRLPSGVELD

SEQ ID NO: 372367 - protein, 27 aa, Mycobacterium
VARLLAWRPLVWLGTISYGIYLWHWPI

SEQ ID NO: 372368 - protein, 24 aa, Mycobacterium
VARLTRWTAVFPWAAMHSLRGTKG

SEQ ID NO: 372369 - protein, 28 aa, Mycobacterium
VARNRPRLPLALVGSAAAAVLCLGGFGA

SEQ ID NO: 372370 - protein, 39 aa, Mycobacterium
VARPLSWRAALWSVMSVRWAAFALALFLAGLGAQLNGAP

SEQ ID NO: 372371 - protein, 26 aa, Mycobacterium
VARSSDHPLLSTLLLASSMSHRGPPV

SEQ ID NO: 372372 - protein, 33 aa, Mycobacterium
VARTLMLALGLYLVAALMVWIQARLLNVVVQRT

SEQ ID NO: 372373 - protein, 17 aa, Mycobacterium
VARVRPDLVYLLRRQRQ

SEQ ID NO: 372374 - protein, 48 aa, Mycobacterium
VARWFAAAYIWLFRGLPVLLQILIWYNLALVIPVISIPLPMGGYLLQE

SEQ ID NO: 372375 - protein, 20 aa, Mycobacterium
VARWYTWVIAILGVDLLYYA

SEQ ID NO: 372376 - protein, 18 aa, Mycobacterium
VASALLILLPTPAAAGEI

SEQ ID NO: 372377 - protein, 30 aa, Mycobacterium
VASAMMVFSYLQAPVLFGIGRITVTLELPS

SEQ ID NO: 372378 - protein, 28 aa, Mycobacterium
VASGAMVFAILVLLGRYINYTLDLAGIA

SEQ ID NO: 372379 - protein, 30 aa, Mycobacterium
VASGAMVFAILVLLGRYISYTLDLAGIAGL

SEQ ID NO: 372380 - protein, 31 aa, Mycobacterium
VASGIYLASSLLLWAKGRLLNVIVQRTILVL

SEQ ID NO: 372381 - protein, 22 aa, Mycobacterium
VASGLLLLLPLSLQTRTVVGLL

SEQ ID NO: 372382 - protein, 25 aa, Mycobacterium
VASGLTLMWQPEALPAAACALALVA

SEQ ID NO: 372383 - protein, 25 aa, Mycobacterium
VASGPAWRLIGTTAIGLLLVTFTPT

SEQ ID NO: 372384 - protein, 35 aa, Mycobacterium
VASGPYFKVALLNLAPFWMTQPWVDAAFKKRGIDP

SEQ ID NO: 372385 - protein, 30 aa, Mycobacterium
VASISAALVICLGALLYSFISPAGQINESP

SEQ ID NO: 372386 - protein, 18 aa, Mycobacterium
VASIVLLVAGGIFAIVKL

SEQ ID NO: 372387 - protein, 27 aa, Mycobacterium
VASLCLIFIVMLILTRAFVAATVIVGT

SEQ ID NO: 372388 - protein, 22 aa, Mycobacterium
VASLFYAFPIFLDAGFIVMLPI

SEQ ID NO: 372389 - protein, 21 aa, Mycobacterium
VASLMLTAFLVIVGNAAAAGP

SEQ ID NO: 372390 - protein, 23 aa, Mycobacterium
VASLTLLPALIGLAGRRGLAQPR

SEQ ID NO: 372391 - protein, 24 aa, Mycobacterium
VASMLIAQAMVRPVRRLEAGTQKI

SEQ ID NO: 372392 - protein, 51 aa, Mycobacterium
VASMVRPLSTTNFLLVLIAALLLGPGIPLALLYAAKWYVGKIPPVPMVAER

SEQ ID NO: 372393 - protein, 28 aa, Mycobacterium
VASPGRPWPRVVGALALAVLGACGVMLL

SEQ ID NO: 372394 - protein, 17 aa, Mycobacterium
VASSVVALIWFGVSRNR

SEQ ID NO: 372395 - protein, 19 aa, Mycobacterium
VASSYRRFVTWLIERDVDG

SEQ ID NO: 372396 - protein, 39 aa, Mycobacterium
VASTGQLVLVIHHLAIDAVSWRILLEDLNIAWGQHRHGQ

SEQ ID NO: 372397 - protein, 24 aa, Mycobacterium
VASVISWVSIVLIGIVVVMQIADV

SEQ ID NO: 372398 - protein, 30 aa, Mycobacterium
VASVISWVSVALLFVIVLVEVTDVLAVPVA

SEQ ID NO: 372399 - protein, 24 aa, Mycobacterium
VASVISWVSVVIIGIWVMLQIADV

SEQ ID NO: 372400 - protein, 28 aa, Mycobacterium
VASVLPVWLLLAPRDYLSTFMKVGAIAL

SEQ ID NO: 372401 - protein, 36 aa, Mycobacterium
VASVLYFLVAFAILIVGFVMVNLLTPGNLRTLVFVE

SEQ ID NO: 372402 - protein, 31 aa, Mycobacterium
VASVSAALVICLGSLLWSFISPSGQINDSPI

SEQ ID NO: 372403 - protein, 24 aa, Mycobacterium
VASVTFLPAVLVLVGRRGWITPRK

SEQ ID NO: 372404 - protein, 23 aa, Mycobacterium
VASYSWYYAWTPGTGYLANLLPQ

SEQ ID NO: 372405 - protein, 19 aa, Mycobacterium
VATAGLVLLIGCPSAGAVS

SEQ ID NO: 372406 - protein, 26 aa, Mycobacterium
VATAPGWYVVPLLILAVLGGCGQGVI

SEQ ID NO: 372407 - protein, 24 aa, Mycobacterium
VATASRAYAFLVPTAVKSVTARQV

SEQ ID NO: 372408 - protein, 26 aa, Mycobacterium
VATAVVWTVALTRPAKVHEAVVCNPP

SEQ ID NO: 372409 - protein, 20 aa, Mycobacterium
VATDAVIAVVWFAALSLHTV

SEQ ID NO: 372410 - protein, 22 aa, Mycobacterium
VATFAGWTLIAGNPLAGMTAAV

SEQ ID NO: 372411 - protein, 17 aa, Mycobacterium
VATFFRFVARRLDTRPE

SEQ ID NO: 372412 - protein, 36 aa, Mycobacterium
VATGMKMISPQTLFFPFVLLLAATALFRGNDKKMRT

SEQ ID NO: 372413 - protein, 21 aa, Mycobacterium
VATITPLIFAGAVSGAAPSLP

SEQ ID NO: 372414 - protein, 19 aa, Mycobacterium
VATLGFWIGSGYPVAAAFT

SEQ ID NO: 372415 - protein, 25 aa, Mycobacterium
VATLLGASAFWRLRREHVRLVAVGA

SEQ ID NO: 372416 - protein, 22 aa, Mycobacterium
VATNFAWLFPVLTGLPISQQTW

SEQ ID NO: 372417 - protein, 23 aa, Mycobacterium
VATPALIWLSLALELPLVVVIVL

SEQ ID NO: 372418 - protein, 27 aa, Mycobacterium
VATPPSHILGLLNLLTAWETGACVRLH

SEQ ID NO: 372419 - protein, 34 aa, Mycobacterium
VATPRELFWPFGVYALIILAVWRAARIPLRWILP

SEQ ID NO: 372420 - protein, 28 aa, Mycobacterium
VATPRETFWPFGVYALIIVSMWAVAKIP

SEQ ID NO: 372421 - protein, 23 aa, Mycobacterium
VATQILQMLRQLAPLVRFDGYHV

SEQ ID NO: 372422 - protein, 19 aa, Mycobacterium
VATQLLLGPVARGAIASRT

SEQ ID NO: 372423 - protein, 26 aa, Mycobacterium
VATRLIFPLIMVLSAYFFFAGHNTPG

SEQ ID NO: 372424 - protein, 26 aa, Mycobacterium
VATTALLIMVFGYMRVPAMVGIGQYR

SEQ ID NO: 372425 - protein, 24 aa, Mycobacterium
VATTGFWLAPLLLSVPLFSRDTYS

SEQ ID NO: 372426 - protein, 25 aa, Mycobacterium
VATVGFLVLIGGTFLALIQAFNALF

SEQ ID NO: 372427 - protein, 28 aa, Mycobacterium
VATVLALLFIPLCVLLAVIALLTGHVAM

SEQ ID NO: 372428 - protein, 25 aa, Mycobacterium
VATVLGLLVPFAPTYALLLCGRFVE

SEQ ID NO: 372429 - protein, 32 aa, Mycobacterium
VATVLYGLAVLPWLWQVRRLTPAGRRLLAQER

SEQ ID NO: 372430 - protein, 23 aa, Mycobacterium
VATWLNRSLGWCFLFANGNASVA

SEQ ID NO: 372431 - protein, 23 aa, Mycobacterium
VATWTTIWVFVGLAVHAAVATIA

SEQ ID NO: 372432 - protein, 17 aa, Mycobacterium
VAVAFVIIKIVQAGVVG

SEQ ID NO: 372433 - protein, 28 aa, Mycobacterium
VAVAGVLVAFLAWWFPRQAGGGANNASG

SEQ ID NO: 372434 - protein, 26 aa, Mycobacterium
VAVDAFLVRPLLVPAFMQLMGRLNWW

SEQ ID NO: 372435 - protein, 22 aa, Mycobacterium
VAVFFALSGFLLWRGHAAAARD

SEQ ID NO: 372436 - protein, 22 aa, Mycobacterium
VAVFFALSGFLLWRGHAGAARD

SEQ ID NO: 372437 - protein, 38 aa, Mycobacterium
VAVGIALVFVRWWGQPAWSWLVLWRRGRRPISWDAPIT

SEQ ID NO: 372438 - protein, 60 aa, Mycobacterium
VAVIAGALGMWWTLRGGYAEWWQHLSGETSWTLLLGIGQMLMAVLAGAALFTGGKYLTGL

SEQ ID NO: 372439 - protein, 21 aa, Mycobacterium
VAVIFCWIGMVLAISFLEAPL

SEQ ID NO: 372440 - protein, 34 aa, Mycobacterium
VAVIFIMLLVVYRSPITVILLLLTVGAEFTVARG

SEQ ID NO: 372441 - protein, 26 aa, Mycobacterium
VAVIILMLLAIYRSIVTMLISMVIIG

SEQ ID NO: 372442 - protein, 17 aa, Mycobacterium
VAVIVGPPLFREHLNRA

SEQ ID NO: 372443 - protein, 18 aa, Mycobacterium
VAVKALMIGGFPILSVIG

SEQ ID NO: 372444 - protein, 21 aa, Mycobacterium
VAVLFLLWERFSRTRLIEPAG

SEQ ID NO: 372445 - protein, 31 aa, Mycobacterium
VAVLIAMLIALTLLPALLGFAGGRVAKFIEP

SEQ ID NO: 372446 - protein, 17 aa, Mycobacterium
VAVLIIACPCALGLATP

SEQ ID NO: 372447 - protein, 19 aa, Mycobacterium
VAVLMFRFNNPDALLVFLM

SEQ ID NO: 372448 - protein, 20 aa, Mycobacterium
VAVLPWKIWGNEAAIVYFLG

SEQ ID NO: 372449 - protein, 23 aa, Mycobacterium
VAVLPWLCLQLVMIPTVAGIYGI

SEQ ID NO: 372450 - protein, 24 aa, Mycobacterium
VAVLTFAGWTLIAANPIAGMTAAV

SEQ ID NO: 372451 - protein, 21 aa, Mycobacterium
VAVLVTVLTLIGDSPPAVVSA

SEQ ID NO: 372452 - protein, 38 aa, Mycobacterium
VAVLVVIAALVIGLVRYRRRRIRLSTQPKPGVIDRSGG

SEQ ID NO: 372453 - protein, 20 aa, Mycobacterium
VAVLVYLFVVDWRVALVLFA

SEQ ID NO: 372454 - protein, 20 aa, Mycobacterium
VAVLVYLFVVDWRVALVLFL

SEQ ID NO: 372455 - protein, 19 aa, Mycobacterium
VAVMCLLPLMTSPYYVRVA

SEQ ID NO: 372456 - protein, 17 aa, Mycobacterium
VAVPAHWHPAAFDAVRA

SEQ ID NO: 372457 - protein, 26 aa, Mycobacterium
VAVPGWAYLALPVVATLIGLLASLAG

SEQ ID NO: 372458 - protein, 18 aa, Mycobacterium
VAVPPGWSYPQAASVPAA

SEQ ID NO: 372459 - protein, 32 aa, Mycobacterium
VAVQALLFPTFLLIVYKLLIGKAVLAVTGHDS

SEQ ID NO: 372460 - protein, 28 aa, Mycobacterium
VAVQLVVVLTAAWLLATPLTQSKDQPEL

SEQ ID NO: 372461 - protein, 28 aa, Mycobacterium
VAVRNLPGWPLWFAAAWSATEWGKASIP

SEQ ID NO: 372462 - protein, 18 aa, Mycobacterium
VAVRRLRYGRFTPIAVLA

SEQ ID NO: 372463 - protein, 32 aa, Mycobacterium
VAVRYPAGINWVLAFWGVLMAGGIAVAVNTRS

SEQ ID NO: 372464 - protein, 25 aa, Mycobacterium
VAVTFIVMVFCKLPVFSTVGPAISV

SEQ ID NO: 372465 - protein, 24 aa, Mycobacterium
VAVTFLGMGFTKLGILSTVGPALS

SEQ ID NO: 372466 - protein, 24 aa, Mycobacterium
VAVTFLGMIFTQLGILRTVGPVLG

SEQ ID NO: 372467 - protein, 23 aa, Mycobacterium
VAVTFVWLGMVLAISFLEAPLKF

SEQ ID NO: 372468 - protein, 17 aa, Mycobacterium
VAVTGTTIWWTSDARAT

SEQ ID NO: 372469 - protein, 22 aa, Mycobacterium
VAVTSILRHSLISRIDSTLLDA

SEQ ID NO: 372470 - protein, 26 aa, Mycobacterium
VAVVAVVLAGLFWSGHRADTDELRYR

SEQ ID NO: 372471 - protein, 30 aa, Mycobacterium
VAVVFFAAITLLPALLVLAGRRGWIAPRTD

SEQ ID NO: 372472 - protein, 19 aa, Mycobacterium
VAVVFFSGFFIGRATEGFG

SEQ ID NO: 372473 - protein, 30 aa, Mycobacterium
VAVVLLVLALLLPWNLQFGVGVPGSDGSTF

SEQ ID NO: 372474 - protein, 18 aa, Mycobacterium
VAVVPHMAPPTAAPAPVV

SEQ ID NO: 372475 - protein, 46 aa, Mycobacterium
VAVVSGAVLLFGFLLPWLGVLAVVGVVIYGLIRWSRARTAPPPPAP

SEQ ID NO: 372476 - protein, 18 aa, Mycobacterium
VAVVSIAVTLVAVAALTV

SEQ ID NO: 372477 - protein, 28 aa, Mycobacterium
VAVVSLGLWVIFLPSVVRRRLPEKWAAD

SEQ ID NO: 372478 - protein, 39 aa, Mycobacterium
VAVVVGIALVFVRWWGLPAWSWAVLWRRGRRPIDWSAPI

SEQ ID NO: 372479 - protein, 38 aa, Mycobacterium
VAVVVQPTFLYELIWNLLVFAALIYLDRRFTIGHGRLF

SEQ ID NO: 372480 - protein, 28 aa, Mycobacterium
VAVVVVLGWSFFYFSDDTRGYKPVDTSV

SEQ ID NO: 372481 - protein, 27 aa, Mycobacterium
VAVWDTPVWALFIPSPIAVGAAFLATL

SEQ ID NO: 372482 - protein, 32 aa, Mycobacterium
VAVYGLMGVILLGIALLTMHLLIPGSFHEHID

SEQ ID NO: 372483 - protein, 24 aa, Mycobacterium
VAVYGLMGVILLGIAMLAMHLLIP

SEQ ID NO: 372484 - protein, 25 aa, Mycobacterium
VAVYLIAMLAFGFWGKTRTKDSADF

SEQ ID NO: 372485 - protein, 17 aa, Mycobacterium
VAWFGLDVDWGYSGVPT

SEQ ID NO: 372486 - protein, 26 aa, Mycobacterium
VAWGGPLPVSIYAIALLVLCALAAYG

SEQ ID NO: 372487 - protein, 17 aa, Mycobacterium
VAWGLVFGYAQQLFTRL

SEQ ID NO: 372488 - protein, 21 aa, Mycobacterium
VAWPAVLERFPQRWRPLIGAG

SEQ ID NO: 372489 - protein, 17 aa, Mycobacterium
VAWVRRDLLGGYRYPMW

SEQ ID NO: 372490 - protein, 29 aa, Mycobacterium
VAYHPSLEQLLVLLPPYLAATQSYGSSLN

SEQ ID NO: 372491 - protein, 25 aa, Mycobacterium
VAYTVLFLLMQGWAGAQPANVIALL

SEQ ID NO: 372492 - protein, 20 aa, Mycobacterium
VCDLTEPPAFRVALIRVAAE

SEQ ID NO: 372493 - protein, 20 aa, Mycobacterium
VCDQLLLVAPGGKTAFLGPP

SEQ ID NO: 372494 - protein, 21 aa, Mycobacterium
VCFAIRMLGVHFGLNAPSPPG

SEQ ID NO: 372495 - protein, 28 aa, Mycobacterium
VCGVAGTLTIAWYILAAPGELGSKAEWF

SEQ ID NO: 372496 - protein, 45 aa, Mycobacterium
VCIGLLLDTLVVRTLLMPSIATLLGRWFWWPQVVHPRGDNARRSV

SEQ ID NO: 372497 - protein, 24 aa, Mycobacterium
VCIYGFRFMLLVNKIAVIAATLLF

SEQ ID NO: 372498 - protein, 29 aa, Mycobacterium
VCLAAPNLWIFLIGRFLQGAALAAVFLTV

SEQ ID NO: 372499 - protein, 35 aa, Mycobacterium
VCLFIALVLFRYLTPWGRQFWRITRGYFVGAHSVR

SEQ ID NO: 372500 - protein, 23 aa, Mycobacterium
VCLTGIFPLAFWLMGVLAAIRYR

SEQ ID NO: 372501 - protein, 19 aa, Mycobacterium
VCLVLFAAVIVWPQVRHAG

SEQ ID NO: 372502 - protein, 23 aa, Mycobacterium
VCQVFVMYVVVHFGVGLQAKHPV

SEQ ID NO: 372503 - protein, 25 aa, Mycobacterium
VCTLGLIAMLAIFADLRFGDEKPYR

SEQ ID NO: 372504 - protein, 19 aa, Mycobacterium
VCTQRPGRWRQVIAAGLQV

SEQ ID NO: 372505 - protein, 23 aa, Mycobacterium
VCTVLFAALLPKSQFFVPKKVRV

SEQ ID NO: 372506 - protein, 26 aa, Mycobacterium
VCVAVFPVLLGLGAWFRAESSKTYRE

SEQ ID NO: 372507 - protein, 33 aa, Mycobacterium
VCVGAGLLLYASFPPVNWWWAAIVAVALLTWVL

SEQ ID NO: 372508 - protein, 26 aa, Mycobacterium
VCVPELLLPLMLLNFTPMFGHIAHGS

SEQ ID NO: 372509 - protein, 28 aa, Mycobacterium
VCWPTAPRWLGVPLYIVLGWVAVWFCPT

SEQ ID NO: 372510 - protein, 22 aa, Mycobacterium
VDADGFFYYSGRLSTMIKTAGA

SEQ ID NO: 372511 - protein, 19 aa, Mycobacterium
VDALILGLSERRRSRRAWA

SEQ ID NO: 372512 - protein, 18 aa, Mycobacterium
VDALLKDMREFTGLLAQH

SEQ ID NO: 372513 - protein, 18 aa, Mycobacterium
VDANAALRWSLLAGAVCN

SEQ ID NO: 372514 - protein, 25 aa, Mycobacterium
VDAPLTMVFAHGFCLRMGAFHFQRM

SEQ ID NO: 372515 - protein, 23 aa, Mycobacterium
VDARGFLLGGAVAVTLGIGVLAV

SEQ ID NO: 372516 - protein, 38 aa, Mycobacterium
VDARRFSLLGLFMPSALALLFVMFAVPQLQLYMSPAML

SEQ ID NO: 372517 - protein, 30 aa, Mycobacterium
VDARRNLLGLFMPSALALLFAMFAVPQLQL

SEQ ID NO: 372518 - protein, 22 aa, Mycobacterium
VDATIRMWWQLTVALAVVGIVA

SEQ ID NO: 372519 - protein, 29 aa, Mycobacterium
VDAVLALPAAIRALIATVVILVKASSDRQ

SEQ ID NO: 372520 - protein, 22 aa, Mycobacterium
VDAVRLLRERYPNGMPGPEVTA

SEQ ID NO: 372521 - protein, 23 aa, Mycobacterium
VDDAASITLFPQANSWYVGANIP

SEQ ID NO: 372522 - protein, 22 aa, Mycobacterium
VDDDLVLGVTLIADGRRQPGVG

SEQ ID NO: 372523 - protein, 26 aa, Mycobacterium
VDDLAYGLGLWWGVLRERNVRALKPQ

SEQ ID NO: 372524 - protein, 18 aa, Mycobacterium
VDDLLMLARLDVQRPLEH

SEQ ID NO: 372525 - protein, 26 aa, Mycobacterium
VDDPPACTVGFLPPSAWRSPADTTTI

SEQ ID NO: 372526 - protein, 29 aa, Mycobacterium
VDDRPVGAVLLRDPLRRQAPRTMRRLREA

SEQ ID NO: 372527 - protein, 25 aa, Mycobacterium
VDDSLPAWLWTGISGMLRASALLLA

SEQ ID NO: 372528 - protein, 20 aa, Mycobacterium
VDEPVFLGRRWGIGNMWAEA

SEQ ID NO: 372529 - protein, 25 aa, Mycobacterium
VDFADWPLLAKLTRWTIDAHMGLLF

SEQ ID NO: 372530 - protein, 18 aa, Mycobacterium
VDFGGFAPLGWGAVLAAV

SEQ ID NO: 372531 - protein, 18 aa, Mycobacterium
VDFVLLLEDLRDWDNADH

SEQ ID NO: 372532 - protein, 32 aa, Mycobacterium
VDGASWFYMFRKLMLPMLWPYILVAVIFRFMD

SEQ ID NO: 372533 - protein, 29 aa, Mycobacterium
VDGEEPPPPRWPWVVGVAAIIAAITLVAS

SEQ ID NO: 372534 - protein, 22 aa, Mycobacterium
VDGVSWRILLDDLAEAYRQALS

SEQ ID NO: 372535 - protein, 25 aa, Mycobacterium
VDHAARPRLRPTRVLAMVIGVGAVL

SEQ ID NO: 372536 - protein, 24 aa, Mycobacterium
VDHIRFRYITWEKALASVQIVGGF

SEQ ID NO: 372537 - protein, 18 aa, Mycobacterium
VDHYLAVTSLIETDIDSI

SEQ ID NO: 372538 - protein, 17 aa, Mycobacterium
VDIDPWRAMFNSGVWLQ

SEQ ID NO: 372539 - protein, 24 aa, Mycobacterium
VDIFFVLSGFLITSLLLDEFARTG

SEQ ID NO: 372540 - protein, 22 aa, Mycobacterium
VDIMPTWLRWLSAVNPLSYEVN

SEQ ID NO: 372541 - protein, 23 aa, Mycobacterium
VDKMGMHPVVLDAVLHALGLTAE

SEQ ID NO: 372542 - protein, 24 aa, Mycobacterium
VDKPPLFLWPMELSVRLFGFSPWS

SEQ ID NO: 372543 - protein, 17 aa, Mycobacterium
VDLAYPRTRIEYMLRHA

SEQ ID NO: 372544 - protein, 22 aa, Mycobacterium
VDLCWRLIESGVRLRYEPIALV

SEQ ID NO: 372545 - protein, 18 aa, Mycobacterium
VDLIRLVPGPLTPKDSHW

SEQ ID NO: 372546 - protein, 19 aa, Mycobacterium
VDLIRLVPGPLTPQDRHWE

SEQ ID NO: 372547 - protein, 32 aa, Mycobacterium
VDLRPHVWITRVPFVVFVIGALGVGLAITLWL

SEQ ID NO: 372548 - protein, 18 aa, Mycobacterium
VDLTAFLFGDVLGVRLGD

SEQ ID NO: 372549 - protein, 28 aa, Mycobacterium
VDLTYIPIVGWAMSAAFQAPVCAAAMAV

SEQ ID NO: 372550 - protein, 26 aa, Mycobacterium
VDMDGTLSFLLLPRLTHVLSTLPRGT

SEQ ID NO: 372551 - protein, 28 aa, Mycobacterium
VDMPWTQWLTWPFQAVPTFFLVAGYAGA

SEQ ID NO: 372552 - protein, 25 aa, Mycobacterium
VDNGTGSWLLWDGKRSLLDLNDHAV

SEQ ID NO: 372553 - protein, 27 aa, Mycobacterium
VDNPRPLDPPPAPPPPAPTKGGPDAFS

SEQ ID NO: 372554 - protein, 25 aa, Mycobacterium
VDNVQLPWAFKIVSTLPSLSGNIVA

SEQ ID NO: 372555 - protein, 23 aa, Mycobacterium
VDPIAEGWFFDRPDLIGADGVHP

SEQ ID NO: 372556 - protein, 19 aa, Mycobacterium
VDPVAALTWNVPAAGVDAS

SEQ ID NO: 372557 - protein, 33 aa, Mycobacterium
VDPVFRARLPLIRDLFVVLAYAASATSALTIGS

SEQ ID NO: 372558 - protein, 21 aa, Mycobacterium
VDPVGLHTLMARPALESTAAE

SEQ ID NO: 372559 - protein, 30 aa, Mycobacterium
VDQGALLLGVFFWFTVIGGITVVLSGGIRP

SEQ ID NO: 372560 - protein, 27 aa, Mycobacterium
VDRAANPVLPPFGPPPNPAPAPVAPAS

SEQ ID NO: 372561 - protein, 21 aa, Mycobacterium
VDRFYLVLLVVAAAPLVASVG

SEQ ID NO: 372562 - protein, 21 aa, Mycobacterium
VDRNIDRLLRRVCPGDIVVLD

SEQ ID NO: 372563 - protein, 22 aa, Mycobacterium
VDRNIDRLLRRVCPGDIVVLDI

SEQ ID NO: 372564 - protein, 18 aa, Mycobacterium
VDSALDDAVRGLRARLLR

SEQ ID NO: 372565 - protein, 23 aa, Mycobacterium
VDSFADFEYLFWVGCAGAYEDRA

SEQ ID NO: 372566 - protein, 23 aa, Mycobacterium
VDSFDGFEYLFWVGCAGAYDDKA

SEQ ID NO: 372567 - protein, 24 aa, Mycobacterium
VDSFDGFEYLFWVGCAGAYEDRAK

SEQ ID NO: 372568 - protein, 24 aa, Mycobacterium
VDSHAPLVLLTAAGSFAAFTAMIS

SEQ ID NO: 372569 - protein, 26 aa, Mycobacterium
VDSLGWQWIFIVNVPVGIVGLVMALR

SEQ ID NO: 372570 - protein, 18 aa, Mycobacterium
VDSMRRFAWAPGAPVLDP

SEQ ID NO: 372571 - protein, 21 aa, Mycobacterium
VDSNVLWWALALGADFGGNLT

SEQ ID NO: 372572 - protein, 24 aa, Mycobacterium
VDSRLWVGIGVLAGLLAASLATSA

SEQ ID NO: 372573 - protein, 36 aa, Mycobacterium
VDSRRNILGLFMPAALAMIFFMLALPNVQAQQVLSY

SEQ ID NO: 372574 - protein, 36 aa, Mycobacterium
VDSRRNLLGLFMPATLFLMFAMFTTPQLQLYVSPAM

SEQ ID NO: 372575 - protein, 44 aa, Mycobacterium
VDSRRNLLGLFMPSTLFLMFVMFGVPQLQLWISPAMLALMAVMS

SEQ ID NO: 372576 - protein, 25 aa, Mycobacterium
VDTGNPWYTNLWHNIADSPTVVPTP

SEQ ID NO: 372577 - protein, 20 aa, Mycobacterium
VDTLLRTFIGAGVLALPAVT

SEQ ID NO: 372578 - protein, 19 aa, Mycobacterium
VDVDRWLFFGTVPTVWLQE

SEQ ID NO: 372579 - protein, 25 aa, Mycobacterium
VDVFFVISGFLITGLLWSEVTTTNT

SEQ ID NO: 372580 - protein, 24 aa, Mycobacterium
VDVFFVLSGFLITSLLLDEIGRTG

SEQ ID NO: 372581 - protein, 17 aa, Mycobacterium
VDVKRILDSATGTFYDE

SEQ ID NO: 372582 - protein, 35 aa, Mycobacterium
VDVKRVFEFGLHYWPWLMLGYVTYGVMVSSLIGWW

SEQ ID NO: 372583 - protein, 26 aa, Mycobacterium
VDVLTAAPIPIAAGLMVLFMVASMAI

SEQ ID NO: 372584 - protein, 26 aa, Mycobacterium
VDVMFAFPVLLLALAVVAILGPGVTT

SEQ ID NO: 372585 - protein, 22 aa, Mycobacterium
VDVMLIRRYFGSKQQLFDEATN

SEQ ID NO: 372586 - protein, 29 aa, Mycobacterium
VDVPGMPRLLRWLSPFIPLASTVAPETFF

SEQ ID NO: 372587 - protein, 25 aa, Mycobacterium
VDVPKPRLADYFQPGSPPKASELEK

SEQ ID NO: 372588 - protein, 24 aa, Mycobacterium
VDVSPLGLPMRWNGLGIYIGEHGE

SEQ ID NO: 372589 - protein, 33 aa, Mycobacterium
VDVVLRILIGSAVVLLPIVLVATAIVLMRTQPN

SEQ ID NO: 372590 - protein, 18 aa, Mycobacterium
VDWLELLVQVIVAAVGVA

SEQ ID NO: 372591 - protein, 28 aa, Mycobacterium
VDYADILYIAPWLLLLGVAMAGLTAYAT

SEQ ID NO: 372592 - protein, 35 aa, Mycobacterium
VDYLIKDLELLPTFPFHYKYLRNAVRGDYLNVFAT

SEQ ID NO: 372593 - protein, 23 aa, Mycobacterium
VDYSLFILMRFREELRSGRDPQE

SEQ ID NO: 372594 - protein, 23 aa, Mycobacterium
VDYSLFILMRFREELRSGRQPQE

SEQ ID NO: 372595 - protein, 24 aa, Mycobacterium
VDYSLFILMRFREELRSGRQPREA

SEQ ID NO: 372596 - protein, 24 aa, Mycobacterium
VDYSLFILMRFREELRTGRRPQEA

SEQ ID NO: 372597 - protein, 24 aa, Mycobacterium
VDYTMVSVAIAVLWLAALAINHSR

SEQ ID NO: 372598 - protein, 21 aa, Mycobacterium
VEAAYFINLAFMALFVFATPV

SEQ ID NO: 372599 - protein, 22 aa, Mycobacterium
VEAPEFHAALLAELALIGHRGP

SEQ ID NO: 372600 - protein, 23 aa, Mycobacterium
VEASFYVLLPFLAYLLLVVISRR

SEQ ID NO: 372601 - protein, 24 aa, Mycobacterium
VEASSLFLVSRLNCSITASDGTVL

SEQ ID NO: 372602 - protein, 31 aa, Mycobacterium
VEAVPVALRLFVFAAVVMLLGIVGAIASNDA

SEQ ID NO: 372603 - protein, 25 aa, Mycobacterium
VEAYAVIALALFVNWLRVLVAHRYE

SEQ ID NO: 372604 - protein, 28 aa, Mycobacterium
VEDQLFRFSRILDTQPRLAILLGDYAVP

SEQ ID NO: 372605 - protein, 23 aa, Mycobacterium
VEDRMLCVLFLALSYAIGTSYLA

SEQ ID NO: 372606 - protein, 28 aa, Mycobacterium
VEEQYYFVWPVLLIAVTLLLAARARRRF

SEQ ID NO: 372607 - protein, 25 aa, Mycobacterium
VEERRFDWLLFDDHSYFPADTPDAV

SEQ ID NO: 372608 - protein, 22 aa, Mycobacterium
VEEVDFIFRVGPVSFMVALLAG

SEQ ID NO: 372609 - protein, 30 aa, Mycobacterium
VEGLAALIFFRYLWAFELTSALLITAAIGA

SEQ ID NO: 372610 - protein, 22 aa, Mycobacterium
VEGRRLTLGRLRLLSDRSFEIP

SEQ ID NO: 372611 - protein, 20 aa, Mycobacterium
VEGRVQLMVPAEWAVRRIPA

SEQ ID NO: 372612 - protein, 18 aa, Mycobacterium
VEHALNFWAALHVVGCRE

SEQ ID NO: 372613 - protein, 32 aa, Mycobacterium
VEIDGEIVLLLFLPAILYWESLNTSFREIRWN

SEQ ID NO: 372614 - protein, 26 aa, Mycobacterium
VEIGILVAAFFALRSVARRSSVVREE

SEQ ID NO: 372615 - protein, 27 aa, Mycobacterium
VEIPKDYIALFAIAPLVLIVPALLGGL

SEQ ID NO: 372616 - protein, 17 aa, Mycobacterium
VEIPLVCYLVAPERTRA

SEQ ID NO: 372617 - protein, 21 aa, Mycobacterium
VEITALRLLAPYLGLTLETST

SEQ ID NO: 372618 - protein, 19 aa, Mycobacterium
VEKPLWSSFVWRNEVADTF

SEQ ID NO: 372619 - protein, 18 aa, Mycobacterium
VEKTLTWAQLYRKVINVA

SEQ ID NO: 372620 - protein, 23 aa, Mycobacterium
VEKVWLRFVLSVTCALGVATAVI

SEQ ID NO: 372621 - protein, 36 aa, Mycobacterium
VELGAMAYSLYLWHWPLLIFWLSYTGHKHATFLEGA

SEQ ID NO: 372622 - protein, 36 aa, Mycobacterium
VELGDLRWFYVYSGVMWAIVFMRTGARRVHFGELEK

SEQ ID NO: 372623 - protein, 17 aa, Mycobacterium
VELHWMVLAMSVILLLA

SEQ ID NO: 372624 - protein, 22 aa, Mycobacterium
VELHWMVLVMSIIALIAVGSDY

SEQ ID NO: 372625 - protein, 27 aa, Mycobacterium
VELLKLAVVLALWAAVAGAFVSVLYRR

SEQ ID NO: 372626 - protein, 18 aa, Mycobacterium
VELMYFLAVPIAVVGVLV

SEQ ID NO: 372627 - protein, 28 aa, Mycobacterium
VELRGPIGGWFVWRPEERSQILLIAGGS

SEQ ID NO: 372628 - protein, 26 aa, Mycobacterium
VELRLPRELPVLAPGQEWRLVWDSAL

SEQ ID NO: 372629 - protein, 17 aa, Mycobacterium
VELVTTVFFLKAALIIP

SEQ ID NO: 372630 - protein, 18 aa, Mycobacterium
VEMAIFMLTVFVAYAYVW

SEQ ID NO: 372631 - protein, 18 aa, Mycobacterium
VEMLIFMLTVFVAYAYVW

SEQ ID NO: 372632 - protein, 18 aa, Mycobacterium
VEMMIFTVFLALSAVGMG

SEQ ID NO: 372633 - protein, 18 aa, Mycobacterium
VEPALLRIRSFVAGSALT

SEQ ID NO: 372634 - protein, 17 aa, Mycobacterium
VEPTILLAVFALSMPAG

SEQ ID NO: 372635 - protein, 21 aa, Mycobacterium
VEQFRLVLQPMMIAGAAALAA

SEQ ID NO: 372636 - protein, 17 aa, Mycobacterium
VEQLLAVPSLAAVLADE

SEQ ID NO: 372637 - protein, 34 aa, Mycobacterium
VERPPVTVAHFLPPVLRRLSIFVPPSPSVAESDA

SEQ ID NO: 372638 - protein, 21 aa, Mycobacterium
VERVPLVVKDFPDGPHLFDRD

SEQ ID NO: 372639 - protein, 22 aa, Mycobacterium
VESLPVSYYPPTRLHLVDTSIN

SEQ ID NO: 372640 - protein, 20 aa, Mycobacterium
VESMISTMAQLYVYGHDLDI

SEQ ID NO: 372641 - protein, 33 aa, Mycobacterium
VESRVPEPILPPRLFRDPVFTICCVLSFVVGFA

SEQ ID NO: 372642 - protein, 25 aa, Mycobacterium
VESTPLPWSLTLQTTLPSVMPHIMA

SEQ ID NO: 372643 - protein, 19 aa, Mycobacterium
VETLGWRSVFAVNVPLGAI

SEQ ID NO: 372644 - protein, 21 aa, Mycobacterium
VEVAPGITIPVGPPTTVTLAP

SEQ ID NO: 372645 - protein, 25 aa, Mycobacterium
VEVGLPAWIFVPATLGALFVVIPLV

SEQ ID NO: 372646 - protein, 24 aa, Mycobacterium
VEVGQFIRRLFSFLVRQLDRIAPF

SEQ ID NO: 372647 - protein, 19 aa, Mycobacterium
VEVGWDGLSMRLVAVRTGV

SEQ ID NO: 372648 - protein, 27 aa, Mycobacterium
VEVMNALLLPIVLGLLLVLEARALPEQ

SEQ ID NO: 372649 - protein, 23 aa, Mycobacterium
VEVPVQLPPVPPPVAVVPHMAPP

SEQ ID NO: 372650 - protein, 18 aa, Mycobacterium
VEVTFYAALPLLAYVLLV

SEQ ID NO: 372651 - protein, 23 aa, Mycobacterium
VEWDTLLFFAGLFIMVGALVKTG

SEQ ID NO: 372652 - protein, 26 aa, Mycobacterium
VEWLEVLAMIVFLPAAAALGGLFAWI

SEQ ID NO: 372653 - protein, 29 aa, Mycobacterium
VEYVLAWVFACVLIALLLAMFEPRPLIVA

SEQ ID NO: 372654 - protein, 23 aa, Mycobacterium
VFAAAPNFAFDLAAQRGLPPAGE

SEQ ID NO: 372655 - protein, 21 aa, Mycobacterium
VFAALWPMSLALFVQLFVGRH

SEQ ID NO: 372656 - protein, 21 aa, Mycobacterium
VFAAVVFLAGGLFALRFPVFI

SEQ ID NO: 372657 - protein, 25 aa, Mycobacterium
VFAIIGMTCYIAILGLTGALTSAMF

SEQ ID NO: 372658 - protein, 22 aa, Mycobacterium
VFALFGVLWILVASIVGAALTG

SEQ ID NO: 372659 - protein, 24 aa, Mycobacterium
VFALMPFWRMLFNTVLYAGCVTAG

SEQ ID NO: 372660 - protein, 17 aa, Mycobacterium
VFAPFRPAGKGLTYAAI

SEQ ID NO: 372661 - protein, 19 aa, Mycobacterium
VFAPLTAALGSHLSWRQTY

SEQ ID NO: 372662 - protein, 25 aa, Mycobacterium
VFAVAMVLLIWQLVYLSGWKPSFVL

SEQ ID NO: 372663 - protein, 25 aa, Mycobacterium
VFAVGIPFANAWYPAARRGFATGVF

SEQ ID NO: 372664 - protein, 20 aa, Mycobacterium
VFAWLALVFGVGFSMLALVT

SEQ ID NO: 372665 - protein, 17 aa, Mycobacterium
VFAYRFTRTAALPVVLA

SEQ ID NO: 372666 - protein, 24 aa, Mycobacterium
VFCLNFTRLPYFQPLGIPCAIGIT

SEQ ID NO: 372667 - protein, 24 aa, Mycobacterium
VFDDAPWWITFAASPAYIALALAV

SEQ ID NO: 372668 - protein, 42 aa, Mycobacterium
VFDIREAAWLSWPGFVWLALVFYLVLTLLVLEPVRLVLRRWV

SEQ ID NO: 372669 - protein, 18 aa, Mycobacterium
VFDLLAPAAAIAALVYIG

SEQ ID NO: 372670 - protein, 18 aa, Mycobacterium
VFDLLKRYHAGVEQLLVF

SEQ ID NO: 372671 - protein, 17 aa, Mycobacterium
VFDLVVTAGVYALVGFE

SEQ ID NO: 372672 - protein, 19 aa, Mycobacterium
VFDNLTKFITWTLPTNIGE

SEQ ID NO: 372673 - protein, 23 aa, Mycobacterium
VFDPAQLIKALPLAVRKLDPRHM

SEQ ID NO: 372674 - protein, 17 aa, Mycobacterium
VFDPLLVVAAVIEWILG

SEQ ID NO: 372675 - protein, 19 aa, Mycobacterium
VFFHGPRLHLVHIAWCTAS

SEQ ID NO: 372676 - protein, 48 aa, Mycobacterium
VFFIAALVVLFYSTFFFFFFVAELLDTWLWRWAAFLIVFGAQVVVGAL

SEQ ID NO: 372677 - protein, 26 aa, Mycobacterium
VFFLASGLLFILPILSTGPLPVRQSN

SEQ ID NO: 372678 - protein, 27 aa, Mycobacterium
VFFSELRSANWWWALVGLAVSALKYLG

SEQ ID NO: 372679 - protein, 17 aa, Mycobacterium
VFFSSFAIALVPLVWLL

SEQ ID NO: 372680 - protein, 27 aa, Mycobacterium
VFFVISGFLITGLLWREATTAGTVRLS

SEQ ID NO: 372681 - protein, 25 aa, Mycobacterium
VFFVLSGFLLFRPWVAAAAEGRRGP

SEQ ID NO: 372682 - protein, 24 aa, Mycobacterium
VFGAKFVELVPPAEPSPRPLRSGQ

SEQ ID NO: 372683 - protein, 25 aa, Mycobacterium
VFGCTPVGPLGWGQALLAAAVAGGI

SEQ ID NO: 372684 - protein, 22 aa, Mycobacterium
VFGFVIPVWAILAAMGLVIPNA

SEQ ID NO: 372685 - protein, 20 aa, Mycobacterium
VFGGSLNWSLVGLGALIGIV

SEQ ID NO: 372686 - protein, 21 aa, Mycobacterium
VFGIALTITSGSLYLLHVMTP

SEQ ID NO: 372687 - protein, 33 aa, Mycobacterium
VFGIGLGRAAWFTILAFWFFAIGWAASKSSTVW

SEQ ID NO: 372688 - protein, 39 aa, Mycobacterium
VFGLACFVPLLPWIGTLVGPVPWLVLATTSALFPGLFGL

SEQ ID NO: 372689 - protein, 19 aa, Mycobacterium
VFGLLIAWVLIRDEFVGKR

SEQ ID NO: 372690 - protein, 20 aa, Mycobacterium
VFGLPLFLWGVRLLRRALRD

SEQ ID NO: 372691 - protein, 19 aa, Mycobacterium
VFGLRRWYTLTLAMGTFFV

SEQ ID NO: 372692 - protein, 18 aa, Mycobacterium
VFGLWGGALADRMDRRTL

SEQ ID NO: 372693 - protein, 17 aa, Mycobacterium
VFGNKYVALSSPPAPAG

SEQ ID NO: 372694 - protein, 18 aa, Mycobacterium
VFGQTWVPQALAKRVGHS

SEQ ID NO: 372695 - protein, 20 aa, Mycobacterium
VFGWALVPYILISAIFGFTL

SEQ ID NO: 372696 - protein, 19 aa, Mycobacterium
VFGWQVLPFLIIQAFYGAS

SEQ ID NO: 372697 - protein, 27 aa, Mycobacterium
VFGYVAFYFAPFFPAIWCLRKLQAKHG

SEQ ID NO: 372698 - protein, 24 aa, Mycobacterium
VFHNIAFPGFYLLLSAASTVYMAQ

SEQ ID NO: 372699 - protein, 28 aa, Mycobacterium
VFIETGLLFPFLPGDTLLFSAGLIAAQP

SEQ ID NO: 372700 - protein, 20 aa, Mycobacterium
VFIGMLFVYRSGAIRVTPKF

SEQ ID NO: 372701 - protein, 24 aa, Mycobacterium
VFITAVVIFLLLLAGAIACGIGLL

SEQ ID NO: 372702 - protein, 20 aa, Mycobacterium
VFIVYGVLTLTIFISGLLFA

SEQ ID NO: 372703 - protein, 19 aa, Mycobacterium
VFKAAAWVAIVAGIVFIVS

SEQ ID NO: 372704 - protein, 18 aa, Mycobacterium
VFLAAWVPLFASFGAMLV

SEQ ID NO: 372705 - protein, 18 aa, Mycobacterium
VFLGIATFAIIRIKRNPR

SEQ ID NO: 372706 - protein, 17 aa, Mycobacterium
VFLISRYHDFLRSGHGY

SEQ ID NO: 372707 - protein, 19 aa, Mycobacterium
VFLISRYHDYVRKGQDSDL

SEQ ID NO: 372708 - protein, 18 aa, Mycobacterium
VFLLISILVGNPVQQAFV

SEQ ID NO: 372709 - protein, 18 aa, Mycobacterium
VFLLSRIREYWLASEQGA

SEQ ID NO: 372710 - protein, 18 aa, Mycobacterium
VFLLYFLLRRDGRAALTA

SEQ ID NO: 372711 - protein, 25 aa, Mycobacterium
VFLVGWRGARWWRRGVAVLSIPLCV

SEQ ID NO: 372712 - protein, 17 aa, Mycobacterium
VFLVSMDVSVLFLAMPR

SEQ ID NO: 372713 - protein, 19 aa, Mycobacterium
VFLVSRIREYWLASQTTLE

SEQ ID NO: 372714 - protein, 17 aa, Mycobacterium
VFLVVLVAAVAVVHVPF

SEQ ID NO: 372715 - protein, 18 aa, Mycobacterium
VFMTPVLVMLLMQTTGEA

SEQ ID NO: 372716 - protein, 25 aa, Mycobacterium
VFNMWALYIVGPPLEMWLGRLRFGG

SEQ ID NO: 372717 - protein, 18 aa, Mycobacterium
VFNRLFFTDLDPAAATLA

SEQ ID NO: 372718 - protein, 18 aa, Mycobacterium
VFPAVFYPGLSPALATIA

SEQ ID NO: 372719 - protein, 20 aa, Mycobacterium
VFPIGIIDRPFKHDQPPWTV

SEQ ID NO: 372720 - protein, 18 aa, Mycobacterium
VFPLPVDIITPFLRHPEV

SEQ ID NO: 372721 - protein, 18 aa, Mycobacterium
VFPRWLAVATPWTAIPLA

SEQ ID NO: 372722 - protein, 21 aa, Mycobacterium
VFQRSAPWVLPKFDRQYGGRH

SEQ ID NO: 372723 - protein, 20 aa, Mycobacterium
VFRIVIFYIGSTVLLALLLP

SEQ ID NO: 372724 - protein, 34 aa, Mycobacterium
VFRMGHVRPLYQPGLRFLIPLADKMIRVDQRLVT

SEQ ID NO: 372725 - protein, 26 aa, Mycobacterium
VFSAIPAPLMAMVFDMVYQPGKLPDS

SEQ ID NO: 372726 - protein, 32 aa, Mycobacterium
VFSDLVMMKYLAFGLLIALLLDATIIRMFLVP

SEQ ID NO: 372727 - protein, 18 aa, Mycobacterium
VFSLLNWGLGLVAGALVA

SEQ ID NO: 372728 - protein, 25 aa, Mycobacterium
VFSTLYLPLLAILFGMILRAVAIEW

SEQ ID NO: 372729 - protein, 24 aa, Mycobacterium
VFSTLYLPLLAILFGMIVRAVAIE

SEQ ID NO: 372730 - protein, 54 aa, Mycobacterium
VFSVVMIFACLFFAVYFMQVTYSLMTFWITTMLALLYGLLGKFTFGVLMLRIEE

SEQ ID NO: 372731 - protein, 20 aa, Mycobacterium
VFSYDLWQRYIRKDRPDGYY

SEQ ID NO: 372732 - protein, 25 aa, Mycobacterium
VFTAYFGFYLFYRGRSPELFSGAQA

SEQ ID NO: 372733 - protein, 26 aa, Mycobacterium
VFTDAPWWVTFVVAPAYIVVALVLGT

SEQ ID NO: 372734 - protein, 18 aa, Mycobacterium
VFTFFTRLVGRVNRAEFI

SEQ ID NO: 372735 - protein, 24 aa, Mycobacterium
VFTLMPFWRMFFNTVLYAGCVTAG

SEQ ID NO: 372736 - protein, 19 aa, Mycobacterium
VFTNHVVRLPIGLLDRGRS

SEQ ID NO: 372737 - protein, 31 aa, Mycobacterium
VFTPKVVAAWRPWLGVLGGVLILLIGISRVL

SEQ ID NO: 372738 - protein, 23 aa, Mycobacterium
VFTQLLLLPVAWYLSVGSRQPAF

SEQ ID NO: 372739 - protein, 27 aa, Mycobacterium
VFTRINAILGVLFVIVLSTGSLINGAF

SEQ ID NO: 372740 - protein, 25 aa, Mycobacterium
VFTRINAILGVLFVIVLSTGSVING

SEQ ID NO: 372741 - protein, 28 aa, Mycobacterium
VFTRINAILGVLLLIVLATGSLINGMFG

SEQ ID NO: 372742 - protein, 33 aa, Mycobacterium
VFTSRVELLRLAVILALWAAVVAAFVSVIYRRQ

SEQ ID NO: 372743 - protein, 29 aa, Mycobacterium
VFTVLTTLGSLIWNCVFIGAGYGLGANWH

SEQ ID NO: 372744 - protein, 19 aa, Mycobacterium
VFTVNQLLHGLLMHSGNDA

SEQ ID NO: 372745 - protein, 26 aa, Mycobacterium
VFVAALIVAIRRLARRRTAFFVPLLG

SEQ ID NO: 372746 - protein, 24 aa, Mycobacterium
VFVAAWIPLFASFGALLVYPDNGA

SEQ ID NO: 372747 - protein, 25 aa, Mycobacterium
VFVAFLIPFLDLGIIQSPMLRPIPQ

SEQ ID NO: 372748 - protein, 25 aa, Mycobacterium
VFVAFQLMFAIITVALISGAVSDRL

SEQ ID NO: 372749 - protein, 18 aa, Mycobacterium
VFVFPGQGSQWAGMGAQL

SEQ ID NO: 372750 - protein, 19 aa, Mycobacterium
VFVGPFILIAAVTGLLYAL

SEQ ID NO: 372751 - protein, 30 aa, Mycobacterium
VFVGVLTLAALWFWLPEQLRTMHISSPLTE

SEQ ID NO: 372752 - protein, 17 aa, Mycobacterium
VFVIGVVALVISLAVSI

SEQ ID NO: 372753 - protein, 29 aa, Mycobacterium
VFVNSLVSLFYYLRWIIPSFQRPAEGMSN

SEQ ID NO: 372754 - protein, 18 aa, Mycobacterium
VFVTDLTVERLRAAVAGV

SEQ ID NO: 372755 - protein, 17 aa, Mycobacterium
VFVVAALVNRGLCPRGW

SEQ ID NO: 372756 - protein, 28 aa, Mycobacterium
VFVYSGRGWQWPGMGRQLLADEPAFAEA

SEQ ID NO: 372757 - protein, 17 aa, Mycobacterium
VFWAAVTAVLAAWGWFA

SEQ ID NO: 372758 - protein, 17 aa, Mycobacterium
VFWALSWCTRPWPSLRR

SEQ ID NO: 372759 - protein, 20 aa, Mycobacterium
VFYALLAPVDWVVVLLITAG

SEQ ID NO: 372760 - protein, 22 aa, Mycobacterium
VFYNIFFVVFFLVTRTQPPPDP

SEQ ID NO: 372761 - protein, 22 aa, Mycobacterium
VFYPLTLLPFDVVAFGWQIATM

SEQ ID NO: 372762 - protein, 19 aa, Mycobacterium
VFYTDELHWGPLGLALVPL

SEQ ID NO: 372763 - protein, 30 aa, Mycobacterium
VGAAFLATLAFLRYRWLRGEPLPPQRITRH

SEQ ID NO: 372764 - protein, 34 aa, Mycobacterium
VGAAILVALILVLWVARSLVRPLRTLRDSALRVA

SEQ ID NO: 372765 - protein, 22 aa, Mycobacterium
VGAALWLPWLIAAGVAFVITSV

SEQ ID NO: 372766 - protein, 28 aa, Mycobacterium
VGAAVATMWLLMLGQVSAAGIGGAGVPD

SEQ ID NO: 372767 - protein, 22 aa, Mycobacterium
VGAAVVWWGWRERRDLFSGFGW

SEQ ID NO: 372768 - protein, 24 aa, Mycobacterium
VGAAWAWVAPPIKGVIALTRTGDR

SEQ ID NO: 372769 - protein, 39 aa, Mycobacterium
VGACGLMLARWWGSEQLGLLVFVPLIALAPVITDGVTLL

SEQ ID NO: 372770 - protein, 19 aa, Mycobacterium
VGAFAPMWPVPAGAVRTLV

SEQ ID NO: 372771 - protein, 18 aa, Mycobacterium
VGAFLIYTTMTMTIAQRR

SEQ ID NO: 372772 - protein, 22 aa, Mycobacterium
VGAFVRKLPHAGRPRMIAVDAV

SEQ ID NO: 372773 - protein, 26 aa, Mycobacterium
VGAIAIFILFLIVAPPFRSPESMATV

SEQ ID NO: 372774 - protein, 26 aa, Mycobacterium
VGAITYWLVHMIGGYPGAIIGFALLC

SEQ ID NO: 372775 - protein, 22 aa, Mycobacterium
VGAKLVFMVIWLGAATSKLNKH

SEQ ID NO: 372776 - protein, 26 aa, Mycobacterium
VGALAILVMVVWVGTALTISTTASRS

SEQ ID NO: 372777 - protein, 23 aa, Mycobacterium
VGALFVLGFLRFGLPPSDRVELT

SEQ ID NO: 372778 - protein, 26 aa, Mycobacterium
VGALGILVMVVWVGTALTLSTAASRI

SEQ ID NO: 372779 - protein, 34 aa, Mycobacterium
VGALIIFVVLLFVYRSILTVILLLVTVGIEVLAA

SEQ ID NO: 372780 - protein, 20 aa, Mycobacterium
VGALLVMSLLITPAAAAARV

SEQ ID NO: 372781 - protein, 21 aa, Mycobacterium
VGALLVYWRYGALDFDTVPLA

SEQ ID NO: 372782 - protein, 30 aa, Mycobacterium
VGALVLGWWIAVLVYLLPRRSWLRVAAEDM

SEQ ID NO: 372783 - protein, 23 aa, Mycobacterium
VGALVRIPYAMAANWFGGSTWTT

SEQ ID NO: 372784 - protein, 20 aa, Mycobacterium
VGAMILAIGPGWFGALTAIQ

SEQ ID NO: 372785 - protein, 30 aa, Mycobacterium
VGAPILAIGTLRWPRRRALLAFLGVFVVAH

SEQ ID NO: 372786 - protein, 22 aa, Mycobacterium
VGAPLLGAVFTMVPTRGSSSYS

SEQ ID NO: 372787 - protein, 24 aa, Mycobacterium
VGAPVNYMKLMPATYLVLVVVVGY

SEQ ID NO: 372788 - protein, 28 aa, Mycobacterium
VGASRWYTQLPFLMEAMLAATLGVVIAI

SEQ ID NO: 372789 - protein, 26 aa, Mycobacterium
VGASRWYTQLPFLVEAMLAAAIGVAI

SEQ ID NO: 372790 - protein, 25 aa, Mycobacterium
VGASRWYTQLPFLVEAMLAASIGVA

SEQ ID NO: 372791 - protein, 24 aa, Mycobacterium
VGASRWYTQLPFLVEAMLAATVGV

SEQ ID NO: 372792 - protein, 43 aa, Mycobacterium
VGATTRIAPAHPWWWFLKSTPGKILMLGIALAAAGVLSAVATS

SEQ ID NO: 372793 - protein, 26 aa, Mycobacterium
VGATVLFLLRRVLLRSTYFTLPRVQI

SEQ ID NO: 372794 - protein, 17 aa, Mycobacterium
VGAVAAFVMAITGFGWA

SEQ ID NO: 372795 - protein, 24 aa, Mycobacterium
VGAVALFYLHVPAAVGIGAYNVTA

SEQ ID NO: 372796 - protein, 17 aa, Mycobacterium
VGAVFFGVALLLGTPPS

SEQ ID NO: 372797 - protein, 25 aa, Mycobacterium
VGAVIIARLLWRWLRPKRQAEQTPS

SEQ ID NO: 372798 - protein, 28 aa, Mycobacterium
VGAVLLAMWYPPYRPGRANYMLLAAAVI

SEQ ID NO: 372799 - protein, 30 aa, Mycobacterium
VGAVLLLLGRPLSVLISLAPFRVPWREQVF

SEQ ID NO: 372800 - protein, 18 aa, Mycobacterium
VGAVPMLLRARRMAETGP

SEQ ID NO: 372801 - protein, 26 aa, Mycobacterium
VGAVTYWIVHLIGGYPGVIVGFGLLV

SEQ ID NO: 372802 - protein, 26 aa, Mycobacterium
VGAVVALLVVVLVAAAALVAGRESDE

SEQ ID NO: 372803 - protein, 17 aa, Mycobacterium
VGAVWSTILAGVNPTWF

SEQ ID NO: 372804 - protein, 21 aa, Mycobacterium
VGAYGPYLAWLTAASADCMAR

SEQ ID NO: 372805 - protein, 24 aa, Mycobacterium
VGAYLFTPLFNWFGRRLGTGLAAT

SEQ ID NO: 372806 - protein, 23 aa, Mycobacterium
VGAYLFTPLFNWFNKRLNAGLSA

SEQ ID NO: 372807 - protein, 23 aa, Mycobacterium
VGAYLFTPLFTWFNKRLSTGLSA

SEQ ID NO: 372808 - protein, 24 aa, Mycobacterium
VGCSLRLPGLYPPGLYNGTLHVDG

SEQ ID NO: 372809 - protein, 18 aa, Mycobacterium
VGDAWHISLTTPAAPTPS

SEQ ID NO: 372810 - protein, 25 aa, Mycobacterium
VGDDEFWMLMAGRKLLARDRRVLTA

SEQ ID NO: 372811 - protein, 21 aa, Mycobacterium
VGDLLSAAVAALPRLQSGKAC

SEQ ID NO: 372812 - protein, 17 aa, Mycobacterium
VGDRLYPALNLASARLI

SEQ ID NO: 372813 - protein, 30 aa, Mycobacterium
VGDRPVQVWSLWSTTLRRLAEGHRAGMIVV

SEQ ID NO: 372814 - protein, 24 aa, Mycobacterium
VGDTVQIWVDRSGAWAPAPPPASS

SEQ ID NO: 372815 - protein, 34 aa, Mycobacterium
VGDVPDPAAAVNNFILLFIGNGTATHPDAGLLIG

SEQ ID NO: 372816 - protein, 22 aa, Mycobacterium
VGEAATLAFLFSISEGLEEYAV

SEQ ID NO: 372817 - protein, 28 aa, Mycobacterium
VGEHRDGRLFGFFGEACVNVLALNLDLD

SEQ ID NO: 372818 - protein, 30 aa, Mycobacterium
VGELPIIIVILIQIILISLEILFAIVAYAI

SEQ ID NO: 372819 - protein, 34 aa, Mycobacterium
VGELPWFIPMAFISLPFLLAFRLTCYYYRKAYYR

SEQ ID NO: 372820 - protein, 27 aa, Mycobacterium
VGENFSRRFVPISFIVSAITLAITGDV

SEQ ID NO: 372821 - protein, 24 aa, Mycobacterium
VGESLWRRVGVTLRLLVIGSLVGT

SEQ ID NO: 372822 - protein, 18 aa, Mycobacterium
VGEVLRYLGFTLKNYRKE

SEQ ID NO: 372823 - protein, 29 aa, Mycobacterium
VGFAAIVFLVVRYVVPPVRRLMAARQATV

SEQ ID NO: 372824 - protein, 17 aa, Mycobacterium
VGFALVLLALVVAGPTP

SEQ ID NO: 372825 - protein, 22 aa, Mycobacterium
VGFCWALFFNGFLGAKLGVFYY

SEQ ID NO: 372826 - protein, 19 aa, Mycobacterium
VGFLALSAPASWGAPEETD

SEQ ID NO: 372827 - protein, 21 aa, Mycobacterium
VGFLVAWQRPLAGKKTFMDLV

SEQ ID NO: 372828 - protein, 24 aa, Mycobacterium
VGFLVCFAATIPLAGWFGDRFGRR

SEQ ID NO: 372829 - protein, 22 aa, Mycobacterium
VGFLVVATLFFALGNAILIIPL

SEQ ID NO: 372830 - protein, 17 aa, Mycobacterium
VGFMAVMFSIYLTNTWL

SEQ ID NO: 372831 - protein, 21 aa, Mycobacterium
VGFQMLMLFGFAGAALWKVGT

SEQ ID NO: 372832 - protein, 23 aa, Mycobacterium
VGFTQMTLLNYLVSQLRLSAPDR

SEQ ID NO: 372833 - protein, 43 aa, Mycobacterium
VGFVNALAILIFLAQIPHLLGVPWLVYPMVAVALVIIVALPKL

SEQ ID NO: 372834 - protein, 19 aa, Mycobacterium
VGFWKVGVRLPLLQGVTFA

SEQ ID NO: 372835 - protein, 25 aa, Mycobacterium
VGGAIALRILFDLPLLLGGIITGLV

SEQ ID NO: 372836 - protein, 25 aa, Mycobacterium
VGGAIALRILFGLPLPIGGIITGVI

SEQ ID NO: 372837 - protein, 25 aa, Mycobacterium
VGGAIALYLLFDLPLLVGGIITGAV

SEQ ID NO: 372838 - protein, 27 aa, Mycobacterium
VGGAIALYLLFDLPLLVGGLITGVVSL

SEQ ID NO: 372839 - protein, 19 aa, Mycobacterium
VGGALAGLGWWLLRRRTDV

SEQ ID NO: 372840 - protein, 22 aa, Mycobacterium
VGGALFLTRAFLASGALRDNSV

SEQ ID NO: 372841 - protein, 48 aa, Mycobacterium
VGGFFRMCVLTGKALFRWPFQWREFVLQCWFIMRVAFLPTIMVSIPLT

SEQ ID NO: 372842 - protein, 23 aa, Mycobacterium
VGGIFYGLRWPDLWPRTFGYHEF

SEQ ID NO: 372843 - protein, 19 aa, Mycobacterium
VGGLAFTYFLVMSTFALAI

SEQ ID NO: 372844 - protein, 24 aa, Mycobacterium
VGGLAFVYFLAMSTVALAIGLVVG

SEQ ID NO: 372845 - protein, 31 aa, Mycobacterium
VGGLARRFALSPIPVYLLAGLSLGKGGILPV

SEQ ID NO: 372846 - protein, 26 aa, Mycobacterium
VGGLGWQWIFFVNVPVGIVGIALAVW

SEQ ID NO: 372847 - protein, 20 aa, Mycobacterium
VGGLLIAVVVMLLGGDPSQV

SEQ ID NO: 372848 - protein, 25 aa, Mycobacterium
VGGLLIQWVGWRAVFWINLPVCVLA

SEQ ID NO: 372849 - protein, 31 aa, Mycobacterium
VGGLLLCASFPTLNWWWAAVIAAALLAWVLT

SEQ ID NO: 372850 - protein, 18 aa, Mycobacterium
VGGLWAWVAPAVHAVVAV

SEQ ID NO: 372851 - protein, 28 aa, Mycobacterium
VGGRMDPVNLLPFLLLGTTFGARLLGIA

SEQ ID NO: 372852 - protein, 21 aa, Mycobacterium
VGGRWLGVAIGLDKCQGAPAE

SEQ ID NO: 372853 - protein, 22 aa, Mycobacterium
VGGSRQIILDRDLQLVVNSLWA

SEQ ID NO: 372854 - protein, 17 aa, Mycobacterium
VGGVGIVLMAIWFHFWQ

SEQ ID NO: 372855 - protein, 24 aa, Mycobacterium
VGGVLLLAPTLRWFVPGDEPTPQQ

SEQ ID NO: 372856 - protein, 23 aa, Mycobacterium
VGGVLPFVWIAWIALRNFRSGTT

SEQ ID NO: 372857 - protein, 32 aa, Mycobacterium
VGGVTVLAIVLWRWRPFRLVSGVAALAGLAWA

SEQ ID NO: 372858 - protein, 33 aa, Mycobacterium
VGGVTVLAVALWRFRWFRLATSWALVAALGCLL

SEQ ID NO: 372859 - protein, 23 aa, Mycobacterium
VGGVWAWIAPPIHAVVALTRAGE

SEQ ID NO: 372860 - protein, 24 aa, Mycobacterium
VGGWPVWVALAVLVEWVLSAVPEV

SEQ ID NO: 372861 - protein, 19 aa, Mycobacterium
VGHFLFAAFLVPPQASGVL

SEQ ID NO: 372862 - protein, 32 aa, Mycobacterium
VGHFTLFHLSLRHTLWWLGSLAALGSFGLQAV

SEQ ID NO: 372863 - protein, 26 aa, Mycobacterium
VGHFTLLHLSLRHGQWWLGSAAALSS

SEQ ID NO: 372864 - protein, 30 aa, Mycobacterium
VGHHRGIIGLLPQTGFPPPGGPAAGTEQQQ

SEQ ID NO: 372865 - protein, 25 aa, Mycobacterium
VGHLTLFGMLLRDTRWWLGGLGDIG

SEQ ID NO: 372866 - protein, 26 aa, Mycobacterium
VGIAFLVPLMLRWDHYLRRGHSRREV

SEQ ID NO: 372867 - protein, 25 aa, Mycobacterium
VGIATFLSYLLARQILHVSGNSTQA

SEQ ID NO: 372868 - protein, 26 aa, Mycobacterium
VGIGAAVLLVLGIAGYAVVHRSLRPL

SEQ ID NO: 372869 - protein, 21 aa, Mycobacterium
VGIGFAFWVKSPRDDWARLPK

SEQ ID NO: 372870 - protein, 26 aa, Mycobacterium
VGIGLWLPWLIFAGVMFVLSSVAGLV

SEQ ID NO: 372871 - protein, 20 aa, Mycobacterium
VGIGPIPWLIEPRWAMASLC

SEQ ID NO: 372872 - protein, 22 aa, Mycobacterium
VGIHPALLDAALHAWLCVGGFG

SEQ ID NO: 372873 - protein, 28 aa, Mycobacterium
VGILARNHRWFLVSLYGAARVGARIIML

SEQ ID NO: 372874 - protein, 38 aa, Mycobacterium
VGILVAGYRVGAWLPTRVALLVVPLLAAGVSGAAVING

SEQ ID NO: 372875 - protein, 18 aa, Mycobacterium
VGIMLRNHPVHVAALLGV

SEQ ID NO: 372876 - protein, 25 aa, Mycobacterium
VGINYLFYMQFEDKPWRVPVAFVIA

SEQ ID NO: 372877 - protein, 27 aa, Mycobacterium
VGIRQHVLTALWWAALAGAAIVAIRLV

SEQ ID NO: 372878 - protein, 23 aa, Mycobacterium
VGITVLTVPLSLLATRAIARRSQ

SEQ ID NO: 372879 - protein, 23 aa, Mycobacterium
VGLAALLSITLLPAVLGVLGRHV

SEQ ID NO: 372880 - protein, 30 aa, Mycobacterium
VGLAAVLLYSLLYYRALGVLIALSLVASGA

SEQ ID NO: 372881 - protein, 24 aa, Mycobacterium
VGLAGFAFAIFTAPRKPRVSGAGD

SEQ ID NO: 372882 - protein, 29 aa, Mycobacterium
VGLALFALVFAGLWLILTKARKKRIAQLE

SEQ ID NO: 372883 - protein, 23 aa, Mycobacterium
VGLALMAIDFRVTAAGAAVVFAV

SEQ ID NO: 372884 - protein, 26 aa, Mycobacterium
VGLALMLSYIWGVRIGGLFTALGITS

SEQ ID NO: 372885 - protein, 17 aa, Mycobacterium
VGLARVHPLLAAGLNLI

SEQ ID NO: 372886 - protein, 25 aa, Mycobacterium
VGLASYLLIGFWYQKPSAAAAAKKA

SEQ ID NO: 372887 - protein, 23 aa, Mycobacterium
VGLFLIFTGFFGFLMGCVIYGPG

SEQ ID NO: 372888 - protein, 18 aa, Mycobacterium
VGLFVLLIVLVEPLGWTI

SEQ ID NO: 372889 - protein, 34 aa, Mycobacterium
VGLGALGAIGLIEWPVLLAVGGGALVLQRIARQQ

SEQ ID NO: 372890 - protein, 24 aa, Mycobacterium
VGLGIVIAVLILLGAGLLAFFKPQ

SEQ ID NO: 372891 - protein, 26 aa, Mycobacterium
VGLGLALLIMPLIGLWAMVATLRAGF

SEQ ID NO: 372892 - protein, 46 aa, Mycobacterium
VGLGLLMDTLIVRSFVVPAIATLLGRWFWWPAVVHDRAASRDTVAR

SEQ ID NO: 372893 - protein, 23 aa, Mycobacterium
VGLHFESILIRGLIQYAFSVPNG

SEQ ID NO: 372894 - protein, 17 aa, Mycobacterium
VGLIDLVLSVVWLSRSR

SEQ ID NO: 372895 - protein, 24 aa, Mycobacterium
VGLIGLIVMVFRFHSWQDDVRDLM

SEQ ID NO: 372896 - protein, 21 aa, Mycobacterium
VGLLAPALLVTLRLLQGLAVG

SEQ ID NO: 372897 - protein, 21 aa, Mycobacterium
VGLLIWFWPHLGQEKLTIPVT

SEQ ID NO: 372898 - protein, 29 aa, Mycobacterium
VGLLPAWKIVLILLLLAVLGLRDKVIFLA

SEQ ID NO: 372899 - protein, 26 aa, Mycobacterium
VGLLRNYVLPLGALLLLMVNATGVPA

SEQ ID NO: 372900 - protein, 19 aa, Mycobacterium
VGLLTLPGYHTTYNDRIYL

SEQ ID NO: 372901 - protein, 33 aa, Mycobacterium
VGLQAKYPLATVGFLILVAATFLALIQAFNALF

SEQ ID NO: 372902 - protein, 20 aa, Mycobacterium
VGLQPERLLQWATSVRHQAL

SEQ ID NO: 372903 - protein, 26 aa, Mycobacterium
VGLRRMKLVALGFLVGATIVFLACRW

SEQ ID NO: 372904 - protein, 17 aa, Mycobacterium
VGLRRQLRTLAGFGSMF

SEQ ID NO: 372905 - protein, 27 aa, Mycobacterium
VGLTVNLMIYWRLWAKYKASTELSGGA

SEQ ID NO: 372906 - protein, 18 aa, Mycobacterium
VGLVAPFVWVYASNVDGS

SEQ ID NO: 372907 - protein, 18 aa, Mycobacterium
VGLVARPLDRRPKGAIIG

SEQ ID NO: 372908 - protein, 27 aa, Mycobacterium
VGMALLSPALVLLLYGLSALPARGTIG

SEQ ID NO: 372909 - protein, 23 aa, Mycobacterium
VGMALYLDLRLTVPGGAVLPAAG

SEQ ID NO: 372910 - protein, 21 aa, Mycobacterium
VGMIAFFVTSGSFGGGAGGGM

SEQ ID NO: 372911 - protein, 22 aa, Mycobacterium
VGMLMLLILTSVAVPLFFSRDD

SEQ ID NO: 372912 - protein, 18 aa, Mycobacterium
VGNNFVWAHQRAMHLAAQ

SEQ ID NO: 372913 - protein, 21 aa, Mycobacterium
VGNTVGWRFALAGWIVTAGVY

SEQ ID NO: 372914 - protein, 25 aa, Mycobacterium
VGNVILMLGIPLALGSYWGLVIVPP

SEQ ID NO: 372915 - protein, 27 aa, Mycobacterium
VGPAQIVFWIAFDGFFFGLTYGLLQIV

SEQ ID NO: 372916 - protein, 18 aa, Mycobacterium
VGPEIIDHWPTDGHGAID

SEQ ID NO: 372917 - protein, 32 aa, Mycobacterium
VGPGLLSRFLIALEVLWWAPGAFLEAIVTGQY

SEQ ID NO: 372918 - protein, 25 aa, Mycobacterium
VGPGVLVVPVVWVLLGVLGVLVVVR

SEQ ID NO: 372919 - protein, 17 aa, Mycobacterium
VGPLCEEILYRGLLWGA

SEQ ID NO: 372920 - protein, 22 aa, Mycobacterium
VGPQHLAAPLVLAPPKVGRDMT

SEQ ID NO: 372921 - protein, 17 aa, Mycobacterium
VGPRFFPIVIGVALLVM

SEQ ID NO: 372922 - protein, 18 aa, Mycobacterium
VGPRPLVRALLYHPQRGV

SEQ ID NO: 372923 - protein, 25 aa, Mycobacterium
VGPTIAWYQDFLRYYFLTVESNADG

SEQ ID NO: 372924 - protein, 26 aa, Mycobacterium
VGPTIAWYQDFLRYYFLTVETNIDGS

SEQ ID NO: 372925 - protein, 27 aa, Mycobacterium
VGPTIAWYQDWLRYYFLTVESNPDGSM

SEQ ID NO: 372926 - protein, 24 aa, Mycobacterium
VGPTIPWYQEFLRYYFLTVEDSVD

SEQ ID NO: 372927 - protein, 25 aa, Mycobacterium
VGPVVATPIMRWLREVDGPTGQFNQ

SEQ ID NO: 372928 - protein, 22 aa, Mycobacterium
VGPYRLQRLLGKGGMGEVYEAY

SEQ ID NO: 372929 - protein, 19 aa, Mycobacterium
VGPYTRYGLPLVAACAAAG

SEQ ID NO: 372930 - protein, 27 aa, Mycobacterium
VGQLITVIGLAQFLIEPFSLLAVVPSW

SEQ ID NO: 372931 - protein, 29 aa, Mycobacterium
VGQLVGQGAMWLWNNAIQPAWDGIKNAIS

SEQ ID NO: 372932 - protein, 24 aa, Mycobacterium
VGQPATPPLPMPFPRTGQGGEPRM

SEQ ID NO: 372933 - protein, 26 aa, Mycobacterium
VGQPGTPALPIPYPRTGQGGDPKLTL

SEQ ID NO: 372934 - protein, 24 aa, Mycobacterium
VGQRRTWLVVRLDALASARAIVWR

SEQ ID NO: 372935 - protein, 32 aa, Mycobacterium
VGQTLLTYNPALEQLLVLFPGIIAAQQSFGLP

SEQ ID NO: 372936 - protein, 19 aa, Mycobacterium
VGQTVLFPGAGFVELAIRA

SEQ ID NO: 372937 - protein, 17 aa, Mycobacterium
VGQWLAALLFGGALLAE

SEQ ID NO: 372938 - protein, 24 aa, Mycobacterium
VGQYTLYAELPRSGGLYPTGNVTY

SEQ ID NO: 372939 - protein, 29 aa, Mycobacterium
VGRDRWFNLLWLIPIGFGLLIASVAIGKG

SEQ ID NO: 372940 - protein, 23 aa, Mycobacterium
VGRESIPVWTLLGVLLLSVMVSV

SEQ ID NO: 372941 - protein, 24 aa, Mycobacterium
VGRHLRVLLIVLLSALTIASFVYA

SEQ ID NO: 372942 - protein, 24 aa, Mycobacterium
VGRKPLLLFFGFGGVVYTYVLITY

SEQ ID NO: 372943 - protein, 23 aa, Mycobacterium
VGRMPIGMLIPTAALIVVGLVLT

SEQ ID NO: 372944 - protein, 28 aa, Mycobacterium
VGRPWASWMMPKMISPIRTAINTPQPAN

SEQ ID NO: 372945 - protein, 25 aa, Mycobacterium
VGRRTLYMLITTWDAAGGGPFAASA

SEQ ID NO: 372946 - protein, 19 aa, Mycobacterium
VGRRVLLIIGLTAAGVATA

SEQ ID NO: 372947 - protein, 32 aa, Mycobacterium
VGRTLALALALYVVASLLIWTQARLLNVTVQR

SEQ ID NO: 372948 - protein, 33 aa, Mycobacterium
VGRTLALALGLYLVAALLVWVQARLLNVTVQRT

SEQ ID NO: 372949 - protein, 22 aa, Mycobacterium
VGRVLLVCRVALLAVTVVLVAS

SEQ ID NO: 372950 - protein, 26 aa, Mycobacterium
VGSAAAVTLLFGGFGAAVYQSHPGDA

SEQ ID NO: 372951 - protein, 24 aa, Mycobacterium
VGSAIICIIGYRLIHFLNRIGTWV

SEQ ID NO: 372952 - protein, 27 aa, Mycobacterium
VGSCWMLMLLLIAFGTMELAWMLALSI

SEQ ID NO: 372953 - protein, 31 aa, Mycobacterium
VGSFPPPPKPPWWNIIWQLLETLAHVLTQAL

SEQ ID NO: 372954 - protein, 27 aa, Mycobacterium
VGSFVYAPLFPIRFLPGVDAPSGPITV

SEQ ID NO: 372955 - protein, 26 aa, Mycobacterium
VGSGGMPGIVPYLISPSGQQVQLPKK

SEQ ID NO: 372956 - protein, 25 aa, Mycobacterium
VGSGPGFQINLYGLPPAAISEVLLD

SEQ ID NO: 372957 - protein, 28 aa, Mycobacterium
VGSGPGFQINLYGLPPAPIAEVLLDTYF

SEQ ID NO: 372958 - protein, 25 aa, Mycobacterium
VGSGTLITFPTLVALGFPPVTATMS

SEQ ID NO: 372959 - protein, 27 aa, Mycobacterium
VGSKSALFLIAVLGVSLLGGVSTALVS

SEQ ID NO: 372960 - protein, 23 aa, Mycobacterium
VGSLIYFVVLVVVVFVAAVVALN

SEQ ID NO: 372961 - protein, 22 aa, Mycobacterium
VGSLLFGFWHIATSLGLTTGNV

SEQ ID NO: 372962 - protein, 24 aa, Mycobacterium
VGSLRPSLSWLWPSGLDFGTQMAP

SEQ ID NO: 372963 - protein, 26 aa, Mycobacterium
VGSMVATPIMLWLKGIEGPIDEFNQT

SEQ ID NO: 372964 - protein, 22 aa, Mycobacterium
VGSRRIRWPAVAIGVAGVAVIL

SEQ ID NO: 372965 - protein, 25 aa, Mycobacterium
VGSVAALGLGLWQMSEKNRPAPVLV

SEQ ID NO: 372966 - protein, 25 aa, Mycobacterium
VGSVALLALLLPYTSYKATESPFVT

SEQ ID NO: 372967 - protein, 24 aa, Mycobacterium
VGTAFVHWLIFQSLYRIGALCPYC

SEQ ID NO: 372968 - protein, 26 aa, Mycobacterium
VGTEPDFLRRWLPGQLLQGIGVGATL

SEQ ID NO: 372969 - protein, 17 aa, Mycobacterium
VGTLFAFVLVSGGVIIL

SEQ ID NO: 372970 - protein, 21 aa, Mycobacterium
VGTLLVHEYLAGALIAVMLAG

SEQ ID NO: 372971 - protein, 18 aa, Mycobacterium
VGTLPLLSPMLAAGTIIL

SEQ ID NO: 372972 - protein, 23 aa, Mycobacterium
VGTMGWLAGLWRDVLGTTVDGPE

SEQ ID NO: 372973 - protein, 29 aa, Mycobacterium
VGTPLTMITALLLYFGWARSDAQSQWMGI

SEQ ID NO: 372974 - protein, 23 aa, Mycobacterium
VGTRPLLAGLLALAGHRPPVAEG

SEQ ID NO: 372975 - protein, 23 aa, Mycobacterium
VGTRPLLTGLLALAGHRPPVAEG

SEQ ID NO: 372976 - protein, 36 aa, Mycobacterium
VGTTIALGLLFDTLIVRSFMMPSVAALMGRWFWWPQ

SEQ ID NO: 372977 - protein, 28 aa, Mycobacterium
VGTTIALGLLFDTLIVRSFMTPAVAALL

SEQ ID NO: 372978 - protein, 28 aa, Mycobacterium
VGTTIALGLLFDTLIVRSFMTPAVAAQL

SEQ ID NO: 372979 - protein, 28 aa, Mycobacterium
VGTTIALGLLFDTLIVRSFMTPAVATLL

SEQ ID NO: 372980 - protein, 30 aa, Mycobacterium
VGTTIGLGLLFDTLIVRAFMTPSIAALLGR

SEQ ID NO: 372981 - protein, 29 aa, Mycobacterium
VGTTISLGLLFDTLIVRAFMTPSIAALLG

SEQ ID NO: 372982 - protein, 23 aa, Mycobacterium
VGTVFVHWLIFESLYRIGSLCPY

SEQ ID NO: 372983 - protein, 26 aa, Mycobacterium
VGTVGLWLESLWIAAVYHYPWPVGMW

SEQ ID NO: 372984 - protein, 26 aa, Mycobacterium
VGTVLGRRYRVGPPVLLIVLGTLLGL

SEQ ID NO: 372985 - protein, 32 aa, Mycobacterium
VGTVLQFIPQIVLLFLLIALLENVGYMARAAF

SEQ ID NO: 372986 - protein, 33 aa, Mycobacterium
VGTVLQFIPQIVLLFLLIALLENVGYMARAAFL

SEQ ID NO: 372987 - protein, 21 aa, Mycobacterium
VGTWIVVVWSIFSLTAGMINQ

SEQ ID NO: 372988 - protein, 18 aa, Mycobacterium
VGVAALVLLLRLIRREST

SEQ ID NO: 372989 - protein, 25 aa, Mycobacterium
VGVACAFLTLLLKQPKLPKSERLAA

SEQ ID NO: 372990 - protein, 27 aa, Mycobacterium
VGVALTFTFLWFVFVGVGDSDPHFPRE

SEQ ID NO: 372991 - protein, 25 aa, Mycobacterium
VGVAVMLFAYMQVPTLLGLGRITVT

SEQ ID NO: 372992 - protein, 25 aa, Mycobacterium
VGVDALFAFFFVANWHFAASGVDAA

SEQ ID NO: 372993 - protein, 19 aa, Mycobacterium
VGVDLCWDEPDLRVRARRI

SEQ ID NO: 372994 - protein, 23 aa, Mycobacterium
VGVDLLFYVYHRTAHRVRLVWAT

SEQ ID NO: 372995 - protein, 29 aa, Mycobacterium
VGVDPVVMWILMPLAVFGSAYVPEIASFI

SEQ ID NO: 372996 - protein, 40 aa, Mycobacterium
VGVEALLRWPHPELGLLYPGTFMPLVREHKLIRPVTDLVI

SEQ ID NO: 372997 - protein, 25 aa, Mycobacterium
VGVFAAKRVLWLTKLIRSGQPLSEG

SEQ ID NO: 372998 - protein, 23 aa, Mycobacterium
VGVGLFYVLVSWLAIVGTGPENA

SEQ ID NO: 372999 - protein, 24 aa, Mycobacterium
VGVGLIEHYFTKPVLLGATNHRLP

SEQ ID NO: 373000 - protein, 21 aa, Mycobacterium
VGVGWITATLLPATGTGLPSE

SEQ ID NO: 373001 - protein, 29 aa, Mycobacterium
VGVIAVMLFFVYRSVLTTLLVLATVLIEM

SEQ ID NO: 373002 - protein, 20 aa, Mycobacterium
VGVILLIVDAIRDRSNRNAG

SEQ ID NO: 373003 - protein, 19 aa, Mycobacterium
VGVLFLLWERFSRTRLIEP

SEQ ID NO: 373004 - protein, 20 aa, Mycobacterium
VGVLIVVFTLVHLVPGDPVR

SEQ ID NO: 373005 - protein, 17 aa, Mycobacterium
VGVLLATKTDLYPHWRE

SEQ ID NO: 373006 - protein, 24 aa, Mycobacterium
VGVLLGCVALFLIERNMDFLTGEA

SEQ ID NO: 373007 - protein, 23 aa, Mycobacterium
VGVLLLLSGILMATTLFPGLNVI

SEQ ID NO: 373008 - protein, 18 aa, Mycobacterium
VGVLLLSQGLRWWCVKSL

SEQ ID NO: 373009 - protein, 26 aa, Mycobacterium
VGVLQAAGLLFFAFAGYARIATLGEE

SEQ ID NO: 373010 - protein, 26 aa, Mycobacterium
VGVLTLTALALWLPVQLRLMRSTSPL

SEQ ID NO: 373011 - protein, 19 aa, Mycobacterium
VGVMTPMGFLRDPISWLRH

SEQ ID NO: 373012 - protein, 19 aa, Mycobacterium
VGVRGRRLQRREFGIRVVV

SEQ ID NO: 373013 - protein, 25 aa, Mycobacterium
VGVVTLVRMLPSALLAPLAATLATS

SEQ ID NO: 373014 - protein, 18 aa, Mycobacterium
VGVWIGLALLIIAQVWDI

SEQ ID NO: 373015 - protein, 39 aa, Mycobacterium
VGWAITHYGIQTPYLALSGLWILTIIGYLLGPETKGKEL

SEQ ID NO: 373016 - protein, 31 aa, Mycobacterium
VGWAVLLDYLFLPLVIWLIGGSYLQDRFPTV

SEQ ID NO: 373017 - protein, 22 aa, Mycobacterium
VGWCVGIFVWTMPVEKLRSIPV

SEQ ID NO: 373018 - protein, 24 aa, Mycobacterium
VGWDVYAFLFATILIEATSALALG

SEQ ID NO: 373019 - protein, 32 aa, Mycobacterium
VGWFVGWIVVASALPILWLVTRHPAVMVGVAL

SEQ ID NO: 373020 - protein, 22 aa, Mycobacterium
VGWGWLALTIVGVPWLLLFAQP

SEQ ID NO: 373021 - protein, 23 aa, Mycobacterium
VGWLRLGALLVLAAAFVGLVINR

SEQ ID NO: 373022 - protein, 29 aa, Mycobacterium
VGWPALRLKGAYFAIATWALAEAVRELTT

SEQ ID NO: 373023 - protein, 17 aa, Mycobacterium
VGWSFVGPRLPVAWRVT

SEQ ID NO: 373024 - protein, 17 aa, Mycobacterium
VGWSHFFNLFLMMFIIR

SEQ ID NO: 373025 - protein, 35 aa, Mycobacterium
VGYFGHMWELYALWTWLAIFLMAGNRRDATVAGGI

SEQ ID NO: 373026 - protein, 25 aa, Mycobacterium
VGYGALLYVLAALPAIRKVGVAVAT

SEQ ID NO: 373027 - protein, 27 aa, Mycobacterium
VGYIDGWVPFWVTIPVNAAVTFVMFTV

SEQ ID NO: 373028 - protein, 25 aa, Mycobacterium
VGYIVGFIALFIFCGAAKGAVYKLI

SEQ ID NO: 373029 - protein, 25 aa, Mycobacterium
VGYKVMATPATLATLRRGSEARLIT

SEQ ID NO: 373030 - protein, 24 aa, Mycobacterium
VGYRTFTAQFLQAAALQPGNPVSV

SEQ ID NO: 373031 - protein, 17 aa, Mycobacterium
VGYTLVFGVLRLINFAH

SEQ ID NO: 373032 - protein, 21 aa, Mycobacterium
VHALFVAYLLITIIDAVARRG

SEQ ID NO: 373033 - protein, 28 aa, Mycobacterium
VHAPGRWEWSPLYFKEISWVGSNAFGVE

SEQ ID NO: 373034 - protein, 27 aa, Mycobacterium
VHDETAGLWTLLRIPTLIACGDHDLMT

SEQ ID NO: 373035 - protein, 24 aa, Mycobacterium
VHFLLSGYLFYWIVIGVDPTPRPI

SEQ ID NO: 373036 - protein, 19 aa, Mycobacterium
VHFLPMATRLKVFSDKFFS

SEQ ID NO: 373037 - protein, 22 aa, Mycobacterium
VHGHFFIHSMIVAGLITVICSF

SEQ ID NO: 373038 - protein, 24 aa, Mycobacterium
VHGHFFVHSLVVAGLITVICGFRS

SEQ ID NO: 373039 - protein, 30 aa, Mycobacterium
VHHVDAVHGFYYLLLRGWFEIVPVTEFWAR

SEQ ID NO: 373040 - protein, 23 aa, Mycobacterium
VHKLAVPVVFAWVGLVVVLSVLV

SEQ ID NO: 373041 - protein, 29 aa, Mycobacterium
VHKLGPVIRLPLVLGIAELLGRIPLPGSA

SEQ ID NO: 373042 - protein, 37 aa, Mycobacterium
VHKLGPVIRLPLVLGLAELLGRIPLPGSAPKPVWLGA

SEQ ID NO: 373043 - protein, 35 aa, Mycobacterium
VHKLPLVLAIIAVVTFVLLFLLTGSVVLPIKALVL

SEQ ID NO: 373044 - protein, 24 aa, Mycobacterium
VHKPVEQLFWYRSTKFVMRRWLPI

SEQ ID NO: 373045 - protein, 18 aa, Mycobacterium
VHLHIAGPGLLPFDSEDR

SEQ ID NO: 373046 - protein, 33 aa, Mycobacterium
VHLTGGFIVVLFAVGWWLLDVVWRPVRGRLADA

SEQ ID NO: 373047 - protein, 21 aa, Mycobacterium
VHNIDYIRPQLFTNSFTPLEV

SEQ ID NO: 373048 - protein, 18 aa, Mycobacterium
VHPGPMPMAPQPPATLLQ

SEQ ID NO: 373049 - protein, 17 aa, Mycobacterium
VHPQGVWLALTIGVLQF

SEQ ID NO: 373050 - protein, 26 aa, Mycobacterium
VHPVAMLGFMILISAAFVAATQAINA

SEQ ID NO: 373051 - protein, 26 aa, Mycobacterium
VHQGQLRRLAVWGPWISVGAAASSAS

SEQ ID NO: 373052 - protein, 26 aa, Mycobacterium
VHRALTCWRWWLAPAALFVALGAWPF

SEQ ID NO: 373053 - protein, 41 aa, Mycobacterium
VHRGRAWLSAGALVFILVVAAAYLFVGALQVNPLAKSYRVT

SEQ ID NO: 373054 - protein, 27 aa, Mycobacterium
VHRPRLWFALVFLMTIAVSFLLSTMMA

SEQ ID NO: 373055 - protein, 25 aa, Mycobacterium
VHRREVVLVTGPWLAGVSAVAAALR

SEQ ID NO: 373056 - protein, 24 aa, Mycobacterium
VHRTPARMFPKVTTLPLGVPTPRI

SEQ ID NO: 373057 - protein, 17 aa, Mycobacterium
VHSFAFPDPPMAICTGE

SEQ ID NO: 373058 - protein, 22 aa, Mycobacterium
VHSIDYIRPQLFTNSFTPLEVT

SEQ ID NO: 373059 - protein, 18 aa, Mycobacterium
VHSIDYVRPQLFTNSFTP

SEQ ID NO: 373060 - protein, 24 aa, Mycobacterium
VHSLTLMGVYLFLGGMAAASCNSA

SEQ ID NO: 373061 - protein, 20 aa, Mycobacterium
VHSSLLVAYLALVVGLGFGL

SEQ ID NO: 373062 - protein, 23 aa, Mycobacterium
VHSVVLLGVVYLATGPVAAIPLA

SEQ ID NO: 373063 - protein, 28 aa, Mycobacterium
VHTPGRWEWSPLYFKEISWVGSNAFGVE

SEQ ID NO: 373064 - protein, 24 aa, Mycobacterium
VHTRLVRPLAALTVLICLAGPGAY

SEQ ID NO: 373065 - protein, 31 aa, Mycobacterium
VHTWQPPNVFDPIVGFPGPGWRTLRSREDQI

SEQ ID NO: 373066 - protein, 18 aa, Mycobacterium
VHVSFWCGIFSLLFSGLM

SEQ ID NO: 373067 - protein, 40 aa, Mycobacterium
VHWAAVRALLVLTAITGVAYPLVIWLAAQVPGLRDKADGS

SEQ ID NO: 373068 - protein, 18 aa, Mycobacterium
VHYGPRAPQLWLPPLEEA

SEQ ID NO: 373069 - protein, 19 aa, Mycobacterium
VIAALGWGVLALVGQHRDA

SEQ ID NO: 373070 - protein, 25 aa, Mycobacterium
VIAAPRLVLGMALLIAIAAALFGVP

SEQ ID NO: 373071 - protein, 24 aa, Mycobacterium
VIAATTIYQWVPAPAGLVLAALVG

SEQ ID NO: 373072 - protein, 22 aa, Mycobacterium
VIAAYFLLRLFNFTLASVAAPA

SEQ ID NO: 373073 - protein, 45 aa, Mycobacterium
VIACGYILFSLPWITWIAFGAWVAIVLVFYLVWGRHHSALNDLPS

SEQ ID NO: 373074 - protein, 25 aa, Mycobacterium
VIADAPWFDLAARPDLDPALVSRTI

SEQ ID NO: 373075 - protein, 25 aa, Mycobacterium
VIAEGPLYFWLPCLACLLALAELHL

SEQ ID NO: 373076 - protein, 26 aa, Mycobacterium
VIAFGVLVVFLLPALRDGAPAVPVAL

SEQ ID NO: 373077 - protein, 25 aa, Mycobacterium
VIAGIIIIVPLYVLTLLLAYGSCAF

SEQ ID NO: 373078 - protein, 25 aa, Mycobacterium
VIAHYPVTTIFLVLAIVGGLLAGWL

SEQ ID NO: 373079 - protein, 23 aa, Mycobacterium
VIALAFFIPLLIGTGGNTGTQIA

SEQ ID NO: 373080 - protein, 20 aa, Mycobacterium
VIALLITMSAVLGLSSYWGC

SEQ ID NO: 373081 - protein, 19 aa, Mycobacterium
VIALLLVRAVGWRLNRLVR

SEQ ID NO: 373082 - protein, 19 aa, Mycobacterium
VIALLVVLGAPFLGVKWGL

SEQ ID NO: 373083 - protein, 19 aa, Mycobacterium
VIALPFFGIISEIVPVFSR

SEQ ID NO: 373084 - protein, 17 aa, Mycobacterium
VIALPFFGIVSEVIPVF

SEQ ID NO: 373085 - protein, 25 aa, Mycobacterium
VIASLAMAMLWLREHWPTRAQSLAC

SEQ ID NO: 373086 - protein, 17 aa, Mycobacterium
VIATLSLLASISPLVRW

SEQ ID NO: 373087 - protein, 20 aa, Mycobacterium
VIATPIWLRKINALTPWHLV

SEQ ID NO: 373088 - protein, 23 aa, Mycobacterium
VIATVMFVVGFYGLYFGGIFDAA

SEQ ID NO: 373089 - protein, 28 aa, Mycobacterium
VIAVFGMRLLFPLVIVWATAGIGPVRAM

SEQ ID NO: 373090 - protein, 26 aa, Mycobacterium
VIAVFGMRLVFPLTIVWVTAGLDPVR

SEQ ID NO: 373091 - protein, 29 aa, Mycobacterium
VIAVFVALIIGLWLLTTYNGFVRIRNLVQ

SEQ ID NO: 373092 - protein, 22 aa, Mycobacterium
VIAVGFYLYKSAPRGSLIWLVL

SEQ ID NO: 373093 - protein, 19 aa, Mycobacterium
VIAVLMIALNFSLSWFATW

SEQ ID NO: 373094 - protein, 25 aa, Mycobacterium
VIAVTAIYEWVPAPVGLALAGVVGA

SEQ ID NO: 373095 - protein, 30 aa, Mycobacterium
VIAVVVGAVLLILTWAYQTATRLDRLHVRY

SEQ ID NO: 373096 - protein, 19 aa, Mycobacterium
VICIFYLVPQYQGAGLALK

SEQ ID NO: 373097 - protein, 29 aa, Mycobacterium
VICSTIGVWLFFYLILRGVKQAAVINRIV

SEQ ID NO: 373098 - protein, 32 aa, Mycobacterium
VICVLTFRERTVWQWAWRAMSWTRRRVRRLQL

SEQ ID NO: 373099 - protein, 17 aa, Mycobacterium
VIDDAMRWLRAPHPDVV

SEQ ID NO: 373100 - protein, 25 aa, Mycobacterium
VIDLAMVRPLPRLPRSLPLADALSR

SEQ ID NO: 373101 - protein, 19 aa, Mycobacterium
VIDLAVRGYLWIAETTGAE

SEQ ID NO: 373102 - protein, 31 aa, Mycobacterium
VIDPAWLLSWPFWPRLLVACVVGFLPIYLAN

SEQ ID NO: 373103 - protein, 17 aa, Mycobacterium
VIDTLVLATGFDLWEAN

SEQ ID NO: 373104 - protein, 18 aa, Mycobacterium
VIDTLVLATGFDLWEANF

SEQ ID NO: 373105 - protein, 28 aa, Mycobacterium
VIDTYGWEWIFLINLPIGITTIVLAAIL

SEQ ID NO: 373106 - protein, 23 aa, Mycobacterium
VIDVTAFQWNWKFGYQKVEFADG

SEQ ID NO: 373107 - protein, 18 aa, Mycobacterium
VIEATWWIRARVLGVKPQ

SEQ ID NO: 373108 - protein, 24 aa, Mycobacterium
VIFATFTFIFFALEGSIMAQGLKL

SEQ ID NO: 373109 - protein, 22 aa, Mycobacterium
VIFILLLLVGFAQLLGYLFVKM

SEQ ID NO: 373110 - protein, 17 aa, Mycobacterium
VIFLRDHRMLSRYGYVC

SEQ ID NO: 373111 - protein, 24 aa, Mycobacterium
VIFNAIIIVALIPLSLRGVRYTPS

SEQ ID NO: 373112 - protein, 25 aa, Mycobacterium
VIFNAVIIVALIPLALRGVRYTPSR

SEQ ID NO: 373113 - protein, 34 aa, Mycobacterium
VIFSNFYPIPKFPFNILPLIFGAILLAGLLRYWY

SEQ ID NO: 373114 - protein, 19 aa, Mycobacterium
VIFVLIYVVAGVLVVSHLP

SEQ ID NO: 373115 - protein, 17 aa, Mycobacterium
VIFVLPSYSEGLPMALL

SEQ ID NO: 373116 - protein, 17 aa, Mycobacterium
VIFVYMIIGFMLFFVMR

SEQ ID NO: 373117 - protein, 18 aa, Mycobacterium
VIGAGFSGLYMLHRLREL

SEQ ID NO: 373118 - protein, 22 aa, Mycobacterium
VIGAIIVFSLIMAARSMNRRPQ

SEQ ID NO: 373119 - protein, 19 aa, Mycobacterium
VIGAILAVGFGGGLLVAPA

SEQ ID NO: 373120 - protein, 24 aa, Mycobacterium
VIGALVGAMLLVKAIGLGYSHYTG

SEQ ID NO: 373121 - protein, 17 aa, Mycobacterium
VIGFSVWLPWLRTSASG

SEQ ID NO: 373122 - protein, 19 aa, Mycobacterium
VIGGFFRMCVLTGRALFRW

SEQ ID NO: 373123 - protein, 17 aa, Mycobacterium
VIGILMLPTIGLRIPLE

SEQ ID NO: 373124 - protein, 18 aa, Mycobacterium
VIGIWAPILLVIARIFQG

SEQ ID NO: 373125 - protein, 25 aa, Mycobacterium
VIGKARFIVWPPGRWGGVSSVNPQQ

SEQ ID NO: 373126 - protein, 25 aa, Mycobacterium
VIGKARFIVWPPSRWGGVESVNPQQ

SEQ ID NO: 373127 - protein, 26 aa, Mycobacterium
VIGLGVAIAFLLIRVIRAPIEARLVS

SEQ ID NO: 373128 - protein, 17 aa, Mycobacterium
VIGMLTYVDTLVFGITA

SEQ ID NO: 373129 - protein, 24 aa, Mycobacterium
VIGSGVDIPLIKPALEAATSLQLS

SEQ ID NO: 373130 - protein, 22 aa, Mycobacterium
VIGSWIIGNLFGVGSLLMGTAA

SEQ ID NO: 373131 - protein, 26 aa, Mycobacterium
VIGTLRRWSMLVIALTSTMCANVFIN

SEQ ID NO: 373132 - protein, 35 aa, Mycobacterium
VIGTVLGRRYRVGPPVLLILLGALLGLVPRFGDVQ

SEQ ID NO: 373133 - protein, 18 aa, Mycobacterium
VIGVMLLVHAIGAGYRHY

SEQ ID NO: 373134 - protein, 23 aa, Mycobacterium
VIGVPWLLSFAQPTIWQIGRPWY

SEQ ID NO: 373135 - protein, 19 aa, Mycobacterium
VIGWFAFQTGLTGATLNLS

SEQ ID NO: 373136 - protein, 24 aa, Mycobacterium
VIHLSMIFFWSWGQLTASMIFGSV

SEQ ID NO: 373137 - protein, 25 aa, Mycobacterium
VIHLSMVFFWGWGELTALMIFGSIR

SEQ ID NO: 373138 - protein, 24 aa, Mycobacterium
VIIGAMLLIVYRSVATMLGMLLTV

SEQ ID NO: 373139 - protein, 23 aa, Mycobacterium
VIIGSLVLVLGLVAAFVGLKLYQ

SEQ ID NO: 373140 - protein, 25 aa, Mycobacterium
VIITQHLSAPPPLISARRPELAHLD

SEQ ID NO: 373141 - protein, 18 aa, Mycobacterium
VIKQNLWASLGIVAVLIP

SEQ ID NO: 373142 - protein, 28 aa, Mycobacterium
VILAFQIYVWIRWITGPYFERVDPGPTD

SEQ ID NO: 373143 - protein, 45 aa, Mycobacterium
VILAIIALQLYDFLWYPYYASYGLLLLPFFTPALSALSALSALAY

SEQ ID NO: 373144 - protein, 27 aa, Mycobacterium
VILAPQGLEYIVGFLGALQAGIIAVPL

SEQ ID NO: 373145 - protein, 38 aa, Mycobacterium
VILAPQGLPYIVAFLGAIQAGLIAVPLMVPQPGTHDER

SEQ ID NO: 373146 - protein, 19 aa, Mycobacterium
VILATLTLLPRAPANGWFG

SEQ ID NO: 373147 - protein, 31 aa, Mycobacterium
VILGLLVIAIMVAWRWAPAKVAPVPGPLVAI

SEQ ID NO: 373148 - protein, 20 aa, Mycobacterium
VILGLYAAAAVLWLVVVIRG

SEQ ID NO: 373149 - protein, 28 aa, Mycobacterium
VILGVLVIVIMVAWRWVPAKARRVPGPL

SEQ ID NO: 373150 - protein, 19 aa, Mycobacterium
VILLPIFTIVDGYRRGLRH

SEQ ID NO: 373151 - protein, 17 aa, Mycobacterium
VILLVCVVGAVATVAAG

SEQ ID NO: 373152 - protein, 17 aa, Mycobacterium
VILLVVLVAIFVRGWRR

SEQ ID NO: 373153 - protein, 28 aa, Mycobacterium
VILMIFTTGLLLAPPSGAQPPFRLASYV

SEQ ID NO: 373154 - protein, 20 aa, Mycobacterium
VILPFFVTFLIRTIAWKTIL

SEQ ID NO: 373155 - protein, 17 aa, Mycobacterium
VILPLLAYLLLVLICRR

SEQ ID NO: 373156 - protein, 18 aa, Mycobacterium
VILRQILTWMLSTAVPVL

SEQ ID NO: 373157 - protein, 23 aa, Mycobacterium
VILRQVLTWVLSTGVPLLAIILA

SEQ ID NO: 373158 - protein, 17 aa, Mycobacterium
VILSIFGFDFDTVGRRK

SEQ ID NO: 373159 - protein, 19 aa, Mycobacterium
VILSLVMVVFSLAAARGVI

SEQ ID NO: 373160 - protein, 17 aa, Mycobacterium
VILVRWLLTAGARWDAQ

SEQ ID NO: 373161 - protein, 23 aa, Mycobacterium
VILVVVMITVLLTNRHGAKPGQS

SEQ ID NO: 373162 - protein, 17 aa, Mycobacterium
VILYRVALPEPLPTHRL

SEQ ID NO: 373163 - protein, 19 aa, Mycobacterium
VIMILLVVGWCVGIFVWTM

SEQ ID NO: 373164 - protein, 23 aa, Mycobacterium
VIMIMLAIVYRSVSTVLLVLFMV

SEQ ID NO: 373165 - protein, 17 aa, Mycobacterium
VINFVVAAILLFPGFFV

SEQ ID NO: 373166 - protein, 23 aa, Mycobacterium
VINTSSVALIWFGGLRIDQGQMQ

SEQ ID NO: 373167 - protein, 22 aa, Mycobacterium
VIPAGSLVLLAWGAANRDPRQY

SEQ ID NO: 373168 - protein, 35 aa, Mycobacterium
VIPAILVVVLAVLYILLRSAFAPLLLVGVTVLSSL

SEQ ID NO: 373169 - protein, 24 aa, Mycobacterium
VIPSRWRAAWVGWWVAAGIASAIV

SEQ ID NO: 373170 - protein, 24 aa, Mycobacterium
VIQPPLVLFVTVPAAYFLMHSSEI

SEQ ID NO: 373171 - protein, 33 aa, Mycobacterium
VIRAFSMLMTAPLFVSWWIAGARYLMANDPTID

SEQ ID NO: 373172 - protein, 25 aa, Mycobacterium
VIREAYRLYRGPIFRGLIPDLTKYL

SEQ ID NO: 373173 - protein, 19 aa, Mycobacterium
VIRLARWKDRLLVGCIAIA

SEQ ID NO: 373174 - protein, 20 aa, Mycobacterium
VIRLVRRLVPALVVVLAGCA

SEQ ID NO: 373175 - protein, 18 aa, Mycobacterium
VIRRAVLTLFPHRGPEVG

SEQ ID NO: 373176 - protein, 19 aa, Mycobacterium
VIRSLWPESGRNRRLAGAV

SEQ ID NO: 373177 - protein, 35 aa, Mycobacterium
VISALVVVLLVARSLVRPLRTLRDGALKVAHEDLA

SEQ ID NO: 373178 - protein, 17 aa, Mycobacterium
VISGPVVMHIYLVAHPA

SEQ ID NO: 373179 - protein, 19 aa, Mycobacterium
VISHLGLPVILIALYVLII

SEQ ID NO: 373180 - protein, 20 aa, Mycobacterium
VISLCIALGVWVTRIFGDVG

SEQ ID NO: 373181 - protein, 24 aa, Mycobacterium
VISRRAMHYLPLVGMALLAAGVVA

SEQ ID NO: 373182 - protein, 27 aa, Mycobacterium
VISRVAMHFLPRWLPNPLRRSGEEAKA

SEQ ID NO: 373183 - protein, 25 aa, Mycobacterium
VISTGLPMMFYTQLALGFSPTKAAL

SEQ ID NO: 373184 - protein, 32 aa, Mycobacterium
VISVLPIIALMVIAVWLLGVGTLMDLALVQLV

SEQ ID NO: 373185 - protein, 23 aa, Mycobacterium
VISWIIVVLVVVLTTVHVVGVLG

SEQ ID NO: 373186 - protein, 23 aa, Mycobacterium
VISYPVALLLLVLAAVPFGGQLS

SEQ ID NO: 373187 - protein, 26 aa, Mycobacterium
VITELLLLPVAWYLTVDSHRPGFGIP

SEQ ID NO: 373188 - protein, 18 aa, Mycobacterium
VITLMYFMFDKVPPRPGA

SEQ ID NO: 373189 - protein, 18 aa, Mycobacterium
VITTPNWIEVPLAMRDSL

SEQ ID NO: 373190 - protein, 19 aa, Mycobacterium
VITTPNWLEVPLAMRDGLG

SEQ ID NO: 373191 - protein, 24 aa, Mycobacterium
VITTTAMVFVICVAALLVAQIFVR

SEQ ID NO: 373192 - protein, 30 aa, Mycobacterium
VIVALVVAMLLYIVCWWRHLRPETAAPPAE

SEQ ID NO: 373193 - protein, 25 aa, Mycobacterium
VIVFTVVMLLVAAGLIITFGEFRFG

SEQ ID NO: 373194 - protein, 20 aa, Mycobacterium
VIVGPPLFREHLNRAGLPHS

SEQ ID NO: 373195 - protein, 27 aa, Mycobacterium
VIVGTLIVVLALVAAFVGWRLYQKLTN

SEQ ID NO: 373196 - protein, 27 aa, Mycobacterium
VIVLLGVDSVFWYLPAILAIGSAVAVT

SEQ ID NO: 373197 - protein, 23 aa, Mycobacterium
VIVLLTGLYVAYYGYYEIRLNFG

SEQ ID NO: 373198 - protein, 22 aa, Mycobacterium
VIVMAFAYLQAPVLLGVGRMTV

SEQ ID NO: 373199 - protein, 20 aa, Mycobacterium
VIVMLNHCYYGFYASGGPVG

SEQ ID NO: 373200 - protein, 17 aa, Mycobacterium
VIVPPIVYFVTYRWCIG

SEQ ID NO: 373201 - protein, 24 aa, Mycobacterium
VIVVALAITPWPRARRRTLVVVAL

SEQ ID NO: 373202 - protein, 24 aa, Mycobacterium
VIVVLAVLTVYLTAPRPGGRMDPD

SEQ ID NO: 373203 - protein, 33 aa, Mycobacterium
VIVVLVIGIVLVVGFWQPGFFVTTKLDVNKANS

SEQ ID NO: 373204 - protein, 25 aa, Mycobacterium
VIVVVPLYCVALLMSFFSVRVITTA

SEQ ID NO: 373205 - protein, 27 aa, Mycobacterium
VIWVTSAYLLAYAVPLLVSGRLGDRYG

SEQ ID NO: 373206 - protein, 18 aa, Mycobacterium
VIYSFVPMLWMISLAFKP

SEQ ID NO: 373207 - protein, 22 aa, Mycobacterium
VKALIYFEAVTTFALLFGLLVG

SEQ ID NO: 373208 - protein, 25 aa, Mycobacterium
VKAPLWPFHRWLPDAAVEATPASAV

SEQ ID NO: 373209 - protein, 25 aa, Mycobacterium
VKAPLWPFHRWLPDAAVESTPATAV

SEQ ID NO: 373210 - protein, 26 aa, Mycobacterium
VKDLLSGFFILAERQYGFGDLVTLTV

SEQ ID NO: 373211 - protein, 25 aa, Mycobacterium
VKDYVAFPLLAGPFAPLVFAGNLTA

SEQ ID NO: 373212 - protein, 28 aa, Mycobacterium
VKEEGLPFWIIFSCAVAIGLGTYLGGWR

SEQ ID NO: 373213 - protein, 21 aa, Mycobacterium
VKFLFQRPFQWREFLEQSWFI

SEQ ID NO: 373214 - protein, 17 aa, Mycobacterium
VKGFLFTTLVFSGAHGF

SEQ ID NO: 373215 - protein, 19 aa, Mycobacterium
VKGRFLAWFYTAVGQVPID

SEQ ID NO: 373216 - protein, 29 aa, Mycobacterium
VKGRIPLEQLAWLSPSRWAYAMAASTVDL

SEQ ID NO: 373217 - protein, 26 aa, Mycobacterium
VKGRPPLEQLAWLSPSRWAYAMAAAT

SEQ ID NO: 373218 - protein, 18 aa, Mycobacterium
VKHFNMFDTWVLAAPAIL

SEQ ID NO: 373219 - protein, 52 aa, Mycobacterium
VKIGKIEFSGFIAWLSWLALHLVYLVGFKNRLVTLILWSIAFVTRSRGQMAI

SEQ ID NO: 373220 - protein, 18 aa, Mycobacterium
VKIPGGALCGKLAVPVDY

SEQ ID NO: 373221 - protein, 17 aa, Mycobacterium
VKIPLAGPYLQLSEGQP

SEQ ID NO: 373222 - protein, 44 aa, Mycobacterium
VKMGHRQRFWLSGMALLATLLVACAYLMVGALRARAFASTYEVS

SEQ ID NO: 373223 - protein, 34 aa, Mycobacterium
VKMTTEWLHVPLLPIPIPIRVPASQAPPSPVSQN

SEQ ID NO: 373224 - protein, 32 aa, Mycobacterium
VKMTTEWLHVPLLPVPIPIQLPANQAPQNPAP

SEQ ID NO: 373225 - protein, 24 aa, Mycobacterium
VKPATLIAALITVALVMVAVVLGV

SEQ ID NO: 373226 - protein, 23 aa, Mycobacterium
VKPHLTPIFAWGAAVIIVVAHVA

SEQ ID NO: 373227 - protein, 22 aa, Mycobacterium
VKQAYGFAYQQALDAQANGSAD

SEQ ID NO: 373228 - protein, 17 aa, Mycobacterium
VKRLAPQRRLSIAVITL

SEQ ID NO: 373229 - protein, 17 aa, Mycobacterium
VKRMAIMANPGIPLVGN

SEQ ID NO: 373230 - protein, 17 aa, Mycobacterium
VKRVVTRRAAVDEVLLV

SEQ ID NO: 373231 - protein, 19 aa, Mycobacterium
VKWDVAAWLLALLGSIVPL

SEQ ID NO: 373232 - protein, 23 aa, Mycobacterium
VKYAAPLLLEYAMEHLAVVLGAR

SEQ ID NO: 373233 - protein, 25 aa, Mycobacterium
VLAAGLLALPLGYWGAVVAIIVFQV

SEQ ID NO: 373234 - protein, 22 aa, Mycobacterium
VLAAIYVLWMYQRMMTGPLAPG

SEQ ID NO: 373235 - protein, 27 aa, Mycobacterium
VLAALLVVLIAFLIRQMLRGWVHRAQR

SEQ ID NO: 373236 - protein, 26 aa, Mycobacterium
VLAASGHLLFALIGTGTVIAIHVLGR

SEQ ID NO: 373237 - protein, 26 aa, Mycobacterium
VLAAVSLLVMPLLFHAKQRVGQELGS

SEQ ID NO: 373238 - protein, 29 aa, Mycobacterium
VLAAVTVPWWFLVAQLPFAGIVFALDGVL

SEQ ID NO: 373239 - protein, 19 aa, Mycobacterium
VLAAVVIAAAVLRAKRKDP

SEQ ID NO: 373240 - protein, 26 aa, Mycobacterium
VLAAWTTPVWVLIITGAIAAGAAFPA

SEQ ID NO: 373241 - protein, 25 aa, Mycobacterium
VLACAALLVWFWPRLLEQGMAVPVT

SEQ ID NO: 373242 - protein, 18 aa, Mycobacterium
VLACFLLAIALTVSVTIR

SEQ ID NO: 373243 - protein, 31 aa, Mycobacterium
VLACGWAFLIWGLLLYLWSAVLYLMQVVLVV

SEQ ID NO: 373244 - protein, 46 aa, Mycobacterium
VLACGYILFSLPWYTWLAFSIWVSVVLVFYFVWGRHHSALNDGGDG

SEQ ID NO: 373245 - protein, 28 aa, Mycobacterium
VLACIFILPGRRWVRPAEQWAAGHHVDR

SEQ ID NO: 373246 - protein, 19 aa, Mycobacterium
VLAFALGWAIFRITDWLSP

SEQ ID NO: 373247 - protein, 17 aa, Mycobacterium
VLAFQGVLCLFLLEMGM

SEQ ID NO: 373248 - protein, 28 aa, Mycobacterium
VLAGAMLLVLAFVLRYVLLTATRGSPVL

SEQ ID NO: 373249 - protein, 30 aa, Mycobacterium
VLAGAYPLYLDAYPLPQFAIYGAVSLRTIK

SEQ ID NO: 373250 - protein, 26 aa, Mycobacterium
VLAGGVALLVGWWLWERRITHPLVST

SEQ ID NO: 373251 - protein, 22 aa, Mycobacterium
VLAGLLVVIPLYCVGVLASFWA

SEQ ID NO: 373252 - protein, 27 aa, Mycobacterium
VLAGPVGWAVLWLVTVVPVVLVGTVVP

SEQ ID NO: 373253 - protein, 24 aa, Mycobacterium
VLAGPVSRWRWLLGATVAAVLGSA

SEQ ID NO: 373254 - protein, 29 aa, Mycobacterium
VLAGRQVVLNLWAYWCGPCADELPAMAEL

SEQ ID NO: 373255 - protein, 28 aa, Mycobacterium
VLAGVTGWLPLFAVAWLVVGVAQAGTLY

SEQ ID NO: 373256 - protein, 19 aa, Mycobacterium
VLAGWLVGMVWGGVVVLVG

SEQ ID NO: 373257 - protein, 18 aa, Mycobacterium
VLAICLLVAGVVAPWLAG

SEQ ID NO: 373258 - protein, 17 aa, Mycobacterium
VLAICYLIPLVRPRVSD

SEQ ID NO: 373259 - protein, 25 aa, Mycobacterium
VLAISALTFVAWAALGNSLASAFTA

SEQ ID NO: 373260 - protein, 17 aa, Mycobacterium
VLAISHGPRVGLICAIV

SEQ ID NO: 373261 - protein, 18 aa, Mycobacterium
VLAIVFLPSTPPQHCPRH

SEQ ID NO: 373262 - protein, 17 aa, Mycobacterium
VLAIVIDALIVAAGRLV

SEQ ID NO: 373263 - protein, 34 aa, Mycobacterium
VLAIVTYVISLFFWPTPAVPLVGAVLIPVAIRAG

SEQ ID NO: 373264 - protein, 22 aa, Mycobacterium
VLALAFWAYYRAPESSRHLSEE

SEQ ID NO: 373265 - protein, 17 aa, Mycobacterium
VLALILGFVLGVGRLST

SEQ ID NO: 373266 - protein, 17 aa, Mycobacterium
VLALLLIRAAGWQLSRL

SEQ ID NO: 373267 - protein, 19 aa, Mycobacterium
VLALLVAGMARRTGREPTA

SEQ ID NO: 373268 - protein, 29 aa, Mycobacterium
VLALLVNIVAVVWLLWSKRLFGLNGGGKA

SEQ ID NO: 373269 - protein, 23 aa, Mycobacterium
VLALPSFLITLAFTFLYGAAGAV

SEQ ID NO: 373270 - protein, 19 aa, Mycobacterium
VLALVLVLILNRDSDPRQA

SEQ ID NO: 373271 - protein, 31 aa, Mycobacterium
VLAMGLDAWRWMFLAMAVPAVLYGALAFTIP

SEQ ID NO: 373272 - protein, 17 aa, Mycobacterium
VLAMRARRLLDGRSLWT

SEQ ID NO: 373273 - protein, 20 aa, Mycobacterium
VLANQYWLAASIGPLLALLA

SEQ ID NO: 373274 - protein, 26 aa, Mycobacterium
VLAPRWSMRLTARGWPKPLADALCVA

SEQ ID NO: 373275 - protein, 25 aa, Mycobacterium
VLAPYLLIWVIIVAYLCHVPFAVRN

SEQ ID NO: 373276 - protein, 26 aa, Mycobacterium
VLARLGTPQLLFNYLGRWAADACDDW

SEQ ID NO: 373277 - protein, 28 aa, Mycobacterium
VLASEKSFFMLAFTKIGLMPDGAASALI

SEQ ID NO: 373278 - protein, 22 aa, Mycobacterium
VLATLLTVGLGGGLLSAPAAGA

SEQ ID NO: 373279 - protein, 21 aa, Mycobacterium
VLATLWGLGALYWAGGLVGFE

SEQ ID NO: 373280 - protein, 37 aa, Mycobacterium
VLAVAAPSWFAWLAVIWLWLTVLFANLAEAVAEGRGK

SEQ ID NO: 373281 - protein, 17 aa, Mycobacterium
VLAVALAKNPADRYARC

SEQ ID NO: 373282 - protein, 25 aa, Mycobacterium
VLAVAMVGVLLWVTGAGAYLGSVAV

SEQ ID NO: 373283 - protein, 39 aa, Mycobacterium
VLAVFGYLCYQVVLLALSALFWAIVAIVALIAGMIPGSP

SEQ ID NO: 373284 - protein, 20 aa, Mycobacterium
VLAVFLIFTLSVDVSQLLIV

SEQ ID NO: 373285 - protein, 25 aa, Mycobacterium
VLAVLAFIPLAFLPKWSALTALSQT

SEQ ID NO: 373286 - protein, 24 aa, Mycobacterium
VLAVLVVLALARWGSRHRPDSVRS

SEQ ID NO: 373287 - protein, 18 aa, Mycobacterium
VLAVRPELQPALAGQNWA

SEQ ID NO: 373288 - protein, 20 aa, Mycobacterium
VLAWLAVGVLVNTAWPQLER

SEQ ID NO: 373289 - protein, 36 aa, Mycobacterium
VLAYLWLDRWEPEPPRLLIFAFIWGTSVAVVVSAIL

SEQ ID NO: 373290 - protein, 19 aa, Mycobacterium
VLAYPLFLLMTSGSVAAAI

SEQ ID NO: 373291 - protein, 18 aa, Mycobacterium
VLAYREFWAKVRKGALVK

SEQ ID NO: 373292 - protein, 28 aa, Mycobacterium
VLCALMAGVWFLHWPTRAESIAFSILSN

SEQ ID NO: 373293 - protein, 18 aa, Mycobacterium
VLCARILLRKVTPGSYPR

SEQ ID NO: 373294 - protein, 22 aa, Mycobacterium
VLCLSFTRLPFFQPLGIPCAVG

SEQ ID NO: 373295 - protein, 19 aa, Mycobacterium
VLCRAIVVPPKAFWQEFDI

SEQ ID NO: 373296 - protein, 18 aa, Mycobacterium
VLCSIYWQRPVPAVQVHG

SEQ ID NO: 373297 - protein, 26 aa, Mycobacterium
VLCVAACAALVLNAPHSEKRTIEASQ

SEQ ID NO: 373298 - protein, 18 aa, Mycobacterium
VLCYRHRIRVALAACVAA

SEQ ID NO: 373299 - protein, 21 aa, Mycobacterium
VLDHPQPFFAPISAAVCMSAT

SEQ ID NO: 373300 - protein, 17 aa, Mycobacterium
VLDLPIGLIDRPYTHAQ

SEQ ID NO: 373301 - protein, 18 aa, Mycobacterium
VLDQIRHIFAQALDLDSV

SEQ ID NO: 373302 - protein, 28 aa, Mycobacterium
VLDRIGVPWWFLVAQLPVAGIVFAIDGV

SEQ ID NO: 373303 - protein, 18 aa, Mycobacterium
VLDTLAGQLLEKETLHRP

SEQ ID NO: 373304 - protein, 20 aa, Mycobacterium
VLEDFAMAAYLPLLAVLAAG

SEQ ID NO: 373305 - protein, 28 aa, Mycobacterium
VLEPRGWRIWRVWPDTTTLLVTLVDVTP

SEQ ID NO: 373306 - protein, 18 aa, Mycobacterium
VLEQHRQFRRELGLHHHL

SEQ ID NO: 373307 - protein, 25 aa, Mycobacterium
VLEQPIRRWRPARVPLLPLAAATVA

SEQ ID NO: 373308 - protein, 24 aa, Mycobacterium
VLEWYDFFLYGFAATLVFGPLFFP

SEQ ID NO: 373309 - protein, 18 aa, Mycobacterium
VLFAAVIVWPQVRHAGAG

SEQ ID NO: 373310 - protein, 20 aa, Mycobacterium
VLFAVLVLQFRNPAGLAPAS

SEQ ID NO: 373311 - protein, 29 aa, Mycobacterium
VLFHTPIVDLPFTYPPLAAIVFCPFAWMH

SEQ ID NO: 373312 - protein, 20 aa, Mycobacterium
VLFLRYWPQLAACYLLGMLG

SEQ ID NO: 373313 - protein, 26 aa, Mycobacterium
VLFTLVEIGQFIRWLVRFLVGQVDRI

SEQ ID NO: 373314 - protein, 17 aa, Mycobacterium
VLFTMRVAPARSSSRGQ

SEQ ID NO: 373315 - protein, 20 aa, Mycobacterium
VLFVLALSWASAAGWWYVSS

SEQ ID NO: 373316 - protein, 19 aa, Mycobacterium
VLFVLLDQYAPAGLTVLVL

SEQ ID NO: 373317 - protein, 18 aa, Mycobacterium
VLGAFVACYLVLVELGKL

SEQ ID NO: 373318 - protein, 22 aa, Mycobacterium
VLGALAYFPAAFLPAKPTTIAP

SEQ ID NO: 373319 - protein, 26 aa, Mycobacterium
VLGALITLLPFALGLLTSFTSAHQFA

SEQ ID NO: 373320 - protein, 24 aa, Mycobacterium
VLGALITLLPFTLGLLTSFTSAHQ

SEQ ID NO: 373321 - protein, 18 aa, Mycobacterium
VLGAPFLGVKWGLPDERM

SEQ ID NO: 373322 - protein, 17 aa, Mycobacterium
VLGAWLLSGRELSALAS

SEQ ID NO: 373323 - protein, 24 aa, Mycobacterium
VLGGIIIGNVLRGGFGGGGGYGGY

SEQ ID NO: 373324 - protein, 17 aa, Mycobacterium
VLGGWRAAGAQKVASDQ

SEQ ID NO: 373325 - protein, 19 aa, Mycobacterium
VLGIFPQPLLDLADHAAHL

SEQ ID NO: 373326 - protein, 18 aa, Mycobacterium
VLGIPMLLGPVFGPVLGG

SEQ ID NO: 373327 - protein, 20 aa, Mycobacterium
VLGIQLHWSVPVAVFAILIS

SEQ ID NO: 373328 - protein, 40 aa, Mycobacterium
VLGKALYRFALRNRTWWPPPNWVLLWAKTLIVGGSIASCV

SEQ ID NO: 373329 - protein, 26 aa, Mycobacterium
VLGKPDPWWVFLAAFAVLVVSILPWC

SEQ ID NO: 373330 - protein, 24 aa, Mycobacterium
VLGKTWVVVLPLALALVVCTVLWP

SEQ ID NO: 373331 - protein, 18 aa, Mycobacterium
VLGLAVATLGFWIGSGYP

SEQ ID NO: 373332 - protein, 18 aa, Mycobacterium
VLGLIWLGLEHRRIRRLA

SEQ ID NO: 373333 - protein, 18 aa, Mycobacterium
VLGLPIPFVLFENAANVG

SEQ ID NO: 373334 - protein, 23 aa, Mycobacterium
VLGLPIPLVLFQNAANVGVIAGL

SEQ ID NO: 373335 - protein, 17 aa, Mycobacterium
VLGLTLVLGLGTLAARA

SEQ ID NO: 373336 - protein, 18 aa, Mycobacterium
VLGPFFGPFLSLAVLASA

SEQ ID NO: 373337 - protein, 36 aa, Mycobacterium
VLGPLYGVLCVWLFGSWTAIFWVNVPLAIIAIVLVQ

SEQ ID NO: 373338 - protein, 27 aa, Mycobacterium
VLGSAAALLAVLWPAGAQLLIRFTGPE

SEQ ID NO: 373339 - protein, 26 aa, Mycobacterium
VLGSAAAVLVIPWPAGAQLLIRFTGP

SEQ ID NO: 373340 - protein, 26 aa, Mycobacterium
VLGSWFGPLLLLAIFASAIASLQTTS

SEQ ID NO: 373341 - protein, 17 aa, Mycobacterium
VLGSWGGPLLFLAVLAS

SEQ ID NO: 373342 - protein, 28 aa, Mycobacterium
VLGTAVVLLVILGLGVWVAVGAFKAKSN

SEQ ID NO: 373343 - protein, 30 aa, Mycobacterium
VLGTFLVMFFIINIAYFAYGSWFAAIKASG

SEQ ID NO: 373344 - protein, 25 aa, Mycobacterium
VLGTFPIIFGLSFRDALLATLAGLV

SEQ ID NO: 373345 - protein, 23 aa, Mycobacterium
VLGVAMFGLIGLLIAVGEPSDVT

SEQ ID NO: 373346 - protein, 28 aa, Mycobacterium
VLGVGAFAWLWWTANLLSGLLAVATIAF

SEQ ID NO: 373347 - protein, 25 aa, Mycobacterium
VLGVGMLVLGIPLMLACFAFGTKRF

SEQ ID NO: 373348 - protein, 17 aa, Mycobacterium
VLGVLLVAAIVVAAVEF

SEQ ID NO: 373349 - protein, 25 aa, Mycobacterium
VLGVLVAFIIFGRRVQKSVFTKAEG

SEQ ID NO: 373350 - protein, 29 aa, Mycobacterium
VLGVPTLLYLPFALFNIASPALSVFYGYT

SEQ ID NO: 373351 - protein, 18 aa, Mycobacterium
VLGVRPAWVARPVAVASA

SEQ ID NO: 373352 - protein, 17 aa, Mycobacterium
VLGVSWQAALLLGAIVS

SEQ ID NO: 373353 - protein, 24 aa, Mycobacterium
VLGVVSVRLFGFTPGQLALGLRVV

SEQ ID NO: 373354 - protein, 24 aa, Mycobacterium
VLGWGWLALILVGVPWLLSFAQPT

SEQ ID NO: 373355 - protein, 19 aa, Mycobacterium
VLGYFRDDVWLSVTAGLLL

SEQ ID NO: 373356 - protein, 29 aa, Mycobacterium
VLGYLLVNGLYRWFPPITVLTGLSLLAVA

SEQ ID NO: 373357 - protein, 29 aa, Mycobacterium
VLHEMRVPWWFLVCQLPISGLVFALDGVL

SEQ ID NO: 373358 - protein, 22 aa, Mycobacterium
VLHHRTVWTVIAILALFGWPQV

SEQ ID NO: 373359 - protein, 21 aa, Mycobacterium
VLHPPLQVLAAIEAAARRALE

SEQ ID NO: 373360 - protein, 19 aa, Mycobacterium
VLIAAIGAFLLWRAIPALA

SEQ ID NO: 373361 - protein, 24 aa, Mycobacterium
VLIAARLIQGLGAAFLVPGSLALI

SEQ ID NO: 373362 - protein, 17 aa, Mycobacterium
VLIAGTVVWFGITDAWN

SEQ ID NO: 373363 - protein, 25 aa, Mycobacterium
VLIALPVLALWVAIPMALGRTTFLP

SEQ ID NO: 373364 - protein, 26 aa, Mycobacterium
VLIALVPLVWVLYTVFDRGFAAILSA

SEQ ID NO: 373365 - protein, 32 aa, Mycobacterium
VLIALVVFALLPLFLVTDILAAFPILIPILIG

SEQ ID NO: 373366 - protein, 19 aa, Mycobacterium
VLIAPILTTVRRAFRHPVD

SEQ ID NO: 373367 - protein, 28 aa, Mycobacterium
VLIATGAYLAWYWLPAATGHTASGGNLL

SEQ ID NO: 373368 - protein, 26 aa, Mycobacterium
VLICLGAALMAYFKPLGKQGSDQLLV

SEQ ID NO: 373369 - protein, 26 aa, Mycobacterium
VLICLGAVLLAYFKPLGKRGDDTLLV

SEQ ID NO: 373370 - protein, 19 aa, Mycobacterium
VLIGAVWGTRRIFKAVRWA

SEQ ID NO: 373371 - protein, 18 aa, Mycobacterium
VLIGFIALYLIGSLARFP

SEQ ID NO: 373372 - protein, 19 aa, Mycobacterium
VLIGLYVQDILGYSALRAG

SEQ ID NO: 373373 - protein, 17 aa, Mycobacterium
VLIRRPVVGYIWGWVHT

SEQ ID NO: 373374 - protein, 19 aa, Mycobacterium
VLIVFILVVAAFPSLFTGI

SEQ ID NO: 373375 - protein, 20 aa, Mycobacterium
VLKPHLSPYFVYGAALVIAA

SEQ ID NO: 373376 - protein, 18 aa, Mycobacterium
VLKRLGTVLLIVGGIGVV

SEQ ID NO: 373377 - protein, 33 aa, Mycobacterium
VLLAAALLVWAVFDAVPPWAWAAPAATAVAGAL

SEQ ID NO: 373378 - protein, 19 aa, Mycobacterium
VLLAATGLRRLVFDAVPMQ

SEQ ID NO: 373379 - protein, 18 aa, Mycobacterium
VLLALASFLTFCLTSVAF

SEQ ID NO: 373380 - protein, 20 aa, Mycobacterium
VLLALASFLTYCLTSLAFSP

SEQ ID NO: 373381 - protein, 22 aa, Mycobacterium
VLLALPGFLVSVWIVTAYGAGP

SEQ ID NO: 373382 - protein, 19 aa, Mycobacterium
VLLAPAMMTVFIPSAIAAV

SEQ ID NO: 373383 - protein, 27 aa, Mycobacterium
VLLASAILLLLFWQWRTMPAVIWDVQY

SEQ ID NO: 373384 - protein, 21 aa, Mycobacterium
VLLASILDGLLGVSWGLVTAA

SEQ ID NO: 373385 - protein, 19 aa, Mycobacterium
VLLCIAGTGVYLGAAMVAR

SEQ ID NO: 373386 - protein, 26 aa, Mycobacterium
VLLELRRRVFRHFGRLDIAFHDRYTS

SEQ ID NO: 373387 - protein, 20 aa, Mycobacterium
VLLEVWPVILVGALAWLGAA

SEQ ID NO: 373388 - protein, 19 aa, Mycobacterium
VLLGAIAYSIRRGRTDGYR

SEQ ID NO: 373389 - protein, 19 aa, Mycobacterium
VLLGAPFLGATWGFPDDRV

SEQ ID NO: 373390 - protein, 37 aa, Mycobacterium
VLLGAVALLWFRSVLEKPPGFPLQYAPPPGLGPVQAE

SEQ ID NO: 373391 - protein, 17 aa, Mycobacterium
VLLGLAILYFVVRDLRG

SEQ ID NO: 373392 - protein, 19 aa, Mycobacterium
VLLGLLWPHLHLSHSWGVA

SEQ ID NO: 373393 - protein, 25 aa, Mycobacterium
VLLGLPIPFVLFQNAANLGLISGLM

SEQ ID NO: 373394 - protein, 18 aa, Mycobacterium
VLLGPLLALIARPKIEGL

SEQ ID NO: 373395 - protein, 22 aa, Mycobacterium
VLLGPLLALIGRPKVTGLENIP

SEQ ID NO: 373396 - protein, 23 aa, Mycobacterium
VLLGPLLYLLGRPKVEGLEHIPS

SEQ ID NO: 373397 - protein, 18 aa, Mycobacterium
VLLIFTIGVTWSSVHYLL

SEQ ID NO: 373398 - protein, 32 aa, Mycobacterium
VLLISMWGWRRGQRWVWWCLLLGCACATVPVV

SEQ ID NO: 373399 - protein, 18 aa, Mycobacterium
VLLIWRRASDGFAFLSTL

SEQ ID NO: 373400 - protein, 28 aa, Mycobacterium
VLLKASWHWVFVALVILAGLLLVMAALA

SEQ ID NO: 373401 - protein, 18 aa, Mycobacterium
VLLLGWRGVALAVSRRSA

SEQ ID NO: 373402 - protein, 18 aa, Mycobacterium
VLLLLSSIVSVAAVVIVG

SEQ ID NO: 373403 - protein, 26 aa, Mycobacterium
VLLLSFSALILVAAWRMHARQAETPC

SEQ ID NO: 373404 - protein, 22 aa, Mycobacterium
VLLMISFLVLLVLRIVGSRAAK

SEQ ID NO: 373405 - protein, 18 aa, Mycobacterium
VLLMLLVLAVHLFPIRLN

SEQ ID NO: 373406 - protein, 17 aa, Mycobacterium
VLLMTPGLAFFYGGLSR

SEQ ID NO: 373407 - protein, 19 aa, Mycobacterium
VLLNADWTWARSALDQTQV

SEQ ID NO: 373408 - protein, 27 aa, Mycobacterium
VLLNHPGLPLWPYLICAALTGLGGANY

SEQ ID NO: 373409 - protein, 19 aa, Mycobacterium
VLLNMLSLTAGFGALVWIF

SEQ ID NO: 373410 - protein, 26 aa, Mycobacterium
VLLQDAGISLWRLLIGLCLAAVIGVP

SEQ ID NO: 373411 - protein, 34 aa, Mycobacterium
VLLRAHLVPQEGFCVYPWSPLRLINGTVGYTGVE

SEQ ID NO: 373412 - protein, 18 aa, Mycobacterium
VLLSAALVLGVRRFPSGH

SEQ ID NO: 373413 - protein, 28 aa, Mycobacterium
VLLSSLLLFLLFWQWRTMPAVIWAVSWP

SEQ ID NO: 373414 - protein, 58 aa, Mycobacterium
VLLSVPVIAMAMIPVLQFTYWQWASLVLAAPVIVWAAWPFHRAAWANLRHATATMDTL

SEQ ID NO: 373415 - protein, 27 aa, Mycobacterium
VLLTAGLSLAVAWPLAAALRAIPGQNI

SEQ ID NO: 373416 - protein, 22 aa, Mycobacterium
VLLTGLYVTYYGYYELRLYFAN

SEQ ID NO: 373417 - protein, 24 aa, Mycobacterium
VLLTPVFCMLLPISVVPLAAPDSA

SEQ ID NO: 373418 - protein, 17 aa, Mycobacterium
VLLTVFLIISVVAATII

SEQ ID NO: 373419 - protein, 20 aa, Mycobacterium
VLLVAESMLTIFLRTIAPTE

SEQ ID NO: 373420 - protein, 17 aa, Mycobacterium
VLLVAVIVGFTGALLNA

SEQ ID NO: 373421 - protein, 23 aa, Mycobacterium
VLLVGLAIWLLAGKELSIILPKS

SEQ ID NO: 373422 - protein, 17 aa, Mycobacterium
VLLVVCIGLELQGPEGQ

SEQ ID NO: 373423 - protein, 18 aa, Mycobacterium
VLLVWRRASDGWAFTCVA

SEQ ID NO: 373424 - protein, 17 aa, Mycobacterium
VLLWIVWGGALAGVALK

SEQ ID NO: 373425 - protein, 20 aa, Mycobacterium
VLLYFAKDIWRILRAWFDGL

SEQ ID NO: 373426 - protein, 18 aa, Mycobacterium
VLLYGPPGTGKTLLARAV

SEQ ID NO: 373427 - protein, 21 aa, Mycobacterium
VLLYLLIPGWSFDSDFARLGL

SEQ ID NO: 373428 - protein, 17 aa, Mycobacterium
VLMIFRPQGLFPARQHL

SEQ ID NO: 373429 - protein, 17 aa, Mycobacterium
VLMRLSEARRRGLAVLG

SEQ ID NO: 373430 - protein, 18 aa, Mycobacterium
VLMYVPFGVLWVLTLPRA

SEQ ID NO: 373431 - protein, 20 aa, Mycobacterium
VLNAAFTTTPLSASQWLVCF

SEQ ID NO: 373432 - protein, 24 aa, Mycobacterium
VLNALWTPLFFGLGWRGAALAEIA

SEQ ID NO: 373433 - protein, 25 aa, Mycobacterium
VLNAYNIVFAAFLVAAGKLADLLGR

SEQ ID NO: 373434 - protein, 18 aa, Mycobacterium
VLNFLIGGLAYLLLSRMS

SEQ ID NO: 373435 - protein, 17 aa, Mycobacterium
VLNFLMCMAYLLLNLAE

SEQ ID NO: 373436 - protein, 20 aa, Mycobacterium
VLNIVFTDFKLRSAAGMIGR

SEQ ID NO: 373437 - protein, 19 aa, Mycobacterium
VLNLFGWVGLTVLGTLVTL

SEQ ID NO: 373438 - protein, 17 aa, Mycobacterium
VLNLLDNAAKWSPPGGH

SEQ ID NO: 373439 - protein, 17 aa, Mycobacterium
VLNLLDNAAKWSPPGGR

SEQ ID NO: 373440 - protein, 21 aa, Mycobacterium
VLNSWLMTAALFSALIAGFGV

SEQ ID NO: 373441 - protein, 26 aa, Mycobacterium
VLPAKLILMAIAVICAAAVFSAIVLR

SEQ ID NO: 373442 - protein, 23 aa, Mycobacterium
VLPAKLILMAIAVICAVAVFSAI

SEQ ID NO: 373443 - protein, 17 aa, Mycobacterium
VLPALQIVFDPLLVVAA

SEQ ID NO: 373444 - protein, 23 aa, Mycobacterium
VLPGLVAAFFKFTLGITAASSLV

SEQ ID NO: 373445 - protein, 17 aa, Mycobacterium
VLPHSVFGPGPLKWIYL

SEQ ID NO: 373446 - protein, 20 aa, Mycobacterium
VLPILFMVVLNIVLGNLAYA

SEQ ID NO: 373447 - protein, 17 aa, Mycobacterium
VLPLTLAGGAAVTALAL

SEQ ID NO: 373448 - protein, 17 aa, Mycobacterium
VLPLTLAGGASVSVLAL

SEQ ID NO: 373449 - protein, 18 aa, Mycobacterium
VLPPNKFPYIPPDSDPDP

SEQ ID NO: 373450 - protein, 18 aa, Mycobacterium
VLPQRRPEPPPPVEPPPP

SEQ ID NO: 373451 - protein, 29 aa, Mycobacterium
VLPSVIMLVFFGFLPILRNVLVGLGGVDR

SEQ ID NO: 373452 - protein, 24 aa, Mycobacterium
VLPVTWPVMAPTLAWLVGFTLFLV

SEQ ID NO: 373453 - protein, 33 aa, Mycobacterium
VLPVYVVMAMTFGWVWLIKRVLAGLRWENDNQP

SEQ ID NO: 373454 - protein, 27 aa, Mycobacterium
VLQAAWAQVLMWLTGRHDVAFGVAVSG

SEQ ID NO: 373455 - protein, 19 aa, Mycobacterium
VLQFFVIVAALLPLTIVGL

SEQ ID NO: 373456 - protein, 20 aa, Mycobacterium
VLQLWSFLALVLDSLAIAAQ

SEQ ID NO: 373457 - protein, 18 aa, Mycobacterium
VLQMWSFLALVLDSLAIA

SEQ ID NO: 373458 - protein, 26 aa, Mycobacterium
VLQPPGHPLPVLPLAFDPPQHTRYRK

SEQ ID NO: 373459 - protein, 25 aa, Mycobacterium
VLQSSWVHLLPSRKEGWGLAVVEAA

SEQ ID NO: 373460 - protein, 35 aa, Mycobacterium
VLRAIGRVSYSWYLWHWPALLLAPALIGADLGLAG

SEQ ID NO: 373461 - protein, 26 aa, Mycobacterium
VLRAPEFYPWLLAALAGMIFQQSAFR

SEQ ID NO: 373462 - protein, 26 aa, Mycobacterium
VLRAWTLVWLMLVWTMLWGNFSVANT

SEQ ID NO: 373463 - protein, 19 aa, Mycobacterium
VLRDTGLAMMVWAIAMSAA

SEQ ID NO: 373464 - protein, 22 aa, Mycobacterium
VLRELYAALLADGAPFLVSDLQ

SEQ ID NO: 373465 - protein, 32 aa, Mycobacterium; identical to SEQ ID NO: 25533

SEQ ID NO: 373466 - protein, 33 aa, Mycobacterium
VLREVLMAELRPELPRSIRALPHADKPSVLLVV

SEQ ID NO: 373467 - protein, 26 aa, Mycobacterium
VLRGSNLMWYIGLVVVLAVGGGVTFT

SEQ ID NO: 373468 - protein, 18 aa, Mycobacterium
VLRIVTGYLGGGTAFPIH

SEQ ID NO: 373469 - protein, 19 aa, Mycobacterium
VLRIYQYERFFDTARLTDI

SEQ ID NO: 373470 - protein, 17 aa, Mycobacterium
VLRMPFYRTLISVGSWA

SEQ ID NO: 373471 - protein, 24 aa, Mycobacterium
VLRNWGWVFLGNFAGALTVAFMMA

SEQ ID NO: 373472 - protein, 18 aa, Mycobacterium
VLRPLLAFVAARQLSRRA

SEQ ID NO: 373473 - protein, 17 aa, Mycobacterium
VLRRACLDAQWIQRQVT

SEQ ID NO: 373474 - protein, 19 aa, Mycobacterium
VLRRTVAEPPPRGAYGVML

SEQ ID NO: 373475 - protein, 29 aa, Mycobacterium
VLRVLFQWRWSIATLWFTAVFLQIMIRFW

SEQ ID NO: 373476 - protein, 17 aa, Mycobacterium
VLRVWPVPVVMAVMVAL

SEQ ID NO: 373477 - protein, 18 aa, Mycobacterium
VLRWFVLGAGIGVAGAWL

SEQ ID NO: 373478 - protein, 25 aa, Mycobacterium
VLSAFKVPTVWLLLADDANIPRGPT

SEQ ID NO: 373479 - protein, 21 aa, Mycobacterium
VLSARLIFALPFSVLNYAAGA

SEQ ID NO: 373480 - protein, 21 aa, Mycobacterium
VLSAVPFLALLTAAGWTPAYL

SEQ ID NO: 373481 - protein, 27 aa, Mycobacterium
VLSDAPLWITFAVMPAYVVIAFALGSY

SEQ ID NO: 373482 - protein, 18 aa, Mycobacterium
VLSGRHLPLPPSVVSAGI

SEQ ID NO: 373483 - protein, 25 aa, Mycobacterium
VLSIALPLVFIALGGIGLPGGAVYV

SEQ ID NO: 373484 - protein, 27 aa, Mycobacterium
VLSIRDTWLLALLYLGTFGSFIGFSFA

SEQ ID NO: 373485 - protein, 27 aa, Mycobacterium
VLSKLLAPLFPMIVAVPGGAYLALPVV

SEQ ID NO: 373486 - protein, 22 aa, Mycobacterium
VLSLGLLGAAPRMSIALARLSP

SEQ ID NO: 373487 - protein, 31 aa, Mycobacterium
VLSQLQLWTTPLWLLLMVAPFGYLVVSHPES

SEQ ID NO: 373488 - protein, 27 aa, Mycobacterium
VLSSVAWVFLWIFRGTPVYVQLAFWGL

SEQ ID NO: 373489 - protein, 25 aa, Mycobacterium
VLSSVVLVLLYWQWRTMPAVVWDVR

SEQ ID NO: 373490 - protein, 26 aa, Mycobacterium
VLSVAAVVFGFFLWSGHRDDTAERRY

SEQ ID NO: 373491 - protein, 17 aa, Mycobacterium
VLSVIGFIVMFGGVIFA

SEQ ID NO: 373492 - protein, 18 aa, Mycobacterium
VLSVLGVALLMLGAARLY

SEQ ID NO: 373493 - protein, 20 aa, Mycobacterium
VLTAFQLLSADGIYPLLMMT

SEQ ID NO: 373494 - protein, 27 aa, Mycobacterium
VLTAGAVFLAAWLPFNNGLRPEPLIAF

SEQ ID NO: 373495 - protein, 27 aa, Mycobacterium
VLTAGAVFLAAWLPFNNGLRPEPLIAL

SEQ ID NO: 373496 - protein, 22 aa, Mycobacterium
VLTAIPFVLTLVLIAATPWCAA

SEQ ID NO: 373497 - protein, 30 aa, Mycobacterium
VLTCAFALGTALPLLFFALAGRETAGRVSA

SEQ ID NO: 373498 - protein, 17 aa, Mycobacterium
VLTDVRLLGPRLARSAA

SEQ ID NO: 373499 - protein, 23 aa, Mycobacterium
VLTELPDRFPLKGVFHAAGVLDD

SEQ ID NO: 373500 - protein, 22 aa, Mycobacterium
VLTFSLLRLLTGFGLGASMPNV

SEQ ID NO: 373501 - protein, 21 aa, Mycobacterium
VLTGFVFVSRMPVSVILIGLG

SEQ ID NO: 373502 - protein, 26 aa, Mycobacterium
VLTGFVLVSRIPVSVILIGLGSILVL

SEQ ID NO: 373503 - protein, 24 aa, Mycobacterium
VLTGLQWVVWLAVANNIAAEFSLV

SEQ ID NO: 373504 - protein, 19 aa, Mycobacterium
VLTGWLWTSLSVGAFAIGF

SEQ ID NO: 373505 - protein, 20 aa, Mycobacterium
VLTHLPVLLGTVLAIMVWRS

SEQ ID NO: 373506 - protein, 26 aa, Mycobacterium
VLTIRGLRITGWVRAIFSWRRRHRST

SEQ ID NO: 373507 - protein, 23 aa, Mycobacterium
VLTIVMGLVFVGLIPALQRQARF

SEQ ID NO: 373508 - protein, 25 aa, Mycobacterium
VLTLFTTIFFLYGGKEIWEFVTRIF

SEQ ID NO: 373509 - protein, 20 aa, Mycobacterium
VLTLTIFISGLLFAVENGSA

SEQ ID NO: 373510 - protein, 17 aa, Mycobacterium
VLTLWLETPARLGITIP

SEQ ID NO: 373511 - protein, 17 aa, Mycobacterium
VLTMERVAPTLPAPLIG

SEQ ID NO: 373512 - protein, 23 aa, Mycobacterium
VLTNFAWLFPVLTGLPISQQTWD

SEQ ID NO: 373513 - protein, 23 aa, Mycobacterium
VLTTPVLYAVMARPLGAAGADHP

SEQ ID NO: 373514 - protein, 25 aa, Mycobacterium
VLTVAAFYFILRRDNHLAPLLSIDG

SEQ ID NO: 373515 - protein, 26 aa, Mycobacterium
VLTVFAVLVMMLTISPLLTLFTVVTV

SEQ ID NO: 373516 - protein, 24 aa, Mycobacterium
VLTVVMVVLLRKAPRIDPERACAV

SEQ ID NO: 373517 - protein, 26 aa, Mycobacterium
VLTYHIARPWRWGYLGVLFVIFGFPL

SEQ ID NO: 373518 - protein, 24 aa, Mycobacterium
VLVALLLSALLLPVVDWLDRRGLP

SEQ ID NO: 373519 - protein, 20 aa, Mycobacterium
VLVALLLSALLVPVVDWLDR

SEQ ID NO: 373520 - protein, 24 aa, Mycobacterium
VLVALPIGVTLSIQFALLANQVGA

SEQ ID NO: 373521 - protein, 27 aa, Mycobacterium
VLVATIIVFAIGRPLIRLSYLNELRNA

SEQ ID NO: 373522 - protein, 24 aa, Mycobacterium
VLVAWLMFTWMIARLPRQPGRLGT

SEQ ID NO: 373523 - protein, 20 aa, Mycobacterium
VLVESLGWRWALVVAPAVAL

SEQ ID NO: 373524 - protein, 20 aa, Mycobacterium
VLVFLAFMVALVGSADLGLS

SEQ ID NO: 373525 - protein, 28 aa, Mycobacterium
VLVFTTSIICALFGFIWDVSWHIGNGRD

SEQ ID NO: 373526 - protein, 24 aa, Mycobacterium
VLVGAAVVRLARAWSLAVSMVALV

SEQ ID NO: 373527 - protein, 33 aa, Mycobacterium
VLVGGLLLLVYRSLVVAFLPLITVGVAVGIATP

SEQ ID NO: 373528 - protein, 22 aa, Mycobacterium
VLVGLGMRTWADGRTLLLGSPG

SEQ ID NO: 373529 - protein, 22 aa, Mycobacterium
VLVGLGMRTWADGRTLLLGSPS

SEQ ID NO: 373530 - protein, 28 aa, Mycobacterium
VLVGMQLALTELWRAYGVHPDAVIGHSM

SEQ ID NO: 373531 - protein, 26 aa, Mycobacterium
VLVGNANWWPSRRFATRRPARPPQPT

SEQ ID NO: 373532 - protein, 25 aa, Mycobacterium
VLVGTLLSWYALVAALTTVPLVRWT

SEQ ID NO: 373533 - protein, 29 aa, Mycobacterium
VLVIAYCLGLGIPFVLLAFGSAGAVGALG

SEQ ID NO: 373534 - protein, 18 aa, Mycobacterium
VLVIMNKFNMFKLDVKRQ

SEQ ID NO: 373535 - protein, 17 aa, Mycobacterium
VLVIMVILLAVLALVVV

SEQ ID NO: 373536 - protein, 17 aa, Mycobacterium
VLVIVIGSPIRGAADEA

SEQ ID NO: 373537 - protein, 18 aa, Mycobacterium
VLVLAFFFAGMDPYIHMY

SEQ ID NO: 373538 - protein, 17 aa, Mycobacterium
VLVLALLGGFTLVAHYN

SEQ ID NO: 373539 - protein, 22 aa, Mycobacterium
VLVLAVWALMTWPWERPWGKTV

SEQ ID NO: 373540 - protein, 27 aa, Mycobacterium
VLVLAYCLGLGIPFVLLALGSARAVQG

SEQ ID NO: 373541 - protein, 25 aa, Mycobacterium
VLVLFTLIFFLYGGRNIWAYVSKIF

SEQ ID NO: 373542 - protein, 24 aa, Mycobacterium
VLVLFTLIFFLYGGRNIWRYVVQI

SEQ ID NO: 373543 - protein, 19 aa, Mycobacterium
VLVLLAFPLLTAALFGLAA

SEQ ID NO: 373544 - protein, 19 aa, Mycobacterium
VLVLLARYTTWGRQFWTVT

SEQ ID NO: 373545 - protein, 19 aa, Mycobacterium
VLVLLLVALLGLAAGGVYQ

SEQ ID NO: 373546 - protein, 20 aa, Mycobacterium
VLVLVAVLALAWAAVRLLRR

SEQ ID NO: 373547 - protein, 18 aa, Mycobacterium
VLVLVFGVGFMWLGMVVG

SEQ ID NO: 373548 - protein, 29 aa, Mycobacterium
VLVMAANRLLLPPILGWSLGRALCGITVV

SEQ ID NO: 373549 - protein, 22 aa, Mycobacterium
VLVPLILAATFGGLRIYASVTE

SEQ ID NO: 373550 - protein, 21 aa, Mycobacterium
VLVQALLVTSLLFALLISARA

SEQ ID NO: 373551 - protein, 18 aa, Mycobacterium
VLVRLRYGALDIAGASLD

SEQ ID NO: 373552 - protein, 17 aa, Mycobacterium
VLVSAAHRLAFAGLLLL

SEQ ID NO: 373553 - protein, 17 aa, Mycobacterium
VLVSAGVLVLRRTRPDL

SEQ ID NO: 373554 - protein, 30 aa, Mycobacterium
VLVSFGYTGLPFFPQGKPYEAYFADAGGIE

SEQ ID NO: 373555 - protein, 29 aa, Mycobacterium
VLVSGLGWEWIFFVNIPIGLAGLVVAYLL

SEQ ID NO: 373556 - protein, 19 aa, Mycobacterium
VLVTGPWMAGVSAVATALQ

SEQ ID NO: 373557 - protein, 20 aa, Mycobacterium
VLVTLIAWRLRQLDPQRKAR

SEQ ID NO: 373558 - protein, 25 aa, Mycobacterium
VLVTLSMLVALTPLIWVLGSVIAKG

SEQ ID NO: 373559 - protein, 24 aa, Mycobacterium
VLVVGLWWRYRYDKFGWTSRSSQI

SEQ ID NO: 373560 - protein, 22 aa, Mycobacterium
VLVVLAWRNRRIWVPAARTHRS

SEQ ID NO: 373561 - protein, 19 aa, Mycobacterium
VLVVLPARLANTVAGAVLG

SEQ ID NO: 373562 - protein, 20 aa, Mycobacterium
VLVVLPPLLALCGRRLFWPF

SEQ ID NO: 373563 - protein, 32 aa, Mycobacterium
VLVWEDILGIELYWMVLAMSVILLLAVGSDYN

SEQ ID NO: 373564 - protein, 25 aa, Mycobacterium
VLVWSFFCMVMFGICMILLAEAGRY

SEQ ID NO: 373565 - protein, 20 aa, Mycobacterium
VLVYAWLMPASTVVQAVIGG

SEQ ID NO: 373566 - protein, 20 aa, Mycobacterium
VLVYAWLMPVSTVVQAVIGG

SEQ ID NO: 373567 - protein, 29 aa, Mycobacterium
VLWAVQYALAWVPVLLAVGAAWTVTSLPA

SEQ ID NO: 373568 - protein, 25 aa, Mycobacterium
VLWIALLVTIALFWVRSRAAAVLLL

SEQ ID NO: 373569 - protein, 28 aa, Mycobacterium
VLWLHDSVLIVLLPIWVIKHTAVPAGWV

SEQ ID NO: 373570 - protein, 18 aa, Mycobacterium
VLWVLFGFSMVFGTSYGG

SEQ ID NO: 373571 - protein, 19 aa, Mycobacterium
VLWVVFWFGWAIVFASTFM

SEQ ID NO: 373572 - protein, 18 aa, Mycobacterium
VLYQLACVTGIIAGYLIA

SEQ ID NO: 373573 - protein, 20 aa, Mycobacterium
VMACALLVADVLAPALAARA

SEQ ID NO: 373574 - protein, 29 aa, Mycobacterium
VMADFARLYPFQVFMDLYGLPLADRDRLI

SEQ ID NO: 373575 - protein, 23 aa, Mycobacterium
VMAIFTFLLMFIVSVLIARTGKG

SEQ ID NO: 373576 - protein, 17 aa, Mycobacterium
VMALCIPGALFMLSCFF

SEQ ID NO: 373577 - protein, 24 aa, Mycobacterium
VMALYLWHMIPVVVVAIVAYPAGL

SEQ ID NO: 373578 - protein, 25 aa, Mycobacterium
VMAMDPQQRLLLEVSWEALERTGID

SEQ ID NO: 373579 - protein, 18 aa, Mycobacterium
VMAWGLAYPASPLGPAVV

SEQ ID NO: 373580 - protein, 24 aa, Mycobacterium
VMCWAILGFFVFVIWTLTTETETA

SEQ ID NO: 373581 - protein, 19 aa, Mycobacterium
VMFALAWLLLPDLPEYRTG

SEQ ID NO: 373582 - protein, 22 aa, Mycobacterium
VMFAVLGWFYLSVLPGWLHLPQ

SEQ ID NO: 373583 - protein, 20 aa, Mycobacterium
VMFFNIAAFGLALAWLGTIW

SEQ ID NO: 373584 - protein, 18 aa, Mycobacterium
VMFLVAVGFWNFLGAGIF

SEQ ID NO: 373585 - protein, 30 aa, Mycobacterium
VMFRMPIFTWNILVVSVLVLLVFPLLAAAA

SEQ ID NO: 373586 - protein, 19 aa, Mycobacterium
VMFVLALVLIFGLAMAPAA

SEQ ID NO: 373587 - protein, 22 aa, Mycobacterium
VMGIPLLLGPMAGPILGGWLID

SEQ ID NO: 373588 - protein, 25 aa, Mycobacterium
VMGIWEMFLLLLDNIVQLLVLIVAG

SEQ ID NO: 373589 - protein, 25 aa, Mycobacterium
VMGLPSIFVGFSRQRGLAADGRCKA

SEQ ID NO: 373590 - protein, 18 aa, Mycobacterium
VMGLVFGYAWQRTGRLWP

SEQ ID NO: 373591 - protein, 24 aa, Mycobacterium
VMGLVFGYAWRRTGRLWPLIIAHG

SEQ ID NO: 373592 - protein, 19 aa, Mycobacterium
VMGVGETFLLFAFADTALG

SEQ ID NO: 373593 - protein, 23 aa, Mycobacterium
VMHHRTVWTVIAILALFGWPQIA

SEQ ID NO: 373594 - protein, 17 aa, Mycobacterium
VMILFVIAYFATVVAIS

SEQ ID NO: 373595 - protein, 24 aa, Mycobacterium
VMIVACLWCARDLWRRGTPAVWCT

SEQ ID NO: 373596 - protein, 19 aa, Mycobacterium
VMIVLLLNVAAAYSAKRLA

SEQ ID NO: 373597 - protein, 17 aa, Mycobacterium
VMKAQPPGSPCYFPFCL

SEQ ID NO: 373598 - protein, 21 aa, Mycobacterium
VMLALYLLGIRRGITAPELAK

SEQ ID NO: 373599 - protein, 18 aa, Mycobacterium
VMLARYQARRMVWEAEIR

SEQ ID NO: 373600 - protein, 18 aa, Mycobacterium
VMLCLYVPPLLVGAHPLV

SEQ ID NO: 373601 - protein, 27 aa, Mycobacterium
VMLLAAAWLALFAVPVFFAVPSPHVSV

SEQ ID NO: 373602 - protein, 18 aa, Mycobacterium
VMLLFYATPIVFGFANVV

SEQ ID NO: 373603 - protein, 18 aa, Mycobacterium
VMLLVLLVVFIRGWRRNP

SEQ ID NO: 373604 - protein, 17 aa, Mycobacterium
VMLTHRNLVANVAQIRP

SEQ ID NO: 373605 - protein, 18 aa, Mycobacterium
VMLVNIPANRKRVVAVSF

SEQ ID NO: 373606 - protein, 19 aa, Mycobacterium
VMMLRKKPGGPVAVSALVR

SEQ ID NO: 373607 - protein, 26 aa, Mycobacterium
VMPAWRARPVLLVAPVVLVALVVVPG

SEQ ID NO: 373608 - protein, 28 aa, Mycobacterium
VMPHDAFLLWGWRVPFILSVVMLGVAVY

SEQ ID NO: 373609 - protein, 23 aa, Mycobacterium
VMPLFPALLMVWGTARTTALATS

SEQ ID NO: 373610 - protein, 23 aa, Mycobacterium
VMPLLPVLLMVWGTARTTALATS

SEQ ID NO: 373611 - protein, 36 aa, Mycobacterium
VMQRPLVFAVPIVIVMLLLIIPLGNLKLGGFSEKYL

SEQ ID NO: 373612 - protein, 38 aa, Mycobacterium
VMRAIGRVSYSWYLWHWPVLLLLPPLLGDPAGLPARLA

SEQ ID NO: 373613 - protein, 19 aa, Mycobacterium
VMRRWAPIGLTVVALLLLL

SEQ ID NO: 373614 - protein, 18 aa, Mycobacterium
VMRRWAPVGLAVVGLLLL

SEQ ID NO: 373615 - protein, 25 aa, Mycobacterium
VMSGNFSWLNWLTILLACSAIEQSA

SEQ ID NO: 373616 - protein, 34 aa, Mycobacterium
VMSLFTAAGYVLWWAVLFPAISVPIIASLVLAIS

SEQ ID NO: 373617 - protein, 19 aa, Mycobacterium
VMSPQAFLIRPSRWLWAIH

SEQ ID NO: 373618 - protein, 18 aa, Mycobacterium
VMSWVDRRRGHHLRGIAV

SEQ ID NO: 373619 - protein, 26 aa, Mycobacterium
VMTAFLFPILLKSIGTTALLYVLVGA

SEQ ID NO: 373620 - protein, 17 aa, Mycobacterium
VMTAIIALALKPMGWRV

SEQ ID NO: 373621 - protein, 32 aa, Mycobacterium
VMTCVTVVLIALLLIAVYRSLTTALIPLMTVG

SEQ ID NO: 373622 - protein, 23 aa, Mycobacterium
VMTPLLLVMIAIGGSDVLFAFDS

SEQ ID NO: 373623 - protein, 27 aa, Mycobacterium
VMTQLGFATLLLGLMVLAAAAGTDRFA

SEQ ID NO: 373624 - protein, 32 aa, Mycobacterium
VMTYHHIVLDGWSLPILLREVFASYYGQRLPV

SEQ ID NO: 373625 - protein, 26 aa, Mycobacterium
VMVAIPLTVLIIFTLNILLAEFGAAD

SEQ ID NO: 373626 - protein, 22 aa, Mycobacterium
VMVALLVCLIPTTIGALLSAIG

SEQ ID NO: 373627 - protein, 17 aa, Mycobacterium
VMVAVLAVGSVAALGLG

SEQ ID NO: 373628 - protein, 21 aa, Mycobacterium
VMVIPAFMRVSRMAPSPAGPE

SEQ ID NO: 373629 - protein, 38 aa, Mycobacterium
VMVSVSFVLMQLLTDAWLWPLSWINVAAAVVFAIVPML

SEQ ID NO: 373630 - protein, 17 aa, Mycobacterium
VMVVIGLTLLVGVVVGF

SEQ ID NO: 373631 - protein, 17 aa, Mycobacterium
VMYSIPLRRALVTGSDL

SEQ ID NO: 373632 - protein, 19 aa, Mycobacterium
VNALFWIGCVCCLAVVVVP

SEQ ID NO: 373633 - protein, 25 aa, Mycobacterium
VNATQLVLGTSRRSRWARILDEGVA

SEQ ID NO: 373634 - protein, 34 aa, Mycobacterium
VNDEARRLLGLPPGPVRLDDLPGFLRSHDPGARD

SEQ ID NO: 373635 - protein, 27 aa, Mycobacterium
VNDLRNWFLIFAFVAIGLEFSARGLRE

SEQ ID NO: 373636 - protein, 33 aa, Mycobacterium
VNELSTPEFPWTGLTIFLLLAVFAAAVATRVLQ

SEQ ID NO: 373637 - protein, 18 aa, Mycobacterium
VNEMDYVRMWVQAAAVMG

SEQ ID NO: 373638 - protein, 19 aa, Mycobacterium
VNFGLFTLVWDHLMRTYAY

SEQ ID NO: 373639 - protein, 25 aa, Mycobacterium
VNFQLWQLLVFIPIAAVLGAQVGYW

SEQ ID NO: 373640 - protein, 22 aa, Mycobacterium
VNFRDVLVALGMYPGGGELGAE

SEQ ID NO: 373641 - protein, 23 aa, Mycobacterium
VNFVVVPIFALANAGVALTGAAF

SEQ ID NO: 373642 - protein, 26 aa, Mycobacterium
VNGAVIILLIWMIDVFVGPAGSGGDY

SEQ ID NO: 373643 - protein, 26 aa, Mycobacterium
VNGKSWLVFGPYAGWSPKFLKHGRLS

SEQ ID NO: 373644 - protein, 29 aa, Mycobacterium
VNGKSWLVFGPYAGWSPKFLKQGHFSDLP

SEQ ID NO: 373645 - protein, 20 aa, Mycobacterium
VNHALAWSGIAAAAVFIVAV

SEQ ID NO: 373646 - protein, 32 aa, Mycobacterium
VNIGRSLPFLILMAAIIPVTRFLVGTTVGIPA

SEQ ID NO: 373647 - protein, 29 aa, Mycobacterium
VNISRFRTLLLKWGLMTVLALLTSAVYMA

SEQ ID NO: 373648 - protein, 28 aa, Mycobacterium
VNITALLFLGGIYLFWNTVAGQAGIFMP

SEQ ID NO: 373649 - protein, 27 aa, Mycobacterium
VNIVRHPWPFFGVATVILLAAASFVPF

SEQ ID NO: 373650 - protein, 24 aa, Mycobacterium
VNIVRPIPFVVLIAALGPITLGVV

SEQ ID NO: 373651 - protein, 20 aa, Mycobacterium
VNKPWLNIVAGLIVGVLLFL

SEQ ID NO: 373652 - protein, 19 aa, Mycobacterium
VNLIASVLVLIVLASCAGL

SEQ ID NO: 373653 - protein, 23 aa, Mycobacterium
VNLKLLMPVFRWQRRDNMLAETD

SEQ ID NO: 373654 - protein, 17 aa, Mycobacterium
VNLLMRFYEVDSGQILL

SEQ ID NO: 373655 - protein, 24 aa, Mycobacterium
VNLMLGLFNLLPGAPLDGGRLVRA

SEQ ID NO: 373656 - protein, 18 aa, Mycobacterium
VNLTAAMMLVFFFVAAIA

SEQ ID NO: 373657 - protein, 17 aa, Mycobacterium
VNLWRFVVYIKDELFLA

SEQ ID NO: 373658 - protein, 17 aa, Mycobacterium
VNMFIADSYVDNIKTKD

SEQ ID NO: 373659 - protein, 25 aa, Mycobacterium
VNNVVRAHVPADRLLFDTQAAKEIC

SEQ ID NO: 373660 - protein, 26 aa, Mycobacterium
VNPDHPYHLLANSLVWVSERYPRRLL

SEQ ID NO: 373661 - protein, 29 aa, Mycobacterium
VNPPAGIALAAYPLWCAFATALSTRIWLL

SEQ ID NO: 373662 - protein, 25 aa, Mycobacterium
VNPQRQLSFLALAAAIIALSCLRCG

SEQ ID NO: 373663 - protein, 24 aa, Mycobacterium
VNQADVRLVLLRPGKDDDEPQQRI

SEQ ID NO: 373664 - protein, 35 aa, Mycobacterium
VNQGSILGELLVYVLPLLLLVGLFVMFSRMQGGAR

SEQ ID NO: 373665 - protein, 34 aa, Mycobacterium
VNQGSVFGTLLIYMLPLLLLVALFVMFSRMQTGG

SEQ ID NO: 373666 - protein, 39 aa, Mycobacterium
VNQSSIFGTLLIYMLPLLLLVALFVLFSRMQSGGRMGFG

SEQ ID NO: 373667 - protein, 25 aa, Mycobacterium
VNRPWLNWVAGLIVGVLLLLSGILM

SEQ ID NO: 373668 - protein, 26 aa, Mycobacterium
VNSGLALPDRLWRLGVGGGGTFEEVA

SEQ ID NO: 373669 - protein, 19 aa, Mycobacterium
VNSLLILLLVHHMRDVDVE

SEQ ID NO: 373670 - protein, 23 aa, Mycobacterium
VNTIMVLIKLSVLVMFAVIALTA

SEQ ID NO: 373671 - protein, 25 aa, Mycobacterium
VNTPAPQQVPAPAPLPGAVPQGAPL

SEQ ID NO: 373672 - protein, 18 aa, Mycobacterium
VNVLYRVSLPKPLPTHRL

SEQ ID NO: 373673 - protein, 18 aa, Mycobacterium
VNVVMKRPIAFAAPILVV

SEQ ID NO: 373674 - protein, 19 aa, Mycobacterium
VNYLKLMPATYVVLAVVAG

SEQ ID NO: 373675 - protein, 24 aa, Mycobacterium
VPAAIVVPPLGRAALWRAARSGLE

SEQ ID NO: 373676 - protein, 25 aa, Mycobacterium
VPAALFLFPPRHHDELRRTAARVCR

SEQ ID NO: 373677 - protein, 24 aa, Mycobacterium
VPAALGILVALFAALTLGPAILTL

SEQ ID NO: 373678 - protein, 33 aa, Mycobacterium
VPAALTSWLVTAAGILWLWAGALAVLAVAVGVT

SEQ ID NO: 373679 - protein, 26 aa, Mycobacterium
VPAFMHVFGGLNWWAPKPLERWHSRS

SEQ ID NO: 373680 - protein, 32 aa, Mycobacterium
VPAFMHVFGSLNWWAPQPLAAMHRRIFAGETG

SEQ ID NO: 373681 - protein, 25 aa, Mycobacterium
VPAGQPWYTSLWHTIADQPHGVTPT

SEQ ID NO: 373682 - protein, 18 aa, Mycobacterium
VPAHFLAGLNWPTAFLVG

SEQ ID NO: 373683 - protein, 23 aa, Mycobacterium
VPAHFLTGLNWPTAFLVGAILSP

SEQ ID NO: 373684 - protein, 39 aa, Mycobacterium
VPAIAGALGKWFWWSPVPLLRGLLFRWSKARSPRTAGVL

SEQ ID NO: 373685 - protein, 17 aa, Mycobacterium
VPAILWGVAFASLVRGL

SEQ ID NO: 373686 - protein, 24 aa, Mycobacterium
VPALLALVWPLLRGAWRGWAVAAG

SEQ ID NO: 373687 - protein, 20 aa, Mycobacterium
VPALLARARWPYRAPRAAMV

SEQ ID NO: 373688 - protein, 25 aa, Mycobacterium
VPALTLLGGLPMPAAVGTSLIVIAL

SEQ ID NO: 373689 - protein, 25 aa, Mycobacterium
VPAMLNFMLPTYQPELRESLALRWI

SEQ ID NO: 373690 - protein, 17 aa, Mycobacterium
VPAPSAWWLLIAGAIGL

SEQ ID NO: 373691 - protein, 28 aa, Mycobacterium
VPATLLLPLLMRLPDTARWYLLKGRADD

SEQ ID NO: 373692 - protein, 35 aa, Mycobacterium
VPATLRVALRIVWALLLMPGLPLLGVPVPGRSHAQ

SEQ ID NO: 373693 - protein, 17 aa, Mycobacterium
VPAVLIELAFSFVVLFV

SEQ ID NO: 373694 - protein, 29 aa, Mycobacterium
VPAWREAHPYLPFIFTGSAAASGAGLGML

SEQ ID NO: 373695 - protein, 23 aa, Mycobacterium
VPCALVILVIVAAALTLAPAILA

SEQ ID NO: 373696 - protein, 33 aa, Mycobacterium
VPDDALLGWVWRIPFLASIFLIGVAVLIRLRLK

SEQ ID NO: 373697 - protein, 25 aa, Mycobacterium
VPDDGFGEVFLLIDNLYAFGRDNTD

SEQ ID NO: 373698 - protein, 19 aa, Mycobacterium
VPDLRGAMLLGVALGLMTL

SEQ ID NO: 373699 - protein, 28 aa, Mycobacterium
VPDNPALMMILLVLLVMLAAVVFVGRLS

SEQ ID NO: 373700 - protein, 19 aa, Mycobacterium
VPDRLLQRWTGVDLTLDVS

SEQ ID NO: 373701 - protein, 25 aa, Mycobacterium
VPDSLIHLCLFIGALTFMYISARAV

SEQ ID NO: 373702 - protein, 25 aa, Mycobacterium
VPDSLIHMCLFLGALTFMYISARAV

SEQ ID NO: 373703 - protein, 25 aa, Mycobacterium
VPDSLVHMSLFLGALTFMYISARAA

SEQ ID NO: 373704 - protein, 17 aa, Mycobacterium
VPDVPRPGFPDFGAPDL

SEQ ID NO: 373705 - protein, 24 aa, Mycobacterium
VPEAKRFCWNCGRPVGRSDSETKG

SEQ ID NO: 373706 - protein, 25 aa, Mycobacterium
VPEERVDEFLAWQKDIVAAESKFAG

SEQ ID NO: 373707 - protein, 23 aa, Mycobacterium
VPEKFWQSFFLVDHPVWSALWGP

SEQ ID NO: 373708 - protein, 25 aa, Mycobacterium
VPEYGFWAWLAMLFSAGMGIGLVFY

SEQ ID NO: 373709 - protein, 33 aa, Mycobacterium
VPFPFQPIHVTIAAWFTIGIPAFILSLAPNNER

SEQ ID NO: 373710 - protein, 21 aa, Mycobacterium
VPGARPPLPPAPPGARTVPLA

SEQ ID NO: 373711 - protein, 24 aa, Mycobacterium
VPGDQLRIVNWPVSARRGTLHITE

SEQ ID NO: 373712 - protein, 18 aa, Mycobacterium
VPGGAWMIGMRRPQSYPL

SEQ ID NO: 373713 - protein, 25 aa, Mycobacterium
VPGIAWFAVLLEMSRPRDTWRGRAG

SEQ ID NO: 373714 - protein, 18 aa, Mycobacterium
VPGLLAMAPFDALARRQA

SEQ ID NO: 373715 - protein, 19 aa, Mycobacterium
VPGLPPPPLIFAEREAPTG

SEQ ID NO: 373716 - protein, 19 aa, Mycobacterium
VPGLVAAGLWAVGLVAGLV

SEQ ID NO: 373717 - protein, 28 aa, Mycobacterium
VPGMPRLLRWLQPVIPLAAGPTPIPFFF

SEQ ID NO: 373718 - protein, 17 aa, Mycobacterium
VPGPWNPIAAPPGRRAA

SEQ ID NO: 373719 - protein, 19 aa, Mycobacterium
VPGRPVLPGLDLVIPAGQT

SEQ ID NO: 373720 - protein, 27 aa, Mycobacterium
VPGVFARLVLLWFLCSALPIGVIGTFI

SEQ ID NO: 373721 - protein, 17 aa, Mycobacterium
VPGVMIVAALIAVIGSL

SEQ ID NO: 373722 - protein, 24 aa, Mycobacterium
VPGVRRLRGPGPVTVGAVAGILSG

SEQ ID NO: 373723 - protein, 30 aa, Mycobacterium
VPGVYARLVLLWFLCSAFPIGVIATLVMLR

SEQ ID NO: 373724 - protein, 18 aa, Mycobacterium
VPIAFLGVGMVFAWPVLT

SEQ ID NO: 373725 - protein, 25 aa, Mycobacterium
VPIEEVLFFLVIPICALLTLNAVST

SEQ ID NO: 373726 - protein, 21 aa, Mycobacterium
VPIEHVGWVALAGLVGFIGNE

SEQ ID NO: 373727 - protein, 28 aa, Mycobacterium
VPIFFVLSGFLLFRPWLKSAATGGPPPS

SEQ ID NO: 373728 - protein, 19 aa, Mycobacterium
VPILGGFVWKRATGAGALV

SEQ ID NO: 373729 - protein, 21 aa, Mycobacterium
VPILSIFGFIVMFGGVVFGIT

SEQ ID NO: 373730 - protein, 20 aa, Mycobacterium
VPILVVSLAALLLGLPTMIL

SEQ ID NO: 373731 - protein, 25 aa, Mycobacterium
VPIPAYEPPPLPPPVQQPVVLPPPN

SEQ ID NO: 373732 - protein, 20 aa, Mycobacterium
VPIPVIIMAVTFAVGYVILH

SEQ ID NO: 373733 - protein, 18 aa, Mycobacterium
VPIVGIILVVLTLVYAFM

SEQ ID NO: 373734 - protein, 18 aa, Mycobacterium
VPIYLMRASAFTALLLAQ

SEQ ID NO: 373735 - protein, 17 aa, Mycobacterium
VPKAWYPKPYSASPSDV

SEQ ID NO: 373736 - protein, 26 aa, Mycobacterium
VPKGATFVLDEWLRPVPPGVVGELYL

SEQ ID NO: 373737 - protein, 27 aa, Mycobacterium
VPKIVLYPIFLLFLGLGALSQVSFAFF

SEQ ID NO: 373738 - protein, 24 aa, Mycobacterium
VPLAYALAIITFIGGFIPIVGAFV

SEQ ID NO: 373739 - protein, 27 aa, Mycobacterium
VPLEAVPPFFRWLAKFEPMHQVFLGVR

SEQ ID NO: 373740 - protein, 26 aa, Mycobacterium
VPLEAVPPFFRWLATFEPMHQVFLGV

SEQ ID NO: 373741 - protein, 23 aa, Mycobacterium
VPLEWNVFMIFGVLALFVGHADL

SEQ ID NO: 373742 - protein, 24 aa, Mycobacterium
VPLEWNVFMIFGVLSLFVAHARLG

SEQ ID NO: 373743 - protein, 22 aa, Mycobacterium
VPLEWNVFMIFGVLSLFVAHTQ

SEQ ID NO: 373744 - protein, 25 aa, Mycobacterium
VPLEWNVFMIFGVLWLFVAHAHLGL

SEQ ID NO: 373745 - protein, 25 aa, Mycobacterium
VPLEWNVFMIFGVLWLFVTHAPLGL

SEQ ID NO: 373746 - protein, 22 aa, Mycobacterium
VPLEWNVFMMFSVLALFVGNAG

SEQ ID NO: 373747 - protein, 17 aa, Mycobacterium
VPLGTNPWYGDPNQIVA

SEQ ID NO: 373748 - protein, 20 aa, Mycobacterium
VPLILIGLPVDVASALALAV

SEQ ID NO: 373749 - protein, 19 aa, Mycobacterium
VPLLIVWALIRRRQSRRVF

SEQ ID NO: 373750 - protein, 30 aa, Mycobacterium
VPLRVGLVAATLALVLCGLLASGVAVTSIL

SEQ ID NO: 373751 - protein, 26 aa, Mycobacterium
VPLSLAVLVWVFGGLLVAALPVLVAV

SEQ ID NO: 373752 - protein, 22 aa, Mycobacterium
VPLVMVLVIAIASFAVVRLHGV

SEQ ID NO: 373753 - protein, 23 aa, Mycobacterium
VPLVRWTAHWPRRHALMVSLVCL

SEQ ID NO: 373754 - protein, 31 aa, Mycobacterium
VPLWAGYACSTLIIFPLVIYGMKVLSQLQLW

SEQ ID NO: 373755 - protein, 19 aa, Mycobacterium
VPMFLGAMIMGPLGGWCMK

SEQ ID NO: 373756 - protein, 17 aa, Mycobacterium
VPMGVLCYRHRIRVALA

SEQ ID NO: 373757 - protein, 23 aa, Mycobacterium
VPMLHRFGELVAPLTFIGAAYVT

SEQ ID NO: 373758 - protein, 36 aa, Mycobacterium
VPMMSGLTGLIFRALLALVGAVARRAPRMRPQRGIS

SEQ ID NO: 373759 - protein, 28 aa, Mycobacterium
VPNFALTPLLIIWMGIGEGPKIVLITMG

SEQ ID NO: 373760 - protein, 27 aa, Mycobacterium
VPNIPGAPWWGAVLIAVSTTALGYAFD

SEQ ID NO: 373761 - protein, 17 aa, Mycobacterium
VPNLAWCVGYINASWTL

SEQ ID NO: 373762 - protein, 25 aa, Mycobacterium
VPNTIYSPLFRKFVEWTEYLCLMPI

SEQ ID NO: 373763 - protein, 19 aa, Mycobacterium
VPNVLALAALILLVVAIEL

SEQ ID NO: 373764 - protein, 39 aa, Mycobacterium
VPPAKRSLVRPAVLIPALLAILLVIATLVALREFQRADD

SEQ ID NO: 373765 - protein, 26 aa, Mycobacterium
VPPDSTIPIELPFTGLADPHGLAFDS

SEQ ID NO: 373766 - protein, 24 aa, Mycobacterium
VPPDWSLDFEPALTRLLTATCIGI

SEQ ID NO: 373767 - protein, 36 aa, Mycobacterium
VPPEPPPIPPPAPAPPPAPYRPPVNVLATLSLVFAF

SEQ ID NO: 373768 - protein, 19 aa, Mycobacterium
VPPIGLNAPVPIQPPPPGP

SEQ ID NO: 373769 - protein, 21 aa, Mycobacterium
VPPPPVAVQPAPVTMPPAAVV

SEQ ID NO: 373770 - protein, 21 aa, Mycobacterium
VPPPRVPVMRPRAPAPAFRGP

SEQ ID NO: 373771 - protein, 20 aa, Mycobacterium
VPPSYGYQPAFPGATPRSSS

SEQ ID NO: 373772 - protein, 24 aa, Mycobacterium
VPPYGRPPLAPPPAPGPAPAPAPA

SEQ ID NO: 373773 - protein, 25 aa, Mycobacterium
VPQAPAPVPVPIPQAPAPAPEAPVP

SEQ ID NO: 373774 - protein, 25 aa, Mycobacterium
VPQGPLPILLTVLGAMLAGACLTVA

SEQ ID NO: 373775 - protein, 17 aa, Mycobacterium
VPQPLAYCLPGVRSRVV

SEQ ID NO: 373776 - protein, 20 aa, Mycobacterium
VPQPLAYCLPGVRSRVVVSE

SEQ ID NO: 373777 - protein, 17 aa, Mycobacterium
VPRLAVLPRTRQTLLDT

SEQ ID NO: 373778 - protein, 17 aa, Mycobacterium
VPRLLAAMVIGVALCGV

SEQ ID NO: 373779 - protein, 19 aa, Mycobacterium
VPRLTFWDYPLAAAISVVT

SEQ ID NO: 373780 - protein, 17 aa, Mycobacterium
VPRPVRIALAELAAALA

SEQ ID NO: 373781 - protein, 21 aa, Mycobacterium
VPSATLLYLIAGVALGIIGTF

SEQ ID NO: 373782 - protein, 31 aa, Mycobacterium
VPSGTALWAPYLPLLVAGIVVPPLVTTGLER

SEQ ID NO: 373783 - protein, 28 aa, Mycobacterium
VPSGTVPLFFILWALSNFVGPLALGHLF

SEQ ID NO: 373784 - protein, 28 aa, Mycobacterium
VPSIVAALFIFALWIATLGFPQSALAVS

SEQ ID NO: 373785 - protein, 26 aa, Mycobacterium
VPSIVAALFIFSLWIATLGFQQSAFA

SEQ ID NO: 373786 - protein, 26 aa, Mycobacterium
VPSIVAALFIFSLWIATLGFQQSALA

SEQ ID NO: 373787 - protein, 26 aa, Mycobacterium
VPSIVAALFVFSLWIATLGFQQSSFA

SEQ ID NO: 373788 - protein, 21 aa, Mycobacterium
VPSLLRTLLSDHLDAGYLEAA

SEQ ID NO: 373789 - protein, 31 aa, Mycobacterium
VPSRIAAVHLFLWGLGTLLFTTLYGLIDIRF

SEQ ID NO: 373790 - protein, 17 aa, Mycobacterium
VPSRRLLPALAVVAVAG

SEQ ID NO: 373791 - protein, 21 aa, Mycobacterium
VPSVLLYRMLTCWLPVFVGWP

SEQ ID NO: 373792 - protein, 25 aa, Mycobacterium
VPSVPRWLWVVLAIGGITAALAGGA

SEQ ID NO: 373793 - protein, 32 aa, Mycobacterium
VPTARAAAPFQLLFSLIFTPVIRLTNGTANWI

SEQ ID NO: 373794 - protein, 21 aa, Mycobacterium
VPTMLAPVAVPYPSGPAAPPP

SEQ ID NO: 373795 - protein, 25 aa, Mycobacterium
VPTRAALPDVLLPQNYQPPKDLQPP

SEQ ID NO: 373796 - protein, 20 aa, Mycobacterium
VPTSALLDKYSPSFFCMMRN

SEQ ID NO: 373797 - protein, 19 aa, Mycobacterium
VPVALILWRTFRPGFDQFF

SEQ ID NO: 373798 - protein, 17 aa, Mycobacterium
VPVDIPAVGFNIVFSDA

SEQ ID NO: 373799 - protein, 26 aa, Mycobacterium
VPVERTFWYRTAKLAMRHALPVGLAI

SEQ ID NO: 373800 - protein, 24 aa, Mycobacterium
VPVFFSLFGLVFIPLSWMMPPRSP

SEQ ID NO: 373801 - protein, 25 aa, Mycobacterium
VPVIGIMMLALFELVLRNLTQTQFA

SEQ ID NO: 373802 - protein, 18 aa, Mycobacterium
VPVLIALLLSLRFAPRVL

SEQ ID NO: 373803 - protein, 24 aa, Mycobacterium
VPVQFVAGWPFLKGAVQQARAGSA

SEQ ID NO: 373804 - protein, 25 aa, Mycobacterium
VPVRPDLPEVLLPQNYQPPKDLAPP

SEQ ID NO: 373805 - protein, 27 aa, Mycobacterium
VPVVLAVWVLIVGWRRGPAGPVALVAP

SEQ ID NO: 373806 - protein, 24 aa, Mycobacterium
VPVYGAILPLLLPGGSRRSPVVWW

SEQ ID NO: 373807 - protein, 18 aa, Mycobacterium
VPWLRSVLEPWLTFLRAL

SEQ ID NO: 373808 - protein, 24 aa, Mycobacterium
VPWPAYKLIALAVGAVVLLVVAAV

SEQ ID NO: 373809 - protein, 23 aa, Mycobacterium
VPWWWWPLGFAAAALIAFEVNMG

SEQ ID NO: 373810 - protein, 21 aa, Mycobacterium
VPYLAFLAPGIIAQSALFISI

SEQ ID NO: 373811 - protein, 19 aa, Mycobacterium
VQAAVLVTLIAWRLRQLDP

SEQ ID NO: 373812 - protein, 37 aa, Mycobacterium
VQAFDVFSSFWFTSIYVLLFVSLVGCLTPRLFEHFRS

SEQ ID NO: 373813 - protein, 18 aa, Mycobacterium
VQAFIQYVRQFNTPVGQV

SEQ ID NO: 373814 - protein, 25 aa, Mycobacterium
VQAGLFWPVLAVVMFAALGLAAALL

SEQ ID NO: 373815 - protein, 17 aa, Mycobacterium
VQALRDALRTHVGFVRS

SEQ ID NO: 373816 - protein, 26 aa, Mycobacterium
VQAPLYFHIHVMIALVLFCLWPFTRL

SEQ ID NO: 373817 - protein, 26 aa, Mycobacterium
VQARDVILVTGPWLAGTSSVLAALRE

SEQ ID NO: 373818 - protein, 23 aa, Mycobacterium
VQASWPWAVAVFALVVFVGPLGE

SEQ ID NO: 373819 - protein, 26 aa, Mycobacterium
VQAVDLRLFFLSFMFLFVATGIGNGS

SEQ ID NO: 373820 - protein, 22 aa, Mycobacterium
VQDGRNILPPNKFPMIPPQVDP

SEQ ID NO: 373821 - protein, 18 aa, Mycobacterium
VQDLLAGFFIITEKQYGF

SEQ ID NO: 373822 - protein, 21 aa, Mycobacterium
VQDPELAYATLKWARIDPEMY

SEQ ID NO: 373823 - protein, 25 aa, Mycobacterium
VQFRGGFTPKITLTALASRSGLVLD

SEQ ID NO: 373824 - protein, 28 aa, Mycobacterium
VQGAIRWWQPLTWLLYPAVYAAVALLVL

SEQ ID NO: 373825 - protein, 28 aa, Mycobacterium
VQGQFYVSFLVLIAGLAYLCGRRPGARL

SEQ ID NO: 373826 - protein, 17 aa, Mycobacterium
VQGQTLHEILKGGALEA

SEQ ID NO: 373827 - protein, 19 aa, Mycobacterium
VQHLLGHICWIFAVTAIIR

SEQ ID NO: 373828 - protein, 27 aa, Mycobacterium
VQHTVRSLVWLQIGIGAAVLVVVGIAG

SEQ ID NO: 373829 - protein, 26 aa, Mycobacterium
VQHTWIDTFVVSAPWLVLAAAVTRVV

SEQ ID NO: 373830 - protein, 26 aa, Mycobacterium
VQIGILVAAFFALRSVARRSSVVREE

SEQ ID NO: 373831 - protein, 20 aa, Mycobacterium
VQIVPLALTGWRQLNNWPAV

SEQ ID NO: 373832 - protein, 19 aa, Mycobacterium
VQLFVQWTPDRVLAVSGWA

SEQ ID NO: 373833 - protein, 22 aa, Mycobacterium
VQLLRIWLSGWSDRLLGAVSGR

SEQ ID NO: 373834 - protein, 17 aa, Mycobacterium
VQLPAVWLLAAVAVGLF

SEQ ID NO: 373835 - protein, 32 aa, Mycobacterium
VQMVAWALFKNPWIMPAFGFAVGFISDYIALN

SEQ ID NO: 373836 - protein, 20 aa, Mycobacterium
VQPALWLLIFGTTFSHLHVI

SEQ ID NO: 373837 - protein, 25 aa, Mycobacterium
VQPHFISQLPFWYFGGVAAIAVIYG

SEQ ID NO: 373838 - protein, 23 aa, Mycobacterium
VQPMLFAVMVSLARTLISYGIEP

SEQ ID NO: 373839 - protein, 20 aa, Mycobacterium
VQPPKQLSAPLALPKPPTER

SEQ ID NO: 373840 - protein, 31 aa, Mycobacterium
VQPVLWAMMVSLAQLWRSVGVVPDAVIGHSQ

SEQ ID NO: 373841 - protein, 37 aa, Mycobacterium
VQQGPLLAYTGWMFLLQGPPLAIFAAIRRGPRLLGAV

SEQ ID NO: 373842 - protein, 26 aa, Mycobacterium
VQQVPVKWWDILRKPSYLAIVAGAAS

SEQ ID NO: 373843 - protein, 20 aa, Mycobacterium
VQQYFERCPPFAVLSALVIA

SEQ ID NO: 373844 - protein, 19 aa, Mycobacterium
VQRLIAFLVILTQGGIAVT

SEQ ID NO: 373845 - protein, 26 aa, Mycobacterium
VQRTLALFLATFVYALTVLRTVRNDA

SEQ ID NO: 373846 - protein, 25 aa, Mycobacterium
VQRTLAVFLATFAYALTVLRSVRNK

SEQ ID NO: 373847 - protein, 29 aa, Mycobacterium
VQRYLPYLTVLIGVLLFGLGVWLLSGREL

SEQ ID NO: 373848 - protein, 17 aa, Mycobacterium
VQSSRWGRYPVRAGVRV

SEQ ID NO: 373849 - protein, 24 aa, Mycobacterium
VQTMTAPMDPALIQLIHQLEETID

SEQ ID NO: 373850 - protein, 17 aa, Mycobacterium
VQTPVLSQFFGCTPLGP

SEQ ID NO: 373851 - protein, 24 aa, Mycobacterium
VQTRPYRVIAGLVLSFCLVTLTGS

SEQ ID NO: 373852 - protein, 25 aa, Mycobacterium
VQTTMALFLATFAYALTVLKNIQNG

SEQ ID NO: 373853 - protein, 26 aa, Mycobacterium
VQVIVHLLLLIFFSVVAGASMHLSHF

SEQ ID NO: 373854 - protein, 25 aa, Mycobacterium
VQVLAIGLFVLPLGGPFRVAAAVVM

SEQ ID NO: 373855 - protein, 28 aa, Mycobacterium
VQVLGPGPRWWGVALLAVGAVTALYGVL

SEQ ID NO: 373856 - protein, 20 aa, Mycobacterium
VQVSGWRFLLRRLEHAIVRR

SEQ ID NO: 373857 - protein, 28 aa, Mycobacterium
VQWFAGVVLLIVGPALWLGHRQWRKYEE

SEQ ID NO: 373858 - protein, 18 aa, Mycobacterium
VQWRHRALLVAAIATMLA

SEQ ID NO: 373859 - protein, 20 aa, Mycobacterium
VQWVVLPLSIVILLAVGSDY

SEQ ID NO: 373860 - protein, 21 aa, Mycobacterium
VQYLFTELFTGRFQWQEFIRQ

SEQ ID NO: 373861 - protein, 22 aa, Mycobacterium
VQYVDYTLWQRAEFGDFADGGS

SEQ ID NO: 373862 - protein, 23 aa, Mycobacterium
VRAARRILRRLIVLLALVCAQAA

SEQ ID NO: 373863 - protein, 26 aa, Mycobacterium
VRACLAALLMLTAAMAWLLLGRSPEF

SEQ ID NO: 373864 - protein, 24 aa, Mycobacterium
VRADWVPLVLLGYGLGSLAGMAGG

SEQ ID NO: 373865 - protein, 17 aa, Mycobacterium
VRAGRAKPLPLAPTDQP

SEQ ID NO: 373866 - protein, 29 aa, Mycobacterium
VRANSTDRPLLPRAFPSASASALLLNLPR

SEQ ID NO: 373867 - protein, 18 aa, Mycobacterium
VRANWFRFDAVRAVAIED

SEQ ID NO: 373868 - protein, 23 aa, Mycobacterium
VRANWVLRNLMREYGRRLVEAGI

SEQ ID NO: 373869 - protein, 22 aa, Mycobacterium
VRATRPVLRRLGVLLVLLCAQA

SEQ ID NO: 373870 - protein, 25 aa, Mycobacterium
VRAVEPRLPAILLGLGAEPDDRERR

SEQ ID NO: 373871 - protein, 19 aa, Mycobacterium
VRDMFAWIGPVLTALQGNR

SEQ ID NO: 373872 - protein, 31 aa, Mycobacterium
VRDTLALRVRRPVRWLRLGGTAPMPTYFEII

SEQ ID NO: 373873 - protein, 35 aa, Mycobacterium
VRDVLFGGKVSYLALAVLAILALVIGVIGGVIGRK

SEQ ID NO: 373874 - protein, 38 aa, Mycobacterium
VRDVLFGGKVSYLALLVLVLIALLIGVIGGVVGRKTAE

SEQ ID NO: 373875 - protein, 37 aa, Mycobacterium
VRDVLFGGQVSYLALIVLAVIALVIGALGGVIGRKTA

SEQ ID NO: 373876 - protein, 38 aa, Mycobacterium
VRDVLFGGRVSYLALLVLALIALVIGLIGGVVGRKTAE

SEQ ID NO: 373877 - protein, 33 aa, Mycobacterium
VRDVLIVERIALIGTFALCLWYELMDGPEGQAL

SEQ ID NO: 373878 - protein, 23 aa, Mycobacterium
VREGWAFVAMRLTSTVPIVGGLN

SEQ ID NO: 373879 - protein, 27 aa, Mycobacterium
VRELVVAWGKLYPQFGAVGALSLVQCL

SEQ ID NO: 373880 - protein, 20 aa, Mycobacterium
VRELYGPLLAEGVPFLVTDL

SEQ ID NO: 373881 - protein, 17 aa, Mycobacterium
VRERMGVTLQLRDFVHA

SEQ ID NO: 373882 - protein, 20 aa, Mycobacterium
VRFAFRRPFQGREFLEQSWF

SEQ ID NO: 373883 - protein, 20 aa, Mycobacterium
VRFGRWIFLVGAAARIALLG

SEQ ID NO: 373884 - protein, 18 aa, Mycobacterium
VRFPRTSALVIRYGDVPS

SEQ ID NO: 373885 - protein, 26 aa, Mycobacterium
VRGAEALVRWQHPRFGVLEPAQFLPL

SEQ ID NO: 373886 - protein, 20 aa, Mycobacterium
VRGAMKAAWDKLKGATGKLG

SEQ ID NO: 373887 - protein, 28 aa, Mycobacterium
VRGDYLNVFATFDLTLRRTGESVFTTSG

SEQ ID NO: 373888 - protein, 26 aa, Mycobacterium
VRGGARVYWVLLWVSFALAVIAGAWT

SEQ ID NO: 373889 - protein, 26 aa, Mycobacterium
VRGIQGSLLGLPLQEPYLVGCLSAHN

SEQ ID NO: 373890 - protein, 27 aa, Mycobacterium
VRGNLRILLPLAIVGALLLVAGGAIQN

SEQ ID NO: 373891 - protein, 24 aa, Mycobacterium
VRGPNLAWVLAAYGLAGLLSVPLV

SEQ ID NO: 373892 - protein, 28 aa, Mycobacterium
VRGWRKIGAAIVRWPGPILIGAVALALV

SEQ ID NO: 373893 - protein, 34 aa, Mycobacterium
VRHGIFWAGFVLYFTTYHTWLGYRRRRLTQHLES

SEQ ID NO: 373894 - protein, 25 aa, Mycobacterium
VRIGRHWVSFAWLAVGALVALAVIV

SEQ ID NO: 373895 - protein, 29 aa, Mycobacterium
VRILTTLFGFLVLVLLLSALNATVFQSAP

SEQ ID NO: 373896 - protein, 25 aa, Mycobacterium
VRIQIILTFFILFTNIMGIAVSLLL

SEQ ID NO: 373897 - protein, 18 aa, Mycobacterium
VRIQIIMTVLVLGANLIG

SEQ ID NO: 373898 - protein, 41 aa, Mycobacterium
VRKAAAWSWRLLIIGGAIVALLWLIKRLEILFVPVALATMV

SEQ ID NO: 373899 - protein, 28 aa, Mycobacterium
VRKVFVLQAFLTLFISFPLQLSAVTGPT

SEQ ID NO: 373900 - protein, 29 aa, Mycobacterium
VRLAEPRWMPLWAFVIAMVLLRSSLVGYG

SEQ ID NO: 373901 - protein, 29 aa, Mycobacterium
VRLALIIPTAWILMTLVFVLMRGIGDPIT

SEQ ID NO: 373902 - protein, 32 aa, Mycobacterium
VRLATRAVMTTLMALAFWLSGVGVAAAHTSLV

SEQ ID NO: 373903 - protein, 28 aa, Mycobacterium
VRLGSYGAWIPYYLCELSLRVSDLQYRT

SEQ ID NO: 373904 - protein, 33 aa, Mycobacterium
VRLIYTWRWSLVTLWFTGVLLLILERFWNYWST

SEQ ID NO: 373905 - protein, 18 aa, Mycobacterium
VRLLRTFLRDVPNQVVLA

SEQ ID NO: 373906 - protein, 17 aa, Mycobacterium
VRLPLLQGVTFAGVSPI

SEQ ID NO: 373907 - protein, 32 aa, Mycobacterium
VRLSLWYPHYAWLMLTIYLATAVVALIVVGAT

SEQ ID NO: 373908 - protein, 21 aa, Mycobacterium
VRLTARWPRRRALLVTMVCLT

SEQ ID NO: 373909 - protein, 19 aa, Mycobacterium
VRLVDFHRLVYAIKASRYD

SEQ ID NO: 373910 - protein, 19 aa, Mycobacterium
VRLWAGWVPAMGLLTHVGR

SEQ ID NO: 373911 - protein, 41 aa, Mycobacterium
VRMAAAWSWRLLVIFAAIVTLLWLVLRLEILVVPVALATII

SEQ ID NO: 373912 - protein, 32 aa, Mycobacterium
VRMAIPALIILAPFWLIPTTLYVHISMTLPIF

SEQ ID NO: 373913 - protein, 19 aa, Mycobacterium
VRMALLVLAGGSFAWCVHM

SEQ ID NO: 373914 - protein, 17 aa, Mycobacterium
VRMILVPAFMHVLGHWN

SEQ ID NO: 373915 - protein, 32 aa, Mycobacterium
VRMILVPAFMYLMGQWNWWAPAPLARLHQRVG

SEQ ID NO: 373916 - protein, 17 aa, Mycobacterium
VRMLRLGGTASLPTYFE

SEQ ID NO: 373917 - protein, 17 aa, Mycobacterium
VRMVLVPAFMHLMGGVN

SEQ ID NO: 373918 - protein, 35 aa, Mycobacterium
VRMVLVPAFMHVMGRWNWWAPKPLVWLHQRFGISE

SEQ ID NO: 373919 - protein, 27 aa, Mycobacterium
VRNGMPVWLVVLWALALLVTGAGIGIA

SEQ ID NO: 373920 - protein, 19 aa, Mycobacterium
VRNRLAVASLTLLVLLFVG

SEQ ID NO: 373921 - protein, 18 aa, Mycobacterium
VRNSGYVRKWLILGIAIG

SEQ ID NO: 373922 - protein, 19 aa, Mycobacterium
VRNYFYWEPHCYNIPLCWS

SEQ ID NO: 373923 - protein, 27 aa, Mycobacterium
VRPARLAMAVMFGVLALGSALGLAGLS

SEQ ID NO: 373924 - protein, 22 aa, Mycobacterium
VRPDLPETLLPQNYKVPADLQP

SEQ ID NO: 373925 - protein, 20 aa, Mycobacterium
VRPLRYVVAGFGLSALLCPL

SEQ ID NO: 373926 - protein, 26 aa, Mycobacterium
VRPPLRERILLRLSSIELNPRELVAR

SEQ ID NO: 373927 - protein, 18 aa, Mycobacterium
VRPVTGPGLVVTLTDAKR

SEQ ID NO: 373928 - protein, 19 aa, Mycobacterium
VRPYGYDETARWVPRLWRR

SEQ ID NO: 373929 - protein, 18 aa, Mycobacterium
VRQRPLPAPWPQPVQRDP

SEQ ID NO: 373930 - protein, 19 aa, Mycobacterium
VRQVYDMALVFRHRVRKDR

SEQ ID NO: 373931 - protein, 37 aa, Mycobacterium
VRRGWSAMPLALRLLLPIAFVLISAGIGVAFWLQSPP

SEQ ID NO: 373932 - protein, 20 aa, Mycobacterium
VRRHPGFLIGAVASIVLLVA

SEQ ID NO: 373933 - protein, 31 aa, Mycobacterium
VRRLLGELTHFFALLLWAAAVLAFFAKLPQL

SEQ ID NO: 373934 - protein, 17 aa, Mycobacterium
VRRLLLPGREFRVSGEG

SEQ ID NO: 373935 - protein, 29 aa, Mycobacterium
VRRLPAWPIWFALLWAAQEWLKSVFPFGG

SEQ ID NO: 373936 - protein, 29 aa, Mycobacterium
VRRLSGVIAIVVLLFLACAPVASAQPAAG

SEQ ID NO: 373937 - protein, 19 aa, Mycobacterium
VRRPVPHLVASALVLALLA

SEQ ID NO: 373938 - protein, 18 aa, Mycobacterium
VRRRGFYSALPFVGIMLG

SEQ ID NO: 373939 - protein, 40 aa, Mycobacterium
VRRVADGSPIIWLGPGLQEKLAFVWELPDNALATGDVVTL

SEQ ID NO: 373940 - protein, 30 aa, Mycobacterium
VRRVLPALVNQFIALLKASALVYFLGLVAD

SEQ ID NO: 373941 - protein, 17 aa, Mycobacterium
VRRWRKLGAAIARWPGP

SEQ ID NO: 373942 - protein, 26 aa, Mycobacterium
VRSAGFAYPFLAYHVAGRGHQAGAVG

SEQ ID NO: 373943 - protein, 36 aa, Mycobacterium
VRSFLVPSIAALLGRWFWWPRRVYSRPVNTAPSSPR

SEQ ID NO: 373944 - protein, 18 aa, Mycobacterium
VRSGMDLGPWLVSRDVTV

SEQ ID NO: 373945 - protein, 20 aa, Mycobacterium
VRSRFPHLSAREVMRRIEAT

SEQ ID NO: 373946 - protein, 25 aa, Mycobacterium
VRSSLRAMFARTVKLVGWFVGWIVV

SEQ ID NO: 373947 - protein, 19 aa, Mycobacterium
VRSSQIASLPRGPMVGIPG

SEQ ID NO: 373948 - protein, 24 aa, Mycobacterium
VRSTVDLAAPWFIGAAMGLQVLGT

SEQ ID NO: 373949 - protein, 40 aa, Mycobacterium
VRSVLEPWLTFLRTLPPLAYFFLLVIWLGIDEAPKITLLA

SEQ ID NO: 373950 - protein, 20 aa, Mycobacterium
VRSYFYWERHCYDIPVCFGL

SEQ ID NO: 373951 - protein, 20 aa, Mycobacterium
VRTGLLWWTVAIHLLTSMTM

SEQ ID NO: 373952 - protein, 20 aa, Mycobacterium
VRTGLLWWTVAIHLLVSMGM

SEQ ID NO: 373953 - protein, 17 aa, Mycobacterium
VRTLAGMWTDLLTAIAS

SEQ ID NO: 373954 - protein, 17 aa, Mycobacterium
VRTLPSPRPRRWSRAAV

SEQ ID NO: 373955 - protein, 25 aa, Mycobacterium
VRTLTFPVPVIIAATGPAIAMGSFL

SEQ ID NO: 373956 - protein, 30 aa, Mycobacterium
VRTLVFAVVMLILFRLLSPLERRPLPWWDG

SEQ ID NO: 373957 - protein, 18 aa, Mycobacterium
VRTLVIPALFALIGDRIW

SEQ ID NO: 373958 - protein, 25 aa, Mycobacterium
VRTQVTLVRRLVVAVVAVLGVAAAL

SEQ ID NO: 373959 - protein, 24 aa, Mycobacterium
VRTSLIVLTLIVLAISLSVHGQSG

SEQ ID NO: 373960 - protein, 19 aa, Mycobacterium
VRTYRVWKARGTWWGWQGA

SEQ ID NO: 373961 - protein, 24 aa, Mycobacterium
VRVGDTWHPVLNLASARLIAATAA

SEQ ID NO: 373962 - protein, 23 aa, Mycobacterium
VRVGDTWHPVLNLASARLIAGTG

SEQ ID NO: 373963 - protein, 17 aa, Mycobacterium
VRVIELGGIGPGPHAGM

SEQ ID NO: 373964 - protein, 27 aa, Mycobacterium
VRVLAIPIVLFWVGVAVLLSVLVPKLD

SEQ ID NO: 373965 - protein, 24 aa, Mycobacterium
VRVLLDMYLTQRFMMRWRVWLTRR

SEQ ID NO: 373966 - protein, 22 aa, Mycobacterium
VRVLPPFLSRKHLPSRLAKLRE

SEQ ID NO: 373967 - protein, 24 aa, Mycobacterium
VRVPTLWIVLGPLGQSITAAGLLA

SEQ ID NO: 373968 - protein, 27 aa, Mycobacterium
VRVRLLLLLVYLILPIDLVPDFIPFLG

SEQ ID NO: 373969 - protein, 29 aa, Mycobacterium
VRVSAVLRLPLIGLIFVLVMVWEVDHWLP

SEQ ID NO: 373970 - protein, 18 aa, Mycobacterium
VRVTLWCGVISLLLSAIS

SEQ ID NO: 373971 - protein, 27 aa, Mycobacterium
VRWDPYPFILLNLAFSTQAAYAAPLIL

SEQ ID NO: 373972 - protein, 19 aa, Mycobacterium
VRWGEFGMIPALNARRHPH

SEQ ID NO: 373973 - protein, 35 aa, Mycobacterium
VRWPWAVIGVWIALAVALPLSFPSLGQMAAKNPLQ

SEQ ID NO: 373974 - protein, 35 aa, Mycobacterium
VRWPWVVIGAWVALAIALPLTFPSLTEMAEKHPLA

SEQ ID NO: 373975 - protein, 26 aa, Mycobacterium
VRWSIRVMIVILWFSAAMAIISSLYA

SEQ ID NO: 373976 - protein, 24 aa, Mycobacterium
VRWTAHLPRRRVLVASLTCLTASQ

SEQ ID NO: 373977 - protein, 19 aa, Mycobacterium
VRWTAHWPRRRTLVVALVC

SEQ ID NO: 373978 - protein, 19 aa, Mycobacterium
VRYEWSMALAALATLVFDL

SEQ ID NO: 373979 - protein, 30 aa, Mycobacterium
VRYRERLWVPWWWWPPALALAGILAFEFNM

SEQ ID NO: 373980 - protein, 26 aa, Mycobacterium
VRYSMILFNWFCVGLIPVLILLVMQI

SEQ ID NO: 373981 - protein, 22 aa, Mycobacterium
VSAAHRLAFAGLLLLGLAMAGV

SEQ ID NO: 373982 - protein, 31 aa, Mycobacterium
VSAALTLVTGVWLLALPLPGRSHLQRGYCRL

SEQ ID NO: 373983 - protein, 26 aa, Mycobacterium
VSADLILFFVFFDLSIVAMYFVIAGW

SEQ ID NO: 373984 - protein, 35 aa, Mycobacterium
VSADMIDWFWRHNAWRGVFNNPLPRRATTDQLDTA

SEQ ID NO: 373985 - protein, 23 aa, Mycobacterium
VSAEVRFRRWDGDTMWGAVSASV

SEQ ID NO: 373986 - protein, 22 aa, Mycobacterium
VSAFALILAMPVALGVAIFITQ

SEQ ID NO: 373987 - protein, 23 aa, Mycobacterium
VSAFAVIWLILAATLWLMRPTAS

SEQ ID NO: 373988 - protein, 23 aa, Mycobacterium
VSAFIGLPREIIQPALDTFSKGL

SEQ ID NO: 373989 - protein, 25 aa, Mycobacterium
VSAFPTAAGFWGAALVLTLVSYPLV

SEQ ID NO: 373990 - protein, 26 aa, Mycobacterium
VSAGEWLWAGLLTVAVIVIVTVGDPQ

SEQ ID NO: 373991 - protein, 22 aa, Mycobacterium
VSAIIMLAGIYYGAQYGGTITS

SEQ ID NO: 373992 - protein, 22 aa, Mycobacterium
VSALAALAVSVYVSRRLQRSVT

SEQ ID NO: 373993 - protein, 28 aa, Mycobacterium
VSALAVLPALWRYAPLTPIRGPPRSPVA

SEQ ID NO: 373994 - protein, 25 aa, Mycobacterium
VSALGQFIPVIWLGALGATLATLST

SEQ ID NO: 373995 - protein, 18 aa, Mycobacterium
VSALLIAAAIAGSTLMLV

SEQ ID NO: 373996 - protein, 28 aa, Mycobacterium
VSALTLIFMIMLLLTRSVVAALVIVGTA

SEQ ID NO: 373997 - protein, 17 aa, Mycobacterium
VSAPIDRAWDVLCDLEQ

SEQ ID NO: 373998 - protein, 25 aa, Mycobacterium
VSAQPLWLVFAGVGVLIFTLGVYST

SEQ ID NO: 373999 - protein, 22 aa, Mycobacterium
VSATILIVLGLALAAPALADHN

SEQ ID NO: 374000 - protein, 19 aa, Mycobacterium
VSAVAVLIIACPCALGLAT

SEQ ID NO: 374001 - protein, 35 aa, Mycobacterium
VSAVFVPIVLALSVATLAVWLLTGHSATVAFTAAV

SEQ ID NO: 374002 - protein, 30 aa, Mycobacterium
VSAVISGLLLNFLFVAPRYSFTIGETDNAL

SEQ ID NO: 374003 - protein, 27 aa, Mycobacterium
VSAVLAYLFFPLYRRLRTRMGTGGAAA

SEQ ID NO: 374004 - protein, 23 aa, Mycobacterium
VSAVVMIALATIGTLSVFTLRSS

SEQ ID NO: 374005 - protein, 20 aa, Mycobacterium
VSCLLLITFGIAMALSLGAE

SEQ ID NO: 374006 - protein, 36 aa, Mycobacterium
VSDASIWIRLPDLICALICWLLLSREVLPRLGPAVA

SEQ ID NO: 374007 - protein, 25 aa, Mycobacterium
VSDAWYLNWGFFVAMGAILALGAVI

SEQ ID NO: 374008 - protein, 17 aa, Mycobacterium
VSDELWRRIGVSLRLVL

SEQ ID NO: 374009 - protein, 24 aa, Mycobacterium
VSDLPRPGFPDFGAPGLAIPEVAG

SEQ ID NO: 374010 - protein, 27 aa, Mycobacterium
VSDPHRAHWEWLKWLPHNQHPGDSDAA

SEQ ID NO: 374011 - protein, 31 aa, Mycobacterium; identical to SEQ ID NO: 25585

SEQ ID NO: 374012 - protein, 24 aa, Mycobacterium
VSEGELFVVGRSKEMLIVRGRNFP

SEQ ID NO: 374013 - protein, 18 aa, Mycobacterium
VSELDRFESLLNDLLEIS

SEQ ID NO: 374014 - protein, 21 aa, Mycobacterium
VSFAAILWRLSGTLTVFGIDI

SEQ ID NO: 374015 - protein, 19 aa, Mycobacterium
VSFASTLGLALVIWQHVLG

SEQ ID NO: 374016 - protein, 28 aa, Mycobacterium
VSFGVNPPFLWQHITGHYTNISVQTAGR

SEQ ID NO: 374017 - protein, 18 aa, Mycobacterium
VSFMRLFGFGLTAAVLVD

SEQ ID NO: 374018 - protein, 27 aa, Mycobacterium
VSFVGIVLVLMWWRRPPVRSDYPPERA

SEQ ID NO: 374019 - protein, 20 aa, Mycobacterium
VSFVILPLFALVNAGVLLDG

SEQ ID NO: 374020 - protein, 28 aa, Mycobacterium
VSFVTIALAQLWHVFNMRGPRSAVLCNA

SEQ ID NO: 374021 - protein, 23 aa, Mycobacterium
VSFWLAVVVFSIWLGALIVLLRH

SEQ ID NO: 374022 - protein, 20 aa, Mycobacterium
VSGDDFAYLVDFGIASATSD

SEQ ID NO: 374023 - protein, 25 aa, Mycobacterium
VSGELFLIAVAITAPLWPNLVRVVF

SEQ ID NO: 374024 - protein, 17 aa, Mycobacterium
VSGFFGFFLLAFLDHCP

SEQ ID NO: 374025 - protein, 28 aa, Mycobacterium
VSGGQRRRILLARALLSRVPVLLLDEPT

SEQ ID NO: 374026 - protein, 27 aa, Mycobacterium
VSGGWFTITVLVILLVIAVVVAINIAR

SEQ ID NO: 374027 - protein, 25 aa, Mycobacterium
VSGLPRALVPLALSLYGIGMVTGNV

SEQ ID NO: 374028 - protein, 26 aa, Mycobacterium
VSGLSWQWIFLINVPIGICGLILAAW

SEQ ID NO: 374029 - protein, 25 aa, Mycobacterium
VSGLVIWLISLFNDGIYAASILAEL

SEQ ID NO: 374030 - protein, 36 aa, Mycobacterium
VSGPPGYSAIWLWLGIALLGAVILWYTAVFVATMPS

SEQ ID NO: 374031 - protein, 25 aa, Mycobacterium
VSGPTLRRPAVYRGWYALPERIAAT

SEQ ID NO: 374032 - protein, 33 aa, Mycobacterium
VSGVRSLTTGFFPLMGIGAFSMLAFSGRFGRAR

SEQ ID NO: 374033 - protein, 21 aa, Mycobacterium
VSGVTLPWTLAVTTTLPSVSV

SEQ ID NO: 374034 - protein, 34 aa, Mycobacterium
VSGVVVPVMSLAVLTACTPMFAADPRYATDSGAH

SEQ ID NO: 374035 - protein, 24 aa, Mycobacterium
VSHAGSLMTWWTGDSLMVFDVNTL

SEQ ID NO: 374036 - protein, 25 aa, Mycobacterium
VSHLGLFKRLLRDGRWWLGSGVAAA

SEQ ID NO: 374037 - protein, 23 aa, Mycobacterium
VSHLLQLLREHLVISLSATVLTC

SEQ ID NO: 374038 - protein, 17 aa, Mycobacterium
VSHMWVTKFLRTHGLIH

SEQ ID NO: 374039 - protein, 20 aa, Mycobacterium
VSHMWVTKFLRTHGLIHDCP

SEQ ID NO: 374040 - protein, 18 aa, Mycobacterium
VSHMWVVKFLRTHGLIHD

SEQ ID NO: 374041 - protein, 17 aa, Mycobacterium
VSIALRPLGPSGTYTVN

SEQ ID NO: 374042 - protein, 21 aa, Mycobacterium
VSIFKLARYLAREYLLIVATS

SEQ ID NO: 374043 - protein, 25 aa, Mycobacterium
VSIPDFWMGILLIALFSTVLGWLPT

SEQ ID NO: 374044 - protein, 25 aa, Mycobacterium
VSIPSLWQPYVLSVASLTAGGQPSK

SEQ ID NO: 374045 - protein, 24 aa, Mycobacterium
VSIPSLWQPYVLSVASLTPDGQPS

SEQ ID NO: 374046 - protein, 25 aa, Mycobacterium
VSIPSLWQPYVLSVASLTPEGQPSK

SEQ ID NO: 374047 - protein, 30 aa, Mycobacterium
VSITFVSLVGWWALSRVLKRLAGVPDVHKL

SEQ ID NO: 374048 - protein, 27 aa, Mycobacterium
VSITTVWITWLVRPLGALLWGHFGDRL

SEQ ID NO: 374049 - protein, 21 aa, Mycobacterium
VSIVASLLVLLPAAGMTAAAV

SEQ ID NO: 374050 - protein, 23 aa, Mycobacterium
VSIVLLVWVVLAVLNVVGVNIAP

SEQ ID NO: 374051 - protein, 24 aa, Mycobacterium
VSLDIPFLIFVLCLGVVVDAVMRN

SEQ ID NO: 374052 - protein, 24 aa, Mycobacterium
VSLGIVMMFLTGQPAFWICGLAIA

SEQ ID NO: 374053 - protein, 23 aa, Mycobacterium
VSLGWIIIMGLACGIPAWFVSGV

SEQ ID NO: 374054 - protein, 19 aa, Mycobacterium
VSLIGWLIVLRGLLLVAFP

SEQ ID NO: 374055 - protein, 20 aa, Mycobacterium
VSLLALTLWIPATARHRSAW

SEQ ID NO: 374056 - protein, 17 aa, Mycobacterium
VSLLAQLAKLLAEAVAD

SEQ ID NO: 374057 - protein, 26 aa, Mycobacterium
VSLLASVSPAIRWLIKVPREFINDYL

SEQ ID NO: 374058 - protein, 19 aa, Mycobacterium
VSLLIVALTIWYYTINVNP

SEQ ID NO: 374059 - protein, 27 aa, Mycobacterium
VSLMLVAVLVAAWLLGSLLTSSDQPNL

SEQ ID NO: 374060 - protein, 44 aa, Mycobacterium
VSLPRSTVSWLPLYHDMGLMVGLFIPVYCACPSYFMSPAAFVRK

SEQ ID NO: 374061 - protein, 19 aa, Mycobacterium
VSLTMLLGARLLVGLTIGV

SEQ ID NO: 374062 - protein, 25 aa, Mycobacterium
VSLTPRLWVRARPGPQLRDLIQQPG

SEQ ID NO: 374063 - protein, 24 aa, Mycobacterium
VSLVIAITIVYFLCNLVARPSQAT

SEQ ID NO: 374064 - protein, 21 aa, Mycobacterium
VSMAMVWLAVLLFVKIGEPDD

SEQ ID NO: 374065 - protein, 33 aa, Mycobacterium
VSMATLIFGFILMWIMSWLTATPVRVVRAALNR

SEQ ID NO: 374066 - protein, 31 aa, Mycobacterium
VSMDIVEFVLFHLLPLLPESVLRVLIPRYDN

SEQ ID NO: 374067 - protein, 25 aa, Mycobacterium
VSMFAFAMYAVFPITAGFTALANLR

SEQ ID NO: 374068 - protein, 27 aa, Mycobacterium
VSMIALAVLLGLFLATAVLLIMKMSGV

SEQ ID NO: 374069 - protein, 22 aa, Mycobacterium
VSMIFQHPYLFDGPIRDNILVG

SEQ ID NO: 374070 - protein, 19 aa, Mycobacterium
VSMQYSYLPSWLSFLVDKE

SEQ ID NO: 374071 - protein, 27 aa, Mycobacterium
VSNLALSSLVILILGFVLTSQVTDRIL

SEQ ID NO: 374072 - protein, 21 aa, Mycobacterium
VSNVPLPWTLSVTTTLPSVSV

SEQ ID NO: 374073 - protein, 30 aa, Mycobacterium
VSNYPGDGWKWWAWLSIGAGCVAVIVAVAV

SEQ ID NO: 374074 - protein, 18 aa, Mycobacterium
VSPGWYFVPVCLIALIGG

SEQ ID NO: 374075 - protein, 17 aa, Mycobacterium
VSPPRLGDDFDALATAF

SEQ ID NO: 374076 - protein, 24 aa, Mycobacterium
VSPSAWWVCGTATAVTLLYLGYLR

SEQ ID NO: 374077 - protein, 30 aa, Mycobacterium
VSPSRPLPKRNLVMGLAAGLLLGIAVALAR

SEQ ID NO: 374078 - protein, 28 aa, Mycobacterium
VSQLLGCTPLGPFGWAQGLGAAAAATVA

SEQ ID NO: 374079 - protein, 22 aa, Mycobacterium
VSQMFRAVSWLPAEGKDRLLKV

SEQ ID NO: 374080 - protein, 17 aa, Mycobacterium
VSQPPLRPAPTLQPDQV

SEQ ID NO: 374081 - protein, 25 aa, Mycobacterium
VSQTINPLPWLVQAQGLFAQRITFG

SEQ ID NO: 374082 - protein, 23 aa, Mycobacterium
VSQVATTLFNAAYFAGMDLVEHQ

SEQ ID NO: 374083 - protein, 24 aa, Mycobacterium
VSQVPPTRWSWYDDGSPEGAAALA

SEQ ID NO: 374084 - protein, 29 aa, Mycobacterium
VSRAARAYWTTLHQLRWAILTVMAVLALA

SEQ ID NO: 374085 - protein, 23 aa, Mycobacterium
VSRAHLLLRFDHGRWMAIDNGSH

SEQ ID NO: 374086 - protein, 27 aa, Mycobacterium
VSRERIIMTTFLIGGLLAGAAALLYTL

SEQ ID NO: 374087 - protein, 26 aa, Mycobacterium
VSRITGFIKLLLITAALGAASASAFS

SEQ ID NO: 374088 - protein, 28 aa, Mycobacterium
VSRLQALLVEWTLLSLLALPTSAVCLGI

SEQ ID NO: 374089 - protein, 24 aa, Mycobacterium
VSRMYAIHILIFPAIFAALIGVHL

SEQ ID NO: 374090 - protein, 22 aa, Mycobacterium
VSRRSWWQERLMLWATIGLAVV

SEQ ID NO: 374091 - protein, 19 aa, Mycobacterium
VSRVPVSMILIGLGSMLVL

SEQ ID NO: 374092 - protein, 27 aa, Mycobacterium
VSRVSIFRLVRYLAREYLLIVSTSSSE

SEQ ID NO: 374093 - protein, 21 aa, Mycobacterium
VSSFAAFRLVFAPVAGALVQR

SEQ ID NO: 374094 - protein, 29 aa, Mycobacterium
VSSGGDLLWLWCYHLGWVVIALAIVAIWT

SEQ ID NO: 374095 - protein, 27 aa, Mycobacterium
VSTDVVWAMPFNVPFLVAFGAATLLFT

SEQ ID NO: 374096 - protein, 22 aa, Mycobacterium
VSTFLLAWELMAISSLVLVATD

SEQ ID NO: 374097 - protein, 33 aa, Mycobacterium
VSTGTLIFGFILMWIMSWLTATPVRVVRAALNR

SEQ ID NO: 374098 - protein, 27 aa, Mycobacterium
VSTIVVPVVLALLLVSAVAFAVTQVLR

SEQ ID NO: 374099 - protein, 26 aa, Mycobacterium
VSTLAIPAWWEQYVLSVGSVGPQGRP

SEQ ID NO: 374100 - protein, 18 aa, Mycobacterium
VSTRLIAGLIAIVPLYAL

SEQ ID NO: 374101 - protein, 18 aa, Mycobacterium
VSTSLVVFVGFRSSRKSA

SEQ ID NO: 374102 - protein, 22 aa, Mycobacterium
VSTSLVVFVGFRSSRKSASERY

SEQ ID NO: 374103 - protein, 26 aa, Mycobacterium
VSTVLLVLFMVFLEMLTARGVIAILG

SEQ ID NO: 374104 - protein, 29 aa, Mycobacterium
VSTVMLRTLLRRKLWWAGTISAVMGYGFQ

SEQ ID NO: 374105 - protein, 25 aa, Mycobacterium
VSVFLLALGILLGSGWLGTTCLDEW

SEQ ID NO: 374106 - protein, 17 aa, Mycobacterium
VSVFLLRRVVGVRQLVT

SEQ ID NO: 374107 - protein, 25 aa, Mycobacterium
VSVFVASISFLIYLVCWLVGRRREA

SEQ ID NO: 374108 - protein, 20 aa, Mycobacterium
VSVGLLWIGYLHRQRRITWL

SEQ ID NO: 374109 - protein, 28 aa, Mycobacterium
VSVGSRVFALPWRLATIQDLPAVDTPAE

SEQ ID NO: 374110 - protein, 23 aa, Mycobacterium
VSVLLFLSVVAIAWIFIKVFKTD

SEQ ID NO: 374111 - protein, 21 aa, Mycobacterium
VSVLPMCMVAIPLAVLIVLVL

SEQ ID NO: 374112 - protein, 20 aa, Mycobacterium
VSVLPTLALLGTRLPELIAG

SEQ ID NO: 374113 - protein, 18 aa, Mycobacterium
VSVMGLAIERLISRPLPR

SEQ ID NO: 374114 - protein, 26 aa, Mycobacterium
VSVSIFTVVMLMVAASLIVVFGEFRF

SEQ ID NO: 374115 - protein, 21 aa, Mycobacterium
VSVVLMTVGFVSVLSLRGYVT

SEQ ID NO: 374116 - protein, 25 aa, Mycobacterium
VSVVSFAAILWDLSFPITVASLQIP

SEQ ID NO: 374117 - protein, 25 aa, Mycobacterium
VSWAGYLGWFPTLQHTWASWVGNIV

SEQ ID NO: 374118 - protein, 21 aa, Mycobacterium
VSWRLAFMVNVPIGLVMIYLA

SEQ ID NO: 374119 - protein, 25 aa, Mycobacterium
VSWSHHWVWMLPAVLVTGVLAWRRR

SEQ ID NO: 374120 - protein, 25 aa, Mycobacterium
VSWSHHWVWMLPTVVVTAVLAVRLR

SEQ ID NO: 374121 - protein, 24 aa, Mycobacterium
VTAAILVFIFAWNDLLLALTLTAT

SEQ ID NO: 374122 - protein, 23 aa, Mycobacterium
VTAAPWLGITIGLTLAILGGFML

SEQ ID NO: 374123 - protein, 26 aa, Mycobacterium
VTAARWLFALFTVLAALGFIASYQAT

SEQ ID NO: 374124 - protein, 36 aa, Mycobacterium
VTAAVVALLLIITYRSPVLWLVPLLVIGFADRVAAV

SEQ ID NO: 374125 - protein, 23 aa, Mycobacterium
VTAAYALMLLAVSVTLTALGRHT

SEQ ID NO: 374126 - protein, 17 aa, Mycobacterium
VTAAYVLITFWQYRNAC

SEQ ID NO: 374127 - protein, 24 aa, Mycobacterium
VTAEWVVIIWMIGVSLLVVSRIPM

SEQ ID NO: 374128 - protein, 22 aa, Mycobacterium
VTAFQWNWKFGYQKIAFADGSF

SEQ ID NO: 374129 - protein, 20 aa, Mycobacterium
VTAFQWNWKFGYQKVAFKDG

SEQ ID NO: 374130 - protein, 24 aa, Mycobacterium
VTAGEWMWAALLTAGVSVVVIVGN

SEQ ID NO: 374131 - protein, 24 aa, Mycobacterium
VTAGWLAWLLALAVAAPPILALMM

SEQ ID NO: 374132 - protein, 25 aa, Mycobacterium
VTAGYLARRAGRIPKRFWAQASSPQ

SEQ ID NO: 374133 - protein, 23 aa, Mycobacterium
VTAIISVIVPFAAGLALLGTVPT

SEQ ID NO: 374134 - protein, 39 aa, Mycobacterium
VTAIIVMAAAMAWGLLVAHRRPPPPPETGYLAALRDTGL

SEQ ID NO: 374135 - protein, 20 aa, Mycobacterium
VTAISVGIPLASAPPLPAVA

SEQ ID NO: 374136 - protein, 26 aa, Mycobacterium
VTAIVLLLAIGWRSRRRLPAAVIFGA

SEQ ID NO: 374137 - protein, 27 aa, Mycobacterium
VTALCLFTALFIMLRRKRIPGVARGPA

SEQ ID NO: 374138 - protein, 24 aa, Mycobacterium
VTALGIMMALFERTRTGKGQVIDG

SEQ ID NO: 374139 - protein, 23 aa, Mycobacterium
VTALIQLYIVGVFISFTLSQIGM

SEQ ID NO: 374140 - protein, 26 aa, Mycobacterium
VTALQVTALLFALPIYARLAGHRVSR

SEQ ID NO: 374141 - protein, 25 aa, Mycobacterium
VTALSKFLLIVVWGLGVFGWAISDL

SEQ ID NO: 374142 - protein, 25 aa, Mycobacterium
VTALSLICLLITPAWFLMSHRGIDV

SEQ ID NO: 374143 - protein, 21 aa, Mycobacterium
VTALSRWYITSLGVAGDPAPT

SEQ ID NO: 374144 - protein, 20 aa, Mycobacterium
VTAMIFAICVASMFVAQAAV

SEQ ID NO: 374145 - protein, 22 aa, Mycobacterium
VTAPSPLLKGGLAFVDTPGVGG

SEQ ID NO: 374146 - protein, 24 aa, Mycobacterium
VTAPWQLIVLRLVIGAAIGADYPI

SEQ ID NO: 374147 - protein, 24 aa, Mycobacterium
VTARFPRKPLLLTTLLGYAVSNTL

SEQ ID NO: 374148 - protein, 32 aa, Mycobacterium
VTARFTRKAIWWSAFRQLLFGSVAVAATYLVG

SEQ ID NO: 374149 - protein, 17 aa, Mycobacterium
VTASDLLAPSGAPPRLI

SEQ ID NO: 374150 - protein, 24 aa, Mycobacterium
VTATLLALLVLALGYRRSHAIRDS

SEQ ID NO: 374151 - protein, 20 aa, Mycobacterium
VTAVLWWIIGLAGLWLGLLG

SEQ ID NO: 374152 - protein, 20 aa, Mycobacterium
VTAVPPGWSLQTAASVPVVF

SEQ ID NO: 374153 - protein, 42 aa, Mycobacterium
VTAVVHPTFLYELIWNIAVFGFLIWVDRKFRIGHGRLFALYV

SEQ ID NO: 374154 - protein, 24 aa, Mycobacterium
VTAVVIGWCLPLFGLSLAAFLVID

SEQ ID NO: 374155 - protein, 26 aa, Mycobacterium
VTAVYAVFRWFFARDLRVAPDPEQLG

SEQ ID NO: 374156 - protein, 19 aa, Mycobacterium
VTAWRWMYGVGVLPAVAVI

SEQ ID NO: 374157 - protein, 24 aa, Mycobacterium
VTAYFPEVLALYPGDKVLIMGVRV

SEQ ID NO: 374158 - protein, 37 aa, Mycobacterium
VTCLRPKPARRPVFVDGRLRKQILRLDSSCLVARVLT

SEQ ID NO: 374159 - protein, 17 aa, Mycobacterium
VTDLPARRWEFPQFPQL

SEQ ID NO: 374160 - protein, 36 aa, Mycobacterium
VTDRLPLVLGLMAVITLVLLFLLTGSVVLPVKALVC

SEQ ID NO: 374161 - protein, 31 aa, Mycobacterium
VTDRLVLDQMSWFTPARWGFAASASTVDLIR

SEQ ID NO: 374162 - protein, 27 aa, Mycobacterium
VTDRRTYRALLPRLALPGACVALVTGP

SEQ ID NO: 374163 - protein, 26 aa, Mycobacterium
VTEAVLWFIRRWLVARATMGVEADIR

SEQ ID NO: 374164 - protein, 22 aa, Mycobacterium
VTELVLLLIAVAVAILVDGATK

SEQ ID NO: 374165 - protein, 36 aa, Mycobacterium
VTERLPLVLGLMAAITFVLLFLLTGSVLLPIKALAC

SEQ ID NO: 374166 - protein, 36 aa, Mycobacterium
VTERLPLVLGLMAAITFVLLFLLTGSVVLPAKALIC

SEQ ID NO: 374167 - protein, 21 aa, Mycobacterium
VTFATFGLGYLAIIGVPPLAG

SEQ ID NO: 374168 - protein, 23 aa, Mycobacterium
VTFFAMAYIVVLNPLIIGGEPGR

SEQ ID NO: 374169 - protein, 17 aa, Mycobacterium
VTFFCIGGATLAQAASL

SEQ ID NO: 374170 - protein, 22 aa, Mycobacterium
VTFGSYFYFLGTGGFIEPLHTL

SEQ ID NO: 374171 - protein, 41 aa, Mycobacterium
VTFGTGFAPFFLPLALFIGALIIWMLLKPLQTRPVVNGLGA

SEQ ID NO: 374172 - protein, 28 aa, Mycobacterium
VTFGVIMVMLLLVYRSVITMVIVVAMVM

SEQ ID NO: 374173 - protein, 21 aa, Mycobacterium
VTFMLVWLMNHHGWPVATAGI

SEQ ID NO: 374174 - protein, 24 aa, Mycobacterium
VTFSRGCLPFLPTSDPPTHTRLRK

SEQ ID NO: 374175 - protein, 32 aa, Mycobacterium
VTFSVGAVVPLIPFLLGFASLLAGLICGGVGL

SEQ ID NO: 374176 - protein, 24 aa, Mycobacterium
VTGALLAELFPPALRYSGVSLGYN

SEQ ID NO: 374177 - protein, 17 aa, Mycobacterium
VTGFRYIDGIVAAAIGL

SEQ ID NO: 374178 - protein, 28 aa, Mycobacterium
VTGHIAFSIWYLWSVMVLFMPESVYGFS

SEQ ID NO: 374179 - protein, 24 aa, Mycobacterium
VTGLAGWLFGWLAERSGSLAAPMV

SEQ ID NO: 374180 - protein, 25 aa, Mycobacterium
VTGLLFLAAMFFTPLYSVVPLEAAA

SEQ ID NO: 374181 - protein, 28 aa, Mycobacterium
VTGLLIGALWAWIAPPIRAVVALTRSGE

SEQ ID NO: 374182 - protein, 26 aa, Mycobacterium
VTGLVGCFVFSLLRPSGIAGTDPILA

SEQ ID NO: 374183 - protein, 44 aa, Mycobacterium
VTGMRGSYGGVLIFGMLTSFAGLGMFNPLSLGAGFVLGRKAYKE

SEQ ID NO: 374184 - protein, 22 aa, Mycobacterium
VTGPVARLALVGPGARGADVID

SEQ ID NO: 374185 - protein, 28 aa, Mycobacterium
VTGRMDPVNLLPFLLLGTTFGARLLGIA

SEQ ID NO: 374186 - protein, 38 aa, Mycobacterium
VTGRRKFLPPFSTWYAAMLFAVVPLRNILPGSPPAGSW

SEQ ID NO: 374187 - protein, 22 aa, Mycobacterium
VTGSIFAFWGWDTCLTLGEESK

SEQ ID NO: 374188 - protein, 33 aa, Mycobacterium
VTGSLALAFLSIGALIYFLHHLMHSIQLDTIMD

SEQ ID NO: 374189 - protein, 24 aa, Mycobacterium
VTGSWSFRVLTAAGPAPATAAPVP

SEQ ID NO: 374190 - protein, 19 aa, Mycobacterium
VTGTALMALAFLLMSRMEP

SEQ ID NO: 374191 - protein, 17 aa, Mycobacterium
VTGVIILPQRQSVLVAK

SEQ ID NO: 374192 - protein, 17 aa, Mycobacterium
VTGVIILPQRQTALVAK

SEQ ID NO: 374193 - protein, 21 aa, Mycobacterium
VTGWVATVFAWLRRRRRPPDV

SEQ ID NO: 374194 - protein, 23 aa, Mycobacterium
VTGWVIRLPAAPQTTRAAAALIN

SEQ ID NO: 374195 - protein, 27 aa, Mycobacterium
VTGYLAEPVIARLLSQLFGYTGIAVSS

SEQ ID NO: 374196 - protein, 23 aa, Mycobacterium
VTHALFFSLVIGYAPRLVSGGNV

SEQ ID NO: 374197 - protein, 23 aa, Mycobacterium
VTHFAFVTLAFLGTLFASYSRAS

SEQ ID NO: 374198 - protein, 24 aa, Mycobacterium
VTHGLLWSVIAPIATRLVPASHAG

SEQ ID NO: 374199 - protein, 24 aa, Mycobacterium
VTHGLLWSVIAPIATRLVPPSHAG

SEQ ID NO: 374200 - protein, 27 aa, Mycobacterium
VTHGWTAPWVLFLAVFCVQTVTGALAG

SEQ ID NO: 374201 - protein, 26 aa, Mycobacterium
VTHSLTYLSYCDQVLLLAPGGKTAYC

SEQ ID NO: 374202 - protein, 18 aa, Mycobacterium
VTIACAVWLVVWGGSRMP

SEQ ID NO: 374203 - protein, 27 aa, Mycobacterium
VTIASLPVLRWGWTPVLFAGSLVTLVP

SEQ ID NO: 374204 - protein, 23 aa, Mycobacterium
VTIFVFILISNWLAVLPLQYGGA

SEQ ID NO: 374205 - protein, 32 aa, Mycobacterium
VTIRGRRITGWIAALFAWRRRHRQPPPAPSEP

SEQ ID NO: 374206 - protein, 22 aa, Mycobacterium
VTKAALFLAAGAWLSVLGSKQL

SEQ ID NO: 374207 - protein, 23 aa, Mycobacterium
VTKVPLPRWYWVGLTIGVLVGTV

SEQ ID NO: 374208 - protein, 43 aa, Mycobacterium
VTLASLCVIFLTLLIVYRSIVTVILLLLIVGLELQIARGMVAL

SEQ ID NO: 374209 - protein, 17 aa, Mycobacterium
VTLFLFVEIGQLVGRLV

SEQ ID NO: 374210 - protein, 28 aa, Mycobacterium
VTLFLLAAFFIYEGIRRLITPPEVSGLL

SEQ ID NO: 374211 - protein, 20 aa, Mycobacterium
VTLGAFYQIAKAVEPITVCL

SEQ ID NO: 374212 - protein, 23 aa, Mycobacterium
VTLGIALLVLAAYLVGAYAAAVA

SEQ ID NO: 374213 - protein, 18 aa, Mycobacterium
VTLGIGVLAVRKGGKLPP

SEQ ID NO: 374214 - protein, 18 aa, Mycobacterium
VTLLLCSIMSVAVVGLTG

SEQ ID NO: 374215 - protein, 22 aa, Mycobacterium
VTLLQIPMLLMSHPQWGQAAKS

SEQ ID NO: 374216 - protein, 33 aa, Mycobacterium
VTLLYRVSLPRPLPSHRLWIGALLAVTFFAIAS

SEQ ID NO: 374217 - protein, 18 aa, Mycobacterium
VTLRLALIALAVEAVLGI

SEQ ID NO: 374218 - protein, 38 aa, Mycobacterium
VTLTLTLVVMLRISWQITLLALVLVPLFVVPARRIGSR

SEQ ID NO: 374219 - protein, 25 aa, Mycobacterium
VTLTTTWWQRLPVFAAAMIGWGGLV

SEQ ID NO: 374220 - protein, 18 aa, Mycobacterium
VTLTWLWVAAFAGMTLSS

SEQ ID NO: 374221 - protein, 31 aa, Mycobacterium
VTLVRGRVWAFPWIMFVLAAGLAGVGAVPPA

SEQ ID NO: 374222 - protein, 31 aa, Mycobacterium
VTMGLRFHQGWPAAILFLLIPSVVVTGFTAL

SEQ ID NO: 374223 - protein, 22 aa, Mycobacterium
VTMGLVYLLSAYTTMSVFVTST

SEQ ID NO: 374224 - protein, 24 aa, Mycobacterium
VTMIPFTIAILRYAVDIDGGIAGE

SEQ ID NO: 374225 - protein, 33 aa, Mycobacterium
VTMITFLVIIVMLLFVYRSIVQVLLVLVMVGIE

SEQ ID NO: 374226 - protein, 23 aa, Mycobacterium
VTMLFMAALSRIPLGTAAALEFL

SEQ ID NO: 374227 - protein, 18 aa, Mycobacterium
VTMMAGLLVSLLVRRRRV

SEQ ID NO: 374228 - protein, 30 aa, Mycobacterium
VTMMAGLLVSLLVRRRRVWARLTPAAGTVN

SEQ ID NO: 374229 - protein, 27 aa, Mycobacterium
VTNPVRQRFWAWWRYGRNWASVCALHG

SEQ ID NO: 374230 - protein, 25 aa, Mycobacterium
VTNRIFLDQLSWVVPSRWGYAAQAA

SEQ ID NO: 374231 - protein, 25 aa, Mycobacterium
VTNRLFLDQLSWAVPARWGYAASAA

SEQ ID NO: 374232 - protein, 30 aa, Mycobacterium
VTNRVVLDQLSWLTPARWGFAASASTIDLN

SEQ ID NO: 374233 - protein, 22 aa, Mycobacterium
VTPGSFWLSFGSFAKMVDVWFA

SEQ ID NO: 374234 - protein, 24 aa, Mycobacterium
VTPHPRFPHLIPGGDYVMAGGDGL

SEQ ID NO: 374235 - protein, 22 aa, Mycobacterium
VTPLSFYGIVRMWLRSLLCITP

SEQ ID NO: 374236 - protein, 19 aa, Mycobacterium
VTPPPPPPAPTTAAPPPAT

SEQ ID NO: 374237 - protein, 21 aa, Mycobacterium
VTPYRFTPKVAWLTLLAGSAM

SEQ ID NO: 374238 - protein, 18 aa, Mycobacterium
VTRFQTVMVRILEAILPY

SEQ ID NO: 374239 - protein, 28 aa, Mycobacterium
VTRHLWIPLVLVIVLAVSGLVVMRLHRI

SEQ ID NO: 374240 - protein, 28 aa, Mycobacterium
VTRHQVSGWRFVMRRIASGVALHDTRML

SEQ ID NO: 374241 - protein, 27 aa, Mycobacterium
VTRHQVTGWRFVMRRIASGIALHDTRM

SEQ ID NO: 374242 - protein, 26 aa, Mycobacterium
VTRNRLVWCALAICLGLIAAAFTIPV

SEQ ID NO: 374243 - protein, 32 aa, Mycobacterium
VTRNVVLLWPAYPILLFGKWFRLGTTTYGWIA

SEQ ID NO: 374244 - protein, 25 aa, Mycobacterium
VTRPSTFLWLIATTGTLLVVGGRMD

SEQ ID NO: 374245 - protein, 28 aa, Mycobacterium
VTRSLPFLVLVIALWPLGRLLVGSSLGT

SEQ ID NO: 374246 - protein, 23 aa, Mycobacterium
VTRVPVWSLLLIGAAALAVSVAE

SEQ ID NO: 374247 - protein, 20 aa, Mycobacterium
VTSAYLLAYAVPLLVTGRLG

SEQ ID NO: 374248 - protein, 22 aa, Mycobacterium
VTSFAVLYWLLPDVLEGPDWVR

SEQ ID NO: 374249 - protein, 22 aa, Mycobacterium
VTSFCWLWLSTNLLSGLLAVAT

SEQ ID NO: 374250 - protein, 22 aa, Mycobacterium
VTSILLTYLLVAVALTMYAGVG

SEQ ID NO: 374251 - protein, 27 aa, Mycobacterium
VTSISIPSWWQPYVLSVASLTPDGQPS

SEQ ID NO: 374252 - protein, 24 aa, Mycobacterium
VTSLGLAWWLTPSLAVVMVVYLAM

SEQ ID NO: 374253 - protein, 24 aa, Mycobacterium
VTSLLVLMIFPLLTAALFGLAADR

SEQ ID NO: 374254 - protein, 25 aa, Mycobacterium
VTSRWGLVALTVPAGVFLGVLAVRR

SEQ ID NO: 374255 - protein, 25 aa, Mycobacterium
VTSSKSIWLPIVGGLVVVVVVVVVV

SEQ ID NO: 374256 - protein, 26 aa, Mycobacterium
VTSVSIPSWWQPYVLSVGAVDSTGQP

SEQ ID NO: 374257 - protein, 24 aa, Mycobacterium
VTTAVFYFLFLYGLRIPLPHLISF

SEQ ID NO: 374258 - protein, 31 aa, Mycobacterium
VTTAVVLLVRPLWLLLTQSLPGSLHTRLGNV

SEQ ID NO: 374259 - protein, 22 aa, Mycobacterium
VTTAYLVMCGFIFVATQYLQFV

SEQ ID NO: 374260 - protein, 21 aa, Mycobacterium
VTTILLTYLLVAVAVMMYAGV

SEQ ID NO: 374261 - protein, 20 aa, Mycobacterium
VTTKLPPFATRTDSVLLVAT

SEQ ID NO: 374262 - protein, 25 aa, Mycobacterium
VTTLGVWLGAGYPVSAALTAAVAVL

SEQ ID NO: 374263 - protein, 33 aa, Mycobacterium
VTTLIWQDLLGRDLHWAVPSIALIALVAVGADY

SEQ ID NO: 374264 - protein, 24 aa, Mycobacterium
VTTLPLGVPTPRILRVLRGFEPDV

SEQ ID NO: 374265 - protein, 24 aa, Mycobacterium
VTTRLLNAIPEAPALVIPAIAGAG

SEQ ID NO: 374266 - protein, 19 aa, Mycobacterium
VTTSPLPMKPIPQPSQPGG

SEQ ID NO: 374267 - protein, 24 aa, Mycobacterium
VTTSPLPMKPIPQPVPQPNAPEQK

SEQ ID NO: 374268 - protein, 30 aa, Mycobacterium
VTTTGVAFVKLAWLLAVSAYVSLVHGRVAV

SEQ ID NO: 374269 - protein, 22 aa, Mycobacterium
VTTVVTPSWFSDYVLTVGAVDA

SEQ ID NO: 374270 - protein, 33 aa, Mycobacterium
VTTYNRRRLVDPTLPPIPVLWVITDEYNEVFAD

SEQ ID NO: 374271 - protein, 30 aa, Mycobacterium
VTVAYLLAMVSVLALVLFLGHLVRQIRIET

SEQ ID NO: 374272 - protein, 31 aa, Mycobacterium
VTVESTSDYWRIWYYLLEAAGLDVQLVNARD

SEQ ID NO: 374273 - protein, 17 aa, Mycobacterium
VTVFFGSQAFLAYIMMG

SEQ ID NO: 374274 - protein, 17 aa, Mycobacterium
VTVFPFPRTAFTLAAGL

SEQ ID NO: 374275 - protein, 17 aa, Mycobacterium
VTVFTVGAISLFYLQLP

SEQ ID NO: 374276 - protein, 26 aa, Mycobacterium
VTVFVWQELIGIPLHWSVAPLSFVFL

SEQ ID NO: 374277 - protein, 23 aa, Mycobacterium
VTVIYLVWSLLPVLIAVMFSFND

SEQ ID NO: 374278 - protein, 22 aa, Mycobacterium
VTVLAFWIGRPLVRLNFLNERY

SEQ ID NO: 374279 - protein, 18 aa, Mycobacterium
VTVLAGLLVLLAGVTGLG

SEQ ID NO: 374280 - protein, 31 aa, Mycobacterium
VTVLLAGVLGWLLAGPAIRPLRKLTEHTKQL

SEQ ID NO: 374281 - protein, 27 aa, Mycobacterium
VTVLLLIALTYRRLPWRPAPEPPARPP

SEQ ID NO: 374282 - protein, 20 aa, Mycobacterium
VTVLLPPVLVLGYSALRADR

SEQ ID NO: 374283 - protein, 27 aa, Mycobacterium
VTVLVMVYLLTNLLVDLLYAALDPRIR

SEQ ID NO: 374284 - protein, 34 aa, Mycobacterium
VTVPGRYFYVKWWKLALMLLGVWAAAAVVGLGLF

SEQ ID NO: 374285 - protein, 20 aa, Mycobacterium
VTVPISVLASRFLLQRSKQL

SEQ ID NO: 374286 - protein, 22 aa, Mycobacterium
VTVPLVLACVFGGLRISASTVE

SEQ ID NO: 374287 - protein, 29 aa, Mycobacterium
VTVPMLGGLLLIVTLIVYQFRAPRPLLTI

SEQ ID NO: 374288 - protein, 25 aa, Mycobacterium
VTVSWLIIAYGFVASVLPVWLLLAP

SEQ ID NO: 374289 - protein, 30 aa, Mycobacterium
VTVTFMLVWLIRNLHWSVTAAGGLVTLSQL

SEQ ID NO: 374290 - protein, 34 aa, Mycobacterium
VTVVIIFTLLLILYRSVITVILLLIMVGVELAAA

SEQ ID NO: 374291 - protein, 26 aa, Mycobacterium
VTVVSIPVLRWSWTPVLLASSLITLL

SEQ ID NO: 374292 - protein, 21 aa, Mycobacterium
VTWEMSFLYAVVFGGFVAFSN

SEQ ID NO: 374293 - protein, 22 aa, Mycobacterium
VTWEMSFLYAVVFGGFVAFSNY

SEQ ID NO: 374294 - protein, 23 aa, Mycobacterium
VTWSQLPVYLAAELFAGVVAALA

SEQ ID NO: 374295 - protein, 28 aa, Mycobacterium
VTWVTATLWIPPLIYFALHRIRRYPNML

SEQ ID NO: 374296 - protein, 29 aa, Mycobacterium
VTYNPSIEQLLVLLPPYLAATQSYGSSLN

SEQ ID NO: 374297 - protein, 38 aa, Mycobacterium
VVAAAGFYAYLLTHVLFLNYVWHYTLLQAGFAIAPAAL

SEQ ID NO: 374298 - protein, 17 aa, Mycobacterium
VVAAAGVIMILLGFLPK

SEQ ID NO: 374299 - protein, 34 aa, Mycobacterium
VVAAILLFPGFFVPGYLFVGVPVLLIASAIIAVL

SEQ ID NO: 374300 - protein, 24 aa, Mycobacterium
VVAAIVAMLAFGAGLAWLAMDRRR

SEQ ID NO: 374301 - protein, 29 aa, Mycobacterium
VVAALAARRVLWLFKLITSGKPAPGHTDE

SEQ ID NO: 374302 - protein, 24 aa, Mycobacterium
VVAALGGLVFGGWVLFQQHQKDDA

SEQ ID NO: 374303 - protein, 18 aa, Mycobacterium
VVAALGMYPGEAPPLGAE

SEQ ID NO: 374304 - protein, 20 aa, Mycobacterium
VVAATLLALSPVAAPVAGAV

SEQ ID NO: 374305 - protein, 18 aa, Mycobacterium
VVAAVLGLIWLGLEHRRI

SEQ ID NO: 374306 - protein, 18 aa, Mycobacterium
VVAEQLQQGLYGFALRRL

SEQ ID NO: 374307 - protein, 23 aa, Mycobacterium
VVAFALFAQFNRHRLDLQYGVHA

SEQ ID NO: 374308 - protein, 27 aa, Mycobacterium
VVAFAVLVVFLLPALRDGAPAVPVALV

SEQ ID NO: 374309 - protein, 20 aa, Mycobacterium
VVAFAWRRPRFDPDKPGHPL

SEQ ID NO: 374310 - protein, 27 aa, Mycobacterium
VVAFGVLVVFLLPALRDGASAVPVSLV

SEQ ID NO: 374311 - protein, 27 aa, Mycobacterium
VVAFLGAFLMLWDWFAVRAHAFAASAM

SEQ ID NO: 374312 - protein, 27 aa, Mycobacterium
VVAGCAILAFFRPNMPLGDQPIVMGKD

SEQ ID NO: 374313 - protein, 17 aa, Mycobacterium
VVAGIVTILLAVALVFN

SEQ ID NO: 374314 - protein, 22 aa, Mycobacterium
VVAGLLVVIPLYCVGVLASFWA

SEQ ID NO: 374315 - protein, 18 aa, Mycobacterium
VVAGYVAAFVLLTLVLRA

SEQ ID NO: 374316 - protein, 24 aa, Mycobacterium
VVAIALIAVFLLLRAVPSLRANHV

SEQ ID NO: 374317 - protein, 19 aa, Mycobacterium
VVAIAPRRWGLRDTLEAAD

SEQ ID NO: 374318 - protein, 20 aa, Mycobacterium
VVAIVVLVLGYRQFWAKVRR

SEQ ID NO: 374319 - protein, 25 aa, Mycobacterium
VVAIWLGRPLIWLSFNNEKLNAAFR

SEQ ID NO: 374320 - protein, 22 aa, Mycobacterium
VVALAFFIPLLIGTGGNTGTQI

SEQ ID NO: 374321 - protein, 17 aa, Mycobacterium
VVALIRRHFRPAVFALL

SEQ ID NO: 374322 - protein, 18 aa, Mycobacterium
VVALIYFFNQITNVGIVF

SEQ ID NO: 374323 - protein, 23 aa, Mycobacterium
VVALQLPNWREAAVTFWASAFLG

SEQ ID NO: 374324 - protein, 31 aa, Mycobacterium
VVALSFLVGATVIFLLCTWAQSHGAAPWVGY

SEQ ID NO: 374325 - protein, 18 aa, Mycobacterium
VVALVVTAFLLPATPPAA

SEQ ID NO: 374326 - protein, 23 aa, Mycobacterium
VVALVYIIGVILWAMTLSQFDPA

SEQ ID NO: 374327 - protein, 31 aa, Mycobacterium
VVALWAYFIGWEWALLVIPLHLCGDRALFGN

SEQ ID NO: 374328 - protein, 27 aa, Mycobacterium
VVAMAYLLPQLLVPLLATALFGMHSAQ

SEQ ID NO: 374329 - protein, 40 aa, Mycobacterium
VVAMLGVFLVLAVLLRSLLAPLFMVAVVTLSFAAAAGITI

SEQ ID NO: 374330 - protein, 18 aa, Mycobacterium
VVAPLLALVALVLSWGQH

SEQ ID NO: 374331 - protein, 28 aa, Mycobacterium
VVAPLPYSVLWLALGVIMILLVVGWCVG

SEQ ID NO: 374332 - protein, 19 aa, Mycobacterium
VVAPLYLVASVVVSYLSAL

SEQ ID NO: 374333 - protein, 20 aa, Mycobacterium
VVARGRLMQALPAGGAMVAV

SEQ ID NO: 374334 - protein, 24 aa, Mycobacterium
VVASYSWYYAWTPGTGYLANLLPH

SEQ ID NO: 374335 - protein, 18 aa, Mycobacterium
VVATLCLIFVVMLAITRS

SEQ ID NO: 374336 - protein, 18 aa, Mycobacterium
VVAVALVSALLVGTGWIW

SEQ ID NO: 374337 - protein, 27 aa, Mycobacterium
VVAVFLVAGFWWFDGYTLVQERYWQGI

SEQ ID NO: 374338 - protein, 18 aa, Mycobacterium
VVAVLAMMLSISPLLVGI

SEQ ID NO: 374339 - protein, 20 aa, Mycobacterium
VVAVLAMMVSISPLLALITV

SEQ ID NO: 374340 - protein, 19 aa, Mycobacterium
VVAVLGMPVGKITKITPQS

SEQ ID NO: 374341 - protein, 18 aa, Mycobacterium
VVAVLLVVAGATAFVLAK

SEQ ID NO: 374342 - protein, 27 aa, Mycobacterium
VVAVLPALVWVLAALRRGRFGVDLIAV

SEQ ID NO: 374343 - protein, 27 aa, Mycobacterium
VVAVLVILGLPFFSVKWGFPDDRVLPA

SEQ ID NO: 374344 - protein, 18 aa, Mycobacterium
VVAVVAAVLIWQWREHRG

SEQ ID NO: 374345 - protein, 26 aa, Mycobacterium
VVAVVIFLGAWVWVGITNNQYSQLDR

SEQ ID NO: 374346 - protein, 18 aa, Mycobacterium
VVAVVLIPLYKRGGFVSA

SEQ ID NO: 374347 - protein, 19 aa, Mycobacterium
VVAWVLISGLLQALYWIRQ

SEQ ID NO: 374348 - protein, 19 aa, Mycobacterium
VVAYQFTFAPKGDWQRFFA

SEQ ID NO: 374349 - protein, 18 aa, Mycobacterium
VVCLLFDSGIITPPVPRP

SEQ ID NO: 374350 - protein, 37 aa, Mycobacterium
VVCVAISVALTFLVINIRALLHDRALLDRWAGDATAS

SEQ ID NO: 374351 - protein, 31 aa, Mycobacterium; identical to SEQ ID NO: 25609

SEQ ID NO: 374352 - protein, 27 aa, Mycobacterium
VVDAGPLYFWLPFLTCLLALGELHLRT

SEQ ID NO: 374353 - protein, 18 aa, Mycobacterium
VVDLLLVVPSFILIAIVT

SEQ ID NO: 374354 - protein, 17 aa, Mycobacterium
VVDVLTPGKLRHLVFID

SEQ ID NO: 374355 - protein, 24 aa, Mycobacterium
VVDVTAFQWNWKFGYQKVDFHDHT

SEQ ID NO: 374356 - protein, 28 aa, Mycobacterium
VVDWRVALVLFAPVLVYLVLTSSLTIQS

SEQ ID NO: 374357 - protein, 24 aa, Mycobacterium
VVEGPYVLPSLSLLVAGDPPKKRS

SEQ ID NO: 374358 - protein, 24 aa, Mycobacterium
VVEHLSVPEGRRGRRRWMVAAAVA

SEQ ID NO: 374359 - protein, 26 aa, Mycobacterium
VVELAVFGLVLFLLAGTVDYWQVWTF

SEQ ID NO: 374360 - protein, 31 aa, Mycobacterium
VVELLGGPALPWWLFAAAAFALTTYLGYRNI

SEQ ID NO: 374361 - protein, 21 aa, Mycobacterium
VVELVPMLRQALGLQLDSISV

SEQ ID NO: 374362 - protein, 22 aa, Mycobacterium
VVFAMLLVLTFSTAFNMVETNA

SEQ ID NO: 374363 - protein, 25 aa, Mycobacterium
VVFATLWPMSLALCVQFFVGRHIDR

SEQ ID NO: 374364 - protein, 24 aa, Mycobacterium
VVFGGYFIIFMIYRSMNPDEFLRA

SEQ ID NO: 374365 - protein, 29 aa, Mycobacterium
VVFGYVTFYLGPYFPAIWILRKLQAKYGP

SEQ ID NO: 374366 - protein, 17 aa, Mycobacterium
VVFIVAVVFGTGFVLGK

SEQ ID NO: 374367 - protein, 21 aa, Mycobacterium
VVFLLDKPWWAGVALGLMLVI

SEQ ID NO: 374368 - protein, 25 aa, Mycobacterium
VVFNALVIIALVPLALKGVRYRPVG

SEQ ID NO: 374369 - protein, 31 aa, Mycobacterium
VVFPVVGWWLYDIFYITPFLAIPYLHTVNRE

SEQ ID NO: 374370 - protein, 19 aa, Mycobacterium
VVFQHPYLFHGSIRDNVFA

SEQ ID NO: 374371 - protein, 17 aa, Mycobacterium
VVFRLISILISVLVAWL

SEQ ID NO: 374372 - protein, 35 aa, Mycobacterium
VVFRMGHVRPLYAPGLRLLIPLLDKMIRVDQRLVT

SEQ ID NO: 374373 - protein, 19 aa, Mycobacterium
VVFSAFAIAQAAIATTICV

SEQ ID NO: 374374 - protein, 29 aa, Mycobacterium
VVFTIPSLALFVVLPLIIKTRILQEANVI

SEQ ID NO: 374375 - protein, 28 aa, Mycobacterium
VVFVATAGRPYYLGGLYAPFVAAGAVCL

SEQ ID NO: 374376 - protein, 18 aa, Mycobacterium
VVFVDYMTVLPDAGYCPD

SEQ ID NO: 374377 - protein, 17 aa, Mycobacterium
VVFVFTLLVTGILVARR

SEQ ID NO: 374378 - protein, 18 aa, Mycobacterium
VVFVLYLALGRYGAIPLG

SEQ ID NO: 374379 - protein, 23 aa, Mycobacterium
VVFYPLHVLPFGLVAFAWQIGII

SEQ ID NO: 374380 - protein, 24 aa, Mycobacterium
VVGADIITVLYFTSLFACILAFHN

SEQ ID NO: 374381 - protein, 19 aa, Mycobacterium
VVGAFLIYTTMTMAITARR

SEQ ID NO: 374382 - protein, 19 aa, Mycobacterium
VVGARPPRPAAFHEWHAMS

SEQ ID NO: 374383 - protein, 25 aa, Mycobacterium
VVGAVLCLVARWRGWQLTEGPAWHY

SEQ ID NO: 374384 - protein, 29 aa, Mycobacterium
VVGDPTLLTMLWQNLIGNAVKFRREDLPP

SEQ ID NO: 374385 - protein, 18 aa, Mycobacterium
VVGFTYLAIRLFTQYDVS

SEQ ID NO: 374386 - protein, 39 aa, Mycobacterium
VVGGIALLFVVVILVLGFWVPGFFVTTKLDVSKANAGVQ

SEQ ID NO: 374387 - protein, 25 aa, Mycobacterium
VVGGIVYVLTFWTTIFHRKKATDTE

SEQ ID NO: 374388 - protein, 27 aa, Mycobacterium
VVGGLAILVMVVWVGTALAISTAASRS

SEQ ID NO: 374389 - protein, 39 aa, Mycobacterium
VVGGVLLEHFWWGSVFLINIPVMVILLVGGLVLLPEHRD

SEQ ID NO: 374390 - protein, 19 aa, Mycobacterium
VVGILTVAASWFAVHTLFT

SEQ ID NO: 374391 - protein, 23 aa, Mycobacterium
VVGIPFLGWFVEGWSGATTLLVY

SEQ ID NO: 374392 - protein, 17 aa, Mycobacterium
VVGIVWLLILVPAAVVL

SEQ ID NO: 374393 - protein, 24 aa, Mycobacterium
VVGKRTLWFGISGAFMVVAILSIA

SEQ ID NO: 374394 - protein, 19 aa, Mycobacterium
VVGLAAGVFFVWWELRTDH

SEQ ID NO: 374395 - protein, 24 aa, Mycobacterium
VVGLGPWLESLPQGLDTVMTAGAG

SEQ ID NO: 374396 - protein, 18 aa, Mycobacterium
VVGLLGAGAVAFSVLRRS

SEQ ID NO: 374397 - protein, 27 aa, Mycobacterium
VVGLVAGLGYWLLTPEHVTAQCVQDDP

SEQ ID NO: 374398 - protein, 22 aa, Mycobacterium
VVGLVHTPGLFTLAPGARVADA

SEQ ID NO: 374399 - protein, 17 aa, Mycobacterium
VVGLVHTPGLVTLAPGA

SEQ ID NO: 374400 - protein, 19 aa, Mycobacterium
VVGLVVLVSLIPIGLLLGD

SEQ ID NO: 374401 - protein, 33 aa, Mycobacterium
VVGMSLSLLAMAIAALGWLPPAAGALLQEGIDI

SEQ ID NO: 374402 - protein, 23 aa, Mycobacterium
VVGPWLLRVAFGPQYQASGALLA

SEQ ID NO: 374403 - protein, 37 aa, Mycobacterium
VVGRLTTWVRSWWHDLEFVQMWHVVAVAAILATAGFG

SEQ ID NO: 374404 - protein, 22 aa, Mycobacterium
VVGSAFWRKIYRRFGVRGMLLG

SEQ ID NO: 374405 - protein, 17 aa, Mycobacterium
VVGSGIDIPMIKPALET

SEQ ID NO: 374406 - protein, 24 aa, Mycobacterium
VVGSRRIRWPAVAIGVAGVAVILV

SEQ ID NO: 374407 - protein, 25 aa, Mycobacterium
VVGTAELIRFALTSKLKPFNFVSTS

SEQ ID NO: 374408 - protein, 24 aa, Mycobacterium
VVGTGVDIALIKPALEAATSLTVS

SEQ ID NO: 374409 - protein, 30 aa, Mycobacterium
VVGVALQLVLVLTAAWLLGTALVSSPQPNL

SEQ ID NO: 374410 - protein, 25 aa, Mycobacterium
VVGVGWFMPLLGISLAAFLAIDLAG

SEQ ID NO: 374411 - protein, 26 aa, Mycobacterium
VVGVIALVIVLVVVLNHRDSSTTAGS

SEQ ID NO: 374412 - protein, 25 aa, Mycobacterium
VVGVIVWGLTFWTVAFHRHKPGDTE

SEQ ID NO: 374413 - protein, 25 aa, Mycobacterium
VVGVIVYGLIFWSSAFHRKKATDTE

SEQ ID NO: 374414 - protein, 30 aa, Mycobacterium
VVGVTFQLFTIVLLTYLISRIELIDIRHLI

SEQ ID NO: 374415 - protein, 20 aa, Mycobacterium
VVGVTLACAGLLWADAITGK

SEQ ID NO: 374416 - protein, 17 aa, Mycobacterium
VVGVVAAIVVLGGLIVV

SEQ ID NO: 374417 - protein, 30 aa, Mycobacterium
VVGYPLVIALFRWFPQITVWTGLSLLGVAI

SEQ ID NO: 374418 - protein, 26 aa, Mycobacterium
VVHGWVYFAYLLFTANLAVKVRWPIG

SEQ ID NO: 374419 - protein, 25 aa, Mycobacterium
VVHGWVYFVYLLFTANLAVKVRWPI

SEQ ID NO: 374420 - protein, 23 aa, Mycobacterium
VVHGWVYFVYVLTAFNLAVKVRW

SEQ ID NO: 374421 - protein, 19 aa, Mycobacterium
VVHLTLIFGLFGVAISGAS

SEQ ID NO: 374422 - protein, 30 aa, Mycobacterium
VVHPTFLYELLWNVLVFVLLIVVDRRFKIG

SEQ ID NO: 374423 - protein, 21 aa, Mycobacterium
VVHSFWVPEFLFKRDVMPNPA

SEQ ID NO: 374424 - protein, 25 aa, Mycobacterium
VVHVDDVLRLLIRAILRADSGVVNL

SEQ ID NO: 374425 - protein, 20 aa, Mycobacterium
VVIAFLLLFVVNAIVTAVGF

SEQ ID NO: 374426 - protein, 25 aa, Mycobacterium
VVIAFTYLCFTVLAPWQLGKNTKTS

SEQ ID NO: 374427 - protein, 32 aa, Mycobacterium
VVIAIIALLVALGLLWAYLVANRLDRLHVRSD

SEQ ID NO: 374428 - protein, 18 aa, Mycobacterium
VVIAVWFAAVGRGVRRWA

SEQ ID NO: 374429 - protein, 23 aa, Mycobacterium
VVIGAMMIAPLMAPIMGIAACLI

SEQ ID NO: 374430 - protein, 22 aa, Mycobacterium
VVIGILGFLLDTTARWLLNPAR

SEQ ID NO: 374431 - protein, 28 aa, Mycobacterium
VVIGWRSRRWRLLWVPVSVAFGALGALA

SEQ ID NO: 374432 - protein, 39 aa, Mycobacterium
VVIIFAMLLMVYRSVITVILLLIMVGFEVAAARGIVAFL

SEQ ID NO: 374433 - protein, 17 aa, Mycobacterium
VVILRLKRVRHPDVVCI

SEQ ID NO: 374434 - protein, 24 aa, Mycobacterium
VVIMIMLFIAYRSVSTVLLVLVMV

SEQ ID NO: 374435 - protein, 25 aa, Mycobacterium
VVIMIMLFIVYRSVSTVLLVLAMVG

SEQ ID NO: 374436 - protein, 20 aa, Mycobacterium
VVIMNRLNFALVGLQLAFVL

SEQ ID NO: 374437 - protein, 34 aa, Mycobacterium
VVIRMNGWPEAIFRFGLYAFLCATALMVVRSEER

SEQ ID NO: 374438 - protein, 24 aa, Mycobacterium
VVISNFVPYLLWPRDFPETIAQSA

SEQ ID NO: 374439 - protein, 24 aa, Mycobacterium
VVITVMLLIVYRSVGNLLPVLLVV

SEQ ID NO: 374440 - protein, 17 aa, Mycobacterium
VVIVAGVIFIAWSILVA

SEQ ID NO: 374441 - protein, 22 aa, Mycobacterium
VVIVALRMYTLYRVLVVVGGGS

SEQ ID NO: 374442 - protein, 19 aa, Mycobacterium
VVIVATLFFALANAILIIP

SEQ ID NO: 374443 - protein, 24 aa, Mycobacterium
VVIVLLVMVIAGYNGLVRARNAYK

SEQ ID NO: 374444 - protein, 17 aa, Mycobacterium
VVIWYLPDDCDTAAALS

SEQ ID NO: 374445 - protein, 18 aa, Mycobacterium
VVKPPPQYIAPATQPRRT

SEQ ID NO: 374446 - protein, 19 aa, Mycobacterium
VVLAALALVAFVIVVQPTA

SEQ ID NO: 374447 - protein, 27 aa, Mycobacterium
VVLACPVWLYQIWRFITPGLYRNERKF

SEQ ID NO: 374448 - protein, 19 aa, Mycobacterium
VVLAFAMPRWSVLSGVAVL

SEQ ID NO: 374449 - protein, 30 aa, Mycobacterium
VVLAFGPSGIWWAALLGGLVLLAAGAVAGV

SEQ ID NO: 374450 - protein, 29 aa, Mycobacterium
VVLAGPVGWAVLWLVTVVPVVLVGTVVPG

SEQ ID NO: 374451 - protein, 30 aa, Mycobacterium; identical to SEQ ID NO: 25619

SEQ ID NO: 374452 - protein, 17 aa, Mycobacterium
VVLALAVRYVLHRAIDR

SEQ ID NO: 374453 - protein, 18 aa, Mycobacterium
VVLALLFPQLETVVRQQS

SEQ ID NO: 374454 - protein, 19 aa, Mycobacterium
VVLALLNAPPALAINPPSI

SEQ ID NO: 374455 - protein, 18 aa, Mycobacterium
VVLALQHDKLPPSINFAG

SEQ ID NO: 374456 - protein, 17 aa, Mycobacterium
VVLALSGLVAVLVGGWA

SEQ ID NO: 374457 - protein, 19 aa, Mycobacterium
VVLARRWVAKLGAFNGALA

SEQ ID NO: 374458 - protein, 34 aa, Mycobacterium
VVLASGLLGWWRWHHNTWLTTIFASVVAVLVLAV

SEQ ID NO: 374459 - protein, 24 aa, Mycobacterium
VVLAVPFTAFGFKNPLPAGADQHI

SEQ ID NO: 374460 - protein, 17 aa, Mycobacterium
VVLAVPVTVVLFQQSSR

SEQ ID NO: 374461 - protein, 20 aa, Mycobacterium
VVLAVRPELAPALAKQNWAA

SEQ ID NO: 374462 - protein, 18 aa, Mycobacterium
VVLFAALVWWRTAELLAE

SEQ ID NO: 374463 - protein, 18 aa, Mycobacterium
VVLFLSIAFFGNGLASIT

SEQ ID NO: 374464 - protein, 17 aa, Mycobacterium
VVLFPGAGFVELAIRAG

SEQ ID NO: 374465 - protein, 17 aa, Mycobacterium
VVLFPGAGFVELALRAG

SEQ ID NO: 374466 - protein, 28 aa, Mycobacterium
VVLGLIGTVLMIVWFHFWQDRVRDLMGV

SEQ ID NO: 374467 - protein, 18 aa, Mycobacterium
VVLGLYEDFLCPACGNFE

SEQ ID NO: 374468 - protein, 26 aa, Mycobacterium
VVLGWWLAVVIYLLPRRASLRVAAED

SEQ ID NO: 374469 - protein, 25 aa, Mycobacterium
VVLKHCLFSYIYGTVIIACTINLVI

SEQ ID NO: 374470 - protein, 17 aa, Mycobacterium
VVLLAVFEKDEIRSEAR

SEQ ID NO: 374471 - protein, 18 aa, Mycobacterium
VVLLAVHAFLIAVTIGLL

SEQ ID NO: 374472 - protein, 24 aa, Mycobacterium
VVLLLEVLFFRWLLHGTKKSEWLA

SEQ ID NO: 374473 - protein, 18 aa, Mycobacterium
VVLLLLTLGLEFSVAEFA

SEQ ID NO: 374474 - protein, 18 aa, Mycobacterium
VVLLPLFTIVDGYRRGLR

SEQ ID NO: 374475 - protein, 17 aa, Mycobacterium
VVLLRRFTPQAITVAAL

SEQ ID NO: 374476 - protein, 22 aa, Mycobacterium
VVLLTFPPVFALSIVAGRATRL

SEQ ID NO: 374477 - protein, 35 aa, Mycobacterium
VVLLTLTVLLRTVIAPLYLVGSVVVSYFAAIGLGV

SEQ ID NO: 374478 - protein, 19 aa, Mycobacterium
VVLLVALVAAWWIGADILD

SEQ ID NO: 374479 - protein, 17 aa, Mycobacterium
VVLLVIGAVLWILGSIG

SEQ ID NO: 374480 - protein, 18 aa, Mycobacterium
VVLLVLLGAPFLGATWGF

SEQ ID NO: 374481 - protein, 18 aa, Mycobacterium
VVLLVLLHRAKGGGLSSL

SEQ ID NO: 374482 - protein, 29 aa, Mycobacterium
VVLLVVSILLLWFATLVQTYVGLTGEIKA

SEQ ID NO: 374483 - protein, 20 aa, Mycobacterium
VVLLVVYRNPRTMLLPLIAI

SEQ ID NO: 374484 - protein, 20 aa, Mycobacterium
VVLPALLPALLSGAGLAFSR

SEQ ID NO: 374485 - protein, 19 aa, Mycobacterium
VVLPLKALLLNVLSLTAAF

SEQ ID NO: 374486 - protein, 18 aa, Mycobacterium
VVLPLLAYVLLVLLCRRR

SEQ ID NO: 374487 - protein, 20 aa, Mycobacterium
VVLPPLLALSGRRLFWPFIP

SEQ ID NO: 374488 - protein, 19 aa, Mycobacterium
VVLPSLLPALLSGAGLAFS

SEQ ID NO: 374489 - protein, 59 aa, Mycobacterium
VVLQLLVSLALLRALWVILGWRPVLLVPLTFALFTPLAVPGFAWWAAALNSLPMLAALA

SEQ ID NO: 374490 - protein, 49 aa, Mycobacterium
VVLQSILAVAFGGGLFVAFDQLWRWNSIVALVLSVLVILGLVVGVRVVR

SEQ ID NO: 374491 - protein, 22 aa, Mycobacterium
VVLRPYWTPVVAYTAAILIVAA

SEQ ID NO: 374492 - protein, 22 aa, Mycobacterium
VVLSFGIMLFASRFVFTFVNRH

SEQ ID NO: 374493 - protein, 25 aa, Mycobacterium
VVLSLAFIAIWATLGFKWFEELGGR

SEQ ID NO: 374494 - protein, 30 aa, Mycobacterium
VVLSTYGLKLPLLALLDFLTGHFSVALSLL

SEQ ID NO: 374495 - protein, 29 aa, Mycobacterium
VVLTAPFLILLIVLEWIAARKLLTTSAPA

SEQ ID NO: 374496 - protein, 22 aa, Mycobacterium
VVLTGMLWPEVQGWLGDHVVGG

SEQ ID NO: 374497 - protein, 17 aa, Mycobacterium
VVLTLEAVALLAGAYTF

SEQ ID NO: 374498 - protein, 18 aa, Mycobacterium
VVLTVAAFNRDLRPYARV

SEQ ID NO: 374499 - protein, 25 aa, Mycobacterium
VVLTVVFIFGLIEYAKRDWLVENGH

SEQ ID NO: 374500 - protein, 17 aa, Mycobacterium
VVLTVVTVGLAGGVLLA

SEQ ID NO: 374501 - protein, 25 aa, Mycobacterium
VVLVAGWPRSRWWRRGASALAIPMS

SEQ ID NO: 374502 - protein, 19 aa, Mycobacterium
VVLVLVAVVLFGAASLLFG

SEQ ID NO: 374503 - protein, 19 aa, Mycobacterium
VVLVLVAVVLFGVASLLFG

SEQ ID NO: 374504 - protein, 19 aa, Mycobacterium
VVLVLVGIVLFAVGSVLFG

SEQ ID NO: 374505 - protein, 20 aa, Mycobacterium
VVLVPICSITLGALGHRWFA

SEQ ID NO: 374506 - protein, 17 aa, Mycobacterium
VVLVSWLIAFFEYCLAV

SEQ ID NO: 374507 - protein, 30 aa, Mycobacterium
VVLVVLIVFVALLPRLFRPATVKPDRVADV

SEQ ID NO: 374508 - protein, 31 aa, Mycobacterium
VVLWIALPVVVWWFFIRPWRRERRITLDGML

SEQ ID NO: 374509 - protein, 17 aa, Mycobacterium
VVLYRLGAALPSPGVNF

SEQ ID NO: 374510 - protein, 26 aa, Mycobacterium
VVLYSILGLLLMIIGFHAIDFTTPGP

SEQ ID NO: 374511 - protein, 18 aa, Mycobacterium
VVLYVVFVATAGRPYYLG

SEQ ID NO: 374512 - protein, 26 aa, Mycobacterium
VVMFAALGWFYLSVLPGWLGLSTTGI

SEQ ID NO: 374513 - protein, 24 aa, Mycobacterium
VVMFAVLGWFYLAVLPGWLGLETA

SEQ ID NO: 374514 - protein, 23 aa, Mycobacterium
VVMFAVLGWFYLSVLPGWLGLEQ

SEQ ID NO: 374515 - protein, 19 aa, Mycobacterium
VVMGALLLVLIIEACRRTT

SEQ ID NO: 374516 - protein, 25 aa, Mycobacterium
VVMGLVFGYTWRRTGRLWPLIIAHG

SEQ ID NO: 374517 - protein, 19 aa, Mycobacterium
VVMGLVFVGLIPALQRQVK

SEQ ID NO: 374518 - protein, 21 aa, Mycobacterium
VVMNFSFYCAIARIPLGIAVT

SEQ ID NO: 374519 - protein, 24 aa, Mycobacterium
VVMSPQAFLMRPSRWLWAIHDNRA

SEQ ID NO: 374520 - protein, 25 aa, Mycobacterium
VVMTCILPPLLFNAALESSLVGIRR

SEQ ID NO: 374521 - protein, 26 aa, Mycobacterium
VVNDALMTFFFFIVGLEVTREFTIGE

SEQ ID NO: 374522 - protein, 26 aa, Mycobacterium
VVNHPSWIDPLALAAVMPRSFHFVAA

SEQ ID NO: 374523 - protein, 58 aa, Mycobacterium
VVNLLTPLISAVLLPAAIAVVLLPVSWQLGLAALGGLPLMLGALWASARLARRADSTA

SEQ ID NO: 374524 - protein, 31 aa, Mycobacterium
VVNVHVAFSIWYLWSVMVLFMPQSVYGFSTG

SEQ ID NO: 374525 - protein, 24 aa, Mycobacterium
VVPFALELLALRRLTTAAFGTLMA

SEQ ID NO: 374526 - protein, 18 aa, Mycobacterium
VVPFALFVAAGKGAAWAA

SEQ ID NO: 374527 - protein, 19 aa, Mycobacterium
VVPGLLVLALVLVVLGPRI

SEQ ID NO: 374528 - protein, 19 aa, Mycobacterium
VVPGLYGYVSATKWVVDLE

SEQ ID NO: 374529 - protein, 17 aa, Mycobacterium
VVPIVIYGLILSAVGGV

SEQ ID NO: 374530 - protein, 19 aa, Mycobacterium
VVPIYLLGMLVDRVEHGDG

SEQ ID NO: 374531 - protein, 23 aa, Mycobacterium
VVPKRGWLEALLGHFCDPAVALV

SEQ ID NO: 374532 - protein, 25 aa, Mycobacterium
VVPLLRPLYDYNWVVAFLVAMFVYW

SEQ ID NO: 374533 - protein, 24 aa, Mycobacterium
VVPRKGWLEALLGHFCDPAVALVA

SEQ ID NO: 374534 - protein, 32 aa, Mycobacterium
VVPSLICALTVAWLDRFLAVGGESALFVIGVL

SEQ ID NO: 374535 - protein, 20 aa, Mycobacterium
VVPTVAFAVPWLNELHRLFL

SEQ ID NO: 374536 - protein, 19 aa, Mycobacterium
VVPTVALAVPWLTELQRLF

SEQ ID NO: 374537 - protein, 23 aa, Mycobacterium
VVPVGLILWRTFAPGIGAFVTSI

SEQ ID NO: 374538 - protein, 23 aa, Mycobacterium
VVQAAGLLFFAFAGYARIATLGE

SEQ ID NO: 374539 - protein, 26 aa, Mycobacterium
VVQANLAMPLAIHSLLRALRGDLVHA

SEQ ID NO: 374540 - protein, 24 aa, Mycobacterium
VVQLAPFVLLVELARLLVAGAPAS

SEQ ID NO: 374541 - protein, 18 aa, Mycobacterium
VVQSRFPRAWKLGAGWVG

SEQ ID NO: 374542 - protein, 24 aa, Mycobacterium
VVRAIGTVLLVPLIGALFSSTPQQ

SEQ ID NO: 374543 - protein, 20 aa, Mycobacterium
VVRALYLSMGALCAMLTLFV

SEQ ID NO: 374544 - protein, 25 aa, Mycobacterium
VVRANWVLRTLLREYGRRAVESGVF

SEQ ID NO: 374545 - protein, 24 aa, Mycobacterium
VVRAPRWPVWVVLGVLAVPAVIAA

SEQ ID NO: 374546 - protein, 25 aa, Mycobacterium
VVRARALLHDRAVLQAWAADAVAAV

SEQ ID NO: 374547 - protein, 24 aa, Mycobacterium
VVRGPLLRGFYREMKPFMRRGFHP

SEQ ID NO: 374548 - protein, 22 aa, Mycobacterium
VVRLVRRLVPALVVVLAGCALL

SEQ ID NO: 374549 - protein, 25 aa, Mycobacterium
VVRPDLPETLLPQNYKPPADLAPPA

SEQ ID NO: 374550 - protein, 29 aa, Mycobacterium
VVRRLPGWPIWFAVLWGAQEWLKSIVPFG

SEQ ID NO: 374551 - protein, 17 aa, Mycobacterium
VVRSWLFGDADHPGLLG

SEQ ID NO: 374552 - protein, 21 aa, Mycobacterium
VVRTLMVPTLAQAFGKLSWWP

SEQ ID NO: 374553 - protein, 27 aa, Mycobacterium
VVRTLVIPALFALIGDRIWWPTAPQHA

SEQ ID NO: 374554 - protein, 31 aa, Mycobacterium
VVRTLVIPALFTLIGDRIWWPTFPNIARYQP

SEQ ID NO: 374555 - protein, 31 aa, Mycobacterium
VVRTVIGGPALALFGLCRRLLGGSPDGDRPG

SEQ ID NO: 374556 - protein, 22 aa, Mycobacterium
VVSALAFDYFRSWPDTAMGWPE

SEQ ID NO: 374557 - protein, 28 aa, Mycobacterium
VVSALIGFLPLTWLSLVYGWGLAGIWSG

SEQ ID NO: 374558 - protein, 29 aa, Mycobacterium
VVSALTLIFLIMLLLTRSVVAALVIVGTA

SEQ ID NO: 374559 - protein, 28 aa, Mycobacterium
VVSALTLIFMIMLILTRSAVAALVIVGT

SEQ ID NO: 374560 - protein, 18 aa, Mycobacterium
VVSARRLIRDLWFDGHRI

SEQ ID NO: 374561 - protein, 32 aa, Mycobacterium
VVSDRGYTIFLAILPFLIGALSLTVKGPHPGL

SEQ ID NO: 374562 - protein, 32 aa, Mycobacterium
VVSDRGYTVFLALLPFLIGVLSLTVRGKTGFG

SEQ ID NO: 374563 - protein, 30 aa, Mycobacterium
VVSEGELFIIGRIKDLLIVYGRNHSPDDIE

SEQ ID NO: 374564 - protein, 17 aa, Mycobacterium
VVSFTAWLNAVAARARQ

SEQ ID NO: 374565 - protein, 17 aa, Mycobacterium
VVSFVVLLWLIELFDTL

SEQ ID NO: 374566 - protein, 33 aa, Mycobacterium
VVSGFANSWPSELGDRPALWIPSSSIGSARLEA

SEQ ID NO: 374567 - protein, 19 aa, Mycobacterium
VVSILLAAVHRSALAEQGR

SEQ ID NO: 374568 - protein, 17 aa, Mycobacterium
VVSLRRLLTAVPGTTIV

SEQ ID NO: 374569 - protein, 27 aa, Mycobacterium
VVSTALIFLQPLLAGRLVDRAAAGSPV

SEQ ID NO: 374570 - protein, 24 aa, Mycobacterium
VVSTRQLLLALCALAAALGLLATL

SEQ ID NO: 374571 - protein, 25 aa, Mycobacterium
VVSVLGMFTLVALFGQLRFQSEKTY

SEQ ID NO: 374572 - protein, 22 aa, Mycobacterium
VVSVLNILLPAGERWFVETFNE

SEQ ID NO: 374573 - protein, 24 aa, Mycobacterium
VVSVWLGLLLSWHAATAGGASIAA

SEQ ID NO: 374574 - protein, 19 aa, Mycobacterium
VVSWLLWVLVSATAGVVAF

SEQ ID NO: 374575 - protein, 27 aa, Mycobacterium
VVTAALLCLLFWQRRFFAASAPTFGVP

SEQ ID NO: 374576 - protein, 38 aa, Mycobacterium
VVTAGEMLLLWWQRRFFAVPLPTFGLPLGDRWAEAIML

SEQ ID NO: 374577 - protein, 17 aa, Mycobacterium
VVTALVLHYTALRKRHQ

SEQ ID NO: 374578 - protein, 34 aa, Mycobacterium
VVTDFYLLQAFIIRWRVWLTERITVDWLSKRAFY

SEQ ID NO: 374579 - protein, 21 aa, Mycobacterium
VVTFILALILKYTIGLRLGPE

SEQ ID NO: 374580 - protein, 17 aa, Mycobacterium
VVTFLSTALAWVYVWLR

SEQ ID NO: 374581 - protein, 25 aa, Mycobacterium
VVTGRPLGLFAAYGAVLMVFLVTVR

SEQ ID NO: 374582 - protein, 24 aa, Mycobacterium
VVTGTLLFIVWIRLMRSDLPVESR

SEQ ID NO: 374583 - protein, 31 aa, Mycobacterium
VVTLANVAMFLFAASFFGAGLLFPSYFQELL

SEQ ID NO: 374584 - protein, 22 aa, Mycobacterium
VVTLARWWRPAVAGLVCCVALV

SEQ ID NO: 374585 - protein, 20 aa, Mycobacterium
VVTLGTWVWLGVEEDQYSQL

SEQ ID NO: 374586 - protein, 24 aa, Mycobacterium
VVTLLQSLLDRHAMLRLRVSGDGV

SEQ ID NO: 374587 - protein, 24 aa, Mycobacterium
VVTNFAWLFPILTGLPISQQTWNM

SEQ ID NO: 374588 - protein, 23 aa, Mycobacterium
VVTNFAWLFPVLTGLPISQQTWN

SEQ ID NO: 374589 - protein, 18 aa, Mycobacterium
VVTPAWFSDYVLTVGEVD

SEQ ID NO: 374590 - protein, 20 aa, Mycobacterium
VVTPLYALLTYLPTILTGFH

SEQ ID NO: 374591 - protein, 17 aa, Mycobacterium
VVTTWMKLAIRDRILPD

SEQ ID NO: 374592 - protein, 28 aa, Mycobacterium
VVTVEVVGFLLSLLEPQPAVNELRAIAA

SEQ ID NO: 374593 - protein, 17 aa, Mycobacterium
VVTWAVALLVWRLGRIE

SEQ ID NO: 374594 - protein, 29 aa, Mycobacterium
VVTWVAATLWIPPLVYFGLRRFGREPEAL

SEQ ID NO: 374595 - protein, 18 aa, Mycobacterium
VVVAAICHGVLLAARSVD

SEQ ID NO: 374596 - protein, 29 aa, Mycobacterium
VVVAAVARWWVPEPRWAGGWLGLERAAHI

SEQ ID NO: 374597 - protein, 25 aa, Mycobacterium
VVVAFAYLCFTVLAPWQLGKNTKTS

SEQ ID NO: 374598 - protein, 25 aa, Mycobacterium
VVVAFTYLCFTVLAPWQLGKHNRTS

SEQ ID NO: 374599 - protein, 21 aa, Mycobacterium
VVVAIPLFCVGLITAYLAARA

SEQ ID NO: 374600 - protein, 18 aa, Mycobacterium
VVVALLAALLAGLSLLPK

SEQ ID NO: 374601 - protein, 28 aa, Mycobacterium
VVVATLALLTVPLMFGADLRSTLLRAMT

SEQ ID NO: 374602 - protein, 17 aa, Mycobacterium
VVVCAAALAFVVCVANF

SEQ ID NO: 374603 - protein, 18 aa, Mycobacterium
VVVFLKDHRMLSRYGYVF

SEQ ID NO: 374604 - protein, 17 aa, Mycobacterium
VVVFQWGLGHEIAWPVP

SEQ ID NO: 374605 - protein, 30 aa, Mycobacterium
VVVGIFWMGRRLVSPWWALGLGMILGGAMG

SEQ ID NO: 374606 - protein, 25 aa, Mycobacterium
VVVGIFWMGRRLVSPWWAVGLGLIL

SEQ ID NO: 374607 - protein, 23 aa, Mycobacterium
VVVGILFIGRRLVSTWWAIGLGM

SEQ ID NO: 374608 - protein, 18 aa, Mycobacterium
VVVGLLFLGTVALTLAGI

SEQ ID NO: 374609 - protein, 19 aa, Mycobacterium
VVVGLWWRYRYDKFGWTTR

SEQ ID NO: 374610 - protein, 25 aa, Mycobacterium
VVVGSVILWSFFGDVLSKRSHKAAG

SEQ ID NO: 374611 - protein, 26 aa, Mycobacterium
VVVGVGLGLVLYFTPAMSARDVVVTG

SEQ ID NO: 374612 - protein, 20 aa, Mycobacterium
VVVILQALLDRHATLRLRVE

SEQ ID NO: 374613 - protein, 35 aa, Mycobacterium
VVVIPLFASMVVGLLMFLLLGRPLAALTSGLTNWL

SEQ ID NO: 374614 - protein, 17 aa, Mycobacterium
VVVLACIFILPGRRWVR

SEQ ID NO: 374615 - protein, 21 aa, Mycobacterium
VVVLAPFWLIPTTLDVHLSMT

SEQ ID NO: 374616 - protein, 27 aa, Mycobacterium
VVVLIVAIVIVVLRRPDTPPTAVPPSA

SEQ ID NO: 374617 - protein, 27 aa, Mycobacterium
VVVLLLGWSFFYFSDDTRGYKPVDTTV

SEQ ID NO: 374618 - protein, 26 aa, Mycobacterium
VVVLQSIMAVIFGAGLFIAFDQLWRW

SEQ ID NO: 374619 - protein, 28 aa, Mycobacterium
VVVPHLGWRWMFFIGLVPAFVAWWMRRT

SEQ ID NO: 374620 - protein, 28 aa, Mycobacterium
VVVPLLDGPRYRAELSRRAWLPLVVASA

SEQ ID NO: 374621 - protein, 18 aa, Mycobacterium
VVVPVMLSRILDAVEKMD

SEQ ID NO: 374622 - protein, 17 aa, Mycobacterium
VVVPVMLSRLLDAVEKI

SEQ ID NO: 374623 - protein, 30 aa, Mycobacterium
VVVRGLPGWPIWFAVLWAAQEWLKSLMPFG

SEQ ID NO: 374624 - protein, 29 aa, Mycobacterium
VVVRRLPGWPLWFAGLWSAQEWLKSTVPF

SEQ ID NO: 374625 - protein, 24 aa, Mycobacterium
VVVSWLLFTWMIARLPRQSGRFVT

SEQ ID NO: 374626 - protein, 30 aa, Mycobacterium
VVVVAGVIVWRFFGEALYHRSRTAAARCVG

SEQ ID NO: 374627 - protein, 27 aa, Mycobacterium
VVVVAVAAGLIWWTSDARATLSRPAAA

SEQ ID NO: 374628 - protein, 23 aa, Mycobacterium
VVVVIPLYCIGLWMSFYAARFAT

SEQ ID NO: 374629 - protein, 17 aa, Mycobacterium
VVVVITLFISLAVYGAS

SEQ ID NO: 374630 - protein, 31 aa, Mycobacterium
VVVVLFVPAALPWYYTWPLAVAAALVQTRPG

SEQ ID NO: 374631 - protein, 18 aa, Mycobacterium
VVVVLKGKVWTGLLGMFL

SEQ ID NO: 374632 - protein, 27 aa, Mycobacterium
VVVVLLVARALVRPLRQLRDGALKVAH

SEQ ID NO: 374633 - protein, 30 aa, Mycobacterium
VVVVRLPGWPLWFATLWVAAEWAKSTFPFG

SEQ ID NO: 374634 - protein, 26 aa, Mycobacterium
VVVVVVGVIGWRFFGDVLSNRSQTAA

SEQ ID NO: 374635 - protein, 28 aa, Mycobacterium
VVVVVVVVVFLLLYRARRRRRGIDTSGG

SEQ ID NO: 374636 - protein, 20 aa, Mycobacterium
VVVWGALPFHRAAWANARHR

SEQ ID NO: 374637 - protein, 22 aa, Mycobacterium
VVVWGAWPFHRAGWANLRHGTA

SEQ ID NO: 374638 - protein, 21 aa, Mycobacterium
VVVYRSWRWSVASGAAFYLVA

SEQ ID NO: 374639 - protein, 17 aa, Mycobacterium
VVWGLKGFGLVCWVVVL

SEQ ID NO: 374640 - protein, 17 aa, Mycobacterium
VVWLSVIVLLPLAAIAW

SEQ ID NO: 374641 - protein, 23 aa, Mycobacterium
VVYAFICLFVINVIMTAIGVRVL

SEQ ID NO: 374642 - protein, 23 aa, Mycobacterium
VVYAFICLFVINVIMTAVGVRVL

SEQ ID NO: 374643 - protein, 22 aa, Mycobacterium
VVYAFICLFVINVVMTAIGVRI

SEQ ID NO: 374644 - protein, 22 aa, Mycobacterium
VVYAFICLFVINVVMTAIGVRV

SEQ ID NO: 374645 - protein, 25 aa, Mycobacterium
VVYEPLLNRLPAGTPMYGLERVEGT

SEQ ID NO: 374646 - protein, 18 aa, Mycobacterium
VVYGVLTLTIFISGLMFA

SEQ ID NO: 374647 - protein, 27 aa, Mycobacterium
VVYHPQLLVLTLLLATVAGIFAVVGAA

SEQ ID NO: 374648 - protein, 24 aa, Mycobacterium
VVYIFSLVGYHWLASTPGPLPKPD

SEQ ID NO: 374649 - protein, 17 aa, Mycobacterium
VVYLFRPYIVYRSREAT

SEQ ID NO: 374650 - protein, 29 aa, Mycobacterium
VVYNLPKMVSLLVEPWYALVGTREQVLGL

SEQ ID NO: 374651 - protein, 28 aa, Mycobacterium
VVYTGAVMMLFLFVLMLIGVDLTESLVE

SEQ ID NO: 374652 - protein, 28 aa, Mycobacterium
VVYTGAVMMLFLFVLMLIGVDSAESLRE

SEQ ID NO: 374653 - protein, 28 aa, Mycobacterium
VVYTGAVMMLFLFVLMMIGVDSSESLVE

SEQ ID NO: 374654 - protein, 21 aa, Mycobacterium
VWAFIAVLAVAFFLASAGASA

SEQ ID NO: 374655 - protein, 20 aa, Mycobacterium
VWAPAMLLFLRIVQGVGLGG

SEQ ID NO: 374656 - protein, 17 aa, Mycobacterium
VWAPLLEIECARLSLID

SEQ ID NO: 374657 - protein, 21 aa, Mycobacterium
VWARFPLPVIPAPGDPTPSAP

SEQ ID NO: 374658 - protein, 17 aa, Mycobacterium
VWDSATCKAWLLAQPHL

SEQ ID NO: 374659 - protein, 34 aa, Mycobacterium
VWEANHVWLIYILVIWWTGFPRTFAAATTTLFIP

SEQ ID NO: 374660 - protein, 18 aa, Mycobacterium
VWELLSGSGERLLIYLGI

SEQ ID NO: 374661 - protein, 32 aa, Mycobacterium
VWFGHFPWWIPLGMLVLPFLLGFRLTCYYYRK

SEQ ID NO: 374662 - protein, 25 aa, Mycobacterium
VWGAALTLILIIAALYIGAAFINRY

SEQ ID NO: 374663 - protein, 27 aa, Mycobacterium
VWGALIPFVGPLFDFAFSPDRPWAWTA

SEQ ID NO: 374664 - protein, 18 aa, Mycobacterium
VWGTRRIFKAVRWALDER

SEQ ID NO: 374665 - protein, 19 aa, Mycobacterium
VWHLGPVPIRAYALCIIVG

SEQ ID NO: 374666 - protein, 19 aa, Mycobacterium
VWIADALGMPIDLSWQLWA

SEQ ID NO: 374667 - protein, 17 aa, Mycobacterium
VWIVTMLTALVIGSFWG

SEQ ID NO: 374668 - protein, 26 aa, Mycobacterium
VWKTTPFMSLLLLAGLALVPEDLLRA

SEQ ID NO: 374669 - protein, 22 aa, Mycobacterium
VWLAFELALFRDAAFKEAWLYV

SEQ ID NO: 374670 - protein, 18 aa, Mycobacterium
VWLGLYPTVVLLTMLLSP

SEQ ID NO: 374671 - protein, 17 aa, Mycobacterium
VWLHWAPVSIARASDVG

SEQ ID NO: 374672 - protein, 26 aa, Mycobacterium
VWLSDYYPKPLLKPIPSWFKELTYRP

SEQ ID NO: 374673 - protein, 19 aa, Mycobacterium
VWLSIIVLLPLAAIAWQAS

SEQ ID NO: 374674 - protein, 19 aa, Mycobacterium
VWLVRYMCSADSSPKAPRW

SEQ ID NO: 374675 - protein, 24 aa, Mycobacterium
VWMFAGILMAVGVVLYFVARAATN

SEQ ID NO: 374676 - protein, 23 aa, Mycobacterium
VWPAAAVAVMWLLAVHHCSLRQR

SEQ ID NO: 374677 - protein, 22 aa, Mycobacterium
VWPMMLLIAAFALPLLIAFEYH

SEQ ID NO: 374678 - protein, 23 aa, Mycobacterium
VWPNPVLYLLPTQGPLLLLGAAF

SEQ ID NO: 374679 - protein, 24 aa, Mycobacterium
VWPNPVLYLLPTQGPLLLLGCAFN

SEQ ID NO: 374680 - protein, 17 aa, Mycobacterium
VWSLPCAGAVLIGLGLS

SEQ ID NO: 374681 - protein, 18 aa, Mycobacterium
VWSPQFSLWLVPLAVLAL

SEQ ID NO: 374682 - protein, 20 aa, Mycobacterium
VWSWIFIEPLINRAIDYEDA

SEQ ID NO: 374683 - protein, 19 aa, Mycobacterium
VWSYAAMAVLFALAGLQMQ

SEQ ID NO: 374684 - protein, 18 aa, Mycobacterium
VWTHFIFGSALAGLGLGA

SEQ ID NO: 374685 - protein, 28 aa, Mycobacterium
VWTHYSGWWVFDMTMLMLFGVAAAGFAL

SEQ ID NO: 374686 - protein, 24 aa, Mycobacterium
VWVALITPVAFVLIGLWTMRKKGP

SEQ ID NO: 374687 - protein, 18 aa, Mycobacterium
VWVRVWPAVTVGPGVLGV

SEQ ID NO: 374688 - protein, 27 aa, Mycobacterium
VWVSERYPRRLLRPIPSWFKELTHEPA

SEQ ID NO: 374689 - protein, 19 aa, Mycobacterium
VWVVLRFDPGANVDAVFRR

SEQ ID NO: 374690 - protein, 17 aa, Mycobacterium
VWWQSIIVWFAAAIVAH

SEQ ID NO: 374691 - protein, 26 aa, Mycobacterium
VYAGILLLMRSSLKRVPMPIRIDSLV

SEQ ID NO: 374692 - protein, 26 aa, Mycobacterium
VYAICGLFVFFMLRALGELVLHRPSS

SEQ ID NO: 374693 - protein, 23 aa, Mycobacterium
VYALLPVLWILSLSLKPTSTVKD

SEQ ID NO: 374694 - protein, 24 aa, Mycobacterium
VYALSLFGVHLLATSAPPLPEPDL

SEQ ID NO: 374695 - protein, 23 aa, Mycobacterium
VYAQFPPELPRMPSWWPMNMTWG

SEQ ID NO: 374696 - protein, 26 aa, Mycobacterium
VYAVCGFFVFLILRALGELVLHRPSS

SEQ ID NO: 374697 - protein, 24 aa, Mycobacterium
VYAVGILTFELLTGTTPFTGDSAL

SEQ ID NO: 374698 - protein, 23 aa, Mycobacterium
VYAVMLALALYLVVAAGWENVHF

SEQ ID NO: 374699 - protein, 22 aa, Mycobacterium
VYCLSFTRLPYFQSLGVPVAIG

SEQ ID NO: 374700 - protein, 24 aa, Mycobacterium
VYDHYFRTFLNPTDLVWSFAQCIV

SEQ ID NO: 374701 - protein, 26 aa, Mycobacterium
VYDHYFRTFLNSIDLLWSFVTVIAAA

SEQ ID NO: 374702 - protein, 25 aa, Mycobacterium
VYDHYFRTFLNSTDLLWSFLTVIAA

SEQ ID NO: 374703 - protein, 29 aa, Mycobacterium
VYDRFAARGYGYGPAFRGLRSVWRRGREI

SEQ ID NO: 374704 - protein, 17 aa, Mycobacterium
VYELAFKGGPSAACPDG

SEQ ID NO: 374705 - protein, 28 aa, Mycobacterium
VYFGLPTWLIVFLRVLFVLITIGALWLL

SEQ ID NO: 374706 - protein, 26 aa, Mycobacterium
VYGICGFFVFLILRALGELVLHRPSS

SEQ ID NO: 374707 - protein, 26 aa, Mycobacterium
VYGVCGIFVFLILRALGELVLHRPSS

SEQ ID NO: 374708 - protein, 18 aa, Mycobacterium
VYGVIPAPLLATMFDFFY

SEQ ID NO: 374709 - protein, 17 aa, Mycobacterium
VYGVWGLYVLAPVLKPV

SEQ ID NO: 374710 - protein, 41 aa, Mycobacterium
VYIAFFSFIGFIIANPWLVPAGLLALLALPPALALEVATAI

SEQ ID NO: 374711 - protein, 27 aa, Mycobacterium
VYIAVYFGLIVFFTYFYVSITFNPDER

SEQ ID NO: 374712 - protein, 28 aa, Mycobacterium
VYIGIYFGLIIFFTYFYVSITFNPDERA

SEQ ID NO: 374713 - protein, 19 aa, Mycobacterium
VYILAGFAAIEAIGLVVLW

SEQ ID NO: 374714 - protein, 17 aa, Mycobacterium
VYIYAWPIQQLLVICGL

SEQ ID NO: 374715 - protein, 20 aa, Mycobacterium
VYLARHPSLPRRDALKILDG

SEQ ID NO: 374716 - protein, 20 aa, Mycobacterium
VYLVAIAWFGLRASGRQKTS

SEQ ID NO: 374717 - protein, 19 aa, Mycobacterium
VYLVGPYRELLATLRKGQP

SEQ ID NO: 374718 - protein, 27 aa, Mycobacterium
VYLVLLILEVFWWPRRQAQLLTNADRA

SEQ ID NO: 374719 - protein, 23 aa, Mycobacterium
VYMQVGFLLWLAVATTALSLVLV

SEQ ID NO: 374720 - protein, 24 aa, Mycobacterium
VYPPGLEMVAAFFACARIGVIAVP

SEQ ID NO: 374721 - protein, 29 aa, Mycobacterium
VYQRIGLEQLAWLTPARWGYAAGASSIDF

SEQ ID NO: 374722 - protein, 19 aa, Mycobacterium
VYRYRFIVVAAFVTVCLGS

SEQ ID NO: 374723 - protein, 25 aa, Mycobacterium
VYSAGILMYELLTGSTPFTGDTPLA

SEQ ID NO: 374724 - protein, 26 aa, Mycobacterium
VYSAPRWVATLYWAVLGVCLLGIAVG

SEQ ID NO: 374725 - protein, 22 aa, Mycobacterium
VYSLGCVLYELVTGEPPFVGDS

SEQ ID NO: 374726 - protein, 25 aa, Mycobacterium
VYTDIFRGLPEVVIILLIGLGVGPV

SEQ ID NO: 374727 - protein, 25 aa, Mycobacterium
VYTDVFRGLPEVVIILIIGLGVGPI

SEQ ID NO: 374728 - protein, 26 aa, Mycobacterium
VYTGAVMMLFLFVLMLIGVDSAESLK

SEQ ID NO: 374729 - protein, 18 aa, Mycobacterium
VYVIDYRDRVLKLPAQSN

SEQ ID NO: 374730 - protein, 23 aa, Mycobacterium
VYVLSLVGYHWLASTPGPLPKPD

SEQ ID NO: 374731 - protein, 28 aa, Mycobacterium
VYYPVSWIMWVWYKLFALIFGPSNFFAW

SEQ ID NO: 374732 - protein, 29 aa, Mycobacterium
VYYPVSWIMWVWYKLFALVLGPSNFFAWA

SEQ ID NO: 374733 - protein, 27 aa, Mycobacterium
VYYPVSWIMWVWYKLFASMLGPSNFFA

SEQ ID NO: 374734 - protein, 17 aa, Mycobacterium
WAAALLGLSNGFPTPYY

SEQ ID NO: 374735 - protein, 23 aa, Mycobacterium
WAADGLLAIFFFVVGVELKREFV

SEQ ID NO: 374736 - protein, 35 aa, Mycobacterium
WAAIFVWELARPPVWLFFLFLVTATGAHALKVVAT

SEQ ID NO: 374737 - protein, 26 aa, Mycobacterium
WAAIGFLYLLWLTRGLTRQPPDLAGA

SEQ ID NO: 374738 - protein, 20 aa, Mycobacterium
WAAPLLAILAICAAAAVLAP

SEQ ID NO: 374739 - protein, 24 aa, Mycobacterium
WAAQEWLKSVFPFGGFPWGSVAFG

SEQ ID NO: 374740 - protein, 28 aa, Mycobacterium
WAATRWELASVFPWFAGIVSAACLGAAV

SEQ ID NO: 374741 - protein, 17 aa, Mycobacterium
WAAYTVSFLLLSALPGD

SEQ ID NO: 374742 - protein, 23 aa, Mycobacterium
WACNSLVLVIRDPSPLILVNIGY

SEQ ID NO: 374743 - protein, 31 aa, Mycobacterium
WADRGNPAPLMLWVWIALTGVAATVLVVGWR

SEQ ID NO: 374744 - protein, 25 aa, Mycobacterium
WAESVGPWFPLAFLAAHVVATVVPI

SEQ ID NO: 374745 - protein, 26 aa, Mycobacterium
WAETQVIIRFWLLTAIACGLGVALFY

SEQ ID NO: 374746 - protein, 26 aa, Mycobacterium
WAETTVIIRFWLLTAIACGLGLALFY

SEQ ID NO: 374747 - protein, 25 aa, Mycobacterium
WAETTVIIRFWLLTAIACGLGVALF

SEQ ID NO: 374748 - protein, 26 aa, Mycobacterium
WAETTVIIRFWLLTAIACGLGVALFY

SEQ ID NO: 374749 - protein, 25 aa, Mycobacterium
WAETTVIIRFWLLTAISCGLGVALF

SEQ ID NO: 374750 - protein, 26 aa, Mycobacterium
WAGCVVPLANLLWAPVYVIELALLED

SEQ ID NO: 374751 - protein, 29 aa, Mycobacterium
WAGFSVGWLYWYFWVIVVGFEAVAGGKVL

SEQ ID NO: 374752 - protein, 25 aa, Mycobacterium
WAGGLTMITLIPLGVVLGALAAFIV

SEQ ID NO: 374753 - protein, 25 aa, Mycobacterium
WAGGLTMITLIPLGVVLGALVAFIV

SEQ ID NO: 374754 - protein, 30 aa, Mycobacterium
WAGGLTMITMIPFGLLLGGLVAFIIFGRRA

SEQ ID NO: 374755 - protein, 26 aa, Mycobacterium
WAGTKLIAVFLISVLLTFFPTWTAIG

SEQ ID NO: 374756 - protein, 24 aa, Mycobacterium
WAGVGLVLGPLLIAFSFRERTDAT

SEQ ID NO: 374757 - protein, 27 aa, Mycobacterium
WAGVRTIVSPAWFSDYVLAVAAVTPEG

SEQ ID NO: 374758 - protein, 26 aa, Mycobacterium
WAHYAGWWAFDIGMLVTFGVVAAGLA

SEQ ID NO: 374759 - protein, 24 aa, Mycobacterium
WAIADIYPRYTCDYGYPRTAVSAA

SEQ ID NO: 374760 - protein, 24 aa, Mycobacterium
WAILAVVVILLFGAKKLPDAARSL

SEQ ID NO: 374761 - protein, 26 aa, Mycobacterium
WAISFLYLCCSGSFLGFAFAFGQVLV

SEQ ID NO: 374762 - protein, 20 aa, Mycobacterium
WAITVFNILLVTGSFACGMA

SEQ ID NO: 374763 - protein, 24 aa, Mycobacterium
WAKLYCQWVPRTLPPGWKPGSKAA

SEQ ID NO: 374764 - protein, 23 aa, Mycobacterium
WAKLYSDWVPRTLPPGWKPGSKA

SEQ ID NO: 374765 - protein, 19 aa, Mycobacterium
WALAIPWWTQSFVVGLAAF

SEQ ID NO: 374766 - protein, 19 aa, Mycobacterium
WALFMVTVTYVWKNLGYTC

SEQ ID NO: 374767 - protein, 26 aa, Mycobacterium
WALHRPFIAWLGWPMLAVVALSQGLR

SEQ ID NO: 374768 - protein, 18 aa, Mycobacterium
WALLYLIHRRNVASQPHF

SEQ ID NO: 374769 - protein, 19 aa, Mycobacterium
WALSWCTRPWPSLRRSRMF

SEQ ID NO: 374770 - protein, 21 aa, Mycobacterium
WALYVVGPPLESWLGRLRFGA

SEQ ID NO: 374771 - protein, 17 aa, Mycobacterium
WAMAFATLISRLTGFAR

SEQ ID NO: 374772 - protein, 17 aa, Mycobacterium
WAMAFATLVSRLTGFAR

SEQ ID NO: 374773 - protein, 23 aa, Mycobacterium
WAMIPTGLYYLGILLAVEIDARR

SEQ ID NO: 374774 - protein, 17 aa, Mycobacterium
WAMPDIERVYKVTILAR

SEQ ID NO: 374775 - protein, 18 aa, Mycobacterium
WANSPWSSWYYRLGAITV

SEQ ID NO: 374776 - protein, 32 aa, Mycobacterium
WAPIGLTVVALLLLLGLPFLSVKWGFPDDRVL

SEQ ID NO: 374777 - protein, 17 aa, Mycobacterium
WAPTLLVMTLGIDPAQA

SEQ ID NO: 374778 - protein, 21 aa, Mycobacterium
WAPVIGPFFHRGIMLLDFEEH

SEQ ID NO: 374779 - protein, 25 aa, Mycobacterium
WAPYHLRLDWLMWFAAISPGYALPW

SEQ ID NO: 374780 - protein, 25 aa, Mycobacterium
WAPYHLRLDWLMWFAAISPGYAQPW

SEQ ID NO: 374781 - protein, 25 aa, Mycobacterium
WAPYHLRLDWLMWFAAISPSYAQPW

SEQ ID NO: 374782 - protein, 25 aa, Mycobacterium
WAQADGAAPLWVGYVGAAAEAGMVG

SEQ ID NO: 374783 - protein, 34 aa, Mycobacterium
WAQQMRPFVDLRWWPFLLLLGTTLALMLTAHLLE

SEQ ID NO: 374784 - protein, 28 aa, Mycobacterium
WARQRAKRMVLMWVIAVLTVTGLTAAAA

SEQ ID NO: 374785 - protein, 20 aa, Mycobacterium
WARRIVEFLCLLPLTIPALV

SEQ ID NO: 374786 - protein, 21 aa, Mycobacterium
WARRPFYPTFVPVVSVAPACV

SEQ ID NO: 374787 - protein, 20 aa, Mycobacterium
WARRRPMLAGVLIGLGAAAK

SEQ ID NO: 374788 - protein, 20 aa, Mycobacterium
WARRRPWLAGLLIGLGAAAK

SEQ ID NO: 374789 - protein, 29 aa, Mycobacterium
WASHVFTEFRWLSVALLAGGLAGFCMHAT

SEQ ID NO: 374790 - protein, 25 aa, Mycobacterium
WASTPLALVPIWTRHRIHAAVIALW

SEQ ID NO: 374791 - protein, 26 aa, Mycobacterium
WATADLYPRYVCDYPTPRLPGSAADY

SEQ ID NO: 374792 - protein, 23 aa, Mycobacterium
WATPARWGFATSASTVDLIKLVP

SEQ ID NO: 374793 - protein, 29 aa, Mycobacterium
WAVAGRMVLAWLVTLPAAGIVGALSYWLS

SEQ ID NO: 374794 - protein, 18 aa, Mycobacterium
WAVALSPPLLILALSMRR

SEQ ID NO: 374795 - protein, 23 aa, Mycobacterium
WAVLAFFAFVIWTLTTNTETLVA

SEQ ID NO: 374796 - protein, 21 aa, Mycobacterium
WAVLQFLNIAWPRVAFEQRYL

SEQ ID NO: 374797 - protein, 17 aa, Mycobacterium
WAVTVFEWLVVGGSFAC

SEQ ID NO: 374798 - protein, 30 aa, Mycobacterium
WAWMTGWVYMFTLLALLADAAYGAGPYVAD

SEQ ID NO: 374799 - protein, 17 aa, Mycobacterium
WCDIYDPDHATLKSLAE

SEQ ID NO: 374800 - protein, 20 aa, Mycobacterium
WCGALFNVLAVVVFLGVITA

SEQ ID NO: 374801 - protein, 18 aa, Mycobacterium
WCGPPPLSVRTRQLGVAA

SEQ ID NO: 374802 - protein, 23 aa, Mycobacterium
WCLIAVGMFQIAIAAAQISGINF

SEQ ID NO: 374803 - protein, 27 aa, Mycobacterium
WDADTGAFLWNVMYGHEGRIWGLVYSP

SEQ ID NO: 374804 - protein, 24 aa, Mycobacterium
WDDARAHVWPIPAFMLGIAMAARI

SEQ ID NO: 374805 - protein, 19 aa, Mycobacterium
WDGFLSFWMRNGAFAVFVV

SEQ ID NO: 374806 - protein, 26 aa, Mycobacterium
WDIGFLIFGLALIGAGWLLYRRGSRP

SEQ ID NO: 374807 - protein, 24 aa, Mycobacterium
WDIRNRGVIPPGALPRIRAFVDGS

SEQ ID NO: 374808 - protein, 21 aa, Mycobacterium
WDIRNRGVIPPGALPRVRAFV

SEQ ID NO: 374809 - protein, 18 aa, Mycobacterium
WDIRNRGVISPGALPRVR

SEQ ID NO: 374810 - protein, 23 aa, Mycobacterium
WDKPFVPFVPGAGTFRGRQLHTH

SEQ ID NO: 374811 - protein, 17 aa, Mycobacterium
WDLLIVGISAMCLIFII

SEQ ID NO: 374812 - protein, 27 aa, Mycobacterium
WDLVVFRVDHLLVFRAETILILPVAIA

SEQ ID NO: 374813 - protein, 28 aa, Mycobacterium
WDNYYIENWSLWLDFKILAMTVGAVLRP

SEQ ID NO: 374814 - protein, 42 aa, Mycobacterium
WDRFGPRYLLACWVLAFVISLPIYSVLISLPIVAFEKSGRYI

SEQ ID NO: 374815 - protein, 22 aa, Mycobacterium
WDRHLRPMLARRYEIATGQRQA

SEQ ID NO: 374816 - protein, 38 aa, Mycobacterium
WDSAACKAWLLGQPFLAAGVLLVFYTATARYGAALGAA

SEQ ID NO: 374817 - protein, 23 aa, Mycobacterium
WEFLVLLLIGGSLALLIMQMRRG

SEQ ID NO: 374818 - protein, 22 aa, Mycobacterium
WEHILFPIVLIGLGIVILIGGL

SEQ ID NO: 374819 - protein, 19 aa, Mycobacterium
WEHRCHFHWAPEDLISVAG

SEQ ID NO: 374820 - protein, 35 aa, Mycobacterium
WEHTPGTWLFDMGMLALISVGYLALVRWRIRLKSA

SEQ ID NO: 374821 - protein, 21 aa, Mycobacterium
WEHWRIFLVLMAWCVGGVIAC

SEQ ID NO: 374822 - protein, 24 aa, Mycobacterium
WEIGRPWYLAWAGLVYIVATLATL

SEQ ID NO: 374823 - protein, 28 aa, Mycobacterium
WEIVRFLSPLAVLLIWQAGSAWGLIDPD

SEQ ID NO: 374824 - protein, 27 aa, Mycobacterium
WELARPPIWMLVVFLVTAVGAHGLKTL

SEQ ID NO: 374825 - protein, 18 aa, Mycobacterium
WELLLGALAGALVHHVRW

SEQ ID NO: 374826 - protein, 18 aa, Mycobacterium
WELLLGALVGALVPAIRW

SEQ ID NO: 374827 - protein, 19 aa, Mycobacterium
WEMFKPWSIISITIAIVLA

SEQ ID NO: 374828 - protein, 17 aa, Mycobacterium
WEMSFLYAIVFGGFVAF

SEQ ID NO: 374829 - protein, 23 aa, Mycobacterium
WENRYLLSLAAERALRDPLTGLA

SEQ ID NO: 374830 - protein, 26 aa, Mycobacterium
WEPHCYNIPLCWSFRSLFDSMDGIST

SEQ ID NO: 374831 - protein, 18 aa, Mycobacterium
WERFSFYGMLTILGYYLY

SEQ ID NO: 374832 - protein, 25 aa, Mycobacterium
WERHCYDIPICFSLRSIFDALDGVD

SEQ ID NO: 374833 - protein, 25 aa, Mycobacterium
WERHCYDIPICWSLRSIFDALDGLD

SEQ ID NO: 374834 - protein, 19 aa, Mycobacterium
WERHCYDVPVCWALRSLFD

SEQ ID NO: 374835 - protein, 20 aa, Mycobacterium
WERLAVYWQLASDHGLAIAT

SEQ ID NO: 374836 - protein, 19 aa, Mycobacterium
WERLRGRLLALIGLTLLEA

SEQ ID NO: 374837 - protein, 21 aa, Mycobacterium
WESKPWAWPMSLRPVLYAIDT

SEQ ID NO: 374838 - protein, 20 aa, Mycobacterium
WESKPWSWPMSLRPVLYAID

SEQ ID NO: 374839 - protein, 20 aa, Mycobacterium
WESKPWTWPMSLRPLLYAIE

SEQ ID NO: 374840 - protein, 18 aa, Mycobacterium
WEYNPRGLTDLPALVKAA

SEQ ID NO: 374841 - protein, 23 aa, Mycobacterium
WFAALLFAVVPLRNFLPGSPPPG

SEQ ID NO: 374842 - protein, 20 aa, Mycobacterium
WFAAMLFAVVPLRNILPGAP

SEQ ID NO: 374843 - protein, 21 aa, Mycobacterium
WFASPRTWRLLDAAIAAVMIA

SEQ ID NO: 374844 - protein, 17 aa, Mycobacterium
WFATFWAVQVITIRFWE

SEQ ID NO: 374845 - protein, 18 aa, Mycobacterium
WFATLLPHDRIVAVEYVL

SEQ ID NO: 374846 - protein, 25 aa, Mycobacterium
WFAVFALPLVLTRPVPDPAAPPPSS

SEQ ID NO: 374847 - protein, 19 aa, Mycobacterium
WFAVLCWNNNPRKILGDTA

SEQ ID NO: 374848 - protein, 18 aa, Mycobacterium
WFCWIVTGVAEVVAIAGY

SEQ ID NO: 374849 - protein, 20 aa, Mycobacterium
WFFAIRGVLLLTLPRAYDAA

SEQ ID NO: 374850 - protein, 18 aa, Mycobacterium
WFFAIVSVLFLAQTLLGA

SEQ ID NO: 374851 - protein, 20 aa, Mycobacterium
WFFVDLFTGQFQWQEFVRQG

SEQ ID NO: 374852 - protein, 26 aa, Mycobacterium
WFGAIAYLLIIEPPLYFPGPFGISEH

SEQ ID NO: 374853 - protein, 26 aa, Mycobacterium
WFGLFTTHVIIAVALALTAVLCLVVM

SEQ ID NO: 374854 - protein, 23 aa, Mycobacterium
WFLAALAAPLLTALFAVVCRART

SEQ ID NO: 374855 - protein, 30 aa, Mycobacterium
WFLGQGRFLPLQPDKFLAVIGLILVPIAIG

SEQ ID NO: 374856 - protein, 18 aa, Mycobacterium
WFSTGLLVLYAIGVAVWG

SEQ ID NO: 374857 - protein, 19 aa, Mycobacterium
WFSWLSAVGEIGTGLILGV

SEQ ID NO: 374858 - protein, 25 aa, Mycobacterium
WFTTSSGVLLLWSWLVMSLAQGYYS

SEQ ID NO: 374859 - protein, 22 aa, Mycobacterium
WFYWALSVAVGLPIGLVLLTEL

SEQ ID NO: 374860 - protein, 18 aa, Mycobacterium
WGAFLFMMSIYLQGERGL

SEQ ID NO: 374861 - protein, 18 aa, Mycobacterium
WGAGLFVAGLAFGSMTKS

SEQ ID NO: 374862 - protein, 25 aa, Mycobacterium
WGAVLPYWIVQVIGGLLAGLVIYVV

SEQ ID NO: 374863 - protein, 20 aa, Mycobacterium
WGAWLLTLGAYWFNNKHWSG

SEQ ID NO: 374864 - protein, 18 aa, Mycobacterium
WGAWQRRRGKLGWAAFAF

SEQ ID NO: 374865 - protein, 17 aa, Mycobacterium
WGEFGMLPSFNARRHPH

SEQ ID NO: 374866 - protein, 25 aa, Mycobacterium
WGEQISLLVFMIFASKGAAGVSGAG

SEQ ID NO: 374867 - protein, 25 aa, Mycobacterium
WGFDQIAWFVPAHWGFAATASTVDL

SEQ ID NO: 374868 - protein, 24 aa, Mycobacterium
WGFQQISWFVPAQWGFAASASTVN

SEQ ID NO: 374869 - protein, 25 aa, Mycobacterium
WGFVISGIVLLIAAVGWVVAPETRT

SEQ ID NO: 374870 - protein, 24 aa, Mycobacterium
WGGALMMVALLIGWLVLGFGARIA

SEQ ID NO: 374871 - protein, 25 aa, Mycobacterium
WGGLVLIVVLLFFRGAQDDKKPAPA

SEQ ID NO: 374872 - protein, 27 aa, Mycobacterium
WGHELVASLLWILQAWAVSGACLLVVA

SEQ ID NO: 374873 - protein, 17 aa, Mycobacterium
WGIPLNMLVFGGIVITL

SEQ ID NO: 374874 - protein, 43 aa, Mycobacterium
WGKLVNWVMRRPLVFAIPIVLGMILLVIPLFNLSLGGMSEKYL

SEQ ID NO: 374875 - protein, 18 aa, Mycobacterium
WGLAVFAVSTWIALPVSA

SEQ ID NO: 374876 - protein, 17 aa, Mycobacterium
WGLGFKFIGENIPFIVL

SEQ ID NO: 374877 - protein, 30 aa, Mycobacterium
WGLGHEIAWPVPLLAFIILVAVGADYNMLL

SEQ ID NO: 374878 - protein, 20 aa, Mycobacterium
WGPPFVADQSAYYLSVNRNK

SEQ ID NO: 374879 - protein, 25 aa, Mycobacterium
WGPSSIPVLDPFPRWIRADTVSSGD

SEQ ID NO: 374880 - protein, 34 aa, Mycobacterium
WGQPPPQPTVAAKTWPWIAAAVAVVVVIAGVLGV

SEQ ID NO: 374881 - protein, 19 aa, Mycobacterium
WGRKPIFLLGFGVLAARGF

SEQ ID NO: 374882 - protein, 20 aa, Mycobacterium
WGRKPIFLVAFAVLTARGFL

SEQ ID NO: 374883 - protein, 20 aa, Mycobacterium
WGRQWWGVAICVVTEVLLSG

SEQ ID NO: 374884 - protein, 23 aa, Mycobacterium
WGSKLQSFFGGIPGLSGMGGGLS

SEQ ID NO: 374885 - protein, 17 aa, Mycobacterium
WGSPIYGSGLPSDIWKA

SEQ ID NO: 374886 - protein, 22 aa, Mycobacterium
WGTNALYHWPTVILGAVIMVAA

SEQ ID NO: 374887 - protein, 20 aa, Mycobacterium
WGVEWFTLSKVALSWCIIIY

SEQ ID NO: 374888 - protein, 18 aa, Mycobacterium
WGVGTLFGGLASASRWAP

SEQ ID NO: 374889 - protein, 18 aa, Mycobacterium
WGVLDPLAALTWNVADPV

SEQ ID NO: 374890 - protein, 17 aa, Mycobacterium
WGVWLFGIWIPIFGVGF

SEQ ID NO: 374891 - protein, 23 aa, Mycobacterium
WGWRNRPVWRWFVLGSAVGVVGG

SEQ ID NO: 374892 - protein, 25 aa, Mycobacterium
WGWRNTLVLRWFVLGAGVGVAVAWL

SEQ ID NO: 374893 - protein, 23 aa, Mycobacterium
WGWRVPFLLGAVLLVVGYFIRRS

SEQ ID NO: 374894 - protein, 18 aa, Mycobacterium
WGYRPAAVGLFAFVWMEL

SEQ ID NO: 374895 - protein, 20 aa, Mycobacterium
WHEAAVIYLAATLAGLVANP

SEQ ID NO: 374896 - protein, 26 aa, Mycobacterium
WHEAHPYLPFVFTGSAAASGGGWGMV

SEQ ID NO: 374897 - protein, 35 aa, Mycobacterium
WHGEIGVWILTKGLRIALLLIGGLLAARFISWAAQ

SEQ ID NO: 374898 - protein, 17 aa, Mycobacterium
WHIGGLTIGFHGVLAVA

SEQ ID NO: 374899 - protein, 18 aa, Mycobacterium
WHITGLVIFGFLLAMLRG

SEQ ID NO: 374900 - protein, 18 aa, Mycobacterium
WHIVGLGIFVFLLAMLRG

SEQ ID NO: 374901 - protein, 18 aa, Mycobacterium
WHLGPLPIRAYALFIITG

SEQ ID NO: 374902 - protein, 20 aa, Mycobacterium
WHLLFSFAAGALYFFFVLPR

SEQ ID NO: 374903 - protein, 17 aa, Mycobacterium
WHLSVARWYTWVIAILG

SEQ ID NO: 374904 - protein, 18 aa, Mycobacterium
WHMYPVGLLFGLGFDTAT

SEQ ID NO: 374905 - protein, 26 aa, Mycobacterium
WHQHRVLTRVQWSFNDVPPTAIPQET

SEQ ID NO: 374906 - protein, 25 aa, Mycobacterium
WHQLSSCDPKQIRRWWTANPNCGIA

SEQ ID NO: 374907 - protein, 19 aa, Mycobacterium
WHYQPRAMDWPAPISAPGP

SEQ ID NO: 374908 - protein, 17 aa, Mycobacterium
WIAGALAIVIAVVAGAF

SEQ ID NO: 374909 - protein, 23 aa, Mycobacterium
WIAPVFGLIILLAVGSDYNLLLV

SEQ ID NO: 374910 - protein, 24 aa, Mycobacterium
WIAPVFGLIILLAVGSDYNLLLVS

SEQ ID NO: 374911 - protein, 18 aa, Mycobacterium
WIDLHGTWAAWMGNIITA

SEQ ID NO: 374912 - protein, 18 aa, Mycobacterium
WIEQRLYSVGWLTRPWED

SEQ ID NO: 374913 - protein, 27 aa, Mycobacterium
WIEYLCLMPIFPLALWLMNVYAAIRYR

SEQ ID NO: 374914 - protein, 17 aa, Mycobacterium
WIFAIVSVLFLAQTLMG

SEQ ID NO: 374915 - protein, 17 aa, Mycobacterium
WIFPPIKAASAVGLIAA

SEQ ID NO: 374916 - protein, 18 aa, Mycobacterium
WIGMGRLVAIGRLEPFAF

SEQ ID NO: 374917 - protein, 35 aa, Mycobacterium
WIGSIEPIWIIALSPLFALMWTRLGKRAPTTPRKF

SEQ ID NO: 374918 - protein, 25 aa, Mycobacterium
WIGTAIILAVPYLAIGTLWSLTHTG

SEQ ID NO: 374919 - protein, 18 aa, Mycobacterium
WIITRGLRIAMVLIAAVL

SEQ ID NO: 374920 - protein, 19 aa, Mycobacterium
WIITRGLRIAMVLIAAVLA

SEQ ID NO: 374921 - protein, 21 aa, Mycobacterium
WILREFIETLKIGWAGLALVL

SEQ ID NO: 374922 - protein, 18 aa, Mycobacterium
WINLIIHIGQEGRGANVF

SEQ ID NO: 374923 - protein, 24 aa, Mycobacterium
WIPGVPLLWDLIVTLTASWQKIFS

SEQ ID NO: 374924 - protein, 17 aa, Mycobacterium
WITRRTVIALRWAIEER

SEQ ID NO: 374925 - protein, 25 aa, Mycobacterium
WIVCWLVLVWVLLWGNISAANILSG

SEQ ID NO: 374926 - protein, 26 aa, Mycobacterium
WKAAILATTLLLFLGGGVAGIVFGAR

SEQ ID NO: 374927 - protein, 23 aa, Mycobacterium
WKARGTWWGWQGAGWFLLTVMAL

SEQ ID NO: 374928 - protein, 17 aa, Mycobacterium
WKARTLGVGYLDLTGCM

SEQ ID NO: 374929 - protein, 31 aa, Mycobacterium
WKAVQLLLESFAFLLIGLQLPKVVAGLRGLS

SEQ ID NO: 374930 - protein, 18 aa, Mycobacterium
WKEIIRLVAQMSLGTGAL

SEQ ID NO: 374931 - protein, 36 aa, Mycobacterium
WKIAPPFAAMIAISRLFGFLPASRRGVAVMVTLASV

SEQ ID NO: 374932 - protein, 17 aa, Mycobacterium
WKKFVRLFVGLSFAALA

SEQ ID NO: 374933 - protein, 26 aa, Mycobacterium
WKQSMTVLLMLYPTIMCISYLMTYLQ

SEQ ID NO: 374934 - protein, 35 aa, Mycobacterium
WKRLRPRFWPLIGFTVLKMLVFLVGLVLVVGIIGA

SEQ ID NO: 374935 - protein, 22 aa, Mycobacterium
WKRSWKPWLRGTAYGFPFGALP

SEQ ID NO: 374936 - protein, 25 aa, Mycobacterium
WKRVKPLGLAIVNFALAFSAARYAM

SEQ ID NO: 374937 - protein, 17 aa, Mycobacterium
WKSLLTPSDAFLQGLVL

SEQ ID NO: 374938 - protein, 26 aa, Mycobacterium
WKTITRDLWPAPYLVTDSGSSIAPYT

SEQ ID NO: 374939 - protein, 20 aa, Mycobacterium
WKTTPFISLLLLAGLVQVPE

SEQ ID NO: 374940 - protein, 24 aa, Mycobacterium
WKTTPFMALLLLAGLALVPDDLLK

SEQ ID NO: 374941 - protein, 24 aa, Mycobacterium
WKTTPFMALLLLAGLALVPQDLLN

SEQ ID NO: 374942 - protein, 24 aa, Mycobacterium
WKTTPFMSLLLLAGLALVPEDLLK

SEQ ID NO: 374943 - protein, 24 aa, Mycobacterium
WKTTPFMSLLLLAGLALVPEELLK

SEQ ID NO: 374944 - protein, 30 aa, Mycobacterium
WLAAALAITILPAHLLWLIERRHADPAVSK

SEQ ID NO: 374945 - protein, 19 aa, Mycobacterium
WLAAVNLMLGLFNLLPGAP

SEQ ID NO: 374946 - protein, 18 aa, Mycobacterium
WLAAVTAVYAVFRWFFAR

SEQ ID NO: 374947 - protein, 21 aa, Mycobacterium
WLADHAVGQTVLFPGAGFVEL

SEQ ID NO: 374948 - protein, 28 aa, Mycobacterium
WLAFAGLWATFVYFPVAHWVFAFDKFAS

SEQ ID NO: 374949 - protein, 27 aa, Mycobacterium
WLAGINLLLGLFNLLPGAPLDGGRVLR

SEQ ID NO: 374950 - protein, 18 aa, Mycobacterium
WLAIPYLTVGLVWSFFHA

SEQ ID NO: 374951 - protein, 20 aa, Mycobacterium
WLARLPRPTLALGTAIALLA

SEQ ID NO: 374952 - protein, 19 aa, Mycobacterium
WLATLIVGGAGALIGRLRR

SEQ ID NO: 374953 - protein, 19 aa, Mycobacterium
WLAYAAIAVWCVTAIVGAV

SEQ ID NO: 374954 - protein, 18 aa, Mycobacterium
WLAYLLFGALVLVIFRMT

SEQ ID NO: 374955 - protein, 18 aa, Mycobacterium
WLAYLLFGGLVLVIFRMA

SEQ ID NO: 374956 - protein, 30 aa, Mycobacterium
WLCSAATVVTMLYLAYLRRQTRIEAKVRRR

SEQ ID NO: 374957 - protein, 19 aa, Mycobacterium
WLDIAVLAVAFIAAVSGWR

SEQ ID NO: 374958 - protein, 28 aa, Mycobacterium
WLDLTRPQWFLLPTLLIIGFRLCYGYRH

SEQ ID NO: 374959 - protein, 30 aa, Mycobacterium
WLDRLRALAQRTCVVPLPYAQADLDALQRV

SEQ ID NO: 374960 - protein, 21 aa, Mycobacterium
WLEQLGFPRISSLDSTIPPLV

SEQ ID NO: 374961 - protein, 18 aa, Mycobacterium
WLEVPLAMRDGLGLRLEL

SEQ ID NO: 374962 - protein, 18 aa, Mycobacterium
WLFAGYSLALLAIGWSFD

SEQ ID NO: 374963 - protein, 19 aa, Mycobacterium
WLFGALLFFCGLMIIAFHQ

SEQ ID NO: 374964 - protein, 18 aa, Mycobacterium
WLFGYDPFGWRFAAALSG

SEQ ID NO: 374965 - protein, 22 aa, Mycobacterium
WLFPEYPMHWGTLGSLGYFAAV

SEQ ID NO: 374966 - protein, 17 aa, Mycobacterium
WLFPVSAAVLTWRAVRT

SEQ ID NO: 374967 - protein, 19 aa, Mycobacterium
WLGCMYFGVPLVVMSPQAF

SEQ ID NO: 374968 - protein, 18 aa, Mycobacterium
WLGHPLIWLSFNNEKLNA

SEQ ID NO: 374969 - protein, 26 aa, Mycobacterium
WLGLTRPQWFLLPSVVLIAVRLGYGY

SEQ ID NO: 374970 - protein, 20 aa, Mycobacterium
WLGMLRRDLIPTGYALALIP

SEQ ID NO: 374971 - protein, 21 aa, Mycobacterium
WLGPIIVAVALMYGLGLFYVG

SEQ ID NO: 374972 - protein, 20 aa, Mycobacterium
WLGQFPIIQKLLEPIFILIV

SEQ ID NO: 374973 - protein, 17 aa, Mycobacterium
WLGTRWSKGTVVAAERR

SEQ ID NO: 374974 - protein, 18 aa, Mycobacterium
WLGWLAADIVGVLVFCAV

SEQ ID NO: 374975 - protein, 17 aa, Mycobacterium
WLHAARIAAAVLPLLVA

SEQ ID NO: 374976 - protein, 17 aa, Mycobacterium
WLHGNNLGIGYWGKEEE

SEQ ID NO: 374977 - protein, 18 aa, Mycobacterium
WLHILGSAFMRNALIGGT

SEQ ID NO: 374978 - protein, 18 aa, Mycobacterium
WLIADLRGRRTALAAVVT

SEQ ID NO: 374979 - protein, 30 aa, Mycobacterium
WLIDDYGWQWIFWINVPIGLITVALAAIAF

SEQ ID NO: 374980 - protein, 33 aa, Mycobacterium
WLIDSYGWQWIFWINLPIGLITLLLAATVFPGD

SEQ ID NO: 374981 - protein, 29 aa, Mycobacterium
WLIDTSSWRWIFLINLPIGLVTIVLAAVI

SEQ ID NO: 374982 - protein, 29 aa, Mycobacterium
WLIDTSSWRWIFLINVPIGLLTIVLAAIV

SEQ ID NO: 374983 - protein, 24 aa, Mycobacterium
WLIEHFSVGSIFWVNVPIAVVAIV

SEQ ID NO: 374984 - protein, 19 aa, Mycobacterium
WLIGGVVFIIASWSVARFA

SEQ ID NO: 374985 - protein, 19 aa, Mycobacterium
WLIGPAVMFALAWLLLPDL

SEQ ID NO: 374986 - protein, 18 aa, Mycobacterium
WLKLPTFDWPTDPSWLYR

SEQ ID NO: 374987 - protein, 18 aa, Mycobacterium
WLLFGGLWMAAGYLVAAL

SEQ ID NO: 374988 - protein, 20 aa, Mycobacterium
WLLGSVVFIVASWPVASKSA

SEQ ID NO: 374989 - protein, 21 aa, Mycobacterium
WLLIALPAAGATILLLAGRRS

SEQ ID NO: 374990 - protein, 18 aa, Mycobacterium
WLLLALVTVWGLRLSWHM

SEQ ID NO: 374991 - protein, 17 aa, Mycobacterium
WLLLGVPGAIYASGLFE

SEQ ID NO: 374992 - protein, 19 aa, Mycobacterium
WLLLHLPERVFIQVVPGLL

SEQ ID NO: 374993 - protein, 26 aa, Mycobacterium
WLLVNLPVLVLFPRGWSEFFRLNTRR

SEQ ID NO: 374994 - protein, 20 aa, Mycobacterium
WLMQRENVPLSADPGPPLLL

SEQ ID NO: 374995 - protein, 19 aa, Mycobacterium
WLMQRENVPLSPDPGPPLT

SEQ ID NO: 374996 - protein, 21 aa, Mycobacterium
WLMQRENVPLSPDPGPPLVLQ

SEQ ID NO: 374997 - protein, 21 aa, Mycobacterium
WLMRRENVPLSPDPGPPLILQ

SEQ ID NO: 374998 - protein, 19 aa, Mycobacterium
WLNVIRADPGRVGVLALAT

SEQ ID NO: 374999 - protein, 17 aa, Mycobacterium
WLPTWREGHWYTRLIGI

SEQ ID NO: 375000 - protein, 19 aa, Mycobacterium
WLPVLIVVAVAAGALIVMN

SEQ ID NO: 375001 - protein, 17 aa, Mycobacterium
WLQQYTQNFAWPVSKDL

SEQ ID NO: 375002 - protein, 19 aa, Mycobacterium
WLRAANAVAFILMVCAFFR

SEQ ID NO: 375003 - protein, 25 aa, Mycobacterium
WLRIEHWLNVLFLTLVIRSGIEILS

SEQ ID NO: 375004 - protein, 19 aa, Mycobacterium
WLRIGVMGVLYVLAIPVIT

SEQ ID NO: 375005 - protein, 25 aa, Mycobacterium
WLSAALVVLMLMLVAALVVPRTVGV

SEQ ID NO: 375006 - protein, 17 aa, Mycobacterium
WLSAVFAAIAAWVGALV

SEQ ID NO: 375007 - protein, 17 aa, Mycobacterium
WLSMAASVLVLVVSTAL

SEQ ID NO: 375008 - protein, 17 aa, Mycobacterium
WLSVIVLLPLAAIAWEA

SEQ ID NO: 375009 - protein, 27 aa, Mycobacterium
WLSVLWLVPLAGAVLIILMPPGLRQLA

SEQ ID NO: 375010 - protein, 19 aa, Mycobacterium
WLSVMLTFAPVIIVLERRD

SEQ ID NO: 375011 - protein, 18 aa, Mycobacterium
WLTAWHKALSSPLLTLNG

SEQ ID NO: 375012 - protein, 35 aa, Mycobacterium
WLTPYTLEPAQWLLLIWLLVRWIRTRDDRLLVAAG

SEQ ID NO: 375013 - protein, 21 aa, Mycobacterium
WLTTRLRRLLDGRSLWVAAAA

SEQ ID NO: 375014 - protein, 18 aa, Mycobacterium
WLVAGYALALVAAAWGVD

SEQ ID NO: 375015 - protein, 18 aa, Mycobacterium
WLVARGWRRPTSVAPTGV

SEQ ID NO: 375016 - protein, 21 aa, Mycobacterium
WLVFGGLWMAAGYFLAALACF

SEQ ID NO: 375017 - protein, 26 aa, Mycobacterium
WLVGLPAMLLLAFPAQLHGAGVWIGL

SEQ ID NO: 375018 - protein, 18 aa, Mycobacterium
WLVLIHTVSLFPDGARLW

SEQ ID NO: 375019 - protein, 19 aa, Mycobacterium
WLVVWGGSRMPRRGRKEAV

SEQ ID NO: 375020 - protein, 18 aa, Mycobacterium
WLWVLIFGLQFTSQGISG

SEQ ID NO: 375021 - protein, 18 aa, Mycobacterium
WLYEGHVLGAIFLGFLIG

SEQ ID NO: 375022 - protein, 18 aa, Mycobacterium
WLYEGHVLGAIFLGFLMG

SEQ ID NO: 375023 - protein, 23 aa, Mycobacterium
WMAIGVVLYFVYGRRHSLVARRQ

SEQ ID NO: 375024 - protein, 19 aa, Mycobacterium
WMAILRDLVIGLLIAGAIA

SEQ ID NO: 375025 - protein, 26 aa, Mycobacterium
WMGTSLLYWINGIVYATFAVMTVRCI

SEQ ID NO: 375026 - protein, 18 aa, Mycobacterium
WMLYVRRPVSETMVRDAK

SEQ ID NO: 375027 - protein, 18 aa, Mycobacterium
WMRLPTLAMALTCWWLIS

SEQ ID NO: 375028 - protein, 25 aa, Mycobacterium
WMSRPRRWSVLLASLLLGVAAVSRW

SEQ ID NO: 375029 - protein, 18 aa, Mycobacterium
WMTAVAAFILAIAPGWFG

SEQ ID NO: 375030 - protein, 17 aa, Mycobacterium
WMTFTILVPFLIGQSVI

SEQ ID NO: 375031 - protein, 18 aa, Mycobacterium
WMTLTSCWRLFVPGGFLD

SEQ ID NO: 375032 - protein, 17 aa, Mycobacterium
WMTPTVAILAAVSFASF

SEQ ID NO: 375033 - protein, 25 aa, Mycobacterium
WMTTLKGFFLMAFPQTYLGFASDAI

SEQ ID NO: 375034 - protein, 31 aa, Mycobacterium
WMVFAAFWAVLVYFPVAHWVFAFDGTVTEDS

SEQ ID NO: 375035 - protein, 18 aa, Mycobacterium
WMVIGVIVYFAYSRKHSV

SEQ ID NO: 375036 - protein, 19 aa, Mycobacterium
WMVIVAVLVVVLAGFAIYR

SEQ ID NO: 375037 - protein, 18 aa, Mycobacterium
WMVLAMSVIILLAVGADY

SEQ ID NO: 375038 - protein, 26 aa, Mycobacterium
WMVNLKLLMPVFRWQRRDNLLAEADP

SEQ ID NO: 375039 - protein, 17 aa, Mycobacterium
WMVPFMVWLLHGPWRDK

SEQ ID NO: 375040 - protein, 20 aa, Mycobacterium
WNGLLTFWFAMALYVSWQMI

SEQ ID NO: 375041 - protein, 24 aa, Mycobacterium
WNGSLWSLIWELLCYAAVALIGIA

SEQ ID NO: 375042 - protein, 28 aa, Mycobacterium
WNGVFAFYIPGLVLVVWLFCTTAVMSTS

SEQ ID NO: 375043 - protein, 28 aa, Mycobacterium
WNILVTSVLVLIVFPLLTAALFALEADR

SEQ ID NO: 375044 - protein, 22 aa, Mycobacterium
WNLFGLAHLHVAYVLSMHPPLL

SEQ ID NO: 375045 - protein, 17 aa, Mycobacterium
WNLHQLTRDLDLSAFVV

SEQ ID NO: 375046 - protein, 20 aa, Mycobacterium
WNNFMWPLVITSGHKWRVLT

SEQ ID NO: 375047 - protein, 20 aa, Mycobacterium
WNPPWLRGRTPAIIAVVFVA

SEQ ID NO: 375048 - protein, 23 aa, Mycobacterium
WNSLLRYGYFPLLGIALVALVTL

SEQ ID NO: 375049 - protein, 27 aa, Mycobacterium
WNSPFWQTWDLLLLWLAQLHGGNGLRV

SEQ ID NO: 375050 - protein, 21 aa, Mycobacterium
WNVQHLLGHICWIFAVTAIIR

SEQ ID NO: 375051 - protein, 25 aa, Mycobacterium
WNYTTWLNIVFLVVAAILVIRFAAT

SEQ ID NO: 375052 - protein, 34 aa, Mycobacterium
WPAGSQLLIRFTGPELWWVLRVARWSARVPAATV

SEQ ID NO: 375053 - protein, 26 aa, Mycobacterium
WPALAMFAIIFFWTPPHTWALAMRYK

SEQ ID NO: 375054 - protein, 26 aa, Mycobacterium
WPALAMFAIVFFWTPPHTWALAMRYK

SEQ ID NO: 375055 - protein, 26 aa, Mycobacterium
WPALVMFAIIFFWTPPHTWALAMRYK

SEQ ID NO: 375056 - protein, 27 aa, Mycobacterium
WPALVMFAIIFFWTPPHTWALAMRYKD

SEQ ID NO: 375057 - protein, 24 aa, Mycobacterium
WPAYKVFALLIGAFVLVTVGVVTA

SEQ ID NO: 375058 - protein, 26 aa, Mycobacterium
WPDAFKILNRQGLYGDFFSFYLCDIV

SEQ ID NO: 375059 - protein, 27 aa, Mycobacterium
WPFAAGAFAAALPWLAAALGTPEVPPV

SEQ ID NO: 375060 - protein, 20 aa, Mycobacterium
WPFQWREFVLQCWFIMRVAF

SEQ ID NO: 375061 - protein, 19 aa, Mycobacterium
WPLRILAVLVAAASAGMGY

SEQ ID NO: 375062 - protein, 24 aa, Mycobacterium
WPPALPVAMWLLAAASLVTCAQRL

SEQ ID NO: 375063 - protein, 17 aa, Mycobacterium
WPPGRPTTWLQVSAYRF

SEQ ID NO: 375064 - protein, 20 aa, Mycobacterium
WPPTTIRIALAVLTIGVVSF

SEQ ID NO: 375065 - protein, 21 aa, Mycobacterium
WPQPLQRWWLYRRVADVAALE

SEQ ID NO: 375066 - protein, 19 aa, Mycobacterium
WPRHKLFAVIAGFAALVLL

SEQ ID NO: 375067 - protein, 21 aa, Mycobacterium
WPRHKLFAVIAGLVTFVLVGA

SEQ ID NO: 375068 - protein, 26 aa, Mycobacterium
WPSAPRWVGIPLYLMLGYVAIWFADA

SEQ ID NO: 375069 - protein, 33 aa, Mycobacterium
WPTAPRWVGVPLYLLLGWVAVGFFPTLLNGAGV

SEQ ID NO: 375070 - protein, 20 aa, Mycobacterium
WPTHLAFVVHIGLVSIAVAA

SEQ ID NO: 375071 - protein, 19 aa, Mycobacterium
WPVGRTVAWLLGCATLLFT

SEQ ID NO: 375072 - protein, 34 aa, Mycobacterium
WPVVARLIAAVVMPFGILLAGLLTPLAGADTPDR

SEQ ID NO: 375073 - protein, 18 aa, Mycobacterium
WQAARIYGVLISSFAGGA

SEQ ID NO: 375074 - protein, 17 aa, Mycobacterium
WQAWVFIAVFMAATIVP

SEQ ID NO: 375075 - protein, 18 aa, Mycobacterium
WQAWVFIAVFMVATIVPS

SEQ ID NO: 375076 - protein, 29 aa, Mycobacterium
WQDLLGMDLHWFVVPLSVIILLAVGSDYN

SEQ ID NO: 375077 - protein, 29 aa, Mycobacterium
WQDVLGLGVQWIVIPLSIVILLAVGSDYN

SEQ ID NO: 375078 - protein, 17 aa, Mycobacterium
WQGDTGVWILGRGVPIA

SEQ ID NO: 375079 - protein, 29 aa, Mycobacterium
WQGEYRVAWWVGVGLAVVLTLLSIVTYHG

SEQ ID NO: 375080 - protein, 32 aa, Mycobacterium
WQGYAAHQWLAAHGPYLIWLEQAAIDSSVTAA

SEQ ID NO: 375081 - protein, 19 aa, Mycobacterium
WQHFFLTDHPVWSALWGPI

SEQ ID NO: 375082 - protein, 33 aa, Mycobacterium
WQHTPRVWLLDMGMLAALSVFYAGFVRWRIRLR

SEQ ID NO: 375083 - protein, 28 aa, Mycobacterium
WQIGRPWYLAWAGLIYTAAAVATLIWIA

SEQ ID NO: 375084 - protein, 18 aa, Mycobacterium
WQLPASFIGAAGGAWLLL

SEQ ID NO: 375085 - protein, 26 aa, Mycobacterium
WQLSGPLLLWGFEIPRAMVFIAFVFS

SEQ ID NO: 375086 - protein, 17 aa, Mycobacterium
WQLSLIHLRLSLVPILI

SEQ ID NO: 375087 - protein, 24 aa, Mycobacterium
WQMLHDTFPEPAVLWMLADSDRRW

SEQ ID NO: 375088 - protein, 19 aa, Mycobacterium
WQNPLSYDPLGRVPPIEPM

SEQ ID NO: 375089 - protein, 18 aa, Mycobacterium
WQNPYTYDPLGRVPPEPP

SEQ ID NO: 375090 - protein, 19 aa, Mycobacterium
WQPPSTEQPAWQPPAYQPQ

SEQ ID NO: 375091 - protein, 20 aa, Mycobacterium
WQQGFTYLANFNQPYLLWAP

SEQ ID NO: 375092 - protein, 19 aa, Mycobacterium
WQRFWRITLPMLRPTTFFV

SEQ ID NO: 375093 - protein, 18 aa, Mycobacterium
WQRLDVVFVLGPRTRDLA

SEQ ID NO: 375094 - protein, 18 aa, Mycobacterium
WQRLGLQGQLVWAAARAL

SEQ ID NO: 375095 - protein, 17 aa, Mycobacterium
WQRLSPRMLLVHPVHEV

SEQ ID NO: 375096 - protein, 19 aa, Mycobacterium
WQRMFLAMSALFVVTSAFT

SEQ ID NO: 375097 - protein, 22 aa, Mycobacterium
WQRWQPMAMLVLGAVLIAMSSQ

SEQ ID NO: 375098 - protein, 18 aa, Mycobacterium
WQWFVTEVPQRSLHNWQN

SEQ ID NO: 375099 - protein, 17 aa, Mycobacterium
WQWLVTEVPQRSLHNWQ

SEQ ID NO: 375100 - protein, 25 aa, Mycobacterium
WRAAARIGLLLIAVWGVGSMLMRMT

SEQ ID NO: 375101 - protein, 22 aa, Mycobacterium
WRAVFWINVPICALAVLLTAIF

SEQ ID NO: 375102 - protein, 30 aa, Mycobacterium
WRDIVLLLCALLFTIIWWEVSHSRSNWLPT

SEQ ID NO: 375103 - protein, 27 aa, Mycobacterium
WRDLVLLLCVVLFTFVWWGVSHSRANW

SEQ ID NO: 375104 - protein, 23 aa, Mycobacterium
WRDRPVLRWFVLGIAIGVAGGWL

SEQ ID NO: 375105 - protein, 27 aa, Mycobacterium
WRDRVLAAMVLVFFATAALLGLLTRRA

SEQ ID NO: 375106 - protein, 18 aa, Mycobacterium
WRETPAPYGPLFLWIGRG

SEQ ID NO: 375107 - protein, 20 aa, Mycobacterium
WRFFKHPIEVMVFVTFVSVM

SEQ ID NO: 375108 - protein, 19 aa, Mycobacterium
WRGAFWDWIAGLNLNLVGF

SEQ ID NO: 375109 - protein, 18 aa, Mycobacterium
WRGLLISVVLGLAGAIGQ

SEQ ID NO: 375110 - protein, 19 aa, Mycobacterium
WRGPFWKWIAGLDLNVVGF

SEQ ID NO: 375111 - protein, 26 aa, Mycobacterium
WRGVLQAAGLLFFAFAGYARIATLGE

SEQ ID NO: 375112 - protein, 19 aa, Mycobacterium
WRHLLSVLLAPAMMTVFIP

SEQ ID NO: 375113 - protein, 29 aa, Mycobacterium
WRHLPIAASLLSLALLTIALATPTHDMRI

SEQ ID NO: 375114 - protein, 19 aa, Mycobacterium
WRHWHIWYWPTLCALVLVR

SEQ ID NO: 375115 - protein, 41 aa, Mycobacterium
WRKQTWLGRFVSTYGWRAYALPVLIVLTVVVVYQTVTGTAA

SEQ ID NO: 375116 - protein, 28 aa, Mycobacterium
WRLANFLLEGLVFLLIGQQFPAILDGLS

SEQ ID NO: 375117 - protein, 19 aa, Mycobacterium
WRLAVFDVAAPLVAAMALL

SEQ ID NO: 375118 - protein, 21 aa, Mycobacterium
WRMPPLTLLEPVVWSPGTRLG

SEQ ID NO: 375119 - protein, 17 aa, Mycobacterium
WRMVRFEYALIVTTATA

SEQ ID NO: 375120 - protein, 18 aa, Mycobacterium
WRNPVMFIVEIGATWATA

SEQ ID NO: 375121 - protein, 21 aa, Mycobacterium
WRPLLEPALTILTVGALGAGA

SEQ ID NO: 375122 - protein, 17 aa, Mycobacterium
WRRGAGMLAVPLCLLSA

SEQ ID NO: 375123 - protein, 26 aa, Mycobacterium
WRRGERWVWWSLLLGCAFGTVPVLAV

SEQ ID NO: 375124 - protein, 19 aa, Mycobacterium
WRRGLIMGLFVFCAFVTPG

SEQ ID NO: 375125 - protein, 27 aa, Mycobacterium
WRRIGAAIVRWPAPILVATCAVALIGL

SEQ ID NO: 375126 - protein, 23 aa, Mycobacterium
WRRIGTAVVRWPGAVLAAALAVS

SEQ ID NO: 375127 - protein, 18 aa, Mycobacterium
WRRIGVSLRLVLIGSVIG

SEQ ID NO: 375128 - protein, 25 aa, Mycobacterium
WRRLATAIVRWPAPILATSVILAIV

SEQ ID NO: 375129 - protein, 24 aa, Mycobacterium
WRRLSRAVWPPLVTGPAVVVACAA

SEQ ID NO: 375130 - protein, 17 aa, Mycobacterium
WRRLTGVILPIIKPAVV

SEQ ID NO: 375131 - protein, 24 aa, Mycobacterium
WRRLTKIILPLIKPAVLVALLFRT

SEQ ID NO: 375132 - protein, 24 aa, Mycobacterium
WRRVGTIVVRWPKPVLVASSAAVL

SEQ ID NO: 375133 - protein, 17 aa, Mycobacterium
WRRVGVTLRLLVIGSLA

SEQ ID NO: 375134 - protein, 23 aa, Mycobacterium
WRRVRAWGPWLLGLSVAVRLAWA

SEQ ID NO: 375135 - protein, 24 aa, Mycobacterium
WRSVFWINLPICAAAIILTAVFVP

SEQ ID NO: 375136 - protein, 19 aa, Mycobacterium
WRVAFWLSAVVVLIGYYIR

SEQ ID NO: 375137 - protein, 25 aa, Mycobacterium
WRVLPAHLAVVFLVADLVLVTFATS

SEQ ID NO: 375138 - protein, 21 aa, Mycobacterium
WRVMWFRIHAHPAGDEWHVAV

SEQ ID NO: 375139 - protein, 19 aa, Mycobacterium
WRVVAGNRPFLRFAAAMIG

SEQ ID NO: 375140 - protein, 27 aa, Mycobacterium
WRVVNSHWVELPHLLQPRAAAAAAVVG

SEQ ID NO: 375141 - protein, 20 aa, Mycobacterium
WRWDPYPFILLNLAFSTQAA

SEQ ID NO: 375142 - protein, 28 aa, Mycobacterium
WRWIGTATVRWPGPILAAACAVGLVGLL

SEQ ID NO: 375143 - protein, 17 aa, Mycobacterium
WRYAAVLVGYCAGWLPW

SEQ ID NO: 375144 - protein, 24 aa, Mycobacterium
WSAACAVAYLRGFGRRPAWVITEI

SEQ ID NO: 375145 - protein, 18 aa, Mycobacterium
WSAACAVAYLRGFGRRPS

SEQ ID NO: 375146 - protein, 26 aa, Mycobacterium
WSAANALFNGFFREIVTRSGFDDALL

SEQ ID NO: 375147 - protein, 17 aa, Mycobacterium
WSAARVAVVTRAARAAG

SEQ ID NO: 375148 - protein, 21 aa, Mycobacterium
WSALLLVALTIAAPLTVDGAS

SEQ ID NO: 375149 - protein, 22 aa, Mycobacterium
WSALPVLGAIPLIGLALRANRD

SEQ ID NO: 375150 - protein, 28 aa, Mycobacterium
WSDELVHSLWWLAQAWTIAALCTLAVLV

SEQ ID NO: 375151 - protein, 34 aa, Mycobacterium
WSDFWEEFVYNFFDIFTYAWDSIALLGMDIGEYL

SEQ ID NO: 375152 - protein, 20 aa, Mycobacterium
WSDRLAAHLSARGAAPGTVV

SEQ ID NO: 375153 - protein, 17 aa, Mycobacterium
WSFLQAIVMSIAVMLVH

SEQ ID NO: 375154 - protein, 31 aa, Mycobacterium
WSFRAMIGFLAIPVLFALLALWLTRGGRIPD

SEQ ID NO: 375155 - protein, 31 aa, Mycobacterium
WSFRAMIGFLAIPVLFALLALWLTRGGRIPG

SEQ ID NO: 375156 - protein, 19 aa, Mycobacterium
WSFVLALLAAALTARKRIA

SEQ ID NO: 375157 - protein, 18 aa, Mycobacterium
WSGGWWVDPVIGLAISGV

SEQ ID NO: 375158 - protein, 18 aa, Mycobacterium
WSGLYFIAFFGVLCIAFD

SEQ ID NO: 375159 - protein, 26 aa, Mycobacterium
WSHVQGLLFLPLTAYLLARLAVRRFG

SEQ ID NO: 375160 - protein, 29 aa, Mycobacterium
WSKVQTVVTPAWYAPLVLTVGGIGESGVP

SEQ ID NO: 375161 - protein, 17 aa, Mycobacterium
WSLLAFVVGHVIGGALM

SEQ ID NO: 375162 - protein, 17 aa, Mycobacterium
WSLLAVALVATLCATVF

SEQ ID NO: 375163 - protein, 21 aa, Mycobacterium
WSLLLGYGCLPWVATAMLGLR

SEQ ID NO: 375164 - protein, 21 aa, Mycobacterium
WSLLVGYGCLPWVATAMLRLR

SEQ ID NO: 375165 - protein, 22 aa, Mycobacterium
WSLLVGYGCLPWVAVSMLSLRA

SEQ ID NO: 375166 - protein, 21 aa, Mycobacterium
WSLLVGYGCLPWVAVSVLRLR

SEQ ID NO: 375167 - protein, 32 aa, Mycobacterium
WSMLIVVLFVPAALPWYYSWPLAIVAPLAQSR

SEQ ID NO: 375168 - protein, 20 aa, Mycobacterium
WSMQILKAVPNFALTPLLII

SEQ ID NO: 375169 - protein, 26 aa, Mycobacterium
WSQRHWAFVLTYYWGLVLSSQALLTP

SEQ ID NO: 375170 - protein, 21 aa, Mycobacterium
WSRTPAARRVLAGLLVVLAAV

SEQ ID NO: 375171 - protein, 28 aa, Mycobacterium
WSSLVAAILPPLLKKLRIDPAIVSGPLI

SEQ ID NO: 375172 - protein, 26 aa, Mycobacterium
WSSPFWQTWDLLLLWLAQLHGGNGLR

SEQ ID NO: 375173 - protein, 25 aa, Mycobacterium
WSSPFWQTWDLLLLWLAQLHGGNGM

SEQ ID NO: 375174 - protein, 20 aa, Mycobacterium
WSSVHYLLDVLRRVAIDFDR

SEQ ID NO: 375175 - protein, 18 aa, Mycobacterium
WSSVPVWLSLLGDLLVAT

SEQ ID NO: 375176 - protein, 21 aa, Mycobacterium
WSTALLPLAVLMLATAVAAIA

SEQ ID NO: 375177 - protein, 25 aa, Mycobacterium
WSTALVPLALLILAAAVAALAVRGW

SEQ ID NO: 375178 - protein, 19 aa, Mycobacterium
WSTIGFHWAFQITAQFLGP

SEQ ID NO: 375179 - protein, 39 aa, Mycobacterium
WSTILAGVNPTWFGWLIVAWLWLTVVFANLAEAVAEGRG

SEQ ID NO: 375180 - protein, 40 aa, Mycobacterium
WSTLLAVVDPSWFAGLIVAWLWLTVIFANLAEAVAEGRGK

SEQ ID NO: 375181 - protein, 17 aa, Mycobacterium
WSVFGWTAPSNWIGSIE

SEQ ID NO: 375182 - protein, 22 aa, Mycobacterium
WSVRVVAQWFQGRLSQRGATAV

SEQ ID NO: 375183 - protein, 28 aa, Mycobacterium
WSWIVGMLVWVWQGILEVAYLGITVAFL

SEQ ID NO: 375184 - protein, 19 aa, Mycobacterium
WSWSDVWLPAILLAVAGLG

SEQ ID NO: 375185 - protein, 23 aa, Mycobacterium
WSYAMAWPAIAPQLVALLTSPRR

SEQ ID NO: 375186 - protein, 27 aa, Mycobacterium
WTAAAMFLAFWLPFNNGLRPEPIIALG

SEQ ID NO: 375187 - protein, 20 aa, Mycobacterium
WTALAAWVALAVTVIALVYA

SEQ ID NO: 375188 - protein, 26 aa, Mycobacterium
WTDDVLPYMRFNANRALANLGYEPMF

SEQ ID NO: 375189 - protein, 18 aa, Mycobacterium
WTGFPIKPILESVGVHPD

SEQ ID NO: 375190 - protein, 18 aa, Mycobacterium
WTGMGRRLLADEPAFAAA

SEQ ID NO: 375191 - protein, 20 aa, Mycobacterium
WTGYFLGLMSVTITALGLAA

SEQ ID NO: 375192 - protein, 26 aa, Mycobacterium
WTHHWVWLVPLMIWLLSGPLRDRLGA

SEQ ID NO: 375193 - protein, 23 aa, Mycobacterium
WTHHWVWLVPLMIWVLQGPVRER

SEQ ID NO: 375194 - protein, 28 aa, Mycobacterium
WTHSRPAWLFDMAMLATLSVAYACLVWW

SEQ ID NO: 375195 - protein, 30 aa, Mycobacterium
WTHYSGWWAFDMAMLVILGALWAGFVLFRL

SEQ ID NO: 375196 - protein, 26 aa, Mycobacterium
WTHYSGWWVFDMVMLGLFGAVAAGFT

SEQ ID NO: 375197 - protein, 18 aa, Mycobacterium
WTLIYEVMCYLAVLAIGV

SEQ ID NO: 375198 - protein, 20 aa, Mycobacterium
WTLVFEMICYIAVAVLGVAG

SEQ ID NO: 375199 - protein, 29 aa, Mycobacterium
WTPTTDPGWKWLWWQYGLADTRYTSGNAW

SEQ ID NO: 375200 - protein, 17 aa, Mycobacterium
WTQFGLHLSWVAGATAG

SEQ ID NO: 375201 - protein, 17 aa, Mycobacterium
WTRTSFALLVNGVLLTL

SEQ ID NO: 375202 - protein, 35 aa, Mycobacterium
WTRVARGWPGWGLALWLICPIWLAHSMPTWAAVLV

SEQ ID NO: 375203 - protein, 18 aa, Mycobacterium
WTRWSATVCAALAEPGPG

SEQ ID NO: 375204 - protein, 24 aa, Mycobacterium
WTSVYEANWWWLLASVAASAASMH

SEQ ID NO: 375205 - protein, 30 aa, Mycobacterium
WTTRPILLMQLLFHLLWVTGATLGGLVGEA

SEQ ID NO: 375206 - protein, 19 aa, Mycobacterium
WTTYLGCVLGSFLAFAFGA

SEQ ID NO: 375207 - protein, 25 aa, Mycobacterium
WTVLGDKIWIMGGLRDGVALQTVES

SEQ ID NO: 375208 - protein, 17 aa, Mycobacterium
WTVRGGARVYWVLLWVS

SEQ ID NO: 375209 - protein, 17 aa, Mycobacterium
WVAAIYLVLIAFAAVGA

SEQ ID NO: 375210 - protein, 18 aa, Mycobacterium
WVANHFVALMPVISGREH

SEQ ID NO: 375211 - protein, 28 aa, Mycobacterium
WVASVNWLWFLVFTIAAIVWTAVSLAGW

SEQ ID NO: 375212 - protein, 17 aa, Mycobacterium
WVAVYGVTSILLGSLPL

SEQ ID NO: 375213 - protein, 31 aa, Mycobacterium
WVDLVRGSLRILLPLSFAVALILLSQGTIQS

SEQ ID NO: 375214 - protein, 22 aa, Mycobacterium
WVELPHLLQPRAAAAAAAVGDR

SEQ ID NO: 375215 - protein, 21 aa, Mycobacterium
WVELPHLLQPRAAAAAAVVGD

SEQ ID NO: 375216 - protein, 31 aa, Mycobacterium
WVGASILYPSLFLLPLLATTLAIVAGVGQHL

SEQ ID NO: 375217 - protein, 35 aa, Mycobacterium
WVGDLPWFIPMAFISLPFLLAFRLTCYYYRKAYYR

SEQ ID NO: 375218 - protein, 17 aa, Mycobacterium
WVGFTVVSALLILGLAQ

SEQ ID NO: 375219 - protein, 22 aa, Mycobacterium
WVGTMLLTCGLLTGVFAVISLH

SEQ ID NO: 375220 - protein, 35 aa, Mycobacterium
WVGYTLSLLGFSFASVIFLYVLQRIQGVLPLSGGL

SEQ ID NO: 375221 - protein, 28 aa, Mycobacterium
WVHQHGIWPWLVAMLALAVVVIGGAWHR

SEQ ID NO: 375222 - protein, 27 aa, Mycobacterium
WVIALLGVDLLWYTYHRVAHRVRLIWA

SEQ ID NO: 375223 - protein, 17 aa, Mycobacterium
WVKWYPGVPAYLDQQWV

SEQ ID NO: 375224 - protein, 28 aa, Mycobacterium
WVLALGSYGLMTWLIVWRAAEDRRDREN

SEQ ID NO: 375225 - protein, 21 aa, Mycobacterium
WVLARAWQRPAALLPTGLIVW

SEQ ID NO: 375226 - protein, 17 aa, Mycobacterium
WVLAVVARPYEWWRVAL

SEQ ID NO: 375227 - protein, 25 aa, Mycobacterium
WVLCFLVLVWVLLWGDLSPANIVGG

SEQ ID NO: 375228 - protein, 25 aa, Mycobacterium
WVLLIFTILLCALLLWRGVEAVSFL

SEQ ID NO: 375229 - protein, 19 aa, Mycobacterium
WVLPVAMIVLLVAVAPRMW

SEQ ID NO: 375230 - protein, 17 aa, Mycobacterium
WVLVGRFTKPRLRDPEL

SEQ ID NO: 375231 - protein, 20 aa, Mycobacterium
WVNEGLMTVFFFAVGLDVRR

SEQ ID NO: 375232 - protein, 21 aa, Mycobacterium
WVNLIGLILLMLLQPVGGMIS

SEQ ID NO: 375233 - protein, 26 aa, Mycobacterium
WVQAQGGAPLWVGYLGAAAEAGMVGA

SEQ ID NO: 375234 - protein, 17 aa, Mycobacterium
WVRLPTGQRLSHYGDNP

SEQ ID NO: 375235 - protein, 33 aa, Mycobacterium
WVRTLIVLTIMLLLFGVPWWTLVMSGNAWPVPV

SEQ ID NO: 375236 - protein, 23 aa, Mycobacterium
WVSIPIATTMLLALALTGSYRRV

SEQ ID NO: 375237 - protein, 23 aa, Mycobacterium
WVSIPIATVMLLALALTGSYRRV

SEQ ID NO: 375238 - protein, 17 aa, Mycobacterium
WVSMLIVLGFQIPVDGW

SEQ ID NO: 375239 - protein, 19 aa, Mycobacterium
WVSVALLFVMVAVQITDIL

SEQ ID NO: 375240 - protein, 22 aa, Mycobacterium
WVTTAVLLVVLIISALNSAAAA

SEQ ID NO: 375241 - protein, 19 aa, Mycobacterium
WVVLAFFVFLVWAFTQKSD

SEQ ID NO: 375242 - protein, 18 aa, Mycobacterium
WVVLDVLKHDLATRHIPV

SEQ ID NO: 375243 - protein, 19 aa, Mycobacterium
WVVLFHFRPMLAESAPGFT

SEQ ID NO: 375244 - protein, 18 aa, Mycobacterium
WVVLTIVALAPVLIVGIG

SEQ ID NO: 375245 - protein, 17 aa, Mycobacterium
WVVTAAALALLFPQLET

SEQ ID NO: 375246 - protein, 18 aa, Mycobacterium
WVWPVGLVGPGAVVVGCG

SEQ ID NO: 375247 - protein, 17 aa, Mycobacterium
WVYLADPADIKTVFAGD

SEQ ID NO: 375248 - protein, 21 aa, Mycobacterium
WWAKLVVLGLILFAGIAAAVL

SEQ ID NO: 375249 - protein, 18 aa, Mycobacterium
WWAQLSWLPQRPVLVPGT

SEQ ID NO: 375250 - protein, 25 aa, Mycobacterium
WWATGRSPFWPLAIGIIGVVVLVGC

SEQ ID NO: 375251 - protein, 20 aa, Mycobacterium
WWGAGYNLIAVPLAAGVLAP

SEQ ID NO: 375252 - protein, 27 aa, Mycobacterium
WWLLEQPIRRWRPARVPLLPLAAATVA

SEQ ID NO: 375253 - protein, 18 aa, Mycobacterium
WWLRRRCGYRTPVPFVLR

SEQ ID NO: 375254 - protein, 18 aa, Mycobacterium
WWLTNEAALVVFAIGIAL

SEQ ID NO: 375255 - protein, 21 aa, Mycobacterium
WWMFIVLAVVIVALRMYTLYR

SEQ ID NO: 375256 - protein, 42 aa, Mycobacterium
WWPGVKEPLLRWLAIAAISIVIALVFWGPYLVAVAHASLEKA

SEQ ID NO: 375257 - protein, 18 aa, Mycobacterium
WWPTFPNIARYQPDPAYA

SEQ ID NO: 375258 - protein, 19 aa, Mycobacterium
WWTAMLLAGPGWVLFGAIK

SEQ ID NO: 375259 - protein, 20 aa, Mycobacterium
WYAAMLFAVVPLRNILPGAP

SEQ ID NO: 375260 - protein, 18 aa, Mycobacterium
WYARLRKPPYQPPNAAFP

SEQ ID NO: 375261 - protein, 18 aa, Mycobacterium
WYASVHRLPNPAEPEHLA

SEQ ID NO: 375262 - protein, 19 aa, Mycobacterium
WYDFYLYATAAALVLKPLF

SEQ ID NO: 375263 - protein, 17 aa, Mycobacterium
WYESQFLPRIGPWALYG

SEQ ID NO: 375264 - protein, 17 aa, Mycobacterium
WYFRQLLGSANLTGGKW

SEQ ID NO: 375265 - protein, 20 aa, Mycobacterium
WYITDATLTGLWARPTLETS

SEQ ID NO: 375266 - protein, 19 aa, Mycobacterium
WYLRATPLAAVALGLAVVL

SEQ ID NO: 375267 - protein, 17 aa, Mycobacterium
WYQAWWQWIGGVARGEL

SEQ ID NO: 375268 - protein, 17 aa, Mycobacterium
WYRDAKLYTIFEGTSEI

SEQ ID NO: 375269 - protein, 26 aa, Mycobacterium
WYRQLYFWVLVAIAAGIVVGWLAPVT

SEQ ID NO: 375270 - protein, 18 aa, Mycobacterium
WYYAWTPGTGYLANLLPA

SEQ ID NO: 375271 - protein, 25 aa, Mycobacterium
YAAALLFIGVLAVIARLFAGVNLWR

SEQ ID NO: 375272 - protein, 26 aa, Mycobacterium
YAADSLAVRLRREGPIPWPEALEIGV

SEQ ID NO: 375273 - protein, 28 aa, Mycobacterium
YAAIIAVLLPPVFVLAWSGLAGRERSGG

SEQ ID NO: 375274 - protein, 29 aa, Mycobacterium
YAAIITVLMPPVFVLAWAGLRARTRGGGW

SEQ ID NO: 375275 - protein, 28 aa, Mycobacterium
YAAMITVLLPPLLVLTWSGLRAGDRRRE

SEQ ID NO: 375276 - protein, 17 aa, Mycobacterium
YAAMLSGLGLDAADLPA

SEQ ID NO: 375277 - protein, 17 aa, Mycobacterium
YAARLRPVRADSAIGLP

SEQ ID NO: 375278 - protein, 30 aa, Mycobacterium
YAAVAWFLRFLVRHSMYWFVGYRIILGSVV

SEQ ID NO: 375279 - protein, 25 aa, Mycobacterium
YAAVSLPFLLLFRLTCYYYRGAYYR

SEQ ID NO: 375280 - protein, 23 aa, Mycobacterium
YADLFVLVAILATLLLLIVQTMC

SEQ ID NO: 375281 - protein, 22 aa, Mycobacterium
YADLLILPILNIYRKYYGTKMM

SEQ ID NO: 375282 - protein, 22 aa, Mycobacterium
YADLLILPILNIYRKYYGTRMM

SEQ ID NO: 375283 - protein, 20 aa, Mycobacterium
YAFARLQFPGRDALFWVYIA

SEQ ID NO: 375284 - protein, 32 aa, Mycobacterium
YAFARLRFPGRDGLFWIYLATLMIPATVTVVP

SEQ ID NO: 375285 - protein, 23 aa, Mycobacterium
YAFGAFGVPLWQMAIGAFVGSVP

SEQ ID NO: 375286 - protein, 24 aa, Mycobacterium
YAFGAFGVPLWQMAVGAFIGSMPR

SEQ ID NO: 375287 - protein, 17 aa, Mycobacterium
YAFGFQLAVNADLESPV

SEQ ID NO: 375288 - protein, 21 aa, Mycobacterium
YAFIVGIACMLVWGLFRIFVL

SEQ ID NO: 375289 - protein, 17 aa, Mycobacterium
YAFIVGMSVMLIWGFVQ

SEQ ID NO: 375290 - protein, 17 aa, Mycobacterium
YAFLVPSTVDGITSSQV

SEQ ID NO: 375291 - protein, 27 aa, Mycobacterium
YAGAGVLALVAFSATAFGLATFSSYLP

SEQ ID NO: 375292 - protein, 26 aa, Mycobacterium
YAGDRWWVLLLHLATAAALTVVAYRL

SEQ ID NO: 375293 - protein, 30 aa, Mycobacterium
YAGHMVATILWIAMAAVLFWYAARLPREDR

SEQ ID NO: 375294 - protein, 25 aa, Mycobacterium
YAGIENPLFFLNHTSMLFGDAKKSV

SEQ ID NO: 375295 - protein, 19 aa, Mycobacterium
YAGIMFIGLSLAALTLATS

SEQ ID NO: 375296 - protein, 18 aa, Mycobacterium
YAGIVLIGLGASALTLAT

SEQ ID NO: 375297 - protein, 22 aa, Mycobacterium
YAGKVLVVLWRSKATDSSPNIT

SEQ ID NO: 375298 - protein, 24 aa, Mycobacterium
YAGNSLPLMLLFSVANRSLGDVLT

SEQ ID NO: 375299 - protein, 27 aa, Mycobacterium
YAGRRETWLIMRLAVLDNAHALVWRTT

SEQ ID NO: 375300 - protein, 27 aa, Mycobacterium
YAGRRETWLIMRLSIIDNTQALRWRTT

SEQ ID NO: 375301 - protein, 24 aa, Mycobacterium
YAILLLAIWIGIGFIFRGVATTIS

SEQ ID NO: 375302 - protein, 19 aa, Mycobacterium
YAITMVCVVFLNLLEGVGI

SEQ ID NO: 375303 - protein, 27 aa, Mycobacterium
YAIVVIGLWVVAAGLGTLLVPPAEHMA

SEQ ID NO: 375304 - protein, 35 aa, Mycobacterium
YAIVWGLSFFIFSLVLLKLGWLPQIELLLWAGIFW

SEQ ID NO: 375305 - protein, 19 aa, Mycobacterium
YAKLVAFTQFVPVLSEMTE

SEQ ID NO: 375306 - protein, 17 aa, Mycobacterium
YAKLYRPDQQVGPSVAR

SEQ ID NO: 375307 - protein, 24 aa, Mycobacterium
YALAATAFHLLAGRSPFHHSNAAV

SEQ ID NO: 375308 - protein, 21 aa, Mycobacterium
YALGDLTWLVRESAMHTQPFP

SEQ ID NO: 375309 - protein, 19 aa, Mycobacterium
YALGWIIATVAAVGLLLLP

SEQ ID NO: 375310 - protein, 18 aa, Mycobacterium
YALLTYLPTILTGFHIQG

SEQ ID NO: 375311 - protein, 22 aa, Mycobacterium
YALRIAIDMLWHDLPQPHRVTT

SEQ ID NO: 375312 - protein, 25 aa, Mycobacterium
YALRILALLYVAVLLIVPLGLILWR

SEQ ID NO: 375313 - protein, 20 aa, Mycobacterium
YALSLIAVHLLAKSAPALPS

SEQ ID NO: 375314 - protein, 22 aa, Mycobacterium
YALTLITVPLLGVAGALWVACS

SEQ ID NO: 375315 - protein, 18 aa, Mycobacterium
YALVVGALVVLLLLVMTA

SEQ ID NO: 375316 - protein, 19 aa, Mycobacterium
YALYVAILATLAAGAAYVP

SEQ ID NO: 375317 - protein, 19 aa, Mycobacterium
YAMFAWLPVIVTSAGGSEA

SEQ ID NO: 375318 - protein, 21 aa, Mycobacterium
YAMLLGIHVVLLFVASTRYAA

SEQ ID NO: 375319 - protein, 17 aa, Mycobacterium
YAMSPAALAALLPDVLA

SEQ ID NO: 375320 - protein, 25 aa, Mycobacterium
YANVRQPVRFYDSIKHLLAAAEQVF

SEQ ID NO: 375321 - protein, 46 aa, Mycobacterium
YANVYPVPPYPLNVIPWLFILTVAAALAWYLILRRRSPHVVANIGT

SEQ ID NO: 375322 - protein, 18 aa, Mycobacterium
YAPKMILLVVLLGLGQQV

SEQ ID NO: 375323 - protein, 25 aa, Mycobacterium
YAPRRFAMPLAHLVDLLAAVPSIIY

SEQ ID NO: 375324 - protein, 17 aa, Mycobacterium
YAQFFFEDAPFLVAERG

SEQ ID NO: 375325 - protein, 19 aa, Mycobacterium
YAQTALLYIEPETATLAIV

SEQ ID NO: 375326 - protein, 20 aa, Mycobacterium
YARAALLFVEPYTATLAVVN

SEQ ID NO: 375327 - protein, 32 aa, Mycobacterium
YARALQRLGDILTAAGYNWAIADWRANRDPNK

SEQ ID NO: 375328 - protein, 23 aa, Mycobacterium
YARAMGPMQFLPGTWARYASDGK

SEQ ID NO: 375329 - protein, 23 aa, Mycobacterium
YARMRVIVMVAIKNDLALIASAV

SEQ ID NO: 375330 - protein, 25 aa, Mycobacterium
YARQGFWQLLFVTILVLGVIAVAIR

SEQ ID NO: 375331 - protein, 37 aa, Mycobacterium
YARQHGRRMVLIWVAAVLALTGLVATAAWTIGSNLNG

SEQ ID NO: 375332 - protein, 18 aa, Mycobacterium
YASDSGFLARFRLEARAV

SEQ ID NO: 375333 - protein, 22 aa, Mycobacterium
YASMIALTYFPPVWRMVMDHRV

SEQ ID NO: 375334 - protein, 27 aa, Mycobacterium
YATLFSALYLPLLAILFGMILRIVGIE

SEQ ID NO: 375335 - protein, 25 aa, Mycobacterium
YATVSGLRLLLVPPLVVIAYEMFAN

SEQ ID NO: 375336 - protein, 27 aa, Mycobacterium
YAVARTRRGLRALLALVPDQATVLRAG

SEQ ID NO: 375337 - protein, 28 aa, Mycobacterium
YAVINSALPRWLWTRGSALVSAMWGVAT

SEQ ID NO: 375338 - protein, 25 aa, Mycobacterium
YAVLAVVWFFLLKRYTVEGPLEHDA

SEQ ID NO: 375339 - protein, 17 aa, Mycobacterium
YAVLWLYGLVIDPHSSA

SEQ ID NO: 375340 - protein, 19 aa, Mycobacterium
YAVMGAGWVWRRGRRGESI

SEQ ID NO: 375341 - protein, 29 aa, Mycobacterium
YAVPDFPGARWIAPLLGTVMYVVGGRPFL

SEQ ID NO: 375342 - protein, 24 aa, Mycobacterium
YAWPYRWLIAVVAGLQLISTLTSL

SEQ ID NO: 375343 - protein, 19 aa, Mycobacterium
YAWSLLSMLTTLAGTTLLS

SEQ ID NO: 375344 - protein, 24 aa, Mycobacterium
YAWSSPMIIGLFVGSAVALAVFVR

SEQ ID NO: 375345 - protein, 20 aa, Mycobacterium
YAYEYFIRNNPLRDYAVPIK

SEQ ID NO: 375346 - protein, 23 aa, Mycobacterium
YAYVAPWHLSAGQWYTWVIAIAG

SEQ ID NO: 375347 - protein, 18 aa, Mycobacterium
YCAGGWYTGDTLDITAAT

SEQ ID NO: 375348 - protein, 19 aa, Mycobacterium
YCAGWLPWFADIDRQMYFF

SEQ ID NO: 375349 - protein, 17 aa, Mycobacterium
YCDDMRRLYPRVELRPD

SEQ ID NO: 375350 - protein, 28 aa, Mycobacterium
YCITQNFIARPYLIPSESMEPTLHGCRG

SEQ ID NO: 375351 - protein, 19 aa, Mycobacterium
YCLSFTRLPYFQTLGAPCA

SEQ ID NO: 375352 - protein, 17 aa, Mycobacterium
YCPADRTAYFDTSFFQV

SEQ ID NO: 375353 - protein, 18 aa, Mycobacterium
YDALPATEPLGVPQVPLA

SEQ ID NO: 375354 - protein, 26 aa, Mycobacterium
YDETARWVPRLWRRDIKAGHFSPMSH

SEQ ID NO: 375355 - protein, 24 aa, Mycobacterium
YDFDLVPYYPLVLTGFLLLTSIIV

SEQ ID NO: 375356 - protein, 18 aa, Mycobacterium
YDFGFYSLVVPPGSPIHN

SEQ ID NO: 375357 - protein, 25 aa, Mycobacterium
YDGAWRIPFLLCGPLGVIALIIRLR

SEQ ID NO: 375358 - protein, 26 aa, Mycobacterium
YDGFLLVMLGFLLQWPTIPTLMMFPV

SEQ ID NO: 375359 - protein, 32 aa, Mycobacterium
YDHYFNTFLIPSDLLWSFLQAIVMSIAVMLVH

SEQ ID NO: 375360 - protein, 23 aa, Mycobacterium
YDHYFRTFLNPTDLVWSFVQCIA

SEQ ID NO: 375361 - protein, 20 aa, Mycobacterium
YDKLPFFQSGKQYSAYFADA

SEQ ID NO: 375362 - protein, 19 aa, Mycobacterium
YDLSLFLNQLLHGNFIAAI

SEQ ID NO: 375363 - protein, 24 aa, Mycobacterium
YDMVGKFGLGQRTGVGLPGESAGL

SEQ ID NO: 375364 - protein, 17 aa, Mycobacterium
YDMVRKFGLGQRTNAGL

SEQ ID NO: 375365 - protein, 18 aa, Mycobacterium
YDMVRKFGLGQRTNVGLP

SEQ ID NO: 375366 - protein, 27 aa, Mycobacterium
YDNLGLFGLFEPVLWLSAQIGSFLIRG

SEQ ID NO: 375367 - protein, 25 aa, Mycobacterium
YDNVAIPLVVILFAGFVVAVMVATV

SEQ ID NO: 375368 - protein, 26 aa, Mycobacterium
YDPHAGAWQPGPPLPIRLHHATAATY

SEQ ID NO: 375369 - protein, 25 aa, Mycobacterium
YDPQLLLLTLVLLTSAGVLVVVGAA

SEQ ID NO: 375370 - protein, 21 aa, Mycobacterium
YDRPEQRPGWRFWRRGRRPLE

SEQ ID NO: 375371 - protein, 52 aa, Mycobacterium
YDSDLREIIVVTLLIIFLVMCLLLRAVVAPLYLLGTVLLTYIASLGIGVLVF

SEQ ID NO: 375372 - protein, 18 aa, Mycobacterium
YDTCAIAPVTSYLDNGKL

SEQ ID NO: 375373 - protein, 17 aa, Mycobacterium
YDTWWRIPVLLGSAFAN

SEQ ID NO: 375374 - protein, 28 aa, Mycobacterium
YDWLARELPNLRAAFRWTADRNDMDTCA

SEQ ID NO: 375375 - protein, 19 aa, Mycobacterium
YDWSVYAIFAPFFAHQFFV

SEQ ID NO: 375376 - protein, 18 aa, Mycobacterium
YDYPLTAVVSLIVLFAFV

SEQ ID NO: 375377 - protein, 26 aa, Mycobacterium
YEAIRRLVHPPAVTGPLVLITALVGV

SEQ ID NO: 375378 - protein, 17 aa, Mycobacterium
YEDAVAEIWFASEEFAR

SEQ ID NO: 375379 - protein, 25 aa, Mycobacterium
YEDRFFATVFLGSGLLFLAMIFVMT

SEQ ID NO: 375380 - protein, 23 aa, Mycobacterium
YEFWLKIGIVALGARFVLGDVLK

SEQ ID NO: 375381 - protein, 25 aa, Mycobacterium
YEHYFRTFLRPDDVFWSFVQAVIIS

SEQ ID NO: 375382 - protein, 17 aa, Mycobacterium
YELQWHYRAWGLEAWEM

SEQ ID NO: 375383 - protein, 28 aa, Mycobacterium
YEPGGRWLWLLLGPLAGLIMFGLQVWGR

SEQ ID NO: 375384 - protein, 18 aa, Mycobacterium
YERAGPGRFGWSVALLGA

SEQ ID NO: 375385 - protein, 20 aa, Mycobacterium
YERYWLYPGAQNLANFRAHL

SEQ ID NO: 375386 - protein, 25 aa, Mycobacterium
YESCMVALIVAGFLAGAAGAGAVLA

SEQ ID NO: 375387 - protein, 27 aa, Mycobacterium
YESTPLWAGIFLLPMTLGFLVAGPVAG

SEQ ID NO: 375388 - protein, 18 aa, Mycobacterium
YEWFRIMPTAVDVLDSIG

SEQ ID NO: 375389 - protein, 21 aa, Mycobacterium
YEWGAFIYIGVILGAGLVWYF

SEQ ID NO: 375390 - protein, 19 aa, Mycobacterium
YFARDPLKPELTLADYKVT

SEQ ID NO: 375391 - protein, 17 aa, Mycobacterium
YFAVMWGGGYLLGAALH

SEQ ID NO: 375392 - protein, 24 aa, Mycobacterium
YFAYGAWFWVIKVSHAATSVACPW

SEQ ID NO: 375393 - protein, 33 aa, Mycobacterium
YFDAGALMRLQSPALPFFTPLAPVAGVPDSWLD

SEQ ID NO: 375394 - protein, 18 aa, Mycobacterium
YFDQPPLVPFIAGVADNI

SEQ ID NO: 375395 - protein, 17 aa, Mycobacterium
YFEARAKRRAGAALRAL

SEQ ID NO: 375396 - protein, 20 aa, Mycobacterium
YFEAVGVILTLIMLGRLLEA

SEQ ID NO: 375397 - protein, 24 aa, Mycobacterium
YFEKYAWLFMRFSGIALVFLALGH

SEQ ID NO: 375398 - protein, 24 aa, Mycobacterium
YFERSPPFAILAALLMCAAIVLWL

SEQ ID NO: 375399 - protein, 24 aa, Mycobacterium
YFEVVAAVTVFLLAGRFAESRAKR

SEQ ID NO: 375400 - protein, 17 aa, Mycobacterium
YFGFLINLLVVFGVSFE

SEQ ID NO: 375401 - protein, 29 aa, Mycobacterium
YFGLPTWLILFLRLLFTAIAIASLWLLYR

SEQ ID NO: 375402 - protein, 33 aa, Mycobacterium
YFGLPTWLIVFLRILFTLLAIGALWLLYRHYRT

SEQ ID NO: 375403 - protein, 29 aa, Mycobacterium
YFGLPTWLIVFLRLLFTALAIASLWLLYR

SEQ ID NO: 375404 - protein, 28 aa, Mycobacterium
YFGTTDAPFDWYLGLLSRLASVSTAGVW

SEQ ID NO: 375405 - protein, 25 aa, Mycobacterium
YFGTYVFWMVPVFALTIALAVHSRR

SEQ ID NO: 375406 - protein, 21 aa, Mycobacterium
YFNTFLVPTDLLWSFLQAIVM

SEQ ID NO: 375407 - protein, 19 aa, Mycobacterium
YFPNLVLPIIVGGIGIGIC

SEQ ID NO: 375408 - protein, 19 aa, Mycobacterium
YFPVAHWVFAFDGAAAEKG

SEQ ID NO: 375409 - protein, 23 aa, Mycobacterium
YFQIPLMVIVFIPALEGLRGQWR

SEQ ID NO: 375410 - protein, 19 aa, Mycobacterium
YFQTLGAPCAVGMLVAVLA

SEQ ID NO: 375411 - protein, 30 aa, Mycobacterium
YFQTLGIPCSVGMLVALLVALTLAPAVLVV

SEQ ID NO: 375412 - protein, 18 aa, Mycobacterium
YFRPLIVTLAIIGVIYGA

SEQ ID NO: 375413 - protein, 18 aa, Mycobacterium
YFRPLIVVLAVIGVIYGA

SEQ ID NO: 375414 - protein, 18 aa, Mycobacterium
YFRPLIVVLAVIGVVYGA

SEQ ID NO: 375415 - protein, 26 aa, Mycobacterium
YFRTLGPPCFVAMVVAVIAALTLGPA

SEQ ID NO: 375416 - protein, 18 aa, Mycobacterium
YFSAFWRRVALENKLDPD

SEQ ID NO: 375417 - protein, 17 aa, Mycobacterium
YFSITLPEDFSASVASP

SEQ ID NO: 375418 - protein, 39 aa, Mycobacterium
YFTTFLNPIDLLWSFLQAVLMALTVLLIHTYFGYFASGG

SEQ ID NO: 375419 - protein, 18 aa, Mycobacterium
YFTYQDLARFAYAQAKFQ

SEQ ID NO: 375420 - protein, 17 aa, Mycobacterium
YFVDNAGSLFWLSDTGV

SEQ ID NO: 375421 - protein, 29 aa, Mycobacterium
YFVGPRSIWVWLMLGVLLLSVVLAVRLNV

SEQ ID NO: 375422 - protein, 19 aa, Mycobacterium
YFYVRVIVLMFFTEPPDDA

SEQ ID NO: 375423 - protein, 21 aa, Mycobacterium
YGADALWYPVGFTAGYLGLLL

SEQ ID NO: 375424 - protein, 25 aa, Mycobacterium
YGAKIWIELPFLSIQPAEAAKILLL

SEQ ID NO: 375425 - protein, 29 aa, Mycobacterium
YGALIPFVGPYLDFAFTPDQPWAWTTARG

SEQ ID NO: 375426 - protein, 18 aa, Mycobacterium
YGALLVVLLIAIFSDGTG

SEQ ID NO: 375427 - protein, 18 aa, Mycobacterium
YGARARRLLPASALVGVV

SEQ ID NO: 375428 - protein, 18 aa, Mycobacterium
YGCYALCAVLSLLFVARW

SEQ ID NO: 375429 - protein, 18 aa, Mycobacterium
YGELLRALGLKLSDHDVA

SEQ ID NO: 375430 - protein, 28 aa, Mycobacterium
YGFNQPFFDYRNSNISPHFPYAAQIWQG

SEQ ID NO: 375431 - protein, 27 aa, Mycobacterium
YGFYLRDIVTRFEYPDALLLDMQGNVI

SEQ ID NO: 375432 - protein, 46 aa, Mycobacterium
YGGGYYNGMFFYPGYYPYAFWGPGWGWALTDVLLMDALLDDHWGGG

SEQ ID NO: 375433 - protein, 28 aa, Mycobacterium
YGGPELPWWLWAIVTLGLVAYLGYRNIE

SEQ ID NO: 375434 - protein, 21 aa, Mycobacterium
YGGVIMFGMLTSVAGLGMFNL

SEQ ID NO: 375435 - protein, 18 aa, Mycobacterium
YGILILAVITVFVAGLMV

SEQ ID NO: 375436 - protein, 26 aa, Mycobacterium
YGITAFACMWYFRKELFTSLRNVVFK

SEQ ID NO: 375437 - protein, 28 aa, Mycobacterium
YGKGAFLSQLFGAILRPLGQPANEIIET

SEQ ID NO: 375438 - protein, 21 aa, Mycobacterium
YGKVLFAITLSAAAVLVLLAG

SEQ ID NO: 375439 - protein, 18 aa, Mycobacterium
YGLAMGLFVRNLGLIGGL

SEQ ID NO: 375440 - protein, 19 aa, Mycobacterium
YGLFVFRDAIAACGVQTVP

SEQ ID NO: 375441 - protein, 19 aa, Mycobacterium
YGLGGFGPAPEGMAIWIIG

SEQ ID NO: 375442 - protein, 28 aa, Mycobacterium
YGLGKKIAWLVPLLAFIILIAVGADYNM

SEQ ID NO: 375443 - protein, 20 aa, Mycobacterium
YGLGYHTAAATLLTVAEAVP

SEQ ID NO: 375444 - protein, 26 aa, Mycobacterium
YGLLFQPNFHIPIIGRWDALGFLQDF

SEQ ID NO: 375445 - protein, 18 aa, Mycobacterium
YGLLWVAAVAVLVGAAAL

SEQ ID NO: 375446 - protein, 27 aa, Mycobacterium
YGLQDTAFIPRFLFAVGFPGIVVATAC

SEQ ID NO: 375447 - protein, 29 aa, Mycobacterium
YGLSVLVWQYLLGLQLHWTVLSTSVIVLL

SEQ ID NO: 375448 - protein, 27 aa, Mycobacterium
YGLTAPLMRWFFDHYADPEVRDDPRIA

SEQ ID NO: 375449 - protein, 21 aa, Mycobacterium
YGMLTILGYYLYYTATDGGLG

SEQ ID NO: 375450 - protein, 28 aa, Mycobacterium
YGNGAFLSQLFGAILRPLGQPANEIIET

SEQ ID NO: 375451 - protein, 47 aa, Mycobacterium; identical to SEQ ID NO: 21720

SEQ ID NO: 375452 - protein, 25 aa, Mycobacterium
YGPEQILIELLPNAGLAAFALLLPL

SEQ ID NO: 375453 - protein, 26 aa, Mycobacterium
YGPEQILIELLPQAGLAAFALLLPIT

SEQ ID NO: 375454 - protein, 25 aa, Mycobacterium
YGPKAPQLWLPPLDEPIALADVLAG

SEQ ID NO: 375455 - protein, 32 aa, Mycobacterium
YGPRLLEAMRKFKLIWDPEWKMNPGKVIDPYR

SEQ ID NO: 375456 - protein, 25 aa, Mycobacterium
YGQNVPYPGFGTLAGFLASTSVIVV

SEQ ID NO: 375457 - protein, 29 aa, Mycobacterium
YGRIKRQQLFLSSLLRSLISADTLLDLNK

SEQ ID NO: 375458 - protein, 29 aa, Mycobacterium
YGRIKRQQLFLSSLLRSLISEDTLLDLNK

SEQ ID NO: 375459 - protein, 37 aa, Mycobacterium
YGRIKRQQLFLSSLLRSLISKDTFFSLSKLNNVVNMF

SEQ ID NO: 375460 - protein, 40 aa, Mycobacterium
YGRIKRQQLFLSSLLRSLISKETFFSLSKLNNVVNMFIGD

SEQ ID NO: 375461 - protein, 41 aa, Mycobacterium
YGRIKRQQLFLSSLLRSMISHNTFFSLSKLNNVVNTFIDDS

SEQ ID NO: 375462 - protein, 20 aa, Mycobacterium
YGRRGWLIAGLALFAMTSGV

SEQ ID NO: 375463 - protein, 23 aa, Mycobacterium
YGRRGWLSAGLILFALTSALAAQ

SEQ ID NO: 375464 - protein, 22 aa, Mycobacterium
YGRRGWLTIGLVIVGASSAVAA

SEQ ID NO: 375465 - protein, 21 aa, Mycobacterium
YGRRLIYIVLTTLTAILAFPL

SEQ ID NO: 375466 - protein, 29 aa, Mycobacterium
YGRRTTALTWALERRAWQLTRRTRRWDPD

SEQ ID NO: 375467 - protein, 28 aa, Mycobacterium
YGRSRYFYSFVVALLVFVLGAVAAMYEG

SEQ ID NO: 375468 - protein, 27 aa, Mycobacterium
YGRYELDPALFLRYPGVTDVTRGPVMD

SEQ ID NO: 375469 - protein, 21 aa, Mycobacterium
YGSLPPIPLLAGVSLLVLAVA

SEQ ID NO: 375470 - protein, 24 aa, Mycobacterium
YGSLVVVFQWGWLSSLGFDQLSSL

SEQ ID NO: 375471 - protein, 25 aa, Mycobacterium
YGSRALLVAVLLLLVNPIAAHALAR

SEQ ID NO: 375472 - protein, 31 aa, Mycobacterium
YGSREQPRLSRRWILIAVAALVLVAGVIVAV

SEQ ID NO: 375473 - protein, 18 aa, Mycobacterium
YGSRPLHLLTLIAGFALL

SEQ ID NO: 375474 - protein, 21 aa, Mycobacterium
YGSWAIGFMLAALTAVSLACT

SEQ ID NO: 375475 - protein, 22 aa, Mycobacterium
YGTDYLERWSNFAALESVLTAC

SEQ ID NO: 375476 - protein, 24 aa, Mycobacterium
YGTGPGWPTGPYSPGPPPKGPGSK

SEQ ID NO: 375477 - protein, 20 aa, Mycobacterium
YGTWGWRGLAAYAIGIIAMI

SEQ ID NO: 375478 - protein, 23 aa, Mycobacterium
YGVAAVLTWMLYVRRPVSETMVR

SEQ ID NO: 375479 - protein, 25 aa, Mycobacterium
YGVLQAAGLLFFAFAGYARIATLGE

SEQ ID NO: 375480 - protein, 18 aa, Mycobacterium
YGVPWFDKQPVILSYPVT

SEQ ID NO: 375481 - protein, 25 aa, Mycobacterium
YGVTSILLGSLPLAGLAAGLAVIGW

SEQ ID NO: 375482 - protein, 25 aa, Mycobacterium
YGVTSLLLAALPLTALAAGLAVIGW

SEQ ID NO: 375483 - protein, 32 aa, Mycobacterium
YGWRFSLVAWVLVPVAALLPWIGVVIARRGHD

SEQ ID NO: 375484 - protein, 30 aa, Mycobacterium
YGYDGFLYSIGFLVAWLVALLLVAELLRNT

SEQ ID NO: 375485 - protein, 34 aa, Mycobacterium
YGYDGFLYSIGFLVAWLVALLLVAELLRNTGRFT

SEQ ID NO: 375486 - protein, 23 aa, Mycobacterium
YGYDHTPRFVPRLWRRDIRAGHF

SEQ ID NO: 375487 - protein, 34 aa, Mycobacterium
YGYFGVLKILLEWVIGNLFGFSPLLAGMLAGGVA

SEQ ID NO: 375488 - protein, 22 aa, Mycobacterium
YGYHAIMMLATAWMYAVMSMPG

SEQ ID NO: 375489 - protein, 21 aa, Mycobacterium
YGYSLLWVQVLLLIPVLIVNQ

SEQ ID NO: 375490 - protein, 24 aa, Mycobacterium
YGYVPYMILPLYAGLDRLPQSTLE

SEQ ID NO: 375491 - protein, 27 aa, Mycobacterium
YHAGVEQLLVFLPQGASIVQTVGLANP

SEQ ID NO: 375492 - protein, 28 aa, Mycobacterium
YHASVEQILVLLPPFTAAIQSFLGTKSP

SEQ ID NO: 375493 - protein, 25 aa, Mycobacterium
YHDTTHFPLTWVLTPGRELAIKLEH

SEQ ID NO: 375494 - protein, 23 aa, Mycobacterium
YHIARPWRWGYLGVLFVIFGFPL

SEQ ID NO: 375495 - protein, 23 aa, Mycobacterium
YHLRLDWLMWFAAISPTYAHPWL

SEQ ID NO: 375496 - protein, 21 aa, Mycobacterium
YHPSLEQLLVLFPQGTAVTQA

SEQ ID NO: 375497 - protein, 27 aa, Mycobacterium
YHPVSYPGAIWPVSGLTAPTFKTSVAQ

SEQ ID NO: 375498 - protein, 24 aa, Mycobacterium
YHTALGRIIISHALPNGAASLGDN

SEQ ID NO: 375499 - protein, 17 aa, Mycobacterium
YHVRWYPATLVFLAFDV

SEQ ID NO: 375500 - protein, 28 aa, Mycobacterium
YHYRVRKPAVWTLFAVGVLVVGWAALRQ

SEQ ID NO: 375501 - protein, 23 aa, Mycobacterium
YIAAFALFILGLSGLTGPKTAVR

SEQ ID NO: 375502 - protein, 24 aa, Mycobacterium
YIAQRSDVMLLLRSDPGAGGGGYA

SEQ ID NO: 375503 - protein, 25 aa, Mycobacterium
YIATRGWLTLFPALTIIAVVLATNN

SEQ ID NO: 375504 - protein, 32 aa, Mycobacterium
YIDAEYRFEKAWPLLWFVVIGVVAAAIGYLYA

SEQ ID NO: 375505 - protein, 19 aa, Mycobacterium
YIDAEYRFERAWPLLWFVV

SEQ ID NO: 375506 - protein, 27 aa, Mycobacterium
YIDLQDPALLQFIYVRAFASVVDASFP

SEQ ID NO: 375507 - protein, 31 aa, Mycobacterium
YIGNLALLILSIPLVGLFVRILRVRPAILAP

SEQ ID NO: 375508 - protein, 20 aa, Mycobacterium
YIIALPFFGIVSEIFPVFSR

SEQ ID NO: 375509 - protein, 20 aa, Mycobacterium
YIIALPFFGIVTEIFPVFSR

SEQ ID NO: 375510 - protein, 23 aa, Mycobacterium
YILAFSLFIYGLMGLTGPKTAVR

SEQ ID NO: 375511 - protein, 17 aa, Mycobacterium
YIPALIVIAVLMIALNF

SEQ ID NO: 375512 - protein, 18 aa, Mycobacterium
YIQIGLGVLALLVAAVLA

SEQ ID NO: 375513 - protein, 29 aa, Mycobacterium
YIQPYRRLVAMLMVLQLISNLASLYLPTV

SEQ ID NO: 375514 - protein, 18 aa, Mycobacterium
YIRLMALVEYSADEIETV

SEQ ID NO: 375515 - protein, 26 aa, Mycobacterium
YIRPYRRLVAALMALQLISTLASLYL

SEQ ID NO: 375516 - protein, 28 aa, Mycobacterium
YIRPYRRLVAVLMVLQLISTLASLYLPT

SEQ ID NO: 375517 - protein, 17 aa, Mycobacterium
YISFNVLAFLIAAYLML

SEQ ID NO: 375518 - protein, 20 aa, Mycobacterium
YISGLMGLGFFLALTVRDTT

SEQ ID NO: 375519 - protein, 21 aa, Mycobacterium
YISLVLACWLWSGGAHIPMSD

SEQ ID NO: 375520 - protein, 21 aa, Mycobacterium
YITEALKRLPAYATTLGEVVG

SEQ ID NO: 375521 - protein, 18 aa, Mycobacterium
YIVGFIALFIVCGAGKGA

SEQ ID NO: 375522 - protein, 18 aa, Mycobacterium
YIVMLRVAPPIDKALIPR

SEQ ID NO: 375523 - protein, 23 aa, Mycobacterium
YIVSFSLFIYGLMGLTGPKTAVR

SEQ ID NO: 375524 - protein, 42 aa, Mycobacterium
YKIAGVVLALVTILILVLVYLQFRGDFLPRTQLTMISARSGL

SEQ ID NO: 375525 - protein, 42 aa, Mycobacterium
YKIIGLAALMVLVFFGAMLYWQFRGTFIPKTRLTMIAPRAGL

SEQ ID NO: 375526 - protein, 27 aa, Mycobacterium
YKIIGLLGLMVLALVGTGLYAQFRGAF

SEQ ID NO: 375527 - protein, 23 aa, Mycobacterium
YKIPRRFLAVPRSQLPLLSSGKV

SEQ ID NO: 375528 - protein, 19 aa, Mycobacterium
YKWGEFGMLPALNARRHPD

SEQ ID NO: 375529 - protein, 23 aa, Mycobacterium
YLAAKLTVYALAAALWTAVMFAI

SEQ ID NO: 375530 - protein, 28 aa, Mycobacterium
YLAAVSMFLGFFAWYRGLAIGPMAQVSQ

SEQ ID NO: 375531 - protein, 20 aa, Mycobacterium
YLAFLAPGIIAQSALFISIF

SEQ ID NO: 375532 - protein, 28 aa, Mycobacterium
YLAGFHHGFFIFAIVLTALSIIPLGGGI

SEQ ID NO: 375533 - protein, 25 aa, Mycobacterium
YLAGKPPWIGALLGVILVLTCTLGD

SEQ ID NO: 375534 - protein, 27 aa, Mycobacterium
YLAGKTPWVGALLGVLFVLTTTLGDLV

SEQ ID NO: 375535 - protein, 17 aa, Mycobacterium
YLAGPLGLAAWAVGLVM

SEQ ID NO: 375536 - protein, 17 aa, Mycobacterium
YLAIALPVGTMGLLASR

SEQ ID NO: 375537 - protein, 25 aa, Mycobacterium
YLAIQTIFVVVWIALNLFAVGLEWD

SEQ ID NO: 375538 - protein, 25 aa, Mycobacterium
YLAIQTIFVVVWIALNLFAVGYEWD

SEQ ID NO: 375539 - protein, 18 aa, Mycobacterium
YLAIRLFTQYDVSSVIGV

SEQ ID NO: 375540 - protein, 20 aa, Mycobacterium
YLALHPRLPRRDVIKVLAEA

SEQ ID NO: 375541 - protein, 20 aa, Mycobacterium
YLALPLLAFLARRVPVGARV

SEQ ID NO: 375542 - protein, 21 aa, Mycobacterium
YLALPLLALLARRVPVRARIP

SEQ ID NO: 375543 - protein, 22 aa, Mycobacterium
YLALVVKFHWGFSLAAGVLTLS

SEQ ID NO: 375544 - protein, 28 aa, Mycobacterium
YLANFNQPYLLWAPAVLLIGLAVMVMLL

SEQ ID NO: 375545 - protein, 35 aa, Mycobacterium
YLANFNQPYLLWVPAVLLVLLGLVLVATRSRPWWL

SEQ ID NO: 375546 - protein, 27 aa, Mycobacterium
YLAQHPRLPRLDALKILSLDATDDDEF

SEQ ID NO: 375547 - protein, 20 aa, Mycobacterium
YLAVLPQFLQPKSPLLPQYV

SEQ ID NO: 375548 - protein, 27 aa, Mycobacterium
YLAVYVLWMVPMFVLMIVVGVRSRRRE

SEQ ID NO: 375549 - protein, 30 aa, Mycobacterium
YLDVIALTTIYKWVPAPAGLLLAAVVGGAG

SEQ ID NO: 375550 - protein, 20 aa, Mycobacterium
YLELMIRQHRFTISVARDEL

SEQ ID NO: 375551 - protein, 17 aa, Mycobacterium
YLFGFKLGWFPIAGIRD

SEQ ID NO: 375552 - protein, 17 aa, Mycobacterium
YLFSYYLGSSVAGAVGG

SEQ ID NO: 375553 - protein, 26 aa, Mycobacterium
YLGAFALRRIALPASGLYPIATFGLG

SEQ ID NO: 375554 - protein, 26 aa, Mycobacterium
YLGAFTLRRIALPASGLYPIATFGLG

SEQ ID NO: 375555 - protein, 24 aa, Mycobacterium
YLGGLWLMMVKWAQAVRTPVTLDR

SEQ ID NO: 375556 - protein, 30 aa, Mycobacterium
YLGIWAAIPFAIWFFLAIEGVPLAAEETVN

SEQ ID NO: 375557 - protein, 29 aa, Mycobacterium
YLGIWAAIPFAIWFFLAVEGVPLAAEETA

SEQ ID NO: 375558 - protein, 18 aa, Mycobacterium
YLGIWAAVPFAIWLFLAI

SEQ ID NO: 375559 - protein, 17 aa, Mycobacterium
YLGLFAYTVYLGLALAR

SEQ ID NO: 375560 - protein, 29 aa, Mycobacterium
YLGVWSALPFAIWFFLAVEGVPLAAEETA

SEQ ID NO: 375561 - protein, 19 aa, Mycobacterium
YLHAGWYSIIGYAIAAAVA

SEQ ID NO: 375562 - protein, 18 aa, Mycobacterium
YLIAKICVYTVFAVVQSA

SEQ ID NO: 375563 - protein, 17 aa, Mycobacterium
YLIAVIELVPRPFTPTV

SEQ ID NO: 375564 - protein, 19 aa, Mycobacterium
YLICALYSVFLAIAAIGVA

SEQ ID NO: 375565 - protein, 21 aa, Mycobacterium
YLIDAIACVAPIWATVRLHTM

SEQ ID NO: 375566 - protein, 17 aa, Mycobacterium
YLILFTLFLAPAEHWLG

SEQ ID NO: 375567 - protein, 18 aa, Mycobacterium
YLISGWPVDVLAAVHNFG

SEQ ID NO: 375568 - protein, 25 aa, Mycobacterium
YLKFCMRVMVVTLWFSAGMAIFSSL

SEQ ID NO: 375569 - protein, 23 aa, Mycobacterium
YLLAKSAVFCAFAILQSAIVTAI

SEQ ID NO: 375570 - protein, 17 aa, Mycobacterium
YLLFDLAIVGRLGALSL

SEQ ID NO: 375571 - protein, 17 aa, Mycobacterium
YLLGTVVLNYGAALGLG

SEQ ID NO: 375572 - protein, 18 aa, Mycobacterium
YLLGTVVLNYGAALGLGT

SEQ ID NO: 375573 - protein, 24 aa, Mycobacterium
YLLGVLLSWILKRIGRRSELLRDI

SEQ ID NO: 375574 - protein, 17 aa, Mycobacterium
YLLGYIAAMPLLGQASD

SEQ ID NO: 375575 - protein, 25 aa, Mycobacterium
YLLLQTVVVFVWIALNLFAVTVRWD

SEQ ID NO: 375576 - protein, 17 aa, Mycobacterium
YLLRAIALTYVFALLVV

SEQ ID NO: 375577 - protein, 24 aa, Mycobacterium
YLLRRRERLVDRLTVGVAASGLIL

SEQ ID NO: 375578 - protein, 22 aa, Mycobacterium
YLLSFQIYLALPMQASVLAPRN

SEQ ID NO: 375579 - protein, 20 aa, Mycobacterium
YLLVQTLIVVIWISLNLFAV

SEQ ID NO: 375580 - protein, 18 aa, Mycobacterium
YLMLGYVAIWFADALLHG

SEQ ID NO: 375581 - protein, 27 aa, Mycobacterium
YLMRASAFTALLLAQTLRYLPDLVVVA

SEQ ID NO: 375582 - protein, 17 aa, Mycobacterium
YLNLCVWLIPAMFGVAY

SEQ ID NO: 375583 - protein, 21 aa, Mycobacterium
YLPTFAILALPGGATLLLLFW

SEQ ID NO: 375584 - protein, 18 aa, Mycobacterium
YLQAHYTAAPRPTADSPP

SEQ ID NO: 375585 - protein, 19 aa, Mycobacterium
YLQALWVVLLLNAASNRLV

SEQ ID NO: 375586 - protein, 17 aa, Mycobacterium
YLQPTDLIWSLLQVIAT

SEQ ID NO: 375587 - protein, 28 aa, Mycobacterium
YLREFGNLVFHLSLVGLLVAFAVGKLFG

SEQ ID NO: 375588 - protein, 19 aa, Mycobacterium
YLRFVLSRITLPGSIYLGA

SEQ ID NO: 375589 - protein, 23 aa, Mycobacterium
YLRLNIFHLLGYLRAELLLVLGT

SEQ ID NO: 375590 - protein, 28 aa, Mycobacterium
YLRPYRRLVAVLMVLQLISTLASLYLPT

SEQ ID NO: 375591 - protein, 21 aa, Mycobacterium
YLRRQLLVLAAFTTGVLLICD

SEQ ID NO: 375592 - protein, 17 aa, Mycobacterium
YLRYVLSRITLPGSIYL

SEQ ID NO: 375593 - protein, 25 aa, Mycobacterium
YLSQYQAQALFTMKAAPAAGGPLRG

SEQ ID NO: 375594 - protein, 31 aa, Mycobacterium
YLTARTETPALWIFLGCYIGFAVLTWATYVR

SEQ ID NO: 375595 - protein, 25 aa, Mycobacterium
YLTDPMLANLPHPWFDAIGISDRAA

SEQ ID NO: 375596 - protein, 17 aa, Mycobacterium
YLTLMSFRVPALILAAV

SEQ ID NO: 375597 - protein, 17 aa, Mycobacterium
YLVALRTLNPQAPVAML

SEQ ID NO: 375598 - protein, 18 aa, Mycobacterium
YLVFVFTQTVRHRDFFLP

SEQ ID NO: 375599 - protein, 18 aa, Mycobacterium
YLVGYLRDQLQTPLTVIG

SEQ ID NO: 375600 - protein, 30 aa, Mycobacterium
YLVYPILGWMNITLGWRTSLLILAAAFALT

SEQ ID NO: 375601 - protein, 21 aa, Mycobacterium
YLWLPGLVCLLALGELIWRGR

SEQ ID NO: 375602 - protein, 17 aa, Mycobacterium
YLYGPVLAKYEALGGPA

SEQ ID NO: 375603 - protein, 22 aa, Mycobacterium
YMCASGSFLGFAFAFGQVLAHN

SEQ ID NO: 375604 - protein, 17 aa, Mycobacterium
YMISTTFMLWFQTQHHG

SEQ ID NO: 375605 - protein, 17 aa, Mycobacterium
YMKVPLMANAVVLWIAL

SEQ ID NO: 375606 - protein, 17 aa, Mycobacterium
YMLIGWQAGLAFTRASL

SEQ ID NO: 375607 - protein, 27 aa, Mycobacterium
YMLVSLIHFFIPINSIARFFPLVRATE

SEQ ID NO: 375608 - protein, 20 aa, Mycobacterium
YMNMVSIMAICFEKMIVSTV

SEQ ID NO: 375609 - protein, 18 aa, Mycobacterium
YMSALDVALLASSTGRDV

SEQ ID NO: 375610 - protein, 18 aa, Mycobacterium
YMTRVMLMTFFGEKRWAP

SEQ ID NO: 375611 - protein, 19 aa, Mycobacterium
YMTRVMLMTFFGEKRWAPG

SEQ ID NO: 375612 - protein, 18 aa, Mycobacterium
YMTRVMLMTFFGTRRWEG

SEQ ID NO: 375613 - protein, 40 aa, Mycobacterium
YNHDIRFIIVVTIVVVLFILIMLLRAVVAPLYLVASVVVS

SEQ ID NO: 375614 - protein, 26 aa, Mycobacterium
YNKSLEHALVVFPALLAALNTVAGGV

SEQ ID NO: 375615 - protein, 17 aa, Mycobacterium
YNLFLGIVTVVGVVFAL

SEQ ID NO: 375616 - protein, 20 aa, Mycobacterium
YNLHLNLWVGALLALVLALT

SEQ ID NO: 375617 - protein, 18 aa, Mycobacterium
YNLISFDLHDQACFTVLA

SEQ ID NO: 375618 - protein, 31 aa, Mycobacterium
YNLLAGWWSLLSLLLFNWIALISNANAMRQL

SEQ ID NO: 375619 - protein, 20 aa, Mycobacterium
YNLLLVSRLKEELPGGLKTG

SEQ ID NO: 375620 - protein, 31 aa, Mycobacterium
YNMPLELTLTVIPFIIISVLFYFTVVVQEEM

SEQ ID NO: 375621 - protein, 33 aa, Mycobacterium
YNMPLELTLTVIPFLIISVLFYFTVVVQERMMH

SEQ ID NO: 375622 - protein, 54 aa, Mycobacterium
YNNVIQPFVDWLANLPFFQTMFAGIDPYLVILGNPLTYLSPLNIAFALGYPMDI

SEQ ID NO: 375623 - protein, 24 aa, Mycobacterium
YNNVPGLGLLWRPFRARNGRDFMW

SEQ ID NO: 375624 - protein, 23 aa, Mycobacterium
YNNVPGLGVLWRPFRARNGRDFM

SEQ ID NO: 375625 - protein, 27 aa, Mycobacterium
YNPSIEQLLVLLPPYVAQIQTYTPTNS

SEQ ID NO: 375626 - protein, 26 aa, Mycobacterium
YNQRGVRLWVVYVKDFGGLKPARWAE

SEQ ID NO: 375627 - protein, 29 aa, Mycobacterium
YNTAAIPLAALGLLNPIIAGAAMGLSSVS

SEQ ID NO: 375628 - protein, 26 aa, Mycobacterium
YNVDPLLVRVIFVVTTIFGGAGAIMY

SEQ ID NO: 375629 - protein, 24 aa, Mycobacterium
YPAGLLPQPPLGSGAWWLARLEWE

SEQ ID NO: 375630 - protein, 23 aa, Mycobacterium
YPALMYMVTLWFAQSYRATVVGF

SEQ ID NO: 375631 - protein, 21 aa, Mycobacterium
YPDALGYWPAAAGLFAFVWLE

SEQ ID NO: 375632 - protein, 31 aa, Mycobacterium
YPDAVMTLFSFLFAALWLSALAVFQTRSPRV

SEQ ID NO: 375633 - protein, 18 aa, Mycobacterium
YPEPFLYTYCRDDDPAVL

SEQ ID NO: 375634 - protein, 26 aa, Mycobacterium
YPEVPKRQWGLPLAATAAAVLMAAAI

SEQ ID NO: 375635 - protein, 23 aa, Mycobacterium
YPFLHGVLVPSAHRLMRSKFGRT

SEQ ID NO: 375636 - protein, 21 aa, Mycobacterium
YPGFGHLAGFIASTSLIFVLM

SEQ ID NO: 375637 - protein, 27 aa, Mycobacterium
YPGMAAPPVRLLPIDLAPDAVGNLYRG

SEQ ID NO: 375638 - protein, 18 aa, Mycobacterium
YPGPLDATTVFFSPGNEE

SEQ ID NO: 375639 - protein, 18 aa, Mycobacterium
YPGPLEKTTVFFSPGNEE

SEQ ID NO: 375640 - protein, 31 aa, Mycobacterium
YPGPVMTLFSFLFAALWLSSLAIFHTRSPHV

SEQ ID NO: 375641 - protein, 31 aa, Mycobacterium
YPGVGFIGLLFFVVWLLIAYLRAEVLRRQKR

SEQ ID NO: 375642 - protein, 25 aa, Mycobacterium
YPLAFAVCALFPLLALPVVPSEARS

SEQ ID NO: 375643 - protein, 29 aa, Mycobacterium
YPLAFAVCGLFPLLAWPIVPQHTRARVRT

SEQ ID NO: 375644 - protein, 17 aa, Mycobacterium
YPLLLVLSGVALGVSGL

SEQ ID NO: 375645 - protein, 18 aa, Mycobacterium
YPLPQPMQDPITRLTGHG

SEQ ID NO: 375646 - protein, 26 aa, Mycobacterium
YPPAYPSVPAPPRRTPTPPAPAAVAA

SEQ ID NO: 375647 - protein, 25 aa, Mycobacterium
YPPNDPALRQPVIYPRGTLAMANAG

SEQ ID NO: 375648 - protein, 22 aa, Mycobacterium
YPRKVSFLPGMRYYAGNWDTTV

SEQ ID NO: 375649 - protein, 21 aa, Mycobacterium
YPRRAFLGLALFIGQAFLYNG

SEQ ID NO: 375650 - protein, 18 aa, Mycobacterium
YPRTASVVIWYSPQHCDT

SEQ ID NO: 375651 - protein, 18 aa, Mycobacterium
YPRTASVVIWYSPQQCDT

SEQ ID NO: 375652 - protein, 26 aa, Mycobacterium
YPTFSHNFYLWWLAKAGAVGMALFAM

SEQ ID NO: 375653 - protein, 29 aa, Mycobacterium
YPTKFLVWNLFLAWIPMLCAVAFDLAERR

SEQ ID NO: 375654 - protein, 32 aa, Mycobacterium
YPTVVLLTMLLSPLRMPLWLGMLVGNLLSSFV

SEQ ID NO: 375655 - protein, 25 aa, Mycobacterium
YPVTTIFLVLAIACGLLAGWLHFRM

SEQ ID NO: 375656 - protein, 20 aa, Mycobacterium
YPWSSPVIIGLFASSIAAIG

SEQ ID NO: 375657 - protein, 26 aa, Mycobacterium
YQAYCAPLPCFTFLELLGAPLEDIEF

SEQ ID NO: 375658 - protein, 18 aa, Mycobacterium
YQHMSFVVQTLLIATAAA

SEQ ID NO: 375659 - protein, 26 aa, Mycobacterium
YQIQRWRSRLRNHIIIVGYGTKGRTA

SEQ ID NO: 375660 - protein, 23 aa, Mycobacterium
YQKLMFWIVGVVFLLLMVPAGVV

SEQ ID NO: 375661 - protein, 25 aa, Mycobacterium
YQNIVGQRYLGLSLGKEGDPTLLAA

SEQ ID NO: 375662 - protein, 22 aa, Mycobacterium
YQNIVGQRYLGLTLGSQGEPVP

SEQ ID NO: 375663 - protein, 18 aa, Mycobacterium
YQPRLRGLLEDRIGAAAT

SEQ ID NO: 375664 - protein, 18 aa, Mycobacterium
YQQMLADYQLLAREQLIC

SEQ ID NO: 375665 - protein, 21 aa, Mycobacterium
YQQWVPAGAIAFGLFIVTNAA

SEQ ID NO: 375666 - protein, 21 aa, Mycobacterium
YQRLMLWIIGAVWFVVMVPAV

SEQ ID NO: 375667 - protein, 27 aa, Mycobacterium
YQVDDLLACLYGLHALLRLHFVQEEEN

SEQ ID NO: 375668 - protein, 23 aa, Mycobacterium
YQWPIYEGLMWGGVQAALCCLRF

SEQ ID NO: 375669 - protein, 18 aa, Mycobacterium
YRAGLIGGLALLPLLLVL

SEQ ID NO: 375670 - protein, 25 aa, Mycobacterium
YRAGSTLDVLWPASSLLVAIASWAR

SEQ ID NO: 375671 - protein, 33 aa, Mycobacterium
YRDAVPFPKFIEGMGLLLHLAQPTALSEVTIDV

SEQ ID NO: 375672 - protein, 19 aa, Mycobacterium
YRFALHGVDYFHISKLSLS

SEQ ID NO: 375673 - protein, 26 aa, Mycobacterium
YRGTTVLWRIHFASALLMVPQTVVLT

SEQ ID NO: 375674 - protein, 20 aa, Mycobacterium
YRGWYALPERIAATLTDMAN

SEQ ID NO: 375675 - protein, 48 aa, Mycobacterium
YRIAETIRVLLLITLAIVFMNFFPVTAVMIVFLALLNDGAILAIAYDH

SEQ ID NO: 375676 - protein, 17 aa, Mycobacterium
YRIMAWTTGIWLIALCY

SEQ ID NO: 375677 - protein, 24 aa, Mycobacterium
YRKPAPHEFIPFSGGLHRCIGAVM

SEQ ID NO: 375678 - protein, 17 aa, Mycobacterium
YRLAMGAALLAVFLFGC

SEQ ID NO: 375679 - protein, 21 aa, Mycobacterium
YRLGWFVIVGTIPIGVFGLLF

SEQ ID NO: 375680 - protein, 27 aa, Mycobacterium
YRLLEKPMRIFSLRTLVAIAALGVMVL

SEQ ID NO: 375681 - protein, 21 aa, Mycobacterium
YRLRLGKPSWVTPGPLADDIE

SEQ ID NO: 375682 - protein, 18 aa, Mycobacterium
YRLRVIVHEDDNGHMTGY

SEQ ID NO: 375683 - protein, 17 aa, Mycobacterium
YRLTKFFGKLFLINFAL

SEQ ID NO: 375684 - protein, 19 aa, Mycobacterium
YRLWDHIRFNTTITEACFD

SEQ ID NO: 375685 - protein, 24 aa, Mycobacterium
YRNLLIVVGVLYLLAFVLTPKRDG

SEQ ID NO: 375686 - protein, 19 aa, Mycobacterium
YRPRWLMFAPTFVQLGILT

SEQ ID NO: 375687 - protein, 24 aa, Mycobacterium
YRQQRLWGATPLVASWQLVMSGVL

SEQ ID NO: 375688 - protein, 24 aa, Mycobacterium
YRQRWAWLYRVDWSLLDGARALAI

SEQ ID NO: 375689 - protein, 24 aa, Mycobacterium
YRRRLLRVTRWDVGLAMIVAGGVN

SEQ ID NO: 375690 - protein, 22 aa, Mycobacterium
YRRVQWGTVFLIAGILPMSTAV

SEQ ID NO: 375691 - protein, 19 aa, Mycobacterium
YRRYLAVQLLFGSVVLGSS

SEQ ID NO: 375692 - protein, 35 aa, Mycobacterium
YRSGLAFGLTLLPALALLAFWRRRRKDLGHAAVRP

SEQ ID NO: 375693 - protein, 24 aa, Mycobacterium
YRSIACVVLILLTVAFEFTVSNGI

SEQ ID NO: 375694 - protein, 27 aa, Mycobacterium
YRSSKIVLRYRIPIGLAAVALLLLLGA

SEQ ID NO: 375695 - protein, 42 aa, Mycobacterium
YRSTKFVMRRWLPIGLAVLALLVLLGLPFLSVKWGFPDDRVL

SEQ ID NO: 375696 - protein, 24 aa, Mycobacterium
YRTRFLFFGTGYYDYDNPYRPEFP

SEQ ID NO: 375697 - protein, 20 aa, Mycobacterium
YRTTIFAFPVFGFGVIFGAI

SEQ ID NO: 375698 - protein, 23 aa, Mycobacterium
YRTTIFAFPVFGFGVIFGAIWAE

SEQ ID NO: 375699 - protein, 27 aa, Mycobacterium
YRTVVLARLRLFGIGIPAAIGLLAGIV

SEQ ID NO: 375700 - protein, 32 aa, Mycobacterium
YRVAETIRVLLLITLAIVTMNFFPVTAVMIVF

SEQ ID NO: 375701 - protein, 34 aa, Mycobacterium
YRVALPVAVYSWAFGPGLWNAWQQPTAEAIRSAV

SEQ ID NO: 375702 - protein, 26 aa, Mycobacterium
YRVIIGVGALIWAGSLLWYLTCVGTT

SEQ ID NO: 375703 - protein, 28 aa, Mycobacterium
YRVLDHPLRWLSLRSIVILSQLGVTILV

SEQ ID NO: 375704 - protein, 22 aa, Mycobacterium
YRVRSFIAPGNIPVAVGAPVAE

SEQ ID NO: 375705 - protein, 19 aa, Mycobacterium
YRVSNIDDMLFAFDSLNPE

SEQ ID NO: 375706 - protein, 17 aa, Mycobacterium
YRYARAMARWSPTSRSE

SEQ ID NO: 375707 - protein, 19 aa, Mycobacterium
YRYARAMARWSPTSRSEIA

SEQ ID NO: 375708 - protein, 23 aa, Mycobacterium
YSAGILTYELLTGATPFTGDTAL

SEQ ID NO: 375709 - protein, 25 aa, Mycobacterium
YSAGILTYELLTGRTPFTGDSALSI

SEQ ID NO: 375710 - protein, 24 aa, Mycobacterium
YSAIFLAMTMVILAVFFVAQGALF

SEQ ID NO: 375711 - protein, 23 aa, Mycobacterium
YSAPLWMPLIAWAVTRHRVAAPT

SEQ ID NO: 375712 - protein, 23 aa, Mycobacterium
YSAYLLLRTVFTVAPIVFGLDKF

SEQ ID NO: 375713 - protein, 32 aa, Mycobacterium
YSDPTMTLFSFLFAALWLSALAIFQTRSTRII

SEQ ID NO: 375714 - protein, 28 aa, Mycobacterium
YSESLTQVFLWAVPVALVGFVLALFLRQ

SEQ ID NO: 375715 - protein, 24 aa, Mycobacterium
YSFIAVAVVALVAWAGLGAAPSPR

SEQ ID NO: 375716 - protein, 21 aa, Mycobacterium
YSFLSYYPYYGFQGLTSHYAN

SEQ ID NO: 375717 - protein, 20 aa, Mycobacterium
YSFMRFCGAAVAPWLAGVLG

SEQ ID NO: 375718 - protein, 28 aa, Mycobacterium
YSGDDALNLPWLAMGAIGFISVIGHLAA

SEQ ID NO: 375719 - protein, 24 aa, Mycobacterium
YSGDTWRMWSYAWEARDTGFHTIT

SEQ ID NO: 375720 - protein, 30 aa, Mycobacterium
YSGGYGIQWVVPVLFLVLVSGFLAIQVKAA

SEQ ID NO: 375721 - protein, 17 aa, Mycobacterium
YSGYLTLAFLAGVLVMM

SEQ ID NO: 375722 - protein, 28 aa, Mycobacterium
YSIGAFFVLYGLLVFGLAAIPNLRRAGI

SEQ ID NO: 375723 - protein, 26 aa, Mycobacterium
YSKRTILLWTALGGMLPALVLGVLVW

SEQ ID NO: 375724 - protein, 25 aa, Mycobacterium
YSKSTWRLWSFPWQAKSPGKHTITV

SEQ ID NO: 375725 - protein, 20 aa, Mycobacterium
YSLIKAVIFVWIASTIQCYY

SEQ ID NO: 375726 - protein, 20 aa, Mycobacterium
YSLTTPLYGLTFGMSILSIG

SEQ ID NO: 375727 - protein, 17 aa, Mycobacterium
YSLVRLLERLLLSWRNG

SEQ ID NO: 375728 - protein, 25 aa, Mycobacterium
YSMGAFFVLYGLVVFGLAALPNLRR

SEQ ID NO: 375729 - protein, 25 aa, Mycobacterium
YSNATWRLWSLPWQAKSPGTHTITV

SEQ ID NO: 375730 - protein, 26 aa, Mycobacterium
YSNETWRLWSFPWEAKTPGRHTITVR

SEQ ID NO: 375731 - protein, 23 aa, Mycobacterium
YSPNVFFAYLGFSFFGGGAAGFV

SEQ ID NO: 375732 - protein, 18 aa, Mycobacterium
YSQPLRFENGRLLTWRRG

SEQ ID NO: 375733 - protein, 23 aa, Mycobacterium
YSRNLVLLIGVLGGLVCIGFVAL

SEQ ID NO: 375734 - protein, 23 aa, Mycobacterium
YSSELLSELPDLGSAAFAPDTVA

SEQ ID NO: 375735 - protein, 22 aa, Mycobacterium
YSSIFFATPLLVALRERTDLVA

SEQ ID NO: 375736 - protein, 21 aa, Mycobacterium
YSSIFFATPLLVSLRERTELV

SEQ ID NO: 375737 - protein, 21 aa, Mycobacterium
YSSIFFATPLLVTLRERTELV

SEQ ID NO: 375738 - protein, 18 aa, Mycobacterium
YSTRWWLSGLLVGLAAGI

SEQ ID NO: 375739 - protein, 27 aa, Mycobacterium
YSVDTWRQWWFAWQATAGEHIITARAT

SEQ ID NO: 375740 - protein, 19 aa, Mycobacterium
YSVGGIFYALRWPDPWPST

SEQ ID NO: 375741 - protein, 25 aa, Mycobacterium
YSVIKAIIFVWIASTIQCYYGFYAS

SEQ ID NO: 375742 - protein, 24 aa, Mycobacterium
YSVLKTVIFVWIASTVQCYYGFYA

SEQ ID NO: 375743 - protein, 23 aa, Mycobacterium
YSWLLVALPLAGATILLFGGRRT

SEQ ID NO: 375744 - protein, 24 aa, Mycobacterium
YTAEAARMLMLPDVLNSVVKATEA

SEQ ID NO: 375745 - protein, 17 aa, Mycobacterium
YTAFGIPLVAAGSLTGR

SEQ ID NO: 375746 - protein, 27 aa, Mycobacterium
YTALIGIAWCWLFPIAWAVSGSLKGEG

SEQ ID NO: 375747 - protein, 25 aa, Mycobacterium
YTALLGICCDLYEPVTWAEELVQPA

SEQ ID NO: 375748 - protein, 24 aa, Mycobacterium
YTDNLRYYYMFLPTVDGSVSRRFG

SEQ ID NO: 375749 - protein, 18 aa, Mycobacterium
YTDRLAWSLTVLVAVAWI

SEQ ID NO: 375750 - protein, 18 aa, Mycobacterium
YTFIRGREWIRLPAIFGA

SEQ ID NO: 375751 - protein, 26 aa, Mycobacterium
YTGAVMMLFLFVLMFVGVDSSDSLVE

SEQ ID NO: 375752 - protein, 20 aa, Mycobacterium
YTLKIMTWVTAIFAPLTVVY

SEQ ID NO: 375753 - protein, 21 aa, Mycobacterium
YTLVFGVLRLINFAHSEIFML

SEQ ID NO: 375754 - protein, 18 aa, Mycobacterium
YTSIIYMLYFLQHVLEVD

SEQ ID NO: 375755 - protein, 25 aa, Mycobacterium
YTSSYLRFVWTLSATAMVVCYGLWA

SEQ ID NO: 375756 - protein, 26 aa, Mycobacterium
YTSVVLVFLVFMVTLIGVIDLGLARL

SEQ ID NO: 375757 - protein, 22 aa, Mycobacterium
YTSYGWAFLVSGIILAVAAIGW

SEQ ID NO: 375758 - protein, 18 aa, Mycobacterium
YTTMTMTIAQRRPVISLL

SEQ ID NO: 375759 - protein, 22 aa, Mycobacterium
YTTTLLVLLLLGAYSPYRLVEA

SEQ ID NO: 375760 - protein, 18 aa, Mycobacterium
YTTYISIAAMIVLKMGAR

SEQ ID NO: 375761 - protein, 25 aa, Mycobacterium
YTVAAYLLALPIAAPIIMAIMGTFF

SEQ ID NO: 375762 - protein, 28 aa, Mycobacterium
YTVADFWRFWVVHLWVEDFLELFTTVMV

SEQ ID NO: 375763 - protein, 18 aa, Mycobacterium
YTVDRPVYVALTLPSGSG

SEQ ID NO: 375764 - protein, 24 aa, Mycobacterium
YTVNDLLHGLLMYSGNDAAHALAM

SEQ ID NO: 375765 - protein, 22 aa, Mycobacterium
YTVPLLIMIVVAAAVMARRRWR

SEQ ID NO: 375766 - protein, 25 aa, Mycobacterium
YTYFQIPLMVIVFIPALEGLREQWR

SEQ ID NO: 375767 - protein, 20 aa, Mycobacterium
YVAAFVLLTLVLRAGMPVGV

SEQ ID NO: 375768 - protein, 24 aa, Mycobacterium
YVAAHAPYLQWLAQQSANSAAAAV

SEQ ID NO: 375769 - protein, 22 aa, Mycobacterium
YVAAHVPYVAWLMQTSADSAAT

SEQ ID NO: 375770 - protein, 26 aa, Mycobacterium
YVAGFHHGFFIFAILLTAMSIIPLGG

SEQ ID NO: 375771 - protein, 18 aa, Mycobacterium
YVALILVQLIWTGARNVS

SEQ ID NO: 375772 - protein, 20 aa, Mycobacterium
YVAPWHLSPGRWYTWVIAIV

SEQ ID NO: 375773 - protein, 17 aa, Mycobacterium
YVAPWHLSPHQWYTWVI

SEQ ID NO: 375774 - protein, 22 aa, Mycobacterium
YVDAHAPYLAWLTTTSADYAAT

SEQ ID NO: 375775 - protein, 33 aa, Mycobacterium
YVDATPFPAFKQGVGLILRLAKPTALSEVTIDV

SEQ ID NO: 375776 - protein, 18 aa, Mycobacterium
YVDLIPPPTGAAGTLRSG

SEQ ID NO: 375777 - protein, 17 aa, Mycobacterium
YVDRFVHMLPAGYQTRI

SEQ ID NO: 375778 - protein, 18 aa, Mycobacterium
YVDWRAVFWINVPICALA

SEQ ID NO: 375779 - protein, 24 aa, Mycobacterium
YVENWSMVSDLLIALKTVKAMLGH

SEQ ID NO: 375780 - protein, 17 aa, Mycobacterium
YVEPLAPAPYVPPAPAY

SEQ ID NO: 375781 - protein, 19 aa, Mycobacterium
YVFGLTGLVLLVIPALLPA

SEQ ID NO: 375782 - protein, 27 aa, Mycobacterium
YVFVSCAAFFVAWPTAAVYLTVAITCC

SEQ ID NO: 375783 - protein, 17 aa, Mycobacterium
YVGFFRGTPVLVQLIFW

SEQ ID NO: 375784 - protein, 26 aa, Mycobacterium
YVGQRPWSPLIGLLSQAADLGIRVIV

SEQ ID NO: 375785 - protein, 17 aa, Mycobacterium
YVGRIVGVIVLLTGLYV

SEQ ID NO: 375786 - protein, 26 aa, Mycobacterium
YVGSLVLLALLLPYTTYKAGESPFVT

SEQ ID NO: 375787 - protein, 26 aa, Mycobacterium
YVGSVVLLILIYLGFVAGSGAHRGLL

SEQ ID NO: 375788 - protein, 26 aa, Mycobacterium
YVHGHDLDMRTLFPGPAGPADYAIIP

SEQ ID NO: 375789 - protein, 23 aa, Mycobacterium
YVIALPFFGIISEVIPVFARKPI

SEQ ID NO: 375790 - protein, 23 aa, Mycobacterium
YVIALPFFGIISEVIPVFSRKPI

SEQ ID NO: 375791 - protein, 18 aa, Mycobacterium
YVITFLMGLFFVCGQGYE

SEQ ID NO: 375792 - protein, 20 aa, Mycobacterium
YVITFLMGLFFVCGQGYEYF

SEQ ID NO: 375793 - protein, 17 aa, Mycobacterium
YVKTYRPDQQVDPAVAR

SEQ ID NO: 375794 - protein, 17 aa, Mycobacterium
YVLHRAWVGPMVLLVLD

SEQ ID NO: 375795 - protein, 19 aa, Mycobacterium
YVLITFWQDHNACVTAPGL

SEQ ID NO: 375796 - protein, 19 aa, Mycobacterium
YVLITFWQFRNACATAPGV

SEQ ID NO: 375797 - protein, 17 aa, Mycobacterium
YVLITYLPQVHAPIVSF

SEQ ID NO: 375798 - protein, 18 aa, Mycobacterium
YVLLIINRDILLNSVLAG

SEQ ID NO: 375799 - protein, 17 aa, Mycobacterium
YVLLLVLIVVYLTHIPF

SEQ ID NO: 375800 - protein, 44 aa, Mycobacterium
YVLQMVKILNLLISDLLVLLLDQVQLVLIFLDITLRAAMAVVQQ

SEQ ID NO: 375801 - protein, 25 aa, Mycobacterium
YVLSFQVYLALPMQASLLAPGHQSV

SEQ ID NO: 375802 - protein, 20 aa, Mycobacterium
YVLTFQVYLALPLQAALLTD

SEQ ID NO: 375803 - protein, 17 aa, Mycobacterium
YVMLPGSNQLRPVYNLT

SEQ ID NO: 375804 - protein, 30 aa, Mycobacterium
YVNELQALLVDWGFTPMTVGPRPAAGKPNV

SEQ ID NO: 375805 - protein, 23 aa, Mycobacterium
YVNKLLHNVFGFQLPQALSEAPW

SEQ ID NO: 375806 - protein, 18 aa, Mycobacterium
YVQTYWMSPRDISSTTID

SEQ ID NO: 375807 - protein, 17 aa, Mycobacterium
YVRAGVAAIGLLMAVSS

SEQ ID NO: 375808 - protein, 53 aa, Mycobacterium
YVRKGAAWAWRLLVLLAFGLTVLWLFWHLKTITIPLLLALMGSALLVPTVNFL

SEQ ID NO: 375809 - protein, 19 aa, Mycobacterium
YVRKWLILGIAIGVIAGLG

SEQ ID NO: 375810 - protein, 23 aa, Mycobacterium
YVRPYRWLLAVVAVLQVISNMAS

SEQ ID NO: 375811 - protein, 19 aa, Mycobacterium
YVRSRVVAWALWDCGSTGL

SEQ ID NO: 375812 - protein, 25 aa, Mycobacterium
YVSYVLVLVGFVAFGALVASLAYGS

SEQ ID NO: 375813 - protein, 18 aa, Mycobacterium
YVTLWIRKRLANPGLETV

SEQ ID NO: 375814 - protein, 29 aa, Mycobacterium
YVTQAPPVFFGWRPSLVAATLLSPAATAS

SEQ ID NO: 375815 - protein, 29 aa, Mycobacterium
YVTQRFLIRWRVWLTDRLTADWLGGRAYY

SEQ ID NO: 375816 - protein, 27 aa, Mycobacterium
YVTSKTLWHRSFWVIPLALVRTVELRQ

SEQ ID NO: 375817 - protein, 19 aa, Mycobacterium
YVTYGAFAVLYGEGRPYRV

SEQ ID NO: 375818 - protein, 20 aa, Mycobacterium
YVVICSVGIAVAFLGTAMLY

SEQ ID NO: 375819 - protein, 19 aa, Mycobacterium
YVVICSVGIAVAFLGTVLL

SEQ ID NO: 375820 - protein, 20 aa, Mycobacterium
YVVICSVGIAVAFLGTVLLY

SEQ ID NO: 375821 - protein, 25 aa, Mycobacterium
YVVMFLLCGYLIFQAGWGAIDLSLG

SEQ ID NO: 375822 - protein, 26 aa, Mycobacterium
YVVNLFPGQFVQPFIDAAFSDLGLDP

SEQ ID NO: 375823 - protein, 17 aa, Mycobacterium
YVWGVRIGGLFTAVGVT

SEQ ID NO: 375824 - protein, 25 aa, Mycobacterium
YVWVPDVTGSIFFLVSGVLAMVSVA

SEQ ID NO: 375825 - protein, 27 aa, Mycobacterium
YVYGHDLDIWTLFTRAAGPADYANIPP

SEQ ID NO: 375826 - protein, 18 aa, Mycobacterium
YWAVLGVCLLGIAVGAWH

SEQ ID NO: 375827 - protein, 23 aa, Mycobacterium
YWDSPLFMRINAVITAVWAGAFT

SEQ ID NO: 375828 - protein, 17 aa, Mycobacterium
YWHMVDVLWVVLFSLIY

SEQ ID NO: 375829 - protein, 19 aa, Mycobacterium
YWHRMGVNIVRHPWPFFGV

SEQ ID NO: 375830 - protein, 19 aa, Mycobacterium
YWLSMLIVLGFQIPVDGWL

SEQ ID NO: 375831 - protein, 29 aa, Mycobacterium
YWPQYPPQPAPFRPWPQAPAPAPTQALTP

SEQ ID NO: 375832 - protein, 23 aa, Mycobacterium
YWQAWVFIAVFLAGTLIPSFYLA

SEQ ID NO: 375833 - protein, 25 aa, Mycobacterium
YWQVWTFLVVFALSTWIPTVYLQRA

SEQ ID NO: 375834 - protein, 25 aa, Mycobacterium
YWSFRAMIGLLLVPVAFALVTLWLT

SEQ ID NO: 375835 - protein, 20 aa, Mycobacterium
YWVCAIYLVLLVAVGIAAAL

SEQ ID NO: 375836 - protein, 21 aa, Mycobacterium
YWVSGLYMVLLTIASIGAMLF

SEQ ID NO: 375837 - protein, 53 aa, Mycobacterium
YYDGDLRFIITVTLIVVFLILAALLRSIIAPIYLVLSVVLSYMSALGIGVVFF

SEQ ID NO: 375838 - protein, 20 aa, Mycobacterium
YYDLAVFALSLHHLPPELAA

SEQ ID NO: 375839 - protein, 20 aa, Mycobacterium
YYEAVGVILTLIMLGRLLEA

SEQ ID NO: 375840 - protein, 29 aa, Mycobacterium
YYGRPVLKPPVWEWKIAAYLFSGGLSAGS

SEQ ID NO: 375841 - protein, 17 aa, Mycobacterium
YYGTKMMLTLLGTFYAS

SEQ ID NO: 375842 - protein, 19 aa, Mycobacterium
YYLAAFVVGSAVAWGIVTV

SEQ ID NO: 375843 - protein, 22 aa, Mycobacterium
YYLIGALVTALVPILVTSGVVS

SEQ ID NO: 375844 - protein, 46 aa, Mycobacterium
YYNHDLRFIIVLTVIVVLLILVALLRAIVAPLYLIGSVIISYASAV

SEQ ID NO: 375845 - protein, 17 aa, Mycobacterium
YYPLILTGFLLLTSIII

SEQ ID NO: 375846 - protein, 30 aa, Mycobacterium
YYPVLLAIHRPLGVLILLFALVRLANRLRH

SEQ ID NO: 375847 - protein, 41 aa, Mycobacterium
YYQHDIRFIIAVTLIVVLLTLIALLRAVVAPLYLVASVVIS

SEQ ID NO: 375848 - protein, 27 aa, Mycobacterium
YYRYCTYAFLPFQYLSVVFGAYLFTAS

SEQ ID NO: 375849 - protein, 31 aa, Mycobacterium
YYRYCTYIFIPFQYASFFLGAYYFTATDLSW

SEQ ID NO: 375850 - protein, 26 aa, Mycobacterium
YYRYCTYIFIPFQYLSVVFGAYLFTA

SEQ ID NO: 375851 - protein, 20 aa, Mycobacterium
YYRYCTYLYIPFQYASVIFG

SEQ ID NO: 375852 - protein, 18 aa, Mycobacterium
DFDDFWRPIRSYFYWEKH

SEQ ID NO: 375853 - protein, 18 aa, Mycobacterium
ATSWLVRRPPLHGLTPSA

SEQ ID NO: 375854 - protein, 21 aa, Mycobacterium
GACIGFLWWNAAPAKIFMGDT

SEQ ID NO: 375855 - protein, 27 aa, Mycobacterium
HNLFKPLLLFFYFGFLIPILKVRFEFP

SEQ ID NO: 375856 - protein, 24 aa, Mycobacterium
GKEIAWPVPLLAFIILVAVGADYN

SEQ ID NO: 375857 - protein, 24 aa, Mycobacterium
IYNYTWLVLMLPFGMIGVTVLTVV

SEQ ID NO: 375858 - protein, 24 aa, Mycobacterium
LAIKPDICFLWDEAWYAFATAVPW

SEQ ID NO: 375859 - protein, 21 aa, Mycobacterium
PFVMLGAGLLWFGWYGFNAGS

SEQ ID NO: 375860 - protein, 30 aa, Mycobacterium; identical to SEQ ID NO: 25920

SEQ ID NO: 375861 - protein, 23 aa, Mycobacterium
SATTFPWVFLFPAGVLVLILVCA

SEQ ID NO: 375862 - protein, 21 aa, Mycobacterium
TAAGMFLAVWLPLNNGLRPEP

SEQ ID NO: 375863 - protein, 23 aa, Mycobacterium
VVYGLAFFFGAFFTVQEAFASVR

SEQ ID NO: 375864 - protein, 22 aa, Mycobacterium
AAGLFLAFWLPLNNGLRPEPII

SEQ ID NO: 375865 - protein, 17 aa, Mycobacterium
AAVLVLLAGRRLWHRFR

SEQ ID NO: 375866 - protein, 26 aa, Mycobacterium
AHWEFYMALAYFKLAIIAAGIDFRRR

SEQ ID NO: 375867 - protein, 17 aa, Mycobacterium
AIFMGLYLRFLRPGRVS

SEQ ID NO: 375868 - protein, 24 aa, Mycobacterium
ALCLIFIIMLIITRAVVASAVIVG

SEQ ID NO: 375869 - protein, 18 aa, Mycobacterium
APLWPFHRWLPDAAVEAT

SEQ ID NO: 375870 - protein, 22 aa, Mycobacterium
ARAFAVLFLPYSLLGPFAGALM

SEQ ID NO: 375871 - protein, 17 aa, Mycobacterium
AVIALVVFLVLVAIYIT

SEQ ID NO: 375872 - protein, 17 aa, Mycobacterium
CLHFTRMPYFQSLGIPL

SEQ ID NO: 375873 - protein, 17 aa, Mycobacterium
DAWLRLCQTYGWSPGVM

SEQ ID NO: 375874 - protein, 19 aa, Mycobacterium
DILYYSAPWMLFLGLAMSG

SEQ ID NO: 375875 - protein, 21 aa, Mycobacterium
DPMLWLERALVVLVAASPCAL

SEQ ID NO: 375876 - protein, 24 aa, Mycobacterium
DPQLWLLVVVTVLALLLGWHLVAS

SEQ ID NO: 375877 - protein, 22 aa, Mycobacterium
DTFVSWLPLYHDMGLIGAWLGC

SEQ ID NO: 375878 - protein, 24 aa, Mycobacterium
DVLQAYLNIIYFGRGAYGISAASK

SEQ ID NO: 375879 - protein, 25 aa, Mycobacterium
EIAEGALLLFLFSVGHALEGYAMGR

SEQ ID NO: 375880 - protein, 23 aa, Mycobacterium
EPEDLPWEVPLIELGLDSLMAVR

SEQ ID NO: 375881 - protein, 23 aa, Mycobacterium
ERTAMLLVPPYLAYVRAARPFIV

SEQ ID NO: 375882 - protein, 18 aa, Mycobacterium
EWSPLYFKEISWVGSNAF

SEQ ID NO: 375883 - protein, 19 aa, Mycobacterium
FAVTALFRHPLGIPIPHTA

SEQ ID NO: 375884 - protein, 23 aa, Mycobacterium
FDIPLWVLITWLLVRWARTRDDR

SEQ ID NO: 375885 - protein, 25 aa, Mycobacterium
FGGPGAMFWMWAVAFLGASTSFVEC

SEQ ID NO: 375886 - protein, 25 aa, Mycobacterium
FGIGPLVQLFLRLTPRRILFHDFGA

SEQ ID NO: 375887 - protein, 17 aa, Mycobacterium
FMIMLLLTRSVVAALVI

SEQ ID NO: 375888 - protein, 25 aa, Mycobacterium
FSVAWLYWYFWVIVVGFEAVAGGKV

SEQ ID NO: 375889 - protein, 22 aa, Mycobacterium
FVLIFLIMMFITRSLVAALVIP

SEQ ID NO: 375890 - protein, 18 aa, Mycobacterium
FWQFWDLALLWLAQLHGG

SEQ ID NO: 375891 - protein, 18 aa, Mycobacterium
GLVGIGVLPLLCCAGPAL

SEQ ID NO: 375892 - protein, 17 aa, Mycobacterium
GPPRLWVWIALTVLACG

SEQ ID NO: 375893 - protein, 18 aa, Mycobacterium
GVLGNPWLIGATAVLVIA

SEQ ID NO: 375894 - protein, 19 aa, Mycobacterium
HYWLKLLVFFFPFTDQIAA

SEQ ID NO: 375895 - protein, 25 aa, Mycobacterium
IAFSLAIIAVLIPLAAFGVLGLATV

SEQ ID NO: 375896 - protein, 23 aa, Mycobacterium
IARAFTVLFLPYSLLGPFAGALM

SEQ ID NO: 375897 - protein, 24 aa, Mycobacterium
IKTPQFWLLWIVLCFNVTAGIGIL

SEQ ID NO: 375898 - protein, 18 aa, Mycobacterium
IPIAIFMGLYLRFLRPGR

SEQ ID NO: 375899 - protein, 27 aa, Mycobacterium
IVSDRGYFVFLALLPFIMGSLSMSVPG

SEQ ID NO: 375900 - protein, 28 aa, Mycobacterium
KWSIPGLAHFFTMWGFFILLTVYIEAYG

SEQ ID NO: 375901 - protein, 23 aa, Mycobacterium
LATLLGRWFWWPQHVRPRPASTM

SEQ ID NO: 375902 - protein, 27 aa, Mycobacterium
LFCNSPFFWIGGFAFGLLATLVAGSTL

SEQ ID NO: 375903 - protein, 19 aa, Mycobacterium
LIFSRYLWAFELTSALLIT

SEQ ID NO: 375904 - protein, 20 aa, Mycobacterium
LLVLGLFTPLAAAGALAFLI

SEQ ID NO: 375905 - protein, 18 aa, Mycobacterium
LQIKWLVPILWICVGLSV

SEQ ID NO: 375906 - protein, 18 aa, Mycobacterium
LTCWLPVFVGWPVMRWLT

SEQ ID NO: 375907 - protein, 24 aa, Mycobacterium
LVIVGLILVVLLRALVAPLYLLGT

SEQ ID NO: 375908 - protein, 27 aa, Mycobacterium
LVPNGTFFFVLAIFLIVLAVIGTFVVP

SEQ ID NO: 375909 - protein, 25 aa, Mycobacterium
MQGDGPYILVGWSLGGVLAYACAIG

SEQ ID NO: 375910 - protein, 28 aa, Mycobacterium
NGEIVLLLFLPAILYWEGLNTSFREIRA

SEQ ID NO: 375911 - protein, 22 aa, Mycobacterium
NTSYYRLMLKLKGGPQAVADAA

SEQ ID NO: 375912 - protein, 25 aa, Mycobacterium
PALVMFLIIFFWTPPHTWALAMRYK

SEQ ID NO: 375913 - protein, 18 aa, Mycobacterium
PEDLPWEVPLIELGLDSL

SEQ ID NO: 375914 - protein, 25 aa, Mycobacterium
PEGKPWWLVVVGVLVVGLLIGMVGM

SEQ ID NO: 375915 - protein, 17 aa, Mycobacterium
PGLPLWPYLVCAALTGL

SEQ ID NO: 375916 - protein, 21 aa, Mycobacterium
PLSQWFLLSAAFASLFMVAGK

SEQ ID NO: 375917 - protein, 20 aa, Mycobacterium
PLTVLLIFTLNVLLAQFGAA

SEQ ID NO: 375918 - protein, 18 aa, Mycobacterium
PPMGSILYWLRPGTIRLP

SEQ ID NO: 375919 - protein, 17 aa, Mycobacterium
PRLWVWIALTVLACGVL

SEQ ID NO: 375920 - protein, 18 aa, Mycobacterium
PRMYALHILLLPGIILAL

SEQ ID NO: 375921 - protein, 20 aa, Mycobacterium
PVGWAVLWLVTVVPVVLVGT

SEQ ID NO: 375922 - protein, 18 aa, Mycobacterium
QFIPQIVLLFLLIALLEN

SEQ ID NO: 375923 - protein, 23 aa, Mycobacterium
RENVVALTVLWLLNIGEYLQDLT

SEQ ID NO: 375924 - protein, 18 aa, Mycobacterium
RLNALSFWLFLFGALIAL

SEQ ID NO: 375925 - protein, 17 aa, Mycobacterium
RLYALHILLIPGIILAL

SEQ ID NO: 375926 - protein, 18 aa, Mycobacterium
RPIQLCRTVLAQAALIAG

SEQ ID NO: 375927 - protein, 18 aa, Mycobacterium
RQGRFEIDFLMLVSAAGA

SEQ ID NO: 375928 - protein, 18 aa, Mycobacterium
SAGGLGLGWFTPATVPQA

SEQ ID NO: 375929 - protein, 24 aa, Mycobacterium
SALCLIFLIMLLITRSFVASLVIV

SEQ ID NO: 375930 - protein, 19 aa, Mycobacterium
SFWLFLFGALIAIAGFITP

SEQ ID NO: 375931 - protein, 23 aa, Mycobacterium
SIAVLLGRWFWWPHHVRPRPIPQ

SEQ ID NO: 375932 - protein, 17 aa, Mycobacterium
SIPLTVLLIFTLNVLLA

SEQ ID NO: 375933 - protein, 17 aa, Mycobacterium
SPLFRKFVEWIEYLCLM

SEQ ID NO: 375934 - protein, 24 aa, Mycobacterium
SPQTLFFPFVLLLAATAMYRGNDN

SEQ ID NO: 375935 - protein, 25 aa, Mycobacterium
SSFWFTAIYVLLFVSLVGCLTPRMI

SEQ ID NO: 375936 - protein, 20 aa, Mycobacterium
SVALFFVWMIAVAFLYLVLG

SEQ ID NO: 375937 - protein, 17 aa, Mycobacterium
SVFTALLPLLVIGVSLA

SEQ ID NO: 375938 - protein, 25 aa, Mycobacterium
TAKMWTFLFIYFWLRASLPRLRYDQ

SEQ ID NO: 375939 - protein, 24 aa, Mycobacterium
TETRHWWHLPLLGHHLLVAGATGA

SEQ ID NO: 375940 - protein, 18 aa, Mycobacterium
TLIFMIMLLLTRSVVAAL

SEQ ID NO: 375941 - protein, 17 aa, Mycobacterium
TLLGRWFWWPQVVHPRG

SEQ ID NO: 375942 - protein, 26 aa, Mycobacterium
TSMGTALVLLFLLALGAIPGALLPQR

SEQ ID NO: 375943 - protein, 21 aa, Mycobacterium
TYDMDLFLRIAPELYLKRLCV

SEQ ID NO: 375944 - protein, 27 aa, Mycobacterium
VGLSLGLIIVLMPLALFGVLGLAAVVL

SEQ ID NO: 375945 - protein, 24 aa, Mycobacterium
VGTPAMWWLAVPVLLYAAWRMFVR

SEQ ID NO: 375946 - protein, 21 aa, Mycobacterium
VISLIMVNPFLLLAQQARAIN

SEQ ID NO: 375947 - protein, 19 aa, Mycobacterium
VLFTLIFFLYGGRNIWQYV

SEQ ID NO: 375948 - protein, 24 aa, Mycobacterium
VLSGAWLGLFIGLVLGFFSPNPWA

SEQ ID NO: 375949 - protein, 24 aa, Mycobacterium
VLSGAWLGLFIGLVLGFFSPNPWG

SEQ ID NO: 375950 - protein, 21 aa, Mycobacterium
VMVGFLFLYPAFVAKAHDASG

SEQ ID NO: 375951 - protein, 25 aa, Mycobacterium
VSLGIILLALLWYAGLPLRVFATSL

SEQ ID NO: 375952 - protein, 19 aa, Mycobacterium
VVALLMFSAGGLGLGWFTP

SEQ ID NO: 375953 - protein, 17 aa, Mycobacterium
VWAAWPFHRAAWANLRH

SEQ ID NO: 375954 - protein, 18 aa, Mycobacterium
VYEPLLNRLPADTPMYGF

SEQ ID NO: 375955 - protein, 19 aa, Mycobacterium
WIIGWNLLLELAIGAAVVA

SEQ ID NO: 375956 - protein, 19 aa, Mycobacterium
WLVPILWICVGLSVLLVGP

SEQ ID NO: 375957 - protein, 17 aa, Mycobacterium
WWALSRLLERMRGIPDV

SEQ ID NO: 375958 - protein, 19 aa, Mycobacterium
YDEYPVLPPIGLQAPVPIQ

SEQ ID NO: 375959 - protein, 24 aa, Mycobacterium
YGYSLLWVLLLLIPVLIVNQEMVV

SEQ ID NO: 375960 - protein, 22 aa, Mycobacterium
YIISFALFIYGLMGLTGPKTAV

SEQ ID NO: 375961 - protein, 18 aa, Mycobacterium
YMMWTDGLIRLWPAWEFY

SEQ ID NO: 375962 - protein, 20 aa, Mycobacterium
YPLYLDAYPLPQFAIYGAVS

SEQ ID NO: 375963 - protein, 26 aa, Mycobacterium
AAAAILIRWKLSIAFLPNVGIAAAAA

SEQ ID NO: 375964 - protein, 28 aa, Mycobacterium
AAAARWVVPLTLLLTLAAALFPALRCSP

SEQ ID NO: 375965 - protein, 18 aa, Mycobacterium
AAAFPFYGPTPEAPDFAG

SEQ ID NO: 375966 - protein, 25 aa, Mycobacterium
AAALGRWFWWPINVFEIVRRGRETQ

SEQ ID NO: 375967 - protein, 26 aa, Mycobacterium
AAAPFQLLFSLIFTPVIRLTNGTANW

SEQ ID NO: 375968 - protein, 25 aa, Mycobacterium
AAFRKIILPLLWPGIVAALLVAFFL

SEQ ID NO: 375969 - protein, 23 aa, Mycobacterium
AAFVLIFLIMLYLTRSLVAAMVI

SEQ ID NO: 375970 - protein, 24 aa, Mycobacterium
AAGDWLLAIPWWTPSFVFGLGSFL

SEQ ID NO: 375971 - protein, 20 aa, Mycobacterium
AAGLFYLALTIPLTHLVNYI

SEQ ID NO: 375972 - protein, 26 aa, Mycobacterium
AAGYVLWWAVLFPAISVPIIASLVLA

SEQ ID NO: 375973 - protein, 23 aa, Mycobacterium
AAIAVPWWFLVAQLPFAGIVFAL

SEQ ID NO: 375974 - protein, 20 aa, Mycobacterium
AAIAVVLLPVSWQLGLAALG

SEQ ID NO: 375975 - protein, 17 aa, Mycobacterium
AAILFGWFMISAGASVF

SEQ ID NO: 375976 - protein, 19 aa, Mycobacterium
AAILFQFTLPLTPAQVLWI

SEQ ID NO: 375977 - protein, 25 aa, Mycobacterium
AAILLFPGFFVPGYLFVGVPVLLIA

SEQ ID NO: 375978 - protein, 22 aa, Mycobacterium
AAIMLWLLLRLPESPRWLVKQG

SEQ ID NO: 375979 - protein, 23 aa, Mycobacterium
AAIPFAIWFFLAIEGVPLAAEEA

SEQ ID NO: 375980 - protein, 23 aa, Mycobacterium
AAIPFAIWFFLAIEGVPLAAEET

SEQ ID NO: 375981 - protein, 18 aa, Mycobacterium
AAITFVLLFLLTGSVVLP

SEQ ID NO: 375982 - protein, 18 aa, Mycobacterium
AAKTWPWIAAAVAVVVVI

SEQ ID NO: 375983 - protein, 21 aa, Mycobacterium
AALAAVLLTAGWILGRSGYEG

SEQ ID NO: 375984 - protein, 23 aa, Mycobacterium
AALALLGMRRYVFARPPLLGPSG

SEQ ID NO: 375985 - protein, 24 aa, Mycobacterium
AALALLGVRRYVFARPPLLGPSGQ

SEQ ID NO: 375986 - protein, 24 aa, Mycobacterium
AALALLGVRRYVFKRPPLLGPSGR

SEQ ID NO: 375987 - protein, 17 aa, Mycobacterium
AALALVLPVWAAALIVA

SEQ ID NO: 375988 - protein, 27 aa, Mycobacterium
AALATWLPFLLVLASMTYVLFAQVFWL

SEQ ID NO: 375989 - protein, 17 aa, Mycobacterium
AALFDRAKERLAEPVLA

SEQ ID NO: 375990 - protein, 17 aa, Mycobacterium
AALFIFALWIATLGFPQ

SEQ ID NO: 375991 - protein, 23 aa, Mycobacterium
AALFITAAILFRFTERRTLAEFA

SEQ ID NO: 375992 - protein, 20 aa, Mycobacterium
AALFIYALWVAVLGFPRSQL

SEQ ID NO: 375993 - protein, 25 aa, Mycobacterium
AALFRRVFLINGLIFALGTLILAVS

SEQ ID NO: 375994 - protein, 23 aa, Mycobacterium
AALLALFVLLLGPTLFLLQSWVQ

SEQ ID NO: 375995 - protein, 22 aa, Mycobacterium
AALLFPVLVFLLSPAISWRAPV

SEQ ID NO: 375996 - protein, 26 aa, Mycobacterium
AALLGRWFWWPLNIRSRPPRLTRQRP

SEQ ID NO: 375997 - protein, 23 aa, Mycobacterium
AALLGRWFWWPLQVRSRPTGTTT

SEQ ID NO: 375998 - protein, 25 aa, Mycobacterium
AALLGRWFWWPLQVRTRPTRPTAVK

SEQ ID NO: 375999 - protein, 24 aa, Mycobacterium
AALLGRWFWWPLQVSPRPVGAVRG

SEQ ID NO: 376000 - protein, 26 aa, Mycobacterium
AALLGRWFWWPLRVRPRPASYMLRPF

SEQ ID NO: 376001 - protein, 25 aa, Mycobacterium
AALLGRWFWWPLRVRSRPDRRAIQR

SEQ ID NO: 376002 - protein, 22 aa, Mycobacterium
AALLGRWFWWPQLVRPRPASTM

SEQ ID NO: 376003 - protein, 17 aa, Mycobacterium
AALLGRWFWWPQRVRPR

SEQ ID NO: 376004 - protein, 23 aa, Mycobacterium
AALLGRWFWWPRRVYSRPVNTAP

SEQ ID NO: 376005 - protein, 24 aa, Mycobacterium
AALMGRWFWWPMKVSKYATDPPPP

SEQ ID NO: 376006 - protein, 24 aa, Mycobacterium
AALMLSILLVAIASGWMLLLNVLK

SEQ ID NO: 376007 - protein, 26 aa, Mycobacterium
AALVLSILLVAIAAGWMMLLNVLKPT

SEQ ID NO: 376008 - protein, 24 aa, Mycobacterium
AAMLLFVVARRWVLALLAVALTVA

SEQ ID NO: 376009 - protein, 21 aa, Mycobacterium
AANRLLLPPILGWSLGRALCG

SEQ ID NO: 376010 - protein, 25 aa, Mycobacterium
AAPILIGMILLILPLGQLALGGISE

SEQ ID NO: 376011 - protein, 23 aa, Mycobacterium
AAPNLWIFLIGRFLQGAALAAVF

SEQ ID NO: 376012 - protein, 27 aa, Mycobacterium
AAQFRKLFWLNLILAVPVVAFSGMFAM

SEQ ID NO: 376013 - protein, 22 aa, Mycobacterium
AAQPILPIRLFAAPVFSVCCVL

SEQ ID NO: 376014 - protein, 24 aa, Mycobacterium
AARKRIAWLLLLTNVVLAAFLNAA

SEQ ID NO: 376015 - protein, 27 aa, Mycobacterium
AARKRIAWWVLVLYLVGAIGWNVGDLA

SEQ ID NO: 376016 - protein, 24 aa, Mycobacterium
AARPWPDWIQQINWKWVRRSVGLA

SEQ ID NO: 376017 - protein, 24 aa, Mycobacterium
AARRRLRLRPRWLRRPGRTGLAAM

SEQ ID NO: 376018 - protein, 21 aa, Mycobacterium
AASGPSWWAAGGIAVVAAALG

SEQ ID NO: 376019 - protein, 23 aa, Mycobacterium
AASLWFGFRSAAKVFRDPLPEPE

SEQ ID NO: 376020 - protein, 23 aa, Mycobacterium
AASWLWVVALGGLFLWIGYRRRT

SEQ ID NO: 376021 - protein, 18 aa, Mycobacterium
AASWLWVVASGGLYLWLV

SEQ ID NO: 376022 - protein, 22 aa, Mycobacterium
AATLWIPPLVYFGLRRFGREPE

SEQ ID NO: 376023 - protein, 26 aa, Mycobacterium
AAVAAIVAVLVWGVGANLGWWKGLAG

SEQ ID NO: 376024 - protein, 20 aa, Mycobacterium
AAVAALIWWTSDARATISRP

SEQ ID NO: 376025 - protein, 25 aa, Mycobacterium
AAVAVVFGYLLWPGARRLPGSARFS

SEQ ID NO: 376026 - protein, 20 aa, Mycobacterium
AAVFAWLLAVFAVRPFKQLA

SEQ ID NO: 376027 - protein, 19 aa, Mycobacterium
AAVLLIAIGYLTVGALRVS

SEQ ID NO: 376028 - protein, 25 aa, Mycobacterium
AAVLVLLPIVTFAMAYFIVDIPKPG

SEQ ID NO: 376029 - protein, 23 aa, Mycobacterium
AAVLYFVIMLPYKKLRERGEVEQ

SEQ ID NO: 376030 - protein, 24 aa, Mycobacterium
AAVMILLPIVTFTMAYFIVDVPRP

SEQ ID NO: 376031 - protein, 19 aa, Mycobacterium
AAVPPLLLGLAAGVFFVWW

SEQ ID NO: 376032 - protein, 22 aa, Mycobacterium
AAVQAPWPLLRTFAAGPALSRE

SEQ ID NO: 376033 - protein, 20 aa, Mycobacterium
AAVTLLYLAYLRRQTRIEEQ

SEQ ID NO: 376034 - protein, 24 aa, Mycobacterium
AAVVILLPIVTFTMAYFIVDVPRP

SEQ ID NO: 376035 - protein, 24 aa, Mycobacterium
AAWAWRLLVILFALLALLWVVKKL

SEQ ID NO: 376036 - protein, 20 aa, Mycobacterium
AAWFALFALPLLISAPRHTG

SEQ ID NO: 376037 - protein, 22 aa, Mycobacterium
AAWGWFALLLQITGAIAVVQVI

SEQ ID NO: 376038 - protein, 31 aa, Mycobacterium
AAWLSWPGFVWLALVFYLVLTLLVLEPVRLV

SEQ ID NO: 376039 - protein, 20 aa, Mycobacterium
AAYIWLFRGLPVLLQILIWY

SEQ ID NO: 376040 - protein, 23 aa, Mycobacterium
AAYKLIMLLLWWGAATSKLNHHF

SEQ ID NO: 376041 - protein, 25 aa, Mycobacterium
ACALALFAVFWVLVPLLLRTRDVRL

SEQ ID NO: 376042 - protein, 21 aa, Mycobacterium
ACKAWLLAQPFLAAGVLLVIY

SEQ ID NO: 376043 - protein, 23 aa, Mycobacterium
ACKAWLLTQPYLVGGTLLVLYAA

SEQ ID NO: 376044 - protein, 17 aa, Mycobacterium
ACPVWLYQIWRFITPGL

SEQ ID NO: 376045 - protein, 20 aa, Mycobacterium
ACVGFLWWNAAPAKIFMGDT

SEQ ID NO: 376046 - protein, 23 aa, Mycobacterium
ADALARLLSLLPLGYAPGTCRPF

SEQ ID NO: 376047 - protein, 20 aa, Mycobacterium
ADFDDFWRPIRSYLYWEKHC

SEQ ID NO: 376048 - protein, 21 aa, Mycobacterium
ADFDDFWRPLRSYFYWEQHCF

SEQ ID NO: 376049 - protein, 24 aa, Mycobacterium
ADGDPYQFLLLPLARVSGIEDQAL

SEQ ID NO: 376050 - protein, 20 aa, Mycobacterium
ADLSFFVLDDWLRPLQAGAV

SEQ ID NO: 376051 - protein, 18 aa, Mycobacterium
ADPDLLEPPPPPPPPIPA

SEQ ID NO: 376052 - protein, 27 aa, Mycobacterium
ADRAAGWLFWFALVTALVTAAAWSAIG

SEQ ID NO: 376053 - protein, 28 aa, Mycobacterium
ADRSDRLYWKAVVYLRIVIRWISDEHPG

SEQ ID NO: 376054 - protein, 23 aa, Mycobacterium
ADVYALGCTLFRMLTGQPPFGSG

SEQ ID NO: 376055 - protein, 19 aa, Mycobacterium
AEAGWYLLPTHPADIKNPG

SEQ ID NO: 376056 - protein, 28 aa, Mycobacterium
AEHARKLLWRLLVAAVLFVPLADLSTMC

SEQ ID NO: 376057 - protein, 26 aa, Mycobacterium
AELAPFLVWALFGGLFPLALGVLQIL

SEQ ID NO: 376058 - protein, 23 aa, Mycobacterium
AELAPFLVWALSGGLFPLALGVL

SEQ ID NO: 376059 - protein, 19 aa, Mycobacterium
AELGIVLVLLVVCLGLESQ

SEQ ID NO: 376060 - protein, 25 aa, Mycobacterium
AELPIIIVILIQIILVLLEILYAIV

SEQ ID NO: 376061 - protein, 18 aa, Mycobacterium
AENALLQVLFFAVLFGLA

SEQ ID NO: 376062 - protein, 23 aa, Mycobacterium
AENALLQVLFFAVLFGLGLAKFG

SEQ ID NO: 376063 - protein, 25 aa, Mycobacterium
AEPAHPRWWFISTTPGRILTIGIVL

SEQ ID NO: 376064 - protein, 24 aa, Mycobacterium
AEPAVLRLPFVFSGVTLYATAATR

SEQ ID NO: 376065 - protein, 19 aa, Mycobacterium
AEPILPMRLFRSPVFTVCC

SEQ ID NO: 376066 - protein, 17 aa, Mycobacterium
AETYWQLLLFRSLGGVG

SEQ ID NO: 376067 - protein, 19 aa, Mycobacterium
AEYLLPICPPPRATSPPGS

SEQ ID NO: 376068 - protein, 19 aa, Mycobacterium
AFAALFLPYSLLGPFAGAL

SEQ ID NO: 376069 - protein, 19 aa, Mycobacterium
AFAFFGWHWSLPLGVAILL

SEQ ID NO: 376070 - protein, 25 aa, Mycobacterium
AFAFLLLPQIIFYGLSSVFMAILNT

SEQ ID NO: 376071 - protein, 17 aa, Mycobacterium
AFALVLALKHEVWTRLI

SEQ ID NO: 376072 - protein, 20 aa, Mycobacterium
AFAPWFFFVCRFFTGAGIGG

SEQ ID NO: 376073 - protein, 20 aa, Mycobacterium
AFAPWYFFVARFFTGSGIGG

SEQ ID NO: 376074 - protein, 22 aa, Mycobacterium
AFAVSIPMWWLLAGQQLGNLPV

SEQ ID NO: 376075 - protein, 19 aa, Mycobacterium
AFAWLWWTANLLSGLLAVA

SEQ ID NO: 376076 - protein, 21 aa, Mycobacterium
AFDGLLAPLLVFGAGVLQAVL

SEQ ID NO: 376077 - protein, 26 aa, Mycobacterium
AFFGGPRWVWLRYITLWAGLTVGAVL

SEQ ID NO: 376078 - protein, 18 aa, Mycobacterium
AFFIPIYFAIVGLKLDLI

SEQ ID NO: 376079 - protein, 20 aa, Mycobacterium
AFFIVYLMNSWLPILMTDVG

SEQ ID NO: 376080 - protein, 18 aa, Mycobacterium
AFFLLLDEPEVYGLPPDP

SEQ ID NO: 376081 - protein, 20 aa, Mycobacterium
AFFNIYFCTVTIKINGPAGS

SEQ ID NO: 376082 - protein, 27 aa, Mycobacterium
AFGLALLLVFLFWPWQYKASGESGSFL

SEQ ID NO: 376083 - protein, 20 aa, Mycobacterium
AFGWRWVFFAPVVLASVVLL

SEQ ID NO: 376084 - protein, 21 aa, Mycobacterium
AFIRRFMLIFGPISSLFDFLT

SEQ ID NO: 376085 - protein, 20 aa, Mycobacterium
AFLLRPGWIALALVVIAFTY

SEQ ID NO: 376086 - protein, 20 aa, Mycobacterium
AFLPVFLLAYFASAVALLAA

SEQ ID NO: 376087 - protein, 20 aa, Mycobacterium
AFLVSLLALGWRPAAPFPTG

SEQ ID NO: 376088 - protein, 25 aa, Mycobacterium
AFMAYFFSLYLRAGVAQLPWMIGAV

SEQ ID NO: 376089 - protein, 20 aa, Mycobacterium
AFMVWLLLRFDPFRAMRPYP

SEQ ID NO: 376090 - protein, 28 aa, Mycobacterium
AFTAIGTGAMWLWNNAIKPAWNGIKEVI

SEQ ID NO: 376091 - protein, 24 aa, Mycobacterium
AFVLIFLIMLYLTRSLVAALVIPG

SEQ ID NO: 376092 - protein, 21 aa, Mycobacterium
AFVVIFAVVLVFYIVTSNHKK

SEQ ID NO: 376093 - protein, 20 aa, Mycobacterium
AFWVFLLCYIGATTLTWWRY

SEQ ID NO: 376094 - protein, 23 aa, Mycobacterium
AFYPLALVPFGSLIWVLARWPGN

SEQ ID NO: 376095 - protein, 22 aa, Mycobacterium
AGAALFLWAFAFGPPPPPGPGG

SEQ ID NO: 376096 - protein, 23 aa, Mycobacterium
AGAALIEVLWWVQGRVLGEERRV

SEQ ID NO: 376097 - protein, 23 aa, Mycobacterium
AGACIGFLWWNAAPAKIFMGDTG

SEQ ID NO: 376098 - protein, 27 aa, Mycobacterium
AGAFTFLIAPFFARLIRFFPPVVTGSV

SEQ ID NO: 376099 - protein, 27 aa, Mycobacterium
AGALGKWFWWSPVPLLRGLLFRWSKAR

SEQ ID NO: 376100 - protein, 18 aa, Mycobacterium
AGCLPAVIWLACHRPNRL

SEQ ID NO: 376101 - protein, 23 aa, Mycobacterium
AGFAIGWAMWPLVAAIVLQAIAA

SEQ ID NO: 376102 - protein, 22 aa, Mycobacterium
AGFAILCSVVIAPSWADPAQDA

SEQ ID NO: 376103 - protein, 25 aa, Mycobacterium
AGFLMLLWVFIWSVLRILRTDIYAP

SEQ ID NO: 376104 - protein, 25 aa, Mycobacterium
AGGLALLLMVVWVGIALAVSASLGT

SEQ ID NO: 376105 - protein, 25 aa, Mycobacterium
AGGPAWLYWTLYLACYAAGGWEPGL

SEQ ID NO: 376106 - protein, 21 aa, Mycobacterium
AGGYWLMHYWPVDLLAYRHSI

SEQ ID NO: 376107 - protein, 23 aa, Mycobacterium
AGIAAIALIIWLITVIARQFSEP

SEQ ID NO: 376108 - protein, 20 aa, Mycobacterium
AGIAMMTFVGAALGYRQAKA

SEQ ID NO: 376109 - protein, 19 aa, Mycobacterium
AGISFLIYLFCWLLGRRQG

SEQ ID NO: 376110 - protein, 18 aa, Mycobacterium
AGITFVLLFLLTGSVVLP

SEQ ID NO: 376111 - protein, 17 aa, Mycobacterium
AGLAWWWAPVFAAVIYA

SEQ ID NO: 376112 - protein, 21 aa, Mycobacterium
AGLCWLSFSWPGRRAMAAFVV

SEQ ID NO: 376113 - protein, 18 aa, Mycobacterium
AGLGLWAWAPWDDGDDDA

SEQ ID NO: 376114 - protein, 20 aa, Mycobacterium
AGLLAYFKPAGKLGGSNLLT

SEQ ID NO: 376115 - protein, 19 aa, Mycobacterium
AGLLLLIALVVAGGLASTF

SEQ ID NO: 376116 - protein, 17 aa, Mycobacterium
AGLLWFGWFGFNAGSAL

SEQ ID NO: 376117 - protein, 24 aa, Mycobacterium
AGLMNIFLLFWLLAVLFNAMNRID

SEQ ID NO: 376118 - protein, 21 aa, Mycobacterium
AGLNGFFFYGGHQYRYYYGSS

SEQ ID NO: 376119 - protein, 19 aa, Mycobacterium
AGLSWLLMVSMPALGLANW

SEQ ID NO: 376120 - protein, 17 aa, Mycobacterium
AGRALMYLGFIPPVWLA

SEQ ID NO: 376121 - protein, 25 aa, Mycobacterium
AGRLLAPLRWALILSGLLQAVITLV

SEQ ID NO: 376122 - protein, 22 aa, Mycobacterium
AGRLWFVEVLVWVLVGLALLCA

SEQ ID NO: 376123 - protein, 25 aa, Mycobacterium
AGRPARWSWLWPREHHLVSWLAAVV

SEQ ID NO: 376124 - protein, 24 aa, Mycobacterium
AGSIFAALLFWWTWHRLETKRRSD

SEQ ID NO: 376125 - protein, 24 aa, Mycobacterium
AGSLLRLFILAVIMAPIMAAVMLR

SEQ ID NO: 376126 - protein, 24 aa, Mycobacterium
AGSLLRLLVLGLIMVPILAAVMLG

SEQ ID NO: 376127 - protein, 17 aa, Mycobacterium
AGSTSCLLALLPQVRHL

SEQ ID NO: 376128 - protein, 18 aa, Mycobacterium
AGTCAVVLFLLFWSLLPL

SEQ ID NO: 376129 - protein, 24 aa, Mycobacterium
AGTYPFRMFGIRTVLIGLDLLLLR

SEQ ID NO: 376130 - protein, 24 aa, Mycobacterium
AGVKSAWDLLWRYGGQYVATVLAP

SEQ ID NO: 376131 - protein, 17 aa, Mycobacterium
AGVLWWITDRRPRSRRW

SEQ ID NO: 376132 - protein, 30 aa, Mycobacterium
AGVNPTWFGWLIVAWLWLTVVFANLAEAVA

SEQ ID NO: 376133 - protein, 17 aa, Mycobacterium
AGWLPQGPAAVADYPTV

SEQ ID NO: 376134 - protein, 22 aa, Mycobacterium
AGWQPWIWAVLVAGLGFMSAFV

SEQ ID NO: 376135 - protein, 26 aa, Mycobacterium
AHAPLWRKFIRFWTVSFPVVVYRSWR

SEQ ID NO: 376136 - protein, 18 aa, Mycobacterium
AHDWLFVTLVFALGALSF

SEQ ID NO: 376137 - protein, 18 aa, Mycobacterium
AHFLPPVLRKLTIFVPES

SEQ ID NO: 376138 - protein, 18 aa, Mycobacterium
AHFLPPVLRKLTIYLPQS

SEQ ID NO: 376139 - protein, 23 aa, Mycobacterium
AHGLYPLLIMTLLPVLAGVDISS

SEQ ID NO: 376140 - protein, 22 aa, Mycobacterium
AHKPAHSMFWYRSTRFVLRHAV

SEQ ID NO: 376141 - protein, 28 aa, Mycobacterium
AHLLVAALTMAPLWMTPPAHAVSPPRVD

SEQ ID NO: 376142 - protein, 19 aa, Mycobacterium
AHQVWLPPLDRAPALASLL

SEQ ID NO: 376143 - protein, 25 aa, Mycobacterium
AHRVPGAFRLAVLAGALALAGLAVV

SEQ ID NO: 376144 - protein, 24 aa, Mycobacterium
AHRWMLRVRWLIEPTLVVLTVGLL

SEQ ID NO: 376145 - protein, 19 aa, Mycobacterium
AIAIFILFLIVAPPFRSPE

SEQ ID NO: 376146 - protein, 23 aa, Mycobacterium
AIAPLFIVWLGFGPSPKILVAVL

SEQ ID NO: 376147 - protein, 24 aa, Mycobacterium
AIAVPIALPIALPLGIDAYVRGSS

SEQ ID NO: 376148 - protein, 24 aa, Mycobacterium
AIAVVLCWLLYRRAVRLNLRVFFT

SEQ ID NO: 376149 - protein, 24 aa, Mycobacterium
AIAWFLKFLVSHSMYWFVGYRVVL

SEQ ID NO: 376150 - protein, 23 aa, Mycobacterium
AIAYLLEILPALAYLHALGLVYN

SEQ ID NO: 376151 - protein, 25 aa, Mycobacterium
AIGIALWLLRFAMSSSWLLALVQIG

SEQ ID NO: 376152 - protein, 22 aa, Mycobacterium
AIGLALLPISWQLGLAALAGVP

SEQ ID NO: 376153 - protein, 24 aa, Mycobacterium
AIGLIFIIMLILTRAVIAAAVIVG

SEQ ID NO: 376154 - protein, 20 aa, Mycobacterium
AIGVPWWFLVAQLPFAGMVF

SEQ ID NO: 376155 - protein, 26 aa, Mycobacterium
AIGVVLGWPLWWVSACSVLVLLILEG

SEQ ID NO: 376156 - protein, 20 aa, Mycobacterium
AIHPALLHTLSLALALVIVV

SEQ ID NO: 376157 - protein, 21 aa, Mycobacterium
AIIAPLYLIGSVLVSFFAALG

SEQ ID NO: 376158 - protein, 24 aa, Mycobacterium
AIICYAWPFYWLVDMRAMAWLVVA

SEQ ID NO: 376159 - protein, 19 aa, Mycobacterium
AIITLLIALGIPFLGIKWG

SEQ ID NO: 376160 - protein, 21 aa, Mycobacterium
AIKITTLFGSRYVDLRPAGAG

SEQ ID NO: 376161 - protein, 31 aa, Mycobacterium
AILALALLANTWWWRALSGWWAWAHTPNGPG

SEQ ID NO: 376162 - protein, 20 aa, Mycobacterium
AILAWIWRLGGPRGAFLGGV

SEQ ID NO: 376163 - protein, 19 aa, Mycobacterium
AILGFPFIPQAMRHRYFEL

SEQ ID NO: 376164 - protein, 24 aa, Mycobacterium
AIPATLLLLRYRWLRAEPLPTPRP

SEQ ID NO: 376165 - protein, 20 aa, Mycobacterium
AIPFAIWFFLAVEGVPLAAE

SEQ ID NO: 376166 - protein, 29 aa, Mycobacterium
AIPGIMWQRWLFAWPAMLAALIVAIGQPA

SEQ ID NO: 376167 - protein, 25 aa, Mycobacterium
AIPIMLGWLAIIVLINILVPSLQQV

SEQ ID NO: 376168 - protein, 17 aa, Mycobacterium
AIPLARKAFMLDPGNLA

SEQ ID NO: 376169 - protein, 20 aa, Mycobacterium
AIPLWIAFALSTKAATRRYT

SEQ ID NO: 376170 - protein, 24 aa, Mycobacterium
AIRLGTFLLVCFLGVIGLFAVFGQ

SEQ ID NO: 376171 - protein, 20 aa, Mycobacterium
AIRLLSVPIIVFWLALAAVT

SEQ ID NO: 376172 - protein, 21 aa, Mycobacterium
AIRWAALVVLVLIGAGLIFPP

SEQ ID NO: 376173 - protein, 25 aa, Mycobacterium
AITAVALGWYYLQIPTAMGIGQYTL

SEQ ID NO: 376174 - protein, 17 aa, Mycobacterium
AITFLHFAKLPAMLFGV

SEQ ID NO: 376175 - protein, 25 aa, Mycobacterium
AITHDPWLIPPLAASAALVVGGAHF

SEQ ID NO: 376176 - protein, 17 aa, Mycobacterium
AITILPAHLLWLIERRH

SEQ ID NO: 376177 - protein, 23 aa, Mycobacterium
AITLIFIVMLVITRALFASFVII

SEQ ID NO: 376178 - protein, 27 aa, Mycobacterium
AITTLVLWDLFGQLPLPLGVAGHEGST

SEQ ID NO: 376179 - protein, 24 aa, Mycobacterium
AITWRLSFLWLAVAGLLLTLALAR

SEQ ID NO: 376180 - protein, 21 aa, Mycobacterium
AKAFLRFNLHLLFASTLPPRV

SEQ ID NO: 376181 - protein, 21 aa, Mycobacterium
AKFVLNVYPRYLPLIPENVDA

SEQ ID NO: 376182 - protein, 32 aa, Mycobacterium
AKGEQRKWLRRVWLALPLGLLSMAAPMLFGGA

SEQ ID NO: 376183 - protein, 26 aa, Mycobacterium
AKGRRTVWIPWALGPAAAVMRLLPAF

SEQ ID NO: 376184 - protein, 17 aa, Mycobacterium
AKILGRWFWWPQRVRPR

SEQ ID NO: 376185 - protein, 21 aa, Mycobacterium
AKLFAALFLILALVVIGEVAG

SEQ ID NO: 376186 - protein, 17 aa, Mycobacterium
AKLFTALFLILGLVVVG

SEQ ID NO: 376187 - protein, 23 aa, Mycobacterium
AKSALASWLPPGPAPVADYPTVL

SEQ ID NO: 376188 - protein, 25 aa, Mycobacterium
AKVWGFLFIYFWLRATLPRLRYDQF

SEQ ID NO: 376189 - protein, 22 aa, Mycobacterium
ALAARRVLWLFKLITSGKPAPG

SEQ ID NO: 376190 - protein, 23 aa, Mycobacterium
ALACLVYESLIGRPPYEAGDLRQ

SEQ ID NO: 376191 - protein, 19 aa, Mycobacterium
ALAFLSIGALIYFLHHLMH

SEQ ID NO: 376192 - protein, 21 aa, Mycobacterium
ALAILVMVVWVGTALTISTTA

SEQ ID NO: 376193 - protein, 23 aa, Mycobacterium
ALALFKFFTPWGRQFWRITSEYF

SEQ ID NO: 376194 - protein, 25 aa, Mycobacterium
ALALFMVVSLTLTWLVYVSLRRDVA

SEQ ID NO: 376195 - protein, 22 aa, Mycobacterium
ALALLGVRRYVFARPPLLGPSG

SEQ ID NO: 376196 - protein, 22 aa, Mycobacterium
ALALLGVRRYVFKRPPLLSPSG

SEQ ID NO: 376197 - protein, 24 aa, Mycobacterium
ALAPILIFGILLSAVTVPYVALGP

SEQ ID NO: 376198 - protein, 18 aa, Mycobacterium
ALAPNRLPRKRLRVAGMT

SEQ ID NO: 376199 - protein, 25 aa, Mycobacterium
ALAQYRALILSRVRLFLIGVPILIG

SEQ ID NO: 376200 - protein, 24 aa, Mycobacterium
ALAYLLLPQVFFYGLSSLFMAILN

SEQ ID NO: 376201 - protein, 23 aa, Mycobacterium
ALCLIFIIMLIITRGFVASLVIV

SEQ ID NO: 376202 - protein, 24 aa, Mycobacterium
ALCLIFIIMLIITRSFIAALVIVG

SEQ ID NO: 376203 - protein, 18 aa, Mycobacterium
ALELLRSAFIPWLVTINP

SEQ ID NO: 376204 - protein, 24 aa, Mycobacterium
ALFAAFLLGLFYLVAVARVVEIGD

SEQ ID NO: 376205 - protein, 17 aa, Mycobacterium
ALFFYLVLKMLSENALL

SEQ ID NO: 376206 - protein, 17 aa, Mycobacterium
ALFIDWLARLIEMVAAP

SEQ ID NO: 376207 - protein, 19 aa, Mycobacterium
ALFLYALWVGVLGFPRSEF

SEQ ID NO: 376208 - protein, 18 aa, Mycobacterium
ALGALLMLPGVRGLGPGP

SEQ ID NO: 376209 - protein, 19 aa, Mycobacterium
ALGALLWRGLSPELTPRTQ

SEQ ID NO: 376210 - protein, 17 aa, Mycobacterium
ALGFLPAYLLSLGLKKA

SEQ ID NO: 376211 - protein, 24 aa, Mycobacterium
ALGLIFIIMLILTRAVVAAAVIVG

SEQ ID NO: 376212 - protein, 24 aa, Mycobacterium
ALGLLLMWILSWLTTTPVKVVCAA

SEQ ID NO: 376213 - protein, 23 aa, Mycobacterium
ALGLYLVAALLVWVQARLLNVTV

SEQ ID NO: 376214 - protein, 25 aa, Mycobacterium
ALGMGALWLPWGWVAHRLLSAPLSA

SEQ ID NO: 376215 - protein, 19 aa, Mycobacterium
ALGSIFWHALRPDDAPRTQ

SEQ ID NO: 376216 - protein, 18 aa, Mycobacterium
ALGVFLVLAGIYIAVRYE

SEQ ID NO: 376217 - protein, 25 aa, Mycobacterium
ALIEWAWRLPFLMSLILVGLALYVH

SEQ ID NO: 376218 - protein, 23 aa, Mycobacterium
ALIFFRYLWAFELTSALLITAAI

SEQ ID NO: 376219 - protein, 23 aa, Mycobacterium
ALILIFIIMMVLTRAVVAAAVIV

SEQ ID NO: 376220 - protein, 24 aa, Mycobacterium
ALILIFLIMVLLTRAVVAAAVIVG

SEQ ID NO: 376221 - protein, 19 aa, Mycobacterium
ALITLLMTALWVLAVVARP

SEQ ID NO: 376222 - protein, 17 aa, Mycobacterium
ALKRTWIALVILAVVVI

SEQ ID NO: 376223 - protein, 18 aa, Mycobacterium
ALLAAPRWFSELTGLPVA

SEQ ID NO: 376224 - protein, 19 aa, Mycobacterium
ALLAFMLLTAGTAVFVAAE

SEQ ID NO: 376225 - protein, 17 aa, Mycobacterium
ALLFLLTGSVLLPAKAL

SEQ ID NO: 376226 - protein, 28 aa, Mycobacterium
ALLFPGAHGWITYLWVPPFASEKVRRRL

SEQ ID NO: 376227 - protein, 23 aa, Mycobacterium
ALLGRWFWWPINVRTRPARARPV

SEQ ID NO: 376228 - protein, 17 aa, Mycobacterium
ALLLDWGFAPMTVGSRP

SEQ ID NO: 376229 - protein, 21 aa, Mycobacterium
ALLLGVFFWFTVIGGITVVLS

SEQ ID NO: 376230 - protein, 17 aa, Mycobacterium
ALLLIPCLLLAWAVAHP

SEQ ID NO: 376231 - protein, 24 aa, Mycobacterium
ALLLISIVFGFTWWLGGRLGLEDK

SEQ ID NO: 376232 - protein, 17 aa, Mycobacterium
ALLMCSLLFALPINARL

SEQ ID NO: 376233 - protein, 19 aa, Mycobacterium
ALLMLGLWLAGWGAARLVA

SEQ ID NO: 376234 - protein, 18 aa, Mycobacterium
ALLPLFLVTDILAAFPIL

SEQ ID NO: 376235 - protein, 25 aa, Mycobacterium
ALLRALWVILGWRPVLLVPLTFALF

SEQ ID NO: 376236 - protein, 23 aa, Mycobacterium
ALLRGLVAIFWYGIQTYLASTAV

SEQ ID NO: 376237 - protein, 27 aa, Mycobacterium
ALLSVALFFIWMIAVAFLYLVLGGMGV

SEQ ID NO: 376238 - protein, 24 aa, Mycobacterium
ALMAIPLWIIIVLPVAKILATSLS

SEQ ID NO: 376239 - protein, 19 aa, Mycobacterium
ALMFGFYVTCFVFVFGVLG

SEQ ID NO: 376240 - protein, 19 aa, Mycobacterium
ALMMILLVLLVMLAAVVFV

SEQ ID NO: 376241 - protein, 24 aa, Mycobacterium
ALMRLQSPALPFFTPLAPVAGVPD

SEQ ID NO: 376242 - protein, 17 aa, Mycobacterium
ALMWTIVLALSGPAPLW

SEQ ID NO: 376243 - protein, 20 aa, Mycobacterium
ALPFAIWFFLAVEGVPLAAE

SEQ ID NO: 376244 - protein, 21 aa, Mycobacterium
ALPHLGLIPLFIVWFGIGELP

SEQ ID NO: 376245 - protein, 24 aa, Mycobacterium
ALQKLVFRILIGVLWLAPIGAFGA

SEQ ID NO: 376246 - protein, 37 aa, Mycobacterium
ALQLYDFLWYPYYASYGLLLLPFFTPALSALSALSAL

SEQ ID NO: 376247 - protein, 26 aa, Mycobacterium
ALQVKWLIPIFWIATLIAVGCLGPRE

SEQ ID NO: 376248 - protein, 22 aa, Mycobacterium
ALRCWPFALLVLLAVALIALAA

SEQ ID NO: 376249 - protein, 17 aa, Mycobacterium
ALRLLTRFWPGPEKPGE

SEQ ID NO: 376250 - protein, 19 aa, Mycobacterium
ALSFAIGALLPLIAILAPP

SEQ ID NO: 376251 - protein, 19 aa, Mycobacterium
ALTALFVTWYFSRRLQHSI

SEQ ID NO: 376252 - protein, 24 aa, Mycobacterium
ALTLIFLIMLLLTRSVVAALVIVG

SEQ ID NO: 376253 - protein, 34 aa, Mycobacterium
ALTLRLLTIAFCVLLYLLPLILGRWRGETTHDRR

SEQ ID NO: 376254 - protein, 18 aa, Mycobacterium
ALTMLIAIIVVLWVSRTD

SEQ ID NO: 376255 - protein, 24 aa, Mycobacterium
ALTTPILLWGGYPFHRAALVNARH

SEQ ID NO: 376256 - protein, 24 aa, Mycobacterium
ALVAKLTHLYRPIPVRIDVTAAAQ

SEQ ID NO: 376257 - protein, 19 aa, Mycobacterium
ALVFLTYIYVIVTTLIAFR

SEQ ID NO: 376258 - protein, 23 aa, Mycobacterium
ALVLFALFWVLVPLLLRTRDVQL

SEQ ID NO: 376259 - protein, 21 aa, Mycobacterium
ALVLGWLIAVLIRLATGSATV

SEQ ID NO: 376260 - protein, 24 aa, Mycobacterium
ALVPAIRWPMWLRTLLATVALAAI

SEQ ID NO: 376261 - protein, 23 aa, Mycobacterium
ALVPYIRWPMWLRTIAATVGLAI

SEQ ID NO: 376262 - protein, 24 aa, Mycobacterium
ALVTILILVLVYLQFRGDFLPRTQ

SEQ ID NO: 376263 - protein, 25 aa, Mycobacterium
ALVWFPLWFVILGIGWALVRRRPGH

SEQ ID NO: 376264 - protein, 18 aa, Mycobacterium
ALVYLYTVVLFAPVLIVL

SEQ ID NO: 376265 - protein, 19 aa, Mycobacterium
ALWVPIVLLVPLGLVLMLA

SEQ ID NO: 376266 - protein, 21 aa, Mycobacterium
ALYGLRTSLFGAPPAVRTDPV

SEQ ID NO: 376267 - protein, 21 aa, Mycobacterium
ALYLGALLRLPRWLLDLSPVG

SEQ ID NO: 376268 - protein, 17 aa, Mycobacterium
ALYLLFDLPLLVGGIIT

SEQ ID NO: 376269 - protein, 18 aa, Mycobacterium
ALYLLFDLPLLVGGLITG

SEQ ID NO: 376270 - protein, 18 aa, Mycobacterium
ALYLLITIAPFAVIAPLI

SEQ ID NO: 376271 - protein, 17 aa, Mycobacterium
ALYLLITIAPFAVVAPL

SEQ ID NO: 376272 - protein, 19 aa, Mycobacterium
ALYVTALLFILAWATSGLN

SEQ ID NO: 376273 - protein, 18 aa, Mycobacterium
ALYVVASLLIWTQARLLN

SEQ ID NO: 376274 - protein, 17 aa, Mycobacterium
ALYYVMLTFVARPYLIP

SEQ ID NO: 376275 - protein, 30 aa, Mycobacterium
AMAPPLQFTYWQWLSLTLAAPVVVWGAWPF

SEQ ID NO: 376276 - protein, 22 aa, Mycobacterium
AMARNPVFLAFPLMMLVSALAS

SEQ ID NO: 376277 - protein, 27 aa, Mycobacterium
AMAYSLYLWHWPLLIFWLAYSGHTQAN

SEQ ID NO: 376278 - protein, 28 aa, Mycobacterium
AMAYSLYLWHWPLLIFWLSFTGHRHAGF

SEQ ID NO: 376279 - protein, 29 aa, Mycobacterium
AMAYSLYLWHWPLLIFWLSYTGHKHATFL

SEQ ID NO: 376280 - protein, 28 aa, Mycobacterium
AMAYSLYLWHWPLLIFWLSYTGHRHANF

SEQ ID NO: 376281 - protein, 31 aa, Mycobacterium
AMAYSLYLWHWPLLIFWLSYTGHRQANFLEG

SEQ ID NO: 376282 - protein, 28 aa, Mycobacterium
AMAYSLYLWHWPLLIFYLAYTGGTRVNF

SEQ ID NO: 376283 - protein, 23 aa, Mycobacterium
AMCLIFIIMLIVTRSFIAALVIV

SEQ ID NO: 376284 - protein, 23 aa, Mycobacterium
AMEALACLVLWTAKVLPPAEFYP

SEQ ID NO: 376285 - protein, 26 aa, Mycobacterium
AMFAQWNWWLPPWLSRILPSVDFDRP

SEQ ID NO: 376286 - protein, 23 aa, Mycobacterium
AMFKWPFPWREFLLQSWFVARVS

SEQ ID NO: 376287 - protein, 26 aa, Mycobacterium
AMFSQWNWWLPRWLARMLPSVDFDRP

SEQ ID NO: 376288 - protein, 25 aa, Mycobacterium
AMGLDAWRWMFLAMAVPAVLYGALA

SEQ ID NO: 376289 - protein, 23 aa, Mycobacterium
AMGWPVFLLTSTLIYLAIRTAMR

SEQ ID NO: 376290 - protein, 17 aa, Mycobacterium
AMLIYRLISWLFIAAIG

SEQ ID NO: 376291 - protein, 22 aa, Mycobacterium
AMLLGRFLPIIFTLALAGSLAT

SEQ ID NO: 376292 - protein, 17 aa, Mycobacterium
AMLLVYAVVWYALSQTA

SEQ ID NO: 376293 - protein, 19 aa, Mycobacterium
AMLVLVGCLIYLLATTARN

SEQ ID NO: 376294 - protein, 18 aa, Mycobacterium
AMTFGWVWLIKRVLAGLR

SEQ ID NO: 376295 - protein, 17 aa, Mycobacterium
AMWIIGMVAAIGLALWI

SEQ ID NO: 376296 - protein, 19 aa, Mycobacterium
AMWMPIMLFFYMGFEHSIV

SEQ ID NO: 376297 - protein, 19 aa, Mycobacterium
ANILMLVLLLAGFGWMISS

SEQ ID NO: 376298 - protein, 19 aa, Mycobacterium
ANLFPFQLFLVLYGLPVAD

SEQ ID NO: 376299 - protein, 24 aa, Mycobacterium
ANPAHYFILFGLFLLFIAGTLAMV

SEQ ID NO: 376300 - protein, 28 aa, Mycobacterium
ANSVLLLFGLLLPWLGALAVLGGLGYGI

SEQ ID NO: 376301 - protein, 19 aa, Mycobacterium
APAPMPWYPTAPAPARPRR

SEQ ID NO: 376302 - protein, 22 aa, Mycobacterium
APAQLWAFWLAPLVGAAIAGVA

SEQ ID NO: 376303 - protein, 27 aa, Mycobacterium
APARSTPRLPRWWPPAAIGLAAAIVVT

SEQ ID NO: 376304 - protein, 27 aa, Mycobacterium
APESLYPALLGFILLSAVAATLLVAMI

SEQ ID NO: 376305 - protein, 20 aa, Mycobacterium
APEVFWPLRRVGAAFHAAQD

SEQ ID NO: 376306 - protein, 19 aa, Mycobacterium
APFRFAIFHLLVWGTFTIL

SEQ ID NO: 376307 - protein, 19 aa, Mycobacterium
APITLLRLLYTAGAAATVP

SEQ ID NO: 376308 - protein, 23 aa, Mycobacterium
APLLATMFDFFYQPGKMPASLAD

SEQ ID NO: 376309 - protein, 17 aa, Mycobacterium
APLLVFGAGVLQAVLIA

SEQ ID NO: 376310 - protein, 20 aa, Mycobacterium
APLWPFHRWLPDAAVEATPA

SEQ ID NO: 376311 - protein, 18 aa, Mycobacterium
APLWPFHRWLPDAAVEST

SEQ ID NO: 376312 - protein, 19 aa, Mycobacterium
APLWPLHTWLPDAAVHATP

SEQ ID NO: 376313 - protein, 27 aa, Mycobacterium
APNFLIPQLFQELFDYLWGFRTFDTSK

SEQ ID NO: 376314 - protein, 27 aa, Mycobacterium
APPIDWRALLRQLPLLNILGVVAVLVA

SEQ ID NO: 376315 - protein, 20 aa, Mycobacterium
APPTLWVWIALSGTAFGVLV

SEQ ID NO: 376316 - protein, 17 aa, Mycobacterium
APQARWIRPAYWAMLVG

SEQ ID NO: 376317 - protein, 17 aa, Mycobacterium
APQGLEYVLAFLGALQA

SEQ ID NO: 376318 - protein, 17 aa, Mycobacterium
APRSLWVWIAISGATVV

SEQ ID NO: 376319 - protein, 20 aa, Mycobacterium
APSQPLFVPPAPPAVLPPGQ

SEQ ID NO: 376320 - protein, 18 aa, Mycobacterium
APTLWGWRRTPVLRWFVL

SEQ ID NO: 376321 - protein, 23 aa, Mycobacterium
APTLWGWRRTPVLRWFVLGAGVG

SEQ ID NO: 376322 - protein, 24 aa, Mycobacterium
APTTLAILVLLPLAAFEASTALPA

SEQ ID NO: 376323 - protein, 28 aa, Mycobacterium
APVAIATPAYWGPAALGALRGALRNKPA

SEQ ID NO: 376324 - protein, 27 aa, Mycobacterium
APVAILSIVGFLFVLGGLFGNPFAAAV

SEQ ID NO: 376325 - protein, 26 aa, Mycobacterium
APVGTRQLLLVNLLTDMFPALAVAIT

SEQ ID NO: 376326 - protein, 24 aa, Mycobacterium
APVLDAIKFNYFPFGLNAFNTAEV

SEQ ID NO: 376327 - protein, 18 aa, Mycobacterium
APVLPFRASGTDAPLFCV

SEQ ID NO: 376328 - protein, 24 aa, Mycobacterium
APWPALWLVLVVIALWSTAFGGVP

SEQ ID NO: 376329 - protein, 24 aa, Mycobacterium
AQDRTWFVFLLLPSFLVYVVSMVG

SEQ ID NO: 376330 - protein, 28 aa, Mycobacterium
AQLTVRGWLALVLWIMGATVLLGAVVGG

SEQ ID NO: 376331 - protein, 24 aa, Mycobacterium
AQQLKLLRAAFIPWLATINPDNDQ

SEQ ID NO: 376332 - protein, 27 aa, Mycobacterium
AQYLAPILDSIKFNYLPFGANLFSTAE

SEQ ID NO: 376333 - protein, 24 aa, Mycobacterium
ARAFGWLWQALAATLVAAVFAAAV

SEQ ID NO: 376334 - protein, 28 aa, Mycobacterium
ARDLLSAEIWIVLVLLVVCIGLELHGPE

SEQ ID NO: 376335 - protein, 19 aa, Mycobacterium
AREGYPAVIWLLLGGNLVV

SEQ ID NO: 376336 - protein, 24 aa, Mycobacterium
ARGRLITMLLIGVVLLGLGYSGGL

SEQ ID NO: 376337 - protein, 22 aa, Mycobacterium
ARGRLITMLLVGVVLLASTYSG

SEQ ID NO: 376338 - protein, 22 aa, Mycobacterium
ARIARLSIVVKVAALLIVFGFA

SEQ ID NO: 376339 - protein, 24 aa, Mycobacterium
ARILGPWFWWPRVVRWRPAHASGA

SEQ ID NO: 376340 - protein, 22 aa, Mycobacterium
ARKRIAWLLLLGNMVLAAFLNA

SEQ ID NO: 376341 - protein, 25 aa, Mycobacterium
ARLVHTLIFTALRIAFLAVLVGTTL

SEQ ID NO: 376342 - protein, 27 aa, Mycobacterium
ARLWRALLVFFSKWWQLESLYRSNMKY

SEQ ID NO: 376343 - protein, 18 aa, Mycobacterium
ARLYPFQVFLDLYGLPLQ

SEQ ID NO: 376344 - protein, 18 aa, Mycobacterium
ARMRVIVLLALVVGLEGA

SEQ ID NO: 376345 - protein, 18 aa, Mycobacterium
ARNHRWFLIANYGAARVG

SEQ ID NO: 376346 - protein, 21 aa, Mycobacterium
ARNHRWFLVSLYGAARVGARI

SEQ ID NO: 376347 - protein, 17 aa, Mycobacterium
ARPYLIPSESMEPTLHG

SEQ ID NO: 376348 - protein, 26 aa, Mycobacterium
ARRGRSRLLFGALAILLCLVLGVAIV

SEQ ID NO: 376349 - protein, 17 aa, Mycobacterium
ARRLAWISLAVLVTEGA

SEQ ID NO: 376350 - protein, 27 aa, Mycobacterium
ARRRRLLAIAMLLLLVPLATGCLRVRA

SEQ ID NO: 376351 - protein, 17 aa, Mycobacterium
ARRRTKRPWVFAGAAVA

SEQ ID NO: 376352 - protein, 24 aa, Mycobacterium
ARRSWGWVIAVVLVIAALVAIAIL

SEQ ID NO: 376353 - protein, 24 aa, Mycobacterium
ARRTRTPWLLAVAVLVVVIVVVGT

SEQ ID NO: 376354 - protein, 24 aa, Mycobacterium
ARRWAGLVAPLLRFLAIVTKPVIW

SEQ ID NO: 376355 - protein, 24 aa, Mycobacterium
ARSGDRWLWWNLGDVVRRASNVTV

SEQ ID NO: 376356 - protein, 28 aa, Mycobacterium
ARTAPGFLPWHLRLLIRLGAAVSVVLPG

SEQ ID NO: 376357 - protein, 23 aa, Mycobacterium
ARTKLFVTLFLILALVVVGEIAG

SEQ ID NO: 376358 - protein, 20 aa, Mycobacterium
ARWAVALVCAMLVAVAATCS

SEQ ID NO: 376359 - protein, 18 aa, Mycobacterium
ARWPGPVLVAAALVLLIC

SEQ ID NO: 376360 - protein, 18 aa, Mycobacterium
ARWRPAWIGWWLGIAVAA

SEQ ID NO: 376361 - protein, 28 aa, Mycobacterium
ARWSAPLQLMFSFLALPLIRLTNGTANW

SEQ ID NO: 376362 - protein, 18 aa, Mycobacterium
ARWWVPEPRWAGGWLGLE

SEQ ID NO: 376363 - protein, 19 aa, Mycobacterium
ASAALIWRRPRWGRRLQPG

SEQ ID NO: 376364 - protein, 17 aa, Mycobacterium
ASAFWRLRREHVRLVAV

SEQ ID NO: 376365 - protein, 17 aa, Mycobacterium
ASAIWFLGLGLGAKRLA

SEQ ID NO: 376366 - protein, 21 aa, Mycobacterium
ASALWLMRGWLPALVAVIAVC

SEQ ID NO: 376367 - protein, 17 aa, Mycobacterium
ASELRRRYRQGRLAREV

SEQ ID NO: 376368 - protein, 23 aa, Mycobacterium
ASFGVAPLLLWQLATRHFTNITV

SEQ ID NO: 376369 - protein, 22 aa, Mycobacterium
ASFPPWGFWWAAFPALSVLGLV

SEQ ID NO: 376370 - protein, 17 aa, Mycobacterium
ASFVFRHRAGNAVILVL

SEQ ID NO: 376371 - protein, 23 aa, Mycobacterium
ASGPFFKVVLHNLALYQISQPWV

SEQ ID NO: 376372 - protein, 26 aa, Mycobacterium
ASGYVLWWAVLFPAISVPIIASLVLA

SEQ ID NO: 376373 - protein, 26 aa, Mycobacterium
ASHGSPWLLPLRWSLVEYYYLKYYIP

SEQ ID NO: 376374 - protein, 21 aa, Mycobacterium
ASHMLMIGYFLLSGALFFTAV

SEQ ID NO: 376375 - protein, 17 aa, Mycobacterium
ASHSWALAPRRQSPPPY

SEQ ID NO: 376376 - protein, 25 aa, Mycobacterium
ASLAGRFLVFQLLVVAVVLGAVAAI

SEQ ID NO: 376377 - protein, 25 aa, Mycobacterium
ASLCLIFIIMLLITRGVVASAVIVG

SEQ ID NO: 376378 - protein, 24 aa, Mycobacterium
ASLILIFLIMVVLTRAIVAAAVIV

SEQ ID NO: 376379 - protein, 21 aa, Mycobacterium
ASLIWRFGVPLVCALAGFLLA

SEQ ID NO: 376380 - protein, 18 aa, Mycobacterium
ASLTLLPALIALAGRYGL

SEQ ID NO: 376381 - protein, 23 aa, Mycobacterium
ASLVRSFWQFGPTPAMLLAASAI

SEQ ID NO: 376382 - protein, 24 aa, Mycobacterium
ASRVLLLQLVLVTLTLVVAFALFA

SEQ ID NO: 376383 - protein, 27 aa, Mycobacterium
ASSATLVFGLLLIAISAWLTATPVRLV

SEQ ID NO: 376384 - protein, 18 aa, Mycobacterium
ASTLWWTLLMRPETQMWQ

SEQ ID NO: 376385 - protein, 21 aa, Mycobacterium
ASTRRALLLTALGGLLIAGLI

SEQ ID NO: 376386 - protein, 26 aa, Mycobacterium
ASVGMLLVWLLLYLRVSAPINHQLIA

SEQ ID NO: 376387 - protein, 25 aa, Mycobacterium
ASWAPWIWFMLLSGVVLMALFVYWQ

SEQ ID NO: 376388 - protein, 23 aa, Mycobacterium
ASWAVVIVLFWLNRMFVSRRPQT

SEQ ID NO: 376389 - protein, 19 aa, Mycobacterium
ASWMMPKMISPIRTAINTP

SEQ ID NO: 376390 - protein, 19 aa, Mycobacterium
ASYAPWRTLLPAGLAAGFA

SEQ ID NO: 376391 - protein, 18 aa, Mycobacterium
ASYLLIGFWYHKPTAATA

SEQ ID NO: 376392 - protein, 26 aa, Mycobacterium
ATACGVLMSVWWWRRKWPSRNQSWLV

SEQ ID NO: 376393 - protein, 24 aa, Mycobacterium
ATAFAFAPWYFFLTRFFTGSGIGG

SEQ ID NO: 376394 - protein, 20 aa, Mycobacterium
ATAFWVCGLLLCLFIGPSQS

SEQ ID NO: 376395 - protein, 23 aa, Mycobacterium
ATAILFPMYFLKSFAYAGVATVA

SEQ ID NO: 376396 - protein, 24 aa, Mycobacterium
ATASKLLYLRVPALNALFPNYRGS

SEQ ID NO: 376397 - protein, 21 aa, Mycobacterium
ATFAIWWAWMNFTWFASAYDT

SEQ ID NO: 376398 - protein, 25 aa, Mycobacterium
ATFTVIIVLMLFFFRSVPTVLVLLG

SEQ ID NO: 376399 - protein, 27 aa, Mycobacterium
ATGADPLLAWMFWTGLLITAADVLIAL

SEQ ID NO: 376400 - protein, 23 aa, Mycobacterium
ATGAMSHIKLALIAGLVGVLALA

SEQ ID NO: 376401 - protein, 24 aa, Mycobacterium
ATHMLMIGYFLLSGALFFTAVGGV

SEQ ID NO: 376402 - protein, 22 aa, Mycobacterium
ATLGSWRWIFIVNIPIGIVGFV

SEQ ID NO: 376403 - protein, 18 aa, Mycobacterium
ATLLFFRYRWLRAEPLPT

SEQ ID NO: 376404 - protein, 21 aa, Mycobacterium
ATLLGRWFWWPLRVRPRPASQ

SEQ ID NO: 376405 - protein, 19 aa, Mycobacterium
ATLLGRWFWWPQVVHPRGD

SEQ ID NO: 376406 - protein, 19 aa, Mycobacterium
ATLLLFVLPLCTPVGPIAD

SEQ ID NO: 376407 - protein, 17 aa, Mycobacterium
ATLVYFPVAHWIFAVEG

SEQ ID NO: 376408 - protein, 19 aa, Mycobacterium
ATMWLLMLGQVSAAGIGGA

SEQ ID NO: 376409 - protein, 28 aa, Mycobacterium
ATPARRARWLLWALISWPRVAKACGLST

SEQ ID NO: 376410 - protein, 24 aa, Mycobacterium
ATPVLWWVGPLLLYVLLPILDLFF

SEQ ID NO: 376411 - protein, 20 aa, Mycobacterium
ATQLTLLRYLLGQLRLSEPD

SEQ ID NO: 376412 - protein, 18 aa, Mycobacterium
ATRWGPMLQWILVAAAGA

SEQ ID NO: 376413 - protein, 24 aa, Mycobacterium
ATSFPLQVPWLPLVAPVAVVAIYV

SEQ ID NO: 376414 - protein, 22 aa, Mycobacterium
ATTFPWVFLFPAGVLVLIILCS

SEQ ID NO: 376415 - protein, 25 aa, Mycobacterium
AVAAIVAVLVWGVGANLGWWKGLAG

SEQ ID NO: 376416 - protein, 25 aa, Mycobacterium
AVAALLGRWFWWPQKFRSAASERRL

SEQ ID NO: 376417 - protein, 23 aa, Mycobacterium
AVADLIWLLCDYVLHIEPFPSPA

SEQ ID NO: 376418 - protein, 27 aa, Mycobacterium
AVAGAFLLAALLFTIGRLRMARKALRG

SEQ ID NO: 376419 - protein, 37 aa, Mycobacterium
AVAGWLVHWPWFFGVSVWLIVIFGTSFGWRVLTPVLR

SEQ ID NO: 376420 - protein, 21 aa, Mycobacterium
AVALLPISWPLGIAALGGVPL

SEQ ID NO: 376421 - protein, 26 aa, Mycobacterium
AVAVAIFWIVMRYRASRRRTNALAAA

SEQ ID NO: 376422 - protein, 17 aa, Mycobacterium
AVAWVILALRSGRLGVD

SEQ ID NO: 376423 - protein, 24 aa, Mycobacterium
AVDGVSWRILLEDLNIAWAQHCTG

SEQ ID NO: 376424 - protein, 21 aa, Mycobacterium
AVFLLVLPLLLSLFAHAVPGK

SEQ ID NO: 376425 - protein, 18 aa, Mycobacterium
AVFVLAVRFVFYGVPFPG

SEQ ID NO: 376426 - protein, 25 aa, Mycobacterium
AVGGTRWWSPRTWPLRARLVGTQVA

SEQ ID NO: 376427 - protein, 17 aa, Mycobacterium
AVGLAISWLLQRLGRRS

SEQ ID NO: 376428 - protein, 17 aa, Mycobacterium
AVGMLPILGWRSEFRWG

SEQ ID NO: 376429 - protein, 25 aa, Mycobacterium
AVGPLWLWVWVLLLPIAFGALWGAI

SEQ ID NO: 376430 - protein, 21 aa, Mycobacterium
AVHGFYYLLLRGWFEIVPVTE

SEQ ID NO: 376431 - protein, 18 aa, Mycobacterium
AVIFFSATFLGWYSGGHY

SEQ ID NO: 376432 - protein, 23 aa, Mycobacterium
AVIGYFVAGLLFVVAMLLLVRAG

SEQ ID NO: 376433 - protein, 17 aa, Mycobacterium
AVILWRFVGDTLSDRSD

SEQ ID NO: 376434 - protein, 20 aa, Mycobacterium
AVIPLLLWIAGVYDLLRNLR

SEQ ID NO: 376435 - protein, 26 aa, Mycobacterium
AVISGLLLNFLFVAPRYSFTIGETDN

SEQ ID NO: 376436 - protein, 17 aa, Mycobacterium
AVIWLAFVGMLVGAIVV

SEQ ID NO: 376437 - protein, 17 aa, Mycobacterium
AVKHPFWVRFWAGVSFA

SEQ ID NO: 376438 - protein, 19 aa, Mycobacterium
AVLAILLVVAIAVALREFE

SEQ ID NO: 376439 - protein, 19 aa, Mycobacterium
AVLATALRLMPRWAWRRVK

SEQ ID NO: 376440 - protein, 37 aa, Mycobacterium
AVLAVIMLFLYDLLWYPYYASYLLPFLIPALSGLSGL

SEQ ID NO: 376441 - protein, 21 aa, Mycobacterium
AVLAVIWFWLLKRYIVEGPLE

SEQ ID NO: 376442 - protein, 22 aa, Mycobacterium
AVLAWVVLPSLALLLAITAGVL

SEQ ID NO: 376443 - protein, 22 aa, Mycobacterium
AVLFAWLIHALAHPTPPEKGDS

SEQ ID NO: 376444 - protein, 24 aa, Mycobacterium
AVLGRWFWWPLQVRSRPGHVAPLP

SEQ ID NO: 376445 - protein, 17 aa, Mycobacterium
AVLLFPADPMTVLRTAR

SEQ ID NO: 376446 - protein, 17 aa, Mycobacterium
AVLLFPPDPVQILCDAR

SEQ ID NO: 376447 - protein, 17 aa, Mycobacterium
AVLLLAAGGIGAGGYLA

SEQ ID NO: 376448 - protein, 18 aa, Mycobacterium
AVLLNPLRWYPLASAAAD

SEQ ID NO: 376449 - protein, 22 aa, Mycobacterium
AVLLYSLLYYRALGVLIALSLV

SEQ ID NO: 376450 - protein, 25 aa, Mycobacterium
AVLLYSLLYYRVLGLLVALSLVAAG

SEQ ID NO: 376451 - protein, 21 aa, Mycobacterium
AVLMWILRRVPAPALRAVVGQ

SEQ ID NO: 376452 - protein, 17 aa, Mycobacterium
AVLPRRPFSAPGGPPAP

SEQ ID NO: 376453 - protein, 17 aa, Mycobacterium
AVLTAFLFLVFSDTRTG

SEQ ID NO: 376454 - protein, 22 aa, Mycobacterium
AVLVLLRFLTPWGRQYWRITRE

SEQ ID NO: 376455 - protein, 20 aa, Mycobacterium
AVLVVFLLPALRDGAPAVPV

SEQ ID NO: 376456 - protein, 18 aa, Mycobacterium
AVLVYFPVAHWVFAFDGV

SEQ ID NO: 376457 - protein, 21 aa, Mycobacterium
AVMHRFIPRYSPWPRHARAES

SEQ ID NO: 376458 - protein, 26 aa, Mycobacterium
AVMILLTVFLFFIFGQYRTGSTNGYS

SEQ ID NO: 376459 - protein, 18 aa, Mycobacterium
AVMLLFIYRSVVTAFLVL

SEQ ID NO: 376460 - protein, 19 aa, Mycobacterium
AVMLLFIYRSVVTAFLVLI

SEQ ID NO: 376461 - protein, 20 aa, Mycobacterium
AVMMLFLFVLMLIGVDLTES

SEQ ID NO: 376462 - protein, 18 aa, Mycobacterium
AVMMLFLFVLMMIGVDSS

SEQ ID NO: 376463 - protein, 21 aa, Mycobacterium
AVNWFWLLAFAIAAIIWAVMS

SEQ ID NO: 376464 - protein, 31 aa, Mycobacterium
AVPAIMGLLGRWFWWSPPPFLRASLAGPRRW

SEQ ID NO: 376465 - protein, 18 aa, Mycobacterium
AVPIILGWIAIIAVLNVS

SEQ ID NO: 376466 - protein, 26 aa, Mycobacterium
AVPIVIVMLLLIIPLGNLKLGGFSEK

SEQ ID NO: 376467 - protein, 21 aa, Mycobacterium
AVPIVLLWIGLVVVLSIFVPS

SEQ ID NO: 376468 - protein, 28 aa, Mycobacterium
AVPLQVISWLLMPISRLLVLLGNALTPG

SEQ ID NO: 376469 - protein, 24 aa, Mycobacterium
AVPLRVLSWLLMPLSRLLVVLGNA

SEQ ID NO: 376470 - protein, 19 aa, Mycobacterium
AVPVWRKVLRLLADKMTLV

SEQ ID NO: 376471 - protein, 22 aa, Mycobacterium
AVQAPWPLLRTFASGPALSREA

SEQ ID NO: 376472 - protein, 17 aa, Mycobacterium
AVRLRREGPIPWPEALE

SEQ ID NO: 376473 - protein, 19 aa, Mycobacterium
AVRRLTIGLLAVALAGLLV

SEQ ID NO: 376474 - protein, 28 aa, Mycobacterium
AVSGLPVLFLLLCALWCAGVAMLWAHGP

SEQ ID NO: 376475 - protein, 24 aa, Mycobacterium
AVSWFLRFLLRHSMYWFVGYRVVV

SEQ ID NO: 376476 - protein, 17 aa, Mycobacterium
AVTFLAMVFSKLAIFAS

SEQ ID NO: 376477 - protein, 23 aa, Mycobacterium
AVTVLLLWPLLIEPLLGNLPGRS

SEQ ID NO: 376478 - protein, 20 aa, Mycobacterium
AVTVPWWFLVAQLPFAGIVF

SEQ ID NO: 376479 - protein, 22 aa, Mycobacterium
AVTWLMRVGFFGAPLLVGVVAD

SEQ ID NO: 376480 - protein, 22 aa, Mycobacterium
AVTWWVIALLHLGRISPPFLDF

SEQ ID NO: 376481 - protein, 19 aa, Mycobacterium
AVVALLLIITYRSPVLWLV

SEQ ID NO: 376482 - protein, 17 aa, Mycobacterium
AVVGFIRKPAVTASLAG

SEQ ID NO: 376483 - protein, 26 aa, Mycobacterium
AVVGVQLLFSLLFTPAIRLTNGVANW

SEQ ID NO: 376484 - protein, 24 aa, Mycobacterium
AVVGVVIYGLIRWSRARTAPPPPA

SEQ ID NO: 376485 - protein, 19 aa, Mycobacterium
AVVILLVVTRYRARRRRAD

SEQ ID NO: 376486 - protein, 24 aa, Mycobacterium
AVVLIVLLVTAFLAPGWAVTTTLD

SEQ ID NO: 376487 - protein, 19 aa, Mycobacterium
AVVLIVLPLLTFGMAYMIV

SEQ ID NO: 376488 - protein, 26 aa, Mycobacterium
AVVLPQWLFSALFTPAIRLTNGAANW

SEQ ID NO: 376489 - protein, 27 aa, Mycobacterium
AVVMAVLTAFLFFIFGQYRTGATTGYS

SEQ ID NO: 376490 - protein, 22 aa, Mycobacterium
AVVPLLLATVFGVLRIDAAMAN

SEQ ID NO: 376491 - protein, 27 aa, Mycobacterium
AVVQPFRFLFMAFLWTIALTFEAGYYL

SEQ ID NO: 376492 - protein, 18 aa, Mycobacterium
AVVSFPRDLAIQPTLCEV

SEQ ID NO: 376493 - protein, 19 aa, Mycobacterium
AVVWTVALTRPAKVHEAVV

SEQ ID NO: 376494 - protein, 20 aa, Mycobacterium
AVVYFLIVLPYNRLRRKGEV

SEQ ID NO: 376495 - protein, 18 aa, Mycobacterium
AVWIERALVVLVAASPCA

SEQ ID NO: 376496 - protein, 17 aa, Mycobacterium
AVWLLLVIAIVHSSKPF

SEQ ID NO: 376497 - protein, 20 aa, Mycobacterium
AVWPLRWLRNAALAFTFLNA

SEQ ID NO: 376498 - protein, 23 aa, Mycobacterium
AWAFAVWILLTWTPTVENLLVGL

SEQ ID NO: 376499 - protein, 18 aa, Mycobacterium
AWLAIFALPLLFVAHRLP

SEQ ID NO: 376500 - protein, 21 aa, Mycobacterium
AWLFDMAMLAVLSIAYTAIVW

SEQ ID NO: 376501 - protein, 17 aa, Mycobacterium
AWLGTVAVVVVAVLVGA

SEQ ID NO: 376502 - protein, 17 aa, Mycobacterium
AWLPLFVVFGVLTGLLG

SEQ ID NO: 376503 - protein, 20 aa, Mycobacterium
AWPLLWFVVIGVVAAAIGYL

SEQ ID NO: 376504 - protein, 20 aa, Mycobacterium
AWRIGFWSNRWIIFGVAAQA

SEQ ID NO: 376505 - protein, 17 aa, Mycobacterium
AWRIMHAIPAAKAARRR

SEQ ID NO: 376506 - protein, 22 aa, Mycobacterium
AWSWRLLVILAALVALLLVIKK

SEQ ID NO: 376507 - protein, 22 aa, Mycobacterium
AWWFLFLVVVAGLVALYIVVQR

SEQ ID NO: 376508 - protein, 24 aa, Mycobacterium
AYDIALFYRYAWQNPVFADIVHTQ

SEQ ID NO: 376509 - protein, 25 aa, Mycobacterium
AYDIGLFYRYAWQNPIFADIVATRT

SEQ ID NO: 376510 - protein, 24 aa, Mycobacterium
AYDIGLFYRYAWQNPTFADIVATR

SEQ ID NO: 376511 - protein, 24 aa, Mycobacterium
AYDIGLFYRYAWQNPTFANIVATR

SEQ ID NO: 376512 - protein, 18 aa, Mycobacterium
AYFQLLVKALLMHGLREL

SEQ ID NO: 376513 - protein, 23 aa, Mycobacterium
AYGKVLFFITLSAGAVLFLLAGR

SEQ ID NO: 376514 - protein, 17 aa, Mycobacterium
AYRSWRWWLGATLGSMA

SEQ ID NO: 376515 - protein, 22 aa, Mycobacterium
AYSHNFYLWWLAKAGAVGMAAF

SEQ ID NO: 376516 - protein, 20 aa, Mycobacterium
AYVLLGFPLATVSFTVIVAM

SEQ ID NO: 376517 - protein, 18 aa, Mycobacterium
AYWLSRFGYLAVGVPLGA

SEQ ID NO: 376518 - protein, 23 aa, Mycobacterium
CAGQWALWWANGFSWIWMAVGLV

SEQ ID NO: 376519 - protein, 18 aa, Mycobacterium
CASFPTLNWWWAAVIAAA

SEQ ID NO: 376520 - protein, 17 aa, Mycobacterium
CGGFGVLSVLYLGYLRR

SEQ ID NO: 376521 - protein, 20 aa, Mycobacterium
CGLMLARWWGSEQLGLLVFV

SEQ ID NO: 376522 - protein, 23 aa, Mycobacterium
CGWAFLIWGLLLYLWSAVLYLMQ

SEQ ID NO: 376523 - protein, 17 aa, Mycobacterium
CGWAFLIWGLYAYLWAF

SEQ ID NO: 376524 - protein, 24 aa, Mycobacterium
CIAAILLARVFVRPIRRLEAGAQQ

SEQ ID NO: 376525 - protein, 20 aa, Mycobacterium
CLIFIIMLIITRSVVAAAVI

SEQ ID NO: 376526 - protein, 17 aa, Mycobacterium
CLWLMLNLTALTWIRFG

SEQ ID NO: 376527 - protein, 18 aa, Mycobacterium
CPLLVLGIWWRRLTVVGA

SEQ ID NO: 376528 - protein, 18 aa, Mycobacterium
CRHYWPVALLAAALSRHF

SEQ ID NO: 376529 - protein, 23 aa, Mycobacterium
CSGFWILMFPFMGELDFYHVDRW

SEQ ID NO: 376530 - protein, 23 aa, Mycobacterium
CTRLFRPVFYYLAFWAVALTVLY

SEQ ID NO: 376531 - protein, 24 aa, Mycobacterium
CVGLLLTLVVSVAYLLIGVLHVRP

SEQ ID NO: 376532 - protein, 30 aa, Mycobacterium
CVTADTRLYLPMPFFWVGGFGAGIVTALVA

SEQ ID NO: 376533 - protein, 20 aa, Mycobacterium
CVVLLILIALLRAVVAPLYL

SEQ ID NO: 376534 - protein, 24 aa, Mycobacterium
CVVSMLLAKLLVRPIRRLEAGTER

SEQ ID NO: 376535 - protein, 20 aa, Mycobacterium
CVWWGLWLITITGWVPLLTV

SEQ ID NO: 376536 - protein, 17 aa, Mycobacterium
CVWYFRRTLFSSARNLF

SEQ ID NO: 376537 - protein, 19 aa, Mycobacterium
CWAVTAGGIWWPIGRALAW

SEQ ID NO: 376538 - protein, 25 aa, Mycobacterium
DAAADVFAFLLRGIGFDADLLDDQR

SEQ ID NO: 376539 - protein, 31 aa, Mycobacterium
DAAELIAWSGLLLLALTALGGGIKLAMWGAR

SEQ ID NO: 376540 - protein, 20 aa, Mycobacterium
DAAVWWKALLALAVSLALIV

SEQ ID NO: 376541 - protein, 26 aa, Mycobacterium
DAEPPVPWYRKPAALVGLGALGAVLI

SEQ ID NO: 376542 - protein, 21 aa, Mycobacterium
DAGLFFIAFVRNPVTQFVPMQ

SEQ ID NO: 376543 - protein, 20 aa, Mycobacterium
DAGPIYLWLPGLMSILALAE

SEQ ID NO: 376544 - protein, 24 aa, Mycobacterium
DAGPLYFWLPFLTCLLALAELHLR

SEQ ID NO: 376545 - protein, 23 aa, Mycobacterium
DAGPLYFWLPFLTCLLALGELHL

SEQ ID NO: 376546 - protein, 24 aa, Mycobacterium
DAGTWLFDMGILGLLSLVMAGFVR

SEQ ID NO: 376547 - protein, 22 aa, Mycobacterium
DAIALYLGFIAVGWLLGYVMRA

SEQ ID NO: 376548 - protein, 21 aa, Mycobacterium
DALGALLWRSLYPDAAPRTQI

SEQ ID NO: 376549 - protein, 25 aa, Mycobacterium
DALLGWVWRIPFLASIFLIGVAVLI

SEQ ID NO: 376550 - protein, 24 aa, Mycobacterium
DALLTRLWPVPLLGVVVAIAAGLT

SEQ ID NO: 376551 - protein, 27 aa, Mycobacterium
DANYGAWWFWLGLILIVGILLLVGNLE

SEQ ID NO: 376552 - protein, 17 aa, Mycobacterium
DAQTRLMGLLPSGYPAG

SEQ ID NO: 376553 - protein, 18 aa, Mycobacterium
DARFLLPVLGVPPPNNAA

SEQ ID NO: 376554 - protein, 17 aa, Mycobacterium
DARNLWFVIITALALAL

SEQ ID NO: 376555 - protein, 25 aa, Mycobacterium
DATMIRMLIIFGIVTIVALVAATTA

SEQ ID NO: 376556 - protein, 26 aa, Mycobacterium
DAVLTALWAWILFAAGVGGGLILLHR

SEQ ID NO: 376557 - protein, 23 aa, Mycobacterium
DDALNLPWLAMGAIGFISVIGHL

SEQ ID NO: 376558 - protein, 24 aa, Mycobacterium
DDAMFSLLAFWFFAAGWAASKATS

SEQ ID NO: 376559 - protein, 19 aa, Mycobacterium
DDEFWMLLAGRKLSARDRR

SEQ ID NO: 376560 - protein, 24 aa, Mycobacterium
DDELFFFAVLLLVAGYESTAHMIS

SEQ ID NO: 376561 - protein, 22 aa, Mycobacterium
DDLRPYFAGYLPALLSAAIVTP

SEQ ID NO: 376562 - protein, 27 aa, Mycobacterium
DDQAPPWLWFLFAPLGAAFILLLAGAW

SEQ ID NO: 376563 - protein, 29 aa, Mycobacterium
DDRLLAVLPFFHIYGMTVLLNAALHARAQ

SEQ ID NO: 376564 - protein, 28 aa, Mycobacterium
DDSGPGIWKWIAIGLLALGIIGALLGVW

SEQ ID NO: 376565 - protein, 25 aa, Mycobacterium
DDVKASFDPLPPFLLQHMSGHYTNI

SEQ ID NO: 376566 - protein, 27 aa, Mycobacterium
DDVNPLLFPAMLLALTLLLASTIVVHF

SEQ ID NO: 376567 - protein, 18 aa, Mycobacterium
DEFWMLLAGRKLSARDRR

SEQ ID NO: 376568 - protein, 25 aa, Mycobacterium
DENNPLPPPWYPQPGPPPAPAPGVI

SEQ ID NO: 376569 - protein, 37 aa, Mycobacterium
DESKPFSWHWSWWWLVALIPVLLLAGLVVGAALWHRR

SEQ ID NO: 376570 - protein, 22 aa, Mycobacterium
DETKLPFCWRGVSLHAGGAGRV

SEQ ID NO: 376571 - protein, 18 aa, Mycobacterium
DFDDFWRPIRSYFYWDKH

SEQ ID NO: 376572 - protein, 17 aa, Mycobacterium
DFMNIMLAALLAAALWL

SEQ ID NO: 376573 - protein, 21 aa, Mycobacterium
DFQDFWRPIRNYLYWEPHCYD

SEQ ID NO: 376574 - protein, 21 aa, Mycobacterium
DFWLLAYWLVLGALMIYLLSY

SEQ ID NO: 376575 - protein, 32 aa, Mycobacterium
DGDLRFIITVTLIVVFLILAALLRSIIAPIYL

SEQ ID NO: 376576 - protein, 23 aa, Mycobacterium
DGDPTLLIMVWQNLLGNAVKFRR

SEQ ID NO: 376577 - protein, 27 aa, Mycobacterium
DGEIVLLLFLPAILYWESLNTSFREIR

SEQ ID NO: 376578 - protein, 27 aa, Mycobacterium
DGEIVLLLFLPAILYWESLNTSFRELR

SEQ ID NO: 376579 - protein, 23 aa, Mycobacterium
DGEKPKLHWLLDDYYDVPYGALV

SEQ ID NO: 376580 - protein, 20 aa, Mycobacterium
DGLRLPNWGTLKLALPKLDN

SEQ ID NO: 376581 - protein, 18 aa, Mycobacterium
DGLRPYFTGYLPALLLAA

SEQ ID NO: 376582 - protein, 25 aa, Mycobacterium
DGLRPYFTGYLPTLFLAAILTPATV

SEQ ID NO: 376583 - protein, 30 aa, Mycobacterium
DGLTPWIAAPLLFIGFMFGLLLLTGTTIRE

SEQ ID NO: 376584 - protein, 21 aa, Mycobacterium
DGQLYLVMPIINGVDLEVALQ

SEQ ID NO: 376585 - protein, 27 aa, Mycobacterium
DGRARAFGWLWQALAATLVAAVFAAAV

SEQ ID NO: 376586 - protein, 26 aa, Mycobacterium
DGRDMFWSLIPLVLACIVLAGLVGMC

SEQ ID NO: 376587 - protein, 28 aa, Mycobacterium
DGRLWQAVITLLFILLGGLLITSLSARR

SEQ ID NO: 376588 - protein, 24 aa, Mycobacterium
DHGLWVAFWFFLAQLNLILGAINL

SEQ ID NO: 376589 - protein, 25 aa, Mycobacterium
DHGLWVAFWFFLAQLNLILGAINLL

SEQ ID NO: 376590 - protein, 25 aa, Mycobacterium
DHGLWVAFWFFLAQLNLILGAINLV

SEQ ID NO: 376591 - protein, 18 aa, Mycobacterium
DHPGLLGANIYWLGEQWW

SEQ ID NO: 376592 - protein, 21 aa, Mycobacterium
DHPLRWLSLRSIVILSQLGVT

SEQ ID NO: 376593 - protein, 28 aa, Mycobacterium
DHVAQFRKLFWINLIIAVPVIAFSTMFA

SEQ ID NO: 376594 - protein, 17 aa, Mycobacterium
DIPMCWALRSVFDALDG

SEQ ID NO: 376595 - protein, 21 aa, Mycobacterium
DIYFTVDWLQAWWAHYGRQRN

SEQ ID NO: 376596 - protein, 25 aa, Mycobacterium
DIYSLGCTLYRLLTGHPPFPATNGA

SEQ ID NO: 376597 - protein, 22 aa, Mycobacterium
DKLFNPILLLALAALAIGSAST

SEQ ID NO: 376598 - protein, 20 aa, Mycobacterium
DLDTLLKRFGPLTPPRAVAI

SEQ ID NO: 376599 - protein, 30 aa, Mycobacterium
DLGFFAFDLPFYRFVLTYLFIAASIALIVN

SEQ ID NO: 376600 - protein, 24 aa, Mycobacterium
DLGLPAPVPAPWPILRTLPAGPEL

SEQ ID NO: 376601 - protein, 18 aa, Mycobacterium
DLIHLLAELLDNALRYSP

SEQ ID NO: 376602 - protein, 20 aa, Mycobacterium
DLLEPPPPPPPPIPAAPVAP

SEQ ID NO: 376603 - protein, 19 aa, Mycobacterium
DLPITYPYQGGFRDGGAMP

SEQ ID NO: 376604 - protein, 18 aa, Mycobacterium
DLPRLWQVLLIVGMFLWI

SEQ ID NO: 376605 - protein, 23 aa, Mycobacterium
DLRQYLRRSILPLLLVASLAVSG

SEQ ID NO: 376606 - protein, 26 aa, Mycobacterium
DLRRPVLGWVLFAGLIVWSAACATVY

SEQ ID NO: 376607 - protein, 17 aa, Mycobacterium
DLSLGLILALVPLALFG

SEQ ID NO: 376608 - protein, 21 aa, Mycobacterium
DLSVYLLYRRAIEDGTGELCD

SEQ ID NO: 376609 - protein, 19 aa, Mycobacterium
DLWRMMPYLLPYRGRWIVM

SEQ ID NO: 376610 - protein, 21 aa, Mycobacterium
DMTLRLWPGPAAWPDLLCDKL

SEQ ID NO: 376611 - protein, 17 aa, Mycobacterium
DMVVALFAVLRAGAAYL

SEQ ID NO: 376612 - protein, 27 aa, Mycobacterium
DPAAAVNNFILLFIGNGTATHPDAGLL

SEQ ID NO: 376613 - protein, 33 aa, Mycobacterium
DPAAERRTWLRRVWLAWPFGLLSAGLTMMAAPW

SEQ ID NO: 376614 - protein, 25 aa, Mycobacterium
DPAPAALWLWIMLTGTAAAVLVLGW

SEQ ID NO: 376615 - protein, 23 aa, Mycobacterium
DPAPFRLWLWIGVFATSVAVAAV

SEQ ID NO: 376616 - protein, 27 aa, Mycobacterium
DPDLVLFVILPPLLWSAGMESSYVALR

SEQ ID NO: 376617 - protein, 20 aa, Mycobacterium
DPEVRLLFSLGLRILERRRH

SEQ ID NO: 376618 - protein, 24 aa, Mycobacterium
DPGRQVIGLNLILSFSPAWTYVRD

SEQ ID NO: 376619 - protein, 23 aa, Mycobacterium
DPNPPLPAWLTPSPRVPGTGDPD

SEQ ID NO: 376620 - protein, 25 aa, Mycobacterium
DPNPPLPPWMAPAPPVPGTANSALP

SEQ ID NO: 376621 - protein, 23 aa, Mycobacterium
DPNPPLPPWMPPSPPVPLTANPA

SEQ ID NO: 376622 - protein, 21 aa, Mycobacterium
DPNPPLPPWQPYPMPRVPGTS

SEQ ID NO: 376623 - protein, 20 aa, Mycobacterium
DPPACSVGFLPPSSWRSPAD

SEQ ID NO: 376624 - protein, 18 aa, Mycobacterium
DPPACTVGFLPPSAWRSP

SEQ ID NO: 376625 - protein, 19 aa, Mycobacterium
DPPPCNVGFLPPPLIRSPA

SEQ ID NO: 376626 - protein, 23 aa, Mycobacterium
DPRALAVLNLLVALGLLTMAPPM

SEQ ID NO: 376627 - protein, 19 aa, Mycobacterium
DPTRLPYLLLPKIANRYGD

SEQ ID NO: 376628 - protein, 28 aa, Mycobacterium
DPVFRARLPLIRDLFVVLAYAASATSAL

SEQ ID NO: 376629 - protein, 25 aa, Mycobacterium
DQACFTVLAFWFFAAGWAAAKATQT

SEQ ID NO: 376630 - protein, 26 aa, Mycobacterium
DQDRYAEAAPLPWYKRAAVVFSLAAA

SEQ ID NO: 376631 - protein, 19 aa, Mycobacterium
DQFLLVQWLAPLASEAPEF

SEQ ID NO: 376632 - protein, 25 aa, Mycobacterium
DQIEAAFLLLWFLAALPVGALLGGW

SEQ ID NO: 376633 - protein, 23 aa, Mycobacterium
DQLFRFSRILDTQPRLAILLGDY

SEQ ID NO: 376634 - protein, 26 aa, Mycobacterium
DQNNPLPPPWYPQPGPPPAPAPGVVP

SEQ ID NO: 376635 - protein, 25 aa, Mycobacterium
DQTGLLYFWVPIVGPLIGALVGAAA

SEQ ID NO: 376636 - protein, 25 aa, Mycobacterium
DRAAGWLFWFALGTAAITAAAWSIV

SEQ ID NO: 376637 - protein, 25 aa, Mycobacterium
DRAAGWLFWFALGTAAITAVAWSIV

SEQ ID NO: 376638 - protein, 18 aa, Mycobacterium
DRARFHHLAFGSGIHRCL

SEQ ID NO: 376639 - protein, 18 aa, Mycobacterium
DRDALAPNRLPRKRLRVA

SEQ ID NO: 376640 - protein, 27 aa, Mycobacterium
DRDLVRPFRMPLWPLPPLLAVVGVVVT

SEQ ID NO: 376641 - protein, 23 aa, Mycobacterium
DREPRMWLWVLAALAVLVVVGLV

SEQ ID NO: 376642 - protein, 26 aa, Mycobacterium
DRGVSWLPFFHDMGLITVLLASVLGH

SEQ ID NO: 376643 - protein, 25 aa, Mycobacterium
DRGYTIFLAILPFLIGALSLTVKGP

SEQ ID NO: 376644 - protein, 25 aa, Mycobacterium
DRGYTVFLALLPFLIGTLTLTVRGK

SEQ ID NO: 376645 - protein, 22 aa, Mycobacterium
DRKWLTIALILIGGFMAIEVVI

SEQ ID NO: 376646 - protein, 17 aa, Mycobacterium
DRLGWPLWAAYIGVFAL

SEQ ID NO: 376647 - protein, 21 aa, Mycobacterium
DRTLLLWLLPLLVAPPMYSKD

SEQ ID NO: 376648 - protein, 23 aa, Mycobacterium
DRVFWLIVLLSLFSWMISSRIVR

SEQ ID NO: 376649 - protein, 19 aa, Mycobacterium
DRVLAAMVLLFFATAALLG

SEQ ID NO: 376650 - protein, 24 aa, Mycobacterium
DRWFNLLWLIPIGFALLIAGVAVG

SEQ ID NO: 376651 - protein, 21 aa, Mycobacterium
DRWFNLLWLIPIGFGLLIASV

SEQ ID NO: 376652 - protein, 27 aa, Mycobacterium
DRYAAWFLPLTLLVAGAAWLASGSPVR

SEQ ID NO: 376653 - protein, 18 aa, Mycobacterium
DRYLISLPLFHVAALAPL

SEQ ID NO: 376654 - protein, 24 aa, Mycobacterium
DSGWAFITILVLTLIQAGAALTVL

SEQ ID NO: 376655 - protein, 17 aa, Mycobacterium
DSLLKRFGPLTPPRAVA

SEQ ID NO: 376656 - protein, 22 aa, Mycobacterium
DSLRSWLRFLVLASAAPLAGAP

SEQ ID NO: 376657 - protein, 20 aa, Mycobacterium
DSMLLTIWLIIGAVTFGALL

SEQ ID NO: 376658 - protein, 17 aa, Mycobacterium
DSRLWIAIVVLTGLLAV

SEQ ID NO: 376659 - protein, 24 aa, Mycobacterium
DSVTWRVFLHPSVAPMIVLVTALL

SEQ ID NO: 376660 - protein, 19 aa, Mycobacterium
DTFLWHLWDELLGIGTVIG

SEQ ID NO: 376661 - protein, 22 aa, Mycobacterium
DTGAFLWNVMYGHEGRIWGLVY

SEQ ID NO: 376662 - protein, 31 aa, Mycobacterium
DTGRKWNKWWLLAVVPLLLLAGLVAFAVMRH

SEQ ID NO: 376663 - protein, 17 aa, Mycobacterium
DTIVLIAALFRALVERE

SEQ ID NO: 376664 - protein, 22 aa, Mycobacterium
DTRAWLIHEMIIVAAVGISCLA

SEQ ID NO: 376665 - protein, 23 aa, Mycobacterium
DTSAYWVFLLFYVGAALLTWSRY

SEQ ID NO: 376666 - protein, 23 aa, Mycobacterium
DTSVWEVFWPLSVGATLVVARPG

SEQ ID NO: 376667 - protein, 27 aa, Mycobacterium
DTVPLVVGWLWPLWDPDRRTFADMLLR

SEQ ID NO: 376668 - protein, 17 aa, Mycobacterium
DVFWWTLGTGLLVCVVM

SEQ ID NO: 376669 - protein, 17 aa, Mycobacterium
DVGLVLGWPGGLRIAVD

SEQ ID NO: 376670 - protein, 23 aa, Mycobacterium
DVHTPWFWCLLALRAVVFTLVMA

SEQ ID NO: 376671 - protein, 19 aa, Mycobacterium
DVILVTGPWLAGTSSVLAA

SEQ ID NO: 376672 - protein, 25 aa, Mycobacterium
DVLQAYLNIIYFGRGAYGISAAAKA

SEQ ID NO: 376673 - protein, 23 aa, Mycobacterium
DVPVWPFVAAALALVAGGAWWAV

SEQ ID NO: 376674 - protein, 25 aa, Mycobacterium
DVRTTVRDLLWLQVAIGIAVLTVLG

SEQ ID NO: 376675 - protein, 22 aa, Mycobacterium
DWFAVTALFRHPLGLKIPHTAI

SEQ ID NO: 376676 - protein, 17 aa, Mycobacterium
DWIDELLYRLAYEGSTV

SEQ ID NO: 376677 - protein, 17 aa, Mycobacterium
DWKLWLGFLLVAIPVCL

SEQ ID NO: 376678 - protein, 20 aa, Mycobacterium
DWLLAIPWWTQSFVLGLGSF

SEQ ID NO: 376679 - protein, 18 aa, Mycobacterium
DWTRTVLARRIAAGGLVL

SEQ ID NO: 376680 - protein, 25 aa, Mycobacterium
DYADILYISPWLFLLGVSMAALTAY

SEQ ID NO: 376681 - protein, 24 aa, Mycobacterium
DYADILYISPWLFLLGVSMAGLTA

SEQ ID NO: 376682 - protein, 21 aa, Mycobacterium
DYGMKLLWTLTLLIPVLYVNQ

SEQ ID NO: 376683 - protein, 21 aa, Mycobacterium
DYLGWPMISAGAFALAQLALR

SEQ ID NO: 376684 - protein, 21 aa, Mycobacterium
DYPNVPLLCSLAVAGLLFISL

SEQ ID NO: 376685 - protein, 23 aa, Mycobacterium
EAAGFVIPFLPRGLDEIPPSPND

SEQ ID NO: 376686 - protein, 23 aa, Mycobacterium
EAARSVMFWLLGSLGASSWDKVP

SEQ ID NO: 376687 - protein, 23 aa, Mycobacterium
EADARLRRQLALRYVIFGGEALD

SEQ ID NO: 376688 - protein, 21 aa, Mycobacterium
EAFLAFGWRIPFLSSIVLVVV

SEQ ID NO: 376689 - protein, 24 aa, Mycobacterium
EAGIWVAFWFFLAQLNFVLGGINL

SEQ ID NO: 376690 - protein, 21 aa, Mycobacterium
EAGMLFIRRWLTAHATMGVEA

SEQ ID NO: 376691 - protein, 25 aa, Mycobacterium
EAHAWRPLFWIIAAIALAALVMALL

SEQ ID NO: 376692 - protein, 17 aa, Mycobacterium
EALWRGSLVVFQSILAV

SEQ ID NO: 376693 - protein, 23 aa, Mycobacterium
EARPFVLLPKFELQRWAAAVREH

SEQ ID NO: 376694 - protein, 21 aa, Mycobacterium
EARVQYWLPGYAIPLALAATA

SEQ ID NO: 376695 - protein, 22 aa, Mycobacterium
EAVLWFIRRWLVARATMGVEAD

SEQ ID NO: 376696 - protein, 21 aa, Mycobacterium
EAVPPFFRWLAKFEPMHQVFL

SEQ ID NO: 376697 - protein, 21 aa, Mycobacterium
EAVPPFFRWLATFEPMHQVFL

SEQ ID NO: 376698 - protein, 25 aa, Mycobacterium
EEAELAFLLAGWRDDVRQAPMTGII

SEQ ID NO: 376699 - protein, 24 aa, Mycobacterium
EEGLPFWIIFSCAVAIGLGTYLGG

SEQ ID NO: 376700 - protein, 22 aa, Mycobacterium
EEQFYILWPALIIGTAWLIRRA

SEQ ID NO: 376701 - protein, 25 aa, Mycobacterium
EEQLFRFSRILDAQPRLAILLGDYA

SEQ ID NO: 376702 - protein, 27 aa, Mycobacterium
EEQSVWFSWPFRSLAVLCAVAVAIGGL

SEQ ID NO: 376703 - protein, 24 aa, Mycobacterium
EEQYYFVWPLLLVAVTLALAARAR

SEQ ID NO: 376704 - protein, 23 aa, Mycobacterium
EEQYYLVWPLLVLFAVLLLRRRG

SEQ ID NO: 376705 - protein, 28 aa, Mycobacterium
EFAGFFAWLCWLVLHLVYLVGFKTKIVT

SEQ ID NO: 376706 - protein, 18 aa, Mycobacterium
EFDDFWRPMRSYFYWEKH

SEQ ID NO: 376707 - protein, 19 aa, Mycobacterium
EFVLFHLLPLLPESVLRVL

SEQ ID NO: 376708 - protein, 22 aa, Mycobacterium
EGAAWLRLAWAGILMLVIVRPR

SEQ ID NO: 376709 - protein, 22 aa, Mycobacterium
EGAWLVVVVFPILVYFLMRLNR

SEQ ID NO: 376710 - protein, 22 aa, Mycobacterium
EGAWVLLIVIPLLVLLFGRTEN

SEQ ID NO: 376711 - protein, 23 aa, Mycobacterium
EGKPWWLIVVGVVVIGLLGGMVA

SEQ ID NO: 376712 - protein, 18 aa, Mycobacterium
EGRLGWPLWAAYVSVFAL

SEQ ID NO: 376713 - protein, 24 aa, Mycobacterium
EGRRALWVFVLIPVLILLAVSGRY

SEQ ID NO: 376714 - protein, 23 aa, Mycobacterium
EGRSYLATAWWLTSLPGAVILVV

SEQ ID NO: 376715 - protein, 23 aa, Mycobacterium
EGVAWLRLAWAGILFLIIVRPRR

SEQ ID NO: 376716 - protein, 17 aa, Mycobacterium
EGVMALPVPIGKINTIM

SEQ ID NO: 376717 - protein, 22 aa, Mycobacterium
EGWWTSVYFLAFWITGTSLLMV

SEQ ID NO: 376718 - protein, 24 aa, Mycobacterium
EHARHLLIRLAVAAVLFVPLADLS

SEQ ID NO: 376719 - protein, 26 aa, Mycobacterium
EHARTLLRRLLVAAVLFVPLADLSTM

SEQ ID NO: 376720 - protein, 25 aa, Mycobacterium
EHDPTNIRWLLYALGTIAIIVAIQR

SEQ ID NO: 376721 - protein, 23 aa, Mycobacterium
EIAMLVAFLYLPPLARLLGQTGP

SEQ ID NO: 376722 - protein, 17 aa, Mycobacterium
EILSFVLLLFGAAIETT

SEQ ID NO: 376723 - protein, 18 aa, Mycobacterium
EIWEVFTLQPGPGGAFTG

SEQ ID NO: 376724 - protein, 21 aa, Mycobacterium
EKLFTPILLLALAALGIGFVS

SEQ ID NO: 376725 - protein, 18 aa, Mycobacterium
ELAIVRRVLSLLPQLPDD

SEQ ID NO: 376726 - protein, 25 aa, Mycobacterium
ELARPPLWLFALFLLTATAAHALKV

SEQ ID NO: 376727 - protein, 17 aa, Mycobacterium
ELFFVMPLTFFIGKVID

SEQ ID NO: 376728 - protein, 26 aa, Mycobacterium
ELGVILRWPVWWVVVCTAVCVLIVEG

SEQ ID NO: 376729 - protein, 21 aa, Mycobacterium
ELKYLIRIFGARALALGIGYL

SEQ ID NO: 376730 - protein, 18 aa, Mycobacterium
ELLVLIAPIVGLIYAGIR

SEQ ID NO: 376731 - protein, 23 aa, Mycobacterium
ELPPTWMLFFFAPTLVGLCAMRG

SEQ ID NO: 376732 - protein, 20 aa, Mycobacterium
ELVIAWFLGNLGFVGGPGLV

SEQ ID NO: 376733 - protein, 24 aa, Mycobacterium
ELVSPLHWYWAVIAAFVVFAGTNS

SEQ ID NO: 376734 - protein, 18 aa, Mycobacterium
ENGPPLFWLLFGIMIVTS

SEQ ID NO: 376735 - protein, 18 aa, Mycobacterium
ENSKYFLVFWGVVFFVTV

SEQ ID NO: 376736 - protein, 22 aa, Mycobacterium
EPAHPRWWFVSTTPGRILTIGI

SEQ ID NO: 376737 - protein, 24 aa, Mycobacterium
EPAPPWLWLWIAGIGLSAGLTGAD

SEQ ID NO: 376738 - protein, 23 aa, Mycobacterium
EPDNYLIWAILTTLFCCLPLGIV

SEQ ID NO: 376739 - protein, 23 aa, Mycobacterium
EPGDWLYFVTIDLQGTTLFTREY

SEQ ID NO: 376740 - protein, 17 aa, Mycobacterium
EPIGPWGLLLRDLAHLL

SEQ ID NO: 376741 - protein, 21 aa, Mycobacterium
EPLRPAPVVLPFTGLDGPTPV

SEQ ID NO: 376742 - protein, 23 aa, Mycobacterium
EQFYLVWPALIIATAWLLRRIGK

SEQ ID NO: 376743 - protein, 25 aa, Mycobacterium
EQFYLVWPALILGVAWWLRRRSAGG

SEQ ID NO: 376744 - protein, 21 aa, Mycobacterium
EQWIPNYPPQAAPRPSAWPLV

SEQ ID NO: 376745 - protein, 23 aa, Mycobacterium
EQYYFVWPVLLIAVTLLLAARAR

SEQ ID NO: 376746 - protein, 23 aa, Mycobacterium
EQYYIVWPLLLIAVTLLLAARAR

SEQ ID NO: 376747 - protein, 22 aa, Mycobacterium
EQYYVLWPLLIAAVIAGLTALA

SEQ ID NO: 376748 - protein, 22 aa, Mycobacterium
ERALLYLLAALAALLLGGAAVW

SEQ ID NO: 376749 - protein, 25 aa, Mycobacterium
ERDRIALWTRILPITFTALGLVSLV

SEQ ID NO: 376750 - protein, 25 aa, Mycobacterium
ERDRLALWSRVLPITFTAVGLIALV

SEQ ID NO: 376751 - protein, 23 aa, Mycobacterium
ERDRLALWSRVLPITFTAVGVIA

SEQ ID NO: 376752 - protein, 29 aa, Mycobacterium
ERGGSLGRWLIAVAVLAVLTVLVTIGINA

SEQ ID NO: 376753 - protein, 17 aa, Mycobacterium
ERLLVRWIELGLGLVLV

SEQ ID NO: 376754 - protein, 21 aa, Mycobacterium
ERLTLPPIPLQVPPAAPAPAP

SEQ ID NO: 376755 - protein, 19 aa, Mycobacterium
ERLVLGMLTHAIAVAFSAA

SEQ ID NO: 376756 - protein, 29 aa, Mycobacterium
ERMLRRFVLPNRLWWPLSPRLRKALKTVT

SEQ ID NO: 376757 - protein, 23 aa, Mycobacterium
ERMRIYFARLLKLFGVGFIVGAA

SEQ ID NO: 376758 - protein, 22 aa, Mycobacterium
ERPRLLLGFAMVALPILGLWHL

SEQ ID NO: 376759 - protein, 19 aa, Mycobacterium
ERRRAWLHKLTPGKVVVAV

SEQ ID NO: 376760 - protein, 22 aa, Mycobacterium
ERTELYWVFTGLAAVLALGEIS

SEQ ID NO: 376761 - protein, 23 aa, Mycobacterium
ERWRTLRWVLLGLAAIVAVAALS

SEQ ID NO: 376762 - protein, 25 aa, Mycobacterium
ESAAMLLIPPYLVYIRLARPLIAFY

SEQ ID NO: 376763 - protein, 24 aa, Mycobacterium
ESGTLIWLILLLAAFSWMISARIV

SEQ ID NO: 376764 - protein, 27 aa, Mycobacterium
ESHSDWGWLWWFGGAWAVLAVAGAAVI

SEQ ID NO: 376765 - protein, 17 aa, Mycobacterium
ESPFLLIRAALPHMYRQ

SEQ ID NO: 376766 - protein, 27 aa, Mycobacterium
ESPTRKRLLRRPGWASVGVALVLVIAV

SEQ ID NO: 376767 - protein, 20 aa, Mycobacterium
ESRLNRLLALQIPPARKVVT

SEQ ID NO: 376768 - protein, 20 aa, Mycobacterium
ETASWWRTLLAPIIGGAGML

SEQ ID NO: 376769 - protein, 26 aa, Mycobacterium
ETEFRARLWLPYLPLILAAAAGWAHA

SEQ ID NO: 376770 - protein, 33 aa, Mycobacterium
ETEPTPWYRKPPLLIAWLVFVAVLIGLIVYGIT

SEQ ID NO: 376771 - protein, 23 aa, Mycobacterium
ETGGGWRFLAFTLGICAIFLLRA

SEQ ID NO: 376772 - protein, 26 aa, Mycobacterium
ETHPDFFTPLLWTAALLKGGDPARSL

SEQ ID NO: 376773 - protein, 25 aa, Mycobacterium
ETLPMMLAPWVLLPTILALRATSER

SEQ ID NO: 376774 - protein, 24 aa, Mycobacterium
ETLPMMLAPWVLLPVILALQGGSG

SEQ ID NO: 376775 - protein, 24 aa, Mycobacterium
ETLPMMLAPWVLLPVILALRGQHS

SEQ ID NO: 376776 - protein, 23 aa, Mycobacterium
ETWPLLTGFVWLGGLLIVASVVL

SEQ ID NO: 376777 - protein, 25 aa, Mycobacterium
EVAEGALLLFLFSVGHALEGYAMGR

SEQ ID NO: 376778 - protein, 22 aa, Mycobacterium
EVLEWLAWSALVPLACWISELY

SEQ ID NO: 376779 - protein, 19 aa, Mycobacterium
EVLPLAVPVILASALFGGG

SEQ ID NO: 376780 - protein, 18 aa, Mycobacterium
EVLPLLVPVVLVSALFNG

SEQ ID NO: 376781 - protein, 18 aa, Mycobacterium
EVLPLVVPVILASLLFAG

SEQ ID NO: 376782 - protein, 20 aa, Mycobacterium
EVTPLAWWLCGTATAVTVLY

SEQ ID NO: 376783 - protein, 18 aa, Mycobacterium
EWTLFLSAQWVAAAGSIF

SEQ ID NO: 376784 - protein, 22 aa, Mycobacterium
EYDYRLLLGHRPGGLPWPDAAR

SEQ ID NO: 376785 - protein, 28 aa, Mycobacterium
EYNEVFADPIWGPKFRKLYLRIARVGRS

SEQ ID NO: 376786 - protein, 17 aa, Mycobacterium
EYVLAFLGALQAGQIAV

SEQ ID NO: 376787 - protein, 18 aa, Mycobacterium
EYWLLLAGPDLTSHDRRV

SEQ ID NO: 376788 - protein, 18 aa, Mycobacterium
FAAFLYRRWNLPVAVLAG

SEQ ID NO: 376789 - protein, 20 aa, Mycobacterium
FAAGKLHRLPVKTWDVRCAP

SEQ ID NO: 376790 - protein, 17 aa, Mycobacterium
FAAYFLRGYFVLIVVAA

SEQ ID NO: 376791 - protein, 30 aa, Mycobacterium
FADGLQYWPWVLLGYFTLGIVIVSLIGWWA

SEQ ID NO: 376792 - protein, 20 aa, Mycobacterium
FADRVFAAALPWLAGALGTP

SEQ ID NO: 376793 - protein, 19 aa, Mycobacterium
FAFLGWHWSLPLGVAILFA

SEQ ID NO: 376794 - protein, 24 aa, Mycobacterium
FAGITVPLFLLFAGGWWLPKTVDA

SEQ ID NO: 376795 - protein, 24 aa, Mycobacterium
FAHHYAIWFLVLLAAGKMLACSLT

SEQ ID NO: 376796 - protein, 24 aa, Mycobacterium
FAIGAVMPLIPYLLGFGSLSAGLI

SEQ ID NO: 376797 - protein, 21 aa, Mycobacterium
FAIGWAMWPLVACSVLQAIAA

SEQ ID NO: 376798 - protein, 17 aa, Mycobacterium
FAIILLDASLIGANAIG

SEQ ID NO: 376799 - protein, 19 aa, Mycobacterium
FAIIPAMFVALFPGLDLLN

SEQ ID NO: 376800 - protein, 17 aa, Mycobacterium
FALFPLLMLGFSVAGFV

SEQ ID NO: 376801 - protein, 23 aa, Mycobacterium
FALSWWLGLYLLARDPRKPMLVL

SEQ ID NO: 376802 - protein, 17 aa, Mycobacterium
FALVFAGLWLILTKARK

SEQ ID NO: 376803 - protein, 17 aa, Mycobacterium
FAMAYFIVDIPKPGDLR

SEQ ID NO: 376804 - protein, 28 aa, Mycobacterium
FAMFAIGALLPLIPYLLGFGSLVAGLAC

SEQ ID NO: 376805 - protein, 33 aa, Mycobacterium
FAPFFLPLALFIGALIIWMLLKPLQTRPVVNGL

SEQ ID NO: 376806 - protein, 21 aa, Mycobacterium
FAQFGLWRWAFGAMAVLTTLM

SEQ ID NO: 376807 - protein, 25 aa, Mycobacterium
FARLLLIWTAIATVALVLVGCIRVV

SEQ ID NO: 376808 - protein, 21 aa, Mycobacterium
FATLPTYRYGWWPATAITVVA

SEQ ID NO: 376809 - protein, 19 aa, Mycobacterium
FATWLLLLVPSIYLALNQS

SEQ ID NO: 376810 - protein, 26 aa, Mycobacterium
FAVFDWLFWLFSILIATLVSWLLFTW

SEQ ID NO: 376811 - protein, 19 aa, Mycobacterium
FAVFLYRVWNLPVAILSGA

SEQ ID NO: 376812 - protein, 20 aa, Mycobacterium
FAVIPLLYRLGELVPALALV

SEQ ID NO: 376813 - protein, 23 aa, Mycobacterium
FAVYPILVVLFGVGVWPIVVLAS

SEQ ID NO: 376814 - protein, 23 aa, Mycobacterium
FAWSTVWCLVLLSLALTAATFFP

SEQ ID NO: 376815 - protein, 23 aa, Mycobacterium
FAYLLLPQVLFYGLSSVFMAILN

SEQ ID NO: 376816 - protein, 20 aa, Mycobacterium
FCDLGWFGVWAILDAVVPRG

SEQ ID NO: 376817 - protein, 25 aa, Mycobacterium
FCNSPFFWIGGFAFGLLATLVAGST

SEQ ID NO: 376818 - protein, 22 aa, Mycobacterium
FCNSPFFWVGGLAFALLASMIA

SEQ ID NO: 376819 - protein, 26 aa, Mycobacterium
FCTDYLHWRWAFWINLPISIVVLAVT

SEQ ID NO: 376820 - protein, 18 aa, Mycobacterium
FCVAAYAPYLAWLAATSA

SEQ ID NO: 376821 - protein, 17 aa, Mycobacterium
FDDFFRPIRNYLYWEPH

SEQ ID NO: 376822 - protein, 19 aa, Mycobacterium
FDGALLIVIFATSGALEAV

SEQ ID NO: 376823 - protein, 25 aa, Mycobacterium
FDGLPPHFLNWLFGLFGALALIAAA

SEQ ID NO: 376824 - protein, 17 aa, Mycobacterium
FDGRLPWLHILAALGTV

SEQ ID NO: 376825 - protein, 23 aa, Mycobacterium
FDKRNWWLPGWLDHVLPTVDFET

SEQ ID NO: 376826 - protein, 40 aa, Mycobacterium
FDMMIVRLFLVMPLARILGPWFWWPQKLPTPKRATFRDKP

SEQ ID NO: 376827 - protein, 38 aa, Mycobacterium
FDMMIVRLFLVMPLARLLGPWFWWPQKLPRRQPVQLRG

SEQ ID NO: 376828 - protein, 21 aa, Mycobacterium
FDMSWEELLWLIEGHEVHICD

SEQ ID NO: 376829 - protein, 23 aa, Mycobacterium
FDNMPELHWAWGYPAVLCVMAVV

SEQ ID NO: 376830 - protein, 21 aa, Mycobacterium
FEPYRLWQPPLTQPVAIDDLV

SEQ ID NO: 376831 - protein, 25 aa, Mycobacterium
FERRRAIWQWLLVLLATVATAGATN

SEQ ID NO: 376832 - protein, 17 aa, Mycobacterium
FERVITGLLLIIAVGFT

SEQ ID NO: 376833 - protein, 18 aa, Mycobacterium
FFAGLRFAVLALPVILFV

SEQ ID NO: 376834 - protein, 20 aa, Mycobacterium
FFDIQWPWSTAIYTLIVVAW

SEQ ID NO: 376835 - protein, 17 aa, Mycobacterium
FFFAAIARIPLGVAVTI

SEQ ID NO: 376836 - protein, 17 aa, Mycobacterium
FFFDLLTGRFQWQEFVR

SEQ ID NO: 376837 - protein, 17 aa, Mycobacterium
FFFPLPGLWKWVAAAVF

SEQ ID NO: 376838 - protein, 26 aa, Mycobacterium
FFGLALLLVFLFWPWEYKPSGDKGNL

SEQ ID NO: 376839 - protein, 19 aa, Mycobacterium
FFHGFGLAALLGPLALGGT

SEQ ID NO: 376840 - protein, 19 aa, Mycobacterium
FFLLPPERIHTMVFAVLRG

SEQ ID NO: 376841 - protein, 17 aa, Mycobacterium
FFLQFGLLLLAATILGR

SEQ ID NO: 376842 - protein, 17 aa, Mycobacterium
FFLYIKDEMFLALGTAS

SEQ ID NO: 376843 - protein, 20 aa, Mycobacterium
FFNLFLMMFIIRSGIQILCD

SEQ ID NO: 376844 - protein, 18 aa, Mycobacterium
FFPWNLYFGFRIPGSSRI

SEQ ID NO: 376845 - protein, 17 aa, Mycobacterium
FFQGVMLIINWIIGNLA

SEQ ID NO: 376846 - protein, 18 aa, Mycobacterium
FFTIIGWIMRLAPVGALG

SEQ ID NO: 376847 - protein, 18 aa, Mycobacterium
FFTVIGWIMRLAPLGAFG

SEQ ID NO: 376848 - protein, 18 aa, Mycobacterium
FFVGVLLVGLLGGVAPAV

SEQ ID NO: 376849 - protein, 17 aa, Mycobacterium
FFVLWALSNFAGPLVLG

SEQ ID NO: 376850 - protein, 25 aa, Mycobacterium
FGAAAYLMWGLFPAFFPLLEPAGAL

SEQ ID NO: 376851 - protein, 28 aa, Mycobacterium
FGASAWFWLLIYSDWVWPSLPPVVHAVS

SEQ ID NO: 376852 - protein, 18 aa, Mycobacterium
FGCTPLDPLGWGQGLLAA

SEQ ID NO: 376853 - protein, 19 aa, Mycobacterium
FGEFLAWIIGWNLLLELAI

SEQ ID NO: 376854 - protein, 17 aa, Mycobacterium
FGFLPASRRGVAVMVTL

SEQ ID NO: 376855 - protein, 24 aa, Mycobacterium
FGFVLMWILAWLTATPVRVVRAAL

SEQ ID NO: 376856 - protein, 22 aa, Mycobacterium
FGGKVSFVALMVLGLIALVIGV

SEQ ID NO: 376857 - protein, 24 aa, Mycobacterium
FGGLLTFLGFLGIVLIAVGFTFGF

SEQ ID NO: 376858 - protein, 18 aa, Mycobacterium
FGGQAMIWLTWPWGTAGS

SEQ ID NO: 376859 - protein, 17 aa, Mycobacterium
FGHFPWWIPLGSLVLPF

SEQ ID NO: 376860 - protein, 18 aa, Mycobacterium
FGIGLLLDGILVAASLLV

SEQ ID NO: 376861 - protein, 21 aa, Mycobacterium
FGITAGWWIYLAAFAIFIGIH

SEQ ID NO: 376862 - protein, 20 aa, Mycobacterium
FGLSVLFWQDILGIALHWLV

SEQ ID NO: 376863 - protein, 22 aa, Mycobacterium
FGLSVLLWQHLIGIPLHWMVLP

SEQ ID NO: 376864 - protein, 23 aa, Mycobacterium
FGLSVLLWQYILGLKLHWMVLAM

SEQ ID NO: 376865 - protein, 23 aa, Mycobacterium
FGLSWWLGLYLLARNPRKPVLVL

SEQ ID NO: 376866 - protein, 25 aa, Mycobacterium
FGLTVLWLFWHLKTITIPLLLALMG

SEQ ID NO: 376867 - protein, 24 aa, Mycobacterium
FGPGVFFWFLVIGLLTVFMLGGAT

SEQ ID NO: 376868 - protein, 24 aa, Mycobacterium
FGQLAVWIFFGLTLVLAGLTQLAV

SEQ ID NO: 376869 - protein, 18 aa, Mycobacterium
FGRHRWVVDARAPDIARE

SEQ ID NO: 376870 - protein, 24 aa, Mycobacterium
FGSWLLFAGLWVTVVYFPVAHWVF

SEQ ID NO: 376871 - protein, 18 aa, Mycobacterium
FGVLYLIGVLIVATGWGA

SEQ ID NO: 376872 - protein, 20 aa, Mycobacterium
FGVPVWGFAMLWIALSTALT

SEQ ID NO: 376873 - protein, 22 aa, Mycobacterium
FGYSSLPFFPQGKAYEAYFADA

SEQ ID NO: 376874 - protein, 26 aa, Mycobacterium
FHAFAVQMNLISPLWFAIRAYRQMKT

SEQ ID NO: 376875 - protein, 25 aa, Mycobacterium
FHGFGLGMLMLTFALGGTVLTHRRF

SEQ ID NO: 376876 - protein, 18 aa, Mycobacterium
FHHLAFGSGIHRCLGSHL

SEQ ID NO: 376877 - protein, 22 aa, Mycobacterium
FHLSLRHTLWWLGSLAALGSFG

SEQ ID NO: 376878 - protein, 24 aa, Mycobacterium
FIAFDQLWRWNSIVALVLSVLVIL

SEQ ID NO: 376879 - protein, 23 aa, Mycobacterium
FIGLLFFVVWLLIAYLRAEVLRR

SEQ ID NO: 376880 - protein, 17 aa, Mycobacterium
FILASRFVRRETSPCSA

SEQ ID NO: 376881 - protein, 23 aa, Mycobacterium
FILLIKKIWWPLAVWVLLVVMNV

SEQ ID NO: 376882 - protein, 19 aa, Mycobacterium
FILQCWFIMRVALLPAILV

SEQ ID NO: 376883 - protein, 26 aa, Mycobacterium
FILVQFLTQAWIWQITLINIAATLVF

SEQ ID NO: 376884 - protein, 18 aa, Mycobacterium
FIRVLAWFFGLMVFNRID

SEQ ID NO: 376885 - protein, 18 aa, Mycobacterium
FISAIGWVIFFFMFRTET

SEQ ID NO: 376886 - protein, 25 aa, Mycobacterium
FISVLVLWDLLGHLPLPLGVAGHEG

SEQ ID NO: 376887 - protein, 18 aa, Mycobacterium
FIVSVIFFTGFRLGMHSG

SEQ ID NO: 376888 - protein, 19 aa, Mycobacterium
FKGHLYIAGRIKDLVIIDG

SEQ ID NO: 376889 - protein, 18 aa, Mycobacterium
FKHSWVMSFLYIGTFGSF

SEQ ID NO: 376890 - protein, 18 aa, Mycobacterium
FKLPFPWREFLLQTWFVA

SEQ ID NO: 376891 - protein, 19 aa, Mycobacterium
FLAWGWRIPFLVSAILIVI

SEQ ID NO: 376892 - protein, 17 aa, Mycobacterium
FLFAALWLSCLAIFNTR

SEQ ID NO: 376893 - protein, 25 aa, Mycobacterium
FLFAIGAVIPLVPYLLGYESLWAGL

SEQ ID NO: 376894 - protein, 18 aa, Mycobacterium
FLFFAFLVGFGGGAFYPM

SEQ ID NO: 376895 - protein, 26 aa, Mycobacterium
FLFGLAFYLPLLPWVGLLVGSVPWVA

SEQ ID NO: 376896 - protein, 24 aa, Mycobacterium
FLGLPLNFLLFSLLVVVTASLTVP

SEQ ID NO: 376897 - protein, 19 aa, Mycobacterium
FLHFAKLPAMLFGVGRYTV

SEQ ID NO: 376898 - protein, 21 aa, Mycobacterium
FLHMRYWWVGIALVALGVIVA

SEQ ID NO: 376899 - protein, 17 aa, Mycobacterium
FLIDNLLYRLIYLPYGL

SEQ ID NO: 376900 - protein, 17 aa, Mycobacterium
FLIIFMLLMVYRSVTTM

SEQ ID NO: 376901 - protein, 29 aa, Mycobacterium
FLIPNGTFFAVLIIFLIVLGVISKWVVPP

SEQ ID NO: 376902 - protein, 26 aa, Mycobacterium
FLIPNGTFFVVLAIFLIVLAVIGTFV

SEQ ID NO: 376903 - protein, 17 aa, Mycobacterium
FLLAIPWWEPSFVGGLA

SEQ ID NO: 376904 - protein, 18 aa, Mycobacterium
FLLARIREYWLQSPRARA

SEQ ID NO: 376905 - protein, 17 aa, Mycobacterium
FLLFGLWMLFDGAFGWR

SEQ ID NO: 376906 - protein, 19 aa, Mycobacterium
FLLLVGMSGLIVFVGSLFG

SEQ ID NO: 376907 - protein, 17 aa, Mycobacterium
FLLLYPRRSWGPTAWVV

SEQ ID NO: 376908 - protein, 30 aa, Mycobacterium
FLLPNGTFFAVLLIFLIVLGVIAKWVVPPI

SEQ ID NO: 376909 - protein, 17 aa, Mycobacterium
FLLPVLGVPPPNNAASE

SEQ ID NO: 376910 - protein, 17 aa, Mycobacterium
FLLVQWLAPLASEAPEF

SEQ ID NO: 376911 - protein, 21 aa, Mycobacterium
FLPFLLIMGGFMYFASRRQRK

SEQ ID NO: 376912 - protein, 21 aa, Mycobacterium
FLPFLLIMGGFMYFASRRQRR

SEQ ID NO: 376913 - protein, 18 aa, Mycobacterium
FLPPRWWSVSPLDGLVAA

SEQ ID NO: 376914 - protein, 18 aa, Mycobacterium
FLQWGWRVPFLVSAALIG

SEQ ID NO: 376915 - protein, 17 aa, Mycobacterium
FLRIAPELYLKRLCVGG

SEQ ID NO: 376916 - protein, 19 aa, Mycobacterium
FLRLPYTFAVPIFGGRNWT

SEQ ID NO: 376917 - protein, 21 aa, Mycobacterium
FLRRAMPVVIVILIVGMVVAL

SEQ ID NO: 376918 - protein, 18 aa, Mycobacterium
FLSWGWRVPFIASGLLVA

SEQ ID NO: 376919 - protein, 19 aa, Mycobacterium
FLVAGFWWFDGYTLVQERY

SEQ ID NO: 376920 - protein, 20 aa, Mycobacterium
FLVILALVLLIVRLCYTWIV

SEQ ID NO: 376921 - protein, 27 aa, Mycobacterium
FLVMEIFQPFFDYFFGFRAYGAPGQPP

SEQ ID NO: 376922 - protein, 18 aa, Mycobacterium
FLVPLYFAFGVVAALLGE

SEQ ID NO: 376923 - protein, 20 aa, Mycobacterium
FLVRTVIIPALFTWIGPKIW

SEQ ID NO: 376924 - protein, 19 aa, Mycobacterium
FLVVVVGLAFILLTIAFRA

SEQ ID NO: 376925 - protein, 19 aa, Mycobacterium
FLYELIWNVLVFAILIYAD

SEQ ID NO: 376926 - protein, 19 aa, Mycobacterium
FLYELLWNVLVFVLLIVVD

SEQ ID NO: 376927 - protein, 17 aa, Mycobacterium
FMCYWVIPVSLLGLAAL

SEQ ID NO: 376928 - protein, 18 aa, Mycobacterium
FMDYLKLGLPVTIVFFLA

SEQ ID NO: 376929 - protein, 27 aa, Mycobacterium
FMLLVKKIWWPLAVWLLLVVMNVNAGT

SEQ ID NO: 376930 - protein, 17 aa, Mycobacterium
FMWAFIGLLVLFSAIVI

SEQ ID NO: 376931 - protein, 17 aa, Mycobacterium
FNALPNRGPWQLPQIPA

SEQ ID NO: 376932 - protein, 18 aa, Mycobacterium
FNLLFIFIALFAVASVTA

SEQ ID NO: 376933 - protein, 18 aa, Mycobacterium
FNTFLRYLSFGGLFIGLS

SEQ ID NO: 376934 - protein, 17 aa, Mycobacterium
FNYFPFGVNFFSTAEVL

SEQ ID NO: 376935 - protein, 17 aa, Mycobacterium
FNYLFSNPIPYARAGLD

SEQ ID NO: 376936 - protein, 25 aa, Mycobacterium
FPATLAWLRYRWLRRTPLPVQRPTV

SEQ ID NO: 376937 - protein, 17 aa, Mycobacterium
FPGLITFSATQQGQTIP

SEQ ID NO: 376938 - protein, 24 aa, Mycobacterium
FPGWQPGYPRPPYNPPYTPPSTTT

SEQ ID NO: 376939 - protein, 17 aa, Mycobacterium
FPIFWMLMLALKNAEEQ

SEQ ID NO: 376940 - protein, 19 aa, Mycobacterium
FPLIGFLVVLLRKTWKPGS

SEQ ID NO: 376941 - protein, 28 aa, Mycobacterium
FPPPGMPPMPPWPPPPPPPPPPPADATA

SEQ ID NO: 376942 - protein, 19 aa, Mycobacterium
FPRSLRGQLLLGVLAVVTV

SEQ ID NO: 376943 - protein, 17 aa, Mycobacterium
FPRTPLNWRVLVGAFFV

SEQ ID NO: 376944 - protein, 19 aa, Mycobacterium
FPVFVFTVILITLVLIPGI

SEQ ID NO: 376945 - protein, 26 aa, Mycobacterium
FPVVQPWYLLWAIIPLAAWATRPAFR

SEQ ID NO: 376946 - protein, 26 aa, Mycobacterium
FPVVQPWYLLWAIIPLAAWATRPGFR

SEQ ID NO: 376947 - protein, 26 aa, Mycobacterium
FPVVQPWYLLWAIIPLAAWATRSGFR

SEQ ID NO: 376948 - protein, 23 aa, Mycobacterium
FPVVQPWYLLWAIIPLACWATRA

SEQ ID NO: 376949 - protein, 19 aa, Mycobacterium
FPWTGLTIFLLIAVFAAAV

SEQ ID NO: 376950 - protein, 18 aa, Mycobacterium
FPYVLMKPKLIIATILGG

SEQ ID NO: 376951 - protein, 21 aa, Mycobacterium
FQAEFLWRDYFPRGLTDDGDE

SEQ ID NO: 376952 - protein, 20 aa, Mycobacterium
FQAEFLWRDYFPRGLTDDGE

SEQ ID NO: 376953 - protein, 17 aa, Mycobacterium
FQFFYLVLPLFCGAFEG

SEQ ID NO: 376954 - protein, 20 aa, Mycobacterium
FQIYVWIRWITGPYFERVDP

SEQ ID NO: 376955 - protein, 20 aa, Mycobacterium
FQIYVWIRWITGPYFTRVDP

SEQ ID NO: 376956 - protein, 19 aa, Mycobacterium
FQRTPIYCLPKPDFPIPTW

SEQ ID NO: 376957 - protein, 20 aa, Mycobacterium
FQTLLLKWAIMVLLGLFTSG

SEQ ID NO: 376958 - protein, 19 aa, Mycobacterium
FQVLWAYPYFWLLDTRGIP

SEQ ID NO: 376959 - protein, 18 aa, Mycobacterium
FQWRWSIATLWFTAVFLQ

SEQ ID NO: 376960 - protein, 27 aa, Mycobacterium
FRHRTGNIIIFLTLAIAAIQLFTLQGP

SEQ ID NO: 376961 - protein, 18 aa, Mycobacterium
FRPVFYYLGFWVIALISL

SEQ ID NO: 376962 - protein, 24 aa, Mycobacterium
FRQGFFFFAILLTALSIIPLGGGI

SEQ ID NO: 376963 - protein, 23 aa, Mycobacterium
FRRRWLVLGTWLAVLLGVGLAFV

SEQ ID NO: 376964 - protein, 25 aa, Mycobacterium
FRRSWKWLSVVGLVAILVICVGYVM

SEQ ID NO: 376965 - protein, 21 aa, Mycobacterium
FRTIRKIWMPLLIAAVVAIGG

SEQ ID NO: 376966 - protein, 17 aa, Mycobacterium
FRTIYVIPWICAPLAIG

SEQ ID NO: 376967 - protein, 17 aa, Mycobacterium
FRTPWVPVLPILSIIAC

SEQ ID NO: 376968 - protein, 20 aa, Mycobacterium
FSATFLGWYSGGHYSWHRGG

SEQ ID NO: 376969 - protein, 26 aa, Mycobacterium
FSDRGYFVFLAVLPFIMGSLSMSVPG

SEQ ID NO: 376970 - protein, 23 aa, Mycobacterium
FSFIGFIIANPWLVPAGLLALLA

SEQ ID NO: 376971 - protein, 17 aa, Mycobacterium
FSGFGWLAVLLLAVASA

SEQ ID NO: 376972 - protein, 28 aa, Mycobacterium
FSGLALLLIFLFWPWEYKPYGSGGEFLY

SEQ ID NO: 376973 - protein, 31 aa, Mycobacterium
FSLCKALGYLLWWAVLFPAVSIPIIASAATA

SEQ ID NO: 376974 - protein, 19 aa, Mycobacterium
FSLLGLFMPSALALLFVMF

SEQ ID NO: 376975 - protein, 25 aa, Mycobacterium
FSNKPLVFIFYLGAVIFMISSLAAG

SEQ ID NO: 376976 - protein, 26 aa, Mycobacterium
FSSFWFTAIYVLLFISLVGCLTPRMI

SEQ ID NO: 376977 - protein, 27 aa, Mycobacterium
FSSFWFTAVYVLLFVSLVGCLTPRMIE

SEQ ID NO: 376978 - protein, 26 aa, Mycobacterium
FSSFWFTSIYVLLFVSLVGCLTPRLF

SEQ ID NO: 376979 - protein, 22 aa, Mycobacterium
FSSIWIWNIFITFLPLFLQDTL

SEQ ID NO: 376980 - protein, 25 aa, Mycobacterium
FSVGWLYWYFWVIVVGFEAIAGAKI

SEQ ID NO: 376981 - protein, 26 aa, Mycobacterium
FSVGWLYWYFWVIVVGFEAIAGAKII

SEQ ID NO: 376982 - protein, 25 aa, Mycobacterium
FSVGWLYWYFWVIVVGFEAVAGGKV

SEQ ID NO: 376983 - protein, 17 aa, Mycobacterium
FSWTGFLRAIKNNLFGG

SEQ ID NO: 376984 - protein, 21 aa, Mycobacterium
FSYWLFLFGALITLAGFITPG

SEQ ID NO: 376985 - protein, 25 aa, Mycobacterium
FTAEPLLWLLAIDAGLITLGAMAFQ

SEQ ID NO: 376986 - protein, 26 aa, Mycobacterium
FTAKVWLFLFFFMWLRATLPRMRYDQ

SEQ ID NO: 376987 - protein, 26 aa, Mycobacterium
FTAKVWTFMFLYFWLRATLPRLRYDQ

SEQ ID NO: 376988 - protein, 23 aa, Mycobacterium
FTALQILWVNIIMDGPPALALGV

SEQ ID NO: 376989 - protein, 24 aa, Mycobacterium
FTAVPLLWLLAIDITLILLGALAL

SEQ ID NO: 376990 - protein, 25 aa, Mycobacterium
FTDHLTWRWAFWINVPIGIVVLIVA

SEQ ID NO: 376991 - protein, 17 aa, Mycobacterium
FTDLLPLTPLQQGLLYH

SEQ ID NO: 376992 - protein, 22 aa, Mycobacterium
FTEGFFSPLFFVWLGASLHVRE

SEQ ID NO: 376993 - protein, 18 aa, Mycobacterium
FTFMTPAAFVRRPGRWIR

SEQ ID NO: 376994 - protein, 24 aa, Mycobacterium
FTGAPLLWLLAIDAGLITLGVMAF

SEQ ID NO: 376995 - protein, 23 aa, Mycobacterium
FTGPEVWWLLTVARWAARMPAAT

SEQ ID NO: 376996 - protein, 25 aa, Mycobacterium
FTILIAPIFTKLLRFFPPVVTGTLI

SEQ ID NO: 376997 - protein, 24 aa, Mycobacterium
FTLALIVFGLLWPVIFAGGGGDAA

SEQ ID NO: 376998 - protein, 22 aa, Mycobacterium
FTLIFVIMLIITRSLIAACTII

SEQ ID NO: 376999 - protein, 21 aa, Mycobacterium
FTLIPYALVLLQLRVFYARER

SEQ ID NO: 377000 - protein, 23 aa, Mycobacterium
FTLSLWLGLYLLARDPRKPVLVL

SEQ ID NO: 377001 - protein, 20 aa, Mycobacterium
FTLSWWLGLYLVARDPRKPV

SEQ ID NO: 377002 - protein, 17 aa, Mycobacterium
FTPARPRRLPQWGRIAA

SEQ ID NO: 377003 - protein, 25 aa, Mycobacterium
FTRKAIWWSAFRQLLFGSVAVAATY

SEQ ID NO: 377004 - protein, 24 aa, Mycobacterium
FTVIIVMLLLVYRSIITAAIMLTM

SEQ ID NO: 377005 - protein, 28 aa, Mycobacterium
FTVLLGVGYPLLIWLVAGLPGLHDKAQG

SEQ ID NO: 377006 - protein, 18 aa, Mycobacterium
FVAAVALTFLAVTTSRNA

SEQ ID NO: 377007 - protein, 23 aa, Mycobacterium
FVAFDQLWRWNSIVALVLSVLVI

SEQ ID NO: 377008 - protein, 25 aa, Mycobacterium
FVAILVMIGLLYLLCRLIYVIVDEA

SEQ ID NO: 377009 - protein, 29 aa, Mycobacterium
FVARRVSFLFLLLLPFALGGLTLLIPGDS

SEQ ID NO: 377010 - protein, 17 aa, Mycobacterium
FVCLGIVPVLAGLAAKV

SEQ ID NO: 377011 - protein, 18 aa, Mycobacterium
FVFFAIGNLLWFVIAVAL

SEQ ID NO: 377012 - protein, 26 aa, Mycobacterium
FVGVLTLAALWFWLPEQLRTMHISSP

SEQ ID NO: 377013 - protein, 18 aa, Mycobacterium
FVILAFLVPLTIFGLIKV

SEQ ID NO: 377014 - protein, 17 aa, Mycobacterium
FVILLFLLLAPVLNHWF

SEQ ID NO: 377015 - protein, 18 aa, Mycobacterium
FVILLVIYRNPVTMVLPL

SEQ ID NO: 377016 - protein, 19 aa, Mycobacterium
FVISLPIYSVLISLPIVAF

SEQ ID NO: 377017 - protein, 22 aa, Mycobacterium
FVLIFLIMMFLTRSLMAPFVII

SEQ ID NO: 377018 - protein, 18 aa, Mycobacterium
FVLLFLLTGSVVLPLKAL

SEQ ID NO: 377019 - protein, 18 aa, Mycobacterium
FVLLGVGLLWFGWFGFNA

SEQ ID NO: 377020 - protein, 18 aa, Mycobacterium
FVLLLWPVGAMTSLVLLS

SEQ ID NO: 377021 - protein, 19 aa, Mycobacterium
FVMLPIVWGLNQLGWHAAA

SEQ ID NO: 377022 - protein, 19 aa, Mycobacterium
FVMPDLVGQFWSDAYPRLT

SEQ ID NO: 377023 - protein, 22 aa, Mycobacterium
FVNALLLWLIVFASAIVGFLLC

SEQ ID NO: 377024 - protein, 32 aa, Mycobacterium
FVPRTIRRLALPILLFWVGLAALTNIAVPQLE

SEQ ID NO: 377025 - protein, 24 aa, Mycobacterium
FVSTYGWRAYALPLLVVLTAVVIY

SEQ ID NO: 377026 - protein, 25 aa, Mycobacterium
FVSTYGWRAYALPVLIVLTVVVVYQ

SEQ ID NO: 377027 - protein, 18 aa, Mycobacterium
FVTLAWWMAVFPGAAIFV

SEQ ID NO: 377028 - protein, 22 aa, Mycobacterium
FVVAMIPLVWLLYTVVAKGISA

SEQ ID NO: 377029 - protein, 24 aa, Mycobacterium
FVVLLFVYRSILTVILLLVTVGIE

SEQ ID NO: 377030 - protein, 17 aa, Mycobacterium
FWACGLLLCLFIGPTLS

SEQ ID NO: 377031 - protein, 18 aa, Mycobacterium
FWAFVYNVAAIPVAALGM

SEQ ID NO: 377032 - protein, 20 aa, Mycobacterium
FWELPPRFWLYCGFTAITMS

SEQ ID NO: 377033 - protein, 19 aa, Mycobacterium
FWLLAYWLVLGALMIYLLS

SEQ ID NO: 377034 - protein, 19 aa, Mycobacterium
FWLRHQKWWPLRDRVMITV

SEQ ID NO: 377035 - protein, 18 aa, Mycobacterium
FWQTWDLLLLWLAQLHGG

SEQ ID NO: 377036 - protein, 18 aa, Mycobacterium
FWWPQRVRQRPARAFHAS

SEQ ID NO: 377037 - protein, 19 aa, Mycobacterium
FWWPTFIRQRPLRQAVRQR

SEQ ID NO: 377038 - protein, 27 aa, Mycobacterium
FYAYLLTHVLFLNYVWGYTLLQAGLAV

SEQ ID NO: 377039 - protein, 25 aa, Mycobacterium
FYHDMGFILGIVFPVLAGVPAVLTS

SEQ ID NO: 377040 - protein, 18 aa, Mycobacterium
FYITCVIFIFGVLGALLW

SEQ ID NO: 377041 - protein, 20 aa, Mycobacterium
FYTLLLVYAAFTLTIMALCV

SEQ ID NO: 377042 - protein, 17 aa, Mycobacterium
FYVLFTLVSRNLLSALI

SEQ ID NO: 377043 - protein, 17 aa, Mycobacterium
FYVTCFVFVFGVLGVLM

SEQ ID NO: 377044 - protein, 17 aa, Mycobacterium
FYVVKILLYILGAWVFA

SEQ ID NO: 377045 - protein, 19 aa, Mycobacterium
FYWAIGIAVGFPVGLILLT

SEQ ID NO: 377046 - protein, 18 aa, Mycobacterium
FYWAVGIAAALPVLVVIL

SEQ ID NO: 377047 - protein, 19 aa, Mycobacterium
FYYLGFWVIALISLYPILP

SEQ ID NO: 377048 - protein, 29 aa, Mycobacterium
GAAALVLIVLAVLFFWVPGWAVTTELDID

SEQ ID NO: 377049 - protein, 25 aa, Mycobacterium
GAAFGPLILLSLFWRRLTSAGAIAG

SEQ ID NO: 377050 - protein, 19 aa, Mycobacterium
GAAGIWWVMRGHASGWWAQ

SEQ ID NO: 377051 - protein, 22 aa, Mycobacterium
GACIGFLWWNAAPAKIFMGDTG

SEQ ID NO: 377052 - protein, 20 aa, Mycobacterium
GAFLMLWDWFAVRAHAFAAS

SEQ ID NO: 377053 - protein, 25 aa, Mycobacterium
GAGESLLVYLGLGAALGLLASWLLS

SEQ ID NO: 377054 - protein, 19 aa, Mycobacterium
GAGWLWTVLAGLLAPVLVV

SEQ ID NO: 377055 - protein, 31 aa, Mycobacterium
GAIALLLIAVVLVLGFWQPGFFVTTKLDVNK

SEQ ID NO: 377056 - protein, 38 aa, Mycobacterium
GALALRLLTIAFFALVYLLPLILWLWRGETTHDRHAAA

SEQ ID NO: 377057 - protein, 24 aa, Mycobacterium
GALATWWPFLFGVAYQVFFNLVGW

SEQ ID NO: 377058 - protein, 25 aa, Mycobacterium
GALGAVLIALIVFGLAKAITGDSDS

SEQ ID NO: 377059 - protein, 23 aa, Mycobacterium
GALGILVMVVWVGTALTLSTAAS

SEQ ID NO: 377060 - protein, 24 aa, Mycobacterium
GALGVVWFWLIRRYTIEGPLEHDA

SEQ ID NO: 377061 - protein, 39 aa, Mycobacterium
GALVLRALLIAFFALVYLLPLILWLWRGETTHDRHAAAR

SEQ ID NO: 377062 - protein, 20 aa, Mycobacterium
GALWAPLLAALMLALLTAGS

SEQ ID NO: 377063 - protein, 17 aa, Mycobacterium
GANLGWWKGLAGLWQWA

SEQ ID NO: 377064 - protein, 26 aa, Mycobacterium
GASILYPSLFLLPLLATTLAIVAGVG

SEQ ID NO: 377065 - protein, 18 aa, Mycobacterium
GASWWKALLALVVAVALI

SEQ ID NO: 377066 - protein, 25 aa, Mycobacterium
GATIALFVIPLWLGADLQSALLRAM

SEQ ID NO: 377067 - protein, 17 aa, Mycobacterium
GATIVFLACRWVQAQGG

SEQ ID NO: 377068 - protein, 18 aa, Mycobacterium
GAVLAWLVAGLAVSESVS

SEQ ID NO: 377069 - protein, 22 aa, Mycobacterium
GAVVPLIPFLLGFASLLAGLIC

SEQ ID NO: 377070 - protein, 25 aa, Mycobacterium
GAWLPTRVALLVVPLLAAGVSGAAV

SEQ ID NO: 377071 - protein, 24 aa, Mycobacterium
GAYPLYLDAYPLPPFAIYGAVSLH

SEQ ID NO: 377072 - protein, 22 aa, Mycobacterium
GAYPLYLDAYPLPQFAIYGAVS

SEQ ID NO: 377073 - protein, 18 aa, Mycobacterium
GCHTMSLDWVAWRGLGFA

SEQ ID NO: 377074 - protein, 20 aa, Mycobacterium
GCVALGLVLTLWVVHTRALL

SEQ ID NO: 377075 - protein, 25 aa, Mycobacterium
GDEYVTWAALLWLTVFTTGMCFVLK

SEQ ID NO: 377076 - protein, 23 aa, Mycobacterium
GDFFSFYLCEMLFKLNGKGGQPV

SEQ ID NO: 377077 - protein, 22 aa, Mycobacterium
GDFFSFYMCDLLLKLNGKGGQP

SEQ ID NO: 377078 - protein, 27 aa, Mycobacterium
GDFSFLHQPTWLRLFSIMLMFAGVTTT

SEQ ID NO: 377079 - protein, 18 aa, Mycobacterium
GDGAFFLLLDEPEVYGLP

SEQ ID NO: 377080 - protein, 20 aa, Mycobacterium
GDLPMWPFVVAVVVSVGAAL

SEQ ID NO: 377081 - protein, 17 aa, Mycobacterium
GDPLLVVTINFLGLRHL

SEQ ID NO: 377082 - protein, 24 aa, Mycobacterium
GDRPVQVWSLWSTTLRRLAEGHRA

SEQ ID NO: 377083 - protein, 23 aa, Mycobacterium
GDRRPELAPLDRVFAAALAKQPN

SEQ ID NO: 377084 - protein, 20 aa, Mycobacterium
GDRTLLLYPPGLPFVAAFLG

SEQ ID NO: 377085 - protein, 17 aa, Mycobacterium
GDWWDAMPLPKNRTYLA

SEQ ID NO: 377086 - protein, 18 aa, Mycobacterium
GEFLAWIIGWNLLLELAI

SEQ ID NO: 377087 - protein, 25 aa, Mycobacterium
GELVYLPPEWFATSPPPPLPTVMMI

SEQ ID NO: 377088 - protein, 24 aa, Mycobacterium
GELVYLPPEWFTSSPPPALPTVMM

SEQ ID NO: 377089 - protein, 22 aa, Mycobacterium
GEPMLWLERALVVLVAASPCAL

SEQ ID NO: 377090 - protein, 24 aa, Mycobacterium
GEWAVLIFRWLLLTGTFACAMAFH

SEQ ID NO: 377091 - protein, 23 aa, Mycobacterium
GFALTVWLWFSLDGLALIIGLCW

SEQ ID NO: 377092 - protein, 21 aa, Mycobacterium
GFAMFTMFWTALTFLLSGAPY

SEQ ID NO: 377093 - protein, 27 aa, Mycobacterium
GFAPFFLPLALFIGALIVWMLLSPLRS

SEQ ID NO: 377094 - protein, 17 aa, Mycobacterium
GFFAIWWAWMNFTWFAS

SEQ ID NO: 377095 - protein, 22 aa, Mycobacterium
GFFSPLFFVWLGASLQVRELGA

SEQ ID NO: 377096 - protein, 28 aa, Mycobacterium
GFGLALLLIFLFWPWEYKPKAAPGSLLY

SEQ ID NO: 377097 - protein, 27 aa, Mycobacterium
GFGLALLLIFLFWPWEYKPKEAADSWL

SEQ ID NO: 377098 - protein, 31 aa, Mycobacterium
GFLFGLAFYLPLLPWISLLVGAVPWVVLATT

SEQ ID NO: 377099 - protein, 17 aa, Mycobacterium
GFLRAIKNNLFGGGGLQ

SEQ ID NO: 377100 - protein, 17 aa, Mycobacterium
GFLYFFFVLPRWPELMG

SEQ ID NO: 377101 - protein, 21 aa, Mycobacterium
GFMVLFAFPFFWLAGANSGWT

SEQ ID NO: 377102 - protein, 22 aa, Mycobacterium
GFPLFTPRFDGAFTAGLYSVAP

SEQ ID NO: 377103 - protein, 18 aa, Mycobacterium
GFQHRRFWLGQLDAGRTD

SEQ ID NO: 377104 - protein, 18 aa, Mycobacterium
GFVALIAFVMLLVSVHSV

SEQ ID NO: 377105 - protein, 20 aa, Mycobacterium
GFVLYFTTYHTWLGYRRRRL

SEQ ID NO: 377106 - protein, 32 aa, Mycobacterium
GFYAFDLPFYRLVLTYLFVATFLAFVANLLGH

SEQ ID NO: 377107 - protein, 31 aa, Mycobacterium
GFYAFDLPFYRLVLTYLFVGVFLAFLANLLG

SEQ ID NO: 377108 - protein, 31 aa, Mycobacterium
GFYAFELPFYRLLLSYLFVAIFLAFVANVVS

SEQ ID NO: 377109 - protein, 31 aa, Mycobacterium
GFYAFELPFYRLVLSYLFVAVFLAFVANLLA

SEQ ID NO: 377110 - protein, 17 aa, Mycobacterium
GFYPILMFGLPAAALAM

SEQ ID NO: 377111 - protein, 38 aa, Mycobacterium
GFYYTAFVPNLLLFELFQPFFDYFWGFKAYGTPGYPPD

SEQ ID NO: 377112 - protein, 24 aa, Mycobacterium
GGASLWWMIGLLAAAGVLGLMVVL

SEQ ID NO: 377113 - protein, 24 aa, Mycobacterium
GGASLWWMIGLLVAAGVLGLMVVL

SEQ ID NO: 377114 - protein, 19 aa, Mycobacterium
GGCMLGMIAILIFGGLRNF

SEQ ID NO: 377115 - protein, 22 aa, Mycobacterium
GGDGAFFLLLDEPEVYGLPPDP

SEQ ID NO: 377116 - protein, 22 aa, Mycobacterium
GGDGAFFLLLDQPEVYGLPPDP

SEQ ID NO: 377117 - protein, 22 aa, Mycobacterium
GGDLLWLWCYHLGWVVIALAIV

SEQ ID NO: 377118 - protein, 31 aa, Mycobacterium
GGERRKWLRRVWLTWPLALLATASTMVFGAA

SEQ ID NO: 377119 - protein, 17 aa, Mycobacterium
GGGFVGWQLWQTKQVIA

SEQ ID NO: 377120 - protein, 18 aa, Mycobacterium
GGGIKLIAWGIKPAITAV

SEQ ID NO: 377121 - protein, 24 aa, Mycobacterium
GGGLGLIILLGALFLGVDPGRVMN

SEQ ID NO: 377122 - protein, 41 aa, Mycobacterium
GGGVSWPALLIVLGIIAVLIGILWIWSRRRRAKRRKAEFEA

SEQ ID NO: 377123 - protein, 33 aa, Mycobacterium
GGIALLFVVVILVLGFWVPGFFVTTKLDVSKAN

SEQ ID NO: 377124 - protein, 22 aa, Mycobacterium
GGIALVVVLLVTSWLLAKSMGY

SEQ ID NO: 377125 - protein, 24 aa, Mycobacterium
GGLAILVMVVWVGTALAISTAASR

SEQ ID NO: 377126 - protein, 24 aa, Mycobacterium
GGLAVLIMLIWVSTALVISTSDSR

SEQ ID NO: 377127 - protein, 24 aa, Mycobacterium
GGLAVLIMLMWVGTALIISTADSR

SEQ ID NO: 377128 - protein, 21 aa, Mycobacterium
GGLFLWIGYRRRTGRLRRIAV

SEQ ID NO: 377129 - protein, 25 aa, Mycobacterium
GGLQFMLIIWLQGIWLPLHGYSFES

SEQ ID NO: 377130 - protein, 25 aa, Mycobacterium
GGLQFMLIIWLQGIWLPLRGYSYES

SEQ ID NO: 377131 - protein, 23 aa, Mycobacterium
GGNSGAFALFAQAGNGGAGANGG

SEQ ID NO: 377132 - protein, 25 aa, Mycobacterium
GGPELPWWLWAIVTLGLVAYLGYRN

SEQ ID NO: 377133 - protein, 17 aa, Mycobacterium
GGPGALFWMWMVAFLGA

SEQ ID NO: 377134 - protein, 23 aa, Mycobacterium
GGRRPGWVLLTTLLVLAIGASSA

SEQ ID NO: 377135 - protein, 18 aa, Mycobacterium
GGRSRLGFGTLAVLLCLL

SEQ ID NO: 377136 - protein, 24 aa, Mycobacterium
GGSDPWQLLWQLLQYLWNAYTGFN

SEQ ID NO: 377137 - protein, 17 aa, Mycobacterium
GGSVSWFGVIVALALIA

SEQ ID NO: 377138 - protein, 17 aa, Mycobacterium
GGTAFVVIFAVVLVFYI

SEQ ID NO: 377139 - protein, 24 aa, Mycobacterium
GGTAVVVIFLVALVSYIVVTHHKK

SEQ ID NO: 377140 - protein, 25 aa, Mycobacterium
GGVLLHHFWWGSVFLINVPVLIVLL

SEQ ID NO: 377141 - protein, 26 aa, Mycobacterium
GGVTVLAIVLWRWRPFRLVSGVAALA

SEQ ID NO: 377142 - protein, 30 aa, Mycobacterium
GGVTVLAVALWRFRWFRLATSWALVAALGC

SEQ ID NO: 377143 - protein, 30 aa, Mycobacterium
GGVTVLVVALWRFRWIRLAMISALLATLGS

SEQ ID NO: 377144 - protein, 21 aa, Mycobacterium
GGWKRLPLTVFGIAVAAVLVA

SEQ ID NO: 377145 - protein, 22 aa, Mycobacterium
GGYFFRYLFSNPIPYARAGLDP

SEQ ID NO: 377146 - protein, 25 aa, Mycobacterium
GHDRLLGLVLLAPAAPAPGLGLAAV

SEQ ID NO: 377147 - protein, 24 aa, Mycobacterium
GHEQLFDTLFLYESYPIDTSAFMG

SEQ ID NO: 377148 - protein, 17 aa, Mycobacterium
GHMLVFFVRALLGIPVA

SEQ ID NO: 377149 - protein, 22 aa, Mycobacterium
GHPVHPLLIFLPLGSWMTALLF

SEQ ID NO: 377150 - protein, 24 aa, Mycobacterium
GHPWQVFGVLWLYCLAVGGAVTGV

SEQ ID NO: 377151 - protein, 35 aa, Mycobacterium
GHRQRFWLSGMALLATLLVACAYLMVGALRARAFA

SEQ ID NO: 377152 - protein, 20 aa, Mycobacterium
GHSWWIQLLALISVASVALA

SEQ ID NO: 377153 - protein, 24 aa, Mycobacterium
GHVRPLYAPGLRLLIPLLDKMIRV

SEQ ID NO: 377154 - protein, 26 aa, Mycobacterium
GHWEFYMALAYFKLAIIAAGIDFRRR

SEQ ID NO: 377155 - protein, 29 aa, Mycobacterium
GIALVFVRWWGLPAWSWAVLWRRGRRPID

SEQ ID NO: 377156 - protein, 23 aa, Mycobacterium
GIARWIRRLAIPIILGWIALLGV

SEQ ID NO: 377157 - protein, 24 aa, Mycobacterium
GIDGWRWLLILGGLAAVFVLAVRS

SEQ ID NO: 377158 - protein, 18 aa, Mycobacterium
GIELYWLVLAMSVILLLA

SEQ ID NO: 377159 - protein, 17 aa, Mycobacterium
GIFLINVPIGLAVLAGL

SEQ ID NO: 377160 - protein, 20 aa, Mycobacterium
GIFSALSFWYVPKLGLRLVL

SEQ ID NO: 377161 - protein, 18 aa, Mycobacterium
GIFVCLFCAFYFMTVTYS

SEQ ID NO: 377162 - protein, 19 aa, Mycobacterium
GIFVCLFCAFYFMTVTYSL

SEQ ID NO: 377163 - protein, 18 aa, Mycobacterium
GIFYLRLPATFGIGTYEV

SEQ ID NO: 377164 - protein, 23 aa, Mycobacterium
GIGWAFIGIIFVAFYTANLTAAL

SEQ ID NO: 377165 - protein, 22 aa, Mycobacterium
GIIGLLPQTGFPPPGGPAAGTE

SEQ ID NO: 377166 - protein, 18 aa, Mycobacterium
GIITVLMPLAMFGTLGLA

SEQ ID NO: 377167 - protein, 17 aa, Mycobacterium
GILTWIFVDGHLSGVLN

SEQ ID NO: 377168 - protein, 24 aa, Mycobacterium
GIPYGYWIPLTALLVLRPETAHTY

SEQ ID NO: 377169 - protein, 18 aa, Mycobacterium
GISLWRLLIGLCLAAVIG

SEQ ID NO: 377170 - protein, 18 aa, Mycobacterium
GITFFDYQPWLRRRLEDR

SEQ ID NO: 377171 - protein, 21 aa, Mycobacterium
GIVAYGLLWMLMPPGDDVAAV

SEQ ID NO: 377172 - protein, 17 aa, Mycobacterium
GIVFTWLFMYGMVPMMQ

SEQ ID NO: 377173 - protein, 18 aa, Mycobacterium
GIVLLFARPRLRVGPSGV

SEQ ID NO: 377174 - protein, 27 aa, Mycobacterium
GIVRGLKMLLVTVLLVVLGIGLALVLY

SEQ ID NO: 377175 - protein, 17 aa, Mycobacterium
GIWWPIGRALAWCCVVL

SEQ ID NO: 377176 - protein, 18 aa, Mycobacterium
GIYFSKRQLLARGGIALV

SEQ ID NO: 377177 - protein, 18 aa, Mycobacterium
GKFMPLLPTQQQAPVPPP

SEQ ID NO: 377178 - protein, 22 aa, Mycobacterium
GKGIGLLRRALAPVSAVLSASV

SEQ ID NO: 377179 - protein, 23 aa, Mycobacterium
GKGITLLRRALAPLSAVWSASVD

SEQ ID NO: 377180 - protein, 28 aa, Mycobacterium
GKPYMWWAAALVPLYWMLQSIAALKAVF

SEQ ID NO: 377181 - protein, 20 aa, Mycobacterium
GKRPKLRRILSDPDARVIVV

SEQ ID NO: 377182 - protein, 22 aa, Mycobacterium
GKSTLLINLLLGLVARHTPEQL

SEQ ID NO: 377183 - protein, 22 aa, Mycobacterium
GKVALYLLITIAPFAVIAPLIG

SEQ ID NO: 377184 - protein, 35 aa, Mycobacterium
GKVEFAGFFAWLAWLVLHLYYLIGHRNRLAAMFAW

SEQ ID NO: 377185 - protein, 33 aa, Mycobacterium
GKVEFAGFIAWLAWLFLHLLYLVGHRNRVAAAF

SEQ ID NO: 377186 - protein, 23 aa, Mycobacterium
GKYWWLRWVILGIVAIVLAVEIA

SEQ ID NO: 377187 - protein, 19 aa, Mycobacterium
GLAFYVPLLPWIGSLVGPM

SEQ ID NO: 377188 - protein, 21 aa, Mycobacterium
GLAFYVPLLPWISGLVGAVPW

SEQ ID NO: 377189 - protein, 24 aa, Mycobacterium
GLALLGVFLFWPWEYKPFGDPGNA

SEQ ID NO: 377190 - protein, 19 aa, Mycobacterium
GLALLIWVPAIRCPAGVAV

SEQ ID NO: 377191 - protein, 24 aa, Mycobacterium
GLALLPLLLVLAFVPVRAGAAAGA

SEQ ID NO: 377192 - protein, 22 aa, Mycobacterium
GLEQLLVLLPPASAFYQSAVGS

SEQ ID NO: 377193 - protein, 23 aa, Mycobacterium
GLEYEAWFLAAAVRRGWVVAVTD

SEQ ID NO: 377194 - protein, 23 aa, Mycobacterium
GLFAQWGLWRWAFGMLAVITAGI

SEQ ID NO: 377195 - protein, 26 aa, Mycobacterium
GLGSYNPWPVALIVGIPLVTVGLAVV

SEQ ID NO: 377196 - protein, 24 aa, Mycobacterium
GLHPGLPVWWIVAVLVFAGVMGLF

SEQ ID NO: 377197 - protein, 18 aa, Mycobacterium
GLHPLMFFLPIWHDANSW

SEQ ID NO: 377198 - protein, 21 aa, Mycobacterium
GLIAIIMFALLFLLTGSVVVP

SEQ ID NO: 377199 - protein, 18 aa, Mycobacterium
GLLFGPPLLTIAAPLLLN

SEQ ID NO: 377200 - protein, 26 aa, Mycobacterium
GLLIFCGLSLWWWPLHAGTGNLDLTP

SEQ ID NO: 377201 - protein, 18 aa, Mycobacterium
GLLNLVLVDFKGGATFLG

SEQ ID NO: 377202 - protein, 17 aa, Mycobacterium
GLLPLHAWLPRAHPESP

SEQ ID NO: 377203 - protein, 17 aa, Mycobacterium
GLMIAFYYGLTGFACAW

SEQ ID NO: 377204 - protein, 25 aa, Mycobacterium
GLMVIAILVVWRWAPARVAKIPGPL

SEQ ID NO: 377205 - protein, 17 aa, Mycobacterium
GLPLPALLIPPMALSRL

SEQ ID NO: 377206 - protein, 25 aa, Mycobacterium
GLPPALWTLILLGTITGLVVLTVAA

SEQ ID NO: 377207 - protein, 20 aa, Mycobacterium
GLPPFYPAGWFWLGGRIAAA

SEQ ID NO: 377208 - protein, 21 aa, Mycobacterium
GLPPFYPAGWFWLGGRLAALT

SEQ ID NO: 377209 - protein, 17 aa, Mycobacterium
GLPPFYPPGWFWIGGRA

SEQ ID NO: 377210 - protein, 18 aa, Mycobacterium
GLPPFYPPGWFWIGGRAA

SEQ ID NO: 377211 - protein, 22 aa, Mycobacterium
GLPWYAILVLPILFSAGMSLFD

SEQ ID NO: 377212 - protein, 20 aa, Mycobacterium
GLPYIVAFLGAIQAGLIAVP

SEQ ID NO: 377213 - protein, 22 aa, Mycobacterium
GLQTLLLVVLLALIAVGLGSIL

SEQ ID NO: 377214 - protein, 27 aa, Mycobacterium
GLRFVLVPIFLYLLFYDGGHQTTFRIA

SEQ ID NO: 377215 - protein, 17 aa, Mycobacterium
GLRLLVVNSLVVLAGIA

SEQ ID NO: 377216 - protein, 21 aa, Mycobacterium
GLSFTLTWWSFTFPVGTCVTG

SEQ ID NO: 377217 - protein, 24 aa, Mycobacterium
GLSLAIITVLMPLSLFGTLGLAAV

SEQ ID NO: 377218 - protein, 25 aa, Mycobacterium
GLSLFMIVAITLTWLVYVTLRRDVA

SEQ ID NO: 377219 - protein, 24 aa, Mycobacterium
GLSLFMVVALTLTWMVYVTLRRDV

SEQ ID NO: 377220 - protein, 21 aa, Mycobacterium
GLSLFMVVAVALTWMVYVSLR

SEQ ID NO: 377221 - protein, 22 aa, Mycobacterium
GLSLPMFMEELFWGCAGIGLAI

SEQ ID NO: 377222 - protein, 22 aa, Mycobacterium
GLSLPMFMEELFWGCAGIGLAV

SEQ ID NO: 377223 - protein, 20 aa, Mycobacterium
GLSVLIWQDLFGFKIHWIVA

SEQ ID NO: 377224 - protein, 20 aa, Mycobacterium
GLSVLIWQDLFGIKIHWIVA

SEQ ID NO: 377225 - protein, 18 aa, Mycobacterium
GLSWPFVLLPHLGMIRGA

SEQ ID NO: 377226 - protein, 29 aa, Mycobacterium
GLTAWIAAPLLFIGFMFGLLLLTGTTIRE

SEQ ID NO: 377227 - protein, 30 aa, Mycobacterium
GLTAWIAAPLLFIGVLFGLLLITGTTIREV

SEQ ID NO: 377228 - protein, 29 aa, Mycobacterium
GLTFIVIIIMLLFFYRSIFTVLMVLLMVG

SEQ ID NO: 377229 - protein, 20 aa, Mycobacterium
GLTLMWLLSWLIATPVRVVR

SEQ ID NO: 377230 - protein, 26 aa, Mycobacterium
GLTMLTWLMRIGFLGAPLIVGVVADA

SEQ ID NO: 377231 - protein, 18 aa, Mycobacterium
GLTSWLTGMFDRSAWRPA

SEQ ID NO: 377232 - protein, 18 aa, Mycobacterium
GLTVLVLLLAAWFHFVSP

SEQ ID NO: 377233 - protein, 24 aa, Mycobacterium
GLTVNLMIYWRLWAKYKASTELSG

SEQ ID NO: 377234 - protein, 22 aa, Mycobacterium
GLTVTLVWLYIEILRLLSYLQN

SEQ ID NO: 377235 - protein, 29 aa, Mycobacterium
GLTVWIAAPLLFIGALFGLLLLTGTTIRE

SEQ ID NO: 377236 - protein, 25 aa, Mycobacterium
GLVGPIFLIVYFTLGLGSLLQWMFY

SEQ ID NO: 377237 - protein, 40 aa, Mycobacterium
GLVLTIGFLLPWIPVLGVLVLAVVWVLRRKIFSRASRVGH

SEQ ID NO: 377238 - protein, 17 aa, Mycobacterium
GLVLTLWVVHTRALLSD

SEQ ID NO: 377239 - protein, 23 aa, Mycobacterium
GLVWPFVLLPHLGMIRGAAATGI

SEQ ID NO: 377240 - protein, 23 aa, Mycobacterium
GLWAFLTRFALNCRLSSWTRAAK

SEQ ID NO: 377241 - protein, 18 aa, Mycobacterium
GLWTLLRIPTLIACGDHD

SEQ ID NO: 377242 - protein, 18 aa, Mycobacterium
GMAAPPVRLLPIDLAPDA

SEQ ID NO: 377243 - protein, 18 aa, Mycobacterium
GMALIFYAFLRGLTHWQS

SEQ ID NO: 377244 - protein, 25 aa, Mycobacterium
GMLREVGVLLLIALVLYCITQNFIA

SEQ ID NO: 377245 - protein, 23 aa, Mycobacterium
GMNFRFMPELTWTWGYPGVMAVM

SEQ ID NO: 377246 - protein, 17 aa, Mycobacterium
GMNGFFFAAIARIPLGV

SEQ ID NO: 377247 - protein, 19 aa, Mycobacterium
GMPRLLRWLSPFIPLASTV

SEQ ID NO: 377248 - protein, 19 aa, Mycobacterium
GMTLLWTLALLIPVLYVNQ

SEQ ID NO: 377249 - protein, 23 aa, Mycobacterium
GNGWVATICAVLLLLAGGAVAAG

SEQ ID NO: 377250 - protein, 26 aa, Mycobacterium
GNMLPWLLPLLYVLVALSLVAAAGLR

SEQ ID NO: 377251 - protein, 21 aa, Mycobacterium
GNPLVWIERALVVLVAASPCA

SEQ ID NO: 377252 - protein, 24 aa, Mycobacterium
GNRAFWIIAAVFVVGILGAVAAVA

SEQ ID NO: 377253 - protein, 19 aa, Mycobacterium
GPAFFWTWPIVFLGQYMVA

SEQ ID NO: 377254 - protein, 21 aa, Mycobacterium
GPALALFGLCRRLLGGSPDGD

SEQ ID NO: 377255 - protein, 33 aa, Mycobacterium
GPARPRRRRLLWTLIAAPFALLAVAYIGDLLYS

SEQ ID NO: 377256 - protein, 19 aa, Mycobacterium
GPAVFLWFVGIGGLTVVMS

SEQ ID NO: 377257 - protein, 22 aa, Mycobacterium
GPEVWWLLSVARWASGMPAATV

SEQ ID NO: 377258 - protein, 24 aa, Mycobacterium
GPGSKLPWLIIGGLVILAVVALVA

SEQ ID NO: 377259 - protein, 21 aa, Mycobacterium
GPIFLVIYFATGADPLLAWMF

SEQ ID NO: 377260 - protein, 18 aa, Mycobacterium
GPPPLIPPGGHQGPHGPP

SEQ ID NO: 377261 - protein, 19 aa, Mycobacterium
GPPPVRWPRALHLVPPYHE

SEQ ID NO: 377262 - protein, 26 aa, Mycobacterium
GPRYLVSMWPWRALLWTVFGGVLGTV

SEQ ID NO: 377263 - protein, 20 aa, Mycobacterium
GPSGIWWAALLGGLVLLAAG

SEQ ID NO: 377264 - protein, 24 aa, Mycobacterium
GPSWLLWSVILLTSGLVLGCSIVF

SEQ ID NO: 377265 - protein, 30 aa, Mycobacterium
GPVEFSGLIAWFAWLVLHLVYLVGFKTKVS

SEQ ID NO: 377266 - protein, 26 aa, Mycobacterium
GQFLIAFLQLIWTLAIFVLLLVEIIK

SEQ ID NO: 377267 - protein, 27 aa, Mycobacterium
GQGEPCEKLWLPPLLRPRPLGRLIADS

SEQ ID NO: 377268 - protein, 24 aa, Mycobacterium
GQMRVGQLLAFMLYAMQILAAASM

SEQ ID NO: 377269 - protein, 17 aa, Mycobacterium
GQRPAWLNVIRADPGRV

SEQ ID NO: 377270 - protein, 32 aa, Mycobacterium
GQRRPLYARLLYGLSIPIVILWVLLACGLNAA

SEQ ID NO: 377271 - protein, 22 aa, Mycobacterium
GQRRRILLARALLSRVPVLLLD

SEQ ID NO: 377272 - protein, 26 aa, Mycobacterium
GQVSYLALIVLAVIALVIGALGGVIG

SEQ ID NO: 377273 - protein, 21 aa, Mycobacterium
GQVVLPFTGLNFRFAPGGVAV

SEQ ID NO: 377274 - protein, 25 aa, Mycobacterium
GRAAALLLLGIGIAVLIVVGGWALT

SEQ ID NO: 377275 - protein, 24 aa, Mycobacterium
GRALLFLPPAWLLGTAMLGLSKIL

SEQ ID NO: 377276 - protein, 18 aa, Mycobacterium
GRFIALLRIFAGPLAGAL

SEQ ID NO: 377277 - protein, 30 aa, Mycobacterium
GRFISTYGWRAYAIPLLVALTVFVGYQTVT

SEQ ID NO: 377278 - protein, 20 aa, Mycobacterium
GRIMALWLVGFLGSRPFAAA

SEQ ID NO: 377279 - protein, 19 aa, Mycobacterium
GRIMALWLVGFLGSRPIAA

SEQ ID NO: 377280 - protein, 17 aa, Mycobacterium
GRIPLEQLAWLSPSRWA

SEQ ID NO: 377281 - protein, 29 aa, Mycobacterium
GRISYSWYLWHWPVLLLAPPLLGHPLGLV

SEQ ID NO: 377282 - protein, 23 aa, Mycobacterium
GRLGWPLWVAYVGVFALTVLVGA

SEQ ID NO: 377283 - protein, 19 aa, Mycobacterium
GRLLIFSAYVTHRIPEVWP

SEQ ID NO: 377284 - protein, 22 aa, Mycobacterium
GRLRNPWILLAAAALAVLLVFA

SEQ ID NO: 377285 - protein, 32 aa, Mycobacterium
GRPFRRRNYLPALILGIALLAVTVFVWASALT

SEQ ID NO: 377286 - protein, 17 aa, Mycobacterium
GRPPLARFLYRFSIPIL

SEQ ID NO: 377287 - protein, 22 aa, Mycobacterium
GRRETWLIMRLPIIDNAQALRW

SEQ ID NO: 377288 - protein, 26 aa, Mycobacterium
GRRNWGWVIAIILVIAALAAAAVVGT

SEQ ID NO: 377289 - protein, 27 aa, Mycobacterium
GRSQSRRLLPYTWLGAGAVALGVGAAL

SEQ ID NO: 377290 - protein, 18 aa, Mycobacterium
GRVLAVVILLLSAATYAL

SEQ ID NO: 377291 - protein, 24 aa, Mycobacterium
GRVLLFLPPAWLLGTAMLGVSKIL

SEQ ID NO: 377292 - protein, 26 aa, Mycobacterium
GRVSYSWYLWHWPALLLAPALIGADL

SEQ ID NO: 377293 - protein, 31 aa, Mycobacterium
GRVSYSWYLWHWPVLLLLPPLLGDPAGLPAR

SEQ ID NO: 377294 - protein, 17 aa, Mycobacterium
GRVWLLPAATALAVLWS

SEQ ID NO: 377295 - protein, 21 aa, Mycobacterium
GRYSVYVWALLAMAAARLGLG

SEQ ID NO: 377296 - protein, 23 aa, Mycobacterium
GSAAAVLVIPWPAGAQLLIRFTG

SEQ ID NO: 377297 - protein, 23 aa, Mycobacterium
GSAVGLIFLWFSMTPSLLPRGPL

SEQ ID NO: 377298 - protein, 21 aa, Mycobacterium
GSFFWLWWTTNLLSGLLALAT

SEQ ID NO: 377299 - protein, 22 aa, Mycobacterium
GSFLVILLYLLVPWTSVNLVDY

SEQ ID NO: 377300 - protein, 22 aa, Mycobacterium
GSFRARFLTDKLLFESQTGKEI

SEQ ID NO: 377301 - protein, 24 aa, Mycobacterium
GSGERLLIYLGIGAALGLLTSWLL

SEQ ID NO: 377302 - protein, 27 aa, Mycobacterium
GSGGSPLIKWMFWTGLLITALDVLIAL

SEQ ID NO: 377303 - protein, 25 aa, Mycobacterium
GSHSDLDWLWWFGAGWVAVAIVGAG

SEQ ID NO: 377304 - protein, 21 aa, Mycobacterium
GSLHLWLNLTLLAGVALVVVG

SEQ ID NO: 377305 - protein, 24 aa, Mycobacterium
GSLLRLPRLPDLVAVPPTLADHLP

SEQ ID NO: 377306 - protein, 22 aa, Mycobacterium
GSLRILLPLSFAVALILLSQGT

SEQ ID NO: 377307 - protein, 23 aa, Mycobacterium
GSLVRLFVLGLIMLPITATVMLR

SEQ ID NO: 377308 - protein, 28 aa, Mycobacterium
GSMAYPLYLWHWPLLIFWFAYSNDDTAG

SEQ ID NO: 377309 - protein, 24 aa, Mycobacterium
GSYAWTIFRKRFWRFWLGAPIADM

SEQ ID NO: 377310 - protein, 24 aa, Mycobacterium
GTAATWLWNNAITPAWNGIKAVIG

SEQ ID NO: 377311 - protein, 17 aa, Mycobacterium
GTAELIRFALTSKLKPF

SEQ ID NO: 377312 - protein, 24 aa, Mycobacterium
GTATGLVFIWLSLTPSLLPRGPLF

SEQ ID NO: 377313 - protein, 26 aa, Mycobacterium
GTFLVGSWMWSIMIKPFRLLAQHARA

SEQ ID NO: 377314 - protein, 23 aa, Mycobacterium
GTFPLAALWPLLLLALATVFTYR

SEQ ID NO: 377315 - protein, 22 aa, Mycobacterium
GTIAAYLWSLWVLFANAGHTHG

SEQ ID NO: 377316 - protein, 25 aa, Mycobacterium
GTLAAFLWSLYALFLGTAGEPGMRH

SEQ ID NO: 377317 - protein, 23 aa, Mycobacterium
GTLSAFLWSLYALFFGTAGTPGM

SEQ ID NO: 377318 - protein, 21 aa, Mycobacterium
GTLWFGGWLVPLLAIWAYWQV

SEQ ID NO: 377319 - protein, 23 aa, Mycobacterium
GTNGSQFFLVYKDSQLPPQYTVF

SEQ ID NO: 377320 - protein, 24 aa, Mycobacterium
GTPAMWWVAVPVLIFALWRMLVRR

SEQ ID NO: 377321 - protein, 23 aa, Mycobacterium
GTQPLWVAAAWLVAIAGLATLAG

SEQ ID NO: 377322 - protein, 24 aa, Mycobacterium
GTVSAFLWSLYALFFGTAGTPGMK

SEQ ID NO: 377323 - protein, 22 aa, Mycobacterium
GVAFVKLAWLLAVSAYVSLVHG

SEQ ID NO: 377324 - protein, 23 aa, Mycobacterium
GVALWLLLGGFFGLALLLVFLFW

SEQ ID NO: 377325 - protein, 20 aa, Mycobacterium
GVALWLPWLLAAGAVFVLSA

SEQ ID NO: 377326 - protein, 27 aa, Mycobacterium
GVASIAVPFLLFSNPLGWAAAAAGFGI

SEQ ID NO: 377327 - protein, 19 aa, Mycobacterium
GVAWHRFAAFFNIYFKRNA

SEQ ID NO: 377328 - protein, 23 aa, Mycobacterium
GVAWLLLIPIVLLAFVAPPAIRP

SEQ ID NO: 377329 - protein, 23 aa, Mycobacterium
GVFARLVLLWFLCSALPIGVIGT

SEQ ID NO: 377330 - protein, 24 aa, Mycobacterium
GVGAFLRLPYTFAVPLFGGRNWTT

SEQ ID NO: 377331 - protein, 20 aa, Mycobacterium
GVGFLLVFMLPALAGYVTAS

SEQ ID NO: 377332 - protein, 18 aa, Mycobacterium
GVGRLTIGLLGVATVLLL

SEQ ID NO: 377333 - protein, 23 aa, Mycobacterium
GVGSLLSWMLYVGLLITVADVLI

SEQ ID NO: 377334 - protein, 21 aa, Mycobacterium
GVIAIVVLLFLACAPVASAQP

SEQ ID NO: 377335 - protein, 25 aa, Mycobacterium
GVIVFLLWLWLTNLALLFGAEVDAE

SEQ ID NO: 377336 - protein, 27 aa, Mycobacterium
GVIVLLLLLAWWLLDALWRPVRGRLAD

SEQ ID NO: 377337 - protein, 20 aa, Mycobacterium
GVLAPLILILLRLLQGFAAG

SEQ ID NO: 377338 - protein, 21 aa, Mycobacterium
GVLDWFFWLLSIVISTAVSWL

SEQ ID NO: 377339 - protein, 18 aa, Mycobacterium
GVLFGLAFYVPLLPWISG

SEQ ID NO: 377340 - protein, 19 aa, Mycobacterium
GVLHVIWRQGLYPGIGAPS

SEQ ID NO: 377341 - protein, 23 aa, Mycobacterium
GVLIVGFIWMLRSAPRRVLASAL

SEQ ID NO: 377342 - protein, 18 aa, Mycobacterium
GVLLWLWLLAFTDSVWSV

SEQ ID NO: 377343 - protein, 17 aa, Mycobacterium
GVLYFFFVLPRTPELLG

SEQ ID NO: 377344 - protein, 24 aa, Mycobacterium
GVMSLIWLGTLPFMTLAVLASILT

SEQ ID NO: 377345 - protein, 24 aa, Mycobacterium
GVMTILFGLIARLPFALAAGLGIN

SEQ ID NO: 377346 - protein, 36 aa, Mycobacterium
GVPESRWIAWPGYLWFGVLVYLFLVLLALEPVRLVL

SEQ ID NO: 377347 - protein, 22 aa, Mycobacterium
GVPPWMVFFAFSVSLIYQFWVH

SEQ ID NO: 377348 - protein, 24 aa, Mycobacterium
GVPVVFLTAWYGLSVLAGVRAGQK

SEQ ID NO: 377349 - protein, 19 aa, Mycobacterium
GVPVWGFAMLWIALATALT

SEQ ID NO: 377350 - protein, 19 aa, Mycobacterium
GVPVWGFAVLWIGLATALT

SEQ ID NO: 377351 - protein, 18 aa, Mycobacterium
GVPWLLISGPLGSAAESS

SEQ ID NO: 377352 - protein, 24 aa, Mycobacterium
GVRRWALILIPLGAASFVLPGVGN

SEQ ID NO: 377353 - protein, 17 aa, Mycobacterium
GVTAWFLSVAGAVATLL

SEQ ID NO: 377354 - protein, 22 aa, Mycobacterium
GVTGWLPLFAVAWLVVGVAQAG

SEQ ID NO: 377355 - protein, 26 aa, Mycobacterium
GVVFVAAVIFFTGLFLGWSSSGHYGW

SEQ ID NO: 377356 - protein, 32 aa, Mycobacterium
GVVHPTFLYELLWNLLVFAVLILVDRRFKIGH

SEQ ID NO: 377357 - protein, 18 aa, Mycobacterium
GVVLHWIIDYWNRFSLWV

SEQ ID NO: 377358 - protein, 17 aa, Mycobacterium
GVVLHWVTDYWNHFCLM

SEQ ID NO: 377359 - protein, 23 aa, Mycobacterium
GVVVMLIWWAISPGFFRGRTLRR

SEQ ID NO: 377360 - protein, 17 aa, Mycobacterium
GVWPLTGWGIGVLLGGA

SEQ ID NO: 377361 - protein, 24 aa, Mycobacterium
GVYARLVLLWFLCSAFPIGVIATL

SEQ ID NO: 377362 - protein, 24 aa, Mycobacterium
GVYPLLIMAMLPVLLGLDVSSRRA

SEQ ID NO: 377363 - protein, 27 aa, Mycobacterium
GWAIFHTLMIFWPFIQLAIQMAVVLAP

SEQ ID NO: 377364 - protein, 26 aa, Mycobacterium
GWALGYVYFLFWLWVLRPVPVAEQEP

SEQ ID NO: 377365 - protein, 22 aa, Mycobacterium
GWALLTWILMAFGTCLSRLASV

SEQ ID NO: 377366 - protein, 19 aa, Mycobacterium
GWASYLILWVLQACVFWRG

SEQ ID NO: 377367 - protein, 19 aa, Mycobacterium
GWEWIFFVNIPIGLAGLVV

SEQ ID NO: 377368 - protein, 18 aa, Mycobacterium
GWLAGIASTLVLLAAAVG

SEQ ID NO: 377369 - protein, 18 aa, Mycobacterium
GWLSTTVFPALKTAFTAI

SEQ ID NO: 377370 - protein, 18 aa, Mycobacterium
GWQWIFFVNVPIGVAGLA

SEQ ID NO: 377371 - protein, 20 aa, Mycobacterium
GWQWIFLINLPIGALTLILA

SEQ ID NO: 377372 - protein, 18 aa, Mycobacterium
GWRIPFFFSLVLVAVALV

SEQ ID NO: 377373 - protein, 19 aa, Mycobacterium
GWRRVPVWRWFVLGAGVGV

SEQ ID NO: 377374 - protein, 17 aa, Mycobacterium
GWRWAFYINLPISVVVI

SEQ ID NO: 377375 - protein, 25 aa, Mycobacterium
GWSAVYLIFIAIITAGLSALAEREH

SEQ ID NO: 377376 - protein, 22 aa, Mycobacterium
GWVILLCLAFSALGKGIGLLRR

SEQ ID NO: 377377 - protein, 17 aa, Mycobacterium
GWVIMWLIMLGFPKLHA

SEQ ID NO: 377378 - protein, 18 aa, Mycobacterium
GWVLAIVVIVLAVAAIAI

SEQ ID NO: 377379 - protein, 25 aa, Mycobacterium
GWVVLALVFYFVWGRHHSALNDETV

SEQ ID NO: 377380 - protein, 21 aa, Mycobacterium
GWWSLLSLLLFNWIALISNAN

SEQ ID NO: 377381 - protein, 20 aa, Mycobacterium
GWWTLILVAVFAVAIFVTYA

SEQ ID NO: 377382 - protein, 22 aa, Mycobacterium
GYAALPFWPQGKIYDAYFSDAG

SEQ ID NO: 377383 - protein, 23 aa, Mycobacterium
GYAEWWQHLSGETSWTLLLGIGQ

SEQ ID NO: 377384 - protein, 20 aa, Mycobacterium
GYFWAPIPWMIEVALALSVA

SEQ ID NO: 377385 - protein, 19 aa, Mycobacterium
GYLALFGMLLRDTRWWLGG

SEQ ID NO: 377386 - protein, 31 aa, Mycobacterium
GYLCYQVVLLALSALFWAIVAIVALIAGMIP

SEQ ID NO: 377387 - protein, 29 aa, Mycobacterium
GYSDDLPPLPWYKRPPVLFGLAAAAALLA

SEQ ID NO: 377388 - protein, 20 aa, Mycobacterium
GYTGLPFFPQGKPYEAYFAD

SEQ ID NO: 377389 - protein, 20 aa, Mycobacterium
GYVAFWWPDLPLWIPALVTV

SEQ ID NO: 377390 - protein, 31 aa, Mycobacterium
GYYNGMFFYPGYYPYAFWGPGWGWALTDVLL

SEQ ID NO: 377391 - protein, 17 aa, Mycobacterium
HAAVWWKALLALVVAVA

SEQ ID NO: 377392 - protein, 36 aa, Mycobacterium
HANKFGWHSWWWLAAIPVLVLLVVVAWALFGWRRRR

SEQ ID NO: 377393 - protein, 25 aa, Mycobacterium
HAPKTWLLDMAMLAALSLLYGGFVR

SEQ ID NO: 377394 - protein, 23 aa, Mycobacterium
HAPLLWLALLFLVIGGIADMVSA

SEQ ID NO: 377395 - protein, 21 aa, Mycobacterium
HARAILIYGLLLTAATAGAAA

SEQ ID NO: 377396 - protein, 27 aa, Mycobacterium
HATRILAIPILIGWLLITAALNVIAPQ

SEQ ID NO: 377397 - protein, 18 aa, Mycobacterium
HCFDIPMCWALRSVFDAL

SEQ ID NO: 377398 - protein, 18 aa, Mycobacterium
HCFNIPICWALRSVFDSL

SEQ ID NO: 377399 - protein, 25 aa, Mycobacterium
HDLRFIIVLTVIVVLLILVALLRAI

SEQ ID NO: 377400 - protein, 23 aa, Mycobacterium
HETDWLAIVLTAIAGAALGLALG

SEQ ID NO: 377401 - protein, 19 aa, Mycobacterium
HFFNIVFMMFIIRSGLQIL

SEQ ID NO: 377402 - protein, 17 aa, Mycobacterium
HFRSGRWLLLVDAVLLI

SEQ ID NO: 377403 - protein, 20 aa, Mycobacterium
HGAPRWPWVVGIAAIVAAIA

SEQ ID NO: 377404 - protein, 21 aa, Mycobacterium
HGAPRWPWVVGVAAILAAIAL

SEQ ID NO: 377405 - protein, 19 aa, Mycobacterium
HGGLFLGTGGDGGAGAAGV

SEQ ID NO: 377406 - protein, 23 aa, Mycobacterium
HGLMPIVFFLLAAGWFVLVAGGR

SEQ ID NO: 377407 - protein, 25 aa, Mycobacterium
HGSLLLIQPLLVSSLLFALPLSARL

SEQ ID NO: 377408 - protein, 19 aa, Mycobacterium
HGVWILLFTIPFAGLVDEI

SEQ ID NO: 377409 - protein, 21 aa, Mycobacterium
HHCVIAFAALGWYASVHRLPN

SEQ ID NO: 377410 - protein, 17 aa, Mycobacterium
HIPAMLLALSLVLFTVA

SEQ ID NO: 377411 - protein, 25 aa, Mycobacterium
HKLEPLIRLPLILGLAHALSRIPLP

SEQ ID NO: 377412 - protein, 32 aa, Mycobacterium
HKLEPLLRLPLALGLIYLLGRIPLPGSVARPV

SEQ ID NO: 377413 - protein, 20 aa, Mycobacterium
HLHWLVLPLTFIILVAVGSD

SEQ ID NO: 377414 - protein, 18 aa, Mycobacterium
HLIGLHLHWLVLPLTFII

SEQ ID NO: 377415 - protein, 25 aa, Mycobacterium
HLIGLPLHWLVLPLAFIILVAVGSD

SEQ ID NO: 377416 - protein, 25 aa, Mycobacterium
HLIGLPLHWLVLPLTFIILVAVGSD

SEQ ID NO: 377417 - protein, 18 aa, Mycobacterium
HLRLPLRQVLWGLDEALL

SEQ ID NO: 377418 - protein, 17 aa, Mycobacterium
HLVGLHLHWLVLPLTFI

SEQ ID NO: 377419 - protein, 27 aa, Mycobacterium
HLVGLPLHWLILPLTFIILVAVGSDYN

SEQ ID NO: 377420 - protein, 20 aa, Mycobacterium
HLWIPLVLVIVLAVSGLVVM

SEQ ID NO: 377421 - protein, 25 aa, Mycobacterium
HNSGAWLVLFMIFNVIWTYVLVRGS

SEQ ID NO: 377422 - protein, 26 aa, Mycobacterium
HPARYLTLFLVLLVGVYLLVFLTGDK

SEQ ID NO: 377423 - protein, 25 aa, Mycobacterium
HPAWHTLILVLLFVAAMWVTYALFM

SEQ ID NO: 377424 - protein, 20 aa, Mycobacterium
HPGLPLWPYLVCAALTGLGG

SEQ ID NO: 377425 - protein, 21 aa, Mycobacterium
HPMRYLAAFLVLLIGAYLLVF

SEQ ID NO: 377426 - protein, 19 aa, Mycobacterium
HPRWAWWLTTVPLLREFLV

SEQ ID NO: 377427 - protein, 25 aa, Mycobacterium
HQEAALTWLLLVSVPILALANYWIM

SEQ ID NO: 377428 - protein, 31 aa, Mycobacterium
HQNPDRWAWLWSLLVFLAVASSVVALIWFGV

SEQ ID NO: 377429 - protein, 21 aa, Mycobacterium
HRLFMAFLAVTIFISAVAGVV

SEQ ID NO: 377430 - protein, 17 aa, Mycobacterium
HRLTIVALLLLTFATGL

SEQ ID NO: 377431 - protein, 17 aa, Mycobacterium
HRMRCTTTFFGIAALGA

SEQ ID NO: 377432 - protein, 33 aa, Mycobacterium
HRPFLGHLIRVLSLPIILFWVALAVILGTVTPS

SEQ ID NO: 377433 - protein, 18 aa, Mycobacterium
HRPILLTLLALLLAAGSF

SEQ ID NO: 377434 - protein, 34 aa, Mycobacterium
HRPNRVWWRFVAWWLPCVALAVTWWVIALLHLGR

SEQ ID NO: 377435 - protein, 19 aa, Mycobacterium
HRRVLIICTLAIGAATLGG

SEQ ID NO: 377436 - protein, 25 aa, Mycobacterium
HRWSRRRIMLVAVLAAVLVVAALFI

SEQ ID NO: 377437 - protein, 24 aa, Mycobacterium
HSGNILTFVYWLGLLLLMFLSGAE

SEQ ID NO: 377438 - protein, 17 aa, Mycobacterium
HSMLQISPIFFREAANL

SEQ ID NO: 377439 - protein, 23 aa, Mycobacterium
HSRPAWLFDMAMLATLSVAYACL

SEQ ID NO: 377440 - protein, 25 aa, Mycobacterium
HSTVPLVVAIALSLLAMLLIRQLRR

SEQ ID NO: 377441 - protein, 23 aa, Mycobacterium
HTAGAWWFDMAMLAFISLCYVSF

SEQ ID NO: 377442 - protein, 27 aa, Mycobacterium
HTGGAWLILFMIFNVIWTYALVRGAAA

SEQ ID NO: 377443 - protein, 25 aa, Mycobacterium
HTGGAWLILFMIFNVIWTYVLVRGS

SEQ ID NO: 377444 - protein, 25 aa, Mycobacterium
HTGGAWLVLFMIFNVVWTYVLVRGS

SEQ ID NO: 377445 - protein, 23 aa, Mycobacterium
HTPARWWFDVGMLALISAVYLGF

SEQ ID NO: 377446 - protein, 23 aa, Mycobacterium
HTTWVLYAVIIVSALIIAGAIPI

SEQ ID NO: 377447 - protein, 22 aa, Mycobacterium
HTTWVLYTVIIISALIIAGAIP

SEQ ID NO: 377448 - protein, 17 aa, Mycobacterium
HTWLLVALPLAGAAILL

SEQ ID NO: 377449 - protein, 28 aa, Mycobacterium
HVAVFRKLFWINLIIAIPVIAFSTMFAM

SEQ ID NO: 377450 - protein, 25 aa, Mycobacterium
HVNDALVAALYLALRRWLHTRGVGA

SEQ ID NO: 377451 - protein, 19 aa, Mycobacterium
HVVLYLTLRFSTVLIRVLR

SEQ ID NO: 377452 - protein, 22 aa, Mycobacterium
HVWLIYILVIWWTGFPRTFAAA

SEQ ID NO: 377453 - protein, 25 aa, Mycobacterium
HWEFYMALGYFKLAIIAAGIDFRRR

SEQ ID NO: 377454 - protein, 20 aa, Mycobacterium
HWGWRWIFVPLVPVALAGFV

SEQ ID NO: 377455 - protein, 27 aa, Mycobacterium
HWYTWIAFTAWVAAALLFYLFWGRHHS

SEQ ID NO: 377456 - protein, 17 aa, Mycobacterium
HYDLFIRVLAWFFGLMV

SEQ ID NO: 377457 - protein, 18 aa, Mycobacterium
HYFILVGLFLLFIAGVLA

SEQ ID NO: 377458 - protein, 24 aa, Mycobacterium
HYPLTWVASPGRRLWMKLEYRPDV

SEQ ID NO: 377459 - protein, 19 aa, Mycobacterium
HYSGWWVFDMVMLGLFGAV

SEQ ID NO: 377460 - protein, 18 aa, Mycobacterium
HYWLKLFVFFFPFTDQVA

SEQ ID NO: 377461 - protein, 27 aa, Mycobacterium
IAAALGRWFWWPLDVYQIVDRTAGRRS

SEQ ID NO: 377462 - protein, 25 aa, Mycobacterium
IAAALGRWFWWPLNTFEITRHGRGG

SEQ ID NO: 377463 - protein, 25 aa, Mycobacterium
IAAALGRWFWWPLNTFEITRRGRQA

SEQ ID NO: 377464 - protein, 25 aa, Mycobacterium
IAACLFIAMFILLRRKRVPGVARGP

SEQ ID NO: 377465 - protein, 17 aa, Mycobacterium
IAAFFIVYLMNSWLPIL

SEQ ID NO: 377466 - protein, 25 aa, Mycobacterium
IAAFVVIVLFAWWRGLYLTTILHRR

SEQ ID NO: 377467 - protein, 34 aa, Mycobacterium
IAAILSVAFLANTWWWRALSGWWTWAHTPNGPGG

SEQ ID NO: 377468 - protein, 23 aa, Mycobacterium
IAALLGPWFWWPQRVRTRPVPAP

SEQ ID NO: 377469 - protein, 20 aa, Mycobacterium
IAALLGRWFWWPIRVRPRPA

SEQ ID NO: 377470 - protein, 26 aa, Mycobacterium
IAALLGRWFWWPMKVRSRPARIRSAP

SEQ ID NO: 377471 - protein, 26 aa, Mycobacterium
IAALLGRWFWWPMRVRTRPARTPSSP

SEQ ID NO: 377472 - protein, 23 aa, Mycobacterium
IAALLGRWFWWPQIVRPRPASQM

SEQ ID NO: 377473 - protein, 23 aa, Mycobacterium
IAALLGRWFWWPQIVRSRPASQL

SEQ ID NO: 377474 - protein, 18 aa, Mycobacterium
IAALLGRWFWWPQKIRTR

SEQ ID NO: 377475 - protein, 19 aa, Mycobacterium
IAALLGRWFWWPQRVRPRP

SEQ ID NO: 377476 - protein, 24 aa, Mycobacterium
IAALLGRWFWWPQVVRARPARGVV

SEQ ID NO: 377477 - protein, 18 aa, Mycobacterium
IAALVYLGAALGWPTWWV

SEQ ID NO: 377478 - protein, 18 aa, Mycobacterium
IAAPLYLLLGITAIVLAL

SEQ ID NO: 377479 - protein, 25 aa, Mycobacterium
IAATVVFPLLPFSPKIRTGYNVPIS

SEQ ID NO: 377480 - protein, 23 aa, Mycobacterium
IADAVWIIVVFVATVALLNTLTL

SEQ ID NO: 377481 - protein, 21 aa, Mycobacterium
IAFDQLWRWNSIVALVLSVLV

SEQ ID NO: 377482 - protein, 26 aa, Mycobacterium
IAFLSYFLLILMSVLILMEFLELLPR

SEQ ID NO: 377483 - protein, 17 aa, Mycobacterium
IAFYFLMSVLVAALVLG

SEQ ID NO: 377484 - protein, 23 aa, Mycobacterium
IAGALGMWWTLRGGYAEWWQHLS

SEQ ID NO: 377485 - protein, 26 aa, Mycobacterium
IAGLLFFFFVLPRWPELNGATGHTFG

SEQ ID NO: 377486 - protein, 22 aa, Mycobacterium
IAIMVAWRWAPAKLAPIPGPLV

SEQ ID NO: 377487 - protein, 22 aa, Mycobacterium
IAITGVWLWLDYDALLLVVATQ

SEQ ID NO: 377488 - protein, 17 aa, Mycobacterium
IAKWIRVLAVPIILVWV

SEQ ID NO: 377489 - protein, 26 aa, Mycobacterium
IALATIIVMPLLYGAMYLWAFWNPFA

SEQ ID NO: 377490 - protein, 17 aa, Mycobacterium
IALFFWSLAAVLGTYVL

SEQ ID NO: 377491 - protein, 20 aa, Mycobacterium
IALLLALRREVWIRYAAAVV

SEQ ID NO: 377492 - protein, 29 aa, Mycobacterium
IALLLVVVVLVLGFWQPGFFVTTKLDVSK

SEQ ID NO: 377493 - protein, 19 aa, Mycobacterium
IALRWLLLLAVTIAVTVPL

SEQ ID NO: 377494 - protein, 25 aa, Mycobacterium
IALSLWVMKLTISTYWLLVFGQLAK

SEQ ID NO: 377495 - protein, 23 aa, Mycobacterium
IALVLFRYLTPWGRQFWRITRGY

SEQ ID NO: 377496 - protein, 17 aa, Mycobacterium
IALVLLAIVIPLATFAL

SEQ ID NO: 377497 - protein, 18 aa, Mycobacterium
IALWLPWLIAAGVTFVLA

SEQ ID NO: 377498 - protein, 18 aa, Mycobacterium
IALWLPWLIVAGVVFILG

SEQ ID NO: 377499 - protein, 18 aa, Mycobacterium
IANAKWSTLPPLPTPRHA

SEQ ID NO: 377500 - protein, 19 aa, Mycobacterium
IAQPLVPGIMIAGALIAGT

SEQ ID NO: 377501 - protein, 25 aa, Mycobacterium
IASLLGRWFWWPMVVRPRPRPQPWP

SEQ ID NO: 377502 - protein, 23 aa, Mycobacterium
IATGAYLAWYWLPAATGHTASGG

SEQ ID NO: 377503 - protein, 25 aa, Mycobacterium
IATLLGRWFWWPLVVRSRPLRPRPQ

SEQ ID NO: 377504 - protein, 24 aa, Mycobacterium
IATTLLYLVFHWSWLALTGVALAA

SEQ ID NO: 377505 - protein, 22 aa, Mycobacterium
IAVMLFFVYRSVLTTLLVLATV

SEQ ID NO: 377506 - protein, 24 aa, Mycobacterium
IAVSAVLVLLLLLGPRFIDTYVDW

SEQ ID NO: 377507 - protein, 23 aa, Mycobacterium
IAVVFVRWWGQPAWSWAVLGLRG

SEQ ID NO: 377508 - protein, 27 aa, Mycobacterium
IAVWLWRRRWFRGLVWTGVLCALALMI

SEQ ID NO: 377509 - protein, 19 aa, Mycobacterium
IAWTTVWCLVLLSLALTVT

SEQ ID NO: 377510 - protein, 25 aa, Mycobacterium
IAYTIIFAILLIPILIALAFSVVVF

SEQ ID NO: 377511 - protein, 17 aa, Mycobacterium
ICAAGFVAAIWLPSKST

SEQ ID NO: 377512 - protein, 17 aa, Mycobacterium
ICFIGFLFPLWDAKRQT

SEQ ID NO: 377513 - protein, 19 aa, Mycobacterium
ICLIFIIMLIMTRSFIAAL

SEQ ID NO: 377514 - protein, 17 aa, Mycobacterium
ICVYAFAALWALALAFR

SEQ ID NO: 377515 - protein, 18 aa, Mycobacterium
IDAFRRFHTALFSKDIQP

SEQ ID NO: 377516 - protein, 18 aa, Mycobacterium
IDAFRRFHTALFTTDLQP

SEQ ID NO: 377517 - protein, 25 aa, Mycobacterium
IDATLIRMLIIFGIVTAIALAAATI

SEQ ID NO: 377518 - protein, 22 aa, Mycobacterium
IDAVSWRILLEDLNIAWGQHRH

SEQ ID NO: 377519 - protein, 23 aa, Mycobacterium
IDDKWLPGPALPAPTRPTVQREV

SEQ ID NO: 377520 - protein, 29 aa, Mycobacterium
IDDRTRLYLPMPFFWVGGFGGGLLSALVA

SEQ ID NO: 377521 - protein, 27 aa, Mycobacterium
IDDYGWQWIFWINVPIGLITVALAAIA

SEQ ID NO: 377522 - protein, 25 aa, Mycobacterium
IDIPKALFWVLFAYVSMATVVAFWI

SEQ ID NO: 377523 - protein, 27 aa, Mycobacterium
IDLIMWLIMNILYYSIILGVYLYVIVY

SEQ ID NO: 377524 - protein, 18 aa, Mycobacterium
IDPALLPRLFERFARADN

SEQ ID NO: 377525 - protein, 26 aa, Mycobacterium
IDPALWLLIVVTVLALLLGWHLVASI

SEQ ID NO: 377526 - protein, 27 aa, Mycobacterium
IDRFGWEWIFWINLPIGLITVGLAAVV

SEQ ID NO: 377527 - protein, 22 aa, Mycobacterium
IDRRWMWIAGVAGAILFVAVIT

SEQ ID NO: 377528 - protein, 26 aa, Mycobacterium
IDSYGWQWIFLINVPAGLLAFGLAAI

SEQ ID NO: 377529 - protein, 28 aa, Mycobacterium
IDSYGWQWIFWINLPIGLITLLLAATVF

SEQ ID NO: 377530 - protein, 26 aa, Mycobacterium
IDSYSWQWIFWINLPVGVVAIGLAAI

SEQ ID NO: 377531 - protein, 23 aa, Mycobacterium
IDSYSWQWIFWVNLPVGVVAVGL

SEQ ID NO: 377532 - protein, 22 aa, Mycobacterium
IDTGCWLWLAALPLMIVSYMAA

SEQ ID NO: 377533 - protein, 25 aa, Mycobacterium
IDTSSWRWIFLINVPIGLLTIVLAA

SEQ ID NO: 377534 - protein, 18 aa, Mycobacterium
IDVDAMRRAFTALLRRHP

SEQ ID NO: 377535 - protein, 29 aa, Mycobacterium
IDVLGWPLWLLYVVVFSLTLFIGARLCVA

SEQ ID NO: 377536 - protein, 17 aa, Mycobacterium
IDWFWRHNAWRGVFNNP

SEQ ID NO: 377537 - protein, 22 aa, Mycobacterium
IDWIIWGVIIAAATLGAAIGVP

SEQ ID NO: 377538 - protein, 18 aa, Mycobacterium
IEQSLVILPALFSALLTV

SEQ ID NO: 377539 - protein, 18 aa, Mycobacterium
IFAIIIAALILLQASEKK

SEQ ID NO: 377540 - protein, 17 aa, Mycobacterium
IFAVCVVLFLTTLARHI

SEQ ID NO: 377541 - protein, 26 aa, Mycobacterium
IFAYKKIWWPLAVWLLLVAVEVDAGT

SEQ ID NO: 377542 - protein, 25 aa, Mycobacterium
IFGCVLMWILAWLTATPVRVVRAAL

SEQ ID NO: 377543 - protein, 19 aa, Mycobacterium
IFGVVLVICVVLIAFGYSG

SEQ ID NO: 377544 - protein, 21 aa, Mycobacterium
IFHTLMIFWPFMQAAIQMAVV

SEQ ID NO: 377545 - protein, 17 aa, Mycobacterium
IFILPGRRWVRPAEQWA

SEQ ID NO: 377546 - protein, 18 aa, Mycobacterium
IFIVLIPVALALWLSVRF

SEQ ID NO: 377547 - protein, 24 aa, Mycobacterium
IFIVLLFVYRSVITVILLLLTVGI

SEQ ID NO: 377548 - protein, 19 aa, Mycobacterium
IFLLPIALVLDILTAFPIL

SEQ ID NO: 377549 - protein, 27 aa, Mycobacterium
IFLMLLLLYRRVLIVLILLATVAIELQ

SEQ ID NO: 377550 - protein, 23 aa, Mycobacterium
IFQVTFFVFLIIPLVVLRTVTGA

SEQ ID NO: 377551 - protein, 17 aa, Mycobacterium
IFSLFRPGGVPGNNAIL

SEQ ID NO: 377552 - protein, 24 aa, Mycobacterium
IFSLPIIVFWVLVAVGLGILTPSL

SEQ ID NO: 377553 - protein, 18 aa, Mycobacterium
IFTKYLWAFELTGALLIT

SEQ ID NO: 377554 - protein, 25 aa, Mycobacterium
IFTMLLFVYRSVMTVILLLIMVGIQ

SEQ ID NO: 377555 - protein, 22 aa, Mycobacterium
IFTMLLLVYRSIVTVTLLLITV

SEQ ID NO: 377556 - protein, 22 aa, Mycobacterium
IFTMLLLVYRSVVSVILMLVVV

SEQ ID NO: 377557 - protein, 26 aa, Mycobacterium
IFVLPALIMIGWWSGFPYWTTVAVCG

SEQ ID NO: 377558 - protein, 19 aa, Mycobacterium
IGALFVLGFLRFGLPPEDR

SEQ ID NO: 377559 - protein, 20 aa, Mycobacterium
IGALLPLIAILAPPTTWRIP

SEQ ID NO: 377560 - protein, 18 aa, Mycobacterium
IGARWQLIAFAAPLLGVL

SEQ ID NO: 377561 - protein, 24 aa, Mycobacterium
IGATVLFLACRWWQSVGAPGWVGY

SEQ ID NO: 377562 - protein, 27 aa, Mycobacterium
IGAYGWKWIFLINLPIGLTAFALAAIM

SEQ ID NO: 377563 - protein, 31 aa, Mycobacterium
IGDNTWFSWLVVFWLWLTVIFANLAEAVAEG

SEQ ID NO: 377564 - protein, 17 aa, Mycobacterium
IGEAVMFVLFWASAFVL

SEQ ID NO: 377565 - protein, 25 aa, Mycobacterium
IGELTHFFALLLWAAAVLAFFADLP

SEQ ID NO: 377566 - protein, 25 aa, Mycobacterium
IGFAVIVFIIMKWVAPLVKSMMQKQ

SEQ ID NO: 377567 - protein, 24 aa, Mycobacterium
IGFCMGGGLVWRLLAAGTPELAAA

SEQ ID NO: 377568 - protein, 17 aa, Mycobacterium
IGFPPYIQQILPPSPGP

SEQ ID NO: 377569 - protein, 27 aa, Mycobacterium
IGGPLNVLLWLSYFVMLGLYAVAFGSY

SEQ ID NO: 377570 - protein, 28 aa, Mycobacterium
IGGPLNVLLWLSYFVMLGLYAVAFGSYG

SEQ ID NO: 377571 - protein, 18 aa, Mycobacterium
IGGRWQLIAFAAPLLGVL

SEQ ID NO: 377572 - protein, 25 aa, Mycobacterium
IGGTAFVVFFAVALVFYIVTSHQKK

SEQ ID NO: 377573 - protein, 35 aa, Mycobacterium
IGKIEFAGFFAWLAWLLLHLLYLVGHRNRIAAAYS

SEQ ID NO: 377574 - protein, 31 aa, Mycobacterium
IGKIEFSGFIAWLSWLALHLVYLVGFKNRLV

SEQ ID NO: 377575 - protein, 17 aa, Mycobacterium
IGLFILFIGLVDAGFIG

SEQ ID NO: 377576 - protein, 29 aa, Mycobacterium
IGLGRAAWFTILAFWFFAIGWAASKSSTV

SEQ ID NO: 377577 - protein, 17 aa, Mycobacterium
IGLIAVLVWIWEVNHWL

SEQ ID NO: 377578 - protein, 20 aa, Mycobacterium
IGLLGLMVLALVGTGLYAQF

SEQ ID NO: 377579 - protein, 24 aa, Mycobacterium
IGLNLHWMVLPLTFILLVAVGSDY

SEQ ID NO: 377580 - protein, 24 aa, Mycobacterium
IGLRPWWVRPLWKLLHIDGRPSRY

SEQ ID NO: 377581 - protein, 26 aa, Mycobacterium
IGLSLAIITILIPLAAFGVLGLATVV

SEQ ID NO: 377582 - protein, 17 aa, Mycobacterium
IGLWLPWLIFAGVMFVL

SEQ ID NO: 377583 - protein, 18 aa, Mycobacterium
IGMFVWIAIIFRGMRARL

SEQ ID NO: 377584 - protein, 17 aa, Mycobacterium
IGPFLVYILLPLLDLRF

SEQ ID NO: 377585 - protein, 17 aa, Mycobacterium
IGPILLYVLLPTLDRFF

SEQ ID NO: 377586 - protein, 32 aa, Mycobacterium
IGPLEFGGFIAWLSWLVLHLVYLVGFKTKIVT

SEQ ID NO: 377587 - protein, 31 aa, Mycobacterium
IGPVEISGFIAWLAWLVLHLVYLVGFKTKVS

SEQ ID NO: 377588 - protein, 25 aa, Mycobacterium
IGRSLPFLILMAAIIPVTRFLVGTT

SEQ ID NO: 377589 - protein, 17 aa, Mycobacterium
IGTATVRWPGPILAAAC

SEQ ID NO: 377590 - protein, 24 aa, Mycobacterium
IGTLAAFLLYLRMFFEPMQEISQF

SEQ ID NO: 377591 - protein, 24 aa, Mycobacterium
IGTLTAFLLYLRMFFEPMQEISQF

SEQ ID NO: 377592 - protein, 18 aa, Mycobacterium
IGVLLLAIVGGATGWLVW

SEQ ID NO: 377593 - protein, 26 aa, Mycobacterium
IGVMVIAILLLWPKLPPKIRMVPGAL

SEQ ID NO: 377594 - protein, 21 aa, Mycobacterium
IGVPWWFLVAQLPVAGIVFAI

SEQ ID NO: 377595 - protein, 21 aa, Mycobacterium
IGVWAIRRRLLRQTHGLRPDE

SEQ ID NO: 377596 - protein, 22 aa, Mycobacterium
IGVWLAMAVALPLSFPSLGEMA

SEQ ID NO: 377597 - protein, 17 aa, Mycobacterium
IGYFLLSGALFFTAVGG

SEQ ID NO: 377598 - protein, 17 aa, Mycobacterium
IHALAHPTPPEKGDSVV

SEQ ID NO: 377599 - protein, 20 aa, Mycobacterium
IHGLCRWFFLNRAGAVRLTV

SEQ ID NO: 377600 - protein, 24 aa, Mycobacterium
IHNGFFMFVIFLTVLSFIPLGSGI

SEQ ID NO: 377601 - protein, 18 aa, Mycobacterium
IIAGLVVRYIWWVVGAAA

SEQ ID NO: 377602 - protein, 28 aa, Mycobacterium
IIAIAALVLFVALPLIYVRNYVKVPPNE

SEQ ID NO: 377603 - protein, 23 aa, Mycobacterium
IIALMVIAVWLLGVGTLMDLALV

SEQ ID NO: 377604 - protein, 19 aa, Mycobacterium
IICFIGFLFPLWDSKRQTL

SEQ ID NO: 377605 - protein, 26 aa, Mycobacterium
IIFTLLLILYRSVITVILLLIMVGVE

SEQ ID NO: 377606 - protein, 18 aa, Mycobacterium
IILFVYWLIALSQIILRR

SEQ ID NO: 377607 - protein, 19 aa, Mycobacterium
IILFWLAVVVLLSVFVPSL

SEQ ID NO: 377608 - protein, 19 aa, Mycobacterium
IILIIVMLLLVYRSFSTLL

SEQ ID NO: 377609 - protein, 20 aa, Mycobacterium
IILSPLWLFAFVLAELLGYS

SEQ ID NO: 377610 - protein, 17 aa, Mycobacterium
IIRLGHMLVFFVRALLG

SEQ ID NO: 377611 - protein, 28 aa, Mycobacterium
IISDRGYFIFLAILPFIMGSLSMSVPGD

SEQ ID NO: 377612 - protein, 21 aa, Mycobacterium
IITMLLLVYRSIVTVILTLVM

SEQ ID NO: 377613 - protein, 17 aa, Mycobacterium
IIVALLWTFIRHERRAP

SEQ ID NO: 377614 - protein, 18 aa, Mycobacterium
IIVLLIALGIPFLNIKWG

SEQ ID NO: 377615 - protein, 25 aa, Mycobacterium
IKRQQLFLSSLLRSLISADTLLDLN

SEQ ID NO: 377616 - protein, 28 aa, Mycobacterium
ILADRGYFIFLALLPFVLAGLVLSVPGS

SEQ ID NO: 377617 - protein, 18 aa, Mycobacterium
ILALVPLALFGILGLAAV

SEQ ID NO: 377618 - protein, 19 aa, Mycobacterium
ILAVVLVTGFWKPGFFVTT

SEQ ID NO: 377619 - protein, 17 aa, Mycobacterium
ILCAAVLFWLAWKSMRT

SEQ ID NO: 377620 - protein, 25 aa, Mycobacterium
ILDLVVVFLVTWPLVYLASKSPTMA

SEQ ID NO: 377621 - protein, 21 aa, Mycobacterium
ILFSLPWITWIAFGAWVAIVL

SEQ ID NO: 377622 - protein, 17 aa, Mycobacterium
ILGWLWSWELALPMSGI

SEQ ID NO: 377623 - protein, 19 aa, Mycobacterium
ILGWRPVLLIPLTFALFTP

SEQ ID NO: 377624 - protein, 22 aa, Mycobacterium
ILHGFWVLLFALPFAGLIEQIP

SEQ ID NO: 377625 - protein, 23 aa, Mycobacterium
ILHGVWILLFASLFTNLVELIPK

SEQ ID NO: 377626 - protein, 18 aa, Mycobacterium
ILIAFGVLWPVVFDGGSG

SEQ ID NO: 377627 - protein, 18 aa, Mycobacterium
ILILLRLLQGFAAGGEWA

SEQ ID NO: 377628 - protein, 18 aa, Mycobacterium
ILLAVLFLGFFLLEGFDF

SEQ ID NO: 377629 - protein, 17 aa, Mycobacterium
ILLLTAPAARVAARQVT

SEQ ID NO: 377630 - protein, 20 aa, Mycobacterium
ILLMQLLFHLLWVTGATLGG

SEQ ID NO: 377631 - protein, 27 aa, Mycobacterium
ILLVKRIWWPLALWLLLIVVNVDAGNP

SEQ ID NO: 377632 - protein, 17 aa, Mycobacterium
ILMGFWIGAITAGAILG

SEQ ID NO: 377633 - protein, 19 aa, Mycobacterium
ILPGRRWVRPAEQWAAGHH

SEQ ID NO: 377634 - protein, 36 aa, Mycobacterium
ILRRQVRVFLASRLYLVFLALLPFALGALTLLIPGD

SEQ ID NO: 377635 - protein, 18 aa, Mycobacterium
ILSALSFWYVPKLGLRLV

SEQ ID NO: 377636 - protein, 22 aa, Mycobacterium
ILTAVLLVWRRDLRSIVRLLAA

SEQ ID NO: 377637 - protein, 21 aa, Mycobacterium
ILTCWLPVFVGWPIMRWLTRK

SEQ ID NO: 377638 - protein, 18 aa, Mycobacterium
ILTLLTMAAAFMGTALTI

SEQ ID NO: 377639 - protein, 27 aa, Mycobacterium
ILTVLAVLFMMVWISPLLALITVLTVP

SEQ ID NO: 377640 - protein, 24 aa, Mycobacterium
ILVALILVLWVARSLVRPLRTLRD

SEQ ID NO: 377641 - protein, 18 aa, Mycobacterium
ILVLLPPFVAAIASFTAP

SEQ ID NO: 377642 - protein, 18 aa, Mycobacterium
ILVMVVWVGTALTISTAA

SEQ ID NO: 377643 - protein, 18 aa, Mycobacterium
ILWIAMAAVLFWYAARLP

SEQ ID NO: 377644 - protein, 19 aa, Mycobacterium
IMLLLIAIGTILRARRRAA

SEQ ID NO: 377645 - protein, 17 aa, Mycobacterium
IMTILYWRVARVRPRFA

SEQ ID NO: 377646 - protein, 25 aa, Mycobacterium
IMTVLTVFLFFIFGQYRTGSTNGYS

SEQ ID NO: 377647 - protein, 21 aa, Mycobacterium
IMVMLLLVYRSVITMVIVVAM

SEQ ID NO: 377648 - protein, 27 aa, Mycobacterium
INAATLLLLFYFLRHWMPFKRPAGDWV

SEQ ID NO: 377649 - protein, 25 aa, Mycobacterium
INKILQFITYLLLPAGALIIYTQLF

SEQ ID NO: 377650 - protein, 22 aa, Mycobacterium
INKILQFITYLLVPAGLLTIYT

SEQ ID NO: 377651 - protein, 24 aa, Mycobacterium
INQILRFITYLLIPAGALIIYTQL

SEQ ID NO: 377652 - protein, 18 aa, Mycobacterium
IPALILLFLGGVSFVSCL

SEQ ID NO: 377653 - protein, 21 aa, Mycobacterium
IPAPWAVLAILADGPGLSKEA

SEQ ID NO: 377654 - protein, 17 aa, Mycobacterium
IPGLPFVALIILIVGGI

SEQ ID NO: 377655 - protein, 18 aa, Mycobacterium
IPIALFMGVYLRYLRPGK

SEQ ID NO: 377656 - protein, 21 aa, Mycobacterium
IPIQLFFVYFGLPVVGIRPSA

SEQ ID NO: 377657 - protein, 18 aa, Mycobacterium
IPIVGWAMSAAFQAPVCA

SEQ ID NO: 377658 - protein, 21 aa, Mycobacterium
IPLEQLAWLSPSRWAYAMAAS

SEQ ID NO: 377659 - protein, 24 aa, Mycobacterium
IPPTLRMLFVFGVLTLLAMAGSLT

SEQ ID NO: 377660 - protein, 19 aa, Mycobacterium
IPRLYAMHILLIPAIILAL

SEQ ID NO: 377661 - protein, 17 aa, Mycobacterium
IPVIVPFPGWQPGYPRP

SEQ ID NO: 377662 - protein, 17 aa, Mycobacterium
IPVVFYQLSFARTGRWN

SEQ ID NO: 377663 - protein, 25 aa, Mycobacterium
IPWVMLGAALLWFGWFGFNVGSEGA

SEQ ID NO: 377664 - protein, 23 aa, Mycobacterium
IPYVLPLILLLLIGMTVLLRRTA

SEQ ID NO: 377665 - protein, 20 aa, Mycobacterium
IQAKLLVTLLVCSILSVAVV

SEQ ID NO: 377666 - protein, 24 aa, Mycobacterium
IQHPQPWFFWPTRPVWLYRLTQGL

SEQ ID NO: 377667 - protein, 25 aa, Mycobacterium
IQKFSLPVILLWIALTVGANLLAPQ

SEQ ID NO: 377668 - protein, 25 aa, Mycobacterium
IQKPDFPWMTLTIVLVLGVAAAAAL

SEQ ID NO: 377669 - protein, 18 aa, Mycobacterium
IQLVLRLVPRRLLAVSGW

SEQ ID NO: 377670 - protein, 18 aa, Mycobacterium
IQPPLILFCAVPGAYWLF

SEQ ID NO: 377671 - protein, 23 aa, Mycobacterium
IQPPLILFCAVPGAYWLFHDAKI

SEQ ID NO: 377672 - protein, 23 aa, Mycobacterium
IQPPLILFFTVPGAYWLFHGSKI

SEQ ID NO: 377673 - protein, 23 aa, Mycobacterium
IRALPHLGLIPLFIVWFGIGELP

SEQ ID NO: 377674 - protein, 23 aa, Mycobacterium
IRENLFFALIYNAIGIPLAAGVL

SEQ ID NO: 377675 - protein, 18 aa, Mycobacterium
IRFTGPEVWWLLSVARWA

SEQ ID NO: 377676 - protein, 17 aa, Mycobacterium
IRLPLVLGLAELLGRIP

SEQ ID NO: 377677 - protein, 24 aa, Mycobacterium
IRMNGWPEAIFRFGLYAFLCATAL

SEQ ID NO: 377678 - protein, 17 aa, Mycobacterium
IRPIPYLVTTRLLASVV

SEQ ID NO: 377679 - protein, 24 aa, Mycobacterium
IRQNLFFALIYNAIGIPLAAGVLY

SEQ ID NO: 377680 - protein, 21 aa, Mycobacterium
IRRFSVLIILAWIVVAALATF

SEQ ID NO: 377681 - protein, 27 aa, Mycobacterium
IRSRTRLWLPYLPLLVAAAVGLGHAVG

SEQ ID NO: 377682 - protein, 26 aa, Mycobacterium
IRSVSWLPLFHDMGLLMIMFPALCGG

SEQ ID NO: 377683 - protein, 19 aa, Mycobacterium
IRTFAVPIILGWIAIIAVL

SEQ ID NO: 377684 - protein, 25 aa, Mycobacterium
IRTFAVPIILVWIALIAVLNTVVPQ

SEQ ID NO: 377685 - protein, 27 aa, Mycobacterium
IRTSRAFLWTFASLIVVALGALMFITS

SEQ ID NO: 377686 - protein, 19 aa, Mycobacterium
IRWAALVVLTLIGLGLIFP

SEQ ID NO: 377687 - protein, 18 aa, Mycobacterium
ISDLWRLYQRIYEILWAL

SEQ ID NO: 377688 - protein, 28 aa, Mycobacterium
ISGETRLYLPMPFFWVGGFGSGILSVLL

SEQ ID NO: 377689 - protein, 27 aa, Mycobacterium
ISGWVYLHGAWPWLFILGLVAVGAAIW

SEQ ID NO: 377690 - protein, 22 aa, Mycobacterium
ISHLPVLLGLIFALLVLRDYRA

SEQ ID NO: 377691 - protein, 18 aa, Mycobacterium
ISLFFWPTPAVPLVGAVL

SEQ ID NO: 377692 - protein, 20 aa, Mycobacterium
ISLPMFMEELFWGCAGIGLA

SEQ ID NO: 377693 - protein, 26 aa, Mycobacterium
ISPQTLFFPFVLLLAATALYRGGGDK

SEQ ID NO: 377694 - protein, 27 aa, Mycobacterium
ISPQTLFFPFVMLLAATSLFRGNDNKM

SEQ ID NO: 377695 - protein, 25 aa, Mycobacterium
ISSFGWHWIFLVNLPIGLAAFALAA

SEQ ID NO: 377696 - protein, 18 aa, Mycobacterium
ISTLLGLALLVAGGVFAG

SEQ ID NO: 377697 - protein, 25 aa, Mycobacterium
ISVALMAIFYLRVPTALGIGKHDVK

SEQ ID NO: 377698 - protein, 25 aa, Mycobacterium
ISVLVAWLAVLLFASLAAAPRPWQG

SEQ ID NO: 377699 - protein, 24 aa, Mycobacterium
ISVLVLWDLFGQLPLPLGVAGHEG

SEQ ID NO: 377700 - protein, 20 aa, Mycobacterium
ITALLLLLGSPFHRARWGFA

SEQ ID NO: 377701 - protein, 26 aa, Mycobacterium
ITFVVIIVMLLWVYRSIITVFSTLFM

SEQ ID NO: 377702 - protein, 25 aa, Mycobacterium
ITGVAYPLVIWLAAQVPGLRDKADG

SEQ ID NO: 377703 - protein, 23 aa, Mycobacterium
ITHDLWPAPFLVMDVGASVAPYN

SEQ ID NO: 377704 - protein, 19 aa, Mycobacterium
ITLAPWLLTAAILVPLNLH

SEQ ID NO: 377705 - protein, 19 aa, Mycobacterium
ITLILPGFWLLVPGSMGLI

SEQ ID NO: 377706 - protein, 17 aa, Mycobacterium
ITLLMTALWVLAIVARP

SEQ ID NO: 377707 - protein, 20 aa, Mycobacterium
ITMLLLVYRSIVTVLITMGM

SEQ ID NO: 377708 - protein, 20 aa, Mycobacterium
ITRRLAIALVVLFGAAVIVY

SEQ ID NO: 377709 - protein, 24 aa, Mycobacterium
ITTAKWLALFSFWLVCLYSLAVHL

SEQ ID NO: 377710 - protein, 17 aa, Mycobacterium
ITTFLIFPILGLAIRAL

SEQ ID NO: 377711 - protein, 27 aa, Mycobacterium
ITVAFLFWEFFIPLLLSLLQGLLGLIG

SEQ ID NO: 377712 - protein, 25 aa, Mycobacterium
ITVSTIFFVLFALAVLYAAWLHFAP

SEQ ID NO: 377713 - protein, 23 aa, Mycobacterium
ITYLLLLVVLLPHSPHAATAILC

SEQ ID NO: 377714 - protein, 26 aa, Mycobacterium
IVADRAYFIFLALLPFVMGALALTVP

SEQ ID NO: 377715 - protein, 18 aa, Mycobacterium
IVAPLYLIGSVLVSFLSA

SEQ ID NO: 377716 - protein, 18 aa, Mycobacterium
IVAVLLLWRRPAAERMLP

SEQ ID NO: 377717 - protein, 18 aa, Mycobacterium
IVAWLLLTIAVNVLVPWI

SEQ ID NO: 377718 - protein, 31 aa, Mycobacterium
IVFATILIVFLILVILLRAIVAPLYLIGSVL

SEQ ID NO: 377719 - protein, 18 aa, Mycobacterium
IVFLFHDWRYVFWINVPL

SEQ ID NO: 377720 - protein, 23 aa, Mycobacterium
IVGAFALRRVWWLYKLIMSGQPA

SEQ ID NO: 377721 - protein, 26 aa, Mycobacterium
IVGALGMWWTFRGGYAGWWQQLSGES

SEQ ID NO: 377722 - protein, 26 aa, Mycobacterium
IVGVILVLLLRALLAPLYLLGTVVLN

SEQ ID NO: 377723 - protein, 25 aa, Mycobacterium
IVITIMLLFIYRSITTVLLILFMVF

SEQ ID NO: 377724 - protein, 19 aa, Mycobacterium
IVKRVYWPVAVWLLLVIAI

SEQ ID NO: 377725 - protein, 21 aa, Mycobacterium
IVLLYSLIYYRVLGLLTALSL

SEQ ID NO: 377726 - protein, 19 aa, Mycobacterium
IVLMQRFFRGFWSTIAVLL

SEQ ID NO: 377727 - protein, 17 aa, Mycobacterium
IVLVWLGIVFVTNTVAP

SEQ ID NO: 377728 - protein, 18 aa, Mycobacterium
IVLYPIFLLFLGLGALSQ

SEQ ID NO: 377729 - protein, 19 aa, Mycobacterium
IVMAVFILMLPRLFPGSFE

SEQ ID NO: 377730 - protein, 20 aa, Mycobacterium
IVQPFGEYLPWRGFFRLFSS

SEQ ID NO: 377731 - protein, 22 aa, Mycobacterium
IVQYWMDVPLWLSALIFMVLMT

SEQ ID NO: 377732 - protein, 23 aa, Mycobacterium
IVRHPWPFFGVATVILLAAASFV

SEQ ID NO: 377733 - protein, 18 aa, Mycobacterium
IVRLILVPALMAMFSQWN

SEQ ID NO: 377734 - protein, 25 aa, Mycobacterium
IVRRSNALLDWAYGRQLRYSESMSL

SEQ ID NO: 377735 - protein, 19 aa, Mycobacterium
IVRWPLPILAVTCAVALVG

SEQ ID NO: 377736 - protein, 17 aa, Mycobacterium
IVTLVLLFLLTGSVLLP

SEQ ID NO: 377737 - protein, 24 aa, Mycobacterium
IVTWTPLFYVFAYAATFAVMGTPI

SEQ ID NO: 377738 - protein, 23 aa, Mycobacterium
IVVFLCAVLFTIVWWNIDHDRTN

SEQ ID NO: 377739 - protein, 20 aa, Mycobacterium
IVVILFVGFLVVVLATAVVL

SEQ ID NO: 377740 - protein, 23 aa, Mycobacterium
IVVLFVPAALPWYYSWPLAIVAP

SEQ ID NO: 377741 - protein, 20 aa, Mycobacterium
IVVLLILVALLRAIVAPLYL

SEQ ID NO: 377742 - protein, 19 aa, Mycobacterium
IVVLLLISTLFLLRSMNRQ

SEQ ID NO: 377743 - protein, 31 aa, Mycobacterium
IVVLMLLPLVYGALYLWAYWDPFGHVNKMPV

SEQ ID NO: 377744 - protein, 18 aa, Mycobacterium
IVVLRRGPRVTLWQFHWV

SEQ ID NO: 377745 - protein, 17 aa, Mycobacterium
IVVMLLLVYRAPSTLLV

SEQ ID NO: 377746 - protein, 23 aa, Mycobacterium
IVVMLLLVYRTPSTLLVPLLGVL

SEQ ID NO: 377747 - protein, 28 aa, Mycobacterium
IVVTLLIIFLVMCLLLRAVVAPLYLLGT

SEQ ID NO: 377748 - protein, 22 aa, Mycobacterium
IVWNMLTWLLGIPSSSSMALFG

SEQ ID NO: 377749 - protein, 24 aa, Mycobacterium
IVWRRDLLAIIRLLAWQGAALAAI

SEQ ID NO: 377750 - protein, 18 aa, Mycobacterium
IVYQFLPVLIANGYHMVT

SEQ ID NO: 377751 - protein, 20 aa, Mycobacterium
IWIRLPDLICALICWLLLSR

SEQ ID NO: 377752 - protein, 20 aa, Mycobacterium
IWRLAIFMVVCTLGLIAMLA

SEQ ID NO: 377753 - protein, 19 aa, Mycobacterium
IWSSPLWFPVLVGGATVIL

SEQ ID NO: 377754 - protein, 20 aa, Mycobacterium
IYFGLIIFFTYFYVSITFNP

SEQ ID NO: 377755 - protein, 18 aa, Mycobacterium
IYGIAILGLPFFILIGLI

SEQ ID NO: 377756 - protein, 17 aa, Mycobacterium
IYGLLLTAATAGAAALI

SEQ ID NO: 377757 - protein, 24 aa, Mycobacterium
IYKFAVPIALFWLAVCAIIAAFVP

SEQ ID NO: 377758 - protein, 19 aa, Mycobacterium
IYNYAWLVLQLPFGMIGVT

SEQ ID NO: 377759 - protein, 18 aa, Mycobacterium
IYVPLAFHLGYHSLPIGG

SEQ ID NO: 377760 - protein, 27 aa, Mycobacterium
KAAGQLLWWAILFPVLSIPATVALCVT

SEQ ID NO: 377761 - protein, 26 aa, Mycobacterium
KAAGYLLWWAVLFPAISIPIIASVAM

SEQ ID NO: 377762 - protein, 26 aa, Mycobacterium
KAIYLRVGLLLALWAAVIASFAALTY

SEQ ID NO: 377763 - protein, 18 aa, Mycobacterium
KALWALGVFLVLAGIYIA

SEQ ID NO: 377764 - protein, 35 aa, Mycobacterium
KARLSFLLVMLFVKPLLILFPIFDAGLRQLKWLDR

SEQ ID NO: 377765 - protein, 23 aa, Mycobacterium
KARVTLHDMKFARFVRSGPIGVV

SEQ ID NO: 377766 - protein, 35 aa, Mycobacterium
KEPKFERRPLGVSWLIGVVVIPLLLAALGYGAYQR

SEQ ID NO: 377767 - protein, 19 aa, Mycobacterium
KETLAPRSWRIVMTLQRDG

SEQ ID NO: 377768 - protein, 22 aa, Mycobacterium
KFAPLNWFWPAVSLVVLQALAS

SEQ ID NO: 377769 - protein, 19 aa, Mycobacterium
KFFLPPKLVSLYGTPLWES

SEQ ID NO: 377770 - protein, 18 aa, Mycobacterium
KFVIAGLLILFIAAVALF

SEQ ID NO: 377771 - protein, 26 aa, Mycobacterium
KGEQRKWLRRVWLAAPLGLVSMAAPM

SEQ ID NO: 377772 - protein, 21 aa, Mycobacterium
KGLLKWAWIPGLPLLWDLAVT

SEQ ID NO: 377773 - protein, 23 aa, Mycobacterium
KGNLFWAFAYNVAALPLAAAGLL

SEQ ID NO: 377774 - protein, 23 aa, Mycobacterium
KGNLFWAFAYNVAALPLAVAGLL

SEQ ID NO: 377775 - protein, 22 aa, Mycobacterium
KGVLGRFWLVLTIAAVVALSGF

SEQ ID NO: 377776 - protein, 25 aa, Mycobacterium
KGYSTVLVFWFGWPASEVPGVYFSA

SEQ ID NO: 377777 - protein, 25 aa, Mycobacterium
KGYSTVLVFWFGWPTSEVPGIYFSI

SEQ ID NO: 377778 - protein, 27 aa, Mycobacterium
KHGATWFLVLPIVLLIFIVPPALSARS

SEQ ID NO: 377779 - protein, 17 aa, Mycobacterium
KHPFWVRFWAGVSFALG

SEQ ID NO: 377780 - protein, 26 aa, Mycobacterium
KIAGIALFLVGLLILSLVYLQFRGDF

SEQ ID NO: 377781 - protein, 18 aa, Mycobacterium
KIASAVVLVLLGIGIGWG

SEQ ID NO: 377782 - protein, 22 aa, Mycobacterium
KIKFEPYRLWQPPLTVPVAIDE

SEQ ID NO: 377783 - protein, 18 aa, Mycobacterium
KILAFSLLCGIVGPIFIV

SEQ ID NO: 377784 - protein, 17 aa, Mycobacterium
KILITMLLSSILGVAVI

SEQ ID NO: 377785 - protein, 18 aa, Mycobacterium
KIPNDQFLLFCFDSPTAD

SEQ ID NO: 377786 - protein, 18 aa, Mycobacterium
KIRYFVIALLGGVGLLGA

SEQ ID NO: 377787 - protein, 18 aa, Mycobacterium
KKRRWPWIAGAATAVAAI

SEQ ID NO: 377788 - protein, 32 aa, Mycobacterium
KLAGLALWLITAVVLIVVWVQFRGGFTPKITL

SEQ ID NO: 377789 - protein, 21 aa, Mycobacterium
KLAVLVGPIWWAAGHSALAVA

SEQ ID NO: 377790 - protein, 24 aa, Mycobacterium
KLEPVIRLPLALGLVHLLGRIPLP

SEQ ID NO: 377791 - protein, 21 aa, Mycobacterium
KLFASLLLILVLVVIGEVAGV

SEQ ID NO: 377792 - protein, 22 aa, Mycobacterium
KLFDWLPMFVLIAGIFGWVTDA

SEQ ID NO: 377793 - protein, 24 aa, Mycobacterium
KLGAFALVLLMFTAIIIVVFGQMR

SEQ ID NO: 377794 - protein, 21 aa, Mycobacterium
KLGDKPMPLFQLLIVCMLASK

SEQ ID NO: 377795 - protein, 18 aa, Mycobacterium
KLGLPVTIVFFLAAVIYT

SEQ ID NO: 377796 - protein, 23 aa, Mycobacterium
KLPGPWRILVTVPLRYLRPSHHP

SEQ ID NO: 377797 - protein, 17 aa, Mycobacterium
KLQARWRRQSAVRRLAY

SEQ ID NO: 377798 - protein, 30 aa, Mycobacterium
KLSLWYPHYAWLLLTIYLAAALVTLISVGA

SEQ ID NO: 377799 - protein, 20 aa, Mycobacterium
KLSSWLPPGPVAVADYPAVL

SEQ ID NO: 377800 - protein, 24 aa, Mycobacterium
KLTLKMWFFPYLPIAVIACFVLVL

SEQ ID NO: 377801 - protein, 18 aa, Mycobacterium
KLVLLTVLVIVLIGSVLA

SEQ ID NO: 377802 - protein, 19 aa, Mycobacterium
KLVMWFPPRVVVLASSGLI

SEQ ID NO: 377803 - protein, 23 aa, Mycobacterium
KNLRYWILGWLLLAGILNYMDRS

SEQ ID NO: 377804 - protein, 18 aa, Mycobacterium
KNRLVTLILWSIAFVTRS

SEQ ID NO: 377805 - protein, 20 aa, Mycobacterium
KNVPSLRYLSYRLTLVRSDG

SEQ ID NO: 377806 - protein, 23 aa, Mycobacterium
KPFVVIAIWISLAAIPALMFPPL

SEQ ID NO: 377807 - protein, 18 aa, Mycobacterium
KPLLLWFGFGGVIYTYIL

SEQ ID NO: 377808 - protein, 24 aa, Mycobacterium
KPRRRILRRLLITSLGLATVLAVA

SEQ ID NO: 377809 - protein, 19 aa, Mycobacterium
KPWYMWFCPGANHAPHHSP

SEQ ID NO: 377810 - protein, 21 aa, Mycobacterium
KQWLMVHRTIFRLAFPGGKPR

SEQ ID NO: 377811 - protein, 25 aa, Mycobacterium
KRQQLFLSSLLRSLISKETFFSLSK

SEQ ID NO: 377812 - protein, 20 aa, Mycobacterium
KRQRFWISLYLPLTMRSLAN

SEQ ID NO: 377813 - protein, 25 aa, Mycobacterium
KRRGKYWWIRWAILIVLAIVLAVEI

SEQ ID NO: 377814 - protein, 24 aa, Mycobacterium
KRRLRWLIAAVLVVLIALAGLAIA

SEQ ID NO: 377815 - protein, 32 aa, Mycobacterium
KRSLVRPAVLIPALLAILLVIATLVALREFQR

SEQ ID NO: 377816 - protein, 21 aa, Mycobacterium
KRSRRPIYLGRSIAAVVAVCS

SEQ ID NO: 377817 - protein, 23 aa, Mycobacterium
KRSWGWVIALALVVAALAAVIVL

SEQ ID NO: 377818 - protein, 22 aa, Mycobacterium
KSALFFVGVLVVALLGGVAPAA

SEQ ID NO: 377819 - protein, 17 aa, Mycobacterium
KSALFLIAVLGVSLLGG

SEQ ID NO: 377820 - protein, 26 aa, Mycobacterium
KSLAPGLRLGWLVLPASLLDAVVEAK

SEQ ID NO: 377821 - protein, 23 aa, Mycobacterium
KSNLFWAFAYNVAALPLAAAGLL

SEQ ID NO: 377822 - protein, 21 aa, Mycobacterium
KTLRLFVLLVIAFALIPVGAV

SEQ ID NO: 377823 - protein, 33 aa, Mycobacterium
KVGPLEFSGFIAWLMWLVLHLVYLVGFKTKVST

SEQ ID NO: 377824 - protein, 18 aa, Mycobacterium
KVHWSVLVILWLFTWSLA

SEQ ID NO: 377825 - protein, 25 aa, Mycobacterium
KVHWSVLVILWLFTWSLATTLPETA

SEQ ID NO: 377826 - protein, 22 aa, Mycobacterium
KVNLRLMPFIFLLYLVNYVDRT

SEQ ID NO: 377827 - protein, 17 aa, Mycobacterium
KVSYLALAVLAILALVI

SEQ ID NO: 377828 - protein, 23 aa, Mycobacterium
KVWGFLFMYFWLRATLPRLRYDQ

SEQ ID NO: 377829 - protein, 23 aa, Mycobacterium
KVWGFMFLFMWLRATLPRLRYDQ

SEQ ID NO: 377830 - protein, 17 aa, Mycobacterium
KWFWWPQHVRQRPVPSP

SEQ ID NO: 377831 - protein, 19 aa, Mycobacterium
KYFAIIPALFVGLFPGLDL

SEQ ID NO: 377832 - protein, 20 aa, Mycobacterium
KYFLVFWGVVFFVTVNTIAG

SEQ ID NO: 377833 - protein, 19 aa, Mycobacterium
KYLSYRLIMKRDNSRWFVT

SEQ ID NO: 377834 - protein, 23 aa, Mycobacterium
KYRWLVFTGWLLALVPAVYLALT

SEQ ID NO: 377835 - protein, 20 aa, Mycobacterium
KYWWVRWVILGIVAIVLAVE

SEQ ID NO: 377836 - protein, 17 aa, Mycobacterium
LAAAFAAVLWTCPSALA

SEQ ID NO: 377837 - protein, 23 aa, Mycobacterium
LAAFLLLLPITGVILLILVLVAA

SEQ ID NO: 377838 - protein, 25 aa, Mycobacterium
LAAFPILVALVWWFRNESARTYRKV

SEQ ID NO: 377839 - protein, 30 aa, Mycobacterium
LAAIAAILILVVVPLIYVKNYIKVPPNEVA

SEQ ID NO: 377840 - protein, 17 aa, Mycobacterium
LAAIAVLLALCAGAIGA

SEQ ID NO: 377841 - protein, 18 aa, Mycobacterium
LAALFAVLALVLTGGAWE

SEQ ID NO: 377842 - protein, 24 aa, Mycobacterium
LAALFGKWFWWPMHVRQRPRARPW

SEQ ID NO: 377843 - protein, 19 aa, Mycobacterium
LAALLRSIIAPIYLVLSVV

SEQ ID NO: 377844 - protein, 24 aa, Mycobacterium
LAARLIRAFSVPIVLFWLAVCVVV

SEQ ID NO: 377845 - protein, 23 aa, Mycobacterium
LAARVPFVVLIISALGLGLGVTL

SEQ ID NO: 377846 - protein, 32 aa, Mycobacterium
LAAVLISLLFGWPWWAALLIAIVSLALVLGRW

SEQ ID NO: 377847 - protein, 18 aa, Mycobacterium
LAAVYLIGILVISVIWRL

SEQ ID NO: 377848 - protein, 40 aa, Mycobacterium
LACHRPNRLWWRYTAWWLVALVLATLWWVVALSQLRGVSP

SEQ ID NO: 377849 - protein, 28 aa, Mycobacterium
LADRYAAWFLPMALVLAAASWLASGSAV

SEQ ID NO: 377850 - protein, 28 aa, Mycobacterium
LAFPAPSWWWLAWFALVPLLLLVRAAAT

SEQ ID NO: 377851 - protein, 17 aa, Mycobacterium
LAFTLGALAISLLGSVP

SEQ ID NO: 377852 - protein, 20 aa, Mycobacterium
LAFVFRFLVLAPLSWLIPAI

SEQ ID NO: 377853 - protein, 17 aa, Mycobacterium
LAFWVCGLLLCLFVGPS

SEQ ID NO: 377854 - protein, 23 aa, Mycobacterium
LAFYPLALVPLGSLVWVVLNWPA

SEQ ID NO: 377855 - protein, 18 aa, Mycobacterium
LAFYVPLLPWISGLVGAV

SEQ ID NO: 377856 - protein, 18 aa, Mycobacterium
LAGAGLLAYFKPAGKLGG

SEQ ID NO: 377857 - protein, 20 aa, Mycobacterium
LAGALLLTGWLLAAFADTPR

SEQ ID NO: 377858 - protein, 18 aa, Mycobacterium
LAGLLFLLFGLWMLFDGA

SEQ ID NO: 377859 - protein, 24 aa, Mycobacterium
LAGLLGPWFWWPLRVRTGPTAEAR

SEQ ID NO: 377860 - protein, 22 aa, Mycobacterium
LAHIAIMLVFLLIVLHSKHLHI

SEQ ID NO: 377861 - protein, 20 aa, Mycobacterium
LAIGTLRWPRRRALLAFLGV

SEQ ID NO: 377862 - protein, 26 aa, Mycobacterium
LALALYLIASLLIWGQARLLNVTVQR

SEQ ID NO: 377863 - protein, 26 aa, Mycobacterium
LALALYLVSALLIWSQARLLNLTVQR

SEQ ID NO: 377864 - protein, 27 aa, Mycobacterium
LALAYFLFYLYLIPVFSLVPSVLILEQ

SEQ ID NO: 377865 - protein, 17 aa, Mycobacterium
LALAYLGLLWWMMVCWA

SEQ ID NO: 377866 - protein, 20 aa, Mycobacterium
LALFGLRRGVQDRAPDGAAC

SEQ ID NO: 377867 - protein, 25 aa, Mycobacterium
LALGLLIPVMLWPPSAPLLIIPVVL

SEQ ID NO: 377868 - protein, 33 aa, Mycobacterium
LALINPTWFAWLIVTWLWLTVLFANLAEAVAEG

SEQ ID NO: 377869 - protein, 18 aa, Mycobacterium
LALLLERFGPVTPPWAVA

SEQ ID NO: 377870 - protein, 22 aa, Mycobacterium
LALLLTRLYAPLTALANARVEI

SEQ ID NO: 377871 - protein, 22 aa, Mycobacterium
LALLLTRMYAPLTALANARVEI

SEQ ID NO: 377872 - protein, 20 aa, Mycobacterium
LALPGLAGILLLTGAGGLLG

SEQ ID NO: 377873 - protein, 18 aa, Mycobacterium
LALPSFAWWAAGLNALPM

SEQ ID NO: 377874 - protein, 19 aa, Mycobacterium
LALTALWRSYGVQPDAVIG

SEQ ID NO: 377875 - protein, 24 aa, Mycobacterium
LALVLLLLLLPRERWRWWAVRRSI

SEQ ID NO: 377876 - protein, 26 aa, Mycobacterium
LALVLLYSLLYYRVLGLLTALSLIAS

SEQ ID NO: 377877 - protein, 20 aa, Mycobacterium
LALVLPVWAAALIVAVVLFA

SEQ ID NO: 377878 - protein, 18 aa, Mycobacterium
LALWYYRLYVYPPVTAGY

SEQ ID NO: 377879 - protein, 25 aa, Mycobacterium
LAMLALLVYLYTVVLFAPVLIVLER

SEQ ID NO: 377880 - protein, 24 aa, Mycobacterium
LAMPSYLLAYLWVSAFPTAAGFWG

SEQ ID NO: 377881 - protein, 19 aa, Mycobacterium
LAMQIPGQLLFSLASQLAL

SEQ ID NO: 377882 - protein, 18 aa, Mycobacterium
LAPILIFIIAGRKLNTFW

SEQ ID NO: 377883 - protein, 20 aa, Mycobacterium
LAQHGPWIAILTAALTALAL

SEQ ID NO: 377884 - protein, 23 aa, Mycobacterium
LARAAALLLLGLGFAAVIVIGGW

SEQ ID NO: 377885 - protein, 20 aa, Mycobacterium
LARNHRWFLIANYGAARAGA

SEQ ID NO: 377886 - protein, 24 aa, Mycobacterium
LARPAFLLRSYLIPLGALLVLLVN

SEQ ID NO: 377887 - protein, 20 aa, Mycobacterium
LARSGYLSLFSWMFGLVVTE

SEQ ID NO: 377888 - protein, 26 aa, Mycobacterium
LASEKSFFMLAFTKIGLMPDGAASAL

SEQ ID NO: 377889 - protein, 21 aa, Mycobacterium
LASLHWYTWVAFSGWVVLALV

SEQ ID NO: 377890 - protein, 22 aa, Mycobacterium
LASLTIIFLLAVVALGPMGNYG

SEQ ID NO: 377891 - protein, 24 aa, Mycobacterium
LASVLLFVFLVPDIPPVSGGRFDP

SEQ ID NO: 377892 - protein, 20 aa, Mycobacterium
LASYLFNVYFQRGAPGSFVA

SEQ ID NO: 377893 - protein, 26 aa, Mycobacterium
LASYNKTWLGFVGLSLAVVLIGALLL

SEQ ID NO: 377894 - protein, 18 aa, Mycobacterium
LATICQVIIIAALFLGIA

SEQ ID NO: 377895 - protein, 20 aa, Mycobacterium
LATLAFLRYRWLRGEPLPPQ

SEQ ID NO: 377896 - protein, 25 aa, Mycobacterium
LAVAALLVWMIALSRPPEVVQAAIC

SEQ ID NO: 377897 - protein, 32 aa, Mycobacterium
LAVAAPSWFAWLAVIWLWLTVLFANLAEAVAE

SEQ ID NO: 377898 - protein, 22 aa, Mycobacterium
LAVFAFPFWMLVQTGQFWLITV

SEQ ID NO: 377899 - protein, 26 aa, Mycobacterium
LAVFVVFLLVLFYLVAVARVIDVDEV

SEQ ID NO: 377900 - protein, 18 aa, Mycobacterium
LAVHRRALGLPGVSVAWG

SEQ ID NO: 377901 - protein, 25 aa, Mycobacterium
LAVIVAWLLIVMLLSRLLAPHGIGP

SEQ ID NO: 377902 - protein, 22 aa, Mycobacterium
LAVIVILAGLSGSLFMLVKHRD

SEQ ID NO: 377903 - protein, 23 aa, Mycobacterium
LAVLPALWRYAPLTPIRGPPRSP

SEQ ID NO: 377904 - protein, 20 aa, Mycobacterium
LAVLPWLWQVRRLTPAGRRL

SEQ ID NO: 377905 - protein, 18 aa, Mycobacterium
LAVLVILAALAGSAYMVL

SEQ ID NO: 377906 - protein, 17 aa, Mycobacterium
LAVMAWLSLPLALLVVL

SEQ ID NO: 377907 - protein, 17 aa, Mycobacterium
LAVPIWWAYAASLLLIT

SEQ ID NO: 377908 - protein, 22 aa, Mycobacterium
LAVVVALAAPLGWFGFRVHLAG

SEQ ID NO: 377909 - protein, 19 aa, Mycobacterium
LAVYLVIALALFLLTQRDL

SEQ ID NO: 377910 - protein, 19 aa, Mycobacterium
LAWGWRLPFLFSAALIVIG

SEQ ID NO: 377911 - protein, 21 aa, Mycobacterium
LAWGWRVPFLLSAPLVLVGLL

SEQ ID NO: 377912 - protein, 17 aa, Mycobacterium
LAYLGLLWWMMVCWAQP

SEQ ID NO: 377913 - protein, 18 aa, Mycobacterium
LAYLLLFSLMRAGLGAQA

SEQ ID NO: 377914 - protein, 25 aa, Mycobacterium
LAYSLYLWHWPLLVYWLVYTGEARV

SEQ ID NO: 377915 - protein, 19 aa, Mycobacterium
LAYVFIALPLLSALVPWAI

SEQ ID NO: 377916 - protein, 19 aa, Mycobacterium
LCFLILMLAMFPANIYAAR

SEQ ID NO: 377917 - protein, 20 aa, Mycobacterium
LCLFGLIMVLLRRGRVPGAV

SEQ ID NO: 377918 - protein, 19 aa, Mycobacterium
LCLIFIIMLIMTRSFIAAL

SEQ ID NO: 377919 - protein, 22 aa, Mycobacterium
LCLIFIIMLLITRSVVAAAVIV

SEQ ID NO: 377920 - protein, 23 aa, Mycobacterium
LCLIFVIMLILTRALVAAGVIVG

SEQ ID NO: 377921 - protein, 18 aa, Mycobacterium
LCLLFWQRRFFAASAPTF

SEQ ID NO: 377922 - protein, 24 aa, Mycobacterium
LCVDLLGWRWVFVLSAIPMAAGYA

SEQ ID NO: 377923 - protein, 25 aa, Mycobacterium
LCVSFPPFGWWYIAILAFAVLGWVL

SEQ ID NO: 377924 - protein, 23 aa, Mycobacterium
LCYSIFLFLLRRGGPDRPLVQSY

SEQ ID NO: 377925 - protein, 18 aa, Mycobacterium
LDADYWFRSIRQTVQFER

SEQ ID NO: 377926 - protein, 20 aa, Mycobacterium
LDAIFEPAFAPMPFAGVTAA

SEQ ID NO: 377927 - protein, 18 aa, Mycobacterium
LDHWVQLVLITPVMMYVG

SEQ ID NO: 377928 - protein, 18 aa, Mycobacterium
LDIVVVFLVTWPLVYLAS

SEQ ID NO: 377929 - protein, 19 aa, Mycobacterium
LDSIKFNYFPFGVNFFSTA

SEQ ID NO: 377930 - protein, 17 aa, Mycobacterium
LDTFLVRTVIIPALFTL

SEQ ID NO: 377931 - protein, 27 aa, Mycobacterium
LDTLAVFVGWLWPLWDARNRTFADLLT

SEQ ID NO: 377932 - protein, 17 aa, Mycobacterium
LDVVVVFLVTWPLVYLA

SEQ ID NO: 377933 - protein, 23 aa, Mycobacterium
LEAAALIALWRLLARARQENDEL

SEQ ID NO: 377934 - protein, 55 aa, Mycobacterium
LEALVAWGPLLFFIAYEAFFIPFGFTFWGVMLSAPLWLPLLLVGLAQLVNPVPVE

SEQ ID NO: 377935 - protein, 19 aa, Mycobacterium
LEGLRFFWNIKILRTIALV

SEQ ID NO: 377936 - protein, 20 aa, Mycobacterium
LEHFWWGSVFLINIPVMVIL

SEQ ID NO: 377937 - protein, 24 aa, Mycobacterium
LETRMMALFGIFFGLGAALTVSRL

SEQ ID NO: 377938 - protein, 20 aa, Mycobacterium
LEWLALIAMAPLACWICGLY

SEQ ID NO: 377939 - protein, 19 aa, Mycobacterium
LFAALFLILALVVIGEVAG

SEQ ID NO: 377940 - protein, 18 aa, Mycobacterium
LFDLLQLVVAYVVLLAGY

SEQ ID NO: 377941 - protein, 18 aa, Mycobacterium
LFDTNFFGLIRLTNEVLP

SEQ ID NO: 377942 - protein, 19 aa, Mycobacterium
LFFVGVLVVALLGGVAPAV

SEQ ID NO: 377943 - protein, 19 aa, Mycobacterium
LFGALTLWGTFQGALDVAM

SEQ ID NO: 377944 - protein, 19 aa, Mycobacterium
LFGAMIVVALLVLSRLRNL

SEQ ID NO: 377945 - protein, 21 aa, Mycobacterium
LFGCTPVGPLAWGQALLAAAV

SEQ ID NO: 377946 - protein, 30 aa, Mycobacterium
LFGGKVSYLALLVLVLIALLIGVIGGVVGR

SEQ ID NO: 377947 - protein, 32 aa, Mycobacterium
LFGGRVSWIALLTLALVAVLIAFVGGWVGQKT

SEQ ID NO: 377948 - protein, 31 aa, Mycobacterium
LFGGRVSYLALLVLALIALVIGLIGGVVGRK

SEQ ID NO: 377949 - protein, 26 aa, Mycobacterium
LFGLAFFIPLLPWTGQLVGAVPWLAL

SEQ ID NO: 377950 - protein, 18 aa, Mycobacterium
LFLAPPLSFLPWLVVICY

SEQ ID NO: 377951 - protein, 22 aa, Mycobacterium
LFLLTTTLLDGFWYVASAPLAA

SEQ ID NO: 377952 - protein, 21 aa, Mycobacterium
LFLVLALFTLFSGTPVALADS

SEQ ID NO: 377953 - protein, 18 aa, Mycobacterium
LFLVLYVVPFLKFPANPP

SEQ ID NO: 377954 - protein, 19 aa, Mycobacterium
LFNIIWRIFEAIISIVIAA

SEQ ID NO: 377955 - protein, 25 aa, Mycobacterium
LFPVVQPWYLLWAIIPMAAWATRTG

SEQ ID NO: 377956 - protein, 26 aa, Mycobacterium
LFPVVQPWYLLWAIIPMAAWATRTGF

SEQ ID NO: 377957 - protein, 19 aa, Mycobacterium
LFRPVFYYLSFWAVALVIF

SEQ ID NO: 377958 - protein, 26 aa, Mycobacterium
LFVAFDQLWKWNNIIALVLSVLVILG

SEQ ID NO: 377959 - protein, 25 aa, Mycobacterium
LFVAFDQLWKWNTIVALVLGVLVIL

SEQ ID NO: 377960 - protein, 18 aa, Mycobacterium
LFVCAIMFTLVWWHVDHS

SEQ ID NO: 377961 - protein, 18 aa, Mycobacterium
LFVLSGMAVGWWVIQRNY

SEQ ID NO: 377962 - protein, 19 aa, Mycobacterium
LFVSPLLCIFIIFVGIFAG

SEQ ID NO: 377963 - protein, 17 aa, Mycobacterium
LFYLFWGRHHSALNNRA

SEQ ID NO: 377964 - protein, 20 aa, Mycobacterium
LFYSGFYLPMYWSSRGKLTN

SEQ ID NO: 377965 - protein, 18 aa, Mycobacterium
LGAALWYAATAKDAVIVA

SEQ ID NO: 377966 - protein, 25 aa, Mycobacterium
LGAIGLIEWPVLLAVGGGALVLQRI

SEQ ID NO: 377967 - protein, 20 aa, Mycobacterium
LGANIYWLGEQWWRPLIAVG

SEQ ID NO: 377968 - protein, 25 aa, Mycobacterium
LGAPWYAFWRLLPKIPPWLGLQTTL

SEQ ID NO: 377969 - protein, 23 aa, Mycobacterium
LGATVVFLVCSWWQSAGAPGWVG

SEQ ID NO: 377970 - protein, 20 aa, Mycobacterium
LGCTPLGPFGWAQGLGAAAA

SEQ ID NO: 377971 - protein, 19 aa, Mycobacterium
LGCTPVGPLGWAQGLGTAT

SEQ ID NO: 377972 - protein, 25 aa, Mycobacterium
LGDKAWWIPAWLDRLLPDLDIEGDA

SEQ ID NO: 377973 - protein, 22 aa, Mycobacterium
LGDLRWFYVYSGVMWAIVFMRT

SEQ ID NO: 377974 - protein, 25 aa, Mycobacterium
LGELTHFFALLLWAAAVLAFFAKLP

SEQ ID NO: 377975 - protein, 24 aa, Mycobacterium
LGFKRRLLHRLLGPGDPALASTVF

SEQ ID NO: 377976 - protein, 18 aa, Mycobacterium
LGGLAHRMRCTTTFFGIA

SEQ ID NO: 377977 - protein, 23 aa, Mycobacterium
LGGLLIVVLALFLGVDPGQVLPQ

SEQ ID NO: 377978 - protein, 25 aa, Mycobacterium
LGHVVPLPIMLWLKGIDGPIEEFNQ

SEQ ID NO: 377979 - protein, 18 aa, Mycobacterium
LGIFFVVPFFTLARTSLS

SEQ ID NO: 377980 - protein, 17 aa, Mycobacterium
LGIPLLVLAWLFGPKVM

SEQ ID NO: 377981 - protein, 26 aa, Mycobacterium
LGLGSLLQWMFYVGLLVTVADVLIAL

SEQ ID NO: 377982 - protein, 24 aa, Mycobacterium
LGLGSLLSWMFYVGLLITVADVLI

SEQ ID NO: 377983 - protein, 23 aa, Mycobacterium
LGLILLIMMFLTRSLVAALVIVG

SEQ ID NO: 377984 - protein, 17 aa, Mycobacterium
LGLLLYFTPIMSARNVE

SEQ ID NO: 377985 - protein, 19 aa, Mycobacterium
LGLLPLFLPAVIALIAENI

SEQ ID NO: 377986 - protein, 25 aa, Mycobacterium
LGLLVIAILVAWRWAPARVAGIPGP

SEQ ID NO: 377987 - protein, 23 aa, Mycobacterium
LGLPLNFLFFAVLAVCTVSAGAT

SEQ ID NO: 377988 - protein, 19 aa, Mycobacterium
LGLSWRWLFALSIVPALVS

SEQ ID NO: 377989 - protein, 21 aa, Mycobacterium
LGLSWRWLFGLSIIPALISLI

SEQ ID NO: 377990 - protein, 23 aa, Mycobacterium
LGLTVTLVWLYLEILRLLSYFNN

SEQ ID NO: 377991 - protein, 20 aa, Mycobacterium
LGLWLLPGLPWAVLLAVACI

SEQ ID NO: 377992 - protein, 17 aa, Mycobacterium
LGMFLFGPLLNLALRRF

SEQ ID NO: 377993 - protein, 19 aa, Mycobacterium
LGMILLVIPLFNLSLGGMS

SEQ ID NO: 377994 - protein, 23 aa, Mycobacterium
LGMLLLGVLLWGLGLVPPTVALL

SEQ ID NO: 377995 - protein, 23 aa, Mycobacterium
LGNGKFFINLPVSVPYKAVEVGS

SEQ ID NO: 377996 - protein, 19 aa, Mycobacterium
LGNWTIFYWGWWISWAPFV

SEQ ID NO: 377997 - protein, 19 aa, Mycobacterium
LGPPLLLIASPFLLGGSLL

SEQ ID NO: 377998 - protein, 26 aa, Mycobacterium
LGQHRLLFLAWLPLSGFLLYAGKLSR

SEQ ID NO: 377999 - protein, 17 aa, Mycobacterium
LGQPMFIEYVWGRQVGE

SEQ ID NO: 378000 - protein, 23 aa, Mycobacterium
LGRALSLAWRRSLQLRVVTLTLG

SEQ ID NO: 378001 - protein, 23 aa, Mycobacterium
LGRRYRVGPPVLLILLGALLGLI

SEQ ID NO: 378002 - protein, 25 aa, Mycobacterium
LGRRYRVGPPVLLILLGALLGLVPR

SEQ ID NO: 378003 - protein, 17 aa, Mycobacterium
LGRWFWWPQKIRTRPVP

SEQ ID NO: 378004 - protein, 24 aa, Mycobacterium
LGSAAALLAVLWPAGAQLLIRFTG

SEQ ID NO: 378005 - protein, 17 aa, Mycobacterium
LGSAVVVLLVGLLGVGI

SEQ ID NO: 378006 - protein, 20 aa, Mycobacterium
LGSAVWWKALLALAVALALT

SEQ ID NO: 378007 - protein, 23 aa, Mycobacterium
LGSLLRPYRWAVVLLAVVVVVEN

SEQ ID NO: 378008 - protein, 22 aa, Mycobacterium
LGSMLLALYWRKARPDLYDRIG

SEQ ID NO: 378009 - protein, 24 aa, Mycobacterium
LGSYGSWIMYYVCGISIRVTDLQG

SEQ ID NO: 378010 - protein, 20 aa, Mycobacterium
LGVFLVLAVLLRSLLAPLFM

SEQ ID NO: 378011 - protein, 23 aa, Mycobacterium
LGVLLLGVLLWGLGLIPPTVALM

SEQ ID NO: 378012 - protein, 23 aa, Mycobacterium
LGVLLLGVLLWGLGLVPPTVALM

SEQ ID NO: 378013 - protein, 19 aa, Mycobacterium
LGVLLLLRDFAHALADNVT

SEQ ID NO: 378014 - protein, 31 aa, Mycobacterium
LGVPAWVTQRLWWALLIVAGFWGLIRVAEAL

SEQ ID NO: 378015 - protein, 31 aa, Mycobacterium
LGVPGWVTQRLWWALLLTVGFWGVLRVAEAL

SEQ ID NO: 378016 - protein, 20 aa, Mycobacterium
LGVTLLLALIWADALATALA

SEQ ID NO: 378017 - protein, 18 aa, Mycobacterium
LGVVLLIVDALRERSRGA

SEQ ID NO: 378018 - protein, 19 aa, Mycobacterium
LGWALRWAVGPWPSLREAV

SEQ ID NO: 378019 - protein, 21 aa, Mycobacterium
LGWGSFLLLWVLQACVFWRGM

SEQ ID NO: 378020 - protein, 21 aa, Mycobacterium
LGWPLWAAYIGVFALTVLVGA

SEQ ID NO: 378021 - protein, 19 aa, Mycobacterium
LGWPLWAAYVSVFALTVLV

SEQ ID NO: 378022 - protein, 18 aa, Mycobacterium
LGWRWMFFIGLVPAFVAW

SEQ ID NO: 378023 - protein, 21 aa, Mycobacterium
LGWWKGLAGLWKWATDASHKA

SEQ ID NO: 378024 - protein, 23 aa, Mycobacterium
LGYTLIIVMIGLAALMAYIKPAG

SEQ ID NO: 378025 - protein, 22 aa, Mycobacterium
LGYVYFLVCLWVFRPLPITGAE

SEQ ID NO: 378026 - protein, 32 aa, Mycobacterium
LHFAAGFFMLWYYGFLWYHFVVMPAWQFVIDP

SEQ ID NO: 378027 - protein, 18 aa, Mycobacterium
LHFLVLVYFLFFILVHVT

SEQ ID NO: 378028 - protein, 17 aa, Mycobacterium
LHGVLVPSAHRLMRSKF

SEQ ID NO: 378029 - protein, 21 aa, Mycobacterium
LHGVWILLFASLFTGLVELIP

SEQ ID NO: 378030 - protein, 21 aa, Mycobacterium
LHPAWWTLILVVATLGTIVLT

SEQ ID NO: 378031 - protein, 20 aa, Mycobacterium
LHPGLPLWPYLVCAALSGLG

SEQ ID NO: 378032 - protein, 19 aa, Mycobacterium
LHPLLIMTALPILIGLDVS

SEQ ID NO: 378033 - protein, 28 aa, Mycobacterium
LHPSIFAWAITAWLWFTVVFANLAEAVA

SEQ ID NO: 378034 - protein, 18 aa, Mycobacterium
LHWLVLPLTFIILVAVGS

SEQ ID NO: 378035 - protein, 22 aa, Mycobacterium
LHYRHELLYYKVLIDHLPELMP

SEQ ID NO: 378036 - protein, 19 aa, Mycobacterium
LIALALTILVLWQRRRRRK

SEQ ID NO: 378037 - protein, 17 aa, Mycobacterium
LIAVCAPTLLLAPVASA

SEQ ID NO: 378038 - protein, 17 aa, Mycobacterium
LICALICWLLLSREVLP

SEQ ID NO: 378039 - protein, 17 aa, Mycobacterium
LICWLLLSREVLPRLGP

SEQ ID NO: 378040 - protein, 26 aa, Mycobacterium
LIDTSSWRWIFLINLPIGLVTIVLAA

SEQ ID NO: 378041 - protein, 18 aa, Mycobacterium
LIERFPLMLGTAGAVLAI

SEQ ID NO: 378042 - protein, 23 aa, Mycobacterium
LIFAPLFWVPIVALAILVATHEV

SEQ ID NO: 378043 - protein, 20 aa, Mycobacterium
LIFEGYRWQLIPAYVLAAAI

SEQ ID NO: 378044 - protein, 22 aa, Mycobacterium
LIFGFILMWIMSWLTATPVRVV

SEQ ID NO: 378045 - protein, 18 aa, Mycobacterium
LIFIIMLLMTRSLVAALV

SEQ ID NO: 378046 - protein, 20 aa, Mycobacterium
LIFTRYLWAFELTSALLITA

SEQ ID NO: 378047 - protein, 18 aa, Mycobacterium
LIGVFFWFSVVGGITVVM

SEQ ID NO: 378048 - protein, 27 aa, Mycobacterium
LIHRFSVLILLVWLGLTAIVNLAVPQL

SEQ ID NO: 378049 - protein, 18 aa, Mycobacterium
LIILLIIYRNVVTMLVPL

SEQ ID NO: 378050 - protein, 19 aa, Mycobacterium
LIILSFLLGLVLTCALMVR

SEQ ID NO: 378051 - protein, 17 aa, Mycobacterium
LIITYRSPVLWLVPLLV

SEQ ID NO: 378052 - protein, 19 aa, Mycobacterium
LILFFVFFDLSIVAMYFVI

SEQ ID NO: 378053 - protein, 28 aa, Mycobacterium
LILLLVFRSWFTAMLPLLVMGVSLLIAR

SEQ ID NO: 378054 - protein, 17 aa, Mycobacterium
LILRIVALFYVIALLIV

SEQ ID NO: 378055 - protein, 21 aa, Mycobacterium
LILWADLLNLVYYRVWFLKLR

SEQ ID NO: 378056 - protein, 24 aa, Mycobacterium
LIMLLFVYRSPVTVFLLLVTVGLE

SEQ ID NO: 378057 - protein, 17 aa, Mycobacterium
LIMMIFAYFFYAAYDVF

SEQ ID NO: 378058 - protein, 18 aa, Mycobacterium
LIMMIFAYFLYAFYDVFP

SEQ ID NO: 378059 - protein, 17 aa, Mycobacterium
LIMTLLPVLVALDISSR

SEQ ID NO: 378060 - protein, 25 aa, Mycobacterium
LINTFAWVFYLFGLILLLAAGGVLR

SEQ ID NO: 378061 - protein, 20 aa, Mycobacterium
LIPPFLPRMIHRLALPIVLV

SEQ ID NO: 378062 - protein, 22 aa, Mycobacterium
LIPYLLLYLWLATTGIVMLRRS

SEQ ID NO: 378063 - protein, 22 aa, Mycobacterium
LIRAGFIGVILIILVIAVGLQP

SEQ ID NO: 378064 - protein, 20 aa, Mycobacterium
LIRLFFQPVLIAWALWATGI

SEQ ID NO: 378065 - protein, 27 aa, Mycobacterium
LISPTMLFFPFVLLLAATALYRGGDNK

SEQ ID NO: 378066 - protein, 26 aa, Mycobacterium
LISPTTLFFPFVLLLAATALYRGTDN

SEQ ID NO: 378067 - protein, 17 aa, Mycobacterium
LITLLVAALWVLAVVAR

SEQ ID NO: 378068 - protein, 23 aa, Mycobacterium
LIVLMILIIVYRNLVAMLLPLLM

SEQ ID NO: 378069 - protein, 25 aa, Mycobacterium
LIVVLFVPAALPWYYSWPLAIVAPL

SEQ ID NO: 378070 - protein, 24 aa, Mycobacterium
LIVVLFVPAALPWYYSWPLAVAAP

SEQ ID NO: 378071 - protein, 25 aa, Mycobacterium
LIVVLFVPAALPWYYSWPLAVVAPL

SEQ ID NO: 378072 - protein, 18 aa, Mycobacterium
LIYRLISWLFIAAIGWVV

SEQ ID NO: 378073 - protein, 18 aa, Mycobacterium
LIYTPKPLFRAGGAIFDR

SEQ ID NO: 378074 - protein, 19 aa, Mycobacterium
LIYVIVLYEIVDILPFPVG

SEQ ID NO: 378075 - protein, 21 aa, Mycobacterium
LKRHLPRQIPIYGLQSPLFTG

SEQ ID NO: 378076 - protein, 18 aa, Mycobacterium
LKRWWTLVVAAAVVAVVA

SEQ ID NO: 378077 - protein, 25 aa, Mycobacterium
LKTIGVFFLLLPFTWNRAGGLDGIR

SEQ ID NO: 378078 - protein, 18 aa, Mycobacterium
LLAAFAVEMALMFAVPAG

SEQ ID NO: 378079 - protein, 18 aa, Mycobacterium
LLAAFFIYEGIRRLITPP

SEQ ID NO: 378080 - protein, 21 aa, Mycobacterium
LLAAWPLLRPRLPRVALSVLL

SEQ ID NO: 378081 - protein, 17 aa, Mycobacterium
LLAFAIAAIIWAVMSVR

SEQ ID NO: 378082 - protein, 19 aa, Mycobacterium
LLAHRSYFAFLAILPFVLA

SEQ ID NO: 378083 - protein, 17 aa, Mycobacterium
LLALIWADALATALAGF

SEQ ID NO: 378084 - protein, 17 aa, Mycobacterium
LLALIWADALAVALAGF

SEQ ID NO: 378085 - protein, 18 aa, Mycobacterium
LLAMVLGGLRIHGGMANS

SEQ ID NO: 378086 - protein, 18 aa, Mycobacterium
LLAPLFMVAVVTLSFAAA

SEQ ID NO: 378087 - protein, 19 aa, Mycobacterium
LLAPLFPMIVAVPGGAYLA

SEQ ID NO: 378088 - protein, 27 aa, Mycobacterium
LLAQFHSPLIYLLLAALIASLAVWVVE

SEQ ID NO: 378089 - protein, 18 aa, Mycobacterium
LLAWATFRIGDRVRPLPT

SEQ ID NO: 378090 - protein, 20 aa, Mycobacterium
LLAWLGIVVAVPALWLVAGR

SEQ ID NO: 378091 - protein, 27 aa, Mycobacterium
LLAWSVVLLLLMRWVSPLPLDEPPAPQ

SEQ ID NO: 378092 - protein, 18 aa, Mycobacterium
LLAYLYTMLVFAPVLIVL

SEQ ID NO: 378093 - protein, 25 aa, Mycobacterium
LLAYTGWMFLLQGPPLAIFAAIRRG

SEQ ID NO: 378094 - protein, 24 aa, Mycobacterium
LLCISLSIPAFLWGIRYARARAVT

SEQ ID NO: 378095 - protein, 21 aa, Mycobacterium
LLCLFGMLFVLLRRGRVPGLA

SEQ ID NO: 378096 - protein, 19 aa, Mycobacterium
LLCLVISYITCRLLVGISS

SEQ ID NO: 378097 - protein, 25 aa, Mycobacterium
LLDATIIRMFLVPAIMKLLGDDCWW

SEQ ID NO: 378098 - protein, 24 aa, Mycobacterium
LLDATIIRMFLVPAVMKLLGDDCW

SEQ ID NO: 378099 - protein, 19 aa, Mycobacterium
LLDSWLWRWVAFLIVFALM

SEQ ID NO: 378100 - protein, 26 aa, Mycobacterium
LLDTLPLLIGWLWPLWDSRRRTFADL

SEQ ID NO: 378101 - protein, 27 aa, Mycobacterium
LLDTLSLFVGWLWPLWDSRRRTFADMV

SEQ ID NO: 378102 - protein, 21 aa, Mycobacterium
LLDYLFLPLVIWLIGGSYLQD

SEQ ID NO: 378103 - protein, 19 aa, Mycobacterium
LLEHFWWGSVFMVNIPIAA

SEQ ID NO: 378104 - protein, 24 aa, Mycobacterium
LLEKPMRIFSLRTLVAIAALGVMV

SEQ ID NO: 378105 - protein, 17 aa, Mycobacterium
LLEWVIGNLFGFSPLLA

SEQ ID NO: 378106 - protein, 19 aa, Mycobacterium
LLFFWRDWLRILSGFFSSL

SEQ ID NO: 378107 - protein, 20 aa, Mycobacterium
LLFIPLCVLLAVIALLTGHV

SEQ ID NO: 378108 - protein, 19 aa, Mycobacterium
LLGAYFLRTFFVLIVMAAV

SEQ ID NO: 378109 - protein, 27 aa, Mycobacterium
LLGGLVWPFLLLPQLGMIRGAAATGIV

SEQ ID NO: 378110 - protein, 26 aa, Mycobacterium
LLGGLVWPFLLLPQLGMIRGAAATGM

SEQ ID NO: 378111 - protein, 25 aa, Mycobacterium
LLGGPALPWWLFAAAAFALTTYLGY

SEQ ID NO: 378112 - protein, 19 aa, Mycobacterium
LLGLALLVAGGVFAGAKLT

SEQ ID NO: 378113 - protein, 18 aa, Mycobacterium
LLGLGFAAVIVIGGWALS

SEQ ID NO: 378114 - protein, 20 aa, Mycobacterium
LLGPLFWWPRLIRSRPAPAQ

SEQ ID NO: 378115 - protein, 25 aa, Mycobacterium
LLGQGALWLWNNAISPAWEGIKTAI

SEQ ID NO: 378116 - protein, 20 aa, Mycobacterium
LLGRWFWWPRRVPTHAASPP

SEQ ID NO: 378117 - protein, 18 aa, Mycobacterium
LLGTPVWLGPLAVGAIVI

SEQ ID NO: 378118 - protein, 20 aa, Mycobacterium
LLGWNQWLSLIVAALIVLTY

SEQ ID NO: 378119 - protein, 20 aa, Mycobacterium
LLIAALLLIAVSRAALRPLD

SEQ ID NO: 378120 - protein, 21 aa, Mycobacterium
LLIGALVSILLLIAGGVFAVV

SEQ ID NO: 378121 - protein, 20 aa, Mycobacterium
LLIIGGAIVALLWLIKRLEI

SEQ ID NO: 378122 - protein, 18 aa, Mycobacterium
LLIIMGAFMYFASRRQKK

SEQ ID NO: 378123 - protein, 19 aa, Mycobacterium
LLILLRTTAPVLFFGIALN

SEQ ID NO: 378124 - protein, 31 aa, Mycobacterium
LLILVSPWPVRLFWLLLLALALLIAVDIAAA

SEQ ID NO: 378125 - protein, 17 aa, Mycobacterium
LLIMAFGSLMMTAGKRY

SEQ ID NO: 378126 - protein, 18 aa, Mycobacterium
LLIPCLLLAWAVAHPGLS

SEQ ID NO: 378127 - protein, 19 aa, Mycobacterium
LLIPVLAWPPSAPLLLLPV

SEQ ID NO: 378128 - protein, 17 aa, Mycobacterium
LLIVDLPRPPVPLHLAL

SEQ ID NO: 378129 - protein, 22 aa, Mycobacterium
LLIVYRSIVTVILLLLIVGLEL

SEQ ID NO: 378130 - protein, 19 aa, Mycobacterium
LLIVYRSVFTALLPLLVIG

SEQ ID NO: 378131 - protein, 20 aa, Mycobacterium
LLLAILTTGLLVAPAAAAEP

SEQ ID NO: 378132 - protein, 19 aa, Mycobacterium
LLLAWPWALLIAASSWVAA

SEQ ID NO: 378133 - protein, 26 aa, Mycobacterium
LLLCVSFPPFGWWYTAIVAFALLAWV

SEQ ID NO: 378134 - protein, 17 aa, Mycobacterium
LLLGALWASARLARRAD

SEQ ID NO: 378135 - protein, 17 aa, Mycobacterium
LLLLFWQWRTMPAVIWD

SEQ ID NO: 378136 - protein, 20 aa, Mycobacterium
LLLPLLMRLPDTARWYLLKG

SEQ ID NO: 378137 - protein, 18 aa, Mycobacterium
LLLQFFSFGLHLIPASDN

SEQ ID NO: 378138 - protein, 17 aa, Mycobacterium
LLLRFLIALPIGALIGG

SEQ ID NO: 378139 - protein, 21 aa, Mycobacterium
LLLVYRSLVVAFLPLITVGVA

SEQ ID NO: 378140 - protein, 17 aa, Mycobacterium
LLLYLHPVSIAAGFTCL

SEQ ID NO: 378141 - protein, 19 aa, Mycobacterium
LLMALLMLQLVSAGGMYPV

SEQ ID NO: 378142 - protein, 28 aa, Mycobacterium
LLMESLILFLPFLLIMGGFMYFASRRQK

SEQ ID NO: 378143 - protein, 19 aa, Mycobacterium
LLMGLGWPVVVLVSIVVAR

SEQ ID NO: 378144 - protein, 25 aa, Mycobacterium
LLNGVVFYVLLFATGQWRHIVPTSW

SEQ ID NO: 378145 - protein, 23 aa, Mycobacterium
LLNRMRTLLFDALRASLEGLFKM

SEQ ID NO: 378146 - protein, 18 aa, Mycobacterium
LLPHYRLLGGIPLAYAVI

SEQ ID NO: 378147 - protein, 17 aa, Mycobacterium
LLPILLGVLLGGPAAAG

SEQ ID NO: 378148 - protein, 17 aa, Mycobacterium
LLPILVVIWLSLYRWDL

SEQ ID NO: 378149 - protein, 17 aa, Mycobacterium
LLPLLQHPLGLQLDSIS

SEQ ID NO: 378150 - protein, 25 aa, Mycobacterium
LLPTFPFHYKYLRNAVRGDYLNVFA

SEQ ID NO: 378151 - protein, 17 aa, Mycobacterium
LLPVLWIFSLSLKPTST

SEQ ID NO: 378152 - protein, 33 aa, Mycobacterium
LLQLPGWITQRLWWALLLTIGFWGLLRVAEALG

SEQ ID NO: 378153 - protein, 26 aa, Mycobacterium
LLQTIGFVWFELLITSCYLGAATALA

SEQ ID NO: 378154 - protein, 24 aa, Mycobacterium
LLRALYVILGWRPVLLVPLTFALF

SEQ ID NO: 378155 - protein, 24 aa, Mycobacterium
LLRNYLLPLGALLLLLVKASQIPA

SEQ ID NO: 378156 - protein, 17 aa, Mycobacterium
LLRPQWLALFVVVAAFA

SEQ ID NO: 378157 - protein, 17 aa, Mycobacterium
LLRSAFIPWLVTINPED

SEQ ID NO: 378158 - protein, 18 aa, Mycobacterium
LLSFVLMLFAIWLRLNLK

SEQ ID NO: 378159 - protein, 23 aa, Mycobacterium
LLSLTLAWLYRDYGSTGRLTLEP

SEQ ID NO: 378160 - protein, 20 aa, Mycobacterium
LLSRVPFVVLVIGSLGVGLG

SEQ ID NO: 378161 - protein, 25 aa, Mycobacterium
LLSSLLLFLLFWQWRTMPAVIWAVS

SEQ ID NO: 378162 - protein, 25 aa, Mycobacterium
LLSVALFFVWMISVAFLYLVLGGMG

SEQ ID NO: 378163 - protein, 17 aa, Mycobacterium
LLTLVAIWGLRLSWHIH

SEQ ID NO: 378164 - protein, 17 aa, Mycobacterium
LLTMLWQNLIGNAIKFR

SEQ ID NO: 378165 - protein, 18 aa, Mycobacterium
LLTMLWQNLIGNAIKFRR

SEQ ID NO: 378166 - protein, 17 aa, Mycobacterium
LLTMLWQNLIGNAVKFR

SEQ ID NO: 378167 - protein, 23 aa, Mycobacterium
LLTRALVTRILLVSTLLVASAWW

SEQ ID NO: 378168 - protein, 19 aa, Mycobacterium
LLTRRWVLSWIALAGSFVA

SEQ ID NO: 378169 - protein, 19 aa, Mycobacterium
LLVAHRRPPPPPETGYLAA

SEQ ID NO: 378170 - protein, 17 aa, Mycobacterium
LLVATLTILAPGALLSA

SEQ ID NO: 378171 - protein, 18 aa, Mycobacterium
LLVEWTLLSLLALPTSAV

SEQ ID NO: 378172 - protein, 24 aa, Mycobacterium
LLVEYFWWGAIFLINVPLALLVLL

SEQ ID NO: 378173 - protein, 29 aa, Mycobacterium
LLVGTWLLMRYILPWLLPQIARSQELLVL

SEQ ID NO: 378174 - protein, 25 aa, Mycobacterium
LLVIVALVVGLLRYRRRRISLAARP

SEQ ID NO: 378175 - protein, 18 aa, Mycobacterium
LLVLFLYDNLGLNWALFG

SEQ ID NO: 378176 - protein, 19 aa, Mycobacterium
LLVLGLFTPLAGAGALAFL

SEQ ID NO: 378177 - protein, 22 aa, Mycobacterium
LLVLLLAFTVIFWGVSILPTDP

SEQ ID NO: 378178 - protein, 19 aa, Mycobacterium
LLVNIVAVVWLLWSKRLFG

SEQ ID NO: 378179 - protein, 23 aa, Mycobacterium
LLVPAFMRVMGRWNWWAPAPLAR

SEQ ID NO: 378180 - protein, 18 aa, Mycobacterium
LLVPAYLPYVRAARPIIF

SEQ ID NO: 378181 - protein, 23 aa, Mycobacterium
LLVQAFFIYFGIPSALGFQMSAL

SEQ ID NO: 378182 - protein, 20 aa, Mycobacterium
LLVQALLVLSLLFALPISAR

SEQ ID NO: 378183 - protein, 20 aa, Mycobacterium
LLVQALLVTSLLFALPLSAR

SEQ ID NO: 378184 - protein, 22 aa, Mycobacterium
LLVSTLLVASAWWLFEWEISRG

SEQ ID NO: 378185 - protein, 20 aa, Mycobacterium
LLVVLIAFLIRQMLRGWVHR

SEQ ID NO: 378186 - protein, 17 aa, Mycobacterium
LLVVVLVAAAALVAGRE

SEQ ID NO: 378187 - protein, 20 aa, Mycobacterium
LLVVYRNPVTMFLPLLTIGL

SEQ ID NO: 378188 - protein, 18 aa, Mycobacterium
LLVWLPYPGFAAYLQVGC

SEQ ID NO: 378189 - protein, 17 aa, Mycobacterium
LLWFGFGGVIYTYILIT

SEQ ID NO: 378190 - protein, 19 aa, Mycobacterium
LLWVPAVLLVLLGLVLVAT

SEQ ID NO: 378191 - protein, 18 aa, Mycobacterium
LLWWLRRLFEAPLPTVGV

SEQ ID NO: 378192 - protein, 17 aa, Mycobacterium
LLYGYNVLDWFNWGLSG

SEQ ID NO: 378193 - protein, 22 aa, Mycobacterium
LLYLFLPIFVIILFSFNKPAGK

SEQ ID NO: 378194 - protein, 18 aa, Mycobacterium
LMFLAFGSVVLPIKAAVM

SEQ ID NO: 378195 - protein, 18 aa, Mycobacterium
LMGLGWPVVVLVSIVVAR

SEQ ID NO: 378196 - protein, 18 aa, Mycobacterium
LMGVIVVALIIGVGSTLT

SEQ ID NO: 378197 - protein, 21 aa, Mycobacterium
LMIYLTQPLTFFLLEWGRSLL

SEQ ID NO: 378198 - protein, 17 aa, Mycobacterium
LMLLVSPATRAAARVQT

SEQ ID NO: 378199 - protein, 18 aa, Mycobacterium
LMLVLLLGATMLLMFLAF

SEQ ID NO: 378200 - protein, 17 aa, Mycobacterium
LMMFIIRSGIQILCDHP

SEQ ID NO: 378201 - protein, 24 aa, Mycobacterium
LMNIPLWIVLVLPVAKIVATSLSI

SEQ ID NO: 378202 - protein, 17 aa, Mycobacterium
LMPLAMFGTLGLATVVL

SEQ ID NO: 378203 - protein, 21 aa, Mycobacterium
LMSIPLWIIVVLPIAKIIATS

SEQ ID NO: 378204 - protein, 21 aa, Mycobacterium
LMVGLFIPVYCACPSYFMSPA

SEQ ID NO: 378205 - protein, 25 aa, Mycobacterium
LMVLAGFALLIWVPALRCPAPVAAV

SEQ ID NO: 378206 - protein, 18 aa, Mycobacterium
LMVLLLLSSIVSVAAIVA

SEQ ID NO: 378207 - protein, 24 aa, Mycobacterium
LNGAVFYVLLFTTGQWRHIVPTSW

SEQ ID NO: 378208 - protein, 17 aa, Mycobacterium
LNLDLLLGGLKPVIQGL

SEQ ID NO: 378209 - protein, 22 aa, Mycobacterium
LNMVRLWWDKPWPMRIIALARL

SEQ ID NO: 378210 - protein, 17 aa, Mycobacterium
LNNWIRQGVVERGLVVS

SEQ ID NO: 378211 - protein, 17 aa, Mycobacterium
LNPLSWAGGLWRASVAT

SEQ ID NO: 378212 - protein, 18 aa, Mycobacterium
LNWRVLVGAFFVAAAFAS

SEQ ID NO: 378213 - protein, 22 aa, Mycobacterium
LPAFGLWHLWAGAPADPVERRH

SEQ ID NO: 378214 - protein, 17 aa, Mycobacterium
LPALIALAGRYGLAQPR

SEQ ID NO: 378215 - protein, 26 aa, Mycobacterium
LPARWRRWWWALLLAFVPIHLVVSAI

SEQ ID NO: 378216 - protein, 26 aa, Mycobacterium
LPARWRRWWWALLLAFVPIHLVVSAV

SEQ ID NO: 378217 - protein, 23 aa, Mycobacterium
LPAWPIWFALLWAAQEWLKSVFP

SEQ ID NO: 378218 - protein, 17 aa, Mycobacterium
LPFAWQGVSLHAAGASR

SEQ ID NO: 378219 - protein, 18 aa, Mycobacterium
LPFLVLVIALWPLGRLLV

SEQ ID NO: 378220 - protein, 23 aa, Mycobacterium
LPFVMLGAGLLWFGWYGFNAGSA

SEQ ID NO: 378221 - protein, 24 aa, Mycobacterium
LPFVMLGAGLLWFGWYGFNAGSAT

SEQ ID NO: 378222 - protein, 26 aa, Mycobacterium
LPFYHDMGFFVGIIIPILAGIPVVLT

SEQ ID NO: 378223 - protein, 20 aa, Mycobacterium
LPGFGLVTAPLRAGALLAAT

SEQ ID NO: 378224 - protein, 22 aa, Mycobacterium
LPGVIAIVVLLFLACAPVASAQ

SEQ ID NO: 378225 - protein, 21 aa, Mycobacterium
LPGVLSIVVLLFVACAPVASA

SEQ ID NO: 378226 - protein, 23 aa, Mycobacterium
LPGWPIWFAVLWAAQEWLKSLMP

SEQ ID NO: 378227 - protein, 21 aa, Mycobacterium
LPGWPIWFAVLWGAQEWLKSI

SEQ ID NO: 378228 - protein, 23 aa, Mycobacterium
LPGWPLWFATLWVAAEWAKSTFP

SEQ ID NO: 378229 - protein, 22 aa, Mycobacterium
LPHAIRIFAIPIILGWLVITVL

SEQ ID NO: 378230 - protein, 18 aa, Mycobacterium
LPIILIVLLAVFGSLAAA

SEQ ID NO: 378231 - protein, 18 aa, Mycobacterium
LPILGWRSEFRWGFLVVG

SEQ ID NO: 378232 - protein, 27 aa, Mycobacterium
LPLPLLPLQILFLNLVTDVFPAFALAT

SEQ ID NO: 378233 - protein, 29 aa, Mycobacterium
LPLRAMVMVLLFLGVIFLLVGFNALGSDK

SEQ ID NO: 378234 - protein, 24 aa, Mycobacterium
LPLSFLILIWVFGGLLAAALPMAL

SEQ ID NO: 378235 - protein, 29 aa, Mycobacterium
LPLVGVIPYLLFLILGLASMLVLVGAGRG

SEQ ID NO: 378236 - protein, 27 aa, Mycobacterium
LPLVYGALYLWAFWDPFGHTNKMPVAL

SEQ ID NO: 378237 - protein, 21 aa, Mycobacterium
LPMLRPLRLLRLVTLIAVLQR

SEQ ID NO: 378238 - protein, 18 aa, Mycobacterium
LPPVLRKLTIFVPESPSA

SEQ ID NO: 378239 - protein, 20 aa, Mycobacterium
LPPVLRKLTIYLPQSPSTAE

SEQ ID NO: 378240 - protein, 29 aa, Mycobacterium
LPRLWQILLTVGLFLWIAIIWRGIRGKLK

SEQ ID NO: 378241 - protein, 22 aa, Mycobacterium
LPRPWNPLPCMGLGAGPFGGPS

SEQ ID NO: 378242 - protein, 18 aa, Mycobacterium
LPRQIYWRRRALAAGIAA

SEQ ID NO: 378243 - protein, 24 aa, Mycobacterium
LPSIPRWLWILLALGFGTAALAGG

SEQ ID NO: 378244 - protein, 18 aa, Mycobacterium
LPVRYRVHLFLLVIVERA

SEQ ID NO: 378245 - protein, 24 aa, Mycobacterium
LPVVFYSAWIFFDGAWRALRARTL

SEQ ID NO: 378246 - protein, 17 aa, Mycobacterium
LPWEVPLIELGLDSLMA

SEQ ID NO: 378247 - protein, 19 aa, Mycobacterium
LPWMFFFTGLAIPAFYAVG

SEQ ID NO: 378248 - protein, 17 aa, Mycobacterium
LQALLVEWTLLSLLALP

SEQ ID NO: 378249 - protein, 25 aa, Mycobacterium
LQFTNWQWLSLTLAAPVVVWGALPF

SEQ ID NO: 378250 - protein, 22 aa, Mycobacterium
LQFTYWQWASLTLAAPVIVWAA

SEQ ID NO: 378251 - protein, 24 aa, Mycobacterium
LQGATGVPWLLISGPLGPSNASDT

SEQ ID NO: 378252 - protein, 22 aa, Mycobacterium
LQLAGWIIYLVLVLGLFLRPVA

SEQ ID NO: 378253 - protein, 20 aa, Mycobacterium
LQLCLVVLLVAVWRGRRPGP

SEQ ID NO: 378254 - protein, 22 aa, Mycobacterium
LQLYVWIRWITGPYFERVPSGP

SEQ ID NO: 378255 - protein, 22 aa, Mycobacterium
LQTFWILGVLVLICLFFSVLAG

SEQ ID NO: 378256 - protein, 21 aa, Mycobacterium
LQVILGWRPVLLIPLTFALFT

SEQ ID NO: 378257 - protein, 19 aa, Mycobacterium
LRALLVFTVLLGVGYPLLI

SEQ ID NO: 378258 - protein, 24 aa, Mycobacterium
LREFRLFFFHRLLMMTPLIALFFW

SEQ ID NO: 378259 - protein, 24 aa, Mycobacterium
LRENVVALTVLWLLNIGEYLQDLT

SEQ ID NO: 378260 - protein, 25 aa, Mycobacterium
LRENVVALTVLWLLNIGEYLQDLTL

SEQ ID NO: 378261 - protein, 23 aa, Mycobacterium
LRERHPAWRLLRAGNATLILSFL

SEQ ID NO: 378262 - protein, 19 aa, Mycobacterium
LRFAYLRPPGMTWLDALYF

SEQ ID NO: 378263 - protein, 17 aa, Mycobacterium
LRFLVRHSMYWFVGYRI

SEQ ID NO: 378264 - protein, 18 aa, Mycobacterium
LRGATGVPWLLISGPLGS

SEQ ID NO: 378265 - protein, 18 aa, Mycobacterium
LRHDGLAYRFPFHTEKKT

SEQ ID NO: 378266 - protein, 18 aa, Mycobacterium
LRHEGLAYRFPFHTEKKS

SEQ ID NO: 378267 - protein, 18 aa, Mycobacterium
LRLFVFAAVVMLLGIVGA

SEQ ID NO: 378268 - protein, 19 aa, Mycobacterium
LRLGLNIPYLLLLLAFVVY

SEQ ID NO: 378269 - protein, 22 aa, Mycobacterium
LRLNDPWYQQLWYYVVRGPEIK

SEQ ID NO: 378270 - protein, 18 aa, Mycobacterium
LRLRWRPLLIAAAILLAW

SEQ ID NO: 378271 - protein, 20 aa, Mycobacterium
LRNKRWWAGALLLAASIALQ

SEQ ID NO: 378272 - protein, 22 aa, Mycobacterium
LRNYILPLAALLILLVKGSEIS

SEQ ID NO: 378273 - protein, 23 aa, Mycobacterium
LRNYLLPLAALLLLLVQASGIPA

SEQ ID NO: 378274 - protein, 20 aa, Mycobacterium
LRNYLLPLGALLLLIVNSEG

SEQ ID NO: 378275 - protein, 18 aa, Mycobacterium
LRNYLLPLGALLLLVVKV

SEQ ID NO: 378276 - protein, 18 aa, Mycobacterium
LRPGWIALALVVIAFTYL

SEQ ID NO: 378277 - protein, 17 aa, Mycobacterium
LRPGWIVLALVVIAFAY

SEQ ID NO: 378278 - protein, 26 aa, Mycobacterium
LRQFHHPLIYVLLAAGLITAGLREYV

SEQ ID NO: 378279 - protein, 17 aa, Mycobacterium
LRRGAHWRAIVVVGLLV

SEQ ID NO: 378280 - protein, 24 aa, Mycobacterium
LRRRLSAGLLLLIGLAVAGGVAAT

SEQ ID NO: 378281 - protein, 18 aa, Mycobacterium
LRRWQRMVPAIEALLTAA

SEQ ID NO: 378282 - protein, 23 aa, Mycobacterium
LRSFNYFGWFFLVPGVLAAAVAL

SEQ ID NO: 378283 - protein, 18 aa, Mycobacterium
LRSLVMRMWPQIKSIGGR

SEQ ID NO: 378284 - protein, 26 aa, Mycobacterium
LRVALRIVWALLLMPGLPLLGVPVPG

SEQ ID NO: 378285 - protein, 19 aa, Mycobacterium
LRVMFLIGLVFLALGWSTK

SEQ ID NO: 378286 - protein, 21 aa, Mycobacterium
LRVMLGWRPVLLIPLTFALFT

SEQ ID NO: 378287 - protein, 20 aa, Mycobacterium
LRWWPAIGYGLLPALALLLA

SEQ ID NO: 378288 - protein, 19 aa, Mycobacterium
LRYAIACLLLLGWVRLTGH

SEQ ID NO: 378289 - protein, 20 aa, Mycobacterium
LSARWWIVIVSLIVTASSFL

SEQ ID NO: 378290 - protein, 17 aa, Mycobacterium
LSFLFPSRWGFAATAAT

SEQ ID NO: 378291 - protein, 20 aa, Mycobacterium
LSFWLFIFGALIALSGFIVP

SEQ ID NO: 378292 - protein, 20 aa, Mycobacterium
LSFWLFLFGALIALAGFITP

SEQ ID NO: 378293 - protein, 21 aa, Mycobacterium
LSFWLFLFGALIALAGFITPG

SEQ ID NO: 378294 - protein, 29 aa, Mycobacterium
LSGFEHSWFFLFLFVIVGLVALYIVLQLA

SEQ ID NO: 378295 - protein, 27 aa, Mycobacterium
LSGLALLLVFLFWPWEYQPFGSEGEFL

SEQ ID NO: 378296 - protein, 18 aa, Mycobacterium
LSGLGLMLNPTSLVPLLL

SEQ ID NO: 378297 - protein, 17 aa, Mycobacterium
LSILFWQHLVGLHLHWL

SEQ ID NO: 378298 - protein, 18 aa, Mycobacterium
LSILLVCIIVVCLVIAGL

SEQ ID NO: 378299 - protein, 19 aa, Mycobacterium
LSISWQITVLALIVLPLFL

SEQ ID NO: 378300 - protein, 19 aa, Mycobacterium
LSLFKAAGYLLWWAVLFPA

SEQ ID NO: 378301 - protein, 30 aa, Mycobacterium
LSLFKAAGYLLWWAVLFPAISIPIIASVAM

SEQ ID NO: 378302 - protein, 17 aa, Mycobacterium
LSLFLLAPYARRLLTAF

SEQ ID NO: 378303 - protein, 19 aa, Mycobacterium
LSLFYLFPTLLGVFSRLYV

SEQ ID NO: 378304 - protein, 17 aa, Mycobacterium
LSLFYLFPTLLGVFSRW

SEQ ID NO: 378305 - protein, 19 aa, Mycobacterium
LSLIGFRVPWREKMFLSWA

SEQ ID NO: 378306 - protein, 23 aa, Mycobacterium
LSLILLIMMFLTRSLVAALVIVG

SEQ ID NO: 378307 - protein, 17 aa, Mycobacterium
LSLPLWVFLLSVPLATV

SEQ ID NO: 378308 - protein, 20 aa, Mycobacterium
LSLPMFMEELFWGCAGIGLA

SEQ ID NO: 378309 - protein, 25 aa, Mycobacterium
LSMGVILLGLLWYAGLPLRVFLTSL

SEQ ID NO: 378310 - protein, 18 aa, Mycobacterium
LSMLLAGGFAWLFAGRAV

SEQ ID NO: 378311 - protein, 24 aa, Mycobacterium
LSPYMLMMPLMMIMGTVGFMAGGG

SEQ ID NO: 378312 - protein, 36 aa, Mycobacterium
LSQALRFTYMLLFSIPVLAPLFLRLTLSVPALRRNA

SEQ ID NO: 378313 - protein, 22 aa, Mycobacterium
LSQALRLGWMALPAELVDQVVE

SEQ ID NO: 378314 - protein, 23 aa, Mycobacterium
LSQQPWSMFGIPAPLVAFVLGFL

SEQ ID NO: 378315 - protein, 18 aa, Mycobacterium
LSQWFLLTAAFGSLFMVA

SEQ ID NO: 378316 - protein, 23 aa, Mycobacterium
LSQWFLLVMAFGSLFMAAGKRYA

SEQ ID NO: 378317 - protein, 21 aa, Mycobacterium
LSRHFAWRVLLVSVLMAGGAL

SEQ ID NO: 378318 - protein, 25 aa, Mycobacterium
LSRNWFRRWQLVLCDQAIVIALMLA

SEQ ID NO: 378319 - protein, 25 aa, Mycobacterium
LSRWRSIVLMLLLISTIGSAAGLFY

SEQ ID NO: 378320 - protein, 20 aa, Mycobacterium
LSRWWRVALLAAISTFLAAE

SEQ ID NO: 378321 - protein, 17 aa, Mycobacterium
LSVAGLVLILVVATAYL

SEQ ID NO: 378322 - protein, 17 aa, Mycobacterium
LSVLIWQHLIGLPLHWL

SEQ ID NO: 378323 - protein, 19 aa, Mycobacterium
LSVLIWQHLLHMPLNWIVV

SEQ ID NO: 378324 - protein, 21 aa, Mycobacterium
LSVLIWQSILGIPLNWVVLAM

SEQ ID NO: 378325 - protein, 23 aa, Mycobacterium
LSVLIWQYIFGIELYWMVLPMSV

SEQ ID NO: 378326 - protein, 19 aa, Mycobacterium
LSVLLLFGVLVWLTALGAR

SEQ ID NO: 378327 - protein, 17 aa, Mycobacterium
LSVLLWQDILGLGVQWI

SEQ ID NO: 378328 - protein, 17 aa, Mycobacterium
LSVLLWQHIIGLALHWM

SEQ ID NO: 378329 - protein, 19 aa, Mycobacterium
LSVLLWQHIIGMPLHWLVI

SEQ ID NO: 378330 - protein, 25 aa, Mycobacterium
LSVPIILGWLGMIAIVTFAVPSLEQ

SEQ ID NO: 378331 - protein, 17 aa, Mycobacterium
LSWRWLFGLSIIPALIS

SEQ ID NO: 378332 - protein, 23 aa, Mycobacterium
LSYTPVLAPLRKPARNLVKLAAA

SEQ ID NO: 378333 - protein, 17 aa, Mycobacterium
LTALFLAGTLILTVARR

SEQ ID NO: 378334 - protein, 18 aa, Mycobacterium
LTALRELALLWLADQVDT

SEQ ID NO: 378335 - protein, 20 aa, Mycobacterium
LTALRELALLWLADQVDTAL

SEQ ID NO: 378336 - protein, 28 aa, Mycobacterium
LTAWIAAPLLFIGALFGLLLLTGTTVRE

SEQ ID NO: 378337 - protein, 28 aa, Mycobacterium
LTAWIAAPLLFIGVLFGVLLLTGTTIRE

SEQ ID NO: 378338 - protein, 20 aa, Mycobacterium
LTCWLPVFLGWPIMRWLTKN

SEQ ID NO: 378339 - protein, 20 aa, Mycobacterium
LTCWLPVFLGWPIMRWLTKS

SEQ ID NO: 378340 - protein, 23 aa, Mycobacterium
LTETWFAIGVMLIPLLLSALVLE

SEQ ID NO: 378341 - protein, 27 aa, Mycobacterium
LTFLVIVVMLLFFYRSIFTVIMVFMLV

SEQ ID NO: 378342 - protein, 23 aa, Mycobacterium
LTGCLAAVIWWACHRPNRLWWRF

SEQ ID NO: 378343 - protein, 35 aa, Mycobacterium
LTGHLLGIPGWITQRLWWAVLLTVGFWGLLRVAEA

SEQ ID NO: 378344 - protein, 20 aa, Mycobacterium
LTGRPLSLYTLPISGFGKDA

SEQ ID NO: 378345 - protein, 17 aa, Mycobacterium
LTLAYLGLLWWMMVCWA

SEQ ID NO: 378346 - protein, 22 aa, Mycobacterium
LTLIFMIMLILTRSAVAALVIV

SEQ ID NO: 378347 - protein, 22 aa, Mycobacterium
LTLLRLVLVPVFLLALFAGDGQ

SEQ ID NO: 378348 - protein, 17 aa, Mycobacterium
LTLLTMAAAFMGTALTI

SEQ ID NO: 378349 - protein, 25 aa, Mycobacterium
LTMAILLLVYLLFRPVRFYYDGENH

SEQ ID NO: 378350 - protein, 17 aa, Mycobacterium
LTPLQWVSTARPLAAKV

SEQ ID NO: 378351 - protein, 20 aa, Mycobacterium
LTPMIFIVFLFVVGRIRAAV

SEQ ID NO: 378352 - protein, 17 aa, Mycobacterium
LTRLLSFALTALTLVAA

SEQ ID NO: 378353 - protein, 24 aa, Mycobacterium
LTSTLWFFLTWFPTYLVEYRGMDY

SEQ ID NO: 378354 - protein, 19 aa, Mycobacterium
LTTGFFPLMGIGAFSMLAF

SEQ ID NO: 378355 - protein, 28 aa, Mycobacterium
LTTRTNAPVWKWIAAGVTVVIILGLLTV

SEQ ID NO: 378356 - protein, 24 aa, Mycobacterium
LTVISLLVLGVYYLQIPSLMGIGR

SEQ ID NO: 378357 - protein, 25 aa, Mycobacterium
LTVISLLVLGVYYLQLPSLAGIGRY

SEQ ID NO: 378358 - protein, 20 aa, Mycobacterium
LTVLLALLANLFFPWGIAGD

SEQ ID NO: 378359 - protein, 19 aa, Mycobacterium
LTVLLFDSGILTPPPPKPA

SEQ ID NO: 378360 - protein, 20 aa, Mycobacterium
LTVTLVWLYIEILRLLSYFN

SEQ ID NO: 378361 - protein, 20 aa, Mycobacterium
LTVTLVWLYIEILRLLSYLQ

SEQ ID NO: 378362 - protein, 22 aa, Mycobacterium
LTVWVVGITLRPLRRVAATAAT

SEQ ID NO: 378363 - protein, 22 aa, Mycobacterium
LTVWVVGYTLRPLRRLAGIAAE

SEQ ID NO: 378364 - protein, 17 aa, Mycobacterium
LTWPFQAVPVFFLVAGY

SEQ ID NO: 378365 - protein, 24 aa, Mycobacterium
LTYGWRIPLLLGLPFGLVALFLRL

SEQ ID NO: 378366 - protein, 24 aa, Mycobacterium
LVAAGLGWLLAGPAIRPLRKLTEH

SEQ ID NO: 378367 - protein, 24 aa, Mycobacterium
LVALAWFPLWLILLAVGWLVVRRR

SEQ ID NO: 378368 - protein, 22 aa, Mycobacterium
LVAMLLPLLMIGMALVVAEQSV

SEQ ID NO: 378369 - protein, 19 aa, Mycobacterium
LVAPPFFHGFGLAALLGPL

SEQ ID NO: 378370 - protein, 20 aa, Mycobacterium
LVAVLALLFAVLPVAAAPVA

SEQ ID NO: 378371 - protein, 18 aa, Mycobacterium
LVAYLYTVLMFAPVLIVL

SEQ ID NO: 378372 - protein, 25 aa, Mycobacterium
LVDYVWGGLRRPWRPRRFLRSLAQA

SEQ ID NO: 378373 - protein, 27 aa, Mycobacterium
LVEALNWRWVFLVNLPLGIVAVLAARR

SEQ ID NO: 378374 - protein, 24 aa, Mycobacterium
LVEGPPPRWPWVVGVTAIIAAIAL

SEQ ID NO: 378375 - protein, 17 aa, Mycobacterium
LVERLFDGKLGSNSLEL

SEQ ID NO: 378376 - protein, 20 aa, Mycobacterium
LVEYYYLKYYIPRARSRPVV

SEQ ID NO: 378377 - protein, 18 aa, Mycobacterium
LVFGPYAGWSPKFLKQGH

SEQ ID NO: 378378 - protein, 21 aa, Mycobacterium
LVFKVLIMVLWLAPIGAFGAI

SEQ ID NO: 378379 - protein, 21 aa, Mycobacterium
LVFLIVLLMLRSPVAAAVVIG

SEQ ID NO: 378380 - protein, 22 aa, Mycobacterium
LVFWHTFLMVYLYEIALAVGVL

SEQ ID NO: 378381 - protein, 17 aa, Mycobacterium
LVFWMALAGLTPTGLVL

SEQ ID NO: 378382 - protein, 20 aa, Mycobacterium
LVGALLWLVGVSALAWLLVD

SEQ ID NO: 378383 - protein, 29 aa, Mycobacterium
LVGAVLLTVPLWLRLWRALGIERAARIRT

SEQ ID NO: 378384 - protein, 18 aa, Mycobacterium
LVGFVRWPMWLRTVVSVV

SEQ ID NO: 378385 - protein, 23 aa, Mycobacterium
LVGGPFVYLIDFGATPTATDTAD

SEQ ID NO: 378386 - protein, 19 aa, Mycobacterium
LVGIPMLAGWLLINRGRGE

SEQ ID NO: 378387 - protein, 18 aa, Mycobacterium
LVGLAFALGMLLTFTLMV

SEQ ID NO: 378388 - protein, 17 aa, Mycobacterium
LVGLLLNSLFGFSWADH

SEQ ID NO: 378389 - protein, 17 aa, Mycobacterium
LVGLSYYILLFATGQWH

SEQ ID NO: 378390 - protein, 25 aa, Mycobacterium
LVGPIFLIVYFALGVGSLLSWMLYV

SEQ ID NO: 378391 - protein, 24 aa, Mycobacterium
LVGPIFLIVYFTLGLGSLLSWMFY

SEQ ID NO: 378392 - protein, 23 aa, Mycobacterium
LVGPIFLVVYFVMGLDSLLQWMF

SEQ ID NO: 378393 - protein, 24 aa, Mycobacterium
LVGQFWSDAYPRLTALGWTGVLDK

SEQ ID NO: 378394 - protein, 25 aa, Mycobacterium
LVGQGAMWLWNNAIQPAWDGIKNAI

SEQ ID NO: 378395 - protein, 18 aa, Mycobacterium
LVGYLLLRRALLPAGGHL

SEQ ID NO: 378396 - protein, 21 aa, Mycobacterium
LVHSLWWLAQAWTIAALCTLA

SEQ ID NO: 378397 - protein, 30 aa, Mycobacterium
LVIADRAYFAFLAILPFILGALSLTVPGDT

SEQ ID NO: 378398 - protein, 24 aa, Mycobacterium
LVIAIMVAWRWAPAKVAPVPGPLV

SEQ ID NO: 378399 - protein, 28 aa, Mycobacterium
LVIGFVLGWPWWWISACSVLVLLIAEGV

SEQ ID NO: 378400 - protein, 26 aa, Mycobacterium
LVIGIVLVVGFWQPGFFVTTKLDVNK

SEQ ID NO: 378401 - protein, 23 aa, Mycobacterium
LVIILMLLFVYRSAITMLIMLVM

SEQ ID NO: 378402 - protein, 23 aa, Mycobacterium
LVIITMLLLVYRSIVTVLITLFL

SEQ ID NO: 378403 - protein, 24 aa, Mycobacterium
LVIQLLWIFFVLPQLGLRFEPMAA

SEQ ID NO: 378404 - protein, 27 aa, Mycobacterium
LVISGWTLMVWLMLGVGSFFGYLASLA

SEQ ID NO: 378405 - protein, 19 aa, Mycobacterium
LVITLIATITWTIASLVRV

SEQ ID NO: 378406 - protein, 17 aa, Mycobacterium
LVITPLRVAFLIVLIGT

SEQ ID NO: 378407 - protein, 23 aa, Mycobacterium
LVIVGLILVVLLRALVAPLYLLG

SEQ ID NO: 378408 - protein, 18 aa, Mycobacterium
LVIVGWLTLWPFLSWLTT

SEQ ID NO: 378409 - protein, 21 aa, Mycobacterium
LVIVYALIPVLWILSLSLKPT

SEQ ID NO: 378410 - protein, 23 aa, Mycobacterium
LVKALLVLGLWLAGWGAAVLVAR

SEQ ID NO: 378411 - protein, 18 aa, Mycobacterium
LVLAYLGLLWWMMVCWSQ

SEQ ID NO: 378412 - protein, 19 aa, Mycobacterium
LVLFLPVLVYLVLTSSLTI

SEQ ID NO: 378413 - protein, 20 aa, Mycobacterium
LVLIIAFFLVWWTYDTYRPA

SEQ ID NO: 378414 - protein, 23 aa, Mycobacterium
LVLLYSLLYYRVLGLLTALSLIA

SEQ ID NO: 378415 - protein, 20 aa, Mycobacterium
LVLNAGWSWLFFRFHRLGAS

SEQ ID NO: 378416 - protein, 28 aa, Mycobacterium
LVLSVVLFFVWMIAVAFLYLVLGGMGVW

SEQ ID NO: 378417 - protein, 19 aa, Mycobacterium
LVLTLVVGLAYLAIGALRI

SEQ ID NO: 378418 - protein, 17 aa, Mycobacterium
LVLTYLGLLWWMMVCWA

SEQ ID NO: 378419 - protein, 21 aa, Mycobacterium
LVLVPIFLYALFYDGGHQTPA

SEQ ID NO: 378420 - protein, 24 aa, Mycobacterium
LVLVYFLFFILVHVTLVFTTEALR

SEQ ID NO: 378421 - protein, 19 aa, Mycobacterium
LVLYIFWELTTVLSFLLVG

SEQ ID NO: 378422 - protein, 27 aa, Mycobacterium
LVMIGFILGWPWWWISACSVLVLLVLE

SEQ ID NO: 378423 - protein, 18 aa, Mycobacterium
LVMILIALIVYGIIELIS

SEQ ID NO: 378424 - protein, 18 aa, Mycobacterium
LVMILVAIVIWAATHDDN

SEQ ID NO: 378425 - protein, 18 aa, Mycobacterium
LVMVLVCTLLYRNFRKNG

SEQ ID NO: 378426 - protein, 19 aa, Mycobacterium
LVNFLIVAAWIAVAVIANL

SEQ ID NO: 378427 - protein, 24 aa, Mycobacterium
LVPAFMHLLGRWNWWAPPPLARLH

SEQ ID NO: 378428 - protein, 18 aa, Mycobacterium
LVPGIMIAGALIAGTGSI

SEQ ID NO: 378429 - protein, 19 aa, Mycobacterium
LVPGWLFISAVVYVPLALI

SEQ ID NO: 378430 - protein, 18 aa, Mycobacterium
LVPLALFGILGLAAVVLV

SEQ ID NO: 378431 - protein, 18 aa, Mycobacterium
LVPLFWVLSIVVARGWYA

SEQ ID NO: 378432 - protein, 24 aa, Mycobacterium
LVPLVWLLWVVIERGWYAIIRVDW

SEQ ID NO: 378433 - protein, 21 aa, Mycobacterium
LVPLVWLLWVVIERGWYAVVQ

SEQ ID NO: 378434 - protein, 25 aa, Mycobacterium
LVPWAQPVNWWLLLAGFGVFITPVG

SEQ ID NO: 378435 - protein, 21 aa, Mycobacterium
LVQHVRWPMWLRTLVSVLALA

SEQ ID NO: 378436 - protein, 17 aa, Mycobacterium
LVQLFIVFFALPEFGVK

SEQ ID NO: 378437 - protein, 22 aa, Mycobacterium
LVQLFLVFYALPEFGVRIDPFP

SEQ ID NO: 378438 - protein, 27 aa, Mycobacterium
LVRGRVWAFPWIMFVLAAGLAGVGAVP

SEQ ID NO: 378439 - protein, 32 aa, Mycobacterium
LVRLADRYAAYFLPLALAMAGIAWLASGSAVR

SEQ ID NO: 378440 - protein, 20 aa, Mycobacterium
LVSLFYYLRWIIPSFQRPAE

SEQ ID NO: 378441 - protein, 20 aa, Mycobacterium
LVSLRLWRHLGRLYLMSPDP

SEQ ID NO: 378442 - protein, 23 aa, Mycobacterium
LVSLVSWGLVWRALHPGVPADDE

SEQ ID NO: 378443 - protein, 25 aa, Mycobacterium
LVSPARWYWAVIAAFVIFAGTNSWG

SEQ ID NO: 378444 - protein, 18 aa, Mycobacterium
LVSTLLVASAWWLFEWEV

SEQ ID NO: 378445 - protein, 19 aa, Mycobacterium
LVTGFWKPGFFVTTKLDVD

SEQ ID NO: 378446 - protein, 28 aa, Mycobacterium
LVVADRAYFTFLAALPFVLGALSLTVPG

SEQ ID NO: 378447 - protein, 31 aa, Mycobacterium
LVVADRAYFVFLALLPFILGSLSLTVPGGNG

SEQ ID NO: 378448 - protein, 27 aa, Mycobacterium
LVVADRAYFVFLALLPFIMGSLSLTVP

SEQ ID NO: 378449 - protein, 18 aa, Mycobacterium
LVVIWLSLYRWDLLGPLR

SEQ ID NO: 378450 - protein, 20 aa, Mycobacterium
LVVLFAVVLVFYIVTSHDKK

SEQ ID NO: 378451 - protein, 24 aa, Mycobacterium
LVVLIVFVALLPRLFRPATVKPDR

SEQ ID NO: 378452 - protein, 20 aa, Mycobacterium
LVVPVILASLLFAGGLVPLV

SEQ ID NO: 378453 - protein, 31 aa, Mycobacterium
LVVSLLALLRWRGAALLTLAWRSVSKRHVAD

SEQ ID NO: 378454 - protein, 24 aa, Mycobacterium
LVVSLLMLWFATLVQTYLGLTGEV

SEQ ID NO: 378455 - protein, 17 aa, Mycobacterium
LVWLQIGIGVAVLVVVG

SEQ ID NO: 378456 - protein, 21 aa, Mycobacterium
LVYRSALTMMLPLVTIGSSLV

SEQ ID NO: 378457 - protein, 19 aa, Mycobacterium
LVYSLLYYRVLGLLTALSL

SEQ ID NO: 378458 - protein, 29 aa, Mycobacterium
LWEHILGLQLHWFVLPFTVIILLAVGSDY

SEQ ID NO: 378459 - protein, 24 aa, Mycobacterium
LWERAWLTWFWMGMALGYCVLALI

SEQ ID NO: 378460 - protein, 20 aa, Mycobacterium
LWFGGWLIPLLAIWAYWQVF

SEQ ID NO: 378461 - protein, 20 aa, Mycobacterium
LWGWRRTPVLRWFVLGAGVG

SEQ ID NO: 378462 - protein, 19 aa, Mycobacterium
LWHVVKLRRAALSGALLTG

SEQ ID NO: 378463 - protein, 25 aa, Mycobacterium
LWIGLVVLWLFVLVPMLINKRDVVK

SEQ ID NO: 378464 - protein, 18 aa, Mycobacterium
LWILVQIILILLEILYAI

SEQ ID NO: 378465 - protein, 17 aa, Mycobacterium
LWISIVATPIVLFALRG

SEQ ID NO: 378466 - protein, 24 aa, Mycobacterium
LWISLVVLWLFVLVPMLISKREAV

SEQ ID NO: 378467 - protein, 23 aa, Mycobacterium
LWISLVVLWLFVLVPMLVSKRDA

SEQ ID NO: 378468 - protein, 20 aa, Mycobacterium
LWLITTLALAVAIPAAWTQL

SEQ ID NO: 378469 - protein, 17 aa, Mycobacterium
LWLLTTMALAVAIPAVW

SEQ ID NO: 378470 - protein, 18 aa, Mycobacterium
LWLLTTVLLAAAVPSAWA

SEQ ID NO: 378471 - protein, 24 aa, Mycobacterium
LWLSFPPIGWWFTAFPGLALLGWV

SEQ ID NO: 378472 - protein, 19 aa, Mycobacterium
LWLVMMVIPFVYLLVRHPD

SEQ ID NO: 378473 - protein, 18 aa, Mycobacterium
LWMALVAVIFFLPYGLLT

SEQ ID NO: 378474 - protein, 18 aa, Mycobacterium
LWPKLQARWRRQSAVRRL

SEQ ID NO: 378475 - protein, 19 aa, Mycobacterium
LWQHLFWFFGHPEVYILAL

SEQ ID NO: 378476 - protein, 19 aa, Mycobacterium
LWQHLFWFFGHPEVYIVAL

SEQ ID NO: 378477 - protein, 19 aa, Mycobacterium
LWQVLLIVGMFLWIAIIWR

SEQ ID NO: 378478 - protein, 24 aa, Mycobacterium
LWRLYQRIYEILWALRRGDLAPGP

SEQ ID NO: 378479 - protein, 20 aa, Mycobacterium
LWSMLPWYALLVPCVLIGSL

SEQ ID NO: 378480 - protein, 30 aa, Mycobacterium
LWSVALIIGLLALFGGMMWISFASGARSFT

SEQ ID NO: 378481 - protein, 25 aa, Mycobacterium
LWTHSPGWWLSAMGILLVFGVLWTG

SEQ ID NO: 378482 - protein, 25 aa, Mycobacterium
LWTIQFFVYWLPYYLQHALAVPFSA

SEQ ID NO: 378483 - protein, 23 aa, Mycobacterium
LWTTPLWLVLMVVPFVYLVVRHP

SEQ ID NO: 378484 - protein, 18 aa, Mycobacterium
LWVFVLVPVLILLTVSGK

SEQ ID NO: 378485 - protein, 19 aa, Mycobacterium
LWVFVLVPVLILLTVSGRW

SEQ ID NO: 378486 - protein, 17 aa, Mycobacterium
LWVLGMFCVIAAVALIA

SEQ ID NO: 378487 - protein, 21 aa, Mycobacterium
LWWALLLVVGFWGVLRVSEAL

SEQ ID NO: 378488 - protein, 18 aa, Mycobacterium
LWYLVMVLASVVLALAAV

SEQ ID NO: 378489 - protein, 20 aa, Mycobacterium
LYALWTWLAIFLMAGNRRDA

SEQ ID NO: 378490 - protein, 19 aa, Mycobacterium
LYDNFGLKWGLFGAAAIMV

SEQ ID NO: 378491 - protein, 20 aa, Mycobacterium
LYDNLGLNWALFGAAATMVV

SEQ ID NO: 378492 - protein, 18 aa, Mycobacterium
LYFLVCLWVFRPPAPTVR

SEQ ID NO: 378493 - protein, 23 aa, Mycobacterium
LYGNYAWWFRLSGLGVLALLAWI

SEQ ID NO: 378494 - protein, 18 aa, Mycobacterium
LYHDMGLIMILFPPLCGG

SEQ ID NO: 378495 - protein, 20 aa, Mycobacterium
LYLFLPIFVIVLFSFNKPAG

SEQ ID NO: 378496 - protein, 19 aa, Mycobacterium
LYPLLGLRLSPMIAAGAMA

SEQ ID NO: 378497 - protein, 18 aa, Mycobacterium
LYPLLLLIPLVLLAVRTG

SEQ ID NO: 378498 - protein, 17 aa, Mycobacterium
LYPLVDFLTRSAGKIEA

SEQ ID NO: 378499 - protein, 25 aa, Mycobacterium
LYRPVFYYLGFWAVALLILRQILPL

SEQ ID NO: 378500 - protein, 21 aa, Mycobacterium
LYSAFLVILPFVLAGLTLLIP

SEQ ID NO: 378501 - protein, 20 aa, Mycobacterium
LYVAFFFFFVGISAGVVILV

SEQ ID NO: 378502 - protein, 19 aa, Mycobacterium
LYVVAPYWVLRPFLDPADA

SEQ ID NO: 378503 - protein, 18 aa, Mycobacterium
LYWQFRGTFIPKTRLTMI

SEQ ID NO: 378504 - protein, 20 aa, Mycobacterium
LYYLLMHAWFQAFPPTEFFS

SEQ ID NO: 378505 - protein, 22 aa, Mycobacterium
LYYVMLTFIARPYLIPSESMEP

SEQ ID NO: 378506 - protein, 24 aa, Mycobacterium
MAAITFVLLFLLTGSVLLPIKALA

SEQ ID NO: 378507 - protein, 23 aa, Mycobacterium
MACAVWLTVLFVAAVRRGGRRWW

SEQ ID NO: 378508 - protein, 17 aa, Mycobacterium
MAFWACGLLLCLFIGPT

SEQ ID NO: 378509 - protein, 19 aa, Mycobacterium
MAFWVFLVFYVICAAVTWY

SEQ ID NO: 378510 - protein, 25 aa, Mycobacterium
MAFYTPIVLLFVGYLLLIGNTHLAL

SEQ ID NO: 378511 - protein, 28 aa, Mycobacterium
MAIWQLCIVVLLLAIWRGRRLGPVIAEK

SEQ ID NO: 378512 - protein, 20 aa, Mycobacterium
MALILLIPILVYLLTMMAMM

SEQ ID NO: 378513 - protein, 27 aa, Mycobacterium
MAMFAQWNWWLPPWLSRVLPSVDFDRP

SEQ ID NO: 378514 - protein, 26 aa, Mycobacterium
MAMLPALQFRYWQWASLALAAPVIVW

SEQ ID NO: 378515 - protein, 23 aa, Mycobacterium
MAMPLVSLLLVALVLALRKVGKG

SEQ ID NO: 378516 - protein, 19 aa, Mycobacterium
MAMWIIGIVAAIAAALWIG

SEQ ID NO: 378517 - protein, 25 aa, Mycobacterium
MAPTTPIWRLLLPQLLMGIGMAFIW

SEQ ID NO: 378518 - protein, 20 aa, Mycobacterium
MARFTGLPRRASTVGLVALV

SEQ ID NO: 378519 - protein, 20 aa, Mycobacterium
MARRFAVLILLLCLFGMLVI

SEQ ID NO: 378520 - protein, 22 aa, Mycobacterium
MASLLIFRPLTPYLPLGISLFV

SEQ ID NO: 378521 - protein, 29 aa, Mycobacterium
MASTMFFGAYPWAGWLAFAATVPVQFVAG

SEQ ID NO: 378522 - protein, 30 aa, Mycobacterium
MASTMFFGAYPWAGWLAFAATVPVQFVAGW

SEQ ID NO: 378523 - protein, 20 aa, Mycobacterium
MAVFYLRLPATFGLGTYGVS

SEQ ID NO: 378524 - protein, 27 aa, Mycobacterium
MAWLSLPLALLVVLLVPLIGLVAHRSR

SEQ ID NO: 378525 - protein, 26 aa, Mycobacterium
MAYSLYLWHWPLLIFWLAYSGHAQAN

SEQ ID NO: 378526 - protein, 26 aa, Mycobacterium
MAYSLYLWHWPLLIFWLSYSGHTAAN

SEQ ID NO: 378527 - protein, 26 aa, Mycobacterium
MAYSLYLWHWPVLIFWLVHTGAPRVG

SEQ ID NO: 378528 - protein, 23 aa, Mycobacterium
MCLIFIIVLILTRALIAAAVIVG

SEQ ID NO: 378529 - protein, 25 aa, Mycobacterium
MDLVIFLPLLIIMGAFMFFASRRQK

SEQ ID NO: 378530 - protein, 17 aa, Mycobacterium
MDPVNLLPFLLLGTTFG

SEQ ID NO: 378531 - protein, 29 aa, Mycobacterium
MFAVGAIIPLIPYLLGFESLWGGLACGGV

SEQ ID NO: 378532 - protein, 35 aa, Mycobacterium
MFGTLTVLSLLVLGVYYLQIPALLGVGRYPLKAEL

SEQ ID NO: 378533 - protein, 18 aa, Mycobacterium
MFIPRFLFAVSFCGLLVA

SEQ ID NO: 378534 - protein, 18 aa, Mycobacterium
MFNALPAMGAWQLPPIPG

SEQ ID NO: 378535 - protein, 20 aa, Mycobacterium
MFNALPARGPWQLPPIPAAG

SEQ ID NO: 378536 - protein, 25 aa, Mycobacterium
MFSQWNWWLPRWLGRILPSVDFDRP

SEQ ID NO: 378537 - protein, 17 aa, Mycobacterium
MFVLFWASAFVLLISPL

SEQ ID NO: 378538 - protein, 19 aa, Mycobacterium
MGILLVFGVLWTGALSWRL

SEQ ID NO: 378539 - protein, 20 aa, Mycobacterium
MGLVYPWIDLVLLALAAGML

SEQ ID NO: 378540 - protein, 23 aa, Mycobacterium
MHFDLLWLGITLGALIALFSVLT

SEQ ID NO: 378541 - protein, 17 aa, Mycobacterium
MHILLIPAIILALIGIH

SEQ ID NO: 378542 - protein, 27 aa, Mycobacterium
MIAMSLWLLRFAMSNTWLVWLATWFRP

SEQ ID NO: 378543 - protein, 23 aa, Mycobacterium
MIINTLPFFFRGSVLWVAALIGE

SEQ ID NO: 378544 - protein, 17 aa, Mycobacterium
MIMLLITYRSVSTMLLV

SEQ ID NO: 378545 - protein, 28 aa, Mycobacterium
MISPQTLFFPFVLLLAATALFRGNDKKM

SEQ ID NO: 378546 - protein, 19 aa, Mycobacterium
MITMIPFGLLLGGLVAFII

SEQ ID NO: 378547 - protein, 22 aa, Mycobacterium
MKRFWIPLLLVVVVAVGAYAIV

SEQ ID NO: 378548 - protein, 18 aa, Mycobacterium
MLAWRQWLTARLTSDWLD

SEQ ID NO: 378549 - protein, 20 aa, Mycobacterium
MLGDLPWWVTVLILAREIGV

SEQ ID NO: 378550 - protein, 22 aa, Mycobacterium
MLGFLPLIWLSLAFGWGLFGIW

SEQ ID NO: 378551 - protein, 17 aa, Mycobacterium
MLLAMWVAVVVLAGLPI

SEQ ID NO: 378552 - protein, 18 aa, Mycobacterium
MLLLPLLIRMPDTPRWYV

SEQ ID NO: 378553 - protein, 20 aa, Mycobacterium
MLLLVYRAPSTLLVPLLGVL

SEQ ID NO: 378554 - protein, 18 aa, Mycobacterium
MLLLVYRSFSTLLLPLAG

SEQ ID NO: 378555 - protein, 19 aa, Mycobacterium
MLLLVYRSVPSLLVPLPAV

SEQ ID NO: 378556 - protein, 18 aa, Mycobacterium
MLLLWWQRRFFAVPLPTF

SEQ ID NO: 378557 - protein, 18 aa, Mycobacterium
MLMMPLMMIVMMVGSLAG

SEQ ID NO: 378558 - protein, 19 aa, Mycobacterium
MLMMPLMMIVMMVGTLAGG

SEQ ID NO: 378559 - protein, 25 aa, Mycobacterium
MLMTAPLFVSWWIAGARYLMANDPT

SEQ ID NO: 378560 - protein, 26 aa, Mycobacterium
MLRISWQITLLALVLVPLFVVPARRI

SEQ ID NO: 378561 - protein, 23 aa, Mycobacterium
MLSGAWLGLFIGLVLGMFSTNLA

SEQ ID NO: 378562 - protein, 17 aa, Mycobacterium
MLTFVARPYLIPSESME

SEQ ID NO: 378563 - protein, 26 aa, Mycobacterium
MLVDWASWRWVFLVNIPLGVVAVLAT

SEQ ID NO: 378564 - protein, 23 aa, Mycobacterium
MLVGWSCCLLWSFLVMPLLNTGK

SEQ ID NO: 378565 - protein, 17 aa, Mycobacterium
MLVPLLSGCLRVRASLT

SEQ ID NO: 378566 - protein, 20 aa, Mycobacterium
MLWPLADRPRLAPGVPGGTI

SEQ ID NO: 378567 - protein, 19 aa, Mycobacterium
MMAPLPPPPPPPPPPPPPQ

SEQ ID NO: 378568 - protein, 18 aa, Mycobacterium
MMFLVLLLAGFGWMISSR

SEQ ID NO: 378569 - protein, 17 aa, Mycobacterium
MMGWLPQVFIDNGIDKV

SEQ ID NO: 378570 - protein, 23 aa, Mycobacterium
MMRSPMFMLFPIMMMVSMVSMVS

SEQ ID NO: 378571 - protein, 18 aa, Mycobacterium
MMTPLIALFFWSLAAVLG

SEQ ID NO: 378572 - protein, 21 aa, Mycobacterium
MNKLRWVLLIVGGVGVAVAAV

SEQ ID NO: 378573 - protein, 24 aa, Mycobacterium
MPVALRLLLPIAMVLTLVGIGFAF

SEQ ID NO: 378574 - protein, 18 aa, Mycobacterium
MPWLFFFSGLAIPAFYAV

SEQ ID NO: 378575 - protein, 17 aa, Mycobacterium
MPWLFFFSGLAIPAFYT

SEQ ID NO: 378576 - protein, 24 aa, Mycobacterium
MQGDGPYILAGWSLGGVLAYACAI

SEQ ID NO: 378577 - protein, 25 aa, Mycobacterium
MQTKFLIPALWFAVLLSAAVLGPRA

SEQ ID NO: 378578 - protein, 18 aa, Mycobacterium
MRRIRAEPRWRHLPIVAL

SEQ ID NO: 378579 - protein, 23 aa, Mycobacterium
MRVLALPIIVVWLLIAIGVNVFV

SEQ ID NO: 378580 - protein, 18 aa, Mycobacterium
MRVLSLRTIVVVAALSVI

SEQ ID NO: 378581 - protein, 25 aa, Mycobacterium
MRVSAWLRLPLIGLIVLLGSDPNIQ

SEQ ID NO: 378582 - protein, 19 aa, Mycobacterium
MSPWLFGWFALFCTATAIA

SEQ ID NO: 378583 - protein, 22 aa, Mycobacterium
MSWPGYLFMLVGVIAVFRCLVA

SEQ ID NO: 378584 - protein, 20 aa, Mycobacterium
MSWRWAFWINVPVGILVLVI

SEQ ID NO: 378585 - protein, 18 aa, Mycobacterium
MTALMWFVFGLTAVLALG

SEQ ID NO: 378586 - protein, 23 aa, Mycobacterium
MTLLWWLRRFFAAPLPTIRIPLP

SEQ ID NO: 378587 - protein, 30 aa, Mycobacterium
MTLTGFAHPWFFLVLLLVAALIALYVVAQY

SEQ ID NO: 378588 - protein, 25 aa, Mycobacterium
MTMYLHLPFVSIPIPINPPPPPAPP

SEQ ID NO: 378589 - protein, 34 aa, Mycobacterium
MTPLGWRWAALVWAYALFWFLIEDRVKLATHYWL

SEQ ID NO: 378590 - protein, 23 aa, Mycobacterium
MTPTTPIWRLLLPLTAMGAAMAF

SEQ ID NO: 378591 - protein, 21 aa, Mycobacterium
MTVIAGRRLPLPPSALATGID

SEQ ID NO: 378592 - protein, 43 aa, Mycobacterium
MTYVLFAQVFWLFWAALLSAPLWLPLLILAAWQYLQPPAVDAA

SEQ ID NO: 378593 - protein, 22 aa, Mycobacterium
MVAAWLITLPLAGLVGAITYEL

SEQ ID NO: 378594 - protein, 18 aa, Mycobacterium
MVATGSAALWWHAARRPK

SEQ ID NO: 378595 - protein, 21 aa, Mycobacterium
MVATPIMLWLKGIEGPIDEFN

SEQ ID NO: 378596 - protein, 17 aa, Mycobacterium
MVGALVFSGIFGWKVWQ

SEQ ID NO: 378597 - protein, 19 aa, Mycobacterium
MVGFLFLYPAFVAKSHDAS

SEQ ID NO: 378598 - protein, 18 aa, Mycobacterium
MVLFYIQAPTLLGIGRMT

SEQ ID NO: 378599 - protein, 20 aa, Mycobacterium
MVLLILLVVYRNPVTMFLPL

SEQ ID NO: 378600 - protein, 17 aa, Mycobacterium
MVLTGLALLIWVPAIRC

SEQ ID NO: 378601 - protein, 29 aa, Mycobacterium
MVPRLQFTNWQWLSLTLAAPVVVWGAWPF

SEQ ID NO: 378602 - protein, 27 aa, Mycobacterium
MWLKIVGLAVWLLTLYLGWNSLSGLSS

SEQ ID NO: 378603 - protein, 19 aa, Mycobacterium
MWLPIWILVAIFGGGGTSA

SEQ ID NO: 378604 - protein, 18 aa, Mycobacterium
MWWFSVVGLFVAGVPMFM

SEQ ID NO: 378605 - protein, 18 aa, Mycobacterium
MYFILPLYVLLVLPAMSV

SEQ ID NO: 378606 - protein, 18 aa, Mycobacterium
MYLNVAVAVLGFLAYLAS

SEQ ID NO: 378607 - protein, 20 aa, Mycobacterium
NAFLAPWRLALVPVVSWTIG

SEQ ID NO: 378608 - protein, 23 aa, Mycobacterium
NAGRPWWRPSFKALVRVYDPHEP

SEQ ID NO: 378609 - protein, 20 aa, Mycobacterium
NAKLIFPGLITFSATQQGQT

SEQ ID NO: 378610 - protein, 25 aa, Mycobacterium
NAYGKPLFFITISAATVLFALTGRR

SEQ ID NO: 378611 - protein, 24 aa, Mycobacterium
NDGKPFILAGWSLGGALAYACAIG

SEQ ID NO: 378612 - protein, 22 aa, Mycobacterium
NEPLTFLDCLYFSAVSLSTTGY

SEQ ID NO: 378613 - protein, 17 aa, Mycobacterium
NEVLFLFFAFLVGFGGG

SEQ ID NO: 378614 - protein, 18 aa, Mycobacterium
NFDDFWRPIRSYFYWEKH

SEQ ID NO: 378615 - protein, 27 aa, Mycobacterium
NFLVPNGTFFFVLAIFLVVLAVIGTFV

SEQ ID NO: 378616 - protein, 28 aa, Mycobacterium
NFLVPNGTFFFVLAIFLVVLGVIGTFVV

SEQ ID NO: 378617 - protein, 25 aa, Mycobacterium
NFQSFTMWLIIGIIYFVVIMALTKL

SEQ ID NO: 378618 - protein, 25 aa, Mycobacterium
NGAAEPVWWTLYLACYLAGGWGSAW

SEQ ID NO: 378619 - protein, 24 aa, Mycobacterium
NGAPQPVWWTLYLGCYLAGGWGSA

SEQ ID NO: 378620 - protein, 20 aa, Mycobacterium
NGFSWIWMAVGLVGAAAALI

SEQ ID NO: 378621 - protein, 24 aa, Mycobacterium
NGGSVGLFAIFATAGAGGAGGAGG

SEQ ID NO: 378622 - protein, 23 aa, Mycobacterium
NGMPVWLVVLWALALLVTGAGIG

SEQ ID NO: 378623 - protein, 27 aa, Mycobacterium
NGMSWLLPLLYVLLALTLVAWAGLRYS

SEQ ID NO: 378624 - protein, 18 aa, Mycobacterium
NGVMALPLPISKINKIMT

SEQ ID NO: 378625 - protein, 20 aa, Mycobacterium
NHIIIPLPWLLQAPRLFAGQ

SEQ ID NO: 378626 - protein, 22 aa, Mycobacterium
NHPGLPLWPYLICAALTGLGGA

SEQ ID NO: 378627 - protein, 17 aa, Mycobacterium
NHRWFLVSVYAAGKVGA

SEQ ID NO: 378628 - protein, 25 aa, Mycobacterium
NIDNWVRRLFALPAFPDGSADDVLQ

SEQ ID NO: 378629 - protein, 30 aa, Mycobacterium
NIGLSLAIITILLPLALLGVLGLAAVVLVH

SEQ ID NO: 378630 - protein, 20 aa, Mycobacterium
NILLILGITCLIPAGGLALP

SEQ ID NO: 378631 - protein, 17 aa, Mycobacterium
NIPSLRYLSYRLTMNRD

SEQ ID NO: 378632 - protein, 24 aa, Mycobacterium
NKILQFITYLLIPAGLLTIYTQLF

SEQ ID NO: 378633 - protein, 24 aa, Mycobacterium
NKKGLLARFWLVLTIAAVVALSGF

SEQ ID NO: 378634 - protein, 19 aa, Mycobacterium
NLAILAVLVIAAVQLFMLQ

SEQ ID NO: 378635 - protein, 21 aa, Mycobacterium
NLALYVTALLFILAWSTSGIN

SEQ ID NO: 378636 - protein, 23 aa, Mycobacterium
NLDLPPILQPFLDYAFGFRRGVD

SEQ ID NO: 378637 - protein, 21 aa, Mycobacterium
NLFWAFAYNVAALPLAALGLL

SEQ ID NO: 378638 - protein, 26 aa, Mycobacterium
NLGQPLYNLLLMLLFEWGVAVHDTDI

SEQ ID NO: 378639 - protein, 18 aa, Mycobacterium
NLLGLFMPSTLFLMFVMF

SEQ ID NO: 378640 - protein, 21 aa, Mycobacterium
NLLYRLIYLPYGLATILGFIG

SEQ ID NO: 378641 - protein, 19 aa, Mycobacterium
NLPIILIVLLAVFGSLTAA

SEQ ID NO: 378642 - protein, 23 aa, Mycobacterium
NLPRSRIWVFRTPRRNELMVNAT

SEQ ID NO: 378643 - protein, 25 aa, Mycobacterium
NLQRPLLGWALFAVLIGWSAACAVA

SEQ ID NO: 378644 - protein, 28 aa, Mycobacterium
NLRRFRWLVFTGWFLALVPAIYLAMTQS

SEQ ID NO: 378645 - protein, 19 aa, Mycobacterium
NLTALRELALLWLADQVDA

SEQ ID NO: 378646 - protein, 22 aa, Mycobacterium
NLTALRELALLWLADQVDTALA

SEQ ID NO: 378647 - protein, 19 aa, Mycobacterium
NLTALRQLALLWLADQVDA

SEQ ID NO: 378648 - protein, 26 aa, Mycobacterium
NLVGWPTWALILSSPFLLPAALGLAL

SEQ ID NO: 378649 - protein, 27 aa, Mycobacterium
NLVGWPTWGMIFASPFLIPALAALGIT

SEQ ID NO: 378650 - protein, 19 aa, Mycobacterium
NLWFVIITALALALAIYGY

SEQ ID NO: 378651 - protein, 25 aa, Mycobacterium
NMAALWNLPVLFLCENNLYAMGTAL

SEQ ID NO: 378652 - protein, 22 aa, Mycobacterium
NMIQPFWLLPLLAIAKLNVRQV

SEQ ID NO: 378653 - protein, 22 aa, Mycobacterium
NMIQPFWPLPLLAIAKLNVRQV

SEQ ID NO: 378654 - protein, 20 aa, Mycobacterium
NMPWLFFFSGLAIPTFYAVG

SEQ ID NO: 378655 - protein, 18 aa, Mycobacterium
NMVRLWWDKPLALKLGAI

SEQ ID NO: 378656 - protein, 24 aa, Mycobacterium
NMVSVGAFIFAPMLSIYASMKAAM

SEQ ID NO: 378657 - protein, 25 aa, Mycobacterium
NPEDPVWAWLKWLPHLQHQTDTDAA

SEQ ID NO: 378658 - protein, 24 aa, Mycobacterium
NPEVWSWMVWLPHNLHDELFDACG

SEQ ID NO: 378659 - protein, 20 aa, Mycobacterium
NPGLPLWLFVLCAALTGLGG

SEQ ID NO: 378660 - protein, 20 aa, Mycobacterium
NPGLPLWPYLVCAALTGLGG

SEQ ID NO: 378661 - protein, 24 aa, Mycobacterium
NPKRIRGRHWALTAAAIVAIAIVA

SEQ ID NO: 378662 - protein, 18 aa, Mycobacterium
NPLLALPFRPLLAFLTTG

SEQ ID NO: 378663 - protein, 22 aa, Mycobacterium
NPLWLIVVVLVLAGIMGLFVVF

SEQ ID NO: 378664 - protein, 58 aa, Mycobacterium
NPVAAFFAWFPLLFFIAYEAFFIPFGFTFWGVLLSAPAWLPIVLGLALSALVPPAGIE

SEQ ID NO: 378665 - protein, 22 aa, Mycobacterium
NRILQFITYLLVPAGLLTIYTQ

SEQ ID NO: 378666 - protein, 17 aa, Mycobacterium
NRLLLPTILGWSLGRAV

SEQ ID NO: 378667 - protein, 20 aa, Mycobacterium
NRLWLGVVAVAVVSVLIGAM

SEQ ID NO: 378668 - protein, 19 aa, Mycobacterium
NRMAFLAAVLFLMALCFAT

SEQ ID NO: 378669 - protein, 25 aa, Mycobacterium
NRMRVFAMWFTTFGFFTLAACASLA

SEQ ID NO: 378670 - protein, 18 aa, Mycobacterium
NRMWWIMGTVIAVGVLAL

SEQ ID NO: 378671 - protein, 20 aa, Mycobacterium
NRPRPLLQLFVFLCGAFAMG

SEQ ID NO: 378672 - protein, 18 aa, Mycobacterium
NRYAIFWPEGHEFELLMI

SEQ ID NO: 378673 - protein, 17 aa, Mycobacterium
NSFPKWRWSLTTALLEL

SEQ ID NO: 378674 - protein, 23 aa, Mycobacterium
NSGLWGLLGLLGLGGLAGLMRRK

SEQ ID NO: 378675 - protein, 19 aa, Mycobacterium
NSLLPRWLPATTGSHGWLA

SEQ ID NO: 378676 - protein, 20 aa, Mycobacterium
NSSPPPPRWVWLPLIAVGAV

SEQ ID NO: 378677 - protein, 25 aa, Mycobacterium
NSWRWPAFAWCYMFVLAWTMAFVAR

SEQ ID NO: 378678 - protein, 22 aa, Mycobacterium
NTELLPVFFLLPVSVAFQERPA

SEQ ID NO: 378679 - protein, 21 aa, Mycobacterium
NTRQLLLINTLTDALPATAVA

SEQ ID NO: 378680 - protein, 23 aa, Mycobacterium
NTRQLLLVNMLTDALPAAALAVS

SEQ ID NO: 378681 - protein, 23 aa, Mycobacterium
NTRQLLLVNMLTDALPAAALSVS

SEQ ID NO: 378682 - protein, 22 aa, Mycobacterium
NTSYYRLMLKLKGGPEAVADAA

SEQ ID NO: 378683 - protein, 18 aa, Mycobacterium
NTWLVWLATWFRPVFETI

SEQ ID NO: 378684 - protein, 22 aa, Mycobacterium
NTYSMDLFLRIAPELYLKRLCV

SEQ ID NO: 378685 - protein, 19 aa, Mycobacterium
NVLVITPLRVAFLIVLIGT

SEQ ID NO: 378686 - protein, 28 aa, Mycobacterium
NVMWVVWQLWLVVLLAALWKGRRLGPLV

SEQ ID NO: 378687 - protein, 21 aa, Mycobacterium
NVNMVRLWWDKPWAMRIVALA

SEQ ID NO: 378688 - protein, 25 aa, Mycobacterium
NVSWIVWQLALVVLLVAAWKGRRPG

SEQ ID NO: 378689 - protein, 20 aa, Mycobacterium
NWFLIFAFVAIGLEFSARGL

SEQ ID NO: 378690 - protein, 19 aa, Mycobacterium
NWIIFMILPLYVSLEKIDP

SEQ ID NO: 378691 - protein, 18 aa, Mycobacterium
NWKWVRRSAYLAAAVVIL

SEQ ID NO: 378692 - protein, 21 aa, Mycobacterium
NWLEIFLILVIGFSLPRTFGR

SEQ ID NO: 378693 - protein, 17 aa, Mycobacterium
NWRLGGKRSTFALGDGV

SEQ ID NO: 378694 - protein, 22 aa, Mycobacterium
NWTGWPAELRWRPVTAIVGAVV

SEQ ID NO: 378695 - protein, 21 aa, Mycobacterium
NWVEIFLLLVISFSLPRTFGR

SEQ ID NO: 378696 - protein, 17 aa, Mycobacterium
NWVLDGMVTIGALSAQD

SEQ ID NO: 378697 - protein, 17 aa, Mycobacterium
NYAMLWFGFVVLPALQI

SEQ ID NO: 378698 - protein, 24 aa, Mycobacterium
NYGTWWFWLGLALIVGILLLVGNL

SEQ ID NO: 378699 - protein, 20 aa, Mycobacterium
NYGVWWYWLGLCLIAAVLVL

SEQ ID NO: 378700 - protein, 28 aa, Mycobacterium
NYLFPIYASQLTPWWLRILGAKIGKDTE

SEQ ID NO: 378701 - protein, 26 aa, Mycobacterium
NYLFPLYASLLTPIWLRILGAKVGRG

SEQ ID NO: 378702 - protein, 21 aa, Mycobacterium
NYWIMTHLLPLFRGMQSLIDG

SEQ ID NO: 378703 - protein, 32 aa, Mycobacterium
PAAARWLRVLAIPVVLFWVIAAAVLNIFVPSL

SEQ ID NO: 378704 - protein, 23 aa, Mycobacterium
PAAIMLVLLLRLPESPRWLIKDG

SEQ ID NO: 378705 - protein, 33 aa, Mycobacterium
PAAPPLQWPVLPRLPIPTFVLPAAPSSAPEPTA

SEQ ID NO: 378706 - protein, 22 aa, Mycobacterium
PAATPPPPLFRVAGHRGLRGWQ

SEQ ID NO: 378707 - protein, 21 aa, Mycobacterium
PACGCYFDNVYWITFAGLATV

SEQ ID NO: 378708 - protein, 21 aa, Mycobacterium
PADRLNMPPIPLSTTPAPTQQ

SEQ ID NO: 378709 - protein, 24 aa, Mycobacterium
PAEFAPPPRWPWVVGVVAIVAAVA

SEQ ID NO: 378710 - protein, 32 aa, Mycobacterium
PAERKPFLLVGAPLLLVFGICSIALAVSLTVT

SEQ ID NO: 378711 - protein, 25 aa, Mycobacterium
PAFAYFAVWYLLCGCAFLLLGFETR

SEQ ID NO: 378712 - protein, 30 aa, Mycobacterium
PAFGVIWLLWAVLWFMLFLLLGLGHDALGP

SEQ ID NO: 378713 - protein, 21 aa, Mycobacterium
PAFGWRPMFFVGAGTGLIILV

SEQ ID NO: 378714 - protein, 21 aa, Mycobacterium
PAFMHVMGRWNWWAPKPLVWL

SEQ ID NO: 378715 - protein, 19 aa, Mycobacterium
PAFWIFLLCYIAAAALTWV

SEQ ID NO: 378716 - protein, 29 aa, Mycobacterium
PAFWIGILFILLFAVRLRVLPAAGYGGAA

SEQ ID NO: 378717 - protein, 20 aa, Mycobacterium
PAGPFFFIFAMGATATVPAG

SEQ ID NO: 378718 - protein, 22 aa, Mycobacterium
PAGRWLLAVLAVWSLYRLATRS

SEQ ID NO: 378719 - protein, 20 aa, Mycobacterium
PAHPRWWFVSTTPGRILTIG

SEQ ID NO: 378720 - protein, 20 aa, Mycobacterium
PAICALLLAVPPLGVGTQTA

SEQ ID NO: 378721 - protein, 25 aa, Mycobacterium
PAIYNYTWLILQLPFGIVGVTVLTV

SEQ ID NO: 378722 - protein, 26 aa, Mycobacterium
PALLARWIRRLAIPIMLGWLAIIVLI

SEQ ID NO: 378723 - protein, 17 aa, Mycobacterium
PAMFALTVLYFTVVGFQ

SEQ ID NO: 378724 - protein, 19 aa, Mycobacterium
PAMLLLPLLIRAPDTARWY

SEQ ID NO: 378725 - protein, 29 aa, Mycobacterium
PANVSWIVWQLWLAVILVALWKGRRMGPL

SEQ ID NO: 378726 - protein, 26 aa, Mycobacterium
PAPEPVPWYRKPAALVGLGALGALIV

SEQ ID NO: 378727 - protein, 27 aa, Mycobacterium
PAPLFLWETILAIIAFIAKLAEFIYLF

SEQ ID NO: 378728 - protein, 17 aa, Mycobacterium
PAPPPPSNFPPPPPRPG

SEQ ID NO: 378729 - protein, 24 aa, Mycobacterium
PAPTPRPFIIKPPTPEPAADPAAT

SEQ ID NO: 378730 - protein, 17 aa, Mycobacterium
PAPVALLRLVRELYRGG

SEQ ID NO: 378731 - protein, 17 aa, Mycobacterium
PAPWVVLRLLPQGPTLS

SEQ ID NO: 378732 - protein, 22 aa, Mycobacterium
PARGRLVAVLLIGLVLLTAGYT

SEQ ID NO: 378733 - protein, 18 aa, Mycobacterium
PARRNIIFMALMLGVLVA

SEQ ID NO: 378734 - protein, 25 aa, Mycobacterium
PARWRHWWWALLLAFVPIHLVISAI

SEQ ID NO: 378735 - protein, 25 aa, Mycobacterium
PARWRHWWWGLLLAFVPIHLVISAI

SEQ ID NO: 378736 - protein, 27 aa, Mycobacterium
PARWRHWWWTLLWAFVPIHLVISAVVP

SEQ ID NO: 378737 - protein, 26 aa, Mycobacterium
PARYLALFLVLLIGAFLLVFFTGDKK

SEQ ID NO: 378738 - protein, 28 aa, Mycobacterium
PATLIGWALLCLILIALIIYGITQLMGD

SEQ ID NO: 378739 - protein, 29 aa, Mycobacterium
PAVATLLGRWFWWPRPLAWQTRKPQMVSQ

SEQ ID NO: 378740 - protein, 19 aa, Mycobacterium
PAVFLLYFLLRRDTRALLV

SEQ ID NO: 378741 - protein, 25 aa, Mycobacterium
PAVKRAWLRTWQAAVLIAVIVVALV

SEQ ID NO: 378742 - protein, 17 aa, Mycobacterium
PAVLAVLAVLVLIWVLR

SEQ ID NO: 378743 - protein, 24 aa, Mycobacterium
PAVTWLWFSVWVGAVLLFYLLWGR

SEQ ID NO: 378744 - protein, 22 aa, Mycobacterium
PAVWLNPWRWYSVPRAAAAALT

SEQ ID NO: 378745 - protein, 17 aa, Mycobacterium
PAWASWLRVVLGSALIL

SEQ ID NO: 378746 - protein, 21 aa, Mycobacterium
PAWKIVLILLLLAVLGLRDKV

SEQ ID NO: 378747 - protein, 19 aa, Mycobacterium
PAWLLLVALVILVAGGAVL

SEQ ID NO: 378748 - protein, 25 aa, Mycobacterium
PAYIAGLHWYLPRSAPMYADERIAI

SEQ ID NO: 378749 - protein, 19 aa, Mycobacterium
PAYTLPWRVHRFAPGELDD

SEQ ID NO: 378750 - protein, 20 aa, Mycobacterium
PAYWSEGQFAALRGALRSQP

SEQ ID NO: 378751 - protein, 25 aa, Mycobacterium
PCIMLFLHTRYWWAGIAIVAVATIV

SEQ ID NO: 378752 - protein, 31 aa, Mycobacterium
PDAWDPVWNYWFIEVLFLALVFCAVLLAIPA

SEQ ID NO: 378753 - protein, 29 aa, Mycobacterium
PDFWFAITGVWLFAVLLGWLPTSGVDSGV

SEQ ID NO: 378754 - protein, 25 aa, Mycobacterium
PDKTARWFGGIGLILGAVALVLAVT

SEQ ID NO: 378755 - protein, 28 aa, Mycobacterium
PDKTLVRFIPLLILIAIGVLILSLIVFG

SEQ ID NO: 378756 - protein, 18 aa, Mycobacterium
PDLICSVICWLLLSREVL

SEQ ID NO: 378757 - protein, 23 aa, Mycobacterium
PDLVLFVILPPLLYTTALESSYV

SEQ ID NO: 378758 - protein, 22 aa, Mycobacterium
PDMPPFYPAGWFWIGGRLAALT

SEQ ID NO: 378759 - protein, 23 aa, Mycobacterium
PDPPPLYYIPPSSSSATVTGSTT

SEQ ID NO: 378760 - protein, 24 aa, Mycobacterium
PDQPNPWYKQPAVLIALAGAGVAV

SEQ ID NO: 378761 - protein, 22 aa, Mycobacterium
PDRNLFVPLAFHLGYHSLPIGN

SEQ ID NO: 378762 - protein, 24 aa, Mycobacterium
PDSWRLLHIVFILVVLYTAIQGPS

SEQ ID NO: 378763 - protein, 24 aa, Mycobacterium
PDTAWPVYVDPPLHLTGAGGAPLG

SEQ ID NO: 378764 - protein, 19 aa, Mycobacterium
PDWFKFFLGAMLLFAVVAN

SEQ ID NO: 378765 - protein, 25 aa, Mycobacterium
PDYPPQPPLLPYPKTLPPPPPPVGT

SEQ ID NO: 378766 - protein, 20 aa, Mycobacterium
PEDLPWEVPLIELGLDSLMA

SEQ ID NO: 378767 - protein, 24 aa, Mycobacterium
PEFLAVVLAIWRLAATAVLISPAW

SEQ ID NO: 378768 - protein, 17 aa, Mycobacterium
PEFPWTGLTIFLLIAVF

SEQ ID NO: 378769 - protein, 26 aa, Mycobacterium
PEFQPWLRWAILILALLALIGLAMSR

SEQ ID NO: 378770 - protein, 20 aa, Mycobacterium
PEGLWHPGLVAALVGGGLAL

SEQ ID NO: 378771 - protein, 23 aa, Mycobacterium
PEGMAIWIIGMVAAIGLALWIGA

SEQ ID NO: 378772 - protein, 22 aa, Mycobacterium
PEKLFDPILLLALAALGIGFVS

SEQ ID NO: 378773 - protein, 19 aa, Mycobacterium
PELLLPLMLLNFTPMFGHI

SEQ ID NO: 378774 - protein, 17 aa, Mycobacterium
PEMWFLCKAHQVCPVGA

SEQ ID NO: 378775 - protein, 18 aa, Mycobacterium
PEMWFLRKAHQLCPAGVV

SEQ ID NO: 378776 - protein, 22 aa, Mycobacterium
PEPPVIPWYRLPAVIIVSTVVA

SEQ ID NO: 378777 - protein, 23 aa, Mycobacterium
PERPWMAVMFFAGFLILYCLGVM

SEQ ID NO: 378778 - protein, 31 aa, Mycobacterium
PETAAMLLIPPYLLYIRAARPFIAFYNWCAN

SEQ ID NO: 378779 - protein, 22 aa, Mycobacterium
PFDGWVRWLFTVLAAVVFVLTV

SEQ ID NO: 378780 - protein, 19 aa, Mycobacterium
PFDVLPFLLAVPGLILIAA

SEQ ID NO: 378781 - protein, 25 aa, Mycobacterium
PFFTLFVISVIILSPLWLFAFVLAE

SEQ ID NO: 378782 - protein, 17 aa, Mycobacterium
PFGLLFGNPFRESLRIY

SEQ ID NO: 378783 - protein, 20 aa, Mycobacterium
PFIAMVPLFVVWFGIGEESK

SEQ ID NO: 378784 - protein, 17 aa, Mycobacterium
PFLFWVWMRHLRDDRGY

SEQ ID NO: 378785 - protein, 17 aa, Mycobacterium
PFLIFGLLGKWLHWPQL

SEQ ID NO: 378786 - protein, 19 aa, Mycobacterium
PFLLIMGGFMYFASRRQKR

SEQ ID NO: 378787 - protein, 18 aa, Mycobacterium
PFLWQHITGRYTNISVRT

SEQ ID NO: 378788 - protein, 22 aa, Mycobacterium
PFRRRNYIPGIVLFVALAVVTL

SEQ ID NO: 378789 - protein, 19 aa, Mycobacterium
PFVLLGVGLLWFGWFGFNA

SEQ ID NO: 378790 - protein, 23 aa, Mycobacterium
PFVMLGAALLWFGWFGFNVGSEG

SEQ ID NO: 378791 - protein, 17 aa, Mycobacterium
PFVVLVIGSLGVGLGLT

SEQ ID NO: 378792 - protein, 22 aa, Mycobacterium
PGALFWMWMVAFLGASTSFVEC

SEQ ID NO: 378793 - protein, 19 aa, Mycobacterium
PGAPLPTFPELPAAVLDQA

SEQ ID NO: 378794 - protein, 18 aa, Mycobacterium
PGAPWWGAVLIAVSTTAL

SEQ ID NO: 378795 - protein, 20 aa, Mycobacterium
PGDWLYFVTIDMQGTTLFTR

SEQ ID NO: 378796 - protein, 24 aa, Mycobacterium
PGGRTTFRFLLVAAAAVILTAALV

SEQ ID NO: 378797 - protein, 24 aa, Mycobacterium
PGGRWLWLLLGPLAGLIMFGLQVW

SEQ ID NO: 378798 - protein, 27 aa, Mycobacterium
PGHSDLGWLWWFGAGWVAVAVVGAGVI

SEQ ID NO: 378799 - protein, 22 aa, Mycobacterium
PGLADGWWIYLAVYAVFIGIHL

SEQ ID NO: 378800 - protein, 17 aa, Mycobacterium
PGLPLWPYLVCAALAGF

SEQ ID NO: 378801 - protein, 22 aa, Mycobacterium
PGLVMIGWWTGFPYWITVAVCA

SEQ ID NO: 378802 - protein, 19 aa, Mycobacterium
PGMMLLIGLAITVAFLASW

SEQ ID NO: 378803 - protein, 26 aa, Mycobacterium
PGPARLLRVLAIPVVIFWVAAAAALN

SEQ ID NO: 378804 - protein, 19 aa, Mycobacterium
PGPVLAGSLLVLVVCALPV

SEQ ID NO: 378805 - protein, 21 aa, Mycobacterium
PGQLWLFWVAPLIGGLIGGLL

SEQ ID NO: 378806 - protein, 18 aa, Mycobacterium
PGRFWWWSLAAVVGILAV

SEQ ID NO: 378807 - protein, 17 aa, Mycobacterium
PGRLEALWRGSLVVFQS

SEQ ID NO: 378808 - protein, 17 aa, Mycobacterium
PGRWEWSPLYFKEISWV

SEQ ID NO: 378809 - protein, 20 aa, Mycobacterium
PGTCRPFLPPKDALASVICD

SEQ ID NO: 378810 - protein, 23 aa, Mycobacterium
PGTPTWRRLLDDLSYEPLVSPLR

SEQ ID NO: 378811 - protein, 23 aa, Mycobacterium
PGTSFYVLLPGRPLPPATYSATE

SEQ ID NO: 378812 - protein, 24 aa, Mycobacterium
PGVLARLVLLWFLCSAIPIGVIAA

SEQ ID NO: 378813 - protein, 26 aa, Mycobacterium
PGVLILVLYFFLWLTTYGVALLNFDP

SEQ ID NO: 378814 - protein, 21 aa, Mycobacterium
PGVPVPIPVIVPFPGWQPGYP

SEQ ID NO: 378815 - protein, 23 aa, Mycobacterium
PGVPWWGAILIAVAGTLFGFALD

SEQ ID NO: 378816 - protein, 18 aa, Mycobacterium
PGWPLWFAAAWSATEWGK

SEQ ID NO: 378817 - protein, 27 aa, Mycobacterium
PGYSAIWLWLGIALLGAVILWYTAVFV

SEQ ID NO: 378818 - protein, 26 aa, Mycobacterium
PHAIRIFAVPIILIWVAVTVLVNVVV

SEQ ID NO: 378819 - protein, 17 aa, Mycobacterium
PHGGIFVFFAIGNLLWF

SEQ ID NO: 378820 - protein, 20 aa, Mycobacterium
PHLGLIPLFILWFGIGELPK

SEQ ID NO: 378821 - protein, 27 aa, Mycobacterium
PHPRLEHRILLVLLIQADGAVVGVDGR

SEQ ID NO: 378822 - protein, 17 aa, Mycobacterium
PIALLLIGGLLAARFIN

SEQ ID NO: 378823 - protein, 19 aa, Mycobacterium
PIILIWVAIAAFLNVSVPQ

SEQ ID NO: 378824 - protein, 21 aa, Mycobacterium
PILVVMVLLIIPLGQLSLGGI

SEQ ID NO: 378825 - protein, 27 aa, Mycobacterium
PIPVPLPPVIVVPPLTPPWTPPWATPT

SEQ ID NO: 378826 - protein, 21 aa, Mycobacterium
PIQIPLLPDNVSRQAFPPEPS

SEQ ID NO: 378827 - protein, 23 aa, Mycobacterium
PIRAYAFFIIIGIVMGLMIGDRR

SEQ ID NO: 378828 - protein, 18 aa, Mycobacterium
PISKLFILASRFVRRETS

SEQ ID NO: 378829 - protein, 21 aa, Mycobacterium
PITRRITRFSDTFFREVWDPE

SEQ ID NO: 378830 - protein, 19 aa, Mycobacterium
PIVFLTAFYGLSDLAGLRR

SEQ ID NO: 378831 - protein, 19 aa, Mycobacterium
PIYCLPKPDFPIPTWGGRL

SEQ ID NO: 378832 - protein, 23 aa, Mycobacterium
PKASVMTHYRWLRALAGFGGLGM

SEQ ID NO: 378833 - protein, 18 aa, Mycobacterium
PKELPVPVLLLGVQNDPI

SEQ ID NO: 378834 - protein, 20 aa, Mycobacterium
PKGRKLWIAALVAIVGVIVL

SEQ ID NO: 378835 - protein, 19 aa, Mycobacterium
PKMVSLLVEPWYALVGTRE

SEQ ID NO: 378836 - protein, 23 aa, Mycobacterium
PKSVVIPWYRLPGVIIVATVVAV

SEQ ID NO: 378837 - protein, 24 aa, Mycobacterium
PKTRSQLMFGALGVLLCLLLGVAI

SEQ ID NO: 378838 - protein, 23 aa, Mycobacterium
PLARKGFLSIWSWMFGLVVTEFP

SEQ ID NO: 378839 - protein, 29 aa, Mycobacterium
PLARWVLSLVGLLLIGYLAAVALQPAILD

SEQ ID NO: 378840 - protein, 21 aa, Mycobacterium
PLDRRWIWVAGVAGAILLVAV

SEQ ID NO: 378841 - protein, 17 aa, Mycobacterium
PLFALIGVLIVAWRRTH

SEQ ID NO: 378842 - protein, 30 aa, Mycobacterium
PLFASMVVGLLMFLLLGRPLAALTSGLTNW

SEQ ID NO: 378843 - protein, 20 aa, Mycobacterium
PLFWLLFGIMIVTSVGWALH

SEQ ID NO: 378844 - protein, 18 aa, Mycobacterium
PLGLVWLAFLPNAPYLVT

SEQ ID NO: 378845 - protein, 22 aa, Mycobacterium
PLHAYLWLLLPTVVVGVVLGVI

SEQ ID NO: 378846 - protein, 20 aa, Mycobacterium
PLIERFPLMLFTSAAVLLIG

SEQ ID NO: 378847 - protein, 24 aa, Mycobacterium
PLIGLAVFLVIATALTWLVYVTLR

SEQ ID NO: 378848 - protein, 18 aa, Mycobacterium
PLILVMGAFLFFANRRQR

SEQ ID NO: 378849 - protein, 20 aa, Mycobacterium
PLIQRFPLMFFTSAAVLLIG

SEQ ID NO: 378850 - protein, 19 aa, Mycobacterium
PLIVAVAVSLLAILLIRQL

SEQ ID NO: 378851 - protein, 18 aa, Mycobacterium
PLIVIGFWVALAAALSMA

SEQ ID NO: 378852 - protein, 25 aa, Mycobacterium
PLLATQILWINLLTDGAPALALGVD

SEQ ID NO: 378853 - protein, 17 aa, Mycobacterium
PLLLLFGPMLASLVLIA

SEQ ID NO: 378854 - protein, 18 aa, Mycobacterium
PLLRGLLFRWSKARSPRT

SEQ ID NO: 378855 - protein, 19 aa, Mycobacterium
PLLRLVPLAMSIATLIAMA

SEQ ID NO: 378856 - protein, 22 aa, Mycobacterium
PLLWVVALGFVLYFARGWIESF

SEQ ID NO: 378857 - protein, 17 aa, Mycobacterium
PLPHWYWIGLTVGILVG

SEQ ID NO: 378858 - protein, 19 aa, Mycobacterium
PLPVPWSVLSQFAAGPALS

SEQ ID NO: 378859 - protein, 21 aa, Mycobacterium
PLRRILGLQTFWILGVLVLIC

SEQ ID NO: 378860 - protein, 19 aa, Mycobacterium
PLRWILPRMLIEAPFLVLA

SEQ ID NO: 378861 - protein, 18 aa, Mycobacterium
PLSFLVLVWVFGGLLAAA

SEQ ID NO: 378862 - protein, 22 aa, Mycobacterium
PLSFLVLVWVFGGLLAAALPMA

SEQ ID NO: 378863 - protein, 22 aa, Mycobacterium
PLSFLVLVWVFGGVFAAALPVA

SEQ ID NO: 378864 - protein, 41 aa, Mycobacterium
PLSKTNFVLVFLAALLLGPGIPLALLYAGKWYAAKIPGEPM

SEQ ID NO: 378865 - protein, 21 aa, Mycobacterium
PLSQWFLLTAAFGSLFMVAGK

SEQ ID NO: 378866 - protein, 24 aa, Mycobacterium
PLSQWFLLVMTFGSLFMVAGKRYA

SEQ ID NO: 378867 - protein, 41 aa, Mycobacterium
PLSTTNFLLVLIAALLLGPGIPLALLYAAKWYVGKIPPVPM

SEQ ID NO: 378868 - protein, 20 aa, Mycobacterium
PLTIPWSVLSLFAAGPTLSR

SEQ ID NO: 378869 - protein, 19 aa, Mycobacterium
PLTLNLLLIDFKGGATFLD

SEQ ID NO: 378870 - protein, 20 aa, Mycobacterium
PLTVLIIFTLNILLAEFGAA

SEQ ID NO: 378871 - protein, 23 aa, Mycobacterium
PLVATVFDFFYQPGKLPASLADY

SEQ ID NO: 378872 - protein, 23 aa, Mycobacterium
PLVFAFVALIAFVMLLVSIRSVF

SEQ ID NO: 378873 - protein, 23 aa, Mycobacterium
PLVFVFVALIAFVMLLVSIRSVV

SEQ ID NO: 378874 - protein, 17 aa, Mycobacterium
PLVLGLIAIIMFALLFL

SEQ ID NO: 378875 - protein, 19 aa, Mycobacterium
PLVLLGVGLLWFGWFGFNA

SEQ ID NO: 378876 - protein, 19 aa, Mycobacterium
PLWIAFALGRRAATRRYTY

SEQ ID NO: 378877 - protein, 25 aa, Mycobacterium
PLWLGMDAWRWMFLAMAVPAVVYGG

SEQ ID NO: 378878 - protein, 18 aa, Mycobacterium
PLYLNIAVVVLGLVAYLL

SEQ ID NO: 378879 - protein, 34 aa, Mycobacterium
PMRAIGRLSYSWYLWHWPVLLLAAPLLGRPLGPI

SEQ ID NO: 378880 - protein, 24 aa, Mycobacterium
PMVISRWTLLVWILAAVGSGMGYL

SEQ ID NO: 378881 - protein, 18 aa, Mycobacterium
PNLRFRIVSAWRALRPTL

SEQ ID NO: 378882 - protein, 29 aa, Mycobacterium
PNRSWARYLRRGAMPLLLAGALALSAFLG

SEQ ID NO: 378883 - protein, 18 aa, Mycobacterium
PNWFYFLVEVIGAAAMFW

SEQ ID NO: 378884 - protein, 24 aa, Mycobacterium
PPALLLLPVLAWAAFRLEVIGAAL

SEQ ID NO: 378885 - protein, 26 aa, Mycobacterium
PPEGPKSPRWLWIAAGAAVLLVVALV

SEQ ID NO: 378886 - protein, 25 aa, Mycobacterium
PPEGPKTPRWLWIAAGAAVVLVIGL

SEQ ID NO: 378887 - protein, 24 aa, Mycobacterium
PPEPPWWLEILAWLQKFATLLEEV

SEQ ID NO: 378888 - protein, 38 aa, Mycobacterium
PPHSKKFTWHWWWLAAAIPVLLLVVFLVVMAVGLRRRR

SEQ ID NO: 378889 - protein, 20 aa, Mycobacterium
PPKRPPAWSLGNWPVGWKVV

SEQ ID NO: 378890 - protein, 31 aa, Mycobacterium
PPLARFLYRFSIPILVLWLGAAGLLNLAVPQ

SEQ ID NO: 378891 - protein, 20 aa, Mycobacterium
PPLEQLAWLSPSRWAYAMAA

SEQ ID NO: 378892 - protein, 19 aa, Mycobacterium
PPLMLAVWRRPATPHWPPV

SEQ ID NO: 378893 - protein, 18 aa, Mycobacterium
PPNVFDPIVGFPGPGWRT

SEQ ID NO: 378894 - protein, 24 aa, Mycobacterium
PPPKPPWWNIIWQLLETLAHVLTQ

SEQ ID NO: 378895 - protein, 17 aa, Mycobacterium
PPPLPYYAPPDQIVPPY

SEQ ID NO: 378896 - protein, 17 aa, Mycobacterium
PPPPFAPPPPWASGRNF

SEQ ID NO: 378897 - protein, 21 aa, Mycobacterium
PPPPFPPPPPPPYPPAPYAFP

SEQ ID NO: 378898 - protein, 17 aa, Mycobacterium
PPPPPLPYYAPPDQIVP

SEQ ID NO: 378899 - protein, 20 aa, Mycobacterium
PPPPRWPWVVGVAAIIAAIT

SEQ ID NO: 378900 - protein, 27 aa, Mycobacterium
PPRTWSLRTRLILTQLLLLAVVCAGVG

SEQ ID NO: 378901 - protein, 17 aa, Mycobacterium
PPRWAWKVLIPIGVVGQ

SEQ ID NO: 378902 - protein, 17 aa, Mycobacterium
PPVAYPRRWGYWPAAAG

SEQ ID NO: 378903 - protein, 21 aa, Mycobacterium
PPWEFYFWHHTIPAPVWVALI

SEQ ID NO: 378904 - protein, 19 aa, Mycobacterium
PPYPPYPPYPPPSLPDPDG

SEQ ID NO: 378905 - protein, 24 aa, Mycobacterium
PQDAWPWLGWLTAATAAGWIVDTT

SEQ ID NO: 378906 - protein, 20 aa, Mycobacterium
PQEGFCVYPWSPLRLINGTV

SEQ ID NO: 378907 - protein, 24 aa, Mycobacterium
PQFRALWVFVLIPVLILLAVSGKW

SEQ ID NO: 378908 - protein, 25 aa, Mycobacterium
PQFRALWVFVLIPVLILLAVSGKWL

SEQ ID NO: 378909 - protein, 22 aa, Mycobacterium
PQIPWWILTALVLAAVAWLGYR

SEQ ID NO: 378910 - protein, 25 aa, Mycobacterium
PQRLRRWWWGLLLAFVPIHLVVSAV

SEQ ID NO: 378911 - protein, 21 aa, Mycobacterium
PQVYWMVLQLALAVALLAWWR

SEQ ID NO: 378912 - protein, 24 aa, Mycobacterium
PQYRPLWVFLLVPVLILLTVSGRW

SEQ ID NO: 378913 - protein, 26 aa, Mycobacterium
PQYRSLWVFLLLPVLILLTVSGRWLY

SEQ ID NO: 378914 - protein, 20 aa, Mycobacterium
PRAKLFAALFLILGLVVVGE

SEQ ID NO: 378915 - protein, 21 aa, Mycobacterium
PRAMFFIGILYVVVATVIAFW

SEQ ID NO: 378916 - protein, 18 aa, Mycobacterium
PRAPQLWLPPLDTAIPLA

SEQ ID NO: 378917 - protein, 17 aa, Mycobacterium
PRAVWWELVRLRLRGAA

SEQ ID NO: 378918 - protein, 31 aa, Mycobacterium
PRDVPLIFIPWPTLLWLLPVATAVALVAFPR

SEQ ID NO: 378919 - protein, 17 aa, Mycobacterium
PRDYWLLGIAAAVVIVL

SEQ ID NO: 378920 - protein, 26 aa, Mycobacterium
PRGPKPPPRWLWIVAGAAVLLVVALV

SEQ ID NO: 378921 - protein, 23 aa, Mycobacterium
PRGWRIWRVWPDTTTLLVTLVDV

SEQ ID NO: 378922 - protein, 31 aa, Mycobacterium
PRIARLIRTLSIPIILFWLGIAIVLNIVTPS

SEQ ID NO: 378923 - protein, 20 aa, Mycobacterium
PRLLRWLQPVIPLAAGPTPI

SEQ ID NO: 378924 - protein, 21 aa, Mycobacterium
PRLWFALVFLMTIAVSFLLST

SEQ ID NO: 378925 - protein, 20 aa, Mycobacterium
PRPLDPPPAPPPPAPTKGGP

SEQ ID NO: 378926 - protein, 32 aa, Mycobacterium
PRPRKRRIGWSRLLVFGVLPISALLIAVATGF

SEQ ID NO: 378927 - protein, 21 aa, Mycobacterium
PRSIWVWLMLGVLLLSVVLAV

SEQ ID NO: 378928 - protein, 22 aa, Mycobacterium
PRWPFLLRLWGRHPLVRPTDRI

SEQ ID NO: 378929 - protein, 23 aa, Mycobacterium
PRWPRRRMFFVVTLAVLFVLSGM

SEQ ID NO: 378930 - protein, 21 aa, Mycobacterium
PRWSSWLRVVLGAGLIAFGVY

SEQ ID NO: 378931 - protein, 17 aa, Mycobacterium
PSFMRLLGRFNWWAPKP

SEQ ID NO: 378932 - protein, 32 aa, Mycobacterium
PSHGKKFTWHWWWLVAVVPVVLLIVMFVLVAL

SEQ ID NO: 378933 - protein, 21 aa, Mycobacterium
PSHILGLLNLLTAWETGACVR

SEQ ID NO: 378934 - protein, 21 aa, Mycobacterium
PSIEQLLVLLPPYLAATQSYG

SEQ ID NO: 378935 - protein, 25 aa, Mycobacterium
PSLAWVPLLLLWFGIGETPKVTLVA

SEQ ID NO: 378936 - protein, 26 aa, Mycobacterium
PSPPQGVWYLGPFPLRAYALCIIVGI

SEQ ID NO: 378937 - protein, 21 aa, Mycobacterium
PSPPWWSIMWQLLQTLADIVS

SEQ ID NO: 378938 - protein, 23 aa, Mycobacterium
PSRHWWLVWMFAGVFAASLAALA

SEQ ID NO: 378939 - protein, 25 aa, Mycobacterium
PSSRASLWLPYLPVLLAIVVGAVHF

SEQ ID NO: 378940 - protein, 24 aa, Mycobacterium
PSVPGLWELAWPPLSTAAAAAADR

SEQ ID NO: 378941 - protein, 28 aa, Mycobacterium
PSWFAGLIVAWLWLTVIFANLAEAVAEG

SEQ ID NO: 378942 - protein, 17 aa, Mycobacterium
PSWLQPLIQSSPPVFAA

SEQ ID NO: 378943 - protein, 21 aa, Mycobacterium
PTFFFQLRTANWWFALLGLAV

SEQ ID NO: 378944 - protein, 20 aa, Mycobacterium
PTFLAKWIRRLSIPIVIGWL

SEQ ID NO: 378945 - protein, 18 aa, Mycobacterium
PTFSLGLLPLFLPAVIAL

SEQ ID NO: 378946 - protein, 19 aa, Mycobacterium
PTPPPRWWFTIGGATQLGE

SEQ ID NO: 378947 - protein, 17 aa, Mycobacterium
PTSIPLTALWLAQSWHR

SEQ ID NO: 378948 - protein, 27 aa, Mycobacterium
PTTPAHPRWWFLWTTPGRILTIGLVLS

SEQ ID NO: 378949 - protein, 17 aa, Mycobacterium
PTWASWLRVVLGSALIA

SEQ ID NO: 378950 - protein, 24 aa, Mycobacterium
PTWQPWLRWVLLIGGLVVAIALTL

SEQ ID NO: 378951 - protein, 17 aa, Mycobacterium
PTYGFTAPPTVIPVPSP

SEQ ID NO: 378952 - protein, 18 aa, Mycobacterium
PTYGFVRQHFWLPGGSTG

SEQ ID NO: 378953 - protein, 19 aa, Mycobacterium
PVAPLVFWMALAGLTPTGL

SEQ ID NO: 378954 - protein, 28 aa, Mycobacterium
PVARLWRGFLLFFSRWWQLETLYRSNMK

SEQ ID NO: 378955 - protein, 28 aa, Mycobacterium
PVARLWRGLLLFFSRWWQLETLYRSNMK

SEQ ID NO: 378956 - protein, 28 aa, Mycobacterium
PVARLWRWLLIFFSRWWQIETLYRSNQK

SEQ ID NO: 378957 - protein, 29 aa, Mycobacterium
PVEFSGLFAWFAWLVLHLVYLVGFKTKIS

SEQ ID NO: 378958 - protein, 17 aa, Mycobacterium
PVFLGWPIMRWLTKNEM

SEQ ID NO: 378959 - protein, 17 aa, Mycobacterium
PVFLGWPIMRWLTKSEM

SEQ ID NO: 378960 - protein, 18 aa, Mycobacterium
PVFLLFIYKIVLGEQVHK

SEQ ID NO: 378961 - protein, 18 aa, Mycobacterium
PVGLLIVVLLLISTLFLL

SEQ ID NO: 378962 - protein, 24 aa, Mycobacterium
PVGTRQLLLVNLLTDMFPALAVAV

SEQ ID NO: 378963 - protein, 25 aa, Mycobacterium
PVGTRQLLLVNLLTDMFPALAVAVT

SEQ ID NO: 378964 - protein, 24 aa, Mycobacterium
PVKLLSFHLLLISLVLLAPYLDRL

SEQ ID NO: 378965 - protein, 17 aa, Mycobacterium
PVLIMMIFAYFLYAFYD

SEQ ID NO: 378966 - protein, 17 aa, Mycobacterium
PVLLIPLTFALFTPLAV

SEQ ID NO: 378967 - protein, 21 aa, Mycobacterium
PVLQWWIAWVCSYAVSIAAIV

SEQ ID NO: 378968 - protein, 18 aa, Mycobacterium
PVLVAAALVLLICTLPIT

SEQ ID NO: 378969 - protein, 18 aa, Mycobacterium
PVMFLLWVLIPTAASVAV

SEQ ID NO: 378970 - protein, 17 aa, Mycobacterium
PVMLQRILALADLDRRD

SEQ ID NO: 378971 - protein, 25 aa, Mycobacterium
PVPAPWPIVGLLPPGPRLSKEDALV

SEQ ID NO: 378972 - protein, 27 aa, Mycobacterium
PVPPQLPYPKWLPPPAPPLGINPPPPG

SEQ ID NO: 378973 - protein, 31 aa, Mycobacterium
PVPPYPLNVIPWLFILTVAAALAWYLILRRR

SEQ ID NO: 378974 - protein, 18 aa, Mycobacterium
PVQFIAGWPFLVGAVQQA

SEQ ID NO: 378975 - protein, 18 aa, Mycobacterium
PVQFVAGWPFLKEAVQRA

SEQ ID NO: 378976 - protein, 17 aa, Mycobacterium
PVRLLPIDLAPDAVGNL

SEQ ID NO: 378977 - protein, 23 aa, Mycobacterium
PVRPDLPEVLLPQNYHPPKDLAP

SEQ ID NO: 378978 - protein, 19 aa, Mycobacterium
PVRPQYPPPPTPPPAGKRP

SEQ ID NO: 378979 - protein, 17 aa, Mycobacterium
PVSIILVVLVMISGGIA

SEQ ID NO: 378980 - protein, 17 aa, Mycobacterium
PVSWIMWVWYKLFALVL

SEQ ID NO: 378981 - protein, 19 aa, Mycobacterium
PVTEFNVALPWTKMVVLNP

SEQ ID NO: 378982 - protein, 22 aa, Mycobacterium
PVVFLTAFYGLSVLAGLKAGER

SEQ ID NO: 378983 - protein, 21 aa, Mycobacterium
PVVLLIVMFVLVALGVRRRRT

SEQ ID NO: 378984 - protein, 22 aa, Mycobacterium
PVVMWILMPLAVFGSAYVPEIA

SEQ ID NO: 378985 - protein, 23 aa, Mycobacterium
PVVQPWYVLWAIIPLAAWATRPR

SEQ ID NO: 378986 - protein, 24 aa, Mycobacterium
PVVTWAAWPFHRVALRNARHHGAS

SEQ ID NO: 378987 - protein, 19 aa, Mycobacterium
PVWASWLRIVLGTALIIFG

SEQ ID NO: 378988 - protein, 17 aa, Mycobacterium
PVYDWPQSPPAPPTPPP

SEQ ID NO: 378989 - protein, 19 aa, Mycobacterium
PWEFYFWHHTIPAAVWVAL

SEQ ID NO: 378990 - protein, 19 aa, Mycobacterium
PWEFYFWHHTIPAVVWVAL

SEQ ID NO: 378991 - protein, 18 aa, Mycobacterium
PWEFYFWHHTVPAPVWVA

SEQ ID NO: 378992 - protein, 19 aa, Mycobacterium
PWGWIAHRLLSAPVTAARM

SEQ ID NO: 378993 - protein, 18 aa, Mycobacterium
PWIAWLAVAFVIVALYLG

SEQ ID NO: 378994 - protein, 20 aa, Mycobacterium
PWIIYWVLVGNVPFLTAVLI

SEQ ID NO: 378995 - protein, 18 aa, Mycobacterium
PWIVYWVLVGNVPFAAAV

SEQ ID NO: 378996 - protein, 24 aa, Mycobacterium
PWPALWALLIGFFMILVDATIVAV

SEQ ID NO: 378997 - protein, 19 aa, Mycobacterium
PWRAIGKRILIAVGTLFAA

SEQ ID NO: 378998 - protein, 21 aa, Mycobacterium
PWTPIVIILVITAVKILGSVL

SEQ ID NO: 378999 - protein, 18 aa, Mycobacterium
PWVAILFTTLIAFGLIFY

SEQ ID NO: 379000 - protein, 18 aa, Mycobacterium
PWVVFFSWSINLTYQFWV

SEQ ID NO: 379001 - protein, 26 aa, Mycobacterium
PWYRRPAMLIAWLISVVILIGLIVFG

SEQ ID NO: 379002 - protein, 33 aa, Mycobacterium
PYLRASPWLLWRKRIVWLLVLFAAEAYTGTVLR

SEQ ID NO: 379003 - protein, 23 aa, Mycobacterium
QAADWLGYFMLLASFILGATVGG

SEQ ID NO: 379004 - protein, 25 aa, Mycobacterium
QAGPPPPPPWTYGGPFPGPPPQRPS

SEQ ID NO: 379005 - protein, 24 aa, Mycobacterium
QALGWQWIFFINVPIGLAGLVLAA

SEQ ID NO: 379006 - protein, 25 aa, Mycobacterium
QALLFPTFLLIVYKLLIGKAVLAVT

SEQ ID NO: 379007 - protein, 36 aa, Mycobacterium
QALRLTYMIFFSIPVVAPLLLRLTLSIPALRRNAVD

SEQ ID NO: 379008 - protein, 20 aa, Mycobacterium
QAMIWLTWPWGTAGSVGAFA

SEQ ID NO: 379009 - protein, 23 aa, Mycobacterium
QAQGGAPLWVGYLGAAAEAGMVG

SEQ ID NO: 379010 - protein, 18 aa, Mycobacterium
QAQPPYPPYPPYPPPSLP

SEQ ID NO: 379011 - protein, 22 aa, Mycobacterium
QATFLRWLWYAARREGLRLDGT

SEQ ID NO: 379012 - protein, 31 aa, Mycobacterium
QDGRDMFWSLIPLVIGCVVLAGLLGMCSFQL

SEQ ID NO: 379013 - protein, 26 aa, Mycobacterium
QDGRDMFWSVAPLVLACVVLAGVLGM

SEQ ID NO: 379014 - protein, 23 aa, Mycobacterium
QDLFGIRIHWIVMALSVIILLAV

SEQ ID NO: 379015 - protein, 33 aa, Mycobacterium
QDLWRRKINLKPVPVILIVLILISGGITAWLYA

SEQ ID NO: 379016 - protein, 25 aa, Mycobacterium
QDPNPPLPWWQPNPSPRVPGSADPD

SEQ ID NO: 379017 - protein, 23 aa, Mycobacterium
QEAALTWLLLVSVPIMAVANYWV

SEQ ID NO: 379018 - protein, 24 aa, Mycobacterium
QEGRWYLFLLLPSFLVYVTAMVGE

SEQ ID NO: 379019 - protein, 24 aa, Mycobacterium
QFGEGWWTSVWFLAFWITGTSMLM

SEQ ID NO: 379020 - protein, 20 aa, Mycobacterium
QFGIFILLFLLLAPVLNQWL

SEQ ID NO: 379021 - protein, 17 aa, Mycobacterium
QFGLWRWAFAAMAVMSG

SEQ ID NO: 379022 - protein, 30 aa, Mycobacterium
QFHDMGLIGMLLWPLFYGGTSRFLSPVTFI

SEQ ID NO: 379023 - protein, 23 aa, Mycobacterium
QFTNWQWLALTLASPVVVWGALP

SEQ ID NO: 379024 - protein, 18 aa, Mycobacterium
QFYLVWPALIIATAWLVR

SEQ ID NO: 379025 - protein, 24 aa, Mycobacterium
QGDGPYILVGWSLGGALAYACAIG

SEQ ID NO: 379026 - protein, 19 aa, Mycobacterium
QGPLPWYKRTALVLSVAGA

SEQ ID NO: 379027 - protein, 24 aa, Mycobacterium
QGQFYIAFLVLIFGFAYLFRRVFG

SEQ ID NO: 379028 - protein, 21 aa, Mycobacterium
QGQFYLAFLLLVFGIGFLLRR

SEQ ID NO: 379029 - protein, 31 aa, Mycobacterium
QGSILGELLVYVLPLLLLVGLFVMFSRMQGG

SEQ ID NO: 379030 - protein, 23 aa, Mycobacterium
QGSQYYLIVFLSGTLPLVYLVYR

SEQ ID NO: 379031 - protein, 17 aa, Mycobacterium
QHLFWFFGHPEVYIVAL

SEQ ID NO: 379032 - protein, 27 aa, Mycobacterium
QHLIGLPLHWLILPLSFIILVAVGSDY

SEQ ID NO: 379033 - protein, 23 aa, Mycobacterium
QIASLMFLFVITSLLSVLGFFAI

SEQ ID NO: 379034 - protein, 18 aa, Mycobacterium
QIIIGYFVGFLAAAPVLT

SEQ ID NO: 379035 - protein, 24 aa, Mycobacterium
QINWLWVRRAAYLSAAVLVLLPIV

SEQ ID NO: 379036 - protein, 21 aa, Mycobacterium
QIPRALFWIVIAYITFATVVA

SEQ ID NO: 379037 - protein, 24 aa, Mycobacterium
QKALIALVVFLILAAIYITVRYEW

SEQ ID NO: 379038 - protein, 19 aa, Mycobacterium
QKWAPRYLFQPISNLLLTL

SEQ ID NO: 379039 - protein, 23 aa, Mycobacterium
QLGDLRWFYIYSGVIWCCVFMRT

SEQ ID NO: 379040 - protein, 19 aa, Mycobacterium
QLIAFGILTVISLLVLGVY

SEQ ID NO: 379041 - protein, 20 aa, Mycobacterium
QLIAFGILTVISLLVLGVYY

SEQ ID NO: 379042 - protein, 20 aa, Mycobacterium
QLIIFTILTVVALGVLGLYY

SEQ ID NO: 379043 - protein, 26 aa, Mycobacterium
QLILGKDLHWSLPGLSFILLVAVGAD

SEQ ID NO: 379044 - protein, 26 aa, Mycobacterium
QLILGKELHWSLPGLSFILLVAVGAD

SEQ ID NO: 379045 - protein, 25 aa, Mycobacterium
QLKKYAPLLLALLAGVVLGWLLGRR

SEQ ID NO: 379046 - protein, 17 aa, Mycobacterium
QLLRMLRMRHDVTYRTR

SEQ ID NO: 379047 - protein, 19 aa, Mycobacterium
QLNLLWLGITLAVLIALCA

SEQ ID NO: 379048 - protein, 23 aa, Mycobacterium
QNDVWFIFLLLPSFLVYLTSMVG

SEQ ID NO: 379049 - protein, 17 aa, Mycobacterium
QNSLLPRWLPDGSPDRG

SEQ ID NO: 379050 - protein, 21 aa, Mycobacterium
QPFGEYLPWRGFFKHLSSYAD

SEQ ID NO: 379051 - protein, 24 aa, Mycobacterium
QPGTVYQMWLIDTEGPHSAGTMDS

SEQ ID NO: 379052 - protein, 18 aa, Mycobacterium
QPIWNTRGYILDAALRPV

SEQ ID NO: 379053 - protein, 27 aa, Mycobacterium
QPNRALVAWISFAAALLAIGALAGCLA

SEQ ID NO: 379054 - protein, 23 aa, Mycobacterium
QPVVLWILLPIVAFGSAYVPEVA

SEQ ID NO: 379055 - protein, 19 aa, Mycobacterium
QPWTPILIIIIITSVKIGA

SEQ ID NO: 379056 - protein, 23 aa, Mycobacterium
QQDIRFIIIATLIVVLLTLTVLL

SEQ ID NO: 379057 - protein, 18 aa, Mycobacterium
QQLGSILILGIWFETALA

SEQ ID NO: 379058 - protein, 29 aa, Mycobacterium
QQMRPFVDLRWWPFLLLLGTTLALMLTAH

SEQ ID NO: 379059 - protein, 26 aa, Mycobacterium
QQRANRSFFWWVLALAAMASVGSNAL

SEQ ID NO: 379060 - protein, 26 aa, Mycobacterium
QRARRALLFWVIAVITLAGLAAAGAW

SEQ ID NO: 379061 - protein, 23 aa, Mycobacterium
QRLFEWLFLLVALGNRFLPIFVR

SEQ ID NO: 379062 - protein, 24 aa, Mycobacterium
QRNWGWVLAIVVIVLALAAIAILG

SEQ ID NO: 379063 - protein, 17 aa, Mycobacterium
QRPARWMHLLASNTRAF

SEQ ID NO: 379064 - protein, 18 aa, Mycobacterium
QRPRLWRMRIDVQRVGDV

SEQ ID NO: 379065 - protein, 17 aa, Mycobacterium
QRPTVLALVPYFSTVIG

SEQ ID NO: 379066 - protein, 24 aa, Mycobacterium
QRRRTWRWVILTLIVLAVVAGVDA

SEQ ID NO: 379067 - protein, 23 aa, Mycobacterium
QRTPFLVIAAFSAAVIALGVGLL

SEQ ID NO: 379068 - protein, 20 aa, Mycobacterium
QRWLPLLLAGFTAGFLLLRG

SEQ ID NO: 379069 - protein, 25 aa, Mycobacterium
QSKEPLPEYFSAPGGPPLPPVIEAF

SEQ ID NO: 379070 - protein, 24 aa, Mycobacterium
QSPMPLLVALAVSLLAILLIRQLR

SEQ ID NO: 379071 - protein, 28 aa, Mycobacterium
QSRRAIFIWLVIVLILTSSVAAGCWSLG

SEQ ID NO: 379072 - protein, 24 aa, Mycobacterium
QSSYGWLVWVFVAMFGVGLIDLVL

SEQ ID NO: 379073 - protein, 17 aa, Mycobacterium
QTGFPPPGGPAAGTEQQ

SEQ ID NO: 379074 - protein, 18 aa, Mycobacterium
QTLGPLDKPFLAVVLLVV

SEQ ID NO: 379075 - protein, 18 aa, Mycobacterium
QTVLPFTGLKAPAGVAVD

SEQ ID NO: 379076 - protein, 20 aa, Mycobacterium
QVALTLLWPAAIAALVYAVL

SEQ ID NO: 379077 - protein, 23 aa, Mycobacterium
QVANLELYLIFPLKNEQATIQLV

SEQ ID NO: 379078 - protein, 23 aa, Mycobacterium
QVANLELYLIFPLKNEQATITLV

SEQ ID NO: 379079 - protein, 23 aa, Mycobacterium
QVGLSLFYWWFHTIDKTLPVFVV

SEQ ID NO: 379080 - protein, 17 aa, Mycobacterium
QVLLLCAVLLLGIAWCG

SEQ ID NO: 379081 - protein, 17 aa, Mycobacterium
QVMPWTALWLGALSTAI

SEQ ID NO: 379082 - protein, 18 aa, Mycobacterium
QVPVKWWDILRKPSYLAI

SEQ ID NO: 379083 - protein, 17 aa, Mycobacterium
QVQPLMLIAPAGALFVT

SEQ ID NO: 379084 - protein, 17 aa, Mycobacterium
QVVFQRGFQLPALPPGT

SEQ ID NO: 379085 - protein, 22 aa, Mycobacterium
QVVLNLWAYWCGPCADELPAMA

SEQ ID NO: 379086 - protein, 19 aa, Mycobacterium
QVWLRPRSWLLRRATTEAT

SEQ ID NO: 379087 - protein, 21 aa, Mycobacterium
QWREFILQGWFLLGVSFLPTV

SEQ ID NO: 379088 - protein, 17 aa, Mycobacterium
QWREFILQSWFLLRVAF

SEQ ID NO: 379089 - protein, 17 aa, Mycobacterium
QYFFFDLLTGRFQWQEF

SEQ ID NO: 379090 - protein, 18 aa, Mycobacterium
QYLGPILDAIKFNYLPFG

SEQ ID NO: 379091 - protein, 23 aa, Mycobacterium
QYRNIMWWTVLWAATWLLALVTW

SEQ ID NO: 379092 - protein, 19 aa, Mycobacterium
QYYIAWPLLLIAVTLLLAV

SEQ ID NO: 379093 - protein, 24 aa, Mycobacterium
RAAEPILPIRLFASPVFAVCCVLS

SEQ ID NO: 379094 - protein, 19 aa, Mycobacterium
RAASLVLLEAAPRGIEPEA

SEQ ID NO: 379095 - protein, 17 aa, Mycobacterium
RAFAIVAALLAIAAIAV

SEQ ID NO: 379096 - protein, 23 aa, Mycobacterium
RAKTFFLLVGMSALIVFVGSLFG

SEQ ID NO: 379097 - protein, 22 aa, Mycobacterium
RALFSQLIFVHLYLGIAEGALA

SEQ ID NO: 379098 - protein, 19 aa, Mycobacterium
RALFWIVVVYVLVATIIVF

SEQ ID NO: 379099 - protein, 22 aa, Mycobacterium
RALLWVLFWLGWAIALLATFLI

SEQ ID NO: 379100 - protein, 21 aa, Mycobacterium
RALMYLGFIPPVWLAAVGALS

SEQ ID NO: 379101 - protein, 18 aa, Mycobacterium
RALRWPRLPSSVLAGVVA

SEQ ID NO: 379102 - protein, 19 aa, Mycobacterium
RALSLALLIVVAVGAVFLG

SEQ ID NO: 379103 - protein, 23 aa, Mycobacterium
RALYVILGWRRVLLIPLTFALFT

SEQ ID NO: 379104 - protein, 20 aa, Mycobacterium
RAMFWTVLIYVLVATIISFV

SEQ ID NO: 379105 - protein, 17 aa, Mycobacterium
RANWVLRTLLREYGRRA

SEQ ID NO: 379106 - protein, 23 aa, Mycobacterium
RARIPWVLGFIAAVTFTLLFLLT

SEQ ID NO: 379107 - protein, 24 aa, Mycobacterium
RARLRWRWVLLGLAVLMCWLSVAV

SEQ ID NO: 379108 - protein, 23 aa, Mycobacterium
RARVPMPIIPVSSLLRSHAVTLN

SEQ ID NO: 379109 - protein, 24 aa, Mycobacterium
RARVPMPVLPVSSLLRSHAITLND

SEQ ID NO: 379110 - protein, 19 aa, Mycobacterium
RASQEAELLILFAGSVLRG

SEQ ID NO: 379111 - protein, 21 aa, Mycobacterium
RATFLRWIWYAARREKLHLDG

SEQ ID NO: 379112 - protein, 17 aa, Mycobacterium
RATFWAIALLCLPAVVG

SEQ ID NO: 379113 - protein, 18 aa, Mycobacterium
RATRLAKLFALASTLLVV

SEQ ID NO: 379114 - protein, 22 aa, Mycobacterium
RAVFLRWLWYAARRAELHLDGE

SEQ ID NO: 379115 - protein, 18 aa, Mycobacterium
RAVLWSQWRFTFEPMFVV

SEQ ID NO: 379116 - protein, 26 aa, Mycobacterium
RAVMTTLMALAFWLSGVGVAAAHTSL

SEQ ID NO: 379117 - protein, 21 aa, Mycobacterium
RAWTPIIVIIVITVVKIAGSV

SEQ ID NO: 379118 - protein, 24 aa, Mycobacterium
RCTRLYRPVFYYLAFWTATLVVLR

SEQ ID NO: 379119 - protein, 28 aa, Mycobacterium
RDFATMLHYWPFLFFASGVVSITFVSLV

SEQ ID NO: 379120 - protein, 25 aa, Mycobacterium
RDFVSTAWWLELFPGLAIVGCTLAV

SEQ ID NO: 379121 - protein, 24 aa, Mycobacterium
RDLVLLLCVVLFTFVWWGVSHSRA

SEQ ID NO: 379122 - protein, 19 aa, Mycobacterium
RDLWPAPFLVLDTGASVAP

SEQ ID NO: 379123 - protein, 20 aa, Mycobacterium
RDLWPAPYLVMDVGANMAPY

SEQ ID NO: 379124 - protein, 20 aa, Mycobacterium
RDMFWSLVPLVIGCILLAGM

SEQ ID NO: 379125 - protein, 26 aa, Mycobacterium
RDPNPPVPPWLTPAPPVPGSADPGQI

SEQ ID NO: 379126 - protein, 25 aa, Mycobacterium
RDPRWLLWLVALMTAALIPFSTLGL

SEQ ID NO: 379127 - protein, 28 aa, Mycobacterium
RDPVSVLLIFIIVFALIIAGLIGAELYV

SEQ ID NO: 379128 - protein, 17 aa, Mycobacterium
RDRHQWLRWYPLAMLFA

SEQ ID NO: 379129 - protein, 29 aa, Mycobacterium
RDRISLWGRILPITFTALGLVALVGGAVL

SEQ ID NO: 379130 - protein, 24 aa, Mycobacterium
RDRLALWSRVLPITFTAIGLVALV

SEQ ID NO: 379131 - protein, 24 aa, Mycobacterium
RDRLALWSRVLPITFTAVGLIALV

SEQ ID NO: 379132 - protein, 27 aa, Mycobacterium
RDRMLFTYHFLLFDGWSRELVLRDLFA

SEQ ID NO: 379133 - protein, 24 aa, Mycobacterium
RDRWRTLAWALAALVAIVITGLIL

SEQ ID NO: 379134 - protein, 22 aa, Mycobacterium
RDRYPAVMWILLAGNLLVRSAG

SEQ ID NO: 379135 - protein, 17 aa, Mycobacterium
REAGLTRLILLTGDRAE

SEQ ID NO: 379136 - protein, 25 aa, Mycobacterium
REFIWNGWFLMRVSLLPTIAVSIPE

SEQ ID NO: 379137 - protein, 24 aa, Mycobacterium
RENVVALTVLWLLNIGEYLQDLTL

SEQ ID NO: 379138 - protein, 24 aa, Mycobacterium
REPEFVPWLRWVIAASAVLAAAIW

SEQ ID NO: 379139 - protein, 24 aa, Mycobacterium
REQPRLSRRWILIAVAALVLVAGV

SEQ ID NO: 379140 - protein, 17 aa, Mycobacterium
REQWRFRPAWNSSECVE

SEQ ID NO: 379141 - protein, 27 aa, Mycobacterium
RERRTWLRRVLLAFPLGLVAMASTMFF

SEQ ID NO: 379142 - protein, 24 aa, Mycobacterium
RETYDAMFDLWFPAALGARAAVTE

SEQ ID NO: 379143 - protein, 23 aa, Mycobacterium
RFAHLVRIFAVPIILGWVFVAVA

SEQ ID NO: 379144 - protein, 18 aa, Mycobacterium
RFALRNRTWWPPPNWVLL

SEQ ID NO: 379145 - protein, 17 aa, Mycobacterium
RFCGPELWWLLRVADYA

SEQ ID NO: 379146 - protein, 24 aa, Mycobacterium
RFERAWPLLWFVVIGLVAAAVGYL

SEQ ID NO: 379147 - protein, 19 aa, Mycobacterium
RFFAYLNLFLAAMLLLVLA

SEQ ID NO: 379148 - protein, 22 aa, Mycobacterium
RFFPPMGSVLYWLRPRTIRLPP

SEQ ID NO: 379149 - protein, 18 aa, Mycobacterium
RFFWNIKILRTIALVDMA

SEQ ID NO: 379150 - protein, 20 aa, Mycobacterium
RFGIQSKILITMLLSSILGV

SEQ ID NO: 379151 - protein, 17 aa, Mycobacterium
RFIIVVTLVIVMLVLML

SEQ ID NO: 379152 - protein, 18 aa, Mycobacterium
RFLLVQWLAPLASEAPEF

SEQ ID NO: 379153 - protein, 19 aa, Mycobacterium
RFRLLWLRQLSDAVRTFRN

SEQ ID NO: 379154 - protein, 30 aa, Mycobacterium
RFSWRRPWLVIGSWLAVLVILNLGIPQLET

SEQ ID NO: 379155 - protein, 20 aa, Mycobacterium
RFVKFLRYLSFGGLFIGLSV

SEQ ID NO: 379156 - protein, 18 aa, Mycobacterium
RFVLLRGWVFHPARTRRP

SEQ ID NO: 379157 - protein, 27 aa, Mycobacterium
RFVRTFAWPIIIGWLLLTVALNVLVPP

SEQ ID NO: 379158 - protein, 17 aa, Mycobacterium
RFWYALNRVGAFAGADA

SEQ ID NO: 379159 - protein, 17 aa, Mycobacterium
RFYVVFFLALLFVTWHC

SEQ ID NO: 379160 - protein, 25 aa, Mycobacterium
RGFRAPWVPWLPIASLCACLWLMVN

SEQ ID NO: 379161 - protein, 26 aa, Mycobacterium
RGGFLLLLWVFIWSVLRILRTDIYAP

SEQ ID NO: 379162 - protein, 20 aa, Mycobacterium
RGGLLLGLLIPHGLLELTAV

SEQ ID NO: 379163 - protein, 17 aa, Mycobacterium
RGHRFERLPAGRGILLS

SEQ ID NO: 379164 - protein, 20 aa, Mycobacterium
RGKYWWLRWVVIAVAVIVLA

SEQ ID NO: 379165 - protein, 22 aa, Mycobacterium
RGKYWWVRWVILGMVAIVLAVE

SEQ ID NO: 379166 - protein, 24 aa, Mycobacterium
RGNPAPLMLWVWIALTGVAATVLV

SEQ ID NO: 379167 - protein, 18 aa, Mycobacterium
RGPLWLIILGFSAGVALL

SEQ ID NO: 379168 - protein, 19 aa, Mycobacterium
RGPRVTLWQFHWVVIVATL

SEQ ID NO: 379169 - protein, 18 aa, Mycobacterium
RGQFWIWAGANIAPINWI

SEQ ID NO: 379170 - protein, 23 aa, Mycobacterium
RGQGPPAHRVWLPPLGPAPQLHT

SEQ ID NO: 379171 - protein, 23 aa, Mycobacterium
RGQPLTFLDCLYFSAVSLSTTGY

SEQ ID NO: 379172 - protein, 24 aa, Mycobacterium
RGRALRWVWQALAALLIATVFAAA

SEQ ID NO: 379173 - protein, 26 aa, Mycobacterium
RGRSWRWLRVLLAGLAKAAAVVIICG

SEQ ID NO: 379174 - protein, 24 aa, Mycobacterium
RGSRSRMLFGALAILLCLVLGVAI

SEQ ID NO: 379175 - protein, 18 aa, Mycobacterium
RGWPGWGLALWLICPIWL

SEQ ID NO: 379176 - protein, 18 aa, Mycobacterium
RGWPILRFNSRGPVGLRR

SEQ ID NO: 379177 - protein, 28 aa, Mycobacterium
RGWSAMPLALRLLLPIAFVLISAGIGVA

SEQ ID NO: 379178 - protein, 24 aa, Mycobacterium
RGYTIFLAVLPFLIGALSLTVKGP

SEQ ID NO: 379179 - protein, 17 aa, Mycobacterium
RHIAPHMVLAYGAARAD

SEQ ID NO: 379180 - protein, 18 aa, Mycobacterium
RHNTHILSFVYWLGLLLL

SEQ ID NO: 379181 - protein, 18 aa, Mycobacterium
RHPALAKAFLRFNVHLLT

SEQ ID NO: 379182 - protein, 19 aa, Mycobacterium
RHRAGNAVILVLMLVAATQ

SEQ ID NO: 379183 - protein, 24 aa, Mycobacterium
RIALVIVIFMPLLYGAMYLWAFWN

SEQ ID NO: 379184 - protein, 21 aa, Mycobacterium
RIDFEPYRLWKPPLDAPWSIE

SEQ ID NO: 379185 - protein, 26 aa, Mycobacterium
RIFSLPIVLLWVLLVVALGAIFPSLD

SEQ ID NO: 379186 - protein, 27 aa, Mycobacterium
RIKPAWWTWILIAALGVFFFTTGSLFA

SEQ ID NO: 379187 - protein, 33 aa, Mycobacterium
RIKRTLTVVRLLAPVLLPLLYKAAIAVRGVLDQ

SEQ ID NO: 379188 - protein, 17 aa, Mycobacterium
RILQFITYLLVPAGLLT

SEQ ID NO: 379189 - protein, 24 aa, Mycobacterium
RIPQLIQVWLLELFFVMPLTFFIG

SEQ ID NO: 379190 - protein, 25 aa, Mycobacterium
RIQFWSMLITFVLLLTVFATALLTT

SEQ ID NO: 379191 - protein, 18 aa, Mycobacterium
RIRWPMWLRTALATVALG

SEQ ID NO: 379192 - protein, 22 aa, Mycobacterium
RISLPLWVLLLSVPLATVYVGS

SEQ ID NO: 379193 - protein, 18 aa, Mycobacterium
RITRWFSARWRPGRSVYI

SEQ ID NO: 379194 - protein, 22 aa, Mycobacterium
RITSLVEDLLLLARLDSGRPLE

SEQ ID NO: 379195 - protein, 21 aa, Mycobacterium
RITVLWWILFTLIATYVLFKT

SEQ ID NO: 379196 - protein, 28 aa, Mycobacterium
RKLGYRLAWLYNVLFIVAVYGVARKAPR

SEQ ID NO: 379197 - protein, 28 aa, Mycobacterium
RKRLIINWLAAILVPPATALFIHFFDTA

SEQ ID NO: 379198 - protein, 18 aa, Mycobacterium
RKRMLMAMALVLVGSAVA

SEQ ID NO: 379199 - protein, 17 aa, Mycobacterium
RKRNLLIQIGLTAVVVI

SEQ ID NO: 379200 - protein, 17 aa, Mycobacterium
RKSLWALIPRPLRRLMG

SEQ ID NO: 379201 - protein, 29 aa, Mycobacterium
RKYRFRKRVLALFALILVASAAAAFLVTP

SEQ ID NO: 379202 - protein, 23 aa, Mycobacterium
RKYRWLVFTGWLLALVPAVYLAL

SEQ ID NO: 379203 - protein, 31 aa, Mycobacterium
RLADRYAAWFLPLSLLLASAAWLASGSAVRA

SEQ ID NO: 379204 - protein, 17 aa, Mycobacterium
RLALMLLTALRSGMPPE

SEQ ID NO: 379205 - protein, 21 aa, Mycobacterium
RLARRLLPQRALTLAVILLGV

SEQ ID NO: 379206 - protein, 24 aa, Mycobacterium
RLEALLLLVALIASLFLIPATAVV

SEQ ID NO: 379207 - protein, 17 aa, Mycobacterium
RLEALWRGSLVVFQSIL

SEQ ID NO: 379208 - protein, 17 aa, Mycobacterium
RLGALTIDWLIALGLAA

SEQ ID NO: 379209 - protein, 18 aa, Mycobacterium
RLGIFSLVLMLFSVMIII

SEQ ID NO: 379210 - protein, 20 aa, Mycobacterium
RLGLALLLAPGVPLLFVLGR

SEQ ID NO: 379211 - protein, 20 aa, Mycobacterium
RLGLVVLLLSRRRPLVQLLV

SEQ ID NO: 379212 - protein, 25 aa, Mycobacterium
RLGRGWLVGISAVLLLAAGGIGAGG

SEQ ID NO: 379213 - protein, 25 aa, Mycobacterium
RLGWGLWLLYVTVFAITILIGVRLM

SEQ ID NO: 379214 - protein, 24 aa, Mycobacterium
RLHDAWWTVILFAAIVAAILVTTV

SEQ ID NO: 379215 - protein, 26 aa, Mycobacterium
RLHRRLSGGLLLLIALTVAGGLAAVL

SEQ ID NO: 379216 - protein, 25 aa, Mycobacterium
RLIFSYHFLLLDGWSREQLLRELFA

SEQ ID NO: 379217 - protein, 30 aa, Mycobacterium
RLIISDRGYFIFLALLPFIMGTLSLSVPGT

SEQ ID NO: 379218 - protein, 18 aa, Mycobacterium
RLISWLFIAAIGWVVFFF

SEQ ID NO: 379219 - protein, 17 aa, Mycobacterium
RLIVLGLLGFGVLSGVA

SEQ ID NO: 379220 - protein, 18 aa, Mycobacterium
RLKTFLLLVGMSGLIVFV

SEQ ID NO: 379221 - protein, 28 aa, Mycobacterium
RLLAEMVHFFALLFWVAGGLAFIAGMPQ

SEQ ID NO: 379222 - protein, 20 aa, Mycobacterium
RLLAPILAPVIYRAAIAVRG

SEQ ID NO: 379223 - protein, 17 aa, Mycobacterium
RLLFPLLIVWVTAGLDP

SEQ ID NO: 379224 - protein, 19 aa, Mycobacterium
RLLGKMSGLPLGWFTGRGS

SEQ ID NO: 379225 - protein, 17 aa, Mycobacterium
RLLGLVMLPLIAKAARP

SEQ ID NO: 379226 - protein, 21 aa, Mycobacterium
RLLGPWFWWPTFIRQRPLRQA

SEQ ID NO: 379227 - protein, 23 aa, Mycobacterium
RLLGPWFWWPTFIRQRPLRTPDR

SEQ ID NO: 379228 - protein, 17 aa, Mycobacterium
RLLKLFGVGFIVGAAPP

SEQ ID NO: 379229 - protein, 18 aa, Mycobacterium
RLLRPLILLPLVLPPVVG

SEQ ID NO: 379230 - protein, 18 aa, Mycobacterium
RLNAFSYWLFLFGALITL

SEQ ID NO: 379231 - protein, 18 aa, Mycobacterium
RLNALSFWLFIFGALIAL

SEQ ID NO: 379232 - protein, 18 aa, Mycobacterium
RLNALSFWLFLFGASIAL

SEQ ID NO: 379233 - protein, 26 aa, Mycobacterium
RLPDGTPFPTLYYLTHPALTAAASRL

SEQ ID NO: 379234 - protein, 21 aa, Mycobacterium
RLPIVFALIALITFALLFLLT

SEQ ID NO: 379235 - protein, 27 aa, Mycobacterium
RLRRRLSGGLLLLIALTIAGGLAAVLT

SEQ ID NO: 379236 - protein, 17 aa, Mycobacterium
RLSIFSLVLLVFTVMII

SEQ ID NO: 379237 - protein, 21 aa, Mycobacterium
RLSRQLILLTLVLASVVAAAG

SEQ ID NO: 379238 - protein, 28 aa, Mycobacterium
RLTTWVRSWWHDLEFVQMWHVVAVAAIL

SEQ ID NO: 379239 - protein, 20 aa, Mycobacterium
RLVEDLLLLARLDSGRPLER

SEQ ID NO: 379240 - protein, 24 aa, Mycobacterium
RLVHTLIFTALRIAFLAVLVGTTL

SEQ ID NO: 379241 - protein, 29 aa, Mycobacterium
RLVNILVITPLRLLFLIVLVGTTVEALTE

SEQ ID NO: 379242 - protein, 26 aa, Mycobacterium
RLVVFAGFLLGLWYLVAVARVVDVEV

SEQ ID NO: 379243 - protein, 19 aa, Mycobacterium
RLVVLGLIMLPIIAGVLIA

SEQ ID NO: 379244 - protein, 17 aa, Mycobacterium
RLWGRKWAWMTGWVYMF

SEQ ID NO: 379245 - protein, 17 aa, Mycobacterium
RLWPSVIFLISAPVSLV

SEQ ID NO: 379246 - protein, 20 aa, Mycobacterium
RLWQAWVSPGIDYVEACPGL

SEQ ID NO: 379247 - protein, 17 aa, Mycobacterium
RMAFLAALLFTLALCWA

SEQ ID NO: 379248 - protein, 19 aa, Mycobacterium
RMLMTLMVESPFLLIRAAL

SEQ ID NO: 379249 - protein, 25 aa, Mycobacterium
RMVLVPAFIHWLGRWTWWAPKPLER

SEQ ID NO: 379250 - protein, 29 aa, Mycobacterium
RMVRAFAIPIILIWLLLTIAVNVFVPQIE

SEQ ID NO: 379251 - protein, 19 aa, Mycobacterium
RMWAIPIGVLSFVIALCAA

SEQ ID NO: 379252 - protein, 24 aa, Mycobacterium
RMYNALLEAVLWFLSRKTPRLMKW

SEQ ID NO: 379253 - protein, 18 aa, Mycobacterium
RNDLGLVLLLLAPAALVS

SEQ ID NO: 379254 - protein, 19 aa, Mycobacterium
RNEFRWILLVAGFTLFAAA

SEQ ID NO: 379255 - protein, 19 aa, Mycobacterium
RNLLIQIGLTAVVVIFAVA

SEQ ID NO: 379256 - protein, 22 aa, Mycobacterium
RNLTLYITALLFVLAWATSGIN

SEQ ID NO: 379257 - protein, 21 aa, Mycobacterium
RNLTLYVTALLFVLAWATSGI

SEQ ID NO: 379258 - protein, 26 aa, Mycobacterium
RNPEVWSWIVWLPHNLHDELFDACGF

SEQ ID NO: 379259 - protein, 25 aa, Mycobacterium
RNPEVWSWMVWLPHNLHDELFDACG

SEQ ID NO: 379260 - protein, 23 aa, Mycobacterium
RNPKPAIVVVILLAVATAVVWTV

SEQ ID NO: 379261 - protein, 22 aa, Mycobacterium
RNPLSRWLVGLAALVVLTIIVT

SEQ ID NO: 379262 - protein, 17 aa, Mycobacterium
RNPWMLLGAAALVALIV

SEQ ID NO: 379263 - protein, 23 aa, Mycobacterium
RNRMAFLSLVLFVLAFCFASTNG

SEQ ID NO: 379264 - protein, 20 aa, Mycobacterium
RNRMPPQRLALVMGSVAAVT

SEQ ID NO: 379265 - protein, 18 aa, Mycobacterium
RNRPGWEWLKWLPHNQHP

SEQ ID NO: 379266 - protein, 25 aa, Mycobacterium
RNRPRLPLALVGSAAAAVLCLGGFG

SEQ ID NO: 379267 - protein, 23 aa, Mycobacterium
RNRPRWWICYALALALSILLNVN

SEQ ID NO: 379268 - protein, 19 aa, Mycobacterium
RNVDIPGLGWYRVVSHPGD

SEQ ID NO: 379269 - protein, 21 aa, Mycobacterium
RPAMLLFGLVPLALLAVYVVV

SEQ ID NO: 379270 - protein, 17 aa, Mycobacterium
RPAWIGWWVALGLAAAV

SEQ ID NO: 379271 - protein, 23 aa, Mycobacterium
RPGLPLYFWVYLAALIAACLAVA

SEQ ID NO: 379272 - protein, 24 aa, Mycobacterium
RPGMLLFGLLPLALLAVYILVQGR

SEQ ID NO: 379273 - protein, 22 aa, Mycobacterium
RPLLERFLARRLLIKDLRDGEV

SEQ ID NO: 379274 - protein, 23 aa, Mycobacterium
RPPVTSRWRWVPAFFGWFVGIQA

SEQ ID NO: 379275 - protein, 26 aa, Mycobacterium
RPQNRPLWVFLLVPVLILLTVSGRWL

SEQ ID NO: 379276 - protein, 25 aa, Mycobacterium
RPQRLFYLLIHLLDPLISLESLYRY

SEQ ID NO: 379277 - protein, 20 aa, Mycobacterium
RPQWFLLPTLLIIGFRLCYG

SEQ ID NO: 379278 - protein, 27 aa, Mycobacterium
RPQYRPLWVFLLLPVLILLTVSGRWLY

SEQ ID NO: 379279 - protein, 17 aa, Mycobacterium
RPRLRPLASYNKTWLGF

SEQ ID NO: 379280 - protein, 18 aa, Mycobacterium
RPRYAYAFGFIDQAARLA

SEQ ID NO: 379281 - protein, 23 aa, Mycobacterium
RPSTFLWLIAVTGTLLVINHRMD

SEQ ID NO: 379282 - protein, 22 aa, Mycobacterium
RPSTFLWLIVLAGTLLTVTGRM

SEQ ID NO: 379283 - protein, 23 aa, Mycobacterium
RPVGLTLLWPLADRPRLAPGQPG

SEQ ID NO: 379284 - protein, 20 aa, Mycobacterium
RPVPVPVLAPPVFVPPPRVP

SEQ ID NO: 379285 - protein, 20 aa, Mycobacterium
RPYFTGYLPALLLAAILTPA

SEQ ID NO: 379286 - protein, 23 aa, Mycobacterium
RQETWLMIVLGVGFGLGVALTLS

SEQ ID NO: 379287 - protein, 25 aa, Mycobacterium
RQFHHPLIYVLLVAGAITAGLQEYI

SEQ ID NO: 379288 - protein, 18 aa, Mycobacterium
RQLFLVQLWFEPYFDGTS

SEQ ID NO: 379289 - protein, 18 aa, Mycobacterium
RQLLAEYLLPICPPPRAT

SEQ ID NO: 379290 - protein, 26 aa, Mycobacterium
RQPHRALVVWISFAAALVAVGALAGC

SEQ ID NO: 379291 - protein, 24 aa, Mycobacterium
RQQLFLSSLLRSLISKDTFFSLSK

SEQ ID NO: 379292 - protein, 24 aa, Mycobacterium
RQRWIYPVLVVLWAAAGTYITTAP

SEQ ID NO: 379293 - protein, 27 aa, Mycobacterium
RQVTLLRNFLLPLGALLLFLVKASQVP

SEQ ID NO: 379294 - protein, 21 aa, Mycobacterium
RQWGFFILLILLIAPPLNQWF

SEQ ID NO: 379295 - protein, 18 aa, Mycobacterium
RRAMPYLMGILIVGMIVA

SEQ ID NO: 379296 - protein, 19 aa, Mycobacterium
RRARARWFPWFRRARRSRR

SEQ ID NO: 379297 - protein, 22 aa, Mycobacterium
RRARGRLVAWISLAAAVVVIAA

SEQ ID NO: 379298 - protein, 22 aa, Mycobacterium
RRELPALFLLASLVAVVFAGGV

SEQ ID NO: 379299 - protein, 29 aa, Mycobacterium
RREQRNWLRRLWLAMPLALLASVSTMVFG

SEQ ID NO: 379300 - protein, 29 aa, Mycobacterium
RRERRKWWRRVWLAFPLGLVAMASTMFFG

SEQ ID NO: 379301 - protein, 18 aa, Mycobacterium
RRFAVLVLLLCLFGSLVV

SEQ ID NO: 379302 - protein, 20 aa, Mycobacterium
RRFMSFGLVFLILNGLQITV

SEQ ID NO: 379303 - protein, 31 aa, Mycobacterium
RRFRRHPLGVAWLIALAVIPLLMAAIGYGAF

SEQ ID NO: 379304 - protein, 28 aa, Mycobacterium
RRFRWAVFAVWLLLLLPSVYLAMNQAGN

SEQ ID NO: 379305 - protein, 22 aa, Mycobacterium
RRFRWLVFTGWMLALVPAIYLA

SEQ ID NO: 379306 - protein, 18 aa, Mycobacterium
RRFSVLILLVCLFGVIAL

SEQ ID NO: 379307 - protein, 17 aa, Mycobacterium
RRGQRWVWWCLLLGCAC

SEQ ID NO: 379308 - protein, 23 aa, Mycobacterium
RRHETWLMMLLGAGFGLGVALTL

SEQ ID NO: 379309 - protein, 18 aa, Mycobacterium
RRIAVFILLLCLFGTLAV

SEQ ID NO: 379310 - protein, 23 aa, Mycobacterium
RRKRFWLSLYVPVIMRVACSAIV

SEQ ID NO: 379311 - protein, 18 aa, Mycobacterium
RRKVLFLTLLLIGTATAL

SEQ ID NO: 379312 - protein, 23 aa, Mycobacterium
RRLIVRWWIAWVASYLVSVFAMF

SEQ ID NO: 379313 - protein, 20 aa, Mycobacterium
RRLLALLIDWLIAGGLALLF

SEQ ID NO: 379314 - protein, 22 aa, Mycobacterium
RRLLAMVLLLLVVAPSLIGCVR

SEQ ID NO: 379315 - protein, 28 aa, Mycobacterium
RRLRRRLSGGLLLLIALTIAGGVAAVLT

SEQ ID NO: 379316 - protein, 17 aa, Mycobacterium
RRLWLAMIIVAPASIWL

SEQ ID NO: 379317 - protein, 26 aa, Mycobacterium
RRMSPMMLMFPLMFLMAAGGMMAGHG

SEQ ID NO: 379318 - protein, 19 aa, Mycobacterium
RRMVLIWVAAVLALTGLVA

SEQ ID NO: 379319 - protein, 23 aa, Mycobacterium
RRNLVVFGLLGFGLVGGVVGAVI

SEQ ID NO: 379320 - protein, 26 aa, Mycobacterium
RRNPRPAIIVVILLVVLTGVVWTVAL

SEQ ID NO: 379321 - protein, 26 aa, Mycobacterium
RRNPRPAIVVVILLAIATAAAWTVAL

SEQ ID NO: 379322 - protein, 26 aa, Mycobacterium
RRNPVLVFLGYFWAPIPWMIEAALVL

SEQ ID NO: 379323 - protein, 23 aa, Mycobacterium
RRNVWLIVAAVAVVFVLLGSGLG

SEQ ID NO: 379324 - protein, 18 aa, Mycobacterium
RRPALGWVLFTVLIGWSA

SEQ ID NO: 379325 - protein, 18 aa, Mycobacterium
RRPVPPSSLPLPPPSPPA

SEQ ID NO: 379326 - protein, 17 aa, Mycobacterium
RRQLRLIISDRGYFIFL

SEQ ID NO: 379327 - protein, 20 aa, Mycobacterium
RRRMIIAAVLVVLVVVAGLA

SEQ ID NO: 379328 - protein, 27 aa, Mycobacterium
RRRRLVGTWPLIAPLLAAGTVILAVVF

SEQ ID NO: 379329 - protein, 20 aa, Mycobacterium
RRRRQFQLRPAESGPRRQRR

SEQ ID NO: 379330 - protein, 32 aa, Mycobacterium
RRRRVFRIGLQSKLLLTLLLCSILSIGVIGFI

SEQ ID NO: 379331 - protein, 17 aa, Mycobacterium
RRRSLLTIGLLAAGAVS

SEQ ID NO: 379332 - protein, 23 aa, Mycobacterium
RRRSWRWVVVILLVLAVIAGVDA

SEQ ID NO: 379333 - protein, 17 aa, Mycobacterium
RRRVAIAFVWWADISMV

SEQ ID NO: 379334 - protein, 17 aa, Mycobacterium
RRTDWVRLILPYAGFFG

SEQ ID NO: 379335 - protein, 18 aa, Mycobacterium
RRWGWLALTTALAGWAIG

SEQ ID NO: 379336 - protein, 23 aa, Mycobacterium
RSAFHRFFANRWLWAAIGLSALL

SEQ ID NO: 379337 - protein, 17 aa, Mycobacterium
RSFIVPALVRLLGTWFW

SEQ ID NO: 379338 - protein, 26 aa, Mycobacterium
RSFVDLRWWPLALLIGLTLALVTLAA

SEQ ID NO: 379339 - protein, 27 aa, Mycobacterium
RSGSGWIWWFGGAWLVAAVVGAGVILF

SEQ ID NO: 379340 - protein, 23 aa, Mycobacterium
RSISLGWLLLVLPACTLSYFGQG

SEQ ID NO: 379341 - protein, 22 aa, Mycobacterium
RSKRRLVVGILLAVALVAALTV

SEQ ID NO: 379342 - protein, 21 aa, Mycobacterium
RSLLARIPWPSILLLCGLLTY

SEQ ID NO: 379343 - protein, 26 aa, Mycobacterium
RSLLISLLRPYRWIVAVLALVVIVEN

SEQ ID NO: 379344 - protein, 20 aa, Mycobacterium
RSLRRWRPRYAYAFGFIDQA

SEQ ID NO: 379345 - protein, 19 aa, Mycobacterium
RSLVWIGWVWPLTAAIFVT

SEQ ID NO: 379346 - protein, 20 aa, Mycobacterium
RSPRQLALFAQGFLLMGGFV

SEQ ID NO: 379347 - protein, 17 aa, Mycobacterium
RSQALLYTSMLVQAYQA

SEQ ID NO: 379348 - protein, 20 aa, Mycobacterium
RSQRWWWGTVLLAASIGLQA

SEQ ID NO: 379349 - protein, 20 aa, Mycobacterium
RSRLAFGLLAALLCLLLGIA

SEQ ID NO: 379350 - protein, 20 aa, Mycobacterium
RSRRGLLRRPKLSTLTAALA

SEQ ID NO: 379351 - protein, 17 aa, Mycobacterium
RSRRRMIIAAVLVVLVV

SEQ ID NO: 379352 - protein, 25 aa, Mycobacterium
RSRWLRPVLICVLVAVLAIGAYLVW

SEQ ID NO: 379353 - protein, 25 aa, Mycobacterium
RSTHRALLLVTFGGLFIAGVTQALP

SEQ ID NO: 379354 - protein, 23 aa, Mycobacterium
RSYFAFLAILPFVLAGLTLLIPG

SEQ ID NO: 379355 - protein, 20 aa, Mycobacterium
RTANWWFALLGLAVSALTYV

SEQ ID NO: 379356 - protein, 21 aa, Mycobacterium
RTETPALWIFLGCYIGFAVLT

SEQ ID NO: 379357 - protein, 17 aa, Mycobacterium
RTIIIWKKKPSTSTHTP

SEQ ID NO: 379358 - protein, 19 aa, Mycobacterium
RTIVSPAWFSDYVLAVAAV

SEQ ID NO: 379359 - protein, 20 aa, Mycobacterium
RTLLLWMLPLLIAPPMYSKD

SEQ ID NO: 379360 - protein, 19 aa, Mycobacterium
RTLLLWVLPLLIAPPMYSK

SEQ ID NO: 379361 - protein, 18 aa, Mycobacterium
RTSPPWAFFSLPTRAWEL

SEQ ID NO: 379362 - protein, 30 aa, Mycobacterium
RTSRQFNWGWILAIVVIVLALAAIAILGTV

SEQ ID NO: 379363 - protein, 19 aa, Mycobacterium
RTSRWPWLVLGAIAVAAVG

SEQ ID NO: 379364 - protein, 17 aa, Mycobacterium
RTSWGWGWITIGLVAIV

SEQ ID NO: 379365 - protein, 22 aa, Mycobacterium
RTTTLTLIYPTLSLPSWSAGSR

SEQ ID NO: 379366 - protein, 29 aa, Mycobacterium
RTVTPPWVIALLVFVAIGGGILFVVGERI

SEQ ID NO: 379367 - protein, 20 aa, Mycobacterium
RTWRWHLIWLPAAAAVGAVL

SEQ ID NO: 379368 - protein, 25 aa, Mycobacterium
RTWWPPPNWVLLWAKTLIVGGSIAS

SEQ ID NO: 379369 - protein, 25 aa, Mycobacterium
RTYLHTAWWLSFFPGLAIVITTVSA

SEQ ID NO: 379370 - protein, 36 aa, Mycobacterium; identical to SEQ ID NO: 328010

SEQ ID NO: 379371 - protein, 24 aa, Mycobacterium
RVALVLLIPVLMYLVMTSSLAVQS

SEQ ID NO: 379372 - protein, 22 aa, Mycobacterium
RVAMHFLPRWLPNPLRRSGEEA

SEQ ID NO: 379373 - protein, 23 aa, Mycobacterium
RVANLELYLIFPLANEQATITLV

SEQ ID NO: 379374 - protein, 18 aa, Mycobacterium
RVAWLWAVLAFAGVAMLG

SEQ ID NO: 379375 - protein, 20 aa, Mycobacterium
RVEYLLPGYALPVALATTML

SEQ ID NO: 379376 - protein, 21 aa, Mycobacterium
RVFSWLPFYHDMGFIQVLAAL

SEQ ID NO: 379377 - protein, 25 aa, Mycobacterium
RVGRKPLWWFSLAGLFVAGLPMFML

SEQ ID NO: 379378 - protein, 25 aa, Mycobacterium
RVGRKPLWWFSLIGLFVAGIPAFLL

SEQ ID NO: 379379 - protein, 23 aa, Mycobacterium
RVGWRWRLVWYRAVSELLTGAYD

SEQ ID NO: 379380 - protein, 22 aa, Mycobacterium
RVHFDLDPLLPFPRWHEHAAVV

SEQ ID NO: 379381 - protein, 20 aa, Mycobacterium
RVHLDLDPLLPFPRWHEHAA

SEQ ID NO: 379382 - protein, 17 aa, Mycobacterium
RVHVHVPYWLPSQIGPA

SEQ ID NO: 379383 - protein, 18 aa, Mycobacterium
RVLALPAGSKRQIALPFT

SEQ ID NO: 379384 - protein, 20 aa, Mycobacterium
RVLLFLPPAWLLGTGMLGIA

SEQ ID NO: 379385 - protein, 18 aa, Mycobacterium
RVLLVGLAVIVAWLLIVM

SEQ ID NO: 379386 - protein, 20 aa, Mycobacterium
RVLQFLFVAWIGSLGAAFYF

SEQ ID NO: 379387 - protein, 26 aa, Mycobacterium
RVLQKAWIPLLLVVVLALSALVVSRL

SEQ ID NO: 379388 - protein, 17 aa, Mycobacterium
RVMLIIALVFLALGYST

SEQ ID NO: 379389 - protein, 17 aa, Mycobacterium
RVPFVVFVIGALGVGLA

SEQ ID NO: 379390 - protein, 18 aa, Mycobacterium
RVPMPIVPVSSLLRSHAV

SEQ ID NO: 379391 - protein, 17 aa, Mycobacterium
RVRLFLIGVPILIGVLA

SEQ ID NO: 379392 - protein, 20 aa, Mycobacterium
RVRLQKALPPLWADEQRLSQ

SEQ ID NO: 379393 - protein, 19 aa, Mycobacterium
RVRLQTTLPPLWADEQRLS

SEQ ID NO: 379394 - protein, 25 aa, Mycobacterium
RVSIPALAILAAVALLIGLVGGIIG

SEQ ID NO: 379395 - protein, 23 aa, Mycobacterium
RVTRWEWIWAVLLAGAVAVIVTV

SEQ ID NO: 379396 - protein, 24 aa, Mycobacterium
RVVGLILLLILVAAALRGYLPVAD

SEQ ID NO: 379397 - protein, 19 aa, Mycobacterium
RVVLPLWVLLLSVPLATVY

SEQ ID NO: 379398 - protein, 18 aa, Mycobacterium
RWAAALILAVVLAGAGYE

SEQ ID NO: 379399 - protein, 28 aa, Mycobacterium
RWAGIVWAYALFWFLIEDRVKLGAYHWL

SEQ ID NO: 379400 - protein, 27 aa, Mycobacterium
RWAQHAHWMWWTWPAAAAAGIAGLTLL

SEQ ID NO: 379401 - protein, 21 aa, Mycobacterium
RWFFWAAFAVATLLIAGVVSS

SEQ ID NO: 379402 - protein, 17 aa, Mycobacterium
RWFPWFRRARRSRRWAR

SEQ ID NO: 379403 - protein, 18 aa, Mycobacterium
RWFWWPAVVHDRAASRDT

SEQ ID NO: 379404 - protein, 18 aa, Mycobacterium
RWGLIAVGLFQVAIAAAQ

SEQ ID NO: 379405 - protein, 18 aa, Mycobacterium
RWILLVAGFTLFAAADTL

SEQ ID NO: 379406 - protein, 28 aa, Mycobacterium
RWIRRLAVPIILGWLLLAVALNALVPQL

SEQ ID NO: 379407 - protein, 24 aa, Mycobacterium
RWLPRSLRRQLLLGVLAVVSVVLM

SEQ ID NO: 379408 - protein, 17 aa, Mycobacterium
RWMHLLASNTRAFSAAP

SEQ ID NO: 379409 - protein, 31 aa, Mycobacterium
RWSIPGIAHFFTMWGFFILLTVYIEAYGFLF

SEQ ID NO: 379410 - protein, 30 aa, Mycobacterium
RWSIPGIAHFFTMWGFFVLATVYLEAFGLL

SEQ ID NO: 379411 - protein, 21 aa, Mycobacterium
RWVGVPLYLLLGWVAVWYTAT

SEQ ID NO: 379412 - protein, 17 aa, Mycobacterium
RWVPAFFGWFVGIQAIL

SEQ ID NO: 379413 - protein, 20 aa, Mycobacterium
RYLERLWVPWWWALPGFGAA

SEQ ID NO: 379414 - protein, 20 aa, Mycobacterium
RYLSVFLLLLVGVYLLVFLT

SEQ ID NO: 379415 - protein, 22 aa, Mycobacterium
RYRRWLHIVGPRHWQWCLIAVG

SEQ ID NO: 379416 - protein, 17 aa, Mycobacterium
RYSVYVWALLAMVAARM

SEQ ID NO: 379417 - protein, 24 aa, Mycobacterium
SAAALLVWRLRWASAGGWLAPTIF

SEQ ID NO: 379418 - protein, 22 aa, Mycobacterium
SAAGLVFGLWPKGLDAVLEDYA

SEQ ID NO: 379419 - protein, 17 aa, Mycobacterium
SAFIPWLATINPDNGQP

SEQ ID NO: 379420 - protein, 22 aa, Mycobacterium
SAFTLIPYALVLLGLRVFYARE

SEQ ID NO: 379421 - protein, 24 aa, Mycobacterium
SAIGWILTIIGYIALFFVVAYMHA

SEQ ID NO: 379422 - protein, 22 aa, Mycobacterium
SAIGWVIFFFLFRDESQIDPDA

SEQ ID NO: 379423 - protein, 20 aa, Mycobacterium
SALASWLPPGPVPVADYPTV

SEQ ID NO: 379424 - protein, 17 aa, Mycobacterium
SALLRRAVAPPGTLTVP

SEQ ID NO: 379425 - protein, 19 aa, Mycobacterium
SALPRWLWTRGSALVSAMW

SEQ ID NO: 379426 - protein, 17 aa, Mycobacterium
SALRWLPDSLTAGGTRG

SEQ ID NO: 379427 - protein, 20 aa, Mycobacterium
SAMLIYRLISWLLIAAVGWV

SEQ ID NO: 379428 - protein, 19 aa, Mycobacterium
SAMLIYRLISWLLISAIGW

SEQ ID NO: 379429 - protein, 30 aa, Mycobacterium
SAPPRPRLPWFLRTFAVPIILAWVAVVAIL

SEQ ID NO: 379430 - protein, 17 aa, Mycobacterium
SARARWAVALVCAMLVA

SEQ ID NO: 379431 - protein, 25 aa, Mycobacterium
SASDLSYRFVLPTTTKPLGPGTNMA

SEQ ID NO: 379432 - protein, 25 aa, Mycobacterium
SASIPWKPVLGALAFGAVLVGAFML

SEQ ID NO: 379433 - protein, 18 aa, Mycobacterium
SATRWLGCLLACALAGAV

SEQ ID NO: 379434 - protein, 24 aa, Mycobacterium
SATTYPWVFLFPAGVLVLILVCAN

SEQ ID NO: 379435 - protein, 18 aa, Mycobacterium
SAVLHGVWILLFASLFTG

SEQ ID NO: 379436 - protein, 20 aa, Mycobacterium
SAVWLWVAIALTVALIGWYT

SEQ ID NO: 379437 - protein, 24 aa, Mycobacterium
SDIYSLGCALFRLLTSHTPYEDNS

SEQ ID NO: 379438 - protein, 26 aa, Mycobacterium
SDRGYTVFLALLPFLIGVLSLTVRGK

SEQ ID NO: 379439 - protein, 21 aa, Mycobacterium
SDWWLLLGLFVLFPMTFFGAN

SEQ ID NO: 379440 - protein, 25 aa, Mycobacterium
SETLPMMLAPWVLLPLILTFQGRMS

SEQ ID NO: 379441 - protein, 26 aa, Mycobacterium
SETLPMMLAPWVLLPTILALRGTSGR

SEQ ID NO: 379442 - protein, 25 aa, Mycobacterium
SFDSWGWRLPFLAAFPLLGVALWIR

SEQ ID NO: 379443 - protein, 18 aa, Mycobacterium
SFFPLLMVGGLVAMLFGG

SEQ ID NO: 379444 - protein, 24 aa, Mycobacterium
SFGWQWIFLINLPIGVLTLVLAVV

SEQ ID NO: 379445 - protein, 25 aa, Mycobacterium
SFIKFTLVMGLPWLAAVTAVYAVFR

SEQ ID NO: 379446 - protein, 18 aa, Mycobacterium
SFNLNLNWPPPCTTGFLP

SEQ ID NO: 379447 - protein, 20 aa, Mycobacterium
SFPLQLPWLPLTAPLAALAV

SEQ ID NO: 379448 - protein, 19 aa, Mycobacterium
SFWLFLFGALIGIAGFITP

SEQ ID NO: 379449 - protein, 18 aa, Mycobacterium
SFWLFLFGASIALGGFLA

SEQ ID NO: 379450 - protein, 19 aa, Mycobacterium
SFWLFLFGGLVAMGGFIVP

SEQ ID NO: 379451 - protein, 24 aa, Mycobacterium
SGAVAWIIALFYKGIYVGGLINEV

SEQ ID NO: 379452 - protein, 30 aa, Mycobacterium
SGAVLLFGFLLPWLGVLAVVGVVIYGLIRW

SEQ ID NO: 379453 - protein, 23 aa, Mycobacterium
SGDRTVRLWSAEPGPLVGQSLTP

SEQ ID NO: 379454 - protein, 27 aa, Mycobacterium
SGFAHSWFFLFIFVIAGLIAVYVVLQL

SEQ ID NO: 379455 - protein, 25 aa, Mycobacterium
SGGVSLWWMIGLLAAAGVLGLMVVL

SEQ ID NO: 379456 - protein, 24 aa, Mycobacterium
SGGWFTLTVLFILAVIAVIVAVHI

SEQ ID NO: 379457 - protein, 20 aa, Mycobacterium
SGGYYQPLFRLDLSTGAIGQ

SEQ ID NO: 379458 - protein, 18 aa, Mycobacterium
SGHLLFALIGTGTVIAIH

SEQ ID NO: 379459 - protein, 28 aa, Mycobacterium
SGIFPRWFPSSLRRQLLLGVLAVVSVVL

SEQ ID NO: 379460 - protein, 29 aa, Mycobacterium
SGIRFWSRRAWLAWPLGLLASGLTMFFGA

SEQ ID NO: 379461 - protein, 24 aa, Mycobacterium
SGIYLASSLLLWAKGRLLNVIVQR

SEQ ID NO: 379462 - protein, 28 aa, Mycobacterium
SGLTMFFGAYAWAGWLAFAATIPVQFIA

SEQ ID NO: 379463 - protein, 24 aa, Mycobacterium
SGNRVWWILGTVIVIGVIALAGGI

SEQ ID NO: 379464 - protein, 22 aa, Mycobacterium
SGPLLLWFAIFFTFQAIAIRFW

SEQ ID NO: 379465 - protein, 23 aa, Mycobacterium
SGPMPWAPPPWTSPARRTRTPWL

SEQ ID NO: 379466 - protein, 18 aa, Mycobacterium
SGPWLFAALAVWGMFQGG

SEQ ID NO: 379467 - protein, 27 aa, Mycobacterium
SGPYFKVALLNLAPFWMTQPWVDAAFK

SEQ ID NO: 379468 - protein, 23 aa, Mycobacterium
SGPYFKVMLANLAPYWILQPFVD

SEQ ID NO: 379469 - protein, 18 aa, Mycobacterium
SGSLFMLVKHRDATRHRD

SEQ ID NO: 379470 - protein, 33 aa, Mycobacterium
SGSRFYFLTGFGALLQLGLFQLAVRTATENGFT

SEQ ID NO: 379471 - protein, 23 aa, Mycobacterium
SGTAWLVPMLYIAVALSVVLWAG

SEQ ID NO: 379472 - protein, 24 aa, Mycobacterium
SGTNLLWYIVISVASVLGLGAALT

SEQ ID NO: 379473 - protein, 24 aa, Mycobacterium
SGTVPLFFILWALSNFVGPLALGH

SEQ ID NO: 379474 - protein, 29 aa, Mycobacterium
SGVPWLVTVNWWVLLAAFVLFITPVGRMS

SEQ ID NO: 379475 - protein, 19 aa, Mycobacterium
SHFPTWLNLLGIFVPSIGA

SEQ ID NO: 379476 - protein, 34 aa, Mycobacterium
SHGSPWLLPLRWPMVEYFYLKYYLPRARSRPVAE

SEQ ID NO: 379477 - protein, 18 aa, Mycobacterium
SHMLMIGYFLVSGSLFFA

SEQ ID NO: 379478 - protein, 23 aa, Mycobacterium
SHQHPWLRVFSITLMFAGVTTTA

SEQ ID NO: 379479 - protein, 21 aa, Mycobacterium
SHRWVLLKGRLVAGIASAFVM

SEQ ID NO: 379480 - protein, 17 aa, Mycobacterium
SIAFLPNVGIAAAAAIV

SEQ ID NO: 379481 - protein, 25 aa, Mycobacterium
SIATLLGRWFWWPMRVPCRAFRETD

SEQ ID NO: 379482 - protein, 25 aa, Mycobacterium
SIATLLGRWFWWPQVVYPRGDNHFR

SEQ ID NO: 379483 - protein, 22 aa, Mycobacterium
SIAWWVLLIDLLGRSALNVGGF

SEQ ID NO: 379484 - protein, 28 aa, Mycobacterium
SIFGTLLIYMLPLLLLVALFVLFSRMQS

SEQ ID NO: 379485 - protein, 17 aa, Mycobacterium
SIFLPTYLVLSAGVFMA

SEQ ID NO: 379486 - protein, 23 aa, Mycobacterium
SIFPIFMMVGIMMMMFRSVGAGG

SEQ ID NO: 379487 - protein, 34 aa, Mycobacterium
SILGSLLLYLLPVILLVVLFFAFSRMQSGGRGMG

SEQ ID NO: 379488 - protein, 17 aa, Mycobacterium
SILLLIAGGVFAVVKLT

SEQ ID NO: 379489 - protein, 23 aa, Mycobacterium
SIPGWLWFLLLLGAVTATFAGGT

SEQ ID NO: 379490 - protein, 19 aa, Mycobacterium
SIPSWWQPYVLSVASLTPD

SEQ ID NO: 379491 - protein, 24 aa, Mycobacterium
SISALARRFWIPLLIGAVVFVGAF

SEQ ID NO: 379492 - protein, 23 aa, Mycobacterium
SIVRRKWSLARRSLLALLVGFPV

SEQ ID NO: 379493 - protein, 22 aa, Mycobacterium
SKPLFYEPGASWYWLLAGPIAA

SEQ ID NO: 379494 - protein, 26 aa, Mycobacterium
SKRKKAICTVLFPLTMRWLAGEIMTP

SEQ ID NO: 379495 - protein, 22 aa, Mycobacterium
SKVALYLLITIAPFAVIAPLIG

SEQ ID NO: 379496 - protein, 25 aa, Mycobacterium
SLAAQFLVFQLFVVAVVLVAVAAVS

SEQ ID NO: 379497 - protein, 31 aa, Mycobacterium
SLADPLYLAFYPFGYAGLLLLMRARLKRVPV

SEQ ID NO: 379498 - protein, 23 aa, Mycobacterium
SLADTLWSLRRLGYRSRPLWRPF

SEQ ID NO: 379499 - protein, 21 aa, Mycobacterium
SLAMAMLWLREHWPTRAQSLA

SEQ ID NO: 379500 - protein, 27 aa, Mycobacterium
SLAPAMFVFLPIALLTNLLAGQARSQT

SEQ ID NO: 379501 - protein, 25 aa, Mycobacterium
SLAVGLIMFFLIGRPLALINTGLTN

SEQ ID NO: 379502 - protein, 24 aa, Mycobacterium
SLCLIFIIMLILTRALIAATVIVG

SEQ ID NO: 379503 - protein, 24 aa, Mycobacterium
SLCLIFIIMLLITRGVVASAVIVG

SEQ ID NO: 379504 - protein, 23 aa, Mycobacterium
SLCLIFIVMLILTRAFVAATVIV

SEQ ID NO: 379505 - protein, 21 aa, Mycobacterium
SLFNPILLLALTALGVGLIST

SEQ ID NO: 379506 - protein, 18 aa, Mycobacterium
SLFPLLLLLTTGLGVVLA

SEQ ID NO: 379507 - protein, 19 aa, Mycobacterium
SLFWEGILLLLQVPGELLA

SEQ ID NO: 379508 - protein, 20 aa, Mycobacterium
SLGAAPWERFFEPPPDDNIH

SEQ ID NO: 379509 - protein, 18 aa, Mycobacterium
SLGWQLWLYGVFAIIAVG

SEQ ID NO: 379510 - protein, 18 aa, Mycobacterium
SLHFLVLVYFLFFILVHV

SEQ ID NO: 379511 - protein, 18 aa, Mycobacterium
SLHQWLNLTLAVGGGLVV

SEQ ID NO: 379512 - protein, 22 aa, Mycobacterium
SLILIIMLIITRSLVAAVTIVG

SEQ ID NO: 379513 - protein, 21 aa, Mycobacterium
SLILIIMLIITRSLVAAVVIV

SEQ ID NO: 379514 - protein, 18 aa, Mycobacterium
SLILLIMMIITRSLIAAL

SEQ ID NO: 379515 - protein, 18 aa, Mycobacterium
SLLKTIIFVWIASTVQCY

SEQ ID NO: 379516 - protein, 17 aa, Mycobacterium
SLLLLLFPHLALAPYMR

SEQ ID NO: 379517 - protein, 21 aa, Mycobacterium
SLLPVLVLLVLWRARRRGPDD

SEQ ID NO: 379518 - protein, 20 aa, Mycobacterium
SLLRLPRLPDLVAVPPTLID

SEQ ID NO: 379519 - protein, 20 aa, Mycobacterium
SLPLSFWLYSGFTAITMIGF

SEQ ID NO: 379520 - protein, 23 aa, Mycobacterium
SLPSFTIILWNLSGPLNIFGYEM

SEQ ID NO: 379521 - protein, 21 aa, Mycobacterium
SLRDFLLLFFFLDLGARLEFT

SEQ ID NO: 379522 - protein, 18 aa, Mycobacterium
SLRLHPMLDKLLFESQFT

SEQ ID NO: 379523 - protein, 25 aa, Mycobacterium
SLRQRLLISLVLTVPVILMAMVPRL

SEQ ID NO: 379524 - protein, 28 aa, Mycobacterium
SLSGFEHAWFFLFLLVVAGLAALYIVMQ

SEQ ID NO: 379525 - protein, 31 aa, Mycobacterium
SLSGFEHPWFFLFFFVVIGLVALYIVVQLAR

SEQ ID NO: 379526 - protein, 32 aa, Mycobacterium
SLSGFEHSWFFLFLLVVFGLAALYILMQLARQ

SEQ ID NO: 379527 - protein, 29 aa, Mycobacterium
SLVDWVSPVSWWWVLAGFLVFVTPPGRMS

SEQ ID NO: 379528 - protein, 23 aa, Mycobacterium
SLVILLLVFRSILIPLKATLGFL

SEQ ID NO: 379529 - protein, 19 aa, Mycobacterium
SLVILPALFSALLTVAGGA

SEQ ID NO: 379530 - protein, 27 aa, Mycobacterium
SLVRLFGTWFWWPTRVFARPLRRQNVG

SEQ ID NO: 379531 - protein, 22 aa, Mycobacterium
SLVTAWLTPFGPVALGLKVVAL

SEQ ID NO: 379532 - protein, 17 aa, Mycobacterium
SLVWLQIAIGVGVLVLV

SEQ ID NO: 379533 - protein, 20 aa, Mycobacterium
SLWALIPRPLRRLMGPALIL

SEQ ID NO: 379534 - protein, 22 aa, Mycobacterium
SLWYPHYAWLMLTIYLATAVVA

SEQ ID NO: 379535 - protein, 19 aa, Mycobacterium
SLYHYFPNKSELLDAVAED

SEQ ID NO: 379536 - protein, 20 aa, Mycobacterium
SMAIPFFYRPVKLTGADGST

SEQ ID NO: 379537 - protein, 18 aa, Mycobacterium
SMEWIPFVTFLQVSADMA

SEQ ID NO: 379538 - protein, 25 aa, Mycobacterium
SMGTALVLLFLLALGAIPGALLPQR

SEQ ID NO: 379539 - protein, 17 aa, Mycobacterium
SMLALWCYVAIGLSGII

SEQ ID NO: 379540 - protein, 18 aa, Mycobacterium
SMLLGLIFLLWAGPGRWS

SEQ ID NO: 379541 - protein, 20 aa, Mycobacterium
SMLLYIMCWWRHLRPEVPAP

SEQ ID NO: 379542 - protein, 18 aa, Mycobacterium
SMRLILLVTFAVIVVMLL

SEQ ID NO: 379543 - protein, 17 aa, Mycobacterium
SMRPYFDLFFMGAAFLL

SEQ ID NO: 379544 - protein, 24 aa, Mycobacterium
SNGWKIFRNVMIALVLLAIVIPLA

SEQ ID NO: 379545 - protein, 18 aa, Mycobacterium
SNLLFLWERHRVGELLDA

SEQ ID NO: 379546 - protein, 25 aa, Mycobacterium
SNNFTVPLLVAVALSLLAMLLVRQL

SEQ ID NO: 379547 - protein, 18 aa, Mycobacterium
SNTCAMGMLLSKLPYNRG

SEQ ID NO: 379548 - protein, 17 aa, Mycobacterium
SNTFWLWVVGIGALVVI

SEQ ID NO: 379549 - protein, 24 aa, Mycobacterium
SPADFFYLVFTILAVLSVLTMARY

SEQ ID NO: 379550 - protein, 20 aa, Mycobacterium
SPFLLVAAVIFVPMLDLLLA

SEQ ID NO: 379551 - protein, 17 aa, Mycobacterium
SPPPPRWVWPPLIAVGG

SEQ ID NO: 379552 - protein, 21 aa, Mycobacterium
SPSARWWVVFGPLPVITAIWA

SEQ ID NO: 379553 - protein, 24 aa, Mycobacterium
SPSPAPWLALRLLAAGPALSRSDA

SEQ ID NO: 379554 - protein, 25 aa, Mycobacterium
SPSRKIAMRLLYATGALFAAVLIVY

SEQ ID NO: 379555 - protein, 28 aa, Mycobacterium
SPTAPSHPRWWFLWTTPGRILSIGMVLA

SEQ ID NO: 379556 - protein, 24 aa, Mycobacterium
SPVGLLVIVLLVVATLFLVRSMNR

SEQ ID NO: 379557 - protein, 23 aa, Mycobacterium
SQAVLPALLWTPVATLAATAVYV

SEQ ID NO: 379558 - protein, 20 aa, Mycobacterium
SQEFTEPEMWFLCKAHQVCP

SEQ ID NO: 379559 - protein, 20 aa, Mycobacterium
SQFFMVYRDSALPPEYTVFG

SEQ ID NO: 379560 - protein, 24 aa, Mycobacterium
SQFIWWLGVLYILYTFLPLLVSGI

SEQ ID NO: 379561 - protein, 18 aa, Mycobacterium
SQLLLLSLFLLAPYARRL

SEQ ID NO: 379562 - protein, 21 aa, Mycobacterium
SQLLYLRVPALHALFPDYRTS

SEQ ID NO: 379563 - protein, 23 aa, Mycobacterium
SQRLLPYRWIAVGVLVILAIVFT

SEQ ID NO: 379564 - protein, 20 aa, Mycobacterium
SRDFRLWLRSYRTAINSLTS

SEQ ID NO: 379565 - protein, 24 aa, Mycobacterium
SRGMKLRWFVVLVGVTLMAFGAVI

SEQ ID NO: 379566 - protein, 20 aa, Mycobacterium
SRLGFGTLAVLLCLLLGIAI

SEQ ID NO: 379567 - protein, 26 aa, Mycobacterium
SRNPMFLFFPAMMAVSLIGTLAYGSR

SEQ ID NO: 379568 - protein, 18 aa, Mycobacterium
SRPMPLRNMAMGLTAGVL

SEQ ID NO: 379569 - protein, 26 aa, Mycobacterium
SRPQRLFYLLIHLLDPFISLESLYRY

SEQ ID NO: 379570 - protein, 28 aa, Mycobacterium
SRRDPLSIFLILIIVFSLVLAGVIASEL

SEQ ID NO: 379571 - protein, 17 aa, Mycobacterium
SRRLWQAWVSPGIDYVE

SEQ ID NO: 379572 - protein, 39 aa, Mycobacterium
SRRRLRMPPLSVTWKVAVILLICAFVAASGYMMWNRHEV

SEQ ID NO: 379573 - protein, 23 aa, Mycobacterium
SRRWWAWMLLAGPGWVIFGAAKQ

SEQ ID NO: 379574 - protein, 22 aa, Mycobacterium
SRVFALPWRLATIQDLPAVDTP

SEQ ID NO: 379575 - protein, 23 aa, Mycobacterium
SRYAVLIIGLWVLLAGAGNLLVP

SEQ ID NO: 379576 - protein, 34 aa, Mycobacterium
SSDNYAGLIFWDTELWMYPNLLLAHPEIARNIID

SEQ ID NO: 379577 - protein, 18 aa, Mycobacterium
SSGDVFWWTLGTGLLVCV

SEQ ID NO: 379578 - protein, 37 aa, Mycobacterium
SSGRVALLVTLAIILAALAVLLLIMRYRRRRRRAADL

SEQ ID NO: 379579 - protein, 24 aa, Mycobacterium
SSGRVILLATLAGILIALAGLLLV

SEQ ID NO: 379580 - protein, 19 aa, Mycobacterium
SSHFFTWFDGLPTLLRRAV

SEQ ID NO: 379581 - protein, 24 aa, Mycobacterium
SSISILFLFFFQLVQGRLPLHLHD

SEQ ID NO: 379582 - protein, 22 aa, Mycobacterium
SSKIVLRYRIPIGLAAVALLLL

SEQ ID NO: 379583 - protein, 25 aa, Mycobacterium
SSLCLIFIIMLILTRAFVAAAVIVG

SEQ ID NO: 379584 - protein, 26 aa, Mycobacterium
SSLCLIFIIMLILTRAFVAAAVIVGT

SEQ ID NO: 379585 - protein, 25 aa, Mycobacterium
SSLCLIFIIMLLITRGFVAALVIVG

SEQ ID NO: 379586 - protein, 18 aa, Mycobacterium
SSMVLVCLFLYLSFRNRN

SEQ ID NO: 379587 - protein, 24 aa, Mycobacterium
SSPRARLRILPGDRVHAASLAGRF

SEQ ID NO: 379588 - protein, 33 aa, Mycobacterium
SSRDELWLGLPAWRWMFLAMALPALVYGTLAFT

SEQ ID NO: 379589 - protein, 22 aa, Mycobacterium
SSRILFGVLLLVTLLSLTAAVV

SEQ ID NO: 379590 - protein, 25 aa, Mycobacterium
SSSGNRLFWILAAVFVVVILGVVGG

SEQ ID NO: 379591 - protein, 24 aa, Mycobacterium
SSVLVQMMWAMRATGMWTDVRGTN

SEQ ID NO: 379592 - protein, 23 aa, Mycobacterium
SSWRLVFLVNIPLGIVAVLVAGR

SEQ ID NO: 379593 - protein, 24 aa, Mycobacterium
SSYGYLVWVFVAVFVVGLLDLALS

SEQ ID NO: 379594 - protein, 19 aa, Mycobacterium
SSYIWFFLCPGLPELAIWS

SEQ ID NO: 379595 - protein, 21 aa, Mycobacterium
STDRPLLPRAFPSASASALLL

SEQ ID NO: 379596 - protein, 20 aa, Mycobacterium
STFFFFFFVAELLDTWLWRW

SEQ ID NO: 379597 - protein, 21 aa, Mycobacterium
STFIGLWIFGWTRLPRWLHLA

SEQ ID NO: 379598 - protein, 19 aa, Mycobacterium
STFVFIGAVVYIILAPKGR

SEQ ID NO: 379599 - protein, 25 aa, Mycobacterium
STGWALWVVLVFIVFQSVAAVGALL

SEQ ID NO: 379600 - protein, 24 aa, Mycobacterium
STIIFGWLPIVMGLTFWQAVSSSV

SEQ ID NO: 379601 - protein, 17 aa, Mycobacterium
STILLRFAYLRPPGMTW

SEQ ID NO: 379602 - protein, 19 aa, Mycobacterium
STIPLLCISLSIPAFLWGI

SEQ ID NO: 379603 - protein, 17 aa, Mycobacterium
STLAYLLLFSLMRAGLG

SEQ ID NO: 379604 - protein, 21 aa, Mycobacterium
STLFLMFVMFGVPQLQLWISP

SEQ ID NO: 379605 - protein, 27 aa, Mycobacterium
STLLESFLFYSGFYLPMYWSSRAKLTN

SEQ ID NO: 379606 - protein, 19 aa, Mycobacterium
STPRWPWVVGVAAIMAAIA

SEQ ID NO: 379607 - protein, 25 aa, Mycobacterium
STSAYDIGLFYRYAWRNPTFADIVA

SEQ ID NO: 379608 - protein, 23 aa, Mycobacterium
STSWVLYAVIIVSALIIAGAIPM

SEQ ID NO: 379609 - protein, 25 aa, Mycobacterium
STTQRDWLRRINWKWVRRSAYLAAA

SEQ ID NO: 379610 - protein, 28 aa, Mycobacterium
STTVYLKLFGWLIWLFDQSSNLLLRALR

SEQ ID NO: 379611 - protein, 24 aa, Mycobacterium
STYGWRAYALPVLMVLTVVVGYQT

SEQ ID NO: 379612 - protein, 19 aa, Mycobacterium
SVAWVFLWIFRGTPVYVQL

SEQ ID NO: 379613 - protein, 25 aa, Mycobacterium
SVDNWVRRLLALPAFPDGSADRLMQ

SEQ ID NO: 379614 - protein, 24 aa, Mycobacterium
SVEAILRWIAVLAALFVVLTVVYR

SEQ ID NO: 379615 - protein, 17 aa, Mycobacterium
SVFLSLIGFRVPWREKM

SEQ ID NO: 379616 - protein, 18 aa, Mycobacterium
SVFTALLPLLVIGVSLAV

SEQ ID NO: 379617 - protein, 23 aa, Mycobacterium
SVGPWLPLVFLLVHIVVTVPPFP

SEQ ID NO: 379618 - protein, 31 aa, Mycobacterium
SVGVIFLMLLLLYRSIITVIILLFTVGIELQ

SEQ ID NO: 379619 - protein, 24 aa, Mycobacterium
SVGWLYWYFWVIVVGFEAVAGAKV

SEQ ID NO: 379620 - protein, 24 aa, Mycobacterium
SVGWLYWYFWVIVVGFEAVAGGKL

SEQ ID NO: 379621 - protein, 22 aa, Mycobacterium
SVILLTLVLFPTAALVLGAHNR

SEQ ID NO: 379622 - protein, 18 aa, Mycobacterium
SVLLWQYILGINLHWMVL

SEQ ID NO: 379623 - protein, 17 aa, Mycobacterium
SVLVTRWRLIGKCLRPL

SEQ ID NO: 379624 - protein, 23 aa, Mycobacterium
SVNWLWFLVFTIAAIVWTAVSLA

SEQ ID NO: 379625 - protein, 18 aa, Mycobacterium
SVPILALANYWIMTHMLP

SEQ ID NO: 379626 - protein, 21 aa, Mycobacterium
SVRWAAFALALFLAGLGAQLN

SEQ ID NO: 379627 - protein, 19 aa, Mycobacterium
SVSIPSWWQPYVLSVGAVD

SEQ ID NO: 379628 - protein, 22 aa, Mycobacterium
SVSTIFFALFVLAVLYAIWLHF

SEQ ID NO: 379629 - protein, 30 aa, Mycobacterium
SVSWLPLFHDMGLLMIMFPALAGGYLTLMS

SEQ ID NO: 379630 - protein, 19 aa, Mycobacterium
SVSWLPLYHDMGLIMILFP

SEQ ID NO: 379631 - protein, 23 aa, Mycobacterium
SVTTILMFLAFGSLVLPIKAAVM

SEQ ID NO: 379632 - protein, 21 aa, Mycobacterium
SVWFWIPLAILVIGISSIPSV

SEQ ID NO: 379633 - protein, 18 aa, Mycobacterium
SVWHPGLVAALIGGGLGL

SEQ ID NO: 379634 - protein, 24 aa, Mycobacterium
SVYARLVLLWFLCSAFPIAVIASL

SEQ ID NO: 379635 - protein, 18 aa, Mycobacterium
SWIMWVWYKLFALVLGPS

SEQ ID NO: 379636 - protein, 18 aa, Mycobacterium
SWIMWVWYKLFASMLGPS

SEQ ID NO: 379637 - protein, 17 aa, Mycobacterium
SWLRVVLGSALIALGAY

SEQ ID NO: 379638 - protein, 25 aa, Mycobacterium
SWLVTAAGILWLWAGALAVLAVAVG

SEQ ID NO: 379639 - protein, 17 aa, Mycobacterium
SWRLLIIGGAIVALLWL

SEQ ID NO: 379640 - protein, 18 aa, Mycobacterium
SWRWAFWINLPVSAVVIC

SEQ ID NO: 379641 - protein, 17 aa, Mycobacterium
SWWSGPEIYLMVDDYDL

SEQ ID NO: 379642 - protein, 19 aa, Mycobacterium
SYFDLAWPALILSAGIGLC

SEQ ID NO: 379643 - protein, 23 aa, Mycobacterium
SYGAWFPYYLCGLALRVSDLQYR

SEQ ID NO: 379644 - protein, 18 aa, Mycobacterium
SYLALAVLAILALVIGVI

SEQ ID NO: 379645 - protein, 18 aa, Mycobacterium
SYLRFVWTLSATAMVVCY

SEQ ID NO: 379646 - protein, 21 aa, Mycobacterium
SYSMDLFLRIAPELYLKRLCV

SEQ ID NO: 379647 - protein, 21 aa, Mycobacterium
TAALFLLRCRSGAGAGLLSFA

SEQ ID NO: 379648 - protein, 18 aa, Mycobacterium
TAALGWLWKEQRDTEIAG

SEQ ID NO: 379649 - protein, 24 aa, Mycobacterium
TAALLILLMFLWSAAYSSLFYLVA

SEQ ID NO: 379650 - protein, 23 aa, Mycobacterium
TAAQLLYLRVPALNALFPDYRGS

SEQ ID NO: 379651 - protein, 23 aa, Mycobacterium
TAARPLWFVCIALGLVILAVGFF

SEQ ID NO: 379652 - protein, 23 aa, Mycobacterium
TAFAFAPWYFFIARFFTGSGIGG

SEQ ID NO: 379653 - protein, 23 aa, Mycobacterium
TAFAFAPWYFFLTRFFTGSGIGG

SEQ ID NO: 379654 - protein, 20 aa, Mycobacterium
TAGGAWLWNEARRLRKLEDD

SEQ ID NO: 379655 - protein, 28 aa, Mycobacterium
TAGRLWFVEVLVWILVALAAVCWLPAAD

SEQ ID NO: 379656 - protein, 26 aa, Mycobacterium
TAGRLWFVEVLVWTLIALAALFCIPA

SEQ ID NO: 379657 - protein, 25 aa, Mycobacterium
TAGVLALVLLVWWRGTFLTDILGRL

SEQ ID NO: 379658 - protein, 30 aa, Mycobacterium
TAGVVFLVLALVIFVLVYLQFRGDFTPKVK

SEQ ID NO: 379659 - protein, 17 aa, Mycobacterium
TAGWAVFFALIALLVVA

SEQ ID NO: 379660 - protein, 23 aa, Mycobacterium
TAILLAMYWPLGVVVLVSIVPIA

SEQ ID NO: 379661 - protein, 20 aa, Mycobacterium
TAINVLLIRLGVTGAFLAIM

SEQ ID NO: 379662 - protein, 17 aa, Mycobacterium
TAKILIFSLLLGAGLPA

SEQ ID NO: 379663 - protein, 17 aa, Mycobacterium
TALFLILGLVVVGEVAG

SEQ ID NO: 379664 - protein, 17 aa, Mycobacterium
TALGFLFALLSTTSRNA

SEQ ID NO: 379665 - protein, 21 aa, Mycobacterium
TALLIMVFGYMRVPAMVGIGQ

SEQ ID NO: 379666 - protein, 17 aa, Mycobacterium
TALLWYPVGATASLLLL

SEQ ID NO: 379667 - protein, 29 aa, Mycobacterium
TALVAMSIWALLYSALPGLSGLFAAGATG

SEQ ID NO: 379668 - protein, 23 aa, Mycobacterium
TALWAPYLPLLVAGIVVPPLVTT

SEQ ID NO: 379669 - protein, 21 aa, Mycobacterium
TALWLIPVVVVVVLAAGIIGI

SEQ ID NO: 379670 - protein, 19 aa, Mycobacterium
TALWWFPFAVIFPVGDPLD

SEQ ID NO: 379671 - protein, 27 aa, Mycobacterium
TAMLLIPVYLLYIRIARPFIAFYNWCA

SEQ ID NO: 379672 - protein, 19 aa, Mycobacterium
TAMSLFIVAWWRSREKKTP

SEQ ID NO: 379673 - protein, 19 aa, Mycobacterium
TANPLRFLARAFNLWNSDL

SEQ ID NO: 379674 - protein, 26 aa, Mycobacterium
TAPLVISGWMLVVWMLVAVGSGIGYA

SEQ ID NO: 379675 - protein, 19 aa, Mycobacterium
TAREWMWAILLAGAVAVIV

SEQ ID NO: 379676 - protein, 22 aa, Mycobacterium
TARIAFGWIRRPAAPGRLVVIA

SEQ ID NO: 379677 - protein, 25 aa, Mycobacterium
TARKRIAWLLLLGNMILAAGLNAAD

SEQ ID NO: 379678 - protein, 25 aa, Mycobacterium
TARKRIAWLVLLGQIILAAGVNVAD

SEQ ID NO: 379679 - protein, 18 aa, Mycobacterium
TARLMMAWTVLDNKIWIM

SEQ ID NO: 379680 - protein, 17 aa, Mycobacterium
TAYIVIVLIARYVLHRL

SEQ ID NO: 379681 - protein, 23 aa, Mycobacterium
TDAFWIFMVFYAGAAALTWKVYV

SEQ ID NO: 379682 - protein, 17 aa, Mycobacterium
TDCLSWRWAFWINLPVS

SEQ ID NO: 379683 - protein, 25 aa, Mycobacterium
TDGIYPLLIMTLLPVLVGLDVSSRR

SEQ ID NO: 379684 - protein, 24 aa, Mycobacterium
TDHFTWRWAFWINVPISVVVFFVA

SEQ ID NO: 379685 - protein, 28 aa, Mycobacterium
TDKPVWITMLWPLADRPRLAPGVPGGTI

SEQ ID NO: 379686 - protein, 22 aa, Mycobacterium
TDQLMLPFSWQGVSLHAAGAAR

SEQ ID NO: 379687 - protein, 23 aa, Mycobacterium
TDRIFLDQLSWLTPARWGYAASA

SEQ ID NO: 379688 - protein, 25 aa, Mycobacterium
TEARLRWLHRSILLWWVVWVVSTAV

SEQ ID NO: 379689 - protein, 25 aa, Mycobacterium
TEDFSRYWWVYLSMPFVAAFVGWST

SEQ ID NO: 379690 - protein, 19 aa, Mycobacterium
TEFRWLSVALLAGGLAGFC

SEQ ID NO: 379691 - protein, 26 aa, Mycobacterium
TEGAWLVVVVFPLLVFMLMRLNREYR

SEQ ID NO: 379692 - protein, 26 aa, Mycobacterium
TEGAWLVVVVFPLLVFVLTRLNREYR

SEQ ID NO: 379693 - protein, 19 aa, Mycobacterium
TEMGLLKYLIGQLLLSEAA

SEQ ID NO: 379694 - protein, 25 aa, Mycobacterium
TEPTFDIFLWEIFGPLSAGGRLVFP

SEQ ID NO: 379695 - protein, 25 aa, Mycobacterium
TERIWLPFTIWLTAAPALLPERSAR

SEQ ID NO: 379696 - protein, 22 aa, Mycobacterium
TESRRWWTLPVLGQHILVAGAT

SEQ ID NO: 379697 - protein, 23 aa, Mycobacterium
TETRHWWHLPLLGHHVLVAGATG

SEQ ID NO: 379698 - protein, 24 aa, Mycobacterium
TEYAGWRWLFLINVPICAFALRAT

SEQ ID NO: 379699 - protein, 22 aa, Mycobacterium
TFAPAVFLWFAGIGGLTVVMSG

SEQ ID NO: 379700 - protein, 18 aa, Mycobacterium
TFFFFFFVAELLDTWLWR

SEQ ID NO: 379701 - protein, 24 aa, Mycobacterium
TFGCLLMWILAWLTATPVRVVRAA

SEQ ID NO: 379702 - protein, 23 aa, Mycobacterium
TFHEPFVVFGYLAALTSLELVTG

SEQ ID NO: 379703 - protein, 27 aa, Mycobacterium
TFIAVLVTWDLLGHLPLPLGVAGHEGS

SEQ ID NO: 379704 - protein, 18 aa, Mycobacterium
TFLGLWIFGWSRLPRLVH

SEQ ID NO: 379705 - protein, 20 aa, Mycobacterium
TFLIFPILGLAIRALVRSWM

SEQ ID NO: 379706 - protein, 20 aa, Mycobacterium
TFLVRTVIIPALFTLIGPKI

SEQ ID NO: 379707 - protein, 18 aa, Mycobacterium
TFLVTVFSLARLCFAPVS

SEQ ID NO: 379708 - protein, 21 aa, Mycobacterium
TFQLFTIVLLTYLISRIELID

SEQ ID NO: 379709 - protein, 24 aa, Mycobacterium
TFTTFGWFRFYLAAVPLVVIVAMV

SEQ ID NO: 379710 - protein, 23 aa, Mycobacterium
TFTVPLPRTLLARLFSRNPLVRA

SEQ ID NO: 379711 - protein, 20 aa, Mycobacterium
TFVLIFLMTGSVILPIKALV

SEQ ID NO: 379712 - protein, 18 aa, Mycobacterium
TFVNELWMWIQEALLVAA

SEQ ID NO: 379713 - protein, 26 aa, Mycobacterium
TFVWAGLWFYPIPIVLGLLGLVGLGF

SEQ ID NO: 379714 - protein, 17 aa, Mycobacterium
TFYYPLIGLAAGAAAVV

SEQ ID NO: 379715 - protein, 22 aa, Mycobacterium
TGAFVVLLLIHIWQWTPFAVLI

SEQ ID NO: 379716 - protein, 19 aa, Mycobacterium
TGAINWRLGGKRSTFALGD

SEQ ID NO: 379717 - protein, 18 aa, Mycobacterium
TGATGFLGRYLLLEWLRQ

SEQ ID NO: 379718 - protein, 19 aa, Mycobacterium
TGAVLLRDPLRRHAPRTLR

SEQ ID NO: 379719 - protein, 17 aa, Mycobacterium
TGAWQAQPPLPVPLHHA

SEQ ID NO: 379720 - protein, 25 aa, Mycobacterium
TGFLGRYLLLEWLRQLRRVDDKVIC

SEQ ID NO: 379721 - protein, 19 aa, Mycobacterium
TGFWRVLGIWLLASLVASV

SEQ ID NO: 379722 - protein, 25 aa, Mycobacterium
TGGASLWWMIGLLAAAGVLGLMVVL

SEQ ID NO: 379723 - protein, 19 aa, Mycobacterium
TGLALLRRASLRQAVADGV

SEQ ID NO: 379724 - protein, 23 aa, Mycobacterium
TGLFALNFFALISVYLVFFDGPK

SEQ ID NO: 379725 - protein, 31 aa, Mycobacterium
TGMAPFFLTLALFFGALVLWMVLRPLQSRAI

SEQ ID NO: 379726 - protein, 33 aa, Mycobacterium
TGMAPFFLTLALFFGALVLWMVLRPLQTRPIAA

SEQ ID NO: 379727 - protein, 17 aa, Mycobacterium
TGMFDRSAWRPAAVVVV

SEQ ID NO: 379728 - protein, 21 aa, Mycobacterium
TGMQWVVWLGLLNNVAAALDL

SEQ ID NO: 379729 - protein, 21 aa, Mycobacterium
TGSVHLYLAYGALGVLIVLVA

SEQ ID NO: 379730 - protein, 25 aa, Mycobacterium
TGTALGLIFLWFSMTPSLLPRGPLY

SEQ ID NO: 379731 - protein, 19 aa, Mycobacterium
TGVFLVLVMFLWSAAYSSL

SEQ ID NO: 379732 - protein, 22 aa, Mycobacterium
THILSFVYWLGLLLLMFVSGAE

SEQ ID NO: 379733 - protein, 18 aa, Mycobacterium
THTFALPQWRDAFLAIAN

SEQ ID NO: 379734 - protein, 28 aa, Mycobacterium
TIAALLGRWFWWPLLVRPRPASLLLRSV

SEQ ID NO: 379735 - protein, 27 aa, Mycobacterium
TIALLLFAPLLRYIPQAALAGLLLVTA

SEQ ID NO: 379736 - protein, 20 aa, Mycobacterium
TIAWLMMFYGFAASVLPVWL

SEQ ID NO: 379737 - protein, 19 aa, Mycobacterium
TIFYWAWWVSWTPFVGMFI

SEQ ID NO: 379738 - protein, 27 aa, Mycobacterium
TIGACVLLYLAPLILGLWRGQTTYDRH

SEQ ID NO: 379739 - protein, 22 aa, Mycobacterium
TIGLILLLLLMVYRSPVAAAIP

SEQ ID NO: 379740 - protein, 25 aa, Mycobacterium
TIGTFAAFLLYLRMFFEPMHEITHF

SEQ ID NO: 379741 - protein, 21 aa, Mycobacterium
TIGVPWWFLVAQLPVAGIVFA

SEQ ID NO: 379742 - protein, 24 aa, Mycobacterium
TIGVWLFFYLILRGVKQAAVINRI

SEQ ID NO: 379743 - protein, 25 aa, Mycobacterium
TILGRWFWWPLNVRTRPLPPPRTPQ

SEQ ID NO: 379744 - protein, 21 aa, Mycobacterium
TIMHGFWILLFAVPFAGLVEK

SEQ ID NO: 379745 - protein, 18 aa, Mycobacterium
TIPIELPFTGLADPHGLA

SEQ ID NO: 379746 - protein, 28 aa, Mycobacterium
TIRRFAVLVLLLWLAYTAIVNLAVPQLE

SEQ ID NO: 379747 - protein, 25 aa, Mycobacterium
TIVIVFLILVMLLRAIIAPLYLIGS

SEQ ID NO: 379748 - protein, 24 aa, Mycobacterium
TIVLLAVVLRRALVRPLDALAAAC

SEQ ID NO: 379749 - protein, 18 aa, Mycobacterium
TIVTLLFLYIARTRWGTP

SEQ ID NO: 379750 - protein, 21 aa, Mycobacterium
TIVVMALIVLLLYGQFRGDLT

SEQ ID NO: 379751 - protein, 24 aa, Mycobacterium
TKFTLVMALPWLGAVATLYVVFRW

SEQ ID NO: 379752 - protein, 25 aa, Mycobacterium
TKFTLVMTLPWLLAIAAVYVIFRWF

SEQ ID NO: 379753 - protein, 17 aa, Mycobacterium
TLAASLAVLVIIAALAG

SEQ ID NO: 379754 - protein, 26 aa, Mycobacterium
TLAGILIALAGLLLVMRHRGQRRRAA

SEQ ID NO: 379755 - protein, 23 aa, Mycobacterium
TLAQQRIWLLDRLNLGGPELCSQ

SEQ ID NO: 379756 - protein, 19 aa, Mycobacterium
TLAVILDKKFWWPLPMTQL

SEQ ID NO: 379757 - protein, 22 aa, Mycobacterium
TLAYVLRFFGPAASRRASVRLG

SEQ ID NO: 379758 - protein, 25 aa, Mycobacterium
TLCPLLVLGIWWRGLTARGAMSGLA

SEQ ID NO: 379759 - protein, 28 aa, Mycobacterium
TLEPAQWLLLIWLLVRWIRTRDDRLLVA

SEQ ID NO: 379760 - protein, 22 aa, Mycobacterium
TLFGFLVLVLLLSALNATVFQS

SEQ ID NO: 379761 - protein, 23 aa, Mycobacterium
TLFSFLFAALWLSSLAIFHTRSP

SEQ ID NO: 379762 - protein, 19 aa, Mycobacterium
TLGFLLMPLATRALSFWLN

SEQ ID NO: 379763 - protein, 24 aa, Mycobacterium
TLGLLIPVMLWPPSAPLLLIPVVL

SEQ ID NO: 379764 - protein, 17 aa, Mycobacterium
TLGLLYVVAPYWVLRPF

SEQ ID NO: 379765 - protein, 22 aa, Mycobacterium
TLGWLYWYYYVIIIAVEAVAGA

SEQ ID NO: 379766 - protein, 23 aa, Mycobacterium
TLGWQWIFFVNIPVGIVGLVLAV

SEQ ID NO: 379767 - protein, 23 aa, Mycobacterium
TLIFGFILMWIMSWLTATPVRVV

SEQ ID NO: 379768 - protein, 21 aa, Mycobacterium
TLIFMIMLLLTRSVVAALVIV

SEQ ID NO: 379769 - protein, 19 aa, Mycobacterium
TLIPYTMVLLQLRVFYARE

SEQ ID NO: 379770 - protein, 22 aa, Mycobacterium
TLIRMLVIFGIVTAVALAAATI

SEQ ID NO: 379771 - protein, 28 aa, Mycobacterium
TLIVLTIMLLLFGVPWWTLVMSGNAWPV

SEQ ID NO: 379772 - protein, 17 aa, Mycobacterium
TLLFLYIARTRWGTPLW

SEQ ID NO: 379773 - protein, 25 aa, Mycobacterium
TLLGRWFWWPLNVRTRPLPPPRTTV

SEQ ID NO: 379774 - protein, 21 aa, Mycobacterium
TLLTHWKLALGALLACTIGAA

SEQ ID NO: 379775 - protein, 20 aa, Mycobacterium
TLLTRWKLVAAALLACLAGA

SEQ ID NO: 379776 - protein, 21 aa, Mycobacterium
TLLWLVPLAASVLIILLPPGL

SEQ ID NO: 379777 - protein, 20 aa, Mycobacterium
TLLYLPFALFNIASPALSVF

SEQ ID NO: 379778 - protein, 22 aa, Mycobacterium
TLSIVFAFFFAPAGVVLGHVAL

SEQ ID NO: 379779 - protein, 18 aa, Mycobacterium
TLSWLLIGYGFAASVLPV

SEQ ID NO: 379780 - protein, 24 aa, Mycobacterium
TLTAVLCLGALFWSFVRPAGSAGQ

SEQ ID NO: 379781 - protein, 18 aa, Mycobacterium
TLTIAWYILAAPGELGSK

SEQ ID NO: 379782 - protein, 20 aa, Mycobacterium
TLVLLFLLTGSVLLPIKAVV

SEQ ID NO: 379783 - protein, 17 aa, Mycobacterium
TLVPLLRRPAVIVGKST

SEQ ID NO: 379784 - protein, 17 aa, Mycobacterium
TLVWLYIEILRLLSYLQ

SEQ ID NO: 379785 - protein, 23 aa, Mycobacterium
TMFATLLHHWPVLMLLMGISSIT

SEQ ID NO: 379786 - protein, 20 aa, Mycobacterium
TMGILTWIFVDGHFSKWLNF

SEQ ID NO: 379787 - protein, 19 aa, Mycobacterium
TMITLIIFGVVLGALVAFI

SEQ ID NO: 379788 - protein, 24 aa, Mycobacterium
TMLAMSVLGWHYLRLPSVVGMGQY

SEQ ID NO: 379789 - protein, 19 aa, Mycobacterium
TMLGRWFWWPINIRTRPAP

SEQ ID NO: 379790 - protein, 27 aa, Mycobacterium
TMTLFSFLFAALWLSALAIFQTRSTRI

SEQ ID NO: 379791 - protein, 26 aa, Mycobacterium
TMVFGAYPWAGWLAFAATVPVQFVAG

SEQ ID NO: 379792 - protein, 18 aa, Mycobacterium
TMVVLTAGLFMIFGEYRS

SEQ ID NO: 379793 - protein, 21 aa, Mycobacterium
TNLFWAFAYNVAAIPVAALGM

SEQ ID NO: 379794 - protein, 23 aa, Mycobacterium
TNLFWAFGYNVAALPLAAFGLLN

SEQ ID NO: 379795 - protein, 23 aa, Mycobacterium
TNRTLFEVLLYGALLALLVVALV

SEQ ID NO: 379796 - protein, 18 aa, Mycobacterium
TNTCAMGMALAKLPYNRG

SEQ ID NO: 379797 - protein, 26 aa, Mycobacterium
TNWLENFLILLIPFSLPRTFGRMVGS

SEQ ID NO: 379798 - protein, 24 aa, Mycobacterium
TPEFPWAGLTIFLLIAVLAAAVGT

SEQ ID NO: 379799 - protein, 24 aa, Mycobacterium
TPEFPWTGLTIFLLIGVLAAAVGT

SEQ ID NO: 379800 - protein, 23 aa, Mycobacterium
TPEFPWTGLTIFLLLAVFAAAVA

SEQ ID NO: 379801 - protein, 17 aa, Mycobacterium
TPLGWGWATVVWAYALF

SEQ ID NO: 379802 - protein, 19 aa, Mycobacterium
TPLGWRWAGIVWAYALFWF

SEQ ID NO: 379803 - protein, 21 aa, Mycobacterium
TPLLALLIASAYRWPPPGVND

SEQ ID NO: 379804 - protein, 25 aa, Mycobacterium
TPLLLQLFLIFFALPEFGVKISPFP

SEQ ID NO: 379805 - protein, 22 aa, Mycobacterium
TPLLWPAIALVALLILNAFLTP

SEQ ID NO: 379806 - protein, 17 aa, Mycobacterium
TPLSFLCYWIIPFGLVG

SEQ ID NO: 379807 - protein, 21 aa, Mycobacterium
TPLTMITALLLYFGWARSDAQ

SEQ ID NO: 379808 - protein, 20 aa, Mycobacterium
TPLWPGLPPAPPPGAPRDPG

SEQ ID NO: 379809 - protein, 18 aa, Mycobacterium
TPLWTAGILILRRYYRAT

SEQ ID NO: 379810 - protein, 23 aa, Mycobacterium
TPMFLAFPIMLLASSMATSLSGR

SEQ ID NO: 379811 - protein, 26 aa, Mycobacterium
TPNGGIFARFPWLKIPLADIESNGAW

SEQ ID NO: 379812 - protein, 17 aa, Mycobacterium
TPRELFWPFGVYALIIL

SEQ ID NO: 379813 - protein, 23 aa, Mycobacterium
TPRLMKWLLRRTAIKNLPVGYDV

SEQ ID NO: 379814 - protein, 25 aa, Mycobacterium
TPSLQRRVILLVVALLAVLLVVLGV

SEQ ID NO: 379815 - protein, 20 aa, Mycobacterium
TPVWALFIPSPIAVGAAFLA

SEQ ID NO: 379816 - protein, 18 aa, Mycobacterium
TPVWLLLVIFAVFGIGFA

SEQ ID NO: 379817 - protein, 20 aa, Mycobacterium
TPVWNWMIAAYLFSGGLSAG

SEQ ID NO: 379818 - protein, 19 aa, Mycobacterium
TPWRVAIVDLILWGVGAAL

SEQ ID NO: 379819 - protein, 29 aa, Mycobacterium
TQQLPTPPPIPPIPQIPPIPQIPGIGFPQ

SEQ ID NO: 379820 - protein, 25 aa, Mycobacterium
TQRLTAMVAALPRWCDIIPGAPEVA

SEQ ID NO: 379821 - protein, 24 aa, Mycobacterium
TQTPLSFIFYWVVPFALLGVAALL

SEQ ID NO: 379822 - protein, 27 aa, Mycobacterium
TRAGFLMLLWLFIWSVLRILRTDIYAP

SEQ ID NO: 379823 - protein, 26 aa, Mycobacterium
TRAGFLMLLWLFIWSVLRVLRTDIYA

SEQ ID NO: 379824 - protein, 19 aa, Mycobacterium
TRGWFMSWLARSHPELVGR

SEQ ID NO: 379825 - protein, 22 aa, Mycobacterium
TRGWLFFIVKVTAFSVGLATMF

SEQ ID NO: 379826 - protein, 18 aa, Mycobacterium
TRLVLAGAFALLLLAAAA

SEQ ID NO: 379827 - protein, 24 aa, Mycobacterium
TRPQWFLLPWLLLVGVRLGLGYRR

SEQ ID NO: 379828 - protein, 27 aa, Mycobacterium
TRVGFLLLLWLFIWSVLRILRTDIYAP

SEQ ID NO: 379829 - protein, 22 aa, Mycobacterium
TRVLWITVLIWSVAMALGGISA

SEQ ID NO: 379830 - protein, 24 aa, Mycobacterium
TRWGTPLWLVLIGGGALLLVDLMF

SEQ ID NO: 379831 - protein, 19 aa, Mycobacterium
TRWRPILLGLLVIATTGFA

SEQ ID NO: 379832 - protein, 28 aa, Mycobacterium
TSATRLYLPMPFFWVGGFGGGILSALLA

SEQ ID NO: 379833 - protein, 22 aa, Mycobacterium
TSFPLQLPWLPLAAPLGALVIY

SEQ ID NO: 379834 - protein, 28 aa, Mycobacterium
TSKPVWITMLWPLADRPRLAPGVPGGTI

SEQ ID NO: 379835 - protein, 17 aa, Mycobacterium
TSLWMTISPLLTAVLTV

SEQ ID NO: 379836 - protein, 26 aa, Mycobacterium
TSMGTALVLLFLLALAAIPGALLPQR

SEQ ID NO: 379837 - protein, 22 aa, Mycobacterium
TSPPWTFFWIGLAALTAVQGGF

SEQ ID NO: 379838 - protein, 29 aa, Mycobacterium
TSRQFNWGWVLALVLVVLALAAIAILGTV

SEQ ID NO: 379839 - protein, 21 aa, Mycobacterium
TSVARWLIAVAVLAVLTVVVT

SEQ ID NO: 379840 - protein, 26 aa, Mycobacterium
TSVYDMGLFYRYAWHNPVFADIVATR

SEQ ID NO: 379841 - protein, 28 aa, Mycobacterium
TTALSYLCYWLIPFTLFGLAALASRLVS

SEQ ID NO: 379842 - protein, 22 aa, Mycobacterium
TTALVFLIVSAVVLGFVWLQFR

SEQ ID NO: 379843 - protein, 24 aa, Mycobacterium
TTASRLLYLRVPALNALFPSYRTS

SEQ ID NO: 379844 - protein, 21 aa, Mycobacterium
TTAWLFDMAMLAALSVVYSAV

SEQ ID NO: 379845 - protein, 25 aa, Mycobacterium
TTDAFWLFMVFYAGAAALTWKVYVR

SEQ ID NO: 379846 - protein, 27 aa, Mycobacterium
TTEWLHVPLLPIPIPIRVPASQAPPSP

SEQ ID NO: 379847 - protein, 25 aa, Mycobacterium
TTEWLHVPLLPVPIPIQLPANQAPQ

SEQ ID NO: 379848 - protein, 21 aa, Mycobacterium
TTIVSWLPFYHDMGLIVGVFI

SEQ ID NO: 379849 - protein, 28 aa, Mycobacterium
TTKPVWITMLWPLADRPRLAPGVPGGTI

SEQ ID NO: 379850 - protein, 19 aa, Mycobacterium
TTLWYLVMRDFRIALAGIG

SEQ ID NO: 379851 - protein, 20 aa, Mycobacterium
TTMRLLLFQIPGQLIFSVVS

SEQ ID NO: 379852 - protein, 29 aa, Mycobacterium
TTRIAPAHPWWWFLKSTPGKILMLGIALA

SEQ ID NO: 379853 - protein, 23 aa, Mycobacterium
TTTTLLMFLAFGSVVLPIKAAVM

SEQ ID NO: 379854 - protein, 17 aa, Mycobacterium
TTVPLLREFLVSNLVLV

SEQ ID NO: 379855 - protein, 22 aa, Mycobacterium
TTVVSWLPFFHDMGLVLGIAIP

SEQ ID NO: 379856 - protein, 23 aa, Mycobacterium
TTVVSWLPLFHDMGLILGICAPL

SEQ ID NO: 379857 - protein, 25 aa, Mycobacterium
TVAHFLPPVLRKLSIFLPQSPSPNE

SEQ ID NO: 379858 - protein, 22 aa, Mycobacterium
TVCLLVMYWPLGLVVLGSIVPI

SEQ ID NO: 379859 - protein, 19 aa, Mycobacterium
TVFAWLLAVFAVRPFKQLA

SEQ ID NO: 379860 - protein, 22 aa, Mycobacterium
TVFGFLVLVLLLSALNATVFAS

SEQ ID NO: 379861 - protein, 21 aa, Mycobacterium
TVGLVFIWLSLTPSLLPRGPL

SEQ ID NO: 379862 - protein, 24 aa, Mycobacterium
TVGLVLVFFALYWVNQNYQPEPPA

SEQ ID NO: 379863 - protein, 21 aa, Mycobacterium
TVGTLLHTAWGLALGRLTGRD

SEQ ID NO: 379864 - protein, 26 aa, Mycobacterium
TVIAPPPPRMLLVGSALTFVAVSFAT

SEQ ID NO: 379865 - protein, 23 aa, Mycobacterium
TVIIVMLLLVYRSIVTVLITLVM

SEQ ID NO: 379866 - protein, 18 aa, Mycobacterium
TVLALIVLPLFLIPARRI

SEQ ID NO: 379867 - protein, 18 aa, Mycobacterium
TVLLIFTLNVLLAQFGAA

SEQ ID NO: 379868 - protein, 19 aa, Mycobacterium
TVLLILLAIAVFVAFHVAR

SEQ ID NO: 379869 - protein, 23 aa, Mycobacterium
TVLRRLGWVLLIVGGVGVAVAAA

SEQ ID NO: 379870 - protein, 24 aa, Mycobacterium
TVNRYLGLFWAFVGVMLALGGALA

SEQ ID NO: 379871 - protein, 29 aa, Mycobacterium
TVPGRYFYLKWWKLLLVLLGVWSAAAVAG

SEQ ID NO: 379872 - protein, 17 aa, Mycobacterium
TVQYFFFDLLTGRFQWQ

SEQ ID NO: 379873 - protein, 17 aa, Mycobacterium
TVRWPGPILAAACAVGL

SEQ ID NO: 379874 - protein, 26 aa, Mycobacterium
TVSLSIILLALLWYAGLPLKVFLSSV

SEQ ID NO: 379875 - protein, 23 aa, Mycobacterium
TVSQLLYLRVPALNALFPDYRGS

SEQ ID NO: 379876 - protein, 24 aa, Mycobacterium
TVSVVGWLWPLWDSGRRTFADVLL

SEQ ID NO: 379877 - protein, 22 aa, Mycobacterium
TVTYSLMTFWITTMLALLYGLL

SEQ ID NO: 379878 - protein, 23 aa, Mycobacterium
TVTYSLMTFWITTMLALLYGLLG

SEQ ID NO: 379879 - protein, 19 aa, Mycobacterium
TVVSWLPFYHDMGFILGIV

SEQ ID NO: 379880 - protein, 21 aa, Mycobacterium
TWIRFLIWMAIGVVIYFLYGR

SEQ ID NO: 379881 - protein, 19 aa, Mycobacterium
TWRILLRHILPNALAPVLV

SEQ ID NO: 379882 - protein, 20 aa, Mycobacterium
TWVLAMLYLGTFGSWIGFSF

SEQ ID NO: 379883 - protein, 23 aa, Mycobacterium
TYITVPFVPVPIPIQVPSREQPQ

SEQ ID NO: 379884 - protein, 25 aa, Mycobacterium
TYNKTWLGFIAIAVIGALVGGMLLV

SEQ ID NO: 379885 - protein, 21 aa, Mycobacterium
TYNWIIFMILPLYVSLEKIDP

SEQ ID NO: 379886 - protein, 19 aa, Mycobacterium
TYPFQHHRYWLTPRSGTDA

SEQ ID NO: 379887 - protein, 24 aa, Mycobacterium
TYRTMLMHLMRLAGSLGFLPIGGW

SEQ ID NO: 379888 - protein, 20 aa, Mycobacterium
TYSYWFEPNPAWSRLFAPGA

SEQ ID NO: 379889 - protein, 18 aa, Mycobacterium
TYVWIFRSIPLIVQLLFW

SEQ ID NO: 379890 - protein, 22 aa, Mycobacterium
VAAFQTLLLSLLPRVLDALARD

SEQ ID NO: 379891 - protein, 26 aa, Mycobacterium
VAAGANLIVLFYLTLGAAALGVRRVL

SEQ ID NO: 379892 - protein, 21 aa, Mycobacterium
VAAGIFYLLLTIPLTHLVNYI

SEQ ID NO: 379893 - protein, 21 aa, Mycobacterium
VAAGLFYLILTIPLTHLVNYI

SEQ ID NO: 379894 - protein, 18 aa, Mycobacterium
VAAIWLPSKSTMPARPLV

SEQ ID NO: 379895 - protein, 24 aa, Mycobacterium
VAAKLYPVLLLLPLLLVSLRSGKV

SEQ ID NO: 379896 - protein, 23 aa, Mycobacterium
VAALLVAQIFVRPIRRLQAGAQE

SEQ ID NO: 379897 - protein, 23 aa, Mycobacterium
VAAPFLWLAWLLRIPTVFVESIT

SEQ ID NO: 379898 - protein, 17 aa, Mycobacterium
VAAVILWRFVGDTLSDR

SEQ ID NO: 379899 - protein, 24 aa, Mycobacterium
VAAVLALTWIAWPSPRKAVTLYCG

SEQ ID NO: 379900 - protein, 23 aa, Mycobacterium
VAAVVLGVLIWIGHRDEISERVY

SEQ ID NO: 379901 - protein, 28 aa, Mycobacterium
VADTAAGWLFWFALAAAIITAVTWTALG

SEQ ID NO: 379902 - protein, 21 aa, Mycobacterium
VAESCWFRWLASGPLDVRRRQ

SEQ ID NO: 379903 - protein, 21 aa, Mycobacterium
VAFDELWRWNSIVALVLSVLV

SEQ ID NO: 379904 - protein, 23 aa, Mycobacterium
VAFGYTGLPFWPQGKQYTGYFAD

SEQ ID NO: 379905 - protein, 18 aa, Mycobacterium
VAFIPWVMFGITAVLTAL

SEQ ID NO: 379906 - protein, 19 aa, Mycobacterium
VAFPLCFWVMGVYATLRDL

SEQ ID NO: 379907 - protein, 21 aa, Mycobacterium
VAFPVLVLLVWWFQRESSKTY

SEQ ID NO: 379908 - protein, 20 aa, Mycobacterium
VAGAFGWTYLRDRSHRLTIT

SEQ ID NO: 379909 - protein, 19 aa, Mycobacterium
VAGIPWWGAILSAVVASLI

SEQ ID NO: 379910 - protein, 25 aa, Mycobacterium
VAHFLPPVLRRLSIFVPPSPSVAES

SEQ ID NO: 379911 - protein, 19 aa, Mycobacterium
VAIAWRRSLQLRVVALTLG

SEQ ID NO: 379912 - protein, 17 aa, Mycobacterium
VAIFTGYPFLRGALRSL

SEQ ID NO: 379913 - protein, 22 aa, Mycobacterium
VAILLIAVFLLLRALPSLRVNH

SEQ ID NO: 379914 - protein, 18 aa, Mycobacterium
VAILWFGGWLIPLLAIWA

SEQ ID NO: 379915 - protein, 23 aa, Mycobacterium
VAIPLTVLIIFTLNILLAEFGAA

SEQ ID NO: 379916 - protein, 21 aa, Mycobacterium
VALALFLWWEGRTPAPMLSLR

SEQ ID NO: 379917 - protein, 18 aa, Mycobacterium
VALFAALQRWGLQPDFVM

SEQ ID NO: 379918 - protein, 23 aa, Mycobacterium
VALHLFYVLKIALYILGGWLFAM

SEQ ID NO: 379919 - protein, 17 aa, Mycobacterium
VALLLLLGAPFLHARWG

SEQ ID NO: 379920 - protein, 18 aa, Mycobacterium
VALLLLLGLPFLSVKWGF

SEQ ID NO: 379921 - protein, 17 aa, Mycobacterium
VALLWFLGVYLVVLAFV

SEQ ID NO: 379922 - protein, 18 aa, Mycobacterium
VALLWFLGVYLVVLAFVP

SEQ ID NO: 379923 - protein, 17 aa, Mycobacterium
VALPWTKMVVLNPGVQT

SEQ ID NO: 379924 - protein, 20 aa, Mycobacterium
VALTFVWLGMVLAISFLEAP

SEQ ID NO: 379925 - protein, 26 aa, Mycobacterium
VALVGGLLYWVWPSRGTYKIVGHFAS

SEQ ID NO: 379926 - protein, 19 aa, Mycobacterium
VALVLVIAVLGTAALLAVS

SEQ ID NO: 379927 - protein, 19 aa, Mycobacterium
VAMLLYIVCWWRHLRPETA

SEQ ID NO: 379928 - protein, 20 aa, Mycobacterium
VAMVLLIWQLVYLSGWKPSF

SEQ ID NO: 379929 - protein, 31 aa, Mycobacterium
VAPPPAVVPVPIPLFPPVWEPPRRQENPWWP

SEQ ID NO: 379930 - protein, 29 aa, Mycobacterium
VARIPEWILKALFVFVLLATAAKLLLSAA

SEQ ID NO: 379931 - protein, 27 aa, Mycobacterium
VARLWRWLLVFFSRWWQIETLYRSNQK

SEQ ID NO: 379932 - protein, 26 aa, Mycobacterium
VARLWRWLLVFFSRWWQLETLYRSNM

SEQ ID NO: 379933 - protein, 23 aa, Mycobacterium
VARPYQWWRVALVALSGLGYVAI

SEQ ID NO: 379934 - protein, 19 aa, Mycobacterium
VARSLVRPLRTLRDGALKV

SEQ ID NO: 379935 - protein, 17 aa, Mycobacterium
VASAWWLFEWEISRGAS

SEQ ID NO: 379936 - protein, 34 aa, Mycobacterium
VASGPYFKIVLSNLLPYWILQPFVDAAFKKRGID

SEQ ID NO: 379937 - protein, 23 aa, Mycobacterium
VASLALLGGLYWFSYRPDRATDA

SEQ ID NO: 379938 - protein, 22 aa, Mycobacterium
VASLWFGYRAALKTLRDPLPEP

SEQ ID NO: 379939 - protein, 21 aa, Mycobacterium
VATAWWLFEWEIGKGASVEVA

SEQ ID NO: 379940 - protein, 17 aa, Mycobacterium
VATFLAFVANLLGHYLF

SEQ ID NO: 379941 - protein, 17 aa, Mycobacterium
VATIIVFAIGRPLIRLS

SEQ ID NO: 379942 - protein, 24 aa, Mycobacterium
VAVARSILVIIWNLLHDPTARFHD

SEQ ID NO: 379943 - protein, 17 aa, Mycobacterium
VAVILWVLLALSAAMVV

SEQ ID NO: 379944 - protein, 22 aa, Mycobacterium
VAVMVLLPLITFGMAYMIVDVP

SEQ ID NO: 379945 - protein, 18 aa, Mycobacterium
VAVPPLVPIVVPPVRVPS

SEQ ID NO: 379946 - protein, 21 aa, Mycobacterium
VAVVAALIWWTSDARATISRP

SEQ ID NO: 379947 - protein, 24 aa, Mycobacterium
VAWFLHFLLRHNMYWFVGYRIVVG

SEQ ID NO: 379948 - protein, 19 aa, Mycobacterium
VAWFLRFLVRHSMYWFVGY

SEQ ID NO: 379949 - protein, 24 aa, Mycobacterium
VAWGALAVYLLWRSGFRPSSVGLG

SEQ ID NO: 379950 - protein, 22 aa, Mycobacterium
VAWSIVWCLVLLSLALTATTFF

SEQ ID NO: 379951 - protein, 22 aa, Mycobacterium
VAYRAWRWWLATAVAFFAVAAL

SEQ ID NO: 379952 - protein, 24 aa, Mycobacterium
VCKAWLLAVPFLVSTALLVIFAVE

SEQ ID NO: 379953 - protein, 27 aa, Mycobacterium
VDAGLWVAFWFFLAQLNFVLGAINLVP

SEQ ID NO: 379954 - protein, 25 aa, Mycobacterium
VDATIIRMLLVPSFMRLLGRFNWWA

SEQ ID NO: 379955 - protein, 22 aa, Mycobacterium
VDGVSWRILLEDINLGWAQHRD

SEQ ID NO: 379956 - protein, 23 aa, Mycobacterium
VDGVSWRILLEDLNIAWTQQQDG

SEQ ID NO: 379957 - protein, 26 aa, Mycobacterium
VDHGLWVAFWFFLAQLNLILGAINLV

SEQ ID NO: 379958 - protein, 23 aa, Mycobacterium
VDNWARRVWALPVFPDGSADSVV

SEQ ID NO: 379959 - protein, 22 aa, Mycobacterium
VDNWVRRMLALPVFPARSSDHR

SEQ ID NO: 379960 - protein, 24 aa, Mycobacterium
VDPTNLRWFLYALGTIAVIVAIQR

SEQ ID NO: 379961 - protein, 23 aa, Mycobacterium
VDVDIPWYCWVAGAVIGALLGAL

SEQ ID NO: 379962 - protein, 17 aa, Mycobacterium
VEALWWIRARMLGVQPR

SEQ ID NO: 379963 - protein, 17 aa, Mycobacterium
VEFYAVIFLSIGASLGA

SEQ ID NO: 379964 - protein, 27 aa, Mycobacterium
VEHDMWIMFWILLAQLNFALGAINLLP

SEQ ID NO: 379965 - protein, 19 aa, Mycobacterium
VEHPVPPRQGWLVPLAATV

SEQ ID NO: 379966 - protein, 24 aa, Mycobacterium
VEPVHPRWWFISTTPGRILSIGIV

SEQ ID NO: 379967 - protein, 23 aa, Mycobacterium
VERIWLPFTVWLTAAPALLPVRS

SEQ ID NO: 379968 - protein, 28 aa, Mycobacterium
VESTSDYWRIWYYLLEAAGLDVQLVNAR

SEQ ID NO: 379969 - protein, 25 aa, Mycobacterium
VEVEPPFRWGLPLVALVSALLIAAA

SEQ ID NO: 379970 - protein, 26 aa, Mycobacterium
VEWPILLAVGGGALLLRRMNKKPGDS

SEQ ID NO: 379971 - protein, 27 aa, Mycobacterium
VEWSRVVAFLVLPALALVLAAGAGYLK

SEQ ID NO: 379972 - protein, 17 aa, Mycobacterium
VFACVLIALLLAMFEPR

SEQ ID NO: 379973 - protein, 18 aa, Mycobacterium
VFALLSPFLLVAAVIFVP

SEQ ID NO: 379974 - protein, 24 aa, Mycobacterium
VFALPSIFLLPWLADVFGLSDAVA

SEQ ID NO: 379975 - protein, 18 aa, Mycobacterium
VFAWLAMVGLIGGGYAAL

SEQ ID NO: 379976 - protein, 18 aa, Mycobacterium
VFAWSFWLNTGTPMTFVV

SEQ ID NO: 379977 - protein, 26 aa, Mycobacterium
VFEFGLHYWPWLMLGYVTYGVMVSSL

SEQ ID NO: 379978 - protein, 25 aa, Mycobacterium
VFFEVWLARIPFFWFDWDSGKVPKA

SEQ ID NO: 379979 - protein, 21 aa, Mycobacterium
VFFVAILLKLFFSVKLGWLPA

SEQ ID NO: 379980 - protein, 20 aa, Mycobacterium
VFFVVRFLVLAPLSWLVPPL

SEQ ID NO: 379981 - protein, 25 aa, Mycobacterium
VFGFILMWILSWLTATPIRVVRAAL

SEQ ID NO: 379982 - protein, 19 aa, Mycobacterium
VFGLLLLAPPIRAAARPGL

SEQ ID NO: 379983 - protein, 21 aa, Mycobacterium
VFGMRLLFPLVIVWATAGIGP

SEQ ID NO: 379984 - protein, 27 aa, Mycobacterium
VFGTLLIYMLPLLLLVALFVMFSRMQT

SEQ ID NO: 379985 - protein, 26 aa, Mycobacterium
VFHGFPFGLFFIALVTALILVLAANT

SEQ ID NO: 379986 - protein, 18 aa, Mycobacterium
VFILPAILLLSQFVPVLL

SEQ ID NO: 379987 - protein, 19 aa, Mycobacterium
VFITLAVIALVVWLLLGDH

SEQ ID NO: 379988 - protein, 18 aa, Mycobacterium
VFLACRWVQAQGGAPLWV

SEQ ID NO: 379989 - protein, 17 aa, Mycobacterium
VFLRSKPVWYTVSGVLL

SEQ ID NO: 379990 - protein, 19 aa, Mycobacterium
VFLVTWPLVYLASKSPLWA

SEQ ID NO: 379991 - protein, 20 aa, Mycobacterium
VFQRGFQLPALPPGTATVEV

SEQ ID NO: 379992 - protein, 28 aa, Mycobacterium
VFRHRTGNAVIFLLLVVAAAQLFTLQVP

SEQ ID NO: 379993 - protein, 27 aa, Mycobacterium
VFSSFWFTAIYVLLFVSLVGCIIPRTV

SEQ ID NO: 379994 - protein, 27 aa, Mycobacterium
VFSSFWFTAIYVLLFVSLVGCLTPRMI

SEQ ID NO: 379995 - protein, 26 aa, Mycobacterium
VFVRVRLSWWIGTLAPAIGIIALCGM

SEQ ID NO: 379996 - protein, 18 aa, Mycobacterium
VGAFLRLPYTFAVPIFGG

SEQ ID NO: 379997 - protein, 21 aa, Mycobacterium
VGAFMLFSWFRTRSRRRAEIE

SEQ ID NO: 379998 - protein, 20 aa, Mycobacterium
VGALAVALGIGLALGSAAVA

SEQ ID NO: 379999 - protein, 26 aa, Mycobacterium
VGALLPLVAILLPPAAWRIPVTVVAV

SEQ ID NO: 380000 - protein, 25 aa, Mycobacterium
VGFCMGGGLVWRLLAAGTPQLAAAV

SEQ ID NO: 380001 - protein, 24 aa, Mycobacterium
VGIALVFVRWWGQPAWSWLVLWRR

SEQ ID NO: 380002 - protein, 17 aa, Mycobacterium
VGIAVVFVRWWGQPAWS

SEQ ID NO: 380003 - protein, 24 aa, Mycobacterium
VGIGALAWIFWPDAEGGQDTSADS

SEQ ID NO: 380004 - protein, 36 aa, Mycobacterium; identical to SEQ ID NO: 333799

SEQ ID NO: 380005 - protein, 21 aa, Mycobacterium
VGLFFVLCAWLKDFRGFFGIG

SEQ ID NO: 380006 - protein, 24 aa, Mycobacterium
VGLGYPLLVWLVAQLPGLRDKADG

SEQ ID NO: 380007 - protein, 18 aa, Mycobacterium
VGLIYPWGDLVLLALAVG

SEQ ID NO: 380008 - protein, 23 aa, Mycobacterium
VGLLLLLGLPFFSVKWGFPDDRV

SEQ ID NO: 380009 - protein, 17 aa, Mycobacterium
VGLLLLLVARPLSVVLS

SEQ ID NO: 380010 - protein, 21 aa, Mycobacterium
VGLPLWLMAMLLMAALTLTNL

SEQ ID NO: 380011 - protein, 28 aa, Mycobacterium
VGLSLALIAVLIPLALLGILGLAAVVAV

SEQ ID NO: 380012 - protein, 27 aa, Mycobacterium
VGLSLALITVLIPLALLGVLGLAAVVL

SEQ ID NO: 380013 - protein, 26 aa, Mycobacterium
VGLSLTIITVLMPLALFGTLGLAAVV

SEQ ID NO: 380014 - protein, 24 aa, Mycobacterium
VGLTQLTLLRYLLGQLRLSAPDRI

SEQ ID NO: 380015 - protein, 21 aa, Mycobacterium
VGLTWWWWGYRRRGISYVQLT

SEQ ID NO: 380016 - protein, 19 aa, Mycobacterium
VGLVFLFLSLTPSLLPRGP

SEQ ID NO: 380017 - protein, 19 aa, Mycobacterium
VGLVFLWLSMTPSLLPRGP

SEQ ID NO: 380018 - protein, 23 aa, Mycobacterium
VGLVFVWFSMTPSLLPRGALFQG

SEQ ID NO: 380019 - protein, 19 aa, Mycobacterium
VGMFLWIAIIWRGIRGRLK

SEQ ID NO: 380020 - protein, 22 aa, Mycobacterium
VGMTTLDWRLGLAGALAIPAYI

SEQ ID NO: 380021 - protein, 18 aa, Mycobacterium
VGPWALYGLLFTIVILFA

SEQ ID NO: 380022 - protein, 30 aa, Mycobacterium
VGRVSYSWYLWHWPVLLLATPLLGRPMGPL

SEQ ID NO: 380023 - protein, 18 aa, Mycobacterium
VGSLFLLGLLLPYTDYKA

SEQ ID NO: 380024 - protein, 24 aa, Mycobacterium
VGSLILLALLLPYGTYKAGESPFV

SEQ ID NO: 380025 - protein, 26 aa, Mycobacterium
VGSYGAWFPYYICGISFRASDLEGRT

SEQ ID NO: 380026 - protein, 21 aa, Mycobacterium
VGTLALFRRLLRDRQWWTGSL

SEQ ID NO: 380027 - protein, 22 aa, Mycobacterium
VGVIVWGLIFWASAFHRKKATD

SEQ ID NO: 380028 - protein, 22 aa, Mycobacterium
VGVIVWGLIFWSATFHRKKKTD

SEQ ID NO: 380029 - protein, 19 aa, Mycobacterium
VGVIVWGLIFWTAVFHRKK

SEQ ID NO: 380030 - protein, 24 aa, Mycobacterium
VGVPVWAWVLWALVTVAAALLAAD

SEQ ID NO: 380031 - protein, 17 aa, Mycobacterium
VGWVLFVWSVLGQLFGL

SEQ ID NO: 380032 - protein, 27 aa, Mycobacterium
VHRPRWSWRRMALVATLVVLLVVAGLF

SEQ ID NO: 380033 - protein, 21 aa, Mycobacterium
VIAIMVAWRWAPAKAAAVPGP

SEQ ID NO: 380034 - protein, 17 aa, Mycobacterium
VIALFRWFPQITVWTGL

SEQ ID NO: 380035 - protein, 18 aa, Mycobacterium
VIALLLLLGVPFLGVRWG

SEQ ID NO: 380036 - protein, 23 aa, Mycobacterium
VIALTTIYKWVPAPAGLLLAAVV

SEQ ID NO: 380037 - protein, 21 aa, Mycobacterium
VIAVILLWIGWMHRTRKITWL

SEQ ID NO: 380038 - protein, 21 aa, Mycobacterium
VIFFMLLLVYRSVSTVIALLS

SEQ ID NO: 380039 - protein, 27 aa, Mycobacterium
VIFIMLLLVYRSPLTVVLLLLTVGAEF

SEQ ID NO: 380040 - protein, 22 aa, Mycobacterium
VIFIMLLLVYRSVITVVVLLLT

SEQ ID NO: 380041 - protein, 18 aa, Mycobacterium
VIHLFYVVKILLYVLVAW

SEQ ID NO: 380042 - protein, 23 aa, Mycobacterium
VIIAMLLLVYRSVITVLLTLVMV

SEQ ID NO: 380043 - protein, 23 aa, Mycobacterium
VIIGMLLLVYRSVITVLLTLVMV

SEQ ID NO: 380044 - protein, 22 aa, Mycobacterium
VIIIMLLMVYRSIITVILSLVM

SEQ ID NO: 380045 - protein, 19 aa, Mycobacterium
VIIKFVMGIPLLALAWLLG

SEQ ID NO: 380046 - protein, 18 aa, Mycobacterium
VIIKRGLLKWAWIPGVPL

SEQ ID NO: 380047 - protein, 17 aa, Mycobacterium
VIILGLLTVSGLMMYHH

SEQ ID NO: 380048 - protein, 20 aa, Mycobacterium
VIIVLAAFILLVPRLFPGAF

SEQ ID NO: 380049 - protein, 21 aa, Mycobacterium
VIIVMLLFVYRSIVQVLLVLV

SEQ ID NO: 380050 - protein, 21 aa, Mycobacterium
VILDWPLWWVSACSVLALLIV

SEQ ID NO: 380051 - protein, 23 aa, Mycobacterium
VILMIFTTGLLLAPPSGAQPPFR

SEQ ID NO: 380052 - protein, 25 aa, Mycobacterium
VIPATLLFFRYYWLRSEPLPSQRPT

SEQ ID NO: 380053 - protein, 32 aa, Mycobacterium; identical to SEQ ID NO: 26217

SEQ ID NO: 380054 - protein, 32 aa, Mycobacterium
VIPPSFLRRAMPYVLVILIVGMVVALFATGMR

SEQ ID NO: 380055 - protein, 24 aa, Mycobacterium
VIQPPLILFFAVPGSYFLFHGGEI

SEQ ID NO: 380056 - protein, 29 aa, Mycobacterium
VISDRGYFAFLMLLPFIMGILSLSVPGDV

SEQ ID NO: 380057 - protein, 23 aa, Mycobacterium
VISSFALAAMLWQFAHPPKGLEH

SEQ ID NO: 380058 - protein, 22 aa, Mycobacterium
VISVIWRLRLALAMSIASAIVF

SEQ ID NO: 380059 - protein, 23 aa, Mycobacterium
VITIMLVLFFRSIVTTLLILVMV

SEQ ID NO: 380060 - protein, 26 aa, Mycobacterium
VITQAWGWQWLFWLSAAGLAVNVALL

SEQ ID NO: 380061 - protein, 18 aa, Mycobacterium
VIVFTVVMLLVAAGLIIT

SEQ ID NO: 380062 - protein, 26 aa, Mycobacterium
VIVMLVLMLLLRSLIAPLYLVGSVVV

SEQ ID NO: 380063 - protein, 18 aa, Mycobacterium
VIYGLFYRLHRPVKRWYQ

SEQ ID NO: 380064 - protein, 22 aa, Mycobacterium
VKMVFWIIVLLLIGGPFIDPDR

SEQ ID NO: 380065 - protein, 18 aa, Mycobacterium
VKMWLFPVLSILTAAAIF

SEQ ID NO: 380066 - protein, 26 aa, Mycobacterium
VKVAALLIVFGFAGLSAYFVWNHSQV

SEQ ID NO: 380067 - protein, 26 aa, Mycobacterium
VKVVPAILIALLLLSGGGATWLYFKQ

SEQ ID NO: 380068 - protein, 20 aa, Mycobacterium
VLAARIMWRLAARPSTHARR

SEQ ID NO: 380069 - protein, 21 aa, Mycobacterium
VLAFVALIAFVMLLISIHSVL

SEQ ID NO: 380070 - protein, 20 aa, Mycobacterium
VLAFVALIAFVMLLVSVHSM

SEQ ID NO: 380071 - protein, 25 aa, Mycobacterium
VLAIKPDICFLWDEAWYAFATAVPW

SEQ ID NO: 380072 - protein, 23 aa, Mycobacterium
VLAIPIVLFWVGVAVLLSVLVPK

SEQ ID NO: 380073 - protein, 18 aa, Mycobacterium
VLALLLPWNLQFGVGVPG

SEQ ID NO: 380074 - protein, 23 aa, Mycobacterium
VLANLLLRPLGHLLDRQPAIGRE

SEQ ID NO: 380075 - protein, 18 aa, Mycobacterium
VLAVAFVAFVFWPNPTVP

SEQ ID NO: 380076 - protein, 19 aa, Mycobacterium
VLAVIWFWLLKRYVVEGPQ

SEQ ID NO: 380077 - protein, 19 aa, Mycobacterium
VLAVLLRSLLAPLFMVAVV

SEQ ID NO: 380078 - protein, 26 aa, Mycobacterium
VLAVLPFFHIYGMTVLLNAALHARAR

SEQ ID NO: 380079 - protein, 21 aa, Mycobacterium
VLAVWVLIVGWRRGPAGPVAL

SEQ ID NO: 380080 - protein, 20 aa, Mycobacterium
VLAYLFFPLYRRLRTRMGTG

SEQ ID NO: 380081 - protein, 23 aa, Mycobacterium
VLDHFPGWDFGWLDLDKMIRGAE

SEQ ID NO: 380082 - protein, 17 aa, Mycobacterium
VLDWRSARWWGRGASLM

SEQ ID NO: 380083 - protein, 19 aa, Mycobacterium
VLEFLGYFWAPIPWMIEVA

SEQ ID NO: 380084 - protein, 23 aa, Mycobacterium
VLEPWLTFLRALPPLAYFFLLVI

SEQ ID NO: 380085 - protein, 24 aa, Mycobacterium
VLEPWLTFLRALPPLAYFFLLVIW

SEQ ID NO: 380086 - protein, 24 aa, Mycobacterium
VLEPWLTFLRTLPPLAYFFLLVIW

SEQ ID NO: 380087 - protein, 19 aa, Mycobacterium
VLFGALLAWSLACAVAYLQ

SEQ ID NO: 380088 - protein, 17 aa, Mycobacterium
VLFLLAGRRLWHRFRGQ

SEQ ID NO: 380089 - protein, 17 aa, Mycobacterium
VLFLRYWPQLAACYLLG

SEQ ID NO: 380090 - protein, 25 aa, Mycobacterium
VLGLHVALLLLLLPRADWRWRVARA

SEQ ID NO: 380091 - protein, 33 aa, Mycobacterium
VLGLVFLFAAFWIGLFIWYVGVSTLLVGAKATY

SEQ ID NO: 380092 - protein, 20 aa, Mycobacterium
VLGLYYLRLPSLVGVGQYTL

SEQ ID NO: 380093 - protein, 20 aa, Mycobacterium
VLGMILLVIPLFNLSLGGMS

SEQ ID NO: 380094 - protein, 24 aa, Mycobacterium
VLGMLLWLAPIGAFGWIASIIGAT

SEQ ID NO: 380095 - protein, 18 aa, Mycobacterium
VLGVLFIAILVASLWVIR

SEQ ID NO: 380096 - protein, 26 aa, Mycobacterium
VLGWPLWTAYVVVFLLTLVIGARLVV

SEQ ID NO: 380097 - protein, 18 aa, Mycobacterium
VLGWRLVGFLWATVAGAV

SEQ ID NO: 380098 - protein, 19 aa, Mycobacterium
VLIFALWRMLVRRDWRYAA

SEQ ID NO: 380099 - protein, 19 aa, Mycobacterium
VLIFIIMVIVTRALVAAGV

SEQ ID NO: 380100 - protein, 20 aa, Mycobacterium
VLIFIIMVLVTRALVAAGVI

SEQ ID NO: 380101 - protein, 18 aa, Mycobacterium
VLILFAYAAFALLAAFSV

SEQ ID NO: 380102 - protein, 22 aa, Mycobacterium
VLIMALLMLQLVSAGGLYPVET

SEQ ID NO: 380103 - protein, 20 aa, Mycobacterium
VLIMALLMLQLVSAGGMYPV

SEQ ID NO: 380104 - protein, 23 aa, Mycobacterium
VLIVAFFALWWLQQTYQPEPART

SEQ ID NO: 380105 - protein, 29 aa, Mycobacterium
VLIWQHLLGLELHWLVLAFTLIVLLAVGS

SEQ ID NO: 380106 - protein, 18 aa, Mycobacterium
VLKAFYAALGAKNLEVLN

SEQ ID NO: 380107 - protein, 21 aa, Mycobacterium
VLKTPWLLWTVLFASMFVLVV

SEQ ID NO: 380108 - protein, 25 aa, Mycobacterium
VLLAGVLGWLLAGPAIRPLRKLTEH

SEQ ID NO: 380109 - protein, 17 aa, Mycobacterium
VLLFLLTGSVVLPAKAL

SEQ ID NO: 380110 - protein, 17 aa, Mycobacterium
VLLFLLTGSVVLPLQAL

SEQ ID NO: 380111 - protein, 17 aa, Mycobacterium
VLLGPLLALIGRPKVTG

SEQ ID NO: 380112 - protein, 18 aa, Mycobacterium
VLLGPLLYLLGRPKVEGL

SEQ ID NO: 380113 - protein, 21 aa, Mycobacterium
VLLGWPLWVSVIAAAAIVLCY

SEQ ID NO: 380114 - protein, 17 aa, Mycobacterium
VLLGWSFFYFSDDTRGY

SEQ ID NO: 380115 - protein, 17 aa, Mycobacterium
VLLILLGALLGLVPRFG

SEQ ID NO: 380116 - protein, 19 aa, Mycobacterium
VLLIYLWVGIIAFGAASTI

SEQ ID NO: 380117 - protein, 21 aa, Mycobacterium
VLLLCALLFTIIWWEVSHSRS

SEQ ID NO: 380118 - protein, 18 aa, Mycobacterium
VLLLGWSFFYFSDDTRGY

SEQ ID NO: 380119 - protein, 19 aa, Mycobacterium
VLLLGWSFFYFSDDTRGYK

SEQ ID NO: 380120 - protein, 25 aa, Mycobacterium
VLLRFWDWHAIFWSLGAAGLVILAL

SEQ ID NO: 380121 - protein, 24 aa, Mycobacterium
VLLSPMSFLRRPARWMQLLASHPK

SEQ ID NO: 380122 - protein, 20 aa, Mycobacterium
VLLVAAWWLFEALWHPVRGR

SEQ ID NO: 380123 - protein, 17 aa, Mycobacterium
VLLVLWRARRRGPDDPP

SEQ ID NO: 380124 - protein, 27 aa, Mycobacterium
VLMLFAPLRFYGWRIPGLRTLYAFLPR

SEQ ID NO: 380125 - protein, 20 aa, Mycobacterium
VLMLPTLLFIACILAVIVFG

SEQ ID NO: 380126 - protein, 27 aa, Mycobacterium
VLMQLLTDAWLWPLSWINVAAAVVFAI

SEQ ID NO: 380127 - protein, 19 aa, Mycobacterium
VLNAAWSWLFFRFHKLGAS

SEQ ID NO: 380128 - protein, 18 aa, Mycobacterium
VLNGAWSWLFFRFHKLGA

SEQ ID NO: 380129 - protein, 17 aa, Mycobacterium
VLNYWFPAPLWLCSLCL

SEQ ID NO: 380130 - protein, 24 aa, Mycobacterium
VLPLQAISWLLMPISRLLVVLGNA

SEQ ID NO: 380131 - protein, 23 aa, Mycobacterium
VLQAYLNIIYFGRGAYGISAASK

SEQ ID NO: 380132 - protein, 17 aa, Mycobacterium
VLQFFVILAFLVPLTIF

SEQ ID NO: 380133 - protein, 25 aa, Mycobacterium
VLQFTYWQWASLVLAAPVIVWAAWP

SEQ ID NO: 380134 - protein, 22 aa, Mycobacterium
VLQSWFLIRVAFLPTLAVSIPL

SEQ ID NO: 380135 - protein, 23 aa, Mycobacterium
VLQSYLNIIYFGRGAYGVAAAAK

SEQ ID NO: 380136 - protein, 20 aa, Mycobacterium
VLQVLAWVGYLVMVIPAFMR

SEQ ID NO: 380137 - protein, 24 aa, Mycobacterium
VLSGAWLGLFIGLILGFFSPNPWS

SEQ ID NO: 380138 - protein, 17 aa, Mycobacterium
VLSGFLLFLPWVKAAAA

SEQ ID NO: 380139 - protein, 25 aa, Mycobacterium
VLSGLLLNYFLIEPRYTFTIADPDN

SEQ ID NO: 380140 - protein, 19 aa, Mycobacterium
VLSSWLPPGPVAIADYPAV

SEQ ID NO: 380141 - protein, 26 aa, Mycobacterium
VLSVVFFFVWMIAVAMLYLVLGAMGV

SEQ ID NO: 380142 - protein, 17 aa, Mycobacterium
VLTALWWAALAGAAIVA

SEQ ID NO: 380143 - protein, 24 aa, Mycobacterium
VLTAWVVGYALRPLRRLAATAAEV

SEQ ID NO: 380144 - protein, 24 aa, Mycobacterium
VLTGAWLGLFIGLILGFFSPNPWS

SEQ ID NO: 380145 - protein, 22 aa, Mycobacterium
VLTHVLYLNYVWGYSLLKAGFA

SEQ ID NO: 380146 - protein, 18 aa, Mycobacterium
VLVKWWLLGLPQILLCWA

SEQ ID NO: 380147 - protein, 25 aa, Mycobacterium
VLVPAFIHLLGRWTWWAPRPLVSLR

SEQ ID NO: 380148 - protein, 18 aa, Mycobacterium
VLVPLILAATFGGLRIYA

SEQ ID NO: 380149 - protein, 25 aa, Mycobacterium
VLVVAVSIGLWWYFDRRTSDNQAEA

SEQ ID NO: 380150 - protein, 24 aa, Mycobacterium
VLVVRPLWLLLTQSLPRPLRTRLG

SEQ ID NO: 380151 - protein, 30 aa, Mycobacterium
VLVWEYLFGIKLYWVVLALAVILLLAVGSD

SEQ ID NO: 380152 - protein, 26 aa, Mycobacterium
VLVWQYLFGIQLYWVVLALAVILLLA

SEQ ID NO: 380153 - protein, 19 aa, Mycobacterium
VLWFIRRWLVARATMGVEA

SEQ ID NO: 380154 - protein, 25 aa, Mycobacterium
VLYGALFFPVWPLGVLVPVGVAVVM

SEQ ID NO: 380155 - protein, 21 aa, Mycobacterium
VMAIFYLRLPATFGIGTYGVS

SEQ ID NO: 380156 - protein, 18 aa, Mycobacterium
VMALFPMYFLKSSAYTIV

SEQ ID NO: 380157 - protein, 18 aa, Mycobacterium
VMAVLTAFLFMTFSEYRG

SEQ ID NO: 380158 - protein, 23 aa, Mycobacterium
VMEAYLNIIYFGRGAYGISAASK

SEQ ID NO: 380159 - protein, 26 aa, Mycobacterium
VMGLDSLLQWMFYVGLLITAADVLIA

SEQ ID NO: 380160 - protein, 17 aa, Mycobacterium
VMILIVVLLFKTGGNLG

SEQ ID NO: 380161 - protein, 25 aa, Mycobacterium
VMIVLTVFLFFIFGQYRTGSTNGYS

SEQ ID NO: 380162 - protein, 18 aa, Mycobacterium
VMLLIVYRSIVTTLIQLV

SEQ ID NO: 380163 - protein, 17 aa, Mycobacterium
VMLPLVWALNRLGWHAA

SEQ ID NO: 380164 - protein, 18 aa, Mycobacterium
VMLSGLWVAATGQLVLII

SEQ ID NO: 380165 - protein, 17 aa, Mycobacterium
VMNWLGLSWRWLFALSI

SEQ ID NO: 380166 - protein, 18 aa, Mycobacterium
VMSAGWVAVLFALAHWHV

SEQ ID NO: 380167 - protein, 22 aa, Mycobacterium
VMTILFGLVARLPFAFAAGLGI

SEQ ID NO: 380168 - protein, 22 aa, Mycobacterium
VMTKLRWVLLIVGGVGVAVAAV

SEQ ID NO: 380169 - protein, 26 aa, Mycobacterium
VMTLFSFLFAALWLSALAVFQTRSPR

SEQ ID NO: 380170 - protein, 20 aa, Mycobacterium
VMVGFLFLYPAFVAKAHDAD

SEQ ID NO: 380171 - protein, 20 aa, Mycobacterium
VMVGFLFLYPAFVAKAHDAN

SEQ ID NO: 380172 - protein, 21 aa, Mycobacterium
VMVGFLFLYPAFVAKAHQASG

SEQ ID NO: 380173 - protein, 24 aa, Mycobacterium
VNGAVFYVLLFATGQWRHIVPTSW

SEQ ID NO: 380174 - protein, 17 aa, Mycobacterium
VNLWKFFLYIKDEMFLA

SEQ ID NO: 380175 - protein, 19 aa, Mycobacterium
VNMCRLWWNKPWPMRIAAL

SEQ ID NO: 380176 - protein, 21 aa, Mycobacterium
VNPPFLWQHITGHYTNISVQT

SEQ ID NO: 380177 - protein, 24 aa, Mycobacterium
VNSVALLVWVFPVGNLTALTTRVG

SEQ ID NO: 380178 - protein, 29 aa, Mycobacterium
VNVHWSVLVILWLFTWSLASTLPGSVKGY

SEQ ID NO: 380179 - protein, 17 aa, Mycobacterium
VPALLWAVPATAAAVLV

SEQ ID NO: 380180 - protein, 19 aa, Mycobacterium
VPALPGPPPLIPPGGHQGP

SEQ ID NO: 380181 - protein, 24 aa, Mycobacterium
VPALVRLLGTWFWWPTRVLARPRR

SEQ ID NO: 380182 - protein, 31 aa, Mycobacterium; identical to SEQ ID NO: 346636

SEQ ID NO: 380183 - protein, 22 aa, Mycobacterium
VPAPTVIIVGLPAGLRLAVDNA

SEQ ID NO: 380184 - protein, 18 aa, Mycobacterium
VPAQLPLNTLRRWQRMVP

SEQ ID NO: 380185 - protein, 27 aa, Mycobacterium
VPAVLLHHWLQLALITPVMFYVGWPIH

SEQ ID NO: 380186 - protein, 20 aa, Mycobacterium
VPDWLFSLIALIAVANGALL

SEQ ID NO: 380187 - protein, 23 aa, Mycobacterium
VPGDRFWWALNRVAGFSIASHRD

SEQ ID NO: 380188 - protein, 17 aa, Mycobacterium
VPGFAWWAAALNSLPML

SEQ ID NO: 380189 - protein, 30 aa, Mycobacterium
VPGIAGLLGRWFWWSPPAFLLGPLRRRTSQ

SEQ ID NO: 380190 - protein, 30 aa, Mycobacterium
VPGRYFYVKWWKLALMLLGVWAAAAVVGLG

SEQ ID NO: 380191 - protein, 24 aa, Mycobacterium
VPKALFWIALLWVAVTTVIAIWIG

SEQ ID NO: 380192 - protein, 17 aa, Mycobacterium
VPLILGWVLLIAVLNSV

SEQ ID NO: 380193 - protein, 20 aa, Mycobacterium
VPLLLGALWASGRFARRADK

SEQ ID NO: 380194 - protein, 17 aa, Mycobacterium
VPLLRRPAVIVGKSTVP

SEQ ID NO: 380195 - protein, 26 aa, Mycobacterium
VPLQVISWLLMPISRLLVLLGNALTP

SEQ ID NO: 380196 - protein, 17 aa, Mycobacterium
VPLVMVLVIAIASFAVV

SEQ ID NO: 380197 - protein, 19 aa, Mycobacterium
VPLWIAFALSTKAATRRYT

SEQ ID NO: 380198 - protein, 17 aa, Mycobacterium
VPPLMWNLTAPDAQAVL

SEQ ID NO: 380199 - protein, 31 aa, Mycobacterium
VPPSLLRRALPYLIVILIVGMIVALVATGLR

SEQ ID NO: 380200 - protein, 26 aa, Mycobacterium
VPSIVALLGRWFWWPSRPPRRAMAEA

SEQ ID NO: 380201 - protein, 19 aa, Mycobacterium
VPSLLRSLLTDHLDPGYAA

SEQ ID NO: 380202 - protein, 23 aa, Mycobacterium
VPTIPWWMWLLVAFGALTATFAG

SEQ ID NO: 380203 - protein, 17 aa, Mycobacterium
VPTVRFRPFIRLTVEWV

SEQ ID NO: 380204 - protein, 17 aa, Mycobacterium
VPVILASALFGGGLLPL

SEQ ID NO: 380205 - protein, 17 aa, Mycobacterium
VPVLFWINAVACALLAL

SEQ ID NO: 380206 - protein, 26 aa, Mycobacterium
VPVLLYRIWRLWRYPSLLPGKAVTGF

SEQ ID NO: 380207 - protein, 19 aa, Mycobacterium
VPVVFLTALFGLQDLAKIQ

SEQ ID NO: 380208 - protein, 18 aa, Mycobacterium
VPWWFLVCQLPISGLVFA

SEQ ID NO: 380209 - protein, 18 aa, Mycobacterium
VPWWWWPLGFAAAALIAF

SEQ ID NO: 380210 - protein, 21 aa, Mycobacterium
VPYIRWPMWLRTVTATAALAA

SEQ ID NO: 380211 - protein, 35 aa, Mycobacterium
VPYLRASPWLLWRKRVVWLLVLFVAEAYTGSVLRA

SEQ ID NO: 380212 - protein, 17 aa, Mycobacterium
VQAFFIYFGIPATMGFQ

SEQ ID NO: 380213 - protein, 26 aa, Mycobacterium
VQASSWRWVFLVNLPLGIIAVVVARR

SEQ ID NO: 380214 - protein, 24 aa, Mycobacterium
VQGQFYIAFLLLVFGMAFLLRGLL

SEQ ID NO: 380215 - protein, 17 aa, Mycobacterium
VQIILILLEILYAIVAY

SEQ ID NO: 380216 - protein, 17 aa, Mycobacterium
VQLFMLQVPRAAGLRAE

SEQ ID NO: 380217 - protein, 21 aa, Mycobacterium
VQLIFAWMVLSVRLLVARPRA

SEQ ID NO: 380218 - protein, 20 aa, Mycobacterium
VQLIFWFNFAALYPHLSFGI

SEQ ID NO: 380219 - protein, 21 aa, Mycobacterium
VQLVLMYLYITLRGAIAMVTL

SEQ ID NO: 380220 - protein, 17 aa, Mycobacterium
VQMLFDLLQLVVAYVVL

SEQ ID NO: 380221 - protein, 21 aa, Mycobacterium
VQPFGEYLPWRSFFSKLSSYA

SEQ ID NO: 380222 - protein, 19 aa, Mycobacterium
VQPLLMFSLLFALPINARL

SEQ ID NO: 380223 - protein, 17 aa, Mycobacterium
VQTFRARWIPTAQARVF

SEQ ID NO: 380224 - protein, 24 aa, Mycobacterium
VRAFAIPIIFFWGLLAVATNTFMP

SEQ ID NO: 380225 - protein, 19 aa, Mycobacterium
VRAIWVLRDLLREYGRRLV

SEQ ID NO: 380226 - protein, 20 aa, Mycobacterium
VRLLRPLILLPLVLPPVVGG

SEQ ID NO: 380227 - protein, 17 aa, Mycobacterium
VRMLLVPAFMQVLGRLN

SEQ ID NO: 380228 - protein, 18 aa, Mycobacterium
VRMVLLPAYMKLLGRFNW

SEQ ID NO: 380229 - protein, 17 aa, Mycobacterium
VRPPPRRPAHRKLVGWL

SEQ ID NO: 380230 - protein, 24 aa, Mycobacterium
VRQLFMVQLWFRPYFDLSSWNGPA

SEQ ID NO: 380231 - protein, 27 aa, Mycobacterium
VRRFAIPIILFWVAITALLNLAVPQLE

SEQ ID NO: 380232 - protein, 25 aa, Mycobacterium
VRRNKPWVWLLYALGLMLSILISIN

SEQ ID NO: 380233 - protein, 26 aa, Mycobacterium
VRRNRPWLWLLYALVLMVSILININL

SEQ ID NO: 380234 - protein, 23 aa, Mycobacterium
VRRRKELWLRVANLFAFIAALAG

SEQ ID NO: 380235 - protein, 23 aa, Mycobacterium
VRRWFRIALACLLLIAVAGVAVG

SEQ ID NO: 380236 - protein, 20 aa, Mycobacterium
VRTTWFFATLLFAIGYVLVV

SEQ ID NO: 380237 - protein, 18 aa, Mycobacterium
VRVMFLMALVFLALGWST

SEQ ID NO: 380238 - protein, 23 aa, Mycobacterium
VRWPWVVIGAWVALAIALPLTFP

SEQ ID NO: 380239 - protein, 25 aa, Mycobacterium
VRWSVAWRMLLAWCFTLPASGIVGG

SEQ ID NO: 380240 - protein, 17 aa, Mycobacterium
VSALFFPWNLYFGFRIP

SEQ ID NO: 380241 - protein, 26 aa, Mycobacterium
VSFLAPWLFFMFIDIFGTDRAGMGGL

SEQ ID NO: 380242 - protein, 21 aa, Mycobacterium
VSFLTYFYFLVTGFLEPLHTL

SEQ ID NO: 380243 - protein, 18 aa, Mycobacterium
VSFSLFIYGLMGLTGPKT

SEQ ID NO: 380244 - protein, 25 aa, Mycobacterium
VSIAAVIVLLAWWKGMFLTTRIGRA

SEQ ID NO: 380245 - protein, 18 aa, Mycobacterium
VSIPLTVLIIFTLNILLA

SEQ ID NO: 380246 - protein, 19 aa, Mycobacterium
VSLFPLLLLLTTALGVVLA

SEQ ID NO: 380247 - protein, 25 aa, Mycobacterium
VSLGIILLGLLWYAGLPLKVFVSSL

SEQ ID NO: 380248 - protein, 19 aa, Mycobacterium
VSLGVCWLIWVLNAYDREI

SEQ ID NO: 380249 - protein, 17 aa, Mycobacterium
VSLIGWWALSRLLERMR

SEQ ID NO: 380250 - protein, 18 aa, Mycobacterium
VSLIGWWALSRLLERMRG

SEQ ID NO: 380251 - protein, 29 aa, Mycobacterium
VSLLLSVVLFFVWMIAVAFLYLVLGGMGV

SEQ ID NO: 380252 - protein, 30 aa, Mycobacterium
VSLTGFQNPWFFLALLAVLLVIGLYVVQQF

SEQ ID NO: 380253 - protein, 23 aa, Mycobacterium
VSLTLLPILLGFAAPRGLSVPQT

SEQ ID NO: 380254 - protein, 18 aa, Mycobacterium
VSMFRPPFAWREYLLQCW

SEQ ID NO: 380255 - protein, 25 aa, Mycobacterium
VSMGIILLGLLWYAGLPLRVFASSL

SEQ ID NO: 380256 - protein, 25 aa, Mycobacterium
VSMGIILLGLLWYAGLPLRVFMSSF

SEQ ID NO: 380257 - protein, 23 aa, Mycobacterium
VSMPYFPNYLSLAGPYAFLGLNF

SEQ ID NO: 380258 - protein, 19 aa, Mycobacterium
VSRIHLIIRFVDGKWIAED

SEQ ID NO: 380259 - protein, 19 aa, Mycobacterium
VSRWPGPVLAGSLLVLVVC

SEQ ID NO: 380260 - protein, 27 aa, Mycobacterium
VSSSPLAWLWQILFGTSTFPTSIAALL

SEQ ID NO: 380261 - protein, 22 aa, Mycobacterium
VSTYLLLPVLRWQYRSPDFESE

SEQ ID NO: 380262 - protein, 18 aa, Mycobacterium
VSVLILWTPVMVFGFVLM

SEQ ID NO: 380263 - protein, 21 aa, Mycobacterium
VSVLWLWWTTNLLSGLLALAT

SEQ ID NO: 380264 - protein, 17 aa, Mycobacterium
VSVVLVFYFVWGRHHSA

SEQ ID NO: 380265 - protein, 20 aa, Mycobacterium
VSWFGVIVALALIALALTIL

SEQ ID NO: 380266 - protein, 17 aa, Mycobacterium
VSWLPLYHDMGLMVGLF

SEQ ID NO: 380267 - protein, 23 aa, Mycobacterium
VTATLWIPPLIYFALHRIRRYPN

SEQ ID NO: 380268 - protein, 30 aa, Mycobacterium
VTFVVIIVLLLFFYRSISTVLLLLVVVGIQ

SEQ ID NO: 380269 - protein, 29 aa, Mycobacterium
VTGFQNAWFFLFLLAVLLILGIYVVLQFA

SEQ ID NO: 380270 - protein, 23 aa, Mycobacterium
VTGYLMCAVLLAGAIWVASTSRS

SEQ ID NO: 380271 - protein, 23 aa, Mycobacterium
VTIAAPAYWSGAQLGALRGALLT

SEQ ID NO: 380272 - protein, 19 aa, Mycobacterium
VTIWLSWPYGARGVLAGFG

SEQ ID NO: 380273 - protein, 28 aa, Mycobacterium
VTLALFFGALVLWMILRPLQTRAIAAEV

SEQ ID NO: 380274 - protein, 33 aa, Mycobacterium
VTLALLAWTAPLLGWVWWVYTVAAVLVVGAVLA

SEQ ID NO: 380275 - protein, 18 aa, Mycobacterium
VTLRRWLWPAVTAPVCCL

SEQ ID NO: 380276 - protein, 24 aa, Mycobacterium
VTLSWLLIIYGFTASVLPVWLLLA

SEQ ID NO: 380277 - protein, 23 aa, Mycobacterium
VTLTLVWFVALFVMFFRGSPQIP

SEQ ID NO: 380278 - protein, 18 aa, Mycobacterium
VTLVWLYIEILRLLSYLQ

SEQ ID NO: 380279 - protein, 18 aa, Mycobacterium
VTLVWLYVEILRLLSYFQ

SEQ ID NO: 380280 - protein, 18 aa, Mycobacterium
VTLYRQYVARFGLGYTVT

SEQ ID NO: 380281 - protein, 17 aa, Mycobacterium
VTMFLPLLTIGLSLVTA

SEQ ID NO: 380282 - protein, 17 aa, Mycobacterium
VTMLLPLLSIGTSLVIA

SEQ ID NO: 380283 - protein, 22 aa, Mycobacterium
VTNLELYLIFPLANEQATIALV

SEQ ID NO: 380284 - protein, 26 aa, Mycobacterium
VTNRFLLDQLSWLTPARWGFAASAST

SEQ ID NO: 380285 - protein, 29 aa, Mycobacterium
VTPVLWWIGPFLLYLLLPALDVFFGPDGE

SEQ ID NO: 380286 - protein, 17 aa, Mycobacterium
VTRIRWPMWLRTALATV

SEQ ID NO: 380287 - protein, 20 aa, Mycobacterium
VTRPAAPRRRFSLAVVGSAA

SEQ ID NO: 380288 - protein, 17 aa, Mycobacterium
VTRWRWAGLTTAAFLLL

SEQ ID NO: 380289 - protein, 26 aa, Mycobacterium
VTSRIRLWLPYLPLVLAAAIGLGHLM

SEQ ID NO: 380290 - protein, 22 aa, Mycobacterium
VTTFPWVFLFPAGVLVLIAFCA

SEQ ID NO: 380291 - protein, 24 aa, Mycobacterium
VTVGWFLPLLGLTLAAFALTDLIL

SEQ ID NO: 380292 - protein, 24 aa, Mycobacterium
VTVILLVMYWPLGVVVLVSIVPIT

SEQ ID NO: 380293 - protein, 25 aa, Mycobacterium
VTVPIWVVFLAWASFFFVGGGPAGW

SEQ ID NO: 380294 - protein, 18 aa, Mycobacterium
VTYWIVHLIGGYPGVIVG

SEQ ID NO: 380295 - protein, 23 aa, Mycobacterium
VVAAVYLGAFGLAGGLGWKLWDE

SEQ ID NO: 380296 - protein, 26 aa, Mycobacterium
VVADRAYFVFLALLPFVMGALSLTVP

SEQ ID NO: 380297 - protein, 17 aa, Mycobacterium
VVAGLCWLSFSWPGRRA

SEQ ID NO: 380298 - protein, 24 aa, Mycobacterium
VVALLLILTYRSPVLWLLPLLVIA

SEQ ID NO: 380299 - protein, 20 aa, Mycobacterium
VVALLLLLGAPFLGVKWGFP

SEQ ID NO: 380300 - protein, 18 aa, Mycobacterium
VVALLVVVLVAAAALVAG

SEQ ID NO: 380301 - protein, 23 aa, Mycobacterium
VVASSVVAVLIWPRADEGTDPRT

SEQ ID NO: 380302 - protein, 19 aa, Mycobacterium
VVAVFLPWNLYFGVGIPGS

SEQ ID NO: 380303 - protein, 24 aa, Mycobacterium
VVAVLSMMVWISPLLALITLLTVP

SEQ ID NO: 380304 - protein, 23 aa, Mycobacterium
VVAWSVWVVELLAGMTALGGGIK

SEQ ID NO: 380305 - protein, 22 aa, Mycobacterium
VVAYRTWRWWLATAAAFFAVVV

SEQ ID NO: 380306 - protein, 17 aa, Mycobacterium
VVDPSWFAGLIVAWLWL

SEQ ID NO: 380307 - protein, 21 aa, Mycobacterium
VVFIVAVIFFSGFFVGKQYGG

SEQ ID NO: 380308 - protein, 20 aa, Mycobacterium
VVFLVTWPLVYLASKSPRLA

SEQ ID NO: 380309 - protein, 17 aa, Mycobacterium
VVFLVTWPLVYLSSKSA

SEQ ID NO: 380310 - protein, 25 aa, Mycobacterium
VVGAQVLFSLLLTPAIRLTNGAANW

SEQ ID NO: 380311 - protein, 24 aa, Mycobacterium
VVGAVLLILTWAYQTATRLDRLHV

SEQ ID NO: 380312 - protein, 19 aa, Mycobacterium
VVGILLLQFFSFGLHLIPA

SEQ ID NO: 380313 - protein, 23 aa, Mycobacterium
VVGLLLLLIARPLSVVASLAAFR

SEQ ID NO: 380314 - protein, 23 aa, Mycobacterium
VVGSGIDIPLIKPALEAATTLPL

SEQ ID NO: 380315 - protein, 30 aa, Mycobacterium
VVHPTFLYELIWNIAVFGFLIWVDRKFRIG

SEQ ID NO: 380316 - protein, 29 aa, Mycobacterium
VVHPTFLYELLWNVLVFAMLIYLDRRFTI

SEQ ID NO: 380317 - protein, 23 aa, Mycobacterium
VVIALVTLLIWWTSDARATVSRP

SEQ ID NO: 380318 - protein, 17 aa, Mycobacterium
VVILLLSAATYALGVIW

SEQ ID NO: 380319 - protein, 18 aa, Mycobacterium
VVIVLAVLMVLLPRLFPG

SEQ ID NO: 380320 - protein, 17 aa, Mycobacterium
VVLALWYYRLYVYPPVT

SEQ ID NO: 380321 - protein, 20 aa, Mycobacterium
VVLFDMLLTLLFWGNNPGIQ

SEQ ID NO: 380322 - protein, 17 aa, Mycobacterium
VVLFFVFGTVIAAALPA

SEQ ID NO: 380323 - protein, 18 aa, Mycobacterium
VVLGGFLRVFPAFAAAVL

SEQ ID NO: 380324 - protein, 27 aa, Mycobacterium
VVLGLGYPVFIWLVAQLPGLQDKADGS

SEQ ID NO: 380325 - protein, 17 aa, Mycobacterium
VVLIFRLGGAWPPQRGF

SEQ ID NO: 380326 - protein, 19 aa, Mycobacterium
VVLLFVILLVIYRNPVTMV

SEQ ID NO: 380327 - protein, 22 aa, Mycobacterium
VVLLGWSFFYFSDDTRGYKPVD

SEQ ID NO: 380328 - protein, 20 aa, Mycobacterium
VVLLLGWSFFYFSDDTRGYK

SEQ ID NO: 380329 - protein, 17 aa, Mycobacterium
VVLLLIATLFLLRSMNR

SEQ ID NO: 380330 - protein, 18 aa, Mycobacterium
VVLLLLRGLVASLIVIGS

SEQ ID NO: 380331 - protein, 24 aa, Mycobacterium
VVLLVRPLWLLLTQSLPGSLHTRL

SEQ ID NO: 380332 - protein, 21 aa, Mycobacterium
VVLLVSAWWLFDALWHPVRGR

SEQ ID NO: 380333 - protein, 24 aa, Mycobacterium
VVLPPPVVVLPRPQWNPPRPAWTW

SEQ ID NO: 380334 - protein, 20 aa, Mycobacterium
VVLVFYFVWGRHHSALNDGG

SEQ ID NO: 380335 - protein, 18 aa, Mycobacterium
VVMNWLGLSWRWLFGLSI

SEQ ID NO: 380336 - protein, 24 aa, Mycobacterium
VVNLLRKVPPRKLGYRLAWLYNVL

SEQ ID NO: 380337 - protein, 32 aa, Mycobacterium
VVPPSLLRRVLPFLIVILIVGMIVALFATGMR

SEQ ID NO: 380338 - protein, 17 aa, Mycobacterium
VVQAALLILLSRLSANS

SEQ ID NO: 380339 - protein, 30 aa, Mycobacterium
VVQPTFLYELLWNLLIFAVLIYADRRFTLG

SEQ ID NO: 380340 - protein, 19 aa, Mycobacterium
VVRYIWWVVGAAALAGVVY

SEQ ID NO: 380341 - protein, 26 aa, Mycobacterium
VVSDRAYFVFLAVLPFVMGALSLTVP

SEQ ID NO: 380342 - protein, 30 aa, Mycobacterium
VVSDRWYTVFLAALPFMLGLLTLTVPGHSG

SEQ ID NO: 380343 - protein, 23 aa, Mycobacterium
VVSILLLWFATLVQTYVGLTGEI

SEQ ID NO: 380344 - protein, 25 aa, Mycobacterium
VVSLGLWVIFLPSVVRRRLPEKWAA

SEQ ID NO: 380345 - protein, 19 aa, Mycobacterium
VVSRWRPIYARAPFAEVLL

SEQ ID NO: 380346 - protein, 19 aa, Mycobacterium
VVSWLPFYHDMGFFVGIII

SEQ ID NO: 380347 - protein, 19 aa, Mycobacterium
VVTFEEFFFPLPGLWKWVA

SEQ ID NO: 380348 - protein, 17 aa, Mycobacterium
VVTFVLIFLMTGSVILP

SEQ ID NO: 380349 - protein, 19 aa, Mycobacterium
VVTVLIIVKLLSVVVAGRS

SEQ ID NO: 380350 - protein, 19 aa, Mycobacterium
VVVIFAVALVLYIVGSADD

SEQ ID NO: 380351 - protein, 25 aa, Mycobacterium
VVVILFAWWRGLFVTTLVARRIRLL

SEQ ID NO: 380352 - protein, 24 aa, Mycobacterium
VVVLFILIMLLRAVVAPLYLVASV

SEQ ID NO: 380353 - protein, 26 aa, Mycobacterium
VVVLFVPAALPWYYTWPLAVAAALVQ

SEQ ID NO: 380354 - protein, 25 aa, Mycobacterium
VVVLFVPAALPWYYTWPLAVIAALA

SEQ ID NO: 380355 - protein, 18 aa, Mycobacterium
VVVLGLLAFLLMLSEGSA

SEQ ID NO: 380356 - protein, 24 aa, Mycobacterium
VVVLLLLFVLYRARRRRRAPGSVA

SEQ ID NO: 380357 - protein, 22 aa, Mycobacterium
VVVLVAIIALVVLLLVPSQSSD

SEQ ID NO: 380358 - protein, 17 aa, Mycobacterium
VVVPLNWRLVANELAFM

SEQ ID NO: 380359 - protein, 26 aa, Mycobacterium
VVVPPLLPFLVPPVLATGPETLLRPP

SEQ ID NO: 380360 - protein, 19 aa, Mycobacterium
VVVPTWWPGQRVDVIVAAA

SEQ ID NO: 380361 - protein, 32 aa, Mycobacterium
VVVQPTFLYELIWNLLVFAALIYLDRRFTIGH

SEQ ID NO: 380362 - protein, 23 aa, Mycobacterium
VVVTLYAVFRWFFAKDLRVQPRP

SEQ ID NO: 380363 - protein, 18 aa, Mycobacterium
VVVVAAVILWRFVGDTLS

SEQ ID NO: 380364 - protein, 24 aa, Mycobacterium
VVVVLALRRVWWLYKLIMSGQPAS

SEQ ID NO: 380365 - protein, 23 aa, Mycobacterium
VVVVLGWSFFYFSDDTRGYKPVD

SEQ ID NO: 380366 - protein, 19 aa, Mycobacterium
VVVVVFGTKLWNVMLGTGG

SEQ ID NO: 380367 - protein, 17 aa, Mycobacterium
VVVWLSLYRWDLLGPLR

SEQ ID NO: 380368 - protein, 31 aa, Mycobacterium
VVVWQYIFGIPLYWVIFPLAVIILLAVGADY

SEQ ID NO: 380369 - protein, 17 aa, Mycobacterium
VVVYALLPVLWIFSLSL

SEQ ID NO: 380370 - protein, 19 aa, Mycobacterium
VVVYALLPVLWIFSLSLKP

SEQ ID NO: 380371 - protein, 22 aa, Mycobacterium
VVVYALLPVLWILSLSLKPTST

SEQ ID NO: 380372 - protein, 25 aa, Mycobacterium
VVWGALPFHRAAWLNLRHGTATMDT

SEQ ID NO: 380373 - protein, 23 aa, Mycobacterium
VVYEPLLNRLPPDTPMYGFERVE

SEQ ID NO: 380374 - protein, 19 aa, Mycobacterium
VVYPFVIVGLLLMVFLPKL

SEQ ID NO: 380375 - protein, 24 aa, Mycobacterium
VVYRTLFMAFLWTIALTFEAGFFL

SEQ ID NO: 380376 - protein, 18 aa, Mycobacterium
VWALLAMAAARLGLGPLR

SEQ ID NO: 380377 - protein, 18 aa, Mycobacterium
VWCALAICLGLIAAAFTI

SEQ ID NO: 380378 - protein, 24 aa, Mycobacterium
VWFSLFCTVFFGLGWLVTLRNGDL

SEQ ID NO: 380379 - protein, 18 aa, Mycobacterium
VWLIPLMMWLLHGPLSAL

SEQ ID NO: 380380 - protein, 18 aa, Mycobacterium
VWLQFRGRLTPTTQLTML

SEQ ID NO: 380381 - protein, 24 aa, Mycobacterium
VWNIARWPLLLVLVVFGVAMLYYV

SEQ ID NO: 380382 - protein, 18 aa, Mycobacterium
VWNTANLLRKEGFGAAVR

SEQ ID NO: 380383 - protein, 23 aa, Mycobacterium
VWQPLLLWTPLGIGLLLLVISIL

SEQ ID NO: 380384 - protein, 17 aa, Mycobacterium
VWRLILIIAFFGGVEIL

SEQ ID NO: 380385 - protein, 20 aa, Mycobacterium
VYAGLLLLMRARFKRLPIPI

SEQ ID NO: 380386 - protein, 22 aa, Mycobacterium
VYEPLLKRLPADTPMYGFERVE

SEQ ID NO: 380387 - protein, 29 aa, Mycobacterium
VYIGVALSWPLWWVAVCSVLCLLIVEGVV

SEQ ID NO: 380388 - protein, 26 aa, Mycobacterium
VYLGAALGWPTWWVSVCSILCLLIVQ

SEQ ID NO: 380389 - protein, 18 aa, Mycobacterium
VYLQFRGDFTPKVKLTMF

SEQ ID NO: 380390 - protein, 24 aa, Mycobacterium
VYNFFDIFTYAWDSIALLGMDIGE

SEQ ID NO: 380391 - protein, 23 aa, Mycobacterium
VYYRVWFLKLRRKLRLPPRPLWR

SEQ ID NO: 380392 - protein, 17 aa, Mycobacterium
VYYWVICLVLSFGQARF

SEQ ID NO: 380393 - protein, 25 aa, Mycobacterium
WAACKIFFSFLWAALRNAPSVWLGG

SEQ ID NO: 380394 - protein, 21 aa, Mycobacterium
WAALPPLLVYAILGSSRQLSV

SEQ ID NO: 380395 - protein, 27 aa, Mycobacterium
WAAVLALLFFAFFTRGIPEYYSVVMGN

SEQ ID NO: 380396 - protein, 36 aa, Mycobacterium
WACHRPNRLWWRFTAWWLLCGALAVTWWVVALLMLG

SEQ ID NO: 380397 - protein, 18 aa, Mycobacterium
WAGLTTAAFLLLVAALRP

SEQ ID NO: 380398 - protein, 19 aa, Mycobacterium
WAHWLVMVGFLGGFPLYFE

SEQ ID NO: 380399 - protein, 19 aa, Mycobacterium
WAILAVVVILLFGAKKLPD

SEQ ID NO: 380400 - protein, 21 aa, Mycobacterium
WALMLDYLLLPLVNYLLIGIY

SEQ ID NO: 380401 - protein, 20 aa, Mycobacterium
WARILYQWRWSLVVFWFVAL

SEQ ID NO: 380402 - protein, 23 aa, Mycobacterium
WARLTTVFVIDLLILIVASHCPD

SEQ ID NO: 380403 - protein, 17 aa, Mycobacterium
WASLALAAPVIVWAGRP

SEQ ID NO: 380404 - protein, 18 aa, Mycobacterium
WASWLRIVVGVLLILWGA

SEQ ID NO: 380405 - protein, 26 aa, Mycobacterium
WATVVWAYALFWFLVEDRVKLSTYQW

SEQ ID NO: 380406 - protein, 21 aa, Mycobacterium
WAVFFALIALLVVAGFGWVGW

SEQ ID NO: 380407 - protein, 18 aa, Mycobacterium
WAVIGVWIALAVALPLSF

SEQ ID NO: 380408 - protein, 18 aa, Mycobacterium
WAVLVYFPVAHWVFAFDG

SEQ ID NO: 380409 - protein, 17 aa, Mycobacterium
WAWRLLVILAAAVALLW

SEQ ID NO: 380410 - protein, 18 aa, Mycobacterium
WAWRLLVLLAFGLTVLWL

SEQ ID NO: 380411 - protein, 20 aa, Mycobacterium
WCYRQRWVVIAAWLVLISAV

SEQ ID NO: 380412 - protein, 28 aa, Mycobacterium
WDRFGPRYLLACWVLAFVISLPIYSVLI

SEQ ID NO: 380413 - protein, 19 aa, Mycobacterium
WEFLTHPFEFLKDLLNKLV

SEQ ID NO: 380414 - protein, 22 aa, Mycobacterium
WEILFMIFLVIATYALFRGAAV

SEQ ID NO: 380415 - protein, 27 aa, Mycobacterium
WELARPPVWLFFLFLVTATGAHALKVV

SEQ ID NO: 380416 - protein, 17 aa, Mycobacterium
WEVPLIELGLDSLMAVR

SEQ ID NO: 380417 - protein, 18 aa, Mycobacterium
WEWIFFVNIPIGVLGVAL

SEQ ID NO: 380418 - protein, 19 aa, Mycobacterium
WEWIFLINLPIGITTIVLA

SEQ ID NO: 380419 - protein, 18 aa, Mycobacterium
WFALLLQITGAIAVVQVI

SEQ ID NO: 380420 - protein, 21 aa, Mycobacterium
WFGPYRLVRLLRQGGMGEVYE

SEQ ID NO: 380421 - protein, 22 aa, Mycobacterium
WFGVEAWRWMLLVGLVPAVVYA

SEQ ID NO: 380422 - protein, 28 aa, Mycobacterium
WFIGGIVFTFVLLNTMFGWWVLSRVIRR

SEQ ID NO: 380423 - protein, 18 aa, Mycobacterium
WFPMWFSYLLLIAVYPAF

SEQ ID NO: 380424 - protein, 18 aa, Mycobacterium
WFPMWFSYLLLIVVYPAF

SEQ ID NO: 380425 - protein, 17 aa, Mycobacterium
WFWWPQMVRRRPKPSPW

SEQ ID NO: 380426 - protein, 20 aa, Mycobacterium
WFYWALSVAVGLPIGLVLLT

SEQ ID NO: 380427 - protein, 24 aa, Mycobacterium
WGFFILLFLLLPASHWFFGMMLWL

SEQ ID NO: 380428 - protein, 19 aa, Mycobacterium
WGLPLWWVCVNPLMPLTAG

SEQ ID NO: 380429 - protein, 22 aa, Mycobacterium
WGLSFFIFSLVLLKLGWLPQIE

SEQ ID NO: 380430 - protein, 23 aa, Mycobacterium
WGPRLLWRLFQLLTLAALVIAAS

SEQ ID NO: 380431 - protein, 17 aa, Mycobacterium
WGQPAWSWAVLGLRGRR

SEQ ID NO: 380432 - protein, 19 aa, Mycobacterium
WGRYLRRGALPVLLVASLA

SEQ ID NO: 380433 - protein, 22 aa, Mycobacterium
WGWRIPFILGAVLMLVGLWLRR

SEQ ID NO: 380434 - protein, 22 aa, Mycobacterium
WGWRIPFLLSFVLMLFAIWLRL

SEQ ID NO: 380435 - protein, 17 aa, Mycobacterium
WHLGPLPIRAYAFFIII

SEQ ID NO: 380436 - protein, 18 aa, Mycobacterium
WIAIVVLTGLLAVSLAGS

SEQ ID NO: 380437 - protein, 18 aa, Mycobacterium
WIALAVALPLSFPSLGQM

SEQ ID NO: 380438 - protein, 17 aa, Mycobacterium
WIALVILAVVVIAAFSV

SEQ ID NO: 380439 - protein, 19 aa, Mycobacterium
WIDVPLWLTALILLIAMTA

SEQ ID NO: 380440 - protein, 18 aa, Mycobacterium
WIFGWTRLPRWLHLACIW

SEQ ID NO: 380441 - protein, 21 aa, Mycobacterium
WIGWFPLRWTAFAIRPFMSIL

SEQ ID NO: 380442 - protein, 19 aa, Mycobacterium
WIIAILALLFALWVLVAAI

SEQ ID NO: 380443 - protein, 17 aa, Mycobacterium
WIIVVLPIAKIIATSLS

SEQ ID NO: 380444 - protein, 19 aa, Mycobacterium
WIRRLSIPIVIGWLAIVFA

SEQ ID NO: 380445 - protein, 24 aa, Mycobacterium
WISPLLALITLLTVPLSLLVTRAI

SEQ ID NO: 380446 - protein, 18 aa, Mycobacterium
WITWIAFGAWVAIVLVFY

SEQ ID NO: 380447 - protein, 20 aa, Mycobacterium
WIVCWLVLVWVLLWGNISAA

SEQ ID NO: 380448 - protein, 17 aa, Mycobacterium
WIVLQLCLVVLLVAVWR

SEQ ID NO: 380449 - protein, 21 aa, Mycobacterium
WIVLQLCVVVALFALWQARRL

SEQ ID NO: 380450 - protein, 17 aa, Mycobacterium
WLAGLWRDILAAPVDGP

SEQ ID NO: 380451 - protein, 17 aa, Mycobacterium
WLALLALPLLFVAHRLP

SEQ ID NO: 380452 - protein, 17 aa, Mycobacterium
WLALVWVIVETVNVLWP

SEQ ID NO: 380453 - protein, 19 aa, Mycobacterium
WLAVVIYLLPRRASLRVAA

SEQ ID NO: 380454 - protein, 20 aa, Mycobacterium
WLFDMGMLAALSIGYAGLVR

SEQ ID NO: 380455 - protein, 19 aa, Mycobacterium
WLGFLLVAIPVCLSPGAGA

SEQ ID NO: 380456 - protein, 18 aa, Mycobacterium
WLGLLLLMFLSGAEMQQL

SEQ ID NO: 380457 - protein, 19 aa, Mycobacterium
WLGYFLLLASFMVGAAVGG

SEQ ID NO: 380458 - protein, 20 aa, Mycobacterium
WLHAAVWWKALLALVVAIAL

SEQ ID NO: 380459 - protein, 28 aa, Mycobacterium
WLIGAFSWPWIFLVNLPIGLIAFTLAAI

SEQ ID NO: 380460 - protein, 17 aa, Mycobacterium
WLIPWWTARVTVWAVAI

SEQ ID NO: 380461 - protein, 20 aa, Mycobacterium
WLLEHFWWGSIFMVNIPIAV

SEQ ID NO: 380462 - protein, 18 aa, Mycobacterium
WLLLVIFAVFGIGFALVN

SEQ ID NO: 380463 - protein, 23 aa, Mycobacterium
WLNETIFRLLQKAASLPGGWLTA

SEQ ID NO: 380464 - protein, 25 aa, Mycobacterium
WLQSWTIFYWAWWISWTPFVGMFIA

SEQ ID NO: 380465 - protein, 26 aa, Mycobacterium
WLSAGALVFILVVAAAYLFVGALQVN

SEQ ID NO: 380466 - protein, 18 aa, Mycobacterium
WLSVLWLVPLAGAVLIIL

SEQ ID NO: 380467 - protein, 18 aa, Mycobacterium
WLTPARWGFAASASTIDT

SEQ ID NO: 380468 - protein, 17 aa, Mycobacterium
WLVGISAALVLVAGGIG

SEQ ID NO: 380469 - protein, 17 aa, Mycobacterium
WLVLIAFPLLTAALFGL

SEQ ID NO: 380470 - protein, 18 aa, Mycobacterium
WLVTLPLAGLVGAFTYEI

SEQ ID NO: 380471 - protein, 18 aa, Mycobacterium
WMAIMFFAGFLILYSLGV

SEQ ID NO: 380472 - protein, 18 aa, Mycobacterium
WMSMYQAKWWWLLAAMVA

SEQ ID NO: 380473 - protein, 18 aa, Mycobacterium
WNFPIVLVILLAVFGSLA

SEQ ID NO: 380474 - protein, 19 aa, Mycobacterium
WNLLTWLLGIPSSSSHALI

SEQ ID NO: 380475 - protein, 18 aa, Mycobacterium
WNMPIVLIVLLAVFGSLA

SEQ ID NO: 380476 - protein, 19 aa, Mycobacterium
WNWLSTTVFPGLKLAFTAI

SEQ ID NO: 380477 - protein, 17 aa, Mycobacterium
WNWWLPRWLDKILPEVD

SEQ ID NO: 380478 - protein, 20 aa, Mycobacterium
WPFVLLPHLGMIRGAAATGI

SEQ ID NO: 380479 - protein, 19 aa, Mycobacterium
WPVLTGRWLFYGALGAAAA

SEQ ID NO: 380480 - protein, 19 aa, Mycobacterium
WQHIFGIKLHWLVLPMSVI

SEQ ID NO: 380481 - protein, 24 aa, Mycobacterium
WQHIFGIQLYWIVLALAVIVLLGV

SEQ ID NO: 380482 - protein, 24 aa, Mycobacterium
WQLLIFPYMVLLVVIVSFISWSAL

SEQ ID NO: 380483 - protein, 24 aa, Mycobacterium
WQPITRDLWPFPYLVMDTGASIAP

SEQ ID NO: 380484 - protein, 17 aa, Mycobacterium
WQPWLRWVVLVGSIAVA

SEQ ID NO: 380485 - protein, 18 aa, Mycobacterium
WRAYALPILMVLTAVVVY

SEQ ID NO: 380486 - protein, 19 aa, Mycobacterium
WRGVRWWRRSLTVLAIPLC

SEQ ID NO: 380487 - protein, 17 aa, Mycobacterium
WRHLMSVLLFPATMTLV

SEQ ID NO: 380488 - protein, 17 aa, Mycobacterium
WRLVGFLWATVAGAVAW

SEQ ID NO: 380489 - protein, 17 aa, Mycobacterium
WRRVGIRVARWPKPIFV

SEQ ID NO: 380490 - protein, 17 aa, Mycobacterium
WSFWLNTGTPMTFVVLL

SEQ ID NO: 380491 - protein, 23 aa, Mycobacterium
WSIRVMIVILWFSAAMAIISSLY

SEQ ID NO: 380492 - protein, 24 aa, Mycobacterium
WSNAFPAWHYAFATALLGLTVVVL

SEQ ID NO: 380493 - protein, 24 aa, Mycobacterium
WSNSFPAWHYAFATALLGLTVLVL

SEQ ID NO: 380494 - protein, 25 aa, Mycobacterium
WSVLVILWLFTWSLATTLPGAVKGY

SEQ ID NO: 380495 - protein, 29 aa, Mycobacterium
WSVPGIAHFFTMWGFFVLASVYLEAYGVL

SEQ ID NO: 380496 - protein, 20 aa, Mycobacterium
WTAAFVVALLQYLRPIAFVP

SEQ ID NO: 380497 - protein, 22 aa, Mycobacterium
WTNWLEIFLLLVISFSLPRTFG

SEQ ID NO: 380498 - protein, 17 aa, Mycobacterium
WTQQLPFGIAITGLLAV

SEQ ID NO: 380499 - protein, 23 aa, Mycobacterium
WTQWLTWIFQAVPVFFFVAGYAG

SEQ ID NO: 380500 - protein, 18 aa, Mycobacterium
WTSPMIIGLFIGSITALV

SEQ ID NO: 380501 - protein, 18 aa, Mycobacterium
WTTPLWLILMVAPFGYLL

SEQ ID NO: 380502 - protein, 20 aa, Mycobacterium
WVGVPLYLLLGWVAVWYTAT

SEQ ID NO: 380503 - protein, 21 aa, Mycobacterium
WVIPRPWYLAWAGLIYIVATV

SEQ ID NO: 380504 - protein, 20 aa, Mycobacterium
WVLATLWIPPLIYFGLHRVE

SEQ ID NO: 380505 - protein, 17 aa, Mycobacterium
WVLIFALTMMAGLVVSL

SEQ ID NO: 380506 - protein, 19 aa, Mycobacterium
WVLLLILVGTWIPAAAVGL

SEQ ID NO: 380507 - protein, 17 aa, Mycobacterium
WVVASGGLYLWLVNAAG

SEQ ID NO: 380508 - protein, 19 aa, Mycobacterium
WVVGYTLRPLRRLGAIAAN

SEQ ID NO: 380509 - protein, 26 aa, Mycobacterium
WWGQPAWSWLVLWRRGRRPISWDAPI

SEQ ID NO: 380510 - protein, 19 aa, Mycobacterium
WWKGLAGLWQWATDASHKA

SEQ ID NO: 380511 - protein, 19 aa, Mycobacterium
WWLPRWLDRLLPSVDFEKP

SEQ ID NO: 380512 - protein, 19 aa, Mycobacterium
WWMFIVLAVVIVALRMYTL

SEQ ID NO: 380513 - protein, 36 aa, Mycobacterium
WWRFTAWWIPCLALASTWWIVALLIFGKISPKFLDF

SEQ ID NO: 380514 - protein, 32 aa, Mycobacterium
WWRHTAWFMLALLLATLWWLVALTQLRGVSPP

SEQ ID NO: 380515 - protein, 17 aa, Mycobacterium
WWTTNLLSGLLALATIA

SEQ ID NO: 380516 - protein, 17 aa, Mycobacterium
WWTTNLLSGLLALATVA

SEQ ID NO: 380517 - protein, 17 aa, Mycobacterium
WYALNRVGAFAGADAGA

SEQ ID NO: 380518 - protein, 20 aa, Mycobacterium
WYGTLDAIVARRLDPLPSVG

SEQ ID NO: 380519 - protein, 24 aa, Mycobacterium
WYIAIYFTLIVFFTFFYVSITFNP

SEQ ID NO: 380520 - protein, 18 aa, Mycobacterium
WYRQLYFWVLVAIAAGIV

SEQ ID NO: 380521 - protein, 18 aa, Mycobacterium
WYRRPLVMILGAAAAVLA

SEQ ID NO: 380522 - protein, 24 aa, Mycobacterium
YADILYIAPWLLLLGVAMAGLTAY

SEQ ID NO: 380523 - protein, 18 aa, Mycobacterium
YAFRKRMLMAMALVLVGS

SEQ ID NO: 380524 - protein, 22 aa, Mycobacterium
YAGTFLYLCRGLFGIPALSGRT

SEQ ID NO: 380525 - protein, 17 aa, Mycobacterium
YAGWWAFDIGMLVTFGV

SEQ ID NO: 380526 - protein, 25 aa, Mycobacterium
YALTLALFVSFGVTWFLAHGMTSPL

SEQ ID NO: 380527 - protein, 19 aa, Mycobacterium
YARFWWPASPVWLPALLTV

SEQ ID NO: 380528 - protein, 18 aa, Mycobacterium
YAWPYRWLIAVVAGLQLI

SEQ ID NO: 380529 - protein, 26 aa, Mycobacterium
YAYLLTHVLFLNYVWHYTLLQAGFAI

SEQ ID NO: 380530 - protein, 23 aa, Mycobacterium
YCAYELWRFDSIRSWLLVAVMNI

SEQ ID NO: 380531 - protein, 31 aa, Mycobacterium
YDAGPAPLPWYKRPPILFGAAAVAALLAAGG

SEQ ID NO: 380532 - protein, 29 aa, Mycobacterium
YDDYPPLPWYRRPLVWFIAAAAVAGIAFT

SEQ ID NO: 380533 - protein, 18 aa, Mycobacterium
YDLDLYLRIAPELYLKRL

SEQ ID NO: 380534 - protein, 20 aa, Mycobacterium
YDLDLYLRIAPELYLKRLCV

SEQ ID NO: 380535 - protein, 21 aa, Mycobacterium
YDLWIPLIFLVLVSGFIAIQI

SEQ ID NO: 380536 - protein, 18 aa, Mycobacterium
YDVLPSMEWIPFVTFLQV

SEQ ID NO: 380537 - protein, 30 aa, Mycobacterium
YFAEGLHYWPWVLLGYFTVAIMVVSLIGWW

SEQ ID NO: 380538 - protein, 17 aa, Mycobacterium
YFAIIPALFVGLFPGLD

SEQ ID NO: 380539 - protein, 17 aa, Mycobacterium
YFAYLLFTANLAVKVRW

SEQ ID NO: 380540 - protein, 17 aa, Mycobacterium
YFGFYLFYRAHNPELFL

SEQ ID NO: 380541 - protein, 19 aa, Mycobacterium
YFGLPRWISVPLSAVLLFA

SEQ ID NO: 380542 - protein, 17 aa, Mycobacterium
YFPDLVFVLALLAAVAF

SEQ ID NO: 380543 - protein, 17 aa, Mycobacterium
YFQLLVKSLLLHGLREL

SEQ ID NO: 380544 - protein, 18 aa, Mycobacterium
YFSISLLDALRRARRGHF

SEQ ID NO: 380545 - protein, 27 aa, Mycobacterium
YFTDYLTWRWAFWINVPISVVVILVAA

SEQ ID NO: 380546 - protein, 25 aa, Mycobacterium
YFTDYLTWRWAFWVNVPISVVVIFV

SEQ ID NO: 380547 - protein, 22 aa, Mycobacterium
YGEVLRFLFEPIFNFLRDPIGN

SEQ ID NO: 380548 - protein, 17 aa, Mycobacterium
YGFQRPAMLLFGLVPLA

SEQ ID NO: 380549 - protein, 21 aa, Mycobacterium
YGIQWVVPVLFLVLVSGFLAI

SEQ ID NO: 380550 - protein, 18 aa, Mycobacterium
YGPGLRFLIPFVDKMIRV

SEQ ID NO: 380551 - protein, 20 aa, Mycobacterium
YGVPVWGFAVLWIALATALT

SEQ ID NO: 380552 - protein, 17 aa, Mycobacterium
YGWEWIFLINLPIGITT

SEQ ID NO: 380553 - protein, 20 aa, Mycobacterium
YGYNVLDWFNWGLSGFNRYG

SEQ ID NO: 380554 - protein, 23 aa, Mycobacterium
YHDDAIFFEPRYAIRQPDGGWGE

SEQ ID NO: 380555 - protein, 19 aa, Mycobacterium
YHIAKPWRWGYLGVLFVIF

SEQ ID NO: 380556 - protein, 19 aa, Mycobacterium
YHIVKPWRWGYLAVLLVIF

SEQ ID NO: 380557 - protein, 23 aa, Mycobacterium
YHPSLEQLLVLLPPYLAATQSYG

SEQ ID NO: 380558 - protein, 19 aa, Mycobacterium
YIAAFALFILGLSGLTGPK

SEQ ID NO: 380559 - protein, 23 aa, Mycobacterium
YIALSNWLLIHLLGLGAASNAIL

SEQ ID NO: 380560 - protein, 18 aa, Mycobacterium
YICGFIALFIFCGVGKGS

SEQ ID NO: 380561 - protein, 21 aa, Mycobacterium
YILAFSLFIYGLMGLTGPKTA

SEQ ID NO: 380562 - protein, 20 aa, Mycobacterium
YINLVVLLRIICEVTATVLL

SEQ ID NO: 380563 - protein, 17 aa, Mycobacterium
YINWLWFGELGFRGVFT

SEQ ID NO: 380564 - protein, 19 aa, Mycobacterium
YIRPYRRLVAALMALQLIS

SEQ ID NO: 380565 - protein, 22 aa, Mycobacterium
YIRPYRRLVAVLMVLQLISTLA

SEQ ID NO: 380566 - protein, 28 aa, Mycobacterium
YKIIGLAALMVLVFFGAMLYWQFRGTFI

SEQ ID NO: 380567 - protein, 19 aa, Mycobacterium
YLDWLSWFGYTLVLNVVGG

SEQ ID NO: 380568 - protein, 21 aa, Mycobacterium
YLFIVCATVLSWLRLFAVGRV

SEQ ID NO: 380569 - protein, 27 aa, Mycobacterium
YLFPVYAGLLTPWWLRLLGATVGKGTE

SEQ ID NO: 380570 - protein, 26 aa, Mycobacterium
YLFPVYASLLTPWWLRLLGAKVGEGT

SEQ ID NO: 380571 - protein, 18 aa, Mycobacterium
YLGIFFVVPFYSLARTSL

SEQ ID NO: 380572 - protein, 17 aa, Mycobacterium
YLGLLWWMMVCWAQPVR

SEQ ID NO: 380573 - protein, 18 aa, Mycobacterium
YLGLLWWMMVCWAQPVRN

SEQ ID NO: 380574 - protein, 19 aa, Mycobacterium
YLGTSWWIAVFPGLALMLT

SEQ ID NO: 380575 - protein, 22 aa, Mycobacterium
YLIIDRLFFRVLLGGWPSLIVS

SEQ ID NO: 380576 - protein, 17 aa, Mycobacterium
YLILTIPLTHLVNYIDA

SEQ ID NO: 380577 - protein, 17 aa, Mycobacterium
YLKWWKFVLVVLGVWFG

SEQ ID NO: 380578 - protein, 19 aa, Mycobacterium
YLLAMPWWEPSFVLGLAAF

SEQ ID NO: 380579 - protein, 18 aa, Mycobacterium
YLLLGWVAVGFFPTLLNG

SEQ ID NO: 380580 - protein, 22 aa, Mycobacterium
YLLSVVLVALLIWLLARDGGAA

SEQ ID NO: 380581 - protein, 19 aa, Mycobacterium
YLLTFQIYLALPIQASALA

SEQ ID NO: 380582 - protein, 18 aa, Mycobacterium
YLPGGVLVLSLIGFIAGF

SEQ ID NO: 380583 - protein, 18 aa, Mycobacterium
YLPGIWMYLALAVLFTAS

SEQ ID NO: 380584 - protein, 26 aa, Mycobacterium
YLQQVYNLYIRPFYPGSPVLGVTTPE

SEQ ID NO: 380585 - protein, 21 aa, Mycobacterium
YLRALRVAILPAPPPPGPAFR

SEQ ID NO: 380586 - protein, 22 aa, Mycobacterium
YLRPYRRLVAVLMVLQLISTLA

SEQ ID NO: 380587 - protein, 21 aa, Mycobacterium
YLSGILLVGLLLNSLFGFSWA

SEQ ID NO: 380588 - protein, 18 aa, Mycobacterium
YLSQWFLLIMAFGSLMMT

SEQ ID NO: 380589 - protein, 18 aa, Mycobacterium
YLTGYLPTLLLAAILTPA

SEQ ID NO: 380590 - protein, 18 aa, Mycobacterium
YLVRAEHLPLLQPLRDLT

SEQ ID NO: 380591 - protein, 18 aa, Mycobacterium
YLVYIRLARPLIAFYNWC

SEQ ID NO: 380592 - protein, 17 aa, Mycobacterium
YMGFWFPGVPRWVWVFS

SEQ ID NO: 380593 - protein, 24 aa, Mycobacterium
YNKTWLGFIAIAVIASLIGAMLLI

SEQ ID NO: 380594 - protein, 25 aa, Mycobacterium
YNVHWLFWLVPLMPLFFFAGAAANV

SEQ ID NO: 380595 - protein, 17 aa, Mycobacterium
YNYTWMVLMLPFGMIGV

SEQ ID NO: 380596 - protein, 23 aa, Mycobacterium
YPAGINWVLAFWGVLMAGGIAVA

SEQ ID NO: 380597 - protein, 18 aa, Mycobacterium
YPAGWFWLGGRIAAATGT

SEQ ID NO: 380598 - protein, 18 aa, Mycobacterium
YPGAIWPVSGLTAPTFKT

SEQ ID NO: 380599 - protein, 26 aa, Mycobacterium
YPGDGWKWWAWLSIGAGCVAVIVAVA

SEQ ID NO: 380600 - protein, 19 aa, Mycobacterium
YPIKASARFGLYYTPSSAL

SEQ ID NO: 380601 - protein, 20 aa, Mycobacterium
YPIKASARFGLYYTPSSALY

SEQ ID NO: 380602 - protein, 20 aa, Mycobacterium
YPLHLLPFGLLALLWQLATM

SEQ ID NO: 380603 - protein, 19 aa, Mycobacterium
YPLLLRRLVTLVPALLVLA

SEQ ID NO: 380604 - protein, 18 aa, Mycobacterium
YPMVFVPLLFLLAVALVA

SEQ ID NO: 380605 - protein, 18 aa, Mycobacterium
YPRTASVVIWYAPERCDT

SEQ ID NO: 380606 - protein, 21 aa, Mycobacterium
YPTIPVFAFGWPTSELSPLYM

SEQ ID NO: 380607 - protein, 25 aa, Mycobacterium
YPTYSHLFYLWWLAKAGVVGMAAFA

SEQ ID NO: 380608 - protein, 23 aa, Mycobacterium
YPVSWIMWVWYKLFALIFGPSNF

SEQ ID NO: 380609 - protein, 19 aa, Mycobacterium
YPYREPLPAPPPGGPPPGP

SEQ ID NO: 380610 - protein, 19 aa, Mycobacterium
YQWRWSLVVFWFVALVLAI

SEQ ID NO: 380611 - protein, 17 aa, Mycobacterium
YQWWRVLLVACSMLAYV

SEQ ID NO: 380612 - protein, 24 aa, Mycobacterium
YQYLKWWKLLLVILGVWFGAAEVG

SEQ ID NO: 380613 - protein, 19 aa, Mycobacterium
YRDSWIIAFLYIGTFGSFI

SEQ ID NO: 380614 - protein, 27 aa, Mycobacterium
YRDTPPMRWFQRPVLWFFAAAVFSAAV

SEQ ID NO: 380615 - protein, 26 aa, Mycobacterium
YRERLWVPLWWWLPGLGLAALIALEV

SEQ ID NO: 380616 - protein, 25 aa, Mycobacterium
YRERLWVPWWWWPPALALAGILAFE

SEQ ID NO: 380617 - protein, 19 aa, Mycobacterium
YRLIMKRDNSRWFVTRMTT

SEQ ID NO: 380618 - protein, 18 aa, Mycobacterium
YRTPVMFLLWVLIPTAAS

SEQ ID NO: 380619 - protein, 20 aa, Mycobacterium
YSGLPFWPQGKIYDAYFSDA

SEQ ID NO: 380620 - protein, 22 aa, Mycobacterium
YSLACLLYESLTGRAPFEAADV

SEQ ID NO: 380621 - protein, 19 aa, Mycobacterium
YSLMTFWITTMLALLYGLL

SEQ ID NO: 380622 - protein, 25 aa, Mycobacterium
YSNETWRLWRFPWQAKSPGRETITV

SEQ ID NO: 380623 - protein, 20 aa, Mycobacterium
YSVFLTIIGLAMWLIDNVLS

SEQ ID NO: 380624 - protein, 18 aa, Mycobacterium
YTMLVFAPVLIVLERLPL

SEQ ID NO: 380625 - protein, 18 aa, Mycobacterium
YVDWLWFGELGYRSVFTT

SEQ ID NO: 380626 - protein, 18 aa, Mycobacterium
YVLLPGRPMPPSAYPAPP

SEQ ID NO: 380627 - protein, 23 aa, Mycobacterium
YVLTHVLYLNYVWHYSLLKAGFA

SEQ ID NO: 380628 - protein, 20 aa, Mycobacterium
YVRPYRWLLAVVAVLQVISN

SEQ ID NO: 380629 - protein, 18 aa, Mycobacterium
YVVKILLYVLVAWLIVLS

SEQ ID NO: 380630 - protein, 17 aa, Mycobacterium
YWIFLACYVAAALLAWV

SEQ ID NO: 380631 - protein, 19 aa, Mycobacterium
YWLGEQWWRPLIAVGAVAL

SEQ ID NO: 380632 - protein, 18 aa, Mycobacterium
YWLGLLLLMFVSGAEVQQ

SEQ ID NO: 380633 - protein, 18 aa, Mycobacterium
YWLKLFVFFFPFTDQIAA

SEQ ID NO: 380634 - protein, 26 aa, Mycobacterium
YYGLPMWLILLLRVVFLLLAVGSLWL

SEQ ID NO: 380635 - protein, 20 aa, Mycobacterium
YYLIGALVTALVPILVTSGV

SEQ ID NO: 380636 - protein, 4 aa, Mycobacterium
GPSA

SEQ ID NO: 380637 - protein, 9 aa, Mycobacterium
SGTTGTPKG

SEQ ID NO: 380638 - protein, 7 aa, Mycobacterium
ERPHPGA

SEQ ID NO: 380639 - protein, 13 aa, Mycobacterium
RPGTSNGPTEAIN

SEQ ID NO: 380640 - protein, 5 aa, Mycobacterium
RRGDK

SEQ ID NO: 380641 - protein, 6 aa, Mycobacterium
ADRRTR

SEQ ID NO: 380642 - protein, 12 aa, Mycobacterium
AETNDALAALNT

SEQ ID NO: 380643 - protein, 12 aa, Mycobacterium
CPPEDCGGLGGY

SEQ ID NO: 380644 - protein, 6 aa, Mycobacterium
DDPPPA

SEQ ID NO: 380645 - protein, 12 aa, Mycobacterium
GHRGRSTDPLYR

SEQ ID NO: 380646 - protein, 6 aa, Mycobacterium
GRSKKA

SEQ ID NO: 380647 - protein, 9 aa, Mycobacterium
GYDPRETPM

SEQ ID NO: 380648 - protein, 4 aa, Mycobacterium
KKRA

SEQ ID NO: 380649 - protein, 6 aa, Mycobacterium
RPQEWR

SEQ ID NO: 380650 - protein, 5 aa, Mycobacterium
SDKGE

SEQ ID NO: 380651 - protein, 9 aa, Mycobacterium
SEGDDGVVE

SEQ ID NO: 380652 - protein, 10 aa, Mycobacterium
TAATEELPDA

SEQ ID NO: 380653 - protein, 6 aa, Mycobacterium
TDRQKA

SEQ ID NO: 380654 - protein, 12 aa, Mycobacterium
TGGFRTQLRQPR

SEQ ID NO: 380655 - protein, 6 aa, Mycobacterium
TGVPTS

SEQ ID NO: 380656 - protein, 9 aa, Mycobacterium
VRDGTGPAR

SEQ ID NO: 380657 - protein, 11 aa, Mycobacterium
YREPDRTKGRT

SEQ ID NO: 380658 - protein, 7 aa, Mycobacterium
AVPDRAR

SEQ ID NO: 380659 - protein, 6 aa, Mycobacterium
EIAGGE

SEQ ID NO: 380660 - protein, 7 aa, Mycobacterium
EPTPEVR

SEQ ID NO: 380661 - protein, 8 aa, Mycobacterium
TDRPYPPI

SEQ ID NO: 380662 - protein, 17 aa, Mycobacterium
AESRQVSAGEARPTGSV

SEQ ID NO: 380663 - protein, 20 aa, Mycobacterium
AGATVTADRDQQSRGSPPER

SEQ ID NO: 380664 - protein, 7 aa, Mycobacterium
PARQHGP

SEQ ID NO: 380665 - protein, 11 aa, Mycobacterium
QSTPGQPGPRF

SEQ ID NO: 380666 - protein, 4 aa, Mycobacterium
SGIT

SEQ ID NO: 380667 - protein, 9 aa, Mycobacterium
THPADTPTD

SEQ ID NO: 380668 - protein, 5 aa, Mycobacterium
TTPTA

SEQ ID NO: 380669 - protein, 4 aa, Mycobacterium
AAGA

SEQ ID NO: 380670 - protein, 4 aa, Mycobacterium
RPGG

SEQ ID NO: 380671 - protein, 11 aa, Mycobacterium
RPRPLSRHRRA

SEQ ID NO: 380672 - protein, 5 aa, Mycobacterium
ADEQV

SEQ ID NO: 380673 - protein, 4 aa, Mycobacterium
AGAD

SEQ ID NO: 380674 - protein, 9 aa, Mycobacterium
FSTTSEGIG

SEQ ID NO: 380675 - protein, 4 aa, Mycobacterium
HHPP

SEQ ID NO: 380676 - protein, 9 aa, Mycobacterium
REDRPGDKR

SEQ ID NO: 380677 - protein, 5 aa, Mycobacterium
THPDQ

SEQ ID NO: 380678 - protein, 4 aa, Mycobacterium
TRGA

SEQ ID NO: 380679 - protein, 4 aa, Mycobacterium
ADPA

SEQ ID NO: 380680 - protein, 4 aa, Mycobacterium
AGAA

SEQ ID NO: 380681 - protein, 4 aa, Mycobacterium
NPTT

SEQ ID NO: 380682 - protein, 4 aa, Mycobacterium
PAAA

SEQ ID NO: 380683 - protein, 5 aa, Mycobacterium
PPGCG

SEQ ID NO: 380684 - protein, 6 aa, Mycobacterium
VPPGTV

SEQ ID NO: 380685 - protein, 4 aa, Mycobacterium
AAAA

SEQ ID NO: 380686 - protein, 7 aa, Mycobacterium
SDRVSAA

SEQ ID NO: 380687 - protein, 4 aa, Mycobacterium
VADG

SEQ ID NO: 380688 - protein, 8 aa, Mycobacterium
AARGQGRA

SEQ ID NO: 380689 - protein, 4 aa, Mycobacterium
DNPD

SEQ ID NO: 380690 - protein, 7 aa, Mycobacterium
DPHDPTS

SEQ ID NO: 380691 - protein, 8 aa, Mycobacterium
EDRPGDKR

SEQ ID NO: 380692 - protein, 4 aa, Mycobacterium
LEPG

SEQ ID NO: 380693 - protein, 4 aa, Mycobacterium
REQG

SEQ ID NO: 380694 - protein, 5 aa, Mycobacterium
TASTQ

SEQ ID NO: 380695 - protein, 4 aa, Mycobacterium
VGAT

SEQ ID NO: 380696 - protein, 4 aa, Mycobacterium
VRPG

SEQ ID NO: 380697 - protein, 4 aa, Mycobacterium
AAGG

SEQ ID NO: 380698 - protein, 6 aa, Mycobacterium
ERPPRV

SEQ ID NO: 380699 - protein, 4 aa, Mycobacterium
GEGV

SEQ ID NO: 380700 - protein, 4 aa, Mycobacterium
RAGR

SEQ ID NO: 380701 - protein, 6 aa, Mycobacterium
SVGATA

SEQ ID NO: 380702 - protein, 4 aa, Mycobacterium
TGGV

SEQ ID NO: 380703 - protein, 4 aa, Mycobacterium
AAAG

SEQ ID NO: 380704 - protein, 9 aa, Mycobacterium
AARGQGRSH

SEQ ID NO: 380705 - protein, 4 aa, Mycobacterium
ADPE

SEQ ID NO: 380706 - protein, 4 aa, Mycobacterium
AGGA

SEQ ID NO: 380707 - protein, 6 aa, Mycobacterium
APQGPV

SEQ ID NO: 380708 - protein, 4 aa, Mycobacterium
DEGA

SEQ ID NO: 380709 - protein, 4 aa, Mycobacterium
DTDG

SEQ ID NO: 380710 - protein, 4 aa, Mycobacterium
ERSS

SEQ ID NO: 380711 - protein, 4 aa, Mycobacterium
LGPR

SEQ ID NO: 380712 - protein, 9 aa, Mycobacterium
NRTPPKTQA

SEQ ID NO: 380713 - protein, 10 aa, Mycobacterium
PEGAGPGTKG

SEQ ID NO: 380714 - protein, 8 aa, Mycobacterium
PSGSGKST

SEQ ID NO: 380715 - protein, 4 aa, Mycobacterium
PTTG

SEQ ID NO: 380716 - protein, 10 aa, Mycobacterium
SGTTGTPKGV

SEQ ID NO: 380717 - protein, 4 aa, Mycobacterium
AAGR

SEQ ID NO: 380718 - protein, 5 aa, Mycobacterium
ADGAT

SEQ ID NO: 380719 - protein, 9 aa, Mycobacterium
AGAAPEPGG

SEQ ID NO: 380720 - protein, 5 aa, Mycobacterium
AGPGA

SEQ ID NO: 380721 - protein, 4 aa, Mycobacterium
AGRA

SEQ ID NO: 380722 - protein, 4 aa, Mycobacterium
APGG

SEQ ID NO: 380723 - protein, 4 aa, Mycobacterium
ARGL

SEQ ID NO: 380724 - protein, 4 aa, Mycobacterium
ASGV

SEQ ID NO: 380725 - protein, 4 aa, Mycobacterium
ATAT

SEQ ID NO: 380726 - protein, 8 aa, Mycobacterium
DGQPRTLD

SEQ ID NO: 380727 - protein, 8 aa, Mycobacterium
GAKASTTT

SEQ ID NO: 380728 - protein, 4 aa, Mycobacterium
GGAA

SEQ ID NO: 380729 - protein, 4 aa, Mycobacterium
GGAG

SEQ ID NO: 380730 - protein, 4 aa, Mycobacterium
GGGV

SEQ ID NO: 380731 - protein, 6 aa, Mycobacterium
GGKSPN

SEQ ID NO: 380732 - protein, 9 aa, Mycobacterium
GPPGTGKTT

SEQ ID NO: 380733 - protein, 5 aa, Mycobacterium
HEGAG

SEQ ID NO: 380734 - protein, 6 aa, Mycobacterium
KASTTT

SEQ ID NO: 380735 - protein, 4 aa, Mycobacterium
LGGK

SEQ ID NO: 380736 - protein, 4 aa, Mycobacterium
RPEP

SEQ ID NO: 380737 - protein, 8 aa, Mycobacterium
SDAGSQYT

SEQ ID NO: 380738 - protein, 6 aa, Mycobacterium
SDPTLA

SEQ ID NO: 380739 - protein, 4 aa, Mycobacterium
TAGT

SEQ ID NO: 380740 - protein, 7 aa, Mycobacterium
TTGNAGI

SEQ ID NO: 380741 - protein, 4 aa, Mycobacterium
AAAP

SEQ ID NO: 380742 - protein, 4 aa, Mycobacterium
AAGE

SEQ ID NO: 380743 - protein, 4 aa, Mycobacterium
AAPA

SEQ ID NO: 380744 - protein, 4 aa, Mycobacterium
ADEQ

SEQ ID NO: 380745 - protein, 5 aa, Mycobacterium
AEAAG

SEQ ID NO: 380746 - protein, 4 aa, Mycobacterium
AGAG

SEQ ID NO: 380747 - protein, 4 aa, Mycobacterium
ASGR

SEQ ID NO: 380748 - protein, 4 aa, Mycobacterium
DEPL

SEQ ID NO: 380749 - protein, 4 aa, Mycobacterium
DGGA

SEQ ID NO: 380750 - protein, 4 aa, Mycobacterium
DPAA

SEQ ID NO: 380751 - protein, 4 aa, Mycobacterium
EGAE

SEQ ID NO: 380752 - protein, 4 aa, Mycobacterium
EGRG

SEQ ID NO: 380753 - protein, 5 aa, Mycobacterium
EPAGA

SEQ ID NO: 380754 - protein, 4 aa, Mycobacterium
ERRT

SEQ ID NO: 380755 - protein, 5 aa, Mycobacterium
FAPTR

SEQ ID NO: 380756 - protein, 6 aa, Mycobacterium
GADEVS

SEQ ID NO: 380757 - protein, 4 aa, Mycobacterium
GDPA

SEQ ID NO: 380758 - protein, 4 aa, Mycobacterium
GGLG

SEQ ID NO: 380759 - protein, 4 aa, Mycobacterium
GGPM

SEQ ID NO: 380760 - protein, 10 aa, Mycobacterium
GGSGTTAASL

SEQ ID NO: 380761 - protein, 4 aa, Mycobacterium
GPAV

SEQ ID NO: 380762 - protein, 4 aa, Mycobacterium
GPDG

SEQ ID NO: 380763 - protein, 4 aa, Mycobacterium
GPGG

SEQ ID NO: 380764 - protein, 4 aa, Mycobacterium
GQPV

SEQ ID NO: 380765 - protein, 4 aa, Mycobacterium
GTGI

SEQ ID NO: 380766 - protein, 4 aa, Mycobacterium
IPAT

SEQ ID NO: 380767 - protein, 4 aa, Mycobacterium
LDPA

SEQ ID NO: 380768 - protein, 4 aa, Mycobacterium
LPAG

SEQ ID NO: 380769 - protein, 4 aa, Mycobacterium
PAAV

SEQ ID NO: 380770 - protein, 4 aa, Mycobacterium
PAGP

SEQ ID NO: 380771 - protein, 4 aa, Mycobacterium
PGGE

SEQ ID NO: 380772 - protein, 6 aa, Mycobacterium
PTRSRT

SEQ ID NO: 380773 - protein, 4 aa, Mycobacterium
RGAL

SEQ ID NO: 380774 - protein, 4 aa, Mycobacterium
RGEL

SEQ ID NO: 380775 - protein, 4 aa, Mycobacterium
RGLG

SEQ ID NO: 380776 - protein, 4 aa, Mycobacterium
RSGV

SEQ ID NO: 380777 - protein, 7 aa, Mycobacterium
SGCGKTT

SEQ ID NO: 380778 - protein, 9 aa, Mycobacterium
SGGADLPTQ

SEQ ID NO: 380779 - protein, 9 aa, Mycobacterium
SGTTGRPKG

SEQ ID NO: 380780 - protein, 9 aa, Mycobacterium
SGTTGVPKG

SEQ ID NO: 380781 - protein, 5 aa, Mycobacterium
SQTPS

SEQ ID NO: 380782 - protein, 4 aa, Mycobacterium
TADA

SEQ ID NO: 380783 - protein, 4 aa, Mycobacterium
TGFT

SEQ ID NO: 380784 - protein, 5 aa, Mycobacterium
VEGEA

SEQ ID NO: 380785 - protein, 6 aa, Mycobacterium
AAAPGA

SEQ ID NO: 380786 - protein, 5 aa, Mycobacterium
AAEGA

SEQ ID NO: 380787 - protein, 4 aa, Mycobacterium
AASA

SEQ ID NO: 380788 - protein, 6 aa, Mycobacterium
AATTPA

SEQ ID NO: 380789 - protein, 4 aa, Mycobacterium
AEAH

SEQ ID NO: 380790 - protein, 6 aa, Mycobacterium
AEENRH

SEQ ID NO: 380791 - protein, 5 aa, Mycobacterium
AGATH

SEQ ID NO: 380792 - protein, 4 aa, Mycobacterium
AGGQ

SEQ ID NO: 380793 - protein, 4 aa, Mycobacterium
AGLP

SEQ ID NO: 380794 - protein, 4 aa, Mycobacterium
AGPA

SEQ ID NO: 380795 - protein, 4 aa, Mycobacterium
AKAG

SEQ ID NO: 380796 - protein, 4 aa, Mycobacterium
ANAG

SEQ ID NO: 380797 - protein, 4 aa, Mycobacterium
ARAG

SEQ ID NO: 380798 - protein, 8 aa, Mycobacterium
ARASARAA

SEQ ID NO: 380799 - protein, 6 aa, Mycobacterium
ASGPQV

SEQ ID NO: 380800 - protein, 4 aa, Mycobacterium
ATAR

SEQ ID NO: 380801 - protein, 9 aa, Mycobacterium
DKHPDEAIP

SEQ ID NO: 380802 - protein, 10 aa, Mycobacterium
DNKHGATPTW

SEQ ID NO: 380803 - protein, 4 aa, Mycobacterium
DPAT

SEQ ID NO: 380804 - protein, 4 aa, Mycobacterium
DPDG

SEQ ID NO: 380805 - protein, 10 aa, Mycobacterium
DRTGLSAQVT

SEQ ID NO: 380806 - protein, 6 aa, Mycobacterium
DTPTGV

SEQ ID NO: 380807 - protein, 6 aa, Mycobacterium
DTYRGP

SEQ ID NO: 380808 - protein, 4 aa, Mycobacterium
ELTP

SEQ ID NO: 380809 - protein, 6 aa, Mycobacterium
EQRHAN

SEQ ID NO: 380810 - protein, 4 aa, Mycobacterium
ERPA

SEQ ID NO: 380811 - protein, 4 aa, Mycobacterium
FGGG

SEQ ID NO: 380812 - protein, 7 aa, Mycobacterium
GAGAETV

SEQ ID NO: 380813 - protein, 5 aa, Mycobacterium
GAGKT

SEQ ID NO: 380814 - protein, 17 aa, Mycobacterium
GATKSVNRTLEAKTRAL

SEQ ID NO: 380815 - protein, 5 aa, Mycobacterium
GGLAG

SEQ ID NO: 380816 - protein, 4 aa, Mycobacterium
GGSD

SEQ ID NO: 380817 - protein, 4 aa, Mycobacterium
GGTD

SEQ ID NO: 380818 - protein, 8 aa, Mycobacterium
GPSGCGKT

SEQ ID NO: 380819 - protein, 7 aa, Mycobacterium
GPTGCGK

SEQ ID NO: 380820 - protein, 4 aa, Mycobacterium
GPVP

SEQ ID NO: 380821 - protein, 4 aa, Mycobacterium
GRAP

SEQ ID NO: 380822 - protein, 4 aa, Mycobacterium
GRGA

SEQ ID NO: 380823 - protein, 7 aa, Mycobacterium
GRRDPAL

SEQ ID NO: 380824 - protein, 4 aa, Mycobacterium
GTAV

SEQ ID NO: 380825 - protein, 6 aa, Mycobacterium
GTNEIQ

SEQ ID NO: 380826 - protein, 4 aa, Mycobacterium
GTPG

SEQ ID NO: 380827 - protein, 4 aa, Mycobacterium
IAGA

SEQ ID NO: 380828 - protein, 4 aa, Mycobacterium
LGRT

SEQ ID NO: 380829 - protein, 4 aa, Mycobacterium
PGAP

SEQ ID NO: 380830 - protein, 4 aa, Mycobacterium
PGRP

SEQ ID NO: 380831 - protein, 6 aa, Mycobacterium
PRTGTT

SEQ ID NO: 380832 - protein, 5 aa, Mycobacterium
PTNDL

SEQ ID NO: 380833 - protein, 4 aa, Mycobacterium
QSLE

SEQ ID NO: 380834 - protein, 6 aa, Mycobacterium
RARRTL

SEQ ID NO: 380835 - protein, 4 aa, Mycobacterium
RGRR

SEQ ID NO: 380836 - protein, 4 aa, Mycobacterium
SAGA

SEQ ID NO: 380837 - protein, 8 aa, Mycobacterium
SAGGGGRG

SEQ ID NO: 380838 - protein, 4 aa, Mycobacterium
SGFG

SEQ ID NO: 380839 - protein, 10 aa, Mycobacterium
SGNAGSNTAS

SEQ ID NO: 380840 - protein, 4 aa, Mycobacterium
SGRT

SEQ ID NO: 380841 - protein, 4 aa, Mycobacterium
SRDD

SEQ ID NO: 380842 - protein, 6 aa, Mycobacterium
SYGAGN

SEQ ID NO: 380843 - protein, 4 aa, Mycobacterium
TAAG

SEQ ID NO: 380844 - protein, 6 aa, Mycobacterium
TAGATH

SEQ ID NO: 380845 - protein, 4 aa, Mycobacterium
TAGL

SEQ ID NO: 380846 - protein, 7 aa, Mycobacterium
TDGGLRD

SEQ ID NO: 380847 - protein, 4 aa, Mycobacterium
TEEV

SEQ ID NO: 380848 - protein, 7 aa, Mycobacterium
TGETTTG

SEQ ID NO: 380849 - protein, 6 aa, Mycobacterium
TNPPLD

SEQ ID NO: 380850 - protein, 4 aa, Mycobacterium
TPAA

SEQ ID NO: 380851 - protein, 4 aa, Mycobacterium
TPDR

SEQ ID NO: 380852 - protein, 4 aa, Mycobacterium
TPEF

SEQ ID NO: 380853 - protein, 15 aa, Mycobacterium
VAKAQRAVDGHAPVK

SEQ ID NO: 380854 - protein, 4 aa, Mycobacterium
VDGP

SEQ ID NO: 380855 - protein, 13 aa, Mycobacterium
WPATSSEKARGIP

SEQ ID NO: 380856 - protein, 5 aa, Mycobacterium
WPPGT

SEQ ID NO: 380857 - protein, 4 aa, Mycobacterium
AADA

SEQ ID NO: 380858 - protein, 7 aa, Mycobacterium
AADPDAP

SEQ ID NO: 380859 - protein, 4 aa, Mycobacterium
AEGT

SEQ ID NO: 380860 - protein, 4 aa, Mycobacterium
AEQA

SEQ ID NO: 380861 - protein, 4 aa, Mycobacterium
AGAE

SEQ ID NO: 380862 - protein, 4 aa, Mycobacterium
AGAT

SEQ ID NO: 380863 - protein, 4 aa, Mycobacterium
AGDG

SEQ ID NO: 380864 - protein, 7 aa, Mycobacterium
AGDGNTH

SEQ ID NO: 380865 - protein, 4 aa, Mycobacterium
AGET

SEQ ID NO: 380866 - protein, 4 aa, Mycobacterium
ANER

SEQ ID NO: 380867 - protein, 4 aa, Mycobacterium
APAD

SEQ ID NO: 380868 - protein, 4 aa, Mycobacterium
APGQ

SEQ ID NO: 380869 - protein, 4 aa, Mycobacterium
APPG

SEQ ID NO: 380870 - protein, 4 aa, Mycobacterium
APSF

SEQ ID NO: 380871 - protein, 4 aa, Mycobacterium
APTV

SEQ ID NO: 380872 - protein, 5 aa, Mycobacterium
APVPG

SEQ ID NO: 380873 - protein, 4 aa, Mycobacterium
ARPA

SEQ ID NO: 380874 - protein, 4 aa, Mycobacterium
ARRS

SEQ ID NO: 380875 - protein, 4 aa, Mycobacterium
ASRG

SEQ ID NO: 380876 - protein, 4 aa, Mycobacterium
ATGD

SEQ ID NO: 380877 - protein, 7 aa, Mycobacterium
AVPPTGS

SEQ ID NO: 380878 - protein, 11 aa, Mycobacterium
AYTARTAGHPP

SEQ ID NO: 380879 - protein, 12 aa, Mycobacterium
AYTARTAGHPPT

SEQ ID NO: 380880 - protein, 6 aa, Mycobacterium
DAAAAD

SEQ ID NO: 380881 - protein, 4 aa, Mycobacterium
DAGL

SEQ ID NO: 380882 - protein, 4 aa, Mycobacterium
DDEQ

SEQ ID NO: 380883 - protein, 4 aa, Mycobacterium
DELT

SEQ ID NO: 380884 - protein, 4 aa, Mycobacterium
DETA

SEQ ID NO: 380885 - protein, 4 aa, Mycobacterium
DGRE

SEQ ID NO: 380886 - protein, 4 aa, Mycobacterium
DGRP

SEQ ID NO: 380887 - protein, 4 aa, Mycobacterium
DPDA

SEQ ID NO: 380888 - protein, 4 aa, Mycobacterium
DPGA

SEQ ID NO: 380889 - protein, 4 aa, Mycobacterium
DTGP

SEQ ID NO: 380890 - protein, 7 aa, Mycobacterium
DTIRNGY

SEQ ID NO: 380891 - protein, 4 aa, Mycobacterium
DVPG

SEQ ID NO: 380892 - protein, 4 aa, Mycobacterium
EAEN

SEQ ID NO: 380893 - protein, 4 aa, Mycobacterium
EEQH

SEQ ID NO: 380894 - protein, 13 aa, Mycobacterium
EHPTSPDTAPALT

SEQ ID NO: 380895 - protein, 4 aa, Mycobacterium
EPGK

SEQ ID NO: 380896 - protein, 4 aa, Mycobacterium
ERAR

SEQ ID NO: 380897 - protein, 6 aa, Mycobacterium
ERENRE

SEQ ID NO: 380898 - protein, 4 aa, Mycobacterium
ERGL

SEQ ID NO: 380899 - protein, 12 aa, Mycobacterium
ETHATDEPPLEL

SEQ ID NO: 380900 - protein, 4 aa, Mycobacterium
ETTA

SEQ ID NO: 380901 - protein, 4 aa, Mycobacterium
FREE

SEQ ID NO: 380902 - protein, 4 aa, Mycobacterium
FTPR

SEQ ID NO: 380903 - protein, 4 aa, Mycobacterium
GADP

SEQ ID NO: 380904 - protein, 4 aa, Mycobacterium
GARR

SEQ ID NO: 380905 - protein, 14 aa, Mycobacterium
GDSAGGSAKSGRDS

SEQ ID NO: 380906 - protein, 4 aa, Mycobacterium
GDSV

SEQ ID NO: 380907 - protein, 4 aa, Mycobacterium
GEAL

SEQ ID NO: 380908 - protein, 6 aa, Mycobacterium
GEPQPE

SEQ ID NO: 380909 - protein, 6 aa, Mycobacterium
GERVGP

SEQ ID NO: 380910 - protein, 4 aa, Mycobacterium
GGAN

SEQ ID NO: 380911 - protein, 4 aa, Mycobacterium
GGDP

SEQ ID NO: 380912 - protein, 9 aa, Mycobacterium
GGGGPGVGP

SEQ ID NO: 380913 - protein, 5 aa, Mycobacterium
GGGSV

SEQ ID NO: 380914 - protein, 4 aa, Mycobacterium
GGIG

SEQ ID NO: 380915 - protein, 4 aa, Mycobacterium
GGPS

SEQ ID NO: 380916 - protein, 5 aa, Mycobacterium
GGTTE

SEQ ID NO: 380917 - protein, 4 aa, Mycobacterium
GGWG

SEQ ID NO: 380918 - protein, 7 aa, Mycobacterium
GHPLGAT

SEQ ID NO: 380919 - protein, 7 aa, Mycobacterium
GKATPEA

SEQ ID NO: 380920 - protein, 7 aa, Mycobacterium
GKCGSCS

SEQ ID NO: 380921 - protein, 4 aa, Mycobacterium
GKPV

SEQ ID NO: 380922 - protein, 4 aa, Mycobacterium
GLGA

SEQ ID NO: 380923 - protein, 5 aa, Mycobacterium
GLPPG

SEQ ID NO: 380924 - protein, 7 aa, Mycobacterium
GLSDTTV

SEQ ID NO: 380925 - protein, 9 aa, Mycobacterium
GNETTRNSI

SEQ ID NO: 380926 - protein, 4 aa, Mycobacterium
GNGL

SEQ ID NO: 380927 - protein, 4 aa, Mycobacterium
GPAA

SEQ ID NO: 380928 - protein, 4 aa, Mycobacterium
GPDL

SEQ ID NO: 380929 - protein, 9 aa, Mycobacterium
GPGEAREAD

SEQ ID NO: 380930 - protein, 8 aa, Mycobacterium
GPSGTGKS

SEQ ID NO: 380931 - protein, 5 aa, Mycobacterium
GPTET

SEQ ID NO: 380932 - protein, 6 aa, Mycobacterium
GPTETT

SEQ ID NO: 380933 - protein, 4 aa, Mycobacterium
GRSG

SEQ ID NO: 380934 - protein, 5 aa, Mycobacterium
GSDAY

SEQ ID NO: 380935 - protein, 4 aa, Mycobacterium
GTGQ

SEQ ID NO: 380936 - protein, 5 aa, Mycobacterium
GTHPG

SEQ ID NO: 380937 - protein, 5 aa, Mycobacterium
GTPED

SEQ ID NO: 380938 - protein, 5 aa, Mycobacterium
GTPEQ

SEQ ID NO: 380939 - protein, 6 aa, Mycobacterium
GTTGFP

SEQ ID NO: 380940 - protein, 6 aa, Mycobacterium
GTTGMP

SEQ ID NO: 380941 - protein, 9 aa, Mycobacterium
GTTGRPKGA

SEQ ID NO: 380942 - protein, 5 aa, Mycobacterium
GVSGT

SEQ ID NO: 380943 - protein, 7 aa, Mycobacterium
GYGSAGE

SEQ ID NO: 380944 - protein, 4 aa, Mycobacterium
HNGL

SEQ ID NO: 380945 - protein, 6 aa, Mycobacterium
HPGGPK

SEQ ID NO: 380946 - protein, 4 aa, Mycobacterium
IGER

SEQ ID NO: 380947 - protein, 4 aa, Mycobacterium
ITGP

SEQ ID NO: 380948 - protein, 11 aa, Mycobacterium
KGNAGSNTAAD

SEQ ID NO: 380949 - protein, 8 aa, Mycobacterium
KRENADEK

SEQ ID NO: 380950 - protein, 4 aa, Mycobacterium
LGPG

SEQ ID NO: 380951 - protein, 4 aa, Mycobacterium
LPDD

SEQ ID NO: 380952 - protein, 5 aa, Mycobacterium
LSPDE

SEQ ID NO: 380953 - protein, 5 aa, Mycobacterium
LSTNP

SEQ ID NO: 380954 - protein, 4 aa, Mycobacterium
MNPG

SEQ ID NO: 380955 - protein, 9 aa, Mycobacterium
NGEPIGASG

SEQ ID NO: 380956 - protein, 5 aa, Mycobacterium
NGLRP

SEQ ID NO: 380957 - protein, 5 aa, Mycobacterium
NGPEL

SEQ ID NO: 380958 - protein, 5 aa, Mycobacterium
NPIEY

SEQ ID NO: 380959 - protein, 4 aa, Mycobacterium
NPSP

SEQ ID NO: 380960 - protein, 6 aa, Mycobacterium
NSGTGN

SEQ ID NO: 380961 - protein, 4 aa, Mycobacterium
NVNG

SEQ ID NO: 380962 - protein, 4 aa, Mycobacterium
PAEA

SEQ ID NO: 380963 - protein, 7 aa, Mycobacterium
PAEQTPA

SEQ ID NO: 380964 - protein, 4 aa, Mycobacterium
PDAT

SEQ ID NO: 380965 - protein, 4 aa, Mycobacterium
PDEA

SEQ ID NO: 380966 - protein, 5 aa, Mycobacterium
PDGNG

SEQ ID NO: 380967 - protein, 4 aa, Mycobacterium
PDSA

SEQ ID NO: 380968 - protein, 5 aa, Mycobacterium
PEAQD

SEQ ID NO: 380969 - protein, 5 aa, Mycobacterium
PETSL

SEQ ID NO: 380970 - protein, 4 aa, Mycobacterium
PGEL

SEQ ID NO: 380971 - protein, 18 aa, Mycobacterium
PKPYKRTTIAGESATAVP

SEQ ID NO: 380972 - protein, 8 aa, Mycobacterium
PNGAGKTS

SEQ ID NO: 380973 - protein, 4 aa, Mycobacterium
PNPH

SEQ ID NO: 380974 - protein, 4 aa, Mycobacterium
PTAA

SEQ ID NO: 380975 - protein, 4 aa, Mycobacterium
PTTA

SEQ ID NO: 380976 - protein, 13 aa, Mycobacterium
QGAKPGEGGQLPG

SEQ ID NO: 380977 - protein, 8 aa, Mycobacterium
QGSQYPGM

SEQ ID NO: 380978 - protein, 6 aa, Mycobacterium
QKSIAE

SEQ ID NO: 380979 - protein, 8 aa, Mycobacterium
QPTRSRTH

SEQ ID NO: 380980 - protein, 6 aa, Mycobacterium
RAVRDG

SEQ ID NO: 380981 - protein, 4 aa, Mycobacterium
RGGD

SEQ ID NO: 380982 - protein, 4 aa, Mycobacterium
RGGP

SEQ ID NO: 380983 - protein, 7 aa, Mycobacterium
RGPNAGS

SEQ ID NO: 380984 - protein, 9 aa, Mycobacterium
RGTQYTSTD

SEQ ID NO: 380985 - protein, 8 aa, Mycobacterium
RKKARADI

SEQ ID NO: 380986 - protein, 4 aa, Mycobacterium
RPGD

SEQ ID NO: 380987 - protein, 7 aa, Mycobacterium
RRTKNNP

SEQ ID NO: 380988 - protein, 4 aa, Mycobacterium
RSGG

SEQ ID NO: 380989 - protein, 5 aa, Mycobacterium
RSLPE

SEQ ID NO: 380990 - protein, 4 aa, Mycobacterium
RTEA

SEQ ID NO: 380991 - protein, 5 aa, Mycobacterium
RTGTD

SEQ ID NO: 380992 - protein, 4 aa, Mycobacterium
SAGL

SEQ ID NO: 380993 - protein, 6 aa, Mycobacterium
SAPSSL

SEQ ID NO: 380994 - protein, 9 aa, Mycobacterium
SEPEAGSDL

SEQ ID NO: 380995 - protein, 9 aa, Mycobacterium
SEPEAGTDL

SEQ ID NO: 380996 - protein, 6 aa, Mycobacterium
SGCGKS

SEQ ID NO: 380997 - protein, 9 aa, Mycobacterium
SGKKQRGEP

SEQ ID NO: 380998 - protein, 4 aa, Mycobacterium
SGPV

SEQ ID NO: 380999 - protein, 10 aa, Mycobacterium
SGSTGSPKAV

SEQ ID NO: 381000 - protein, 6 aa, Mycobacterium
SKRGGG

SEQ ID NO: 381001 - protein, 5 aa, Mycobacterium
SPPPH

SEQ ID NO: 381002 - protein, 4 aa, Mycobacterium
SRAE

SEQ ID NO: 381003 - protein, 4 aa, Mycobacterium
STAD

SEQ ID NO: 381004 - protein, 4 aa, Mycobacterium
TAAR

SEQ ID NO: 381005 - protein, 4 aa, Mycobacterium
TACS

SEQ ID NO: 381006 - protein, 4 aa, Mycobacterium
TADP

SEQ ID NO: 381007 - protein, 6 aa, Mycobacterium
TADRPG

SEQ ID NO: 381008 - protein, 5 aa, Mycobacterium
TDGRP

SEQ ID NO: 381009 - protein, 9 aa, Mycobacterium
TDPDAPKHK

SEQ ID NO: 381010 - protein, 4 aa, Mycobacterium
TGAR

SEQ ID NO: 381011 - protein, 4 aa, Mycobacterium
TGFA

SEQ ID NO: 381012 - protein, 4 aa, Mycobacterium
TGGQ

SEQ ID NO: 381013 - protein, 4 aa, Mycobacterium
TGRA

SEQ ID NO: 381014 - protein, 5 aa, Mycobacterium
TGRPA

SEQ ID NO: 381015 - protein, 4 aa, Mycobacterium
TGRT

SEQ ID NO: 381016 - protein, 9 aa, Mycobacterium
TLTAPTTTA

SEQ ID NO: 381017 - protein, 5 aa, Mycobacterium
TPGDL

SEQ ID NO: 381018 - protein, 8 aa, Mycobacterium
TSPAGARY

SEQ ID NO: 381019 - protein, 4 aa, Mycobacterium
VGNP

SEQ ID NO: 381020 - protein, 4 aa, Mycobacterium
VPDG

SEQ ID NO: 381021 - protein, 5 aa, Mycobacterium
VPGPQ

SEQ ID NO: 381022 - protein, 5 aa, Mycobacterium
VTDGD

SEQ ID NO: 381023 - protein, 4 aa, Mycobacterium
YDPR

SEQ ID NO: 381024 - protein, 7 aa, Mycobacterium
YGPTETT

SEQ ID NO: 381025 - protein, 5 aa, Mycobacterium
YPLPE

SEQ ID NO: 381026 - protein, 4 aa, Mycobacterium
YSQG

SEQ ID NO: 381027 - protein, 8 aa, Mycobacterium
AAAGPDKV

SEQ ID NO: 381028 - protein, 4 aa, Mycobacterium
AAAR

SEQ ID NO: 381029 - protein, 7 aa, Mycobacterium
AAARGTA

SEQ ID NO: 381030 - protein, 12 aa, Mycobacterium
AADDDSATGGPD

SEQ ID NO: 381031 - protein, 6 aa, Mycobacterium
AADEVS

SEQ ID NO: 381032 - protein, 4 aa, Mycobacterium
AADP

SEQ ID NO: 381033 - protein, 4 aa, Mycobacterium
AAGD

SEQ ID NO: 381034 - protein, 4 aa, Mycobacterium
AAGI

SEQ ID NO: 381035 - protein, 4 aa, Mycobacterium
AAGT

SEQ ID NO: 381036 - protein, 5 aa, Mycobacterium
AASAA

SEQ ID NO: 381037 - protein, 11 aa, Mycobacterium
AASARRAGLGP

SEQ ID NO: 381038 - protein, 5 aa, Mycobacterium
AASTQ

SEQ ID NO: 381039 - protein, 4 aa, Mycobacterium
AATA

SEQ ID NO: 381040 - protein, 4 aa, Mycobacterium
ADDL

SEQ ID NO: 381041 - protein, 4 aa, Mycobacterium
ADGR

SEQ ID NO: 381042 - protein, 7 aa, Mycobacterium
ADLSGEE

SEQ ID NO: 381043 - protein, 4 aa, Mycobacterium
ADPV

SEQ ID NO: 381044 - protein, 4 aa, Mycobacterium
ADRG

SEQ ID NO: 381045 - protein, 7 aa, Mycobacterium
ADTTPKG

SEQ ID NO: 381046 - protein, 6 aa, Mycobacterium
AEAERR

SEQ ID NO: 381047 - protein, 4 aa, Mycobacterium
AEAG

SEQ ID NO: 381048 - protein, 6 aa, Mycobacterium
AEAQAE

SEQ ID NO: 381049 - protein, 6 aa, Mycobacterium
AEEDPT

SEQ ID NO: 381050 - protein, 13 aa, Mycobacterium
AENAARKAQEHGV

SEQ ID NO: 381051 - protein, 9 aa, Mycobacterium
AENPPKKYQ

SEQ ID NO: 381052 - protein, 6 aa, Mycobacterium
AEPDAL

SEQ ID NO: 381053 - protein, 4 aa, Mycobacterium
AERA

SEQ ID NO: 381054 - protein, 6 aa, Mycobacterium
AERQEA

SEQ ID NO: 381055 - protein, 4 aa, Mycobacterium
AERR

SEQ ID NO: 381056 - protein, 4 aa, Mycobacterium
AGAR

SEQ ID NO: 381057 - protein, 4 aa, Mycobacterium
AGAS

SEQ ID NO: 381058 - protein, 5 aa, Mycobacterium
AGDRP

SEQ ID NO: 381059 - protein, 6 aa, Mycobacterium
AGGEIR

SEQ ID NO: 381060 - protein, 8 aa, Mycobacterium
AGLPPATY

SEQ ID NO: 381061 - protein, 6 aa, Mycobacterium
AGMQTS

SEQ ID NO: 381062 - protein, 4 aa, Mycobacterium
AGPR

SEQ ID NO: 381063 - protein, 4 aa, Mycobacterium
AGRT

SEQ ID NO: 381064 - protein, 4 aa, Mycobacterium
AGSL

SEQ ID NO: 381065 - protein, 7 aa, Mycobacterium
AGSVSER

SEQ ID NO: 381066 - protein, 5 aa, Mycobacterium
AGTGI

SEQ ID NO: 381067 - protein, 15 aa, Mycobacterium
AGTQTLTAADPLPED

SEQ ID NO: 381068 - protein, 4 aa, Mycobacterium
AGVD

SEQ ID NO: 381069 - protein, 5 aa, Mycobacterium
AGVGD

SEQ ID NO: 381070 - protein, 4 aa, Mycobacterium
AGVS

SEQ ID NO: 381071 - protein, 7 aa, Mycobacterium
AHPSLPR

SEQ ID NO: 381072 - protein, 6 aa, Mycobacterium
AKEQQL

SEQ ID NO: 381073 - protein, 16 aa, Mycobacterium
AKKTDDVAGDGTTTAT

SEQ ID NO: 381074 - protein, 5 aa, Mycobacterium
AMENA

SEQ ID NO: 381075 - protein, 5 aa, Mycobacterium
ANGDK

SEQ ID NO: 381076 - protein, 7 aa, Mycobacterium
ANPTGPI

SEQ ID NO: 381077 - protein, 4 aa, Mycobacterium
ANRT

SEQ ID NO: 381078 - protein, 6 aa, Mycobacterium
ANSAYH

SEQ ID NO: 381079 - protein, 4 aa, Mycobacterium
ANTA

SEQ ID NO: 381080 - protein, 4 aa, Mycobacterium
APAI

SEQ ID NO: 381081 - protein, 4 aa, Mycobacterium
APDA

SEQ ID NO: 381082 - protein, 6 aa, Mycobacterium
APEAAS

SEQ ID NO: 381083 - protein, 4 aa, Mycobacterium
APGE

SEQ ID NO: 381084 - protein, 7 aa, Mycobacterium
APGFGDR

SEQ ID NO: 381085 - protein, 8 aa, Mycobacterium
APKSALGH

SEQ ID NO: 381086 - protein, 8 aa, Mycobacterium
APPGTVGS

SEQ ID NO: 381087 - protein, 6 aa, Mycobacterium
APPGYV

SEQ ID NO: 381088 - protein, 17 aa, Mycobacterium
APWRPDPSRGGGPDRPQ

SEQ ID NO: 381089 - protein, 4 aa, Mycobacterium
ARAA

SEQ ID NO: 381090 - protein, 20 aa, Mycobacterium
ARAAARATAWAGGAAPARGQ

SEQ ID NO: 381091 - protein, 7 aa, Mycobacterium
AREVRDT

SEQ ID NO: 381092 - protein, 4 aa, Mycobacterium
ARGP

SEQ ID NO: 381093 - protein, 7 aa, Mycobacterium
ARPGSRF

SEQ ID NO: 381094 - protein, 5 aa, Mycobacterium
ARQDT

SEQ ID NO: 381095 - protein, 6 aa, Mycobacterium
ARTPTA

SEQ ID NO: 381096 - protein, 4 aa, Mycobacterium
ASAA

SEQ ID NO: 381097 - protein, 7 aa, Mycobacterium
ASNTSSI

SEQ ID NO: 381098 - protein, 5 aa, Mycobacterium
ASPGI

SEQ ID NO: 381099 - protein, 5 aa, Mycobacterium
ASPGY

SEQ ID NO: 381100 - protein, 4 aa, Mycobacterium
ATAD

SEQ ID NO: 381101 - protein, 4 aa, Mycobacterium
ATPA

SEQ ID NO: 381102 - protein, 4 aa, Mycobacterium
ATTT

SEQ ID NO: 381103 - protein, 9 aa, Mycobacterium
AVGKSTTAR

SEQ ID NO: 381104 - protein, 4 aa, Mycobacterium
CGPQ

SEQ ID NO: 381105 - protein, 5 aa, Mycobacterium
CPPRP

SEQ ID NO: 381106 - protein, 16 aa, Mycobacterium
CSGGMHGSNRLGGNSL

SEQ ID NO: 381107 - protein, 9 aa, Mycobacterium
CTGKGNDQV

SEQ ID NO: 381108 - protein, 19 aa, Mycobacterium
DAGDGFREPGFSKERRLEP

SEQ ID NO: 381109 - protein, 7 aa, Mycobacterium
DAGDPVE

SEQ ID NO: 381110 - protein, 4 aa, Mycobacterium
DARG

SEQ ID NO: 381111 - protein, 7 aa, Mycobacterium
DARGEGW

SEQ ID NO: 381112 - protein, 7 aa, Mycobacterium
DARTDGH

SEQ ID NO: 381113 - protein, 4 aa, Mycobacterium
DDAD

SEQ ID NO: 381114 - protein, 5 aa, Mycobacterium
DDPAL

SEQ ID NO: 381115 - protein, 7 aa, Mycobacterium
DDPGNTT

SEQ ID NO: 381116 - protein, 5 aa, Mycobacterium
DDRAY

SEQ ID NO: 381117 - protein, 11 aa, Mycobacterium
DDYTDPAPATT

SEQ ID NO: 381118 - protein, 6 aa, Mycobacterium
DEAAAE

SEQ ID NO: 381119 - protein, 5 aa, Mycobacterium
DEASN

SEQ ID NO: 381120 - protein, 8 aa, Mycobacterium
DEGTAAAE

SEQ ID NO: 381121 - protein, 9 aa, Mycobacterium
DENGGYPHP

SEQ ID NO: 381122 - protein, 7 aa, Mycobacterium
DEPPGTR

SEQ ID NO: 381123 - protein, 8 aa, Mycobacterium
DESEPGTC

SEQ ID NO: 381124 - protein, 4 aa, Mycobacterium
DEVS

SEQ ID NO: 381125 - protein, 8 aa, Mycobacterium
DGAEKFTK

SEQ ID NO: 381126 - protein, 4 aa, Mycobacterium
DGDL

SEQ ID NO: 381127 - protein, 4 aa, Mycobacterium
DGEA

SEQ ID NO: 381128 - protein, 5 aa, Mycobacterium
DGIPS

SEQ ID NO: 381129 - protein, 4 aa, Mycobacterium
DGLD

SEQ ID NO: 381130 - protein, 8 aa, Mycobacterium
DGPVRGNG

SEQ ID NO: 381131 - protein, 4 aa, Mycobacterium
DGRL

SEQ ID NO: 381132 - protein, 4 aa, Mycobacterium
DGTS

SEQ ID NO: 381133 - protein, 5 aa, Mycobacterium
DHNVP

SEQ ID NO: 381134 - protein, 7 aa, Mycobacterium
DKGTATF

SEQ ID NO: 381135 - protein, 7 aa, Mycobacterium
DLERENA

SEQ ID NO: 381136 - protein, 10 aa, Mycobacterium
DLQPGSSIMP

SEQ ID NO: 381137 - protein, 6 aa, Mycobacterium
DNPDDV

SEQ ID NO: 381138 - protein, 6 aa, Mycobacterium
DNTGAK

SEQ ID NO: 381139 - protein, 4 aa, Mycobacterium
DPDL

SEQ ID NO: 381140 - protein, 13 aa, Mycobacterium
DPGPRTSSATTIT

SEQ ID NO: 381141 - protein, 4 aa, Mycobacterium
DPPV

SEQ ID NO: 381142 - protein, 8 aa, Mycobacterium
DPRKADQM

SEQ ID NO: 381143 - protein, 6 aa, Mycobacterium
DPTPVA

SEQ ID NO: 381144 - protein, 12 aa, Mycobacterium
DPTVKGGTSNPW

SEQ ID NO: 381145 - protein, 8 aa, Mycobacterium
DPYPTPGH

SEQ ID NO: 381146 - protein, 5 aa, Mycobacterium
DQAQR

SEQ ID NO: 381147 - protein, 8 aa, Mycobacterium
DQLPSTHP

SEQ ID NO: 381148 - protein, 4 aa, Mycobacterium
DQPW

SEQ ID NO: 381149 - protein, 10 aa, Mycobacterium
DQTGLSEQVT

SEQ ID NO: 381150 - protein, 4 aa, Mycobacterium
DRSG

SEQ ID NO: 381151 - protein, 6 aa, Mycobacterium
DSNKTQ

SEQ ID NO: 381152 - protein, 11 aa, Mycobacterium
DTAKEKPQEGT

SEQ ID NO: 381153 - protein, 5 aa, Mycobacterium
DTAQA

SEQ ID NO: 381154 - protein, 5 aa, Mycobacterium
DTDTQ

SEQ ID NO: 381155 - protein, 7 aa, Mycobacterium
EAADPGE

SEQ ID NO: 381156 - protein, 8 aa, Mycobacterium
EDGAETDL

SEQ ID NO: 381157 - protein, 4 aa, Mycobacterium
EDPR

SEQ ID NO: 381158 - protein, 4 aa, Mycobacterium
EENA

SEQ ID NO: 381159 - protein, 4 aa, Mycobacterium
EERG

SEQ ID NO: 381160 - protein, 4 aa, Mycobacterium
EERR

SEQ ID NO: 381161 - protein, 6 aa, Mycobacterium
EGEPGD

SEQ ID NO: 381162 - protein, 6 aa, Mycobacterium
EGKDTA

SEQ ID NO: 381163 - protein, 8 aa, Mycobacterium
EGNRAETA

SEQ ID NO: 381164 - protein, 9 aa, Mycobacterium
ENIPEPGIP

SEQ ID NO: 381165 - protein, 6 aa, Mycobacterium
EPASYA

SEQ ID NO: 381166 - protein, 9 aa, Mycobacterium
EPDSGLDPV

SEQ ID NO: 381167 - protein, 8 aa, Mycobacterium
EPGAGSDL

SEQ ID NO: 381168 - protein, 4 aa, Mycobacterium
EPGE

SEQ ID NO: 381169 - protein, 8 aa, Mycobacterium
EPGTNGQH

SEQ ID NO: 381170 - protein, 8 aa, Mycobacterium
EPSGGSDL

SEQ ID NO: 381171 - protein, 11 aa, Mycobacterium
EQLGQGKENAR

SEQ ID NO: 381172 - protein, 4 aa, Mycobacterium
ERGV

SEQ ID NO: 381173 - protein, 7 aa, Mycobacterium
ERNSPGS

SEQ ID NO: 381174 - protein, 4 aa, Mycobacterium
ERTD

SEQ ID NO: 381175 - protein, 11 aa, Mycobacterium
ESGGGSGTANI

SEQ ID NO: 381176 - protein, 6 aa, Mycobacterium
ESIGRS

SEQ ID NO: 381177 - protein, 5 aa, Mycobacterium
ESQEA

SEQ ID NO: 381178 - protein, 5 aa, Mycobacterium
ESYGV

SEQ ID NO: 381179 - protein, 7 aa, Mycobacterium
ETDSGLD

SEQ ID NO: 381180 - protein, 5 aa, Mycobacterium
ETFEE

SEQ ID NO: 381181 - protein, 8 aa, Mycobacterium
FADAGSDG

SEQ ID NO: 381182 - protein, 4 aa, Mycobacterium
FAGQ

SEQ ID NO: 381183 - protein, 4 aa, Mycobacterium
FDGD

SEQ ID NO: 381184 - protein, 6 aa, Mycobacterium
FDTTTA

SEQ ID NO: 381185 - protein, 8 aa, Mycobacterium
FPGGPPPR

SEQ ID NO: 381186 - protein, 7 aa, Mycobacterium
GAAEGAI

SEQ ID NO: 381187 - protein, 7 aa, Mycobacterium
GAATEVE

SEQ ID NO: 381188 - protein, 9 aa, Mycobacterium
GAGAGNAPV

SEQ ID NO: 381189 - protein, 4 aa, Mycobacterium
GAGQ

SEQ ID NO: 381190 - protein, 8 aa, Mycobacterium
GALSDTYK

SEQ ID NO: 381191 - protein, 4 aa, Mycobacterium
GAPQ

SEQ ID NO: 381192 - protein, 9 aa, Mycobacterium
GAPTITNDG

SEQ ID NO: 381193 - protein, 8 aa, Mycobacterium
GARADSVP

SEQ ID NO: 381194 - protein, 18 aa, Mycobacterium
GARKGLADTALRTADSGY

SEQ ID NO: 381195 - protein, 6 aa, Mycobacterium
GDGVGG

SEQ ID NO: 381196 - protein, 4 aa, Mycobacterium
GDIT

SEQ ID NO: 381197 - protein, 8 aa, Mycobacterium
GDNGSGMH

SEQ ID NO: 381198 - protein, 6 aa, Mycobacterium
GDPETQ

SEQ ID NO: 381199 - protein, 4 aa, Mycobacterium
GDPR

SEQ ID NO: 381200 - protein, 4 aa, Mycobacterium
GDQG

SEQ ID NO: 381201 - protein, 6 aa, Mycobacterium
GDRAKN

SEQ ID NO: 381202 - protein, 7 aa, Mycobacterium
GDSPGAV

SEQ ID NO: 381203 - protein, 8 aa, Mycobacterium
GDTAPKAA

SEQ ID NO: 381204 - protein, 5 aa, Mycobacterium
GDTKT

SEQ ID NO: 381205 - protein, 6 aa, Mycobacterium
GEAGFG

SEQ ID NO: 381206 - protein, 5 aa, Mycobacterium
GEEPG

SEQ ID NO: 381207 - protein, 8 aa, Mycobacterium
GEKTSDEA

SEQ ID NO: 381208 - protein, 6 aa, Mycobacterium
GEPINP

SEQ ID NO: 381209 - protein, 5 aa, Mycobacterium
GEPWR

SEQ ID NO: 381210 - protein, 8 aa, Mycobacterium
GERTREGN

SEQ ID NO: 381211 - protein, 11 aa, Mycobacterium
GERTTPAGAEA

SEQ ID NO: 381212 - protein, 8 aa, Mycobacterium
GETAEHPG

SEQ ID NO: 381213 - protein, 9 aa, Mycobacterium
GETEAKTNA

SEQ ID NO: 381214 - protein, 6 aa, Mycobacterium
GGAAAR

SEQ ID NO: 381215 - protein, 8 aa, Mycobacterium
GGAAYGPA

SEQ ID NO: 381216 - protein, 5 aa, Mycobacterium
GGAGM

SEQ ID NO: 381217 - protein, 8 aa, Mycobacterium
GGDTGADC

SEQ ID NO: 381218 - protein, 5 aa, Mycobacterium
GGEKV

SEQ ID NO: 381219 - protein, 7 aa, Mycobacterium
GGEPTVR

SEQ ID NO: 381220 - protein, 5 aa, Mycobacterium
GGGGV

SEQ ID NO: 381221 - protein, 7 aa, Mycobacterium
GGKNVAP

SEQ ID NO: 381222 - protein, 13 aa, Mycobacterium
GGRGIRVDVVDTD

SEQ ID NO: 381223 - protein, 7 aa, Mycobacterium
GGRQASA

SEQ ID NO: 381224 - protein, 5 aa, Mycobacterium
GGSDL

SEQ ID NO: 381225 - protein, 6 aa, Mycobacterium
GHHTAE

SEQ ID NO: 381226 - protein, 4 aa, Mycobacterium
GISG

SEQ ID NO: 381227 - protein, 6 aa, Mycobacterium
GKQGRF

SEQ ID NO: 381228 - protein, 4 aa, Mycobacterium
GKYT

SEQ ID NO: 381229 - protein, 5 aa, Mycobacterium
GLDGI

SEQ ID NO: 381230 - protein, 4 aa, Mycobacterium
GLDT

SEQ ID NO: 381231 - protein, 4 aa, Mycobacterium
GLPA

SEQ ID NO: 381232 - protein, 8 aa, Mycobacterium
GMADQSRT

SEQ ID NO: 381233 - protein, 5 aa, Mycobacterium
GNAGN

SEQ ID NO: 381234 - protein, 6 aa, Mycobacterium
GNGEQR

SEQ ID NO: 381235 - protein, 10 aa, Mycobacterium
GNGPSPKDGG

SEQ ID NO: 381236 - protein, 4 aa, Mycobacterium
GNPT

SEQ ID NO: 381237 - protein, 4 aa, Mycobacterium
GNVG

SEQ ID NO: 381238 - protein, 4 aa, Mycobacterium
GPAG

SEQ ID NO: 381239 - protein, 9 aa, Mycobacterium
GPAGVGKTE

SEQ ID NO: 381240 - protein, 4 aa, Mycobacterium
GPAI

SEQ ID NO: 381241 - protein, 4 aa, Mycobacterium
GPAR

SEQ ID NO: 381242 - protein, 9 aa, Mycobacterium
GPESSGKTT

SEQ ID NO: 381243 - protein, 4 aa, Mycobacterium
GPGA

SEQ ID NO: 381244 - protein, 9 aa, Mycobacterium
GPGKGNAMG

SEQ ID NO: 381245 - protein, 10 aa, Mycobacterium
GPNGAGKSTT

SEQ ID NO: 381246 - protein, 9 aa, Mycobacterium
GPNGAGKTT

SEQ ID NO: 381247 - protein, 9 aa, Mycobacterium
GPSGSGKST

SEQ ID NO: 381248 - protein, 6 aa, Mycobacterium
GPTAAR

SEQ ID NO: 381249 - protein, 6 aa, Mycobacterium
GQERPF

SEQ ID NO: 381250 - protein, 9 aa, Mycobacterium
GQTGKTVSP

SEQ ID NO: 381251 - protein, 9 aa, Mycobacterium
GREPTPEEL

SEQ ID NO: 381252 - protein, 9 aa, Mycobacterium
GRGGRTATA

SEQ ID NO: 381253 - protein, 4 aa, Mycobacterium
GRRG

SEQ ID NO: 381254 - protein, 4 aa, Mycobacterium
GSEE

SEQ ID NO: 381255 - protein, 9 aa, Mycobacterium
GSGNGEQIA

SEQ ID NO: 381256 - protein, 16 aa, Mycobacterium
GSGQIKTGAPARSERV

SEQ ID NO: 381257 - protein, 8 aa, Mycobacterium
GSGTSEKT

SEQ ID NO: 381258 - protein, 5 aa, Mycobacterium
GSLGH

SEQ ID NO: 381259 - protein, 6 aa, Mycobacterium
GSMGGA

SEQ ID NO: 381260 - protein, 8 aa, Mycobacterium
GSNTSTLP

SEQ ID NO: 381261 - protein, 7 aa, Mycobacterium
GSPEDPG

SEQ ID NO: 381262 - protein, 8 aa, Mycobacterium
GSTRSINA

SEQ ID NO: 381263 - protein, 6 aa, Mycobacterium
GTGPFT

SEQ ID NO: 381264 - protein, 4 aa, Mycobacterium
GTGV

SEQ ID NO: 381265 - protein, 4 aa, Mycobacterium
GTPP

SEQ ID NO: 381266 - protein, 4 aa, Mycobacterium
GTSE

SEQ ID NO: 381267 - protein, 11 aa, Mycobacterium
GTSGMKSALNG

SEQ ID NO: 381268 - protein, 4 aa, Mycobacterium
GTSS

SEQ ID NO: 381269 - protein, 5 aa, Mycobacterium
GTTAI

SEQ ID NO: 381270 - protein, 4 aa, Mycobacterium
GTYT

SEQ ID NO: 381271 - protein, 5 aa, Mycobacterium
GYENK

SEQ ID NO: 381272 - protein, 13 aa, Mycobacterium
GYGGSDKPPRGYD

SEQ ID NO: 381273 - protein, 5 aa, Mycobacterium
HDTGT

SEQ ID NO: 381274 - protein, 12 aa, Mycobacterium
HEGQGPDHTSGR

SEQ ID NO: 381275 - protein, 6 aa, Mycobacterium
HGDTNA

SEQ ID NO: 381276 - protein, 11 aa, Mycobacterium
HGGRQANGGLP

SEQ ID NO: 381277 - protein, 6 aa, Mycobacterium
HGRGGF

SEQ ID NO: 381278 - protein, 10 aa, Mycobacterium
HGTGTPVGDP

SEQ ID NO: 381279 - protein, 8 aa, Mycobacterium
HKYKDSRE

SEQ ID NO: 381280 - protein, 8 aa, Mycobacterium
HNGAGKST

SEQ ID NO: 381281 - protein, 7 aa, Mycobacterium
HNPMPDN

SEQ ID NO: 381282 - protein, 4 aa, Mycobacterium
HPTL

SEQ ID NO: 381283 - protein, 5 aa, Mycobacterium
HQPGV

SEQ ID NO: 381284 - protein, 8 aa, Mycobacterium
HRGTGARG

SEQ ID NO: 381285 - protein, 6 aa, Mycobacterium
HTEVPS

SEQ ID NO: 381286 - protein, 10 aa, Mycobacterium
HTGGNSSGIV

SEQ ID NO: 381287 - protein, 20 aa, Mycobacterium
IARKSENPSITRDVSGEGVQ

SEQ ID NO: 381288 - protein, 7 aa, Mycobacterium
IDPRDTR

SEQ ID NO: 381289 - protein, 10 aa, Mycobacterium
IGRRSPDGRE

SEQ ID NO: 381290 - protein, 4 aa, Mycobacterium
INTR

SEQ ID NO: 381291 - protein, 9 aa, Mycobacterium
IPPAPRGVP

SEQ ID NO: 381292 - protein, 5 aa, Mycobacterium
IPPNR

SEQ ID NO: 381293 - protein, 6 aa, Mycobacterium
IRRGSD

SEQ ID NO: 381294 - protein, 6 aa, Mycobacterium
ISDPRN

SEQ ID NO: 381295 - protein, 4 aa, Mycobacterium
IYEA

SEQ ID NO: 381296 - protein, 7 aa, Mycobacterium
KAEDAKR

SEQ ID NO: 381297 - protein, 9 aa, Mycobacterium
KASAAERLA

SEQ ID NO: 381298 - protein, 5 aa, Mycobacterium
KATPE

SEQ ID NO: 381299 - protein, 7 aa, Mycobacterium
KATQEDP

SEQ ID NO: 381300 - protein, 5 aa, Mycobacterium
KDDAI

SEQ ID NO: 381301 - protein, 6 aa, Mycobacterium
KDEEAP

SEQ ID NO: 381302 - protein, 8 aa, Mycobacterium
KDEGGRHT

SEQ ID NO: 381303 - protein, 7 aa, Mycobacterium
KEDKEGR

SEQ ID NO: 381304 - protein, 6 aa, Mycobacterium
KGAGLG

SEQ ID NO: 381305 - protein, 19 aa, Mycobacterium
KGPDQQKPAGVLSGGERNR

SEQ ID NO: 381306 - protein, 7 aa, Mycobacterium
KINEPRF

SEQ ID NO: 381307 - protein, 4 aa, Mycobacterium
KPGD

SEQ ID NO: 381308 - protein, 4 aa, Mycobacterium
KPGV

SEQ ID NO: 381309 - protein, 8 aa, Mycobacterium
KPNVGKSS

SEQ ID NO: 381310 - protein, 13 aa, Mycobacterium
KPPIGKRGYNEDE

SEQ ID NO: 381311 - protein, 6 aa, Mycobacterium
KQNRRV

SEQ ID NO: 381312 - protein, 5 aa, Mycobacterium
KSGTL

SEQ ID NO: 381313 - protein, 6 aa, Mycobacterium
KSQKQV

SEQ ID NO: 381314 - protein, 6 aa, Mycobacterium
LAPEGA

SEQ ID NO: 381315 - protein, 8 aa, Mycobacterium
LDAGADDY

SEQ ID NO: 381316 - protein, 10 aa, Mycobacterium
LDPKADYGPL

SEQ ID NO: 381317 - protein, 22 aa, Mycobacterium
LDTQGVKNRKQARSRYGAKKEK

SEQ ID NO: 381318 - protein, 13 aa, Mycobacterium
LEKDALREIARGN

SEQ ID NO: 381319 - protein, 8 aa, Mycobacterium
LGARQGAG

SEQ ID NO: 381320 - protein, 5 aa, Mycobacterium
LGATG

SEQ ID NO: 381321 - protein, 8 aa, Mycobacterium
LGEDGDPL

SEQ ID NO: 381322 - protein, 4 aa, Mycobacterium
LGPE

SEQ ID NO: 381323 - protein, 4 aa, Mycobacterium
LGTT

SEQ ID NO: 381324 - protein, 7 aa, Mycobacterium
LIGGQED

SEQ ID NO: 381325 - protein, 7 aa, Mycobacterium
LKPEKDG

SEQ ID NO: 381326 - protein, 7 aa, Mycobacterium
LNHTGSH

SEQ ID NO: 381327 - protein, 4 aa, Mycobacterium
LPDG

SEQ ID NO: 381328 - protein, 4 aa, Mycobacterium
LPEG

SEQ ID NO: 381329 - protein, 4 aa, Mycobacterium
LPGG

SEQ ID NO: 381330 - protein, 12 aa, Mycobacterium
LPPARYAAACTH

SEQ ID NO: 381331 - protein, 4 aa, Mycobacterium
LPRP

SEQ ID NO: 381332 - protein, 6 aa, Mycobacterium
LPSTPR

SEQ ID NO: 381333 - protein, 7 aa, Mycobacterium
LRSPSGV

SEQ ID NO: 381334 - protein, 8 aa, Mycobacterium
LSGGQQQR

SEQ ID NO: 381335 - protein, 11 aa, Mycobacterium
LSGSANVTTGQ

SEQ ID NO: 381336 - protein, 6 aa, Mycobacterium
LSTPAA

SEQ ID NO: 381337 - protein, 5 aa, Mycobacterium
LTEDE

SEQ ID NO: 381338 - protein, 7 aa, Mycobacterium
LTEERRR

SEQ ID NO: 381339 - protein, 4 aa, Mycobacterium
LTQP

SEQ ID NO: 381340 - protein, 9 aa, Mycobacterium
NAKDRTVAS

SEQ ID NO: 381341 - protein, 5 aa, Mycobacterium
NATEA

SEQ ID NO: 381342 - protein, 6 aa, Mycobacterium
NDNGGG

SEQ ID NO: 381343 - protein, 8 aa, Mycobacterium
NDSPYGLS

SEQ ID NO: 381344 - protein, 6 aa, Mycobacterium
NDTVAT

SEQ ID NO: 381345 - protein, 9 aa, Mycobacterium
NEAETTTAS

SEQ ID NO: 381346 - protein, 6 aa, Mycobacterium
NEGGLH

SEQ ID NO: 381347 - protein, 6 aa, Mycobacterium
NETTTK

SEQ ID NO: 381348 - protein, 5 aa, Mycobacterium
NGDEV

SEQ ID NO: 381349 - protein, 6 aa, Mycobacterium
NGERTG

SEQ ID NO: 381350 - protein, 10 aa, Mycobacterium
NGGSAQESVV

SEQ ID NO: 381351 - protein, 5 aa, Mycobacterium
NGPAV

SEQ ID NO: 381352 - protein, 17 aa, Mycobacterium
NGRRGRPVTGPGNRPLK

SEQ ID NO: 381353 - protein, 6 aa, Mycobacterium
NGSGGI

SEQ ID NO: 381354 - protein, 8 aa, Mycobacterium
NIENQSSG

SEQ ID NO: 381355 - protein, 8 aa, Mycobacterium
NKHPRRGF

SEQ ID NO: 381356 - protein, 7 aa, Mycobacterium
NNPLSGL

SEQ ID NO: 381357 - protein, 8 aa, Mycobacterium
NNTGEIKS

SEQ ID NO: 381358 - protein, 6 aa, Mycobacterium
NPAPFG

SEQ ID NO: 381359 - protein, 8 aa, Mycobacterium
NPEEGELR

SEQ ID NO: 381360 - protein, 7 aa, Mycobacterium
NPRASRT

SEQ ID NO: 381361 - protein, 5 aa, Mycobacterium
NRDKR

SEQ ID NO: 381362 - protein, 6 aa, Mycobacterium
NRLGTN

SEQ ID NO: 381363 - protein, 4 aa, Mycobacterium
NSDD

SEQ ID NO: 381364 - protein, 10 aa, Mycobacterium
NSEGSRTTPS

SEQ ID NO: 381365 - protein, 6 aa, Mycobacterium
NSTRTR

SEQ ID NO: 381366 - protein, 10 aa, Mycobacterium
NTDSAGNSYG

SEQ ID NO: 381367 - protein, 22 aa, Mycobacterium
NTTIPTKRSETFTTADDNQPSV

SEQ ID NO: 381368 - protein, 6 aa, Mycobacterium
NYQPGT

SEQ ID NO: 381369 - protein, 4 aa, Mycobacterium
PDAE

SEQ ID NO: 381370 - protein, 4 aa, Mycobacterium
PDGT

SEQ ID NO: 381371 - protein, 8 aa, Mycobacterium
PDSSGNPY

SEQ ID NO: 381372 - protein, 6 aa, Mycobacterium
PEDGSA

SEQ ID NO: 381373 - protein, 4 aa, Mycobacterium
PEGI

SEQ ID NO: 381374 - protein, 11 aa, Mycobacterium
PEKQARKARET

SEQ ID NO: 381375 - protein, 4 aa, Mycobacterium
PELP

SEQ ID NO: 381376 - protein, 11 aa, Mycobacterium
PETVSTDYDTA

SEQ ID NO: 381377 - protein, 4 aa, Mycobacterium
PGAT

SEQ ID NO: 381378 - protein, 5 aa, Mycobacterium
PGFGG

SEQ ID NO: 381379 - protein, 6 aa, Mycobacterium
PGFGKS

SEQ ID NO: 381380 - protein, 4 aa, Mycobacterium
PGGV

SEQ ID NO: 381381 - protein, 4 aa, Mycobacterium
PGLG

SEQ ID NO: 381382 - protein, 12 aa, Mycobacterium
PGRWDEDGEKRI

SEQ ID NO: 381383 - protein, 4 aa, Mycobacterium
PHPR

SEQ ID NO: 381384 - protein, 6 aa, Mycobacterium
PKGPGH

SEQ ID NO: 381385 - protein, 7 aa, Mycobacterium
PKTRSGK

SEQ ID NO: 381386 - protein, 10 aa, Mycobacterium
PLEATKEGRG

SEQ ID NO: 381387 - protein, 5 aa, Mycobacterium
PNAPS

SEQ ID NO: 381388 - protein, 6 aa, Mycobacterium
PPDPSS

SEQ ID NO: 381389 - protein, 6 aa, Mycobacterium
PPEAQD

SEQ ID NO: 381390 - protein, 5 aa, Mycobacterium
PPNVT

SEQ ID NO: 381391 - protein, 5 aa, Mycobacterium
PPRHT

SEQ ID NO: 381392 - protein, 4 aa, Mycobacterium
PQHT

SEQ ID NO: 381393 - protein, 4 aa, Mycobacterium
PREQ

SEQ ID NO: 381394 - protein, 11 aa, Mycobacterium
PRGCGKTSSAR

SEQ ID NO: 381395 - protein, 7 aa, Mycobacterium
PRLNTQQ

SEQ ID NO: 381396 - protein, 7 aa, Mycobacterium
PRPGTPF

SEQ ID NO: 381397 - protein, 7 aa, Mycobacterium
PSASQTD

SEQ ID NO: 381398 - protein, 10 aa, Mycobacterium
PSSKADAGRV

SEQ ID NO: 381399 - protein, 4 aa, Mycobacterium
PTGV

SEQ ID NO: 381400 - protein, 4 aa, Mycobacterium
PTLR

SEQ ID NO: 381401 - protein, 12 aa, Mycobacterium
PTNNLDPASREQ

SEQ ID NO: 381402 - protein, 6 aa, Mycobacterium
PTPKTV

SEQ ID NO: 381403 - protein, 12 aa, Mycobacterium
PTRSHTGAAQGG

SEQ ID NO: 381404 - protein, 7 aa, Mycobacterium
PTSALDP

SEQ ID NO: 381405 - protein, 4 aa, Mycobacterium
PTSS

SEQ ID NO: 381406 - protein, 8 aa, Mycobacterium
PTSTGAAK

SEQ ID NO: 381407 - protein, 4 aa, Mycobacterium
PTVN

SEQ ID NO: 381408 - protein, 8 aa, Mycobacterium
PYGEDGTI

SEQ ID NO: 381409 - protein, 11 aa, Mycobacterium
PYIGATRSKVP

SEQ ID NO: 381410 - protein, 7 aa, Mycobacterium
QAASEPV

SEQ ID NO: 381411 - protein, 5 aa, Mycobacterium
QEPGA

SEQ ID NO: 381412 - protein, 7 aa, Mycobacterium
QGQAGDN

SEQ ID NO: 381413 - protein, 9 aa, Mycobacterium
QGQQAPSGH

SEQ ID NO: 381414 - protein, 4 aa, Mycobacterium
QGRG

SEQ ID NO: 381415 - protein, 12 aa, Mycobacterium
QGYGRQKGHTEV

SEQ ID NO: 381416 - protein, 8 aa, Mycobacterium
QHDTTGAE

SEQ ID NO: 381417 - protein, 21 aa, Mycobacterium
QHRATQRHEPVAGTPADPDAA

SEQ ID NO: 381418 - protein, 5 aa, Mycobacterium
QLPDG

SEQ ID NO: 381419 - protein, 6 aa, Mycobacterium
QLTRAG

SEQ ID NO: 381420 - protein, 13 aa, Mycobacterium
QPAPTLSGGEAQR

SEQ ID NO: 381421 - protein, 6 aa, Mycobacterium
QPATPT

SEQ ID NO: 381422 - protein, 6 aa, Mycobacterium
QPPELE

SEQ ID NO: 381423 - protein, 6 aa, Mycobacterium
QQEAGR

SEQ ID NO: 381424 - protein, 16 aa, Mycobacterium
QSPIGRTPRSNPATYT

SEQ ID NO: 381425 - protein, 4 aa, Mycobacterium
QTPS

SEQ ID NO: 381426 - protein, 7 aa, Mycobacterium
QTQSEVR

SEQ ID NO: 381427 - protein, 5 aa, Mycobacterium
RAAGA

SEQ ID NO: 381428 - protein, 6 aa, Mycobacterium
RADDTA

SEQ ID NO: 381429 - protein, 4 aa, Mycobacterium
RADG

SEQ ID NO: 381430 - protein, 8 aa, Mycobacterium
RAYPYEGN

SEQ ID NO: 381431 - protein, 4 aa, Mycobacterium
RDAG

SEQ ID NO: 381432 - protein, 8 aa, Mycobacterium
RDDLPDGG

SEQ ID NO: 381433 - protein, 8 aa, Mycobacterium
RDETDVNP

SEQ ID NO: 381434 - protein, 7 aa, Mycobacterium
RENAELK

SEQ ID NO: 381435 - protein, 7 aa, Mycobacterium
RFSGGTT

SEQ ID NO: 381436 - protein, 4 aa, Mycobacterium
RGGA

SEQ ID NO: 381437 - protein, 4 aa, Mycobacterium
RGKI

SEQ ID NO: 381438 - protein, 5 aa, Mycobacterium
RGPSA

SEQ ID NO: 381439 - protein, 6 aa, Mycobacterium
RGQEAA

SEQ ID NO: 381440 - protein, 4 aa, Mycobacterium
RGRG

SEQ ID NO: 381441 - protein, 6 aa, Mycobacterium
RGRGPV

SEQ ID NO: 381442 - protein, 6 aa, Mycobacterium
RGSAKR

SEQ ID NO: 381443 - protein, 5 aa, Mycobacterium
RGSDV

SEQ ID NO: 381444 - protein, 4 aa, Mycobacterium
RGSF

SEQ ID NO: 381445 - protein, 4 aa, Mycobacterium
RGTD

SEQ ID NO: 381446 - protein, 8 aa, Mycobacterium
RGTEADRI

SEQ ID NO: 381447 - protein, 7 aa, Mycobacterium
RKEIHES

SEQ ID NO: 381448 - protein, 17 aa, Mycobacterium
RKISDGDKLAGRHGNKG

SEQ ID NO: 381449 - protein, 4 aa, Mycobacterium
RLGP

SEQ ID NO: 381450 - protein, 5 aa, Mycobacterium
RNTPR

SEQ ID NO: 381451 - protein, 4 aa, Mycobacterium
RPEA

SEQ ID NO: 381452 - protein, 6 aa, Mycobacterium
RPGEPL

SEQ ID NO: 381453 - protein, 5 aa, Mycobacterium
RPGNQ

SEQ ID NO: 381454 - protein, 9 aa, Mycobacterium
RPGRSEQSL

SEQ ID NO: 381455 - protein, 4 aa, Mycobacterium
RPNV

SEQ ID NO: 381456 - protein, 7 aa, Mycobacterium
RPSGTED

SEQ ID NO: 381457 - protein, 4 aa, Mycobacterium
RPTL

SEQ ID NO: 381458 - protein, 9 aa, Mycobacterium
RRDKATSNI

SEQ ID NO: 381459 - protein, 5 aa, Mycobacterium
RRGLE

SEQ ID NO: 381460 - protein, 7 aa, Mycobacterium
RRGSRNI

SEQ ID NO: 381461 - protein, 4 aa, Mycobacterium
RRTA

SEQ ID NO: 381462 - protein, 6 aa, Mycobacterium
RSENAT

SEQ ID NO: 381463 - protein, 4 aa, Mycobacterium
RSGE

SEQ ID NO: 381464 - protein, 9 aa, Mycobacterium
RSKTQGRAN

SEQ ID NO: 381465 - protein, 7 aa, Mycobacterium
RSPDEFS

SEQ ID NO: 381466 - protein, 4 aa, Mycobacterium
RSPE

SEQ ID NO: 381467 - protein, 6 aa, Mycobacterium
RSSEVA

SEQ ID NO: 381468 - protein, 16 aa, Mycobacterium
RSSGPGGQSVNTTDSA

SEQ ID NO: 381469 - protein, 6 aa, Mycobacterium
RSTGDD

SEQ ID NO: 381470 - protein, 4 aa, Mycobacterium
RTDA

SEQ ID NO: 381471 - protein, 7 aa, Mycobacterium
RTGDEIH

SEQ ID NO: 381472 - protein, 4 aa, Mycobacterium
RTGF

SEQ ID NO: 381473 - protein, 7 aa, Mycobacterium
RTGKIGD

SEQ ID NO: 381474 - protein, 4 aa, Mycobacterium
RTGT

SEQ ID NO: 381475 - protein, 4 aa, Mycobacterium
RTPT

SEQ ID NO: 381476 - protein, 5 aa, Mycobacterium
RVRGQ

SEQ ID NO: 381477 - protein, 15 aa, Mycobacterium
RVSRSSALASKATGF

SEQ ID NO: 381478 - protein, 5 aa, Mycobacterium
RYDAP

SEQ ID NO: 381479 - protein, 5 aa, Mycobacterium
RYTGR

SEQ ID NO: 381480 - protein, 6 aa, Mycobacterium
RYTGRG

SEQ ID NO: 381481 - protein, 7 aa, Mycobacterium
SAAEGDN

SEQ ID NO: 381482 - protein, 6 aa, Mycobacterium
SADGHG

SEQ ID NO: 381483 - protein, 7 aa, Mycobacterium
SAHDEAE

SEQ ID NO: 381484 - protein, 4 aa, Mycobacterium
SARE

SEQ ID NO: 381485 - protein, 4 aa, Mycobacterium
SASN

SEQ ID NO: 381486 - protein, 4 aa, Mycobacterium
SATG

SEQ ID NO: 381487 - protein, 5 aa, Mycobacterium
SDEFT

SEQ ID NO: 381488 - protein, 11 aa, Mycobacterium
SDNKADAAPTW

SEQ ID NO: 381489 - protein, 6 aa, Mycobacterium
SDRTTV

SEQ ID NO: 381490 - protein, 4 aa, Mycobacterium
SDYL

SEQ ID NO: 381491 - protein, 4 aa, Mycobacterium
SEAQ

SEQ ID NO: 381492 - protein, 7 aa, Mycobacterium
SEGPLPQ

SEQ ID NO: 381493 - protein, 4 aa, Mycobacterium
SEHS

SEQ ID NO: 381494 - protein, 11 aa, Mycobacterium
SELASAGDGGM

SEQ ID NO: 381495 - protein, 9 aa, Mycobacterium
SEPGAGTDL

SEQ ID NO: 381496 - protein, 5 aa, Mycobacterium
SEREA

SEQ ID NO: 381497 - protein, 4 aa, Mycobacterium
SGAG

SEQ ID NO: 381498 - protein, 8 aa, Mycobacterium
SGAGGVDA

SEQ ID NO: 381499 - protein, 4 aa, Mycobacterium
SGAT

SEQ ID NO: 381500 - protein, 4 aa, Mycobacterium
SGLT

SEQ ID NO: 381501 - protein, 11 aa, Mycobacterium
SGRGDKDVETA

SEQ ID NO: 381502 - protein, 7 aa, Mycobacterium
SGSGSSY

SEQ ID NO: 381503 - protein, 7 aa, Mycobacterium
SGTEATM

SEQ ID NO: 381504 - protein, 9 aa, Mycobacterium
SGTTGNPKG

SEQ ID NO: 381505 - protein, 8 aa, Mycobacterium
SIGEPGTQ

SEQ ID NO: 381506 - protein, 8 aa, Mycobacterium
SKPGTYGA

SEQ ID NO: 381507 - protein, 7 aa, Mycobacterium
SKTPEQE

SEQ ID NO: 381508 - protein, 7 aa, Mycobacterium
SLGSDNA

SEQ ID NO: 381509 - protein, 16 aa, Mycobacterium
SLPADRRPDPDAEGAP

SEQ ID NO: 381510 - protein, 4 aa, Mycobacterium
SLQT

SEQ ID NO: 381511 - protein, 6 aa, Mycobacterium
SNVDTD

SEQ ID NO: 381512 - protein, 8 aa, Mycobacterium
SPEDEDRE

SEQ ID NO: 381513 - protein, 9 aa, Mycobacterium
SPETTTGGK

SEQ ID NO: 381514 - protein, 7 aa, Mycobacterium
SPGGSIS

SEQ ID NO: 381515 - protein, 13 aa, Mycobacterium
SPPAGSEPLPITS

SEQ ID NO: 381516 - protein, 4 aa, Mycobacterium
SPPF

SEQ ID NO: 381517 - protein, 9 aa, Mycobacterium
SPPKAGKTT

SEQ ID NO: 381518 - protein, 7 aa, Mycobacterium
SPQSIRD

SEQ ID NO: 381519 - protein, 9 aa, Mycobacterium
SQPDTGEQA

SEQ ID NO: 381520 - protein, 6 aa, Mycobacterium
SRSDTY

SEQ ID NO: 381521 - protein, 7 aa, Mycobacterium
SRYRGDF

SEQ ID NO: 381522 - protein, 9 aa, Mycobacterium
SSATTRSRP

SEQ ID NO: 381523 - protein, 6 aa, Mycobacterium
SSGDPG

SEQ ID NO: 381524 - protein, 6 aa, Mycobacterium
SSGGTC

SEQ ID NO: 381525 - protein, 6 aa, Mycobacterium
SSREPY

SEQ ID NO: 381526 - protein, 4 aa, Mycobacterium
STAA

SEQ ID NO: 381527 - protein, 6 aa, Mycobacterium
STAESH

SEQ ID NO: 381528 - protein, 6 aa, Mycobacterium
STGERG

SEQ ID NO: 381529 - protein, 6 aa, Mycobacterium
STKAGL

SEQ ID NO: 381530 - protein, 5 aa, Mycobacterium
STNLP

SEQ ID NO: 381531 - protein, 5 aa, Mycobacterium
STRTR

SEQ ID NO: 381532 - protein, 6 aa, Mycobacterium
SYGPIG

SEQ ID NO: 381533 - protein, 4 aa, Mycobacterium
TAAA

SEQ ID NO: 381534 - protein, 7 aa, Mycobacterium
TAAGTGV

SEQ ID NO: 381535 - protein, 9 aa, Mycobacterium
TAPEGKTMG

SEQ ID NO: 381536 - protein, 6 aa, Mycobacterium
TAPGVI

SEQ ID NO: 381537 - protein, 4 aa, Mycobacterium
TDGQ

SEQ ID NO: 381538 - protein, 7 aa, Mycobacterium
TDRPDAR

SEQ ID NO: 381539 - protein, 9 aa, Mycobacterium
TDRPYPPVA

SEQ ID NO: 381540 - protein, 5 aa, Mycobacterium
TDTGT

SEQ ID NO: 381541 - protein, 5 aa, Mycobacterium
TEAAG

SEQ ID NO: 381542 - protein, 5 aa, Mycobacterium
TEDKY

SEQ ID NO: 381543 - protein, 4 aa, Mycobacterium
TEHT

SEQ ID NO: 381544 - protein, 11 aa, Mycobacterium
TEPEGGSDVAT

SEQ ID NO: 381545 - protein, 8 aa, Mycobacterium
TGAGSGIG

SEQ ID NO: 381546 - protein, 4 aa, Mycobacterium
TGEA

SEQ ID NO: 381547 - protein, 11 aa, Mycobacterium
TGENRLTDTKR

SEQ ID NO: 381548 - protein, 6 aa, Mycobacterium
TGGKHR

SEQ ID NO: 381549 - protein, 4 aa, Mycobacterium
TGGL

SEQ ID NO: 381550 - protein, 4 aa, Mycobacterium
TGLA

SEQ ID NO: 381551 - protein, 4 aa, Mycobacterium
TGLP

SEQ ID NO: 381552 - protein, 4 aa, Mycobacterium
TKGG

SEQ ID NO: 381553 - protein, 5 aa, Mycobacterium
TKHAR

SEQ ID NO: 381554 - protein, 4 aa, Mycobacterium
TPDE

SEQ ID NO: 381555 - protein, 6 aa, Mycobacterium
TPDSFY

SEQ ID NO: 381556 - protein, 6 aa, Mycobacterium
TPSSKV

SEQ ID NO: 381557 - protein, 5 aa, Mycobacterium
TPTTV

SEQ ID NO: 381558 - protein, 5 aa, Mycobacterium
TPVPG

SEQ ID NO: 381559 - protein, 15 aa, Mycobacterium
TQASVPPQGGRKHPH

SEQ ID NO: 381560 - protein, 5 aa, Mycobacterium
TQHVD

SEQ ID NO: 381561 - protein, 4 aa, Mycobacterium
TRPS

SEQ ID NO: 381562 - protein, 5 aa, Mycobacterium
TRQLD

SEQ ID NO: 381563 - protein, 5 aa, Mycobacterium
TSDGA

SEQ ID NO: 381564 - protein, 8 aa, Mycobacterium
TSGPGATN

SEQ ID NO: 381565 - protein, 6 aa, Mycobacterium
TSSAEQ

SEQ ID NO: 381566 - protein, 6 aa, Mycobacterium
TSTTKS

SEQ ID NO: 381567 - protein, 4 aa, Mycobacterium
TTVD

SEQ ID NO: 381568 - protein, 8 aa, Mycobacterium
VDDPTGDA

SEQ ID NO: 381569 - protein, 5 aa, Mycobacterium
VDGQH

SEQ ID NO: 381570 - protein, 5 aa, Mycobacterium
VDPDG

SEQ ID NO: 381571 - protein, 5 aa, Mycobacterium
VDPNE

SEQ ID NO: 381572 - protein, 4 aa, Mycobacterium
VEEG

SEQ ID NO: 381573 - protein, 6 aa, Mycobacterium
VEGSGG

SEQ ID NO: 381574 - protein, 4 aa, Mycobacterium
VEQG

SEQ ID NO: 381575 - protein, 9 aa, Mycobacterium
VGAAGDNAA

SEQ ID NO: 381576 - protein, 7 aa, Mycobacterium
VGESTDV

SEQ ID NO: 381577 - protein, 11 aa, Mycobacterium
VGPGRGSAAGS

SEQ ID NO: 381578 - protein, 10 aa, Mycobacterium
VGPNGAGKSS

SEQ ID NO: 381579 - protein, 6 aa, Mycobacterium
VKPGRA

SEQ ID NO: 381580 - protein, 4 aa, Mycobacterium
VPAG

SEQ ID NO: 381581 - protein, 4 aa, Mycobacterium
VPDD

SEQ ID NO: 381582 - protein, 6 aa, Mycobacterium
VPETLK

SEQ ID NO: 381583 - protein, 8 aa, Mycobacterium
VPHGESGK

SEQ ID NO: 381584 - protein, 5 aa, Mycobacterium
VPPIN

SEQ ID NO: 381585 - protein, 19 aa, Mycobacterium
VPQRRKRKRHGTSTAPPEV

SEQ ID NO: 381586 - protein, 4 aa, Mycobacterium
VPTG

SEQ ID NO: 381587 - protein, 6 aa, Mycobacterium
VPTIET

SEQ ID NO: 381588 - protein, 7 aa, Mycobacterium
VRGEGGR

SEQ ID NO: 381589 - protein, 10 aa, Mycobacterium
VRGPSGTRLE

SEQ ID NO: 381590 - protein, 26 aa, Mycobacterium
VRGQRTKTNARTRKGPKRTIAGKKKA

SEQ ID NO: 381591 - protein, 4 aa, Mycobacterium
VSKA

SEQ ID NO: 381592 - protein, 10 aa, Mycobacterium
VSPNPGGVGP

SEQ ID NO: 381593 - protein, 4 aa, Mycobacterium
VTDP

SEQ ID NO: 381594 - protein, 11 aa, Mycobacterium
VTESQGRVHTS

SEQ ID NO: 381595 - protein, 8 aa, Mycobacterium
YETPDPEI

SEQ ID NO: 381596 - protein, 11 aa, Mycobacterium
YNNASPASGRI

SEQ ID NO: 381597 - protein, 4 aa, Mycobacterium
YPQE

SEQ ID NO: 381598 - protein, 9 aa, Mycobacterium
YRTSGDSPI

SEQ ID NO: 381599 - protein, 8 aa, Mycobacterium
AAAARREY

SEQ ID NO: 381600 - protein, 4 aa, Mycobacterium
AAAD

SEQ ID NO: 381601 - protein, 6 aa, Mycobacterium
AAAEMR

SEQ ID NO: 381602 - protein, 11 aa, Mycobacterium
AAAGGRGGLGN

SEQ ID NO: 381603 - protein, 4 aa, Mycobacterium
AAAT

SEQ ID NO: 381604 - protein, 4 aa, Mycobacterium
AAEA

SEQ ID NO: 381605 - protein, 4 aa, Mycobacterium
AAEP

SEQ ID NO: 381606 - protein, 4 aa, Mycobacterium
AAET

SEQ ID NO: 381607 - protein, 6 aa, Mycobacterium
AAGGVG

SEQ ID NO: 381608 - protein, 8 aa, Mycobacterium
AAGHDAEQ

SEQ ID NO: 381609 - protein, 4 aa, Mycobacterium
AAGQ

SEQ ID NO: 381610 - protein, 4 aa, Mycobacterium
AAGV

SEQ ID NO: 381611 - protein, 4 aa, Mycobacterium
AAKT

SEQ ID NO: 381612 - protein, 6 aa, Mycobacterium
AALGGG

SEQ ID NO: 381613 - protein, 5 aa, Mycobacterium
AANSR

SEQ ID NO: 381614 - protein, 8 aa, Mycobacterium
AAQATTLG

SEQ ID NO: 381615 - protein, 4 aa, Mycobacterium
AARA

SEQ ID NO: 381616 - protein, 7 aa, Mycobacterium
AARANDI

SEQ ID NO: 381617 - protein, 4 aa, Mycobacterium
AASD

SEQ ID NO: 381618 - protein, 4 aa, Mycobacterium
AASH

SEQ ID NO: 381619 - protein, 4 aa, Mycobacterium
AATG

SEQ ID NO: 381620 - protein, 4 aa, Mycobacterium
AATS

SEQ ID NO: 381621 - protein, 8 aa, Mycobacterium
ACGSSQQA

SEQ ID NO: 381622 - protein, 4 aa, Mycobacterium
ADAA

SEQ ID NO: 381623 - protein, 4 aa, Mycobacterium
ADAE

SEQ ID NO: 381624 - protein, 4 aa, Mycobacterium
ADAG

SEQ ID NO: 381625 - protein, 4 aa, Mycobacterium
ADEG

SEQ ID NO: 381626 - protein, 4 aa, Mycobacterium
ADEL

SEQ ID NO: 381627 - protein, 7 aa, Mycobacterium
ADGQAFR

SEQ ID NO: 381628 - protein, 4 aa, Mycobacterium
ADGS

SEQ ID NO: 381629 - protein, 5 aa, Mycobacterium
ADGSI

SEQ ID NO: 381630 - protein, 4 aa, Mycobacterium
ADGT

SEQ ID NO: 381631 - protein, 8 aa, Mycobacterium
ADNASSAG

SEQ ID NO: 381632 - protein, 8 aa, Mycobacterium
ADPLGGAS

SEQ ID NO: 381633 - protein, 4 aa, Mycobacterium
ADRA

SEQ ID NO: 381634 - protein, 4 aa, Mycobacterium
AEAE

SEQ ID NO: 381635 - protein, 4 aa, Mycobacterium
AEAS

SEQ ID NO: 381636 - protein, 6 aa, Mycobacterium
AEDPRA

SEQ ID NO: 381637 - protein, 6 aa, Mycobacterium
AEEPRL

SEQ ID NO: 381638 - protein, 10 aa, Mycobacterium
AEGGEPAAGR

SEQ ID NO: 381639 - protein, 4 aa, Mycobacterium
AEIP

SEQ ID NO: 381640 - protein, 9 aa, Mycobacterium
AEQKGTGRW

SEQ ID NO: 381641 - protein, 4 aa, Mycobacterium
AERG

SEQ ID NO: 381642 - protein, 8 aa, Mycobacterium
AESSPSIV

SEQ ID NO: 381643 - protein, 4 aa, Mycobacterium
AETD

SEQ ID NO: 381644 - protein, 4 aa, Mycobacterium
AETR

SEQ ID NO: 381645 - protein, 5 aa, Mycobacterium
AGAGA

SEQ ID NO: 381646 - protein, 9 aa, Mycobacterium
AGAGGTSWS

SEQ ID NO: 381647 - protein, 9 aa, Mycobacterium
AGAGKTETM

SEQ ID NO: 381648 - protein, 8 aa, Mycobacterium
AGASTGGF

SEQ ID NO: 381649 - protein, 4 aa, Mycobacterium
AGDL

SEQ ID NO: 381650 - protein, 4 aa, Mycobacterium
AGDP

SEQ ID NO: 381651 - protein, 4 aa, Mycobacterium
AGDV

SEQ ID NO: 381652 - protein, 5 aa, Mycobacterium
AGEQR

SEQ ID NO: 381653 - protein, 4 aa, Mycobacterium
AGGD

SEQ ID NO: 381654 - protein, 7 aa, Mycobacterium
AGGGIGR

SEQ ID NO: 381655 - protein, 6 aa, Mycobacterium
AGHSRE

SEQ ID NO: 381656 - protein, 5 aa, Mycobacterium
AGHTG

SEQ ID NO: 381657 - protein, 8 aa, Mycobacterium
AGKTTTTE

SEQ ID NO: 381658 - protein, 4 aa, Mycobacterium
AGMS

SEQ ID NO: 381659 - protein, 12 aa, Mycobacterium
AGNMSKRQSATG

SEQ ID NO: 381660 - protein, 9 aa, Mycobacterium
AGPERATEA

SEQ ID NO: 381661 - protein, 8 aa, Mycobacterium
AGPGTNGS

SEQ ID NO: 381662 - protein, 7 aa, Mycobacterium
AGPTEFT

SEQ ID NO: 381663 - protein, 6 aa, Mycobacterium
AGQETT

SEQ ID NO: 381664 - protein, 6 aa, Mycobacterium
AGRDDT

SEQ ID NO: 381665 - protein, 4 aa, Mycobacterium
AGRP

SEQ ID NO: 381666 - protein, 4 aa, Mycobacterium
AGSA

SEQ ID NO: 381667 - protein, 6 aa, Mycobacterium
AGSEVS

SEQ ID NO: 381668 - protein, 10 aa, Mycobacterium
AGSVDDGKST

SEQ ID NO: 381669 - protein, 10 aa, Mycobacterium
AGTGGTSATI

SEQ ID NO: 381670 - protein, 5 aa, Mycobacterium
AGTNE

SEQ ID NO: 381671 - protein, 5 aa, Mycobacterium
AGTPH

SEQ ID NO: 381672 - protein, 4 aa, Mycobacterium
AGVG

SEQ ID NO: 381673 - protein, 4 aa, Mycobacterium
AGVP

SEQ ID NO: 381674 - protein, 8 aa, Mycobacterium
AHEEGGER

SEQ ID NO: 381675 - protein, 13 aa, Mycobacterium
AHPELKSRPTRPH

SEQ ID NO: 381676 - protein, 5 aa, Mycobacterium
AIPDD

SEQ ID NO: 381677 - protein, 9 aa, Mycobacterium
AIPGELDDA

SEQ ID NO: 381678 - protein, 6 aa, Mycobacterium
AKAAGL

SEQ ID NO: 381679 - protein, 6 aa, Mycobacterium
AKEQKA

SEQ ID NO: 381680 - protein, 8 aa, Mycobacterium
AKGRGRDM

SEQ ID NO: 381681 - protein, 6 aa, Mycobacterium
AKNHPS

SEQ ID NO: 381682 - protein, 4 aa, Mycobacterium
AKPY

SEQ ID NO: 381683 - protein, 4 aa, Mycobacterium
ALES

SEQ ID NO: 381684 - protein, 13 aa, Mycobacterium
ALGPGGLSRERAG

SEQ ID NO: 381685 - protein, 6 aa, Mycobacterium
ALKETS

SEQ ID NO: 381686 - protein, 8 aa, Mycobacterium
ALNNSGTT

SEQ ID NO: 381687 - protein, 5 aa, Mycobacterium
ALTEA

SEQ ID NO: 381688 - protein, 9 aa, Mycobacterium
ANDGGGSIR

SEQ ID NO: 381689 - protein, 12 aa, Mycobacterium
ANDYVGKGLSGG

SEQ ID NO: 381690 - protein, 5 aa, Mycobacterium
ANLET

SEQ ID NO: 381691 - protein, 7 aa, Mycobacterium
ANPDMEA

SEQ ID NO: 381692 - protein, 9 aa, Mycobacterium
ANPEDYTNR

SEQ ID NO: 381693 - protein, 7 aa, Mycobacterium
APANGPA

SEQ ID NO: 381694 - protein, 4 aa, Mycobacterium
APAP

SEQ ID NO: 381695 - protein, 5 aa, Mycobacterium
APAQS

SEQ ID NO: 381696 - protein, 4 aa, Mycobacterium
APGA

SEQ ID NO: 381697 - protein, 4 aa, Mycobacterium
APGP

SEQ ID NO: 381698 - protein, 7 aa, Mycobacterium
APIQGSA

SEQ ID NO: 381699 - protein, 5 aa, Mycobacterium
APPDL

SEQ ID NO: 381700 - protein, 4 aa, Mycobacterium
APPE

SEQ ID NO: 381701 - protein, 4 aa, Mycobacterium
APRP

SEQ ID NO: 381702 - protein, 6 aa, Mycobacterium
AQAAGG

SEQ ID NO: 381703 - protein, 7 aa, Mycobacterium
AQNTTAE

SEQ ID NO: 381704 - protein, 6 aa, Mycobacterium
AQPTEP

SEQ ID NO: 381705 - protein, 6 aa, Mycobacterium
AQTDPE

SEQ ID NO: 381706 - protein, 9 aa, Mycobacterium
AQTGTGKTA

SEQ ID NO: 381707 - protein, 5 aa, Mycobacterium
ARAGE

SEQ ID NO: 381708 - protein, 10 aa, Mycobacterium
ARAKATVGEI

SEQ ID NO: 381709 - protein, 4 aa, Mycobacterium
ARGA

SEQ ID NO: 381710 - protein, 20 aa, Mycobacterium
ARHGGGAFSGKDPSKVDRSA

SEQ ID NO: 381711 - protein, 5 aa, Mycobacterium
ARLAE

SEQ ID NO: 381712 - protein, 4 aa, Mycobacterium
ARPV

SEQ ID NO: 381713 - protein, 5 aa, Mycobacterium
ARRAG

SEQ ID NO: 381714 - protein, 6 aa, Mycobacterium
ASAASI

SEQ ID NO: 381715 - protein, 4 aa, Mycobacterium
ASAG

SEQ ID NO: 381716 - protein, 8 aa, Mycobacterium
ASAGTGKT

SEQ ID NO: 381717 - protein, 9 aa, Mycobacterium
ASARETAAR

SEQ ID NO: 381718 - protein, 8 aa, Mycobacterium
ASATSLDT

SEQ ID NO: 381719 - protein, 7 aa, Mycobacterium
ASDTDTE

SEQ ID NO: 381720 - protein, 6 aa, Mycobacterium
ASEKAA

SEQ ID NO: 381721 - protein, 8 aa, Mycobacterium
ASGGSVGY

SEQ ID NO: 381722 - protein, 7 aa, Mycobacterium
ASGIGRA

SEQ ID NO: 381723 - protein, 4 aa, Mycobacterium
ASGY

SEQ ID NO: 381724 - protein, 12 aa, Mycobacterium
ASHGGVDDTREL

SEQ ID NO: 381725 - protein, 7 aa, Mycobacterium
ASNERQV

SEQ ID NO: 381726 - protein, 12 aa, Mycobacterium
ASPSSGGTRMQE

SEQ ID NO: 381727 - protein, 5 aa, Mycobacterium
ASQRA

SEQ ID NO: 381728 - protein, 7 aa, Mycobacterium
ASRETVN

SEQ ID NO: 381729 - protein, 4 aa, Mycobacterium
ASSL

SEQ ID NO: 381730 - protein, 8 aa, Mycobacterium
ASTHKTPA

SEQ ID NO: 381731 - protein, 8 aa, Mycobacterium
ASTPGCTK

SEQ ID NO: 381732 - protein, 7 aa, Mycobacterium
ATATPQV

SEQ ID NO: 381733 - protein, 4 aa, Mycobacterium
ATDL

SEQ ID NO: 381734 - protein, 5 aa, Mycobacterium
ATEPG

SEQ ID NO: 381735 - protein, 4 aa, Mycobacterium
ATGA

SEQ ID NO: 381736 - protein, 10 aa, Mycobacterium
ATGTGKSATT

SEQ ID NO: 381737 - protein, 4 aa, Mycobacterium
ATGV

SEQ ID NO: 381738 - protein, 5 aa, Mycobacterium
ATLGN

SEQ ID NO: 381739 - protein, 6 aa, Mycobacterium
ATPDQM

SEQ ID NO: 381740 - protein, 12 aa, Mycobacterium
ATPPPVRGGKQP

SEQ ID NO: 381741 - protein, 9 aa, Mycobacterium
ATQGHTQSL

SEQ ID NO: 381742 - protein, 10 aa, Mycobacterium
ATQPNYPAEI

SEQ ID NO: 381743 - protein, 10 aa, Mycobacterium
ATSREGKAQV

SEQ ID NO: 381744 - protein, 4 aa, Mycobacterium
AVGG

SEQ ID NO: 381745 - protein, 12 aa, Mycobacterium
AVPSGASTGEHE

SEQ ID NO: 381746 - protein, 10 aa, Mycobacterium
CAQRTDHRRG

SEQ ID NO: 381747 - protein, 5 aa, Mycobacterium
CGSTG

SEQ ID NO: 381748 - protein, 6 aa, Mycobacterium
CPGPEA

SEQ ID NO: 381749 - protein, 8 aa, Mycobacterium
DACTPSHT

SEQ ID NO: 381750 - protein, 4 aa, Mycobacterium
DADE

SEQ ID NO: 381751 - protein, 4 aa, Mycobacterium
DAER

SEQ ID NO: 381752 - protein, 5 aa, Mycobacterium
DAQTP

SEQ ID NO: 381753 - protein, 12 aa, Mycobacterium
DARDTKLGAEEI

SEQ ID NO: 381754 - protein, 7 aa, Mycobacterium
DAVRDGD

SEQ ID NO: 381755 - protein, 7 aa, Mycobacterium
DDASAND

SEQ ID NO: 381756 - protein, 4 aa, Mycobacterium
DDGI

SEQ ID NO: 381757 - protein, 4 aa, Mycobacterium
DDGR

SEQ ID NO: 381758 - protein, 5 aa, Mycobacterium
DDKSY

SEQ ID NO: 381759 - protein, 4 aa, Mycobacterium
DDPA

SEQ ID NO: 381760 - protein, 7 aa, Mycobacterium
DDPGDEL

SEQ ID NO: 381761 - protein, 4 aa, Mycobacterium
DEAG

SEQ ID NO: 381762 - protein, 4 aa, Mycobacterium
DEDA

SEQ ID NO: 381763 - protein, 6 aa, Mycobacterium
DEFTKR

SEQ ID NO: 381764 - protein, 4 aa, Mycobacterium
DELG

SEQ ID NO: 381765 - protein, 7 aa, Mycobacterium
DELGRSN

SEQ ID NO: 381766 - protein, 6 aa, Mycobacterium
DEPRKG

SEQ ID NO: 381767 - protein, 4 aa, Mycobacterium
DEVG

SEQ ID NO: 381768 - protein, 16 aa, Mycobacterium
DGAGTSGAARQVGVSR

SEQ ID NO: 381769 - protein, 7 aa, Mycobacterium
DGDALSI

SEQ ID NO: 381770 - protein, 9 aa, Mycobacterium
DGDARGGAA

SEQ ID NO: 381771 - protein, 4 aa, Mycobacterium
DGGD

SEQ ID NO: 381772 - protein, 5 aa, Mycobacterium
DGGDA

SEQ ID NO: 381773 - protein, 4 aa, Mycobacterium
DGGR

SEQ ID NO: 381774 - protein, 6 aa, Mycobacterium
DGGRKK

SEQ ID NO: 381775 - protein, 4 aa, Mycobacterium
DGPV

SEQ ID NO: 381776 - protein, 7 aa, Mycobacterium
DGQKRLK

SEQ ID NO: 381777 - protein, 6 aa, Mycobacterium
DGTRHT

SEQ ID NO: 381778 - protein, 4 aa, Mycobacterium
DGVE

SEQ ID NO: 381779 - protein, 8 aa, Mycobacterium
DHDYETKK

SEQ ID NO: 381780 - protein, 13 aa, Mycobacterium
DHPTTPLPPPNPH

SEQ ID NO: 381781 - protein, 4 aa, Mycobacterium
DKGR

SEQ ID NO: 381782 - protein, 6 aa, Mycobacterium
DKGRLT

SEQ ID NO: 381783 - protein, 7 aa, Mycobacterium
DKPTGAV

SEQ ID NO: 381784 - protein, 7 aa, Mycobacterium
DNAGTVE

SEQ ID NO: 381785 - protein, 10 aa, Mycobacterium
DNAPEERQRG

SEQ ID NO: 381786 - protein, 6 aa, Mycobacterium
DNCPQR

SEQ ID NO: 381787 - protein, 4 aa, Mycobacterium
DNDR

SEQ ID NO: 381788 - protein, 11 aa, Mycobacterium
DNDSARRTPDL

SEQ ID NO: 381789 - protein, 5 aa, Mycobacterium
DPDRD

SEQ ID NO: 381790 - protein, 10 aa, Mycobacterium
DPGAAEALDP

SEQ ID NO: 381791 - protein, 4 aa, Mycobacterium
DPGF

SEQ ID NO: 381792 - protein, 7 aa, Mycobacterium
DPHDPAS

SEQ ID NO: 381793 - protein, 7 aa, Mycobacterium
DPPPRTG

SEQ ID NO: 381794 - protein, 9 aa, Mycobacterium
DPQPPFDSG

SEQ ID NO: 381795 - protein, 5 aa, Mycobacterium
DPTFD

SEQ ID NO: 381796 - protein, 6 aa, Mycobacterium
DQSERM

SEQ ID NO: 381797 - protein, 4 aa, Mycobacterium
DRGG

SEQ ID NO: 381798 - protein, 4 aa, Mycobacterium
DRPD

SEQ ID NO: 381799 - protein, 5 aa, Mycobacterium
DRRTT

SEQ ID NO: 381800 - protein, 7 aa, Mycobacterium
DSAADYA

SEQ ID NO: 381801 - protein, 4 aa, Mycobacterium
DSIS

SEQ ID NO: 381802 - protein, 6 aa, Mycobacterium
DSPNSA

SEQ ID NO: 381803 - protein, 8 aa, Mycobacterium
DSRGNPTV

SEQ ID NO: 381804 - protein, 9 aa, Mycobacterium
DSTLSRDDG

SEQ ID NO: 381805 - protein, 9 aa, Mycobacterium
DTGHGGDPH

SEQ ID NO: 381806 - protein, 4 aa, Mycobacterium
DTPE

SEQ ID NO: 381807 - protein, 10 aa, Mycobacterium
DTPGEADYYR

SEQ ID NO: 381808 - protein, 5 aa, Mycobacterium
DTVHP

SEQ ID NO: 381809 - protein, 4 aa, Mycobacterium
DVTP

SEQ ID NO: 381810 - protein, 18 aa, Mycobacterium
EAAEKAKIELSSSQSTSI

SEQ ID NO: 381811 - protein, 4 aa, Mycobacterium
EAAG

SEQ ID NO: 381812 - protein, 7 aa, Mycobacterium
EADGRRP

SEQ ID NO: 381813 - protein, 5 aa, Mycobacterium
EAENA

SEQ ID NO: 381814 - protein, 7 aa, Mycobacterium
EAGATAD

SEQ ID NO: 381815 - protein, 9 aa, Mycobacterium
EAGPAFQGT

SEQ ID NO: 381816 - protein, 13 aa, Mycobacterium
EAKEGIETTETGE

SEQ ID NO: 381817 - protein, 14 aa, Mycobacterium
EALRPMGRATSGVQ

SEQ ID NO: 381818 - protein, 4 aa, Mycobacterium
EARA

SEQ ID NO: 381819 - protein, 4 aa, Mycobacterium
EARE

SEQ ID NO: 381820 - protein, 6 aa, Mycobacterium
EASRRG

SEQ ID NO: 381821 - protein, 8 aa, Mycobacterium
EDGQTIES

SEQ ID NO: 381822 - protein, 7 aa, Mycobacterium
EDRENEG

SEQ ID NO: 381823 - protein, 5 aa, Mycobacterium
EDYDT

SEQ ID NO: 381824 - protein, 4 aa, Mycobacterium
EEGA

SEQ ID NO: 381825 - protein, 9 aa, Mycobacterium
EEGGQLTEK

SEQ ID NO: 381826 - protein, 6 aa, Mycobacterium
EEHQGP

SEQ ID NO: 381827 - protein, 8 aa, Mycobacterium
EENPNLQR

SEQ ID NO: 381828 - protein, 4 aa, Mycobacterium
EEPP

SEQ ID NO: 381829 - protein, 4 aa, Mycobacterium
EESG

SEQ ID NO: 381830 - protein, 9 aa, Mycobacterium
EEYGGGGAG

SEQ ID NO: 381831 - protein, 10 aa, Mycobacterium
EEYGGQGADS

SEQ ID NO: 381832 - protein, 4 aa, Mycobacterium
EGFL

SEQ ID NO: 381833 - protein, 13 aa, Mycobacterium
EGGGTANVTIIER

SEQ ID NO: 381834 - protein, 4 aa, Mycobacterium
EGIQ

SEQ ID NO: 381835 - protein, 5 aa, Mycobacterium
EGPDT

SEQ ID NO: 381836 - protein, 6 aa, Mycobacterium
EGPKNV

SEQ ID NO: 381837 - protein, 4 aa, Mycobacterium
EGRL

SEQ ID NO: 381838 - protein, 8 aa, Mycobacterium
EGRPSTDA

SEQ ID NO: 381839 - protein, 13 aa, Mycobacterium
EGRRGQPRLRPPF

SEQ ID NO: 381840 - protein, 10 aa, Mycobacterium
EGRSLGDPET

SEQ ID NO: 381841 - protein, 4 aa, Mycobacterium
EGTS

SEQ ID NO: 381842 - protein, 4 aa, Mycobacterium
EGVP

SEQ ID NO: 381843 - protein, 4 aa, Mycobacterium
EHNA

SEQ ID NO: 381844 - protein, 6 aa, Mycobacterium
EKADRT

SEQ ID NO: 381845 - protein, 11 aa, Mycobacterium
EKQKEGKKRMK

SEQ ID NO: 381846 - protein, 6 aa, Mycobacterium
ELPGDP

SEQ ID NO: 381847 - protein, 5 aa, Mycobacterium
ELSDG

SEQ ID NO: 381848 - protein, 14 aa, Mycobacterium
ENEDLPNTTNPDDW

SEQ ID NO: 381849 - protein, 6 aa, Mycobacterium
ENIAPA

SEQ ID NO: 381850 - protein, 4 aa, Mycobacterium
EPAL

SEQ ID NO: 381851 - protein, 8 aa, Mycobacterium
EPANQGAW

SEQ ID NO: 381852 - protein, 4 aa, Mycobacterium
EPAT

SEQ ID NO: 381853 - protein, 4 aa, Mycobacterium
EPDI

SEQ ID NO: 381854 - protein, 7 aa, Mycobacterium
EPKTGAV

SEQ ID NO: 381855 - protein, 4 aa, Mycobacterium
EPLT

SEQ ID NO: 381856 - protein, 6 aa, Mycobacterium
EPQHFT

SEQ ID NO: 381857 - protein, 4 aa, Mycobacterium
EPSA

SEQ ID NO: 381858 - protein, 5 aa, Mycobacterium
EPTAA

SEQ ID NO: 381859 - protein, 4 aa, Mycobacterium
EPTG

SEQ ID NO: 381860 - protein, 4 aa, Mycobacterium
EQGR

SEQ ID NO: 381861 - protein, 7 aa, Mycobacterium
EQNCSTS

SEQ ID NO: 381862 - protein, 5 aa, Mycobacterium
EQTRT

SEQ ID NO: 381863 - protein, 5 aa, Mycobacterium
ERAGV

SEQ ID NO: 381864 - protein, 5 aa, Mycobacterium
EREIA

SEQ ID NO: 381865 - protein, 4 aa, Mycobacterium
ERRD

SEQ ID NO: 381866 - protein, 4 aa, Mycobacterium
ERTG

SEQ ID NO: 381867 - protein, 5 aa, Mycobacterium
ERTRD

SEQ ID NO: 381868 - protein, 4 aa, Mycobacterium
ESNT

SEQ ID NO: 381869 - protein, 4 aa, Mycobacterium
ESRY

SEQ ID NO: 381870 - protein, 8 aa, Mycobacterium
ETGSTGDT

SEQ ID NO: 381871 - protein, 8 aa, Mycobacterium
ETTYRSSG

SEQ ID NO: 381872 - protein, 4 aa, Mycobacterium
EVGR

SEQ ID NO: 381873 - protein, 11 aa, Mycobacterium
FDNQSRRQTSF

SEQ ID NO: 381874 - protein, 4 aa, Mycobacterium
FGGS

SEQ ID NO: 381875 - protein, 8 aa, Mycobacterium
FGTQEGGA

SEQ ID NO: 381876 - protein, 6 aa, Mycobacterium
FPESYN

SEQ ID NO: 381877 - protein, 5 aa, Mycobacterium
FQETT

SEQ ID NO: 381878 - protein, 4 aa, Mycobacterium
FQRG

SEQ ID NO: 381879 - protein, 17 aa, Mycobacterium
FRPDRSHAKSARSVAET

SEQ ID NO: 381880 - protein, 4 aa, Mycobacterium
GAAA

SEQ ID NO: 381881 - protein, 4 aa, Mycobacterium
GAAR

SEQ ID NO: 381882 - protein, 6 aa, Mycobacterium
GAEDTN

SEQ ID NO: 381883 - protein, 4 aa, Mycobacterium
GAEL

SEQ ID NO: 381884 - protein, 6 aa, Mycobacterium
GAESGD

SEQ ID NO: 381885 - protein, 4 aa, Mycobacterium
GAGA

SEQ ID NO: 381886 - protein, 4 aa, Mycobacterium
GAGG

SEQ ID NO: 381887 - protein, 9 aa, Mycobacterium
GAGQMPARQ

SEQ ID NO: 381888 - protein, 7 aa, Mycobacterium
GAGRGLG

SEQ ID NO: 381889 - protein, 4 aa, Mycobacterium
GAHD

SEQ ID NO: 381890 - protein, 4 aa, Mycobacterium
GALT

SEQ ID NO: 381891 - protein, 7 aa, Mycobacterium
GANDLGG

SEQ ID NO: 381892 - protein, 4 aa, Mycobacterium
GANP

SEQ ID NO: 381893 - protein, 7 aa, Mycobacterium
GAPFSGA

SEQ ID NO: 381894 - protein, 4 aa, Mycobacterium
GAPG

SEQ ID NO: 381895 - protein, 4 aa, Mycobacterium
GAQA

SEQ ID NO: 381896 - protein, 8 aa, Mycobacterium
GASLDGEQ

SEQ ID NO: 381897 - protein, 7 aa, Mycobacterium
GASPRAE

SEQ ID NO: 381898 - protein, 18 aa, Mycobacterium
GASSTGISRKLPDTERQR

SEQ ID NO: 381899 - protein, 4 aa, Mycobacterium
GAVT

SEQ ID NO: 381900 - protein, 4 aa, Mycobacterium
GCSR

SEQ ID NO: 381901 - protein, 4 aa, Mycobacterium
GDDA

SEQ ID NO: 381902 - protein, 11 aa, Mycobacterium
GDEGKGKATDL

SEQ ID NO: 381903 - protein, 7 aa, Mycobacterium
GDEPLKR

SEQ ID NO: 381904 - protein, 9 aa, Mycobacterium
GDGLGGSSF

SEQ ID NO: 381905 - protein, 7 aa, Mycobacterium
GDPRFSD

SEQ ID NO: 381906 - protein, 8 aa, Mycobacterium
GDSAGGNL

SEQ ID NO: 381907 - protein, 8 aa, Mycobacterium
GDSASSPA

SEQ ID NO: 381908 - protein, 9 aa, Mycobacterium
GDSGDGMQL

SEQ ID NO: 381909 - protein, 7 aa, Mycobacterium
GEDAGRG

SEQ ID NO: 381910 - protein, 8 aa, Mycobacterium
GEESAGQI

SEQ ID NO: 381911 - protein, 13 aa, Mycobacterium
GEGGGTGTGGAPV

SEQ ID NO: 381912 - protein, 6 aa, Mycobacterium
GEGGYQ

SEQ ID NO: 381913 - protein, 5 aa, Mycobacterium
GEGTL

SEQ ID NO: 381914 - protein, 6 aa, Mycobacterium
GEHPDW

SEQ ID NO: 381915 - protein, 4 aa, Mycobacterium
GEIE

SEQ ID NO: 381916 - protein, 12 aa, Mycobacterium
GEKGTAKSTAVR

SEQ ID NO: 381917 - protein, 4 aa, Mycobacterium
GELG

SEQ ID NO: 381918 - protein, 10 aa, Mycobacterium
GEPQQNPDRP

SEQ ID NO: 381919 - protein, 5 aa, Mycobacterium
GEPTV

SEQ ID NO: 381920 - protein, 10 aa, Mycobacterium
GESDSGRAHA

SEQ ID NO: 381921 - protein, 9 aa, Mycobacterium
GESFPTGRA

SEQ ID NO: 381922 - protein, 6 aa, Mycobacterium
GETGGK

SEQ ID NO: 381923 - protein, 10 aa, Mycobacterium
GEVGNAEQAN

SEQ ID NO: 381924 - protein, 6 aa, Mycobacterium
GEYDER

SEQ ID NO: 381925 - protein, 5 aa, Mycobacterium
GFGPE

SEQ ID NO: 381926 - protein, 12 aa, Mycobacterium
GFKGSRKSTPFA

SEQ ID NO: 381927 - protein, 5 aa, Mycobacterium
GGAAH

SEQ ID NO: 381928 - protein, 6 aa, Mycobacterium
GGASAE

SEQ ID NO: 381929 - protein, 5 aa, Mycobacterium
GGDEA

SEQ ID NO: 381930 - protein, 6 aa, Mycobacterium
GGECPL

SEQ ID NO: 381931 - protein, 10 aa, Mycobacterium
GGERKNDPDW

SEQ ID NO: 381932 - protein, 8 aa, Mycobacterium
GGGPGDPE

SEQ ID NO: 381933 - protein, 12 aa, Mycobacterium
GGGQGNHLGGAY

SEQ ID NO: 381934 - protein, 4 aa, Mycobacterium
GGGS

SEQ ID NO: 381935 - protein, 6 aa, Mycobacterium
GGGSTE

SEQ ID NO: 381936 - protein, 5 aa, Mycobacterium
GGHDY

SEQ ID NO: 381937 - protein, 4 aa, Mycobacterium
GGHG

SEQ ID NO: 381938 - protein, 10 aa, Mycobacterium
GGKAGTGKSA

SEQ ID NO: 381939 - protein, 9 aa, Mycobacterium
GGLGPTADD

SEQ ID NO: 381940 - protein, 6 aa, Mycobacterium
GGMSDN

SEQ ID NO: 381941 - protein, 7 aa, Mycobacterium
GGNNAGH

SEQ ID NO: 381942 - protein, 5 aa, Mycobacterium
GGNRG

SEQ ID NO: 381943 - protein, 4 aa, Mycobacterium
GGPD

SEQ ID NO: 381944 - protein, 5 aa, Mycobacterium
GGPTL

SEQ ID NO: 381945 - protein, 6 aa, Mycobacterium
GGRGGS

SEQ ID NO: 381946 - protein, 6 aa, Mycobacterium
GGSDQW

SEQ ID NO: 381947 - protein, 4 aa, Mycobacterium
GGTE

SEQ ID NO: 381948 - protein, 8 aa, Mycobacterium
GGTESDNL

SEQ ID NO: 381949 - protein, 5 aa, Mycobacterium
GGTMP

SEQ ID NO: 381950 - protein, 5 aa, Mycobacterium
GGTNE

SEQ ID NO: 381951 - protein, 6 aa, Mycobacterium
GGVDSA

SEQ ID NO: 381952 - protein, 10 aa, Mycobacterium
GGVDSTALYP

SEQ ID NO: 381953 - protein, 4 aa, Mycobacterium
GGVG

SEQ ID NO: 381954 - protein, 7 aa, Mycobacterium
GGVSAGA

SEQ ID NO: 381955 - protein, 6 aa, Mycobacterium
GGYGNS

SEQ ID NO: 381956 - protein, 5 aa, Mycobacterium
GHPPP

SEQ ID NO: 381957 - protein, 5 aa, Mycobacterium
GISGT

SEQ ID NO: 381958 - protein, 4 aa, Mycobacterium
GITR

SEQ ID NO: 381959 - protein, 9 aa, Mycobacterium
GKEGQNARL

SEQ ID NO: 381960 - protein, 4 aa, Mycobacterium
GKGF

SEQ ID NO: 381961 - protein, 7 aa, Mycobacterium
GKGGKQR

SEQ ID NO: 381962 - protein, 4 aa, Mycobacterium
GKPP

SEQ ID NO: 381963 - protein, 5 aa, Mycobacterium
GKRKG

SEQ ID NO: 381964 - protein, 4 aa, Mycobacterium
GKSP

SEQ ID NO: 381965 - protein, 4 aa, Mycobacterium
GKTT

SEQ ID NO: 381966 - protein, 6 aa, Mycobacterium
GKTTLT

SEQ ID NO: 381967 - protein, 4 aa, Mycobacterium
GLHR

SEQ ID NO: 381968 - protein, 4 aa, Mycobacterium
GLPR

SEQ ID NO: 381969 - protein, 7 aa, Mycobacterium
GNAGKAG

SEQ ID NO: 381970 - protein, 10 aa, Mycobacterium
GNETTRNSIT

SEQ ID NO: 381971 - protein, 6 aa, Mycobacterium
GNNPVR

SEQ ID NO: 381972 - protein, 10 aa, Mycobacterium
GNSSQISDGS

SEQ ID NO: 381973 - protein, 4 aa, Mycobacterium
GPDA

SEQ ID NO: 381974 - protein, 4 aa, Mycobacterium
GPDR

SEQ ID NO: 381975 - protein, 4 aa, Mycobacterium
GPDY

SEQ ID NO: 381976 - protein, 6 aa, Mycobacterium
GPEGYR

SEQ ID NO: 381977 - protein, 5 aa, Mycobacterium
GPGGY

SEQ ID NO: 381978 - protein, 5 aa, Mycobacterium
GPKNV

SEQ ID NO: 381979 - protein, 4 aa, Mycobacterium
GPLT

SEQ ID NO: 381980 - protein, 9 aa, Mycobacterium
GPNGAGKST

SEQ ID NO: 381981 - protein, 8 aa, Mycobacterium
GPPGLGKT

SEQ ID NO: 381982 - protein, 6 aa, Mycobacterium
GPPREL

SEQ ID NO: 381983 - protein, 4 aa, Mycobacterium
GPRF

SEQ ID NO: 381984 - protein, 4 aa, Mycobacterium
GPRG

SEQ ID NO: 381985 - protein, 5 aa, Mycobacterium
GPRPA

SEQ ID NO: 381986 - protein, 5 aa, Mycobacterium
GPSPV

SEQ ID NO: 381987 - protein, 9 aa, Mycobacterium
GPTGNQRDE

SEQ ID NO: 381988 - protein, 4 aa, Mycobacterium
GPVA

SEQ ID NO: 381989 - protein, 10 aa, Mycobacterium
GQDGHDRGQK

SEQ ID NO: 381990 - protein, 5 aa, Mycobacterium
GQPVR

SEQ ID NO: 381991 - protein, 5 aa, Mycobacterium
GQQDS

SEQ ID NO: 381992 - protein, 4 aa, Mycobacterium
GQSE

SEQ ID NO: 381993 - protein, 6 aa, Mycobacterium
GRDPNK

SEQ ID NO: 381994 - protein, 5 aa, Mycobacterium
GRGFN

SEQ ID NO: 381995 - protein, 8 aa, Mycobacterium
GRGSAANS

SEQ ID NO: 381996 - protein, 5 aa, Mycobacterium
GRPET

SEQ ID NO: 381997 - protein, 10 aa, Mycobacterium
GRPPGRKDPA

SEQ ID NO: 381998 - protein, 7 aa, Mycobacterium
GRSAEQR

SEQ ID NO: 381999 - protein, 13 aa, Mycobacterium
GRSYGDNAQNGGG

SEQ ID NO: 382000 - protein, 6 aa, Mycobacterium
GRTGRV

SEQ ID NO: 382001 - protein, 16 aa, Mycobacterium
GSAPDIAGQGIADPTA

SEQ ID NO: 382002 - protein, 5 aa, Mycobacterium
GSAPM

SEQ ID NO: 382003 - protein, 9 aa, Mycobacterium
GSGDNGGDA

SEQ ID NO: 382004 - protein, 5 aa, Mycobacterium
GSGIT

SEQ ID NO: 382005 - protein, 4 aa, Mycobacterium
GSGR

SEQ ID NO: 382006 - protein, 4 aa, Mycobacterium
GSGV

SEQ ID NO: 382007 - protein, 7 aa, Mycobacterium
GSPNRGM

SEQ ID NO: 382008 - protein, 6 aa, Mycobacterium
GSQGHA

SEQ ID NO: 382009 - protein, 5 aa, Mycobacterium
GSRMY

SEQ ID NO: 382010 - protein, 6 aa, Mycobacterium
GSSEKA

SEQ ID NO: 382011 - protein, 6 aa, Mycobacterium
GSSPEA

SEQ ID NO: 382012 - protein, 7 aa, Mycobacterium
GSSSHQK

SEQ ID NO: 382013 - protein, 6 aa, Mycobacterium
GSWGTT

SEQ ID NO: 382014 - protein, 6 aa, Mycobacterium
GTDSHT

SEQ ID NO: 382015 - protein, 12 aa, Mycobacterium
GTFGSRQEEAQR

SEQ ID NO: 382016 - protein, 10 aa, Mycobacterium
GTGGTITGAG

SEQ ID NO: 382017 - protein, 7 aa, Mycobacterium
GTGGVGQ

SEQ ID NO: 382018 - protein, 4 aa, Mycobacterium
GTGK

SEQ ID NO: 382019 - protein, 8 aa, Mycobacterium
GTLSGNPV

SEQ ID NO: 382020 - protein, 12 aa, Mycobacterium
GTNTDPYQRAEG

SEQ ID NO: 382021 - protein, 5 aa, Mycobacterium
GTPDL

SEQ ID NO: 382022 - protein, 6 aa, Mycobacterium
GTPEQL

SEQ ID NO: 382023 - protein, 4 aa, Mycobacterium
GTPV

SEQ ID NO: 382024 - protein, 7 aa, Mycobacterium
GTTGLPK

SEQ ID NO: 382025 - protein, 8 aa, Mycobacterium
GTTGVPKG

SEQ ID NO: 382026 - protein, 5 aa, Mycobacterium
GTTRE

SEQ ID NO: 382027 - protein, 6 aa, Mycobacterium
GTTVDP

SEQ ID NO: 382028 - protein, 5 aa, Mycobacterium
GVEVD

SEQ ID NO: 382029 - protein, 13 aa, Mycobacterium
GVGETRSCGTGTV

SEQ ID NO: 382030 - protein, 6 aa, Mycobacterium
GVGPGD

SEQ ID NO: 382031 - protein, 5 aa, Mycobacterium
GVKRQ

SEQ ID NO: 382032 - protein, 4 aa, Mycobacterium
GVPE

SEQ ID NO: 382033 - protein, 7 aa, Mycobacterium
GVSGLSP

SEQ ID NO: 382034 - protein, 6 aa, Mycobacterium
GYQPTL

SEQ ID NO: 382035 - protein, 5 aa, Mycobacterium
GYSTE

SEQ ID NO: 382036 - protein, 4 aa, Mycobacterium
HAAG

SEQ ID NO: 382037 - protein, 9 aa, Mycobacterium
HARSTGPYS

SEQ ID NO: 382038 - protein, 11 aa, Mycobacterium
HASTAGSQLEV

SEQ ID NO: 382039 - protein, 5 aa, Mycobacterium
HDEPG

SEQ ID NO: 382040 - protein, 6 aa, Mycobacterium
HDGDAD

SEQ ID NO: 382041 - protein, 8 aa, Mycobacterium
HDLPPTAG

SEQ ID NO: 382042 - protein, 4 aa, Mycobacterium
HDRT

SEQ ID NO: 382043 - protein, 4 aa, Mycobacterium
HDTE

SEQ ID NO: 382044 - protein, 5 aa, Mycobacterium
HEDQK

SEQ ID NO: 382045 - protein, 9 aa, Mycobacterium
HEGAPGQQE

SEQ ID NO: 382046 - protein, 4 aa, Mycobacterium
HGAP

SEQ ID NO: 382047 - protein, 10 aa, Mycobacterium
HGTGTPLGDP

SEQ ID NO: 382048 - protein, 8 aa, Mycobacterium
HNDRGTAV

SEQ ID NO: 382049 - protein, 7 aa, Mycobacterium
HNPAAYN

SEQ ID NO: 382050 - protein, 4 aa, Mycobacterium
HPGR

SEQ ID NO: 382051 - protein, 6 aa, Mycobacterium
HRRQDG

SEQ ID NO: 382052 - protein, 11 aa, Mycobacterium
HSERSGEPIEP

SEQ ID NO: 382053 - protein, 4 aa, Mycobacterium
HSPR

SEQ ID NO: 382054 - protein, 5 aa, Mycobacterium
HTPGS

SEQ ID NO: 382055 - protein, 4 aa, Mycobacterium
IAPG

SEQ ID NO: 382056 - protein, 4 aa, Mycobacterium
IAPT

SEQ ID NO: 382057 - protein, 5 aa, Mycobacterium
IEPGS

SEQ ID NO: 382058 - protein, 5 aa, Mycobacterium
IGGQE

SEQ ID NO: 382059 - protein, 5 aa, Mycobacterium
IGPGL

SEQ ID NO: 382060 - protein, 5 aa, Mycobacterium
IGPKG

SEQ ID NO: 382061 - protein, 4 aa, Mycobacterium
IGPS

SEQ ID NO: 382062 - protein, 7 aa, Mycobacterium
IGTASDA

SEQ ID NO: 382063 - protein, 8 aa, Mycobacterium
IGTGGGQG

SEQ ID NO: 382064 - protein, 6 aa, Mycobacterium
IHSGDS

SEQ ID NO: 382065 - protein, 4 aa, Mycobacterium
IKPP

SEQ ID NO: 382066 - protein, 7 aa, Mycobacterium
ILDSGGR

SEQ ID NO: 382067 - protein, 5 aa, Mycobacterium
IPATE

SEQ ID NO: 382068 - protein, 5 aa, Mycobacterium
IPPGD

SEQ ID NO: 382069 - protein, 9 aa, Mycobacterium
IQDKGEGKN

SEQ ID NO: 382070 - protein, 4 aa, Mycobacterium
IRSG

SEQ ID NO: 382071 - protein, 8 aa, Mycobacterium
ISGKKGER

SEQ ID NO: 382072 - protein, 9 aa, Mycobacterium
ISTGGGASL

SEQ ID NO: 382073 - protein, 9 aa, Mycobacterium
ISTPDAPSI

SEQ ID NO: 382074 - protein, 12 aa, Mycobacterium
ITDASGRTLSGQ

SEQ ID NO: 382075 - protein, 6 aa, Mycobacterium
ITDEDA

SEQ ID NO: 382076 - protein, 5 aa, Mycobacterium
IVPPA

SEQ ID NO: 382077 - protein, 7 aa, Mycobacterium
KAAEGHD

SEQ ID NO: 382078 - protein, 6 aa, Mycobacterium
KDGGVL

SEQ ID NO: 382079 - protein, 6 aa, Mycobacterium
KDGRPV

SEQ ID NO: 382080 - protein, 6 aa, Mycobacterium
KDPDEI

SEQ ID NO: 382081 - protein, 6 aa, Mycobacterium
KDPGYS

SEQ ID NO: 382082 - protein, 9 aa, Mycobacterium
KEKDEAVKG

SEQ ID NO: 382083 - protein, 10 aa, Mycobacterium
KGASEGAGLG

SEQ ID NO: 382084 - protein, 6 aa, Mycobacterium
KGRMEE

SEQ ID NO: 382085 - protein, 8 aa, Mycobacterium
KHIDGQGR

SEQ ID NO: 382086 - protein, 10 aa, Mycobacterium
KKNRRNDPDR

SEQ ID NO: 382087 - protein, 6 aa, Mycobacterium
KLRPKI

SEQ ID NO: 382088 - protein, 6 aa, Mycobacterium
KNKGVQ

SEQ ID NO: 382089 - protein, 8 aa, Mycobacterium
KPGKGPAF

SEQ ID NO: 382090 - protein, 5 aa, Mycobacterium
KPRQV

SEQ ID NO: 382091 - protein, 4 aa, Mycobacterium
KQPA

SEQ ID NO: 382092 - protein, 6 aa, Mycobacterium
KRAERA

SEQ ID NO: 382093 - protein, 6 aa, Mycobacterium
KRDTVG

SEQ ID NO: 382094 - protein, 5 aa, Mycobacterium
KSGAA

SEQ ID NO: 382095 - protein, 8 aa, Mycobacterium
KSHPGGGD

SEQ ID NO: 382096 - protein, 6 aa, Mycobacterium
KSLRSR

SEQ ID NO: 382097 - protein, 7 aa, Mycobacterium
KTGKAEK

SEQ ID NO: 382098 - protein, 5 aa, Mycobacterium
KTPYH

SEQ ID NO: 382099 - protein, 7 aa, Mycobacterium
KTRRPSV

SEQ ID NO: 382100 - protein, 12 aa, Mycobacterium
KTTEPKARALRP

SEQ ID NO: 382101 - protein, 8 aa, Mycobacterium
KTWATNGG

SEQ ID NO: 382102 - protein, 8 aa, Mycobacterium
KVSPPFKQ

SEQ ID NO: 382103 - protein, 5 aa, Mycobacterium
KYRDT

SEQ ID NO: 382104 - protein, 4 aa, Mycobacterium
LAPA

SEQ ID NO: 382105 - protein, 5 aa, Mycobacterium
LAPGA

SEQ ID NO: 382106 - protein, 6 aa, Mycobacterium
LARGEL

SEQ ID NO: 382107 - protein, 7 aa, Mycobacterium
LARPTST

SEQ ID NO: 382108 - protein, 10 aa, Mycobacterium
LASEKKCGHL

SEQ ID NO: 382109 - protein, 4 aa, Mycobacterium
LASG

SEQ ID NO: 382110 - protein, 6 aa, Mycobacterium
LASPGQ

SEQ ID NO: 382111 - protein, 7 aa, Mycobacterium
LDAYERG

SEQ ID NO: 382112 - protein, 15 aa, Mycobacterium
LDDEPRSGRPKTVDD

SEQ ID NO: 382113 - protein, 6 aa, Mycobacterium
LDETGG

SEQ ID NO: 382114 - protein, 8 aa, Mycobacterium
LDGHDRGA

SEQ ID NO: 382115 - protein, 5 aa, Mycobacterium
LDGRS

SEQ ID NO: 382116 - protein, 12 aa, Mycobacterium
LDPSQPDDAPAR

SEQ ID NO: 382117 - protein, 6 aa, Mycobacterium
LDTPAS

SEQ ID NO: 382118 - protein, 4 aa, Mycobacterium
LENG

SEQ ID NO: 382119 - protein, 7 aa, Mycobacterium
LEPPPES

SEQ ID NO: 382120 - protein, 4 aa, Mycobacterium
LGEM

SEQ ID NO: 382121 - protein, 5 aa, Mycobacterium
LGGGL

SEQ ID NO: 382122 - protein, 4 aa, Mycobacterium
LGPD

SEQ ID NO: 382123 - protein, 10 aa, Mycobacterium
LGPSGSGKST

SEQ ID NO: 382124 - protein, 6 aa, Mycobacterium
LGSPKQ

SEQ ID NO: 382125 - protein, 6 aa, Mycobacterium
LHTNRG

SEQ ID NO: 382126 - protein, 4 aa, Mycobacterium
LNGT

SEQ ID NO: 382127 - protein, 6 aa, Mycobacterium
LNVSGG

SEQ ID NO: 382128 - protein, 6 aa, Mycobacterium
LPPEGA

SEQ ID NO: 382129 - protein, 6 aa, Mycobacterium
LQTPKA

SEQ ID NO: 382130 - protein, 4 aa, Mycobacterium
LRTG

SEQ ID NO: 382131 - protein, 7 aa, Mycobacterium
LSAPGSR

SEQ ID NO: 382132 - protein, 4 aa, Mycobacterium
LSDG

SEQ ID NO: 382133 - protein, 8 aa, Mycobacterium
LSGGQRRR

SEQ ID NO: 382134 - protein, 6 aa, Mycobacterium
LSPAQL

SEQ ID NO: 382135 - protein, 9 aa, Mycobacterium
LSPASGRPL

SEQ ID NO: 382136 - protein, 5 aa, Mycobacterium
LSSPS

SEQ ID NO: 382137 - protein, 6 aa, Mycobacterium
LTETSS

SEQ ID NO: 382138 - protein, 6 aa, Mycobacterium
LTPDRA

SEQ ID NO: 382139 - protein, 6 aa, Mycobacterium
MAPGSQ

SEQ ID NO: 382140 - protein, 7 aa, Mycobacterium
MDPDDAA

SEQ ID NO: 382141 - protein, 7 aa, Mycobacterium
MGRNGGG

SEQ ID NO: 382142 - protein, 5 aa, Mycobacterium
MRQPN

SEQ ID NO: 382143 - protein, 11 aa, Mycobacterium
MSAPSSGSSKV

SEQ ID NO: 382144 - protein, 6 aa, Mycobacterium
MSKSRG

SEQ ID NO: 382145 - protein, 11 aa, Mycobacterium
MSTSSNERGMS

SEQ ID NO: 382146 - protein, 5 aa, Mycobacterium
MTPTE

SEQ ID NO: 382147 - protein, 4 aa, Mycobacterium
MTTQ

SEQ ID NO: 382148 - protein, 5 aa, Mycobacterium
NADAK

SEQ ID NO: 382149 - protein, 5 aa, Mycobacterium
NARRT

SEQ ID NO: 382150 - protein, 8 aa, Mycobacterium
NASDTHPL

SEQ ID NO: 382151 - protein, 6 aa, Mycobacterium
NATGHP

SEQ ID NO: 382152 - protein, 8 aa, Mycobacterium
NATRELSE

SEQ ID NO: 382153 - protein, 5 aa, Mycobacterium
NDEET

SEQ ID NO: 382154 - protein, 7 aa, Mycobacterium
NDEYDNE

SEQ ID NO: 382155 - protein, 7 aa, Mycobacterium
NDRPTGT

SEQ ID NO: 382156 - protein, 4 aa, Mycobacterium
NEIT

SEQ ID NO: 382157 - protein, 4 aa, Mycobacterium
NERE

SEQ ID NO: 382158 - protein, 7 aa, Mycobacterium
NETSTGV

SEQ ID NO: 382159 - protein, 7 aa, Mycobacterium
NETTRNA

SEQ ID NO: 382160 - protein, 6 aa, Mycobacterium
NGPAIG

SEQ ID NO: 382161 - protein, 9 aa, Mycobacterium
NGRDSAAQR

SEQ ID NO: 382162 - protein, 10 aa, Mycobacterium
NHDPLDASSV

SEQ ID NO: 382163 - protein, 23 aa, Mycobacterium
NKTGYHKRQGHRQQLTVLKVTGI

SEQ ID NO: 382164 - protein, 6 aa, Mycobacterium
NLRKGA

SEQ ID NO: 382165 - protein, 9 aa, Mycobacterium
NLRRSARAA

SEQ ID NO: 382166 - protein, 8 aa, Mycobacterium
NNGLTASE

SEQ ID NO: 382167 - protein, 9 aa, Mycobacterium
NNPAKRVGL

SEQ ID NO: 382168 - protein, 6 aa, Mycobacterium
NPGDAV

SEQ ID NO: 382169 - protein, 6 aa, Mycobacterium
NREPVD

SEQ ID NO: 382170 - protein, 9 aa, Mycobacterium
NRSSGKQGY

SEQ ID NO: 382171 - protein, 5 aa, Mycobacterium
NRTGT

SEQ ID NO: 382172 - protein, 7 aa, Mycobacterium
NSGGGSL

SEQ ID NO: 382173 - protein, 7 aa, Mycobacterium
NSGPALA

SEQ ID NO: 382174 - protein, 10 aa, Mycobacterium
NSPDEVGPPE

SEQ ID NO: 382175 - protein, 9 aa, Mycobacterium
NSQSGKGGV

SEQ ID NO: 382176 - protein, 13 aa, Mycobacterium
NSRPTRAEASDVA

SEQ ID NO: 382177 - protein, 7 aa, Mycobacterium
NSRRGQI

SEQ ID NO: 382178 - protein, 4 aa, Mycobacterium
NSTV

SEQ ID NO: 382179 - protein, 4 aa, Mycobacterium
NTCE

SEQ ID NO: 382180 - protein, 15 aa, Mycobacterium
NTGNNTYKAVQRSAG

SEQ ID NO: 382181 - protein, 6 aa, Mycobacterium
NTNVGS

SEQ ID NO: 382182 - protein, 7 aa, Mycobacterium
NTSEEEF

SEQ ID NO: 382183 - protein, 6 aa, Mycobacterium
NTTLNT

SEQ ID NO: 382184 - protein, 6 aa, Mycobacterium
NVQGKP

SEQ ID NO: 382185 - protein, 4 aa, Mycobacterium
PADT

SEQ ID NO: 382186 - protein, 6 aa, Mycobacterium
PAQQRL

SEQ ID NO: 382187 - protein, 9 aa, Mycobacterium
PARDGPPDI

SEQ ID NO: 382188 - protein, 8 aa, Mycobacterium
PASPGTGV

SEQ ID NO: 382189 - protein, 4 aa, Mycobacterium
PDAG

SEQ ID NO: 382190 - protein, 8 aa, Mycobacterium
PDDPPGRR

SEQ ID NO: 382191 - protein, 4 aa, Mycobacterium
PDEG

SEQ ID NO: 382192 - protein, 8 aa, Mycobacterium
PDETASNR

SEQ ID NO: 382193 - protein, 10 aa, Mycobacterium
PDFGTGSSRE

SEQ ID NO: 382194 - protein, 4 aa, Mycobacterium
PDGV

SEQ ID NO: 382195 - protein, 4 aa, Mycobacterium
PDLD

SEQ ID NO: 382196 - protein, 8 aa, Mycobacterium
PDSHTRDL

SEQ ID NO: 382197 - protein, 8 aa, Mycobacterium
PDSPNQPY

SEQ ID NO: 382198 - protein, 6 aa, Mycobacterium
PEHGPG

SEQ ID NO: 382199 - protein, 4 aa, Mycobacterium
PENK

SEQ ID NO: 382200 - protein, 4 aa, Mycobacterium
PEPV

SEQ ID NO: 382201 - protein, 7 aa, Mycobacterium
PGEGHNL

SEQ ID NO: 382202 - protein, 4 aa, Mycobacterium
PGGC

SEQ ID NO: 382203 - protein, 4 aa, Mycobacterium
PGGD

SEQ ID NO: 382204 - protein, 7 aa, Mycobacterium
PGHTPGS

SEQ ID NO: 382205 - protein, 9 aa, Mycobacterium
PGIGPKSAQ

SEQ ID NO: 382206 - protein, 4 aa, Mycobacterium
PGLP

SEQ ID NO: 382207 - protein, 8 aa, Mycobacterium
PGPIQGGS

SEQ ID NO: 382208 - protein, 6 aa, Mycobacterium
PGPPTI

SEQ ID NO: 382209 - protein, 5 aa, Mycobacterium
PGPRD

SEQ ID NO: 382210 - protein, 5 aa, Mycobacterium
PGPTD

SEQ ID NO: 382211 - protein, 5 aa, Mycobacterium
PGQRI

SEQ ID NO: 382212 - protein, 7 aa, Mycobacterium
PGRPAPR

SEQ ID NO: 382213 - protein, 5 aa, Mycobacterium
PGSPW

SEQ ID NO: 382214 - protein, 5 aa, Mycobacterium
PGTMN

SEQ ID NO: 382215 - protein, 8 aa, Mycobacterium
PHKQDSWK

SEQ ID NO: 382216 - protein, 8 aa, Mycobacterium
PHPTDGRT

SEQ ID NO: 382217 - protein, 11 aa, Mycobacterium
PIADPVSRTQV

SEQ ID NO: 382218 - protein, 4 aa, Mycobacterium
PIPR

SEQ ID NO: 382219 - protein, 5 aa, Mycobacterium
PITDG

SEQ ID NO: 382220 - protein, 7 aa, Mycobacterium
PKEVGAD

SEQ ID NO: 382221 - protein, 9 aa, Mycobacterium
PKLSAGRVQ

SEQ ID NO: 382222 - protein, 7 aa, Mycobacterium
PLAGESL

SEQ ID NO: 382223 - protein, 5 aa, Mycobacterium
PLDTE

SEQ ID NO: 382224 - protein, 6 aa, Mycobacterium
PLGAGK

SEQ ID NO: 382225 - protein, 7 aa, Mycobacterium
PLGGSGA

SEQ ID NO: 382226 - protein, 5 aa, Mycobacterium
PNATE

SEQ ID NO: 382227 - protein, 8 aa, Mycobacterium
PNNPTGAV

SEQ ID NO: 382228 - protein, 10 aa, Mycobacterium
PNPHVGFGGT

SEQ ID NO: 382229 - protein, 7 aa, Mycobacterium
PNTSSNI

SEQ ID NO: 382230 - protein, 4 aa, Mycobacterium
PPAD

SEQ ID NO: 382231 - protein, 5 aa, Mycobacterium
PPFAN

SEQ ID NO: 382232 - protein, 5 aa, Mycobacterium
PPGTG

SEQ ID NO: 382233 - protein, 11 aa, Mycobacterium
PPSAEPRATGH

SEQ ID NO: 382234 - protein, 4 aa, Mycobacterium
PQAG

SEQ ID NO: 382235 - protein, 5 aa, Mycobacterium
PQEDR

SEQ ID NO: 382236 - protein, 4 aa, Mycobacterium
PQHR

SEQ ID NO: 382237 - protein, 4 aa, Mycobacterium
PRPV

SEQ ID NO: 382238 - protein, 9 aa, Mycobacterium
PSAGGGGKG

SEQ ID NO: 382239 - protein, 4 aa, Mycobacterium
PSGR

SEQ ID NO: 382240 - protein, 7 aa, Mycobacterium
PSGRTAD

SEQ ID NO: 382241 - protein, 4 aa, Mycobacterium
PSIT

SEQ ID NO: 382242 - protein, 6 aa, Mycobacterium
PSNPMQ

SEQ ID NO: 382243 - protein, 6 aa, Mycobacterium
PTAGMD

SEQ ID NO: 382244 - protein, 5 aa, Mycobacterium
PTGSV

SEQ ID NO: 382245 - protein, 11 aa, Mycobacterium
PTLTNPPATTA

SEQ ID NO: 382246 - protein, 5 aa, Mycobacterium
PTNHL

SEQ ID NO: 382247 - protein, 4 aa, Mycobacterium
PTNP

SEQ ID NO: 382248 - protein, 4 aa, Mycobacterium
PTRA

SEQ ID NO: 382249 - protein, 4 aa, Mycobacterium
PTSG

SEQ ID NO: 382250 - protein, 5 aa, Mycobacterium
PTSGN

SEQ ID NO: 382251 - protein, 4 aa, Mycobacterium
PVPV

SEQ ID NO: 382252 - protein, 8 aa, Mycobacterium
PVRSTDGR

SEQ ID NO: 382253 - protein, 4 aa, Mycobacterium
PVTG

SEQ ID NO: 382254 - protein, 9 aa, Mycobacterium
PYQPEISQG

SEQ ID NO: 382255 - protein, 8 aa, Mycobacterium
QAASSLGA

SEQ ID NO: 382256 - protein, 4 aa, Mycobacterium
QARK

SEQ ID NO: 382257 - protein, 7 aa, Mycobacterium
QDRTGGF

SEQ ID NO: 382258 - protein, 5 aa, Mycobacterium
QDTDP

SEQ ID NO: 382259 - protein, 5 aa, Mycobacterium
QDTNH

SEQ ID NO: 382260 - protein, 4 aa, Mycobacterium
QETR

SEQ ID NO: 382261 - protein, 4 aa, Mycobacterium
QGAD

SEQ ID NO: 382262 - protein, 8 aa, Mycobacterium
QGASEERI

SEQ ID NO: 382263 - protein, 6 aa, Mycobacterium
QGERNY

SEQ ID NO: 382264 - protein, 13 aa, Mycobacterium
QGEVGPGGGPAGD

SEQ ID NO: 382265 - protein, 4 aa, Mycobacterium
QGTG

SEQ ID NO: 382266 - protein, 4 aa, Mycobacterium
QGTS

SEQ ID NO: 382267 - protein, 7 aa, Mycobacterium
QKGTTIA

SEQ ID NO: 382268 - protein, 5 aa, Mycobacterium
QKSID

SEQ ID NO: 382269 - protein, 9 aa, Mycobacterium
QLGTKGPSL

SEQ ID NO: 382270 - protein, 6 aa, Mycobacterium
QLKTGR

SEQ ID NO: 382271 - protein, 15 aa, Mycobacterium
QLRGRAGRQGDPGSS

SEQ ID NO: 382272 - protein, 7 aa, Mycobacterium
QPFPGPG

SEQ ID NO: 382273 - protein, 5 aa, Mycobacterium
QPTDG

SEQ ID NO: 382274 - protein, 4 aa, Mycobacterium
QPTQ

SEQ ID NO: 382275 - protein, 4 aa, Mycobacterium
QQDL

SEQ ID NO: 382276 - protein, 11 aa, Mycobacterium
QQRGMERTRSD

SEQ ID NO: 382277 - protein, 12 aa, Mycobacterium
QRAEREKQWRSG

SEQ ID NO: 382278 - protein, 5 aa, Mycobacterium
QRNRS

SEQ ID NO: 382279 - protein, 4 aa, Mycobacterium
QRPG

SEQ ID NO: 382280 - protein, 4 aa, Mycobacterium
QRPP

SEQ ID NO: 382281 - protein, 9 aa, Mycobacterium
QSGETADTL

SEQ ID NO: 382282 - protein, 4 aa, Mycobacterium
QSPQ

SEQ ID NO: 382283 - protein, 5 aa, Mycobacterium
QTGGK

SEQ ID NO: 382284 - protein, 5 aa, Mycobacterium
RAEGE

SEQ ID NO: 382285 - protein, 7 aa, Mycobacterium
RAEGLTD

SEQ ID NO: 382286 - protein, 8 aa, Mycobacterium
RAIAGPGT

SEQ ID NO: 382287 - protein, 11 aa, Mycobacterium
RALPAPDYTTT

SEQ ID NO: 382288 - protein, 4 aa, Mycobacterium
RANG

SEQ ID NO: 382289 - protein, 6 aa, Mycobacterium
RAQYER

SEQ ID NO: 382290 - protein, 8 aa, Mycobacterium
RARAEAGA

SEQ ID NO: 382291 - protein, 5 aa, Mycobacterium
RARQI

SEQ ID NO: 382292 - protein, 5 aa, Mycobacterium
RAYPR

SEQ ID NO: 382293 - protein, 5 aa, Mycobacterium
RDGNQ

SEQ ID NO: 382294 - protein, 4 aa, Mycobacterium
RDGV

SEQ ID NO: 382295 - protein, 6 aa, Mycobacterium
RDPRTK

SEQ ID NO: 382296 - protein, 4 aa, Mycobacterium
REAE

SEQ ID NO: 382297 - protein, 9 aa, Mycobacterium
REKASEGTP

SEQ ID NO: 382298 - protein, 4 aa, Mycobacterium
RGAD

SEQ ID NO: 382299 - protein, 4 aa, Mycobacterium
RGAG

SEQ ID NO: 382300 - protein, 6 aa, Mycobacterium
RGAKAT

SEQ ID NO: 382301 - protein, 6 aa, Mycobacterium
RGAREP

SEQ ID NO: 382302 - protein, 4 aa, Mycobacterium
RGDG

SEQ ID NO: 382303 - protein, 4 aa, Mycobacterium
RGEA

SEQ ID NO: 382304 - protein, 4 aa, Mycobacterium
RGEG

SEQ ID NO: 382305 - protein, 6 aa, Mycobacterium
RGEIDG

SEQ ID NO: 382306 - protein, 5 aa, Mycobacterium
RGEQM

SEQ ID NO: 382307 - protein, 7 aa, Mycobacterium
RGGAGTA

SEQ ID NO: 382308 - protein, 15 aa, Mycobacterium
RGGPSTGLPTKTEQA

SEQ ID NO: 382309 - protein, 4 aa, Mycobacterium
RGGV

SEQ ID NO: 382310 - protein, 4 aa, Mycobacterium
RGKR

SEQ ID NO: 382311 - protein, 5 aa, Mycobacterium
RHPGN

SEQ ID NO: 382312 - protein, 5 aa, Mycobacterium
RHPRG

SEQ ID NO: 382313 - protein, 13 aa, Mycobacterium
RHPSRSQVLRDYL

SEQ ID NO: 382314 - protein, 7 aa, Mycobacterium
RKTGKTA

SEQ ID NO: 382315 - protein, 8 aa, Mycobacterium
RLGGAEMS

SEQ ID NO: 382316 - protein, 9 aa, Mycobacterium
RLGQPPSGY

SEQ ID NO: 382317 - protein, 5 aa, Mycobacterium
RLGRR

SEQ ID NO: 382318 - protein, 19 aa, Mycobacterium
RLTGSSDLYEATGRRPSAS

SEQ ID NO: 382319 - protein, 9 aa, Mycobacterium
RNGAGKTTT

SEQ ID NO: 382320 - protein, 7 aa, Mycobacterium
RPDRSTT

SEQ ID NO: 382321 - protein, 13 aa, Mycobacterium
RPGEPPTKESAQT

SEQ ID NO: 382322 - protein, 4 aa, Mycobacterium
RPGQ

SEQ ID NO: 382323 - protein, 4 aa, Mycobacterium
RPGT

SEQ ID NO: 382324 - protein, 4 aa, Mycobacterium
RPLP

SEQ ID NO: 382325 - protein, 20 aa, Mycobacterium
RPLTKKPAETRMGSGKGSPE

SEQ ID NO: 382326 - protein, 10 aa, Mycobacterium
RPNTGKSTLT

SEQ ID NO: 382327 - protein, 7 aa, Mycobacterium
RPQAGRY

SEQ ID NO: 382328 - protein, 8 aa, Mycobacterium
RPSGRGAD

SEQ ID NO: 382329 - protein, 7 aa, Mycobacterium
RPTPGRA

SEQ ID NO: 382330 - protein, 5 aa, Mycobacterium
RQNPL

SEQ ID NO: 382331 - protein, 14 aa, Mycobacterium
RQVSEAAGQGNNAA

SEQ ID NO: 382332 - protein, 4 aa, Mycobacterium
RRAL

SEQ ID NO: 382333 - protein, 14 aa, Mycobacterium
RRALPAPDYTTSAQ

SEQ ID NO: 382334 - protein, 6 aa, Mycobacterium
RRGELG

SEQ ID NO: 382335 - protein, 6 aa, Mycobacterium
RRGGGI

SEQ ID NO: 382336 - protein, 4 aa, Mycobacterium
RRGL

SEQ ID NO: 382337 - protein, 4 aa, Mycobacterium
RSAA

SEQ ID NO: 382338 - protein, 5 aa, Mycobacterium
RSDSD

SEQ ID NO: 382339 - protein, 12 aa, Mycobacterium
RSFETREGEKRT

SEQ ID NO: 382340 - protein, 7 aa, Mycobacterium
RSHEGTM

SEQ ID NO: 382341 - protein, 4 aa, Mycobacterium
RSIP

SEQ ID NO: 382342 - protein, 5 aa, Mycobacterium
RSPFS

SEQ ID NO: 382343 - protein, 7 aa, Mycobacterium
RSSVDDR

SEQ ID NO: 382344 - protein, 6 aa, Mycobacterium
RTEESR

SEQ ID NO: 382345 - protein, 6 aa, Mycobacterium
RTKGEY

SEQ ID NO: 382346 - protein, 8 aa, Mycobacterium
RTPEGRID

SEQ ID NO: 382347 - protein, 8 aa, Mycobacterium
SAADRQSD

SEQ ID NO: 382348 - protein, 4 aa, Mycobacterium
SAAG

SEQ ID NO: 382349 - protein, 5 aa, Mycobacterium
SACGK

SEQ ID NO: 382350 - protein, 12 aa, Mycobacterium
SAHGTNAASAAL

SEQ ID NO: 382351 - protein, 6 aa, Mycobacterium
SALDPE

SEQ ID NO: 382352 - protein, 6 aa, Mycobacterium
SARRAE

SEQ ID NO: 382353 - protein, 7 aa, Mycobacterium
SASNENP

SEQ ID NO: 382354 - protein, 4 aa, Mycobacterium
SAYV

SEQ ID NO: 382355 - protein, 5 aa, Mycobacterium
SDADP

SEQ ID NO: 382356 - protein, 7 aa, Mycobacterium
SDDTVGR

SEQ ID NO: 382357 - protein, 4 aa, Mycobacterium
SDPD

SEQ ID NO: 382358 - protein, 6 aa, Mycobacterium
SDPEKR

SEQ ID NO: 382359 - protein, 4 aa, Mycobacterium
SDRA

SEQ ID NO: 382360 - protein, 8 aa, Mycobacterium
SDRPPKQL

SEQ ID NO: 382361 - protein, 6 aa, Mycobacterium
SEGGTG

SEQ ID NO: 382362 - protein, 4 aa, Mycobacterium
SEPD

SEQ ID NO: 382363 - protein, 5 aa, Mycobacterium
SGADD

SEQ ID NO: 382364 - protein, 9 aa, Mycobacterium
SGAGRGTAA

SEQ ID NO: 382365 - protein, 8 aa, Mycobacterium
SGEAKWGQ

SEQ ID NO: 382366 - protein, 6 aa, Mycobacterium
SGGHAE

SEQ ID NO: 382367 - protein, 8 aa, Mycobacterium
SGKGEELY

SEQ ID NO: 382368 - protein, 8 aa, Mycobacterium
SGKTGEGV

SEQ ID NO: 382369 - protein, 6 aa, Mycobacterium
SGNVSA

SEQ ID NO: 382370 - protein, 4 aa, Mycobacterium
SGPI

SEQ ID NO: 382371 - protein, 4 aa, Mycobacterium
SGPQ

SEQ ID NO: 382372 - protein, 4 aa, Mycobacterium
SGQG

SEQ ID NO: 382373 - protein, 4 aa, Mycobacterium
SGRK

SEQ ID NO: 382374 - protein, 6 aa, Mycobacterium
SGSGPT

SEQ ID NO: 382375 - protein, 5 aa, Mycobacterium
SGTEL

SEQ ID NO: 382376 - protein, 5 aa, Mycobacterium
SGTGN

SEQ ID NO: 382377 - protein, 10 aa, Mycobacterium
SGTTGKPKGI

SEQ ID NO: 382378 - protein, 7 aa, Mycobacterium
SGYGGNA

SEQ ID NO: 382379 - protein, 5 aa, Mycobacterium
SIADE

SEQ ID NO: 382380 - protein, 11 aa, Mycobacterium
SITDGASSRRN

SEQ ID NO: 382381 - protein, 5 aa, Mycobacterium
SKPGL

SEQ ID NO: 382382 - protein, 6 aa, Mycobacterium
SLATDS

SEQ ID NO: 382383 - protein, 7 aa, Mycobacterium
SLDPRDP

SEQ ID NO: 382384 - protein, 5 aa, Mycobacterium
SLGDE

SEQ ID NO: 382385 - protein, 6 aa, Mycobacterium
SNPVRD

SEQ ID NO: 382386 - protein, 5 aa, Mycobacterium
SPAPC

SEQ ID NO: 382387 - protein, 8 aa, Mycobacterium
SPDKPEKL

SEQ ID NO: 382388 - protein, 4 aa, Mycobacterium
SPES

SEQ ID NO: 382389 - protein, 6 aa, Mycobacterium
SPFGQG

SEQ ID NO: 382390 - protein, 4 aa, Mycobacterium
SPGV

SEQ ID NO: 382391 - protein, 7 aa, Mycobacterium
SPHPAEF

SEQ ID NO: 382392 - protein, 6 aa, Mycobacterium
SPLRDA

SEQ ID NO: 382393 - protein, 4 aa, Mycobacterium
SPPL

SEQ ID NO: 382394 - protein, 5 aa, Mycobacterium
SQDHS

SEQ ID NO: 382395 - protein, 8 aa, Mycobacterium
SQGQQDAW

SEQ ID NO: 382396 - protein, 4 aa, Mycobacterium
SQIQ

SEQ ID NO: 382397 - protein, 9 aa, Mycobacterium
SQNRAEEAI

SEQ ID NO: 382398 - protein, 8 aa, Mycobacterium
SRADERDQ

SEQ ID NO: 382399 - protein, 4 aa, Mycobacterium
SRED

SEQ ID NO: 382400 - protein, 8 aa, Mycobacterium
SRNSSNSV

SEQ ID NO: 382401 - protein, 6 aa, Mycobacterium
SRPKPL

SEQ ID NO: 382402 - protein, 8 aa, Mycobacterium
SSEEDEPV

SEQ ID NO: 382403 - protein, 6 aa, Mycobacterium
SSRRGE

SEQ ID NO: 382404 - protein, 8 aa, Mycobacterium
STDPELEA

SEQ ID NO: 382405 - protein, 6 aa, Mycobacterium
STIPDY

SEQ ID NO: 382406 - protein, 8 aa, Mycobacterium
STPPFSTD

SEQ ID NO: 382407 - protein, 9 aa, Mycobacterium
STPTGSTAY

SEQ ID NO: 382408 - protein, 5 aa, Mycobacterium
STRMP

SEQ ID NO: 382409 - protein, 7 aa, Mycobacterium
SVPGAGD

SEQ ID NO: 382410 - protein, 4 aa, Mycobacterium
SYTG

SEQ ID NO: 382411 - protein, 4 aa, Mycobacterium
TAER

SEQ ID NO: 382412 - protein, 5 aa, Mycobacterium
TAGGA

SEQ ID NO: 382413 - protein, 6 aa, Mycobacterium
TAPDAP

SEQ ID NO: 382414 - protein, 8 aa, Mycobacterium
TATTRDVN

SEQ ID NO: 382415 - protein, 5 aa, Mycobacterium
TAVEA

SEQ ID NO: 382416 - protein, 6 aa, Mycobacterium
TDAEAA

SEQ ID NO: 382417 - protein, 9 aa, Mycobacterium
TDGDREGEA

SEQ ID NO: 382418 - protein, 8 aa, Mycobacterium
TDGPMPQT

SEQ ID NO: 382419 - protein, 6 aa, Mycobacterium
TDKADI

SEQ ID NO: 382420 - protein, 4 aa, Mycobacterium
TDPA

SEQ ID NO: 382421 - protein, 11 aa, Mycobacterium
TDPNTEGEATA

SEQ ID NO: 382422 - protein, 13 aa, Mycobacterium
TDPPKLKKQEKHD

SEQ ID NO: 382423 - protein, 5 aa, Mycobacterium
TDPQG

SEQ ID NO: 382424 - protein, 5 aa, Mycobacterium
TDRPR

SEQ ID NO: 382425 - protein, 8 aa, Mycobacterium
TDTTAAQR

SEQ ID NO: 382426 - protein, 11 aa, Mycobacterium
TEAKVRGYQPG

SEQ ID NO: 382427 - protein, 4 aa, Mycobacterium
TEEF

SEQ ID NO: 382428 - protein, 5 aa, Mycobacterium
TEEQK

SEQ ID NO: 382429 - protein, 10 aa, Mycobacterium
TEGAGGGHAP

SEQ ID NO: 382430 - protein, 12 aa, Mycobacterium
TEIKNGQRKQVN

SEQ ID NO: 382431 - protein, 5 aa, Mycobacterium
TEPEK

SEQ ID NO: 382432 - protein, 10 aa, Mycobacterium
TEPGGGSDVG

SEQ ID NO: 382433 - protein, 4 aa, Mycobacterium
TEQG

SEQ ID NO: 382434 - protein, 5 aa, Mycobacterium
TERQR

SEQ ID NO: 382435 - protein, 7 aa, Mycobacterium
TGAAQRA

SEQ ID NO: 382436 - protein, 6 aa, Mycobacterium
TGEPSY

SEQ ID NO: 382437 - protein, 4 aa, Mycobacterium
TGER

SEQ ID NO: 382438 - protein, 5 aa, Mycobacterium
TGGCP

SEQ ID NO: 382439 - protein, 4 aa, Mycobacterium
TGGE

SEQ ID NO: 382440 - protein, 8 aa, Mycobacterium
TGKPGKHK

SEQ ID NO: 382441 - protein, 4 aa, Mycobacterium
TGKV

SEQ ID NO: 382442 - protein, 12 aa, Mycobacterium
TGSGTSSNMNTN

SEQ ID NO: 382443 - protein, 8 aa, Mycobacterium
TGTTAVKP

SEQ ID NO: 382444 - protein, 11 aa, Mycobacterium
TGVSGSGKSTL

SEQ ID NO: 382445 - protein, 30 aa, Mycobacterium; identical to SEQ ID NO: 57507

SEQ ID NO: 382446 - protein, 10 aa, Mycobacterium
TIGDEGDSQL

SEQ ID NO: 382447 - protein, 6 aa, Mycobacterium
TKTVPK

SEQ ID NO: 382448 - protein, 8 aa, Mycobacterium
TLSGAPKV

SEQ ID NO: 382449 - protein, 5 aa, Mycobacterium
TNGRI

SEQ ID NO: 382450 - protein, 7 aa, Mycobacterium
TNPGTIG

SEQ ID NO: 382451 - protein, 5 aa, Mycobacterium
TNPPI

SEQ ID NO: 382452 - protein, 6 aa, Mycobacterium
TNRPDL

SEQ ID NO: 382453 - protein, 4 aa, Mycobacterium
TPEE

SEQ ID NO: 382454 - protein, 6 aa, Mycobacterium
TPGDRS

SEQ ID NO: 382455 - protein, 12 aa, Mycobacterium
TPGHADFGGEVE

SEQ ID NO: 382456 - protein, 7 aa, Mycobacterium
TPGHSPG

SEQ ID NO: 382457 - protein, 5 aa, Mycobacterium
TPIPR

SEQ ID NO: 382458 - protein, 6 aa, Mycobacterium
TPPEER

SEQ ID NO: 382459 - protein, 4 aa, Mycobacterium
TRAG

SEQ ID NO: 382460 - protein, 7 aa, Mycobacterium
TRNGQSL

SEQ ID NO: 382461 - protein, 9 aa, Mycobacterium
TRNPADAED

SEQ ID NO: 382462 - protein, 6 aa, Mycobacterium
TRPTLR

SEQ ID NO: 382463 - protein, 4 aa, Mycobacterium
TRSA

SEQ ID NO: 382464 - protein, 9 aa, Mycobacterium
TSAKQDGRN

SEQ ID NO: 382465 - protein, 4 aa, Mycobacterium
TSDE

SEQ ID NO: 382466 - protein, 5 aa, Mycobacterium
TSGAH

SEQ ID NO: 382467 - protein, 7 aa, Mycobacterium
TSGEQRL

SEQ ID NO: 382468 - protein, 4 aa, Mycobacterium
TSGL

SEQ ID NO: 382469 - protein, 8 aa, Mycobacterium
TSTADANI

SEQ ID NO: 382470 - protein, 7 aa, Mycobacterium
TTADGRT

SEQ ID NO: 382471 - protein, 6 aa, Mycobacterium
TTDTGS

SEQ ID NO: 382472 - protein, 7 aa, Mycobacterium
TTENPSF

SEQ ID NO: 382473 - protein, 5 aa, Mycobacterium
TTETT

SEQ ID NO: 382474 - protein, 4 aa, Mycobacterium
TTPG

SEQ ID NO: 382475 - protein, 11 aa, Mycobacterium
TTTPKKPNSAL

SEQ ID NO: 382476 - protein, 6 aa, Mycobacterium
TVEDEA

SEQ ID NO: 382477 - protein, 4 aa, Mycobacterium
TVPE

SEQ ID NO: 382478 - protein, 6 aa, Mycobacterium
TVPPPV

SEQ ID NO: 382479 - protein, 7 aa, Mycobacterium
TYEPETS

SEQ ID NO: 382480 - protein, 11 aa, Mycobacterium
TYPGPGGTIGP

SEQ ID NO: 382481 - protein, 6 aa, Mycobacterium
TYSPTG

SEQ ID NO: 382482 - protein, 4 aa, Mycobacterium
VADP

SEQ ID NO: 382483 - protein, 4 aa, Mycobacterium
VAGG

SEQ ID NO: 382484 - protein, 4 aa, Mycobacterium
VAPG

SEQ ID NO: 382485 - protein, 11 aa, Mycobacterium
VARNPRTGETV

SEQ ID NO: 382486 - protein, 6 aa, Mycobacterium
VDADGG

SEQ ID NO: 382487 - protein, 6 aa, Mycobacterium
VDGDRT

SEQ ID NO: 382488 - protein, 5 aa, Mycobacterium
VDYSG

SEQ ID NO: 382489 - protein, 5 aa, Mycobacterium
VEAGE

SEQ ID NO: 382490 - protein, 5 aa, Mycobacterium
VEQGT

SEQ ID NO: 382491 - protein, 9 aa, Mycobacterium
VGAGSGKQI

SEQ ID NO: 382492 - protein, 7 aa, Mycobacterium
VGDGAND

SEQ ID NO: 382493 - protein, 4 aa, Mycobacterium
VGGL

SEQ ID NO: 382494 - protein, 4 aa, Mycobacterium
VGPE

SEQ ID NO: 382495 - protein, 5 aa, Mycobacterium
VGQSE

SEQ ID NO: 382496 - protein, 8 aa, Mycobacterium
VGRGGDDT

SEQ ID NO: 382497 - protein, 8 aa, Mycobacterium
VGRSRERG

SEQ ID NO: 382498 - protein, 8 aa, Mycobacterium
VGSEEADK

SEQ ID NO: 382499 - protein, 8 aa, Mycobacterium
VKESNPYN

SEQ ID NO: 382500 - protein, 7 aa, Mycobacterium
VKIPDED

SEQ ID NO: 382501 - protein, 6 aa, Mycobacterium
VKRAET

SEQ ID NO: 382502 - protein, 4 aa, Mycobacterium
VPAT

SEQ ID NO: 382503 - protein, 4 aa, Mycobacterium
VPDA

SEQ ID NO: 382504 - protein, 9 aa, Mycobacterium
VPDPGGAAF

SEQ ID NO: 382505 - protein, 4 aa, Mycobacterium
VPEG

SEQ ID NO: 382506 - protein, 6 aa, Mycobacterium
VPLPTE

SEQ ID NO: 382507 - protein, 4 aa, Mycobacterium
VPPA

SEQ ID NO: 382508 - protein, 10 aa, Mycobacterium
VQPTEEARAA

SEQ ID NO: 382509 - protein, 4 aa, Mycobacterium
VRAG

SEQ ID NO: 382510 - protein, 4 aa, Mycobacterium
VRDG

SEQ ID NO: 382511 - protein, 6 aa, Mycobacterium
VRGNTQ

SEQ ID NO: 382512 - protein, 4 aa, Mycobacterium
VSGD

SEQ ID NO: 382513 - protein, 6 aa, Mycobacterium
VSKVSE

SEQ ID NO: 382514 - protein, 6 aa, Mycobacterium
VSPNPD

SEQ ID NO: 382515 - protein, 7 aa, Mycobacterium
VTEETTG

SEQ ID NO: 382516 - protein, 7 aa, Mycobacterium
VTGGRIP

SEQ ID NO: 382517 - protein, 7 aa, Mycobacterium
VTGPDEY

SEQ ID NO: 382518 - protein, 4 aa, Mycobacterium
VTGR

SEQ ID NO: 382519 - protein, 7 aa, Mycobacterium
VTKPYSA

SEQ ID NO: 382520 - protein, 9 aa, Mycobacterium
VTPAHDPND

SEQ ID NO: 382521 - protein, 13 aa, Mycobacterium
VTPKGETELTPEE

SEQ ID NO: 382522 - protein, 4 aa, Mycobacterium
VTTP

SEQ ID NO: 382523 - protein, 4 aa, Mycobacterium
VTTT

SEQ ID NO: 382524 - protein, 9 aa, Mycobacterium
WKQKDYDEY

SEQ ID NO: 382525 - protein, 9 aa, Mycobacterium
WNEEESGAY

SEQ ID NO: 382526 - protein, 6 aa, Mycobacterium
WSGGGS

SEQ ID NO: 382527 - protein, 8 aa, Mycobacterium
YAEEAGIK

SEQ ID NO: 382528 - protein, 8 aa, Mycobacterium
YDAEGADE

SEQ ID NO: 382529 - protein, 7 aa, Mycobacterium
YDPNRTA

SEQ ID NO: 382530 - protein, 4 aa, Mycobacterium
YDRS

SEQ ID NO: 382531 - protein, 9 aa, Mycobacterium
YEAGGIAKH

SEQ ID NO: 382532 - protein, 8 aa, Mycobacterium
YEGEDAAR

SEQ ID NO: 382533 - protein, 5 aa, Mycobacterium
YGARA

SEQ ID NO: 382534 - protein, 4 aa, Mycobacterium
YGGT

SEQ ID NO: 382535 - protein, 7 aa, Mycobacterium
YGKGSNA

SEQ ID NO: 382536 - protein, 4 aa, Mycobacterium
YGPT

SEQ ID NO: 382537 - protein, 6 aa, Mycobacterium
YGPTET

SEQ ID NO: 382538 - protein, 6 aa, Mycobacterium
YGSTTV

SEQ ID NO: 382539 - protein, 6 aa, Mycobacterium
YGTGHT

SEQ ID NO: 382540 - protein, 4 aa, Mycobacterium
YIGG

SEQ ID NO: 382541 - protein, 4 aa, Mycobacterium
YKSS

SEQ ID NO: 382542 - protein, 4 aa, Mycobacterium
YPDR

SEQ ID NO: 382543 - protein, 8 aa, Mycobacterium
YPGADEAL

SEQ ID NO: 382544 - protein, 6 aa, Mycobacterium
YPTRSG

SEQ ID NO: 382545 - protein, 6 aa, Mycobacterium
YRGQET

SEQ ID NO: 382546 - protein, 9 aa, Mycobacterium
YTSGQPDPD

SEQ ID NO: 382547 - protein, 4 aa, Mycobacterium
AAAE

SEQ ID NO: 382548 - protein, 4 aa, Mycobacterium
AAAL

SEQ ID NO: 382549 - protein, 5 aa, Mycobacterium
AAAPA

SEQ ID NO: 382550 - protein, 7 aa, Mycobacterium
AAATNSL

SEQ ID NO: 382551 - protein, 4 aa, Mycobacterium
AAAV

SEQ ID NO: 382552 - protein, 4 aa, Mycobacterium
AADG

SEQ ID NO: 382553 - protein, 5 aa, Mycobacterium
AADPN

SEQ ID NO: 382554 - protein, 7 aa, Mycobacterium
AAEADQL

SEQ ID NO: 382555 - protein, 7 aa, Mycobacterium
AAEGETI

SEQ ID NO: 382556 - protein, 5 aa, Mycobacterium
AAGAQ

SEQ ID NO: 382557 - protein, 6 aa, Mycobacterium
AAGGGH

SEQ ID NO: 382558 - protein, 4 aa, Mycobacterium
AAGL

SEQ ID NO: 382559 - protein, 9 aa, Mycobacterium
AAGRDGAPQ

SEQ ID NO: 382560 - protein, 7 aa, Mycobacterium
AAHTTAH

SEQ ID NO: 382561 - protein, 10 aa, Mycobacterium
AAKKDGDTLG

SEQ ID NO: 382562 - protein, 6 aa, Mycobacterium
AANRPG

SEQ ID NO: 382563 - protein, 5 aa, Mycobacterium
AAPAG

SEQ ID NO: 382564 - protein, 4 aa, Mycobacterium
AAPD

SEQ ID NO: 382565 - protein, 5 aa, Mycobacterium
AAPGA

SEQ ID NO: 382566 - protein, 4 aa, Mycobacterium
AAPY

SEQ ID NO: 382567 - protein, 6 aa, Mycobacterium
AAREPD

SEQ ID NO: 382568 - protein, 4 aa, Mycobacterium
AARP

SEQ ID NO: 382569 - protein, 10 aa, Mycobacterium
AARYGQPGKT

SEQ ID NO: 382570 - protein, 5 aa, Mycobacterium
AASGR

SEQ ID NO: 382571 - protein, 4 aa, Mycobacterium
AASR

SEQ ID NO: 382572 - protein, 13 aa, Mycobacterium
AATGRLSSTEPNL

SEQ ID NO: 382573 - protein, 4 aa, Mycobacterium
ACPT

SEQ ID NO: 382574 - protein, 8 aa, Mycobacterium
ACSSGSEA

SEQ ID NO: 382575 - protein, 16 aa, Mycobacterium
ADARREKESAIDAQDF

SEQ ID NO: 382576 - protein, 9 aa, Mycobacterium
ADDAANYGG

SEQ ID NO: 382577 - protein, 11 aa, Mycobacterium
ADDGGSSGRLR

SEQ ID NO: 382578 - protein, 7 aa, Mycobacterium
ADDPGTI

SEQ ID NO: 382579 - protein, 7 aa, Mycobacterium
ADDPRRR

SEQ ID NO: 382580 - protein, 4 aa, Mycobacterium
ADEF

SEQ ID NO: 382581 - protein, 16 aa, Mycobacterium
ADEGPTAKRIRPRAQG

SEQ ID NO: 382582 - protein, 4 aa, Mycobacterium
ADEV

SEQ ID NO: 382583 - protein, 6 aa, Mycobacterium
ADEVST

SEQ ID NO: 382584 - protein, 4 aa, Mycobacterium
ADGD

SEQ ID NO: 382585 - protein, 22 aa, Mycobacterium
ADKPEKAAAPAGDPTGGMGGMD

SEQ ID NO: 382586 - protein, 6 aa, Mycobacterium
ADLPPA

SEQ ID NO: 382587 - protein, 6 aa, Mycobacterium
ADNQRA

SEQ ID NO: 382588 - protein, 4 aa, Mycobacterium
ADPD

SEQ ID NO: 382589 - protein, 8 aa, Mycobacterium
ADPPMTKD

SEQ ID NO: 382590 - protein, 4 aa, Mycobacterium
ADPR

SEQ ID NO: 382591 - protein, 7 aa, Mycobacterium
ADPSQQL

SEQ ID NO: 382592 - protein, 4 aa, Mycobacterium
ADPT

SEQ ID NO: 382593 - protein, 10 aa, Mycobacterium
ADRAKPAVPF

SEQ ID NO: 382594 - protein, 4 aa, Mycobacterium
ADRK

SEQ ID NO: 382595 - protein, 9 aa, Mycobacterium
ADSETPLSA

SEQ ID NO: 382596 - protein, 4 aa, Mycobacterium
ADSG

SEQ ID NO: 382597 - protein, 6 aa, Mycobacterium
AEAGKQ

SEQ ID NO: 382598 - protein, 4 aa, Mycobacterium
AEAL

SEQ ID NO: 382599 - protein, 7 aa, Mycobacterium
AEDDPTK

SEQ ID NO: 382600 - protein, 8 aa, Mycobacterium
AEEYGSHD

SEQ ID NO: 382601 - protein, 4 aa, Mycobacterium
AEGA

SEQ ID NO: 382602 - protein, 5 aa, Mycobacterium
AEGRD

SEQ ID NO: 382603 - protein, 5 aa, Mycobacterium
AEGRS

SEQ ID NO: 382604 - protein, 4 aa, Mycobacterium
AEGV

SEQ ID NO: 382605 - protein, 6 aa, Mycobacterium
AEHDEM

SEQ ID NO: 382606 - protein, 4 aa, Mycobacterium
AENA

SEQ ID NO: 382607 - protein, 7 aa, Mycobacterium
AENGRSW

SEQ ID NO: 382608 - protein, 5 aa, Mycobacterium
AENYG

SEQ ID NO: 382609 - protein, 6 aa, Mycobacterium
AEPGPY

SEQ ID NO: 382610 - protein, 4 aa, Mycobacterium
AERT

SEQ ID NO: 382611 - protein, 6 aa, Mycobacterium
AESTAW

SEQ ID NO: 382612 - protein, 4 aa, Mycobacterium
AETA

SEQ ID NO: 382613 - protein, 8 aa, Mycobacterium
AETGDANG

SEQ ID NO: 382614 - protein, 12 aa, Mycobacterium
AEVRGDDAREAK

SEQ ID NO: 382615 - protein, 8 aa, Mycobacterium
AGAEGADV

SEQ ID NO: 382616 - protein, 5 aa, Mycobacterium
AGAGV

SEQ ID NO: 382617 - protein, 4 aa, Mycobacterium
AGAP

SEQ ID NO: 382618 - protein, 14 aa, Mycobacterium
AGAPGRASANGTSM

SEQ ID NO: 382619 - protein, 4 aa, Mycobacterium
AGAQ

SEQ ID NO: 382620 - protein, 8 aa, Mycobacterium
AGAVPGPF

SEQ ID NO: 382621 - protein, 5 aa, Mycobacterium
AGDDL

SEQ ID NO: 382622 - protein, 6 aa, Mycobacterium
AGDEVS

SEQ ID NO: 382623 - protein, 6 aa, Mycobacterium
AGDNKF

SEQ ID NO: 382624 - protein, 10 aa, Mycobacterium
AGEGESTTDL

SEQ ID NO: 382625 - protein, 4 aa, Mycobacterium
AGEP

SEQ ID NO: 382626 - protein, 7 aa, Mycobacterium
AGGGLGR

SEQ ID NO: 382627 - protein, 6 aa, Mycobacterium
AGGGSA

SEQ ID NO: 382628 - protein, 7 aa, Mycobacterium
AGGIGTS

SEQ ID NO: 382629 - protein, 10 aa, Mycobacterium
AGIQRAKRTR

SEQ ID NO: 382630 - protein, 4 aa, Mycobacterium
AGKT

SEQ ID NO: 382631 - protein, 4 aa, Mycobacterium
AGLR

SEQ ID NO: 382632 - protein, 6 aa, Mycobacterium
AGPGQR

SEQ ID NO: 382633 - protein, 4 aa, Mycobacterium
AGPL

SEQ ID NO: 382634 - protein, 5 aa, Mycobacterium
AGPNV

SEQ ID NO: 382635 - protein, 4 aa, Mycobacterium
AGQM

SEQ ID NO: 382636 - protein, 7 aa, Mycobacterium
AGQRNAI

SEQ ID NO: 382637 - protein, 4 aa, Mycobacterium
AGRE

SEQ ID NO: 382638 - protein, 4 aa, Mycobacterium
AGRG

SEQ ID NO: 382639 - protein, 9 aa, Mycobacterium
AGRNPKLGY

SEQ ID NO: 382640 - protein, 10 aa, Mycobacterium
AGRSGRRGQG

SEQ ID NO: 382641 - protein, 6 aa, Mycobacterium
AGRSIR

SEQ ID NO: 382642 - protein, 7 aa, Mycobacterium
AGSGKTA

SEQ ID NO: 382643 - protein, 4 aa, Mycobacterium
AGSP

SEQ ID NO: 382644 - protein, 8 aa, Mycobacterium
AGTAGQRC

SEQ ID NO: 382645 - protein, 6 aa, Mycobacterium
AGTDGA

SEQ ID NO: 382646 - protein, 5 aa, Mycobacterium
AGTEK

SEQ ID NO: 382647 - protein, 4 aa, Mycobacterium
AGTG

SEQ ID NO: 382648 - protein, 7 aa, Mycobacterium
AGTGKLT

SEQ ID NO: 382649 - protein, 9 aa, Mycobacterium
AGTGKTRTI

SEQ ID NO: 382650 - protein, 4 aa, Mycobacterium
AGVT

SEQ ID NO: 382651 - protein, 8 aa, Mycobacterium
AIDPDHAS

SEQ ID NO: 382652 - protein, 6 aa, Mycobacterium
AIEEQS

SEQ ID NO: 382653 - protein, 6 aa, Mycobacterium
AIGRPR

SEQ ID NO: 382654 - protein, 4 aa, Mycobacterium
AITP

SEQ ID NO: 382655 - protein, 12 aa, Mycobacterium
AKAAGDAVRNGD

SEQ ID NO: 382656 - protein, 10 aa, Mycobacterium
AKAKGHLDAG

SEQ ID NO: 382657 - protein, 7 aa, Mycobacterium
AKATRKL

SEQ ID NO: 382658 - protein, 4 aa, Mycobacterium
AKIG

SEQ ID NO: 382659 - protein, 6 aa, Mycobacterium
AKLTNT

SEQ ID NO: 382660 - protein, 9 aa, Mycobacterium
AKNRGGTPD

SEQ ID NO: 382661 - protein, 6 aa, Mycobacterium
AKPTSN

SEQ ID NO: 382662 - protein, 11 aa, Mycobacterium
AKQGASYGHTK

SEQ ID NO: 382663 - protein, 8 aa, Mycobacterium
AKSGTAEL

SEQ ID NO: 382664 - protein, 11 aa, Mycobacterium
ALASRARKAPG

SEQ ID NO: 382665 - protein, 17 aa, Mycobacterium
ALPAPEYGDGDRYRAPV

SEQ ID NO: 382666 - protein, 4 aa, Mycobacterium
ALPP

SEQ ID NO: 382667 - protein, 4 aa, Mycobacterium
ALQT

SEQ ID NO: 382668 - protein, 6 aa, Mycobacterium
ANGSNE

SEQ ID NO: 382669 - protein, 6 aa, Mycobacterium
ANPSHL

SEQ ID NO: 382670 - protein, 4 aa, Mycobacterium
APAT

SEQ ID NO: 382671 - protein, 5 aa, Mycobacterium
APDAD

SEQ ID NO: 382672 - protein, 6 aa, Mycobacterium
APDDEL

SEQ ID NO: 382673 - protein, 4 aa, Mycobacterium
APDE

SEQ ID NO: 382674 - protein, 8 aa, Mycobacterium
APDTPEIA

SEQ ID NO: 382675 - protein, 6 aa, Mycobacterium
APGHAD

SEQ ID NO: 382676 - protein, 6 aa, Mycobacterium
APGSAD

SEQ ID NO: 382677 - protein, 13 aa, Mycobacterium
APGSKPIDLFGAP

SEQ ID NO: 382678 - protein, 9 aa, Mycobacterium
APLCSPSRG

SEQ ID NO: 382679 - protein, 4 aa, Mycobacterium
APLP

SEQ ID NO: 382680 - protein, 6 aa, Mycobacterium
APLPCT

SEQ ID NO: 382681 - protein, 5 aa, Mycobacterium
APNQA

SEQ ID NO: 382682 - protein, 6 aa, Mycobacterium
APPDAR

SEQ ID NO: 382683 - protein, 8 aa, Mycobacterium
APPGSFNN

SEQ ID NO: 382684 - protein, 4 aa, Mycobacterium
APPR

SEQ ID NO: 382685 - protein, 5 aa, Mycobacterium
APTQA

SEQ ID NO: 382686 - protein, 4 aa, Mycobacterium
APTR

SEQ ID NO: 382687 - protein, 7 aa, Mycobacterium
AQGAWTG

SEQ ID NO: 382688 - protein, 4 aa, Mycobacterium
AQNG

SEQ ID NO: 382689 - protein, 4 aa, Mycobacterium
AQNH

SEQ ID NO: 382690 - protein, 5 aa, Mycobacterium
AQPDS

SEQ ID NO: 382691 - protein, 9 aa, Mycobacterium
AQSTDKRVN

SEQ ID NO: 382692 - protein, 7 aa, Mycobacterium
AQTEHPG

SEQ ID NO: 382693 - protein, 4 aa, Mycobacterium
AQWN

SEQ ID NO: 382694 - protein, 8 aa, Mycobacterium
ARANRTPI

SEQ ID NO: 382695 - protein, 5 aa, Mycobacterium
ARPQR

SEQ ID NO: 382696 - protein, 4 aa, Mycobacterium
ARPR

SEQ ID NO: 382697 - protein, 4 aa, Mycobacterium
ARQR

SEQ ID NO: 382698 - protein, 7 aa, Mycobacterium
ARQTPQQ

SEQ ID NO: 382699 - protein, 8 aa, Mycobacterium
ARRERGDL

SEQ ID NO: 382700 - protein, 5 aa, Mycobacterium
ARRPV

SEQ ID NO: 382701 - protein, 4 aa, Mycobacterium
ARSA

SEQ ID NO: 382702 - protein, 4 aa, Mycobacterium
ARTA

SEQ ID NO: 382703 - protein, 10 aa, Mycobacterium
ASAPGGDSYA

SEQ ID NO: 382704 - protein, 7 aa, Mycobacterium
ASDSPHG

SEQ ID NO: 382705 - protein, 4 aa, Mycobacterium
ASEG

SEQ ID NO: 382706 - protein, 6 aa, Mycobacterium
ASEVKR

SEQ ID NO: 382707 - protein, 5 aa, Mycobacterium
ASGGR

SEQ ID NO: 382708 - protein, 13 aa, Mycobacterium
ASGNIDATRTNPS

SEQ ID NO: 382709 - protein, 5 aa, Mycobacterium
ASKPI

SEQ ID NO: 382710 - protein, 6 aa, Mycobacterium
ASPALQ

SEQ ID NO: 382711 - protein, 7 aa, Mycobacterium
ASPERRK

SEQ ID NO: 382712 - protein, 10 aa, Mycobacterium
ASPLPGPSGN

SEQ ID NO: 382713 - protein, 6 aa, Mycobacterium
ASRDGL

SEQ ID NO: 382714 - protein, 4 aa, Mycobacterium
ASRE

SEQ ID NO: 382715 - protein, 7 aa, Mycobacterium
ASRGKWD

SEQ ID NO: 382716 - protein, 7 aa, Mycobacterium
ASRPWAT

SEQ ID NO: 382717 - protein, 16 aa, Mycobacterium
ASRQKARAARRLGFEV

SEQ ID NO: 382718 - protein, 8 aa, Mycobacterium
ASRVGAPL

SEQ ID NO: 382719 - protein, 4 aa, Mycobacterium
ASSG

SEQ ID NO: 382720 - protein, 8 aa, Mycobacterium
ASSGIGRA

SEQ ID NO: 382721 - protein, 7 aa, Mycobacterium
ASTARRL

SEQ ID NO: 382722 - protein, 4 aa, Mycobacterium
ATAA

SEQ ID NO: 382723 - protein, 5 aa, Mycobacterium
ATETL

SEQ ID NO: 382724 - protein, 5 aa, Mycobacterium
ATGGE

SEQ ID NO: 382725 - protein, 14 aa, Mycobacterium
ATGSSTRLVPGTSL

SEQ ID NO: 382726 - protein, 16 aa, Mycobacterium
ATKTNDVAGDGTTTAT

SEQ ID NO: 382727 - protein, 6 aa, Mycobacterium
ATPGPH

SEQ ID NO: 382728 - protein, 5 aa, Mycobacterium
ATSAA

SEQ ID NO: 382729 - protein, 6 aa, Mycobacterium
ATSAST

SEQ ID NO: 382730 - protein, 7 aa, Mycobacterium
ATTPGKV

SEQ ID NO: 382731 - protein, 4 aa, Mycobacterium
ATTV

SEQ ID NO: 382732 - protein, 9 aa, Mycobacterium
ATVKGGTYY

SEQ ID NO: 382733 - protein, 5 aa, Mycobacterium
AVEGR

SEQ ID NO: 382734 - protein, 7 aa, Mycobacterium
AVPSRDI

SEQ ID NO: 382735 - protein, 11 aa, Mycobacterium
AVRQGDPLDTE

SEQ ID NO: 382736 - protein, 10 aa, Mycobacterium
AVSSGDNSNI

SEQ ID NO: 382737 - protein, 5 aa, Mycobacterium
AYAPY

SEQ ID NO: 382738 - protein, 8 aa, Mycobacterium
AYENQDAP

SEQ ID NO: 382739 - protein, 8 aa, Mycobacterium
CAEARGKD

SEQ ID NO: 382740 - protein, 12 aa, Mycobacterium
CASGSQALQSAR

SEQ ID NO: 382741 - protein, 6 aa, Mycobacterium
CGEGYG

SEQ ID NO: 382742 - protein, 4 aa, Mycobacterium
CGPE

SEQ ID NO: 382743 - protein, 4 aa, Mycobacterium
CGSG

SEQ ID NO: 382744 - protein, 4 aa, Mycobacterium
CGTG

SEQ ID NO: 382745 - protein, 4 aa, Mycobacterium
CPSG

SEQ ID NO: 382746 - protein, 4 aa, Mycobacterium
CPTK

SEQ ID NO: 382747 - protein, 12 aa, Mycobacterium
CRPDASPGSPEW

SEQ ID NO: 382748 - protein, 5 aa, Mycobacterium
CSAPV

SEQ ID NO: 382749 - protein, 11 aa, Mycobacterium
CSPTSDGSGAA

SEQ ID NO: 382750 - protein, 8 aa, Mycobacterium
CTNTSNPE

SEQ ID NO: 382751 - protein, 4 aa, Mycobacterium
DAAA

SEQ ID NO: 382752 - protein, 4 aa, Mycobacterium
DAAG

SEQ ID NO: 382753 - protein, 8 aa, Mycobacterium
DADGTKAG

SEQ ID NO: 382754 - protein, 5 aa, Mycobacterium
DADTE

SEQ ID NO: 382755 - protein, 4 aa, Mycobacterium
DAGV

SEQ ID NO: 382756 - protein, 12 aa, Mycobacterium
DAIPGGNVKRGD

SEQ ID NO: 382757 - protein, 4 aa, Mycobacterium
DATA

SEQ ID NO: 382758 - protein, 5 aa, Mycobacterium
DAYGG

SEQ ID NO: 382759 - protein, 8 aa, Mycobacterium
DDAPGQPR

SEQ ID NO: 382760 - protein, 4 aa, Mycobacterium
DDDA

SEQ ID NO: 382761 - protein, 6 aa, Mycobacterium
DDDGNV

SEQ ID NO: 382762 - protein, 5 aa, Mycobacterium
DDEYQ

SEQ ID NO: 382763 - protein, 5 aa, Mycobacterium
DDIDA

SEQ ID NO: 382764 - protein, 5 aa, Mycobacterium
DDLGG

SEQ ID NO: 382765 - protein, 9 aa, Mycobacterium
DDPADAEVP

SEQ ID NO: 382766 - protein, 5 aa, Mycobacterium
DDQAE

SEQ ID NO: 382767 - protein, 7 aa, Mycobacterium
DDTPEGF

SEQ ID NO: 382768 - protein, 4 aa, Mycobacterium
DEAA

SEQ ID NO: 382769 - protein, 4 aa, Mycobacterium
DEDT

SEQ ID NO: 382770 - protein, 4 aa, Mycobacterium
DELP

SEQ ID NO: 382771 - protein, 10 aa, Mycobacterium
DEPRPGRPRV

SEQ ID NO: 382772 - protein, 7 aa, Mycobacterium
DEPTTAL

SEQ ID NO: 382773 - protein, 4 aa, Mycobacterium
DEQV

SEQ ID NO: 382774 - protein, 4 aa, Mycobacterium
DERG

SEQ ID NO: 382775 - protein, 8 aa, Mycobacterium
DERTVAPS

SEQ ID NO: 382776 - protein, 5 aa, Mycobacterium
DEWAE

SEQ ID NO: 382777 - protein, 4 aa, Mycobacterium
DFPD

SEQ ID NO: 382778 - protein, 4 aa, Mycobacterium
DFPP

SEQ ID NO: 382779 - protein, 8 aa, Mycobacterium
DGAAEADL

SEQ ID NO: 382780 - protein, 5 aa, Mycobacterium
DGDTE

SEQ ID NO: 382781 - protein, 4 aa, Mycobacterium
DGEF

SEQ ID NO: 382782 - protein, 4 aa, Mycobacterium
DGEI

SEQ ID NO: 382783 - protein, 8 aa, Mycobacterium
DGEKLSDD

SEQ ID NO: 382784 - protein, 7 aa, Mycobacterium
DGEPTAH

SEQ ID NO: 382785 - protein, 7 aa, Mycobacterium
DGGTRPY

SEQ ID NO: 382786 - protein, 7 aa, Mycobacterium
DGIDGEE

SEQ ID NO: 382787 - protein, 12 aa, Mycobacterium
DGLDELTTTTTS

SEQ ID NO: 382788 - protein, 5 aa, Mycobacterium
DGQAL

SEQ ID NO: 382789 - protein, 6 aa, Mycobacterium
DGRYGP

SEQ ID NO: 382790 - protein, 4 aa, Mycobacterium
DGSQ

SEQ ID NO: 382791 - protein, 5 aa, Mycobacterium
DGSSI

SEQ ID NO: 382792 - protein, 4 aa, Mycobacterium
DGTL

SEQ ID NO: 382793 - protein, 9 aa, Mycobacterium
DGTLGGPVA

SEQ ID NO: 382794 - protein, 4 aa, Mycobacterium
DGVT

SEQ ID NO: 382795 - protein, 8 aa, Mycobacterium
DIGQPASV

SEQ ID NO: 382796 - protein, 7 aa, Mycobacterium
DIQGGGS

SEQ ID NO: 382797 - protein, 9 aa, Mycobacterium
DISGPPRAH

SEQ ID NO: 382798 - protein, 7 aa, Mycobacterium
DKGEKEQ

SEQ ID NO: 382799 - protein, 5 aa, Mycobacterium
DKGKL

SEQ ID NO: 382800 - protein, 9 aa, Mycobacterium
DLSPKARDL

SEQ ID NO: 382801 - protein, 5 aa, Mycobacterium
DMSRK

SEQ ID NO: 382802 - protein, 7 aa, Mycobacterium
DNEHDEA

SEQ ID NO: 382803 - protein, 15 aa, Mycobacterium
DNPNATGSCACGDSF

SEQ ID NO: 382804 - protein, 5 aa, Mycobacterium
DPAAR

SEQ ID NO: 382805 - protein, 4 aa, Mycobacterium
DPAG

SEQ ID NO: 382806 - protein, 4 aa, Mycobacterium
DPAL

SEQ ID NO: 382807 - protein, 7 aa, Mycobacterium
DPHSPPE

SEQ ID NO: 382808 - protein, 8 aa, Mycobacterium
DPPGNTDR

SEQ ID NO: 382809 - protein, 4 aa, Mycobacterium
DPQG

SEQ ID NO: 382810 - protein, 4 aa, Mycobacterium
DPRL

SEQ ID NO: 382811 - protein, 4 aa, Mycobacterium
DPSA

SEQ ID NO: 382812 - protein, 6 aa, Mycobacterium
DPTLEP

SEQ ID NO: 382813 - protein, 4 aa, Mycobacterium
DPTT

SEQ ID NO: 382814 - protein, 4 aa, Mycobacterium
DPTV

SEQ ID NO: 382815 - protein, 11 aa, Mycobacterium
DQERGLSAGEK

SEQ ID NO: 382816 - protein, 14 aa, Mycobacterium
DQRPGTKKCGHQGG

SEQ ID NO: 382817 - protein, 7 aa, Mycobacterium
DRAGVSK

SEQ ID NO: 382818 - protein, 7 aa, Mycobacterium
DRAQREL

SEQ ID NO: 382819 - protein, 6 aa, Mycobacterium
DRDGSD

SEQ ID NO: 382820 - protein, 5 aa, Mycobacterium
DRFTS

SEQ ID NO: 382821 - protein, 5 aa, Mycobacterium
DRGGT

SEQ ID NO: 382822 - protein, 7 aa, Mycobacterium
DRGSQFR

SEQ ID NO: 382823 - protein, 6 aa, Mycobacterium
DRNPLH

SEQ ID NO: 382824 - protein, 4 aa, Mycobacterium
DRPT

SEQ ID NO: 382825 - protein, 8 aa, Mycobacterium
DRRSTQGN

SEQ ID NO: 382826 - protein, 5 aa, Mycobacterium
DRSER

SEQ ID NO: 382827 - protein, 4 aa, Mycobacterium
DRVT

SEQ ID NO: 382828 - protein, 5 aa, Mycobacterium
DSAGG

SEQ ID NO: 382829 - protein, 6 aa, Mycobacterium
DSAGGY

SEQ ID NO: 382830 - protein, 5 aa, Mycobacterium
DSEID

SEQ ID NO: 382831 - protein, 5 aa, Mycobacterium
DSGIG

SEQ ID NO: 382832 - protein, 6 aa, Mycobacterium
DSLQDK

SEQ ID NO: 382833 - protein, 7 aa, Mycobacterium
DSTVPDA

SEQ ID NO: 382834 - protein, 6 aa, Mycobacterium
DSVSER

SEQ ID NO: 382835 - protein, 5 aa, Mycobacterium
DTDGK

SEQ ID NO: 382836 - protein, 7 aa, Mycobacterium
DTEPYRK

SEQ ID NO: 382837 - protein, 4 aa, Mycobacterium
DTGG

SEQ ID NO: 382838 - protein, 4 aa, Mycobacterium
DTGV

SEQ ID NO: 382839 - protein, 7 aa, Mycobacterium
DTIPGTA

SEQ ID NO: 382840 - protein, 9 aa, Mycobacterium
DTPHTRPVP

SEQ ID NO: 382841 - protein, 5 aa, Mycobacterium
DTVPK

SEQ ID NO: 382842 - protein, 5 aa, Mycobacterium
DTVTE

SEQ ID NO: 382843 - protein, 13 aa, Mycobacterium
DTYIEKDSSINDD

SEQ ID NO: 382844 - protein, 8 aa, Mycobacterium
DWGTETGA

SEQ ID NO: 382845 - protein, 8 aa, Mycobacterium
DYTREPGV

SEQ ID NO: 382846 - protein, 4 aa, Mycobacterium
EAAD

SEQ ID NO: 382847 - protein, 4 aa, Mycobacterium
EAAN

SEQ ID NO: 382848 - protein, 9 aa, Mycobacterium
EAGAGSGAL

SEQ ID NO: 382849 - protein, 6 aa, Mycobacterium
EAGPRV

SEQ ID NO: 382850 - protein, 12 aa, Mycobacterium
EALGSNGSTSMG

SEQ ID NO: 382851 - protein, 6 aa, Mycobacterium
EAPARA

SEQ ID NO: 382852 - protein, 8 aa, Mycobacterium
EAPTRANA

SEQ ID NO: 382853 - protein, 14 aa, Mycobacterium
EARWRDSAGEEHAA

SEQ ID NO: 382854 - protein, 4 aa, Mycobacterium
EDGP

SEQ ID NO: 382855 - protein, 5 aa, Mycobacterium
EDNPD

SEQ ID NO: 382856 - protein, 8 aa, Mycobacterium
EDQSRSAL

SEQ ID NO: 382857 - protein, 7 aa, Mycobacterium
EDRGGDR

SEQ ID NO: 382858 - protein, 4 aa, Mycobacterium
EDSP

SEQ ID NO: 382859 - protein, 9 aa, Mycobacterium
EDTGELTPT

SEQ ID NO: 382860 - protein, 15 aa, Mycobacterium
EEQGVPPEKLAGTIQ

SEQ ID NO: 382861 - protein, 7 aa, Mycobacterium
EESQKAT

SEQ ID NO: 382862 - protein, 8 aa, Mycobacterium
EEYGGSPV

SEQ ID NO: 382863 - protein, 4 aa, Mycobacterium
EGAA

SEQ ID NO: 382864 - protein, 4 aa, Mycobacterium
EGDR

SEQ ID NO: 382865 - protein, 6 aa, Mycobacterium
EGGERV

SEQ ID NO: 382866 - protein, 4 aa, Mycobacterium
EGKQ

SEQ ID NO: 382867 - protein, 9 aa, Mycobacterium
EGPKGGPGM

SEQ ID NO: 382868 - protein, 5 aa, Mycobacterium
EGTPE

SEQ ID NO: 382869 - protein, 8 aa, Mycobacterium
EGTSTITN

SEQ ID NO: 382870 - protein, 5 aa, Mycobacterium
EGTTV

SEQ ID NO: 382871 - protein, 6 aa, Mycobacterium
EGVEQS

SEQ ID NO: 382872 - protein, 5 aa, Mycobacterium
EGVTP

SEQ ID NO: 382873 - protein, 9 aa, Mycobacterium
EGYPTPTDQ

SEQ ID NO: 382874 - protein, 13 aa, Mycobacterium
EHDTTNDTSPIGT

SEQ ID NO: 382875 - protein, 7 aa, Mycobacterium
EHGNERV

SEQ ID NO: 382876 - protein, 4 aa, Mycobacterium
EIGA

SEQ ID NO: 382877 - protein, 4 aa, Mycobacterium
ELGP

SEQ ID NO: 382878 - protein, 5 aa, Mycobacterium
ELPPG

SEQ ID NO: 382879 - protein, 14 aa, Mycobacterium
ELRGPGKTRALAQS

SEQ ID NO: 382880 - protein, 6 aa, Mycobacterium
ENAGQC

SEQ ID NO: 382881 - protein, 4 aa, Mycobacterium
ENDR

SEQ ID NO: 382882 - protein, 7 aa, Mycobacterium
ENGVGTV

SEQ ID NO: 382883 - protein, 4 aa, Mycobacterium
EPAR

SEQ ID NO: 382884 - protein, 4 aa, Mycobacterium
EPAS

SEQ ID NO: 382885 - protein, 6 aa, Mycobacterium
EPCTDS

SEQ ID NO: 382886 - protein, 4 aa, Mycobacterium
EPDG

SEQ ID NO: 382887 - protein, 5 aa, Mycobacterium
EPDTG

SEQ ID NO: 382888 - protein, 4 aa, Mycobacterium
EPDY

SEQ ID NO: 382889 - protein, 5 aa, Mycobacterium
EPEHQ

SEQ ID NO: 382890 - protein, 4 aa, Mycobacterium
EPER

SEQ ID NO: 382891 - protein, 10 aa, Mycobacterium
EPGAGLDTSR

SEQ ID NO: 382892 - protein, 9 aa, Mycobacterium
EPGAGSDLA

SEQ ID NO: 382893 - protein, 4 aa, Mycobacterium
EPGD

SEQ ID NO: 382894 - protein, 8 aa, Mycobacterium
EPGETAGF

SEQ ID NO: 382895 - protein, 6 aa, Mycobacterium
EPGVGK

SEQ ID NO: 382896 - protein, 7 aa, Mycobacterium
EPGVGKT

SEQ ID NO: 382897 - protein, 5 aa, Mycobacterium
EPPVM

SEQ ID NO: 382898 - protein, 4 aa, Mycobacterium
EPTA

SEQ ID NO: 382899 - protein, 13 aa, Mycobacterium
EPTGNLDPDTSKD

SEQ ID NO: 382900 - protein, 6 aa, Mycobacterium
EPTSAL

SEQ ID NO: 382901 - protein, 6 aa, Mycobacterium
EPVDAA

SEQ ID NO: 382902 - protein, 4 aa, Mycobacterium
EQGL

SEQ ID NO: 382903 - protein, 4 aa, Mycobacterium
EQHR

SEQ ID NO: 382904 - protein, 5 aa, Mycobacterium
EQTSR

SEQ ID NO: 382905 - protein, 7 aa, Mycobacterium
ERASGFR

SEQ ID NO: 382906 - protein, 5 aa, Mycobacterium
EREPA

SEQ ID NO: 382907 - protein, 8 aa, Mycobacterium
ERGTTTTP

SEQ ID NO: 382908 - protein, 4 aa, Mycobacterium
ERPD

SEQ ID NO: 382909 - protein, 4 aa, Mycobacterium
ERPT

SEQ ID NO: 382910 - protein, 4 aa, Mycobacterium
ERRA

SEQ ID NO: 382911 - protein, 4 aa, Mycobacterium
ERSI

SEQ ID NO: 382912 - protein, 7 aa, Mycobacterium
ERTRPTV

SEQ ID NO: 382913 - protein, 4 aa, Mycobacterium
ERVE

SEQ ID NO: 382914 - protein, 7 aa, Mycobacterium
ERYPGDA

SEQ ID NO: 382915 - protein, 4 aa, Mycobacterium
ESGP

SEQ ID NO: 382916 - protein, 6 aa, Mycobacterium
ESGQLD

SEQ ID NO: 382917 - protein, 4 aa, Mycobacterium
ESLP

SEQ ID NO: 382918 - protein, 5 aa, Mycobacterium
ESPRP

SEQ ID NO: 382919 - protein, 4 aa, Mycobacterium
ESQE

SEQ ID NO: 382920 - protein, 9 aa, Mycobacterium
ESVNSSYKT

SEQ ID NO: 382921 - protein, 7 aa, Mycobacterium
ESVTEGT

SEQ ID NO: 382922 - protein, 4 aa, Mycobacterium
ETAA

SEQ ID NO: 382923 - protein, 4 aa, Mycobacterium
ETDG

SEQ ID NO: 382924 - protein, 4 aa, Mycobacterium
ETDQ

SEQ ID NO: 382925 - protein, 4 aa, Mycobacterium
ETGE

SEQ ID NO: 382926 - protein, 6 aa, Mycobacterium
ETPRGG

SEQ ID NO: 382927 - protein, 4 aa, Mycobacterium
ETSL

SEQ ID NO: 382928 - protein, 11 aa, Mycobacterium
ETTSDLGGYKD

SEQ ID NO: 382929 - protein, 4 aa, Mycobacterium
ETYD

SEQ ID NO: 382930 - protein, 9 aa, Mycobacterium
EVEEDRDED

SEQ ID NO: 382931 - protein, 5 aa, Mycobacterium
EVERQ

SEQ ID NO: 382932 - protein, 7 aa, Mycobacterium
EVGSGKT

SEQ ID NO: 382933 - protein, 4 aa, Mycobacterium
EVPT

SEQ ID NO: 382934 - protein, 8 aa, Mycobacterium
EYEVGNPA

SEQ ID NO: 382935 - protein, 10 aa, Mycobacterium
FAPASDTPGL

SEQ ID NO: 382936 - protein, 13 aa, Mycobacterium
FDDQGAKYDGDGN

SEQ ID NO: 382937 - protein, 5 aa, Mycobacterium
FDEDA

SEQ ID NO: 382938 - protein, 5 aa, Mycobacterium
FDPEA

SEQ ID NO: 382939 - protein, 8 aa, Mycobacterium
FDPQAKGL

SEQ ID NO: 382940 - protein, 4 aa, Mycobacterium
FDPR

SEQ ID NO: 382941 - protein, 8 aa, Mycobacterium
FGAEPNTQ

SEQ ID NO: 382942 - protein, 5 aa, Mycobacterium
FGDTP

SEQ ID NO: 382943 - protein, 10 aa, Mycobacterium
FGGEESAGAS

SEQ ID NO: 382944 - protein, 7 aa, Mycobacterium
FGRGSNR

SEQ ID NO: 382945 - protein, 10 aa, Mycobacterium
FGTAEESNRR

SEQ ID NO: 382946 - protein, 9 aa, Mycobacterium
FKDETETDL

SEQ ID NO: 382947 - protein, 17 aa, Mycobacterium
FKQTDADVGSFDGGYGS

SEQ ID NO: 382948 - protein, 5 aa, Mycobacterium
FRGTD

SEQ ID NO: 382949 - protein, 4 aa, Mycobacterium
FRSH

SEQ ID NO: 382950 - protein, 9 aa, Mycobacterium
FSGTSPDGH

SEQ ID NO: 382951 - protein, 18 aa, Mycobacterium
FSTGETGRVGSPKRREIG

SEQ ID NO: 382952 - protein, 11 aa, Mycobacterium
FTGQPGSTVPL

SEQ ID NO: 382953 - protein, 6 aa, Mycobacterium
FTPSGA

SEQ ID NO: 382954 - protein, 4 aa, Mycobacterium
GAAE

SEQ ID NO: 382955 - protein, 6 aa, Mycobacterium
GAAGQI

SEQ ID NO: 382956 - protein, 5 aa, Mycobacterium
GAAGV

SEQ ID NO: 382957 - protein, 10 aa, Mycobacterium
GAARGQGRSH

SEQ ID NO: 382958 - protein, 4 aa, Mycobacterium
GADT

SEQ ID NO: 382959 - protein, 5 aa, Mycobacterium
GADTP

SEQ ID NO: 382960 - protein, 9 aa, Mycobacterium
GAEPVEPAD

SEQ ID NO: 382961 - protein, 9 aa, Mycobacterium
GAGNETTGR

SEQ ID NO: 382962 - protein, 8 aa, Mycobacterium
GAGNETTT

SEQ ID NO: 382963 - protein, 4 aa, Mycobacterium
GAGP

SEQ ID NO: 382964 - protein, 7 aa, Mycobacterium
GAGSGIG

SEQ ID NO: 382965 - protein, 6 aa, Mycobacterium
GAKVSG

SEQ ID NO: 382966 - protein, 10 aa, Mycobacterium
GAMGGSASEE

SEQ ID NO: 382967 - protein, 9 aa, Mycobacterium
GANGAGKST

SEQ ID NO: 382968 - protein, 6 aa, Mycobacterium
GANQTM

SEQ ID NO: 382969 - protein, 4 aa, Mycobacterium
GARI

SEQ ID NO: 382970 - protein, 5 aa, Mycobacterium
GARIS

SEQ ID NO: 382971 - protein, 5 aa, Mycobacterium
GASEG

SEQ ID NO: 382972 - protein, 4 aa, Mycobacterium
GATA

SEQ ID NO: 382973 - protein, 8 aa, Mycobacterium
GATEQKDM

SEQ ID NO: 382974 - protein, 10 aa, Mycobacterium
GATGTGKTKT

SEQ ID NO: 382975 - protein, 4 aa, Mycobacterium
GATP

SEQ ID NO: 382976 - protein, 7 aa, Mycobacterium
GATTIGG

SEQ ID NO: 382977 - protein, 5 aa, Mycobacterium
GAYGD

SEQ ID NO: 382978 - protein, 8 aa, Mycobacterium
GDAARDAK

SEQ ID NO: 382979 - protein, 14 aa, Mycobacterium
GDANLSGHTYPDQS

SEQ ID NO: 382980 - protein, 6 aa, Mycobacterium
GDARRA

SEQ ID NO: 382981 - protein, 4 aa, Mycobacterium
GDAY

SEQ ID NO: 382982 - protein, 6 aa, Mycobacterium
GDDERR

SEQ ID NO: 382983 - protein, 6 aa, Mycobacterium
GDDPEA

SEQ ID NO: 382984 - protein, 8 aa, Mycobacterium
GDDVGTPT

SEQ ID NO: 382985 - protein, 6 aa, Mycobacterium
GDGTDA

SEQ ID NO: 382986 - protein, 6 aa, Mycobacterium
GDPTDA

SEQ ID NO: 382987 - protein, 4 aa, Mycobacterium
GDRG

SEQ ID NO: 382988 - protein, 4 aa, Mycobacterium
GDTA

SEQ ID NO: 382989 - protein, 4 aa, Mycobacterium
GDTG

SEQ ID NO: 382990 - protein, 6 aa, Mycobacterium
GDTQTA

SEQ ID NO: 382991 - protein, 6 aa, Mycobacterium
GDTTDD

SEQ ID NO: 382992 - protein, 5 aa, Mycobacterium
GDVEP

SEQ ID NO: 382993 - protein, 4 aa, Mycobacterium
GEAD

SEQ ID NO: 382994 - protein, 4 aa, Mycobacterium
GEDV

SEQ ID NO: 382995 - protein, 6 aa, Mycobacterium
GEEGEV

SEQ ID NO: 382996 - protein, 4 aa, Mycobacterium
GEGA

SEQ ID NO: 382997 - protein, 4 aa, Mycobacterium
GEGD

SEQ ID NO: 382998 - protein, 10 aa, Mycobacterium
GEGVAAKSLE

SEQ ID NO: 382999 - protein, 9 aa, Mycobacterium
GEKHGGVKP

SEQ ID NO: 383000 - protein, 4 aa, Mycobacterium
GEKL

SEQ ID NO: 383001 - protein, 8 aa, Mycobacterium
GEKMSKSL

SEQ ID NO: 383002 - protein, 5 aa, Mycobacterium
GENPR

SEQ ID NO: 383003 - protein, 4 aa, Mycobacterium
GENT

SEQ ID NO: 383004 - protein, 7 aa, Mycobacterium
GEPDPRH

SEQ ID NO: 383005 - protein, 4 aa, Mycobacterium
GEPF

SEQ ID NO: 383006 - protein, 7 aa, Mycobacterium
GEPGTGF

SEQ ID NO: 383007 - protein, 4 aa, Mycobacterium
GEPV

SEQ ID NO: 383008 - protein, 4 aa, Mycobacterium
GERV

SEQ ID NO: 383009 - protein, 6 aa, Mycobacterium
GESGYF

SEQ ID NO: 383010 - protein, 8 aa, Mycobacterium
GETAEQTA

SEQ ID NO: 383011 - protein, 11 aa, Mycobacterium
GETGSGKTTQL

SEQ ID NO: 383012 - protein, 4 aa, Mycobacterium
GEVR

SEQ ID NO: 383013 - protein, 6 aa, Mycobacterium
GEYSSY

SEQ ID NO: 383014 - protein, 5 aa, Mycobacterium
GFGGT

SEQ ID NO: 383015 - protein, 4 aa, Mycobacterium
GFPG

SEQ ID NO: 383016 - protein, 6 aa, Mycobacterium
GFTPRQ

SEQ ID NO: 383017 - protein, 4 aa, Mycobacterium
GGAD

SEQ ID NO: 383018 - protein, 5 aa, Mycobacterium
GGAHG

SEQ ID NO: 383019 - protein, 6 aa, Mycobacterium
GGARNA

SEQ ID NO: 383020 - protein, 14 aa, Mycobacterium
GGARRDEEKARAKE

SEQ ID NO: 383021 - protein, 9 aa, Mycobacterium
GGASGLGLA

SEQ ID NO: 383022 - protein, 14 aa, Mycobacterium
GGDKVPRKGGPGVT

SEQ ID NO: 383023 - protein, 6 aa, Mycobacterium
GGDRFT

SEQ ID NO: 383024 - protein, 7 aa, Mycobacterium
GGDSAME

SEQ ID NO: 383025 - protein, 9 aa, Mycobacterium
GGEAGGHCG

SEQ ID NO: 383026 - protein, 4 aa, Mycobacterium
GGEL

SEQ ID NO: 383027 - protein, 6 aa, Mycobacterium
GGEPCP

SEQ ID NO: 383028 - protein, 8 aa, Mycobacterium
GGGDSAAA

SEQ ID NO: 383029 - protein, 10 aa, Mycobacterium
GGGEGGHNGL

SEQ ID NO: 383030 - protein, 7 aa, Mycobacterium
GGGERKT

SEQ ID NO: 383031 - protein, 4 aa, Mycobacterium
GGGG

SEQ ID NO: 383032 - protein, 5 aa, Mycobacterium
GGGLA

SEQ ID NO: 383033 - protein, 6 aa, Mycobacterium
GGGPGY

SEQ ID NO: 383034 - protein, 6 aa, Mycobacterium
GGGQVT

SEQ ID NO: 383035 - protein, 4 aa, Mycobacterium
GGGR

SEQ ID NO: 383036 - protein, 6 aa, Mycobacterium
GGGSNA

SEQ ID NO: 383037 - protein, 9 aa, Mycobacterium
GGGSPRDTL

SEQ ID NO: 383038 - protein, 5 aa, Mycobacterium
GGGSS

SEQ ID NO: 383039 - protein, 8 aa, Mycobacterium
GGGTAGHV

SEQ ID NO: 383040 - protein, 4 aa, Mycobacterium
GGHA

SEQ ID NO: 383041 - protein, 8 aa, Mycobacterium
GGHPVGAS

SEQ ID NO: 383042 - protein, 12 aa, Mycobacterium
GGHTRDHGKAPV

SEQ ID NO: 383043 - protein, 6 aa, Mycobacterium
GGIGEK

SEQ ID NO: 383044 - protein, 5 aa, Mycobacterium
GGLDS

SEQ ID NO: 383045 - protein, 8 aa, Mycobacterium
GGLNPAGL

SEQ ID NO: 383046 - protein, 5 aa, Mycobacterium
GGLPS

SEQ ID NO: 383047 - protein, 4 aa, Mycobacterium
GGPP

SEQ ID NO: 383048 - protein, 5 aa, Mycobacterium
GGPQI

SEQ ID NO: 383049 - protein, 6 aa, Mycobacterium
GGQPVD

SEQ ID NO: 383050 - protein, 6 aa, Mycobacterium
GGQTAL

SEQ ID NO: 383051 - protein, 6 aa, Mycobacterium
GGRGSG

SEQ ID NO: 383052 - protein, 7 aa, Mycobacterium
GGRPPYG

SEQ ID NO: 383053 - protein, 4 aa, Mycobacterium
GGRV

SEQ ID NO: 383054 - protein, 6 aa, Mycobacterium
GGSARL

SEQ ID NO: 383055 - protein, 5 aa, Mycobacterium
GGSLE

SEQ ID NO: 383056 - protein, 5 aa, Mycobacterium
GGSPL

SEQ ID NO: 383057 - protein, 4 aa, Mycobacterium
GGTA

SEQ ID NO: 383058 - protein, 6 aa, Mycobacterium
GGTGDW

SEQ ID NO: 383059 - protein, 7 aa, Mycobacterium
GGTNEVQ

SEQ ID NO: 383060 - protein, 5 aa, Mycobacterium
GGVAG

SEQ ID NO: 383061 - protein, 10 aa, Mycobacterium
GGVDDRDRNA

SEQ ID NO: 383062 - protein, 7 aa, Mycobacterium
GGYGGDS

SEQ ID NO: 383063 - protein, 4 aa, Mycobacterium
GHDQ

SEQ ID NO: 383064 - protein, 6 aa, Mycobacterium
GHEPDN

SEQ ID NO: 383065 - protein, 7 aa, Mycobacterium
GHGGGAS

SEQ ID NO: 383066 - protein, 13 aa, Mycobacterium
GHPPYGHNGERAL

SEQ ID NO: 383067 - protein, 7 aa, Mycobacterium
GIATPAD

SEQ ID NO: 383068 - protein, 12 aa, Mycobacterium
GIEPSEVTPEKS

SEQ ID NO: 383069 - protein, 9 aa, Mycobacterium
GIGTPERAA

SEQ ID NO: 383070 - protein, 6 aa, Mycobacterium
GISRKA

SEQ ID NO: 383071 - protein, 11 aa, Mycobacterium
GKEGVEPQSEQ

SEQ ID NO: 383072 - protein, 9 aa, Mycobacterium
GKGPGATSI

SEQ ID NO: 383073 - protein, 8 aa, Mycobacterium
GKLSDPRP

SEQ ID NO: 383074 - protein, 4 aa, Mycobacterium
GKPE

SEQ ID NO: 383075 - protein, 6 aa, Mycobacterium
GKPHAR

SEQ ID NO: 383076 - protein, 6 aa, Mycobacterium
GKTQAK

SEQ ID NO: 383077 - protein, 10 aa, Mycobacterium
GKYPPPPGAS

SEQ ID NO: 383078 - protein, 4 aa, Mycobacterium
GLEP

SEQ ID NO: 383079 - protein, 5 aa, Mycobacterium
GLGSP

SEQ ID NO: 383080 - protein, 11 aa, Mycobacterium
GLNPTGSFKDR

SEQ ID NO: 383081 - protein, 5 aa, Mycobacterium
GLPAT

SEQ ID NO: 383082 - protein, 10 aa, Mycobacterium
GLPDRKDVKD

SEQ ID NO: 383083 - protein, 8 aa, Mycobacterium
GLRKPSAD

SEQ ID NO: 383084 - protein, 15 aa, Mycobacterium
GLRPGSIADANDAAQ

SEQ ID NO: 383085 - protein, 9 aa, Mycobacterium
GLRRGDAVT

SEQ ID NO: 383086 - protein, 7 aa, Mycobacterium
GLTPEGE

SEQ ID NO: 383087 - protein, 7 aa, Mycobacterium
GMGGSQR

SEQ ID NO: 383088 - protein, 5 aa, Mycobacterium
GNNNF

SEQ ID NO: 383089 - protein, 12 aa, Mycobacterium
GNTHESSTGYKT

SEQ ID NO: 383090 - protein, 8 aa, Mycobacterium
GPAIAGGT

SEQ ID NO: 383091 - protein, 4 aa, Mycobacterium
GPAM

SEQ ID NO: 383092 - protein, 7 aa, Mycobacterium
GPAPLGG

SEQ ID NO: 383093 - protein, 5 aa, Mycobacterium
GPDVN

SEQ ID NO: 383094 - protein, 8 aa, Mycobacterium
GPGALPSD

SEQ ID NO: 383095 - protein, 9 aa, Mycobacterium
GPLHGGAPA

SEQ ID NO: 383096 - protein, 10 aa, Mycobacterium
GPNGAGKTTT

SEQ ID NO: 383097 - protein, 11 aa, Mycobacterium
GPNGSGKSTLS

SEQ ID NO: 383098 - protein, 6 aa, Mycobacterium
GPQAED

SEQ ID NO: 383099 - protein, 4 aa, Mycobacterium
GPRE

SEQ ID NO: 383100 - protein, 5 aa, Mycobacterium
GPRKM

SEQ ID NO: 383101 - protein, 6 aa, Mycobacterium
GPSGNY

SEQ ID NO: 383102 - protein, 6 aa, Mycobacterium
GPTEAT

SEQ ID NO: 383103 - protein, 6 aa, Mycobacterium
GPTGAT

SEQ ID NO: 383104 - protein, 4 aa, Mycobacterium
GPTL

SEQ ID NO: 383105 - protein, 12 aa, Mycobacterium
GQAAYSASKGGV

SEQ ID NO: 383106 - protein, 7 aa, Mycobacterium
GQGGEDM

SEQ ID NO: 383107 - protein, 7 aa, Mycobacterium
GQIAGDS

SEQ ID NO: 383108 - protein, 6 aa, Mycobacterium
GQTPLG

SEQ ID NO: 383109 - protein, 7 aa, Mycobacterium
GQYPPSD

SEQ ID NO: 383110 - protein, 8 aa, Mycobacterium
GRGEPADA

SEQ ID NO: 383111 - protein, 4 aa, Mycobacterium
GRGL

SEQ ID NO: 383112 - protein, 4 aa, Mycobacterium
GRHN

SEQ ID NO: 383113 - protein, 7 aa, Mycobacterium
GRPAEAD

SEQ ID NO: 383114 - protein, 5 aa, Mycobacterium
GRPEE

SEQ ID NO: 383115 - protein, 4 aa, Mycobacterium
GRPG

SEQ ID NO: 383116 - protein, 4 aa, Mycobacterium
GRPL

SEQ ID NO: 383117 - protein, 5 aa, Mycobacterium
GRPPR

SEQ ID NO: 383118 - protein, 7 aa, Mycobacterium
GRPSTYS

SEQ ID NO: 383119 - protein, 4 aa, Mycobacterium
GRRA

SEQ ID NO: 383120 - protein, 7 aa, Mycobacterium
GRRPGAR

SEQ ID NO: 383121 - protein, 4 aa, Mycobacterium
GRRT

SEQ ID NO: 383122 - protein, 7 aa, Mycobacterium
GRTEETF

SEQ ID NO: 383123 - protein, 7 aa, Mycobacterium
GRVQEPT

SEQ ID NO: 383124 - protein, 4 aa, Mycobacterium
GSAG

SEQ ID NO: 383125 - protein, 6 aa, Mycobacterium
GSAGAK

SEQ ID NO: 383126 - protein, 7 aa, Mycobacterium
GSAGNSF

SEQ ID NO: 383127 - protein, 7 aa, Mycobacterium
GSCSTND

SEQ ID NO: 383128 - protein, 4 aa, Mycobacterium
GSDA

SEQ ID NO: 383129 - protein, 8 aa, Mycobacterium
GSEKSPGF

SEQ ID NO: 383130 - protein, 12 aa, Mycobacterium
GSGARPGTSPKV

SEQ ID NO: 383131 - protein, 8 aa, Mycobacterium
GSGEKRTL

SEQ ID NO: 383132 - protein, 9 aa, Mycobacterium
GSGKSTIGR

SEQ ID NO: 383133 - protein, 5 aa, Mycobacterium
GSGRT

SEQ ID NO: 383134 - protein, 4 aa, Mycobacterium
GSID

SEQ ID NO: 383135 - protein, 7 aa, Mycobacterium
GSKEARI

SEQ ID NO: 383136 - protein, 4 aa, Mycobacterium
GSLR

SEQ ID NO: 383137 - protein, 5 aa, Mycobacterium
GSLTG

SEQ ID NO: 383138 - protein, 6 aa, Mycobacterium
GSMAAR

SEQ ID NO: 383139 - protein, 4 aa, Mycobacterium
GSPE

SEQ ID NO: 383140 - protein, 4 aa, Mycobacterium
GSPL

SEQ ID NO: 383141 - protein, 4 aa, Mycobacterium
GSPV

SEQ ID NO: 383142 - protein, 6 aa, Mycobacterium
GSRGLG

SEQ ID NO: 383143 - protein, 6 aa, Mycobacterium
GSRNAP

SEQ ID NO: 383144 - protein, 7 aa, Mycobacterium
GSRQGLA

SEQ ID NO: 383145 - protein, 6 aa, Mycobacterium
GSSYNT

SEQ ID NO: 383146 - protein, 5 aa, Mycobacterium
GSTAV

SEQ ID NO: 383147 - protein, 6 aa, Mycobacterium
GSTDFT

SEQ ID NO: 383148 - protein, 9 aa, Mycobacterium
GTAGEAPDH

SEQ ID NO: 383149 - protein, 5 aa, Mycobacterium
GTDAA

SEQ ID NO: 383150 - protein, 6 aa, Mycobacterium
GTEANE

SEQ ID NO: 383151 - protein, 5 aa, Mycobacterium
GTEIG

SEQ ID NO: 383152 - protein, 26 aa, Mycobacterium
GTGNFGIGNSGDYNTGIGNAGATNTG

SEQ ID NO: 383153 - protein, 10 aa, Mycobacterium
GTIAGGTSEI

SEQ ID NO: 383154 - protein, 4 aa, Mycobacterium
GTID

SEQ ID NO: 383155 - protein, 8 aa, Mycobacterium
GTITGEHG

SEQ ID NO: 383156 - protein, 8 aa, Mycobacterium
GTKGKRYA

SEQ ID NO: 383157 - protein, 7 aa, Mycobacterium
GTPPPTW

SEQ ID NO: 383158 - protein, 6 aa, Mycobacterium
GTSEIQ

SEQ ID NO: 383159 - protein, 10 aa, Mycobacterium
GTSNDEIQAA

SEQ ID NO: 383160 - protein, 7 aa, Mycobacterium
GTTGRPK

SEQ ID NO: 383161 - protein, 6 aa, Mycobacterium
GVEEAR

SEQ ID NO: 383162 - protein, 6 aa, Mycobacterium
GVGKST

SEQ ID NO: 383163 - protein, 4 aa, Mycobacterium
GVMP

SEQ ID NO: 383164 - protein, 9 aa, Mycobacterium
GVRRTRSKF

SEQ ID NO: 383165 - protein, 4 aa, Mycobacterium
GVSG

SEQ ID NO: 383166 - protein, 4 aa, Mycobacterium
GVTG

SEQ ID NO: 383167 - protein, 5 aa, Mycobacterium
GVTPP

SEQ ID NO: 383168 - protein, 8 aa, Mycobacterium
GVTSGASV

SEQ ID NO: 383169 - protein, 6 aa, Mycobacterium
GVTSGR

SEQ ID NO: 383170 - protein, 4 aa, Mycobacterium
GVVP

SEQ ID NO: 383171 - protein, 4 aa, Mycobacterium
GWAP

SEQ ID NO: 383172 - protein, 5 aa, Mycobacterium
GYPRR

SEQ ID NO: 383173 - protein, 5 aa, Mycobacterium
GYSES

SEQ ID NO: 383174 - protein, 6 aa, Mycobacterium
GYTSSL

SEQ ID NO: 383175 - protein, 5 aa, Mycobacterium
GYTYG

SEQ ID NO: 383176 - protein, 5 aa, Mycobacterium
GYVGE

SEQ ID NO: 383177 - protein, 5 aa, Mycobacterium
HAKGE

SEQ ID NO: 383178 - protein, 6 aa, Mycobacterium
HAPHAE

SEQ ID NO: 383179 - protein, 6 aa, Mycobacterium
HAPKTV

SEQ ID NO: 383180 - protein, 5 aa, Mycobacterium
HATEY

SEQ ID NO: 383181 - protein, 11 aa, Mycobacterium
HDGGTGATPLT

SEQ ID NO: 383182 - protein, 4 aa, Mycobacterium
HDHD

SEQ ID NO: 383183 - protein, 5 aa, Mycobacterium
HDQYN

SEQ ID NO: 383184 - protein, 8 aa, Mycobacterium
HDTPGGQL

SEQ ID NO: 383185 - protein, 15 aa, Mycobacterium
HDTSTLANDPNETEL

SEQ ID NO: 383186 - protein, 5 aa, Mycobacterium
HGMNA

SEQ ID NO: 383187 - protein, 18 aa, Mycobacterium
HGRGRGRGGNRNRRHGSG

SEQ ID NO: 383188 - protein, 8 aa, Mycobacterium
HGSVSTIG

SEQ ID NO: 383189 - protein, 4 aa, Mycobacterium
HGTR

SEQ ID NO: 383190 - protein, 5 aa, Mycobacterium
HKPGA

SEQ ID NO: 383191 - protein, 7 aa, Mycobacterium
HLPTSSD

SEQ ID NO: 383192 - protein, 7 aa, Mycobacterium
HNHPESE

SEQ ID NO: 383193 - protein, 4 aa, Mycobacterium
HPDG

SEQ ID NO: 383194 - protein, 9 aa, Mycobacterium
HPDRSEGDL

SEQ ID NO: 383195 - protein, 4 aa, Mycobacterium
HPEL

SEQ ID NO: 383196 - protein, 7 aa, Mycobacterium
HPEPELA

SEQ ID NO: 383197 - protein, 6 aa, Mycobacterium
HPSETV

SEQ ID NO: 383198 - protein, 5 aa, Mycobacterium
HPTNV

SEQ ID NO: 383199 - protein, 5 aa, Mycobacterium
HPYEE

SEQ ID NO: 383200 - protein, 5 aa, Mycobacterium
HQGKR

SEQ ID NO: 383201 - protein, 5 aa, Mycobacterium
HSTPG

SEQ ID NO: 383202 - protein, 6 aa, Mycobacterium
HTKGPK

SEQ ID NO: 383203 - protein, 6 aa, Mycobacterium
HTPGRT

SEQ ID NO: 383204 - protein, 8 aa, Mycobacterium
HTSSGTSA

SEQ ID NO: 383205 - protein, 5 aa, Mycobacterium
IDASA

SEQ ID NO: 383206 - protein, 4 aa, Mycobacterium
IDGT

SEQ ID NO: 383207 - protein, 4 aa, Mycobacterium
IDPD

SEQ ID NO: 383208 - protein, 6 aa, Mycobacterium
IGPGPH

SEQ ID NO: 383209 - protein, 9 aa, Mycobacterium
IKTTDADIE

SEQ ID NO: 383210 - protein, 4 aa, Mycobacterium
IPAG

SEQ ID NO: 383211 - protein, 6 aa, Mycobacterium
IPGNEE

SEQ ID NO: 383212 - protein, 8 aa, Mycobacterium
IPKTNPEL

SEQ ID NO: 383213 - protein, 9 aa, Mycobacterium
IPRGEEAGK

SEQ ID NO: 383214 - protein, 4 aa, Mycobacterium
IPTA

SEQ ID NO: 383215 - protein, 9 aa, Mycobacterium
IQGEGGDRH

SEQ ID NO: 383216 - protein, 13 aa, Mycobacterium
IRAQGGVSRMSDP

SEQ ID NO: 383217 - protein, 4 aa, Mycobacterium
IREG

SEQ ID NO: 383218 - protein, 4 aa, Mycobacterium
IRRR

SEQ ID NO: 383219 - protein, 17 aa, Mycobacterium
IRRTRAGLKDPKRPSGS

SEQ ID NO: 383220 - protein, 5 aa, Mycobacterium
ISREG

SEQ ID NO: 383221 - protein, 5 aa, Mycobacterium
ISSGE

SEQ ID NO: 383222 - protein, 8 aa, Mycobacterium
ITPTGGHL

SEQ ID NO: 383223 - protein, 7 aa, Mycobacterium
KAALKDS

SEQ ID NO: 383224 - protein, 13 aa, Mycobacterium
KADPEKVNPNGGA

SEQ ID NO: 383225 - protein, 6 aa, Mycobacterium
KAEFDG

SEQ ID NO: 383226 - protein, 5 aa, Mycobacterium
KALGH

SEQ ID NO: 383227 - protein, 7 aa, Mycobacterium
KASAGEC

SEQ ID NO: 383228 - protein, 12 aa, Mycobacterium
KAYGGQGLPDGT

SEQ ID NO: 383229 - protein, 12 aa, Mycobacterium
KDKGTGKENTIK

SEQ ID NO: 383230 - protein, 9 aa, Mycobacterium
KDNTAGTDE

SEQ ID NO: 383231 - protein, 4 aa, Mycobacterium
KDPR

SEQ ID NO: 383232 - protein, 9 aa, Mycobacterium
KDVIKSGGE

SEQ ID NO: 383233 - protein, 6 aa, Mycobacterium
KEAPDR

SEQ ID NO: 383234 - protein, 10 aa, Mycobacterium
KGAHGSRSSV

SEQ ID NO: 383235 - protein, 8 aa, Mycobacterium
KGAPMPAP

SEQ ID NO: 383236 - protein, 8 aa, Mycobacterium
KGGDYLAD

SEQ ID NO: 383237 - protein, 4 aa, Mycobacterium
KGHP

SEQ ID NO: 383238 - protein, 7 aa, Mycobacterium
KGKLTAR

SEQ ID NO: 383239 - protein, 7 aa, Mycobacterium
KGPMGTA

SEQ ID NO: 383240 - protein, 7 aa, Mycobacterium
KGSLGGN

SEQ ID NO: 383241 - protein, 8 aa, Mycobacterium
KGTGNAEL

SEQ ID NO: 383242 - protein, 7 aa, Mycobacterium
KGTMTAA

SEQ ID NO: 383243 - protein, 13 aa, Mycobacterium
KHPRGAFTDDPAK

SEQ ID NO: 383244 - protein, 5 aa, Mycobacterium
KIAES

SEQ ID NO: 383245 - protein, 9 aa, Mycobacterium
KKQTGGSGQ

SEQ ID NO: 383246 - protein, 5 aa, Mycobacterium
KKSLA

SEQ ID NO: 383247 - protein, 8 aa, Mycobacterium
KLASGDVN

SEQ ID NO: 383248 - protein, 5 aa, Mycobacterium
KNRNN

SEQ ID NO: 383249 - protein, 8 aa, Mycobacterium
KNRRNDPD

SEQ ID NO: 383250 - protein, 7 aa, Mycobacterium
KPTKGQI

SEQ ID NO: 383251 - protein, 7 aa, Mycobacterium
KPTYGTV

SEQ ID NO: 383252 - protein, 6 aa, Mycobacterium
KQAEAY

SEQ ID NO: 383253 - protein, 7 aa, Mycobacterium
KQSESNA

SEQ ID NO: 383254 - protein, 4 aa, Mycobacterium
KRGR

SEQ ID NO: 383255 - protein, 12 aa, Mycobacterium
KRGTDSRSLATE

SEQ ID NO: 383256 - protein, 4 aa, Mycobacterium
KRQP

SEQ ID NO: 383257 - protein, 5 aa, Mycobacterium
KRRDE

SEQ ID NO: 383258 - protein, 5 aa, Mycobacterium
KRSED

SEQ ID NO: 383259 - protein, 7 aa, Mycobacterium
KRTRGGK

SEQ ID NO: 383260 - protein, 6 aa, Mycobacterium
KSFGSS

SEQ ID NO: 383261 - protein, 9 aa, Mycobacterium
KSGEGGEES

SEQ ID NO: 383262 - protein, 5 aa, Mycobacterium
KSGTV

SEQ ID NO: 383263 - protein, 11 aa, Mycobacterium
KSHPADDGGKA

SEQ ID NO: 383264 - protein, 8 aa, Mycobacterium
KSMSTGGV

SEQ ID NO: 383265 - protein, 6 aa, Mycobacterium
KSQVGA

SEQ ID NO: 383266 - protein, 4 aa, Mycobacterium
KSYR

SEQ ID NO: 383267 - protein, 5 aa, Mycobacterium
KTKNN

SEQ ID NO: 383268 - protein, 6 aa, Mycobacterium
KTWSTS

SEQ ID NO: 383269 - protein, 6 aa, Mycobacterium
KTYNAG

SEQ ID NO: 383270 - protein, 5 aa, Mycobacterium
KVGNE

SEQ ID NO: 383271 - protein, 7 aa, Mycobacterium
KVPGSAM

SEQ ID NO: 383272 - protein, 4 aa, Mycobacterium
KYRD

SEQ ID NO: 383273 - protein, 9 aa, Mycobacterium
KYSSPQTDF

SEQ ID NO: 383274 - protein, 4 aa, Mycobacterium
LAAG

SEQ ID NO: 383275 - protein, 8 aa, Mycobacterium
LAAGASTA

SEQ ID NO: 383276 - protein, 7 aa, Mycobacterium
LADEGIG

SEQ ID NO: 383277 - protein, 6 aa, Mycobacterium
LAETST

SEQ ID NO: 383278 - protein, 4 aa, Mycobacterium
LAGA

SEQ ID NO: 383279 - protein, 6 aa, Mycobacterium
LAKTKP

SEQ ID NO: 383280 - protein, 5 aa, Mycobacterium
LAREG

SEQ ID NO: 383281 - protein, 5 aa, Mycobacterium
LASAS

SEQ ID NO: 383282 - protein, 4 aa, Mycobacterium
LATG

SEQ ID NO: 383283 - protein, 7 aa, Mycobacterium
LDGPGDV

SEQ ID NO: 383284 - protein, 5 aa, Mycobacterium
LDNPA

SEQ ID NO: 383285 - protein, 4 aa, Mycobacterium
LDPD

SEQ ID NO: 383286 - protein, 5 aa, Mycobacterium
LDPEY

SEQ ID NO: 383287 - protein, 6 aa, Mycobacterium
LEAGAD

SEQ ID NO: 383288 - protein, 5 aa, Mycobacterium
LEDGT

SEQ ID NO: 383289 - protein, 8 aa, Mycobacterium
LEDRGVDT

SEQ ID NO: 383290 - protein, 9 aa, Mycobacterium
LENPGPDDM

SEQ ID NO: 383291 - protein, 4 aa, Mycobacterium
LEPA

SEQ ID NO: 383292 - protein, 4 aa, Mycobacterium
LGER

SEQ ID NO: 383293 - protein, 5 aa, Mycobacterium
LGGPR

SEQ ID NO: 383294 - protein, 8 aa, Mycobacterium
LGGRAGYY

SEQ ID NO: 383295 - protein, 8 aa, Mycobacterium
LGNTPQRV

SEQ ID NO: 383296 - protein, 8 aa, Mycobacterium
LGPGDPEL

SEQ ID NO: 383297 - protein, 7 aa, Mycobacterium
LGTDGRQ

SEQ ID NO: 383298 - protein, 7 aa, Mycobacterium
LGTPPAD

SEQ ID NO: 383299 - protein, 15 aa, Mycobacterium
LKDDELGRGGFTGRT

SEQ ID NO: 383300 - protein, 7 aa, Mycobacterium
LKESHPH

SEQ ID NO: 383301 - protein, 5 aa, Mycobacterium
LKPES

SEQ ID NO: 383302 - protein, 8 aa, Mycobacterium
LKRGGTNL

SEQ ID NO: 383303 - protein, 10 aa, Mycobacterium
LNPGGSSKDR

SEQ ID NO: 383304 - protein, 11 aa, Mycobacterium
LNVNGSSLAAG

SEQ ID NO: 383305 - protein, 4 aa, Mycobacterium
LPAD

SEQ ID NO: 383306 - protein, 11 aa, Mycobacterium
LPGSESEKMGP

SEQ ID NO: 383307 - protein, 4 aa, Mycobacterium
LPGT

SEQ ID NO: 383308 - protein, 9 aa, Mycobacterium
LPHGTGKTA

SEQ ID NO: 383309 - protein, 6 aa, Mycobacterium
LPRKSD

SEQ ID NO: 383310 - protein, 4 aa, Mycobacterium
LPTV

SEQ ID NO: 383311 - protein, 8 aa, Mycobacterium
LQDPPSDD

SEQ ID NO: 383312 - protein, 6 aa, Mycobacterium
LQYSGD

SEQ ID NO: 383313 - protein, 4 aa, Mycobacterium
LRDD

SEQ ID NO: 383314 - protein, 8 aa, Mycobacterium
LSDNETVD

SEQ ID NO: 383315 - protein, 7 aa, Mycobacterium
LSGGERQ

SEQ ID NO: 383316 - protein, 4 aa, Mycobacterium
LSPG

SEQ ID NO: 383317 - protein, 7 aa, Mycobacterium
LSQDEGV

SEQ ID NO: 383318 - protein, 8 aa, Mycobacterium
LTAGGDDY

SEQ ID NO: 383319 - protein, 9 aa, Mycobacterium
LTDGTELTP

SEQ ID NO: 383320 - protein, 6 aa, Mycobacterium
LTETSA

SEQ ID NO: 383321 - protein, 5 aa, Mycobacterium
LTGEV

SEQ ID NO: 383322 - protein, 15 aa, Mycobacterium
LTGGKEPNKGVNPDE

SEQ ID NO: 383323 - protein, 5 aa, Mycobacterium
LTPEE

SEQ ID NO: 383324 - protein, 5 aa, Mycobacterium
LTPER

SEQ ID NO: 383325 - protein, 7 aa, Mycobacterium
LTSTSSV

SEQ ID NO: 383326 - protein, 4 aa, Mycobacterium
LVDG

SEQ ID NO: 383327 - protein, 8 aa, Mycobacterium
MADARGTT

SEQ ID NO: 383328 - protein, 6 aa, Mycobacterium
MADDNR

SEQ ID NO: 383329 - protein, 7 aa, Mycobacterium
MDSPDFA

SEQ ID NO: 383330 - protein, 7 aa, Mycobacterium
MEEDTGK

SEQ ID NO: 383331 - protein, 8 aa, Mycobacterium
MKANEAKR

SEQ ID NO: 383332 - protein, 7 aa, Mycobacterium
MPGPTGL

SEQ ID NO: 383333 - protein, 13 aa, Mycobacterium
MPNPKTGTVTPDV

SEQ ID NO: 383334 - protein, 7 aa, Mycobacterium
MRGATAP

SEQ ID NO: 383335 - protein, 5 aa, Mycobacterium
MRGPS

SEQ ID NO: 383336 - protein, 7 aa, Mycobacterium
MRTAGDD

SEQ ID NO: 383337 - protein, 14 aa, Mycobacterium
NAERATDWRGNNNI

SEQ ID NO: 383338 - protein, 6 aa, Mycobacterium
NAPLAV

SEQ ID NO: 383339 - protein, 4 aa, Mycobacterium
NARW

SEQ ID NO: 383340 - protein, 4 aa, Mycobacterium
NASA

SEQ ID NO: 383341 - protein, 5 aa, Mycobacterium
NAVYP

SEQ ID NO: 383342 - protein, 7 aa, Mycobacterium
NCSTGST

SEQ ID NO: 383343 - protein, 4 aa, Mycobacterium
NDDP

SEQ ID NO: 383344 - protein, 7 aa, Mycobacterium
NDNPKPY

SEQ ID NO: 383345 - protein, 4 aa, Mycobacterium
NDPD

SEQ ID NO: 383346 - protein, 28 aa, Mycobacterium
NDRREEGDLRENGGYHAAREEQGQQEAR

SEQ ID NO: 383347 - protein, 14 aa, Mycobacterium
NELNAGYAADGYGR

SEQ ID NO: 383348 - protein, 10 aa, Mycobacterium
NERSQLQNKA

SEQ ID NO: 383349 - protein, 7 aa, Mycobacterium
NGGKSSW

SEQ ID NO: 383350 - protein, 9 aa, Mycobacterium
NGPGDPATA

SEQ ID NO: 383351 - protein, 8 aa, Mycobacterium
NHHSAGSF

SEQ ID NO: 383352 - protein, 6 aa, Mycobacterium
NHYPQD

SEQ ID NO: 383353 - protein, 7 aa, Mycobacterium
NIATNAG

SEQ ID NO: 383354 - protein, 10 aa, Mycobacterium
NIEDQSSDRV

SEQ ID NO: 383355 - protein, 13 aa, Mycobacterium
NIGNSAVTSSIAE

SEQ ID NO: 383356 - protein, 9 aa, Mycobacterium
NLGDAAGTY

SEQ ID NO: 383357 - protein, 8 aa, Mycobacterium
NLPPEGLE

SEQ ID NO: 383358 - protein, 4 aa, Mycobacterium
NLPS

SEQ ID NO: 383359 - protein, 10 aa, Mycobacterium
NMGHTQAAAG

SEQ ID NO: 383360 - protein, 8 aa, Mycobacterium
NNPQERLN

SEQ ID NO: 383361 - protein, 7 aa, Mycobacterium
NNRETGE

SEQ ID NO: 383362 - protein, 5 aa, Mycobacterium
NPDAV

SEQ ID NO: 383363 - protein, 4 aa, Mycobacterium
NPDR

SEQ ID NO: 383364 - protein, 4 aa, Mycobacterium
NPGN

SEQ ID NO: 383365 - protein, 6 aa, Mycobacterium
NPGTSE

SEQ ID NO: 383366 - protein, 8 aa, Mycobacterium
NPSGTRKD

SEQ ID NO: 383367 - protein, 7 aa, Mycobacterium
NPSRSLQ

SEQ ID NO: 383368 - protein, 7 aa, Mycobacterium
NRAPAKV

SEQ ID NO: 383369 - protein, 13 aa, Mycobacterium
NRGPEQRTDKKPM

SEQ ID NO: 383370 - protein, 16 aa, Mycobacterium
NRYAPPPPYPSPDPFE

SEQ ID NO: 383371 - protein, 9 aa, Mycobacterium
NSESAEKAA

SEQ ID NO: 383372 - protein, 7 aa, Mycobacterium
NSRVRAE

SEQ ID NO: 383373 - protein, 8 aa, Mycobacterium
NSTAGGAY

SEQ ID NO: 383374 - protein, 13 aa, Mycobacterium
NSTNGTTVNNAPV

SEQ ID NO: 383375 - protein, 7 aa, Mycobacterium
NTAGGDH

SEQ ID NO: 383376 - protein, 7 aa, Mycobacterium
NVADNGD

SEQ ID NO: 383377 - protein, 8 aa, Mycobacterium
NVGKPQVA

SEQ ID NO: 383378 - protein, 6 aa, Mycobacterium
NWRDDA

SEQ ID NO: 383379 - protein, 4 aa, Mycobacterium
PAAT

SEQ ID NO: 383380 - protein, 8 aa, Mycobacterium
PADARDYG

SEQ ID NO: 383381 - protein, 4 aa, Mycobacterium
PADR

SEQ ID NO: 383382 - protein, 9 aa, Mycobacterium
PAEAPTTRG

SEQ ID NO: 383383 - protein, 5 aa, Mycobacterium
PAGAY

SEQ ID NO: 383384 - protein, 4 aa, Mycobacterium
PAGG

SEQ ID NO: 383385 - protein, 4 aa, Mycobacterium
PAGR

SEQ ID NO: 383386 - protein, 7 aa, Mycobacterium
PAGSRMY

SEQ ID NO: 383387 - protein, 5 aa, Mycobacterium
PAGYE

SEQ ID NO: 383388 - protein, 5 aa, Mycobacterium
PALAA

SEQ ID NO: 383389 - protein, 5 aa, Mycobacterium
PALIG

SEQ ID NO: 383390 - protein, 7 aa, Mycobacterium
PAPDTAR

SEQ ID NO: 383391 - protein, 8 aa, Mycobacterium
PAPGGRRE

SEQ ID NO: 383392 - protein, 4 aa, Mycobacterium
PATA

SEQ ID NO: 383393 - protein, 4 aa, Mycobacterium
PATG

SEQ ID NO: 383394 - protein, 4 aa, Mycobacterium
PATH

SEQ ID NO: 383395 - protein, 4 aa, Mycobacterium
PAVT

SEQ ID NO: 383396 - protein, 8 aa, Mycobacterium
PDAGGPRD

SEQ ID NO: 383397 - protein, 4 aa, Mycobacterium
PDDI

SEQ ID NO: 383398 - protein, 7 aa, Mycobacterium
PDEKGAT

SEQ ID NO: 383399 - protein, 7 aa, Mycobacterium
PDENHEG

SEQ ID NO: 383400 - protein, 4 aa, Mycobacterium
PDGA

SEQ ID NO: 383401 - protein, 4 aa, Mycobacterium
PDGG

SEQ ID NO: 383402 - protein, 5 aa, Mycobacterium
PDGMD

SEQ ID NO: 383403 - protein, 5 aa, Mycobacterium
PDHTR

SEQ ID NO: 383404 - protein, 7 aa, Mycobacterium
PDKGTVT

SEQ ID NO: 383405 - protein, 5 aa, Mycobacterium
PDNPE

SEQ ID NO: 383406 - protein, 7 aa, Mycobacterium
PDNTEVS

SEQ ID NO: 383407 - protein, 4 aa, Mycobacterium
PDRA

SEQ ID NO: 383408 - protein, 4 aa, Mycobacterium
PDRV

SEQ ID NO: 383409 - protein, 6 aa, Mycobacterium
PDSGRV

SEQ ID NO: 383410 - protein, 4 aa, Mycobacterium
PDSV

SEQ ID NO: 383411 - protein, 4 aa, Mycobacterium
PDVT

SEQ ID NO: 383412 - protein, 6 aa, Mycobacterium
PEDTDR

SEQ ID NO: 383413 - protein, 4 aa, Mycobacterium
PEEI

SEQ ID NO: 383414 - protein, 4 aa, Mycobacterium
PEGQ

SEQ ID NO: 383415 - protein, 7 aa, Mycobacterium
PEHPYPA

SEQ ID NO: 383416 - protein, 4 aa, Mycobacterium
PEIS

SEQ ID NO: 383417 - protein, 8 aa, Mycobacterium
PELGGQGF

SEQ ID NO: 383418 - protein, 4 aa, Mycobacterium
PELS

SEQ ID NO: 383419 - protein, 9 aa, Mycobacterium
PEMKSTGEV

SEQ ID NO: 383420 - protein, 4 aa, Mycobacterium
PERA

SEQ ID NO: 383421 - protein, 4 aa, Mycobacterium
PERE

SEQ ID NO: 383422 - protein, 9 aa, Mycobacterium
PERPSAPDI

SEQ ID NO: 383423 - protein, 4 aa, Mycobacterium
PEVY

SEQ ID NO: 383424 - protein, 13 aa, Mycobacterium
PEWSGSETGGRRY

SEQ ID NO: 383425 - protein, 4 aa, Mycobacterium
PGAA

SEQ ID NO: 383426 - protein, 4 aa, Mycobacterium
PGAL

SEQ ID NO: 383427 - protein, 5 aa, Mycobacterium
PGAVE

SEQ ID NO: 383428 - protein, 11 aa, Mycobacterium
PGGASQPRRTL

SEQ ID NO: 383429 - protein, 5 aa, Mycobacterium
PGGES

SEQ ID NO: 383430 - protein, 7 aa, Mycobacterium
PGGETTD

SEQ ID NO: 383431 - protein, 4 aa, Mycobacterium
PGGT

SEQ ID NO: 383432 - protein, 4 aa, Mycobacterium
PGHE

SEQ ID NO: 383433 - protein, 4 aa, Mycobacterium
PGHI

SEQ ID NO: 383434 - protein, 4 aa, Mycobacterium
PGIA

SEQ ID NO: 383435 - protein, 7 aa, Mycobacterium
PGLQEKP

SEQ ID NO: 383436 - protein, 4 aa, Mycobacterium
PGLT

SEQ ID NO: 383437 - protein, 5 aa, Mycobacterium
PGNPV

SEQ ID NO: 383438 - protein, 5 aa, Mycobacterium
PGPEG

SEQ ID NO: 383439 - protein, 4 aa, Mycobacterium
PGPF

SEQ ID NO: 383440 - protein, 4 aa, Mycobacterium
PGPR

SEQ ID NO: 383441 - protein, 4 aa, Mycobacterium
PGRA

SEQ ID NO: 383442 - protein, 4 aa, Mycobacterium
PGSP

SEQ ID NO: 383443 - protein, 4 aa, Mycobacterium
PGTA

SEQ ID NO: 383444 - protein, 7 aa, Mycobacterium
PGTEAPA

SEQ ID NO: 383445 - protein, 9 aa, Mycobacterium
PGVDPGPTH

SEQ ID NO: 383446 - protein, 16 aa, Mycobacterium
PGVQVSSDAAAARSAA

SEQ ID NO: 383447 - protein, 4 aa, Mycobacterium
PGVT

SEQ ID NO: 383448 - protein, 6 aa, Mycobacterium
PGYTSA

SEQ ID NO: 383449 - protein, 7 aa, Mycobacterium
PHDDKQV

SEQ ID NO: 383450 - protein, 7 aa, Mycobacterium
PHGNGET

SEQ ID NO: 383451 - protein, 5 aa, Mycobacterium
PIGRG

SEQ ID NO: 383452 - protein, 4 aa, Mycobacterium
PIPD

SEQ ID NO: 383453 - protein, 4 aa, Mycobacterium
PIPG

SEQ ID NO: 383454 - protein, 15 aa, Mycobacterium
PISHPDTAILAMLLA

SEQ ID NO: 383455 - protein, 5 aa, Mycobacterium
PITPA

SEQ ID NO: 383456 - protein, 9 aa, Mycobacterium
PKSGYPGHA

SEQ ID NO: 383457 - protein, 4 aa, Mycobacterium
PLDP

SEQ ID NO: 383458 - protein, 4 aa, Mycobacterium
PLPD

SEQ ID NO: 383459 - protein, 8 aa, Mycobacterium
PLRGSKAH

SEQ ID NO: 383460 - protein, 6 aa, Mycobacterium
PNARPP

SEQ ID NO: 383461 - protein, 5 aa, Mycobacterium
PNIGG

SEQ ID NO: 383462 - protein, 4 aa, Mycobacterium
PNQA

SEQ ID NO: 383463 - protein, 4 aa, Mycobacterium
PPAP

SEQ ID NO: 383464 - protein, 4 aa, Mycobacterium
PPEK

SEQ ID NO: 383465 - protein, 4 aa, Mycobacterium
PPGA

SEQ ID NO: 383466 - protein, 6 aa, Mycobacterium
PPGTGD

SEQ ID NO: 383467 - protein, 8 aa, Mycobacterium
PPGVEDGQ

SEQ ID NO: 383468 - protein, 5 aa, Mycobacterium
PPKPS

SEQ ID NO: 383469 - protein, 4 aa, Mycobacterium
PPYD

SEQ ID NO: 383470 - protein, 9 aa, Mycobacterium
PQDPKEGDL

SEQ ID NO: 383471 - protein, 5 aa, Mycobacterium
PQHEY

SEQ ID NO: 383472 - protein, 7 aa, Mycobacterium
PQHPSTH

SEQ ID NO: 383473 - protein, 8 aa, Mycobacterium
PQLGPTTN

SEQ ID NO: 383474 - protein, 4 aa, Mycobacterium
PQPD

SEQ ID NO: 383475 - protein, 6 aa, Mycobacterium
PQPTPL

SEQ ID NO: 383476 - protein, 7 aa, Mycobacterium
PRAAEES

SEQ ID NO: 383477 - protein, 5 aa, Mycobacterium
PRARL

SEQ ID NO: 383478 - protein, 8 aa, Mycobacterium
PRDPHDAD

SEQ ID NO: 383479 - protein, 4 aa, Mycobacterium
PRGA

SEQ ID NO: 383480 - protein, 7 aa, Mycobacterium
PRGFGEN

SEQ ID NO: 383481 - protein, 5 aa, Mycobacterium
PRKAF

SEQ ID NO: 383482 - protein, 6 aa, Mycobacterium
PRPDWP

SEQ ID NO: 383483 - protein, 8 aa, Mycobacterium
PRQEDADA

SEQ ID NO: 383484 - protein, 7 aa, Mycobacterium
PRRAGSD

SEQ ID NO: 383485 - protein, 7 aa, Mycobacterium
PRTGRTH

SEQ ID NO: 383486 - protein, 5 aa, Mycobacterium
PRTKR

SEQ ID NO: 383487 - protein, 5 aa, Mycobacterium
PSDEQ

SEQ ID NO: 383488 - protein, 10 aa, Mycobacterium
PSGAGKSTTQ

SEQ ID NO: 383489 - protein, 7 aa, Mycobacterium
PSGCGKS

SEQ ID NO: 383490 - protein, 4 aa, Mycobacterium
PSGT

SEQ ID NO: 383491 - protein, 7 aa, Mycobacterium
PSGTEPK

SEQ ID NO: 383492 - protein, 10 aa, Mycobacterium
PSGVGKTELS

SEQ ID NO: 383493 - protein, 5 aa, Mycobacterium
PSRST

SEQ ID NO: 383494 - protein, 5 aa, Mycobacterium
PTAEQ

SEQ ID NO: 383495 - protein, 4 aa, Mycobacterium
PTAG

SEQ ID NO: 383496 - protein, 4 aa, Mycobacterium
PTGG

SEQ ID NO: 383497 - protein, 4 aa, Mycobacterium
PTMT

SEQ ID NO: 383498 - protein, 4 aa, Mycobacterium
PTQA

SEQ ID NO: 383499 - protein, 6 aa, Mycobacterium
PTRAYG

SEQ ID NO: 383500 - protein, 7 aa, Mycobacterium
PTSNIHS

SEQ ID NO: 383501 - protein, 4 aa, Mycobacterium
PTTV

SEQ ID NO: 383502 - protein, 4 aa, Mycobacterium
PVAG

SEQ ID NO: 383503 - protein, 4 aa, Mycobacterium
PVPG

SEQ ID NO: 383504 - protein, 4 aa, Mycobacterium
PVTP

SEQ ID NO: 383505 - protein, 10 aa, Mycobacterium
PYQGAATGVG

SEQ ID NO: 383506 - protein, 19 aa, Mycobacterium
QARGYDVDKPRNLAKSVTV

SEQ ID NO: 383507 - protein, 7 aa, Mycobacterium
QARTGMG

SEQ ID NO: 383508 - protein, 7 aa, Mycobacterium
QATEEVA

SEQ ID NO: 383509 - protein, 8 aa, Mycobacterium
QCGSSQQA

SEQ ID NO: 383510 - protein, 9 aa, Mycobacterium
QCGSSQQAI

SEQ ID NO: 383511 - protein, 8 aa, Mycobacterium
QCGSSQQS

SEQ ID NO: 383512 - protein, 8 aa, Mycobacterium
QDKHGTAY

SEQ ID NO: 383513 - protein, 12 aa, Mycobacterium
QDKKHRGREPIS

SEQ ID NO: 383514 - protein, 7 aa, Mycobacterium
QDTAKRT

SEQ ID NO: 383515 - protein, 7 aa, Mycobacterium
QEDGEDV

SEQ ID NO: 383516 - protein, 7 aa, Mycobacterium
QEGIKEQ

SEQ ID NO: 383517 - protein, 6 aa, Mycobacterium
QESDGG

SEQ ID NO: 383518 - protein, 15 aa, Mycobacterium
QGAGHAASGYAHATG

SEQ ID NO: 383519 - protein, 5 aa, Mycobacterium
QGATY

SEQ ID NO: 383520 - protein, 4 aa, Mycobacterium
QGGA

SEQ ID NO: 383521 - protein, 6 aa, Mycobacterium
QGIEAQ

SEQ ID NO: 383522 - protein, 14 aa, Mycobacterium
QGNFGSPGNDPPAA

SEQ ID NO: 383523 - protein, 9 aa, Mycobacterium
QGQKCSAAS

SEQ ID NO: 383524 - protein, 4 aa, Mycobacterium
QGRA

SEQ ID NO: 383525 - protein, 7 aa, Mycobacterium
QGSGGPA

SEQ ID NO: 383526 - protein, 4 aa, Mycobacterium
QGTE

SEQ ID NO: 383527 - protein, 6 aa, Mycobacterium
QIPTGF

SEQ ID NO: 383528 - protein, 4 aa, Mycobacterium
QKAN

SEQ ID NO: 383529 - protein, 11 aa, Mycobacterium
QKVGNGHPGTA

SEQ ID NO: 383530 - protein, 4 aa, Mycobacterium
QLPD

SEQ ID NO: 383531 - protein, 15 aa, Mycobacterium
QLRGRSGRQGDPGES

SEQ ID NO: 383532 - protein, 8 aa, Mycobacterium
QMAGRGTD

SEQ ID NO: 383533 - protein, 10 aa, Mycobacterium
QMTDKTAPRV

SEQ ID NO: 383534 - protein, 7 aa, Mycobacterium
QNIAGAG

SEQ ID NO: 383535 - protein, 5 aa, Mycobacterium
QNIKS

SEQ ID NO: 383536 - protein, 6 aa, Mycobacterium
QNNELG

SEQ ID NO: 383537 - protein, 8 aa, Mycobacterium
QNPGTNHP

SEQ ID NO: 383538 - protein, 6 aa, Mycobacterium
QNPIEY

SEQ ID NO: 383539 - protein, 10 aa, Mycobacterium
QPAKNQAVTN

SEQ ID NO: 383540 - protein, 4 aa, Mycobacterium
QPED

SEQ ID NO: 383541 - protein, 13 aa, Mycobacterium
QPLGGKAQFGGQR

SEQ ID NO: 383542 - protein, 4 aa, Mycobacterium
QPLP

SEQ ID NO: 383543 - protein, 7 aa, Mycobacterium
QQAPNST

SEQ ID NO: 383544 - protein, 6 aa, Mycobacterium
QQEAGK

SEQ ID NO: 383545 - protein, 8 aa, Mycobacterium
QQSGNSPM

SEQ ID NO: 383546 - protein, 4 aa, Mycobacterium
QRSP

SEQ ID NO: 383547 - protein, 8 aa, Mycobacterium
QSTHGTWN

SEQ ID NO: 383548 - protein, 7 aa, Mycobacterium
QTGGCPH

SEQ ID NO: 383549 - protein, 12 aa, Mycobacterium
QTGTHPRTRTEA

SEQ ID NO: 383550 - protein, 5 aa, Mycobacterium
QTPAA

SEQ ID NO: 383551 - protein, 5 aa, Mycobacterium
QTQRA

SEQ ID NO: 383552 - protein, 6 aa, Mycobacterium
QYGPGH

SEQ ID NO: 383553 - protein, 5 aa, Mycobacterium
RAAGG

SEQ ID NO: 383554 - protein, 8 aa, Mycobacterium
RADEIGAG

SEQ ID NO: 383555 - protein, 4 aa, Mycobacterium
RADR

SEQ ID NO: 383556 - protein, 4 aa, Mycobacterium
RAEP

SEQ ID NO: 383557 - protein, 7 aa, Mycobacterium
RAEREQG

SEQ ID NO: 383558 - protein, 8 aa, Mycobacterium
RAGHADGN

SEQ ID NO: 383559 - protein, 5 aa, Mycobacterium
RAPRE

SEQ ID NO: 383560 - protein, 4 aa, Mycobacterium
RARA

SEQ ID NO: 383561 - protein, 4 aa, Mycobacterium
RARE

SEQ ID NO: 383562 - protein, 5 aa, Mycobacterium
RARPG

SEQ ID NO: 383563 - protein, 8 aa, Mycobacterium
RASYERRA

SEQ ID NO: 383564 - protein, 7 aa, Mycobacterium
RATRPGA

SEQ ID NO: 383565 - protein, 14 aa, Mycobacterium
RATSGDNHLGGDDW

SEQ ID NO: 383566 - protein, 6 aa, Mycobacterium
RAVGPG

SEQ ID NO: 383567 - protein, 6 aa, Mycobacterium
RCGPEE

SEQ ID NO: 383568 - protein, 4 aa, Mycobacterium
RDET

SEQ ID NO: 383569 - protein, 4 aa, Mycobacterium
RDGA

SEQ ID NO: 383570 - protein, 4 aa, Mycobacterium
RDGG

SEQ ID NO: 383571 - protein, 15 aa, Mycobacterium
RDGGEIRNGSDLPRI

SEQ ID NO: 383572 - protein, 6 aa, Mycobacterium
RDGSER

SEQ ID NO: 383573 - protein, 4 aa, Mycobacterium
RDGT

SEQ ID NO: 383574 - protein, 4 aa, Mycobacterium
RDGW

SEQ ID NO: 383575 - protein, 16 aa, Mycobacterium
RDPEKAARIREEDDAM

SEQ ID NO: 383576 - protein, 5 aa, Mycobacterium
RDPGG

SEQ ID NO: 383577 - protein, 8 aa, Mycobacterium
RDPRASGE

SEQ ID NO: 383578 - protein, 8 aa, Mycobacterium
RDRTRHQV

SEQ ID NO: 383579 - protein, 4 aa, Mycobacterium
RDTG

SEQ ID NO: 383580 - protein, 4 aa, Mycobacterium
REAG

SEQ ID NO: 383581 - protein, 10 aa, Mycobacterium
REDDDELPAG

SEQ ID NO: 383582 - protein, 4 aa, Mycobacterium
REEV

SEQ ID NO: 383583 - protein, 9 aa, Mycobacterium
RENADNKLY

SEQ ID NO: 383584 - protein, 4 aa, Mycobacterium
REPG

SEQ ID NO: 383585 - protein, 22 aa, Mycobacterium
REPGREYAEDIETGSAAAALGG

SEQ ID NO: 383586 - protein, 6 aa, Mycobacterium
REPKKE

SEQ ID NO: 383587 - protein, 8 aa, Mycobacterium
REQSRPEL

SEQ ID NO: 383588 - protein, 4 aa, Mycobacterium
RERA

SEQ ID NO: 383589 - protein, 9 aa, Mycobacterium
RERRPDRAI

SEQ ID NO: 383590 - protein, 4 aa, Mycobacterium
REST

SEQ ID NO: 383591 - protein, 7 aa, Mycobacterium
RETEDSA

SEQ ID NO: 383592 - protein, 7 aa, Mycobacterium
RFSTRAE

SEQ ID NO: 383593 - protein, 4 aa, Mycobacterium
RGAP

SEQ ID NO: 383594 - protein, 6 aa, Mycobacterium
RGFTGD

SEQ ID NO: 383595 - protein, 4 aa, Mycobacterium
RGGE

SEQ ID NO: 383596 - protein, 8 aa, Mycobacterium
RGGQDPDW

SEQ ID NO: 383597 - protein, 6 aa, Mycobacterium
RGGTNE

SEQ ID NO: 383598 - protein, 13 aa, Mycobacterium
RGKTIRPKTLNQK

SEQ ID NO: 383599 - protein, 9 aa, Mycobacterium
RGNPGPAGY

SEQ ID NO: 383600 - protein, 5 aa, Mycobacterium
RGPDE

SEQ ID NO: 383601 - protein, 4 aa, Mycobacterium
RGPL

SEQ ID NO: 383602 - protein, 4 aa, Mycobacterium
RGRA

SEQ ID NO: 383603 - protein, 4 aa, Mycobacterium
RGRN

SEQ ID NO: 383604 - protein, 4 aa, Mycobacterium
RGRP

SEQ ID NO: 383605 - protein, 7 aa, Mycobacterium
RGSDGRV

SEQ ID NO: 383606 - protein, 7 aa, Mycobacterium
RGTGSKD

SEQ ID NO: 383607 - protein, 4 aa, Mycobacterium
RGVP

SEQ ID NO: 383608 - protein, 12 aa, Mycobacterium
RGYDSDHPRVQG

SEQ ID NO: 383609 - protein, 6 aa, Mycobacterium
RGYDST

SEQ ID NO: 383610 - protein, 9 aa, Mycobacterium
RHEAGPADL

SEQ ID NO: 383611 - protein, 6 aa, Mycobacterium
RHGRSI

SEQ ID NO: 383612 - protein, 6 aa, Mycobacterium
RHTPEG

SEQ ID NO: 383613 - protein, 5 aa, Mycobacterium
RKEGK

SEQ ID NO: 383614 - protein, 11 aa, Mycobacterium
RKLDKAASKGV

SEQ ID NO: 383615 - protein, 7 aa, Mycobacterium
RKPSEYV

SEQ ID NO: 383616 - protein, 7 aa, Mycobacterium
RKRRQPV

SEQ ID NO: 383617 - protein, 6 aa, Mycobacterium
RLGEDS

SEQ ID NO: 383618 - protein, 5 aa, Mycobacterium
RLGGG

SEQ ID NO: 383619 - protein, 4 aa, Mycobacterium
RLPS

SEQ ID NO: 383620 - protein, 6 aa, Mycobacterium
RLPTEA

SEQ ID NO: 383621 - protein, 4 aa, Mycobacterium
RNAD

SEQ ID NO: 383622 - protein, 6 aa, Mycobacterium
RNAVSS

SEQ ID NO: 383623 - protein, 6 aa, Mycobacterium
RNNTAA

SEQ ID NO: 383624 - protein, 9 aa, Mycobacterium
RNPLHSDPE

SEQ ID NO: 383625 - protein, 4 aa, Mycobacterium
RNRP

SEQ ID NO: 383626 - protein, 4 aa, Mycobacterium
RPAA

SEQ ID NO: 383627 - protein, 4 aa, Mycobacterium
RPDG

SEQ ID NO: 383628 - protein, 25 aa, Mycobacterium
RPDPYKGKGVRYEGEQIRRKVGKTG

SEQ ID NO: 383629 - protein, 7 aa, Mycobacterium
RPDSPSV

SEQ ID NO: 383630 - protein, 7 aa, Mycobacterium
RPEEVTD

SEQ ID NO: 383631 - protein, 4 aa, Mycobacterium
RPEQ

SEQ ID NO: 383632 - protein, 4 aa, Mycobacterium
RPET

SEQ ID NO: 383633 - protein, 7 aa, Mycobacterium
RPLDAGP

SEQ ID NO: 383634 - protein, 9 aa, Mycobacterium
RPPGREAYP

SEQ ID NO: 383635 - protein, 4 aa, Mycobacterium
RPPK

SEQ ID NO: 383636 - protein, 6 aa, Mycobacterium
RPQVQE

SEQ ID NO: 383637 - protein, 5 aa, Mycobacterium
RPRSV

SEQ ID NO: 383638 - protein, 7 aa, Mycobacterium
RPSERWG

SEQ ID NO: 383639 - protein, 11 aa, Mycobacterium
RPSPTSGTLGG

SEQ ID NO: 383640 - protein, 8 aa, Mycobacterium
RPVPPGTV

SEQ ID NO: 383641 - protein, 7 aa, Mycobacterium
RQARADG

SEQ ID NO: 383642 - protein, 8 aa, Mycobacterium
RQASPGVK

SEQ ID NO: 383643 - protein, 4 aa, Mycobacterium
RRGD

SEQ ID NO: 383644 - protein, 4 aa, Mycobacterium
RRGG

SEQ ID NO: 383645 - protein, 5 aa, Mycobacterium
RRGPH

SEQ ID NO: 383646 - protein, 9 aa, Mycobacterium
RRNDDEPAE

SEQ ID NO: 383647 - protein, 5 aa, Mycobacterium
RRPLR

SEQ ID NO: 383648 - protein, 4 aa, Mycobacterium
RRRG

SEQ ID NO: 383649 - protein, 4 aa, Mycobacterium
RRRR

SEQ ID NO: 383650 - protein, 6 aa, Mycobacterium
RRSASV

SEQ ID NO: 383651 - protein, 7 aa, Mycobacterium
RRTAEEL

SEQ ID NO: 383652 - protein, 9 aa, Mycobacterium
RRTDGTTNG

SEQ ID NO: 383653 - protein, 10 aa, Mycobacterium
RSAGSIKKIT

SEQ ID NO: 383654 - protein, 8 aa, Mycobacterium
RSALQNAA

SEQ ID NO: 383655 - protein, 5 aa, Mycobacterium
RSCPE

SEQ ID NO: 383656 - protein, 7 aa, Mycobacterium
RSDDTII

SEQ ID NO: 383657 - protein, 4 aa, Mycobacterium
RSGA

SEQ ID NO: 383658 - protein, 10 aa, Mycobacterium
RSGETEDTTI

SEQ ID NO: 383659 - protein, 5 aa, Mycobacterium
RSGST

SEQ ID NO: 383660 - protein, 6 aa, Mycobacterium
RSKTSL

SEQ ID NO: 383661 - protein, 4 aa, Mycobacterium
RSQC

SEQ ID NO: 383662 - protein, 8 aa, Mycobacterium
RSRDPSDL

SEQ ID NO: 383663 - protein, 5 aa, Mycobacterium
RSRQS

SEQ ID NO: 383664 - protein, 4 aa, Mycobacterium
RSRY

SEQ ID NO: 383665 - protein, 10 aa, Mycobacterium
RSSTVPAGRV

SEQ ID NO: 383666 - protein, 4 aa, Mycobacterium
RSTA

SEQ ID NO: 383667 - protein, 7 aa, Mycobacterium
RTADGYA

SEQ ID NO: 383668 - protein, 10 aa, Mycobacterium
RTGRTTSPHL

SEQ ID NO: 383669 - protein, 5 aa, Mycobacterium
RTNNN

SEQ ID NO: 383670 - protein, 4 aa, Mycobacterium
RTPD

SEQ ID NO: 383671 - protein, 4 aa, Mycobacterium
RTPV

SEQ ID NO: 383672 - protein, 4 aa, Mycobacterium
RTRE

SEQ ID NO: 383673 - protein, 4 aa, Mycobacterium
RTRT

SEQ ID NO: 383674 - protein, 10 aa, Mycobacterium
RVASAADAQE

SEQ ID NO: 383675 - protein, 4 aa, Mycobacterium
RVDP

SEQ ID NO: 383676 - protein, 9 aa, Mycobacterium
RVGPSTGTN

SEQ ID NO: 383677 - protein, 5 aa, Mycobacterium
RVNPL

SEQ ID NO: 383678 - protein, 4 aa, Mycobacterium
RYDE

SEQ ID NO: 383679 - protein, 7 aa, Mycobacterium
RYGRTRS

SEQ ID NO: 383680 - protein, 8 aa, Mycobacterium
RYSNTGEG

SEQ ID NO: 383681 - protein, 6 aa, Mycobacterium
SAAPAG

SEQ ID NO: 383682 - protein, 6 aa, Mycobacterium
SAEDFE

SEQ ID NO: 383683 - protein, 7 aa, Mycobacterium
SAEETAK

SEQ ID NO: 383684 - protein, 5 aa, Mycobacterium
SAGAK

SEQ ID NO: 383685 - protein, 7 aa, Mycobacterium
SAGNHAQ

SEQ ID NO: 383686 - protein, 4 aa, Mycobacterium
SAGV

SEQ ID NO: 383687 - protein, 4 aa, Mycobacterium
SAPA

SEQ ID NO: 383688 - protein, 7 aa, Mycobacterium
SARPSDS

SEQ ID NO: 383689 - protein, 7 aa, Mycobacterium
SATPLYD

SEQ ID NO: 383690 - protein, 6 aa, Mycobacterium
SATPRQ

SEQ ID NO: 383691 - protein, 6 aa, Mycobacterium
SCPGGP

SEQ ID NO: 383692 - protein, 4 aa, Mycobacterium
SDAH

SEQ ID NO: 383693 - protein, 5 aa, Mycobacterium
SDELK

SEQ ID NO: 383694 - protein, 5 aa, Mycobacterium
SDGAA

SEQ ID NO: 383695 - protein, 4 aa, Mycobacterium
SDGT

SEQ ID NO: 383696 - protein, 5 aa, Mycobacterium
SDPGL

SEQ ID NO: 383697 - protein, 5 aa, Mycobacterium
SDQTH

SEQ ID NO: 383698 - protein, 8 aa, Mycobacterium
SDTRPAAR

SEQ ID NO: 383699 - protein, 7 aa, Mycobacterium
SEGGAPA

SEQ ID NO: 383700 - protein, 6 aa, Mycobacterium
SEGKDG

SEQ ID NO: 383701 - protein, 6 aa, Mycobacterium
SEGKGL

SEQ ID NO: 383702 - protein, 4 aa, Mycobacterium
SEGT

SEQ ID NO: 383703 - protein, 5 aa, Mycobacterium
SENNT

SEQ ID NO: 383704 - protein, 10 aa, Mycobacterium
SEPEAGSDLA

SEQ ID NO: 383705 - protein, 7 aa, Mycobacterium
SEPELGS

SEQ ID NO: 383706 - protein, 16 aa, Mycobacterium
SEQISTAGKEASGTGN

SEQ ID NO: 383707 - protein, 4 aa, Mycobacterium
SERT

SEQ ID NO: 383708 - protein, 15 aa, Mycobacterium
SERYTEKLATPDTSV

SEQ ID NO: 383709 - protein, 5 aa, Mycobacterium
SFAPE

SEQ ID NO: 383710 - protein, 6 aa, Mycobacterium
SFYTGR

SEQ ID NO: 383711 - protein, 5 aa, Mycobacterium
SGAGN

SEQ ID NO: 383712 - protein, 8 aa, Mycobacterium
SGCGKTTS

SEQ ID NO: 383713 - protein, 8 aa, Mycobacterium
SGDAEAQA

SEQ ID NO: 383714 - protein, 5 aa, Mycobacterium
SGDGN

SEQ ID NO: 383715 - protein, 4 aa, Mycobacterium
SGEA

SEQ ID NO: 383716 - protein, 7 aa, Mycobacterium
SGEGADE

SEQ ID NO: 383717 - protein, 7 aa, Mycobacterium
SGEGRYV

SEQ ID NO: 383718 - protein, 5 aa, Mycobacterium
SGGAG

SEQ ID NO: 383719 - protein, 9 aa, Mycobacterium
SGGDNLTAT

SEQ ID NO: 383720 - protein, 5 aa, Mycobacterium
SGGGS

SEQ ID NO: 383721 - protein, 4 aa, Mycobacterium
SGGL

SEQ ID NO: 383722 - protein, 4 aa, Mycobacterium
SGGR

SEQ ID NO: 383723 - protein, 4 aa, Mycobacterium
SGGV

SEQ ID NO: 383724 - protein, 4 aa, Mycobacterium
SGLP

SEQ ID NO: 383725 - protein, 6 aa, Mycobacterium
SGPAAM

SEQ ID NO: 383726 - protein, 7 aa, Mycobacterium
SGPGVTG

SEQ ID NO: 383727 - protein, 8 aa, Mycobacterium
SGRTSNEA

SEQ ID NO: 383728 - protein, 8 aa, Mycobacterium
SGSGKSSL

SEQ ID NO: 383729 - protein, 9 aa, Mycobacterium
SGSTDDTEI

SEQ ID NO: 383730 - protein, 5 aa, Mycobacterium
SGTDN

SEQ ID NO: 383731 - protein, 10 aa, Mycobacterium
SGTTGAPKGV

SEQ ID NO: 383732 - protein, 8 aa, Mycobacterium
SGTTGRSK

SEQ ID NO: 383733 - protein, 12 aa, Mycobacterium
SGYQETLTDPSY

SEQ ID NO: 383734 - protein, 5 aa, Mycobacterium
SHDRL

SEQ ID NO: 383735 - protein, 7 aa, Mycobacterium
SHEGGIA

SEQ ID NO: 383736 - protein, 8 aa, Mycobacterium
SHPEYATA

SEQ ID NO: 383737 - protein, 7 aa, Mycobacterium
SHSPQVD

SEQ ID NO: 383738 - protein, 7 aa, Mycobacterium
SKGERAR

SEQ ID NO: 383739 - protein, 5 aa, Mycobacterium
SKSQV

SEQ ID NO: 383740 - protein, 6 aa, Mycobacterium
SKTTAV

SEQ ID NO: 383741 - protein, 6 aa, Mycobacterium
SLAGTQ

SEQ ID NO: 383742 - protein, 4 aa, Mycobacterium
SLEA

SEQ ID NO: 383743 - protein, 7 aa, Mycobacterium
SLGGGTA

SEQ ID NO: 383744 - protein, 5 aa, Mycobacterium
SLPPE

SEQ ID NO: 383745 - protein, 8 aa, Mycobacterium
SNAQRNAA

SEQ ID NO: 383746 - protein, 11 aa, Mycobacterium
SNMGHTQAAAG

SEQ ID NO: 383747 - protein, 6 aa, Mycobacterium
SNPATI

SEQ ID NO: 383748 - protein, 9 aa, Mycobacterium
SPASNAVTG

SEQ ID NO: 383749 - protein, 4 aa, Mycobacterium
SPAV

SEQ ID NO: 383750 - protein, 4 aa, Mycobacterium
SPDQ

SEQ ID NO: 383751 - protein, 4 aa, Mycobacterium
SPEL

SEQ ID NO: 383752 - protein, 10 aa, Mycobacterium
SPGGHTSRPH

SEQ ID NO: 383753 - protein, 4 aa, Mycobacterium
SPGI

SEQ ID NO: 383754 - protein, 13 aa, Mycobacterium
SPGPGTPERAGAS

SEQ ID NO: 383755 - protein, 6 aa, Mycobacterium
SPGVDT

SEQ ID NO: 383756 - protein, 6 aa, Mycobacterium
SPIGKR

SEQ ID NO: 383757 - protein, 6 aa, Mycobacterium
SPIGTG

SEQ ID NO: 383758 - protein, 6 aa, Mycobacterium
SPKRLP

SEQ ID NO: 383759 - protein, 7 aa, Mycobacterium
SPNADEN

SEQ ID NO: 383760 - protein, 4 aa, Mycobacterium
SPSD

SEQ ID NO: 383761 - protein, 4 aa, Mycobacterium
SPSI

SEQ ID NO: 383762 - protein, 8 aa, Mycobacterium
SPSNPTGR

SEQ ID NO: 383763 - protein, 4 aa, Mycobacterium
SPTR

SEQ ID NO: 383764 - protein, 8 aa, Mycobacterium
SPYRTPQT

SEQ ID NO: 383765 - protein, 9 aa, Mycobacterium
SQPPNPKAT

SEQ ID NO: 383766 - protein, 6 aa, Mycobacterium
SQPTMT

SEQ ID NO: 383767 - protein, 6 aa, Mycobacterium
SQRTKN

SEQ ID NO: 383768 - protein, 6 aa, Mycobacterium
SQTPSA

SEQ ID NO: 383769 - protein, 4 aa, Mycobacterium
SRGI

SEQ ID NO: 383770 - protein, 7 aa, Mycobacterium
SRGRGGF

SEQ ID NO: 383771 - protein, 11 aa, Mycobacterium
SRHDLGNPGGY

SEQ ID NO: 383772 - protein, 8 aa, Mycobacterium
SRQDHGLD

SEQ ID NO: 383773 - protein, 10 aa, Mycobacterium
SRRGRPSVPA

SEQ ID NO: 383774 - protein, 8 aa, Mycobacterium
SRRPDRPG

SEQ ID NO: 383775 - protein, 8 aa, Mycobacterium
SRSGPPQV

SEQ ID NO: 383776 - protein, 5 aa, Mycobacterium
SRTPV

SEQ ID NO: 383777 - protein, 6 aa, Mycobacterium
SSEDAM

SEQ ID NO: 383778 - protein, 4 aa, Mycobacterium
SSGL

SEQ ID NO: 383779 - protein, 4 aa, Mycobacterium
SSGR

SEQ ID NO: 383780 - protein, 5 aa, Mycobacterium
SSGTD

SEQ ID NO: 383781 - protein, 12 aa, Mycobacterium
SSGTTGRPKGIK

SEQ ID NO: 383782 - protein, 9 aa, Mycobacterium
SSLTNNRSR

SEQ ID NO: 383783 - protein, 4 aa, Mycobacterium
SSNA

SEQ ID NO: 383784 - protein, 6 aa, Mycobacterium
SSNTEP

SEQ ID NO: 383785 - protein, 10 aa, Mycobacterium
SSRPHTMPTR

SEQ ID NO: 383786 - protein, 7 aa, Mycobacterium
STDGVGT

SEQ ID NO: 383787 - protein, 4 aa, Mycobacterium
STGL

SEQ ID NO: 383788 - protein, 16 aa, Mycobacterium
STGNTSASAAAYAARA

SEQ ID NO: 383789 - protein, 7 aa, Mycobacterium
STGPAEI

SEQ ID NO: 383790 - protein, 6 aa, Mycobacterium
SVGGQG

SEQ ID NO: 383791 - protein, 6 aa, Mycobacterium
SVPGAA

SEQ ID NO: 383792 - protein, 4 aa, Mycobacterium
SYAP

SEQ ID NO: 383793 - protein, 6 aa, Mycobacterium
SYHSRT

SEQ ID NO: 383794 - protein, 5 aa, Mycobacterium
TAAGG

SEQ ID NO: 383795 - protein, 12 aa, Mycobacterium
TAALKGSPQRRG

SEQ ID NO: 383796 - protein, 7 aa, Mycobacterium
TADLADA

SEQ ID NO: 383797 - protein, 4 aa, Mycobacterium
TADR

SEQ ID NO: 383798 - protein, 4 aa, Mycobacterium
TAET

SEQ ID NO: 383799 - protein, 16 aa, Mycobacterium
TAGRTTLTGEGLQHAD

SEQ ID NO: 383800 - protein, 8 aa, Mycobacterium
TAKFGQPE

SEQ ID NO: 383801 - protein, 6 aa, Mycobacterium
TASEEF

SEQ ID NO: 383802 - protein, 4 aa, Mycobacterium
TAVG

SEQ ID NO: 383803 - protein, 7 aa, Mycobacterium
TDAEAAT

SEQ ID NO: 383804 - protein, 4 aa, Mycobacterium
TDDS

SEQ ID NO: 383805 - protein, 7 aa, Mycobacterium
TDDTRTE

SEQ ID NO: 383806 - protein, 13 aa, Mycobacterium
TDGETNASLRKGD

SEQ ID NO: 383807 - protein, 4 aa, Mycobacterium
TDGS

SEQ ID NO: 383808 - protein, 4 aa, Mycobacterium
TDLP

SEQ ID NO: 383809 - protein, 4 aa, Mycobacterium
TDPH

SEQ ID NO: 383810 - protein, 4 aa, Mycobacterium
TDSM

SEQ ID NO: 383811 - protein, 6 aa, Mycobacterium
TDTPGV

SEQ ID NO: 383812 - protein, 4 aa, Mycobacterium
TEAE

SEQ ID NO: 383813 - protein, 6 aa, Mycobacterium
TEAEKR

SEQ ID NO: 383814 - protein, 7 aa, Mycobacterium
TEAGTQK

SEQ ID NO: 383815 - protein, 7 aa, Mycobacterium
TEDPPSR

SEQ ID NO: 383816 - protein, 4 aa, Mycobacterium
TEDR

SEQ ID NO: 383817 - protein, 6 aa, Mycobacterium
TEEQKQ

SEQ ID NO: 383818 - protein, 8 aa, Mycobacterium
TEKDYASL

SEQ ID NO: 383819 - protein, 9 aa, Mycobacterium
TEKGSKRHA

SEQ ID NO: 383820 - protein, 4 aa, Mycobacterium
TEPG

SEQ ID NO: 383821 - protein, 15 aa, Mycobacterium
TEPRAKTRNLRRDPR

SEQ ID NO: 383822 - protein, 4 aa, Mycobacterium
TEPW

SEQ ID NO: 383823 - protein, 6 aa, Mycobacterium
TERATA

SEQ ID NO: 383824 - protein, 4 aa, Mycobacterium
TERQ

SEQ ID NO: 383825 - protein, 4 aa, Mycobacterium
TETL

SEQ ID NO: 383826 - protein, 8 aa, Mycobacterium
TFDSGDPE

SEQ ID NO: 383827 - protein, 4 aa, Mycobacterium
TGAD

SEQ ID NO: 383828 - protein, 4 aa, Mycobacterium
TGAS

SEQ ID NO: 383829 - protein, 4 aa, Mycobacterium
TGAT

SEQ ID NO: 383830 - protein, 9 aa, Mycobacterium
TGCPSGEVQ

SEQ ID NO: 383831 - protein, 13 aa, Mycobacterium
TGEESDDESLGGA

SEQ ID NO: 383832 - protein, 4 aa, Mycobacterium
TGEL

SEQ ID NO: 383833 - protein, 9 aa, Mycobacterium
TGETGTGKT

SEQ ID NO: 383834 - protein, 8 aa, Mycobacterium
TGGEGTKH

SEQ ID NO: 383835 - protein, 6 aa, Mycobacterium
TGGVGQ

SEQ ID NO: 383836 - protein, 4 aa, Mycobacterium
TGNT

SEQ ID NO: 383837 - protein, 5 aa, Mycobacterium
TGNTH

SEQ ID NO: 383838 - protein, 5 aa, Mycobacterium
TGQGY

SEQ ID NO: 383839 - protein, 5 aa, Mycobacterium
TGRPY

SEQ ID NO: 383840 - protein, 9 aa, Mycobacterium
TGRSDFPNQ

SEQ ID NO: 383841 - protein, 4 aa, Mycobacterium
TGSA

SEQ ID NO: 383842 - protein, 7 aa, Mycobacterium
TGSIGTQ

SEQ ID NO: 383843 - protein, 5 aa, Mycobacterium
TGSVR

SEQ ID NO: 383844 - protein, 9 aa, Mycobacterium
TGTASGKSL

SEQ ID NO: 383845 - protein, 8 aa, Mycobacterium
TGTRGRQL

SEQ ID NO: 383846 - protein, 10 aa, Mycobacterium
TGTSGKTTTT

SEQ ID NO: 383847 - protein, 4 aa, Mycobacterium
TGTT

SEQ ID NO: 383848 - protein, 8 aa, Mycobacterium
TGVAGEPQ

SEQ ID NO: 383849 - protein, 5 aa, Mycobacterium
THDER

SEQ ID NO: 383850 - protein, 10 aa, Mycobacterium
THGGRRGTGI

SEQ ID NO: 383851 - protein, 8 aa, Mycobacterium
THGKTTTT

SEQ ID NO: 383852 - protein, 4 aa, Mycobacterium
THPD

SEQ ID NO: 383853 - protein, 9 aa, Mycobacterium
THSQTSGWS

SEQ ID NO: 383854 - protein, 6 aa, Mycobacterium
TKETPA

SEQ ID NO: 383855 - protein, 9 aa, Mycobacterium
TKPGRQDDY

SEQ ID NO: 383856 - protein, 8 aa, Mycobacterium
TLGPKGRN

SEQ ID NO: 383857 - protein, 9 aa, Mycobacterium
TLPAEPAKT

SEQ ID NO: 383858 - protein, 4 aa, Mycobacterium
TLPG

SEQ ID NO: 383859 - protein, 7 aa, Mycobacterium
TLREGDR

SEQ ID NO: 383860 - protein, 9 aa, Mycobacterium
TLSGGQRRR

SEQ ID NO: 383861 - protein, 6 aa, Mycobacterium
TLTGAQ

SEQ ID NO: 383862 - protein, 12 aa, Mycobacterium
TNADSASPGVSD

SEQ ID NO: 383863 - protein, 8 aa, Mycobacterium
TNAGKSSL

SEQ ID NO: 383864 - protein, 5 aa, Mycobacterium
TNASR

SEQ ID NO: 383865 - protein, 9 aa, Mycobacterium
TNGSQIPRE

SEQ ID NO: 383866 - protein, 4 aa, Mycobacterium
TNHL

SEQ ID NO: 383867 - protein, 6 aa, Mycobacterium
TNQRET

SEQ ID NO: 383868 - protein, 4 aa, Mycobacterium
TPAD

SEQ ID NO: 383869 - protein, 4 aa, Mycobacterium
TPDG

SEQ ID NO: 383870 - protein, 5 aa, Mycobacterium
TPGCT

SEQ ID NO: 383871 - protein, 7 aa, Mycobacterium
TPGHTAD

SEQ ID NO: 383872 - protein, 5 aa, Mycobacterium
TPHLN

SEQ ID NO: 383873 - protein, 6 aa, Mycobacterium
TPPSRN

SEQ ID NO: 383874 - protein, 9 aa, Mycobacterium
TPRRGIGDR

SEQ ID NO: 383875 - protein, 4 aa, Mycobacterium
TPSR

SEQ ID NO: 383876 - protein, 4 aa, Mycobacterium
TPTD

SEQ ID NO: 383877 - protein, 5 aa, Mycobacterium
TPVPA

SEQ ID NO: 383878 - protein, 4 aa, Mycobacterium
TPVR

SEQ ID NO: 383879 - protein, 10 aa, Mycobacterium
TQAPSGAGYA

SEQ ID NO: 383880 - protein, 16 aa, Mycobacterium
TQPHTSSGRVPTEKGY

SEQ ID NO: 383881 - protein, 6 aa, Mycobacterium
TQRRHG

SEQ ID NO: 383882 - protein, 8 aa, Mycobacterium
TQSVGDET

SEQ ID NO: 383883 - protein, 6 aa, Mycobacterium
TQTPHE

SEQ ID NO: 383884 - protein, 5 aa, Mycobacterium
TQTPS

SEQ ID NO: 383885 - protein, 8 aa, Mycobacterium
TRAGEELS

SEQ ID NO: 383886 - protein, 12 aa, Mycobacterium
TRDEPHADAEKY

SEQ ID NO: 383887 - protein, 4 aa, Mycobacterium
TRGG

SEQ ID NO: 383888 - protein, 5 aa, Mycobacterium
TRKGG

SEQ ID NO: 383889 - protein, 4 aa, Mycobacterium
TRPD

SEQ ID NO: 383890 - protein, 5 aa, Mycobacterium
TRPGG

SEQ ID NO: 383891 - protein, 10 aa, Mycobacterium
TRVGSGPFPT

SEQ ID NO: 383892 - protein, 8 aa, Mycobacterium
TRYEGPTG

SEQ ID NO: 383893 - protein, 4 aa, Mycobacterium
TSDP

SEQ ID NO: 383894 - protein, 6 aa, Mycobacterium
TSGAHD

SEQ ID NO: 383895 - protein, 9 aa, Mycobacterium
TSGGAIPDR

SEQ ID NO: 383896 - protein, 4 aa, Mycobacterium
TSIE

SEQ ID NO: 383897 - protein, 7 aa, Mycobacterium
TSLAGGT

SEQ ID NO: 383898 - protein, 4 aa, Mycobacterium
TSPE

SEQ ID NO: 383899 - protein, 4 aa, Mycobacterium
TSPV

SEQ ID NO: 383900 - protein, 8 aa, Mycobacterium
TSRDLTEN

SEQ ID NO: 383901 - protein, 9 aa, Mycobacterium
TSSRAPLGR

SEQ ID NO: 383902 - protein, 5 aa, Mycobacterium
TSTAA

SEQ ID NO: 383903 - protein, 7 aa, Mycobacterium
TTAEDGA

SEQ ID NO: 383904 - protein, 4 aa, Mycobacterium
TTGT

SEQ ID NO: 383905 - protein, 7 aa, Mycobacterium
TTGTHGN

SEQ ID NO: 383906 - protein, 8 aa, Mycobacterium
TTGYGSAV

SEQ ID NO: 383907 - protein, 5 aa, Mycobacterium
TTHIT

SEQ ID NO: 383908 - protein, 9 aa, Mycobacterium
TTIYGGTSE

SEQ ID NO: 383909 - protein, 4 aa, Mycobacterium
TTRS

SEQ ID NO: 383910 - protein, 8 aa, Mycobacterium
TTTTTTQA

SEQ ID NO: 383911 - protein, 11 aa, Mycobacterium
TVDDAAGEAYD

SEQ ID NO: 383912 - protein, 5 aa, Mycobacterium
TYASS

SEQ ID NO: 383913 - protein, 7 aa, Mycobacterium
TYGDGGN

SEQ ID NO: 383914 - protein, 8 aa, Mycobacterium
VAPDHPKI

SEQ ID NO: 383915 - protein, 9 aa, Mycobacterium
VAPGGTLNT

SEQ ID NO: 383916 - protein, 9 aa, Mycobacterium
VASGNGKGQ

SEQ ID NO: 383917 - protein, 4 aa, Mycobacterium
VDAA

SEQ ID NO: 383918 - protein, 8 aa, Mycobacterium
VDAGAQDA

SEQ ID NO: 383919 - protein, 4 aa, Mycobacterium
VDEA

SEQ ID NO: 383920 - protein, 5 aa, Mycobacterium
VDGGG

SEQ ID NO: 383921 - protein, 4 aa, Mycobacterium
VDPD

SEQ ID NO: 383922 - protein, 5 aa, Mycobacterium
VDPED

SEQ ID NO: 383923 - protein, 6 aa, Mycobacterium
VDPSVG

SEQ ID NO: 383924 - protein, 11 aa, Mycobacterium
VDRRPDLPSGK

SEQ ID NO: 383925 - protein, 5 aa, Mycobacterium
VEDEA

SEQ ID NO: 383926 - protein, 9 aa, Mycobacterium
VEKDPENPT

SEQ ID NO: 383927 - protein, 8 aa, Mycobacterium
VEKGETQG

SEQ ID NO: 383928 - protein, 4 aa, Mycobacterium
VEPG

SEQ ID NO: 383929 - protein, 10 aa, Mycobacterium
VEPPRSPAQM

SEQ ID NO: 383930 - protein, 5 aa, Mycobacterium
VESQD

SEQ ID NO: 383931 - protein, 4 aa, Mycobacterium
VETD

SEQ ID NO: 383932 - protein, 5 aa, Mycobacterium
VGADP

SEQ ID NO: 383933 - protein, 4 aa, Mycobacterium
VGAG

SEQ ID NO: 383934 - protein, 9 aa, Mycobacterium
VGDDKDKAA

SEQ ID NO: 383935 - protein, 9 aa, Mycobacterium
VGDQSSNIG

SEQ ID NO: 383936 - protein, 10 aa, Mycobacterium
VGGDSAGGNL

SEQ ID NO: 383937 - protein, 14 aa, Mycobacterium
VGGKTGINTDAGKN

SEQ ID NO: 383938 - protein, 8 aa, Mycobacterium
VGPEGKPL

SEQ ID NO: 383939 - protein, 6 aa, Mycobacterium
VGPGGY

SEQ ID NO: 383940 - protein, 7 aa, Mycobacterium
VGPPPTH

SEQ ID NO: 383941 - protein, 10 aa, Mycobacterium
VGSAGTVTTL

SEQ ID NO: 383942 - protein, 7 aa, Mycobacterium
VGSEQAY

SEQ ID NO: 383943 - protein, 4 aa, Mycobacterium
VKRR

SEQ ID NO: 383944 - protein, 8 aa, Mycobacterium
VMGGTSQI

SEQ ID NO: 383945 - protein, 13 aa, Mycobacterium
VNMSQSSNDTFPT

SEQ ID NO: 383946 - protein, 7 aa, Mycobacterium
VNQSSTA

SEQ ID NO: 383947 - protein, 4 aa, Mycobacterium
VPEA

SEQ ID NO: 383948 - protein, 4 aa, Mycobacterium
VPGA

SEQ ID NO: 383949 - protein, 5 aa, Mycobacterium
VPGPS

SEQ ID NO: 383950 - protein, 4 aa, Mycobacterium
VPGS

SEQ ID NO: 383951 - protein, 8 aa, Mycobacterium
VPNDGKGA

SEQ ID NO: 383952 - protein, 4 aa, Mycobacterium
VPPG

SEQ ID NO: 383953 - protein, 4 aa, Mycobacterium
VPPN

SEQ ID NO: 383954 - protein, 11 aa, Mycobacterium
VPQRRRKKRLT

SEQ ID NO: 383955 - protein, 8 aa, Mycobacterium
VPTAANAG

SEQ ID NO: 383956 - protein, 11 aa, Mycobacterium
VPTDDSSLGAL

SEQ ID NO: 383957 - protein, 5 aa, Mycobacterium
VQDGK

SEQ ID NO: 383958 - protein, 9 aa, Mycobacterium
VQNEKNTKQ

SEQ ID NO: 383959 - protein, 5 aa, Mycobacterium
VRANT

SEQ ID NO: 383960 - protein, 4 aa, Mycobacterium
VRDE

SEQ ID NO: 383961 - protein, 4 aa, Mycobacterium
VRES

SEQ ID NO: 383962 - protein, 14 aa, Mycobacterium
VRPHEPAYDPEPDA

SEQ ID NO: 383963 - protein, 4 aa, Mycobacterium
VRPT

SEQ ID NO: 383964 - protein, 8 aa, Mycobacterium
VRQRSRTT

SEQ ID NO: 383965 - protein, 8 aa, Mycobacterium
VSAEAAAT

SEQ ID NO: 383966 - protein, 4 aa, Mycobacterium
VSAG

SEQ ID NO: 383967 - protein, 14 aa, Mycobacterium
VSINSGGEKIYPEE

SEQ ID NO: 383968 - protein, 6 aa, Mycobacterium
VSNAGG

SEQ ID NO: 383969 - protein, 10 aa, Mycobacterium
VSNPDKVGRD

SEQ ID NO: 383970 - protein, 10 aa, Mycobacterium
VTGDPQRGLR

SEQ ID NO: 383971 - protein, 5 aa, Mycobacterium
VTGED

SEQ ID NO: 383972 - protein, 6 aa, Mycobacterium
VTGEDV

SEQ ID NO: 383973 - protein, 19 aa, Mycobacterium
VTGSGRVGIGPSGDEPGFQ

SEQ ID NO: 383974 - protein, 6 aa, Mycobacterium
VTQPGD

SEQ ID NO: 383975 - protein, 10 aa, Mycobacterium
VTSGPALERA

SEQ ID NO: 383976 - protein, 4 aa, Mycobacterium
VTTG

SEQ ID NO: 383977 - protein, 5 aa, Mycobacterium
VWTTD

SEQ ID NO: 383978 - protein, 7 aa, Mycobacterium
WKANNKR

SEQ ID NO: 383979 - protein, 5 aa, Mycobacterium
WSSTK

SEQ ID NO: 383980 - protein, 7 aa, Mycobacterium
YAGRAGD

SEQ ID NO: 383981 - protein, 4 aa, Mycobacterium
YASR

SEQ ID NO: 383982 - protein, 13 aa, Mycobacterium
YGAPGTASATILS

SEQ ID NO: 383983 - protein, 4 aa, Mycobacterium
YGGR

SEQ ID NO: 383984 - protein, 6 aa, Mycobacterium
YGPTEA

SEQ ID NO: 383985 - protein, 15 aa, Mycobacterium
YNANRPHSAHGELTP

SEQ ID NO: 383986 - protein, 9 aa, Mycobacterium
YPEPPPPGM

SEQ ID NO: 383987 - protein, 4 aa, Mycobacterium
YPGG

SEQ ID NO: 383988 - protein, 9 aa, Mycobacterium
YPKTSGGRG

SEQ ID NO: 383989 - protein, 5 aa, Mycobacterium
YQRRD

SEQ ID NO: 383990 - protein, 4 aa, Mycobacterium
YRNP

SEQ ID NO: 383991 - protein, 6 aa, Mycobacterium
YRSTPQ

SEQ ID NO: 383992 - protein, 5 aa, Mycobacterium
YSGDD

SEQ ID NO: 383993 - protein, 4 aa, Mycobacterium
YSLS

SEQ ID NO: 383994 - protein, 9 aa, Mycobacterium
YSPNSPLGG

SEQ ID NO: 383995 - protein, 6 aa, Mycobacterium
YSQTDL

SEQ ID NO: 383996 - protein, 8 aa, Mycobacterium
YTDKPGHP

SEQ ID NO: 383997 - protein, 4 aa, Mycobacterium
YTTE

SEQ ID NO: 383998 - protein, 6 aa, Mycobacterium
YVTPDD

SEQ ID NO: 383999 - protein, 5 aa, Mycobacterium
AAAAG

SEQ ID NO: 384000 - protein, 7 aa, Mycobacterium
AAADEVS

SEQ ID NO: 384001 - protein, 8 aa, Mycobacterium
AAADEVST

SEQ ID NO: 384002 - protein, 6 aa, Mycobacterium
AAAGGR

SEQ ID NO: 384003 - protein, 7 aa, Mycobacterium
AAAGTPL

SEQ ID NO: 384004 - protein, 12 aa, Mycobacterium
AAAKAAGKVRME

SEQ ID NO: 384005 - protein, 5 aa, Mycobacterium
AAAPY

SEQ ID NO: 384006 - protein, 4 aa, Mycobacterium
AAAQ

SEQ ID NO: 384007 - protein, 9 aa, Mycobacterium
AADAPDTRR

SEQ ID NO: 384008 - protein, 6 aa, Mycobacterium
AADETG

SEQ ID NO: 384009 - protein, 7 aa, Mycobacterium
AADINAA

SEQ ID NO: 384010 - protein, 4 aa, Mycobacterium
AADL

SEQ ID NO: 384011 - protein, 4 aa, Mycobacterium
AADR

SEQ ID NO: 384012 - protein, 9 aa, Mycobacterium
AAEANRRRR

SEQ ID NO: 384013 - protein, 4 aa, Mycobacterium
AAED

SEQ ID NO: 384014 - protein, 4 aa, Mycobacterium
AAEH

SEQ ID NO: 384015 - protein, 7 aa, Mycobacterium
AAEKGGY

SEQ ID NO: 384016 - protein, 4 aa, Mycobacterium
AAEL

SEQ ID NO: 384017 - protein, 7 aa, Mycobacterium
AAEPSPL

SEQ ID NO: 384018 - protein, 4 aa, Mycobacterium
AAER

SEQ ID NO: 384019 - protein, 5 aa, Mycobacterium
AAFGG

SEQ ID NO: 384020 - protein, 5 aa, Mycobacterium
AAGAD

SEQ ID NO: 384021 - protein, 10 aa, Mycobacterium
AAGATGSVAG

SEQ ID NO: 384022 - protein, 7 aa, Mycobacterium
AAGERVR

SEQ ID NO: 384023 - protein, 6 aa, Mycobacterium
AAGGLG

SEQ ID NO: 384024 - protein, 5 aa, Mycobacterium
AAGKG

SEQ ID NO: 384025 - protein, 7 aa, Mycobacterium
AAGMDKE

SEQ ID NO: 384026 - protein, 6 aa, Mycobacterium
AAGQKG

SEQ ID NO: 384027 - protein, 10 aa, Mycobacterium
AAGRDAGAEV

SEQ ID NO: 384028 - protein, 5 aa, Mycobacterium
AAGRS

SEQ ID NO: 384029 - protein, 7 aa, Mycobacterium
AAGRTGR

SEQ ID NO: 384030 - protein, 4 aa, Mycobacterium
AAHG

SEQ ID NO: 384031 - protein, 8 aa, Mycobacterium
AAHPGRPD

SEQ ID NO: 384032 - protein, 4 aa, Mycobacterium
AAIG

SEQ ID NO: 384033 - protein, 10 aa, Mycobacterium
AAKAGGGSIN

SEQ ID NO: 384034 - protein, 5 aa, Mycobacterium
AAKDT

SEQ ID NO: 384035 - protein, 4 aa, Mycobacterium
AAKE

SEQ ID NO: 384036 - protein, 7 aa, Mycobacterium
AAPAPDA

SEQ ID NO: 384037 - protein, 9 aa, Mycobacterium
AAPDYGRDE

SEQ ID NO: 384038 - protein, 4 aa, Mycobacterium
AAPG

SEQ ID NO: 384039 - protein, 6 aa, Mycobacterium
AAPGAH

SEQ ID NO: 384040 - protein, 5 aa, Mycobacterium
AAPGP

SEQ ID NO: 384041 - protein, 5 aa, Mycobacterium
AAPGY

SEQ ID NO: 384042 - protein, 7 aa, Mycobacterium
AAPIPKE

SEQ ID NO: 384043 - protein, 4 aa, Mycobacterium
AAQG

SEQ ID NO: 384044 - protein, 7 aa, Mycobacterium
AAQIGSG

SEQ ID NO: 384045 - protein, 5 aa, Mycobacterium
AAQLG

SEQ ID NO: 384046 - protein, 8 aa, Mycobacterium
AAQPSQDR

SEQ ID NO: 384047 - protein, 13 aa, Mycobacterium
AAQTPGSIHEGGE

SEQ ID NO: 384048 - protein, 4 aa, Mycobacterium
AARG

SEQ ID NO: 384049 - protein, 8 aa, Mycobacterium
AARGAGPE

SEQ ID NO: 384050 - protein, 4 aa, Mycobacterium
AARR

SEQ ID NO: 384051 - protein, 5 aa, Mycobacterium
AARTL

SEQ ID NO: 384052 - protein, 7 aa, Mycobacterium
AARVSDQ

SEQ ID NO: 384053 - protein, 6 aa, Mycobacterium
AASASL

SEQ ID NO: 384054 - protein, 4 aa, Mycobacterium
AASG

SEQ ID NO: 384055 - protein, 10 aa, Mycobacterium
AASGAPGTRV

SEQ ID NO: 384056 - protein, 4 aa, Mycobacterium
AAST

SEQ ID NO: 384057 - protein, 11 aa, Mycobacterium
AATLSGGEAQR

SEQ ID NO: 384058 - protein, 8 aa, Mycobacterium
AATNHNTR

SEQ ID NO: 384059 - protein, 8 aa, Mycobacterium
AATRGGQR

SEQ ID NO: 384060 - protein, 4 aa, Mycobacterium
AATT

SEQ ID NO: 384061 - protein, 7 aa, Mycobacterium
AATTPAN

SEQ ID NO: 384062 - protein, 4 aa, Mycobacterium
AATV

SEQ ID NO: 384063 - protein, 4 aa, Mycobacterium
AAVG

SEQ ID NO: 384064 - protein, 6 aa, Mycobacterium
AAVTGG

SEQ ID NO: 384065 - protein, 13 aa, Mycobacterium
AAYERGRPSYPPE

SEQ ID NO: 384066 - protein, 4 aa, Mycobacterium
ACPP

SEQ ID NO: 384067 - protein, 5 aa, Mycobacterium
ACSRQ

SEQ ID NO: 384068 - protein, 4 aa, Mycobacterium
ADAD

SEQ ID NO: 384069 - protein, 5 aa, Mycobacterium
ADADD

SEQ ID NO: 384070 - protein, 13 aa, Mycobacterium
ADADDDHSDHDMG

SEQ ID NO: 384071 - protein, 8 aa, Mycobacterium
ADAEGVTK

SEQ ID NO: 384072 - protein, 4 aa, Mycobacterium
ADAS

SEQ ID NO: 384073 - protein, 4 aa, Mycobacterium
ADAV

SEQ ID NO: 384074 - protein, 6 aa, Mycobacterium
ADDPAQ

SEQ ID NO: 384075 - protein, 6 aa, Mycobacterium
ADDPEF

SEQ ID NO: 384076 - protein, 8 aa, Mycobacterium
ADDRGDPV

SEQ ID NO: 384077 - protein, 5 aa, Mycobacterium
ADDSR

SEQ ID NO: 384078 - protein, 8 aa, Mycobacterium
ADESDGSL

SEQ ID NO: 384079 - protein, 5 aa, Mycobacterium
ADEVS

SEQ ID NO: 384080 - protein, 4 aa, Mycobacterium
ADGA

SEQ ID NO: 384081 - protein, 9 aa, Mycobacterium
ADGEPTEDQ

SEQ ID NO: 384082 - protein, 4 aa, Mycobacterium
ADGG

SEQ ID NO: 384083 - protein, 9 aa, Mycobacterium
ADGGTRTAA

SEQ ID NO: 384084 - protein, 8 aa, Mycobacterium
ADGPTEAH

SEQ ID NO: 384085 - protein, 9 aa, Mycobacterium
ADGSHAPEQ

SEQ ID NO: 384086 - protein, 14 aa, Mycobacterium
ADGTKFGKSTGGGS

SEQ ID NO: 384087 - protein, 5 aa, Mycobacterium
ADGTL

SEQ ID NO: 384088 - protein, 12 aa, Mycobacterium
ADHSINRLRLRK

SEQ ID NO: 384089 - protein, 4 aa, Mycobacterium
ADLD

SEQ ID NO: 384090 - protein, 6 aa, Mycobacterium
ADNSPH

SEQ ID NO: 384091 - protein, 7 aa, Mycobacterium
ADPARRL

SEQ ID NO: 384092 - protein, 5 aa, Mycobacterium
ADPEF

SEQ ID NO: 384093 - protein, 7 aa, Mycobacterium
ADPNQDI

SEQ ID NO: 384094 - protein, 5 aa, Mycobacterium
ADPTV

SEQ ID NO: 384095 - protein, 7 aa, Mycobacterium
ADPYPTY

SEQ ID NO: 384096 - protein, 4 aa, Mycobacterium
ADRE

SEQ ID NO: 384097 - protein, 5 aa, Mycobacterium
ADRGV

SEQ ID NO: 384098 - protein, 4 aa, Mycobacterium
ADTA

SEQ ID NO: 384099 - protein, 7 aa, Mycobacterium
ADTAAAA

SEQ ID NO: 384100 - protein, 4 aa, Mycobacterium
ADTD

SEQ ID NO: 384101 - protein, 4 aa, Mycobacterium
ADVD

SEQ ID NO: 384102 - protein, 5 aa, Mycobacterium
ADWPD

SEQ ID NO: 384103 - protein, 8 aa, Mycobacterium
AEAEKTRK

SEQ ID NO: 384104 - protein, 4 aa, Mycobacterium
AEAI

SEQ ID NO: 384105 - protein, 4 aa, Mycobacterium
AEAP

SEQ ID NO: 384106 - protein, 4 aa, Mycobacterium
AEAT

SEQ ID NO: 384107 - protein, 4 aa, Mycobacterium
AEDA

SEQ ID NO: 384108 - protein, 8 aa, Mycobacterium
AEDPARGF

SEQ ID NO: 384109 - protein, 9 aa, Mycobacterium
AEDPPAKAR

SEQ ID NO: 384110 - protein, 4 aa, Mycobacterium
AEEF

SEQ ID NO: 384111 - protein, 4 aa, Mycobacterium
AEEG

SEQ ID NO: 384112 - protein, 4 aa, Mycobacterium
AEEQ

SEQ ID NO: 384113 - protein, 16 aa, Mycobacterium
AEERGYTATKHQREVG

SEQ ID NO: 384114 - protein, 5 aa, Mycobacterium
AEGAT

SEQ ID NO: 384115 - protein, 13 aa, Mycobacterium
AEGKATELANREG

SEQ ID NO: 384116 - protein, 5 aa, Mycobacterium
AEGTV

SEQ ID NO: 384117 - protein, 8 aa, Mycobacterium
AEKNTEEM

SEQ ID NO: 384118 - protein, 5 aa, Mycobacterium
AELPA

SEQ ID NO: 384119 - protein, 8 aa, Mycobacterium
AEPATVSE

SEQ ID NO: 384120 - protein, 9 aa, Mycobacterium
AEPDADAPH

SEQ ID NO: 384121 - protein, 9 aa, Mycobacterium
AEPVDSYGV

SEQ ID NO: 384122 - protein, 4 aa, Mycobacterium
AEQD

SEQ ID NO: 384123 - protein, 5 aa, Mycobacterium
AEQFA

SEQ ID NO: 384124 - protein, 10 aa, Mycobacterium
AEQKHSIDDP

SEQ ID NO: 384125 - protein, 4 aa, Mycobacterium
AEQL

SEQ ID NO: 384126 - protein, 4 aa, Mycobacterium
AERD

SEQ ID NO: 384127 - protein, 4 aa, Mycobacterium
AERP

SEQ ID NO: 384128 - protein, 5 aa, Mycobacterium
AESGK

SEQ ID NO: 384129 - protein, 9 aa, Mycobacterium
AESPRSRTR

SEQ ID NO: 384130 - protein, 20 aa, Mycobacterium
AESTDDAKAETILDEVLAAA

SEQ ID NO: 384131 - protein, 7 aa, Mycobacterium
AETAGSQ

SEQ ID NO: 384132 - protein, 6 aa, Mycobacterium
AETTVG

SEQ ID NO: 384133 - protein, 5 aa, Mycobacterium
AETYG

SEQ ID NO: 384134 - protein, 5 aa, Mycobacterium
AEVGR

SEQ ID NO: 384135 - protein, 5 aa, Mycobacterium
AGAAG

SEQ ID NO: 384136 - protein, 7 aa, Mycobacterium
AGADEVS

SEQ ID NO: 384137 - protein, 7 aa, Mycobacterium
AGANPLG

SEQ ID NO: 384138 - protein, 9 aa, Mycobacterium
AGAQSPKET

SEQ ID NO: 384139 - protein, 11 aa, Mycobacterium
AGDADAVAERR

SEQ ID NO: 384140 - protein, 9 aa, Mycobacterium
AGDDPEVNE

SEQ ID NO: 384141 - protein, 10 aa, Mycobacterium
AGDGVETGRH

SEQ ID NO: 384142 - protein, 6 aa, Mycobacterium
AGDPDY

SEQ ID NO: 384143 - protein, 6 aa, Mycobacterium
AGEGDA

SEQ ID NO: 384144 - protein, 10 aa, Mycobacterium
AGEKAKDDPF

SEQ ID NO: 384145 - protein, 4 aa, Mycobacterium
AGEL

SEQ ID NO: 384146 - protein, 4 aa, Mycobacterium
AGFE

SEQ ID NO: 384147 - protein, 6 aa, Mycobacterium
AGFGTS

SEQ ID NO: 384148 - protein, 8 aa, Mycobacterium
AGGEGPAT

SEQ ID NO: 384149 - protein, 11 aa, Mycobacterium
AGGEKGKPRYD

SEQ ID NO: 384150 - protein, 4 aa, Mycobacterium
AGGF

SEQ ID NO: 384151 - protein, 5 aa, Mycobacterium
AGGTE

SEQ ID NO: 384152 - protein, 8 aa, Mycobacterium
AGGTREPI

SEQ ID NO: 384153 - protein, 4 aa, Mycobacterium
AGGV

SEQ ID NO: 384154 - protein, 5 aa, Mycobacterium
AGHPG

SEQ ID NO: 384155 - protein, 10 aa, Mycobacterium
AGKPLASSNR

SEQ ID NO: 384156 - protein, 5 aa, Mycobacterium
AGLDG

SEQ ID NO: 384157 - protein, 4 aa, Mycobacterium
AGLE

SEQ ID NO: 384158 - protein, 6 aa, Mycobacterium
AGLPPG

SEQ ID NO: 384159 - protein, 4 aa, Mycobacterium
AGLS

SEQ ID NO: 384160 - protein, 5 aa, Mycobacterium
AGNGG

SEQ ID NO: 384161 - protein, 7 aa, Mycobacterium
AGPDEVD

SEQ ID NO: 384162 - protein, 15 aa, Mycobacterium
AGPDSTLQSQPANAI

SEQ ID NO: 384163 - protein, 6 aa, Mycobacterium
AGPEIG

SEQ ID NO: 384164 - protein, 7 aa, Mycobacterium
AGPEIGV

SEQ ID NO: 384165 - protein, 4 aa, Mycobacterium
AGPG

SEQ ID NO: 384166 - protein, 8 aa, Mycobacterium
AGPGAHGY

SEQ ID NO: 384167 - protein, 6 aa, Mycobacterium
AGPHPF

SEQ ID NO: 384168 - protein, 6 aa, Mycobacterium
AGPRPV

SEQ ID NO: 384169 - protein, 5 aa, Mycobacterium
AGRAG

SEQ ID NO: 384170 - protein, 4 aa, Mycobacterium
AGRQ

SEQ ID NO: 384171 - protein, 4 aa, Mycobacterium
AGRR

SEQ ID NO: 384172 - protein, 4 aa, Mycobacterium
AGRS

SEQ ID NO: 384173 - protein, 5 aa, Mycobacterium
AGSRA

SEQ ID NO: 384174 - protein, 4 aa, Mycobacterium
AGTF

SEQ ID NO: 384175 - protein, 8 aa, Mycobacterium
AGTSPRRA

SEQ ID NO: 384176 - protein, 4 aa, Mycobacterium
AGTT

SEQ ID NO: 384177 - protein, 6 aa, Mycobacterium
AGTTTR

SEQ ID NO: 384178 - protein, 6 aa, Mycobacterium
AGTVKP

SEQ ID NO: 384179 - protein, 7 aa, Mycobacterium
AGVRNAA

SEQ ID NO: 384180 - protein, 7 aa, Mycobacterium
AGVSRPT

SEQ ID NO: 384181 - protein, 9 aa, Mycobacterium
AGVTTYSTD

SEQ ID NO: 384182 - protein, 17 aa, Mycobacterium
AHDEAARTLAAKTGDRF

SEQ ID NO: 384183 - protein, 7 aa, Mycobacterium
AHHTNAT

SEQ ID NO: 384184 - protein, 4 aa, Mycobacterium
AHPG

SEQ ID NO: 384185 - protein, 4 aa, Mycobacterium
AHQD

SEQ ID NO: 384186 - protein, 7 aa, Mycobacterium
AHSVDSS

SEQ ID NO: 384187 - protein, 11 aa, Mycobacterium
AIDETERRRAK

SEQ ID NO: 384188 - protein, 7 aa, Mycobacterium
AIGGTRA

SEQ ID NO: 384189 - protein, 17 aa, Mycobacterium
AINQDGASGGLTVPNGV

SEQ ID NO: 384190 - protein, 9 aa, Mycobacterium
AKAAGDAGI

SEQ ID NO: 384191 - protein, 6 aa, Mycobacterium
AKAAGI

SEQ ID NO: 384192 - protein, 6 aa, Mycobacterium
AKAAVE

SEQ ID NO: 384193 - protein, 9 aa, Mycobacterium
AKANTGDGI

SEQ ID NO: 384194 - protein, 9 aa, Mycobacterium
AKDSRTTAE

SEQ ID NO: 384195 - protein, 6 aa, Mycobacterium
AKEAGA

SEQ ID NO: 384196 - protein, 5 aa, Mycobacterium
AKGKA

SEQ ID NO: 384197 - protein, 14 aa, Mycobacterium
AKGWPEDGIAPGTR

SEQ ID NO: 384198 - protein, 6 aa, Mycobacterium
AKMPAD

SEQ ID NO: 384199 - protein, 15 aa, Mycobacterium
AKNTDTREHDIADSD

SEQ ID NO: 384200 - protein, 10 aa, Mycobacterium
AKPTPADAAD

SEQ ID NO: 384201 - protein, 10 aa, Mycobacterium
AKQTAKSGAT

SEQ ID NO: 384202 - protein, 8 aa, Mycobacterium
AKRAVDAG

SEQ ID NO: 384203 - protein, 9 aa, Mycobacterium
ALQESRDRV

SEQ ID NO: 384204 - protein, 7 aa, Mycobacterium
ALSGSGP

SEQ ID NO: 384205 - protein, 5 aa, Mycobacterium
AMSAE

SEQ ID NO: 384206 - protein, 7 aa, Mycobacterium
ANKVPGA

SEQ ID NO: 384207 - protein, 5 aa, Mycobacterium
ANPRG

SEQ ID NO: 384208 - protein, 26 aa, Mycobacterium
ANSHGQKVQAAGNNMAQTDSAVGSSW

SEQ ID NO: 384209 - protein, 7 aa, Mycobacterium
ANTLSSY

SEQ ID NO: 384210 - protein, 6 aa, Mycobacterium
ANTTRD

SEQ ID NO: 384211 - protein, 6 aa, Mycobacterium
ANVQDG

SEQ ID NO: 384212 - protein, 5 aa, Mycobacterium
APAKV

SEQ ID NO: 384213 - protein, 9 aa, Mycobacterium
APALSEKDI

SEQ ID NO: 384214 - protein, 6 aa, Mycobacterium
APAQGA

SEQ ID NO: 384215 - protein, 4 aa, Mycobacterium
APAR

SEQ ID NO: 384216 - protein, 8 aa, Mycobacterium
APASDSAG

SEQ ID NO: 384217 - protein, 6 aa, Mycobacterium
APASQV

SEQ ID NO: 384218 - protein, 4 aa, Mycobacterium
APDG

SEQ ID NO: 384219 - protein, 10 aa, Mycobacterium
APDPRQASSL

SEQ ID NO: 384220 - protein, 7 aa, Mycobacterium
APDTGNA

SEQ ID NO: 384221 - protein, 4 aa, Mycobacterium
APDV

SEQ ID NO: 384222 - protein, 4 aa, Mycobacterium
APEA

SEQ ID NO: 384223 - protein, 4 aa, Mycobacterium
APED

SEQ ID NO: 384224 - protein, 6 aa, Mycobacterium
APEGEG

SEQ ID NO: 384225 - protein, 4 aa, Mycobacterium
APEI

SEQ ID NO: 384226 - protein, 4 aa, Mycobacterium
APEL

SEQ ID NO: 384227 - protein, 4 aa, Mycobacterium
APER

SEQ ID NO: 384228 - protein, 4 aa, Mycobacterium
APEV

SEQ ID NO: 384229 - protein, 11 aa, Mycobacterium
APGQVGSSAMP

SEQ ID NO: 384230 - protein, 4 aa, Mycobacterium
APGT

SEQ ID NO: 384231 - protein, 8 aa, Mycobacterium
APHSPMAG

SEQ ID NO: 384232 - protein, 7 aa, Mycobacterium
APKPMLP

SEQ ID NO: 384233 - protein, 15 aa, Mycobacterium
APLVPGTPDPVKDAD

SEQ ID NO: 384234 - protein, 6 aa, Mycobacterium
APPGIR

SEQ ID NO: 384235 - protein, 6 aa, Mycobacterium
APPVEE

SEQ ID NO: 384236 - protein, 5 aa, Mycobacterium
APQRT

SEQ ID NO: 384237 - protein, 8 aa, Mycobacterium
APRDATRL

SEQ ID NO: 384238 - protein, 4 aa, Mycobacterium
APRE

SEQ ID NO: 384239 - protein, 6 aa, Mycobacterium
APRPGE

SEQ ID NO: 384240 - protein, 8 aa, Mycobacterium
APSARTRM

SEQ ID NO: 384241 - protein, 14 aa, Mycobacterium
APSGELKTKPTQHS

SEQ ID NO: 384242 - protein, 5 aa, Mycobacterium
APSGT

SEQ ID NO: 384243 - protein, 6 aa, Mycobacterium
APSRDN

SEQ ID NO: 384244 - protein, 4 aa, Mycobacterium
APTA

SEQ ID NO: 384245 - protein, 5 aa, Mycobacterium
APTQT

SEQ ID NO: 384246 - protein, 6 aa, Mycobacterium
APTRRQ

SEQ ID NO: 384247 - protein, 4 aa, Mycobacterium
APVD

SEQ ID NO: 384248 - protein, 12 aa, Mycobacterium
APVDECKDKDMT

SEQ ID NO: 384249 - protein, 8 aa, Mycobacterium
APYETTNR

SEQ ID NO: 384250 - protein, 11 aa, Mycobacterium
AQARSFTGSQA

SEQ ID NO: 384251 - protein, 7 aa, Mycobacterium
AQATGSG

SEQ ID NO: 384252 - protein, 4 aa, Mycobacterium
AQGA

SEQ ID NO: 384253 - protein, 5 aa, Mycobacterium
AQGYS

SEQ ID NO: 384254 - protein, 5 aa, Mycobacterium
AQPLP

SEQ ID NO: 384255 - protein, 4 aa, Mycobacterium
AQRG

SEQ ID NO: 384256 - protein, 4 aa, Mycobacterium
AQRK

SEQ ID NO: 384257 - protein, 4 aa, Mycobacterium
AQRL

SEQ ID NO: 384258 - protein, 4 aa, Mycobacterium
AQRQ

SEQ ID NO: 384259 - protein, 12 aa, Mycobacterium
AQRQATKEAGQI

SEQ ID NO: 384260 - protein, 7 aa, Mycobacterium
AQRRDHR

SEQ ID NO: 384261 - protein, 7 aa, Mycobacterium
ARADLGQ

SEQ ID NO: 384262 - protein, 4 aa, Mycobacterium
ARAE

SEQ ID NO: 384263 - protein, 5 aa, Mycobacterium
ARAGA

SEQ ID NO: 384264 - protein, 5 aa, Mycobacterium
ARDAG

SEQ ID NO: 384265 - protein, 4 aa, Mycobacterium
ARDD

SEQ ID NO: 384266 - protein, 6 aa, Mycobacterium
ARDTEI

SEQ ID NO: 384267 - protein, 4 aa, Mycobacterium
AREG

SEQ ID NO: 384268 - protein, 5 aa, Mycobacterium
ARFAD

SEQ ID NO: 384269 - protein, 4 aa, Mycobacterium
ARGG

SEQ ID NO: 384270 - protein, 8 aa, Mycobacterium
ARGKSGRL

SEQ ID NO: 384271 - protein, 7 aa, Mycobacterium
ARGRGPV

SEQ ID NO: 384272 - protein, 4 aa, Mycobacterium
ARGV

SEQ ID NO: 384273 - protein, 5 aa, Mycobacterium
ARGYR

SEQ ID NO: 384274 - protein, 9 aa, Mycobacterium
ARKDGYTST

SEQ ID NO: 384275 - protein, 7 aa, Mycobacterium
ARKHPHS

SEQ ID NO: 384276 - protein, 4 aa, Mycobacterium
ARLG

SEQ ID NO: 384277 - protein, 6 aa, Mycobacterium
ARNVSG

SEQ ID NO: 384278 - protein, 4 aa, Mycobacterium
ARPD

SEQ ID NO: 384279 - protein, 4 aa, Mycobacterium
ARPE

SEQ ID NO: 384280 - protein, 8 aa, Mycobacterium
ARRDDEAR

SEQ ID NO: 384281 - protein, 12 aa, Mycobacterium
ARRDQVRATGRA

SEQ ID NO: 384282 - protein, 4 aa, Mycobacterium
ARRG

SEQ ID NO: 384283 - protein, 7 aa, Mycobacterium
ARRGEEL

SEQ ID NO: 384284 - protein, 12 aa, Mycobacterium
ARRGPSKADWTD

SEQ ID NO: 384285 - protein, 11 aa, Mycobacterium
ARRGSVTDLSP

SEQ ID NO: 384286 - protein, 4 aa, Mycobacterium
ARRP

SEQ ID NO: 384287 - protein, 7 aa, Mycobacterium
ARSKLTR

SEQ ID NO: 384288 - protein, 5 aa, Mycobacterium
ARSRS

SEQ ID NO: 384289 - protein, 8 aa, Mycobacterium
ARTAGSGE

SEQ ID NO: 384290 - protein, 4 aa, Mycobacterium
ARTP

SEQ ID NO: 384291 - protein, 8 aa, Mycobacterium
ARTPEETA

SEQ ID NO: 384292 - protein, 4 aa, Mycobacterium
ARTR

SEQ ID NO: 384293 - protein, 9 aa, Mycobacterium
ARTRRDGRS

SEQ ID NO: 384294 - protein, 5 aa, Mycobacterium
ARTSG

SEQ ID NO: 384295 - protein, 21 aa, Mycobacterium
ARYGGAPKTTIQDEKAQRATD

SEQ ID NO: 384296 - protein, 4 aa, Mycobacterium
ARYI

SEQ ID NO: 384297 - protein, 4 aa, Mycobacterium
ASAQ

SEQ ID NO: 384298 - protein, 8 aa, Mycobacterium
ASATDVSK

SEQ ID NO: 384299 - protein, 7 aa, Mycobacterium
ASATNLP

SEQ ID NO: 384300 - protein, 7 aa, Mycobacterium
ASDRPNR

SEQ ID NO: 384301 - protein, 4 aa, Mycobacterium
ASEA

SEQ ID NO: 384302 - protein, 7 aa, Mycobacterium
ASERPGH

SEQ ID NO: 384303 - protein, 4 aa, Mycobacterium
ASGA

SEQ ID NO: 384304 - protein, 5 aa, Mycobacterium
ASGAP

SEQ ID NO: 384305 - protein, 5 aa, Mycobacterium
ASGAS

SEQ ID NO: 384306 - protein, 7 aa, Mycobacterium
ASGEQDA

SEQ ID NO: 384307 - protein, 5 aa, Mycobacterium
ASGGV

SEQ ID NO: 384308 - protein, 6 aa, Mycobacterium
ASGIGT

SEQ ID NO: 384309 - protein, 7 aa, Mycobacterium
ASGPVYD

SEQ ID NO: 384310 - protein, 4 aa, Mycobacterium
ASGS

SEQ ID NO: 384311 - protein, 6 aa, Mycobacterium
ASGTPI

SEQ ID NO: 384312 - protein, 7 aa, Mycobacterium
ASGYAGG

SEQ ID NO: 384313 - protein, 5 aa, Mycobacterium
ASLSD

SEQ ID NO: 384314 - protein, 6 aa, Mycobacterium
ASPGFR

SEQ ID NO: 384315 - protein, 6 aa, Mycobacterium
ASPRAS

SEQ ID NO: 384316 - protein, 4 aa, Mycobacterium
ASPV

SEQ ID NO: 384317 - protein, 8 aa, Mycobacterium
ASQEAKPD

SEQ ID NO: 384318 - protein, 6 aa, Mycobacterium
ASQELR

SEQ ID NO: 384319 - protein, 8 aa, Mycobacterium
ASRAEQGL

SEQ ID NO: 384320 - protein, 4 aa, Mycobacterium
ASRL

SEQ ID NO: 384321 - protein, 7 aa, Mycobacterium
ASRPTFQ

SEQ ID NO: 384322 - protein, 7 aa, Mycobacterium
ASSAPDW

SEQ ID NO: 384323 - protein, 6 aa, Mycobacterium
ASSGIG

SEQ ID NO: 384324 - protein, 8 aa, Mycobacterium
ASSGIGEA

SEQ ID NO: 384325 - protein, 7 aa, Mycobacterium
ASSLRKA

SEQ ID NO: 384326 - protein, 8 aa, Mycobacterium
ASSSGRAT

SEQ ID NO: 384327 - protein, 4 aa, Mycobacterium
ASSV

SEQ ID NO: 384328 - protein, 4 aa, Mycobacterium
ASTL

SEQ ID NO: 384329 - protein, 4 aa, Mycobacterium
ASVD

SEQ ID NO: 384330 - protein, 9 aa, Mycobacterium
ASVGSVADA

SEQ ID NO: 384331 - protein, 6 aa, Mycobacterium
ATADTE

SEQ ID NO: 384332 - protein, 4 aa, Mycobacterium
ATAG

SEQ ID NO: 384333 - protein, 5 aa, Mycobacterium
ATAGA

SEQ ID NO: 384334 - protein, 7 aa, Mycobacterium
ATAGAPA

SEQ ID NO: 384335 - protein, 6 aa, Mycobacterium
ATARPP

SEQ ID NO: 384336 - protein, 5 aa, Mycobacterium
ATATG

SEQ ID NO: 384337 - protein, 4 aa, Mycobacterium
ATAV

SEQ ID NO: 384338 - protein, 4 aa, Mycobacterium
ATDA

SEQ ID NO: 384339 - protein, 5 aa, Mycobacterium
ATDAD

SEQ ID NO: 384340 - protein, 4 aa, Mycobacterium
ATDE

SEQ ID NO: 384341 - protein, 4 aa, Mycobacterium
ATDG

SEQ ID NO: 384342 - protein, 5 aa, Mycobacterium
ATEDR

SEQ ID NO: 384343 - protein, 7 aa, Mycobacterium
ATGDDKA

SEQ ID NO: 384344 - protein, 5 aa, Mycobacterium
ATGDE

SEQ ID NO: 384345 - protein, 8 aa, Mycobacterium
ATGDPEAF

SEQ ID NO: 384346 - protein, 4 aa, Mycobacterium
ATGE

SEQ ID NO: 384347 - protein, 8 aa, Mycobacterium
ATGGHLGP

SEQ ID NO: 384348 - protein, 5 aa, Mycobacterium
ATKAD

SEQ ID NO: 384349 - protein, 51 aa, Mycobacterium
ATKGGNGGNGGIGGNAGTAGLAGTGGTGGTTGAVGNAGHGGNGGNGADGDI

SEQ ID NO: 384350 - protein, 6 aa, Mycobacterium
ATQDTV

SEQ ID NO: 384351 - protein, 4 aa, Mycobacterium
ATRE

SEQ ID NO: 384352 - protein, 4 aa, Mycobacterium
ATRG

SEQ ID NO: 384353 - protein, 7 aa, Mycobacterium
ATRGAEM

SEQ ID NO: 384354 - protein, 9 aa, Mycobacterium
ATRGQADAA

SEQ ID NO: 384355 - protein, 8 aa, Mycobacterium
ATRSSPAL

SEQ ID NO: 384356 - protein, 9 aa, Mycobacterium
ATRVEQRTD

SEQ ID NO: 384357 - protein, 4 aa, Mycobacterium
ATSG

SEQ ID NO: 384358 - protein, 7 aa, Mycobacterium
ATSGPGA

SEQ ID NO: 384359 - protein, 4 aa, Mycobacterium
ATSP

SEQ ID NO: 384360 - protein, 6 aa, Mycobacterium
ATSSQA

SEQ ID NO: 384361 - protein, 5 aa, Mycobacterium
ATTRA

SEQ ID NO: 384362 - protein, 4 aa, Mycobacterium
ATVE

SEQ ID NO: 384363 - protein, 16 aa, Mycobacterium
ATYRGGEAKTDAKDAR

SEQ ID NO: 384364 - protein, 17 aa, Mycobacterium
AVDGAEALRSATETRPD

SEQ ID NO: 384365 - protein, 7 aa, Mycobacterium
AVGDSES

SEQ ID NO: 384366 - protein, 5 aa, Mycobacterium
AVGEG

SEQ ID NO: 384367 - protein, 21 aa, Mycobacterium
AVNQDGASNGLTAPNGPSQQR

SEQ ID NO: 384368 - protein, 4 aa, Mycobacterium
AVPG

SEQ ID NO: 384369 - protein, 12 aa, Mycobacterium
AVRAGAKQIDGS

SEQ ID NO: 384370 - protein, 5 aa, Mycobacterium
AVRDG

SEQ ID NO: 384371 - protein, 8 aa, Mycobacterium
AVTAAPDG

SEQ ID NO: 384372 - protein, 8 aa, Mycobacterium
AYGKNGAD

SEQ ID NO: 384373 - protein, 7 aa, Mycobacterium
AYPSTLG

SEQ ID NO: 384374 - protein, 12 aa, Mycobacterium
AYSTSGGLEGIS

SEQ ID NO: 384375 - protein, 8 aa, Mycobacterium
CEKGGATF

SEQ ID NO: 384376 - protein, 4 aa, Mycobacterium
CESG

SEQ ID NO: 384377 - protein, 6 aa, Mycobacterium
CGPGRL

SEQ ID NO: 384378 - protein, 9 aa, Mycobacterium
CSGRARGRT

SEQ ID NO: 384379 - protein, 11 aa, Mycobacterium
CTTRNKRRAAR

SEQ ID NO: 384380 - protein, 4 aa, Mycobacterium
DAAE

SEQ ID NO: 384381 - protein, 9 aa, Mycobacterium
DAAEAERSG

SEQ ID NO: 384382 - protein, 8 aa, Mycobacterium
DAAHAGEY

SEQ ID NO: 384383 - protein, 4 aa, Mycobacterium
DADP

SEQ ID NO: 384384 - protein, 7 aa, Mycobacterium
DADSDEV

SEQ ID NO: 384385 - protein, 8 aa, Mycobacterium
DAEAGPTE

SEQ ID NO: 384386 - protein, 7 aa, Mycobacterium
DAETDEV

SEQ ID NO: 384387 - protein, 7 aa, Mycobacterium
DAGANAV

SEQ ID NO: 384388 - protein, 14 aa, Mycobacterium
DAGLTSSSWARGPH

SEQ ID NO: 384389 - protein, 7 aa, Mycobacterium
DAGPATR

SEQ ID NO: 384390 - protein, 7 aa, Mycobacterium
DAGSGVA

SEQ ID NO: 384391 - protein, 7 aa, Mycobacterium
DAHAPGQ

SEQ ID NO: 384392 - protein, 7 aa, Mycobacterium
DAPLESD

SEQ ID NO: 384393 - protein, 4 aa, Mycobacterium
DAQD

SEQ ID NO: 384394 - protein, 8 aa, Mycobacterium
DAQDTAEL

SEQ ID NO: 384395 - protein, 4 aa, Mycobacterium
DAQP

SEQ ID NO: 384396 - protein, 5 aa, Mycobacterium
DAQTG

SEQ ID NO: 384397 - protein, 8 aa, Mycobacterium
DATDSAVG

SEQ ID NO: 384398 - protein, 4 aa, Mycobacterium
DATE

SEQ ID NO: 384399 - protein, 4 aa, Mycobacterium
DATH

SEQ ID NO: 384400 - protein, 4 aa, Mycobacterium
DATR

SEQ ID NO: 384401 - protein, 5 aa, Mycobacterium
DATRT

SEQ ID NO: 384402 - protein, 4 aa, Mycobacterium
DATT

SEQ ID NO: 384403 - protein, 4 aa, Mycobacterium
DAVS

SEQ ID NO: 384404 - protein, 10 aa, Mycobacterium
DDAGKASAMR

SEQ ID NO: 384405 - protein, 5 aa, Mycobacterium
DDARF

SEQ ID NO: 384406 - protein, 4 aa, Mycobacterium
DDGA

SEQ ID NO: 384407 - protein, 4 aa, Mycobacterium
DDGE

SEQ ID NO: 384408 - protein, 4 aa, Mycobacterium
DDGP

SEQ ID NO: 384409 - protein, 10 aa, Mycobacterium
DDGSGRTYQL

SEQ ID NO: 384410 - protein, 4 aa, Mycobacterium
DDGV

SEQ ID NO: 384411 - protein, 4 aa, Mycobacterium
DDID

SEQ ID NO: 384412 - protein, 9 aa, Mycobacterium
DDKYDGSQN

SEQ ID NO: 384413 - protein, 4 aa, Mycobacterium
DDPL

SEQ ID NO: 384414 - protein, 5 aa, Mycobacterium
DDPSL

SEQ ID NO: 384415 - protein, 8 aa, Mycobacterium
DDPTGSAN

SEQ ID NO: 384416 - protein, 6 aa, Mycobacterium
DDPYPR

SEQ ID NO: 384417 - protein, 4 aa, Mycobacterium
DDQR

SEQ ID NO: 384418 - protein, 6 aa, Mycobacterium
DDSVPD

SEQ ID NO: 384419 - protein, 6 aa, Mycobacterium
DDYGPE

SEQ ID NO: 384420 - protein, 8 aa, Mycobacterium
DEAETGVN

SEQ ID NO: 384421 - protein, 6 aa, Mycobacterium
DEANKP

SEQ ID NO: 384422 - protein, 7 aa, Mycobacterium
DEDLDQA

SEQ ID NO: 384423 - protein, 11 aa, Mycobacterium
DEDLPSGDELG

SEQ ID NO: 384424 - protein, 6 aa, Mycobacterium
DEDTDE

SEQ ID NO: 384425 - protein, 6 aa, Mycobacterium
DEEDRH

SEQ ID NO: 384426 - protein, 11 aa, Mycobacterium
DEGDSKIGRPR

SEQ ID NO: 384427 - protein, 9 aa, Mycobacterium
DEKKTAETF

SEQ ID NO: 384428 - protein, 4 aa, Mycobacterium
DEPT

SEQ ID NO: 384429 - protein, 7 aa, Mycobacterium
DEQRTEL

SEQ ID NO: 384430 - protein, 6 aa, Mycobacterium
DEQYGQ

SEQ ID NO: 384431 - protein, 22 aa, Mycobacterium
DESEALRQARKDAELTASADSV

SEQ ID NO: 384432 - protein, 5 aa, Mycobacterium
DETGV

SEQ ID NO: 384433 - protein, 14 aa, Mycobacterium
DETTRHTLSGGTEQ

SEQ ID NO: 384434 - protein, 6 aa, Mycobacterium
DFPTGP

SEQ ID NO: 384435 - protein, 4 aa, Mycobacterium
DGAE

SEQ ID NO: 384436 - protein, 4 aa, Mycobacterium
DGAT

SEQ ID NO: 384437 - protein, 4 aa, Mycobacterium
DGDE

SEQ ID NO: 384438 - protein, 7 aa, Mycobacterium
DGDPSNV

SEQ ID NO: 384439 - protein, 5 aa, Mycobacterium
DGEEG

SEQ ID NO: 384440 - protein, 5 aa, Mycobacterium
DGGHE

SEQ ID NO: 384441 - protein, 6 aa, Mycobacterium
DGGRGY

SEQ ID NO: 384442 - protein, 4 aa, Mycobacterium
DGHP

SEQ ID NO: 384443 - protein, 8 aa, Mycobacterium
DGHPAYEA

SEQ ID NO: 384444 - protein, 4 aa, Mycobacterium
DGID

SEQ ID NO: 384445 - protein, 9 aa, Mycobacterium
DGPCTENGE

SEQ ID NO: 384446 - protein, 5 aa, Mycobacterium
DGPGR

SEQ ID NO: 384447 - protein, 4 aa, Mycobacterium
DGRA

SEQ ID NO: 384448 - protein, 5 aa, Mycobacterium
DGRPL

SEQ ID NO: 384449 - protein, 6 aa, Mycobacterium
DGRPYN

SEQ ID NO: 384450 - protein, 4 aa, Mycobacterium
DGRR

SEQ ID NO: 384451 - protein, 9 aa, Mycobacterium
DGSDIGGGA

SEQ ID NO: 384452 - protein, 4 aa, Mycobacterium
DGSE

SEQ ID NO: 384453 - protein, 8 aa, Mycobacterium
DGSPASEL

SEQ ID NO: 384454 - protein, 7 aa, Mycobacterium
DGSYGVP

SEQ ID NO: 384455 - protein, 11 aa, Mycobacterium
DGTPDKSRLGA

SEQ ID NO: 384456 - protein, 4 aa, Mycobacterium
DGTQ

SEQ ID NO: 384457 - protein, 6 aa, Mycobacterium
DGTREF

SEQ ID NO: 384458 - protein, 7 aa, Mycobacterium
DGTTSST

SEQ ID NO: 384459 - protein, 4 aa, Mycobacterium
DGVG

SEQ ID NO: 384460 - protein, 6 aa, Mycobacterium
DGVRST

SEQ ID NO: 384461 - protein, 4 aa, Mycobacterium
DGYA

SEQ ID NO: 384462 - protein, 4 aa, Mycobacterium
DGYT

SEQ ID NO: 384463 - protein, 5 aa, Mycobacterium
DHHSR

SEQ ID NO: 384464 - protein, 7 aa, Mycobacterium
DHNPIHT

SEQ ID NO: 384465 - protein, 6 aa, Mycobacterium
DHRGGR

SEQ ID NO: 384466 - protein, 12 aa, Mycobacterium
DIEDSRGERDAR

SEQ ID NO: 384467 - protein, 4 aa, Mycobacterium
DIPP

SEQ ID NO: 384468 - protein, 4 aa, Mycobacterium
DKEA

SEQ ID NO: 384469 - protein, 4 aa, Mycobacterium
DLAN

SEQ ID NO: 384470 - protein, 11 aa, Mycobacterium
DLDDEAAAAAE

SEQ ID NO: 384471 - protein, 10 aa, Mycobacterium
DLGDEGSPIA

SEQ ID NO: 384472 - protein, 4 aa, Mycobacterium
DLGE

SEQ ID NO: 384473 - protein, 7 aa, Mycobacterium
DLPAKAR

SEQ ID NO: 384474 - protein, 13 aa, Mycobacterium
DLPEPKKVKPPRT

SEQ ID NO: 384475 - protein, 4 aa, Mycobacterium
DLPG

SEQ ID NO: 384476 - protein, 9 aa, Mycobacterium
DLQEDKEPV

SEQ ID NO: 384477 - protein, 5 aa, Mycobacterium
DLQPG

SEQ ID NO: 384478 - protein, 6 aa, Mycobacterium
DLSDRD

SEQ ID NO: 384479 - protein, 12 aa, Mycobacterium
DLVPEDRAGDHA

SEQ ID NO: 384480 - protein, 16 aa, Mycobacterium
DNGASGEGGPNGSVNE

SEQ ID NO: 384481 - protein, 7 aa, Mycobacterium
DNSASRC

SEQ ID NO: 384482 - protein, 7 aa, Mycobacterium
DNTYPGA

SEQ ID NO: 384483 - protein, 9 aa, Mycobacterium
DPADKRAQW

SEQ ID NO: 384484 - protein, 5 aa, Mycobacterium
DPAGG

SEQ ID NO: 384485 - protein, 5 aa, Mycobacterium
DPAHQ

SEQ ID NO: 384486 - protein, 4 aa, Mycobacterium
DPAR

SEQ ID NO: 384487 - protein, 9 aa, Mycobacterium
DPARRGETL

SEQ ID NO: 384488 - protein, 5 aa, Mycobacterium
DPDAD

SEQ ID NO: 384489 - protein, 4 aa, Mycobacterium
DPDE

SEQ ID NO: 384490 - protein, 7 aa, Mycobacterium
DPDTARE

SEQ ID NO: 384491 - protein, 4 aa, Mycobacterium
DPEA

SEQ ID NO: 384492 - protein, 4 aa, Mycobacterium
DPEF

SEQ ID NO: 384493 - protein, 6 aa, Mycobacterium
DPEFGT

SEQ ID NO: 384494 - protein, 5 aa, Mycobacterium
DPELR

SEQ ID NO: 384495 - protein, 12 aa, Mycobacterium
DPFADDPCDPSA

SEQ ID NO: 384496 - protein, 7 aa, Mycobacterium
DPGSRGA

SEQ ID NO: 384497 - protein, 4 aa, Mycobacterium
DPLT

SEQ ID NO: 384498 - protein, 6 aa, Mycobacterium
DPPPEL

SEQ ID NO: 384499 - protein, 10 aa, Mycobacterium
DPPVTPEEPL

SEQ ID NO: 384500 - protein, 9 aa, Mycobacterium
DPQAPKRQA

SEQ ID NO: 384501 - protein, 6 aa, Mycobacterium
DPRDTR

SEQ ID NO: 384502 - protein, 5 aa, Mycobacterium
DPRLT

SEQ ID NO: 384503 - protein, 5 aa, Mycobacterium
DPRRR

SEQ ID NO: 384504 - protein, 7 aa, Mycobacterium
DPSFSEK

SEQ ID NO: 384505 - protein, 12 aa, Mycobacterium
DPSSTRTGGSIL

SEQ ID NO: 384506 - protein, 5 aa, Mycobacterium
DPTAY

SEQ ID NO: 384507 - protein, 4 aa, Mycobacterium
DPTR

SEQ ID NO: 384508 - protein, 5 aa, Mycobacterium
DPTVS

SEQ ID NO: 384509 - protein, 12 aa, Mycobacterium
DQPNLGGSGGYS

SEQ ID NO: 384510 - protein, 8 aa, Mycobacterium
DQSDADGL

SEQ ID NO: 384511 - protein, 26 aa, Mycobacterium
DQYYSPDFGQATGAAVPLDDYGYSDY

SEQ ID NO: 384512 - protein, 8 aa, Mycobacterium
DRARELRE

SEQ ID NO: 384513 - protein, 4 aa, Mycobacterium
DRAT

SEQ ID NO: 384514 - protein, 4 aa, Mycobacterium
DRDG

SEQ ID NO: 384515 - protein, 16 aa, Mycobacterium
DRGDRSVTLRPEGTAG

SEQ ID NO: 384516 - protein, 4 aa, Mycobacterium
DRGI

SEQ ID NO: 384517 - protein, 9 aa, Mycobacterium
DRGSDGQWR

SEQ ID NO: 384518 - protein, 14 aa, Mycobacterium
DRGTQLQRARAGEI

SEQ ID NO: 384519 - protein, 6 aa, Mycobacterium
DRHYTN

SEQ ID NO: 384520 - protein, 6 aa, Mycobacterium
DRPGAL

SEQ ID NO: 384521 - protein, 5 aa, Mycobacterium
DRPGR

SEQ ID NO: 384522 - protein, 7 aa, Mycobacterium
DRPGSLG

SEQ ID NO: 384523 - protein, 8 aa, Mycobacterium
DRPNRGRR

SEQ ID NO: 384524 - protein, 16 aa, Mycobacterium
DRQEVDNALNQAAKEL

SEQ ID NO: 384525 - protein, 8 aa, Mycobacterium
DRRARKGE

SEQ ID NO: 384526 - protein, 5 aa, Mycobacterium
DRRRG

SEQ ID NO: 384527 - protein, 4 aa, Mycobacterium
DRRT

SEQ ID NO: 384528 - protein, 6 aa, Mycobacterium
DRYGNQ

SEQ ID NO: 384529 - protein, 11 aa, Mycobacterium
DSDGHADKRTR

SEQ ID NO: 384530 - protein, 5 aa, Mycobacterium
DSDPF

SEQ ID NO: 384531 - protein, 4 aa, Mycobacterium
DSEI

SEQ ID NO: 384532 - protein, 4 aa, Mycobacterium
DSGD

SEQ ID NO: 384533 - protein, 5 aa, Mycobacterium
DSGFG

SEQ ID NO: 384534 - protein, 4 aa, Mycobacterium
DSGG

SEQ ID NO: 384535 - protein, 7 aa, Mycobacterium
DSGLDPH

SEQ ID NO: 384536 - protein, 4 aa, Mycobacterium
DSGV

SEQ ID NO: 384537 - protein, 4 aa, Mycobacterium
DSLD

SEQ ID NO: 384538 - protein, 5 aa, Mycobacterium
DSQKG

SEQ ID NO: 384539 - protein, 12 aa, Mycobacterium
DSRETDEGQAIR

SEQ ID NO: 384540 - protein, 9 aa, Mycobacterium
DSRRSFSTT

SEQ ID NO: 384541 - protein, 15 aa, Mycobacterium
DSVTKSKFDNKYGTR

SEQ ID NO: 384542 - protein, 6 aa, Mycobacterium
DSYGPY

SEQ ID NO: 384543 - protein, 4 aa, Mycobacterium
DTAA

SEQ ID NO: 384544 - protein, 6 aa, Mycobacterium
DTDAGA

SEQ ID NO: 384545 - protein, 10 aa, Mycobacterium
DTDTGSPEAQ

SEQ ID NO: 384546 - protein, 14 aa, Mycobacterium
DTGADLAKTNVNGG

SEQ ID NO: 384547 - protein, 7 aa, Mycobacterium
DTGGGPL

SEQ ID NO: 384548 - protein, 10 aa, Mycobacterium
DTGNGPYGPL

SEQ ID NO: 384549 - protein, 4 aa, Mycobacterium
DTGS

SEQ ID NO: 384550 - protein, 6 aa, Mycobacterium
DTGSPY

SEQ ID NO: 384551 - protein, 4 aa, Mycobacterium
DTHY

SEQ ID NO: 384552 - protein, 4 aa, Mycobacterium
DTRA

SEQ ID NO: 384553 - protein, 4 aa, Mycobacterium
DTRI

SEQ ID NO: 384554 - protein, 4 aa, Mycobacterium
DTRP

SEQ ID NO: 384555 - protein, 7 aa, Mycobacterium
DTSTITT

SEQ ID NO: 384556 - protein, 12 aa, Mycobacterium
DTTHHNPTQPPL

SEQ ID NO: 384557 - protein, 4 aa, Mycobacterium
DTTL

SEQ ID NO: 384558 - protein, 4 aa, Mycobacterium
DTTV

SEQ ID NO: 384559 - protein, 4 aa, Mycobacterium
DTWS

SEQ ID NO: 384560 - protein, 4 aa, Mycobacterium
DVAG

SEQ ID NO: 384561 - protein, 8 aa, Mycobacterium
DVDERDQP

SEQ ID NO: 384562 - protein, 7 aa, Mycobacterium
DVSSNRV

SEQ ID NO: 384563 - protein, 4 aa, Mycobacterium
EAAA

SEQ ID NO: 384564 - protein, 7 aa, Mycobacterium
EAAKPKR

SEQ ID NO: 384565 - protein, 4 aa, Mycobacterium
EADA

SEQ ID NO: 384566 - protein, 7 aa, Mycobacterium
EADEEAT

SEQ ID NO: 384567 - protein, 7 aa, Mycobacterium
EADGTIT

SEQ ID NO: 384568 - protein, 11 aa, Mycobacterium
EADSKATGPGV

SEQ ID NO: 384569 - protein, 5 aa, Mycobacterium
EAEEL

SEQ ID NO: 384570 - protein, 5 aa, Mycobacterium
EAETT

SEQ ID NO: 384571 - protein, 9 aa, Mycobacterium
EAGDGQEAV

SEQ ID NO: 384572 - protein, 4 aa, Mycobacterium
EAGG

SEQ ID NO: 384573 - protein, 7 aa, Mycobacterium
EAGHRSK

SEQ ID NO: 384574 - protein, 8 aa, Mycobacterium
EAGIGPED

SEQ ID NO: 384575 - protein, 7 aa, Mycobacterium
EAGNGDR

SEQ ID NO: 384576 - protein, 5 aa, Mycobacterium
EAGSM

SEQ ID NO: 384577 - protein, 11 aa, Mycobacterium
EAGSYGKDTRG

SEQ ID NO: 384578 - protein, 4 aa, Mycobacterium
EAGV

SEQ ID NO: 384579 - protein, 4 aa, Mycobacterium
EAGY

SEQ ID NO: 384580 - protein, 4 aa, Mycobacterium
EAHG

SEQ ID NO: 384581 - protein, 7 aa, Mycobacterium
EAIGPGD

SEQ ID NO: 384582 - protein, 4 aa, Mycobacterium
EANG

SEQ ID NO: 384583 - protein, 8 aa, Mycobacterium
EANPRTRS

SEQ ID NO: 384584 - protein, 9 aa, Mycobacterium
EAQRDTSTS

SEQ ID NO: 384585 - protein, 9 aa, Mycobacterium
EARPPGKKV

SEQ ID NO: 384586 - protein, 7 aa, Mycobacterium
EASPGNM

SEQ ID NO: 384587 - protein, 4 aa, Mycobacterium
EATV

SEQ ID NO: 384588 - protein, 8 aa, Mycobacterium
EDADRDAI

SEQ ID NO: 384589 - protein, 7 aa, Mycobacterium
EDALAGE

SEQ ID NO: 384590 - protein, 5 aa, Mycobacterium
EDEVS

SEQ ID NO: 384591 - protein, 7 aa, Mycobacterium
EDGREGD

SEQ ID NO: 384592 - protein, 7 aa, Mycobacterium
EDKGMRD

SEQ ID NO: 384593 - protein, 5 aa, Mycobacterium
EDMTS

SEQ ID NO: 384594 - protein, 5 aa, Mycobacterium
EDPAR

SEQ ID NO: 384595 - protein, 4 aa, Mycobacterium
EDPE

SEQ ID NO: 384596 - protein, 5 aa, Mycobacterium
EDPYE

SEQ ID NO: 384597 - protein, 5 aa, Mycobacterium
EDRSV

SEQ ID NO: 384598 - protein, 4 aa, Mycobacterium
EDTI

SEQ ID NO: 384599 - protein, 4 aa, Mycobacterium
EEAA

SEQ ID NO: 384600 - protein, 8 aa, Mycobacterium
EEDSRGRT

SEQ ID NO: 384601 - protein, 10 aa, Mycobacterium
EEENPEAAEA

SEQ ID NO: 384602 - protein, 5 aa, Mycobacterium
EENGG

SEQ ID NO: 384603 - protein, 10 aa, Mycobacterium
EEPGLGNGGL

SEQ ID NO: 384604 - protein, 7 aa, Mycobacterium
EERSGAR

SEQ ID NO: 384605 - protein, 5 aa, Mycobacterium
EESGV

SEQ ID NO: 384606 - protein, 4 aa, Mycobacterium
EESL

SEQ ID NO: 384607 - protein, 13 aa, Mycobacterium
EETDDGLSGEEGT

SEQ ID NO: 384608 - protein, 4 aa, Mycobacterium
EEVE

SEQ ID NO: 384609 - protein, 11 aa, Mycobacterium
EEYGGGGNPDF

SEQ ID NO: 384610 - protein, 6 aa, Mycobacterium
EGADGV

SEQ ID NO: 384611 - protein, 5 aa, Mycobacterium
EGAEE

SEQ ID NO: 384612 - protein, 13 aa, Mycobacterium
EGALPPPRKKSRR

SEQ ID NO: 384613 - protein, 5 aa, Mycobacterium
EGDPH

SEQ ID NO: 384614 - protein, 8 aa, Mycobacterium
EGEKDNAP

SEQ ID NO: 384615 - protein, 4 aa, Mycobacterium
EGFS

SEQ ID NO: 384616 - protein, 4 aa, Mycobacterium
EGFT

SEQ ID NO: 384617 - protein, 6 aa, Mycobacterium
EGGAGL

SEQ ID NO: 384618 - protein, 4 aa, Mycobacterium
EGGG

SEQ ID NO: 384619 - protein, 7 aa, Mycobacterium
EGPRGLY

SEQ ID NO: 384620 - protein, 7 aa, Mycobacterium
EGPSATY

SEQ ID NO: 384621 - protein, 9 aa, Mycobacterium
EGRGEPRDD

SEQ ID NO: 384622 - protein, 5 aa, Mycobacterium
EGRGV

SEQ ID NO: 384623 - protein, 7 aa, Mycobacterium
EGSADPH

SEQ ID NO: 384624 - protein, 5 aa, Mycobacterium
EGTAE

SEQ ID NO: 384625 - protein, 4 aa, Mycobacterium
EGTG

SEQ ID NO: 384626 - protein, 4 aa, Mycobacterium
EGTK

SEQ ID NO: 384627 - protein, 6 aa, Mycobacterium
EGTLPA

SEQ ID NO: 384628 - protein, 10 aa, Mycobacterium
EGTRSRTGKM

SEQ ID NO: 384629 - protein, 8 aa, Mycobacterium
EHAKARGA

SEQ ID NO: 384630 - protein, 18 aa, Mycobacterium
EHELGTKGPGQDGPGRET

SEQ ID NO: 384631 - protein, 11 aa, Mycobacterium
EHTGNTSAASI

SEQ ID NO: 384632 - protein, 4 aa, Mycobacterium
EIDR

SEQ ID NO: 384633 - protein, 10 aa, Mycobacterium
EIGPSPAEAD

SEQ ID NO: 384634 - protein, 7 aa, Mycobacterium
EIQPGVT

SEQ ID NO: 384635 - protein, 6 aa, Mycobacterium
EKDPDT

SEQ ID NO: 384636 - protein, 6 aa, Mycobacterium
EKPVKT

SEQ ID NO: 384637 - protein, 7 aa, Mycobacterium
EKQRARV

SEQ ID NO: 384638 - protein, 7 aa, Mycobacterium
EKSPSFH

SEQ ID NO: 384639 - protein, 7 aa, Mycobacterium
EKTRRGL

SEQ ID NO: 384640 - protein, 11 aa, Mycobacterium
ELGPYGSSRTR

SEQ ID NO: 384641 - protein, 4 aa, Mycobacterium
ELGQ

SEQ ID NO: 384642 - protein, 7 aa, Mycobacterium
ELGTRGQ

SEQ ID NO: 384643 - protein, 13 aa, Mycobacterium
ELPEASRTARGQH

SEQ ID NO: 384644 - protein, 4 aa, Mycobacterium
ELSA

SEQ ID NO: 384645 - protein, 8 aa, Mycobacterium
EMSEEARV

SEQ ID NO: 384646 - protein, 4 aa, Mycobacterium
EMTP

SEQ ID NO: 384647 - protein, 6 aa, Mycobacterium
ENAELR

SEQ ID NO: 384648 - protein, 10 aa, Mycobacterium
ENVAESLTRG

SEQ ID NO: 384649 - protein, 4 aa, Mycobacterium
EPAA

SEQ ID NO: 384650 - protein, 6 aa, Mycobacterium
EPAGEE

SEQ ID NO: 384651 - protein, 4 aa, Mycobacterium
EPEE

SEQ ID NO: 384652 - protein, 4 aa, Mycobacterium
EPEV

SEQ ID NO: 384653 - protein, 5 aa, Mycobacterium
EPEVD

SEQ ID NO: 384654 - protein, 10 aa, Mycobacterium
EPGAGSDLAG

SEQ ID NO: 384655 - protein, 5 aa, Mycobacterium
EPGRP

SEQ ID NO: 384656 - protein, 9 aa, Mycobacterium
EPGTVTPTT

SEQ ID NO: 384657 - protein, 4 aa, Mycobacterium
EPKN

SEQ ID NO: 384658 - protein, 4 aa, Mycobacterium
EPNE

SEQ ID NO: 384659 - protein, 4 aa, Mycobacterium
EPPA

SEQ ID NO: 384660 - protein, 9 aa, Mycobacterium
EPRKGDNAP

SEQ ID NO: 384661 - protein, 6 aa, Mycobacterium
EPRYGE

SEQ ID NO: 384662 - protein, 6 aa, Mycobacterium
EPSAAS

SEQ ID NO: 384663 - protein, 7 aa, Mycobacterium
EPSSGLD

SEQ ID NO: 384664 - protein, 5 aa, Mycobacterium
EPTGP

SEQ ID NO: 384665 - protein, 6 aa, Mycobacterium
EPTTAL

SEQ ID NO: 384666 - protein, 5 aa, Mycobacterium
EPVPA

SEQ ID NO: 384667 - protein, 4 aa, Mycobacterium
EQAA

SEQ ID NO: 384668 - protein, 4 aa, Mycobacterium
EQAR

SEQ ID NO: 384669 - protein, 9 aa, Mycobacterium
EQASLQDSN

SEQ ID NO: 384670 - protein, 6 aa, Mycobacterium
EQATVG

SEQ ID NO: 384671 - protein, 10 aa, Mycobacterium
EQGQADNLER

SEQ ID NO: 384672 - protein, 4 aa, Mycobacterium
EQHP

SEQ ID NO: 384673 - protein, 9 aa, Mycobacterium
EQLAAPAAV

SEQ ID NO: 384674 - protein, 4 aa, Mycobacterium
EQLH

SEQ ID NO: 384675 - protein, 6 aa, Mycobacterium
EQPQNQ

SEQ ID NO: 384676 - protein, 7 aa, Mycobacterium
EREPSTL

SEQ ID NO: 384677 - protein, 4 aa, Mycobacterium
ERGG

SEQ ID NO: 384678 - protein, 8 aa, Mycobacterium
ERGQGKTR

SEQ ID NO: 384679 - protein, 10 aa, Mycobacterium
ERGRKEPSSE

SEQ ID NO: 384680 - protein, 8 aa, Mycobacterium
ERHESRRI

SEQ ID NO: 384681 - protein, 6 aa, Mycobacterium
ERHPYG

SEQ ID NO: 384682 - protein, 5 aa, Mycobacterium
ERMGG

SEQ ID NO: 384683 - protein, 10 aa, Mycobacterium
ERNPLNKTLG

SEQ ID NO: 384684 - protein, 9 aa, Mycobacterium
ERPDAEAAQ

SEQ ID NO: 384685 - protein, 5 aa, Mycobacterium
ERPDN

SEQ ID NO: 384686 - protein, 5 aa, Mycobacterium
ERPPL

SEQ ID NO: 384687 - protein, 7 aa, Mycobacterium
ERRGEYL

SEQ ID NO: 384688 - protein, 6 aa, Mycobacterium
ERRNAR

SEQ ID NO: 384689 - protein, 8 aa, Mycobacterium
ERRRPDGS

SEQ ID NO: 384690 - protein, 4 aa, Mycobacterium
ERSA

SEQ ID NO: 384691 - protein, 7 aa, Mycobacterium
ERSGPER

SEQ ID NO: 384692 - protein, 5 aa, Mycobacterium
ERSPI

SEQ ID NO: 384693 - protein, 4 aa, Mycobacterium
ERTA

SEQ ID NO: 384694 - protein, 7 aa, Mycobacterium
ERTGGRY

SEQ ID NO: 384695 - protein, 5 aa, Mycobacterium
ERTRP

SEQ ID NO: 384696 - protein, 4 aa, Mycobacterium
ERYA

SEQ ID NO: 384697 - protein, 5 aa, Mycobacterium
ESALP

SEQ ID NO: 384698 - protein, 6 aa, Mycobacterium
ESEVTA

SEQ ID NO: 384699 - protein, 4 aa, Mycobacterium
ESGA

SEQ ID NO: 384700 - protein, 4 aa, Mycobacterium
ESGF

SEQ ID NO: 384701 - protein, 4 aa, Mycobacterium
ESGQ

SEQ ID NO: 384702 - protein, 8 aa, Mycobacterium
ESGSLEQD

SEQ ID NO: 384703 - protein, 11 aa, Mycobacterium
ESIPDPVRETD

SEQ ID NO: 384704 - protein, 10 aa, Mycobacterium
ETATVDRRDT

SEQ ID NO: 384705 - protein, 11 aa, Mycobacterium
ETDDVSEDSLE

SEQ ID NO: 384706 - protein, 11 aa, Mycobacterium
ETGAGQHGVAT

SEQ ID NO: 384707 - protein, 6 aa, Mycobacterium
ETGQPG

SEQ ID NO: 384708 - protein, 5 aa, Mycobacterium
ETGRE

SEQ ID NO: 384709 - protein, 4 aa, Mycobacterium
ETLP

SEQ ID NO: 384710 - protein, 6 aa, Mycobacterium
ETPLSN

SEQ ID NO: 384711 - protein, 9 aa, Mycobacterium
ETRRGKAKW

SEQ ID NO: 384712 - protein, 4 aa, Mycobacterium
ETST

SEQ ID NO: 384713 - protein, 10 aa, Mycobacterium
ETSVAGEPIT

SEQ ID NO: 384714 - protein, 12 aa, Mycobacterium
ETSYGPDGIGTT

SEQ ID NO: 384715 - protein, 6 aa, Mycobacterium
ETTPPG

SEQ ID NO: 384716 - protein, 4 aa, Mycobacterium
ETVQ

SEQ ID NO: 384717 - protein, 5 aa, Mycobacterium
EVSPA

SEQ ID NO: 384718 - protein, 6 aa, Mycobacterium
EVSPNY

SEQ ID NO: 384719 - protein, 6 aa, Mycobacterium
EYGGMG

SEQ ID NO: 384720 - protein, 4 aa, Mycobacterium
EYGL

SEQ ID NO: 384721 - protein, 7 aa, Mycobacterium
FADQPNA

SEQ ID NO: 384722 - protein, 9 aa, Mycobacterium
FAEDSPEAY

SEQ ID NO: 384723 - protein, 11 aa, Mycobacterium
FAPAAEDSTGA

SEQ ID NO: 384724 - protein, 11 aa, Mycobacterium
FAPGATGNIAT

SEQ ID NO: 384725 - protein, 6 aa, Mycobacterium
FAPGPG

SEQ ID NO: 384726 - protein, 11 aa, Mycobacterium
FASGTSSRSSK

SEQ ID NO: 384727 - protein, 4 aa, Mycobacterium
FDPA

SEQ ID NO: 384728 - protein, 6 aa, Mycobacterium
FDPATG

SEQ ID NO: 384729 - protein, 11 aa, Mycobacterium
FDRPPSDHTQA

SEQ ID NO: 384730 - protein, 4 aa, Mycobacterium
FEHN

SEQ ID NO: 384731 - protein, 10 aa, Mycobacterium
FEKPGRREGW

SEQ ID NO: 384732 - protein, 10 aa, Mycobacterium
FESGEEGREQ

SEQ ID NO: 384733 - protein, 4 aa, Mycobacterium
FGAA

SEQ ID NO: 384734 - protein, 11 aa, Mycobacterium
FGDDPNRYTNA

SEQ ID NO: 384735 - protein, 7 aa, Mycobacterium
FGDGSKL

SEQ ID NO: 384736 - protein, 9 aa, Mycobacterium
FGEDPDIDE

SEQ ID NO: 384737 - protein, 7 aa, Mycobacterium
FGGGGRG

SEQ ID NO: 384738 - protein, 6 aa, Mycobacterium
FPGGEG

SEQ ID NO: 384739 - protein, 9 aa, Mycobacterium
FRGRTTGPW

SEQ ID NO: 384740 - protein, 10 aa, Mycobacterium
FTGEDGATYE

SEQ ID NO: 384741 - protein, 5 aa, Mycobacterium
FTGSN

SEQ ID NO: 384742 - protein, 18 aa, Mycobacterium
FTPGERRDASDKSSSAAR

SEQ ID NO: 384743 - protein, 4 aa, Mycobacterium
GAAD

SEQ ID NO: 384744 - protein, 4 aa, Mycobacterium
GAAS

SEQ ID NO: 384745 - protein, 4 aa, Mycobacterium
GAAT

SEQ ID NO: 384746 - protein, 13 aa, Mycobacterium
GADEKKLNPNGGA

SEQ ID NO: 384747 - protein, 4 aa, Mycobacterium
GADL

SEQ ID NO: 384748 - protein, 8 aa, Mycobacterium
GAEAVESG

SEQ ID NO: 384749 - protein, 8 aa, Mycobacterium
GAEDVNDL

SEQ ID NO: 384750 - protein, 7 aa, Mycobacterium
GAEDYAQ

SEQ ID NO: 384751 - protein, 4 aa, Mycobacterium
GAEG

SEQ ID NO: 384752 - protein, 5 aa, Mycobacterium
GAEPA

SEQ ID NO: 384753 - protein, 13 aa, Mycobacterium
GAEPIGSMGTDTP

SEQ ID NO: 384754 - protein, 8 aa, Mycobacterium
GAEQIRTG

SEQ ID NO: 384755 - protein, 9 aa, Mycobacterium
GAETTRNAV

SEQ ID NO: 384756 - protein, 7 aa, Mycobacterium
GAGARIQ

SEQ ID NO: 384757 - protein, 6 aa, Mycobacterium
GAGATV

SEQ ID NO: 384758 - protein, 9 aa, Mycobacterium
GAGDYLPPY

SEQ ID NO: 384759 - protein, 4 aa, Mycobacterium
GAGE

SEQ ID NO: 384760 - protein, 7 aa, Mycobacterium
GAGERGL

SEQ ID NO: 384761 - protein, 7 aa, Mycobacterium
GAGPRKD

SEQ ID NO: 384762 - protein, 7 aa, Mycobacterium
GAGPSSL

SEQ ID NO: 384763 - protein, 4 aa, Mycobacterium
GAGR

SEQ ID NO: 384764 - protein, 4 aa, Mycobacterium
GAGS

SEQ ID NO: 384765 - protein, 8 aa, Mycobacterium
GAHADTGV

SEQ ID NO: 384766 - protein, 4 aa, Mycobacterium
GAIP

SEQ ID NO: 384767 - protein, 9 aa, Mycobacterium
GAKSVPAQK

SEQ ID NO: 384768 - protein, 9 aa, Mycobacterium
GALPPGTRL

SEQ ID NO: 384769 - protein, 4 aa, Mycobacterium
GANN

SEQ ID NO: 384770 - protein, 6 aa, Mycobacterium
GAPGDG

SEQ ID NO: 384771 - protein, 7 aa, Mycobacterium
GAPQGED

SEQ ID NO: 384772 - protein, 4 aa, Mycobacterium
GAPT

SEQ ID NO: 384773 - protein, 4 aa, Mycobacterium
GAPV

SEQ ID NO: 384774 - protein, 9 aa, Mycobacterium
GAQGGSNGG

SEQ ID NO: 384775 - protein, 13 aa, Mycobacterium
GAQSGIGGGGRYD

SEQ ID NO: 384776 - protein, 4 aa, Mycobacterium
GARL

SEQ ID NO: 384777 - protein, 4 aa, Mycobacterium
GASA

SEQ ID NO: 384778 - protein, 4 aa, Mycobacterium
GASG

SEQ ID NO: 384779 - protein, 6 aa, Mycobacterium
GASPRA

SEQ ID NO: 384780 - protein, 8 aa, Mycobacterium
GASTPEEL

SEQ ID NO: 384781 - protein, 8 aa, Mycobacterium
GATDPEIE

SEQ ID NO: 384782 - protein, 5 aa, Mycobacterium
GATPV

SEQ ID NO: 384783 - protein, 5 aa, Mycobacterium
GATTF

SEQ ID NO: 384784 - protein, 9 aa, Mycobacterium
GAVDPGSEA

SEQ ID NO: 384785 - protein, 5 aa, Mycobacterium
GAVHG

SEQ ID NO: 384786 - protein, 10 aa, Mycobacterium
GDAPGSKYDK

SEQ ID NO: 384787 - protein, 4 aa, Mycobacterium
GDDE

SEQ ID NO: 384788 - protein, 4 aa, Mycobacterium
GDDV

SEQ ID NO: 384789 - protein, 5 aa, Mycobacterium
GDEGE

SEQ ID NO: 384790 - protein, 4 aa, Mycobacterium
GDEP

SEQ ID NO: 384791 - protein, 5 aa, Mycobacterium
GDEPA

SEQ ID NO: 384792 - protein, 4 aa, Mycobacterium
GDER

SEQ ID NO: 384793 - protein, 6 aa, Mycobacterium
GDGADI

SEQ ID NO: 384794 - protein, 10 aa, Mycobacterium
GDGAYTGAGT

SEQ ID NO: 384795 - protein, 7 aa, Mycobacterium
GDGTQAL

SEQ ID NO: 384796 - protein, 4 aa, Mycobacterium
GDGV

SEQ ID NO: 384797 - protein, 4 aa, Mycobacterium
GDHP

SEQ ID NO: 384798 - protein, 4 aa, Mycobacterium
GDID

SEQ ID NO: 384799 - protein, 8 aa, Mycobacterium
GDLEKEKG

SEQ ID NO: 384800 - protein, 10 aa, Mycobacterium
GDLGSSAARK

SEQ ID NO: 384801 - protein, 4 aa, Mycobacterium
GDPD

SEQ ID NO: 384802 - protein, 4 aa, Mycobacterium
GDPI

SEQ ID NO: 384803 - protein, 5 aa, Mycobacterium
GDPQG

SEQ ID NO: 384804 - protein, 18 aa, Mycobacterium
GDPSDGLPGVPGVGEKTA

SEQ ID NO: 384805 - protein, 4 aa, Mycobacterium
GDPV

SEQ ID NO: 384806 - protein, 4 aa, Mycobacterium
GDQQ

SEQ ID NO: 384807 - protein, 4 aa, Mycobacterium
GDQR

SEQ ID NO: 384808 - protein, 4 aa, Mycobacterium
GDRA

SEQ ID NO: 384809 - protein, 5 aa, Mycobacterium
GDRDS

SEQ ID NO: 384810 - protein, 12 aa, Mycobacterium
GDRLASRRLPEG

SEQ ID NO: 384811 - protein, 4 aa, Mycobacterium
GDRV

SEQ ID NO: 384812 - protein, 4 aa, Mycobacterium
GDSE

SEQ ID NO: 384813 - protein, 7 aa, Mycobacterium
GDSPAGL

SEQ ID NO: 384814 - protein, 4 aa, Mycobacterium
GDST

SEQ ID NO: 384815 - protein, 9 aa, Mycobacterium
GDTDQTPFG

SEQ ID NO: 384816 - protein, 8 aa, Mycobacterium
GDTPDAEA

SEQ ID NO: 384817 - protein, 5 aa, Mycobacterium
GDTRE

SEQ ID NO: 384818 - protein, 9 aa, Mycobacterium
GEAKNTYGT

SEQ ID NO: 384819 - protein, 13 aa, Mycobacterium
GEANTGGADKSSI

SEQ ID NO: 384820 - protein, 7 aa, Mycobacterium
GEEATTV

SEQ ID NO: 384821 - protein, 7 aa, Mycobacterium
GEEDRLR

SEQ ID NO: 384822 - protein, 4 aa, Mycobacterium
GEEI

SEQ ID NO: 384823 - protein, 9 aa, Mycobacterium
GEFSSQPSA

SEQ ID NO: 384824 - protein, 6 aa, Mycobacterium
GEGGNL

SEQ ID NO: 384825 - protein, 8 aa, Mycobacterium
GEHPGPAN

SEQ ID NO: 384826 - protein, 4 aa, Mycobacterium
GEIP

SEQ ID NO: 384827 - protein, 4 aa, Mycobacterium
GELE

SEQ ID NO: 384828 - protein, 6 aa, Mycobacterium
GELGER

SEQ ID NO: 384829 - protein, 8 aa, Mycobacterium
GELGQHNG

SEQ ID NO: 384830 - protein, 7 aa, Mycobacterium
GELTGSG

SEQ ID NO: 384831 - protein, 6 aa, Mycobacterium
GEPATL

SEQ ID NO: 384832 - protein, 5 aa, Mycobacterium
GEPDH

SEQ ID NO: 384833 - protein, 6 aa, Mycobacterium
GEPERN

SEQ ID NO: 384834 - protein, 6 aa, Mycobacterium
GEPGDG

SEQ ID NO: 384835 - protein, 4 aa, Mycobacterium
GEPL

SEQ ID NO: 384836 - protein, 6 aa, Mycobacterium
GEPRYG

SEQ ID NO: 384837 - protein, 4 aa, Mycobacterium
GEPS

SEQ ID NO: 384838 - protein, 6 aa, Mycobacterium
GEPYGP

SEQ ID NO: 384839 - protein, 5 aa, Mycobacterium
GEQAA

SEQ ID NO: 384840 - protein, 4 aa, Mycobacterium
GEQG

SEQ ID NO: 384841 - protein, 5 aa, Mycobacterium
GEQLR

SEQ ID NO: 384842 - protein, 6 aa, Mycobacterium
GERAQV

SEQ ID NO: 384843 - protein, 7 aa, Mycobacterium
GERKLKT

SEQ ID NO: 384844 - protein, 4 aa, Mycobacterium
GERL

SEQ ID NO: 384845 - protein, 4 aa, Mycobacterium
GERR

SEQ ID NO: 384846 - protein, 5 aa, Mycobacterium
GERSL

SEQ ID NO: 384847 - protein, 10 aa, Mycobacterium
GERSTRSKGW

SEQ ID NO: 384848 - protein, 4 aa, Mycobacterium
GERT

SEQ ID NO: 384849 - protein, 12 aa, Mycobacterium
GESEETSKLSRE

SEQ ID NO: 384850 - protein, 11 aa, Mycobacterium
GESGSGKSTTL

SEQ ID NO: 384851 - protein, 5 aa, Mycobacterium
GESIP

SEQ ID NO: 384852 - protein, 4 aa, Mycobacterium
GETA

SEQ ID NO: 384853 - protein, 5 aa, Mycobacterium
GETDP

SEQ ID NO: 384854 - protein, 4 aa, Mycobacterium
GETH

SEQ ID NO: 384855 - protein, 8 aa, Mycobacterium
GETSVGKY

SEQ ID NO: 384856 - protein, 5 aa, Mycobacterium
GEYGP

SEQ ID NO: 384857 - protein, 5 aa, Mycobacterium
GFDGT

SEQ ID NO: 384858 - protein, 5 aa, Mycobacterium
GFGRT

SEQ ID NO: 384859 - protein, 8 aa, Mycobacterium
GGAEFGSG

SEQ ID NO: 384860 - protein, 4 aa, Mycobacterium
GGAH

SEQ ID NO: 384861 - protein, 4 aa, Mycobacterium
GGAL

SEQ ID NO: 384862 - protein, 5 aa, Mycobacterium
GGAND

SEQ ID NO: 384863 - protein, 8 aa, Mycobacterium
GGAPGASS

SEQ ID NO: 384864 - protein, 4 aa, Mycobacterium
GGAQ

SEQ ID NO: 384865 - protein, 4 aa, Mycobacterium
GGAR

SEQ ID NO: 384866 - protein, 4 aa, Mycobacterium
GGDA

SEQ ID NO: 384867 - protein, 10 aa, Mycobacterium
GGDAEERAAD

SEQ ID NO: 384868 - protein, 4 aa, Mycobacterium
GGDD

SEQ ID NO: 384869 - protein, 4 aa, Mycobacterium
GGDL

SEQ ID NO: 384870 - protein, 15 aa, Mycobacterium
GGDPTGTGRGGPGYK

SEQ ID NO: 384871 - protein, 7 aa, Mycobacterium
GGDPVRA

SEQ ID NO: 384872 - protein, 11 aa, Mycobacterium
GGDRDGNPNVT

SEQ ID NO: 384873 - protein, 5 aa, Mycobacterium
GGDSL

SEQ ID NO: 384874 - protein, 10 aa, Mycobacterium
GGEEDGVEAE

SEQ ID NO: 384875 - protein, 4 aa, Mycobacterium
GGEG

SEQ ID NO: 384876 - protein, 9 aa, Mycobacterium
GGEHRRSAA

SEQ ID NO: 384877 - protein, 6 aa, Mycobacterium
GGEKAL

SEQ ID NO: 384878 - protein, 4 aa, Mycobacterium
GGES

SEQ ID NO: 384879 - protein, 9 aa, Mycobacterium
GGGAATDVA

SEQ ID NO: 384880 - protein, 4 aa, Mycobacterium
GGGL

SEQ ID NO: 384881 - protein, 4 aa, Mycobacterium
GGHV

SEQ ID NO: 384882 - protein, 7 aa, Mycobacterium
GGIGGNH

SEQ ID NO: 384883 - protein, 4 aa, Mycobacterium
GGIP

SEQ ID NO: 384884 - protein, 7 aa, Mycobacterium
GGIRTGM

SEQ ID NO: 384885 - protein, 6 aa, Mycobacterium
GGITET

SEQ ID NO: 384886 - protein, 4 aa, Mycobacterium
GGLD

SEQ ID NO: 384887 - protein, 8 aa, Mycobacterium
GGLPGVDN

SEQ ID NO: 384888 - protein, 5 aa, Mycobacterium
GGLTP

SEQ ID NO: 384889 - protein, 10 aa, Mycobacterium
GGMAGGSADA

SEQ ID NO: 384890 - protein, 5 aa, Mycobacterium
GGMRT

SEQ ID NO: 384891 - protein, 9 aa, Mycobacterium
GGNDTTTGM

SEQ ID NO: 384892 - protein, 7 aa, Mycobacterium
GGNPQYD

SEQ ID NO: 384893 - protein, 4 aa, Mycobacterium
GGPA

SEQ ID NO: 384894 - protein, 6 aa, Mycobacterium
GGPAGL

SEQ ID NO: 384895 - protein, 10 aa, Mycobacterium
GGPEPYTGAP

SEQ ID NO: 384896 - protein, 4 aa, Mycobacterium
GGPF

SEQ ID NO: 384897 - protein, 6 aa, Mycobacterium
GGPGRT

SEQ ID NO: 384898 - protein, 7 aa, Mycobacterium
GGPRGGV

SEQ ID NO: 384899 - protein, 4 aa, Mycobacterium
GGPV

SEQ ID NO: 384900 - protein, 9 aa, Mycobacterium
GGPVGSGKT

SEQ ID NO: 384901 - protein, 9 aa, Mycobacterium
GGRAGGHHS

SEQ ID NO: 384902 - protein, 7 aa, Mycobacterium
GGRLSRQ

SEQ ID NO: 384903 - protein, 4 aa, Mycobacterium
GGRP

SEQ ID NO: 384904 - protein, 8 aa, Mycobacterium
GGRPADTP

SEQ ID NO: 384905 - protein, 4 aa, Mycobacterium
GGRS

SEQ ID NO: 384906 - protein, 14 aa, Mycobacterium
GGRTVGAGRVTKII

SEQ ID NO: 384907 - protein, 5 aa, Mycobacterium
GGSAG

SEQ ID NO: 384908 - protein, 6 aa, Mycobacterium
GGSRGI

SEQ ID NO: 384909 - protein, 4 aa, Mycobacterium
GGTF

SEQ ID NO: 384910 - protein, 9 aa, Mycobacterium
GGTGAGKTT

SEQ ID NO: 384911 - protein, 5 aa, Mycobacterium
GGTGL

SEQ ID NO: 384912 - protein, 4 aa, Mycobacterium
GGTP

SEQ ID NO: 384913 - protein, 8 aa, Mycobacterium
GGTVNPDK

SEQ ID NO: 384914 - protein, 7 aa, Mycobacterium
GGVNSPV

SEQ ID NO: 384915 - protein, 8 aa, Mycobacterium
GGVTGSAA

SEQ ID NO: 384916 - protein, 5 aa, Mycobacterium
GGVTK

SEQ ID NO: 384917 - protein, 11 aa, Mycobacterium
GGYKQSGIGRE

SEQ ID NO: 384918 - protein, 10 aa, Mycobacterium
GHASATGRFD

SEQ ID NO: 384919 - protein, 6 aa, Mycobacterium
GHPENV

SEQ ID NO: 384920 - protein, 4 aa, Mycobacterium
GHPR

SEQ ID NO: 384921 - protein, 4 aa, Mycobacterium
GHTD

SEQ ID NO: 384922 - protein, 7 aa, Mycobacterium
GHTQPRR

SEQ ID NO: 384923 - protein, 5 aa, Mycobacterium
GIGDT

SEQ ID NO: 384924 - protein, 4 aa, Mycobacterium
GIGK

SEQ ID NO: 384925 - protein, 6 aa, Mycobacterium
GIRSDS

SEQ ID NO: 384926 - protein, 4 aa, Mycobacterium
GITP

SEQ ID NO: 384927 - protein, 12 aa, Mycobacterium
GKAGSETEYGSA

SEQ ID NO: 384928 - protein, 9 aa, Mycobacterium
GKAKEVPAA

SEQ ID NO: 384929 - protein, 6 aa, Mycobacterium
GKDEDE

SEQ ID NO: 384930 - protein, 10 aa, Mycobacterium
GKGGTGKSTI

SEQ ID NO: 384931 - protein, 7 aa, Mycobacterium
GKGKRIA

SEQ ID NO: 384932 - protein, 11 aa, Mycobacterium
GKPCGREANTA

SEQ ID NO: 384933 - protein, 5 aa, Mycobacterium
GKPGR

SEQ ID NO: 384934 - protein, 7 aa, Mycobacterium
GKRPSVR

SEQ ID NO: 384935 - protein, 6 aa, Mycobacterium
GKSTLA

SEQ ID NO: 384936 - protein, 4 aa, Mycobacterium
GLAG

SEQ ID NO: 384937 - protein, 5 aa, Mycobacterium
GLATR

SEQ ID NO: 384938 - protein, 4 aa, Mycobacterium
GLDP

SEQ ID NO: 384939 - protein, 5 aa, Mycobacterium
GLGGA

SEQ ID NO: 384940 - protein, 6 aa, Mycobacterium
GLGGGL

SEQ ID NO: 384941 - protein, 11 aa, Mycobacterium
GLGGPGREHEA

SEQ ID NO: 384942 - protein, 6 aa, Mycobacterium
GLGRTA

SEQ ID NO: 384943 - protein, 6 aa, Mycobacterium
GLPDPV

SEQ ID NO: 384944 - protein, 16 aa, Mycobacterium
GLPERATHDYQRNGTA

SEQ ID NO: 384945 - protein, 5 aa, Mycobacterium
GLPPT

SEQ ID NO: 384946 - protein, 14 aa, Mycobacterium
GLPSSPGVTGAAAA

SEQ ID NO: 384947 - protein, 4 aa, Mycobacterium
GLPT

SEQ ID NO: 384948 - protein, 11 aa, Mycobacterium
GLSNARTEGYN

SEQ ID NO: 384949 - protein, 8 aa, Mycobacterium
GLSPEDAF

SEQ ID NO: 384950 - protein, 9 aa, Mycobacterium
GLSPSQDEI

SEQ ID NO: 384951 - protein, 4 aa, Mycobacterium
GLTG

SEQ ID NO: 384952 - protein, 4 aa, Mycobacterium
GLTP

SEQ ID NO: 384953 - protein, 5 aa, Mycobacterium
GMGRE

SEQ ID NO: 384954 - protein, 4 aa, Mycobacterium
GNAI

SEQ ID NO: 384955 - protein, 11 aa, Mycobacterium
GNGLKDPDTAL

SEQ ID NO: 384956 - protein, 4 aa, Mycobacterium
GNIG

SEQ ID NO: 384957 - protein, 8 aa, Mycobacterium
GNNDVSRY

SEQ ID NO: 384958 - protein, 11 aa, Mycobacterium
GNPDGKSKREL

SEQ ID NO: 384959 - protein, 4 aa, Mycobacterium
GNPL

SEQ ID NO: 384960 - protein, 7 aa, Mycobacterium
GNPTTDV

SEQ ID NO: 384961 - protein, 11 aa, Mycobacterium
GNQHDAEDLTQ

SEQ ID NO: 384962 - protein, 9 aa, Mycobacterium
GNRNFEGRI

SEQ ID NO: 384963 - protein, 5 aa, Mycobacterium
GNSAQ

SEQ ID NO: 384964 - protein, 10 aa, Mycobacterium
GNSIEGGTSE

SEQ ID NO: 384965 - protein, 7 aa, Mycobacterium
GNTYRNP

SEQ ID NO: 384966 - protein, 5 aa, Mycobacterium
GNVGS

SEQ ID NO: 384967 - protein, 5 aa, Mycobacterium
GNVGT

SEQ ID NO: 384968 - protein, 8 aa, Mycobacterium
GPAGTGKT

SEQ ID NO: 384969 - protein, 6 aa, Mycobacterium
GPAGVG

SEQ ID NO: 384970 - protein, 5 aa, Mycobacterium
GPAIG

SEQ ID NO: 384971 - protein, 8 aa, Mycobacterium
GPCGPSSE

SEQ ID NO: 384972 - protein, 15 aa, Mycobacterium
GPDETPPEGWEQDPD

SEQ ID NO: 384973 - protein, 5 aa, Mycobacterium
GPDGA

SEQ ID NO: 384974 - protein, 4 aa, Mycobacterium
GPER

SEQ ID NO: 384975 - protein, 6 aa, Mycobacterium
GPGAPA

SEQ ID NO: 384976 - protein, 4 aa, Mycobacterium
GPGD

SEQ ID NO: 384977 - protein, 7 aa, Mycobacterium
GPGGKTA

SEQ ID NO: 384978 - protein, 6 aa, Mycobacterium
GPGLGT

SEQ ID NO: 384979 - protein, 6 aa, Mycobacterium
GPITAD

SEQ ID NO: 384980 - protein, 10 aa, Mycobacterium
GPMGDAGLTG

SEQ ID NO: 384981 - protein, 4 aa, Mycobacterium
GPND

SEQ ID NO: 384982 - protein, 11 aa, Mycobacterium
GPNGAGKTTTV

SEQ ID NO: 384983 - protein, 10 aa, Mycobacterium
GPNGSGKSNV

SEQ ID NO: 384984 - protein, 5 aa, Mycobacterium
GPNLA

SEQ ID NO: 384985 - protein, 5 aa, Mycobacterium
GPNYN

SEQ ID NO: 384986 - protein, 9 aa, Mycobacterium
GPPGSGKTT

SEQ ID NO: 384987 - protein, 7 aa, Mycobacterium
GPPGTAE

SEQ ID NO: 384988 - protein, 14 aa, Mycobacterium
GPPGVGKTSLGESV

SEQ ID NO: 384989 - protein, 6 aa, Mycobacterium
GPQPAD

SEQ ID NO: 384990 - protein, 4 aa, Mycobacterium
GPRA

SEQ ID NO: 384991 - protein, 4 aa, Mycobacterium
GPRK

SEQ ID NO: 384992 - protein, 5 aa, Mycobacterium
GPRRK

SEQ ID NO: 384993 - protein, 7 aa, Mycobacterium
GPSAGHG

SEQ ID NO: 384994 - protein, 9 aa, Mycobacterium
GPSGCGKST

SEQ ID NO: 384995 - protein, 7 aa, Mycobacterium
GPTETTV

SEQ ID NO: 384996 - protein, 4 aa, Mycobacterium
GPTG

SEQ ID NO: 384997 - protein, 5 aa, Mycobacterium
GPTGF

SEQ ID NO: 384998 - protein, 6 aa, Mycobacterium
GPTGFI

SEQ ID NO: 384999 - protein, 7 aa, Mycobacterium
GPTPSEV

SEQ ID NO: 385000 - protein, 5 aa, Mycobacterium
GQAAA

SEQ ID NO: 385001 - protein, 5 aa, Mycobacterium
GQAAE

SEQ ID NO: 385002 - protein, 4 aa, Mycobacterium
GQEG

SEQ ID NO: 385003 - protein, 8 aa, Mycobacterium
GQGGLTRN

SEQ ID NO: 385004 - protein, 5 aa, Mycobacterium
GQGGV

SEQ ID NO: 385005 - protein, 6 aa, Mycobacterium
GQMGSG

SEQ ID NO: 385006 - protein, 4 aa, Mycobacterium
GQPA

SEQ ID NO: 385007 - protein, 4 aa, Mycobacterium
GQPR

SEQ ID NO: 385008 - protein, 4 aa, Mycobacterium
GQRS

SEQ ID NO: 385009 - protein, 7 aa, Mycobacterium
GQTERGL

SEQ ID NO: 385010 - protein, 5 aa, Mycobacterium
GRAAE

SEQ ID NO: 385011 - protein, 11 aa, Mycobacterium
GRCEACTGDGT

SEQ ID NO: 385012 - protein, 4 aa, Mycobacterium
GRDG

SEQ ID NO: 385013 - protein, 6 aa, Mycobacterium
GREQTL

SEQ ID NO: 385014 - protein, 12 aa, Mycobacterium
GRETESGRGPTD

SEQ ID NO: 385015 - protein, 13 aa, Mycobacterium
GRGDKEGGDGAAV

SEQ ID NO: 385016 - protein, 4 aa, Mycobacterium
GRGG

SEQ ID NO: 385017 - protein, 6 aa, Mycobacterium
GRGGVR

SEQ ID NO: 385018 - protein, 4 aa, Mycobacterium
GRGT

SEQ ID NO: 385019 - protein, 15 aa, Mycobacterium
GRHDPSGFADWLTVA

SEQ ID NO: 385020 - protein, 6 aa, Mycobacterium
GRLPST

SEQ ID NO: 385021 - protein, 8 aa, Mycobacterium
GRPADGAP

SEQ ID NO: 385022 - protein, 5 aa, Mycobacterium
GRPDD

SEQ ID NO: 385023 - protein, 6 aa, Mycobacterium
GRPGDG

SEQ ID NO: 385024 - protein, 8 aa, Mycobacterium
GRPSERWG

SEQ ID NO: 385025 - protein, 5 aa, Mycobacterium
GRPVP

SEQ ID NO: 385026 - protein, 5 aa, Mycobacterium
GRRGA

SEQ ID NO: 385027 - protein, 8 aa, Mycobacterium
GRRGGSAM

SEQ ID NO: 385028 - protein, 8 aa, Mycobacterium
GRRGTTTD

SEQ ID NO: 385029 - protein, 5 aa, Mycobacterium
GRSIR

SEQ ID NO: 385030 - protein, 4 aa, Mycobacterium
GRSV

SEQ ID NO: 385031 - protein, 5 aa, Mycobacterium
GRSYR

SEQ ID NO: 385032 - protein, 4 aa, Mycobacterium
GRTD

SEQ ID NO: 385033 - protein, 5 aa, Mycobacterium
GRTGA

SEQ ID NO: 385034 - protein, 9 aa, Mycobacterium
GSDEGGHDA

SEQ ID NO: 385035 - protein, 11 aa, Mycobacterium
GSDSGGGAGIQ

SEQ ID NO: 385036 - protein, 9 aa, Mycobacterium
GSEDDPDSV

SEQ ID NO: 385037 - protein, 8 aa, Mycobacterium
GSEEEAPL

SEQ ID NO: 385038 - protein, 4 aa, Mycobacterium
GSGA

SEQ ID NO: 385039 - protein, 4 aa, Mycobacterium
GSGE

SEQ ID NO: 385040 - protein, 6 aa, Mycobacterium
GSGNFG

SEQ ID NO: 385041 - protein, 6 aa, Mycobacterium
GSGNSI

SEQ ID NO: 385042 - protein, 9 aa, Mycobacterium
GSGPAGLAA

SEQ ID NO: 385043 - protein, 10 aa, Mycobacterium
GSGPGDPGLL

SEQ ID NO: 385044 - protein, 5 aa, Mycobacterium
GSGPL

SEQ ID NO: 385045 - protein, 4 aa, Mycobacterium
GSGQ

SEQ ID NO: 385046 - protein, 4 aa, Mycobacterium
GSGY

SEQ ID NO: 385047 - protein, 10 aa, Mycobacterium
GSHQDAINKG

SEQ ID NO: 385048 - protein, 4 aa, Mycobacterium
GSIG

SEQ ID NO: 385049 - protein, 9 aa, Mycobacterium
GSKTPGHPE

SEQ ID NO: 385050 - protein, 8 aa, Mycobacterium
GSLDQEPE

SEQ ID NO: 385051 - protein, 7 aa, Mycobacterium
GSPEVTN

SEQ ID NO: 385052 - protein, 6 aa, Mycobacterium
GSPPAE

SEQ ID NO: 385053 - protein, 12 aa, Mycobacterium
GSPSQARKHADA

SEQ ID NO: 385054 - protein, 4 aa, Mycobacterium
GSQI

SEQ ID NO: 385055 - protein, 4 aa, Mycobacterium
GSRA

SEQ ID NO: 385056 - protein, 4 aa, Mycobacterium
GSRI

SEQ ID NO: 385057 - protein, 8 aa, Mycobacterium
GSRKQLAA

SEQ ID NO: 385058 - protein, 5 aa, Mycobacterium
GSSAL

SEQ ID NO: 385059 - protein, 4 aa, Mycobacterium
GSSI

SEQ ID NO: 385060 - protein, 7 aa, Mycobacterium
GSSRRYA

SEQ ID NO: 385061 - protein, 15 aa, Mycobacterium
GSSTENSAYGPTRNP

SEQ ID NO: 385062 - protein, 9 aa, Mycobacterium
GSTATGRSV

SEQ ID NO: 385063 - protein, 6 aa, Mycobacterium
GSTEVG

SEQ ID NO: 385064 - protein, 7 aa, Mycobacterium
GSTGDGI

SEQ ID NO: 385065 - protein, 8 aa, Mycobacterium
GSTGLPKG

SEQ ID NO: 385066 - protein, 4 aa, Mycobacterium
GSTP

SEQ ID NO: 385067 - protein, 4 aa, Mycobacterium
GSTV

SEQ ID NO: 385068 - protein, 6 aa, Mycobacterium
GSVSVH

SEQ ID NO: 385069 - protein, 4 aa, Mycobacterium
GSWE

SEQ ID NO: 385070 - protein, 4 aa, Mycobacterium
GSYP

SEQ ID NO: 385071 - protein, 7 aa, Mycobacterium
GTAEAPG

SEQ ID NO: 385072 - protein, 5 aa, Mycobacterium
GTAET

SEQ ID NO: 385073 - protein, 7 aa, Mycobacterium
GTAGYNA

SEQ ID NO: 385074 - protein, 9 aa, Mycobacterium
GTALGGGTE

SEQ ID NO: 385075 - protein, 4 aa, Mycobacterium
GTAT

SEQ ID NO: 385076 - protein, 5 aa, Mycobacterium
GTAVS

SEQ ID NO: 385077 - protein, 5 aa, Mycobacterium
GTDVP

SEQ ID NO: 385078 - protein, 4 aa, Mycobacterium
GTEA

SEQ ID NO: 385079 - protein, 7 aa, Mycobacterium
GTEEQKQ

SEQ ID NO: 385080 - protein, 4 aa, Mycobacterium
GTEL

SEQ ID NO: 385081 - protein, 4 aa, Mycobacterium
GTEP

SEQ ID NO: 385082 - protein, 5 aa, Mycobacterium
GTGGL

SEQ ID NO: 385083 - protein, 7 aa, Mycobacterium
GTGMAGS

SEQ ID NO: 385084 - protein, 6 aa, Mycobacterium
GTGSNT

SEQ ID NO: 385085 - protein, 15 aa, Mycobacterium
GTGVTPRDVTPEATR

SEQ ID NO: 385086 - protein, 8 aa, Mycobacterium
GTNCENLP

SEQ ID NO: 385087 - protein, 10 aa, Mycobacterium
GTNGKTTTTS

SEQ ID NO: 385088 - protein, 8 aa, Mycobacterium
GTPARASH

SEQ ID NO: 385089 - protein, 4 aa, Mycobacterium
GTPE

SEQ ID NO: 385090 - protein, 11 aa, Mycobacterium
GTPFRSDDSPI

SEQ ID NO: 385091 - protein, 4 aa, Mycobacterium
GTPS

SEQ ID NO: 385092 - protein, 5 aa, Mycobacterium
GTPVD

SEQ ID NO: 385093 - protein, 11 aa, Mycobacterium
GTPVPPEPAEV

SEQ ID NO: 385094 - protein, 4 aa, Mycobacterium
GTRD

SEQ ID NO: 385095 - protein, 6 aa, Mycobacterium
GTRDAV

SEQ ID NO: 385096 - protein, 11 aa, Mycobacterium
GTRPARPSGVE

SEQ ID NO: 385097 - protein, 8 aa, Mycobacterium
GTSAGGSL

SEQ ID NO: 385098 - protein, 8 aa, Mycobacterium
GTSDISKP

SEQ ID NO: 385099 - protein, 7 aa, Mycobacterium
GTSGPQV

SEQ ID NO: 385100 - protein, 4 aa, Mycobacterium
GTSN

SEQ ID NO: 385101 - protein, 7 aa, Mycobacterium
GTTGIPK

SEQ ID NO: 385102 - protein, 6 aa, Mycobacterium
GTTGLP

SEQ ID NO: 385103 - protein, 4 aa, Mycobacterium
GTTW

SEQ ID NO: 385104 - protein, 4 aa, Mycobacterium
GTVE

SEQ ID NO: 385105 - protein, 5 aa, Mycobacterium
GTVGD

SEQ ID NO: 385106 - protein, 5 aa, Mycobacterium
GTWTP

SEQ ID NO: 385107 - protein, 6 aa, Mycobacterium
GVAGGT

SEQ ID NO: 385108 - protein, 4 aa, Mycobacterium
GVAP

SEQ ID NO: 385109 - protein, 4 aa, Mycobacterium
GVDG

SEQ ID NO: 385110 - protein, 4 aa, Mycobacterium
GVDT

SEQ ID NO: 385111 - protein, 4 aa, Mycobacterium
GVGE

SEQ ID NO: 385112 - protein, 4 aa, Mycobacterium
GVGG

SEQ ID NO: 385113 - protein, 8 aa, Mycobacterium
GVGGGSLN

SEQ ID NO: 385114 - protein, 5 aa, Mycobacterium
GVGGT

SEQ ID NO: 385115 - protein, 4 aa, Mycobacterium
GVGR

SEQ ID NO: 385116 - protein, 6 aa, Mycobacterium
GVGRKT

SEQ ID NO: 385117 - protein, 5 aa, Mycobacterium
GVKED

SEQ ID NO: 385118 - protein, 4 aa, Mycobacterium
GVPA

SEQ ID NO: 385119 - protein, 4 aa, Mycobacterium
GVPG

SEQ ID NO: 385120 - protein, 5 aa, Mycobacterium
GVRAQ

SEQ ID NO: 385121 - protein, 4 aa, Mycobacterium
GVRE

SEQ ID NO: 385122 - protein, 5 aa, Mycobacterium
GVSRP

SEQ ID NO: 385123 - protein, 8 aa, Mycobacterium
GYAGLSDT

SEQ ID NO: 385124 - protein, 23 aa, Mycobacterium
GYGQTGPDAHKAGYASVAEAASG

SEQ ID NO: 385125 - protein, 4 aa, Mycobacterium
GYPS

SEQ ID NO: 385126 - protein, 6 aa, Mycobacterium
GYTGEH

SEQ ID NO: 385127 - protein, 5 aa, Mycobacterium
GYYRT

SEQ ID NO: 385128 - protein, 5 aa, Mycobacterium
HAERD

SEQ ID NO: 385129 - protein, 13 aa, Mycobacterium
HAVSGAKSDAADA

SEQ ID NO: 385130 - protein, 8 aa, Mycobacterium
HAYGGGSQ

SEQ ID NO: 385131 - protein, 6 aa, Mycobacterium
HCPKDK

SEQ ID NO: 385132 - protein, 8 aa, Mycobacterium
HDDGPRPT

SEQ ID NO: 385133 - protein, 4 aa, Mycobacterium
HDGG

SEQ ID NO: 385134 - protein, 4 aa, Mycobacterium
HDQR

SEQ ID NO: 385135 - protein, 6 aa, Mycobacterium
HEPDSG

SEQ ID NO: 385136 - protein, 6 aa, Mycobacterium
HETTAT

SEQ ID NO: 385137 - protein, 6 aa, Mycobacterium
HETTSN

SEQ ID NO: 385138 - protein, 10 aa, Mycobacterium
HEVGTGGQAE

SEQ ID NO: 385139 - protein, 13 aa, Mycobacterium
HGEDVEEALPSRP

SEQ ID NO: 385140 - protein, 7 aa, Mycobacterium
HGGRQLD

SEQ ID NO: 385141 - protein, 4 aa, Mycobacterium
HGRT

SEQ ID NO: 385142 - protein, 5 aa, Mycobacterium
HGTGT

SEQ ID NO: 385143 - protein, 4 aa, Mycobacterium
HHKG

SEQ ID NO: 385144 - protein, 6 aa, Mycobacterium
HNHPSY

SEQ ID NO: 385145 - protein, 4 aa, Mycobacterium
HNPA

SEQ ID NO: 385146 - protein, 8 aa, Mycobacterium
HNPAGAAA

SEQ ID NO: 385147 - protein, 4 aa, Mycobacterium
HPAD

SEQ ID NO: 385148 - protein, 13 aa, Mycobacterium
HPDDESSKGAATL

SEQ ID NO: 385149 - protein, 6 aa, Mycobacterium
HPDDRA

SEQ ID NO: 385150 - protein, 5 aa, Mycobacterium
HPDGE

SEQ ID NO: 385151 - protein, 12 aa, Mycobacterium
HPEYSAPECTDP

SEQ ID NO: 385152 - protein, 6 aa, Mycobacterium
HPSPVP

SEQ ID NO: 385153 - protein, 4 aa, Mycobacterium
HPTE

SEQ ID NO: 385154 - protein, 4 aa, Mycobacterium
HPTV

SEQ ID NO: 385155 - protein, 6 aa, Mycobacterium
HPVTGG

SEQ ID NO: 385156 - protein, 7 aa, Mycobacterium
HQDGTPD

SEQ ID NO: 385157 - protein, 9 aa, Mycobacterium
HRGSGAPEG

SEQ ID NO: 385158 - protein, 8 aa, Mycobacterium
HSGDPSLY

SEQ ID NO: 385159 - protein, 4 aa, Mycobacterium
HSGG

SEQ ID NO: 385160 - protein, 7 aa, Mycobacterium
HSPERRA

SEQ ID NO: 385161 - protein, 13 aa, Mycobacterium
HSPKGPQATGVRS

SEQ ID NO: 385162 - protein, 4 aa, Mycobacterium
HSPS

SEQ ID NO: 385163 - protein, 13 aa, Mycobacterium
HTAGTSSQISDGA

SEQ ID NO: 385164 - protein, 24 aa, Mycobacterium
HTEPGLQGDRSSAGTKPATVETGA

SEQ ID NO: 385165 - protein, 5 aa, Mycobacterium
HTNAL

SEQ ID NO: 385166 - protein, 7 aa, Mycobacterium
HTRPTIG

SEQ ID NO: 385167 - protein, 11 aa, Mycobacterium
HTVTPSPHHPI

SEQ ID NO: 385168 - protein, 6 aa, Mycobacterium
HYGGGD

SEQ ID NO: 385169 - protein, 11 aa, Mycobacterium
HYGSPDKDPAV

SEQ ID NO: 385170 - protein, 12 aa, Mycobacterium
IADPAATRAPDR

SEQ ID NO: 385171 - protein, 11 aa, Mycobacterium
IAEPDKDGGAL

SEQ ID NO: 385172 - protein, 4 aa, Mycobacterium
IAKT

SEQ ID NO: 385173 - protein, 9 aa, Mycobacterium
IAPPDPDGK

SEQ ID NO: 385174 - protein, 6 aa, Mycobacterium
IASPGS

SEQ ID NO: 385175 - protein, 8 aa, Mycobacterium
IDADAADK

SEQ ID NO: 385176 - protein, 15 aa, Mycobacterium
IDAGDRAGQTSEESE

SEQ ID NO: 385177 - protein, 5 aa, Mycobacterium
IDEEG

SEQ ID NO: 385178 - protein, 8 aa, Mycobacterium
IDGEKLTD

SEQ ID NO: 385179 - protein, 4 aa, Mycobacterium
IDSA

SEQ ID NO: 385180 - protein, 7 aa, Mycobacterium
IDSGREP

SEQ ID NO: 385181 - protein, 6 aa, Mycobacterium
IDTGEK

SEQ ID NO: 385182 - protein, 5 aa, Mycobacterium
IDTGP

SEQ ID NO: 385183 - protein, 8 aa, Mycobacterium
IEADPANP

SEQ ID NO: 385184 - protein, 16 aa, Mycobacterium
IECSTGSACTAGVAQP

SEQ ID NO: 385185 - protein, 4 aa, Mycobacterium
IEEG

SEQ ID NO: 385186 - protein, 11 aa, Mycobacterium
IEEGQQVKRTG

SEQ ID NO: 385187 - protein, 13 aa, Mycobacterium
IENSDSDYDREKL

SEQ ID NO: 385188 - protein, 5 aa, Mycobacterium
IGGGF

SEQ ID NO: 385189 - protein, 8 aa, Mycobacterium
IGGGTTEM

SEQ ID NO: 385190 - protein, 4 aa, Mycobacterium
IGPE

SEQ ID NO: 385191 - protein, 6 aa, Mycobacterium
IGPPIT

SEQ ID NO: 385192 - protein, 9 aa, Mycobacterium
IGQRGQDTS

SEQ ID NO: 385193 - protein, 8 aa, Mycobacterium
IGRSGRHI

SEQ ID NO: 385194 - protein, 4 aa, Mycobacterium
IGSA

SEQ ID NO: 385195 - protein, 10 aa, Mycobacterium
IGSDGAGSVR

SEQ ID NO: 385196 - protein, 5 aa, Mycobacterium
IGTED

SEQ ID NO: 385197 - protein, 7 aa, Mycobacterium
IHPTPDT

SEQ ID NO: 385198 - protein, 8 aa, Mycobacterium
IKGSPTTE

SEQ ID NO: 385199 - protein, 7 aa, Mycobacterium
INANPAS

SEQ ID NO: 385200 - protein, 5 aa, Mycobacterium
IPATR

SEQ ID NO: 385201 - protein, 4 aa, Mycobacterium
IPET

SEQ ID NO: 385202 - protein, 5 aa, Mycobacterium
IPKPT

SEQ ID NO: 385203 - protein, 11 aa, Mycobacterium
IPRTTSGKLAR

SEQ ID NO: 385204 - protein, 4 aa, Mycobacterium
IPSG

SEQ ID NO: 385205 - protein, 5 aa, Mycobacterium
IPTRH

SEQ ID NO: 385206 - protein, 4 aa, Mycobacterium
IPYG

SEQ ID NO: 385207 - protein, 10 aa, Mycobacterium
IRGESENLAP

SEQ ID NO: 385208 - protein, 7 aa, Mycobacterium
IRKRGSV

SEQ ID NO: 385209 - protein, 4 aa, Mycobacterium
IRPG

SEQ ID NO: 385210 - protein, 7 aa, Mycobacterium
IRPPQRL

SEQ ID NO: 385211 - protein, 6 aa, Mycobacterium
ISDTTA

SEQ ID NO: 385212 - protein, 4 aa, Mycobacterium
ISPA

SEQ ID NO: 385213 - protein, 5 aa, Mycobacterium
ISPYP

SEQ ID NO: 385214 - protein, 13 aa, Mycobacterium
ISSPSDPTANPIL

SEQ ID NO: 385215 - protein, 7 aa, Mycobacterium
ITNGPDA

SEQ ID NO: 385216 - protein, 8 aa, Mycobacterium
ITNSGTDI

SEQ ID NO: 385217 - protein, 4 aa, Mycobacterium
ITPT

SEQ ID NO: 385218 - protein, 6 aa, Mycobacterium
ITRNNP

SEQ ID NO: 385219 - protein, 10 aa, Mycobacterium
ITSTRGRSIT

SEQ ID NO: 385220 - protein, 4 aa, Mycobacterium
IVPP

SEQ ID NO: 385221 - protein, 4 aa, Mycobacterium
IYGD

SEQ ID NO: 385222 - protein, 12 aa, Mycobacterium
KAAAARRARAEL

SEQ ID NO: 385223 - protein, 8 aa, Mycobacterium
KAAGRQRN

SEQ ID NO: 385224 - protein, 8 aa, Mycobacterium
KAATDKPF

SEQ ID NO: 385225 - protein, 6 aa, Mycobacterium
KAGATG

SEQ ID NO: 385226 - protein, 6 aa, Mycobacterium
KAGEQL

SEQ ID NO: 385227 - protein, 5 aa, Mycobacterium
KAGGF

SEQ ID NO: 385228 - protein, 7 aa, Mycobacterium
KAINDND

SEQ ID NO: 385229 - protein, 8 aa, Mycobacterium
KAKSQKAV

SEQ ID NO: 385230 - protein, 5 aa, Mycobacterium
KANDI

SEQ ID NO: 385231 - protein, 5 aa, Mycobacterium
KAPSV

SEQ ID NO: 385232 - protein, 8 aa, Mycobacterium
KARQSGAA

SEQ ID NO: 385233 - protein, 9 aa, Mycobacterium
KASGGIRTA

SEQ ID NO: 385234 - protein, 9 aa, Mycobacterium
KDAGGRAVA

SEQ ID NO: 385235 - protein, 17 aa, Mycobacterium
KDETTIVEGAGDSDAIA

SEQ ID NO: 385236 - protein, 9 aa, Mycobacterium
KDEYPATAA

SEQ ID NO: 385237 - protein, 10 aa, Mycobacterium
KDGAIAGPRS

SEQ ID NO: 385238 - protein, 4 aa, Mycobacterium
KDGS

SEQ ID NO: 385239 - protein, 7 aa, Mycobacterium
KDGSGGR

SEQ ID NO: 385240 - protein, 8 aa, Mycobacterium
KDKGAKGK

SEQ ID NO: 385241 - protein, 4 aa, Mycobacterium
KDRT

SEQ ID NO: 385242 - protein, 7 aa, Mycobacterium
KDWTPTQ

SEQ ID NO: 385243 - protein, 7 aa, Mycobacterium
KEPIGSK

SEQ ID NO: 385244 - protein, 6 aa, Mycobacterium
KEPMEV

SEQ ID NO: 385245 - protein, 11 aa, Mycobacterium
KEYGGQDRSPM

SEQ ID NO: 385246 - protein, 13 aa, Mycobacterium
KEYGSGSSRDWAA

SEQ ID NO: 385247 - protein, 6 aa, Mycobacterium
KGARIS

SEQ ID NO: 385248 - protein, 6 aa, Mycobacterium
KGDSVT

SEQ ID NO: 385249 - protein, 11 aa, Mycobacterium
KGGVGKTTSTI

SEQ ID NO: 385250 - protein, 14 aa, Mycobacterium
KGIGESATVGSPPA

SEQ ID NO: 385251 - protein, 5 aa, Mycobacterium
KGITS

SEQ ID NO: 385252 - protein, 6 aa, Mycobacterium
KGKRFN

SEQ ID NO: 385253 - protein, 10 aa, Mycobacterium
KGPGSGRETA

SEQ ID NO: 385254 - protein, 5 aa, Mycobacterium
KGSAL

SEQ ID NO: 385255 - protein, 9 aa, Mycobacterium
KGTGSYDYS

SEQ ID NO: 385256 - protein, 8 aa, Mycobacterium
KGTSGIDL

SEQ ID NO: 385257 - protein, 7 aa, Mycobacterium
KKAAGNV

SEQ ID NO: 385258 - protein, 5 aa, Mycobacterium
KKPGI

SEQ ID NO: 385259 - protein, 4 aa, Mycobacterium
KLPT

SEQ ID NO: 385260 - protein, 10 aa, Mycobacterium
KLRRSTHTSV

SEQ ID NO: 385261 - protein, 5 aa, Mycobacterium
KNELR

SEQ ID NO: 385262 - protein, 8 aa, Mycobacterium
KNKLERSL

SEQ ID NO: 385263 - protein, 14 aa, Mycobacterium
KNSGIGRENGPEGV

SEQ ID NO: 385264 - protein, 9 aa, Mycobacterium
KNYDGSWTE

SEQ ID NO: 385265 - protein, 8 aa, Mycobacterium
KPDSQTPY

SEQ ID NO: 385266 - protein, 5 aa, Mycobacterium
KPEAI

SEQ ID NO: 385267 - protein, 5 aa, Mycobacterium
KPGAG

SEQ ID NO: 385268 - protein, 5 aa, Mycobacterium
KPGNV

SEQ ID NO: 385269 - protein, 11 aa, Mycobacterium
KPGTTTPHTEF

SEQ ID NO: 385270 - protein, 13 aa, Mycobacterium
KPKRRTKAQIARE

SEQ ID NO: 385271 - protein, 15 aa, Mycobacterium
KPLGGPDGGNGGRGG

SEQ ID NO: 385272 - protein, 5 aa, Mycobacterium
KPLRG

SEQ ID NO: 385273 - protein, 7 aa, Mycobacterium
KPRPSDI

SEQ ID NO: 385274 - protein, 9 aa, Mycobacterium
KPSASKGRY

SEQ ID NO: 385275 - protein, 8 aa, Mycobacterium
KPSRGRLP

SEQ ID NO: 385276 - protein, 12 aa, Mycobacterium
KPVGQSVSATRR

SEQ ID NO: 385277 - protein, 7 aa, Mycobacterium
KQARQAA

SEQ ID NO: 385278 - protein, 7 aa, Mycobacterium
KQKVGQI

SEQ ID NO: 385279 - protein, 11 aa, Mycobacterium
KRFRRTGTGKI

SEQ ID NO: 385280 - protein, 8 aa, Mycobacterium
KRGDIGST

SEQ ID NO: 385281 - protein, 6 aa, Mycobacterium
KRGKRM

SEQ ID NO: 385282 - protein, 5 aa, Mycobacterium
KRGRR

SEQ ID NO: 385283 - protein, 4 aa, Mycobacterium
KRPM

SEQ ID NO: 385284 - protein, 5 aa, Mycobacterium
KRPRE

SEQ ID NO: 385285 - protein, 5 aa, Mycobacterium
KRTGK

SEQ ID NO: 385286 - protein, 8 aa, Mycobacterium
KSASGGEL

SEQ ID NO: 385287 - protein, 11 aa, Mycobacterium
KSATDIGGLPG

SEQ ID NO: 385288 - protein, 11 aa, Mycobacterium
KSATDLGGLPG

SEQ ID NO: 385289 - protein, 6 aa, Mycobacterium
KSEPYC

SEQ ID NO: 385290 - protein, 8 aa, Mycobacterium
KSGDPRAA

SEQ ID NO: 385291 - protein, 7 aa, Mycobacterium
KSRNEID

SEQ ID NO: 385292 - protein, 8 aa, Mycobacterium
KSRTRGYA

SEQ ID NO: 385293 - protein, 6 aa, Mycobacterium
KSSPTC

SEQ ID NO: 385294 - protein, 6 aa, Mycobacterium
KSWQES

SEQ ID NO: 385295 - protein, 7 aa, Mycobacterium
KSYGKGS

SEQ ID NO: 385296 - protein, 4 aa, Mycobacterium
KTID

SEQ ID NO: 385297 - protein, 8 aa, Mycobacterium
KTNTPRNF

SEQ ID NO: 385298 - protein, 7 aa, Mycobacterium
KTPETAG

SEQ ID NO: 385299 - protein, 5 aa, Mycobacterium
KTPPT

SEQ ID NO: 385300 - protein, 5 aa, Mycobacterium
KTYGG

SEQ ID NO: 385301 - protein, 8 aa, Mycobacterium
KVEDGKTD

SEQ ID NO: 385302 - protein, 8 aa, Mycobacterium
KVEGDTSV

SEQ ID NO: 385303 - protein, 5 aa, Mycobacterium
KVNDE

SEQ ID NO: 385304 - protein, 8 aa, Mycobacterium
KVTSDELG

SEQ ID NO: 385305 - protein, 4 aa, Mycobacterium
KYDG

SEQ ID NO: 385306 - protein, 7 aa, Mycobacterium
KYGGRDA

SEQ ID NO: 385307 - protein, 6 aa, Mycobacterium
LAAAAG

SEQ ID NO: 385308 - protein, 4 aa, Mycobacterium
LAAP

SEQ ID NO: 385309 - protein, 4 aa, Mycobacterium
LADG

SEQ ID NO: 385310 - protein, 7 aa, Mycobacterium
LADPDHA

SEQ ID NO: 385311 - protein, 4 aa, Mycobacterium
LAER

SEQ ID NO: 385312 - protein, 6 aa, Mycobacterium
LAGNPI

SEQ ID NO: 385313 - protein, 7 aa, Mycobacterium
LAGVSGS

SEQ ID NO: 385314 - protein, 4 aa, Mycobacterium
LAPG

SEQ ID NO: 385315 - protein, 6 aa, Mycobacterium
LAPTDG

SEQ ID NO: 385316 - protein, 9 aa, Mycobacterium
LARRNADGD

SEQ ID NO: 385317 - protein, 9 aa, Mycobacterium
LDKPPGVAE

SEQ ID NO: 385318 - protein, 9 aa, Mycobacterium
LDPAGEKAQ

SEQ ID NO: 385319 - protein, 6 aa, Mycobacterium
LDPQGQ

SEQ ID NO: 385320 - protein, 15 aa, Mycobacterium
LDSSNRQVREAAERA

SEQ ID NO: 385321 - protein, 4 aa, Mycobacterium
LEAQ

SEQ ID NO: 385322 - protein, 4 aa, Mycobacterium
LEEN

SEQ ID NO: 385323 - protein, 6 aa, Mycobacterium
LEQGTN

SEQ ID NO: 385324 - protein, 11 aa, Mycobacterium
LETTPPDATHW

SEQ ID NO: 385325 - protein, 4 aa, Mycobacterium
LGAE

SEQ ID NO: 385326 - protein, 4 aa, Mycobacterium
LGAR

SEQ ID NO: 385327 - protein, 5 aa, Mycobacterium
LGASG

SEQ ID NO: 385328 - protein, 12 aa, Mycobacterium
LGDPPGGWPEPL

SEQ ID NO: 385329 - protein, 4 aa, Mycobacterium
LGDR

SEQ ID NO: 385330 - protein, 10 aa, Mycobacterium
LGEDGPTHQP

SEQ ID NO: 385331 - protein, 7 aa, Mycobacterium
LGEEAGA

SEQ ID NO: 385332 - protein, 5 aa, Mycobacterium
LGGDA

SEQ ID NO: 385333 - protein, 4 aa, Mycobacterium
LGGG

SEQ ID NO: 385334 - protein, 5 aa, Mycobacterium
LGGKS

SEQ ID NO: 385335 - protein, 6 aa, Mycobacterium
LGGPVD

SEQ ID NO: 385336 - protein, 4 aa, Mycobacterium
LGGR

SEQ ID NO: 385337 - protein, 4 aa, Mycobacterium
LGGT

SEQ ID NO: 385338 - protein, 6 aa, Mycobacterium
LGPART

SEQ ID NO: 385339 - protein, 5 aa, Mycobacterium
LGPRG

SEQ ID NO: 385340 - protein, 10 aa, Mycobacterium
LGQNGPYGQV

SEQ ID NO: 385341 - protein, 6 aa, Mycobacterium
LGRHTN

SEQ ID NO: 385342 - protein, 7 aa, Mycobacterium
LGRPVGD

SEQ ID NO: 385343 - protein, 4 aa, Mycobacterium
LGSP

SEQ ID NO: 385344 - protein, 5 aa, Mycobacterium
LGSSV

SEQ ID NO: 385345 - protein, 4 aa, Mycobacterium
LGVP

SEQ ID NO: 385346 - protein, 6 aa, Mycobacterium
LHQGGT

SEQ ID NO: 385347 - protein, 8 aa, Mycobacterium
LKAGKSTL

SEQ ID NO: 385348 - protein, 11 aa, Mycobacterium
LKDSGERNDVA

SEQ ID NO: 385349 - protein, 5 aa, Mycobacterium
LKRDP

SEQ ID NO: 385350 - protein, 10 aa, Mycobacterium
LNASTPGKGV

SEQ ID NO: 385351 - protein, 9 aa, Mycobacterium
LNTAGGQLG

SEQ ID NO: 385352 - protein, 5 aa, Mycobacterium
LPAGS

SEQ ID NO: 385353 - protein, 6 aa, Mycobacterium
LPAGTP

SEQ ID NO: 385354 - protein, 5 aa, Mycobacterium
LPAGV

SEQ ID NO: 385355 - protein, 4 aa, Mycobacterium
LPDE

SEQ ID NO: 385356 - protein, 5 aa, Mycobacterium
LPEQG

SEQ ID NO: 385357 - protein, 8 aa, Mycobacterium
LPETTGGV

SEQ ID NO: 385358 - protein, 4 aa, Mycobacterium
LPGN

SEQ ID NO: 385359 - protein, 9 aa, Mycobacterium
LPGPHYETP

SEQ ID NO: 385360 - protein, 5 aa, Mycobacterium
LPPAE

SEQ ID NO: 385361 - protein, 4 aa, Mycobacterium
LPPD

SEQ ID NO: 385362 - protein, 4 aa, Mycobacterium
LPPE

SEQ ID NO: 385363 - protein, 4 aa, Mycobacterium
LPPG

SEQ ID NO: 385364 - protein, 4 aa, Mycobacterium
LPPP

SEQ ID NO: 385365 - protein, 4 aa, Mycobacterium
LPPQ

SEQ ID NO: 385366 - protein, 6 aa, Mycobacterium
LPPSQA

SEQ ID NO: 385367 - protein, 12 aa, Mycobacterium
LPQEQSQRPGHI

SEQ ID NO: 385368 - protein, 7 aa, Mycobacterium
LPRPGET

SEQ ID NO: 385369 - protein, 7 aa, Mycobacterium
LPRPQTQ

SEQ ID NO: 385370 - protein, 4 aa, Mycobacterium
LPTA

SEQ ID NO: 385371 - protein, 4 aa, Mycobacterium
LPTG

SEQ ID NO: 385372 - protein, 8 aa, Mycobacterium
LQKRSTGR

SEQ ID NO: 385373 - protein, 4 aa, Mycobacterium
LQPG

SEQ ID NO: 385374 - protein, 12 aa, Mycobacterium
LQPNAGSQGEYA

SEQ ID NO: 385375 - protein, 5 aa, Mycobacterium
LRDEP

SEQ ID NO: 385376 - protein, 4 aa, Mycobacterium
LRDG

SEQ ID NO: 385377 - protein, 4 aa, Mycobacterium
LRGG

SEQ ID NO: 385378 - protein, 4 aa, Mycobacterium
LRPE

SEQ ID NO: 385379 - protein, 9 aa, Mycobacterium
LRPEGRSGE

SEQ ID NO: 385380 - protein, 4 aa, Mycobacterium
LRPR

SEQ ID NO: 385381 - protein, 6 aa, Mycobacterium
LRPSRG

SEQ ID NO: 385382 - protein, 4 aa, Mycobacterium
LRSS

SEQ ID NO: 385383 - protein, 4 aa, Mycobacterium
LSAD

SEQ ID NO: 385384 - protein, 7 aa, Mycobacterium
LSEEDKQ

SEQ ID NO: 385385 - protein, 5 aa, Mycobacterium
LSGAG

SEQ ID NO: 385386 - protein, 15 aa, Mycobacterium
LSNQKHTDLTARYGR

SEQ ID NO: 385387 - protein, 6 aa, Mycobacterium
LSPERL

SEQ ID NO: 385388 - protein, 8 aa, Mycobacterium
LSSGKEAD

SEQ ID NO: 385389 - protein, 8 aa, Mycobacterium
LTAGADDY

SEQ ID NO: 385390 - protein, 19 aa, Mycobacterium
LTDRQAARQGVGGEVLAYV

SEQ ID NO: 385391 - protein, 9 aa, Mycobacterium
LTGGASRTT

SEQ ID NO: 385392 - protein, 5 aa, Mycobacterium
LTGKQ

SEQ ID NO: 385393 - protein, 8 aa, Mycobacterium
LTGPSDDG

SEQ ID NO: 385394 - protein, 5 aa, Mycobacterium
LTNKQ

SEQ ID NO: 385395 - protein, 6 aa, Mycobacterium
LTPAEG

SEQ ID NO: 385396 - protein, 4 aa, Mycobacterium
LTPD

SEQ ID NO: 385397 - protein, 9 aa, Mycobacterium
LTPSSAHGV

SEQ ID NO: 385398 - protein, 7 aa, Mycobacterium
LTSPEAT

SEQ ID NO: 385399 - protein, 4 aa, Mycobacterium
LTTS

SEQ ID NO: 385400 - protein, 6 aa, Mycobacterium
MAGRGT

SEQ ID NO: 385401 - protein, 7 aa, Mycobacterium
MAREDED

SEQ ID NO: 385402 - protein, 5 aa, Mycobacterium
MASAA

SEQ ID NO: 385403 - protein, 4 aa, Mycobacterium
MEGA

SEQ ID NO: 385404 - protein, 4 aa, Mycobacterium
MGGA

SEQ ID NO: 385405 - protein, 6 aa, Mycobacterium
MGPSYP

SEQ ID NO: 385406 - protein, 5 aa, Mycobacterium
MGRGQ

SEQ ID NO: 385407 - protein, 5 aa, Mycobacterium
MHGPD

SEQ ID NO: 385408 - protein, 12 aa, Mycobacterium
MKEAEDALRDYQ

SEQ ID NO: 385409 - protein, 7 aa, Mycobacterium
MKEGEEK

SEQ ID NO: 385410 - protein, 9 aa, Mycobacterium
MKTGEGKTL

SEQ ID NO: 385411 - protein, 4 aa, Mycobacterium
MPAE

SEQ ID NO: 385412 - protein, 4 aa, Mycobacterium
MPEH

SEQ ID NO: 385413 - protein, 4 aa, Mycobacterium
MSAG

SEQ ID NO: 385414 - protein, 11 aa, Mycobacterium
MSEPSAGSDLA

SEQ ID NO: 385415 - protein, 6 aa, Mycobacterium
MSKKKH

SEQ ID NO: 385416 - protein, 7 aa, Mycobacterium
MTAGSGA

SEQ ID NO: 385417 - protein, 7 aa, Mycobacterium
NADPERI

SEQ ID NO: 385418 - protein, 6 aa, Mycobacterium
NAEEGR

SEQ ID NO: 385419 - protein, 4 aa, Mycobacterium
NAGI

SEQ ID NO: 385420 - protein, 4 aa, Mycobacterium
NAKG

SEQ ID NO: 385421 - protein, 7 aa, Mycobacterium
NAPAIAA

SEQ ID NO: 385422 - protein, 6 aa, Mycobacterium
NAPTQA

SEQ ID NO: 385423 - protein, 8 aa, Mycobacterium
NARSFSDA

SEQ ID NO: 385424 - protein, 6 aa, Mycobacterium
NASDAL

SEQ ID NO: 385425 - protein, 4 aa, Mycobacterium
NATG

SEQ ID NO: 385426 - protein, 11 aa, Mycobacterium
NDAGDAASDAL

SEQ ID NO: 385427 - protein, 8 aa, Mycobacterium
NDAPGQPR

SEQ ID NO: 385428 - protein, 9 aa, Mycobacterium
NDGEALARQ

SEQ ID NO: 385429 - protein, 5 aa, Mycobacterium
NDHEN

SEQ ID NO: 385430 - protein, 8 aa, Mycobacterium
NDKDGVNA

SEQ ID NO: 385431 - protein, 6 aa, Mycobacterium
NDPAGL

SEQ ID NO: 385432 - protein, 4 aa, Mycobacterium
NDPR

SEQ ID NO: 385433 - protein, 6 aa, Mycobacterium
NDTGGV

SEQ ID NO: 385434 - protein, 14 aa, Mycobacterium
NDYADRKNGRQPIK

SEQ ID NO: 385435 - protein, 4 aa, Mycobacterium
NEEH

SEQ ID NO: 385436 - protein, 9 aa, Mycobacterium
NEGGPRKVS

SEQ ID NO: 385437 - protein, 4 aa, Mycobacterium
NEHE

SEQ ID NO: 385438 - protein, 7 aa, Mycobacterium
NEIGGGS

SEQ ID NO: 385439 - protein, 21 aa, Mycobacterium
NEKHNEANGEDNNDGESHNRS

SEQ ID NO: 385440 - protein, 9 aa, Mycobacterium
NEKSQLQNK

SEQ ID NO: 385441 - protein, 4 aa, Mycobacterium
NEPV

SEQ ID NO: 385442 - protein, 5 aa, Mycobacterium
NETQI

SEQ ID NO: 385443 - protein, 5 aa, Mycobacterium
NETTR

SEQ ID NO: 385444 - protein, 7 aa, Mycobacterium
NFDNDEA

SEQ ID NO: 385445 - protein, 5 aa, Mycobacterium
NGEKL

SEQ ID NO: 385446 - protein, 5 aa, Mycobacterium
NGERN

SEQ ID NO: 385447 - protein, 4 aa, Mycobacterium
NGGY

SEQ ID NO: 385448 - protein, 11 aa, Mycobacterium
NGHNVSTRGRI

SEQ ID NO: 385449 - protein, 6 aa, Mycobacterium
NGLTED

SEQ ID NO: 385450 - protein, 14 aa, Mycobacterium
NGPIKGTSNFGVFR

SEQ ID NO: 385451 - protein, 9 aa, Mycobacterium
NGPSDDPFG

SEQ ID NO: 385452 - protein, 5 aa, Mycobacterium
NGQSI

SEQ ID NO: 385453 - protein, 9 aa, Mycobacterium
NGRSYAPTI

SEQ ID NO: 385454 - protein, 7 aa, Mycobacterium
NGSGVTV

SEQ ID NO: 385455 - protein, 7 aa, Mycobacterium
NGYTRDY

SEQ ID NO: 385456 - protein, 7 aa, Mycobacterium
NHRGGTV

SEQ ID NO: 385457 - protein, 8 aa, Mycobacterium
NHSPDDIE

SEQ ID NO: 385458 - protein, 6 aa, Mycobacterium
NHTSSA

SEQ ID NO: 385459 - protein, 7 aa, Mycobacterium
NIEEGGS

SEQ ID NO: 385460 - protein, 5 aa, Mycobacterium
NIPDE

SEQ ID NO: 385461 - protein, 7 aa, Mycobacterium
NKAPGGV

SEQ ID NO: 385462 - protein, 10 aa, Mycobacterium
NKIEPQAPVD

SEQ ID NO: 385463 - protein, 4 aa, Mycobacterium
NKRS

SEQ ID NO: 385464 - protein, 9 aa, Mycobacterium
NLQRDPDEL

SEQ ID NO: 385465 - protein, 8 aa, Mycobacterium
NLTPGPRA

SEQ ID NO: 385466 - protein, 5 aa, Mycobacterium
NNGIA

SEQ ID NO: 385467 - protein, 7 aa, Mycobacterium
NNVDEGR

SEQ ID NO: 385468 - protein, 15 aa, Mycobacterium
NNYEQQEQASQQILS

SEQ ID NO: 385469 - protein, 6 aa, Mycobacterium
NPAFSS

SEQ ID NO: 385470 - protein, 6 aa, Mycobacterium
NPAGWQ

SEQ ID NO: 385471 - protein, 4 aa, Mycobacterium
NPAT

SEQ ID NO: 385472 - protein, 8 aa, Mycobacterium
NPAVGSAH

SEQ ID NO: 385473 - protein, 7 aa, Mycobacterium
NPDPEIH

SEQ ID NO: 385474 - protein, 4 aa, Mycobacterium
NPDQ

SEQ ID NO: 385475 - protein, 7 aa, Mycobacterium
NPENQRR

SEQ ID NO: 385476 - protein, 4 aa, Mycobacterium
NPFP

SEQ ID NO: 385477 - protein, 7 aa, Mycobacterium
NPHTKPP

SEQ ID NO: 385478 - protein, 17 aa, Mycobacterium
NPLSDDTLSTLSLPGVF

SEQ ID NO: 385479 - protein, 6 aa, Mycobacterium
NPVTAH

SEQ ID NO: 385480 - protein, 6 aa, Mycobacterium
NQDNAY

SEQ ID NO: 385481 - protein, 6 aa, Mycobacterium
NRAGSA

SEQ ID NO: 385482 - protein, 5 aa, Mycobacterium
NREDM

SEQ ID NO: 385483 - protein, 4 aa, Mycobacterium
NREE

SEQ ID NO: 385484 - protein, 4 aa, Mycobacterium
NRLH

SEQ ID NO: 385485 - protein, 10 aa, Mycobacterium
NRSSAKTQSA

SEQ ID NO: 385486 - protein, 10 aa, Mycobacterium
NSAATNEADP

SEQ ID NO: 385487 - protein, 4 aa, Mycobacterium
NSGA

SEQ ID NO: 385488 - protein, 12 aa, Mycobacterium
NSPGTIDAGYRG

SEQ ID NO: 385489 - protein, 5 aa, Mycobacterium
NTGGE

SEQ ID NO: 385490 - protein, 11 aa, Mycobacterium
NTHEGGTHEEG

SEQ ID NO: 385491 - protein, 12 aa, Mycobacterium
NTHEGGTHEEGF

SEQ ID NO: 385492 - protein, 5 aa, Mycobacterium
NTLTA

SEQ ID NO: 385493 - protein, 4 aa, Mycobacterium
NTPD

SEQ ID NO: 385494 - protein, 4 aa, Mycobacterium
NTPE

SEQ ID NO: 385495 - protein, 9 aa, Mycobacterium
NTPNSAGRY

SEQ ID NO: 385496 - protein, 5 aa, Mycobacterium
NTPPS

SEQ ID NO: 385497 - protein, 7 aa, Mycobacterium
NTRPRKT

SEQ ID NO: 385498 - protein, 5 aa, Mycobacterium
NTTRR

SEQ ID NO: 385499 - protein, 6 aa, Mycobacterium
NTYPGA

SEQ ID NO: 385500 - protein, 4 aa, Mycobacterium
NYAA

SEQ ID NO: 385501 - protein, 9 aa, Mycobacterium
PAADPDRYA

SEQ ID NO: 385502 - protein, 4 aa, Mycobacterium
PAAG

SEQ ID NO: 385503 - protein, 5 aa, Mycobacterium
PAAGG

SEQ ID NO: 385504 - protein, 11 aa, Mycobacterium
PAAGLDLGGRE

SEQ ID NO: 385505 - protein, 8 aa, Mycobacterium
PAAGVESG

SEQ ID NO: 385506 - protein, 4 aa, Mycobacterium
PADG

SEQ ID NO: 385507 - protein, 4 aa, Mycobacterium
PAEI

SEQ ID NO: 385508 - protein, 4 aa, Mycobacterium
PAER

SEQ ID NO: 385509 - protein, 4 aa, Mycobacterium
PAEV

SEQ ID NO: 385510 - protein, 6 aa, Mycobacterium
PAGGYQ

SEQ ID NO: 385511 - protein, 4 aa, Mycobacterium
PAGS

SEQ ID NO: 385512 - protein, 4 aa, Mycobacterium
PAGT

SEQ ID NO: 385513 - protein, 4 aa, Mycobacterium
PAGW

SEQ ID NO: 385514 - protein, 6 aa, Mycobacterium
PAHTAA

SEQ ID NO: 385515 - protein, 5 aa, Mycobacterium
PAKAR

SEQ ID NO: 385516 - protein, 5 aa, Mycobacterium
PALRE

SEQ ID NO: 385517 - protein, 4 aa, Mycobacterium
PANA

SEQ ID NO: 385518 - protein, 5 aa, Mycobacterium
PANSE

SEQ ID NO: 385519 - protein, 7 aa, Mycobacterium
PAPETPL

SEQ ID NO: 385520 - protein, 6 aa, Mycobacterium
PAPGPV

SEQ ID NO: 385521 - protein, 4 aa, Mycobacterium
PAPN

SEQ ID NO: 385522 - protein, 18 aa, Mycobacterium
PAPWRPDSSRGGDPDRPQ

SEQ ID NO: 385523 - protein, 4 aa, Mycobacterium
PARR

SEQ ID NO: 385524 - protein, 4 aa, Mycobacterium
PARV

SEQ ID NO: 385525 - protein, 4 aa, Mycobacterium
PASG

SEQ ID NO: 385526 - protein, 4 aa, Mycobacterium
PATI

SEQ ID NO: 385527 - protein, 4 aa, Mycobacterium
PATV

SEQ ID NO: 385528 - protein, 12 aa, Mycobacterium
PAVASSDARNIE

SEQ ID NO: 385529 - protein, 17 aa, Mycobacterium
PAVTGKPSGDDLRSGKR

SEQ ID NO: 385530 - protein, 6 aa, Mycobacterium
PCTGTG

SEQ ID NO: 385531 - protein, 4 aa, Mycobacterium
PDAD

SEQ ID NO: 385532 - protein, 7 aa, Mycobacterium
PDAHRES

SEQ ID NO: 385533 - protein, 4 aa, Mycobacterium
PDAV

SEQ ID NO: 385534 - protein, 8 aa, Mycobacterium
PDDGGEEV

SEQ ID NO: 385535 - protein, 7 aa, Mycobacterium
PDGKTQV

SEQ ID NO: 385536 - protein, 4 aa, Mycobacterium
PDGR

SEQ ID NO: 385537 - protein, 8 aa, Mycobacterium
PDGTYSAF

SEQ ID NO: 385538 - protein, 5 aa, Mycobacterium
PDIGA

SEQ ID NO: 385539 - protein, 4 aa, Mycobacterium
PDLA

SEQ ID NO: 385540 - protein, 7 aa, Mycobacterium
PDLPPSH

SEQ ID NO: 385541 - protein, 5 aa, Mycobacterium
PDLTT

SEQ ID NO: 385542 - protein, 9 aa, Mycobacterium
PDNDPRGTR

SEQ ID NO: 385543 - protein, 11 aa, Mycobacterium
PDPAPRGSAPA

SEQ ID NO: 385544 - protein, 5 aa, Mycobacterium
PDPFT

SEQ ID NO: 385545 - protein, 4 aa, Mycobacterium
PDPG

SEQ ID NO: 385546 - protein, 4 aa, Mycobacterium
PDTA

SEQ ID NO: 385547 - protein, 5 aa, Mycobacterium
PDTDA

SEQ ID NO: 385548 - protein, 6 aa, Mycobacterium
PDTGVS

SEQ ID NO: 385549 - protein, 10 aa, Mycobacterium
PEAAAGPHDA

SEQ ID NO: 385550 - protein, 5 aa, Mycobacterium
PEGRR

SEQ ID NO: 385551 - protein, 10 aa, Mycobacterium
PEKGGSTREA

SEQ ID NO: 385552 - protein, 4 aa, Mycobacterium
PERC

SEQ ID NO: 385553 - protein, 5 aa, Mycobacterium
PERER

SEQ ID NO: 385554 - protein, 5 aa, Mycobacterium
PESAH

SEQ ID NO: 385555 - protein, 13 aa, Mycobacterium
PETSQTDPTGVGD

SEQ ID NO: 385556 - protein, 5 aa, Mycobacterium
PETVP

SEQ ID NO: 385557 - protein, 6 aa, Mycobacterium
PFAATG

SEQ ID NO: 385558 - protein, 7 aa, Mycobacterium
PFGEGTG

SEQ ID NO: 385559 - protein, 5 aa, Mycobacterium
PFSPR

SEQ ID NO: 385560 - protein, 8 aa, Mycobacterium
PGAADDGV

SEQ ID NO: 385561 - protein, 10 aa, Mycobacterium
PGADATLTTT

SEQ ID NO: 385562 - protein, 12 aa, Mycobacterium
PGAGDAVQAAKA

SEQ ID NO: 385563 - protein, 8 aa, Mycobacterium
PGAGGTVS

SEQ ID NO: 385564 - protein, 11 aa, Mycobacterium
PGDREVDDKRL

SEQ ID NO: 385565 - protein, 5 aa, Mycobacterium
PGEGV

SEQ ID NO: 385566 - protein, 4 aa, Mycobacterium
PGER

SEQ ID NO: 385567 - protein, 8 aa, Mycobacterium
PGETEEDF

SEQ ID NO: 385568 - protein, 4 aa, Mycobacterium
PGFE

SEQ ID NO: 385569 - protein, 6 aa, Mycobacterium
PGFGEQ

SEQ ID NO: 385570 - protein, 5 aa, Mycobacterium
PGGDE

SEQ ID NO: 385571 - protein, 5 aa, Mycobacterium
PGGQL

SEQ ID NO: 385572 - protein, 9 aa, Mycobacterium
PGGSSTPLL

SEQ ID NO: 385573 - protein, 4 aa, Mycobacterium
PGHG

SEQ ID NO: 385574 - protein, 9 aa, Mycobacterium
PGIGKRGAE

SEQ ID NO: 385575 - protein, 8 aa, Mycobacterium
PGIGPKTA

SEQ ID NO: 385576 - protein, 8 aa, Mycobacterium
PGNRPSTS

SEQ ID NO: 385577 - protein, 5 aa, Mycobacterium
PGPRL

SEQ ID NO: 385578 - protein, 15 aa, Mycobacterium
PGPTGEQHVAYLKRP

SEQ ID NO: 385579 - protein, 9 aa, Mycobacterium
PGRGTQPTA

SEQ ID NO: 385580 - protein, 7 aa, Mycobacterium
PGRRARV

SEQ ID NO: 385581 - protein, 4 aa, Mycobacterium
PGRT

SEQ ID NO: 385582 - protein, 9 aa, Mycobacterium
PGSPGGVRD

SEQ ID NO: 385583 - protein, 4 aa, Mycobacterium
PGTD

SEQ ID NO: 385584 - protein, 4 aa, Mycobacterium
PGTL

SEQ ID NO: 385585 - protein, 4 aa, Mycobacterium
PGTT

SEQ ID NO: 385586 - protein, 4 aa, Mycobacterium
PGVG

SEQ ID NO: 385587 - protein, 7 aa, Mycobacterium
PGVRNYD

SEQ ID NO: 385588 - protein, 11 aa, Mycobacterium
PGVSSEQSEEL

SEQ ID NO: 385589 - protein, 4 aa, Mycobacterium
PGYQ

SEQ ID NO: 385590 - protein, 10 aa, Mycobacterium
PHAPDTHSPL

SEQ ID NO: 385591 - protein, 5 aa, Mycobacterium
PHPEG

SEQ ID NO: 385592 - protein, 4 aa, Mycobacterium
PHSD

SEQ ID NO: 385593 - protein, 7 aa, Mycobacterium
PHTDPSW

SEQ ID NO: 385594 - protein, 10 aa, Mycobacterium
PHTEEPTNWS

SEQ ID NO: 385595 - protein, 6 aa, Mycobacterium
PIHPTG

SEQ ID NO: 385596 - protein, 4 aa, Mycobacterium
PITT

SEQ ID NO: 385597 - protein, 8 aa, Mycobacterium
PKADGGGA

SEQ ID NO: 385598 - protein, 7 aa, Mycobacterium
PKPLART

SEQ ID NO: 385599 - protein, 15 aa, Mycobacterium
PKTKRTKTGYTTDAD

SEQ ID NO: 385600 - protein, 4 aa, Mycobacterium
PLGP

SEQ ID NO: 385601 - protein, 6 aa, Mycobacterium
PLGPKG

SEQ ID NO: 385602 - protein, 5 aa, Mycobacterium
PLPDD

SEQ ID NO: 385603 - protein, 7 aa, Mycobacterium
PLPEGSG

SEQ ID NO: 385604 - protein, 7 aa, Mycobacterium
PLRDGGY

SEQ ID NO: 385605 - protein, 13 aa, Mycobacterium
PMDAGRKGQKGIE

SEQ ID NO: 385606 - protein, 13 aa, Mycobacterium
PNAVQAGSLNRPG

SEQ ID NO: 385607 - protein, 10 aa, Mycobacterium
PNGTVTAGNA

SEQ ID NO: 385608 - protein, 7 aa, Mycobacterium
PNGVGKT

SEQ ID NO: 385609 - protein, 10 aa, Mycobacterium
PNPEEPGATD

SEQ ID NO: 385610 - protein, 8 aa, Mycobacterium
PNRGKRSV

SEQ ID NO: 385611 - protein, 9 aa, Mycobacterium
PPAADPVSL

SEQ ID NO: 385612 - protein, 4 aa, Mycobacterium
PPAE

SEQ ID NO: 385613 - protein, 6 aa, Mycobacterium
PPDAQD

SEQ ID NO: 385614 - protein, 6 aa, Mycobacterium
PPDGNT

SEQ ID NO: 385615 - protein, 7 aa, Mycobacterium
PPDPRVP

SEQ ID NO: 385616 - protein, 5 aa, Mycobacterium
PPEHT

SEQ ID NO: 385617 - protein, 4 aa, Mycobacterium
PPEV

SEQ ID NO: 385618 - protein, 4 aa, Mycobacterium
PPGV

SEQ ID NO: 385619 - protein, 5 aa, Mycobacterium
PPKPL

SEQ ID NO: 385620 - protein, 10 aa, Mycobacterium
PPLGPDAPPL

SEQ ID NO: 385621 - protein, 5 aa, Mycobacterium
PPRTV

SEQ ID NO: 385622 - protein, 6 aa, Mycobacterium
PPTDRR

SEQ ID NO: 385623 - protein, 4 aa, Mycobacterium
PPTF

SEQ ID NO: 385624 - protein, 7 aa, Mycobacterium
PQGALSA

SEQ ID NO: 385625 - protein, 4 aa, Mycobacterium
PQQR

SEQ ID NO: 385626 - protein, 5 aa, Mycobacterium
PQRGR

SEQ ID NO: 385627 - protein, 4 aa, Mycobacterium
PQRH

SEQ ID NO: 385628 - protein, 10 aa, Mycobacterium
PQRKGDPLQF

SEQ ID NO: 385629 - protein, 8 aa, Mycobacterium
PQSDGGPG

SEQ ID NO: 385630 - protein, 4 aa, Mycobacterium
PRAD

SEQ ID NO: 385631 - protein, 5 aa, Mycobacterium
PRAED

SEQ ID NO: 385632 - protein, 4 aa, Mycobacterium
PRHQ

SEQ ID NO: 385633 - protein, 13 aa, Mycobacterium
PRKPSRSERRDKS

SEQ ID NO: 385634 - protein, 6 aa, Mycobacterium
PRLDNQ

SEQ ID NO: 385635 - protein, 6 aa, Mycobacterium
PRNATG

SEQ ID NO: 385636 - protein, 7 aa, Mycobacterium
PRNPAGK

SEQ ID NO: 385637 - protein, 9 aa, Mycobacterium
PRRASSPFG

SEQ ID NO: 385638 - protein, 7 aa, Mycobacterium
PRSGGLR

SEQ ID NO: 385639 - protein, 7 aa, Mycobacterium
PRVPDSG

SEQ ID NO: 385640 - protein, 4 aa, Mycobacterium
PRWG

SEQ ID NO: 385641 - protein, 4 aa, Mycobacterium
PSAV

SEQ ID NO: 385642 - protein, 8 aa, Mycobacterium
PSERDPSV

SEQ ID NO: 385643 - protein, 9 aa, Mycobacterium
PSERDPSVP

SEQ ID NO: 385644 - protein, 15 aa, Mycobacterium
PSETTPSLPECTGAA

SEQ ID NO: 385645 - protein, 6 aa, Mycobacterium
PSGTEP

SEQ ID NO: 385646 - protein, 5 aa, Mycobacterium
PSGWD

SEQ ID NO: 385647 - protein, 6 aa, Mycobacterium
PSITTA

SEQ ID NO: 385648 - protein, 6 aa, Mycobacterium
PSPRHH

SEQ ID NO: 385649 - protein, 6 aa, Mycobacterium
PSPTAA

SEQ ID NO: 385650 - protein, 12 aa, Mycobacterium
PSPTKDPQPLAG

SEQ ID NO: 385651 - protein, 6 aa, Mycobacterium
PSPYGT

SEQ ID NO: 385652 - protein, 4 aa, Mycobacterium
PSQI

SEQ ID NO: 385653 - protein, 7 aa, Mycobacterium
PSRSTAH

SEQ ID NO: 385654 - protein, 4 aa, Mycobacterium
PSSL

SEQ ID NO: 385655 - protein, 5 aa, Mycobacterium
PSTGE

SEQ ID NO: 385656 - protein, 4 aa, Mycobacterium
PSTR

SEQ ID NO: 385657 - protein, 4 aa, Mycobacterium
PSVA

SEQ ID NO: 385658 - protein, 9 aa, Mycobacterium
PSYDPLDGN

SEQ ID NO: 385659 - protein, 6 aa, Mycobacterium
PTAEQQ

SEQ ID NO: 385660 - protein, 4 aa, Mycobacterium
PTDR

SEQ ID NO: 385661 - protein, 5 aa, Mycobacterium
PTFTD

SEQ ID NO: 385662 - protein, 8 aa, Mycobacterium
PTGAGKTV

SEQ ID NO: 385663 - protein, 4 aa, Mycobacterium
PTGL

SEQ ID NO: 385664 - protein, 7 aa, Mycobacterium
PTGSGKT

SEQ ID NO: 385665 - protein, 7 aa, Mycobacterium
PTGSTPV

SEQ ID NO: 385666 - protein, 4 aa, Mycobacterium
PTID

SEQ ID NO: 385667 - protein, 12 aa, Mycobacterium
PTITRSTPEGAR

SEQ ID NO: 385668 - protein, 4 aa, Mycobacterium
PTLD

SEQ ID NO: 385669 - protein, 4 aa, Mycobacterium
PTPA

SEQ ID NO: 385670 - protein, 5 aa, Mycobacterium
PTPRT

SEQ ID NO: 385671 - protein, 6 aa, Mycobacterium
PTPRTD

SEQ ID NO: 385672 - protein, 4 aa, Mycobacterium
PTPS

SEQ ID NO: 385673 - protein, 5 aa, Mycobacterium
PTRPR

SEQ ID NO: 385674 - protein, 11 aa, Mycobacterium
PTTPLPPPNPH

SEQ ID NO: 385675 - protein, 4 aa, Mycobacterium
PTTR

SEQ ID NO: 385676 - protein, 9 aa, Mycobacterium
PTVPAGTSR

SEQ ID NO: 385677 - protein, 4 aa, Mycobacterium
PVDP

SEQ ID NO: 385678 - protein, 7 aa, Mycobacterium
PVQGEAA

SEQ ID NO: 385679 - protein, 9 aa, Mycobacterium
PVQGRGGKG

SEQ ID NO: 385680 - protein, 6 aa, Mycobacterium
PVQSTA

SEQ ID NO: 385681 - protein, 21 aa, Mycobacterium
PVSRDSGKRTGRLHTPKRYSR

SEQ ID NO: 385682 - protein, 5 aa, Mycobacterium
PYEPG

SEQ ID NO: 385683 - protein, 10 aa, Mycobacterium
PYGNSGPRID

SEQ ID NO: 385684 - protein, 8 aa, Mycobacterium
PYSGPTAA

SEQ ID NO: 385685 - protein, 4 aa, Mycobacterium
PYTT

SEQ ID NO: 385686 - protein, 4 aa, Mycobacterium
QAAG

SEQ ID NO: 385687 - protein, 6 aa, Mycobacterium
QAAGRD

SEQ ID NO: 385688 - protein, 4 aa, Mycobacterium
QAAT

SEQ ID NO: 385689 - protein, 5 aa, Mycobacterium
QAGAD

SEQ ID NO: 385690 - protein, 6 aa, Mycobacterium
QAKYGA

SEQ ID NO: 385691 - protein, 6 aa, Mycobacterium
QANYGA

SEQ ID NO: 385692 - protein, 8 aa, Mycobacterium
QAPDTGNA

SEQ ID NO: 385693 - protein, 6 aa, Mycobacterium
QARKDR

SEQ ID NO: 385694 - protein, 6 aa, Mycobacterium
QATGGN

SEQ ID NO: 385695 - protein, 4 aa, Mycobacterium
QATT

SEQ ID NO: 385696 - protein, 9 aa, Mycobacterium
QDAGEDTVD

SEQ ID NO: 385697 - protein, 8 aa, Mycobacterium
QDDPAYRT

SEQ ID NO: 385698 - protein, 7 aa, Mycobacterium
QDEKDAE

SEQ ID NO: 385699 - protein, 5 aa, Mycobacterium
QDEVS

SEQ ID NO: 385700 - protein, 4 aa, Mycobacterium
QDHA

SEQ ID NO: 385701 - protein, 5 aa, Mycobacterium
QDPDW

SEQ ID NO: 385702 - protein, 5 aa, Mycobacterium
QDPHE

SEQ ID NO: 385703 - protein, 17 aa, Mycobacterium
QDQNLQDGPHKDLRRAR

SEQ ID NO: 385704 - protein, 4 aa, Mycobacterium
QDSV

SEQ ID NO: 385705 - protein, 4 aa, Mycobacterium
QEGA

SEQ ID NO: 385706 - protein, 7 aa, Mycobacterium
QEGVNDG

SEQ ID NO: 385707 - protein, 10 aa, Mycobacterium
QELGGKSPNI

SEQ ID NO: 385708 - protein, 7 aa, Mycobacterium
QETGQTV

SEQ ID NO: 385709 - protein, 4 aa, Mycobacterium
QETV

SEQ ID NO: 385710 - protein, 9 aa, Mycobacterium
QFDPTTMGT

SEQ ID NO: 385711 - protein, 9 aa, Mycobacterium
QGASAAVQG

SEQ ID NO: 385712 - protein, 12 aa, Mycobacterium
QGFPDEDGPPAM

SEQ ID NO: 385713 - protein, 4 aa, Mycobacterium
QGFS

SEQ ID NO: 385714 - protein, 6 aa, Mycobacterium
QGGGIR

SEQ ID NO: 385715 - protein, 6 aa, Mycobacterium
QGGIEE

SEQ ID NO: 385716 - protein, 8 aa, Mycobacterium
QGPGEVTA

SEQ ID NO: 385717 - protein, 4 aa, Mycobacterium
QGPK

SEQ ID NO: 385718 - protein, 7 aa, Mycobacterium
QGPRSAD

SEQ ID NO: 385719 - protein, 5 aa, Mycobacterium
QGRGV

SEQ ID NO: 385720 - protein, 12 aa, Mycobacterium
QGTGEGATFPRS

SEQ ID NO: 385721 - protein, 9 aa, Mycobacterium
QGVEPPRPL

SEQ ID NO: 385722 - protein, 9 aa, Mycobacterium
QGYNSGIRD

SEQ ID NO: 385723 - protein, 9 aa, Mycobacterium
QHTNDGAEM

SEQ ID NO: 385724 - protein, 4 aa, Mycobacterium
QITN

SEQ ID NO: 385725 - protein, 12 aa, Mycobacterium
QKGGVAKTTTVA

SEQ ID NO: 385726 - protein, 6 aa, Mycobacterium
QLGGGY

SEQ ID NO: 385727 - protein, 10 aa, Mycobacterium
QPADSYHNDH

SEQ ID NO: 385728 - protein, 9 aa, Mycobacterium
QPDAESVAA

SEQ ID NO: 385729 - protein, 7 aa, Mycobacterium
QPETAAV

SEQ ID NO: 385730 - protein, 6 aa, Mycobacterium
QPGALG

SEQ ID NO: 385731 - protein, 5 aa, Mycobacterium
QPGVV

SEQ ID NO: 385732 - protein, 6 aa, Mycobacterium
QPHRPG

SEQ ID NO: 385733 - protein, 6 aa, Mycobacterium
QPIPTT

SEQ ID NO: 385734 - protein, 8 aa, Mycobacterium
QPPYPGAA

SEQ ID NO: 385735 - protein, 7 aa, Mycobacterium
QPSATGR

SEQ ID NO: 385736 - protein, 4 aa, Mycobacterium
QPVL

SEQ ID NO: 385737 - protein, 6 aa, Mycobacterium
QQGERL

SEQ ID NO: 385738 - protein, 5 aa, Mycobacterium
QQTGV

SEQ ID NO: 385739 - protein, 4 aa, Mycobacterium
QRAE

SEQ ID NO: 385740 - protein, 9 aa, Mycobacterium
QRAEWSEER

SEQ ID NO: 385741 - protein, 4 aa, Mycobacterium
QRDD

SEQ ID NO: 385742 - protein, 5 aa, Mycobacterium
QRESL

SEQ ID NO: 385743 - protein, 9 aa, Mycobacterium
QRGGTPTAY

SEQ ID NO: 385744 - protein, 5 aa, Mycobacterium
QRGHR

SEQ ID NO: 385745 - protein, 9 aa, Mycobacterium
QRGRRGRKA

SEQ ID NO: 385746 - protein, 6 aa, Mycobacterium
QRNGER

SEQ ID NO: 385747 - protein, 7 aa, Mycobacterium
QRPGVGV

SEQ ID NO: 385748 - protein, 5 aa, Mycobacterium
QRPNG

SEQ ID NO: 385749 - protein, 4 aa, Mycobacterium
QRRD

SEQ ID NO: 385750 - protein, 4 aa, Mycobacterium
QRSD

SEQ ID NO: 385751 - protein, 6 aa, Mycobacterium
QRSGST

SEQ ID NO: 385752 - protein, 4 aa, Mycobacterium
QRTV

SEQ ID NO: 385753 - protein, 7 aa, Mycobacterium
QSERYGV

SEQ ID NO: 385754 - protein, 12 aa, Mycobacterium
QSGAAPGAGETR

SEQ ID NO: 385755 - protein, 8 aa, Mycobacterium
QSGQGADE

SEQ ID NO: 385756 - protein, 6 aa, Mycobacterium
QSGSDR

SEQ ID NO: 385757 - protein, 5 aa, Mycobacterium
QSKRR

SEQ ID NO: 385758 - protein, 4 aa, Mycobacterium
QSLG

SEQ ID NO: 385759 - protein, 5 aa, Mycobacterium
QSMDN

SEQ ID NO: 385760 - protein, 4 aa, Mycobacterium
QSPA

SEQ ID NO: 385761 - protein, 6 aa, Mycobacterium
QSRDGE

SEQ ID NO: 385762 - protein, 4 aa, Mycobacterium
QSRL

SEQ ID NO: 385763 - protein, 9 aa, Mycobacterium
QTDAKTGKP

SEQ ID NO: 385764 - protein, 5 aa, Mycobacterium
QTEAM

SEQ ID NO: 385765 - protein, 6 aa, Mycobacterium
QTNYGA

SEQ ID NO: 385766 - protein, 6 aa, Mycobacterium
QTQTPD

SEQ ID NO: 385767 - protein, 6 aa, Mycobacterium
QVRDGK

SEQ ID NO: 385768 - protein, 5 aa, Mycobacterium
QYEKA

SEQ ID NO: 385769 - protein, 15 aa, Mycobacterium
RAAADVPAKYKSEPW

SEQ ID NO: 385770 - protein, 6 aa, Mycobacterium
RAADAD

SEQ ID NO: 385771 - protein, 8 aa, Mycobacterium
RAAESGLR

SEQ ID NO: 385772 - protein, 4 aa, Mycobacterium
RAAG

SEQ ID NO: 385773 - protein, 5 aa, Mycobacterium
RADDE

SEQ ID NO: 385774 - protein, 6 aa, Mycobacterium
RADEQV

SEQ ID NO: 385775 - protein, 8 aa, Mycobacterium
RADRQPEF

SEQ ID NO: 385776 - protein, 5 aa, Mycobacterium
RAEAA

SEQ ID NO: 385777 - protein, 6 aa, Mycobacterium
RAEGDL

SEQ ID NO: 385778 - protein, 7 aa, Mycobacterium
RAGADSL

SEQ ID NO: 385779 - protein, 4 aa, Mycobacterium
RAGE

SEQ ID NO: 385780 - protein, 4 aa, Mycobacterium
RAGL

SEQ ID NO: 385781 - protein, 4 aa, Mycobacterium
RAGV

SEQ ID NO: 385782 - protein, 7 aa, Mycobacterium
RAGVGAG

SEQ ID NO: 385783 - protein, 4 aa, Mycobacterium
RAGY

SEQ ID NO: 385784 - protein, 4 aa, Mycobacterium
RAKA

SEQ ID NO: 385785 - protein, 7 aa, Mycobacterium
RAKKNAI

SEQ ID NO: 385786 - protein, 4 aa, Mycobacterium
RAPR

SEQ ID NO: 385787 - protein, 7 aa, Mycobacterium
RAPSRDT

SEQ ID NO: 385788 - protein, 6 aa, Mycobacterium
RARDAG

SEQ ID NO: 385789 - protein, 5 aa, Mycobacterium
RATAE

SEQ ID NO: 385790 - protein, 6 aa, Mycobacterium
RATEEA

SEQ ID NO: 385791 - protein, 5 aa, Mycobacterium
RATKG

SEQ ID NO: 385792 - protein, 8 aa, Mycobacterium
RAYEDGGA

SEQ ID NO: 385793 - protein, 5 aa, Mycobacterium
RCGSG

SEQ ID NO: 385794 - protein, 4 aa, Mycobacterium
RDAE

SEQ ID NO: 385795 - protein, 5 aa, Mycobacterium
RDAGA

SEQ ID NO: 385796 - protein, 4 aa, Mycobacterium
RDDA

SEQ ID NO: 385797 - protein, 4 aa, Mycobacterium
RDER

SEQ ID NO: 385798 - protein, 5 aa, Mycobacterium
RDGAA

SEQ ID NO: 385799 - protein, 8 aa, Mycobacterium
RDGDAARD

SEQ ID NO: 385800 - protein, 8 aa, Mycobacterium
RDPDLTPA

SEQ ID NO: 385801 - protein, 24 aa, Mycobacterium
RDPRATERKKYGLKKARKAPQYSK

SEQ ID NO: 385802 - protein, 4 aa, Mycobacterium
RDRD

SEQ ID NO: 385803 - protein, 4 aa, Mycobacterium
RDRG

SEQ ID NO: 385804 - protein, 4 aa, Mycobacterium
RDRL

SEQ ID NO: 385805 - protein, 5 aa, Mycobacterium
RDRPD

SEQ ID NO: 385806 - protein, 8 aa, Mycobacterium
RDSRANAR

SEQ ID NO: 385807 - protein, 7 aa, Mycobacterium
RDYADVP

SEQ ID NO: 385808 - protein, 6 aa, Mycobacterium
RDYPDA

SEQ ID NO: 385809 - protein, 4 aa, Mycobacterium
REAT

SEQ ID NO: 385810 - protein, 4 aa, Mycobacterium
REED

SEQ ID NO: 385811 - protein, 4 aa, Mycobacterium
RELA

SEQ ID NO: 385812 - protein, 4 aa, Mycobacterium
REPD

SEQ ID NO: 385813 - protein, 4 aa, Mycobacterium
RERG

SEQ ID NO: 385814 - protein, 9 aa, Mycobacterium
RERTGEPSV

SEQ ID NO: 385815 - protein, 9 aa, Mycobacterium
RESGGAIGG

SEQ ID NO: 385816 - protein, 7 aa, Mycobacterium
REVPGAG

SEQ ID NO: 385817 - protein, 5 aa, Mycobacterium
RGAGL

SEQ ID NO: 385818 - protein, 4 aa, Mycobacterium
RGAR

SEQ ID NO: 385819 - protein, 6 aa, Mycobacterium
RGDSGR

SEQ ID NO: 385820 - protein, 8 aa, Mycobacterium
RGDTGPEL

SEQ ID NO: 385821 - protein, 4 aa, Mycobacterium
RGEI

SEQ ID NO: 385822 - protein, 13 aa, Mycobacterium
RGGAYSAAKGGLT

SEQ ID NO: 385823 - protein, 4 aa, Mycobacterium
RGGG

SEQ ID NO: 385824 - protein, 14 aa, Mycobacterium
RGGHPTPMSSTKAT

SEQ ID NO: 385825 - protein, 6 aa, Mycobacterium
RGGPAT

SEQ ID NO: 385826 - protein, 8 aa, Mycobacterium
RGGYDGRG

SEQ ID NO: 385827 - protein, 4 aa, Mycobacterium
RGHL

SEQ ID NO: 385828 - protein, 5 aa, Mycobacterium
RGLGA

SEQ ID NO: 385829 - protein, 8 aa, Mycobacterium
RGNGSGPV

SEQ ID NO: 385830 - protein, 10 aa, Mycobacterium
RGPATPGSAA

SEQ ID NO: 385831 - protein, 6 aa, Mycobacterium
RGPTLD

SEQ ID NO: 385832 - protein, 4 aa, Mycobacterium
RGPV

SEQ ID NO: 385833 - protein, 5 aa, Mycobacterium
RGPVA

SEQ ID NO: 385834 - protein, 4 aa, Mycobacterium
RGRD

SEQ ID NO: 385835 - protein, 4 aa, Mycobacterium
RGSM

SEQ ID NO: 385836 - protein, 11 aa, Mycobacterium
RGTGVSSDVET

SEQ ID NO: 385837 - protein, 5 aa, Mycobacterium
RGVGA

SEQ ID NO: 385838 - protein, 8 aa, Mycobacterium
RGWETDGG

SEQ ID NO: 385839 - protein, 5 aa, Mycobacterium
RGYAY

SEQ ID NO: 385840 - protein, 6 aa, Mycobacterium
RHTPEI

SEQ ID NO: 385841 - protein, 12 aa, Mycobacterium
RITSPDEPKYDA

SEQ ID NO: 385842 - protein, 9 aa, Mycobacterium
RKKGYGTAA

SEQ ID NO: 385843 - protein, 4 aa, Mycobacterium
RKPE

SEQ ID NO: 385844 - protein, 13 aa, Mycobacterium
RKPKDLSGGQRQR

SEQ ID NO: 385845 - protein, 5 aa, Mycobacterium
RKPKF

SEQ ID NO: 385846 - protein, 4 aa, Mycobacterium
RKRG

SEQ ID NO: 385847 - protein, 9 aa, Mycobacterium
RKVGQASGH

SEQ ID NO: 385848 - protein, 4 aa, Mycobacterium
RLGE

SEQ ID NO: 385849 - protein, 4 aa, Mycobacterium
RLGQ

SEQ ID NO: 385850 - protein, 7 aa, Mycobacterium
RLKENED

SEQ ID NO: 385851 - protein, 6 aa, Mycobacterium
RLPEKA

SEQ ID NO: 385852 - protein, 11 aa, Mycobacterium
RLPGYTAGDTD

SEQ ID NO: 385853 - protein, 5 aa, Mycobacterium
RLPSG

SEQ ID NO: 385854 - protein, 8 aa, Mycobacterium
RLSDQELR

SEQ ID NO: 385855 - protein, 11 aa, Mycobacterium
RLTDGQGRTVD

SEQ ID NO: 385856 - protein, 4 aa, Mycobacterium
RMRG

SEQ ID NO: 385857 - protein, 5 aa, Mycobacterium
RNADG

SEQ ID NO: 385858 - protein, 9 aa, Mycobacterium
RNAKAAVEE

SEQ ID NO: 385859 - protein, 6 aa, Mycobacterium
RNATHQ

SEQ ID NO: 385860 - protein, 6 aa, Mycobacterium
RNCSPA

SEQ ID NO: 385861 - protein, 6 aa, Mycobacterium
RNGGYT

SEQ ID NO: 385862 - protein, 8 aa, Mycobacterium
RNGPTKTV

SEQ ID NO: 385863 - protein, 4 aa, Mycobacterium
RNPQ

SEQ ID NO: 385864 - protein, 7 aa, Mycobacterium
RNREDGV

SEQ ID NO: 385865 - protein, 4 aa, Mycobacterium
RNTA

SEQ ID NO: 385866 - protein, 5 aa, Mycobacterium
RPADI

SEQ ID NO: 385867 - protein, 4 aa, Mycobacterium
RPDA

SEQ ID NO: 385868 - protein, 6 aa, Mycobacterium
RPDLDG

SEQ ID NO: 385869 - protein, 10 aa, Mycobacterium
RPDRDPRSCT

SEQ ID NO: 385870 - protein, 8 aa, Mycobacterium
RPERRNAL

SEQ ID NO: 385871 - protein, 4 aa, Mycobacterium
RPFG

SEQ ID NO: 385872 - protein, 7 aa, Mycobacterium
RPGAQEE

SEQ ID NO: 385873 - protein, 4 aa, Mycobacterium
RPGH

SEQ ID NO: 385874 - protein, 9 aa, Mycobacterium
RPGPEFRPS

SEQ ID NO: 385875 - protein, 4 aa, Mycobacterium
RPGR

SEQ ID NO: 385876 - protein, 4 aa, Mycobacterium
RPGV

SEQ ID NO: 385877 - protein, 4 aa, Mycobacterium
RPHE

SEQ ID NO: 385878 - protein, 11 aa, Mycobacterium
RPKAIRQSGVS

SEQ ID NO: 385879 - protein, 7 aa, Mycobacterium
RPPGSDR

SEQ ID NO: 385880 - protein, 6 aa, Mycobacterium
RPPPTF

SEQ ID NO: 385881 - protein, 7 aa, Mycobacterium
RPPTNAM

SEQ ID NO: 385882 - protein, 7 aa, Mycobacterium
RPQGVSG

SEQ ID NO: 385883 - protein, 4 aa, Mycobacterium
RPRS

SEQ ID NO: 385884 - protein, 6 aa, Mycobacterium
RPSETA

SEQ ID NO: 385885 - protein, 4 aa, Mycobacterium
RPSS

SEQ ID NO: 385886 - protein, 4 aa, Mycobacterium
RPVA

SEQ ID NO: 385887 - protein, 6 aa, Mycobacterium
RPVRRP

SEQ ID NO: 385888 - protein, 4 aa, Mycobacterium
RQLP

SEQ ID NO: 385889 - protein, 6 aa, Mycobacterium
RQRDRV

SEQ ID NO: 385890 - protein, 4 aa, Mycobacterium
RQRP

SEQ ID NO: 385891 - protein, 6 aa, Mycobacterium
RRAGYG

SEQ ID NO: 385892 - protein, 6 aa, Mycobacterium
RRAQRG

SEQ ID NO: 385893 - protein, 5 aa, Mycobacterium
RRAYT

SEQ ID NO: 385894 - protein, 4 aa, Mycobacterium
RRCP

SEQ ID NO: 385895 - protein, 9 aa, Mycobacterium
RRDGSRNGV

SEQ ID NO: 385896 - protein, 10 aa, Mycobacterium
RRDPNRPRAV

SEQ ID NO: 385897 - protein, 11 aa, Mycobacterium
RRERGSINPDD

SEQ ID NO: 385898 - protein, 6 aa, Mycobacterium
RRKTTV

SEQ ID NO: 385899 - protein, 8 aa, Mycobacterium
RRNLGGAG

SEQ ID NO: 385900 - protein, 7 aa, Mycobacterium
RRPERRR

SEQ ID NO: 385901 - protein, 8 aa, Mycobacterium
RRPGHTEA

SEQ ID NO: 385902 - protein, 4 aa, Mycobacterium
RRRT

SEQ ID NO: 385903 - protein, 4 aa, Mycobacterium
RRSL

SEQ ID NO: 385904 - protein, 5 aa, Mycobacterium
RRSRD

SEQ ID NO: 385905 - protein, 10 aa, Mycobacterium
RRSRTHRRTP

SEQ ID NO: 385906 - protein, 4 aa, Mycobacterium
RRTG

SEQ ID NO: 385907 - protein, 5 aa, Mycobacterium
RRTGA

SEQ ID NO: 385908 - protein, 4 aa, Mycobacterium
RRTQ

SEQ ID NO: 385909 - protein, 7 aa, Mycobacterium
RRVGGAT

SEQ ID NO: 385910 - protein, 4 aa, Mycobacterium
RRYP

SEQ ID NO: 385911 - protein, 9 aa, Mycobacterium
RSAGPPPVV

SEQ ID NO: 385912 - protein, 8 aa, Mycobacterium
RSGAPRGS

SEQ ID NO: 385913 - protein, 13 aa, Mycobacterium
RSGEWTGATGKRI

SEQ ID NO: 385914 - protein, 13 aa, Mycobacterium
RSGNRTNPSSATM

SEQ ID NO: 385915 - protein, 8 aa, Mycobacterium
RSGPKLSG

SEQ ID NO: 385916 - protein, 7 aa, Mycobacterium
RSGRIGG

SEQ ID NO: 385917 - protein, 4 aa, Mycobacterium
RSGS

SEQ ID NO: 385918 - protein, 8 aa, Mycobacterium
RSGSGKST

SEQ ID NO: 385919 - protein, 5 aa, Mycobacterium
RSGTT

SEQ ID NO: 385920 - protein, 6 aa, Mycobacterium
RSHPGV

SEQ ID NO: 385921 - protein, 4 aa, Mycobacterium
RSLG

SEQ ID NO: 385922 - protein, 5 aa, Mycobacterium
RSLNA

SEQ ID NO: 385923 - protein, 7 aa, Mycobacterium
RSPGARQ

SEQ ID NO: 385924 - protein, 13 aa, Mycobacterium
RSRRVTPSRHQRH

SEQ ID NO: 385925 - protein, 4 aa, Mycobacterium
RSRS

SEQ ID NO: 385926 - protein, 5 aa, Mycobacterium
RSSEP

SEQ ID NO: 385927 - protein, 4 aa, Mycobacterium
RSSV

SEQ ID NO: 385928 - protein, 4 aa, Mycobacterium
RSTS

SEQ ID NO: 385929 - protein, 4 aa, Mycobacterium
RSVS

SEQ ID NO: 385930 - protein, 4 aa, Mycobacterium
RTAA

SEQ ID NO: 385931 - protein, 9 aa, Mycobacterium
RTAATDGSL

SEQ ID NO: 385932 - protein, 8 aa, Mycobacterium
RTADSSQR

SEQ ID NO: 385933 - protein, 4 aa, Mycobacterium
RTAT

SEQ ID NO: 385934 - protein, 10 aa, Mycobacterium
RTDPDAPKHR

SEQ ID NO: 385935 - protein, 18 aa, Mycobacterium
RTDSSDKVEALDAGADDY

SEQ ID NO: 385936 - protein, 6 aa, Mycobacterium
RTERGD

SEQ ID NO: 385937 - protein, 4 aa, Mycobacterium
RTES

SEQ ID NO: 385938 - protein, 4 aa, Mycobacterium
RTGA

SEQ ID NO: 385939 - protein, 4 aa, Mycobacterium
RTGD

SEQ ID NO: 385940 - protein, 8 aa, Mycobacterium
RTGEGQEV

SEQ ID NO: 385941 - protein, 9 aa, Mycobacterium
RTGGPGAAG

SEQ ID NO: 385942 - protein, 4 aa, Mycobacterium
RTGL

SEQ ID NO: 385943 - protein, 10 aa, Mycobacterium
RTGRAGRSGT

SEQ ID NO: 385944 - protein, 8 aa, Mycobacterium
RTIKGEQK

SEQ ID NO: 385945 - protein, 8 aa, Mycobacterium
RTNITGSA

SEQ ID NO: 385946 - protein, 8 aa, Mycobacterium
RTNSESIV

SEQ ID NO: 385947 - protein, 8 aa, Mycobacterium
RTPRGRVA

SEQ ID NO: 385948 - protein, 5 aa, Mycobacterium
RTPTI

SEQ ID NO: 385949 - protein, 4 aa, Mycobacterium
RTRD

SEQ ID NO: 385950 - protein, 6 aa, Mycobacterium
RTREAL

SEQ ID NO: 385951 - protein, 13 aa, Mycobacterium
RTRPYRPQTNGKV

SEQ ID NO: 385952 - protein, 5 aa, Mycobacterium
RTRSN

SEQ ID NO: 385953 - protein, 6 aa, Mycobacterium
RTRSNE

SEQ ID NO: 385954 - protein, 4 aa, Mycobacterium
RTSD

SEQ ID NO: 385955 - protein, 6 aa, Mycobacterium
RTTGVG

SEQ ID NO: 385956 - protein, 7 aa, Mycobacterium
RTVAPGH

SEQ ID NO: 385957 - protein, 9 aa, Mycobacterium
RVASDGEPL

SEQ ID NO: 385958 - protein, 7 aa, Mycobacterium
RVGGAAQ

SEQ ID NO: 385959 - protein, 8 aa, Mycobacterium
RVNKNGMP

SEQ ID NO: 385960 - protein, 10 aa, Mycobacterium
RVTPRAKATM

SEQ ID NO: 385961 - protein, 8 aa, Mycobacterium
RYANPDVT

SEQ ID NO: 385962 - protein, 10 aa, Mycobacterium
RYGAQGGDWG

SEQ ID NO: 385963 - protein, 5 aa, Mycobacterium
RYNRE

SEQ ID NO: 385964 - protein, 5 aa, Mycobacterium
RYPDG

SEQ ID NO: 385965 - protein, 7 aa, Mycobacterium
RYPQSNG

SEQ ID NO: 385966 - protein, 5 aa, Mycobacterium
RYSAR

SEQ ID NO: 385967 - protein, 10 aa, Mycobacterium
SAAGSGSQRL

SEQ ID NO: 385968 - protein, 5 aa, Mycobacterium
SAATI

SEQ ID NO: 385969 - protein, 4 aa, Mycobacterium
SADD

SEQ ID NO: 385970 - protein, 4 aa, Mycobacterium
SAEA

SEQ ID NO: 385971 - protein, 8 aa, Mycobacterium
SAGAAGAA

SEQ ID NO: 385972 - protein, 4 aa, Mycobacterium
SAGG

SEQ ID NO: 385973 - protein, 4 aa, Mycobacterium
SAGI

SEQ ID NO: 385974 - protein, 8 aa, Mycobacterium
SAGPQRNI

SEQ ID NO: 385975 - protein, 6 aa, Mycobacterium
SAGRPP

SEQ ID NO: 385976 - protein, 9 aa, Mycobacterium
SAKHDEEHS

SEQ ID NO: 385977 - protein, 8 aa, Mycobacterium
SAKTGRAV

SEQ ID NO: 385978 - protein, 4 aa, Mycobacterium
SANG

SEQ ID NO: 385979 - protein, 4 aa, Mycobacterium
SAPD

SEQ ID NO: 385980 - protein, 8 aa, Mycobacterium
SAPRPPGA

SEQ ID NO: 385981 - protein, 4 aa, Mycobacterium
SAQL

SEQ ID NO: 385982 - protein, 5 aa, Mycobacterium
SARGI

SEQ ID NO: 385983 - protein, 8 aa, Mycobacterium
SASEAISG

SEQ ID NO: 385984 - protein, 8 aa, Mycobacterium
SASNPWGE

SEQ ID NO: 385985 - protein, 6 aa, Mycobacterium
SASSDV

SEQ ID NO: 385986 - protein, 6 aa, Mycobacterium
SASSEV

SEQ ID NO: 385987 - protein, 4 aa, Mycobacterium
SATE

SEQ ID NO: 385988 - protein, 13 aa, Mycobacterium
SATFDRPALGPSA

SEQ ID NO: 385989 - protein, 4 aa, Mycobacterium
SATS

SEQ ID NO: 385990 - protein, 4 aa, Mycobacterium
SAVA

SEQ ID NO: 385991 - protein, 6 aa, Mycobacterium
SAVRDG

SEQ ID NO: 385992 - protein, 8 aa, Mycobacterium
SAWRKDPD

SEQ ID NO: 385993 - protein, 7 aa, Mycobacterium
SDAEEHT

SEQ ID NO: 385994 - protein, 10 aa, Mycobacterium
SDDDDRARLD

SEQ ID NO: 385995 - protein, 8 aa, Mycobacterium
SDGKPAYI

SEQ ID NO: 385996 - protein, 4 aa, Mycobacterium
SDGR

SEQ ID NO: 385997 - protein, 7 aa, Mycobacterium
SDPAAER

SEQ ID NO: 385998 - protein, 9 aa, Mycobacterium
SDPSDVARV

SEQ ID NO: 385999 - protein, 4 aa, Mycobacterium
SDRT

SEQ ID NO: 386000 - protein, 9 aa, Mycobacterium
SDSNKDGGY

SEQ ID NO: 386001 - protein, 6 aa, Mycobacterium
SDTAEF

SEQ ID NO: 386002 - protein, 5 aa, Mycobacterium
SDTDL

SEQ ID NO: 386003 - protein, 9 aa, Mycobacterium
SDTKAKELG

SEQ ID NO: 386004 - protein, 6 aa, Mycobacterium
SDVRQG

SEQ ID NO: 386005 - protein, 4 aa, Mycobacterium
SDYD

SEQ ID NO: 386006 - protein, 20 aa, Mycobacterium
SEDERRALKRRNARTKARSG

SEQ ID NO: 386007 - protein, 4 aa, Mycobacterium
SEGA

SEQ ID NO: 386008 - protein, 4 aa, Mycobacterium
SEGL

SEQ ID NO: 386009 - protein, 5 aa, Mycobacterium
SEKPD

SEQ ID NO: 386010 - protein, 9 aa, Mycobacterium
SEPEAGSDF

SEQ ID NO: 386011 - protein, 5 aa, Mycobacterium
SEPHA

SEQ ID NO: 386012 - protein, 9 aa, Mycobacterium
SERLTADQR

SEQ ID NO: 386013 - protein, 5 aa, Mycobacterium
SESER

SEQ ID NO: 386014 - protein, 7 aa, Mycobacterium
SETGDLG

SEQ ID NO: 386015 - protein, 4 aa, Mycobacterium
SETP

SEQ ID NO: 386016 - protein, 8 aa, Mycobacterium
SFGGGPVG

SEQ ID NO: 386017 - protein, 6 aa, Mycobacterium
SFPPGG

SEQ ID NO: 386018 - protein, 4 aa, Mycobacterium
SGAD

SEQ ID NO: 386019 - protein, 7 aa, Mycobacterium
SGAHPGM

SEQ ID NO: 386020 - protein, 6 aa, Mycobacterium
SGDARE

SEQ ID NO: 386021 - protein, 4 aa, Mycobacterium
SGDR

SEQ ID NO: 386022 - protein, 4 aa, Mycobacterium
SGEL

SEQ ID NO: 386023 - protein, 7 aa, Mycobacterium
SGEQRSS

SEQ ID NO: 386024 - protein, 4 aa, Mycobacterium
SGFR

SEQ ID NO: 386025 - protein, 6 aa, Mycobacterium
SGGAGA

SEQ ID NO: 386026 - protein, 7 aa, Mycobacterium
SGGAGLT

SEQ ID NO: 386027 - protein, 22 aa, Mycobacterium
SGGANACTGPGGFQDTHATAEA

SEQ ID NO: 386028 - protein, 7 aa, Mycobacterium
SGGAPLG

SEQ ID NO: 386029 - protein, 4 aa, Mycobacterium
SGGG

SEQ ID NO: 386030 - protein, 7 aa, Mycobacterium
SGGGGMT

SEQ ID NO: 386031 - protein, 7 aa, Mycobacterium
SGGGNRL

SEQ ID NO: 386032 - protein, 5 aa, Mycobacterium
SGGLI

SEQ ID NO: 386033 - protein, 6 aa, Mycobacterium
SGGLSL

SEQ ID NO: 386034 - protein, 7 aa, Mycobacterium
SGGPDSL

SEQ ID NO: 386035 - protein, 5 aa, Mycobacterium
SGGRA

SEQ ID NO: 386036 - protein, 5 aa, Mycobacterium
SGGVG

SEQ ID NO: 386037 - protein, 11 aa, Mycobacterium
SGKGGVGKSTV

SEQ ID NO: 386038 - protein, 6 aa, Mycobacterium
SGKNFS

SEQ ID NO: 386039 - protein, 4 aa, Mycobacterium
SGKP

SEQ ID NO: 386040 - protein, 7 aa, Mycobacterium
SGKQIPA

SEQ ID NO: 386041 - protein, 8 aa, Mycobacterium
SGLHSNGY

SEQ ID NO: 386042 - protein, 4 aa, Mycobacterium
SGMN

SEQ ID NO: 386043 - protein, 4 aa, Mycobacterium
SGNA

SEQ ID NO: 386044 - protein, 9 aa, Mycobacterium
SGNLRSAQR

SEQ ID NO: 386045 - protein, 7 aa, Mycobacterium
SGPAGYT

SEQ ID NO: 386046 - protein, 6 aa, Mycobacterium
SGPGYA

SEQ ID NO: 386047 - protein, 5 aa, Mycobacterium
SGRLA

SEQ ID NO: 386048 - protein, 6 aa, Mycobacterium
SGRQVG

SEQ ID NO: 386049 - protein, 8 aa, Mycobacterium
SGRRGPQA

SEQ ID NO: 386050 - protein, 7 aa, Mycobacterium
SGRTGVS

SEQ ID NO: 386051 - protein, 17 aa, Mycobacterium
SGSITEAARRLMAHDDL

SEQ ID NO: 386052 - protein, 8 aa, Mycobacterium
SGSPITIG

SEQ ID NO: 386053 - protein, 6 aa, Mycobacterium
SGSTEF

SEQ ID NO: 386054 - protein, 10 aa, Mycobacterium
SGSTGRPKGV

SEQ ID NO: 386055 - protein, 4 aa, Mycobacterium
SGTP

SEQ ID NO: 386056 - protein, 14 aa, Mycobacterium
SGTSGAGRAAKTDL

SEQ ID NO: 386057 - protein, 10 aa, Mycobacterium
SGTTGEPKGV

SEQ ID NO: 386058 - protein, 11 aa, Mycobacterium
SGTTGNPKGVE

SEQ ID NO: 386059 - protein, 10 aa, Mycobacterium
SGTTGRPKGC

SEQ ID NO: 386060 - protein, 11 aa, Mycobacterium
SGTTGRPKGCQ

SEQ ID NO: 386061 - protein, 6 aa, Mycobacterium
SGTTSI

SEQ ID NO: 386062 - protein, 6 aa, Mycobacterium
SGVGES

SEQ ID NO: 386063 - protein, 13 aa, Mycobacterium
SHPESDSVEVTYD

SEQ ID NO: 386064 - protein, 5 aa, Mycobacterium
SHPGV

SEQ ID NO: 386065 - protein, 5 aa, Mycobacterium
SIEDD

SEQ ID NO: 386066 - protein, 11 aa, Mycobacterium
SIEQGNNDSHA

SEQ ID NO: 386067 - protein, 12 aa, Mycobacterium
SIGSSETGFGGT

SEQ ID NO: 386068 - protein, 8 aa, Mycobacterium
SIQGSTDV

SEQ ID NO: 386069 - protein, 8 aa, Mycobacterium
SKAEIDTT

SEQ ID NO: 386070 - protein, 5 aa, Mycobacterium
SKDAR

SEQ ID NO: 386071 - protein, 15 aa, Mycobacterium
SKGEAGTGDVSNATT

SEQ ID NO: 386072 - protein, 9 aa, Mycobacterium
SKGYRGQRS

SEQ ID NO: 386073 - protein, 4 aa, Mycobacterium
SKTF

SEQ ID NO: 386074 - protein, 7 aa, Mycobacterium
SKTQQDA

SEQ ID NO: 386075 - protein, 6 aa, Mycobacterium
SKVSDK

SEQ ID NO: 386076 - protein, 4 aa, Mycobacterium
SLDE

SEQ ID NO: 386077 - protein, 4 aa, Mycobacterium
SLGG

SEQ ID NO: 386078 - protein, 7 aa, Mycobacterium
SLHGDTA

SEQ ID NO: 386079 - protein, 6 aa, Mycobacterium
SNGIGS

SEQ ID NO: 386080 - protein, 28 aa, Mycobacterium
SNGLGASVKRREDTHKMAEANRAFAHYR

SEQ ID NO: 386081 - protein, 15 aa, Mycobacterium
SNHGGNNLDGTPASI

SEQ ID NO: 386082 - protein, 4 aa, Mycobacterium
SNRY

SEQ ID NO: 386083 - protein, 6 aa, Mycobacterium
SNVPQS

SEQ ID NO: 386084 - protein, 8 aa, Mycobacterium
SNVQGDRT

SEQ ID NO: 386085 - protein, 8 aa, Mycobacterium
SNVQTGAV

SEQ ID NO: 386086 - protein, 4 aa, Mycobacterium
SPAA

SEQ ID NO: 386087 - protein, 9 aa, Mycobacterium
SPANPTGTV

SEQ ID NO: 386088 - protein, 9 aa, Mycobacterium
SPDYADNTK

SEQ ID NO: 386089 - protein, 6 aa, Mycobacterium
SPEFGS

SEQ ID NO: 386090 - protein, 6 aa, Mycobacterium
SPGGGF

SEQ ID NO: 386091 - protein, 5 aa, Mycobacterium
SPGLK

SEQ ID NO: 386092 - protein, 6 aa, Mycobacterium
SPHPAA

SEQ ID NO: 386093 - protein, 15 aa, Mycobacterium
SPKCGNGNDPLDKAG

SEQ ID NO: 386094 - protein, 7 aa, Mycobacterium
SPKQFDG

SEQ ID NO: 386095 - protein, 14 aa, Mycobacterium
SPLTPDHVNPERPW

SEQ ID NO: 386096 - protein, 12 aa, Mycobacterium
SPNGGDKPTGEL

SEQ ID NO: 386097 - protein, 4 aa, Mycobacterium
SPPP

SEQ ID NO: 386098 - protein, 4 aa, Mycobacterium
SPRH

SEQ ID NO: 386099 - protein, 5 aa, Mycobacterium
SPSSG

SEQ ID NO: 386100 - protein, 5 aa, Mycobacterium
SPTFG

SEQ ID NO: 386101 - protein, 7 aa, Mycobacterium
SPTKARK

SEQ ID NO: 386102 - protein, 6 aa, Mycobacterium
SPVGED

SEQ ID NO: 386103 - protein, 4 aa, Mycobacterium
SPVP

SEQ ID NO: 386104 - protein, 8 aa, Mycobacterium
SQAYQGEE

SEQ ID NO: 386105 - protein, 6 aa, Mycobacterium
SQGAVS

SEQ ID NO: 386106 - protein, 6 aa, Mycobacterium
SQGDGE

SEQ ID NO: 386107 - protein, 4 aa, Mycobacterium
SQGE

SEQ ID NO: 386108 - protein, 4 aa, Mycobacterium
SQGT

SEQ ID NO: 386109 - protein, 4 aa, Mycobacterium
SRAF

SEQ ID NO: 386110 - protein, 4 aa, Mycobacterium
SRAG

SEQ ID NO: 386111 - protein, 4 aa, Mycobacterium
SRAK

SEQ ID NO: 386112 - protein, 15 aa, Mycobacterium
SRDGNTAYRAGRDIQ

SEQ ID NO: 386113 - protein, 4 aa, Mycobacterium
SRDP

SEQ ID NO: 386114 - protein, 7 aa, Mycobacterium
SREDQDH

SEQ ID NO: 386115 - protein, 4 aa, Mycobacterium
SREL

SEQ ID NO: 386116 - protein, 4 aa, Mycobacterium
SRGA

SEQ ID NO: 386117 - protein, 4 aa, Mycobacterium
SRGL

SEQ ID NO: 386118 - protein, 4 aa, Mycobacterium
SRIG

SEQ ID NO: 386119 - protein, 4 aa, Mycobacterium
SRPE

SEQ ID NO: 386120 - protein, 6 aa, Mycobacterium
SRRGRT

SEQ ID NO: 386121 - protein, 4 aa, Mycobacterium
SRRS

SEQ ID NO: 386122 - protein, 4 aa, Mycobacterium
SRYV

SEQ ID NO: 386123 - protein, 7 aa, Mycobacterium
SSANTRD

SEQ ID NO: 386124 - protein, 8 aa, Mycobacterium
SSARGRPL

SEQ ID NO: 386125 - protein, 8 aa, Mycobacterium
SSDTTTDP

SEQ ID NO: 386126 - protein, 17 aa, Mycobacterium
SSGITGQTLDVNCGEYH

SEQ ID NO: 386127 - protein, 6 aa, Mycobacterium
SSGLRT

SEQ ID NO: 386128 - protein, 4 aa, Mycobacterium
SSGT

SEQ ID NO: 386129 - protein, 5 aa, Mycobacterium
SSITQ

SEQ ID NO: 386130 - protein, 4 aa, Mycobacterium
SSLG

SEQ ID NO: 386131 - protein, 9 aa, Mycobacterium
SSPGAFGES

SEQ ID NO: 386132 - protein, 6 aa, Mycobacterium
SSPSAA

SEQ ID NO: 386133 - protein, 8 aa, Mycobacterium
STFGGNPV

SEQ ID NO: 386134 - protein, 6 aa, Mycobacterium
STGADV

SEQ ID NO: 386135 - protein, 4 aa, Mycobacterium
STGE

SEQ ID NO: 386136 - protein, 4 aa, Mycobacterium
STGG

SEQ ID NO: 386137 - protein, 4 aa, Mycobacterium
STGQ

SEQ ID NO: 386138 - protein, 6 aa, Mycobacterium
STIGSS

SEQ ID NO: 386139 - protein, 6 aa, Mycobacterium
STMPGG

SEQ ID NO: 386140 - protein, 6 aa, Mycobacterium
STPAYR

SEQ ID NO: 386141 - protein, 13 aa, Mycobacterium
STPEEVARQAADN

SEQ ID NO: 386142 - protein, 5 aa, Mycobacterium
STQTL

SEQ ID NO: 386143 - protein, 6 aa, Mycobacterium
STQVGA

SEQ ID NO: 386144 - protein, 6 aa, Mycobacterium
STRGRP

SEQ ID NO: 386145 - protein, 4 aa, Mycobacterium
STRR

SEQ ID NO: 386146 - protein, 5 aa, Mycobacterium
STRSV

SEQ ID NO: 386147 - protein, 5 aa, Mycobacterium
STRTF

SEQ ID NO: 386148 - protein, 6 aa, Mycobacterium
STRTGQ

SEQ ID NO: 386149 - protein, 4 aa, Mycobacterium
STSG

SEQ ID NO: 386150 - protein, 5 aa, Mycobacterium
STTAE

SEQ ID NO: 386151 - protein, 10 aa, Mycobacterium
STTGDTTWEN

SEQ ID NO: 386152 - protein, 6 aa, Mycobacterium
SVDPYN

SEQ ID NO: 386153 - protein, 6 aa, Mycobacterium
SVERSE

SEQ ID NO: 386154 - protein, 8 aa, Mycobacterium
SVTEGHPD

SEQ ID NO: 386155 - protein, 5 aa, Mycobacterium
SYAGQ

SEQ ID NO: 386156 - protein, 11 aa, Mycobacterium
SYGSSTSSSGV

SEQ ID NO: 386157 - protein, 8 aa, Mycobacterium
TAAGSGCA

SEQ ID NO: 386158 - protein, 6 aa, Mycobacterium
TAAQHG

SEQ ID NO: 386159 - protein, 5 aa, Mycobacterium
TAATT

SEQ ID NO: 386160 - protein, 17 aa, Mycobacterium
TADRAELEGVSAERAPQ

SEQ ID NO: 386161 - protein, 4 aa, Mycobacterium
TAEE

SEQ ID NO: 386162 - protein, 9 aa, Mycobacterium
TAEGNHLGP

SEQ ID NO: 386163 - protein, 4 aa, Mycobacterium
TAEP

SEQ ID NO: 386164 - protein, 12 aa, Mycobacterium
TAEPHPKLPGTV

SEQ ID NO: 386165 - protein, 6 aa, Mycobacterium
TAESCT

SEQ ID NO: 386166 - protein, 8 aa, Mycobacterium
TAFTDGEQ

SEQ ID NO: 386167 - protein, 9 aa, Mycobacterium
TAGPGVTNG

SEQ ID NO: 386168 - protein, 4 aa, Mycobacterium
TAGS

SEQ ID NO: 386169 - protein, 7 aa, Mycobacterium
TAGSRLD

SEQ ID NO: 386170 - protein, 5 aa, Mycobacterium
TAHPD

SEQ ID NO: 386171 - protein, 4 aa, Mycobacterium
TAKA

SEQ ID NO: 386172 - protein, 4 aa, Mycobacterium
TALG

SEQ ID NO: 386173 - protein, 4 aa, Mycobacterium
TANA

SEQ ID NO: 386174 - protein, 5 aa, Mycobacterium
TANPT

SEQ ID NO: 386175 - protein, 4 aa, Mycobacterium
TAPA

SEQ ID NO: 386176 - protein, 11 aa, Mycobacterium
TAPKLPDGTPF

SEQ ID NO: 386177 - protein, 5 aa, Mycobacterium
TAQAG

SEQ ID NO: 386178 - protein, 5 aa, Mycobacterium
TARQA

SEQ ID NO: 386179 - protein, 8 aa, Mycobacterium
TATAIPET

SEQ ID NO: 386180 - protein, 7 aa, Mycobacterium
TATSGAD

SEQ ID NO: 386181 - protein, 6 aa, Mycobacterium
TAVRDG

SEQ ID NO: 386182 - protein, 8 aa, Mycobacterium
TAVRDGDD

SEQ ID NO: 386183 - protein, 5 aa, Mycobacterium
TDAEG

SEQ ID NO: 386184 - protein, 8 aa, Mycobacterium
TDARPEQV

SEQ ID NO: 386185 - protein, 9 aa, Mycobacterium
TDAYEQGRA

SEQ ID NO: 386186 - protein, 4 aa, Mycobacterium
TDDA

SEQ ID NO: 386187 - protein, 4 aa, Mycobacterium
TDEA

SEQ ID NO: 386188 - protein, 4 aa, Mycobacterium
TDEH

SEQ ID NO: 386189 - protein, 9 aa, Mycobacterium
TDEPGITPG

SEQ ID NO: 386190 - protein, 6 aa, Mycobacterium
TDEVPE

SEQ ID NO: 386191 - protein, 4 aa, Mycobacterium
TDGT

SEQ ID NO: 386192 - protein, 5 aa, Mycobacterium
TDGVG

SEQ ID NO: 386193 - protein, 5 aa, Mycobacterium
TDIPA

SEQ ID NO: 386194 - protein, 6 aa, Mycobacterium
TDIPPG

SEQ ID NO: 386195 - protein, 4 aa, Mycobacterium
TDPD

SEQ ID NO: 386196 - protein, 10 aa, Mycobacterium
TDPDKGANGI

SEQ ID NO: 386197 - protein, 4 aa, Mycobacterium
TDPS

SEQ ID NO: 386198 - protein, 4 aa, Mycobacterium
TDPY

SEQ ID NO: 386199 - protein, 6 aa, Mycobacterium
TDTPAL

SEQ ID NO: 386200 - protein, 8 aa, Mycobacterium
TDYTPPNK

SEQ ID NO: 386201 - protein, 7 aa, Mycobacterium
TEAAQSR

SEQ ID NO: 386202 - protein, 5 aa, Mycobacterium
TEAGA

SEQ ID NO: 386203 - protein, 8 aa, Mycobacterium
TEAGRHSG

SEQ ID NO: 386204 - protein, 7 aa, Mycobacterium
TEAGRRI

SEQ ID NO: 386205 - protein, 6 aa, Mycobacterium
TEEDCA

SEQ ID NO: 386206 - protein, 4 aa, Mycobacterium
TEER

SEQ ID NO: 386207 - protein, 8 aa, Mycobacterium
TEGEDKPL

SEQ ID NO: 386208 - protein, 5 aa, Mycobacterium
TEGVP

SEQ ID NO: 386209 - protein, 12 aa, Mycobacterium
TEPDSGSDAFGG

SEQ ID NO: 386210 - protein, 9 aa, Mycobacterium
TEPEAGTDL

SEQ ID NO: 386211 - protein, 5 aa, Mycobacterium
TEPEV

SEQ ID NO: 386212 - protein, 14 aa, Mycobacterium
TEPGAGSNPAGLRT

SEQ ID NO: 386213 - protein, 12 aa, Mycobacterium
TEPGTGSDLQGI

SEQ ID NO: 386214 - protein, 4 aa, Mycobacterium
TEQR

SEQ ID NO: 386215 - protein, 7 aa, Mycobacterium
TEQRNDV

SEQ ID NO: 386216 - protein, 4 aa, Mycobacterium
TERG

SEQ ID NO: 386217 - protein, 11 aa, Mycobacterium
TETKAAHPNSR

SEQ ID NO: 386218 - protein, 4 aa, Mycobacterium
TETV

SEQ ID NO: 386219 - protein, 5 aa, Mycobacterium
TFGST

SEQ ID NO: 386220 - protein, 5 aa, Mycobacterium
TFPEG

SEQ ID NO: 386221 - protein, 4 aa, Mycobacterium
TGAA

SEQ ID NO: 386222 - protein, 8 aa, Mycobacterium
TGAADGYA

SEQ ID NO: 386223 - protein, 5 aa, Mycobacterium
TGAPI

SEQ ID NO: 386224 - protein, 5 aa, Mycobacterium
TGAST

SEQ ID NO: 386225 - protein, 10 aa, Mycobacterium
TGDDGTTGLS

SEQ ID NO: 386226 - protein, 7 aa, Mycobacterium
TGDQLQG

SEQ ID NO: 386227 - protein, 4 aa, Mycobacterium
TGED

SEQ ID NO: 386228 - protein, 11 aa, Mycobacterium
TGEGRTADVSR

SEQ ID NO: 386229 - protein, 5 aa, Mycobacterium
TGEKL

SEQ ID NO: 386230 - protein, 7 aa, Mycobacterium
TGERGSG

SEQ ID NO: 386231 - protein, 4 aa, Mycobacterium
TGEV

SEQ ID NO: 386232 - protein, 7 aa, Mycobacterium
TGFGEPM

SEQ ID NO: 386233 - protein, 9 aa, Mycobacterium
TGGAGGIGR

SEQ ID NO: 386234 - protein, 12 aa, Mycobacterium
TGGPGTGKTTTV

SEQ ID NO: 386235 - protein, 19 aa, Mycobacterium
TGGSGRMYKTTSNAHTLTG

SEQ ID NO: 386236 - protein, 10 aa, Mycobacterium
TGGWEPDAKG

SEQ ID NO: 386237 - protein, 13 aa, Mycobacterium
TGIEPDKTTPAQW

SEQ ID NO: 386238 - protein, 20 aa, Mycobacterium
TGKSSSASRAIDTESNLGQY

SEQ ID NO: 386239 - protein, 4 aa, Mycobacterium
TGPA

SEQ ID NO: 386240 - protein, 7 aa, Mycobacterium
TGPGESW

SEQ ID NO: 386241 - protein, 4 aa, Mycobacterium
TGPL

SEQ ID NO: 386242 - protein, 7 aa, Mycobacterium
TGQDSGV

SEQ ID NO: 386243 - protein, 9 aa, Mycobacterium
TGQTPVDED

SEQ ID NO: 386244 - protein, 4 aa, Mycobacterium
TGRV

SEQ ID NO: 386245 - protein, 11 aa, Mycobacterium
TGSSGKTSTKD

SEQ ID NO: 386246 - protein, 4 aa, Mycobacterium
TGVP

SEQ ID NO: 386247 - protein, 7 aa, Mycobacterium
THGGQLG

SEQ ID NO: 386248 - protein, 18 aa, Mycobacterium
THGRPTDRNAHPHRDAAG

SEQ ID NO: 386249 - protein, 4 aa, Mycobacterium
THRG

SEQ ID NO: 386250 - protein, 5 aa, Mycobacterium
TIRAG

SEQ ID NO: 386251 - protein, 9 aa, Mycobacterium
TIYGGSNEI

SEQ ID NO: 386252 - protein, 8 aa, Mycobacterium
TKPTRPDL

SEQ ID NO: 386253 - protein, 5 aa, Mycobacterium
TLGNE

SEQ ID NO: 386254 - protein, 4 aa, Mycobacterium
TLGS

SEQ ID NO: 386255 - protein, 5 aa, Mycobacterium
TLSQA

SEQ ID NO: 386256 - protein, 5 aa, Mycobacterium
TLTHE

SEQ ID NO: 386257 - protein, 5 aa, Mycobacterium
TNAGG

SEQ ID NO: 386258 - protein, 5 aa, Mycobacterium
TNATA

SEQ ID NO: 386259 - protein, 8 aa, Mycobacterium
TNPARPRA

SEQ ID NO: 386260 - protein, 7 aa, Mycobacterium
TNRGDDI

SEQ ID NO: 386261 - protein, 4 aa, Mycobacterium
TPAE

SEQ ID NO: 386262 - protein, 4 aa, Mycobacterium
TPAQ

SEQ ID NO: 386263 - protein, 4 aa, Mycobacterium
TPAT

SEQ ID NO: 386264 - protein, 8 aa, Mycobacterium
TPDEKWGE

SEQ ID NO: 386265 - protein, 4 aa, Mycobacterium
TPDW

SEQ ID NO: 386266 - protein, 4 aa, Mycobacterium
TPEG

SEQ ID NO: 386267 - protein, 8 aa, Mycobacterium
TPEHSPDI

SEQ ID NO: 386268 - protein, 4 aa, Mycobacterium
TPER

SEQ ID NO: 386269 - protein, 5 aa, Mycobacterium
TPGFG

SEQ ID NO: 386270 - protein, 12 aa, Mycobacterium
TPGNSSPLSDGS

SEQ ID NO: 386271 - protein, 5 aa, Mycobacterium
TPLED

SEQ ID NO: 386272 - protein, 4 aa, Mycobacterium
TPLG

SEQ ID NO: 386273 - protein, 4 aa, Mycobacterium
TPLT

SEQ ID NO: 386274 - protein, 5 aa, Mycobacterium
TPPAA

SEQ ID NO: 386275 - protein, 6 aa, Mycobacterium
TPPARQ

SEQ ID NO: 386276 - protein, 6 aa, Mycobacterium
TPQGTL

SEQ ID NO: 386277 - protein, 6 aa, Mycobacterium
TPQITT

SEQ ID NO: 386278 - protein, 4 aa, Mycobacterium
TPRR

SEQ ID NO: 386279 - protein, 11 aa, Mycobacterium
TPSKQQLRDEA

SEQ ID NO: 386280 - protein, 7 aa, Mycobacterium
TPSRERV

SEQ ID NO: 386281 - protein, 5 aa, Mycobacterium
TPTQA

SEQ ID NO: 386282 - protein, 5 aa, Mycobacterium
TPTYA

SEQ ID NO: 386283 - protein, 4 aa, Mycobacterium
TQSA

SEQ ID NO: 386284 - protein, 5 aa, Mycobacterium
TRDAA

SEQ ID NO: 386285 - protein, 11 aa, Mycobacterium
TRDEPHADADR

SEQ ID NO: 386286 - protein, 4 aa, Mycobacterium
TREI

SEQ ID NO: 386287 - protein, 8 aa, Mycobacterium
TRGSGLAS

SEQ ID NO: 386288 - protein, 5 aa, Mycobacterium
TRKPF

SEQ ID NO: 386289 - protein, 8 aa, Mycobacterium
TRLTADGQ

SEQ ID NO: 386290 - protein, 17 aa, Mycobacterium
TRNDEPERASRPFDKDR

SEQ ID NO: 386291 - protein, 4 aa, Mycobacterium
TRNP

SEQ ID NO: 386292 - protein, 4 aa, Mycobacterium
TRPA

SEQ ID NO: 386293 - protein, 5 aa, Mycobacterium
TRPPA

SEQ ID NO: 386294 - protein, 8 aa, Mycobacterium
TRPTSATK

SEQ ID NO: 386295 - protein, 5 aa, Mycobacterium
TRSCE

SEQ ID NO: 386296 - protein, 8 aa, Mycobacterium
TSAGAAAR

SEQ ID NO: 386297 - protein, 6 aa, Mycobacterium
TSARAI

SEQ ID NO: 386298 - protein, 4 aa, Mycobacterium
TSGV

SEQ ID NO: 386299 - protein, 11 aa, Mycobacterium
TSLRDGSHHKR

SEQ ID NO: 386300 - protein, 6 aa, Mycobacterium
TSMEQG

SEQ ID NO: 386301 - protein, 9 aa, Mycobacterium
TSNAAAAGR

SEQ ID NO: 386302 - protein, 6 aa, Mycobacterium
TSPQAF

SEQ ID NO: 386303 - protein, 6 aa, Mycobacterium
TSPWPE

SEQ ID NO: 386304 - protein, 5 aa, Mycobacterium
TSQGV

SEQ ID NO: 386305 - protein, 8 aa, Mycobacterium
TSSAEEDI

SEQ ID NO: 386306 - protein, 6 aa, Mycobacterium
TSSIHP

SEQ ID NO: 386307 - protein, 9 aa, Mycobacterium
TSSSSATYG

SEQ ID NO: 386308 - protein, 5 aa, Mycobacterium
TSTAW

SEQ ID NO: 386309 - protein, 4 aa, Mycobacterium
TSTL

SEQ ID NO: 386310 - protein, 7 aa, Mycobacterium
TSTQSDI

SEQ ID NO: 386311 - protein, 12 aa, Mycobacterium
TSTRDDRVHPGH

SEQ ID NO: 386312 - protein, 4 aa, Mycobacterium
TSVG

SEQ ID NO: 386313 - protein, 5 aa, Mycobacterium
TTAPA

SEQ ID NO: 386314 - protein, 7 aa, Mycobacterium
TTAPSTA

SEQ ID NO: 386315 - protein, 8 aa, Mycobacterium
TTDRPTQV

SEQ ID NO: 386316 - protein, 7 aa, Mycobacterium
TTEGERQ

SEQ ID NO: 386317 - protein, 6 aa, Mycobacterium
TTETTV

SEQ ID NO: 386318 - protein, 4 aa, Mycobacterium
TTLA

SEQ ID NO: 386319 - protein, 7 aa, Mycobacterium
TTPARTA

SEQ ID NO: 386320 - protein, 4 aa, Mycobacterium
TTPE

SEQ ID NO: 386321 - protein, 6 aa, Mycobacterium
TTQQAE

SEQ ID NO: 386322 - protein, 8 aa, Mycobacterium
TTREDSAG

SEQ ID NO: 386323 - protein, 7 aa, Mycobacterium
TTRRGEA

SEQ ID NO: 386324 - protein, 7 aa, Mycobacterium
TTSDPYV

SEQ ID NO: 386325 - protein, 11 aa, Mycobacterium
TTSGTRLDTTD

SEQ ID NO: 386326 - protein, 5 aa, Mycobacterium
TTSPD

SEQ ID NO: 386327 - protein, 4 aa, Mycobacterium
TTST

SEQ ID NO: 386328 - protein, 7 aa, Mycobacterium
TTTERRE

SEQ ID NO: 386329 - protein, 5 aa, Mycobacterium
TTTGD

SEQ ID NO: 386330 - protein, 5 aa, Mycobacterium
TVGDI

SEQ ID NO: 386331 - protein, 8 aa, Mycobacterium
TVGQPGNR

SEQ ID NO: 386332 - protein, 8 aa, Mycobacterium
TVSNAEEF

SEQ ID NO: 386333 - protein, 4 aa, Mycobacterium
TWSG

SEQ ID NO: 386334 - protein, 12 aa, Mycobacterium
TYGSGDWGRTPH

SEQ ID NO: 386335 - protein, 5 aa, Mycobacterium
TYGVP

SEQ ID NO: 386336 - protein, 5 aa, Mycobacterium
TYPGT

SEQ ID NO: 386337 - protein, 5 aa, Mycobacterium
VAAGR

SEQ ID NO: 386338 - protein, 6 aa, Mycobacterium
VADPVK

SEQ ID NO: 386339 - protein, 7 aa, Mycobacterium
VAGDANP

SEQ ID NO: 386340 - protein, 12 aa, Mycobacterium
VAHTGTSEYGRT

SEQ ID NO: 386341 - protein, 13 aa, Mycobacterium
VALPGGDAIGSRP

SEQ ID NO: 386342 - protein, 9 aa, Mycobacterium
VAPQGPVEE

SEQ ID NO: 386343 - protein, 4 aa, Mycobacterium
VAPR

SEQ ID NO: 386344 - protein, 5 aa, Mycobacterium
VAPRP

SEQ ID NO: 386345 - protein, 12 aa, Mycobacterium
VARRGSVTDLSP

SEQ ID NO: 386346 - protein, 7 aa, Mycobacterium
VARSRAD

SEQ ID NO: 386347 - protein, 14 aa, Mycobacterium
VASSLGKGLTASSL

SEQ ID NO: 386348 - protein, 4 aa, Mycobacterium
VATS

SEQ ID NO: 386349 - protein, 9 aa, Mycobacterium
VDDDTEELR

SEQ ID NO: 386350 - protein, 4 aa, Mycobacterium
VDDP

SEQ ID NO: 386351 - protein, 4 aa, Mycobacterium
VDPT

SEQ ID NO: 386352 - protein, 4 aa, Mycobacterium
VDTG

SEQ ID NO: 386353 - protein, 5 aa, Mycobacterium
VDTPI

SEQ ID NO: 386354 - protein, 4 aa, Mycobacterium
VEDE

SEQ ID NO: 386355 - protein, 5 aa, Mycobacterium
VEIPN

SEQ ID NO: 386356 - protein, 4 aa, Mycobacterium
VENG

SEQ ID NO: 386357 - protein, 4 aa, Mycobacterium
VEPE

SEQ ID NO: 386358 - protein, 4 aa, Mycobacterium
VEST

SEQ ID NO: 386359 - protein, 5 aa, Mycobacterium
VETGR

SEQ ID NO: 386360 - protein, 4 aa, Mycobacterium
VGAD

SEQ ID NO: 386361 - protein, 4 aa, Mycobacterium
VGAE

SEQ ID NO: 386362 - protein, 4 aa, Mycobacterium
VGGA

SEQ ID NO: 386363 - protein, 5 aa, Mycobacterium
VGGAR

SEQ ID NO: 386364 - protein, 6 aa, Mycobacterium
VGGEPH

SEQ ID NO: 386365 - protein, 8 aa, Mycobacterium
VGGESARS

SEQ ID NO: 386366 - protein, 4 aa, Mycobacterium
VGGI

SEQ ID NO: 386367 - protein, 7 aa, Mycobacterium
VGGPSTW

SEQ ID NO: 386368 - protein, 4 aa, Mycobacterium
VGPR

SEQ ID NO: 386369 - protein, 5 aa, Mycobacterium
VGQGY

SEQ ID NO: 386370 - protein, 4 aa, Mycobacterium
VGRT

SEQ ID NO: 386371 - protein, 11 aa, Mycobacterium
VGSDYRGDPSA

SEQ ID NO: 386372 - protein, 7 aa, Mycobacterium
VGVGPGS

SEQ ID NO: 386373 - protein, 7 aa, Mycobacterium
VKAARKD

SEQ ID NO: 386374 - protein, 6 aa, Mycobacterium
VKDGYG

SEQ ID NO: 386375 - protein, 8 aa, Mycobacterium
VKEGPAAL

SEQ ID NO: 386376 - protein, 8 aa, Mycobacterium
VKKPETIN

SEQ ID NO: 386377 - protein, 5 aa, Mycobacterium
VNGPA

SEQ ID NO: 386378 - protein, 7 aa, Mycobacterium
VNGRTSA

SEQ ID NO: 386379 - protein, 7 aa, Mycobacterium
VNSDESR

SEQ ID NO: 386380 - protein, 4 aa, Mycobacterium
VNSR

SEQ ID NO: 386381 - protein, 11 aa, Mycobacterium
VNSSQGGGSKD

SEQ ID NO: 386382 - protein, 6 aa, Mycobacterium
VPAAAQ

SEQ ID NO: 386383 - protein, 8 aa, Mycobacterium
VPAGGEDD

SEQ ID NO: 386384 - protein, 8 aa, Mycobacterium
VPDERRGA

SEQ ID NO: 386385 - protein, 5 aa, Mycobacterium
VPDPH

SEQ ID NO: 386386 - protein, 9 aa, Mycobacterium
VPDPTPGKN

SEQ ID NO: 386387 - protein, 6 aa, Mycobacterium
VPETNS

SEQ ID NO: 386388 - protein, 5 aa, Mycobacterium
VPGAC

SEQ ID NO: 386389 - protein, 7 aa, Mycobacterium
VPGFRGP

SEQ ID NO: 386390 - protein, 7 aa, Mycobacterium
VPGGDIK

SEQ ID NO: 386391 - protein, 12 aa, Mycobacterium
VPGGSGGGSAAA

SEQ ID NO: 386392 - protein, 6 aa, Mycobacterium
VPGIPA

SEQ ID NO: 386393 - protein, 4 aa, Mycobacterium
VPGP

SEQ ID NO: 386394 - protein, 6 aa, Mycobacterium
VPGRTG

SEQ ID NO: 386395 - protein, 6 aa, Mycobacterium
VPGSAS

SEQ ID NO: 386396 - protein, 7 aa, Mycobacterium
VPGTPGL

SEQ ID NO: 386397 - protein, 4 aa, Mycobacterium
VPPP

SEQ ID NO: 386398 - protein, 4 aa, Mycobacterium
VPPT

SEQ ID NO: 386399 - protein, 4 aa, Mycobacterium
VPQG

SEQ ID NO: 386400 - protein, 5 aa, Mycobacterium
VPQGL

SEQ ID NO: 386401 - protein, 4 aa, Mycobacterium
VQAG

SEQ ID NO: 386402 - protein, 4 aa, Mycobacterium
VQDG

SEQ ID NO: 386403 - protein, 7 aa, Mycobacterium
VQPTSDS

SEQ ID NO: 386404 - protein, 6 aa, Mycobacterium
VQRPND

SEQ ID NO: 386405 - protein, 6 aa, Mycobacterium
VQTGPR

SEQ ID NO: 386406 - protein, 10 aa, Mycobacterium
VRDEAEIRGH

SEQ ID NO: 386407 - protein, 4 aa, Mycobacterium
VRIG

SEQ ID NO: 386408 - protein, 9 aa, Mycobacterium
VRPENAASR

SEQ ID NO: 386409 - protein, 9 aa, Mycobacterium
VRSPDSACN

SEQ ID NO: 386410 - protein, 10 aa, Mycobacterium
VSAGPGTRAN

SEQ ID NO: 386411 - protein, 10 aa, Mycobacterium
VSASTASESI

SEQ ID NO: 386412 - protein, 5 aa, Mycobacterium
VSDEE

SEQ ID NO: 386413 - protein, 6 aa, Mycobacterium
VSGAGL

SEQ ID NO: 386414 - protein, 10 aa, Mycobacterium
VSGGRADPAM

SEQ ID NO: 386415 - protein, 5 aa, Mycobacterium
VSGGT

SEQ ID NO: 386416 - protein, 8 aa, Mycobacterium
VSGGYTRD

SEQ ID NO: 386417 - protein, 4 aa, Mycobacterium
VSGP

SEQ ID NO: 386418 - protein, 7 aa, Mycobacterium
VSPARAA

SEQ ID NO: 386419 - protein, 8 aa, Mycobacterium
VSPEKRTR

SEQ ID NO: 386420 - protein, 5 aa, Mycobacterium
VSRTQ

SEQ ID NO: 386421 - protein, 4 aa, Mycobacterium
VTDD

SEQ ID NO: 386422 - protein, 6 aa, Mycobacterium
VTEETA

SEQ ID NO: 386423 - protein, 4 aa, Mycobacterium
VTGA

SEQ ID NO: 386424 - protein, 8 aa, Mycobacterium
VTGGSKGM

SEQ ID NO: 386425 - protein, 5 aa, Mycobacterium
VTGTD

SEQ ID NO: 386426 - protein, 7 aa, Mycobacterium
VTNPKGE

SEQ ID NO: 386427 - protein, 4 aa, Mycobacterium
VTPE

SEQ ID NO: 386428 - protein, 7 aa, Mycobacterium
VTPELEA

SEQ ID NO: 386429 - protein, 7 aa, Mycobacterium
VTPNPGA

SEQ ID NO: 386430 - protein, 10 aa, Mycobacterium
VTPQRAASGY

SEQ ID NO: 386431 - protein, 6 aa, Mycobacterium
VTPSPA

SEQ ID NO: 386432 - protein, 6 aa, Mycobacterium
VTPYGG

SEQ ID NO: 386433 - protein, 6 aa, Mycobacterium
VTSDTA

SEQ ID NO: 386434 - protein, 10 aa, Mycobacterium
VTSTSGPGIS

SEQ ID NO: 386435 - protein, 5 aa, Mycobacterium
VTTAD

SEQ ID NO: 386436 - protein, 7 aa, Mycobacterium
VTTSGDR

SEQ ID NO: 386437 - protein, 8 aa, Mycobacterium
WDDPQGVP

SEQ ID NO: 386438 - protein, 7 aa, Mycobacterium
WPDSTKE

SEQ ID NO: 386439 - protein, 9 aa, Mycobacterium
WPGSSDRNF

SEQ ID NO: 386440 - protein, 4 aa, Mycobacterium
YDRR

SEQ ID NO: 386441 - protein, 5 aa, Mycobacterium
YDTSS

SEQ ID NO: 386442 - protein, 4 aa, Mycobacterium
YEPQ

SEQ ID NO: 386443 - protein, 6 aa, Mycobacterium
YEQGGI

SEQ ID NO: 386444 - protein, 6 aa, Mycobacterium
YEQHPL

SEQ ID NO: 386445 - protein, 10 aa, Mycobacterium
YESRTAPVEG

SEQ ID NO: 386446 - protein, 9 aa, Mycobacterium
YGAQGGDWG

SEQ ID NO: 386447 - protein, 8 aa, Mycobacterium
YGGDQEHR

SEQ ID NO: 386448 - protein, 10 aa, Mycobacterium
YGGTEIKYNG

SEQ ID NO: 386449 - protein, 4 aa, Mycobacterium
YGLP

SEQ ID NO: 386450 - protein, 4 aa, Mycobacterium
YGNP

SEQ ID NO: 386451 - protein, 9 aa, Mycobacterium
YGNTASTTH

SEQ ID NO: 386452 - protein, 5 aa, Mycobacterium
YGPNG

SEQ ID NO: 386453 - protein, 7 aa, Mycobacterium
YGPTEAT

SEQ ID NO: 386454 - protein, 8 aa, Mycobacterium
YGPTTGDR

SEQ ID NO: 386455 - protein, 4 aa, Mycobacterium
YGQS

SEQ ID NO: 386456 - protein, 6 aa, Mycobacterium
YGSTEA

SEQ ID NO: 386457 - protein, 7 aa, Mycobacterium
YHPHGDA

SEQ ID NO: 386458 - protein, 5 aa, Mycobacterium
YIDGP

SEQ ID NO: 386459 - protein, 7 aa, Mycobacterium
YPEEVPG

SEQ ID NO: 386460 - protein, 4 aa, Mycobacterium
YPEL

SEQ ID NO: 386461 - protein, 7 aa, Mycobacterium
YPGAPGQ

SEQ ID NO: 386462 - protein, 4 aa, Mycobacterium
YPGP

SEQ ID NO: 386463 - protein, 11 aa, Mycobacterium
YPIPGNDDAIR

SEQ ID NO: 386464 - protein, 11 aa, Mycobacterium
YPPGRGPHTSA

SEQ ID NO: 386465 - protein, 5 aa, Mycobacterium
YPTRA

SEQ ID NO: 386466 - protein, 7 aa, Mycobacterium
YRGVKGG

SEQ ID NO: 386467 - protein, 7 aa, Mycobacterium
YRREGKR

SEQ ID NO: 386468 - protein, 6 aa, Mycobacterium
YRSTQN

SEQ ID NO: 386469 - protein, 9 aa, Mycobacterium
YSDRERDGL

SEQ ID NO: 386470 - protein, 5 aa, Mycobacterium
YSEPH

SEQ ID NO: 386471 - protein, 4 aa, Mycobacterium
YSGT

SEQ ID NO: 386472 - protein, 9 aa, Mycobacterium
YSKSKGQPL

SEQ ID NO: 386473 - protein, 5 aa, Mycobacterium
YTGEL

SEQ ID NO: 386474 - protein, 6 aa, Mycobacterium
YVTTPG

SEQ ID NO: 386475 - protein, 5 aa, Mycobacterium
AAAAR

SEQ ID NO: 386476 - protein, 5 aa, Mycobacterium
AAAAT

SEQ ID NO: 386477 - protein, 5 aa, Mycobacterium
AAAEA

SEQ ID NO: 386478 - protein, 5 aa, Mycobacterium
AAAER

SEQ ID NO: 386479 - protein, 7 aa, Mycobacterium
AAAGGVG

SEQ ID NO: 386480 - protein, 8 aa, Mycobacterium
AAAGQAAL

SEQ ID NO: 386481 - protein, 8 aa, Mycobacterium
AAAGVGKG

SEQ ID NO: 386482 - protein, 4 aa, Mycobacterium
AAAI

SEQ ID NO: 386483 - protein, 6 aa, Mycobacterium
AAAKGK

SEQ ID NO: 386484 - protein, 6 aa, Mycobacterium
AAAPGS

SEQ ID NO: 386485 - protein, 6 aa, Mycobacterium
AAAQGR

SEQ ID NO: 386486 - protein, 7 aa, Mycobacterium
AAAQRAG

SEQ ID NO: 386487 - protein, 5 aa, Mycobacterium
AAARA

SEQ ID NO: 386488 - protein, 5 aa, Mycobacterium
AAARD

SEQ ID NO: 386489 - protein, 6 aa, Mycobacterium
AAARGA

SEQ ID NO: 386490 - protein, 16 aa, Mycobacterium
AAARTQARIDSGQQPV

SEQ ID NO: 386491 - protein, 6 aa, Mycobacterium
AAASAT

SEQ ID NO: 386492 - protein, 12 aa, Mycobacterium
AAATGKRSQCFG

SEQ ID NO: 386493 - protein, 5 aa, Mycobacterium
AADAG

SEQ ID NO: 386494 - protein, 9 aa, Mycobacterium
AADEKESEL

SEQ ID NO: 386495 - protein, 4 aa, Mycobacterium
AADN

SEQ ID NO: 386496 - protein, 6 aa, Mycobacterium
AADPLD

SEQ ID NO: 386497 - protein, 5 aa, Mycobacterium
AAEAA

SEQ ID NO: 386498 - protein, 6 aa, Mycobacterium
AAEAAG

SEQ ID NO: 386499 - protein, 6 aa, Mycobacterium
AAEALK

SEQ ID NO: 386500 - protein, 5 aa, Mycobacterium
AAEGT

SEQ ID NO: 386501 - protein, 5 aa, Mycobacterium
AAELG

SEQ ID NO: 386502 - protein, 5 aa, Mycobacterium
AAEPD

SEQ ID NO: 386503 - protein, 9 aa, Mycobacterium
AAEPDGLPL

SEQ ID NO: 386504 - protein, 12 aa, Mycobacterium
AAEPGGKEYGVP

SEQ ID NO: 386505 - protein, 5 aa, Mycobacterium
AAERA

SEQ ID NO: 386506 - protein, 12 aa, Mycobacterium
AAGANDGGGSIR

SEQ ID NO: 386507 - protein, 5 aa, Mycobacterium
AAGAR

SEQ ID NO: 386508 - protein, 6 aa, Mycobacterium
AAGARS

SEQ ID NO: 386509 - protein, 11 aa, Mycobacterium
AAGDGVETGRH

SEQ ID NO: 386510 - protein, 5 aa, Mycobacterium
AAGEM

SEQ ID NO: 386511 - protein, 6 aa, Mycobacterium
AAGEMR

SEQ ID NO: 386512 - protein, 5 aa, Mycobacterium
AAGEQ

SEQ ID NO: 386513 - protein, 4 aa, Mycobacterium
AAGF

SEQ ID NO: 386514 - protein, 9 aa, Mycobacterium
AAGGGPFAA

SEQ ID NO: 386515 - protein, 6 aa, Mycobacterium
AAGGGV

SEQ ID NO: 386516 - protein, 7 aa, Mycobacterium
AAGGQVR

SEQ ID NO: 386517 - protein, 7 aa, Mycobacterium
AAGGRPI

SEQ ID NO: 386518 - protein, 4 aa, Mycobacterium
AAGH

SEQ ID NO: 386519 - protein, 5 aa, Mycobacterium
AAGLD

SEQ ID NO: 386520 - protein, 7 aa, Mycobacterium
AAGLGRA

SEQ ID NO: 386521 - protein, 7 aa, Mycobacterium
AAGLGTG

SEQ ID NO: 386522 - protein, 11 aa, Mycobacterium
AAGQGRSDDVA

SEQ ID NO: 386523 - protein, 9 aa, Mycobacterium
AAGTDYADL

SEQ ID NO: 386524 - protein, 7 aa, Mycobacterium
AAGTSTS

SEQ ID NO: 386525 - protein, 5 aa, Mycobacterium
AAGVD

SEQ ID NO: 386526 - protein, 5 aa, Mycobacterium
AAGVS

SEQ ID NO: 386527 - protein, 6 aa, Mycobacterium
AAGYGM

SEQ ID NO: 386528 - protein, 9 aa, Mycobacterium
AAHGANRTG

SEQ ID NO: 386529 - protein, 4 aa, Mycobacterium
AAHN

SEQ ID NO: 386530 - protein, 15 aa, Mycobacterium
AAHPTTGDASLPDDR

SEQ ID NO: 386531 - protein, 4 aa, Mycobacterium
AAHS

SEQ ID NO: 386532 - protein, 5 aa, Mycobacterium
AAKAA

SEQ ID NO: 386533 - protein, 7 aa, Mycobacterium
AAKPKIA

SEQ ID NO: 386534 - protein, 4 aa, Mycobacterium
AALA

SEQ ID NO: 386535 - protein, 6 aa, Mycobacterium
AALRGS

SEQ ID NO: 386536 - protein, 10 aa, Mycobacterium
AANPATTASF

SEQ ID NO: 386537 - protein, 18 aa, Mycobacterium
AANPDVAEKIRGGKVAAA

SEQ ID NO: 386538 - protein, 5 aa, Mycobacterium
AANRK

SEQ ID NO: 386539 - protein, 5 aa, Mycobacterium
AANSP

SEQ ID NO: 386540 - protein, 7 aa, Mycobacterium
AAPDTGN

SEQ ID NO: 386541 - protein, 7 aa, Mycobacterium
AAPESTC

SEQ ID NO: 386542 - protein, 4 aa, Mycobacterium
AAPF

SEQ ID NO: 386543 - protein, 6 aa, Mycobacterium
AAPGIT

SEQ ID NO: 386544 - protein, 6 aa, Mycobacterium
AAPGRI

SEQ ID NO: 386545 - protein, 7 aa, Mycobacterium
AAPKSAG

SEQ ID NO: 386546 - protein, 4 aa, Mycobacterium
AAPL

SEQ ID NO: 386547 - protein, 10 aa, Mycobacterium
AAPLRPGKGP

SEQ ID NO: 386548 - protein, 4 aa, Mycobacterium
AAPN

SEQ ID NO: 386549 - protein, 9 aa, Mycobacterium
AAPPAGHGP

SEQ ID NO: 386550 - protein, 6 aa, Mycobacterium
AAPPGP

SEQ ID NO: 386551 - protein, 9 aa, Mycobacterium
AAPQATVPA

SEQ ID NO: 386552 - protein, 6 aa, Mycobacterium
AAQQAS

SEQ ID NO: 386553 - protein, 8 aa, Mycobacterium
AAQQNQSP

SEQ ID NO: 386554 - protein, 4 aa, Mycobacterium
AAQR

SEQ ID NO: 386555 - protein, 5 aa, Mycobacterium
AARAA

SEQ ID NO: 386556 - protein, 5 aa, Mycobacterium
AARAG

SEQ ID NO: 386557 - protein, 5 aa, Mycobacterium
AARDA

SEQ ID NO: 386558 - protein, 7 aa, Mycobacterium
AARDASN

SEQ ID NO: 386559 - protein, 7 aa, Mycobacterium
AARDRVG

SEQ ID NO: 386560 - protein, 7 aa, Mycobacterium
AARKAGH

SEQ ID NO: 386561 - protein, 4 aa, Mycobacterium
AARS

SEQ ID NO: 386562 - protein, 21 aa, Mycobacterium
AASELASRQRAMKSATDNADD

SEQ ID NO: 386563 - protein, 6 aa, Mycobacterium
AASKGG

SEQ ID NO: 386564 - protein, 4 aa, Mycobacterium
AASN

SEQ ID NO: 386565 - protein, 5 aa, Mycobacterium
AASRG

SEQ ID NO: 386566 - protein, 6 aa, Mycobacterium
AATARA

SEQ ID NO: 386567 - protein, 7 aa, Mycobacterium
AATEAVE

SEQ ID NO: 386568 - protein, 6 aa, Mycobacterium
AATETR

SEQ ID NO: 386569 - protein, 6 aa, Mycobacterium
AATGKP

SEQ ID NO: 386570 - protein, 5 aa, Mycobacterium
AATGL

SEQ ID NO: 386571 - protein, 4 aa, Mycobacterium
AATP

SEQ ID NO: 386572 - protein, 4 aa, Mycobacterium
AATR

SEQ ID NO: 386573 - protein, 5 aa, Mycobacterium
AATRG

SEQ ID NO: 386574 - protein, 7 aa, Mycobacterium
AATRNGR

SEQ ID NO: 386575 - protein, 5 aa, Mycobacterium
AATRT

SEQ ID NO: 386576 - protein, 14 aa, Mycobacterium
AATSNTLPEQLGEG

SEQ ID NO: 386577 - protein, 12 aa, Mycobacterium
AAVEKAAKDAGY

SEQ ID NO: 386578 - protein, 5 aa, Mycobacterium
AAVGG

SEQ ID NO: 386579 - protein, 5 aa, Mycobacterium
AAVTG

SEQ ID NO: 386580 - protein, 14 aa, Mycobacterium
AAVTGNGAADKAQV

SEQ ID NO: 386581 - protein, 11 aa, Mycobacterium
AAYRGPRDQRE

SEQ ID NO: 386582 - protein, 5 aa, Mycobacterium
ACGTP

SEQ ID NO: 386583 - protein, 5 aa, Mycobacterium
ADAAE

SEQ ID NO: 386584 - protein, 8 aa, Mycobacterium
ADAAGLAE

SEQ ID NO: 386585 - protein, 6 aa, Mycobacterium
ADADDV

SEQ ID NO: 386586 - protein, 5 aa, Mycobacterium
ADADR

SEQ ID NO: 386587 - protein, 7 aa, Mycobacterium
ADADRDY

SEQ ID NO: 386588 - protein, 7 aa, Mycobacterium
ADAEAEH

SEQ ID NO: 386589 - protein, 5 aa, Mycobacterium
ADAGA

SEQ ID NO: 386590 - protein, 8 aa, Mycobacterium
ADAGTRSQ

SEQ ID NO: 386591 - protein, 4 aa, Mycobacterium
ADAP

SEQ ID NO: 386592 - protein, 4 aa, Mycobacterium
ADAT

SEQ ID NO: 386593 - protein, 21 aa, Mycobacterium
ADAVDGAAAPLAGTTSQPALS

SEQ ID NO: 386594 - protein, 4 aa, Mycobacterium
ADDA

SEQ ID NO: 386595 - protein, 5 aa, Mycobacterium
ADDAE

SEQ ID NO: 386596 - protein, 6 aa, Mycobacterium
ADDDEH

SEQ ID NO: 386597 - protein, 4 aa, Mycobacterium
ADDP

SEQ ID NO: 386598 - protein, 4 aa, Mycobacterium
ADDT

SEQ ID NO: 386599 - protein, 5 aa, Mycobacterium
ADELG

SEQ ID NO: 386600 - protein, 6 aa, Mycobacterium
ADGEHL

SEQ ID NO: 386601 - protein, 7 aa, Mycobacterium
ADGEQEK

SEQ ID NO: 386602 - protein, 6 aa, Mycobacterium
ADGGPL

SEQ ID NO: 386603 - protein, 10 aa, Mycobacterium
ADGGTRTAAI

SEQ ID NO: 386604 - protein, 4 aa, Mycobacterium
ADGH

SEQ ID NO: 386605 - protein, 10 aa, Mycobacterium
ADGNRQRAHY

SEQ ID NO: 386606 - protein, 4 aa, Mycobacterium
ADGP

SEQ ID NO: 386607 - protein, 5 aa, Mycobacterium
ADGRA

SEQ ID NO: 386608 - protein, 14 aa, Mycobacterium
ADGRAARRAADEAL

SEQ ID NO: 386609 - protein, 5 aa, Mycobacterium
ADGRK

SEQ ID NO: 386610 - protein, 5 aa, Mycobacterium
ADGRL

SEQ ID NO: 386611 - protein, 5 aa, Mycobacterium
ADGRQ

SEQ ID NO: 386612 - protein, 14 aa, Mycobacterium
ADGSEVATSPLATE

SEQ ID NO: 386613 - protein, 5 aa, Mycobacterium
ADGSP

SEQ ID NO: 386614 - protein, 6 aa, Mycobacterium
ADGSSV

SEQ ID NO: 386615 - protein, 5 aa, Mycobacterium
ADGTT

SEQ ID NO: 386616 - protein, 5 aa, Mycobacterium
ADGVR

SEQ ID NO: 386617 - protein, 10 aa, Mycobacterium
ADGVRAGRAM

SEQ ID NO: 386618 - protein, 7 aa, Mycobacterium
ADLSTPV

SEQ ID NO: 386619 - protein, 6 aa, Mycobacterium
ADPAER

SEQ ID NO: 386620 - protein, 5 aa, Mycobacterium
ADPAL

SEQ ID NO: 386621 - protein, 8 aa, Mycobacterium
ADPANPYG

SEQ ID NO: 386622 - protein, 9 aa, Mycobacterium
ADPASARGS

SEQ ID NO: 386623 - protein, 5 aa, Mycobacterium
ADPDA

SEQ ID NO: 386624 - protein, 15 aa, Mycobacterium
ADPEGSVYSGGTGRP

SEQ ID NO: 386625 - protein, 12 aa, Mycobacterium
ADPERHCKVLVT

SEQ ID NO: 386626 - protein, 6 aa, Mycobacterium
ADPGHS

SEQ ID NO: 386627 - protein, 9 aa, Mycobacterium
ADPGPPKAL

SEQ ID NO: 386628 - protein, 5 aa, Mycobacterium
ADPIG

SEQ ID NO: 386629 - protein, 4 aa, Mycobacterium
ADPL

SEQ ID NO: 386630 - protein, 7 aa, Mycobacterium
ADPMAKD

SEQ ID NO: 386631 - protein, 5 aa, Mycobacterium
ADPME

SEQ ID NO: 386632 - protein, 5 aa, Mycobacterium
ADPTR

SEQ ID NO: 386633 - protein, 6 aa, Mycobacterium
ADRDEA

SEQ ID NO: 386634 - protein, 4 aa, Mycobacterium
ADRP

SEQ ID NO: 386635 - protein, 5 aa, Mycobacterium
ADRPA

SEQ ID NO: 386636 - protein, 6 aa, Mycobacterium
ADRPAL

SEQ ID NO: 386637 - protein, 4 aa, Mycobacterium
ADRQ

SEQ ID NO: 386638 - protein, 4 aa, Mycobacterium
ADRR

SEQ ID NO: 386639 - protein, 16 aa, Mycobacterium
ADRSSLRQLHAAIKAA

SEQ ID NO: 386640 - protein, 4 aa, Mycobacterium
ADRV

SEQ ID NO: 386641 - protein, 5 aa, Mycobacterium
ADSGA

SEQ ID NO: 386642 - protein, 5 aa, Mycobacterium
ADSGI

SEQ ID NO: 386643 - protein, 5 aa, Mycobacterium
ADSGV

SEQ ID NO: 386644 - protein, 4 aa, Mycobacterium
ADSI

SEQ ID NO: 386645 - protein, 8 aa, Mycobacterium
ADSPFGGF

SEQ ID NO: 386646 - protein, 6 aa, Mycobacterium
ADSPKL

SEQ ID NO: 386647 - protein, 5 aa, Mycobacterium
ADTAR

SEQ ID NO: 386648 - protein, 4 aa, Mycobacterium
ADTG

SEQ ID NO: 386649 - protein, 4 aa, Mycobacterium
ADTL

SEQ ID NO: 386650 - protein, 4 aa, Mycobacterium
ADTP

SEQ ID NO: 386651 - protein, 7 aa, Mycobacterium
ADTPLKG

SEQ ID NO: 386652 - protein, 4 aa, Mycobacterium
ADTV

SEQ ID NO: 386653 - protein, 4 aa, Mycobacterium
ADVA

SEQ ID NO: 386654 - protein, 5 aa, Mycobacterium
ADVPT

SEQ ID NO: 386655 - protein, 7 aa, Mycobacterium
ADYGGDP

SEQ ID NO: 386656 - protein, 4 aa, Mycobacterium
AEAA

SEQ ID NO: 386657 - protein, 5 aa, Mycobacterium
AEAAK

SEQ ID NO: 386658 - protein, 5 aa, Mycobacterium
AEADG

SEQ ID NO: 386659 - protein, 5 aa, Mycobacterium
AEAGA

SEQ ID NO: 386660 - protein, 7 aa, Mycobacterium
AEAGKDA

SEQ ID NO: 386661 - protein, 9 aa, Mycobacterium
AEAGYPPSR

SEQ ID NO: 386662 - protein, 5 aa, Mycobacterium
AEAPD

SEQ ID NO: 386663 - protein, 6 aa, Mycobacterium
AEAPED

SEQ ID NO: 386664 - protein, 4 aa, Mycobacterium
AEAQ

SEQ ID NO: 386665 - protein, 4 aa, Mycobacterium
AEAR

SEQ ID NO: 386666 - protein, 6 aa, Mycobacterium
AEAVEN

SEQ ID NO: 386667 - protein, 5 aa, Mycobacterium
AEDGV

SEQ ID NO: 386668 - protein, 4 aa, Mycobacterium
AEEA

SEQ ID NO: 386669 - protein, 4 aa, Mycobacterium
AEEL

SEQ ID NO: 386670 - protein, 7 aa, Mycobacterium
AEESADL

SEQ ID NO: 386671 - protein, 14 aa, Mycobacterium
AEETAAAVGSTTGA

SEQ ID NO: 386672 - protein, 7 aa, Mycobacterium
AEETGIR

SEQ ID NO: 386673 - protein, 4 aa, Mycobacterium
AEEV

SEQ ID NO: 386674 - protein, 4 aa, Mycobacterium
AEGE

SEQ ID NO: 386675 - protein, 5 aa, Mycobacterium
AEGEP

SEQ ID NO: 386676 - protein, 8 aa, Mycobacterium
AEGIPYED

SEQ ID NO: 386677 - protein, 4 aa, Mycobacterium
AEGL

SEQ ID NO: 386678 - protein, 8 aa, Mycobacterium
AEGLPGRR

SEQ ID NO: 386679 - protein, 5 aa, Mycobacterium
AEGRG

SEQ ID NO: 386680 - protein, 5 aa, Mycobacterium
AEGTG

SEQ ID NO: 386681 - protein, 5 aa, Mycobacterium
AEGVG

SEQ ID NO: 386682 - protein, 7 aa, Mycobacterium
AEHEGKP

SEQ ID NO: 386683 - protein, 6 aa, Mycobacterium
AEINGR

SEQ ID NO: 386684 - protein, 6 aa, Mycobacterium
AEKGGY

SEQ ID NO: 386685 - protein, 4 aa, Mycobacterium
AELD

SEQ ID NO: 386686 - protein, 16 aa, Mycobacterium
AENERTYGEFSTREGE

SEQ ID NO: 386687 - protein, 4 aa, Mycobacterium
AEPA

SEQ ID NO: 386688 - protein, 6 aa, Mycobacterium
AEPEER

SEQ ID NO: 386689 - protein, 4 aa, Mycobacterium
AEPL

SEQ ID NO: 386690 - protein, 4 aa, Mycobacterium
AEPR

SEQ ID NO: 386691 - protein, 9 aa, Mycobacterium
AEPRSEHKK

SEQ ID NO: 386692 - protein, 4 aa, Mycobacterium
AEPT

SEQ ID NO: 386693 - protein, 6 aa, Mycobacterium
AEQAGQ

SEQ ID NO: 386694 - protein, 5 aa, Mycobacterium
AEQDG

SEQ ID NO: 386695 - protein, 4 aa, Mycobacterium
AEQP

SEQ ID NO: 386696 - protein, 8 aa, Mycobacterium
AEQPGFRG

SEQ ID NO: 386697 - protein, 4 aa, Mycobacterium
AEQR

SEQ ID NO: 386698 - protein, 11 aa, Mycobacterium
AEQSDDAQPGV

SEQ ID NO: 386699 - protein, 6 aa, Mycobacterium
AEQSVE

SEQ ID NO: 386700 - protein, 4 aa, Mycobacterium
AEQT

SEQ ID NO: 386701 - protein, 4 aa, Mycobacterium
AEQV

SEQ ID NO: 386702 - protein, 5 aa, Mycobacterium
AERAE

SEQ ID NO: 386703 - protein, 5 aa, Mycobacterium
AERTK

SEQ ID NO: 386704 - protein, 6 aa, Mycobacterium
AESDDL

SEQ ID NO: 386705 - protein, 8 aa, Mycobacterium
AESDGDRL

SEQ ID NO: 386706 - protein, 7 aa, Mycobacterium
AESGVTR

SEQ ID NO: 386707 - protein, 7 aa, Mycobacterium
AETAGSE

SEQ ID NO: 386708 - protein, 5 aa, Mycobacterium
AETDP

SEQ ID NO: 386709 - protein, 4 aa, Mycobacterium
AETE

SEQ ID NO: 386710 - protein, 5 aa, Mycobacterium
AETEL

SEQ ID NO: 386711 - protein, 4 aa, Mycobacterium
AETF

SEQ ID NO: 386712 - protein, 12 aa, Mycobacterium
AETFTDNTEPHI

SEQ ID NO: 386713 - protein, 12 aa, Mycobacterium
AETKRRTAEQLG

SEQ ID NO: 386714 - protein, 4 aa, Mycobacterium
AETN

SEQ ID NO: 386715 - protein, 4 aa, Mycobacterium
AETT

SEQ ID NO: 386716 - protein, 4 aa, Mycobacterium
AEVD

SEQ ID NO: 386717 - protein, 4 aa, Mycobacterium
AEVG

SEQ ID NO: 386718 - protein, 4 aa, Mycobacterium
AEYG

SEQ ID NO: 386719 - protein, 7 aa, Mycobacterium
AFGDDKD

SEQ ID NO: 386720 - protein, 5 aa, Mycobacterium
AGAAA

SEQ ID NO: 386721 - protein, 9 aa, Mycobacterium
AGAAARAEN

SEQ ID NO: 386722 - protein, 5 aa, Mycobacterium
AGAAL

SEQ ID NO: 386723 - protein, 12 aa, Mycobacterium
AGAARTLFGRDP

SEQ ID NO: 386724 - protein, 7 aa, Mycobacterium
AGAGGSV

SEQ ID NO: 386725 - protein, 8 aa, Mycobacterium
AGAGIGRA

SEQ ID NO: 386726 - protein, 5 aa, Mycobacterium
AGAHA

SEQ ID NO: 386727 - protein, 4 aa, Mycobacterium
AGAN

SEQ ID NO: 386728 - protein, 9 aa, Mycobacterium
AGAPPDEFN

SEQ ID NO: 386729 - protein, 5 aa, Mycobacterium
AGARR

SEQ ID NO: 386730 - protein, 8 aa, Mycobacterium
AGARRREE

SEQ ID NO: 386731 - protein, 5 aa, Mycobacterium
AGASF

SEQ ID NO: 386732 - protein, 7 aa, Mycobacterium
AGAVGSV

SEQ ID NO: 386733 - protein, 4 aa, Mycobacterium
AGDD

SEQ ID NO: 386734 - protein, 5 aa, Mycobacterium
AGDDA

SEQ ID NO: 386735 - protein, 5 aa, Mycobacterium
AGDED

SEQ ID NO: 386736 - protein, 6 aa, Mycobacterium
AGDEFT

SEQ ID NO: 386737 - protein, 7 aa, Mycobacterium
AGDPGKP

SEQ ID NO: 386738 - protein, 6 aa, Mycobacterium
AGDQRS

SEQ ID NO: 386739 - protein, 9 aa, Mycobacterium
AGDSAGGNL

SEQ ID NO: 386740 - protein, 9 aa, Mycobacterium
AGDSAGGTI

SEQ ID NO: 386741 - protein, 4 aa, Mycobacterium
AGEA

SEQ ID NO: 386742 - protein, 4 aa, Mycobacterium
AGED

SEQ ID NO: 386743 - protein, 5 aa, Mycobacterium
AGEDI

SEQ ID NO: 386744 - protein, 7 aa, Mycobacterium
AGEETAA

SEQ ID NO: 386745 - protein, 10 aa, Mycobacterium
AGEGGRSSGI

SEQ ID NO: 386746 - protein, 5 aa, Mycobacterium
AGEGH

SEQ ID NO: 386747 - protein, 7 aa, Mycobacterium
AGEGTQQ

SEQ ID NO: 386748 - protein, 5 aa, Mycobacterium
AGEKK

SEQ ID NO: 386749 - protein, 4 aa, Mycobacterium
AGER

SEQ ID NO: 386750 - protein, 14 aa, Mycobacterium
AGERGSPDTWRDPR

SEQ ID NO: 386751 - protein, 7 aa, Mycobacterium
AGERGTD

SEQ ID NO: 386752 - protein, 5 aa, Mycobacterium
AGETG

SEQ ID NO: 386753 - protein, 6 aa, Mycobacterium
AGETGF

SEQ ID NO: 386754 - protein, 7 aa, Mycobacterium
AGEYEIN

SEQ ID NO: 386755 - protein, 8 aa, Mycobacterium
AGFGGGGV

SEQ ID NO: 386756 - protein, 4 aa, Mycobacterium
AGFT

SEQ ID NO: 386757 - protein, 5 aa, Mycobacterium
AGGAD

SEQ ID NO: 386758 - protein, 4 aa, Mycobacterium
AGGG

SEQ ID NO: 386759 - protein, 8 aa, Mycobacterium
AGGGGRGM

SEQ ID NO: 386760 - protein, 9 aa, Mycobacterium
AGGGGRGMR

SEQ ID NO: 386761 - protein, 17 aa, Mycobacterium
AGGGLYSSAEAAAATPL

SEQ ID NO: 386762 - protein, 12 aa, Mycobacterium
AGGGQGGAVVIE

SEQ ID NO: 386763 - protein, 4 aa, Mycobacterium
AGGM

SEQ ID NO: 386764 - protein, 7 aa, Mycobacterium
AGGPQKC

SEQ ID NO: 386765 - protein, 6 aa, Mycobacterium
AGGPVI

SEQ ID NO: 386766 - protein, 6 aa, Mycobacterium
AGGQSQ

SEQ ID NO: 386767 - protein, 4 aa, Mycobacterium
AGGS

SEQ ID NO: 386768 - protein, 4 aa, Mycobacterium
AGGT

SEQ ID NO: 386769 - protein, 11 aa, Mycobacterium
AGGTSEVTRNQ

SEQ ID NO: 386770 - protein, 7 aa, Mycobacterium
AGGVGGN

SEQ ID NO: 386771 - protein, 4 aa, Mycobacterium
AGGY

SEQ ID NO: 386772 - protein, 8 aa, Mycobacterium
AGHDPRRF

SEQ ID NO: 386773 - protein, 4 aa, Mycobacterium
AGIA

SEQ ID NO: 386774 - protein, 13 aa, Mycobacterium
AGIPSQAPASRPH

SEQ ID NO: 386775 - protein, 4 aa, Mycobacterium
AGIS

SEQ ID NO: 386776 - protein, 4 aa, Mycobacterium
AGKF

SEQ ID NO: 386777 - protein, 10 aa, Mycobacterium
AGKPAPDSYL

SEQ ID NO: 386778 - protein, 4 aa, Mycobacterium
AGKV

SEQ ID NO: 386779 - protein, 21 aa, Mycobacterium
AGLAETSRGDGGHGSSGGHAS

SEQ ID NO: 386780 - protein, 4 aa, Mycobacterium
AGLD

SEQ ID NO: 386781 - protein, 8 aa, Mycobacterium
AGLGGQTP

SEQ ID NO: 386782 - protein, 14 aa, Mycobacterium
AGLKATPGNGHYAA

SEQ ID NO: 386783 - protein, 4 aa, Mycobacterium
AGLN

SEQ ID NO: 386784 - protein, 5 aa, Mycobacterium
AGLPD

SEQ ID NO: 386785 - protein, 6 aa, Mycobacterium
AGLPEE

SEQ ID NO: 386786 - protein, 6 aa, Mycobacterium
AGLTDD

SEQ ID NO: 386787 - protein, 5 aa, Mycobacterium
AGLTG

SEQ ID NO: 386788 - protein, 5 aa, Mycobacterium
AGLTN

SEQ ID NO: 386789 - protein, 6 aa, Mycobacterium
AGNGGS

SEQ ID NO: 386790 - protein, 4 aa, Mycobacterium
AGNP

SEQ ID NO: 386791 - protein, 9 aa, Mycobacterium
AGNPTGAMG

SEQ ID NO: 386792 - protein, 11 aa, Mycobacterium
AGNSSQISDGA

SEQ ID NO: 386793 - protein, 7 aa, Mycobacterium
AGNTGAA

SEQ ID NO: 386794 - protein, 7 aa, Mycobacterium
AGPAGLA

SEQ ID NO: 386795 - protein, 18 aa, Mycobacterium
AGPAVAAGAAGAAVTRGA

SEQ ID NO: 386796 - protein, 6 aa, Mycobacterium
AGPAVV

SEQ ID NO: 386797 - protein, 5 aa, Mycobacterium
AGPDR

SEQ ID NO: 386798 - protein, 9 aa, Mycobacterium
AGPGAPIDT

SEQ ID NO: 386799 - protein, 8 aa, Mycobacterium
AGPGSGSM

SEQ ID NO: 386800 - protein, 5 aa, Mycobacterium
AGPGT

SEQ ID NO: 386801 - protein, 5 aa, Mycobacterium
AGPHP

SEQ ID NO: 386802 - protein, 10 aa, Mycobacterium
AGPLGAQAAN

SEQ ID NO: 386803 - protein, 4 aa, Mycobacterium
AGPP

SEQ ID NO: 386804 - protein, 6 aa, Mycobacterium
AGPQVG

SEQ ID NO: 386805 - protein, 4 aa, Mycobacterium
AGPS

SEQ ID NO: 386806 - protein, 5 aa, Mycobacterium
AGPSA

SEQ ID NO: 386807 - protein, 9 aa, Mycobacterium
AGPSGSPLR

SEQ ID NO: 386808 - protein, 9 aa, Mycobacterium
AGPTESLNA

SEQ ID NO: 386809 - protein, 4 aa, Mycobacterium
AGPV

SEQ ID NO: 386810 - protein, 5 aa, Mycobacterium
AGPVK

SEQ ID NO: 386811 - protein, 14 aa, Mycobacterium
AGQANPAPPVGPAL

SEQ ID NO: 386812 - protein, 5 aa, Mycobacterium
AGQKG

SEQ ID NO: 386813 - protein, 4 aa, Mycobacterium
AGQL

SEQ ID NO: 386814 - protein, 9 aa, Mycobacterium
AGRALTGGG

SEQ ID NO: 386815 - protein, 18 aa, Mycobacterium
AGRANKARLNRSPVRSTR

SEQ ID NO: 386816 - protein, 4 aa, Mycobacterium
AGRD

SEQ ID NO: 386817 - protein, 6 aa, Mycobacterium
AGRDDP

SEQ ID NO: 386818 - protein, 8 aa, Mycobacterium
AGRGDRGL

SEQ ID NO: 386819 - protein, 11 aa, Mycobacterium
AGRLEGKSSLG

SEQ ID NO: 386820 - protein, 8 aa, Mycobacterium
AGRPGRNL

SEQ ID NO: 386821 - protein, 8 aa, Mycobacterium
AGRPSPLY

SEQ ID NO: 386822 - protein, 9 aa, Mycobacterium
AGRPTRANF

SEQ ID NO: 386823 - protein, 5 aa, Mycobacterium
AGRRD

SEQ ID NO: 386824 - protein, 6 aa, Mycobacterium
AGRSDN

SEQ ID NO: 386825 - protein, 5 aa, Mycobacterium
AGRSQ

SEQ ID NO: 386826 - protein, 7 aa, Mycobacterium
AGRYGPP

SEQ ID NO: 386827 - protein, 5 aa, Mycobacterium
AGSGA

SEQ ID NO: 386828 - protein, 4 aa, Mycobacterium
AGSR

SEQ ID NO: 386829 - protein, 4 aa, Mycobacterium
AGSS

SEQ ID NO: 386830 - protein, 8 aa, Mycobacterium
AGSSPRGV

SEQ ID NO: 386831 - protein, 10 aa, Mycobacterium
AGSSTVPGVG

SEQ ID NO: 386832 - protein, 5 aa, Mycobacterium
AGSSV

SEQ ID NO: 386833 - protein, 6 aa, Mycobacterium
AGSSVD

SEQ ID NO: 386834 - protein, 4 aa, Mycobacterium
AGSV

SEQ ID NO: 386835 - protein, 9 aa, Mycobacterium
AGTDTTRNQ

SEQ ID NO: 386836 - protein, 9 aa, Mycobacterium
AGTGNDHAR

SEQ ID NO: 386837 - protein, 8 aa, Mycobacterium
AGTGTGKS

SEQ ID NO: 386838 - protein, 7 aa, Mycobacterium
AGTNPTL

SEQ ID NO: 386839 - protein, 7 aa, Mycobacterium
AGTPGKR

SEQ ID NO: 386840 - protein, 8 aa, Mycobacterium
AGTPGKRM

SEQ ID NO: 386841 - protein, 11 aa, Mycobacterium
AGTSFATPDKL

SEQ ID NO: 386842 - protein, 5 aa, Mycobacterium
AGTSL

SEQ ID NO: 386843 - protein, 9 aa, Mycobacterium
AGTTGYSEQ

SEQ ID NO: 386844 - protein, 7 aa, Mycobacterium
AGTYDTA

SEQ ID NO: 386845 - protein, 4 aa, Mycobacterium
AGVA

SEQ ID NO: 386846 - protein, 6 aa, Mycobacterium
AGVETT

SEQ ID NO: 386847 - protein, 6 aa, Mycobacterium
AGVGGR

SEQ ID NO: 386848 - protein, 7 aa, Mycobacterium
AGVGGRA

SEQ ID NO: 386849 - protein, 6 aa, Mycobacterium
AGVGKG

SEQ ID NO: 386850 - protein, 6 aa, Mycobacterium
AGVSHA

SEQ ID NO: 386851 - protein, 7 aa, Mycobacterium
AGVTGAA

SEQ ID NO: 386852 - protein, 8 aa, Mycobacterium
AGVTPEQA

SEQ ID NO: 386853 - protein, 4 aa, Mycobacterium
AGYD

SEQ ID NO: 386854 - protein, 11 aa, Mycobacterium
AGYEDALTGEG

SEQ ID NO: 386855 - protein, 18 aa, Mycobacterium
AGYGERSAERTNSRNGYR

SEQ ID NO: 386856 - protein, 4 aa, Mycobacterium
AHDR

SEQ ID NO: 386857 - protein, 13 aa, Mycobacterium
AHDYDDPGKPAIT

SEQ ID NO: 386858 - protein, 4 aa, Mycobacterium
AHEF

SEQ ID NO: 386859 - protein, 4 aa, Mycobacterium
AHER

SEQ ID NO: 386860 - protein, 4 aa, Mycobacterium
AHGQ

SEQ ID NO: 386861 - protein, 9 aa, Mycobacterium
AHKRTGVPI

SEQ ID NO: 386862 - protein, 5 aa, Mycobacterium
AHPDV

SEQ ID NO: 386863 - protein, 6 aa, Mycobacterium
AHPGTT

SEQ ID NO: 386864 - protein, 7 aa, Mycobacterium
AHSRSPQ

SEQ ID NO: 386865 - protein, 12 aa, Mycobacterium
AIPRTTSGKLAR

SEQ ID NO: 386866 - protein, 10 aa, Mycobacterium
AISAGDQSIG

SEQ ID NO: 386867 - protein, 8 aa, Mycobacterium
AITDPGAV

SEQ ID NO: 386868 - protein, 9 aa, Mycobacterium
AITGSESDQ

SEQ ID NO: 386869 - protein, 6 aa, Mycobacterium
AKAGAT

SEQ ID NO: 386870 - protein, 4 aa, Mycobacterium
AKAI

SEQ ID NO: 386871 - protein, 7 aa, Mycobacterium
AKANGAK

SEQ ID NO: 386872 - protein, 7 aa, Mycobacterium
AKAQADR

SEQ ID NO: 386873 - protein, 14 aa, Mycobacterium
AKDVGKRAERATAE

SEQ ID NO: 386874 - protein, 6 aa, Mycobacterium
AKEQLR

SEQ ID NO: 386875 - protein, 11 aa, Mycobacterium
AKEVETKEQIA

SEQ ID NO: 386876 - protein, 8 aa, Mycobacterium
AKGAGISR

SEQ ID NO: 386877 - protein, 7 aa, Mycobacterium
AKGATLA

SEQ ID NO: 386878 - protein, 4 aa, Mycobacterium
AKGG

SEQ ID NO: 386879 - protein, 7 aa, Mycobacterium
AKGGTSF

SEQ ID NO: 386880 - protein, 8 aa, Mycobacterium
AKGISNFH

SEQ ID NO: 386881 - protein, 4 aa, Mycobacterium
AKGL

SEQ ID NO: 386882 - protein, 7 aa, Mycobacterium
AKIGYPP

SEQ ID NO: 386883 - protein, 6 aa, Mycobacterium
AKLGED

SEQ ID NO: 386884 - protein, 4 aa, Mycobacterium
AKNR

SEQ ID NO: 386885 - protein, 7 aa, Mycobacterium
AKPLSDG

SEQ ID NO: 386886 - protein, 10 aa, Mycobacterium
AKPPPSGSPG

SEQ ID NO: 386887 - protein, 11 aa, Mycobacterium
AKQALKERKTI

SEQ ID NO: 386888 - protein, 4 aa, Mycobacterium
AKQG

SEQ ID NO: 386889 - protein, 10 aa, Mycobacterium
AKQTAKTGAT

SEQ ID NO: 386890 - protein, 7 aa, Mycobacterium
AKRDGDR

SEQ ID NO: 386891 - protein, 7 aa, Mycobacterium
AKSGTAH

SEQ ID NO: 386892 - protein, 4 aa, Mycobacterium
AKSM

SEQ ID NO: 386893 - protein, 14 aa, Mycobacterium
AKTGGEVGVTTGRA

SEQ ID NO: 386894 - protein, 10 aa, Mycobacterium
AKTPKQKRDR

SEQ ID NO: 386895 - protein, 8 aa, Mycobacterium
AKVTSEGE

SEQ ID NO: 386896 - protein, 6 aa, Mycobacterium
AKYPGT

SEQ ID NO: 386897 - protein, 4 aa, Mycobacterium
ALAA

SEQ ID NO: 386898 - protein, 9 aa, Mycobacterium
ALAGGGPKY

SEQ ID NO: 386899 - protein, 11 aa, Mycobacterium
ALAGNGTPEQL

SEQ ID NO: 386900 - protein, 5 aa, Mycobacterium
ALDDT

SEQ ID NO: 386901 - protein, 11 aa, Mycobacterium
ALDGPSGPAAD

SEQ ID NO: 386902 - protein, 38 aa, Mycobacterium
ALESAAAGAGCAAGAAGAAGSALAARGAHGARTDHGGV

SEQ ID NO: 386903 - protein, 6 aa, Mycobacterium
ALGEPS

SEQ ID NO: 386904 - protein, 20 aa, Mycobacterium
ALGGQDNTVSAQAGAGGANI

SEQ ID NO: 386905 - protein, 20 aa, Mycobacterium
ALGGQGNTVSAESGGAGANI

SEQ ID NO: 386906 - protein, 6 aa, Mycobacterium
ALGGRQ

SEQ ID NO: 386907 - protein, 6 aa, Mycobacterium
ALGKGA

SEQ ID NO: 386908 - protein, 6 aa, Mycobacterium
ALGRPH

SEQ ID NO: 386909 - protein, 7 aa, Mycobacterium
ALPAGVE

SEQ ID NO: 386910 - protein, 8 aa, Mycobacterium
ALPAPQFT

SEQ ID NO: 386911 - protein, 12 aa, Mycobacterium
ALPGGDAIGSRP

SEQ ID NO: 386912 - protein, 5 aa, Mycobacterium
ALPGL

SEQ ID NO: 386913 - protein, 5 aa, Mycobacterium
ALPNK

SEQ ID NO: 386914 - protein, 5 aa, Mycobacterium
ALQTK

SEQ ID NO: 386915 - protein, 7 aa, Mycobacterium
ALRDDGS

SEQ ID NO: 386916 - protein, 6 aa, Mycobacterium
ALRDGD

SEQ ID NO: 386917 - protein, 6 aa, Mycobacterium
ALRPGD

SEQ ID NO: 386918 - protein, 10 aa, Mycobacterium
ALSDRARNGR

SEQ ID NO: 386919 - protein, 4 aa, Mycobacterium
ALTE

SEQ ID NO: 386920 - protein, 10 aa, Mycobacterium
AMATKDPRGL

SEQ ID NO: 386921 - protein, 8 aa, Mycobacterium
AMKGNLAK

SEQ ID NO: 386922 - protein, 4 aa, Mycobacterium
AMPG

SEQ ID NO: 386923 - protein, 17 aa, Mycobacterium
AMRERSELARKGIARGK

SEQ ID NO: 386924 - protein, 4 aa, Mycobacterium
ANAA

SEQ ID NO: 386925 - protein, 5 aa, Mycobacterium
ANASP

SEQ ID NO: 386926 - protein, 7 aa, Mycobacterium
ANDSANN

SEQ ID NO: 386927 - protein, 6 aa, Mycobacterium
ANEPEP

SEQ ID NO: 386928 - protein, 4 aa, Mycobacterium
ANGA

SEQ ID NO: 386929 - protein, 8 aa, Mycobacterium
ANGAGKST

SEQ ID NO: 386930 - protein, 6 aa, Mycobacterium
ANGDPL

SEQ ID NO: 386931 - protein, 6 aa, Mycobacterium
ANGGWS

SEQ ID NO: 386932 - protein, 7 aa, Mycobacterium
ANGLQGS

SEQ ID NO: 386933 - protein, 7 aa, Mycobacterium
ANKARPI

SEQ ID NO: 386934 - protein, 13 aa, Mycobacterium
ANLTRNAADFGGS

SEQ ID NO: 386935 - protein, 8 aa, Mycobacterium
ANPDDRAT

SEQ ID NO: 386936 - protein, 5 aa, Mycobacterium
ANPDL

SEQ ID NO: 386937 - protein, 9 aa, Mycobacterium
ANPDRGTLS

SEQ ID NO: 386938 - protein, 13 aa, Mycobacterium
ANPDSHEQPWDKK

SEQ ID NO: 386939 - protein, 7 aa, Mycobacterium
ANPGRRG

SEQ ID NO: 386940 - protein, 4 aa, Mycobacterium
ANPR

SEQ ID NO: 386941 - protein, 5 aa, Mycobacterium
ANPRY

SEQ ID NO: 386942 - protein, 5 aa, Mycobacterium
ANPTV

SEQ ID NO: 386943 - protein, 5 aa, Mycobacterium
ANQLP

SEQ ID NO: 386944 - protein, 7 aa, Mycobacterium
ANRDEDV

SEQ ID NO: 386945 - protein, 7 aa, Mycobacterium
ANRDEEV

SEQ ID NO: 386946 - protein, 7 aa, Mycobacterium
ANRDPAV

SEQ ID NO: 386947 - protein, 7 aa, Mycobacterium
ANRDPKV

SEQ ID NO: 386948 - protein, 8 aa, Mycobacterium
ANRNAAGQ

SEQ ID NO: 386949 - protein, 7 aa, Mycobacterium
ANSGLGA

SEQ ID NO: 386950 - protein, 30 aa, Mycobacterium
ANTGWGNAGAYNSGGFNAGAYNTGSFNPGH

SEQ ID NO: 386951 - protein, 7 aa, Mycobacterium
ANTLEAT

SEQ ID NO: 386952 - protein, 5 aa, Mycobacterium
ANTYP

SEQ ID NO: 386953 - protein, 6 aa, Mycobacterium
ANVRTR

SEQ ID NO: 386954 - protein, 4 aa, Mycobacterium
APAE

SEQ ID NO: 386955 - protein, 8 aa, Mycobacterium
APAKTSAA

SEQ ID NO: 386956 - protein, 6 aa, Mycobacterium
APAKVV

SEQ ID NO: 386957 - protein, 4 aa, Mycobacterium
APAQ

SEQ ID NO: 386958 - protein, 9 aa, Mycobacterium
APASADRSR

SEQ ID NO: 386959 - protein, 8 aa, Mycobacterium
APASDAAG

SEQ ID NO: 386960 - protein, 7 aa, Mycobacterium
APATDED

SEQ ID NO: 386961 - protein, 4 aa, Mycobacterium
APAY

SEQ ID NO: 386962 - protein, 5 aa, Mycobacterium
APDAE

SEQ ID NO: 386963 - protein, 8 aa, Mycobacterium
APDEQNRR

SEQ ID NO: 386964 - protein, 8 aa, Mycobacterium
APDESPRS

SEQ ID NO: 386965 - protein, 5 aa, Mycobacterium
APDEV

SEQ ID NO: 386966 - protein, 7 aa, Mycobacterium
APDIPRE

SEQ ID NO: 386967 - protein, 6 aa, Mycobacterium
APEDMG

SEQ ID NO: 386968 - protein, 5 aa, Mycobacterium
APENV

SEQ ID NO: 386969 - protein, 5 aa, Mycobacterium
APEPV

SEQ ID NO: 386970 - protein, 15 aa, Mycobacterium
APFGGYKQSGNGREM

SEQ ID NO: 386971 - protein, 5 aa, Mycobacterium
APFPT

SEQ ID NO: 386972 - protein, 4 aa, Mycobacterium
APFQ

SEQ ID NO: 386973 - protein, 4 aa, Mycobacterium
APFT

SEQ ID NO: 386974 - protein, 7 aa, Mycobacterium
APGAQSQ

SEQ ID NO: 386975 - protein, 6 aa, Mycobacterium
APGDDR

SEQ ID NO: 386976 - protein, 5 aa, Mycobacterium
APGEL

SEQ ID NO: 386977 - protein, 4 aa, Mycobacterium
APGF

SEQ ID NO: 386978 - protein, 5 aa, Mycobacterium
APGHE

SEQ ID NO: 386979 - protein, 5 aa, Mycobacterium
APGPI

SEQ ID NO: 386980 - protein, 7 aa, Mycobacterium
APGSRMY

SEQ ID NO: 386981 - protein, 6 aa, Mycobacterium
APGTLA

SEQ ID NO: 386982 - protein, 5 aa, Mycobacterium
APGTP

SEQ ID NO: 386983 - protein, 6 aa, Mycobacterium
APGTRM

SEQ ID NO: 386984 - protein, 4 aa, Mycobacterium
APIT

SEQ ID NO: 386985 - protein, 4 aa, Mycobacterium
APLG

SEQ ID NO: 386986 - protein, 10 aa, Mycobacterium
APMQSGDDGW

SEQ ID NO: 386987 - protein, 6 aa, Mycobacterium
APNTGN

SEQ ID NO: 386988 - protein, 12 aa, Mycobacterium
APNYSPGHGAGH

SEQ ID NO: 386989 - protein, 5 aa, Mycobacterium
APPGI

SEQ ID NO: 386990 - protein, 7 aa, Mycobacterium
APPGSPA

SEQ ID NO: 386991 - protein, 5 aa, Mycobacterium
APPGV

SEQ ID NO: 386992 - protein, 6 aa, Mycobacterium
APPHGG

SEQ ID NO: 386993 - protein, 9 aa, Mycobacterium
APPKGSARK

SEQ ID NO: 386994 - protein, 4 aa, Mycobacterium
APPL

SEQ ID NO: 386995 - protein, 8 aa, Mycobacterium
APPSVASG

SEQ ID NO: 386996 - protein, 4 aa, Mycobacterium
APPT

SEQ ID NO: 386997 - protein, 4 aa, Mycobacterium
APPW

SEQ ID NO: 386998 - protein, 7 aa, Mycobacterium
APPYNRR

SEQ ID NO: 386999 - protein, 12 aa, Mycobacterium
APQLSTSDGRGP

SEQ ID NO: 387000 - protein, 16 aa, Mycobacterium
APRADVSAAGLDQPEH

SEQ ID NO: 387001 - protein, 4 aa, Mycobacterium
APRD

SEQ ID NO: 387002 - protein, 4 aa, Mycobacterium
APRG

SEQ ID NO: 387003 - protein, 4 aa, Mycobacterium
APRQ

SEQ ID NO: 387004 - protein, 7 aa, Mycobacterium
APRSPSD

SEQ ID NO: 387005 - protein, 5 aa, Mycobacterium
APRTL

SEQ ID NO: 387006 - protein, 4 aa, Mycobacterium
APSE

SEQ ID NO: 387007 - protein, 4 aa, Mycobacterium
APSG

SEQ ID NO: 387008 - protein, 11 aa, Mycobacterium
APSGGGTDVTE

SEQ ID NO: 387009 - protein, 4 aa, Mycobacterium
APSK

SEQ ID NO: 387010 - protein, 4 aa, Mycobacterium
APSL

SEQ ID NO: 387011 - protein, 10 aa, Mycobacterium
APSPALHGHR

SEQ ID NO: 387012 - protein, 4 aa, Mycobacterium
APTP

SEQ ID NO: 387013 - protein, 5 aa, Mycobacterium
APTQR

SEQ ID NO: 387014 - protein, 7 aa, Mycobacterium
APTSTAA

SEQ ID NO: 387015 - protein, 4 aa, Mycobacterium
APTT

SEQ ID NO: 387016 - protein, 4 aa, Mycobacterium
APVG

SEQ ID NO: 387017 - protein, 5 aa, Mycobacterium
APVSG

SEQ ID NO: 387018 - protein, 4 aa, Mycobacterium
APYP

SEQ ID NO: 387019 - protein, 4 aa, Mycobacterium
AQAD

SEQ ID NO: 387020 - protein, 8 aa, Mycobacterium
AQAGVSRP

SEQ ID NO: 387021 - protein, 6 aa, Mycobacterium
AQAKDA

SEQ ID NO: 387022 - protein, 14 aa, Mycobacterium
AQAPARRGRHKNIP

SEQ ID NO: 387023 - protein, 4 aa, Mycobacterium
AQDP

SEQ ID NO: 387024 - protein, 5 aa, Mycobacterium
AQDTR

SEQ ID NO: 387025 - protein, 7 aa, Mycobacterium
AQEAGRD

SEQ ID NO: 387026 - protein, 5 aa, Mycobacterium
AQGGG

SEQ ID NO: 387027 - protein, 4 aa, Mycobacterium
AQGL

SEQ ID NO: 387028 - protein, 8 aa, Mycobacterium
AQGPGGIA

SEQ ID NO: 387029 - protein, 4 aa, Mycobacterium
AQGR

SEQ ID NO: 387030 - protein, 6 aa, Mycobacterium
AQIPDE

SEQ ID NO: 387031 - protein, 7 aa, Mycobacterium
AQNAASF

SEQ ID NO: 387032 - protein, 4 aa, Mycobacterium
AQPD

SEQ ID NO: 387033 - protein, 6 aa, Mycobacterium
AQPQYV

SEQ ID NO: 387034 - protein, 4 aa, Mycobacterium
AQQG

SEQ ID NO: 387035 - protein, 4 aa, Mycobacterium
AQQL

SEQ ID NO: 387036 - protein, 6 aa, Mycobacterium
AQRAQT

SEQ ID NO: 387037 - protein, 8 aa, Mycobacterium
AQRASREI

SEQ ID NO: 387038 - protein, 6 aa, Mycobacterium
AQRGAE

SEQ ID NO: 387039 - protein, 5 aa, Mycobacterium
AQRGT

SEQ ID NO: 387040 - protein, 12 aa, Mycobacterium
AQRQATKDAGQI

SEQ ID NO: 387041 - protein, 5 aa, Mycobacterium
AQRQL

SEQ ID NO: 387042 - protein, 10 aa, Mycobacterium
AQSPDIAQGV

SEQ ID NO: 387043 - protein, 5 aa, Mycobacterium
AQSRL

SEQ ID NO: 387044 - protein, 6 aa, Mycobacterium
AQTAGV

SEQ ID NO: 387045 - protein, 6 aa, Mycobacterium
AQTERF

SEQ ID NO: 387046 - protein, 10 aa, Mycobacterium
AQTESEQMKE

SEQ ID NO: 387047 - protein, 4 aa, Mycobacterium
AQTG

SEQ ID NO: 387048 - protein, 6 aa, Mycobacterium
AQTSGG

SEQ ID NO: 387049 - protein, 4 aa, Mycobacterium
AQTV

SEQ ID NO: 387050 - protein, 5 aa, Mycobacterium
ARAAG

SEQ ID NO: 387051 - protein, 4 aa, Mycobacterium
ARAN

SEQ ID NO: 387052 - protein, 4 aa, Mycobacterium
ARAR

SEQ ID NO: 387053 - protein, 4 aa, Mycobacterium
ARAS

SEQ ID NO: 387054 - protein, 4 aa, Mycobacterium
ARDG

SEQ ID NO: 387055 - protein, 10 aa, Mycobacterium
ARDGKLTAED

SEQ ID NO: 387056 - protein, 11 aa, Mycobacterium
ARDGKLTAEDF

SEQ ID NO: 387057 - protein, 4 aa, Mycobacterium
ARDR

SEQ ID NO: 387058 - protein, 7 aa, Mycobacterium
ARDSAPS

SEQ ID NO: 387059 - protein, 6 aa, Mycobacterium
AREGGL

SEQ ID NO: 387060 - protein, 14 aa, Mycobacterium
AREQPLAGVSGASV

SEQ ID NO: 387061 - protein, 4 aa, Mycobacterium
ARER

SEQ ID NO: 387062 - protein, 9 aa, Mycobacterium
AREREQFDR

SEQ ID NO: 387063 - protein, 5 aa, Mycobacterium
ARERG

SEQ ID NO: 387064 - protein, 5 aa, Mycobacterium
ARGAT

SEQ ID NO: 387065 - protein, 4 aa, Mycobacterium
ARGE

SEQ ID NO: 387066 - protein, 5 aa, Mycobacterium
ARGIG

SEQ ID NO: 387067 - protein, 6 aa, Mycobacterium
ARGIGA

SEQ ID NO: 387068 - protein, 8 aa, Mycobacterium
ARGQGRSH

SEQ ID NO: 387069 - protein, 4 aa, Mycobacterium
ARGR

SEQ ID NO: 387070 - protein, 5 aa, Mycobacterium
ARGSG

SEQ ID NO: 387071 - protein, 10 aa, Mycobacterium
ARGTKYPDEV

SEQ ID NO: 387072 - protein, 7 aa, Mycobacterium
ARHSSGL

SEQ ID NO: 387073 - protein, 4 aa, Mycobacterium
ARID

SEQ ID NO: 387074 - protein, 5 aa, Mycobacterium
ARMAP

SEQ ID NO: 387075 - protein, 13 aa, Mycobacterium
ARPITERKEAAVI

SEQ ID NO: 387076 - protein, 6 aa, Mycobacterium
ARPPVG

SEQ ID NO: 387077 - protein, 4 aa, Mycobacterium
ARQA

SEQ ID NO: 387078 - protein, 5 aa, Mycobacterium
ARQLP

SEQ ID NO: 387079 - protein, 4 aa, Mycobacterium
ARRA

SEQ ID NO: 387080 - protein, 5 aa, Mycobacterium
ARRGD

SEQ ID NO: 387081 - protein, 4 aa, Mycobacterium
ARRN

SEQ ID NO: 387082 - protein, 5 aa, Mycobacterium
ARRRT

SEQ ID NO: 387083 - protein, 9 aa, Mycobacterium
ARRSGASWT

SEQ ID NO: 387084 - protein, 5 aa, Mycobacterium
ARSAR

SEQ ID NO: 387085 - protein, 11 aa, Mycobacterium
ARSGDKGGSAN

SEQ ID NO: 387086 - protein, 9 aa, Mycobacterium
ARSKAARKV

SEQ ID NO: 387087 - protein, 6 aa, Mycobacterium
ARSPEA

SEQ ID NO: 387088 - protein, 4 aa, Mycobacterium
ARSQ

SEQ ID NO: 387089 - protein, 7 aa, Mycobacterium
ARSQGRK

SEQ ID NO: 387090 - protein, 8 aa, Mycobacterium
ARSRQQAA

SEQ ID NO: 387091 - protein, 15 aa, Mycobacterium
ARSVEGAGPGPEGNV

SEQ ID NO: 387092 - protein, 6 aa, Mycobacterium
ARTGAG

SEQ ID NO: 387093 - protein, 14 aa, Mycobacterium
ARTGGGDPAGNPTL

SEQ ID NO: 387094 - protein, 5 aa, Mycobacterium
ARTGM

SEQ ID NO: 387095 - protein, 4 aa, Mycobacterium
ARTT

SEQ ID NO: 387096 - protein, 8 aa, Mycobacterium
ARTTESQV

SEQ ID NO: 387097 - protein, 9 aa, Mycobacterium
ARVTTDEEI

SEQ ID NO: 387098 - protein, 5 aa, Mycobacterium
ARYDA

SEQ ID NO: 387099 - protein, 5 aa, Mycobacterium
ARYGS

SEQ ID NO: 387100 - protein, 5 aa, Mycobacterium
ASAAQ

SEQ ID NO: 387101 - protein, 6 aa, Mycobacterium
ASAAQE

SEQ ID NO: 387102 - protein, 6 aa, Mycobacterium
ASAATL

SEQ ID NO: 387103 - protein, 9 aa, Mycobacterium
ASADLERQV

SEQ ID NO: 387104 - protein, 4 aa, Mycobacterium
ASAR

SEQ ID NO: 387105 - protein, 4 aa, Mycobacterium
ASAS

SEQ ID NO: 387106 - protein, 4 aa, Mycobacterium
ASAV

SEQ ID NO: 387107 - protein, 7 aa, Mycobacterium
ASAVPER

SEQ ID NO: 387108 - protein, 6 aa, Mycobacterium
ASDEEA

SEQ ID NO: 387109 - protein, 6 aa, Mycobacterium
ASDGRI

SEQ ID NO: 387110 - protein, 4 aa, Mycobacterium
ASDL

SEQ ID NO: 387111 - protein, 6 aa, Mycobacterium
ASDTGA

SEQ ID NO: 387112 - protein, 4 aa, Mycobacterium
ASER

SEQ ID NO: 387113 - protein, 4 aa, Mycobacterium
ASET

SEQ ID NO: 387114 - protein, 5 aa, Mycobacterium
ASETA

SEQ ID NO: 387115 - protein, 4 aa, Mycobacterium
ASGG

SEQ ID NO: 387116 - protein, 4 aa, Mycobacterium
ASGI

SEQ ID NO: 387117 - protein, 7 aa, Mycobacterium
ASGIGQA

SEQ ID NO: 387118 - protein, 4 aa, Mycobacterium
ASGQ

SEQ ID NO: 387119 - protein, 8 aa, Mycobacterium
ASGQERRT

SEQ ID NO: 387120 - protein, 7 aa, Mycobacterium
ASGSRMR

SEQ ID NO: 387121 - protein, 8 aa, Mycobacterium
ASKGGYEA

SEQ ID NO: 387122 - protein, 10 aa, Mycobacterium
ASKGYRGQRS

SEQ ID NO: 387123 - protein, 7 aa, Mycobacterium
ASKYGLR

SEQ ID NO: 387124 - protein, 6 aa, Mycobacterium
ASLATG

SEQ ID NO: 387125 - protein, 6 aa, Mycobacterium
ASNPRF

SEQ ID NO: 387126 - protein, 7 aa, Mycobacterium
ASNPRFS

SEQ ID NO: 387127 - protein, 8 aa, Mycobacterium
ASPAISNR

SEQ ID NO: 387128 - protein, 10 aa, Mycobacterium
ASPNGAKRAI

SEQ ID NO: 387129 - protein, 8 aa, Mycobacterium
ASPTGARL

SEQ ID NO: 387130 - protein, 10 aa, Mycobacterium
ASQQSRPIAS

SEQ ID NO: 387131 - protein, 4 aa, Mycobacterium
ASQT

SEQ ID NO: 387132 - protein, 7 aa, Mycobacterium
ASRGEPH

SEQ ID NO: 387133 - protein, 7 aa, Mycobacterium
ASRGIGA

SEQ ID NO: 387134 - protein, 6 aa, Mycobacterium
ASRSVP

SEQ ID NO: 387135 - protein, 6 aa, Mycobacterium
ASRTPG

SEQ ID NO: 387136 - protein, 4 aa, Mycobacterium
ASSA

SEQ ID NO: 387137 - protein, 9 aa, Mycobacterium
ASSEAHGST

SEQ ID NO: 387138 - protein, 8 aa, Mycobacterium
ASSGIGAA

SEQ ID NO: 387139 - protein, 6 aa, Mycobacterium
ASSIEA

SEQ ID NO: 387140 - protein, 7 aa, Mycobacterium
ASSYCSG

SEQ ID NO: 387141 - protein, 7 aa, Mycobacterium
ASSYMTG

SEQ ID NO: 387142 - protein, 6 aa, Mycobacterium
ASTGSD

SEQ ID NO: 387143 - protein, 8 aa, Mycobacterium
ASTHESNT

SEQ ID NO: 387144 - protein, 5 aa, Mycobacterium
ATAAA

SEQ ID NO: 387145 - protein, 4 aa, Mycobacterium
ATAE

SEQ ID NO: 387146 - protein, 10 aa, Mycobacterium
ATAGSPKRRQ

SEQ ID NO: 387147 - protein, 4 aa, Mycobacterium
ATAL

SEQ ID NO: 387148 - protein, 10 aa, Mycobacterium
ATALSGGEAQ

SEQ ID NO: 387149 - protein, 8 aa, Mycobacterium
ATANAGGL

SEQ ID NO: 387150 - protein, 5 aa, Mycobacterium
ATAPA

SEQ ID NO: 387151 - protein, 5 aa, Mycobacterium
ATATR

SEQ ID NO: 387152 - protein, 14 aa, Mycobacterium
ATAVRGTLSAPADL

SEQ ID NO: 387153 - protein, 13 aa, Mycobacterium
ATDARRHTREETP

SEQ ID NO: 387154 - protein, 7 aa, Mycobacterium
ATDEVGQ

SEQ ID NO: 387155 - protein, 10 aa, Mycobacterium
ATDGPSAQAA

SEQ ID NO: 387156 - protein, 8 aa, Mycobacterium
ATDGRTAA

SEQ ID NO: 387157 - protein, 10 aa, Mycobacterium
ATDPPPGKDR

SEQ ID NO: 387158 - protein, 5 aa, Mycobacterium
ATDRP

SEQ ID NO: 387159 - protein, 4 aa, Mycobacterium
ATDV

SEQ ID NO: 387160 - protein, 4 aa, Mycobacterium
ATEA

SEQ ID NO: 387161 - protein, 4 aa, Mycobacterium
ATER

SEQ ID NO: 387162 - protein, 6 aa, Mycobacterium
ATERGD

SEQ ID NO: 387163 - protein, 7 aa, Mycobacterium
ATEYGSP

SEQ ID NO: 387164 - protein, 4 aa, Mycobacterium
ATFG

SEQ ID NO: 387165 - protein, 16 aa, Mycobacterium
ATFPDGTKLVTVHHPI

SEQ ID NO: 387166 - protein, 4 aa, Mycobacterium
ATGG

SEQ ID NO: 387167 - protein, 9 aa, Mycobacterium
ATGGRGADS

SEQ ID NO: 387168 - protein, 4 aa, Mycobacterium
ATGH

SEQ ID NO: 387169 - protein, 6 aa, Mycobacterium
ATGKGA

SEQ ID NO: 387170 - protein, 7 aa, Mycobacterium
ATGKPGR

SEQ ID NO: 387171 - protein, 6 aa, Mycobacterium
ATGNSV

SEQ ID NO: 387172 - protein, 6 aa, Mycobacterium
ATGPQQ

SEQ ID NO: 387173 - protein, 4 aa, Mycobacterium
ATGR

SEQ ID NO: 387174 - protein, 5 aa, Mycobacterium
ATGSA

SEQ ID NO: 387175 - protein, 4 aa, Mycobacterium
ATGT

SEQ ID NO: 387176 - protein, 9 aa, Mycobacterium
ATGTTVSPP

SEQ ID NO: 387177 - protein, 4 aa, Mycobacterium
ATGY

SEQ ID NO: 387178 - protein, 4 aa, Mycobacterium
ATHA

SEQ ID NO: 387179 - protein, 4 aa, Mycobacterium
ATHR

SEQ ID NO: 387180 - protein, 7 aa, Mycobacterium
ATKNPQR

SEQ ID NO: 387181 - protein, 7 aa, Mycobacterium
ATKPERL

SEQ ID NO: 387182 - protein, 15 aa, Mycobacterium
ATLDPAGILNPGKLI

SEQ ID NO: 387183 - protein, 4 aa, Mycobacterium
ATLP

SEQ ID NO: 387184 - protein, 6 aa, Mycobacterium
ATLPSG

SEQ ID NO: 387185 - protein, 4 aa, Mycobacterium
ATPE

SEQ ID NO: 387186 - protein, 9 aa, Mycobacterium
ATPGSGKTT

SEQ ID NO: 387187 - protein, 7 aa, Mycobacterium
ATPPPTG

SEQ ID NO: 387188 - protein, 4 aa, Mycobacterium
ATPS

SEQ ID NO: 387189 - protein, 5 aa, Mycobacterium
ATPSI

SEQ ID NO: 387190 - protein, 4 aa, Mycobacterium
ATPV

SEQ ID NO: 387191 - protein, 4 aa, Mycobacterium
ATRA

SEQ ID NO: 387192 - protein, 7 aa, Mycobacterium
ATRGGVG

SEQ ID NO: 387193 - protein, 5 aa, Mycobacterium
ATRHH

SEQ ID NO: 387194 - protein, 4 aa, Mycobacterium
ATRP

SEQ ID NO: 387195 - protein, 14 aa, Mycobacterium
ATRSSGQDSAGYGR

SEQ ID NO: 387196 - protein, 4 aa, Mycobacterium
ATRT

SEQ ID NO: 387197 - protein, 11 aa, Mycobacterium
ATRYDPGGGGI

SEQ ID NO: 387198 - protein, 17 aa, Mycobacterium
ATSAKGSTTEDPGPDLA

SEQ ID NO: 387199 - protein, 8 aa, Mycobacterium
ATSRPSAL

SEQ ID NO: 387200 - protein, 9 aa, Mycobacterium
ATSRPSPLS

SEQ ID NO: 387201 - protein, 4 aa, Mycobacterium
ATTA

SEQ ID NO: 387202 - protein, 4 aa, Mycobacterium
ATTG

SEQ ID NO: 387203 - protein, 12 aa, Mycobacterium
ATTRAPRPGEVD

SEQ ID NO: 387204 - protein, 12 aa, Mycobacterium
ATTRSGALTGPL

SEQ ID NO: 387205 - protein, 7 aa, Mycobacterium
ATTSRAH

SEQ ID NO: 387206 - protein, 8 aa, Mycobacterium
ATTSRAHT

SEQ ID NO: 387207 - protein, 4 aa, Mycobacterium
ATVG

SEQ ID NO: 387208 - protein, 5 aa, Mycobacterium
ATYDG

SEQ ID NO: 387209 - protein, 4 aa, Mycobacterium
AVAD

SEQ ID NO: 387210 - protein, 7 aa, Mycobacterium
AVAREDS

SEQ ID NO: 387211 - protein, 5 aa, Mycobacterium
AVDAD

SEQ ID NO: 387212 - protein, 6 aa, Mycobacterium
AVDADD

SEQ ID NO: 387213 - protein, 9 aa, Mycobacterium
AVDPPGDAR

SEQ ID NO: 387214 - protein, 4 aa, Mycobacterium
AVEA

SEQ ID NO: 387215 - protein, 12 aa, Mycobacterium
AVEPGQPLDQQE

SEQ ID NO: 387216 - protein, 4 aa, Mycobacterium
AVGE

SEQ ID NO: 387217 - protein, 11 aa, Mycobacterium
AVGSSADNALA

SEQ ID NO: 387218 - protein, 8 aa, Mycobacterium
AVPAQDPL

SEQ ID NO: 387219 - protein, 5 aa, Mycobacterium
AVPDG

SEQ ID NO: 387220 - protein, 21 aa, Mycobacterium
AVRGKRRTITTASEQGAPRHP

SEQ ID NO: 387221 - protein, 4 aa, Mycobacterium
AVRK

SEQ ID NO: 387222 - protein, 4 aa, Mycobacterium
AVRP

SEQ ID NO: 387223 - protein, 11 aa, Mycobacterium
AVSSAQARIAA

SEQ ID NO: 387224 - protein, 8 aa, Mycobacterium
AVSSNPDA

SEQ ID NO: 387225 - protein, 6 aa, Mycobacterium
AVTGKG

SEQ ID NO: 387226 - protein, 6 aa, Mycobacterium
AVTPRT

SEQ ID NO: 387227 - protein, 5 aa, Mycobacterium
AYEEN

SEQ ID NO: 387228 - protein, 4 aa, Mycobacterium
AYGG

SEQ ID NO: 387229 - protein, 4 aa, Mycobacterium
AYGQ

SEQ ID NO: 387230 - protein, 5 aa, Mycobacterium
AYGQS

SEQ ID NO: 387231 - protein, 9 aa, Mycobacterium
AYGREGEPC

SEQ ID NO: 387232 - protein, 16 aa, Mycobacterium
AYNGPNTVLSGPGEDL

SEQ ID NO: 387233 - protein, 6 aa, Mycobacterium
AYPTPY

SEQ ID NO: 387234 - protein, 6 aa, Mycobacterium
AYTGNP

SEQ ID NO: 387235 - protein, 8 aa, Mycobacterium
AYTTGRGS

SEQ ID NO: 387236 - protein, 14 aa, Mycobacterium
CANRDPGHLDSPSF

SEQ ID NO: 387237 - protein, 11 aa, Mycobacterium
CASGSQALQSA

SEQ ID NO: 387238 - protein, 8 aa, Mycobacterium
CDAGQTRK

SEQ ID NO: 387239 - protein, 7 aa, Mycobacterium
CDEANSA

SEQ ID NO: 387240 - protein, 21 aa, Mycobacterium
CDPDSKAYYQRKRDEGKRPIP

SEQ ID NO: 387241 - protein, 5 aa, Mycobacterium
CGATR

SEQ ID NO: 387242 - protein, 4 aa, Mycobacterium
CGGA

SEQ ID NO: 387243 - protein, 9 aa, Mycobacterium
CGGRGEVQT

SEQ ID NO: 387244 - protein, 7 aa, Mycobacterium
CGNEEAN

SEQ ID NO: 387245 - protein, 7 aa, Mycobacterium
CGPDGTA

SEQ ID NO: 387246 - protein, 5 aa, Mycobacterium
CNTAR

SEQ ID NO: 387247 - protein, 5 aa, Mycobacterium
CPLND

SEQ ID NO: 387248 - protein, 6 aa, Mycobacterium
CPLNDG

SEQ ID NO: 387249 - protein, 4 aa, Mycobacterium
CPPA

SEQ ID NO: 387250 - protein, 8 aa, Mycobacterium
CPPPDEPV

SEQ ID NO: 387251 - protein, 17 aa, Mycobacterium
CPPPDEPVTNLSGGERR

SEQ ID NO: 387252 - protein, 10 aa, Mycobacterium
CRSTDPRKSE

SEQ ID NO: 387253 - protein, 10 aa, Mycobacterium
CRSTDPSKSE

SEQ ID NO: 387254 - protein, 5 aa, Mycobacterium
CSSGT

SEQ ID NO: 387255 - protein, 9 aa, Mycobacterium
CTGSPGCAH

SEQ ID NO: 387256 - protein, 5 aa, Mycobacterium
CTPAE

SEQ ID NO: 387257 - protein, 5 aa, Mycobacterium
CTPCR

SEQ ID NO: 387258 - protein, 6 aa, Mycobacterium
CTPETP

SEQ ID NO: 387259 - protein, 8 aa, Mycobacterium
CTTSIDGR

SEQ ID NO: 387260 - protein, 5 aa, Mycobacterium
DAAAA

SEQ ID NO: 387261 - protein, 5 aa, Mycobacterium
DAAAG

SEQ ID NO: 387262 - protein, 7 aa, Mycobacterium
DAAGRAA

SEQ ID NO: 387263 - protein, 6 aa, Mycobacterium
DAAGRD

SEQ ID NO: 387264 - protein, 6 aa, Mycobacterium
DAAGVT

SEQ ID NO: 387265 - protein, 7 aa, Mycobacterium
DAALGRP

SEQ ID NO: 387266 - protein, 4 aa, Mycobacterium
DAAQ

SEQ ID NO: 387267 - protein, 4 aa, Mycobacterium
DAAR

SEQ ID NO: 387268 - protein, 6 aa, Mycobacterium
DAARYA

SEQ ID NO: 387269 - protein, 4 aa, Mycobacterium
DAAS

SEQ ID NO: 387270 - protein, 4 aa, Mycobacterium
DAAT

SEQ ID NO: 387271 - protein, 6 aa, Mycobacterium
DAATAR

SEQ ID NO: 387272 - protein, 4 aa, Mycobacterium
DADD

SEQ ID NO: 387273 - protein, 7 aa, Mycobacterium
DADFGAR

SEQ ID NO: 387274 - protein, 8 aa, Mycobacterium
DADGSGAA

SEQ ID NO: 387275 - protein, 5 aa, Mycobacterium
DADGV

SEQ ID NO: 387276 - protein, 8 aa, Mycobacterium
DADRNGTM

SEQ ID NO: 387277 - protein, 8 aa, Mycobacterium
DADSAVSP

SEQ ID NO: 387278 - protein, 4 aa, Mycobacterium
DADT

SEQ ID NO: 387279 - protein, 5 aa, Mycobacterium
DAEAY

SEQ ID NO: 387280 - protein, 4 aa, Mycobacterium
DAEE

SEQ ID NO: 387281 - protein, 7 aa, Mycobacterium
DAEGGTG

SEQ ID NO: 387282 - protein, 9 aa, Mycobacterium
DAERGTGGN

SEQ ID NO: 387283 - protein, 5 aa, Mycobacterium
DAGDE

SEQ ID NO: 387284 - protein, 7 aa, Mycobacterium
DAGQARA

SEQ ID NO: 387285 - protein, 4 aa, Mycobacterium
DAGR

SEQ ID NO: 387286 - protein, 6 aa, Mycobacterium
DAGRCQ

SEQ ID NO: 387287 - protein, 5 aa, Mycobacterium
DAGRD

SEQ ID NO: 387288 - protein, 6 aa, Mycobacterium
DALPNG

SEQ ID NO: 387289 - protein, 6 aa, Mycobacterium
DALRDG

SEQ ID NO: 387290 - protein, 11 aa, Mycobacterium
DANASIPTPQP

SEQ ID NO: 387291 - protein, 7 aa, Mycobacterium
DANIGMG

SEQ ID NO: 387292 - protein, 10 aa, Mycobacterium
DANPDRGTLS

SEQ ID NO: 387293 - protein, 8 aa, Mycobacterium
DANTLEAT

SEQ ID NO: 387294 - protein, 4 aa, Mycobacterium
DAPA

SEQ ID NO: 387295 - protein, 22 aa, Mycobacterium
DAPAQAGTESAVSGVEGLPAGS

SEQ ID NO: 387296 - protein, 12 aa, Mycobacterium
DAPDEMSPYAPR

SEQ ID NO: 387297 - protein, 4 aa, Mycobacterium
DAPG

SEQ ID NO: 387298 - protein, 4 aa, Mycobacterium
DAPP

SEQ ID NO: 387299 - protein, 4 aa, Mycobacterium
DAPR

SEQ ID NO: 387300 - protein, 4 aa, Mycobacterium
DAPS

SEQ ID NO: 387301 - protein, 4 aa, Mycobacterium
DAPT

SEQ ID NO: 387302 - protein, 14 aa, Mycobacterium
DAQPRYSAARRDAV

SEQ ID NO: 387303 - protein, 5 aa, Mycobacterium
DAQRL

SEQ ID NO: 387304 - protein, 4 aa, Mycobacterium
DARA

SEQ ID NO: 387305 - protein, 7 aa, Mycobacterium
DARANAR

SEQ ID NO: 387306 - protein, 5 aa, Mycobacterium
DARAT

SEQ ID NO: 387307 - protein, 4 aa, Mycobacterium
DARE

SEQ ID NO: 387308 - protein, 8 aa, Mycobacterium
DARGSYVP

SEQ ID NO: 387309 - protein, 8 aa, Mycobacterium
DARPERDP

SEQ ID NO: 387310 - protein, 7 aa, Mycobacterium
DARRNRH

SEQ ID NO: 387311 - protein, 7 aa, Mycobacterium
DARRSAD

SEQ ID NO: 387312 - protein, 10 aa, Mycobacterium
DASADGYVRS

SEQ ID NO: 387313 - protein, 4 aa, Mycobacterium
DASQ

SEQ ID NO: 387314 - protein, 6 aa, Mycobacterium
DASSTD

SEQ ID NO: 387315 - protein, 5 aa, Mycobacterium
DASSY

SEQ ID NO: 387316 - protein, 4 aa, Mycobacterium
DASY

SEQ ID NO: 387317 - protein, 7 aa, Mycobacterium
DATGERI

SEQ ID NO: 387318 - protein, 8 aa, Mycobacterium
DATRGPGL

SEQ ID NO: 387319 - protein, 8 aa, Mycobacterium
DATTNSTP

SEQ ID NO: 387320 - protein, 4 aa, Mycobacterium
DATV

SEQ ID NO: 387321 - protein, 9 aa, Mycobacterium
DAVDGRPRG

SEQ ID NO: 387322 - protein, 6 aa, Mycobacterium
DAVEDR

SEQ ID NO: 387323 - protein, 4 aa, Mycobacterium
DAVN

SEQ ID NO: 387324 - protein, 4 aa, Mycobacterium
DAVT

SEQ ID NO: 387325 - protein, 4 aa, Mycobacterium
DAYP

SEQ ID NO: 387326 - protein, 7 aa, Mycobacterium
DAYRPTL

SEQ ID NO: 387327 - protein, 6 aa, Mycobacterium
DCRGSG

SEQ ID NO: 387328 - protein, 5 aa, Mycobacterium
DDAAE

SEQ ID NO: 387329 - protein, 8 aa, Mycobacterium
DDAGAAVE

SEQ ID NO: 387330 - protein, 8 aa, Mycobacterium
DDAISTGG

SEQ ID NO: 387331 - protein, 7 aa, Mycobacterium
DDAPGQT

SEQ ID NO: 387332 - protein, 4 aa, Mycobacterium
DDAR

SEQ ID NO: 387333 - protein, 5 aa, Mycobacterium
DDAVD

SEQ ID NO: 387334 - protein, 4 aa, Mycobacterium
DDDG

SEQ ID NO: 387335 - protein, 5 aa, Mycobacterium
DDDGV

SEQ ID NO: 387336 - protein, 4 aa, Mycobacterium
DDDI

SEQ ID NO: 387337 - protein, 4 aa, Mycobacterium
DDDQ

SEQ ID NO: 387338 - protein, 4 aa, Mycobacterium
DDEA

SEQ ID NO: 387339 - protein, 4 aa, Mycobacterium
DDEV

SEQ ID NO: 387340 - protein, 4 aa, Mycobacterium
DDGL

SEQ ID NO: 387341 - protein, 8 aa, Mycobacterium
DDGRDNPV

SEQ ID NO: 387342 - protein, 14 aa, Mycobacterium
DDHPTTALPPPDPH

SEQ ID NO: 387343 - protein, 8 aa, Mycobacterium
DDHPTTPL

SEQ ID NO: 387344 - protein, 4 aa, Mycobacterium
DDIP

SEQ ID NO: 387345 - protein, 10 aa, Mycobacterium
DDKYDGSQNI

SEQ ID NO: 387346 - protein, 4 aa, Mycobacterium
DDLD

SEQ ID NO: 387347 - protein, 5 aa, Mycobacterium
DDPAV

SEQ ID NO: 387348 - protein, 6 aa, Mycobacterium
DDPAYP

SEQ ID NO: 387349 - protein, 5 aa, Mycobacterium
DDPGL

SEQ ID NO: 387350 - protein, 4 aa, Mycobacterium
DDPM

SEQ ID NO: 387351 - protein, 7 aa, Mycobacterium
DDPSWTA

SEQ ID NO: 387352 - protein, 4 aa, Mycobacterium
DDPT

SEQ ID NO: 387353 - protein, 9 aa, Mycobacterium
DDPTRGKDR

SEQ ID NO: 387354 - protein, 4 aa, Mycobacterium
DDPV

SEQ ID NO: 387355 - protein, 5 aa, Mycobacterium
DDRAH

SEQ ID NO: 387356 - protein, 7 aa, Mycobacterium
DDSAGVT

SEQ ID NO: 387357 - protein, 13 aa, Mycobacterium
DDSLAEPRAPYPH

SEQ ID NO: 387358 - protein, 4 aa, Mycobacterium
DDTL

SEQ ID NO: 387359 - protein, 8 aa, Mycobacterium
DDTPGQPR

SEQ ID NO: 387360 - protein, 10 aa, Mycobacterium
DDTPVASASI

SEQ ID NO: 387361 - protein, 7 aa, Mycobacterium
DDVAAGY

SEQ ID NO: 387362 - protein, 4 aa, Mycobacterium
DEAD

SEQ ID NO: 387363 - protein, 7 aa, Mycobacterium
DEAKNRQ

SEQ ID NO: 387364 - protein, 4 aa, Mycobacterium
DEAQ

SEQ ID NO: 387365 - protein, 4 aa, Mycobacterium
DEAS

SEQ ID NO: 387366 - protein, 6 aa, Mycobacterium
DEASNR

SEQ ID NO: 387367 - protein, 10 aa, Mycobacterium
DEDNTYGAPR

SEQ ID NO: 387368 - protein, 6 aa, Mycobacterium
DEDVER

SEQ ID NO: 387369 - protein, 4 aa, Mycobacterium
DEEA

SEQ ID NO: 387370 - protein, 15 aa, Mycobacterium
DEEKAQARATDPRAA

SEQ ID NO: 387371 - protein, 17 aa, Mycobacterium
DEETGKRVRISKRNGKD

SEQ ID NO: 387372 - protein, 4 aa, Mycobacterium
DEFP

SEQ ID NO: 387373 - protein, 5 aa, Mycobacterium
DEGAA

SEQ ID NO: 387374 - protein, 5 aa, Mycobacterium
DEGAV

SEQ ID NO: 387375 - protein, 5 aa, Mycobacterium
DEGPI

SEQ ID NO: 387376 - protein, 4 aa, Mycobacterium
DEGR

SEQ ID NO: 387377 - protein, 7 aa, Mycobacterium
DEIGGTW

SEQ ID NO: 387378 - protein, 5 aa, Mycobacterium
DELGT

SEQ ID NO: 387379 - protein, 4 aa, Mycobacterium
DELN

SEQ ID NO: 387380 - protein, 14 aa, Mycobacterium
DENQPPGSRDIPDN

SEQ ID NO: 387381 - protein, 4 aa, Mycobacterium
DEPV

SEQ ID NO: 387382 - protein, 4 aa, Mycobacterium
DEQA

SEQ ID NO: 387383 - protein, 6 aa, Mycobacterium
DEQGRP

SEQ ID NO: 387384 - protein, 4 aa, Mycobacterium
DEQL

SEQ ID NO: 387385 - protein, 4 aa, Mycobacterium
DERA

SEQ ID NO: 387386 - protein, 5 aa, Mycobacterium
DEREQ

SEQ ID NO: 387387 - protein, 8 aa, Mycobacterium
DERKDTAA

SEQ ID NO: 387388 - protein, 4 aa, Mycobacterium
DERS

SEQ ID NO: 387389 - protein, 8 aa, Mycobacterium
DESAPGDA

SEQ ID NO: 387390 - protein, 9 aa, Mycobacterium
DESSYSTGS

SEQ ID NO: 387391 - protein, 7 aa, Mycobacterium
DEVGRGA

SEQ ID NO: 387392 - protein, 4 aa, Mycobacterium
DEYG

SEQ ID NO: 387393 - protein, 5 aa, Mycobacterium
DFGSY

SEQ ID NO: 387394 - protein, 4 aa, Mycobacterium
DFPA

SEQ ID NO: 387395 - protein, 11 aa, Mycobacterium
DFSKDSGRSEL

SEQ ID NO: 387396 - protein, 10 aa, Mycobacterium
DFTADGTIEA

SEQ ID NO: 387397 - protein, 8 aa, Mycobacterium
DFTPDGTI

SEQ ID NO: 387398 - protein, 7 aa, Mycobacterium
DGAASPV

SEQ ID NO: 387399 - protein, 17 aa, Mycobacterium
DGADGAPGTGQAGGDGG

SEQ ID NO: 387400 - protein, 15 aa, Mycobacterium
DGADGTAPGQAGGAG

SEQ ID NO: 387401 - protein, 4 aa, Mycobacterium
DGAG

SEQ ID NO: 387402 - protein, 10 aa, Mycobacterium
DGAGAADETV

SEQ ID NO: 387403 - protein, 8 aa, Mycobacterium
DGAGARIQ

SEQ ID NO: 387404 - protein, 6 aa, Mycobacterium
DGALPG

SEQ ID NO: 387405 - protein, 4 aa, Mycobacterium
DGAP

SEQ ID NO: 387406 - protein, 11 aa, Mycobacterium
DGASAYGNKMT

SEQ ID NO: 387407 - protein, 6 aa, Mycobacterium
DGATEI

SEQ ID NO: 387408 - protein, 10 aa, Mycobacterium
DGAYGEAKSA

SEQ ID NO: 387409 - protein, 7 aa, Mycobacterium
DGAYSPI

SEQ ID NO: 387410 - protein, 4 aa, Mycobacterium
DGDA

SEQ ID NO: 387411 - protein, 7 aa, Mycobacterium
DGDDDAV

SEQ ID NO: 387412 - protein, 5 aa, Mycobacterium
DGDED

SEQ ID NO: 387413 - protein, 6 aa, Mycobacterium
DGDRFR

SEQ ID NO: 387414 - protein, 7 aa, Mycobacterium
DGDRLTD

SEQ ID NO: 387415 - protein, 4 aa, Mycobacterium
DGDY

SEQ ID NO: 387416 - protein, 6 aa, Mycobacterium
DGEAAR

SEQ ID NO: 387417 - protein, 9 aa, Mycobacterium
DGEAETGPL

SEQ ID NO: 387418 - protein, 10 aa, Mycobacterium
DGEAETGPLA

SEQ ID NO: 387419 - protein, 8 aa, Mycobacterium
DGEEPRAD

SEQ ID NO: 387420 - protein, 9 aa, Mycobacterium
DGEPVPGTF

SEQ ID NO: 387421 - protein, 4 aa, Mycobacterium
DGEV

SEQ ID NO: 387422 - protein, 7 aa, Mycobacterium
DGFGSTE

SEQ ID NO: 387423 - protein, 4 aa, Mycobacterium
DGGC

SEQ ID NO: 387424 - protein, 6 aa, Mycobacterium
DGGGSY

SEQ ID NO: 387425 - protein, 7 aa, Mycobacterium
DGGPTEL

SEQ ID NO: 387426 - protein, 5 aa, Mycobacterium
DGGQA

SEQ ID NO: 387427 - protein, 5 aa, Mycobacterium
DGGRG

SEQ ID NO: 387428 - protein, 6 aa, Mycobacterium
DGGRGG

SEQ ID NO: 387429 - protein, 5 aa, Mycobacterium
DGGTV

SEQ ID NO: 387430 - protein, 6 aa, Mycobacterium
DGGYGW

SEQ ID NO: 387431 - protein, 6 aa, Mycobacterium
DGKTQA

SEQ ID NO: 387432 - protein, 9 aa, Mycobacterium
DGLPGPTDS

SEQ ID NO: 387433 - protein, 4 aa, Mycobacterium
DGLS

SEQ ID NO: 387434 - protein, 9 aa, Mycobacterium
DGNPRGKHG

SEQ ID NO: 387435 - protein, 8 aa, Mycobacterium
DGPATGGV

SEQ ID NO: 387436 - protein, 8 aa, Mycobacterium
DGPATSRP

SEQ ID NO: 387437 - protein, 4 aa, Mycobacterium
DGPD

SEQ ID NO: 387438 - protein, 7 aa, Mycobacterium
DGPDPEC

SEQ ID NO: 387439 - protein, 4 aa, Mycobacterium
DGPL

SEQ ID NO: 387440 - protein, 5 aa, Mycobacterium
DGPLA

SEQ ID NO: 387441 - protein, 5 aa, Mycobacterium
DGPLP

SEQ ID NO: 387442 - protein, 4 aa, Mycobacterium
DGQA

SEQ ID NO: 387443 - protein, 4 aa, Mycobacterium
DGQL

SEQ ID NO: 387444 - protein, 4 aa, Mycobacterium
DGRG

SEQ ID NO: 387445 - protein, 8 aa, Mycobacterium
DGRGARTV

SEQ ID NO: 387446 - protein, 7 aa, Mycobacterium
DGRHAQR

SEQ ID NO: 387447 - protein, 9 aa, Mycobacterium
DGSDSSMRA

SEQ ID NO: 387448 - protein, 6 aa, Mycobacterium
DGSDSV

SEQ ID NO: 387449 - protein, 7 aa, Mycobacterium
DGSKEEM

SEQ ID NO: 387450 - protein, 4 aa, Mycobacterium
DGSR

SEQ ID NO: 387451 - protein, 5 aa, Mycobacterium
DGSSV

SEQ ID NO: 387452 - protein, 7 aa, Mycobacterium
DGTETRI

SEQ ID NO: 387453 - protein, 4 aa, Mycobacterium
DGTG

SEQ ID NO: 387454 - protein, 8 aa, Mycobacterium
DGTGGYRS

SEQ ID NO: 387455 - protein, 5 aa, Mycobacterium
DGTGK

SEQ ID NO: 387456 - protein, 4 aa, Mycobacterium
DGTI

SEQ ID NO: 387457 - protein, 5 aa, Mycobacterium
DGTIT

SEQ ID NO: 387458 - protein, 12 aa, Mycobacterium
DGTPDKSRLGGN

SEQ ID NO: 387459 - protein, 4 aa, Mycobacterium
DGTR

SEQ ID NO: 387460 - protein, 5 aa, Mycobacterium
DGVAD

SEQ ID NO: 387461 - protein, 4 aa, Mycobacterium
DGVD

SEQ ID NO: 387462 - protein, 5 aa, Mycobacterium
DGVPR

SEQ ID NO: 387463 - protein, 4 aa, Mycobacterium
DGVQ

SEQ ID NO: 387464 - protein, 4 aa, Mycobacterium
DGVR

SEQ ID NO: 387465 - protein, 4 aa, Mycobacterium
DGVS

SEQ ID NO: 387466 - protein, 5 aa, Mycobacterium
DHAAA

SEQ ID NO: 387467 - protein, 6 aa, Mycobacterium
DHAAAG

SEQ ID NO: 387468 - protein, 4 aa, Mycobacterium
DHEG

SEQ ID NO: 387469 - protein, 7 aa, Mycobacterium
DHKGQPT

SEQ ID NO: 387470 - protein, 4 aa, Mycobacterium
DHPR

SEQ ID NO: 387471 - protein, 4 aa, Mycobacterium
DHTP

SEQ ID NO: 387472 - protein, 5 aa, Mycobacterium
DIAKG

SEQ ID NO: 387473 - protein, 11 aa, Mycobacterium
DIAPTDATEAT

SEQ ID NO: 387474 - protein, 7 aa, Mycobacterium
DIEAGDR

SEQ ID NO: 387475 - protein, 7 aa, Mycobacterium
DIHTSGE

SEQ ID NO: 387476 - protein, 7 aa, Mycobacterium
DIPGTAL

SEQ ID NO: 387477 - protein, 5 aa, Mycobacterium
DIYGD

SEQ ID NO: 387478 - protein, 8 aa, Mycobacterium
DKGQKTRI

SEQ ID NO: 387479 - protein, 5 aa, Mycobacterium
DKGVR

SEQ ID NO: 387480 - protein, 7 aa, Mycobacterium
DKKDNFT

SEQ ID NO: 387481 - protein, 7 aa, Mycobacterium
DKKTRAG

SEQ ID NO: 387482 - protein, 5 aa, Mycobacterium
DKLPS

SEQ ID NO: 387483 - protein, 6 aa, Mycobacterium
DKPGVL

SEQ ID NO: 387484 - protein, 5 aa, Mycobacterium
DKQAT

SEQ ID NO: 387485 - protein, 7 aa, Mycobacterium
DKQRPAL

SEQ ID NO: 387486 - protein, 7 aa, Mycobacterium
DKQRPGL

SEQ ID NO: 387487 - protein, 5 aa, Mycobacterium
DKRGK

SEQ ID NO: 387488 - protein, 8 aa, Mycobacterium
DKSGDPDV

SEQ ID NO: 387489 - protein, 8 aa, Mycobacterium
DKSKGRAA

SEQ ID NO: 387490 - protein, 8 aa, Mycobacterium
DLAPPEPF

SEQ ID NO: 387491 - protein, 5 aa, Mycobacterium
DLASA

SEQ ID NO: 387492 - protein, 9 aa, Mycobacterium
DLDAQSPAA

SEQ ID NO: 387493 - protein, 4 aa, Mycobacterium
DLGD

SEQ ID NO: 387494 - protein, 7 aa, Mycobacterium
DLGDEDA

SEQ ID NO: 387495 - protein, 4 aa, Mycobacterium
DLGG

SEQ ID NO: 387496 - protein, 9 aa, Mycobacterium
DLNYDNPAV

SEQ ID NO: 387497 - protein, 5 aa, Mycobacterium
DLPDE

SEQ ID NO: 387498 - protein, 10 aa, Mycobacterium
DLPGGARSGL

SEQ ID NO: 387499 - protein, 5 aa, Mycobacterium
DLPPA

SEQ ID NO: 387500 - protein, 5 aa, Mycobacterium
DLPPE

SEQ ID NO: 387501 - protein, 7 aa, Mycobacterium
DLSEGGL

SEQ ID NO: 387502 - protein, 11 aa, Mycobacterium
DLSQGEVKGDE

SEQ ID NO: 387503 - protein, 10 aa, Mycobacterium
DLTPGPDHSL

SEQ ID NO: 387504 - protein, 10 aa, Mycobacterium
DLVDGAPKPL

SEQ ID NO: 387505 - protein, 10 aa, Mycobacterium
DLVDSAPKPL

SEQ ID NO: 387506 - protein, 7 aa, Mycobacterium
DMPDDRD

SEQ ID NO: 387507 - protein, 5 aa, Mycobacterium
DMPGV

SEQ ID NO: 387508 - protein, 8 aa, Mycobacterium
DNGDTTYG

SEQ ID NO: 387509 - protein, 10 aa, Mycobacterium
DNKELATPTW

SEQ ID NO: 387510 - protein, 5 aa, Mycobacterium
DNLPS

SEQ ID NO: 387511 - protein, 6 aa, Mycobacterium
DNNDAF

SEQ ID NO: 387512 - protein, 6 aa, Mycobacterium
DNNTGV

SEQ ID NO: 387513 - protein, 10 aa, Mycobacterium
DNNTSNASSF

SEQ ID NO: 387514 - protein, 5 aa, Mycobacterium
DNPAL

SEQ ID NO: 387515 - protein, 8 aa, Mycobacterium
DNPPTDTR

SEQ ID NO: 387516 - protein, 5 aa, Mycobacterium
DNQPG

SEQ ID NO: 387517 - protein, 4 aa, Mycobacterium
DNRG

SEQ ID NO: 387518 - protein, 4 aa, Mycobacterium
DNTN

SEQ ID NO: 387519 - protein, 5 aa, Mycobacterium
DNTYP

SEQ ID NO: 387520 - protein, 6 aa, Mycobacterium
DNWSTD

SEQ ID NO: 387521 - protein, 5 aa, Mycobacterium
DNYAK

SEQ ID NO: 387522 - protein, 5 aa, Mycobacterium
DPAAA

SEQ ID NO: 387523 - protein, 6 aa, Mycobacterium
DPADTR

SEQ ID NO: 387524 - protein, 4 aa, Mycobacterium
DPAE

SEQ ID NO: 387525 - protein, 10 aa, Mycobacterium
DPAEIGKNRH

SEQ ID NO: 387526 - protein, 5 aa, Mycobacterium
DPAGE

SEQ ID NO: 387527 - protein, 4 aa, Mycobacterium
DPAM

SEQ ID NO: 387528 - protein, 5 aa, Mycobacterium
DPAPA

SEQ ID NO: 387529 - protein, 5 aa, Mycobacterium
DPARS

SEQ ID NO: 387530 - protein, 5 aa, Mycobacterium
DPATA

SEQ ID NO: 387531 - protein, 8 aa, Mycobacterium
DPDADYQA

SEQ ID NO: 387532 - protein, 8 aa, Mycobacterium
DPDAPTAS

SEQ ID NO: 387533 - protein, 10 aa, Mycobacterium
DPDDPSESQA

SEQ ID NO: 387534 - protein, 6 aa, Mycobacterium
DPDDVS

SEQ ID NO: 387535 - protein, 5 aa, Mycobacterium
DPDGA

SEQ ID NO: 387536 - protein, 9 aa, Mycobacterium
DPDGSVYPS

SEQ ID NO: 387537 - protein, 4 aa, Mycobacterium
DPDT

SEQ ID NO: 387538 - protein, 4 aa, Mycobacterium
DPEG

SEQ ID NO: 387539 - protein, 4 aa, Mycobacterium
DPER

SEQ ID NO: 387540 - protein, 9 aa, Mycobacterium
DPESEGLAR

SEQ ID NO: 387541 - protein, 4 aa, Mycobacterium
DPEV

SEQ ID NO: 387542 - protein, 4 aa, Mycobacterium
DPFS

SEQ ID NO: 387543 - protein, 4 aa, Mycobacterium
DPGE

SEQ ID NO: 387544 - protein, 13 aa, Mycobacterium
DPGEGTQAKRRAH

SEQ ID NO: 387545 - protein, 6 aa, Mycobacterium
DPGFSG

SEQ ID NO: 387546 - protein, 4 aa, Mycobacterium
DPGG

SEQ ID NO: 387547 - protein, 6 aa, Mycobacterium
DPGGVD

SEQ ID NO: 387548 - protein, 4 aa, Mycobacterium
DPGR

SEQ ID NO: 387549 - protein, 8 aa, Mycobacterium
DPGSGRVT

SEQ ID NO: 387550 - protein, 4 aa, Mycobacterium
DPGV

SEQ ID NO: 387551 - protein, 8 aa, Mycobacterium
DPHNKPGR

SEQ ID NO: 387552 - protein, 19 aa, Mycobacterium
DPLGHPNSEVGADPERPYA

SEQ ID NO: 387553 - protein, 6 aa, Mycobacterium
DPPEHQ

SEQ ID NO: 387554 - protein, 4 aa, Mycobacterium
DPPR

SEQ ID NO: 387555 - protein, 9 aa, Mycobacterium
DPPRTGAGR

SEQ ID NO: 387556 - protein, 4 aa, Mycobacterium
DPQA

SEQ ID NO: 387557 - protein, 7 aa, Mycobacterium
DPRETRD

SEQ ID NO: 387558 - protein, 4 aa, Mycobacterium
DPRF

SEQ ID NO: 387559 - protein, 5 aa, Mycobacterium
DPRLP

SEQ ID NO: 387560 - protein, 5 aa, Mycobacterium
DPRLR

SEQ ID NO: 387561 - protein, 6 aa, Mycobacterium
DPRRDG

SEQ ID NO: 387562 - protein, 5 aa, Mycobacterium
DPRSE

SEQ ID NO: 387563 - protein, 6 aa, Mycobacterium
DPRTVN

SEQ ID NO: 387564 - protein, 5 aa, Mycobacterium
DPSGL

SEQ ID NO: 387565 - protein, 6 aa, Mycobacterium
DPSGNT

SEQ ID NO: 387566 - protein, 7 aa, Mycobacterium
DPTLRDE

SEQ ID NO: 387567 - protein, 4 aa, Mycobacterium
DPVA

SEQ ID NO: 387568 - protein, 16 aa, Mycobacterium
DPVTAEREQWDDGNNT

SEQ ID NO: 387569 - protein, 6 aa, Mycobacterium
DQDELA

SEQ ID NO: 387570 - protein, 5 aa, Mycobacterium
DQDEV

SEQ ID NO: 387571 - protein, 28 aa, Mycobacterium
DQLAPGERCAATSNRNFEGRQGKGGRTH

SEQ ID NO: 387572 - protein, 4 aa, Mycobacterium
DQNL

SEQ ID NO: 387573 - protein, 7 aa, Mycobacterium
DQQRETA

SEQ ID NO: 387574 - protein, 4 aa, Mycobacterium
DQRA

SEQ ID NO: 387575 - protein, 6 aa, Mycobacterium
DQSEAL

SEQ ID NO: 387576 - protein, 5 aa, Mycobacterium
DQSEP

SEQ ID NO: 387577 - protein, 10 aa, Mycobacterium
DQSGGSTPKA

SEQ ID NO: 387578 - protein, 6 aa, Mycobacterium
DQSPTA

SEQ ID NO: 387579 - protein, 7 aa, Mycobacterium
DQTCRTP

SEQ ID NO: 387580 - protein, 10 aa, Mycobacterium
DQTDVPESGD

SEQ ID NO: 387581 - protein, 4 aa, Mycobacterium
DQVT

SEQ ID NO: 387582 - protein, 5 aa, Mycobacterium
DRAPR

SEQ ID NO: 387583 - protein, 7 aa, Mycobacterium
DRATADA

SEQ ID NO: 387584 - protein, 4 aa, Mycobacterium
DRDA

SEQ ID NO: 387585 - protein, 5 aa, Mycobacterium
DRDAM

SEQ ID NO: 387586 - protein, 4 aa, Mycobacterium
DRDE

SEQ ID NO: 387587 - protein, 7 aa, Mycobacterium
DRDTREA

SEQ ID NO: 387588 - protein, 8 aa, Mycobacterium
DRGAGAGA

SEQ ID NO: 387589 - protein, 6 aa, Mycobacterium
DRGEIT

SEQ ID NO: 387590 - protein, 11 aa, Mycobacterium
DRGGPTYTKDT

SEQ ID NO: 387591 - protein, 4 aa, Mycobacterium
DRGR

SEQ ID NO: 387592 - protein, 4 aa, Mycobacterium
DRGS

SEQ ID NO: 387593 - protein, 6 aa, Mycobacterium
DRGSSV

SEQ ID NO: 387594 - protein, 10 aa, Mycobacterium
DRGTSMTSNT

SEQ ID NO: 387595 - protein, 4 aa, Mycobacterium
DRGV

SEQ ID NO: 387596 - protein, 4 aa, Mycobacterium
DRGY

SEQ ID NO: 387597 - protein, 5 aa, Mycobacterium
DRGYT

SEQ ID NO: 387598 - protein, 4 aa, Mycobacterium
DRHG

SEQ ID NO: 387599 - protein, 7 aa, Mycobacterium
DRLPDGV

SEQ ID NO: 387600 - protein, 4 aa, Mycobacterium
DRLT

SEQ ID NO: 387601 - protein, 8 aa, Mycobacterium
DRLTEGAA

SEQ ID NO: 387602 - protein, 4 aa, Mycobacterium
DRNL

SEQ ID NO: 387603 - protein, 23 aa, Mycobacterium
DRNPSPESLDEAQAKIKAALAQL

SEQ ID NO: 387604 - protein, 5 aa, Mycobacterium
DRPPM

SEQ ID NO: 387605 - protein, 4 aa, Mycobacterium
DRPY

SEQ ID NO: 387606 - protein, 6 aa, Mycobacterium
DRRDDF

SEQ ID NO: 387607 - protein, 9 aa, Mycobacterium
DRRREPRDD

SEQ ID NO: 387608 - protein, 6 aa, Mycobacterium
DRRRGE

SEQ ID NO: 387609 - protein, 18 aa, Mycobacterium
DRRSARKRNALAARSRKR

SEQ ID NO: 387610 - protein, 6 aa, Mycobacterium
DRRSGY

SEQ ID NO: 387611 - protein, 8 aa, Mycobacterium
DRTGALSP

SEQ ID NO: 387612 - protein, 5 aa, Mycobacterium
DRTGR

SEQ ID NO: 387613 - protein, 15 aa, Mycobacterium
DRTHPSAAASLREGL

SEQ ID NO: 387614 - protein, 7 aa, Mycobacterium
DRVSPPD

SEQ ID NO: 387615 - protein, 6 aa, Mycobacterium
DRVTHD

SEQ ID NO: 387616 - protein, 5 aa, Mycobacterium
DRYKP

SEQ ID NO: 387617 - protein, 8 aa, Mycobacterium
DRYTPTPA

SEQ ID NO: 387618 - protein, 4 aa, Mycobacterium
DSAD

SEQ ID NO: 387619 - protein, 13 aa, Mycobacterium
DSAGNISKRQSAT

SEQ ID NO: 387620 - protein, 4 aa, Mycobacterium
DSAQ

SEQ ID NO: 387621 - protein, 4 aa, Mycobacterium
DSAT

SEQ ID NO: 387622 - protein, 8 aa, Mycobacterium
DSAYGNST

SEQ ID NO: 387623 - protein, 4 aa, Mycobacterium
DSDA

SEQ ID NO: 387624 - protein, 6 aa, Mycobacterium
DSDSFD

SEQ ID NO: 387625 - protein, 6 aa, Mycobacterium
DSDTGA

SEQ ID NO: 387626 - protein, 5 aa, Mycobacterium
DSEAR

SEQ ID NO: 387627 - protein, 14 aa, Mycobacterium
DSGIAGSIGSVGDA

SEQ ID NO: 387628 - protein, 7 aa, Mycobacterium
DSGPAMR

SEQ ID NO: 387629 - protein, 4 aa, Mycobacterium
DSGR

SEQ ID NO: 387630 - protein, 14 aa, Mycobacterium
DSHEVTRAGEPISL

SEQ ID NO: 387631 - protein, 4 aa, Mycobacterium
DSLG

SEQ ID NO: 387632 - protein, 7 aa, Mycobacterium
DSPAALG

SEQ ID NO: 387633 - protein, 7 aa, Mycobacterium
DSPGITV

SEQ ID NO: 387634 - protein, 9 aa, Mycobacterium
DSPKPPPQR

SEQ ID NO: 387635 - protein, 9 aa, Mycobacterium
DSRTGEMDK

SEQ ID NO: 387636 - protein, 5 aa, Mycobacterium
DSTAF

SEQ ID NO: 387637 - protein, 8 aa, Mycobacterium
DSTGAESV

SEQ ID NO: 387638 - protein, 4 aa, Mycobacterium
DTAE

SEQ ID NO: 387639 - protein, 5 aa, Mycobacterium
DTART

SEQ ID NO: 387640 - protein, 4 aa, Mycobacterium
DTDA

SEQ ID NO: 387641 - protein, 7 aa, Mycobacterium
DTDERTI

SEQ ID NO: 387642 - protein, 7 aa, Mycobacterium
DTDGAGV

SEQ ID NO: 387643 - protein, 8 aa, Mycobacterium
DTEAEQQL

SEQ ID NO: 387644 - protein, 4 aa, Mycobacterium
DTEE

SEQ ID NO: 387645 - protein, 6 aa, Mycobacterium
DTEEDA

SEQ ID NO: 387646 - protein, 7 aa, Mycobacterium
DTEGATI

SEQ ID NO: 387647 - protein, 7 aa, Mycobacterium
DTEHPDE

SEQ ID NO: 387648 - protein, 4 aa, Mycobacterium
DTEL

SEQ ID NO: 387649 - protein, 4 aa, Mycobacterium
DTEP

SEQ ID NO: 387650 - protein, 8 aa, Mycobacterium
DTGDTPTI

SEQ ID NO: 387651 - protein, 9 aa, Mycobacterium
DTGGKTPLA

SEQ ID NO: 387652 - protein, 5 aa, Mycobacterium
DTLRG

SEQ ID NO: 387653 - protein, 9 aa, Mycobacterium
DTPATEADI

SEQ ID NO: 387654 - protein, 8 aa, Mycobacterium
DTPDPDAG

SEQ ID NO: 387655 - protein, 5 aa, Mycobacterium
DTPEY

SEQ ID NO: 387656 - protein, 5 aa, Mycobacterium
DTPFG

SEQ ID NO: 387657 - protein, 5 aa, Mycobacterium
DTPGG

SEQ ID NO: 387658 - protein, 8 aa, Mycobacterium
DTQETDLD

SEQ ID NO: 387659 - protein, 11 aa, Mycobacterium
DTRKRSGAASL

SEQ ID NO: 387660 - protein, 9 aa, Mycobacterium
DTRKRSGAT

SEQ ID NO: 387661 - protein, 6 aa, Mycobacterium
DTRNGS

SEQ ID NO: 387662 - protein, 4 aa, Mycobacterium
DTRY

SEQ ID NO: 387663 - protein, 7 aa, Mycobacterium
DTSQYEP

SEQ ID NO: 387664 - protein, 7 aa, Mycobacterium
DTTIPAG

SEQ ID NO: 387665 - protein, 5 aa, Mycobacterium
DTTTA

SEQ ID NO: 387666 - protein, 5 aa, Mycobacterium
DTVND

SEQ ID NO: 387667 - protein, 14 aa, Mycobacterium
DVEPVDDSDGTDGR

SEQ ID NO: 387668 - protein, 13 aa, Mycobacterium
DVPEPKKVKPPRT

SEQ ID NO: 387669 - protein, 5 aa, Mycobacterium
DVPGL

SEQ ID NO: 387670 - protein, 4 aa, Mycobacterium
DVPP

SEQ ID NO: 387671 - protein, 6 aa, Mycobacterium
DVPPGA

SEQ ID NO: 387672 - protein, 7 aa, Mycobacterium
DVPSANG

SEQ ID NO: 387673 - protein, 7 aa, Mycobacterium
DVTGEDV

SEQ ID NO: 387674 - protein, 7 aa, Mycobacterium
DVTGRRP

SEQ ID NO: 387675 - protein, 14 aa, Mycobacterium
DVTGTSKGKGFAGT

SEQ ID NO: 387676 - protein, 17 aa, Mycobacterium
DVTPQPHNGCRPPKRRR

SEQ ID NO: 387677 - protein, 17 aa, Mycobacterium
DVTPQPHNGVRPPKRRR

SEQ ID NO: 387678 - protein, 6 aa, Mycobacterium
DVVPDD

SEQ ID NO: 387679 - protein, 5 aa, Mycobacterium
DYADP

SEQ ID NO: 387680 - protein, 6 aa, Mycobacterium
DYEEGG

SEQ ID NO: 387681 - protein, 7 aa, Mycobacterium
DYPGVGP

SEQ ID NO: 387682 - protein, 13 aa, Mycobacterium
DYPTTPLPPPSPH

SEQ ID NO: 387683 - protein, 4 aa, Mycobacterium
DYSG

SEQ ID NO: 387684 - protein, 10 aa, Mycobacterium
DYSLGGEQSG

SEQ ID NO: 387685 - protein, 12 aa, Mycobacterium
EAAAGRGLTGGG

SEQ ID NO: 387686 - protein, 8 aa, Mycobacterium
EAAAMDPQ

SEQ ID NO: 387687 - protein, 4 aa, Mycobacterium
EAAE

SEQ ID NO: 387688 - protein, 8 aa, Mycobacterium
EAAGMPPG

SEQ ID NO: 387689 - protein, 4 aa, Mycobacterium
EAAR

SEQ ID NO: 387690 - protein, 8 aa, Mycobacterium
EAARKAGH

SEQ ID NO: 387691 - protein, 6 aa, Mycobacterium
EAASDI

SEQ ID NO: 387692 - protein, 4 aa, Mycobacterium
EAAT

SEQ ID NO: 387693 - protein, 4 aa, Mycobacterium
EADD

SEQ ID NO: 387694 - protein, 4 aa, Mycobacterium
EADP

SEQ ID NO: 387695 - protein, 4 aa, Mycobacterium
EADR

SEQ ID NO: 387696 - protein, 4 aa, Mycobacterium
EAEA

SEQ ID NO: 387697 - protein, 4 aa, Mycobacterium
EAEG

SEQ ID NO: 387698 - protein, 4 aa, Mycobacterium
EAEL

SEQ ID NO: 387699 - protein, 4 aa, Mycobacterium
EAEQ

SEQ ID NO: 387700 - protein, 13 aa, Mycobacterium
EAEQQQLQSYITQ

SEQ ID NO: 387701 - protein, 5 aa, Mycobacterium
EAERR

SEQ ID NO: 387702 - protein, 4 aa, Mycobacterium
EAFG

SEQ ID NO: 387703 - protein, 7 aa, Mycobacterium
EAGADDY

SEQ ID NO: 387704 - protein, 4 aa, Mycobacterium
EAGD

SEQ ID NO: 387705 - protein, 6 aa, Mycobacterium
EAGHRS

SEQ ID NO: 387706 - protein, 4 aa, Mycobacterium
EAGI

SEQ ID NO: 387707 - protein, 9 aa, Mycobacterium
EAGKARWAA

SEQ ID NO: 387708 - protein, 4 aa, Mycobacterium
EAGM

SEQ ID NO: 387709 - protein, 13 aa, Mycobacterium
EAGPDTETHPPGT

SEQ ID NO: 387710 - protein, 10 aa, Mycobacterium
EAGPEAQEEL

SEQ ID NO: 387711 - protein, 7 aa, Mycobacterium
EAGRRGA

SEQ ID NO: 387712 - protein, 9 aa, Mycobacterium
EAGRTSAPN

SEQ ID NO: 387713 - protein, 5 aa, Mycobacterium
EAGTA

SEQ ID NO: 387714 - protein, 4 aa, Mycobacterium
EAHP

SEQ ID NO: 387715 - protein, 6 aa, Mycobacterium
EAHRAG

SEQ ID NO: 387716 - protein, 5 aa, Mycobacterium
EAIGT

SEQ ID NO: 387717 - protein, 4 aa, Mycobacterium
EALA

SEQ ID NO: 387718 - protein, 8 aa, Mycobacterium
EANAANAR

SEQ ID NO: 387719 - protein, 5 aa, Mycobacterium
EAPLT

SEQ ID NO: 387720 - protein, 6 aa, Mycobacterium
EAPSPL

SEQ ID NO: 387721 - protein, 5 aa, Mycobacterium
EAPTH

SEQ ID NO: 387722 - protein, 8 aa, Mycobacterium
EAQDRYGR

SEQ ID NO: 387723 - protein, 9 aa, Mycobacterium
EARPPGKKI

SEQ ID NO: 387724 - protein, 8 aa, Mycobacterium
EARRREQQ

SEQ ID NO: 387725 - protein, 4 aa, Mycobacterium
EASN

SEQ ID NO: 387726 - protein, 7 aa, Mycobacterium
EASRRGV

SEQ ID NO: 387727 - protein, 10 aa, Mycobacterium
EASSGSTAVS

SEQ ID NO: 387728 - protein, 9 aa, Mycobacterium
EASSSRAGL

SEQ ID NO: 387729 - protein, 4 aa, Mycobacterium
EASY

SEQ ID NO: 387730 - protein, 4 aa, Mycobacterium
EATG

SEQ ID NO: 387731 - protein, 8 aa, Mycobacterium
EATGTDTF

SEQ ID NO: 387732 - protein, 4 aa, Mycobacterium
EATR

SEQ ID NO: 387733 - protein, 6 aa, Mycobacterium
EAVDAG

SEQ ID NO: 387734 - protein, 6 aa, Mycobacterium
EAVDGG

SEQ ID NO: 387735 - protein, 10 aa, Mycobacterium
EDAAREGNSS

SEQ ID NO: 387736 - protein, 4 aa, Mycobacterium
EDAV

SEQ ID NO: 387737 - protein, 6 aa, Mycobacterium
EDDGPD

SEQ ID NO: 387738 - protein, 4 aa, Mycobacterium
EDDP

SEQ ID NO: 387739 - protein, 4 aa, Mycobacterium
EDGD

SEQ ID NO: 387740 - protein, 6 aa, Mycobacterium
EDIRNT

SEQ ID NO: 387741 - protein, 15 aa, Mycobacterium
EDLPAHGEAVRRRFE

SEQ ID NO: 387742 - protein, 8 aa, Mycobacterium
EDNPQTRG

SEQ ID NO: 387743 - protein, 4 aa, Mycobacterium
EDPD

SEQ ID NO: 387744 - protein, 5 aa, Mycobacterium
EDPDK

SEQ ID NO: 387745 - protein, 4 aa, Mycobacterium
EDPH

SEQ ID NO: 387746 - protein, 6 aa, Mycobacterium
EDPQWG

SEQ ID NO: 387747 - protein, 22 aa, Mycobacterium
EDQSARPVAPTRSTSKTPRQAP

SEQ ID NO: 387748 - protein, 6 aa, Mycobacterium
EDRGAF

SEQ ID NO: 387749 - protein, 7 aa, Mycobacterium
EDSDDVQ

SEQ ID NO: 387750 - protein, 4 aa, Mycobacterium
EDSV

SEQ ID NO: 387751 - protein, 4 aa, Mycobacterium
EDTH

SEQ ID NO: 387752 - protein, 11 aa, Mycobacterium
EDTSAYDTGHI

SEQ ID NO: 387753 - protein, 4 aa, Mycobacterium
EDVR

SEQ ID NO: 387754 - protein, 9 aa, Mycobacterium
EEAGTAKPK

SEQ ID NO: 387755 - protein, 5 aa, Mycobacterium
EEALR

SEQ ID NO: 387756 - protein, 4 aa, Mycobacterium
EEAN

SEQ ID NO: 387757 - protein, 4 aa, Mycobacterium
EEAR

SEQ ID NO: 387758 - protein, 4 aa, Mycobacterium
EEAT

SEQ ID NO: 387759 - protein, 4 aa, Mycobacterium
EEDA

SEQ ID NO: 387760 - protein, 5 aa, Mycobacterium
EEDGG

SEQ ID NO: 387761 - protein, 5 aa, Mycobacterium
EEDPV

SEQ ID NO: 387762 - protein, 4 aa, Mycobacterium
EEER

SEQ ID NO: 387763 - protein, 5 aa, Mycobacterium
EEETI

SEQ ID NO: 387764 - protein, 5 aa, Mycobacterium
EEETT

SEQ ID NO: 387765 - protein, 6 aa, Mycobacterium
EEGIRR

SEQ ID NO: 387766 - protein, 4 aa, Mycobacterium
EEGR

SEQ ID NO: 387767 - protein, 5 aa, Mycobacterium
EEKAN

SEQ ID NO: 387768 - protein, 11 aa, Mycobacterium
EEKPATPKSHY

SEQ ID NO: 387769 - protein, 4 aa, Mycobacterium
EELD

SEQ ID NO: 387770 - protein, 4 aa, Mycobacterium
EEPA

SEQ ID NO: 387771 - protein, 11 aa, Mycobacterium
EEPDSGTVKVG

SEQ ID NO: 387772 - protein, 6 aa, Mycobacterium
EEPPPS

SEQ ID NO: 387773 - protein, 4 aa, Mycobacterium
EERA

SEQ ID NO: 387774 - protein, 6 aa, Mycobacterium
EERARR

SEQ ID NO: 387775 - protein, 5 aa, Mycobacterium
EERVA

SEQ ID NO: 387776 - protein, 13 aa, Mycobacterium
EESADPAIDADSD

SEQ ID NO: 387777 - protein, 22 aa, Mycobacterium
EESEALRQARKDAELTASADSV

SEQ ID NO: 387778 - protein, 10 aa, Mycobacterium
EESGDQLTED

SEQ ID NO: 387779 - protein, 4 aa, Mycobacterium
EETH

SEQ ID NO: 387780 - protein, 11 aa, Mycobacterium
EEVGNGDGPDC

SEQ ID NO: 387781 - protein, 13 aa, Mycobacterium
EFGTGESSSVGEL

SEQ ID NO: 387782 - protein, 13 aa, Mycobacterium
EFPRDKPCGDGLT

SEQ ID NO: 387783 - protein, 4 aa, Mycobacterium
EGAV

SEQ ID NO: 387784 - protein, 7 aa, Mycobacterium
EGDDDRI

SEQ ID NO: 387785 - protein, 8 aa, Mycobacterium
EGDDTVRP

SEQ ID NO: 387786 - protein, 6 aa, Mycobacterium
EGDDVH

SEQ ID NO: 387787 - protein, 18 aa, Mycobacterium
EGDPNPNIEHANRGKRSI

SEQ ID NO: 387788 - protein, 5 aa, Mycobacterium
EGDPQ

SEQ ID NO: 387789 - protein, 10 aa, Mycobacterium
EGDRNPPVFD

SEQ ID NO: 387790 - protein, 8 aa, Mycobacterium
EGDTGRVY

SEQ ID NO: 387791 - protein, 4 aa, Mycobacterium
EGDV

SEQ ID NO: 387792 - protein, 4 aa, Mycobacterium
EGEA

SEQ ID NO: 387793 - protein, 9 aa, Mycobacterium
EGENGEPQL

SEQ ID NO: 387794 - protein, 5 aa, Mycobacterium
EGEPD

SEQ ID NO: 387795 - protein, 4 aa, Mycobacterium
EGFR

SEQ ID NO: 387796 - protein, 8 aa, Mycobacterium
EGFRDDGH

SEQ ID NO: 387797 - protein, 13 aa, Mycobacterium
EGGGQANATILEL

SEQ ID NO: 387798 - protein, 14 aa, Mycobacterium
EGGGTANATLVELV

SEQ ID NO: 387799 - protein, 10 aa, Mycobacterium
EGGPSRHHAR

SEQ ID NO: 387800 - protein, 5 aa, Mycobacterium
EGGRI

SEQ ID NO: 387801 - protein, 5 aa, Mycobacterium
EGHDQ

SEQ ID NO: 387802 - protein, 18 aa, Mycobacterium
EGKAPGEKVGKLTREQAE

SEQ ID NO: 387803 - protein, 4 aa, Mycobacterium
EGNR

SEQ ID NO: 387804 - protein, 6 aa, Mycobacterium
EGPDYA

SEQ ID NO: 387805 - protein, 8 aa, Mycobacterium
EGPEVETE

SEQ ID NO: 387806 - protein, 6 aa, Mycobacterium
EGPGLT

SEQ ID NO: 387807 - protein, 5 aa, Mycobacterium
EGPPL

SEQ ID NO: 387808 - protein, 6 aa, Mycobacterium
EGPPPW

SEQ ID NO: 387809 - protein, 4 aa, Mycobacterium
EGPR

SEQ ID NO: 387810 - protein, 4 aa, Mycobacterium
EGRE

SEQ ID NO: 387811 - protein, 11 aa, Mycobacterium
EGRELGDTSTL

SEQ ID NO: 387812 - protein, 4 aa, Mycobacterium
EGRP

SEQ ID NO: 387813 - protein, 6 aa, Mycobacterium
EGRSGS

SEQ ID NO: 387814 - protein, 7 aa, Mycobacterium
EGRSTAT

SEQ ID NO: 387815 - protein, 4 aa, Mycobacterium
EGSA

SEQ ID NO: 387816 - protein, 4 aa, Mycobacterium
EGST

SEQ ID NO: 387817 - protein, 5 aa, Mycobacterium
EGTGL

SEQ ID NO: 387818 - protein, 6 aa, Mycobacterium
EGTPVT

SEQ ID NO: 387819 - protein, 4 aa, Mycobacterium
EGTV

SEQ ID NO: 387820 - protein, 9 aa, Mycobacterium
EGVDEPTKS

SEQ ID NO: 387821 - protein, 8 aa, Mycobacterium
EGVPDDIP

SEQ ID NO: 387822 - protein, 4 aa, Mycobacterium
EHAG

SEQ ID NO: 387823 - protein, 11 aa, Mycobacterium
EHAKARGAKPL

SEQ ID NO: 387824 - protein, 5 aa, Mycobacterium
EHGAP

SEQ ID NO: 387825 - protein, 4 aa, Mycobacterium
EHNL

SEQ ID NO: 387826 - protein, 4 aa, Mycobacterium
EHPD

SEQ ID NO: 387827 - protein, 7 aa, Mycobacterium
EHPDQRR

SEQ ID NO: 387828 - protein, 9 aa, Mycobacterium
EHPLNDPFT

SEQ ID NO: 387829 - protein, 13 aa, Mycobacterium
EHPTTPNTAPTLT

SEQ ID NO: 387830 - protein, 6 aa, Mycobacterium
EHRDSA

SEQ ID NO: 387831 - protein, 7 aa, Mycobacterium
EHRQPRV

SEQ ID NO: 387832 - protein, 13 aa, Mycobacterium
EHRSTVSPYLVKQ

SEQ ID NO: 387833 - protein, 7 aa, Mycobacterium
EHRTDEG

SEQ ID NO: 387834 - protein, 7 aa, Mycobacterium
EHRTGEG

SEQ ID NO: 387835 - protein, 6 aa, Mycobacterium
EHTGGP

SEQ ID NO: 387836 - protein, 5 aa, Mycobacterium
EIAPH

SEQ ID NO: 387837 - protein, 4 aa, Mycobacterium
EIPE

SEQ ID NO: 387838 - protein, 4 aa, Mycobacterium
EIPP

SEQ ID NO: 387839 - protein, 9 aa, Mycobacterium
EIRAGRTKT

SEQ ID NO: 387840 - protein, 6 aa, Mycobacterium
EIRQQR

SEQ ID NO: 387841 - protein, 4 aa, Mycobacterium
EKAG

SEQ ID NO: 387842 - protein, 9 aa, Mycobacterium
EKAGVSNPY

SEQ ID NO: 387843 - protein, 12 aa, Mycobacterium
EKATATSKSAVS

SEQ ID NO: 387844 - protein, 6 aa, Mycobacterium
EKDPET

SEQ ID NO: 387845 - protein, 8 aa, Mycobacterium
EKGAPTPV

SEQ ID NO: 387846 - protein, 6 aa, Mycobacterium
EKGPRL

SEQ ID NO: 387847 - protein, 4 aa, Mycobacterium
EKIG

SEQ ID NO: 387848 - protein, 6 aa, Mycobacterium
EKIGPA

SEQ ID NO: 387849 - protein, 4 aa, Mycobacterium
EKQG

SEQ ID NO: 387850 - protein, 17 aa, Mycobacterium
EKRPYPPGQHGRARIKE

SEQ ID NO: 387851 - protein, 7 aa, Mycobacterium
EKSSREV

SEQ ID NO: 387852 - protein, 4 aa, Mycobacterium
EKVT

SEQ ID NO: 387853 - protein, 9 aa, Mycobacterium
ELAGENGVR

SEQ ID NO: 387854 - protein, 5 aa, Mycobacterium
ELAPR

SEQ ID NO: 387855 - protein, 10 aa, Mycobacterium
ELEGATPDGV

SEQ ID NO: 387856 - protein, 14 aa, Mycobacterium
ELGEAGTNAHHGSG

SEQ ID NO: 387857 - protein, 7 aa, Mycobacterium
ELGEEPE

SEQ ID NO: 387858 - protein, 8 aa, Mycobacterium
ELGGSNPS

SEQ ID NO: 387859 - protein, 5 aa, Mycobacterium
ELGNP

SEQ ID NO: 387860 - protein, 7 aa, Mycobacterium
ELGPDGK

SEQ ID NO: 387861 - protein, 27 aa, Mycobacterium
ELGQRGSAAPVDSSADAGGFDQFNRGN

SEQ ID NO: 387862 - protein, 4 aa, Mycobacterium
ELPD

SEQ ID NO: 387863 - protein, 7 aa, Mycobacterium
ELPKPAE

SEQ ID NO: 387864 - protein, 4 aa, Mycobacterium
ELPP

SEQ ID NO: 387865 - protein, 9 aa, Mycobacterium
ELSGGQRQR

SEQ ID NO: 387866 - protein, 17 aa, Mycobacterium
ELSSSVGGNVGTNAGGM

SEQ ID NO: 387867 - protein, 6 aa, Mycobacterium
ELTEGG

SEQ ID NO: 387868 - protein, 9 aa, Mycobacterium
EMDEPESRG

SEQ ID NO: 387869 - protein, 7 aa, Mycobacterium
ENDQRPI

SEQ ID NO: 387870 - protein, 8 aa, Mycobacterium
ENEAGGPL

SEQ ID NO: 387871 - protein, 4 aa, Mycobacterium
ENGQ

SEQ ID NO: 387872 - protein, 7 aa, Mycobacterium
ENLGTAP

SEQ ID NO: 387873 - protein, 13 aa, Mycobacterium
ENNTSSASAIGAG

SEQ ID NO: 387874 - protein, 4 aa, Mycobacterium
ENPE

SEQ ID NO: 387875 - protein, 11 aa, Mycobacterium
ENREKAREQRN

SEQ ID NO: 387876 - protein, 4 aa, Mycobacterium
ENRT

SEQ ID NO: 387877 - protein, 4 aa, Mycobacterium
ENTH

SEQ ID NO: 387878 - protein, 4 aa, Mycobacterium
ENTR

SEQ ID NO: 387879 - protein, 4 aa, Mycobacterium
ENVP

SEQ ID NO: 387880 - protein, 6 aa, Mycobacterium
ENYASP

SEQ ID NO: 387881 - protein, 5 aa, Mycobacterium
ENYPG

SEQ ID NO: 387882 - protein, 4 aa, Mycobacterium
EPAE

SEQ ID NO: 387883 - protein, 5 aa, Mycobacterium
EPCPP

SEQ ID NO: 387884 - protein, 4 aa, Mycobacterium
EPDA

SEQ ID NO: 387885 - protein, 22 aa, Mycobacterium
EPDAGSDVGAGRTKAVQQPDGT

SEQ ID NO: 387886 - protein, 9 aa, Mycobacterium
EPDERPELA

SEQ ID NO: 387887 - protein, 5 aa, Mycobacterium
EPEDI

SEQ ID NO: 387888 - protein, 6 aa, Mycobacterium
EPEEES

SEQ ID NO: 387889 - protein, 5 aa, Mycobacterium
EPEEV

SEQ ID NO: 387890 - protein, 5 aa, Mycobacterium
EPELT

SEQ ID NO: 387891 - protein, 20 aa, Mycobacterium
EPGFGSDSAAVSTTAKLDGD

SEQ ID NO: 387892 - protein, 4 aa, Mycobacterium
EPGR

SEQ ID NO: 387893 - protein, 6 aa, Mycobacterium
EPGTEG

SEQ ID NO: 387894 - protein, 5 aa, Mycobacterium
EPGTV

SEQ ID NO: 387895 - protein, 4 aa, Mycobacterium
EPHP

SEQ ID NO: 387896 - protein, 9 aa, Mycobacterium
EPIRSGDEV

SEQ ID NO: 387897 - protein, 5 aa, Mycobacterium
EPKNA

SEQ ID NO: 387898 - protein, 11 aa, Mycobacterium
EPKTKSDQEKL

SEQ ID NO: 387899 - protein, 4 aa, Mycobacterium
EPLG

SEQ ID NO: 387900 - protein, 5 aa, Mycobacterium
EPNEG

SEQ ID NO: 387901 - protein, 6 aa, Mycobacterium
EPNGFR

SEQ ID NO: 387902 - protein, 9 aa, Mycobacterium
EPPDHTRYR

SEQ ID NO: 387903 - protein, 4 aa, Mycobacterium
EPPV

SEQ ID NO: 387904 - protein, 10 aa, Mycobacterium
EPQGGADPKV

SEQ ID NO: 387905 - protein, 8 aa, Mycobacterium
EPSSGHGV

SEQ ID NO: 387906 - protein, 6 aa, Mycobacterium
EPTNDL

SEQ ID NO: 387907 - protein, 7 aa, Mycobacterium
EPTNDVD

SEQ ID NO: 387908 - protein, 5 aa, Mycobacterium
EPTNH

SEQ ID NO: 387909 - protein, 4 aa, Mycobacterium
EPTR

SEQ ID NO: 387910 - protein, 5 aa, Mycobacterium
EPTRG

SEQ ID NO: 387911 - protein, 8 aa, Mycobacterium
EPTTVGNR

SEQ ID NO: 387912 - protein, 13 aa, Mycobacterium
EPTYEDGIGDRSK

SEQ ID NO: 387913 - protein, 6 aa, Mycobacterium
EPVAPS

SEQ ID NO: 387914 - protein, 4 aa, Mycobacterium
EPVD

SEQ ID NO: 387915 - protein, 5 aa, Mycobacterium
EPVST

SEQ ID NO: 387916 - protein, 7 aa, Mycobacterium
EPYGGPD

SEQ ID NO: 387917 - protein, 5 aa, Mycobacterium
EQAAT

SEQ ID NO: 387918 - protein, 7 aa, Mycobacterium
EQAGAAR

SEQ ID NO: 387919 - protein, 6 aa, Mycobacterium
EQAHGA

SEQ ID NO: 387920 - protein, 7 aa, Mycobacterium
EQERGIT

SEQ ID NO: 387921 - protein, 8 aa, Mycobacterium
EQGFNSGD

SEQ ID NO: 387922 - protein, 4 aa, Mycobacterium
EQGT

SEQ ID NO: 387923 - protein, 4 aa, Mycobacterium
EQGV

SEQ ID NO: 387924 - protein, 13 aa, Mycobacterium
EQHPLATKDSDGR

SEQ ID NO: 387925 - protein, 6 aa, Mycobacterium
EQKRPG

SEQ ID NO: 387926 - protein, 5 aa, Mycobacterium
EQRGD

SEQ ID NO: 387927 - protein, 7 aa, Mycobacterium
EQRGGRY

SEQ ID NO: 387928 - protein, 9 aa, Mycobacterium
EQWDDGNNT

SEQ ID NO: 387929 - protein, 4 aa, Mycobacterium
ERAA

SEQ ID NO: 387930 - protein, 4 aa, Mycobacterium
ERAE

SEQ ID NO: 387931 - protein, 9 aa, Mycobacterium
ERAGTSKPA

SEQ ID NO: 387932 - protein, 9 aa, Mycobacterium
ERAGTTKSA

SEQ ID NO: 387933 - protein, 10 aa, Mycobacterium
ERAKAVTRGI

SEQ ID NO: 387934 - protein, 6 aa, Mycobacterium
ERDDPD

SEQ ID NO: 387935 - protein, 9 aa, Mycobacterium
EREGGEGSV

SEQ ID NO: 387936 - protein, 4 aa, Mycobacterium
ERES

SEQ ID NO: 387937 - protein, 6 aa, Mycobacterium
ERGAEA

SEQ ID NO: 387938 - protein, 4 aa, Mycobacterium
ERGE

SEQ ID NO: 387939 - protein, 9 aa, Mycobacterium
ERGPAATSI

SEQ ID NO: 387940 - protein, 5 aa, Mycobacterium
ERGSG

SEQ ID NO: 387941 - protein, 5 aa, Mycobacterium
ERGTD

SEQ ID NO: 387942 - protein, 4 aa, Mycobacterium
ERNA

SEQ ID NO: 387943 - protein, 5 aa, Mycobacterium
ERNAE

SEQ ID NO: 387944 - protein, 6 aa, Mycobacterium
ERPEDF

SEQ ID NO: 387945 - protein, 4 aa, Mycobacterium
ERPG

SEQ ID NO: 387946 - protein, 13 aa, Mycobacterium
ERPGRPLGASTAE

SEQ ID NO: 387947 - protein, 6 aa, Mycobacterium
ERPMPG

SEQ ID NO: 387948 - protein, 4 aa, Mycobacterium
ERPP

SEQ ID NO: 387949 - protein, 12 aa, Mycobacterium
ERPRNPEHGDYA

SEQ ID NO: 387950 - protein, 6 aa, Mycobacterium
ERPYTT

SEQ ID NO: 387951 - protein, 7 aa, Mycobacterium
ERQRTHG

SEQ ID NO: 387952 - protein, 6 aa, Mycobacterium
ERQTTI

SEQ ID NO: 387953 - protein, 6 aa, Mycobacterium
ERRAYT

SEQ ID NO: 387954 - protein, 4 aa, Mycobacterium
ERRG

SEQ ID NO: 387955 - protein, 6 aa, Mycobacterium
ERRTTV

SEQ ID NO: 387956 - protein, 9 aa, Mycobacterium
ERRTYHNED

SEQ ID NO: 387957 - protein, 5 aa, Mycobacterium
ERSAE

SEQ ID NO: 387958 - protein, 6 aa, Mycobacterium
ERTGEA

SEQ ID NO: 387959 - protein, 10 aa, Mycobacterium
ERTGIAGVGR

SEQ ID NO: 387960 - protein, 5 aa, Mycobacterium
ERTGK

SEQ ID NO: 387961 - protein, 10 aa, Mycobacterium
ERTGLGSGGQ

SEQ ID NO: 387962 - protein, 4 aa, Mycobacterium
ERTK

SEQ ID NO: 387963 - protein, 5 aa, Mycobacterium
ERTPQ

SEQ ID NO: 387964 - protein, 4 aa, Mycobacterium
ERTR

SEQ ID NO: 387965 - protein, 18 aa, Mycobacterium
ESAADRGLPFDEEADAQM

SEQ ID NO: 387966 - protein, 4 aa, Mycobacterium
ESAG

SEQ ID NO: 387967 - protein, 4 aa, Mycobacterium
ESDP

SEQ ID NO: 387968 - protein, 6 aa, Mycobacterium
ESDQRE

SEQ ID NO: 387969 - protein, 6 aa, Mycobacterium
ESEDES

SEQ ID NO: 387970 - protein, 4 aa, Mycobacterium
ESEH

SEQ ID NO: 387971 - protein, 9 aa, Mycobacterium
ESGAPGRGN

SEQ ID NO: 387972 - protein, 4 aa, Mycobacterium
ESGE

SEQ ID NO: 387973 - protein, 6 aa, Mycobacterium
ESGKMT

SEQ ID NO: 387974 - protein, 4 aa, Mycobacterium
ESGL

SEQ ID NO: 387975 - protein, 4 aa, Mycobacterium
ESGT

SEQ ID NO: 387976 - protein, 10 aa, Mycobacterium
ESLSGGAKEQ

SEQ ID NO: 387977 - protein, 34 aa, Mycobacterium
ESMSRQAGGRAGGAGGGVGTRGPGETKIETDRRR

SEQ ID NO: 387978 - protein, 34 aa, Mycobacterium; identical to SEQ ID NO: 34018

SEQ ID NO: 387979 - protein, 12 aa, Mycobacterium
ESNPDRRHGADR

SEQ ID NO: 387980 - protein, 6 aa, Mycobacterium
ESNTSG

SEQ ID NO: 387981 - protein, 6 aa, Mycobacterium
ESPDAK

SEQ ID NO: 387982 - protein, 8 aa, Mycobacterium
ESPRRGET

SEQ ID NO: 387983 - protein, 4 aa, Mycobacterium
ESRG

SEQ ID NO: 387984 - protein, 9 aa, Mycobacterium
ESRPTRTGL

SEQ ID NO: 387985 - protein, 4 aa, Mycobacterium
ESTL

SEQ ID NO: 387986 - protein, 7 aa, Mycobacterium
ESTSGTL

SEQ ID NO: 387987 - protein, 6 aa, Mycobacterium
ESVTPG

SEQ ID NO: 387988 - protein, 8 aa, Mycobacterium
ESWPPNAA

SEQ ID NO: 387989 - protein, 5 aa, Mycobacterium
ETDDA

SEQ ID NO: 387990 - protein, 10 aa, Mycobacterium
ETDTGSPEAQ

SEQ ID NO: 387991 - protein, 4 aa, Mycobacterium
ETEA

SEQ ID NO: 387992 - protein, 4 aa, Mycobacterium
ETEF

SEQ ID NO: 387993 - protein, 6 aa, Mycobacterium
ETEGMH

SEQ ID NO: 387994 - protein, 4 aa, Mycobacterium
ETGA

SEQ ID NO: 387995 - protein, 4 aa, Mycobacterium
ETHP

SEQ ID NO: 387996 - protein, 9 aa, Mycobacterium
ETNATTTQT

SEQ ID NO: 387997 - protein, 7 aa, Mycobacterium
ETPDEVR

SEQ ID NO: 387998 - protein, 8 aa, Mycobacterium
ETPEGPNI

SEQ ID NO: 387999 - protein, 7 aa, Mycobacterium
ETSENGW

SEQ ID NO: 388000 - protein, 7 aa, Mycobacterium
ETSPLAT

SEQ ID NO: 388001 - protein, 6 aa, Mycobacterium
ETTGES

SEQ ID NO: 388002 - protein, 5 aa, Mycobacterium
ETTYR

SEQ ID NO: 388003 - protein, 7 aa, Mycobacterium
ETTYRSS

SEQ ID NO: 388004 - protein, 4 aa, Mycobacterium
EVAE

SEQ ID NO: 388005 - protein, 4 aa, Mycobacterium
EVGP

SEQ ID NO: 388006 - protein, 9 aa, Mycobacterium
EVGTAGQAE

SEQ ID NO: 388007 - protein, 4 aa, Mycobacterium
EVPA

SEQ ID NO: 388008 - protein, 4 aa, Mycobacterium
EVPE

SEQ ID NO: 388009 - protein, 6 aa, Mycobacterium
EVQGQD

SEQ ID NO: 388010 - protein, 12 aa, Mycobacterium
EVTADGRSDRGN

SEQ ID NO: 388011 - protein, 4 aa, Mycobacterium
EVTG

SEQ ID NO: 388012 - protein, 8 aa, Mycobacterium
EWGRDPAG

SEQ ID NO: 388013 - protein, 11 aa, Mycobacterium
EWTPDDRLRQS

SEQ ID NO: 388014 - protein, 4 aa, Mycobacterium
EYGQ

SEQ ID NO: 388015 - protein, 10 aa, Mycobacterium
EYTEGAGPGI

SEQ ID NO: 388016 - protein, 4 aa, Mycobacterium
FADG

SEQ ID NO: 388017 - protein, 9 aa, Mycobacterium
FAGRGTDTG

SEQ ID NO: 388018 - protein, 4 aa, Mycobacterium
FANP

SEQ ID NO: 388019 - protein, 11 aa, Mycobacterium
FAPSGGNRQGA

SEQ ID NO: 388020 - protein, 6 aa, Mycobacterium
FASPTT

SEQ ID NO: 388021 - protein, 4 aa, Mycobacterium
FDEQ

SEQ ID NO: 388022 - protein, 6 aa, Mycobacterium
FDETRQ

SEQ ID NO: 388023 - protein, 8 aa, Mycobacterium
FDGGDGQR

SEQ ID NO: 388024 - protein, 5 aa, Mycobacterium
FDNDA

SEQ ID NO: 388025 - protein, 10 aa, Mycobacterium
FDRPPSDHTS

SEQ ID NO: 388026 - protein, 5 aa, Mycobacterium
FEPQR

SEQ ID NO: 388027 - protein, 8 aa, Mycobacterium
FERSGPER

SEQ ID NO: 388028 - protein, 12 aa, Mycobacterium
FETARRRGSRAH

SEQ ID NO: 388029 - protein, 7 aa, Mycobacterium
FGGDPDN

SEQ ID NO: 388030 - protein, 8 aa, Mycobacterium
FGGGGRGM

SEQ ID NO: 388031 - protein, 6 aa, Mycobacterium
FGGTRN

SEQ ID NO: 388032 - protein, 4 aa, Mycobacterium
FGKP

SEQ ID NO: 388033 - protein, 6 aa, Mycobacterium
FGNPTA

SEQ ID NO: 388034 - protein, 9 aa, Mycobacterium
FGNSGSNNL

SEQ ID NO: 388035 - protein, 9 aa, Mycobacterium
FGPEDGPRV

SEQ ID NO: 388036 - protein, 6 aa, Mycobacterium
FGPGNL

SEQ ID NO: 388037 - protein, 9 aa, Mycobacterium
FGPPAGDPA

SEQ ID NO: 388038 - protein, 4 aa, Mycobacterium
FGPS

SEQ ID NO: 388039 - protein, 8 aa, Mycobacterium
FGRDGDDL

SEQ ID NO: 388040 - protein, 8 aa, Mycobacterium
FGRDTAPK

SEQ ID NO: 388041 - protein, 9 aa, Mycobacterium
FGREGDQGV

SEQ ID NO: 388042 - protein, 6 aa, Mycobacterium
FGSAGE

SEQ ID NO: 388043 - protein, 7 aa, Mycobacterium
FGTPTFT

SEQ ID NO: 388044 - protein, 10 aa, Mycobacterium
FHSPDDPLQL

SEQ ID NO: 388045 - protein, 4 aa, Mycobacterium
FKGP

SEQ ID NO: 388046 - protein, 9 aa, Mycobacterium
FNPGGMKDR

SEQ ID NO: 388047 - protein, 5 aa, Mycobacterium
FPEPR

SEQ ID NO: 388048 - protein, 4 aa, Mycobacterium
FPGP

SEQ ID NO: 388049 - protein, 7 aa, Mycobacterium
FPGQQGG

SEQ ID NO: 388050 - protein, 4 aa, Mycobacterium
FPKP

SEQ ID NO: 388051 - protein, 12 aa, Mycobacterium
FPPASVTGTPKL

SEQ ID NO: 388052 - protein, 4 aa, Mycobacterium
FPPE

SEQ ID NO: 388053 - protein, 5 aa, Mycobacterium
FPTPE

SEQ ID NO: 388054 - protein, 9 aa, Mycobacterium
FPTPPGSTF

SEQ ID NO: 388055 - protein, 9 aa, Mycobacterium
FRADRQPEF

SEQ ID NO: 388056 - protein, 9 aa, Mycobacterium
FRPGKAPAK

SEQ ID NO: 388057 - protein, 9 aa, Mycobacterium
FSPGRDTPI

SEQ ID NO: 388058 - protein, 9 aa, Mycobacterium
FSTAAESNA

SEQ ID NO: 388059 - protein, 4 aa, Mycobacterium
FTAA

SEQ ID NO: 388060 - protein, 6 aa, Mycobacterium
FTDPDR

SEQ ID NO: 388061 - protein, 10 aa, Mycobacterium
FTPEQKARNV

SEQ ID NO: 388062 - protein, 4 aa, Mycobacterium
FTPT

SEQ ID NO: 388063 - protein, 5 aa, Mycobacterium
FYPEE

SEQ ID NO: 388064 - protein, 4 aa, Mycobacterium
GAAG

SEQ ID NO: 388065 - protein, 9 aa, Mycobacterium
GAAGQPHAR

SEQ ID NO: 388066 - protein, 8 aa, Mycobacterium
GAAGTAAQ

SEQ ID NO: 388067 - protein, 6 aa, Mycobacterium
GAAKAL

SEQ ID NO: 388068 - protein, 4 aa, Mycobacterium
GAAL

SEQ ID NO: 388069 - protein, 4 aa, Mycobacterium
GAAM

SEQ ID NO: 388070 - protein, 4 aa, Mycobacterium
GAAP

SEQ ID NO: 388071 - protein, 10 aa, Mycobacterium
GAAPAGHGSK

SEQ ID NO: 388072 - protein, 4 aa, Mycobacterium
GAAQ

SEQ ID NO: 388073 - protein, 6 aa, Mycobacterium
GACHTG

SEQ ID NO: 388074 - protein, 4 aa, Mycobacterium
GADA

SEQ ID NO: 388075 - protein, 5 aa, Mycobacterium
GADEV

SEQ ID NO: 388076 - protein, 7 aa, Mycobacterium
GADEVSA

SEQ ID NO: 388077 - protein, 4 aa, Mycobacterium
GADG

SEQ ID NO: 388078 - protein, 5 aa, Mycobacterium
GADPE

SEQ ID NO: 388079 - protein, 16 aa, Mycobacterium
GADPEGSVYSGGTGRP

SEQ ID NO: 388080 - protein, 9 aa, Mycobacterium
GADPSPSDA

SEQ ID NO: 388081 - protein, 4 aa, Mycobacterium
GADR

SEQ ID NO: 388082 - protein, 13 aa, Mycobacterium
GAEAGKPLASSNR

SEQ ID NO: 388083 - protein, 7 aa, Mycobacterium
GAEDPKL

SEQ ID NO: 388084 - protein, 8 aa, Mycobacterium
GAEEVNDL

SEQ ID NO: 388085 - protein, 4 aa, Mycobacterium
GAEN

SEQ ID NO: 388086 - protein, 4 aa, Mycobacterium
GAER

SEQ ID NO: 388087 - protein, 7 aa, Mycobacterium
GAESRSE

SEQ ID NO: 388088 - protein, 6 aa, Mycobacterium
GAGAAG

SEQ ID NO: 388089 - protein, 51 aa, Mycobacterium
GAGADGGNGFAGGTGGDGGTGGNTTGGTNGSGGNAGHGGNAGNGAAGNTGV

SEQ ID NO: 388090 - protein, 6 aa, Mycobacterium
GAGAGG

SEQ ID NO: 388091 - protein, 7 aa, Mycobacterium
GAGDKSF

SEQ ID NO: 388092 - protein, 12 aa, Mycobacterium
GAGGAPTASAVT

SEQ ID NO: 388093 - protein, 10 aa, Mycobacterium
GAGGGGIGTT

SEQ ID NO: 388094 - protein, 8 aa, Mycobacterium
GAGGGLGR

SEQ ID NO: 388095 - protein, 11 aa, Mycobacterium
GAGGGNPARTY

SEQ ID NO: 388096 - protein, 4 aa, Mycobacterium
GAGH

SEQ ID NO: 388097 - protein, 6 aa, Mycobacterium
GAGKTT

SEQ ID NO: 388098 - protein, 4 aa, Mycobacterium
GAGL

SEQ ID NO: 388099 - protein, 7 aa, Mycobacterium
GAGPGER

SEQ ID NO: 388100 - protein, 7 aa, Mycobacterium
GAGPNCD

SEQ ID NO: 388101 - protein, 6 aa, Mycobacterium
GAGPPV

SEQ ID NO: 388102 - protein, 8 aa, Mycobacterium
GAGRGLGR

SEQ ID NO: 388103 - protein, 10 aa, Mycobacterium
GAGSAPGPKA

SEQ ID NO: 388104 - protein, 6 aa, Mycobacterium
GAGSTA

SEQ ID NO: 388105 - protein, 4 aa, Mycobacterium
GAGV

SEQ ID NO: 388106 - protein, 18 aa, Mycobacterium
GAHGRAGAAGAGRAAGAA

SEQ ID NO: 388107 - protein, 4 aa, Mycobacterium
GAID

SEQ ID NO: 388108 - protein, 6 aa, Mycobacterium
GAIGRR

SEQ ID NO: 388109 - protein, 14 aa, Mycobacterium
GAKARQAKNKARLQ

SEQ ID NO: 388110 - protein, 14 aa, Mycobacterium
GAKARQAKSKARLQ

SEQ ID NO: 388111 - protein, 9 aa, Mycobacterium
GAKTGKLRK

SEQ ID NO: 388112 - protein, 4 aa, Mycobacterium
GAMS

SEQ ID NO: 388113 - protein, 5 aa, Mycobacterium
GANAA

SEQ ID NO: 388114 - protein, 9 aa, Mycobacterium
GANAGPDRS

SEQ ID NO: 388115 - protein, 7 aa, Mycobacterium
GAPDDRR

SEQ ID NO: 388116 - protein, 7 aa, Mycobacterium
GAPDTPL

SEQ ID NO: 388117 - protein, 4 aa, Mycobacterium
GAPE

SEQ ID NO: 388118 - protein, 8 aa, Mycobacterium
GAPGNTIN

SEQ ID NO: 388119 - protein, 4 aa, Mycobacterium
GAPI

SEQ ID NO: 388120 - protein, 4 aa, Mycobacterium
GAPL

SEQ ID NO: 388121 - protein, 4 aa, Mycobacterium
GAPM

SEQ ID NO: 388122 - protein, 7 aa, Mycobacterium
GAPQVNA

SEQ ID NO: 388123 - protein, 4 aa, Mycobacterium
GAPR

SEQ ID NO: 388124 - protein, 9 aa, Mycobacterium
GAPSALTVR

SEQ ID NO: 388125 - protein, 4 aa, Mycobacterium
GAQC

SEQ ID NO: 388126 - protein, 12 aa, Mycobacterium
GAQSGIGGGGRY

SEQ ID NO: 388127 - protein, 5 aa, Mycobacterium
GARAV

SEQ ID NO: 388128 - protein, 8 aa, Mycobacterium
GARDGRTV

SEQ ID NO: 388129 - protein, 4 aa, Mycobacterium
GARE

SEQ ID NO: 388130 - protein, 4 aa, Mycobacterium
GARG

SEQ ID NO: 388131 - protein, 5 aa, Mycobacterium
GARPS

SEQ ID NO: 388132 - protein, 5 aa, Mycobacterium
GARSV

SEQ ID NO: 388133 - protein, 4 aa, Mycobacterium
GARV

SEQ ID NO: 388134 - protein, 8 aa, Mycobacterium
GARYSDET

SEQ ID NO: 388135 - protein, 10 aa, Mycobacterium
GASAARPEHT

SEQ ID NO: 388136 - protein, 14 aa, Mycobacterium
GASFPYRKDPEDKN

SEQ ID NO: 388137 - protein, 6 aa, Mycobacterium
GASGMG

SEQ ID NO: 388138 - protein, 6 aa, Mycobacterium
GASGYA

SEQ ID NO: 388139 - protein, 7 aa, Mycobacterium
GASKAAQ

SEQ ID NO: 388140 - protein, 7 aa, Mycobacterium
GASNKEI

SEQ ID NO: 388141 - protein, 8 aa, Mycobacterium
GASPGGDL

SEQ ID NO: 388142 - protein, 9 aa, Mycobacterium
GASRGAGAG

SEQ ID NO: 388143 - protein, 4 aa, Mycobacterium
GAST

SEQ ID NO: 388144 - protein, 6 aa, Mycobacterium
GATAAG

SEQ ID NO: 388145 - protein, 15 aa, Mycobacterium
GATAEVNDAVRGPGS

SEQ ID NO: 388146 - protein, 5 aa, Mycobacterium
GATGK

SEQ ID NO: 388147 - protein, 5 aa, Mycobacterium
GATHA

SEQ ID NO: 388148 - protein, 6 aa, Mycobacterium
GATHSP

SEQ ID NO: 388149 - protein, 8 aa, Mycobacterium
GATPSQRY

SEQ ID NO: 388150 - protein, 5 aa, Mycobacterium
GATSD

SEQ ID NO: 388151 - protein, 4 aa, Mycobacterium
GATV

SEQ ID NO: 388152 - protein, 7 aa, Mycobacterium
GATVNAT

SEQ ID NO: 388153 - protein, 9 aa, Mycobacterium
GATYDGAGT

SEQ ID NO: 388154 - protein, 5 aa, Mycobacterium
GAVDP

SEQ ID NO: 388155 - protein, 4 aa, Mycobacterium
GAVP

SEQ ID NO: 388156 - protein, 5 aa, Mycobacterium
GAVPG

SEQ ID NO: 388157 - protein, 12 aa, Mycobacterium
GAVPKDGPSAGV

SEQ ID NO: 388158 - protein, 7 aa, Mycobacterium
GAVPRTS

SEQ ID NO: 388159 - protein, 6 aa, Mycobacterium
GAVTPA

SEQ ID NO: 388160 - protein, 4 aa, Mycobacterium
GAYG

SEQ ID NO: 388161 - protein, 5 aa, Mycobacterium
GCANP

SEQ ID NO: 388162 - protein, 12 aa, Mycobacterium
GCDGQPGSYTDV

SEQ ID NO: 388163 - protein, 4 aa, Mycobacterium
GCGE

SEQ ID NO: 388164 - protein, 6 aa, Mycobacterium
GCGEAA

SEQ ID NO: 388165 - protein, 7 aa, Mycobacterium
GCHGGPG

SEQ ID NO: 388166 - protein, 4 aa, Mycobacterium
GDAA

SEQ ID NO: 388167 - protein, 4 aa, Mycobacterium
GDAD

SEQ ID NO: 388168 - protein, 5 aa, Mycobacterium
GDAEL

SEQ ID NO: 388169 - protein, 5 aa, Mycobacterium
GDAGV

SEQ ID NO: 388170 - protein, 4 aa, Mycobacterium
GDAI

SEQ ID NO: 388171 - protein, 4 aa, Mycobacterium
GDAL

SEQ ID NO: 388172 - protein, 4 aa, Mycobacterium
GDAP

SEQ ID NO: 388173 - protein, 4 aa, Mycobacterium
GDAR

SEQ ID NO: 388174 - protein, 5 aa, Mycobacterium
GDARE

SEQ ID NO: 388175 - protein, 16 aa, Mycobacterium
GDATMTAGNSTPLTDG

SEQ ID NO: 388176 - protein, 17 aa, Mycobacterium
GDATMTAGNSTPLTDGA

SEQ ID NO: 388177 - protein, 7 aa, Mycobacterium
GDDHRRR

SEQ ID NO: 388178 - protein, 7 aa, Mycobacterium
GDDNDAF

SEQ ID NO: 388179 - protein, 4 aa, Mycobacterium
GDDP

SEQ ID NO: 388180 - protein, 9 aa, Mycobacterium
GDDPGDPAL

SEQ ID NO: 388181 - protein, 7 aa, Mycobacterium
GDDPWPA

SEQ ID NO: 388182 - protein, 5 aa, Mycobacterium
GDDVH

SEQ ID NO: 388183 - protein, 4 aa, Mycobacterium
GDDY

SEQ ID NO: 388184 - protein, 5 aa, Mycobacterium
GDEDA

SEQ ID NO: 388185 - protein, 4 aa, Mycobacterium
GDEG

SEQ ID NO: 388186 - protein, 5 aa, Mycobacterium
GDEIK

SEQ ID NO: 388187 - protein, 4 aa, Mycobacterium
GDEL

SEQ ID NO: 388188 - protein, 4 aa, Mycobacterium
GDEQ

SEQ ID NO: 388189 - protein, 4 aa, Mycobacterium
GDES

SEQ ID NO: 388190 - protein, 6 aa, Mycobacterium
GDGGDG

SEQ ID NO: 388191 - protein, 4 aa, Mycobacterium
GDGI

SEQ ID NO: 388192 - protein, 4 aa, Mycobacterium
GDGR

SEQ ID NO: 388193 - protein, 7 aa, Mycobacterium
GDGRCKQ

SEQ ID NO: 388194 - protein, 4 aa, Mycobacterium
GDGS

SEQ ID NO: 388195 - protein, 7 aa, Mycobacterium
GDHTDGI

SEQ ID NO: 388196 - protein, 5 aa, Mycobacterium
GDIPT

SEQ ID NO: 388197 - protein, 12 aa, Mycobacterium
GDKAHPASQGYT

SEQ ID NO: 388198 - protein, 7 aa, Mycobacterium
GDKQGLG

SEQ ID NO: 388199 - protein, 8 aa, Mycobacterium
GDKTYRDF

SEQ ID NO: 388200 - protein, 4 aa, Mycobacterium
GDLA

SEQ ID NO: 388201 - protein, 7 aa, Mycobacterium
GDLEREK

SEQ ID NO: 388202 - protein, 4 aa, Mycobacterium
GDNQ

SEQ ID NO: 388203 - protein, 4 aa, Mycobacterium
GDPF

SEQ ID NO: 388204 - protein, 7 aa, Mycobacterium
GDPGVGK

SEQ ID NO: 388205 - protein, 4 aa, Mycobacterium
GDPP

SEQ ID NO: 388206 - protein, 9 aa, Mycobacterium
GDPSVPSGV

SEQ ID NO: 388207 - protein, 4 aa, Mycobacterium
GDQA

SEQ ID NO: 388208 - protein, 7 aa, Mycobacterium
GDQIGKG

SEQ ID NO: 388209 - protein, 14 aa, Mycobacterium
GDQPAKGFASHGES

SEQ ID NO: 388210 - protein, 11 aa, Mycobacterium
GDQTDVPESGD

SEQ ID NO: 388211 - protein, 6 aa, Mycobacterium
GDRAFS

SEQ ID NO: 388212 - protein, 5 aa, Mycobacterium
GDRET

SEQ ID NO: 388213 - protein, 8 aa, Mycobacterium
GDRGGRVT

SEQ ID NO: 388214 - protein, 8 aa, Mycobacterium
GDRGLKGA

SEQ ID NO: 388215 - protein, 4 aa, Mycobacterium
GDRR

SEQ ID NO: 388216 - protein, 6 aa, Mycobacterium
GDSAGG

SEQ ID NO: 388217 - protein, 4 aa, Mycobacterium
GDSS

SEQ ID NO: 388218 - protein, 9 aa, Mycobacterium
GDSTSGQRA

SEQ ID NO: 388219 - protein, 7 aa, Mycobacterium
GDTERSA

SEQ ID NO: 388220 - protein, 5 aa, Mycobacterium
GDTPL

SEQ ID NO: 388221 - protein, 4 aa, Mycobacterium
GDTY

SEQ ID NO: 388222 - protein, 6 aa, Mycobacterium
GDVNES

SEQ ID NO: 388223 - protein, 10 aa, Mycobacterium
GDVPLRPTTT

SEQ ID NO: 388224 - protein, 5 aa, Mycobacterium
GDVST

SEQ ID NO: 388225 - protein, 4 aa, Mycobacterium
GDYS

SEQ ID NO: 388226 - protein, 14 aa, Mycobacterium
GEAEPAGRPADPPF

SEQ ID NO: 388227 - protein, 5 aa, Mycobacterium
GEAGV

SEQ ID NO: 388228 - protein, 9 aa, Mycobacterium
GEATPTGGM

SEQ ID NO: 388229 - protein, 4 aa, Mycobacterium
GEDG

SEQ ID NO: 388230 - protein, 7 aa, Mycobacterium
GEDGKPV

SEQ ID NO: 388231 - protein, 8 aa, Mycobacterium
GEDLGDPE

SEQ ID NO: 388232 - protein, 10 aa, Mycobacterium
GEEESGSPSL

SEQ ID NO: 388233 - protein, 11 aa, Mycobacterium
GEEESGSPSLG

SEQ ID NO: 388234 - protein, 4 aa, Mycobacterium
GEEF

SEQ ID NO: 388235 - protein, 4 aa, Mycobacterium
GEEH

SEQ ID NO: 388236 - protein, 4 aa, Mycobacterium
GEEP

SEQ ID NO: 388237 - protein, 6 aa, Mycobacterium
GEERQG

SEQ ID NO: 388238 - protein, 7 aa, Mycobacterium
GEFNRDT

SEQ ID NO: 388239 - protein, 4 aa, Mycobacterium
GEGF

SEQ ID NO: 388240 - protein, 10 aa, Mycobacterium
GEGQHQDTGA

SEQ ID NO: 388241 - protein, 8 aa, Mycobacterium
GEGRARDD

SEQ ID NO: 388242 - protein, 6 aa, Mycobacterium
GEGTGL

SEQ ID NO: 388243 - protein, 15 aa, Mycobacterium
GEGTKKLSKRDPQSN

SEQ ID NO: 388244 - protein, 6 aa, Mycobacterium
GEGTTE

SEQ ID NO: 388245 - protein, 7 aa, Mycobacterium
GEHGYPT

SEQ ID NO: 388246 - protein, 5 aa, Mycobacterium
GEHSD

SEQ ID NO: 388247 - protein, 9 aa, Mycobacterium
GEINTVTGN

SEQ ID NO: 388248 - protein, 8 aa, Mycobacterium
GEKPVPNK

SEQ ID NO: 388249 - protein, 4 aa, Mycobacterium
GEKR

SEQ ID NO: 388250 - protein, 9 aa, Mycobacterium
GELGQHNGL

SEQ ID NO: 388251 - protein, 7 aa, Mycobacterium
GENTEGL

SEQ ID NO: 388252 - protein, 4 aa, Mycobacterium
GEPA

SEQ ID NO: 388253 - protein, 9 aa, Mycobacterium
GEPAHDPDF

SEQ ID NO: 388254 - protein, 7 aa, Mycobacterium
GEPATLG

SEQ ID NO: 388255 - protein, 7 aa, Mycobacterium
GEPGVGK

SEQ ID NO: 388256 - protein, 13 aa, Mycobacterium
GEPGVGKTTAAKT

SEQ ID NO: 388257 - protein, 4 aa, Mycobacterium
GEPI

SEQ ID NO: 388258 - protein, 5 aa, Mycobacterium
GEPQL

SEQ ID NO: 388259 - protein, 4 aa, Mycobacterium
GEPT

SEQ ID NO: 388260 - protein, 6 aa, Mycobacterium
GEPTDA

SEQ ID NO: 388261 - protein, 7 aa, Mycobacterium
GEQAPGL

SEQ ID NO: 388262 - protein, 4 aa, Mycobacterium
GEQE

SEQ ID NO: 388263 - protein, 5 aa, Mycobacterium
GERAE

SEQ ID NO: 388264 - protein, 10 aa, Mycobacterium
GEREGNEPYG

SEQ ID NO: 388265 - protein, 4 aa, Mycobacterium
GERG

SEQ ID NO: 388266 - protein, 4 aa, Mycobacterium
GERP

SEQ ID NO: 388267 - protein, 5 aa, Mycobacterium
GERRD

SEQ ID NO: 388268 - protein, 6 aa, Mycobacterium
GESADY

SEQ ID NO: 388269 - protein, 6 aa, Mycobacterium
GESAPV

SEQ ID NO: 388270 - protein, 11 aa, Mycobacterium
GESGSGKSTVA

SEQ ID NO: 388271 - protein, 4 aa, Mycobacterium
GESL

SEQ ID NO: 388272 - protein, 7 aa, Mycobacterium
GESPLDP

SEQ ID NO: 388273 - protein, 8 aa, Mycobacterium
GETGRTDF

SEQ ID NO: 388274 - protein, 8 aa, Mycobacterium
GETRSYGE

SEQ ID NO: 388275 - protein, 4 aa, Mycobacterium
GEVG

SEQ ID NO: 388276 - protein, 6 aa, Mycobacterium
GFEGNA

SEQ ID NO: 388277 - protein, 6 aa, Mycobacterium
GFGGRR

SEQ ID NO: 388278 - protein, 7 aa, Mycobacterium
GFGNTGA

SEQ ID NO: 388279 - protein, 4 aa, Mycobacterium
GFGP

SEQ ID NO: 388280 - protein, 7 aa, Mycobacterium
GFPSGKH

SEQ ID NO: 388281 - protein, 12 aa, Mycobacterium
GFRGQGASHGAQ

SEQ ID NO: 388282 - protein, 5 aa, Mycobacterium
GFTRG

SEQ ID NO: 388283 - protein, 9 aa, Mycobacterium
GFTTPDPSY

SEQ ID NO: 388284 - protein, 11 aa, Mycobacterium
GGAATGKTTAI

SEQ ID NO: 388285 - protein, 4 aa, Mycobacterium
GGAE

SEQ ID NO: 388286 - protein, 9 aa, Mycobacterium
GGAELSGTI

SEQ ID NO: 388287 - protein, 15 aa, Mycobacterium
GGAGDERTQRANREA

SEQ ID NO: 388288 - protein, 6 aa, Mycobacterium
GGAGDS

SEQ ID NO: 388289 - protein, 10 aa, Mycobacterium
GGAGTTAAGM

SEQ ID NO: 388290 - protein, 4 aa, Mycobacterium
GGAP

SEQ ID NO: 388291 - protein, 8 aa, Mycobacterium
GGAPQVNA

SEQ ID NO: 388292 - protein, 8 aa, Mycobacterium
GGARGMGA

SEQ ID NO: 388293 - protein, 5 aa, Mycobacterium
GGASG

SEQ ID NO: 388294 - protein, 8 aa, Mycobacterium
GGASGIGR

SEQ ID NO: 388295 - protein, 4 aa, Mycobacterium
GGAT

SEQ ID NO: 388296 - protein, 5 aa, Mycobacterium
GGATA

SEQ ID NO: 388297 - protein, 10 aa, Mycobacterium
GGATLDNEEN

SEQ ID NO: 388298 - protein, 5 aa, Mycobacterium
GGATM

SEQ ID NO: 388299 - protein, 5 aa, Mycobacterium
GGCTK

SEQ ID NO: 388300 - protein, 9 aa, Mycobacterium
GGDAKTWGD

SEQ ID NO: 388301 - protein, 9 aa, Mycobacterium
GGDATGAEV

SEQ ID NO: 388302 - protein, 5 aa, Mycobacterium
GGDLD

SEQ ID NO: 388303 - protein, 5 aa, Mycobacterium
GGDPV

SEQ ID NO: 388304 - protein, 9 aa, Mycobacterium
GGDVGDTAE

SEQ ID NO: 388305 - protein, 11 aa, Mycobacterium
GGEGGGHTGPV

SEQ ID NO: 388306 - protein, 4 aa, Mycobacterium
GGEP

SEQ ID NO: 388307 - protein, 6 aa, Mycobacterium
GGEPYV

SEQ ID NO: 388308 - protein, 6 aa, Mycobacterium
GGERGD

SEQ ID NO: 388309 - protein, 8 aa, Mycobacterium
GGESTASL

SEQ ID NO: 388310 - protein, 8 aa, Mycobacterium
GGEYAGTR

SEQ ID NO: 388311 - protein, 4 aa, Mycobacterium
GGFA

SEQ ID NO: 388312 - protein, 8 aa, Mycobacterium
GGGDPEEL

SEQ ID NO: 388313 - protein, 6 aa, Mycobacterium
GGGDQW

SEQ ID NO: 388314 - protein, 4 aa, Mycobacterium
GGGE

SEQ ID NO: 388315 - protein, 10 aa, Mycobacterium
GGGELGYGSD

SEQ ID NO: 388316 - protein, 7 aa, Mycobacterium
GGGETAA

SEQ ID NO: 388317 - protein, 9 aa, Mycobacterium
GGGHDIGET

SEQ ID NO: 388318 - protein, 6 aa, Mycobacterium
GGGLGR

SEQ ID NO: 388319 - protein, 13 aa, Mycobacterium
GGGMANATIIERL

SEQ ID NO: 388320 - protein, 14 aa, Mycobacterium
GGGMGSATVIEVAA

SEQ ID NO: 388321 - protein, 7 aa, Mycobacterium
GGGNVSA

SEQ ID NO: 388322 - protein, 12 aa, Mycobacterium
GGGPVAGCMLLT

SEQ ID NO: 388323 - protein, 8 aa, Mycobacterium
GGGTGIGR

SEQ ID NO: 388324 - protein, 18 aa, Mycobacterium
GGGTGPAEGTKATTVTPG

SEQ ID NO: 388325 - protein, 5 aa, Mycobacterium
GGHDA

SEQ ID NO: 388326 - protein, 4 aa, Mycobacterium
GGID

SEQ ID NO: 388327 - protein, 4 aa, Mycobacterium
GGIE

SEQ ID NO: 388328 - protein, 14 aa, Mycobacterium
GGIETGQALTSNPD

SEQ ID NO: 388329 - protein, 8 aa, Mycobacterium
GGIGSGQQ

SEQ ID NO: 388330 - protein, 9 aa, Mycobacterium
GGIRDDDSL

SEQ ID NO: 388331 - protein, 8 aa, Mycobacterium
GGIRTGMD

SEQ ID NO: 388332 - protein, 12 aa, Mycobacterium
GGITADSDPDAE

SEQ ID NO: 388333 - protein, 5 aa, Mycobacterium
GGITG

SEQ ID NO: 388334 - protein, 8 aa, Mycobacterium
GGKDTQRR

SEQ ID NO: 388335 - protein, 4 aa, Mycobacterium
GGKR

SEQ ID NO: 388336 - protein, 5 aa, Mycobacterium
GGKRE

SEQ ID NO: 388337 - protein, 4 aa, Mycobacterium
GGKS

SEQ ID NO: 388338 - protein, 5 aa, Mycobacterium
GGKSA

SEQ ID NO: 388339 - protein, 10 aa, Mycobacterium
GGLPKGDALA

SEQ ID NO: 388340 - protein, 5 aa, Mycobacterium
GGMPG

SEQ ID NO: 388341 - protein, 4 aa, Mycobacterium
GGMS

SEQ ID NO: 388342 - protein, 6 aa, Mycobacterium
GGNGGS

SEQ ID NO: 388343 - protein, 5 aa, Mycobacterium
GGPAG

SEQ ID NO: 388344 - protein, 6 aa, Mycobacterium
GGPAVA

SEQ ID NO: 388345 - protein, 10 aa, Mycobacterium
GGPAVTNDGV

SEQ ID NO: 388346 - protein, 6 aa, Mycobacterium
GGPAYP

SEQ ID NO: 388347 - protein, 9 aa, Mycobacterium
GGPEGPEQV

SEQ ID NO: 388348 - protein, 5 aa, Mycobacterium
GGPGA

SEQ ID NO: 388349 - protein, 7 aa, Mycobacterium
GGPGGLA

SEQ ID NO: 388350 - protein, 8 aa, Mycobacterium
GGPGTGKT

SEQ ID NO: 388351 - protein, 6 aa, Mycobacterium
GGPGVA

SEQ ID NO: 388352 - protein, 7 aa, Mycobacterium
GGPIHPR

SEQ ID NO: 388353 - protein, 4 aa, Mycobacterium
GGPK

SEQ ID NO: 388354 - protein, 6 aa, Mycobacterium
GGPQTY

SEQ ID NO: 388355 - protein, 4 aa, Mycobacterium
GGPR

SEQ ID NO: 388356 - protein, 9 aa, Mycobacterium
GGPSGSAAA

SEQ ID NO: 388357 - protein, 9 aa, Mycobacterium
GGPSTPVHA

SEQ ID NO: 388358 - protein, 4 aa, Mycobacterium
GGPT

SEQ ID NO: 388359 - protein, 12 aa, Mycobacterium
GGPVSNNKGISL

SEQ ID NO: 388360 - protein, 11 aa, Mycobacterium
GGQDPGAQSSV

SEQ ID NO: 388361 - protein, 10 aa, Mycobacterium
GGQGLNTGVQ

SEQ ID NO: 388362 - protein, 6 aa, Mycobacterium
GGQNRH

SEQ ID NO: 388363 - protein, 6 aa, Mycobacterium
GGQQQR

SEQ ID NO: 388364 - protein, 9 aa, Mycobacterium
GGQTSAESY

SEQ ID NO: 388365 - protein, 5 aa, Mycobacterium
GGREH

SEQ ID NO: 388366 - protein, 5 aa, Mycobacterium
GGREN

SEQ ID NO: 388367 - protein, 7 aa, Mycobacterium
GGRGLST

SEQ ID NO: 388368 - protein, 7 aa, Mycobacterium
GGRLGDG

SEQ ID NO: 388369 - protein, 8 aa, Mycobacterium
GGRPEGLD

SEQ ID NO: 388370 - protein, 4 aa, Mycobacterium
GGRR

SEQ ID NO: 388371 - protein, 13 aa, Mycobacterium
GGRSNSGEGGEDV

SEQ ID NO: 388372 - protein, 10 aa, Mycobacterium
GGRTRTGKLR

SEQ ID NO: 388373 - protein, 14 aa, Mycobacterium
GGRTVGAGRVVKII

SEQ ID NO: 388374 - protein, 4 aa, Mycobacterium
GGRY

SEQ ID NO: 388375 - protein, 4 aa, Mycobacterium
GGSA

SEQ ID NO: 388376 - protein, 8 aa, Mycobacterium
GGSAGGHL

SEQ ID NO: 388377 - protein, 8 aa, Mycobacterium
GGSEGVGA

SEQ ID NO: 388378 - protein, 10 aa, Mycobacterium
GGSGALAGHP

SEQ ID NO: 388379 - protein, 7 aa, Mycobacterium
GGSGIKG
